United States Patent 7,374,927 (METHODS OF ANALYSIS OF DEGRADED NUCLEIC ACID SAMPLES) - sequence listing, part 12

SEQ ID NO: 441051 - DNA, 25 bp, Homo sapien
gaagtaattcggtttagatgaggtc

SEQ ID NO: 441052 - DNA, 25 bp, Homo sapien
ggaacagagaccacatactctttct

SEQ ID NO: 441053 - DNA, 25 bp, Homo sapien
cagagaccacatactctttctctct

SEQ ID NO: 441054 - DNA, 25 bp, Homo sapien
tctagcacaggatcagagaggatct

SEQ ID NO: 441055 - DNA, 25 bp, Homo sapien
gagaggatcttggttattggtgact

SEQ ID NO: 441056 - DNA, 25 bp, Homo sapien
ttattggtgactggtgagattctgt

SEQ ID NO: 441057 - DNA, 25 bp, Homo sapien
ttgggtgtttggaagcttcaaatgc

SEQ ID NO: 441058 - DNA, 25 bp, Homo sapien
agcttcaaatgcatggagccacccc

SEQ ID NO: 441059 - DNA, 25 bp, Homo sapien
atggagccaccccttaaaaatgtct

SEQ ID NO: 441060 - DNA, 25 bp, Homo sapien
gccaccccttaaaaatgtctcactg

SEQ ID NO: 441061 - DNA, 25 bp, Homo sapien
atgtctcactggaggcaggcacggt

SEQ ID NO: 441062 - DNA, 25 bp, Homo sapien
gtggatggcttgagtatatatactt

SEQ ID NO: 441063 - DNA, 25 bp, Homo sapien
gtatatatacttcgcgagcaccgtg

SEQ ID NO: 441064 - DNA, 25 bp, Homo sapien
tatacttcgcgagcaccgtgggcaa

SEQ ID NO: 441065 - DNA, 25 bp, Homo sapien
gaaaatggcatgtacctgggaggag

SEQ ID NO: 441066 - DNA, 25 bp, Homo sapien
gactcacaggagaaaattattagat

SEQ ID NO: 441067 - DNA, 25 bp, Homo sapien
gaaaattattagatcctagcaacag

SEQ ID NO: 441068 - DNA, 25 bp, Homo sapien
ttattagatcctagcaacaggtacc

SEQ ID NO: 441069 - DNA, 25 bp, Homo sapien
tattagatcctagcaacaggtacct

SEQ ID NO: 441070 - DNA, 25 bp, Homo sapien
attagatcctagcaacaggtacctg

SEQ ID NO: 441071 - DNA, 25 bp, Homo sapien
ttagatcctagcaacaggtacctgt

SEQ ID NO: 441072 - DNA, 25 bp, Homo sapien
tagatcctagcaacaggtacctgta

SEQ ID NO: 441073 - DNA, 25 bp, Homo sapien
agatcctagcaacaggtacctgtaa

SEQ ID NO: 441074 - DNA, 25 bp, Homo sapien
gatcctagcaacaggtacctgtaat

SEQ ID NO: 441075 - DNA, 25 bp, Homo sapien
atcctagcaacaggtacctgtaatc

SEQ ID NO: 441076 - DNA, 25 bp, Homo sapien
tggaagaatttgatgtgttctttga

SEQ ID NO: 441077 - DNA, 25 bp, Homo sapien
tgaagtcactgcttgtaagagaaga

SEQ ID NO: 441078 - DNA, 25 bp, Homo sapien
agtcactgcttgtaagagaagacaa

SEQ ID NO: 441079 - DNA, 25 bp, Homo sapien
gaagacaacgtgtaatttttgagtt

SEQ ID NO: 441080 - DNA, 25 bp, Homo sapien
caacgtgtaatttttgagttactgt

SEQ ID NO: 441081 - DNA, 25 bp, Homo sapien
agttactgtatgactcacgttggaa

SEQ ID NO: 441082 - DNA, 25 bp, Homo sapien
tactgtatgactcacgttggaaatg

SEQ ID NO: 441083 - DNA, 25 bp, Homo sapien
gtatgactcacgttggaaatgttta

SEQ ID NO: 441084 - DNA, 25 bp, Homo sapien
tgactcacgttggaaatgtttaaag

SEQ ID NO: 441085 - DNA, 25 bp, Homo sapien
ttaaagccttctgtaggcatggtgt

SEQ ID NO: 441086 - DNA, 25 bp, Homo sapien
aagccttctgtaggcatggtgtggt

SEQ ID NO: 441087 - DNA, 25 bp, Homo sapien
tctgtcaatgtcacctccgttttga

SEQ ID NO: 441088 - DNA, 25 bp, Homo sapien
tcaatgtcacctccgttttgaccag

SEQ ID NO: 441089 - DNA, 25 bp, Homo sapien
ctccgttttgaccagccaagctaga

SEQ ID NO: 441090 - DNA, 25 bp, Homo sapien
gttttgaccagccaagctagacctc

SEQ ID NO: 441091 - DNA, 25 bp, Homo sapien
agccaagctagacctccctggagcc

SEQ ID NO: 441092 - DNA, 25 bp, Homo sapien
aacaattgtcaattctgagcagctg

SEQ ID NO: 441093 - DNA, 25 bp, Homo sapien
ttgtcaattctgagcagctgggtat

SEQ ID NO: 441094 - DNA, 25 bp, Homo sapien
ttctgagcagctgggtatggtatga

SEQ ID NO: 441095 - DNA, 25 bp, Homo sapien
gagcagctgggtatggtatgaccct

SEQ ID NO: 441096 - DNA, 25 bp, Homo sapien
ggtatggtatgaccctgtgtacttt

SEQ ID NO: 441097 - DNA, 25 bp, Homo sapien
tatggtatgaccctgtgtacttttt

SEQ ID NO: 441098 - DNA, 25 bp, Homo sapien
gggaattacattaacatgtgactag

SEQ ID NO: 441099 - DNA, 25 bp, Homo sapien
aacatgtgactagttacactatcat

SEQ ID NO: 441100 - DNA, 25 bp, Homo sapien
atgtgactagttacactatcattgg

SEQ ID NO: 441101 - DNA, 25 bp, Homo sapien
gtgactagttacactatcattggaa

SEQ ID NO: 441102 - DNA, 25 bp, Homo sapien
ctagttacactatcattggaatttt

SEQ ID NO: 441103 - DNA, 25 bp, Homo sapien
ttaaccaactgcttccaaatacagt

SEQ ID NO: 441104 - DNA, 25 bp, Homo sapien
aaccaactgcttccaaatacagtta

SEQ ID NO: 441105 - DNA, 25 bp, Homo sapien
ggacattcaaaagatcaatacttga

SEQ ID NO: 441106 - DNA, 25 bp, Homo sapien
ttaaagttaacacttatcttgggag

SEQ ID NO: 441107 - DNA, 25 bp, Homo sapien
gaaagatgcctgtaaatagcacagc

SEQ ID NO: 441108 - DNA, 25 bp, Homo sapien
agatgcctgtaaatagcacagctgt

SEQ ID NO: 441109 - DNA, 25 bp, Homo sapien
tttattttaagagatgaggggccgg

SEQ ID NO: 441110 - DNA, 25 bp, Homo sapien
ttattttaagagatgaggggccggg

SEQ ID NO: 441111 - DNA, 25 bp, Homo sapien
tattttaagagatgaggggccgggc

SEQ ID NO: 441112 - DNA, 25 bp, Homo sapien
attttaagagatgaggggccgggcg

SEQ ID NO: 441113 - DNA, 25 bp, Homo sapien
tttaagagatgaggggccgggcgcc

SEQ ID NO: 441114 - DNA, 25 bp, Homo sapien
ttaagagatgaggggccgggcgccg

SEQ ID NO: 441115 - DNA, 25 bp, Homo sapien
aagagatgaggggccgggcgccgtg

SEQ ID NO: 441116 - DNA, 25 bp, Homo sapien
gagatgaggggccgggcgccgtggc

SEQ ID NO: 441117 - DNA, 25 bp, Homo sapien
agatgaggggccgggcgccgtggct

SEQ ID NO: 441118 - DNA, 25 bp, Homo sapien
tttactaaagatacaaagaattggc

SEQ ID NO: 441119 - DNA, 25 bp, Homo sapien
aaagatacaaagaattggccaggcg

SEQ ID NO: 441120 - DNA, 25 bp, Homo sapien
aatagtttgagaagcaatctttttt

SEQ ID NO: 441121 - DNA, 25 bp, Homo sapien
aaatctgatgaagccagagctgagt

SEQ ID NO: 441122 - DNA, 25 bp, Homo sapien
gccagagctgagttaatattgataa

SEQ ID NO: 441123 - DNA, 25 bp, Homo sapien
gcagtcaggtggtctatacttaatt

SEQ ID NO: 441124 - DNA, 25 bp, Homo sapien
ggtggtctatacttaatttttggtg

SEQ ID NO: 441125 - DNA, 25 bp, Homo sapien
gacagtggaggcagtattgattttg

SEQ ID NO: 441126 - DNA, 25 bp, Homo sapien
ttgaggaagccaaacaggacagcct

SEQ ID NO: 441127 - DNA, 25 bp, Homo sapien
caggacagcctgatgaattcaagat

SEQ ID NO: 441128 - DNA, 25 bp, Homo sapien
gatgaattcaagatttccagcatat

SEQ ID NO: 441129 - DNA, 25 bp, Homo sapien
atttccagcatatatacatcttcac

SEQ ID NO: 441130 - DNA, 25 bp, Homo sapien
atatatacatcttcaccaatcccac

SEQ ID NO: 441131 - DNA, 25 bp, Homo sapien
gtatacactctacttgacccaagat

SEQ ID NO: 441132 - DNA, 25 bp, Homo sapien
aggtatatttgagaaagcacgcatc

SEQ ID NO: 441133 - DNA, 25 bp, Homo sapien
agcacgcatcagttggttagggcaa

SEQ ID NO: 441134 - DNA, 25 bp, Homo sapien
gttagggcaataagcgcctctacca

SEQ ID NO: 441135 - DNA, 25 bp, Homo sapien
atgtgttcccgcaaactgcgttctg

SEQ ID NO: 441136 - DNA, 25 bp, Homo sapien
tgcgttctgctgctgctcgagatat

SEQ ID NO: 441137 - DNA, 25 bp, Homo sapien
gctcgagatatctccatctcagtca

SEQ ID NO: 441138 - DNA, 25 bp, Homo sapien
aatcatgttacataggttcccaggc

SEQ ID NO: 441139 - DNA, 25 bp, Homo sapien
gttcccaggcattaatgtgccacca

SEQ ID NO: 441140 - DNA, 25 bp, Homo sapien
tgtgccaccaaatatactgactccg

SEQ ID NO: 441141 - DNA, 25 bp, Homo sapien
aatatactgactccgcttgtttcag

SEQ ID NO: 441142 - DNA, 25 bp, Homo sapien
tttatcattgatttcctaagtgttg

SEQ ID NO: 441143 - DNA, 25 bp, Homo sapien
cattgatttcctaagtgttgtagta

SEQ ID NO: 441144 - DNA, 25 bp, Homo sapien
atttcctaagtgttgtagtaggtga

SEQ ID NO: 441145 - DNA, 25 bp, Homo sapien
agtaggtgaattttgttggtgataa

SEQ ID NO: 441146 - DNA, 25 bp, Homo sapien
gttggtgataaactggtgattcaat

SEQ ID NO: 441147 - DNA, 25 bp, Homo sapien
aaagcggtgagtctttgtaagctga

SEQ ID NO: 441148 - DNA, 25 bp, Homo sapien
ctttgtaagctgaagggtgtcctct

SEQ ID NO: 441149 - DNA, 25 bp, Homo sapien
ttgtaagctgaagggtgtcctctgc

SEQ ID NO: 441150 - DNA, 25 bp, Homo sapien
gtcctctgctggctaaggaagacag

SEQ ID NO: 441151 - DNA, 25 bp, Homo sapien
tctgctggctaaggaagacagtgca

SEQ ID NO: 441152 - DNA, 25 bp, Homo sapien
gcagctgtgtgggagaaccctaaaa

SEQ ID NO: 441153 - DNA, 25 bp, Homo sapien
agagggccagcatctcaccccatgt

SEQ ID NO: 441154 - DNA, 25 bp, Homo sapien
ctcaccccatgtaactccatgtaat

SEQ ID NO: 441155 - DNA, 25 bp, Homo sapien
taattctcccatctaattacaccgg

SEQ ID NO: 441156 - DNA, 25 bp, Homo sapien
aattacaccggctgagagtctgtct

SEQ ID NO: 441157 - DNA, 25 bp, Homo sapien
accggctgagagtctgtcttaagaa

SEQ ID NO: 441158 - DNA, 25 bp, Homo sapien
ttaagaaattcagtgggagctccag

SEQ ID NO: 441159 - DNA, 25 bp, Homo sapien
aaattcagtgggagctccaggtgtg

SEQ ID NO: 441160 - DNA, 25 bp, Homo sapien
gtattttcctggagtcatgagtcct

SEQ ID NO: 441161 - DNA, 25 bp, Homo sapien
cctggagtcatgagtcctatagaaa

SEQ ID NO: 441162 - DNA, 25 bp, Homo sapien
tactggcaagggatttaagcctttg

SEQ ID NO: 441163 - DNA, 25 bp, Homo sapien
aagcctttggattaagagaaactca

SEQ ID NO: 441164 - DNA, 25 bp, Homo sapien
tttggcatttgtgggccttacagac

SEQ ID NO: 441165 - DNA, 25 bp, Homo sapien
tgtgggccttacagacacagggaga

SEQ ID NO: 441166 - DNA, 25 bp, Homo sapien
gagactggccctcccagggcttata

SEQ ID NO: 441167 - DNA, 25 bp, Homo sapien
agggcttatagccagcacagggttc

SEQ ID NO: 441168 - DNA, 25 bp, Homo sapien
atagccagcacagggttccaggcag

SEQ ID NO: 441169 - DNA, 25 bp, Homo sapien
gttccaggcaggtggtcggctctac

SEQ ID NO: 441170 - DNA, 25 bp, Homo sapien
cccagggcctggtagcaggcagcta

SEQ ID NO: 441171 - DNA, 25 bp, Homo sapien
aggcagctagtgatctctcctacag

SEQ ID NO: 441172 - DNA, 25 bp, Homo sapien
cagcccagggcccactggaactgtt

SEQ ID NO: 441173 - DNA, 25 bp, Homo sapien
tggaactgttcacactagccattcc

SEQ ID NO: 441174 - DNA, 25 bp, Homo sapien
acactagccattcctacacgggtgc

SEQ ID NO: 441175 - DNA, 25 bp, Homo sapien
tgctgtgataacaggccatgggcca

SEQ ID NO: 441176 - DNA, 25 bp, Homo sapien
gctgtgataacaggccatgggccac

SEQ ID NO: 441177 - DNA, 25 bp, Homo sapien
gtgataacaggccatgggccaccac

SEQ ID NO: 441178 - DNA, 25 bp, Homo sapien
tgataacaggccatgggccaccaca

SEQ ID NO: 441179 - DNA, 25 bp, Homo sapien
gataacaggccatgggccaccacac

SEQ ID NO: 441180 - DNA, 25 bp, Homo sapien
tgttgcccaggctatacaaggctta

SEQ ID NO: 441181 - DNA, 25 bp, Homo sapien
gttgcccaggctatacaaggcttaa

SEQ ID NO: 441182 - DNA, 25 bp, Homo sapien
ttgcccaggctatacaaggcttaat

SEQ ID NO: 441183 - DNA, 25 bp, Homo sapien
tgcccaggctatacaaggcttaatt

SEQ ID NO: 441184 - DNA, 25 bp, Homo sapien
cccaggctatacaaggcttaatttt

SEQ ID NO: 441185 - DNA, 25 bp, Homo sapien
ccaggctatacaaggcttaatttta

SEQ ID NO: 441186 - DNA, 25 bp, Homo sapien
gcattcagtttctctatacttttgg

SEQ ID NO: 441187 - DNA, 25 bp, Homo sapien
aaggaggcagttacacggaacatat

SEQ ID NO: 441188 - DNA, 25 bp, Homo sapien
taatgcaaatatgggtgtgactgtt

SEQ ID NO: 441189 - DNA, 25 bp, Homo sapien
gtgactgttaattgggttggcatct

SEQ ID NO: 441190 - DNA, 25 bp, Homo sapien
gttggcatcttatggttaagcaacc

SEQ ID NO: 441191 - DNA, 25 bp, Homo sapien
agtgacagaggagcctttctgttct

SEQ ID NO: 441192 - DNA, 25 bp, Homo sapien
ttctgttctgggaaccattctgatt

SEQ ID NO: 441193 - DNA, 25 bp, Homo sapien
tgggaaccattctgatttatgtaga

SEQ ID NO: 441194 - DNA, 25 bp, Homo sapien
aacttttgcaaaaccatatgtctat

SEQ ID NO: 441195 - DNA, 25 bp, Homo sapien
gtctatctcatggtttaaagctctc

SEQ ID NO: 441196 - DNA, 25 bp, Homo sapien
tttaaagctctcacaggctggccag

SEQ ID NO: 441197 - DNA, 25 bp, Homo sapien
aacagaaatgagatttatccagcat

SEQ ID NO: 441198 - DNA, 25 bp, Homo sapien
tatccagcataaagggttaattttt

SEQ ID NO: 441199 - DNA, 25 bp, Homo sapien
attgttgctaagttttatgtagcta

SEQ ID NO: 441200 - DNA, 25 bp, Homo sapien
taaagacacgggtacaaattaagag

SEQ ID NO: 441201 - DNA, 25 bp, Homo sapien
aagagttatatggttttacaagtat

SEQ ID NO: 441202 - DNA, 25 bp, Homo sapien
aagtatatgttaaccccttggcgct

SEQ ID NO: 441203 - DNA, 25 bp, Homo sapien
tggcggtcacggtgcgtctcattgc

SEQ ID NO: 441204 - DNA, 25 bp, Homo sapien
cacggtgcgtctcattgccggcaat

SEQ ID NO: 441205 - DNA, 25 bp, Homo sapien
caatggaagtgtgccgggaaatccc

SEQ ID NO: 441206 - DNA, 25 bp, Homo sapien
gaagtgtgccgggaaatcccaactc

SEQ ID NO: 441207 - DNA, 25 bp, Homo sapien
gaaatcccaactcccggcgtcaagg

SEQ ID NO: 441208 - DNA, 25 bp, Homo sapien
ctggacctcacagagcaggagttca

SEQ ID NO: 441209 - DNA, 25 bp, Homo sapien
agcaggagttcaggatccagcttcc

SEQ ID NO: 441210 - DNA, 25 bp, Homo sapien
cagcttcctgtcttcaaacacaaat

SEQ ID NO: 441211 - DNA, 25 bp, Homo sapien
aaattgaagaacctggtgtggacca

SEQ ID NO: 441212 - DNA, 25 bp, Homo sapien
ggaccagcagcatcacaaccctgga

SEQ ID NO: 441213 - DNA, 25 bp, Homo sapien
tcacaaccctggatgatgaatttca

SEQ ID NO: 441214 - DNA, 25 bp, Homo sapien
atgatgaatttcagtcagcctcaga

SEQ ID NO: 441215 - DNA, 25 bp, Homo sapien
atcatggacaccaaggtcgccaggc

SEQ ID NO: 441216 - DNA, 25 bp, Homo sapien
gtcgccaggcgctatgggaatttct

SEQ ID NO: 441217 - DNA, 25 bp, Homo sapien
tgggaatttcttcatccgtcagatc

SEQ ID NO: 441218 - DNA, 25 bp, Homo sapien
atccgtcagatccacagattcgagg

SEQ ID NO: 441219 - DNA, 25 bp, Homo sapien
aaaaatgtaaataagccaggtgagg

SEQ ID NO: 441220 - DNA, 25 bp, Homo sapien
aaaatgtaaataagccaggtgaggt

SEQ ID NO: 441221 - DNA, 25 bp, Homo sapien
aaatgtaaataagccaggtgaggtg

SEQ ID NO: 441222 - DNA, 25 bp, Homo sapien
atagggagaccctgggagaccctgt

SEQ ID NO: 441223 - DNA, 25 bp, Homo sapien
tagggagaccctgggagaccctgtc

SEQ ID NO: 441224 - DNA, 25 bp, Homo sapien
agggagaccctgggagaccctgtct

SEQ ID NO: 441225 - DNA, 25 bp, Homo sapien
gggagaccctgggagaccctgtctc

SEQ ID NO: 441226 - DNA, 25 bp, Homo sapien
gaccctgtctcagcaaaagttttaa

SEQ ID NO: 441227 - DNA, 25 bp, Homo sapien
gccgggcatgttggtgtgcaccttt

SEQ ID NO: 441228 - DNA, 25 bp, Homo sapien
gaatttgaagctgtagtgagccata

SEQ ID NO: 441229 - DNA, 25 bp, Homo sapien
tttgaagctgtagtgagccataatc

SEQ ID NO: 441230 - DNA, 25 bp, Homo sapien
ggagcgttcagttttgtgagcccaa

SEQ ID NO: 441231 - DNA, 25 bp, Homo sapien
tcagttttgtgagcccaagaatttt

SEQ ID NO: 441232 - DNA, 25 bp, Homo sapien
atagtcacatgaatgcctcaagtgt

SEQ ID NO: 441233 - DNA, 25 bp, Homo sapien
aatgcctcaagtgtgtgtttagtct

SEQ ID NO: 441234 - DNA, 25 bp, Homo sapien
gtttagtcttgagggtacacatctg

SEQ ID NO: 441235 - DNA, 25 bp, Homo sapien
agtcttgagggtacacatctgtgaa

SEQ ID NO: 441236 - DNA, 25 bp, Homo sapien
gtacacatctgtgaaaacatgacct

SEQ ID NO: 441237 - DNA, 25 bp, Homo sapien
tgtgaaaacatgacctttgggtgtg

SEQ ID NO: 441238 - DNA, 25 bp, Homo sapien
gtgctaagtgggactaagacccaga

SEQ ID NO: 441239 - DNA, 25 bp, Homo sapien
taagacccagagagacaagagccag

SEQ ID NO: 441240 - DNA, 25 bp, Homo sapien
ggctggaggctgtttttatagaaga

SEQ ID NO: 441241 - DNA, 25 bp, Homo sapien
gtgaagatttaggttaacttctcat

SEQ ID NO: 441242 - DNA, 25 bp, Homo sapien
ggttaacttctcattaatcccacga

SEQ ID NO: 441243 - DNA, 25 bp, Homo sapien
aacttctcattaatcccacgaatcc

SEQ ID NO: 441244 - DNA, 25 bp, Homo sapien
ttaatcccacgaatccttaccgagt

SEQ ID NO: 441245 - DNA, 25 bp, Homo sapien
ccacgaatccttaccgagtgccaat

SEQ ID NO: 441246 - DNA, 25 bp, Homo sapien
gagtgccaataatgggtgaggccct

SEQ ID NO: 441247 - DNA, 25 bp, Homo sapien
aataatgggtgaggccctgtgccta

SEQ ID NO: 441248 - DNA, 25 bp, Homo sapien
gaggccctgtgcctagcacaaaata

SEQ ID NO: 441249 - DNA, 25 bp, Homo sapien
tgtgcctagcacaaaataagggcat

SEQ ID NO: 441250 - DNA, 25 bp, Homo sapien
gggcataagaaatactagttacatc

SEQ ID NO: 441251 - DNA, 25 bp, Homo sapien
atactagttacatcacaaggtcagg

SEQ ID NO: 441252 - DNA, 25 bp, Homo sapien
agagggtgacaaggtgcatctatac

SEQ ID NO: 441253 - DNA, 25 bp, Homo sapien
gggtgacaaggtgcatctatacctg

SEQ ID NO: 441254 - DNA, 25 bp, Homo sapien
gacaaggtgcatctatacctggcca

SEQ ID NO: 441255 - DNA, 25 bp, Homo sapien
caaggtgcatctatacctggccagt

SEQ ID NO: 441256 - DNA, 25 bp, Homo sapien
aaggtgcatctatacctggccagtg

SEQ ID NO: 441257 - DNA, 25 bp, Homo sapien
ttgtgcccacctttcctagggaggg

SEQ ID NO: 441258 - DNA, 25 bp, Homo sapien
gaggggctgcactgaattgaaacag

SEQ ID NO: 441259 - DNA, 25 bp, Homo sapien
tgaaacagtgccagctgggaaatga

SEQ ID NO: 441260 - DNA, 25 bp, Homo sapien
gggaaatgagaaggcttatcaacaa

SEQ ID NO: 441261 - DNA, 25 bp, Homo sapien
tgagaaggcttatcaacaagtcttt

SEQ ID NO: 441262 - DNA, 25 bp, Homo sapien
gcaagaaagagctcgagggccgggc

SEQ ID NO: 441263 - DNA, 25 bp, Homo sapien
gggcttaaaagctccatggactggt

SEQ ID NO: 441264 - DNA, 25 bp, Homo sapien
ccatggactggtgaggattatcatt

SEQ ID NO: 441265 - DNA, 25 bp, Homo sapien
tggaatttccccaattcaagaacct

SEQ ID NO: 441266 - DNA, 25 bp, Homo sapien
agaaccttactattatcctccaatc

SEQ ID NO: 441267 - DNA, 25 bp, Homo sapien
attatcctccaatcagttctacact

SEQ ID NO: 441268 - DNA, 25 bp, Homo sapien
aaatcccctggaccttatataacat

SEQ ID NO: 441269 - DNA, 25 bp, Homo sapien
gttagttactcttacactcttgtca

SEQ ID NO: 441270 - DNA, 25 bp, Homo sapien
gttgatagactagctcttgatcaga

SEQ ID NO: 441271 - DNA, 25 bp, Homo sapien
cttgatcagagtacccttgtatgga

SEQ ID NO: 441272 - DNA, 25 bp, Homo sapien
atgccatacatttcacttgattctg

SEQ ID NO: 441273 - DNA, 25 bp, Homo sapien
gaaccataatgcttaggacagtagt

SEQ ID NO: 441274 - DNA, 25 bp, Homo sapien
tagcaccaggcaccagaagggccat

SEQ ID NO: 441275 - DNA, 25 bp, Homo sapien
gaagggccatctactatcagaagct

SEQ ID NO: 441276 - DNA, 25 bp, Homo sapien
gctaacattacagccagtagaccac

SEQ ID NO: 441277 - DNA, 25 bp, Homo sapien
tacagccagtagaccacttgacaat

SEQ ID NO: 441278 - DNA, 25 bp, Homo sapien
gaccacttgacaatttctctacaga

SEQ ID NO: 441279 - DNA, 25 bp, Homo sapien
aatactgtgctgctctgacagaaac

SEQ ID NO: 441280 - DNA, 25 bp, Homo sapien
tgtgctgctctgacagaaactatca

SEQ ID NO: 441281 - DNA, 25 bp, Homo sapien
ttatcacacagaatacccagatgac

SEQ ID NO: 441282 - DNA, 25 bp, Homo sapien
acccagatgactaacatggcgagta

SEQ ID NO: 441283 - DNA, 25 bp, Homo sapien
tggcgagtaccaaggtgactgccct

SEQ ID NO: 441284 - DNA, 25 bp, Homo sapien
accaaggtgactgccctagagatta

SEQ ID NO: 441285 - DNA, 25 bp, Homo sapien
tattgtgacagaatgttggttatta

SEQ ID NO: 441286 - DNA, 25 bp, Homo sapien
gtttgaaagatctagttgcatacac

SEQ ID NO: 441287 - DNA, 25 bp, Homo sapien
gatctagttgcatacacagactctt

SEQ ID NO: 441288 - DNA, 25 bp, Homo sapien
ttgcatacacagactcttggatcaa

SEQ ID NO: 441289 - DNA, 25 bp, Homo sapien
tacacagactcttggatcaaaaata

SEQ ID NO: 441290 - DNA, 25 bp, Homo sapien
aaaataaagagctctgggctcactt

SEQ ID NO: 441291 - DNA, 25 bp, Homo sapien
tgggctcacttcttagatcagtctg

SEQ ID NO: 441292 - DNA, 25 bp, Homo sapien
acttcttagatcagtctgtggccaa

SEQ ID NO: 441293 - DNA, 25 bp, Homo sapien
ttaattcctggcacatcagtttgtc

SEQ ID NO: 441294 - DNA, 25 bp, Homo sapien
attcctggcacatcagtttgtcaaa

SEQ ID NO: 441295 - DNA, 25 bp, Homo sapien
ctggcacatcagtttgtcaaaatta

SEQ ID NO: 441296 - DNA, 25 bp, Homo sapien
gaaatacaatgtagaatggttgcat

SEQ ID NO: 441297 - DNA, 25 bp, Homo sapien
atggttgcattcacttattaaaggg

SEQ ID NO: 441298 - DNA, 25 bp, Homo sapien
gcattcacttattaaagggtagcct

SEQ ID NO: 441299 - DNA, 25 bp, Homo sapien
aagggtagcctctcaaatcagtttg

SEQ ID NO: 441300 - DNA, 25 bp, Homo sapien
ggtagcctctcaaatcagtttgaaa

SEQ ID NO: 441301 - DNA, 25 bp, Homo sapien
aatgtttgctgtttacaaggagcac

SEQ ID NO: 441302 - DNA, 25 bp, Homo sapien
gagcacataaaacatagactagaag

SEQ ID NO: 441303 - DNA, 25 bp, Homo sapien
agtaggcatagcaagagaattcaaa

SEQ ID NO: 441304 - DNA, 25 bp, Homo sapien
ttcaaagcaaaaactcattcaatta

SEQ ID NO: 441305 - DNA, 25 bp, Homo sapien
atcatcttggtaaattgttttatag

SEQ ID NO: 441306 - DNA, 25 bp, Homo sapien
gaattcacttagcaatatagctttg

SEQ ID NO: 441307 - DNA, 25 bp, Homo sapien
ttttgtgaatatactcggaaccact

SEQ ID NO: 441308 - DNA, 25 bp, Homo sapien
actttaagtgggtgaggtatgtgaa

SEQ ID NO: 441309 - DNA, 25 bp, Homo sapien
caaagctacattttacctaaggcaa

SEQ ID NO: 441310 - DNA, 25 bp, Homo sapien
tacctaaggcaaatgtttactaccg

SEQ ID NO: 441311 - DNA, 25 bp, Homo sapien
tgtttactaccgcttctctttcagt

SEQ ID NO: 441312 - DNA, 25 bp, Homo sapien
tctttcagtcccaaataatttccag

SEQ ID NO: 441313 - DNA, 25 bp, Homo sapien
ataatttccagccatatgttccagt

SEQ ID NO: 441314 - DNA, 25 bp, Homo sapien
tttccagccatatgttccagtcaag

SEQ ID NO: 441315 - DNA, 25 bp, Homo sapien
tatgttccagtcaagcctcgacaaa

SEQ ID NO: 441316 - DNA, 25 bp, Homo sapien
tcaagcctcgacaaaattaaacaac

SEQ ID NO: 441317 - DNA, 25 bp, Homo sapien
gaagtttccttggagggatcatgaa

SEQ ID NO: 441318 - DNA, 25 bp, Homo sapien
aaaccattcataggctctaagctta

SEQ ID NO: 441319 - DNA, 25 bp, Homo sapien
atgcttggaaataacaggtgtcact

SEQ ID NO: 441320 - DNA, 25 bp, Homo sapien
aggtgtcacttgtgcccacatttca

SEQ ID NO: 441321 - DNA, 25 bp, Homo sapien
atttcattggccagtgcagatcaca

SEQ ID NO: 441322 - DNA, 25 bp, Homo sapien
tggccacacctgagtttgcatataa

SEQ ID NO: 441323 - DNA, 25 bp, Homo sapien
gaggcatccttcttctgtagagact

SEQ ID NO: 441324 - DNA, 25 bp, Homo sapien
gtagagactggtaccacaagtcatg

SEQ ID NO: 441325 - DNA, 25 bp, Homo sapien
ggcagatgacacatagtcctcttct

SEQ ID NO: 441326 - DNA, 25 bp, Homo sapien
gtgaatcatctaccaagacagcaat

SEQ ID NO: 441327 - DNA, 25 bp, Homo sapien
tgcattgacaggcagggtttcccac

SEQ ID NO: 441328 - DNA, 25 bp, Homo sapien
caggcagggtttcccacttaaaatg

SEQ ID NO: 441329 - DNA, 25 bp, Homo sapien
aaaaacaaatacaatggaccaggca

SEQ ID NO: 441330 - DNA, 25 bp, Homo sapien
aaaacaaatacaatggaccaggcat

SEQ ID NO: 441331 - DNA, 25 bp, Homo sapien
aaacaaatacaatggaccaggcatg

SEQ ID NO: 441332 - DNA, 25 bp, Homo sapien
aacaaatacaatggaccaggcatgg

SEQ ID NO: 441333 - DNA, 25 bp, Homo sapien
aaatgcaggagggttggctggactt

SEQ ID NO: 441334 - DNA, 25 bp, Homo sapien
aatgcaggagggttggctggacttg

SEQ ID NO: 441335 - DNA, 25 bp, Homo sapien
tgcaggagggttggctggacttggt

SEQ ID NO: 441336 - DNA, 25 bp, Homo sapien
aggagggttggctggacttggtggc

SEQ ID NO: 441337 - DNA, 25 bp, Homo sapien
gagggttggctggacttggtggcgg

SEQ ID NO: 441338 - DNA, 25 bp, Homo sapien
agggttggctggacttggtggcggg

SEQ ID NO: 441339 - DNA, 25 bp, Homo sapien
gggttggctggacttggtggcgggc

SEQ ID NO: 441340 - DNA, 25 bp, Homo sapien
cagccactaaaagtgcgttaatgtc

SEQ ID NO: 441341 - DNA, 25 bp, Homo sapien
agccactaaaagtgcgttaatgtca

SEQ ID NO: 441342 - DNA, 25 bp, Homo sapien
gccactaaaagtgcgttaatgtcac

SEQ ID NO: 441343 - DNA, 25 bp, Homo sapien
cactaaaagtgcgttaatgtcacgc

SEQ ID NO: 441344 - DNA, 25 bp, Homo sapien
actaaaagtgcgttaatgtcacgcc

SEQ ID NO: 441345 - DNA, 25 bp, Homo sapien
ctaaaagtgcgttaatgtcacgcct

SEQ ID NO: 441346 - DNA, 25 bp, Homo sapien
taaaagtgcgttaatgtcacgcctg

SEQ ID NO: 441347 - DNA, 25 bp, Homo sapien
aaaagtgcgttaatgtcacgcctgt

SEQ ID NO: 441348 - DNA, 25 bp, Homo sapien
aaagtgcgttaatgtcacgcctgta

SEQ ID NO: 441349 - DNA, 25 bp, Homo sapien
aagtgcgttaatgtcacgcctgtaa

SEQ ID NO: 441350 - DNA, 25 bp, Homo sapien
agtgcgttaatgtcacgcctgtaat

SEQ ID NO: 441351 - DNA, 25 bp, Homo sapien
ctggaagtacctggaaggggtcact

SEQ ID NO: 441352 - DNA, 25 bp, Homo sapien
tggaagtacctggaaggggtcactg

SEQ ID NO: 441353 - DNA, 25 bp, Homo sapien
gaagtacctggaaggggtcactggg

SEQ ID NO: 441354 - DNA, 25 bp, Homo sapien
tacctggaaggggtcactgggagaa

SEQ ID NO: 441355 - DNA, 25 bp, Homo sapien
ccccaagaaagatgcagcctcaggc

SEQ ID NO: 441356 - DNA, 25 bp, Homo sapien
cccaagaaagatgcagcctcaggct

SEQ ID NO: 441357 - DNA, 25 bp, Homo sapien
ccaagaaagatgcagcctcaggctg

SEQ ID NO: 441358 - DNA, 25 bp, Homo sapien
gccgggggtaatggcacgtgcctgc

SEQ ID NO: 441359 - DNA, 25 bp, Homo sapien
cgggggtaatggcacgtgcctgcaa

SEQ ID NO: 441360 - DNA, 25 bp, Homo sapien
gggggtaatggcacgtgcctgcaat

SEQ ID NO: 441361 - DNA, 25 bp, Homo sapien
ggggtaatggcacgtgcctgcaatc

SEQ ID NO: 441362 - DNA, 25 bp, Homo sapien
atcctacggacgtcatgcaggacca

SEQ ID NO: 441363 - DNA, 25 bp, Homo sapien
acggacgtcatgcaggaccagagca

SEQ ID NO: 441364 - DNA, 25 bp, Homo sapien
ggaccagagcatagcaactgcccaa

SEQ ID NO: 441365 - DNA, 25 bp, Homo sapien
agagcatagcaactgcccaaagtga

SEQ ID NO: 441366 - DNA, 25 bp, Homo sapien
gcccaaagtgatcctacggacgtca

SEQ ID NO: 441367 - DNA, 25 bp, Homo sapien
agtgatcctacggacgtcatgcagg

SEQ ID NO: 441368 - DNA, 25 bp, Homo sapien
atcctacggacgtcatgcaggaccg

SEQ ID NO: 441369 - DNA, 25 bp, Homo sapien
aggaccggagcatagcaactgccca

SEQ ID NO: 441370 - DNA, 25 bp, Homo sapien
gagcatagcaactgcccaaagtgat

SEQ ID NO: 441371 - DNA, 25 bp, Homo sapien
ctgcccaaagtgatcctacggacgt

SEQ ID NO: 441372 - DNA, 25 bp, Homo sapien
tatggacgtcatgcaggaccggagc

SEQ ID NO: 441373 - DNA, 25 bp, Homo sapien
cagactttgtgttcccagttgtaaa

SEQ ID NO: 441374 - DNA, 25 bp, Homo sapien
gttcccagttgtaaatgtgctccat

SEQ ID NO: 441375 - DNA, 25 bp, Homo sapien
gtgctccatggagtctatgatcatg

SEQ ID NO: 441376 - DNA, 25 bp, Homo sapien
tatgatcatgctcactcaagatgtg

SEQ ID NO: 441377 - DNA, 25 bp, Homo sapien
gagtcattttggtccagaaatccct

SEQ ID NO: 441378 - DNA, 25 bp, Homo sapien
gaaatccctgttggtacattaaact

SEQ ID NO: 441379 - DNA, 25 bp, Homo sapien
gctgatattgactatgatacctgga

SEQ ID NO: 441380 - DNA, 25 bp, Homo sapien
gatacctggaaaaaaggcctcccat

SEQ ID NO: 441381 - DNA, 25 bp, Homo sapien
aggcctcccatcatttcttaaagaa

SEQ ID NO: 441382 - DNA, 25 bp, Homo sapien
gaagataacagttgtaccaggcaca

SEQ ID NO: 441383 - DNA, 25 bp, Homo sapien
ttgtaccaggcacaacggttcactc

SEQ ID NO: 441384 - DNA, 25 bp, Homo sapien
tgccactgaccttcactgatgcttc

SEQ ID NO: 441385 - DNA, 25 bp, Homo sapien
cactgatgcttctgtacttaagaag

SEQ ID NO: 441386 - DNA, 25 bp, Homo sapien
actgatgcttctgtacttaagaagt

SEQ ID NO: 441387 - DNA, 25 bp, Homo sapien
ctgatgcttctgtacttaagaagta

SEQ ID NO: 441388 - DNA, 25 bp, Homo sapien
tacttaagaagtaatgtcccttggc

SEQ ID NO: 441389 - DNA, 25 bp, Homo sapien
acttaagaagtaatgtcccttggct

SEQ ID NO: 441390 - DNA, 25 bp, Homo sapien
cttaagaagtaatgtcccttggctg

SEQ ID NO: 441391 - DNA, 25 bp, Homo sapien
ttaagaagtaatgtcccttggctgg

SEQ ID NO: 441392 - DNA, 25 bp, Homo sapien
taagaagtaatgtcccttggctggg

SEQ ID NO: 441393 - DNA, 25 bp, Homo sapien
aagaagtaatgtcccttggctgggc

SEQ ID NO: 441394 - DNA, 25 bp, Homo sapien
gaagtaatgtcccttggctgggcgc

SEQ ID NO: 441395 - DNA, 25 bp, Homo sapien
atctcccaggttctcattggaaagg

SEQ ID NO: 441396 - DNA, 25 bp, Homo sapien
tctcccaggttctcattggaaaggc

SEQ ID NO: 441397 - DNA, 25 bp, Homo sapien
ctcccaggttctcattggaaaggca

SEQ ID NO: 441398 - DNA, 25 bp, Homo sapien
tcccaggttctcattggaaaggcag

SEQ ID NO: 441399 - DNA, 25 bp, Homo sapien
cccaggttctcattggaaaggcagg

SEQ ID NO: 441400 - DNA, 25 bp, Homo sapien
ccaggttctcattggaaaggcaggg

SEQ ID NO: 441401 - DNA, 25 bp, Homo sapien
caggttctcattggaaaggcagggt

SEQ ID NO: 441402 - DNA, 25 bp, Homo sapien
aggttctcattggaaaggcagggtt

SEQ ID NO: 441403 - DNA, 25 bp, Homo sapien
ggttctcattggaaaggcagggtta

SEQ ID NO: 441404 - DNA, 25 bp, Homo sapien
ttctcattggaaaggcagggttaaa

SEQ ID NO: 441405 - DNA, 25 bp, Homo sapien
tctcattggaaaggcagggttaaaa

SEQ ID NO: 441406 - DNA, 25 bp, Homo sapien
aaagatgatagaggctggttatggt

SEQ ID NO: 441407 - DNA, 25 bp, Homo sapien
acctatagtcctagcacttaaggag

SEQ ID NO: 441408 - DNA, 25 bp, Homo sapien
ctatagtcctagcacttaaggaggc

SEQ ID NO: 441409 - DNA, 25 bp, Homo sapien
ttagctaggtgtgataatgtgtgtc

SEQ ID NO: 441410 - DNA, 25 bp, Homo sapien
gctaggtgtgataatgtgtgtcttt

SEQ ID NO: 441411 - DNA, 25 bp, Homo sapien
taatgtgtgtctttggtcccagtta

SEQ ID NO: 441412 - DNA, 25 bp, Homo sapien
aatgtgtgtctttggtcccagttac

SEQ ID NO: 441413 - DNA, 25 bp, Homo sapien
atgtgtgtctttggtcccagttacc

SEQ ID NO: 441414 - DNA, 25 bp, Homo sapien
tgtgtgtctttggtcccagttacct

SEQ ID NO: 441415 - DNA, 25 bp, Homo sapien
gtgtgtctttggtcccagttacctg

SEQ ID NO: 441416 - DNA, 25 bp, Homo sapien
tgtgtctttggtcccagttacctgg

SEQ ID NO: 441417 - DNA, 25 bp, Homo sapien
gatgaaattcggatacactattcaa

SEQ ID NO: 441418 - DNA, 25 bp, Homo sapien
ttcaacctaatacatctactaaacg

SEQ ID NO: 441419 - DNA, 25 bp, Homo sapien
aacaatcattcacaaactcttacaa

SEQ ID NO: 441420 - DNA, 25 bp, Homo sapien
aacatttctcaatttattctatgaa

SEQ ID NO: 441421 - DNA, 25 bp, Homo sapien
gaagccagcattagccagataccaa

SEQ ID NO: 441422 - DNA, 25 bp, Homo sapien
gccagcattagccagataccaaagc

SEQ ID NO: 441423 - DNA, 25 bp, Homo sapien
accaaagccagacagacataacaag

SEQ ID NO: 441424 - DNA, 25 bp, Homo sapien
gctgaagaccaatatttctgatgaa

SEQ ID NO: 441425 - DNA, 25 bp, Homo sapien
aatatacaggtataccctcatctta

SEQ ID NO: 441426 - DNA, 25 bp, Homo sapien
ggtataccctcatcttattgtactt

SEQ ID NO: 441427 - DNA, 25 bp, Homo sapien
accctcatcttattgtactttgcag

SEQ ID NO: 441428 - DNA, 25 bp, Homo sapien
gcacagcagcaagacagattgccat

SEQ ID NO: 441429 - DNA, 25 bp, Homo sapien
attgccatggagcatgttgtgccca

SEQ ID NO: 441430 - DNA, 25 bp, Homo sapien
gttgtgcccaactagggacagcgca

SEQ ID NO: 441431 - DNA, 25 bp, Homo sapien
gggacagcgcagatagattctgtaa

SEQ ID NO: 441432 - DNA, 25 bp, Homo sapien
gattctgtaatttgcctaacaatgt

SEQ ID NO: 441433 - DNA, 25 bp, Homo sapien
ataggatgatcccatttgtcaaaaa

SEQ ID NO: 441434 - DNA, 25 bp, Homo sapien
gtcacctaaatgcacctaaacttct

SEQ ID NO: 441435 - DNA, 25 bp, Homo sapien
atgctcttctgtactcttgatcttt

SEQ ID NO: 441436 - DNA, 25 bp, Homo sapien
gtactcttgatctttccccaaattt

SEQ ID NO: 441437 - DNA, 25 bp, Homo sapien
aaaacatgacactcattcccttatt

SEQ ID NO: 441438 - DNA, 25 bp, Homo sapien
tcattcccttatttttcctacttag

SEQ ID NO: 441439 - DNA, 25 bp, Homo sapien
tcccctggcagtcagctactgttag

SEQ ID NO: 441440 - DNA, 25 bp, Homo sapien
gctactgttaggattttgttcactg

SEQ ID NO: 441441 - DNA, 25 bp, Homo sapien
gaacttcatataacggactcactta

SEQ ID NO: 441442 - DNA, 25 bp, Homo sapien
acggactcacttatgcagtatgtat

SEQ ID NO: 441443 - DNA, 25 bp, Homo sapien
aagttccttttactcagcatgtttg

SEQ ID NO: 441444 - DNA, 25 bp, Homo sapien
gcatgtttgtatgttcatcagtgtg

SEQ ID NO: 441445 - DNA, 25 bp, Homo sapien
atcagtgtgtttaagctttgttcct

SEQ ID NO: 441446 - DNA, 25 bp, Homo sapien
atggctgagcagtgttctatgtatg

SEQ ID NO: 441447 - DNA, 25 bp, Homo sapien
atgccacattttaacgtttcacctg

SEQ ID NO: 441448 - DNA, 25 bp, Homo sapien
ggtgaacaactaactggtgaacaat

SEQ ID NO: 441449 - DNA, 25 bp, Homo sapien
aacaatgggctgtttctagtttggg

SEQ ID NO: 441450 - DNA, 25 bp, Homo sapien
gcagtgaaaaattttcagccaggtg

SEQ ID NO: 441451 - DNA, 25 bp, Homo sapien
gcttgaacctgcaaggttgagacta

SEQ ID NO: 441452 - DNA, 25 bp, Homo sapien
cttgaacctgcaaggttgagactac

SEQ ID NO: 441453 - DNA, 25 bp, Homo sapien
ttgaacctgcaaggttgagactaca

SEQ ID NO: 441454 - DNA, 25 bp, Homo sapien
tgaacctgcaaggttgagactacag

SEQ ID NO: 441455 - DNA, 25 bp, Homo sapien
gagctgtgatcccactgctgtaccc

SEQ ID NO: 441456 - DNA, 25 bp, Homo sapien
agctgtgatcccactgctgtacccc

SEQ ID NO: 441457 - DNA, 25 bp, Homo sapien
gctgtgatcccactgctgtacccca

SEQ ID NO: 441458 - DNA, 25 bp, Homo sapien
ggccccacatatgtgttcttttggc

SEQ ID NO: 441459 - DNA, 25 bp, Homo sapien
ttggcccattggttgattcgtaagt

SEQ ID NO: 441460 - DNA, 25 bp, Homo sapien
attcgtaagtctgtgtaaatttctc

SEQ ID NO: 441461 - DNA, 25 bp, Homo sapien
gtaaatttctcagcctgttgacaaa

SEQ ID NO: 441462 - DNA, 25 bp, Homo sapien
gttgacaaactagtcttccaaatgt

SEQ ID NO: 441463 - DNA, 25 bp, Homo sapien
gtgcaatactaagttcatccagagt

SEQ ID NO: 441464 - DNA, 25 bp, Homo sapien
gttcatccagagtaattctttacct

SEQ ID NO: 441465 - DNA, 25 bp, Homo sapien
ctttaccttttgataggtggcctga

SEQ ID NO: 441466 - DNA, 25 bp, Homo sapien
gataggtggcctgaagttgtttcta

SEQ ID NO: 441467 - DNA, 25 bp, Homo sapien
tagtaatagctcctgtaccacgtgc

SEQ ID NO: 441468 - DNA, 25 bp, Homo sapien
cacgtgccaactgggcttttcattt

SEQ ID NO: 441469 - DNA, 25 bp, Homo sapien
agagtcagccagacaggcagctctc

SEQ ID NO: 441470 - DNA, 25 bp, Homo sapien
gagtcagccagacaggcagctctct

SEQ ID NO: 441471 - DNA, 25 bp, Homo sapien
agccagacaggcagctctctcaaat

SEQ ID NO: 441472 - DNA, 25 bp, Homo sapien
cagacaggcagctctctcaaatgga

SEQ ID NO: 441473 - DNA, 25 bp, Homo sapien
gacaggcagctctctcaaatggaga

SEQ ID NO: 441474 - DNA, 25 bp, Homo sapien
caggcagctctctcaaatggagatc

SEQ ID NO: 441475 - DNA, 25 bp, Homo sapien
gcagctctctcaaatggagatcctt

SEQ ID NO: 441476 - DNA, 25 bp, Homo sapien
gctctctcaaatggagatcctttga

SEQ ID NO: 441477 - DNA, 25 bp, Homo sapien
caaatggagatcctttgaagactat

SEQ ID NO: 441478 - DNA, 25 bp, Homo sapien
atctttctctgggatttgagaatat

SEQ ID NO: 441479 - DNA, 25 bp, Homo sapien
gtagatgatgggtgtagcaaaccac

SEQ ID NO: 441480 - DNA, 25 bp, Homo sapien
agactgagtcagatgagtaattgtc

SEQ ID NO: 441481 - DNA, 25 bp, Homo sapien
agtaattgtcactcagttagttatt

SEQ ID NO: 441482 - DNA, 25 bp, Homo sapien
gtcactcagttagttattttttatg

SEQ ID NO: 441483 - DNA, 25 bp, Homo sapien
gttcctctgggctgttgggattgct

SEQ ID NO: 441484 - DNA, 25 bp, Homo sapien
tcctctgggctgttgggattgcttc

SEQ ID NO: 441485 - DNA, 25 bp, Homo sapien
ctctgggctgttgggattgcttcct

SEQ ID NO: 441486 - DNA, 25 bp, Homo sapien
ctgggctgttgggattgcttcctca

SEQ ID NO: 441487 - DNA, 25 bp, Homo sapien
gggctgttgggattgcttcctcagc

SEQ ID NO: 441488 - DNA, 25 bp, Homo sapien
gctgttgggattgcttcctcagctt

SEQ ID NO: 441489 - DNA, 25 bp, Homo sapien
ttcctgtaacagatgtaatttaaac

SEQ ID NO: 441490 - DNA, 25 bp, Homo sapien
tgtaatttaaactgtcgaaaaccat

SEQ ID NO: 441491 - DNA, 25 bp, Homo sapien
aaatcaaaatgcttctctttacaaa

SEQ ID NO: 441492 - DNA, 25 bp, Homo sapien
tcaaaatgcttctctttacaaagac

SEQ ID NO: 441493 - DNA, 25 bp, Homo sapien
aaatgcttctctttacaaagactgt

SEQ ID NO: 441494 - DNA, 25 bp, Homo sapien
atgcttctctttacaaagactgtgt

SEQ ID NO: 441495 - DNA, 25 bp, Homo sapien
gcttctctttacaaagactgtgtat

SEQ ID NO: 441496 - DNA, 25 bp, Homo sapien
tctctttacaaagactgtgtattca

SEQ ID NO: 441497 - DNA, 25 bp, Homo sapien
gactgtgtattcaataccttaaacg

SEQ ID NO: 441498 - DNA, 25 bp, Homo sapien
gtattcaataccttaaacgaacttg

SEQ ID NO: 441499 - DNA, 25 bp, Homo sapien
taccttaaacgaacttgaagtggag

SEQ ID NO: 441500 - DNA, 25 bp, Homo sapien
ttaaacgaacttgaagtggagcttt

SEQ ID NO: 441501 - DNA, 25 bp, Homo sapien
ttttgaaatttgtgtccgaagtgca

SEQ ID NO: 441502 - DNA, 25 bp, Homo sapien
caaagttcccttgttgccagtcaac

SEQ ID NO: 441503 - DNA, 25 bp, Homo sapien
aagttcccttgttgccagtcaactc

SEQ ID NO: 441504 - DNA, 25 bp, Homo sapien
ttcccttgttgccagtcaactctgc

SEQ ID NO: 441505 - DNA, 25 bp, Homo sapien
agttttcctgaatctagaacttaag

SEQ ID NO: 441506 - DNA, 25 bp, Homo sapien
gaatctagaacttaaggaaacatac

SEQ ID NO: 441507 - DNA, 25 bp, Homo sapien
gtgtgggggcatgatcttaatataa

SEQ ID NO: 441508 - DNA, 25 bp, Homo sapien
gggcatgatcttaatataaaatact

SEQ ID NO: 441509 - DNA, 25 bp, Homo sapien
actagatggaagactggaaatacag

SEQ ID NO: 441510 - DNA, 25 bp, Homo sapien
tttgcccccaatccctaaagaatgt

SEQ ID NO: 441511 - DNA, 25 bp, Homo sapien
caatccctaaagaatgttggttctt

SEQ ID NO: 441512 - DNA, 25 bp, Homo sapien
aatgttggttcttaaggaagctgag

SEQ ID NO: 441513 - DNA, 25 bp, Homo sapien
aggattactcgcgtctggctccagg

SEQ ID NO: 441514 - DNA, 25 bp, Homo sapien
ggattactcgcgtctggctccaggc

SEQ ID NO: 441515 - DNA, 25 bp, Homo sapien
gattactcgcgtctggctccaggcg

SEQ ID NO: 441516 - DNA, 25 bp, Homo sapien
attactcgcgtctggctccaggcgc

SEQ ID NO: 441517 - DNA, 25 bp, Homo sapien
gcgtctggctccaggcgccgagaag

SEQ ID NO: 441518 - DNA, 25 bp, Homo sapien
tccaggcgccgagaaggcgcgctgg

SEQ ID NO: 441519 - DNA, 25 bp, Homo sapien
agaaggcgcgctgggcgcccgtggc

SEQ ID NO: 441520 - DNA, 25 bp, Homo sapien
aagaagcagtaagcacagcggcggc

SEQ ID NO: 441521 - DNA, 25 bp, Homo sapien
aagcagtaagcacagcggcggcggc

SEQ ID NO: 441522 - DNA, 25 bp, Homo sapien
tggaccagcgcgctctctggaaata

SEQ ID NO: 441523 - DNA, 25 bp, Homo sapien
ggaccagcgcgctctctggaaatag

SEQ ID NO: 441524 - DNA, 25 bp, Homo sapien
tcctgactttcacttcgctcacttg

SEQ ID NO: 441525 - DNA, 25 bp, Homo sapien
tgactttcacttcgctcacttgcta

SEQ ID NO: 441526 - DNA, 25 bp, Homo sapien
tttcacttcgctcacttgctattgt

SEQ ID NO: 441527 - DNA, 25 bp, Homo sapien
cacttcgctcacttgctattgttta

SEQ ID NO: 441528 - DNA, 25 bp, Homo sapien
cttcgctcacttgctattgtttaaa

SEQ ID NO: 441529 - DNA, 25 bp, Homo sapien
ttcgctcacttgctattgtttaaag

SEQ ID NO: 441530 - DNA, 25 bp, Homo sapien
cgctcacttgctattgtttaaagaa

SEQ ID NO: 441531 - DNA, 25 bp, Homo sapien
tcacttgctattgtttaaagaacct

SEQ ID NO: 441532 - DNA, 25 bp, Homo sapien
taaagaaccttttctagaggccagg

SEQ ID NO: 441533 - DNA, 25 bp, Homo sapien
aagaaccttttctagaggccaggca

SEQ ID NO: 441534 - DNA, 25 bp, Homo sapien
gaaccttttctagaggccaggcacg

SEQ ID NO: 441535 - DNA, 25 bp, Homo sapien
gaaaggctgctaaatggaaagatga

SEQ ID NO: 441536 - DNA, 25 bp, Homo sapien
gatgatttgtagagatactggtaga

SEQ ID NO: 441537 - DNA, 25 bp, Homo sapien
caataaatgggatggttctgaatga

SEQ ID NO: 441538 - DNA, 25 bp, Homo sapien
ggttctgaatgaaagtgggcacaca

SEQ ID NO: 441539 - DNA, 25 bp, Homo sapien
ctgaatgaaagtgggcacacaggag

SEQ ID NO: 441540 - DNA, 25 bp, Homo sapien
acacacacctctttcaaaatccaag

SEQ ID NO: 441541 - DNA, 25 bp, Homo sapien
aaaatccaagccactcactgcatat

SEQ ID NO: 441542 - DNA, 25 bp, Homo sapien
atccaagccactcactgcatatgtg

SEQ ID NO: 441543 - DNA, 25 bp, Homo sapien
actgcatatgtgtcttctttaagaa

SEQ ID NO: 441544 - DNA, 25 bp, Homo sapien
gtcttctttaagaatcccctactga

SEQ ID NO: 441545 - DNA, 25 bp, Homo sapien
ttctttaagaatcccctactgaggc

SEQ ID NO: 441546 - DNA, 25 bp, Homo sapien
accatctaccctatgtgtctgtgtg

SEQ ID NO: 441547 - DNA, 25 bp, Homo sapien
accctatgtgtctgtgtggccttca

SEQ ID NO: 441548 - DNA, 25 bp, Homo sapien
gtctgtgtggccttcacatggcatt

SEQ ID NO: 441549 - DNA, 25 bp, Homo sapien
tggccttcacatggcattccttatt

SEQ ID NO: 441550 - DNA, 25 bp, Homo sapien
tcacatggcattccttatttttgca

SEQ ID NO: 441551 - DNA, 25 bp, Homo sapien
gattatgagtgagtgccaccatgcc

SEQ ID NO: 441552 - DNA, 25 bp, Homo sapien
ggctcacatggcctccttgtaataa

SEQ ID NO: 441553 - DNA, 25 bp, Homo sapien
catggcctccttgtaataacgctag

SEQ ID NO: 441554 - DNA, 25 bp, Homo sapien
ggcctccttgtaataacgctagtgc

SEQ ID NO: 441555 - DNA, 25 bp, Homo sapien
aataacgctagtgcctgggtgcggt

SEQ ID NO: 441556 - DNA, 25 bp, Homo sapien
ctgcggtggacggaccatgaggtca

SEQ ID NO: 441557 - DNA, 25 bp, Homo sapien
gctaaggtaaaatctggcactaaat

SEQ ID NO: 441558 - DNA, 25 bp, Homo sapien
agttaggctggagacagtaggctca

SEQ ID NO: 441559 - DNA, 25 bp, Homo sapien
acagtaggctcagtcatctcttaag

SEQ ID NO: 441560 - DNA, 25 bp, Homo sapien
ggctcagtcatctcttaagcattca

SEQ ID NO: 441561 - DNA, 25 bp, Homo sapien
gtcatctcttaagcattcatggaaa

SEQ ID NO: 441562 - DNA, 25 bp, Homo sapien
ttcatggaaaaacctactatgtgta

SEQ ID NO: 441563 - DNA, 25 bp, Homo sapien
aacctactatgtgtagtcattttgc

SEQ ID NO: 441564 - DNA, 25 bp, Homo sapien
gtgtagtcattttgctagggtcatg

SEQ ID NO: 441565 - DNA, 25 bp, Homo sapien
gggcctacagagacatatcagacag

SEQ ID NO: 441566 - DNA, 25 bp, Homo sapien
gagacatatcagacagtagtaggag

SEQ ID NO: 441567 - DNA, 25 bp, Homo sapien
taacaataacagcaccatggcacat

SEQ ID NO: 441568 - DNA, 25 bp, Homo sapien
ccaaaaggccatcgactgcattctt

SEQ ID NO: 441569 - DNA, 25 bp, Homo sapien
aaaaggccatcgactgcattcttcc

SEQ ID NO: 441570 - DNA, 25 bp, Homo sapien
tgttaagaattcagccccaagataa

SEQ ID NO: 441571 - DNA, 25 bp, Homo sapien
caaaccctggcaactcttttggtga

SEQ ID NO: 441572 - DNA, 25 bp, Homo sapien
aagcagccttacatccctaagatgg

SEQ ID NO: 441573 - DNA, 25 bp, Homo sapien
agccttacatccctaagatggccaa

SEQ ID NO: 441574 - DNA, 25 bp, Homo sapien
catccctaagatggccaagctgaag

SEQ ID NO: 441575 - DNA, 25 bp, Homo sapien
agaatgctgctgactataagtttca

SEQ ID NO: 441576 - DNA, 25 bp, Homo sapien
tgctgctgactataagtttcaagga

SEQ ID NO: 441577 - DNA, 25 bp, Homo sapien
ttgctggtgcaaaggatcctgctaa

SEQ ID NO: 441578 - DNA, 25 bp, Homo sapien
cctgctaaagttgcccggaagaaga

SEQ ID NO: 441579 - DNA, 25 bp, Homo sapien
cccactgctgggtatctgtcagcaa

SEQ ID NO: 441580 - DNA, 25 bp, Homo sapien
actgctgggtatctgtcagcaagga

SEQ ID NO: 441581 - DNA, 25 bp, Homo sapien
ctgggtatctgtcagcaaggaaatc

SEQ ID NO: 441582 - DNA, 25 bp, Homo sapien
gaaaagataccagtactcccatgtt

SEQ ID NO: 441583 - DNA, 25 bp, Homo sapien
aaagataccagtactcccatgttta

SEQ ID NO: 441584 - DNA, 25 bp, Homo sapien
aatcagcctaagtgtccatccacga

SEQ ID NO: 441585 - DNA, 25 bp, Homo sapien
tcagcctaagtgtccatccacgaat

SEQ ID NO: 441586 - DNA, 25 bp, Homo sapien
agcctaagtgtccatccacgaatga

SEQ ID NO: 441587 - DNA, 25 bp, Homo sapien
gcctaagtgtccatccacgaatgaa

SEQ ID NO: 441588 - DNA, 25 bp, Homo sapien
taagtgtccatccacgaatgaatga

SEQ ID NO: 441589 - DNA, 25 bp, Homo sapien
agtgtccatccacgaatgaatgaag

SEQ ID NO: 441590 - DNA, 25 bp, Homo sapien
gaaatgtctgctgagtggccaggca

SEQ ID NO: 441591 - DNA, 25 bp, Homo sapien
aaatgtctgctgagtggccaggcat

SEQ ID NO: 441592 - DNA, 25 bp, Homo sapien
aatgtctgctgagtggccaggcatg

SEQ ID NO: 441593 - DNA, 25 bp, Homo sapien
atgtctgctgagtggccaggcatgg

SEQ ID NO: 441594 - DNA, 25 bp, Homo sapien
tgtctgctgagtggccaggcatggt

SEQ ID NO: 441595 - DNA, 25 bp, Homo sapien
tggtcaacatgatttaacctcgtct

SEQ ID NO: 441596 - DNA, 25 bp, Homo sapien
ggtcaacatgatttaacctcgtctc

SEQ ID NO: 441597 - DNA, 25 bp, Homo sapien
gtcaacatgatttaacctcgtctct

SEQ ID NO: 441598 - DNA, 25 bp, Homo sapien
caacatgatttaacctcgtctctac

SEQ ID NO: 441599 - DNA, 25 bp, Homo sapien
aacatgatttaacctcgtctctact

SEQ ID NO: 441600 - DNA, 25 bp, Homo sapien
aggtgtggtagtgggcgtctgtaat

SEQ ID NO: 441601 - DNA, 25 bp, Homo sapien
gctcagctgtcttgtgtcacccaaa

SEQ ID NO: 441602 - DNA, 25 bp, Homo sapien
ctcagctgtcttgtgtcacccaaag

SEQ ID NO: 441603 - DNA, 25 bp, Homo sapien
tcagctgtcttgtgtcacccaaagt

SEQ ID NO: 441604 - DNA, 25 bp, Homo sapien
cagctgtcttgtgtcacccaaagtc

SEQ ID NO: 441605 - DNA, 25 bp, Homo sapien
gctgtcttgtgtcacccaaagtcag

SEQ ID NO: 441606 - DNA, 25 bp, Homo sapien
tcttgtgtcacccaaagtcagctag

SEQ ID NO: 441607 - DNA, 25 bp, Homo sapien
tgtcacccaaagtcagctagaaatg

SEQ ID NO: 441608 - DNA, 25 bp, Homo sapien
gtcacccaaagtcagctagaaatgg

SEQ ID NO: 441609 - DNA, 25 bp, Homo sapien
aagtcagctagaaatgggagaccca

SEQ ID NO: 441610 - DNA, 25 bp, Homo sapien
atgggagacccaggccagagacagt

SEQ ID NO: 441611 - DNA, 25 bp, Homo sapien
gacccaggccagagacagtggctca

SEQ ID NO: 441612 - DNA, 25 bp, Homo sapien
gagctgagttattctttgacttgga

SEQ ID NO: 441613 - DNA, 25 bp, Homo sapien
aagtgtcctgaagtcatttcctgcc

SEQ ID NO: 441614 - DNA, 25 bp, Homo sapien
gaagtcatttcctgccagtttgtcc

SEQ ID NO: 441615 - DNA, 25 bp, Homo sapien
ttttttcctgctcttcctgtaactg

SEQ ID NO: 441616 - DNA, 25 bp, Homo sapien
gctcttcctgtaactggttcttgtt

SEQ ID NO: 441617 - DNA, 25 bp, Homo sapien
actggttcttgttacggcaatgtag

SEQ ID NO: 441618 - DNA, 25 bp, Homo sapien
tacggcaatgtagctgtatatttaa

SEQ ID NO: 441619 - DNA, 25 bp, Homo sapien
aatcctaagagactcgcttattgtg

SEQ ID NO: 441620 - DNA, 25 bp, Homo sapien
tcgcttattgtgagtaggcagggtc

SEQ ID NO: 441621 - DNA, 25 bp, Homo sapien
aggcagggtcagtagtctgctgaaa

SEQ ID NO: 441622 - DNA, 25 bp, Homo sapien
gtcagtagtctgctgaaacaagcac

SEQ ID NO: 441623 - DNA, 25 bp, Homo sapien
acatggacaaattagcccagccagc

SEQ ID NO: 441624 - DNA, 25 bp, Homo sapien
agcccagttaaatatatcaccttaa

SEQ ID NO: 441625 - DNA, 25 bp, Homo sapien
gctatcggtatcttagcccatctaa

SEQ ID NO: 441626 - DNA, 25 bp, Homo sapien
atctaactgggcaatatgtccacca

SEQ ID NO: 441627 - DNA, 25 bp, Homo sapien
gggcaatatgtccaccatatctaga

SEQ ID NO: 441628 - DNA, 25 bp, Homo sapien
aagacagcagtcaatcccactggtt

SEQ ID NO: 441629 - DNA, 25 bp, Homo sapien
gtcaatcccactggttgtagccaaa

SEQ ID NO: 441630 - DNA, 25 bp, Homo sapien
gaaagccgtcggttcgtcattaaga

SEQ ID NO: 441631 - DNA, 25 bp, Homo sapien
gaaagacagatgtagccctttggat

SEQ ID NO: 441632 - DNA, 25 bp, Homo sapien
agatgtagccctttggattactttc

SEQ ID NO: 441633 - DNA, 25 bp, Homo sapien
gattactttctggttagatcctctc

SEQ ID NO: 441634 - DNA, 25 bp, Homo sapien
attgcagctactcggaaacccaagg

SEQ ID NO: 441635 - DNA, 25 bp, Homo sapien
actcggaaacccaaggcagaaggat

SEQ ID NO: 441636 - DNA, 25 bp, Homo sapien
aaccacaggcatgcaacaacatgct

SEQ ID NO: 441637 - DNA, 25 bp, Homo sapien
acaggcatgcaacaacatgctcggg

SEQ ID NO: 441638 - DNA, 25 bp, Homo sapien
aggcatgcaacaacatgctcgggct

SEQ ID NO: 441639 - DNA, 25 bp, Homo sapien
ggcatgcaacaacatgctcgggcta

SEQ ID NO: 441640 - DNA, 25 bp, Homo sapien
gcatgcaacaacatgctcgggctaa

SEQ ID NO: 441641 - DNA, 25 bp, Homo sapien
catgcaacaacatgctcgggctaat

SEQ ID NO: 441642 - DNA, 25 bp, Homo sapien
atgcaacaacatgctcgggctaatt

SEQ ID NO: 441643 - DNA, 25 bp, Homo sapien
tgcaacaacatgctcgggctaattt

SEQ ID NO: 441644 - DNA, 25 bp, Homo sapien
gcaacaacatgctcgggctaatttt

SEQ ID NO: 441645 - DNA, 25 bp, Homo sapien
gagtttcttcagtaaagatgctaaa

SEQ ID NO: 441646 - DNA, 25 bp, Homo sapien
atataagcatactcagccaaggata

SEQ ID NO: 441647 - DNA, 25 bp, Homo sapien
ccaaggataatgattccctgctatt

SEQ ID NO: 441648 - DNA, 25 bp, Homo sapien
aatgattccctgctattactgtctt

SEQ ID NO: 441649 - DNA, 25 bp, Homo sapien
tccctgctattactgtcttcttctt

SEQ ID NO: 441650 - DNA, 25 bp, Homo sapien
ttcaaaacactcaacagcacccaaa

SEQ ID NO: 441651 - DNA, 25 bp, Homo sapien
cacccaaacattcttcgatattcgt

SEQ ID NO: 441652 - DNA, 25 bp, Homo sapien
cgatattcgtttgaagaacatcttc

SEQ ID NO: 441653 - DNA, 25 bp, Homo sapien
gaacatcttcaattttatctttttc

SEQ ID NO: 441654 - DNA, 25 bp, Homo sapien
aatgtatctcttgccaatcagaact

SEQ ID NO: 441655 - DNA, 25 bp, Homo sapien
aaaatccatatattgcctgcactgc

SEQ ID NO: 441656 - DNA, 25 bp, Homo sapien
tccgatggatgtggtggagtgcacc

SEQ ID NO: 441657 - DNA, 25 bp, Homo sapien
ggtggagtgcaccaaacatagactg

SEQ ID NO: 441658 - DNA, 25 bp, Homo sapien
tggagtgcaccaaacatagactgct

SEQ ID NO: 441659 - DNA, 25 bp, Homo sapien
ggagtgcaccaaacatagactgctg

SEQ ID NO: 441660 - DNA, 25 bp, Homo sapien
gagtgcaccaaacatagactgctgc

SEQ ID NO: 441661 - DNA, 25 bp, Homo sapien
gtgcaccaaacatagactgctgcaa

SEQ ID NO: 441662 - DNA, 25 bp, Homo sapien
caaacatagactgctgcaaccgttt

SEQ ID NO: 441663 - DNA, 25 bp, Homo sapien
aaacatagactgctgcaaccgttta

SEQ ID NO: 441664 - DNA, 25 bp, Homo sapien
aacatagactgctgcaaccgtttaa

SEQ ID NO: 441665 - DNA, 25 bp, Homo sapien
acatagactgctgcaaccgtttaat

SEQ ID NO: 441666 - DNA, 25 bp, Homo sapien
catagactgctgcaaccgtttaatg

SEQ ID NO: 441667 - DNA, 25 bp, Homo sapien
ttgtatcactgcacaactgttgcct

SEQ ID NO: 441668 - DNA, 25 bp, Homo sapien
tgtatcactgcacaactgttgcctg

SEQ ID NO: 441669 - DNA, 25 bp, Homo sapien
gtatcactgcacaactgttgcctgg

SEQ ID NO: 441670 - DNA, 25 bp, Homo sapien
tatcactgcacaactgttgcctggg

SEQ ID NO: 441671 - DNA, 25 bp, Homo sapien
atcactgcacaactgttgcctgggc

SEQ ID NO: 441672 - DNA, 25 bp, Homo sapien
tcactgcacaactgttgcctgggca

SEQ ID NO: 441673 - DNA, 25 bp, Homo sapien
cactgcacaactgttgcctgggcaa

SEQ ID NO: 441674 - DNA, 25 bp, Homo sapien
actgcacaactgttgcctgggcaac

SEQ ID NO: 441675 - DNA, 25 bp, Homo sapien
ggtccggacatgacccctcagctga

SEQ ID NO: 441676 - DNA, 25 bp, Homo sapien
atgacccctcagctgatgcctgtgg

SEQ ID NO: 441677 - DNA, 25 bp, Homo sapien
acccctcagctgatgcctgtggctt

SEQ ID NO: 441678 - DNA, 25 bp, Homo sapien
tgcagagtcctatcaaaggtggcat

SEQ ID NO: 441679 - DNA, 25 bp, Homo sapien
agtcctatcaaaggtggcatcctcc

SEQ ID NO: 441680 - DNA, 25 bp, Homo sapien
tcaaaggtggcatcctcccctctgt

SEQ ID NO: 441681 - DNA, 25 bp, Homo sapien
tttggaaatgcctctgcactgggtg

SEQ ID NO: 441682 - DNA, 25 bp, Homo sapien
ggaaatgcctctgcactgggtgcta

SEQ ID NO: 441683 - DNA, 25 bp, Homo sapien
atgcctctgcactgggtgctaataa

SEQ ID NO: 441684 - DNA, 25 bp, Homo sapien
tgcactgggtgctaataattcactt

SEQ ID NO: 441685 - DNA, 25 bp, Homo sapien
gggtgctaataattcacttttacct

SEQ ID NO: 441686 - DNA, 25 bp, Homo sapien
accatcaactctgttgctcaaacag

SEQ ID NO: 441687 - DNA, 25 bp, Homo sapien
gctcaaacagaaacacctctaccaa

SEQ ID NO: 441688 - DNA, 25 bp, Homo sapien
agaaacacctctaccaagcactggc

SEQ ID NO: 441689 - DNA, 25 bp, Homo sapien
aagcactggcagagaggtgtccctc

SEQ ID NO: 441690 - DNA, 25 bp, Homo sapien
gcactaggcccccttgagattgagg

SEQ ID NO: 441691 - DNA, 25 bp, Homo sapien
cccgtgtgtaggaagaaactctact

SEQ ID NO: 441692 - DNA, 25 bp, Homo sapien
gaaactctactgctgcagtgtctgt

SEQ ID NO: 441693 - DNA, 25 bp, Homo sapien
actctactgctgcagtgtctgtggt

SEQ ID NO: 441694 - DNA, 25 bp, Homo sapien
catccagtggccttggtaaactcta

SEQ ID NO: 441695 - DNA, 25 bp, Homo sapien
gtggccttggtaaactctacattca

SEQ ID NO: 441696 - DNA, 25 bp, Homo sapien
gtaaactctacattcaggcaggctt

SEQ ID NO: 441697 - DNA, 25 bp, Homo sapien
gaaagtggtatctcactatagtttt

SEQ ID NO: 441698 - DNA, 25 bp, Homo sapien
gcattttccttatgactaaggacat

SEQ ID NO: 441699 - DNA, 25 bp, Homo sapien
ggagaactctccagattctttgctc

SEQ ID NO: 441700 - DNA, 25 bp, Homo sapien
aactctccagattctttgctcattt

SEQ ID NO: 441701 - DNA, 25 bp, Homo sapien
attgctaagttataagagttcttta

SEQ ID NO: 441702 - DNA, 25 bp, Homo sapien
tataatctggatacatgtctcgatg

SEQ ID NO: 441703 - DNA, 25 bp, Homo sapien
gatacatgtctcgatgagcctcatt

SEQ ID NO: 441704 - DNA, 25 bp, Homo sapien
atgtctcgatgagcctcatttttgt

SEQ ID NO: 441705 - DNA, 25 bp, Homo sapien
gcctcatttttgtcacccaaattta

SEQ ID NO: 441706 - DNA, 25 bp, Homo sapien
gtcacccaaatttaatgatattcaa

SEQ ID NO: 441707 - DNA, 25 bp, Homo sapien
gataggaaactattctgtttgaaaa

SEQ ID NO: 441708 - DNA, 25 bp, Homo sapien
ccacttccgggaatttatcctacag

SEQ ID NO: 441709 - DNA, 25 bp, Homo sapien
gggaatttatcctacagatactctt

SEQ ID NO: 441710 - DNA, 25 bp, Homo sapien
acagatactcttgtacatgcagaat

SEQ ID NO: 441711 - DNA, 25 bp, Homo sapien
gatactcttgtacatgcagaataac

SEQ ID NO: 441712 - DNA, 25 bp, Homo sapien
tgcagaataacatatggactagatt

SEQ ID NO: 441713 - DNA, 25 bp, Homo sapien
ggactagattgtcattatggtatta

SEQ ID NO: 441714 - DNA, 25 bp, Homo sapien
gtcattatggtattatctgttaaaa

SEQ ID NO: 441715 - DNA, 25 bp, Homo sapien
acaatctaaatataactggttacat

SEQ ID NO: 441716 - DNA, 25 bp, Homo sapien
aattatgatacagctttccagtgga

SEQ ID NO: 441717 - DNA, 25 bp, Homo sapien
tatgatacagctttccagtggaata

SEQ ID NO: 441718 - DNA, 25 bp, Homo sapien
tccagtggaataataagcttctatt

SEQ ID NO: 441719 - DNA, 25 bp, Homo sapien
caatgtctacgtggcaatggaagaa

SEQ ID NO: 441720 - DNA, 25 bp, Homo sapien
aaagcactggtgtggtatgaatcca

SEQ ID NO: 441721 - DNA, 25 bp, Homo sapien
gaatccacattgaagcttcagcccg

SEQ ID NO: 441722 - DNA, 25 bp, Homo sapien
attgaagcttcagcccgagtttgtc

SEQ ID NO: 441723 - DNA, 25 bp, Homo sapien
agcccgagtttgtcccagccaagaa

SEQ ID NO: 441724 - DNA, 25 bp, Homo sapien
aagaaccgaatccagaccatccagt

SEQ ID NO: 441725 - DNA, 25 bp, Homo sapien
gaccatccagtgtcacttaatgctg

SEQ ID NO: 441726 - DNA, 25 bp, Homo sapien
taatgctgaagaagggacggcgctc

SEQ ID NO: 441727 - DNA, 25 bp, Homo sapien
aagggacggcgctctccttagtgca

SEQ ID NO: 441728 - DNA, 25 bp, Homo sapien
ctctttctctttactcatgctctaa

SEQ ID NO: 441729 - DNA, 25 bp, Homo sapien
taagacttataacaggacttttaca

SEQ ID NO: 441730 - DNA, 25 bp, Homo sapien
aaactagaattatcccttcaggtgg

SEQ ID NO: 441731 - DNA, 25 bp, Homo sapien
tatcccttcaggtggagttggaatc

SEQ ID NO: 441732 - DNA, 25 bp, Homo sapien
tggagttggaatctgacccacccat

SEQ ID NO: 441733 - DNA, 25 bp, Homo sapien
acccatctgaactggtggttttcta

SEQ ID NO: 441734 - DNA, 25 bp, Homo sapien
ttttctaggtggctggtgtgttcat

SEQ ID NO: 441735 - DNA, 25 bp, Homo sapien
ggtgtgttcatttcctacagctgct

SEQ ID NO: 441736 - DNA, 25 bp, Homo sapien
aattgattctcccacagttccagag

SEQ ID NO: 441737 - DNA, 25 bp, Homo sapien
gatgtcagaactcaaggtgttggca

SEQ ID NO: 441738 - DNA, 25 bp, Homo sapien
ttggcagggccgtaatccccaaaag

SEQ ID NO: 441739 - DNA, 25 bp, Homo sapien
ggccgtaatccccaaaagctctagg

SEQ ID NO: 441740 - DNA, 25 bp, Homo sapien
ttcagcttctagtggctccacaaca

SEQ ID NO: 441741 - DNA, 25 bp, Homo sapien
tgccctgagatatttgcacctttcc

SEQ ID NO: 441742 - DNA, 25 bp, Homo sapien
tctcatttccaatcctccttcgatt

SEQ ID NO: 441743 - DNA, 25 bp, Homo sapien
tccttcgattccttggcctgtaaaa

SEQ ID NO: 441744 - DNA, 25 bp, Homo sapien
cgattccttggcctgtaaaatccca

SEQ ID NO: 441745 - DNA, 25 bp, Homo sapien
tgtaactctaaccatctcaccttcg

SEQ ID NO: 441746 - DNA, 25 bp, Homo sapien
atctcaccttcgcattgaagtgtca

SEQ ID NO: 441747 - DNA, 25 bp, Homo sapien
aagtgtcactggctgtcttgaacca

SEQ ID NO: 441748 - DNA, 25 bp, Homo sapien
gtcttgaaccattatttagtggtcc

SEQ ID NO: 441749 - DNA, 25 bp, Homo sapien
tatttagtggtcctaccttatgccc

SEQ ID NO: 441750 - DNA, 25 bp, Homo sapien
gtatgacatgctttgtatcaactgc

SEQ ID NO: 441751 - DNA, 25 bp, Homo sapien
tgtatcaactgcagcacctttcaca

SEQ ID NO: 441752 - DNA, 25 bp, Homo sapien
gataccttccttatttctaactcca

SEQ ID NO: 441753 - DNA, 25 bp, Homo sapien
ttatttctaactccacgcgtccact

SEQ ID NO: 441754 - DNA, 25 bp, Homo sapien
tcatccactggaggccatactttat

SEQ ID NO: 441755 - DNA, 25 bp, Homo sapien
atactttatgactatggccaccatt

SEQ ID NO: 441756 - DNA, 25 bp, Homo sapien
gactatggccaccattttgagtttt

SEQ ID NO: 441757 - DNA, 25 bp, Homo sapien
tttcatgaactctaccttctagaag

SEQ ID NO: 441758 - DNA, 25 bp, Homo sapien
gaagattttcccacagaacagcatt

SEQ ID NO: 441759 - DNA, 25 bp, Homo sapien
gaacagcatttaagagtccccactc

SEQ ID NO: 441760 - DNA, 25 bp, Homo sapien
actcagtcctcaagcatacgtcaat

SEQ ID NO: 441761 - DNA, 25 bp, Homo sapien
gcatacgtcaatttttggctcacca

SEQ ID NO: 441762 - DNA, 25 bp, Homo sapien
tttttggctcaccatactcagactt

SEQ ID NO: 441763 - DNA, 25 bp, Homo sapien
agaaagaaatgtctctacccttaga

SEQ ID NO: 441764 - DNA, 25 bp, Homo sapien
tctacccttagagtataactgatga

SEQ ID NO: 441765 - DNA, 25 bp, Homo sapien
taactgatgaaattttagcccaatg

SEQ ID NO: 441766 - DNA, 25 bp, Homo sapien
gaaattttagcccaatgttgtataa

SEQ ID NO: 441767 - DNA, 25 bp, Homo sapien
taagatagtatcttacttgctgtac

SEQ ID NO: 441768 - DNA, 25 bp, Homo sapien
acttgctgtactctaattctctttg

SEQ ID NO: 441769 - DNA, 25 bp, Homo sapien
tctctttgatattccaaatccttgg

SEQ ID NO: 441770 - DNA, 25 bp, Homo sapien
aaatttgtttactgataccagtact

SEQ ID NO: 441771 - DNA, 25 bp, Homo sapien
gaggaattaaggtacagaggcacat

SEQ ID NO: 441772 - DNA, 25 bp, Homo sapien
aaggagacggaagacgcagaagaca

SEQ ID NO: 441773 - DNA, 25 bp, Homo sapien
ggagcagagagaacactgataagtc

SEQ ID NO: 441774 - DNA, 25 bp, Homo sapien
ggacaaagatgggactaaaggagcc

SEQ ID NO: 441775 - DNA, 25 bp, Homo sapien
aagacaggaagatgctgtgtctcat

SEQ ID NO: 441776 - DNA, 25 bp, Homo sapien
acaggaagatgctgtgtctcatgcc

SEQ ID NO: 441777 - DNA, 25 bp, Homo sapien
gtctcatgcctgtagatgctgtgtc

SEQ ID NO: 441778 - DNA, 25 bp, Homo sapien
tctcatgcctgtagatgctgtgtct

SEQ ID NO: 441779 - DNA, 25 bp, Homo sapien
tcatgcctgtagatgctgtgtctca

SEQ ID NO: 441780 - DNA, 25 bp, Homo sapien
catgcctgtagatgctgtgtctcat

SEQ ID NO: 441781 - DNA, 25 bp, Homo sapien
atgcctgtagatgctgtgtctcatg

SEQ ID NO: 441782 - DNA, 25 bp, Homo sapien
tgcctgtagatgctgtgtctcatgc

SEQ ID NO: 441783 - DNA, 25 bp, Homo sapien
gcctgtagatgctgtgtctcatgcc

SEQ ID NO: 441784 - DNA, 25 bp, Homo sapien
tccacctactctggagagtgaggca

SEQ ID NO: 441785 - DNA, 25 bp, Homo sapien
gcatttcacatgcatttagatgagg

SEQ ID NO: 441786 - DNA, 25 bp, Homo sapien
gagtgcaggtggttctcagacctca

SEQ ID NO: 441787 - DNA, 25 bp, Homo sapien
ctcacattgaggaacactgcttatc

SEQ ID NO: 441788 - DNA, 25 bp, Homo sapien
ttatcaagagtttcaggagacccca

SEQ ID NO: 441789 - DNA, 25 bp, Homo sapien
ggagaccccaacgttgagaattcag

SEQ ID NO: 441790 - DNA, 25 bp, Homo sapien
gagaattcagttctgagccatccca

SEQ ID NO: 441791 - DNA, 25 bp, Homo sapien
tctgagccatcccaacttcttagga

SEQ ID NO: 441792 - DNA, 25 bp, Homo sapien
cttcttaggattgttgtgcggtggt

SEQ ID NO: 441793 - DNA, 25 bp, Homo sapien
tgtgcggtggttaaaactttcttgt

SEQ ID NO: 441794 - DNA, 25 bp, Homo sapien
taaggtggctttcttttccctgatc

SEQ ID NO: 441795 - DNA, 25 bp, Homo sapien
ttccctgatcagtcattttgtggtt

SEQ ID NO: 441796 - DNA, 25 bp, Homo sapien
tgaactgttccgtctcactgaaagc

SEQ ID NO: 441797 - DNA, 25 bp, Homo sapien
gttccgtctcactgaaagcacgtac

SEQ ID NO: 441798 - DNA, 25 bp, Homo sapien
gacaatccaggaaaatctcaccaag

SEQ ID NO: 441799 - DNA, 25 bp, Homo sapien
gcatgtcaaggcttcaatcactgtg

SEQ ID NO: 441800 - DNA, 25 bp, Homo sapien
gtcaaggcttcaatcactgtggttt

SEQ ID NO: 441801 - DNA, 25 bp, Homo sapien
caatcactgtggtttgggttatttt

SEQ ID NO: 441802 - DNA, 25 bp, Homo sapien
aagatgactcatgatcgtttacata

SEQ ID NO: 441803 - DNA, 25 bp, Homo sapien
gatcgtttacatatgcacgttaagg

SEQ ID NO: 441804 - DNA, 25 bp, Homo sapien
ggattcaaaatcaaatacccagatc

SEQ ID NO: 441805 - DNA, 25 bp, Homo sapien
gtggcttgtagcttaattatctttt

SEQ ID NO: 441806 - DNA, 25 bp, Homo sapien
tttttctttaagagagggtgttgct

SEQ ID NO: 441807 - DNA, 25 bp, Homo sapien
gggagagagctacacctccccaggc

SEQ ID NO: 441808 - DNA, 25 bp, Homo sapien
ggcccaggtctcacgaaaggagcat

SEQ ID NO: 441809 - DNA, 25 bp, Homo sapien
gcatcgaagggcaccgaggaaaaag

SEQ ID NO: 441810 - DNA, 25 bp, Homo sapien
gaggaaaaagccacttagccctctc

SEQ ID NO: 441811 - DNA, 25 bp, Homo sapien
tgcaccattatctgggcccattggt

SEQ ID NO: 441812 - DNA, 25 bp, Homo sapien
attatctgggcccattggttcttgg

SEQ ID NO: 441813 - DNA, 25 bp, Homo sapien
ggcccattggttcttgggtccctgt

SEQ ID NO: 441814 - DNA, 25 bp, Homo sapien
gggtccctgtctttctcaacaggca

SEQ ID NO: 441815 - DNA, 25 bp, Homo sapien
tttctcaacaggcagccccagttgg

SEQ ID NO: 441816 - DNA, 25 bp, Homo sapien
gactggctatgcctaatgatagctg

SEQ ID NO: 441817 - DNA, 25 bp, Homo sapien
aatgatagctgcaatttgaaaccca

SEQ ID NO: 441818 - DNA, 25 bp, Homo sapien
aatgtttgttgtgtgagccacccgg

SEQ ID NO: 441819 - DNA, 25 bp, Homo sapien
gccacccggtctatggtatttttgt

SEQ ID NO: 441820 - DNA, 25 bp, Homo sapien
gtatttttgttagtagcagccagaa

SEQ ID NO: 441821 - DNA, 25 bp, Homo sapien
gttagtagcagccagaactaagaca

SEQ ID NO: 441822 - DNA, 25 bp, Homo sapien
aactaagacatctgtgctaaggcat

SEQ ID NO: 441823 - DNA, 25 bp, Homo sapien
ctgtgctaaggcatctattatatat

SEQ ID NO: 441824 - DNA, 25 bp, Homo sapien
tagaatgccttgtaagaactgaaaa

SEQ ID NO: 441825 - DNA, 25 bp, Homo sapien
tagtcactcagaatgttttctgcag

SEQ ID NO: 441826 - DNA, 25 bp, Homo sapien
gttttctgcaggacataattctttc

SEQ ID NO: 441827 - DNA, 25 bp, Homo sapien
aattctttcatagaacttgagttga

SEQ ID NO: 441828 - DNA, 25 bp, Homo sapien
agctaccaagctaatagagaaggag

SEQ ID NO: 441829 - DNA, 25 bp, Homo sapien
ggctcgtctttctacgttactttat

SEQ ID NO: 441830 - DNA, 25 bp, Homo sapien
gtctttctacgttactttatgtggg

SEQ ID NO: 441831 - DNA, 25 bp, Homo sapien
tttctacgttactttatgtgggagt

SEQ ID NO: 441832 - DNA, 25 bp, Homo sapien
tactttatgtgggagtagttgtaaa

SEQ ID NO: 441833 - DNA, 25 bp, Homo sapien
gggattgtgcggaaatgtagccacc

SEQ ID NO: 441834 - DNA, 25 bp, Homo sapien
gtgcggaaatgtagccaccgtttac

SEQ ID NO: 441835 - DNA, 25 bp, Homo sapien
ggaaatgtagccaccgtttacatgt

SEQ ID NO: 441836 - DNA, 25 bp, Homo sapien
atgtagccaccgtttacatgtcggg

SEQ ID NO: 441837 - DNA, 25 bp, Homo sapien
gtagccaccgtttacatgtcgggag

SEQ ID NO: 441838 - DNA, 25 bp, Homo sapien
gccaccgtttacatgtcgggaggct

SEQ ID NO: 441839 - DNA, 25 bp, Homo sapien
accgtttacatgtcgggaggctgag

SEQ ID NO: 441840 - DNA, 25 bp, Homo sapien
aacagaaaacatgaccaggcatggt

SEQ ID NO: 441841 - DNA, 25 bp, Homo sapien
acagaaaacatgaccaggcatggtg

SEQ ID NO: 441842 - DNA, 25 bp, Homo sapien
cagaaaacatgaccaggcatggtgg

SEQ ID NO: 441843 - DNA, 25 bp, Homo sapien
agaaaacatgaccaggcatggtggc

SEQ ID NO: 441844 - DNA, 25 bp, Homo sapien
gaaaacatgaccaggcatggtggct

SEQ ID NO: 441845 - DNA, 25 bp, Homo sapien
acccaggaggtggagtttgcagtag

SEQ ID NO: 441846 - DNA, 25 bp, Homo sapien
cccaggaggtggagtttgcagtagg

SEQ ID NO: 441847 - DNA, 25 bp, Homo sapien
gagtttgcagtaggccaagatcgca

SEQ ID NO: 441848 - DNA, 25 bp, Homo sapien
agtttgcagtaggccaagatcgcac

SEQ ID NO: 441849 - DNA, 25 bp, Homo sapien
gtttgcagtaggccaagatcgcacc

SEQ ID NO: 441850 - DNA, 25 bp, Homo sapien
tttgcagtaggccaagatcgcacca

SEQ ID NO: 441851 - DNA, 25 bp, Homo sapien
acacctctgatagatctttcactgc

SEQ ID NO: 441852 - DNA, 25 bp, Homo sapien
agatctttcactgctattgcataga

SEQ ID NO: 441853 - DNA, 25 bp, Homo sapien
attctacttgcagcatagtcttctg

SEQ ID NO: 441854 - DNA, 25 bp, Homo sapien
gcatagtcttctgtcataccttata

SEQ ID NO: 441855 - DNA, 25 bp, Homo sapien
gaaatcatgctacctttcaagtgta

SEQ ID NO: 441856 - DNA, 25 bp, Homo sapien
taaaatgctgtcagtctgccctcta

SEQ ID NO: 441857 - DNA, 25 bp, Homo sapien
agtctgccctctataaacttcggac

SEQ ID NO: 441858 - DNA, 25 bp, Homo sapien
taaacttcggacagtgcactcacat

SEQ ID NO: 441859 - DNA, 25 bp, Homo sapien
aaaaggacttgtttcttgtacacat

SEQ ID NO: 441860 - DNA, 25 bp, Homo sapien
gtacacatttggctaacattaacta

SEQ ID NO: 441861 - DNA, 25 bp, Homo sapien
caagcacctgatgtagtttctttaa

SEQ ID NO: 441862 - DNA, 25 bp, Homo sapien
tacttcagaagttaaggggctgggc

SEQ ID NO: 441863 - DNA, 25 bp, Homo sapien
acttcagaagttaaggggctgggca

SEQ ID NO: 441864 - DNA, 25 bp, Homo sapien
cttcagaagttaaggggctgggcac

SEQ ID NO: 441865 - DNA, 25 bp, Homo sapien
ttcagaagttaaggggctgggcaca

SEQ ID NO: 441866 - DNA, 25 bp, Homo sapien
tcagaagttaaggggctgggcacag

SEQ ID NO: 441867 - DNA, 25 bp, Homo sapien
cagaagttaaggggctgggcacagt

SEQ ID NO: 441868 - DNA, 25 bp, Homo sapien
cctgggcaagatggtaaaacaccat

SEQ ID NO: 441869 - DNA, 25 bp, Homo sapien
ctgggcaagatggtaaaacaccatc

SEQ ID NO: 441870 - DNA, 25 bp, Homo sapien
tgggcaagatggtaaaacaccatct

SEQ ID NO: 441871 - DNA, 25 bp, Homo sapien
gggcaagatggtaaaacaccatctc

SEQ ID NO: 441872 - DNA, 25 bp, Homo sapien
ggcaagatggtaaaacaccatctct

SEQ ID NO: 441873 - DNA, 25 bp, Homo sapien
acattgtcttataggagtgcattta

SEQ ID NO: 441874 - DNA, 25 bp, Homo sapien
ttgtcttataggagtgcatttaggc

SEQ ID NO: 441875 - DNA, 25 bp, Homo sapien
gtcttataggagtgcatttaggcca

SEQ ID NO: 441876 - DNA, 25 bp, Homo sapien
cttataggagtgcatttaggccagg

SEQ ID NO: 441877 - DNA, 25 bp, Homo sapien
ataggagtgcatttaggccaggtgt

SEQ ID NO: 441878 - DNA, 25 bp, Homo sapien
tggtggctcatgactctaattacag

SEQ ID NO: 441879 - DNA, 25 bp, Homo sapien
atgactctaattacagcactctggg

SEQ ID NO: 441880 - DNA, 25 bp, Homo sapien
gactctaattacagcactctgggag

SEQ ID NO: 441881 - DNA, 25 bp, Homo sapien
attagctggacctagtggtgggcgt

SEQ ID NO: 441882 - DNA, 25 bp, Homo sapien
tagctggacctagtggtgggcgtct

SEQ ID NO: 441883 - DNA, 25 bp, Homo sapien
gctggacctagtggtgggcgtctgt

SEQ ID NO: 441884 - DNA, 25 bp, Homo sapien
gagccccaagtctaaacatctctgg

SEQ ID NO: 441885 - DNA, 25 bp, Homo sapien
gaaagggccctgatttggcctatct

SEQ ID NO: 441886 - DNA, 25 bp, Homo sapien
ttggcctatctttcgtcacaagtca

SEQ ID NO: 441887 - DNA, 25 bp, Homo sapien
tcacaagtcacccttgggccaatca

SEQ ID NO: 441888 - DNA, 25 bp, Homo sapien
gccaatcaccttgggcccaaaatag

SEQ ID NO: 441889 - DNA, 25 bp, Homo sapien
ggcccaaaatagctgatgattctgt

SEQ ID NO: 441890 - DNA, 25 bp, Homo sapien
atgattctgtagtagccatgggagc

SEQ ID NO: 441891 - DNA, 25 bp, Homo sapien
tagtcctagaaaaagcgtgtccagt

SEQ ID NO: 441892 - DNA, 25 bp, Homo sapien
aagcgtgtccagtatgcctgacttt

SEQ ID NO: 441893 - DNA, 25 bp, Homo sapien
gcctgactttagctggagacatttc

SEQ ID NO: 441894 - DNA, 25 bp, Homo sapien
gagacatttctgtagctcagcttta

SEQ ID NO: 441895 - DNA, 25 bp, Homo sapien
atgggagacccgacaaccccacagg

SEQ ID NO: 441896 - DNA, 25 bp, Homo sapien
agagggacagcttctgagaccctga

SEQ ID NO: 441897 - DNA, 25 bp, Homo sapien
caaagcccggctcttgcaaatttaa

SEQ ID NO: 441898 - DNA, 25 bp, Homo sapien
agcccggctcttgcaaatttaacag

SEQ ID NO: 441899 - DNA, 25 bp, Homo sapien
atttaacagcaagggtgcacacagg

SEQ ID NO: 441900 - DNA, 25 bp, Homo sapien
gacagtgccagttccccaatttatt

SEQ ID NO: 441901 - DNA, 25 bp, Homo sapien
tgccagttccccaatttattctggg

SEQ ID NO: 441902 - DNA, 25 bp, Homo sapien
gtataggaagcttctgtgtgcccat

SEQ ID NO: 441903 - DNA, 25 bp, Homo sapien
ggaagcttctgtgtgcccatagcca

SEQ ID NO: 441904 - DNA, 25 bp, Homo sapien
gaactttcctgccagatacacatag

SEQ ID NO: 441905 - DNA, 25 bp, Homo sapien
ttcctgccagatacacataggtaca

SEQ ID NO: 441906 - DNA, 25 bp, Homo sapien
gggttatcggtttgcaagctgggaa

SEQ ID NO: 441907 - DNA, 25 bp, Homo sapien
gcaagctgggaagagtctccagcat

SEQ ID NO: 441908 - DNA, 25 bp, Homo sapien
gtctccagcatggactgaaggtgct

SEQ ID NO: 441909 - DNA, 25 bp, Homo sapien
ccagcatggactgaaggtgctctct

SEQ ID NO: 441910 - DNA, 25 bp, Homo sapien
aggtgctctctcttcagaaagaagg

SEQ ID NO: 441911 - DNA, 25 bp, Homo sapien
agaaggacaggttggcttttatgcc

SEQ ID NO: 441912 - DNA, 25 bp, Homo sapien
tttatgcctcaccaggtctgtatca

SEQ ID NO: 441913 - DNA, 25 bp, Homo sapien
tatgcctcaccaggtctgtatcaca

SEQ ID NO: 441914 - DNA, 25 bp, Homo sapien
tcaccaggtctgtatcacacaacag

SEQ ID NO: 441915 - DNA, 25 bp, Homo sapien
tatcacacaacagagtcatacatat

SEQ ID NO: 441916 - DNA, 25 bp, Homo sapien
cagagtcatacatatcagcaggttt

SEQ ID NO: 441917 - DNA, 25 bp, Homo sapien
agatttccctccagacatatgacag

SEQ ID NO: 441918 - DNA, 25 bp, Homo sapien
gatttccctccagacatatgacaga

SEQ ID NO: 441919 - DNA, 25 bp, Homo sapien
tttccctccagacatatgacagatt

SEQ ID NO: 441920 - DNA, 25 bp, Homo sapien
ccctccagacatatgacagattaaa

SEQ ID NO: 441921 - DNA, 25 bp, Homo sapien
ctagatttagatacagttagccaaa

SEQ ID NO: 441922 - DNA, 25 bp, Homo sapien
gatacagttagccaaaatacccctt

SEQ ID NO: 441923 - DNA, 25 bp, Homo sapien
caggcatgttggcattgagactgca

SEQ ID NO: 441924 - DNA, 25 bp, Homo sapien
ggcatgttggcattgagactgcagt

SEQ ID NO: 441925 - DNA, 25 bp, Homo sapien
atgttggcattgagactgcagtggc

SEQ ID NO: 441926 - DNA, 25 bp, Homo sapien
gcattgagactgcagtggccatagt

SEQ ID NO: 441927 - DNA, 25 bp, Homo sapien
tgagactgcagtggccatagtcaca

SEQ ID NO: 441928 - DNA, 25 bp, Homo sapien
gggaattacattaacatgtgactag

SEQ ID NO: 441929 - DNA, 25 bp, Homo sapien
aacatgtgactagttacactatcat

SEQ ID NO: 441930 - DNA, 25 bp, Homo sapien
gtgactagttacactatcattggaa

SEQ ID NO: 441931 - DNA, 25 bp, Homo sapien
ctagttacactatcattggaatttt

SEQ ID NO: 441932 - DNA, 25 bp, Homo sapien
ttaaccaactgcttccaaatacagt

SEQ ID NO: 441933 - DNA, 25 bp, Homo sapien
aaccaactgcttccaaatacagtta

SEQ ID NO: 441934 - DNA, 25 bp, Homo sapien
gggatagctgggactgaatgtcact

SEQ ID NO: 441935 - DNA, 25 bp, Homo sapien
ggacattcaaaagatcaatacttga

SEQ ID NO: 441936 - DNA, 25 bp, Homo sapien
ttaaagttaacacttatcttgggag

SEQ ID NO: 441937 - DNA, 25 bp, Homo sapien
ttcagtgctatgaaagatgcctgta

SEQ ID NO: 441938 - DNA, 25 bp, Homo sapien
agatgcctgtaaatagcacagctgt

SEQ ID NO: 441939 - DNA, 25 bp, Homo sapien
agaccagtgttctcacccactgttt

SEQ ID NO: 441940 - DNA, 25 bp, Homo sapien
actgtttccatgatcactctcacaa

SEQ ID NO: 441941 - DNA, 25 bp, Homo sapien
tttccatgatcactctcacaacaga

SEQ ID NO: 441942 - DNA, 25 bp, Homo sapien
atgatcactctcacaacagaaaaat

SEQ ID NO: 441943 - DNA, 25 bp, Homo sapien
aaaattactcaagaataaggctggg

SEQ ID NO: 441944 - DNA, 25 bp, Homo sapien
gctcgcgcctgtaatgctggcattc

SEQ ID NO: 441945 - DNA, 25 bp, Homo sapien
cgcctgtaatgctggcattctggga

SEQ ID NO: 441946 - DNA, 25 bp, Homo sapien
gtggtggagtgcatctgtagtctaa

SEQ ID NO: 441947 - DNA, 25 bp, Homo sapien
ggagtgcatctgtagtctaagatac

SEQ ID NO: 441948 - DNA, 25 bp, Homo sapien
tctaagatacttgggaggtcaacgc

SEQ ID NO: 441949 - DNA, 25 bp, Homo sapien
acgcaggaggatcacctcaggccag

SEQ ID NO: 441950 - DNA, 25 bp, Homo sapien
ctgggtctcaccaggtatatgccac

SEQ ID NO: 441951 - DNA, 25 bp, Homo sapien
ccaccttctgctctaaattcagaat

SEQ ID NO: 441952 - DNA, 25 bp, Homo sapien
aattcagaataagagtcacatcagg

SEQ ID NO: 441953 - DNA, 25 bp, Homo sapien
gagtcacatcaggagagcactgtcc

SEQ ID NO: 441954 - DNA, 25 bp, Homo sapien
gagcactgtccccaggagaatgcaa

SEQ ID NO: 441955 - DNA, 25 bp, Homo sapien
gtccccaggagaatgcaaacggttt

SEQ ID NO: 441956 - DNA, 25 bp, Homo sapien
gaatgcaaacggtttggcagcagaa

SEQ ID NO: 441957 - DNA, 25 bp, Homo sapien
ttggcagcagaagcaaacctctaac

SEQ ID NO: 441958 - DNA, 25 bp, Homo sapien
gaagcaaacctctaacaatatctaa

SEQ ID NO: 441959 - DNA, 25 bp, Homo sapien
aatatctaagcctgtcgcaaccact

SEQ ID NO: 441960 - DNA, 25 bp, Homo sapien
aaccactcggcgtgcagtagggctg

SEQ ID NO: 441961 - DNA, 25 bp, Homo sapien
aggtgagtaaatgagctgtgcttgc

SEQ ID NO: 441962 - DNA, 25 bp, Homo sapien
atgagctgtgcttgcagagttggaa

SEQ ID NO: 441963 - DNA, 25 bp, Homo sapien
aaagcaggtggttcttgtgctgttt

SEQ ID NO: 441964 - DNA, 25 bp, Homo sapien
tgctgtttgggtgctttcttattcc

SEQ ID NO: 441965 - DNA, 25 bp, Homo sapien
gggtgctttcttattccaagctttt

SEQ ID NO: 441966 - DNA, 25 bp, Homo sapien
tcaaaggaggtctcaggctgatgct

SEQ ID NO: 441967 - DNA, 25 bp, Homo sapien
aggctgatgctgtgtcacccttgca

SEQ ID NO: 441968 - DNA, 25 bp, Homo sapien
gggttatcactgttggtcaccatcc

SEQ ID NO: 441969 - DNA, 25 bp, Homo sapien
gtcaccatccggaaaggctgtgcaa

SEQ ID NO: 441970 - DNA, 25 bp, Homo sapien
gaaaatactgttccatggttcaaat

SEQ ID NO: 441971 - DNA, 25 bp, Homo sapien
gaaaacataggttgaattcagcact

SEQ ID NO: 441972 - DNA, 25 bp, Homo sapien
gccggaccggtcacggtggctcacg

SEQ ID NO: 441973 - DNA, 25 bp, Homo sapien
ccggaccggtcacggtggctcacgc

SEQ ID NO: 441974 - DNA, 25 bp, Homo sapien
ttgcgccactgcacaccaccagcct

SEQ ID NO: 441975 - DNA, 25 bp, Homo sapien
cgccactgcacaccaccagcctggg

SEQ ID NO: 441976 - DNA, 25 bp, Homo sapien
ctgcacaccaccagcctgggtgata

SEQ ID NO: 441977 - DNA, 25 bp, Homo sapien
tgcacaccaccagcctgggtgatag

SEQ ID NO: 441978 - DNA, 25 bp, Homo sapien
gcacaccaccagcctgggtgataga

SEQ ID NO: 441979 - DNA, 25 bp, Homo sapien
cacaccaccagcctgggtgatagag

SEQ ID NO: 441980 - DNA, 25 bp, Homo sapien
acaccaccagcctgggtgatagagt

SEQ ID NO: 441981 - DNA, 25 bp, Homo sapien
caccaccagcctgggtgatagagtg

SEQ ID NO: 441982 - DNA, 25 bp, Homo sapien
accaccagcctgggtgatagagtga

SEQ ID NO: 441983 - DNA, 25 bp, Homo sapien
ctgagacagcaggatttcttgaggc

SEQ ID NO: 441984 - DNA, 25 bp, Homo sapien
tgagacagcaggatttcttgaggcc

SEQ ID NO: 441985 - DNA, 25 bp, Homo sapien
gagacagcaggatttcttgaggcca

SEQ ID NO: 441986 - DNA, 25 bp, Homo sapien
ccccatctctacaacatttaaaaat

SEQ ID NO: 441987 - DNA, 25 bp, Homo sapien
cccatctctacaacatttaaaaatt

SEQ ID NO: 441988 - DNA, 25 bp, Homo sapien
ccagcctggacgagagagagagaac

SEQ ID NO: 441989 - DNA, 25 bp, Homo sapien
agagagagaacccatctctctctct

SEQ ID NO: 441990 - DNA, 25 bp, Homo sapien
gagagagaacccatctctctctctc

SEQ ID NO: 441991 - DNA, 25 bp, Homo sapien
tctctctctctgttttcatttttct

SEQ ID NO: 441992 - DNA, 25 bp, Homo sapien
ctctctctctgttttcatttttctt

SEQ ID NO: 441993 - DNA, 25 bp, Homo sapien
ctctctctgttttcatttttctttt

SEQ ID NO: 441994 - DNA, 25 bp, Homo sapien
cataaaaggctttgtgtgattccat

SEQ ID NO: 441995 - DNA, 25 bp, Homo sapien
tgtgtgattccatttccagacagaa

SEQ ID NO: 441996 - DNA, 25 bp, Homo sapien
gattccatttccagacagaaagcag

SEQ ID NO: 441997 - DNA, 25 bp, Homo sapien
agattagtagttgctgcaggctggc

SEQ ID NO: 441998 - DNA, 25 bp, Homo sapien
gaggaatggaaagtggctgctaaca

SEQ ID NO: 441999 - DNA, 25 bp, Homo sapien
ggctgctaacaggaacacggtttat

SEQ ID NO: 442000 - DNA, 25 bp, Homo sapien
gggcaatgaaagtgttctaaactta

SEQ ID NO: 442001 - DNA, 25 bp, Homo sapien
gatgatggatgtacaactgcgtgaa

SEQ ID NO: 442002 - DNA, 25 bp, Homo sapien
gtacaactgcgtgaatatactaaaa

SEQ ID NO: 442003 - DNA, 25 bp, Homo sapien
aatggcattgaatggttcatcttaa

SEQ ID NO: 442004 - DNA, 25 bp, Homo sapien
tgggtgaattttatagtgcgtgaat

SEQ ID NO: 442005 - DNA, 25 bp, Homo sapien
aaattgtaggagtccagatgagaca

SEQ ID NO: 442006 - DNA, 25 bp, Homo sapien
ccagatgagacagaagccacctttt

SEQ ID NO: 442007 - DNA, 25 bp, Homo sapien
gaagccaccttttttcattctttca

SEQ ID NO: 442008 - DNA, 25 bp, Homo sapien
tatccacattccataaaattcaccc

SEQ ID NO: 442009 - DNA, 25 bp, Homo sapien
gaaagtacacaatgcaagtttttaa

SEQ ID NO: 442010 - DNA, 25 bp, Homo sapien
atattcacaagtttgtttaatcctt

SEQ ID NO: 442011 - DNA, 25 bp, Homo sapien
tttaatccttaccactgtctaattc

SEQ ID NO: 442012 - DNA, 25 bp, Homo sapien
aatccttaccactgtctaattcaag

SEQ ID NO: 442013 - DNA, 25 bp, Homo sapien
taccactgtctaattcaagagtatt

SEQ ID NO: 442014 - DNA, 25 bp, Homo sapien
taattcaagagtattatcattaccc

SEQ ID NO: 442015 - DNA, 25 bp, Homo sapien
ctgagatggcgtcaccgcactcctg

SEQ ID NO: 442016 - DNA, 25 bp, Homo sapien
ttaaaactagtactcatgaaagcat

SEQ ID NO: 442017 - DNA, 25 bp, Homo sapien
gtactcatgaaagcataacccatta

SEQ ID NO: 442018 - DNA, 25 bp, Homo sapien
agcataacccattagtgaacttagg

SEQ ID NO: 442019 - DNA, 25 bp, Homo sapien
gaacttaggtacagacacaaatact

SEQ ID NO: 442020 - DNA, 25 bp, Homo sapien
cacaaatacttaagtcagcaggaag

SEQ ID NO: 442021 - DNA, 25 bp, Homo sapien
taggttactactccatgagagtaag

SEQ ID NO: 442022 - DNA, 25 bp, Homo sapien
gagagtaagattgaccatatcataa

SEQ ID NO: 442023 - DNA, 25 bp, Homo sapien
atatcataatgtttggagccctttc

SEQ ID NO: 442024 - DNA, 25 bp, Homo sapien
atgtttggagccctttctgatgcat

SEQ ID NO: 442025 - DNA, 25 bp, Homo sapien
agccctttctgatgcattttctaca

SEQ ID NO: 442026 - DNA, 25 bp, Homo sapien
tttctgatgcattttctacagtggg

SEQ ID NO: 442027 - DNA, 25 bp, Homo sapien
gtgtcagcaagacggcagccaacaa

SEQ ID NO: 442028 - DNA, 25 bp, Homo sapien
ggcagccaacaaaagtccctgtgag

SEQ ID NO: 442029 - DNA, 25 bp, Homo sapien
gtgagaccattagcagccctagttc

SEQ ID NO: 442030 - DNA, 25 bp, Homo sapien
ataatggctcgaatctcatcaacca

SEQ ID NO: 442031 - DNA, 25 bp, Homo sapien
caaccagagcattcaccaggcactt

SEQ ID NO: 442032 - DNA, 25 bp, Homo sapien
attcaccaggcacttcctcagaggg

SEQ ID NO: 442033 - DNA, 25 bp, Homo sapien
tcctcagagggttttagcatggtct

SEQ ID NO: 442034 - DNA, 25 bp, Homo sapien
ggtctgtgaaggtcagtctgccagc

SEQ ID NO: 442035 - DNA, 25 bp, Homo sapien
ttctttgcaggcagcactgactcca

SEQ ID NO: 442036 - DNA, 25 bp, Homo sapien
actgactccatgtgtagctgagaga

SEQ ID NO: 442037 - DNA, 25 bp, Homo sapien
gtggagcattggcttttacattcct

SEQ ID NO: 442038 - DNA, 25 bp, Homo sapien
ctgtcactgttgagtgcagctcaga

SEQ ID NO: 442039 - DNA, 25 bp, Homo sapien
agagagttggccaaattgttgtcat

SEQ ID NO: 442040 - DNA, 25 bp, Homo sapien
acagcaaaatgctcccgtgcaagag

SEQ ID NO: 442041 - DNA, 25 bp, Homo sapien
tttgtttggctcaagaattgcctgg

SEQ ID NO: 442042 - DNA, 25 bp, Homo sapien
ggttgtgaaatcaaggtccagttct

SEQ ID NO: 442043 - DNA, 25 bp, Homo sapien
gtccagttcttatcgatgtgcctct

SEQ ID NO: 442044 - DNA, 25 bp, Homo sapien
atgtgcctctgctcattctaagatg

SEQ ID NO: 442045 - DNA, 25 bp, Homo sapien
cattctaagatgaggatcccaggga

SEQ ID NO: 442046 - DNA, 25 bp, Homo sapien
gaaaggcaccttagaagactcgcca

SEQ ID NO: 442047 - DNA, 25 bp, Homo sapien
aagactcgccattttgcagcttgca

SEQ ID NO: 442048 - DNA, 25 bp, Homo sapien
ttgcagcttgcatcggctagtaaaa

SEQ ID NO: 442049 - DNA, 25 bp, Homo sapien
acaaaactggacgtctacaagagcc

SEQ ID NO: 442050 - DNA, 25 bp, Homo sapien
caaaactggacgtctacaagagccc

SEQ ID NO: 442051 - DNA, 25 bp, Homo sapien
aaaactggacgtctacaagagccct

SEQ ID NO: 442052 - DNA, 25 bp, Homo sapien
agccctgcttcggatgcctacatag

SEQ ID NO: 442053 - DNA, 25 bp, Homo sapien
gccctgcttcggatgcctacatagt

SEQ ID NO: 442054 - DNA, 25 bp, Homo sapien
ccctgcttcggatgcctacatagtt

SEQ ID NO: 442055 - DNA, 25 bp, Homo sapien
cctgcttcggatgcctacatagttt

SEQ ID NO: 442056 - DNA, 25 bp, Homo sapien
tgcttcggatgcctacatagttttt

SEQ ID NO: 442057 - DNA, 25 bp, Homo sapien
ggtgtagaagttaaagacgtgaaat

SEQ ID NO: 442058 - DNA, 25 bp, Homo sapien
taaagacgtgaaattggtcatgtca

SEQ ID NO: 442059 - DNA, 25 bp, Homo sapien
aaagacgtgaaattggtcatgtcac

SEQ ID NO: 442060 - DNA, 25 bp, Homo sapien
attcggcagatggtgtcgtcagaga

SEQ ID NO: 442061 - DNA, 25 bp, Homo sapien
ggtgtcgtcagagattatggagttc

SEQ ID NO: 442062 - DNA, 25 bp, Homo sapien
tatggagttcaagccacctagcttt

SEQ ID NO: 442063 - DNA, 25 bp, Homo sapien
tcaagccacctagctttacagaggt

SEQ ID NO: 442064 - DNA, 25 bp, Homo sapien
atgtggtgctccagaggttcttcag

SEQ ID NO: 442065 - DNA, 25 bp, Homo sapien
gtctgcttgacctgtattgctttta

SEQ ID NO: 442066 - DNA, 25 bp, Homo sapien
tgcttgacctgtattgcttttatct

SEQ ID NO: 442067 - DNA, 25 bp, Homo sapien
agatttatactctgatgtttgcatc

SEQ ID NO: 442068 - DNA, 25 bp, Homo sapien
gatgtttgcatcacatagcagggag

SEQ ID NO: 442069 - DNA, 25 bp, Homo sapien
agggaggtgatctcaccagaacatt

SEQ ID NO: 442070 - DNA, 25 bp, Homo sapien
tcaccagaacattttgaagtcttgg

SEQ ID NO: 442071 - DNA, 25 bp, Homo sapien
atcaaagcctagcaggtcccctcag

SEQ ID NO: 442072 - DNA, 25 bp, Homo sapien
tcatgcctgccacagactacagtag

SEQ ID NO: 442073 - DNA, 25 bp, Homo sapien
ctacagtaggacaaaacctgacctg

SEQ ID NO: 442074 - DNA, 25 bp, Homo sapien
gaaagcttcctatagtagtatctcc

SEQ ID NO: 442075 - DNA, 25 bp, Homo sapien
atagtagtatctcccatggcactta

SEQ ID NO: 442076 - DNA, 25 bp, Homo sapien
atggcacttaccacattctatctgg

SEQ ID NO: 442077 - DNA, 25 bp, Homo sapien
ttgtatgcaattaatcactcttaga

SEQ ID NO: 442078 - DNA, 25 bp, Homo sapien
cactcttagattgtatgttcctgga

SEQ ID NO: 442079 - DNA, 25 bp, Homo sapien
agggcagaatatgcccattcatatt

SEQ ID NO: 442080 - DNA, 25 bp, Homo sapien
tcatatttgtatcttcttccttctg

SEQ ID NO: 442081 - DNA, 25 bp, Homo sapien
gtgccttgcacacaaacaataaatg

SEQ ID NO: 442082 - DNA, 25 bp, Homo sapien
ctgtctgcctatctaatctatcatc

SEQ ID NO: 442083 - DNA, 25 bp, Homo sapien
gtctgcctatctaatctatcatctg

SEQ ID NO: 442084 - DNA, 25 bp, Homo sapien
gcctatctaatctatcatctgtcag

SEQ ID NO: 442085 - DNA, 25 bp, Homo sapien
tatctaatctatcatctgtcagtct

SEQ ID NO: 442086 - DNA, 25 bp, Homo sapien
tctaatctatcatctgtcagtctat

SEQ ID NO: 442087 - DNA, 25 bp, Homo sapien
atctatcatctgtcagtctatatct

SEQ ID NO: 442088 - DNA, 25 bp, Homo sapien
atcatctgtcagtctatatctaatc

SEQ ID NO: 442089 - DNA, 25 bp, Homo sapien
atctgtcagtctatatctaatctag

SEQ ID NO: 442090 - DNA, 25 bp, Homo sapien
tgtcagtctatatctaatctagatt

SEQ ID NO: 442091 - DNA, 25 bp, Homo sapien
cactgtaacttccaactcctgagct

SEQ ID NO: 442092 - DNA, 25 bp, Homo sapien
tttttatttttgtggcccaggctga

SEQ ID NO: 442093 - DNA, 25 bp, Homo sapien
gtatcccgaattttcttgaattgct

SEQ ID NO: 442094 - DNA, 25 bp, Homo sapien
gaattgctttccctatagattaatt

SEQ ID NO: 442095 - DNA, 25 bp, Homo sapien
aaaaccatacttgtatatgtagtta

SEQ ID NO: 442096 - DNA, 25 bp, Homo sapien
aggaatacattgtttataaccagta

SEQ ID NO: 442097 - DNA, 25 bp, Homo sapien
ataaccagtatgtacttcaaaaatg

SEQ ID NO: 442098 - DNA, 25 bp, Homo sapien
ttgtcaaacatacctaactttcttg

SEQ ID NO: 442099 - DNA, 25 bp, Homo sapien
aacatacctaactttcttgcaataa

SEQ ID NO: 442100 - DNA, 25 bp, Homo sapien
gcaaaagaaactggaacttgacaat

SEQ ID NO: 442101 - DNA, 25 bp, Homo sapien
ggttgcaattatataggccatgggt

SEQ ID NO: 442102 - DNA, 25 bp, Homo sapien
gccatgggtggctcaaaactttgaa

SEQ ID NO: 442103 - DNA, 25 bp, Homo sapien
aactttgaacatttgagcttaaaca

SEQ ID NO: 442104 - DNA, 25 bp, Homo sapien
aacattcaaataaaacttcaactgg

SEQ ID NO: 442105 - DNA, 25 bp, Homo sapien
ttgccagcaatagtattaaacagtt

SEQ ID NO: 442106 - DNA, 25 bp, Homo sapien
acagttgtaaaggagtgcatgagta

SEQ ID NO: 442107 - DNA, 25 bp, Homo sapien
ggagtgcatgagtagtgctctttat

SEQ ID NO: 442108 - DNA, 25 bp, Homo sapien
gagtagtgctctttatgaaacgcaa

SEQ ID NO: 442109 - DNA, 25 bp, Homo sapien
gtgctctttatgaaacgcaacatgc

SEQ ID NO: 442110 - DNA, 25 bp, Homo sapien
gctctttatgaaacgcaacatgcaa

SEQ ID NO: 442111 - DNA, 25 bp, Homo sapien
cgcaacatgcaataatagagtaggt

SEQ ID NO: 442112 - DNA, 25 bp, Homo sapien
gagtaggtatggtttcagaagtcag

SEQ ID NO: 442113 - DNA, 25 bp, Homo sapien
gttttacactatgctaatttcagac

SEQ ID NO: 442114 - DNA, 25 bp, Homo sapien
atttcagacaaacagttttcaattt

SEQ ID NO: 442115 - DNA, 25 bp, Homo sapien
ggtatgaggtattacttaaagagaa

SEQ ID NO: 442116 - DNA, 25 bp, Homo sapien
ttaaagagaaaccagactgtcagcc

SEQ ID NO: 442117 - DNA, 25 bp, Homo sapien
aagagaaaccagactgtcagccttg

SEQ ID NO: 442118 - DNA, 25 bp, Homo sapien
gagaaaccagactgtcagccttgac

SEQ ID NO: 442119 - DNA, 25 bp, Homo sapien
gaaaccagactgtcagccttgacaa

SEQ ID NO: 442120 - DNA, 25 bp, Homo sapien
aaccagactgtcagccttgacaaat

SEQ ID NO: 442121 - DNA, 25 bp, Homo sapien
accagactgtcagccttgacaaatt

SEQ ID NO: 442122 - DNA, 25 bp, Homo sapien
agactgtcagccttgacaaattgtg

SEQ ID NO: 442123 - DNA, 25 bp, Homo sapien
aagagctgagaagattaagggtgtc

SEQ ID NO: 442124 - DNA, 25 bp, Homo sapien
agctgagaagattaagggtgtcaag

SEQ ID NO: 442125 - DNA, 25 bp, Homo sapien
gtcaaggggacctgtgtcctggtgg

SEQ ID NO: 442126 - DNA, 25 bp, Homo sapien
aataacttacattgtcaacaggaat

SEQ ID NO: 442127 - DNA, 25 bp, Homo sapien
ctgttttcttccaattaataggtat

SEQ ID NO: 442128 - DNA, 25 bp, Homo sapien
cttccaattaataggtatgaggtga

SEQ ID NO: 442129 - DNA, 25 bp, Homo sapien
aggtgatagcttatatctgttttca

SEQ ID NO: 442130 - DNA, 25 bp, Homo sapien
atttataaagttgaccatttcttga

SEQ ID NO: 442131 - DNA, 25 bp, Homo sapien
atttttctcccttgacaacaattgc

SEQ ID NO: 442132 - DNA, 25 bp, Homo sapien
tcccttgacaacaattgcttacatg

SEQ ID NO: 442133 - DNA, 25 bp, Homo sapien
ttgcttacatgtacaatgactggat

SEQ ID NO: 442134 - DNA, 25 bp, Homo sapien
atgactggatttgctgggcatttgt

SEQ ID NO: 442135 - DNA, 25 bp, Homo sapien
gatttgctgggcatttgttgcttgt

SEQ ID NO: 442136 - DNA, 25 bp, Homo sapien
gctgggcatttgttgcttgttaata

SEQ ID NO: 442137 - DNA, 25 bp, Homo sapien
ccatctgccaggtcacaagggcaat

SEQ ID NO: 442138 - DNA, 25 bp, Homo sapien
gccaggtcacaagggcaatccatag

SEQ ID NO: 442139 - DNA, 25 bp, Homo sapien
gggcaatccatagagagctgcatca

SEQ ID NO: 442140 - DNA, 25 bp, Homo sapien
agagctgcatcagtgggcccaggaa

SEQ ID NO: 442141 - DNA, 25 bp, Homo sapien
agctgcatcagtgggcccaggaaaa

SEQ ID NO: 442142 - DNA, 25 bp, Homo sapien
agcagcgccgctgggaaaatgccct

SEQ ID NO: 442143 - DNA, 25 bp, Homo sapien
tgggaaaatgccctccagcctgaag

SEQ ID NO: 442144 - DNA, 25 bp, Homo sapien
tgcctggctggatgcctgtgagttc

SEQ ID NO: 442145 - DNA, 25 bp, Homo sapien
tgcctgtgagttccctccagagcag

SEQ ID NO: 442146 - DNA, 25 bp, Homo sapien
gggcgatcacttggttccgcagcca

SEQ ID NO: 442147 - DNA, 25 bp, Homo sapien
gttccgcagccaacgcatgtctgtg

SEQ ID NO: 442148 - DNA, 25 bp, Homo sapien
agtcaccagtgccagcggcatggaa

SEQ ID NO: 442149 - DNA, 25 bp, Homo sapien
acacctgctgagacttgagccccaa

SEQ ID NO: 442150 - DNA, 25 bp, Homo sapien
ttccttgccactggtctcaaagctg

SEQ ID NO: 442151 - DNA, 25 bp, Homo sapien
gccactggtctcaaagctgggcagc

SEQ ID NO: 442152 - DNA, 25 bp, Homo sapien
tggtctcaaagctgggcagcccatt

SEQ ID NO: 442153 - DNA, 25 bp, Homo sapien
attgcatgccctcaactcttgcttg

SEQ ID NO: 442154 - DNA, 25 bp, Homo sapien
tgccctcaactcttgcttggcaggg

SEQ ID NO: 442155 - DNA, 25 bp, Homo sapien
ggtaccagagactgaaagacacggc

SEQ ID NO: 442156 - DNA, 25 bp, Homo sapien
gaaagacacggcactgtttgtactc

SEQ ID NO: 442157 - DNA, 25 bp, Homo sapien
aagacacggcactgtttgtactctg

SEQ ID NO: 442158 - DNA, 25 bp, Homo sapien
gacacggcactgtttgtactctggg

SEQ ID NO: 442159 - DNA, 25 bp, Homo sapien
ccagactcctcaatctgagtgagag

SEQ ID NO: 442160 - DNA, 25 bp, Homo sapien
cagactcctcaatctgagtgagaga

SEQ ID NO: 442161 - DNA, 25 bp, Homo sapien
agactcctcaatctgagtgagagac

SEQ ID NO: 442162 - DNA, 25 bp, Homo sapien
gactcctcaatctgagtgagagaca

SEQ ID NO: 442163 - DNA, 25 bp, Homo sapien
actcctcaatctgagtgagagacaa

SEQ ID NO: 442164 - DNA, 25 bp, Homo sapien
ctcctcaatctgagtgagagacaag

SEQ ID NO: 442165 - DNA, 25 bp, Homo sapien
tcctcaatctgagtgagagacaagt

SEQ ID NO: 442166 - DNA, 25 bp, Homo sapien
tcaatctgagtgagagacaagtcaa

SEQ ID NO: 442167 - DNA, 25 bp, Homo sapien
caatctgagtgagagacaagtcaaa

SEQ ID NO: 442168 - DNA, 25 bp, Homo sapien
aatctgagtgagagacaagtcaaaa

SEQ ID NO: 442169 - DNA, 25 bp, Homo sapien
tctgagtgagagacaagtcaaaatc

SEQ ID NO: 442170 - DNA, 25 bp, Homo sapien
ctagacacttcatacagtttagaaa

SEQ ID NO: 442171 - DNA, 25 bp, Homo sapien
tacagtttagaaaatcagatgggtg

SEQ ID NO: 442172 - DNA, 25 bp, Homo sapien
atcagatgggtgtagatcaaggcag

SEQ ID NO: 442173 - DNA, 25 bp, Homo sapien
aggcaggagcaggaaccaaaaagaa

SEQ ID NO: 442174 - DNA, 25 bp, Homo sapien
gatgggggctattatgaactgagaa

SEQ ID NO: 442175 - DNA, 25 bp, Homo sapien
gggccaaatcatgtagactcttgag

SEQ ID NO: 442176 - DNA, 25 bp, Homo sapien
ccaaatcatgtagactcttgagtga

SEQ ID NO: 442177 - DNA, 25 bp, Homo sapien
gactcttgagtgatgtgttaaggaa

SEQ ID NO: 442178 - DNA, 25 bp, Homo sapien
atgtgttaaggaatgctatgagtgc

SEQ ID NO: 442179 - DNA, 25 bp, Homo sapien
taaggaatgctatgagtgctgagag

SEQ ID NO: 442180 - DNA, 25 bp, Homo sapien
gcatcagaagtccttgagagcctcc

SEQ ID NO: 442181 - DNA, 25 bp, Homo sapien
agttgctgctgagagttcagggtgg

SEQ ID NO: 442182 - DNA, 25 bp, Homo sapien
ttccttgccactggtctcaaagctg

SEQ ID NO: 442183 - DNA, 25 bp, Homo sapien
cttgccactggtctcaaagctgggc

SEQ ID NO: 442184 - DNA, 25 bp, Homo sapien
gccactggtctcaaagctgggcagc

SEQ ID NO: 442185 - DNA, 25 bp, Homo sapien
actggtctcaaagctgggcagccca

SEQ ID NO: 442186 - DNA, 25 bp, Homo sapien
tggtctcaaagctgggcagcccatt

SEQ ID NO: 442187 - DNA, 25 bp, Homo sapien
attgcatgccctcaactcttgcttg

SEQ ID NO: 442188 - DNA, 25 bp, Homo sapien
atgccctcaactcttgcttggcagg

SEQ ID NO: 442189 - DNA, 25 bp, Homo sapien
tgccctcaactcttgcttggcaggg

SEQ ID NO: 442190 - DNA, 25 bp, Homo sapien
actcttgcttggcaggggtaccaga

SEQ ID NO: 442191 - DNA, 25 bp, Homo sapien
taccagagactgaaagacacggcac

SEQ ID NO: 442192 - DNA, 25 bp, Homo sapien
tcaccttgaaggagtctggtcctac

SEQ ID NO: 442193 - DNA, 25 bp, Homo sapien
caccttgaaggagtctggtcctacg

SEQ ID NO: 442194 - DNA, 25 bp, Homo sapien
accttgaaggagtctggtcctacgc

SEQ ID NO: 442195 - DNA, 25 bp, Homo sapien
ccttgaaggagtctggtcctacgct

SEQ ID NO: 442196 - DNA, 25 bp, Homo sapien
cttgaaggagtctggtcctacgctg

SEQ ID NO: 442197 - DNA, 25 bp, Homo sapien
tgaaacccacacagaccctcacgct

SEQ ID NO: 442198 - DNA, 25 bp, Homo sapien
gaaacccacacagaccctcacgctg

SEQ ID NO: 442199 - DNA, 25 bp, Homo sapien
aaacccacacagaccctcacgctga

SEQ ID NO: 442200 - DNA, 25 bp, Homo sapien
aacccacacagaccctcacgctgac

SEQ ID NO: 442201 - DNA, 25 bp, Homo sapien
ttctctgggttctcactcagcacta

SEQ ID NO: 442202 - DNA, 25 bp, Homo sapien
tctctgggttctcactcagcactag

SEQ ID NO: 442203 - DNA, 25 bp, Homo sapien
tgaggacctgcgcaagcaattggtt

SEQ ID NO: 442204 - DNA, 25 bp, Homo sapien
aagcctcagagttattgaaatccca

SEQ ID NO: 442205 - DNA, 25 bp, Homo sapien
ctcagagttattgaaatcccaggcc

SEQ ID NO: 442206 - DNA, 25 bp, Homo sapien
gaaatcccaggccaaagaactcaaa

SEQ ID NO: 442207 - DNA, 25 bp, Homo sapien
aagatgcccatcagcagcaaaagct

SEQ ID NO: 442208 - DNA, 25 bp, Homo sapien
caggacttcttggagctctgtgagc

SEQ ID NO: 442209 - DNA, 25 bp, Homo sapien
ctctgtgagctggtagcagagctct

SEQ ID NO: 442210 - DNA, 25 bp, Homo sapien
agctggtagcagagctctgctccca

SEQ ID NO: 442211 - DNA, 25 bp, Homo sapien
atgcagaaagtcaacacgatgtggc

SEQ ID NO: 442212 - DNA, 25 bp, Homo sapien
gtcaacacgatgtggcaggagagct

SEQ ID NO: 442213 - DNA, 25 bp, Homo sapien
gaagctatttatatggccgggcgcg

SEQ ID NO: 442214 - DNA, 25 bp, Homo sapien
ttgcttgagccctggagttcaaggc

SEQ ID NO: 442215 - DNA, 25 bp, Homo sapien
tgcttgagccctggagttcaaggct

SEQ ID NO: 442216 - DNA, 25 bp, Homo sapien
gagctgtgatttgattacacccctg

SEQ ID NO: 442217 - DNA, 25 bp, Homo sapien
agctgtgatttgattacacccctgc

SEQ ID NO: 442218 - DNA, 25 bp, Homo sapien
gctgtgatttgattacacccctgca

SEQ ID NO: 442219 - DNA, 25 bp, Homo sapien
ctgtgatttgattacacccctgcac

SEQ ID NO: 442220 - DNA, 25 bp, Homo sapien
tgtgatttgattacacccctgcact

SEQ ID NO: 442221 - DNA, 25 bp, Homo sapien
gtgatttgattacacccctgcactc

SEQ ID NO: 442222 - DNA, 25 bp, Homo sapien
tgatttgattacacccctgcactcc

SEQ ID NO: 442223 - DNA, 25 bp, Homo sapien
gatttgattacacccctgcactcca

SEQ ID NO: 442224 - DNA, 25 bp, Homo sapien
atttgattacacccctgcactccag

SEQ ID NO: 442225 - DNA, 25 bp, Homo sapien
ggacaagcttggtatataacctttt

SEQ ID NO: 442226 - DNA, 25 bp, Homo sapien
ccttttggaatttggctttccactg

SEQ ID NO: 442227 - DNA, 25 bp, Homo sapien
gaatttggctttccactgaaggttt

SEQ ID NO: 442228 - DNA, 25 bp, Homo sapien
aagaagcagctttcccattgaatag

SEQ ID NO: 442229 - DNA, 25 bp, Homo sapien
gctttcccattgaatagcttgctac

SEQ ID NO: 442230 - DNA, 25 bp, Homo sapien
gaatagcttgctacacagataacat

SEQ ID NO: 442231 - DNA, 25 bp, Homo sapien
gcttgctacacagataacattattt

SEQ ID NO: 442232 - DNA, 25 bp, Homo sapien
taacattatttaggattctacttca

SEQ ID NO: 442233 - DNA, 25 bp, Homo sapien
gctattctgggctgcatgtcctggc

SEQ ID NO: 442234 - DNA, 25 bp, Homo sapien
ggctgcatgtcctggccgacgagct

SEQ ID NO: 442235 - DNA, 25 bp, Homo sapien
ccgacgagctgcgagttggacaagc

SEQ ID NO: 442236 - DNA, 25 bp, Homo sapien
tcttgggtcccagatggcacaggag

SEQ ID NO: 442237 - DNA, 25 bp, Homo sapien
aggagcactgcatgcttgttttcta

SEQ ID NO: 442238 - DNA, 25 bp, Homo sapien
ttgttttctagagcccagccagtca

SEQ ID NO: 442239 - DNA, 25 bp, Homo sapien
agccagtcatgggtgctagcctagt

SEQ ID NO: 442240 - DNA, 25 bp, Homo sapien
tgggtgctagcctagtctccacaca

SEQ ID NO: 442241 - DNA, 25 bp, Homo sapien
accagcaagtagaacccaagtgtat

SEQ ID NO: 442242 - DNA, 25 bp, Homo sapien
aatatttcctgagtaccagtaagag

SEQ ID NO: 442243 - DNA, 25 bp, Homo sapien
cattcttttctcatctaggccagga

SEQ ID NO: 442244 - DNA, 25 bp, Homo sapien
ttttctcatctaggccaggaatgtt

SEQ ID NO: 442245 - DNA, 25 bp, Homo sapien
gctcagccttacatagaaactccta

SEQ ID NO: 442246 - DNA, 25 bp, Homo sapien
agattttcactaacgcatttcacaa

SEQ ID NO: 442247 - DNA, 25 bp, Homo sapien
aagaggtttgctgggttaaatctca

SEQ ID NO: 442248 - DNA, 25 bp, Homo sapien
gttagcagaggcctttcctgacaac

SEQ ID NO: 442249 - DNA, 25 bp, Homo sapien
tgacaaccccattttaagcacctct

SEQ ID NO: 442250 - DNA, 25 bp, Homo sapien
ctatctcatcactgttactgtctgt

SEQ ID NO: 442251 - DNA, 25 bp, Homo sapien
tactgtctgtgtagccctgtcatga

SEQ ID NO: 442252 - DNA, 25 bp, Homo sapien
tgagctaaaatcatcctgtttgttt

SEQ ID NO: 442253 - DNA, 25 bp, Homo sapien
tcctgtttgtttattgctagcttat

SEQ ID NO: 442254 - DNA, 25 bp, Homo sapien
atactccttgagaacagcaactttg

SEQ ID NO: 442255 - DNA, 25 bp, Homo sapien
ttgtctttttcacctttgtactgag

SEQ ID NO: 442256 - DNA, 25 bp, Homo sapien
ctttgtactgagtcccctgacatgg

SEQ ID NO: 442257 - DNA, 25 bp, Homo sapien
gaataaatgcacagacttgtccaaa

SEQ ID NO: 442258 - DNA, 25 bp, Homo sapien
cacttcacaccagcctgctgcggcg

SEQ ID NO: 442259 - DNA, 25 bp, Homo sapien
cttcacaccagcctgctgcggcggg

SEQ ID NO: 442260 - DNA, 25 bp, Homo sapien
ctgcggcgggggctcattaaaaata

SEQ ID NO: 442261 - DNA, 25 bp, Homo sapien
ggcgggggctcattaaaaatagtca

SEQ ID NO: 442262 - DNA, 25 bp, Homo sapien
cattaaaaatagtcagggccgccgg

SEQ ID NO: 442263 - DNA, 25 bp, Homo sapien
taaaaatagtcagggccgccgggcg

SEQ ID NO: 442264 - DNA, 25 bp, Homo sapien
aaaatagtcagggccgccgggcgcg

SEQ ID NO: 442265 - DNA, 25 bp, Homo sapien
aatagtcagggccgccgggcgcggt

SEQ ID NO: 442266 - DNA, 25 bp, Homo sapien
gtgaaccaaaatagtgacactgcat

SEQ ID NO: 442267 - DNA, 25 bp, Homo sapien
tgaaccaaaatagtgacactgcatt

SEQ ID NO: 442268 - DNA, 25 bp, Homo sapien
gaaccaaaatagtgacactgcattc

SEQ ID NO: 442269 - DNA, 25 bp, Homo sapien
atcatgcggctgcaggcgggtgtca

SEQ ID NO: 442270 - DNA, 25 bp, Homo sapien
ctgcaggcgggtgtcatggcttccc

SEQ ID NO: 442271 - DNA, 25 bp, Homo sapien
tgcaggcgggtgtcatggcttcccc

SEQ ID NO: 442272 - DNA, 25 bp, Homo sapien
gacgaggagcccaagccactgctct

SEQ ID NO: 442273 - DNA, 25 bp, Homo sapien
acgaggagcccaagccactgctctg

SEQ ID NO: 442274 - DNA, 25 bp, Homo sapien
gtgtcaggtcccagcgagccacagg

SEQ ID NO: 442275 - DNA, 25 bp, Homo sapien
tgtcaggtcccagcgagccacagga

SEQ ID NO: 442276 - DNA, 25 bp, Homo sapien
aggtcccagcgagccacaggaacgg

SEQ ID NO: 442277 - DNA, 25 bp, Homo sapien
gcgagccacaggaacggccctgcag

SEQ ID NO: 442278 - DNA, 25 bp, Homo sapien
cgagccacaggaacggccctgcagg

SEQ ID NO: 442279 - DNA, 25 bp, Homo sapien
gaaggagcccctgagtccgcctgcg

SEQ ID NO: 442280 - DNA, 25 bp, Homo sapien
gattataggtacgcgccaccacgcc

SEQ ID NO: 442281 - DNA, 25 bp, Homo sapien
gtgctggaattaccgatgcgagcca

SEQ ID NO: 442282 - DNA, 25 bp, Homo sapien
gctggaattaccgatgcgagccacc

SEQ ID NO: 442283 - DNA, 25 bp, Homo sapien
ggaattaccgatgcgagccaccaca

SEQ ID NO: 442284 - DNA, 25 bp, Homo sapien
gaattaccgatgcgagccaccacac

SEQ ID NO: 442285 - DNA, 25 bp, Homo sapien
aattaccgatgcgagccaccacacc

SEQ ID NO: 442286 - DNA, 25 bp, Homo sapien
attaccgatgcgagccaccacaccc

SEQ ID NO: 442287 - DNA, 25 bp, Homo sapien
ttaccgatgcgagccaccacacccg

SEQ ID NO: 442288 - DNA, 25 bp, Homo sapien
aaaaaagagtatcctgaatacacaa

SEQ ID NO: 442289 - DNA, 25 bp, Homo sapien
aaaaagagtatcctgaatacacaat

SEQ ID NO: 442290 - DNA, 25 bp, Homo sapien
aaaagagtatcctgaatacacaata

SEQ ID NO: 442291 - DNA, 25 bp, Homo sapien
ttatttttgcttctctccgttttca

SEQ ID NO: 442292 - DNA, 25 bp, Homo sapien
tgcttctctccgttttcaaaattaa

SEQ ID NO: 442293 - DNA, 25 bp, Homo sapien
aattaatcatcttgttctctgtata

SEQ ID NO: 442294 - DNA, 25 bp, Homo sapien
gaaaatttgagaagctgtggacaat

SEQ ID NO: 442295 - DNA, 25 bp, Homo sapien
caatttaatagtctgatctggcaac

SEQ ID NO: 442296 - DNA, 25 bp, Homo sapien
gatctggcaacagcgatttttgttt

SEQ ID NO: 442297 - DNA, 25 bp, Homo sapien
ttttctttgaggaggatataattac

SEQ ID NO: 442298 - DNA, 25 bp, Homo sapien
tataattactgatatcctaggatgt

SEQ ID NO: 442299 - DNA, 25 bp, Homo sapien
gaaatttttgagtgacagtatgcac

SEQ ID NO: 442300 - DNA, 25 bp, Homo sapien
gagtgacagtatgcacattttaaag

SEQ ID NO: 442301 - DNA, 25 bp, Homo sapien
atctgtataatgttttttggtctgt

SEQ ID NO: 442302 - DNA, 25 bp, Homo sapien
agaaattgaaaattgccttgcagat

SEQ ID NO: 442303 - DNA, 25 bp, Homo sapien
gagcaacggcacgtcgaggagggca

SEQ ID NO: 442304 - DNA, 25 bp, Homo sapien
aggagggcaggctgcgtctggctgc

SEQ ID NO: 442305 - DNA, 25 bp, Homo sapien
tgctgcctcttctggtcttgcacct

SEQ ID NO: 442306 - DNA, 25 bp, Homo sapien
tcttgcacctgcttctcaaattttg

SEQ ID NO: 442307 - DNA, 25 bp, Homo sapien
gcacctgcttctcaaattttgatgt

SEQ ID NO: 442308 - DNA, 25 bp, Homo sapien
aacaccgacagcaaccaatcagata

SEQ ID NO: 442309 - DNA, 25 bp, Homo sapien
gacagcaaccaatcagatatataca

SEQ ID NO: 442310 - DNA, 25 bp, Homo sapien
tagaagaaacacagcctcatgggac

SEQ ID NO: 442311 - DNA, 25 bp, Homo sapien
gaaacacagcctcatgggacagaaa

SEQ ID NO: 442312 - DNA, 25 bp, Homo sapien
acagcctcatgggacagaaatttga

SEQ ID NO: 442313 - DNA, 25 bp, Homo sapien
cagcctttgaaaaagtcaatttagg

SEQ ID NO: 442314 - DNA, 25 bp, Homo sapien
aaagtcaatttaggctggacgcggc

SEQ ID NO: 442315 - DNA, 25 bp, Homo sapien
gtcaatttaggctggacgcggctgc

SEQ ID NO: 442316 - DNA, 25 bp, Homo sapien
tcaatttaggctggacgcggctgct

SEQ ID NO: 442317 - DNA, 25 bp, Homo sapien
caatttaggctggacgcggctgctc

SEQ ID NO: 442318 - DNA, 25 bp, Homo sapien
aatttaggctggacgcggctgctca

SEQ ID NO: 442319 - DNA, 25 bp, Homo sapien
atttaggctggacgcggctgctcac

SEQ ID NO: 442320 - DNA, 25 bp, Homo sapien
gctggacgcggctgctcacgtctgt

SEQ ID NO: 442321 - DNA, 25 bp, Homo sapien
tggacgcggctgctcacgtctgtca

SEQ ID NO: 442322 - DNA, 25 bp, Homo sapien
ggacgcggctgctcacgtctgtcat

SEQ ID NO: 442323 - DNA, 25 bp, Homo sapien
gaatcgttgaatctgggtggtggag

SEQ ID NO: 442324 - DNA, 25 bp, Homo sapien
cctcaccagggaccgtaggcacgaa

SEQ ID NO: 442325 - DNA, 25 bp, Homo sapien
tcaccagggaccgtaggcacgaagt

SEQ ID NO: 442326 - DNA, 25 bp, Homo sapien
caccagggaccgtaggcacgaagtg

SEQ ID NO: 442327 - DNA, 25 bp, Homo sapien
gaccgtaggcacgaagtggccagac

SEQ ID NO: 442328 - DNA, 25 bp, Homo sapien
gtaggcacgaagtggccagactcct

SEQ ID NO: 442329 - DNA, 25 bp, Homo sapien
gcacgaagtggccagactcctcaat

SEQ ID NO: 442330 - DNA, 25 bp, Homo sapien
aagtggccagactcctcaatctgag

SEQ ID NO: 442331 - DNA, 25 bp, Homo sapien
cagactcctcaatctgagtgagaga

SEQ ID NO: 442332 - DNA, 25 bp, Homo sapien
tcaatctgagtgagagacaagtcaa

SEQ ID NO: 442333 - DNA, 25 bp, Homo sapien
gcacgctcgctcttcccggaaaaag

SEQ ID NO: 442334 - DNA, 25 bp, Homo sapien
gctagagaaggagtttctgttcaat

SEQ ID NO: 442335 - DNA, 25 bp, Homo sapien
cttttcagagccgagtggcatgaat

SEQ ID NO: 442336 - DNA, 25 bp, Homo sapien
agccgagtggcatgaatatgtgtac

SEQ ID NO: 442337 - DNA, 25 bp, Homo sapien
atatgtgtactgtttctgcttctgt

SEQ ID NO: 442338 - DNA, 25 bp, Homo sapien
ttctgcttctgttgatggagtggct

SEQ ID NO: 442339 - DNA, 25 bp, Homo sapien
aaggaaatgctaatttgagcttcat

SEQ ID NO: 442340 - DNA, 25 bp, Homo sapien
gctaatttgagcttcattcataggg

SEQ ID NO: 442341 - DNA, 25 bp, Homo sapien
ccctgctggttggaaattatcttca

SEQ ID NO: 442342 - DNA, 25 bp, Homo sapien
gaaattatcttcatctctggactgc

SEQ ID NO: 442343 - DNA, 25 bp, Homo sapien
catctctggactgcattgtttagaa

SEQ ID NO: 442344 - DNA, 25 bp, Homo sapien
aattctgagaactttattgtgtggc

SEQ ID NO: 442345 - DNA, 25 bp, Homo sapien
gagaactttattgtgtggctctggg

SEQ ID NO: 442346 - DNA, 25 bp, Homo sapien
tggttacctgacttcaccagaactg

SEQ ID NO: 442347 - DNA, 25 bp, Homo sapien
tgacttcaccagaactgcacaagga

SEQ ID NO: 442348 - DNA, 25 bp, Homo sapien
ttcaccagaactgcacaaggagctg

SEQ ID NO: 442349 - DNA, 25 bp, Homo sapien
cagaactgcacaaggagctggtgag

SEQ ID NO: 442350 - DNA, 25 bp, Homo sapien
agctggtgaggctcttcaatgtata

SEQ ID NO: 442351 - DNA, 25 bp, Homo sapien
tggtgaggctcttcaatgtatatat

SEQ ID NO: 442352 - DNA, 25 bp, Homo sapien
aggagatacctatatcccttctcta

SEQ ID NO: 442353 - DNA, 25 bp, Homo sapien
tatatcccttctctaccaaagcatt

SEQ ID NO: 442354 - DNA, 25 bp, Homo sapien
atcccttctctaccaaagcattatg

SEQ ID NO: 442355 - DNA, 25 bp, Homo sapien
caaagcattatgatattcacaggct

SEQ ID NO: 442356 - DNA, 25 bp, Homo sapien
cacaggctagcaaaagtgatgcaga

SEQ ID NO: 442357 - DNA, 25 bp, Homo sapien
agcactagtgcagtgggtgtgggct

SEQ ID NO: 442358 - DNA, 25 bp, Homo sapien
cactagtgcagtgggtgtgggctgg

SEQ ID NO: 442359 - DNA, 25 bp, Homo sapien
agtgcagtgggtgtgggctggatcc

SEQ ID NO: 442360 - DNA, 25 bp, Homo sapien
tgaaggagtctggtcctacgctgat

SEQ ID NO: 442361 - DNA, 25 bp, Homo sapien
gagtctggtcctacgctgatgaaac

SEQ ID NO: 442362 - DNA, 25 bp, Homo sapien
tggtcctacgctgatgaaacccaca

SEQ ID NO: 442363 - DNA, 25 bp, Homo sapien
tacgctgatgaaacccacacagacc

SEQ ID NO: 442364 - DNA, 25 bp, Homo sapien
gctgacctacgccttctctgggttc

SEQ ID NO: 442365 - DNA, 25 bp, Homo sapien
gccttctctgggttctcactcagca

SEQ ID NO: 442366 - DNA, 25 bp, Homo sapien
ctcactcagcactagtgcagtgggt

SEQ ID NO: 442367 - DNA, 25 bp, Homo sapien
cactcagcactagtgcagtgggtgt

SEQ ID NO: 442368 - DNA, 25 bp, Homo sapien
aattataccaattgctagacccagg

SEQ ID NO: 442369 - DNA, 25 bp, Homo sapien
gctagacccaggatgtatctttaat

SEQ ID NO: 442370 - DNA, 25 bp, Homo sapien
gtatctttaattcttgtcatccagg

SEQ ID NO: 442371 - DNA, 25 bp, Homo sapien
ttcttgtcatccaggtcaacatatg

SEQ ID NO: 442372 - DNA, 25 bp, Homo sapien
catatgatgctgctataagtctggg

SEQ ID NO: 442373 - DNA, 25 bp, Homo sapien
gggctcaaattgatatcccagtagc

SEQ ID NO: 442374 - DNA, 25 bp, Homo sapien
aatgtaatggcttctcttttctctc

SEQ ID NO: 442375 - DNA, 25 bp, Homo sapien
ttctctcttgtggaattgcattcaa

SEQ ID NO: 442376 - DNA, 25 bp, Homo sapien
acagtgccttagaatggatgtgccc

SEQ ID NO: 442377 - DNA, 25 bp, Homo sapien
aatggatgtgcccaactgctctgta

SEQ ID NO: 442378 - DNA, 25 bp, Homo sapien
gcccaactgctctgtatttatgcaa

SEQ ID NO: 442379 - DNA, 25 bp, Homo sapien
agactgcattaatagctacttgatt

SEQ ID NO: 442380 - DNA, 25 bp, Homo sapien
gctacttgattagaattcgaacttt

SEQ ID NO: 442381 - DNA, 25 bp, Homo sapien
gaaaatgcatgctttatgttgaaaa

SEQ ID NO: 442382 - DNA, 25 bp, Homo sapien
tgctttaatattcctcattcttgag

SEQ ID NO: 442383 - DNA, 25 bp, Homo sapien
tttatgttaattttgcatgggcaca

SEQ ID NO: 442384 - DNA, 25 bp, Homo sapien
gcatgggcacaaacttaatcagaaa

SEQ ID NO: 442385 - DNA, 25 bp, Homo sapien
gtggagttacatttcctcttattat

SEQ ID NO: 442386 - DNA, 25 bp, Homo sapien
tcaaggttcagtattgatctttgaa

SEQ ID NO: 442387 - DNA, 25 bp, Homo sapien
tgatctttgaaaccttggtcccgtt

SEQ ID NO: 442388 - DNA, 25 bp, Homo sapien
ggtcccgttaacttactagtcacat

SEQ ID NO: 442389 - DNA, 25 bp, Homo sapien
cttactagtcacattgaccaatgtt

SEQ ID NO: 442390 - DNA, 25 bp, Homo sapien
ttattactgtactggtacgtgcttt

SEQ ID NO: 442391 - DNA, 25 bp, Homo sapien
actgtactggtacgtgctttttata

SEQ ID NO: 442392 - DNA, 25 bp, Homo sapien
gtactggtacgtgctttttatatat

SEQ ID NO: 442393 - DNA, 25 bp, Homo sapien
ttatatatttgatctatttctttgc

SEQ ID NO: 442394 - DNA, 25 bp, Homo sapien
ctatttctttgcatcagatccctag

SEQ ID NO: 442395 - DNA, 25 bp, Homo sapien
atttctttgcatcagatccctagaa

SEQ ID NO: 442396 - DNA, 25 bp, Homo sapien
tgatatacagatttttaagacttga

SEQ ID NO: 442397 - DNA, 25 bp, Homo sapien
taagacttgatacgttaatgccaaa

SEQ ID NO: 442398 - DNA, 25 bp, Homo sapien
acgttaatgccaaaatgccttgtgt

SEQ ID NO: 442399 - DNA, 25 bp, Homo sapien
atgccaaaatgccttgtgtggccag

SEQ ID NO: 442400 - DNA, 25 bp, Homo sapien
aaaatgccttgtgtggccaggcgcg

SEQ ID NO: 442401 - DNA, 25 bp, Homo sapien
aagcagcctcaaagaattacccctc

SEQ ID NO: 442402 - DNA, 25 bp, Homo sapien
ttacccctcccaaaatgtcagaagt

SEQ ID NO: 442403 - DNA, 25 bp, Homo sapien
ccctcccaaaatgtcagaagtgctg

SEQ ID NO: 442404 - DNA, 25 bp, Homo sapien
gctgagaaaccctgatgtaaagatc

SEQ ID NO: 442405 - DNA, 25 bp, Homo sapien
ggcaattcttagagacatttccggt

SEQ ID NO: 442406 - DNA, 25 bp, Homo sapien
gtaaagatcagtcccagttataaac

SEQ ID NO: 442407 - DNA, 25 bp, Homo sapien
gaaaacagctatttacaaagcagta

SEQ ID NO: 442408 - DNA, 25 bp, Homo sapien
gaggattttacaagatcagatactg

SEQ ID NO: 442409 - DNA, 25 bp, Homo sapien
gacatttccggttgtcacaattgga

SEQ ID NO: 442410 - DNA, 25 bp, Homo sapien
acaattggagggatactagtagcat

SEQ ID NO: 442411 - DNA, 25 bp, Homo sapien
tagtagcatgaattgggtagaggcc

SEQ ID NO: 442412 - DNA, 25 bp, Homo sapien
tatctacaagacattctgctagtca

SEQ ID NO: 442413 - DNA, 25 bp, Homo sapien
gacattctgctagtcactgtggaaa

SEQ ID NO: 442414 - DNA, 25 bp, Homo sapien
cactgtggaaaagtttccttctctt

SEQ ID NO: 442415 - DNA, 25 bp, Homo sapien
aacagtgttggttatctttattatg

SEQ ID NO: 442416 - DNA, 25 bp, Homo sapien
gtatttgtaacagctgtttcaccct

SEQ ID NO: 442417 - DNA, 25 bp, Homo sapien
agctgtttcacccttgtattgcata

SEQ ID NO: 442418 - DNA, 25 bp, Homo sapien
gtttcacccttgtattgcataatgg

SEQ ID NO: 442419 - DNA, 25 bp, Homo sapien
gaggcatgtaaattcattgagaact

SEQ ID NO: 442420 - DNA, 25 bp, Homo sapien
tgagaactaaccgtagtttgtaaag

SEQ ID NO: 442421 - DNA, 25 bp, Homo sapien
tctagttttttgcagatcacatttc

SEQ ID NO: 442422 - DNA, 25 bp, Homo sapien
gatcacatttctttgaatgctggaa

SEQ ID NO: 442423 - DNA, 25 bp, Homo sapien
agctcagggccctccgaacaaagca

SEQ ID NO: 442424 - DNA, 25 bp, Homo sapien
agggccctccgaacaaagcagcgct

SEQ ID NO: 442425 - DNA, 25 bp, Homo sapien
aacaaagcagcgctcggtgccggac

SEQ ID NO: 442426 - DNA, 25 bp, Homo sapien
agcagcgctcggtgccggacctgca

SEQ ID NO: 442427 - DNA, 25 bp, Homo sapien
aagccccaagcgcagcagcgcagag

SEQ ID NO: 442428 - DNA, 25 bp, Homo sapien
tggggtcaccagagctcgtactagg

SEQ ID NO: 442429 - DNA, 25 bp, Homo sapien
gagctcgtactaggacatcgtctcc

SEQ ID NO: 442430 - DNA, 25 bp, Homo sapien
tactaggacatcgtctccccattta

SEQ ID NO: 442431 - DNA, 25 bp, Homo sapien
taggacatcgtctccccatttaaca

SEQ ID NO: 442432 - DNA, 25 bp, Homo sapien
ccggtcccatctgagttgcaagtgg

SEQ ID NO: 442433 - DNA, 25 bp, Homo sapien
gtcccatctgagttgcaagtggtgg

SEQ ID NO: 442434 - DNA, 25 bp, Homo sapien
cactgccctcttggaaaaggctgta

SEQ ID NO: 442435 - DNA, 25 bp, Homo sapien
aaaggctgtaacaaacagttccaat

SEQ ID NO: 442436 - DNA, 25 bp, Homo sapien
caaacagttccaatcccaacagaaa

SEQ ID NO: 442437 - DNA, 25 bp, Homo sapien
ctggtctgagggtatacaggccttt

SEQ ID NO: 442438 - DNA, 25 bp, Homo sapien
gggtatacaggcctttcacaatatt

SEQ ID NO: 442439 - DNA, 25 bp, Homo sapien
gcctttcacaatatttgccatagtt

SEQ ID NO: 442440 - DNA, 25 bp, Homo sapien
aaatggtgttgactgggcttctaaa

SEQ ID NO: 442441 - DNA, 25 bp, Homo sapien
ggctgtaaatgtgcttttctgcaac

SEQ ID NO: 442442 - DNA, 25 bp, Homo sapien
tgcttttctgcaacatgttccgtaa

SEQ ID NO: 442443 - DNA, 25 bp, Homo sapien
tgttccgtaaacagctttataaggt

SEQ ID NO: 442444 - DNA, 25 bp, Homo sapien
agtctctgttaagcttggtttcgat

SEQ ID NO: 442445 - DNA, 25 bp, Homo sapien
ttcccctttgagcacaagtgttgca

SEQ ID NO: 442446 - DNA, 25 bp, Homo sapien
gaaacataccagattagccaccatt

SEQ ID NO: 442447 - DNA, 25 bp, Homo sapien
aacataccagattagccaccattag

SEQ ID NO: 442448 - DNA, 25 bp, Homo sapien
taccagattagccaccattagcatc

SEQ ID NO: 442449 - DNA, 25 bp, Homo sapien
gattagccaccattagcatctatat

SEQ ID NO: 442450 - DNA, 25 bp, Homo sapien
gccaccattagcatctatatctact

SEQ ID NO: 442451 - DNA, 25 bp, Homo sapien
agcatctatatctactttgtgttta

SEQ ID NO: 442452 - DNA, 25 bp, Homo sapien
aatcaactggtaattctgaaacact

SEQ ID NO: 442453 - DNA, 25 bp, Homo sapien
actggtaattctgaaacactgtaga

SEQ ID NO: 442454 - DNA, 25 bp, Homo sapien
aagtagagtgcaggctaggctgtct

SEQ ID NO: 442455 - DNA, 25 bp, Homo sapien
agagtgcaggctaggctgtcttggg

SEQ ID NO: 442456 - DNA, 25 bp, Homo sapien
tagagaggcaccagcatgaggaata

SEQ ID NO: 442457 - DNA, 25 bp, Homo sapien
atggtgaggcaatcactggcctgcc

SEQ ID NO: 442458 - DNA, 25 bp, Homo sapien
aatcactggcctgccgtgtgtaggt

SEQ ID NO: 442459 - DNA, 25 bp, Homo sapien
aggctgtatagcattctgtgaggaa

SEQ ID NO: 442460 - DNA, 25 bp, Homo sapien
taatagcttgattagccgctgcacc

SEQ ID NO: 442461 - DNA, 25 bp, Homo sapien
ttagccgctgcaccgttagataaga

SEQ ID NO: 442462 - DNA, 25 bp, Homo sapien
tagataagactggagctggaacatt

SEQ ID NO: 442463 - DNA, 25 bp, Homo sapien
ggcacaggaagctgcaactgctgca

SEQ ID NO: 442464 - DNA, 25 bp, Homo sapien
tgcaatatttcccatcatcttctgg

SEQ ID NO: 442465 - DNA, 25 bp, Homo sapien
tgaggtaactgtgtcctgaggagac

SEQ ID NO: 442466 - DNA, 25 bp, Homo sapien
ggagacatagaacatgactttctgt

SEQ ID NO: 442467 - DNA, 25 bp, Homo sapien
cctcactggaattctcaccaaaaat

SEQ ID NO: 442468 - DNA, 25 bp, Homo sapien
ttctcaatattgttttggctatgca

SEQ ID NO: 442469 - DNA, 25 bp, Homo sapien
ttgttttggctatgcaaatatttgt

SEQ ID NO: 442470 - DNA, 25 bp, Homo sapien
tatttgttttgcttaatgtcctcca

SEQ ID NO: 442471 - DNA, 25 bp, Homo sapien
atttacacttctcagcaaatgtagt

SEQ ID NO: 442472 - DNA, 25 bp, Homo sapien
cacttctcagcaaatgtagttgcaa

SEQ ID NO: 442473 - DNA, 25 bp, Homo sapien
atgtagttgcaaacaaatgctttct

SEQ ID NO: 442474 - DNA, 25 bp, Homo sapien
tggtttgaggtatgtaaatagccaa

SEQ ID NO: 442475 - DNA, 25 bp, Homo sapien
ttatcccttgtatgatattactcaa

SEQ ID NO: 442476 - DNA, 25 bp, Homo sapien
tattactcaaaaaatccctgtgtat

SEQ ID NO: 442477 - DNA, 25 bp, Homo sapien
aatccctgtgtatatgaaagtgcat

SEQ ID NO: 442478 - DNA, 25 bp, Homo sapien
taccttgtagttctggtctcatttg

SEQ ID NO: 442479 - DNA, 25 bp, Homo sapien
gttctggtctcatttgtttctgtat

SEQ ID NO: 442480 - DNA, 25 bp, Homo sapien
gtttctgtatttatcaagcctggta

SEQ ID NO: 442481 - DNA, 25 bp, Homo sapien
gcctggtacataaacacagtaggta

SEQ ID NO: 442482 - DNA, 25 bp, Homo sapien
atggatgaatttgctgtccggtcaa

SEQ ID NO: 442483 - DNA, 25 bp, Homo sapien
tgtccggtcaagacttcagctagca

SEQ ID NO: 442484 - DNA, 25 bp, Homo sapien
gacttcagctagcacattcctaatt

SEQ ID NO: 442485 - DNA, 25 bp, Homo sapien
attcctaattgacctgcctttacat

SEQ ID NO: 442486 - DNA, 25 bp, Homo sapien
gacctgcctttacatatatggtttc

SEQ ID NO: 442487 - DNA, 25 bp, Homo sapien
tctaaaacactttcacactgggatg

SEQ ID NO: 442488 - DNA, 25 bp, Homo sapien
gatggttgcacacactattgggaat

SEQ ID NO: 442489 - DNA, 25 bp, Homo sapien
tagtgttaataactacccagcagtg

SEQ ID NO: 442490 - DNA, 25 bp, Homo sapien
ttttccaattcaagtcaggattcaa

SEQ ID NO: 442491 - DNA, 25 bp, Homo sapien
gattcaaataagattcctacattgc

SEQ ID NO: 442492 - DNA, 25 bp, Homo sapien
gattcctacattgcatacatctcaa

SEQ ID NO: 442493 - DNA, 25 bp, Homo sapien
atacatctcaaatgtcctacccagt

SEQ ID NO: 442494 - DNA, 25 bp, Homo sapien
atctcaaatgtcctacccagtggat

SEQ ID NO: 442495 - DNA, 25 bp, Homo sapien
aaatgtcctacccagtggatcccca

SEQ ID NO: 442496 - DNA, 25 bp, Homo sapien
tctccactctttggcttcaaattca

SEQ ID NO: 442497 - DNA, 25 bp, Homo sapien
tccactctttggcttcaaattcatt

SEQ ID NO: 442498 - DNA, 25 bp, Homo sapien
ccacaaatctgttgttagacttaac

SEQ ID NO: 442499 - DNA, 25 bp, Homo sapien
aatctgttgttagacttaactgtta

SEQ ID NO: 442500 - DNA, 25 bp, Homo sapien
tgttgactgggcttctaaaagtaaa

SEQ ID NO: 442501 - DNA, 25 bp, Homo sapien
aaagtaaaggcattaggctgtaaat

SEQ ID NO: 442502 - DNA, 25 bp, Homo sapien
ggctgtaaatgtgcttttctgcaac

SEQ ID NO: 442503 - DNA, 25 bp, Homo sapien
atgtgcttttctgcaacatgttccg

SEQ ID NO: 442504 - DNA, 25 bp, Homo sapien
gcttttctgcaacatgttccgtaaa

SEQ ID NO: 442505 - DNA, 25 bp, Homo sapien
gcaacatgttccgtaaacagcttta

SEQ ID NO: 442506 - DNA, 25 bp, Homo sapien
aacagctttataaggtcatctttta

SEQ ID NO: 442507 - DNA, 25 bp, Homo sapien
tcttttaagtctctgttaagcttgg

SEQ ID NO: 442508 - DNA, 25 bp, Homo sapien
aagtctctgttaagcttggtttcga

SEQ ID NO: 442509 - DNA, 25 bp, Homo sapien
ctctgttaagcttggtttcgatgta

SEQ ID NO: 442510 - DNA, 25 bp, Homo sapien
gcttggtttcgatgtaaaacttatt

SEQ ID NO: 442511 - DNA, 25 bp, Homo sapien
aagccatggtaaaaatagggatctg

SEQ ID NO: 442512 - DNA, 25 bp, Homo sapien
gccatggtaaaaatagggatctgtg

SEQ ID NO: 442513 - DNA, 25 bp, Homo sapien
tagggatctgtgaaggaaatttcta

SEQ ID NO: 442514 - DNA, 25 bp, Homo sapien
attggatgtattaggttttgaactc

SEQ ID NO: 442515 - DNA, 25 bp, Homo sapien
ggatgtattaggttttgaactctga

SEQ ID NO: 442516 - DNA, 25 bp, Homo sapien
atgtattaggttttgaactctgaga

SEQ ID NO: 442517 - DNA, 25 bp, Homo sapien
attaggttttgaactctgagattgc

SEQ ID NO: 442518 - DNA, 25 bp, Homo sapien
taggttttgaactctgagattgcac

SEQ ID NO: 442519 - DNA, 25 bp, Homo sapien
ctctgagattgcacaaatattcaat

SEQ ID NO: 442520 - DNA, 25 bp, Homo sapien
ttgcacaaatattcaattaacttga

SEQ ID NO: 442521 - DNA, 25 bp, Homo sapien
ttaacttgaagttgtgtacatagag

SEQ ID NO: 442522 - DNA, 25 bp, Homo sapien
tatccagagagtggaacatttttca

SEQ ID NO: 442523 - DNA, 25 bp, Homo sapien
atccagagagtggaacatttttcat

SEQ ID NO: 442524 - DNA, 25 bp, Homo sapien
ccagagagtggaacatttttcattg

SEQ ID NO: 442525 - DNA, 25 bp, Homo sapien
cagagagtggaacatttttcattgt

SEQ ID NO: 442526 - DNA, 25 bp, Homo sapien
agagagtggaacatttttcattgtt

SEQ ID NO: 442527 - DNA, 25 bp, Homo sapien
gagagtggaacatttttcattgtta

SEQ ID NO: 442528 - DNA, 25 bp, Homo sapien
gagtggaacatttttcattgttaaa

SEQ ID NO: 442529 - DNA, 25 bp, Homo sapien
attgttaaaaagaaatgagcaggcc

SEQ ID NO: 442530 - DNA, 25 bp, Homo sapien
ttgttaaaaagaaatgagcaggcca

SEQ ID NO: 442531 - DNA, 25 bp, Homo sapien
tgttaaaaagaaatgagcaggccag

SEQ ID NO: 442532 - DNA, 25 bp, Homo sapien
gttaaaaagaaatgagcaggccagg

SEQ ID NO: 442533 - DNA, 25 bp, Homo sapien
gaaacataccagattagccaccatt

SEQ ID NO: 442534 - DNA, 25 bp, Homo sapien
aacataccagattagccaccattag

SEQ ID NO: 442535 - DNA, 25 bp, Homo sapien
taccagattagccaccattagcatc

SEQ ID NO: 442536 - DNA, 25 bp, Homo sapien
cagattagccaccattagcatctat

SEQ ID NO: 442537 - DNA, 25 bp, Homo sapien
gattagccaccattagcatctatat

SEQ ID NO: 442538 - DNA, 25 bp, Homo sapien
ttagccaccattagcatctatatct

SEQ ID NO: 442539 - DNA, 25 bp, Homo sapien
gccaccattagcatctatatctact

SEQ ID NO: 442540 - DNA, 25 bp, Homo sapien
aatcaactggtaattctgaaacact

SEQ ID NO: 442541 - DNA, 25 bp, Homo sapien
actggtaattctgaaacactgtaga

SEQ ID NO: 442542 - DNA, 25 bp, Homo sapien
aagtagagtgcaggctaggctgtct

SEQ ID NO: 442543 - DNA, 25 bp, Homo sapien
agagtgcaggctaggctgtcttggg

SEQ ID NO: 442544 - DNA, 25 bp, Homo sapien
ccccatgggatcttaccagaggcat

SEQ ID NO: 442545 - DNA, 25 bp, Homo sapien
atgggatcttaccagaggcattact

SEQ ID NO: 442546 - DNA, 25 bp, Homo sapien
ggatcttaccagaggcattactgaa

SEQ ID NO: 442547 - DNA, 25 bp, Homo sapien
taccagaggcattactgaagctaaa

SEQ ID NO: 442548 - DNA, 25 bp, Homo sapien
gaagctaaatctttcaactctcccc

SEQ ID NO: 442549 - DNA, 25 bp, Homo sapien
gctaaatctttcaactctccccagt

SEQ ID NO: 442550 - DNA, 25 bp, Homo sapien
tcctcccacttacttgttctaaata

SEQ ID NO: 442551 - DNA, 25 bp, Homo sapien
cctcccacttacttgttctaaatag

SEQ ID NO: 442552 - DNA, 25 bp, Homo sapien
gagtgtcatcaatttctaccacctg

SEQ ID NO: 442553 - DNA, 25 bp, Homo sapien
ttttcctctttggaactcttgtgtt

SEQ ID NO: 442554 - DNA, 25 bp, Homo sapien
tttcctctttggaactcttgtgttg

SEQ ID NO: 442555 - DNA, 25 bp, Homo sapien
tgtatataccttttttcctactcct

SEQ ID NO: 442556 - DNA, 25 bp, Homo sapien
ctactccttccttaagttatatcat

SEQ ID NO: 442557 - DNA, 25 bp, Homo sapien
gttatatcataatgagactaccaat

SEQ ID NO: 442558 - DNA, 25 bp, Homo sapien
taatgagactaccaattattagact

SEQ ID NO: 442559 - DNA, 25 bp, Homo sapien
atgagactaccaattattagacttt

SEQ ID NO: 442560 - DNA, 25 bp, Homo sapien
gagactaccaattattagacttttt

SEQ ID NO: 442561 - DNA, 25 bp, Homo sapien
agggttccaccatgctagcaggatg

SEQ ID NO: 442562 - DNA, 25 bp, Homo sapien
gggttccaccatgctagcaggatgg

SEQ ID NO: 442563 - DNA, 25 bp, Homo sapien
ggttccaccatgctagcaggatggt

SEQ ID NO: 442564 - DNA, 25 bp, Homo sapien
gttccaccatgctagcaggatggtc

SEQ ID NO: 442565 - DNA, 25 bp, Homo sapien
ttccaccatgctagcaggatggtct

SEQ ID NO: 442566 - DNA, 25 bp, Homo sapien
ttttaatcttgttcttgttcagtat

SEQ ID NO: 442567 - DNA, 25 bp, Homo sapien
aatcttgttcttgttcagtattttg

SEQ ID NO: 442568 - DNA, 25 bp, Homo sapien
tttattgtaattgtcctgagttcta

SEQ ID NO: 442569 - DNA, 25 bp, Homo sapien
gtaattgtcctgagttctacagtat

SEQ ID NO: 442570 - DNA, 25 bp, Homo sapien
tgtcctgagttctacagtatgtgaa

SEQ ID NO: 442571 - DNA, 25 bp, Homo sapien
cagtatgtgaacaatatcgtgtgaa

SEQ ID NO: 442572 - DNA, 25 bp, Homo sapien
gtgaacaatatcgtgtgaagtgtgt

SEQ ID NO: 442573 - DNA, 25 bp, Homo sapien
tgaagtgtgtttttgcatttgtgca

SEQ ID NO: 442574 - DNA, 25 bp, Homo sapien
ttatttatgtaactagggctgtgag

SEQ ID NO: 442575 - DNA, 25 bp, Homo sapien
ctagggctgtgagtaacactttttt

SEQ ID NO: 442576 - DNA, 25 bp, Homo sapien
gcagtgtaaaagctaaacttgtttt

SEQ ID NO: 442577 - DNA, 25 bp, Homo sapien
gctccctaagtatttacttggagta

SEQ ID NO: 442578 - DNA, 25 bp, Homo sapien
ctgaagggtgtataaatcctgctct

SEQ ID NO: 442579 - DNA, 25 bp, Homo sapien
ggtgtataaatcctgctcttggtta

SEQ ID NO: 442580 - DNA, 25 bp, Homo sapien
aatcctgctcttggttagaattctc

SEQ ID NO: 442581 - DNA, 25 bp, Homo sapien
gctcttggttagaattctccttatt

SEQ ID NO: 442582 - DNA, 25 bp, Homo sapien
gaattctccttattaacagtgttat

SEQ ID NO: 442583 - DNA, 25 bp, Homo sapien
ttccttttttcagccctgtagacat

SEQ ID NO: 442584 - DNA, 25 bp, Homo sapien
agccctgtagacatgaactgatctt

SEQ ID NO: 442585 - DNA, 25 bp, Homo sapien
tagacatgaactgatcttcccttga

SEQ ID NO: 442586 - DNA, 25 bp, Homo sapien
cttcccttgaagatacaaacacatg

SEQ ID NO: 442587 - DNA, 25 bp, Homo sapien
gaagatacaaacacatggccatttt

SEQ ID NO: 442588 - DNA, 25 bp, Homo sapien
aactccaacgtctcagtcttcaaaa

SEQ ID NO: 442589 - DNA, 25 bp, Homo sapien
ctccaacgtctcagtcttcaaaatg

SEQ ID NO: 442590 - DNA, 25 bp, Homo sapien
tccaacgtctcagtcttcaaaatgg

SEQ ID NO: 442591 - DNA, 25 bp, Homo sapien
agtcttcaaaatggcatacctcaaa

SEQ ID NO: 442592 - DNA, 25 bp, Homo sapien
cttcaaaatggcatacctcaaataa

SEQ ID NO: 442593 - DNA, 25 bp, Homo sapien
aactcattatttgttcagaaccaac

SEQ ID NO: 442594 - DNA, 25 bp, Homo sapien
ttatttgttcagaaccaacagcaac

SEQ ID NO: 442595 - DNA, 25 bp, Homo sapien
taatctcttaagtcaccgggtccga

SEQ ID NO: 442596 - DNA, 25 bp, Homo sapien
aatctcttaagtcaccgggtccgag

SEQ ID NO: 442597 - DNA, 25 bp, Homo sapien
tctcttaagtcaccgggtccgagcg

SEQ ID NO: 442598 - DNA, 25 bp, Homo sapien
ttaagtcaccgggtccgagcgcggc

SEQ ID NO: 442599 - DNA, 25 bp, Homo sapien
cctatctctgtgtatctggatggca

SEQ ID NO: 442600 - DNA, 25 bp, Homo sapien
tgtgtatctggatggcagccgctgc

SEQ ID NO: 442601 - DNA, 25 bp, Homo sapien
gagggcaggtactgtctttgcctgt

SEQ ID NO: 442602 - DNA, 25 bp, Homo sapien
tactgtctttgcctgtgggtccagc

SEQ ID NO: 442603 - DNA, 25 bp, Homo sapien
tgggccttggcttcctcacttgtga

SEQ ID NO: 442604 - DNA, 25 bp, Homo sapien
tcctcacttgtgaaatgagcgggaa

SEQ ID NO: 442605 - DNA, 25 bp, Homo sapien
gagcgggaagatgactctcagttcc

SEQ ID NO: 442606 - DNA, 25 bp, Homo sapien
gaagatgactctcagttccttccac

SEQ ID NO: 442607 - DNA, 25 bp, Homo sapien
tccttccacctcttagacatggtga

SEQ ID NO: 442608 - DNA, 25 bp, Homo sapien
gacatggtgaggtaacagacatcaa

SEQ ID NO: 442609 - DNA, 25 bp, Homo sapien
gacatcaaaagcttttctgaaatct

SEQ ID NO: 442610 - DNA, 25 bp, Homo sapien
ggccctgatgcgatgtatgtgaaat

SEQ ID NO: 442611 - DNA, 25 bp, Homo sapien
aaaccacattgggtggcccaggtca

SEQ ID NO: 442612 - DNA, 25 bp, Homo sapien
ctgctgtgaatgaaaccaatgaggt

SEQ ID NO: 442613 - DNA, 25 bp, Homo sapien
agataccttcgcgtgtgctatcaaa

SEQ ID NO: 442614 - DNA, 25 bp, Homo sapien
ttcgcgtgtgctatcaaaagtatgc

SEQ ID NO: 442615 - DNA, 25 bp, Homo sapien
tatgcacgtattttatgtataaggt

SEQ ID NO: 442616 - DNA, 25 bp, Homo sapien
atgtataaggttcgctaccctaaca

SEQ ID NO: 442617 - DNA, 25 bp, Homo sapien
acagctccaccgaggttccagagct

SEQ ID NO: 442618 - DNA, 25 bp, Homo sapien
gaggttccagagctcccaattgcac

SEQ ID NO: 442619 - DNA, 25 bp, Homo sapien
aactgttaatggatgtgagcttcct

SEQ ID NO: 442620 - DNA, 25 bp, Homo sapien
taatggatgtgagcttcctagattg

SEQ ID NO: 442621 - DNA, 25 bp, Homo sapien
atgtctgtttggctaatgtaattaa

SEQ ID NO: 442622 - DNA, 25 bp, Homo sapien
atgagtgcatttcaactatgtcaat

SEQ ID NO: 442623 - DNA, 25 bp, Homo sapien
tgttttcatgtgtttatagcagaag

SEQ ID NO: 442624 - DNA, 25 bp, Homo sapien
gttatttatttctatggcattccag

SEQ ID NO: 442625 - DNA, 25 bp, Homo sapien
ggcattccagcggatattttggtgt

SEQ ID NO: 442626 - DNA, 25 bp, Homo sapien
atattttggtgtttgcgaggcatgc

SEQ ID NO: 442627 - DNA, 25 bp, Homo sapien
gcgaggcatgcagtcaatattttgt

SEQ ID NO: 442628 - DNA, 25 bp, Homo sapien
caatattttgtacagttagtggaca

SEQ ID NO: 442629 - DNA, 25 bp, Homo sapien
tagtggacagtattcagcaacgcct

SEQ ID NO: 442630 - DNA, 25 bp, Homo sapien
cagcaacgcctgatagcttctttgg

SEQ ID NO: 442631 - DNA, 25 bp, Homo sapien
gatagcttctttggccttatgttaa

SEQ ID NO: 442632 - DNA, 25 bp, Homo sapien
ctaggcaataagaatcttagggatc

SEQ ID NO: 442633 - DNA, 25 bp, Homo sapien
tcttagggatcacagattgactctt

SEQ ID NO: 442634 - DNA, 25 bp, Homo sapien
cttagggatcacagattgactcttg

SEQ ID NO: 442635 - DNA, 25 bp, Homo sapien
ttagggatcacagattgactcttgg

SEQ ID NO: 442636 - DNA, 25 bp, Homo sapien
tagggatcacagattgactcttggc

SEQ ID NO: 442637 - DNA, 25 bp, Homo sapien
agggatcacagattgactcttggct

SEQ ID NO: 442638 - DNA, 25 bp, Homo sapien
gggatcacagattgactcttggctg

SEQ ID NO: 442639 - DNA, 25 bp, Homo sapien
ggatcacagattgactcttggctgg

SEQ ID NO: 442640 - DNA, 25 bp, Homo sapien
gatcacagattgactcttggctggg

SEQ ID NO: 442641 - DNA, 25 bp, Homo sapien
acagattgactcttggctgggtgcg

SEQ ID NO: 442642 - DNA, 25 bp, Homo sapien
aagcgtggtggcatgccccgaagtc

SEQ ID NO: 442643 - DNA, 25 bp, Homo sapien
cgcaggaatcccctgtatgttcagg

SEQ ID NO: 442644 - DNA, 25 bp, Homo sapien
atcccctgtatgttcagggctgtga

SEQ ID NO: 442645 - DNA, 25 bp, Homo sapien
agggctgtgagctgccaccctattc

SEQ ID NO: 442646 - DNA, 25 bp, Homo sapien
tattccgcctgctccgtctttgtgg

SEQ ID NO: 442647 - DNA, 25 bp, Homo sapien
aggcttggcacagccctgacttgaa

SEQ ID NO: 442648 - DNA, 25 bp, Homo sapien
acagccctgacttgaactctgggtg

SEQ ID NO: 442649 - DNA, 25 bp, Homo sapien
tgacttgaactctgggtgaccctgg

SEQ ID NO: 442650 - DNA, 25 bp, Homo sapien
aggcaggaaaactggcgcaaatttc

SEQ ID NO: 442651 - DNA, 25 bp, Homo sapien
aaactggcgcaaatttcctgggcct

SEQ ID NO: 442652 - DNA, 25 bp, Homo sapien
tccctctgacttctgggcgccagat

SEQ ID NO: 442653 - DNA, 25 bp, Homo sapien
acttctgggcgccagatcctgccgt

SEQ ID NO: 442654 - DNA, 25 bp, Homo sapien
ctgagggccggttgctattagcata

SEQ ID NO: 442655 - DNA, 25 bp, Homo sapien
agggccggttgctattagcatagat

SEQ ID NO: 442656 - DNA, 25 bp, Homo sapien
ccagtgtacatcataccaaggtact

SEQ ID NO: 442657 - DNA, 25 bp, Homo sapien
gtgtacatcataccaaggtacttca

SEQ ID NO: 442658 - DNA, 25 bp, Homo sapien
ccaaggtacttcataacctgccccg

SEQ ID NO: 442659 - DNA, 25 bp, Homo sapien
gccgaataccgaaccactcacgctg

SEQ ID NO: 442660 - DNA, 25 bp, Homo sapien
cactcacgctgctgtcataagactg

SEQ ID NO: 442661 - DNA, 25 bp, Homo sapien
tcacgctgctgtcataagactggca

SEQ ID NO: 442662 - DNA, 25 bp, Homo sapien
acgctgctgtcataagactggcagt

SEQ ID NO: 442663 - DNA, 25 bp, Homo sapien
tgctgtcataagactggcagtatta

SEQ ID NO: 442664 - DNA, 25 bp, Homo sapien
aagactggcagtattaatcagcctc

SEQ ID NO: 442665 - DNA, 25 bp, Homo sapien
gtttcaaacctacaagcaaattcat

SEQ ID NO: 442666 - DNA, 25 bp, Homo sapien
caagcaaattcattccaagaagtga

SEQ ID NO: 442667 - DNA, 25 bp, Homo sapien
ataaaaagtttccaggccagtgact

SEQ ID NO: 442668 - DNA, 25 bp, Homo sapien
caggccagtgacttgtttaattaca

SEQ ID NO: 442669 - DNA, 25 bp, Homo sapien
tcacatttttacattcactttgcct

SEQ ID NO: 442670 - DNA, 25 bp, Homo sapien
ttttacattcactttgcctttcaaa

SEQ ID NO: 442671 - DNA, 25 bp, Homo sapien
cattcactttgcctttcaaagcagg

SEQ ID NO: 442672 - DNA, 25 bp, Homo sapien
ctttcaaagcaggagtattttataa

SEQ ID NO: 442673 - DNA, 25 bp, Homo sapien
aactttaaattgtcaagctggtgct

SEQ ID NO: 442674 - DNA, 25 bp, Homo sapien
caagctggtgcttaaagttatgtaa

SEQ ID NO: 442675 - DNA, 25 bp, Homo sapien
ggacagggagcttcctaggtctgtt

SEQ ID NO: 442676 - DNA, 25 bp, Homo sapien
aggagagattgttctcaccaacccg

SEQ ID NO: 442677 - DNA, 25 bp, Homo sapien
agagattgttctcaccaacccgctg

SEQ ID NO: 442678 - DNA, 25 bp, Homo sapien
tgccttcatgctgccttcaaagcta

SEQ ID NO: 442679 - DNA, 25 bp, Homo sapien
catgctgccttcaaagctagatcat

SEQ ID NO: 442680 - DNA, 25 bp, Homo sapien
gctagatcatgtttgccttgcttag

SEQ ID NO: 442681 - DNA, 25 bp, Homo sapien
catgtttgccttgcttagagaatta

SEQ ID NO: 442682 - DNA, 25 bp, Homo sapien
attactgcaaatcagccccagtgct

SEQ ID NO: 442683 - DNA, 25 bp, Homo sapien
aaatcagccccagtgcttggcgatg

SEQ ID NO: 442684 - DNA, 25 bp, Homo sapien
cagtgcttggcgatgcatttacaga

SEQ ID NO: 442685 - DNA, 25 bp, Homo sapien
atttacagatttctaggccctcagg

SEQ ID NO: 442686 - DNA, 25 bp, Homo sapien
tcttctgctggatgctgcttgtaat

SEQ ID NO: 442687 - DNA, 25 bp, Homo sapien
ctgggcccttctgggactgtgcgct

SEQ ID NO: 442688 - DNA, 25 bp, Homo sapien
gggactgtgcgctggacttggagcc

SEQ ID NO: 442689 - DNA, 25 bp, Homo sapien
ggagtatggcttttcacacgggctt

SEQ ID NO: 442690 - DNA, 25 bp, Homo sapien
atggcttttcacacgggcttctata

SEQ ID NO: 442691 - DNA, 25 bp, Homo sapien
tttcacacgggcttctataccgctt

SEQ ID NO: 442692 - DNA, 25 bp, Homo sapien
gcttctataccgcttcgactggaag

SEQ ID NO: 442693 - DNA, 25 bp, Homo sapien
cactgccttttctcactcagatggg

SEQ ID NO: 442694 - DNA, 25 bp, Homo sapien
gacaccgaggtccagaggaaaagac

SEQ ID NO: 442695 - DNA, 25 bp, Homo sapien
ggaaaagacacctgtcaaatgtcac

SEQ ID NO: 442696 - DNA, 25 bp, Homo sapien
gacacctgtcaaatgtcacagatct

SEQ ID NO: 442697 - DNA, 25 bp, Homo sapien
gtcaaatgtcacagatctgggaggg

SEQ ID NO: 442698 - DNA, 25 bp, Homo sapien
cttaagtttctgttgagtcccctga

SEQ ID NO: 442699 - DNA, 25 bp, Homo sapien
gagtcccctgattaggatcacagac

SEQ ID NO: 442700 - DNA, 25 bp, Homo sapien
catccggtccaatccttgaggtttc

SEQ ID NO: 442701 - DNA, 25 bp, Homo sapien
ttgaggtttcctcagcagcacttcc

SEQ ID NO: 442702 - DNA, 25 bp, Homo sapien
tttgctcaccattgaggaagctgcc

SEQ ID NO: 442703 - DNA, 25 bp, Homo sapien
attgaggaagctgcccgttttattc

SEQ ID NO: 442704 - DNA, 25 bp, Homo sapien
ttttattcccagctccatgtgttct

SEQ ID NO: 442705 - DNA, 25 bp, Homo sapien
tggccctagattctacttccaaaac

SEQ ID NO: 442706 - DNA, 25 bp, Homo sapien
ttctacttccaaaacgacagagttg

SEQ ID NO: 442707 - DNA, 25 bp, Homo sapien
cagagttggtctaatttctctttcc

SEQ ID NO: 442708 - DNA, 25 bp, Homo sapien
tctctttcctgagcaaatcttttaa

SEQ ID NO: 442709 - DNA, 25 bp, Homo sapien
agttgaaaaaactgtctgggactgg

SEQ ID NO: 442710 - DNA, 25 bp, Homo sapien
gttgaaaaaactgtctgggactggg

SEQ ID NO: 442711 - DNA, 25 bp, Homo sapien
gtctgggactgggaacttatgaatg

SEQ ID NO: 442712 - DNA, 25 bp, Homo sapien
ctgggactgggaacttatgaatgat

SEQ ID NO: 442713 - DNA, 25 bp, Homo sapien
tgggactgggaacttatgaatgata

SEQ ID NO: 442714 - DNA, 25 bp, Homo sapien
gggactgggaacttatgaatgatat

SEQ ID NO: 442715 - DNA, 25 bp, Homo sapien
ggactgggaacttatgaatgatatc

SEQ ID NO: 442716 - DNA, 25 bp, Homo sapien
atgtatggagcagcaagactgaaac

SEQ ID NO: 442717 - DNA, 25 bp, Homo sapien
tgtatggagcagcaagactgaaact

SEQ ID NO: 442718 - DNA, 25 bp, Homo sapien
atggagcagcaagactgaaactgtt

SEQ ID NO: 442719 - DNA, 25 bp, Homo sapien
tggagcagcaagactgaaactgttg

SEQ ID NO: 442720 - DNA, 25 bp, Homo sapien
gacaaggcctggtggaaatcgttcc

SEQ ID NO: 442721 - DNA, 25 bp, Homo sapien
tggaaatcgttcctcaaccacctca

SEQ ID NO: 442722 - DNA, 25 bp, Homo sapien
tcactcggaagaagccggctaccag

SEQ ID NO: 442723 - DNA, 25 bp, Homo sapien
aagaagccggctaccaggatcgtgc

SEQ ID NO: 442724 - DNA, 25 bp, Homo sapien
ggctaccaggatcgtgctgattctc

SEQ ID NO: 442725 - DNA, 25 bp, Homo sapien
ctggccaacgctgggcaacggattg

SEQ ID NO: 442726 - DNA, 25 bp, Homo sapien
tgggcaacggattgactacgcgtcc

SEQ ID NO: 442727 - DNA, 25 bp, Homo sapien
attgactacgcgtccggcgctgggc

SEQ ID NO: 442728 - DNA, 25 bp, Homo sapien
gccctgccatgggaaactatagttc

SEQ ID NO: 442729 - DNA, 25 bp, Homo sapien
tagttcccacaaaaggaccaaagca

SEQ ID NO: 442730 - DNA, 25 bp, Homo sapien
aaagcacccaagcaggcccgcaagg

SEQ ID NO: 442731 - DNA, 25 bp, Homo sapien
tgttcatgttttccattccactcaa

SEQ ID NO: 442732 - DNA, 25 bp, Homo sapien
catgttttccattccactcaacaaa

SEQ ID NO: 442733 - DNA, 25 bp, Homo sapien
tgttttccattccactcaacaaata

SEQ ID NO: 442734 - DNA, 25 bp, Homo sapien
attccactcaacaaatatcacttaa

SEQ ID NO: 442735 - DNA, 25 bp, Homo sapien
taaaaacagtacagttggtgatttc

SEQ ID NO: 442736 - DNA, 25 bp, Homo sapien
aatcataaatatgtactgcggagtg

SEQ ID NO: 442737 - DNA, 25 bp, Homo sapien
gtactgcggagtgaaaaaaccaact

SEQ ID NO: 442738 - DNA, 25 bp, Homo sapien
aaaaccaactacttaactatgatga

SEQ ID NO: 442739 - DNA, 25 bp, Homo sapien
cttaactatgatgaaatgggaactt

SEQ ID NO: 442740 - DNA, 25 bp, Homo sapien
gttaaatttgtagggataggccagg

SEQ ID NO: 442741 - DNA, 25 bp, Homo sapien
tggccttggcctccctagtctggga

SEQ ID NO: 442742 - DNA, 25 bp, Homo sapien
cctcactggaattctcaccaaaaat

SEQ ID NO: 442743 - DNA, 25 bp, Homo sapien
tcactggaattctcaccaaaaatag

SEQ ID NO: 442744 - DNA, 25 bp, Homo sapien
aacagaagtaaatacttttctcaat

SEQ ID NO: 442745 - DNA, 25 bp, Homo sapien
attgttttggctatgcaaatatttg

SEQ ID NO: 442746 - DNA, 25 bp, Homo sapien
atttacacttctcagcaaatgtagt

SEQ ID NO: 442747 - DNA, 25 bp, Homo sapien
cacttctcagcaaatgtagttgcaa

SEQ ID NO: 442748 - DNA, 25 bp, Homo sapien
atgtagttgcaaacaaatgctttct

SEQ ID NO: 442749 - DNA, 25 bp, Homo sapien
tggtttgaggtatgtaaatagccaa

SEQ ID NO: 442750 - DNA, 25 bp, Homo sapien
ttatcccttgtatgatattactcaa

SEQ ID NO: 442751 - DNA, 25 bp, Homo sapien
tattactcaaaaaatccctgtgtat

SEQ ID NO: 442752 - DNA, 25 bp, Homo sapien
aatccctgtgtatatgaaagtgcat

SEQ ID NO: 442753 - DNA, 25 bp, Homo sapien
ctgcaggctaccaatcacgttagaa

SEQ ID NO: 442754 - DNA, 25 bp, Homo sapien
gaaatctgattaaggcactagagac

SEQ ID NO: 442755 - DNA, 25 bp, Homo sapien
aaggcactagagacaaaggaaccca

SEQ ID NO: 442756 - DNA, 25 bp, Homo sapien
attattgtggttagccgactggtaa

SEQ ID NO: 442757 - DNA, 25 bp, Homo sapien
ttagccgactggtaagaaggttctt

SEQ ID NO: 442758 - DNA, 25 bp, Homo sapien
ttctttcctggttctgaaatggtgc

SEQ ID NO: 442759 - DNA, 25 bp, Homo sapien
ctggttctgaaatggtgcttctccc

SEQ ID NO: 442760 - DNA, 25 bp, Homo sapien
aggaagctccttgagtgccttaccc

SEQ ID NO: 442761 - DNA, 25 bp, Homo sapien
cttctgggctcaaacttgtccttta

SEQ ID NO: 442762 - DNA, 25 bp, Homo sapien
tggctcatatcctgctggcctactt

SEQ ID NO: 442763 - DNA, 25 bp, Homo sapien
tttgcctctggctgatactgggaca

SEQ ID NO: 442764 - DNA, 25 bp, Homo sapien
cttacctcatagagctgttgtgaaa

SEQ ID NO: 442765 - DNA, 25 bp, Homo sapien
agctgttgtgaaaagtgatgactga

SEQ ID NO: 442766 - DNA, 25 bp, Homo sapien
gaatatgtaaaagcacctagaacag

SEQ ID NO: 442767 - DNA, 25 bp, Homo sapien
gcctggcacatgctaagtgctttgt

SEQ ID NO: 442768 - DNA, 25 bp, Homo sapien
agtgctttgttcattattgttgtta

SEQ ID NO: 442769 - DNA, 25 bp, Homo sapien
tctctcagactgagagcactgttag

SEQ ID NO: 442770 - DNA, 25 bp, Homo sapien
gcactgttagtgacccaagtaaatt

SEQ ID NO: 442771 - DNA, 25 bp, Homo sapien
ttaaatcttgactctgccacatact

SEQ ID NO: 442772 - DNA, 25 bp, Homo sapien
tcttgactctgccacatactagctg

SEQ ID NO: 442773 - DNA, 25 bp, Homo sapien
ccacatactagctgtctgactgaac

SEQ ID NO: 442774 - DNA, 25 bp, Homo sapien
tagctgtctgactgaaccttggttt

SEQ ID NO: 442775 - DNA, 25 bp, Homo sapien
gatttactgtttatgtcttcctaag

SEQ ID NO: 442776 - DNA, 25 bp, Homo sapien
ctgtttatgtcttcctaagcctttt

SEQ ID NO: 442777 - DNA, 25 bp, Homo sapien
tatactatatcacaccatgtcaggt

SEQ ID NO: 442778 - DNA, 25 bp, Homo sapien
gtcaggttttgtgcctctgagaatt

SEQ ID NO: 442779 - DNA, 25 bp, Homo sapien
gtgcctctgagaattgcagtaatcc

SEQ ID NO: 442780 - DNA, 25 bp, Homo sapien
gcagtaatccaataacttttgtata

SEQ ID NO: 442781 - DNA, 25 bp, Homo sapien
ttttgtatatgtgtgctccttgatc

SEQ ID NO: 442782 - DNA, 25 bp, Homo sapien
atatgtgtgctccttgatcatcaga

SEQ ID NO: 442783 - DNA, 25 bp, Homo sapien
atattatggccatcttatggcggat

SEQ ID NO: 442784 - DNA, 25 bp, Homo sapien
cttatggcggatattttgggagttt

SEQ ID NO: 442785 - DNA, 25 bp, Homo sapien
ttgcaaacatggtcattcattttct

SEQ ID NO: 442786 - DNA, 25 bp, Homo sapien
ggcatgagcctgatttacaggcact

SEQ ID NO: 442787 - DNA, 25 bp, Homo sapien
gatttacaggcactgatttctgaca

SEQ ID NO: 442788 - DNA, 25 bp, Homo sapien
gatttctgacaatacatccttacta

SEQ ID NO: 442789 - DNA, 25 bp, Homo sapien
acatccttactatatatccaaaact

SEQ ID NO: 442790 - DNA, 25 bp, Homo sapien
tcctacgatactattctatttctgt

SEQ ID NO: 442791 - DNA, 25 bp, Homo sapien
taaaatctgcttgaacagcccattt

SEQ ID NO: 442792 - DNA, 25 bp, Homo sapien
tctgcttgaacagcccattttgaca

SEQ ID NO: 442793 - DNA, 25 bp, Homo sapien
ctctgtgtcagtgtttattgtctta

SEQ ID NO: 442794 - DNA, 25 bp, Homo sapien
tattgtcttagatttaccccctgca

SEQ ID NO: 442795 - DNA, 25 bp, Homo sapien
catgcagaagtgactgcatagtcac

SEQ ID NO: 442796 - DNA, 25 bp, Homo sapien
gtttgaaatctgtttggagagctat

SEQ ID NO: 442797 - DNA, 25 bp, Homo sapien
gaatttggtgcatatgtactgctga

SEQ ID NO: 442798 - DNA, 25 bp, Homo sapien
ggtgcatatgtactgctgaataaag

SEQ ID NO: 442799 - DNA, 25 bp, Homo sapien
acacaagttgccataatagtataaa

SEQ ID NO: 442800 - DNA, 25 bp, Homo sapien
atgtgcttaaaaggccatccttttc

SEQ ID NO: 442801 - DNA, 25 bp, Homo sapien
aaaaggccatccttttcattttcag

SEQ ID NO: 442802 - DNA, 25 bp, Homo sapien
gatctttgcatgaggtaaatctaca

SEQ ID NO: 442803 - DNA, 25 bp, Homo sapien
ggtaaatctacagcatagttcattt

SEQ ID NO: 442804 - DNA, 25 bp, Homo sapien
tagattttgttgagtcctgtaaaga

SEQ ID NO: 442805 - DNA, 25 bp, Homo sapien
aagtttcagttgtggtagaataccg

SEQ ID NO: 442806 - DNA, 25 bp, Homo sapien
ggtagaataccgtgctgtgtttaaa

SEQ ID NO: 442807 - DNA, 25 bp, Homo sapien
accgtgctgtgtttaaatgttactt

SEQ ID NO: 442808 - DNA, 25 bp, Homo sapien
tgggcggcaccctcgatggggtcta

SEQ ID NO: 442809 - DNA, 25 bp, Homo sapien
atggggtctaccctaccctcatgga

SEQ ID NO: 442810 - DNA, 25 bp, Homo sapien
gggtctaccctaccctcatggagcc

SEQ ID NO: 442811 - DNA, 25 bp, Homo sapien
tcatggagcccgtcttgctgcccaa

SEQ ID NO: 442812 - DNA, 25 bp, Homo sapien
atggagcccgtcttgctgcccaagg

SEQ ID NO: 442813 - DNA, 25 bp, Homo sapien
tggagcccgtcttgctgcccaagga

SEQ ID NO: 442814 - DNA, 25 bp, Homo sapien
agagcggccccgagcagacaccggc

SEQ ID NO: 442815 - DNA, 25 bp, Homo sapien
cccgagcagacaccggccatgcctt

SEQ ID NO: 442816 - DNA, 25 bp, Homo sapien
ggcccctagtgcctcctgtctctgg

SEQ ID NO: 442817 - DNA, 25 bp, Homo sapien
ctgtctctggccacgccaccatcgc

SEQ ID NO: 442818 - DNA, 25 bp, Homo sapien
ctgcgaagaacctcgcacctcacca

SEQ ID NO: 442819 - DNA, 25 bp, Homo sapien
agccgaccactcatagcgggagtga

SEQ ID NO: 442820 - DNA, 25 bp, Homo sapien
gggagtgactgaaacaaccacagca

SEQ ID NO: 442821 - DNA, 25 bp, Homo sapien
aaccacagcatctgtaggctcctgc

SEQ ID NO: 442822 - DNA, 25 bp, Homo sapien
ggcaggcgttacaggacccatggaa

SEQ ID NO: 442823 - DNA, 25 bp, Homo sapien
ggacccatggaaaagacagcctcga

SEQ ID NO: 442824 - DNA, 25 bp, Homo sapien
acagcctcgacgtaatggatcccag

SEQ ID NO: 442825 - DNA, 25 bp, Homo sapien
gggaatgctgtatgtgcccctcttt

SEQ ID NO: 442826 - DNA, 25 bp, Homo sapien
gtatgtgcccctctttgtataagat

SEQ ID NO: 442827 - DNA, 25 bp, Homo sapien
ccagttctgagtgacagcgcaggct

SEQ ID NO: 442828 - DNA, 25 bp, Homo sapien
tgagtgacagcgcaggctcaccctg

SEQ ID NO: 442829 - DNA, 25 bp, Homo sapien
gagggttttgtgaacaagcctgaga

SEQ ID NO: 442830 - DNA, 25 bp, Homo sapien
gaactactgacaacgaaggccgcga

SEQ ID NO: 442831 - DNA, 25 bp, Homo sapien
aacgaaggccgcgactgcctctccc

SEQ ID NO: 442832 - DNA, 25 bp, Homo sapien
ctcccatctgtctatctggctggca

SEQ ID NO: 442833 - DNA, 25 bp, Homo sapien
agaacttgcatgttggtgaaggaag

SEQ ID NO: 442834 - DNA, 25 bp, Homo sapien
gggtgggacaacagtgaaatctaaa

SEQ ID NO: 442835 - DNA, 25 bp, Homo sapien
taaagtaaaaccaagctggcccaag

SEQ ID NO: 442836 - DNA, 25 bp, Homo sapien
ccaaggtgtcctgcaggctgtaatg

SEQ ID NO: 442837 - DNA, 25 bp, Homo sapien
aaggtgtcctgcaggctgtaatgca

SEQ ID NO: 442838 - DNA, 25 bp, Homo sapien
gagtgccatttttttcttgttgttc

SEQ ID NO: 442839 - DNA, 25 bp, Homo sapien
tttcttgttgttcaaatgattttaa

SEQ ID NO: 442840 - DNA, 25 bp, Homo sapien
aattattggaatgcacaatttttta

SEQ ID NO: 442841 - DNA, 25 bp, Homo sapien
taattgggctaatttttcctgaatc

SEQ ID NO: 442842 - DNA, 25 bp, Homo sapien
ttacaaaactggtcatcatccacct

SEQ ID NO: 442843 - DNA, 25 bp, Homo sapien
aatctgactctcaatttctgcagag

SEQ ID NO: 442844 - DNA, 25 bp, Homo sapien
gactggtgagctttcaggactggtt

SEQ ID NO: 442845 - DNA, 25 bp, Homo sapien
aggactggttcagcatccaccgctt

SEQ ID NO: 442846 - DNA, 25 bp, Homo sapien
tccaccgcttttttagcaaccatta

SEQ ID NO: 442847 - DNA, 25 bp, Homo sapien
acatctgtttccgatatttgctcat

SEQ ID NO: 442848 - DNA, 25 bp, Homo sapien
taagttccaaagcatcctggtgttc

SEQ ID NO: 442849 - DNA, 25 bp, Homo sapien
aaggaaatccatagctctctgtttt

SEQ ID NO: 442850 - DNA, 25 bp, Homo sapien
ctgttttcctgttgcaagtctctaa

SEQ ID NO: 442851 - DNA, 25 bp, Homo sapien
gcaagtctctaatctgtgtgttctc

SEQ ID NO: 442852 - DNA, 25 bp, Homo sapien
aacaggtttctgtccaggcagtgca

SEQ ID NO: 442853 - DNA, 25 bp, Homo sapien
aaacagggctttgcacagcccttga

SEQ ID NO: 442854 - DNA, 25 bp, Homo sapien
ggtttagccaccaactttctccaat

SEQ ID NO: 442855 - DNA, 25 bp, Homo sapien
gccaccaactttctccaattttatt

SEQ ID NO: 442856 - DNA, 25 bp, Homo sapien
ttattcctcagactgcgctgcaaaa

SEQ ID NO: 442857 - DNA, 25 bp, Homo sapien
tgatggcctagaggagggctcccca

SEQ ID NO: 442858 - DNA, 25 bp, Homo sapien
acagcccttgaatcttctcgggatg

SEQ ID NO: 442859 - DNA, 25 bp, Homo sapien
aaggcgagaattggagagcacccct

SEQ ID NO: 442860 - DNA, 25 bp, Homo sapien
gaatcttctcgggatgtctttccct

SEQ ID NO: 442861 - DNA, 25 bp, Homo sapien
tgggccagagagtccctttcaccct

SEQ ID NO: 442862 - DNA, 25 bp, Homo sapien
ttcacccttgcgctaacaggtttct

SEQ ID NO: 442863 - DNA, 25 bp, Homo sapien
tatggtaacaacaatcgggcctcag

SEQ ID NO: 442864 - DNA, 25 bp, Homo sapien
atggtaacaacaatcgggcctcagg

SEQ ID NO: 442865 - DNA, 25 bp, Homo sapien
tggtaacaacaatcgggcctcaggg

SEQ ID NO: 442866 - DNA, 25 bp, Homo sapien
agaggctgattattacagccagtcc

SEQ ID NO: 442867 - DNA, 25 bp, Homo sapien
gtacactggtatctgcaacttccag

SEQ ID NO: 442868 - DNA, 25 bp, Homo sapien
tacactggtatctgcaacttccagg

SEQ ID NO: 442869 - DNA, 25 bp, Homo sapien
acactggtatctgcaacttccagga

SEQ ID NO: 442870 - DNA, 25 bp, Homo sapien
cactggtatctgcaacttccaggaa

SEQ ID NO: 442871 - DNA, 25 bp, Homo sapien
actggtatctgcaacttccaggaac

SEQ ID NO: 442872 - DNA, 25 bp, Homo sapien
tggtatctgcaacttccaggaacag

SEQ ID NO: 442873 - DNA, 25 bp, Homo sapien
ggtatctgcaacttccaggaacagc

SEQ ID NO: 442874 - DNA, 25 bp, Homo sapien
acattagttttctgtcatcctgggc

SEQ ID NO: 442875 - DNA, 25 bp, Homo sapien
ttttctgtcatcctgggccaagtac

SEQ ID NO: 442876 - DNA, 25 bp, Homo sapien
gggccaagtacctcattacagtaaa

SEQ ID NO: 442877 - DNA, 25 bp, Homo sapien
ttacagtaaatgtgtgtctttggaa

SEQ ID NO: 442878 - DNA, 25 bp, Homo sapien
tctttggaaactctttgcttgtgct

SEQ ID NO: 442879 - DNA, 25 bp, Homo sapien
gaaactctttgcttgtgctgatggc

SEQ ID NO: 442880 - DNA, 25 bp, Homo sapien
tctttgcttgtgctgatggcggtaa

SEQ ID NO: 442881 - DNA, 25 bp, Homo sapien
gggtcccaggcaggttcaaaggctg

SEQ ID NO: 442882 - DNA, 25 bp, Homo sapien
aatgggcaagacaatacattttgtt

SEQ ID NO: 442883 - DNA, 25 bp, Homo sapien
gaaggaatttctcatgggataagtt

SEQ ID NO: 442884 - DNA, 25 bp, Homo sapien
ggataagtttcccaaagcttgaatt

SEQ ID NO: 442885 - DNA, 25 bp, Homo sapien
ttcacactggagtatgactgctgca

SEQ ID NO: 442886 - DNA, 25 bp, Homo sapien
cagctggagccattcaagacttgac

SEQ ID NO: 442887 - DNA, 25 bp, Homo sapien
aagacttgacaactactggagacag

SEQ ID NO: 442888 - DNA, 25 bp, Homo sapien
actactggagacagggcttcgcgct

SEQ ID NO: 442889 - DNA, 25 bp, Homo sapien
gatccctggagcaacgacagagcca

SEQ ID NO: 442890 - DNA, 25 bp, Homo sapien
acagagccaacattcgagtcgggtg

SEQ ID NO: 442891 - DNA, 25 bp, Homo sapien
gaacagaggagtgccgttgctcttg

SEQ ID NO: 442892 - DNA, 25 bp, Homo sapien
tgctcttggatggtttacgcggcaa

SEQ ID NO: 442893 - DNA, 25 bp, Homo sapien
gtttacgcggcaaaacagcccgagt

SEQ ID NO: 442894 - DNA, 25 bp, Homo sapien
aacagcccgagtagttcagaggaga

SEQ ID NO: 442895 - DNA, 25 bp, Homo sapien
aaaaggccaatctatgagggtgcaa

SEQ ID NO: 442896 - DNA, 25 bp, Homo sapien
agttatgtagggacgcagctctcca

SEQ ID NO: 442897 - DNA, 25 bp, Homo sapien
tccactgtgcgcgactgcgaggctg

SEQ ID NO: 442898 - DNA, 25 bp, Homo sapien
agacaccagcatttgccacaatgct

SEQ ID NO: 442899 - DNA, 25 bp, Homo sapien
ttgccacaatgctgtcatccactga

SEQ ID NO: 442900 - DNA, 25 bp, Homo sapien
catccactgactttacatttgcttc

SEQ ID NO: 442901 - DNA, 25 bp, Homo sapien
tgactttacatttgcttcctgggag

SEQ ID NO: 442902 - DNA, 25 bp, Homo sapien
ttcctgggagcttgtggtccgcgtt

SEQ ID NO: 442903 - DNA, 25 bp, Homo sapien
tccgcgttgaccatcccaatgaaga

SEQ ID NO: 442904 - DNA, 25 bp, Homo sapien
gaccatcccaatgaagagcagcaga

SEQ ID NO: 442905 - DNA, 25 bp, Homo sapien
gagcagcagaaagacgtcacactga

SEQ ID NO: 442906 - DNA, 25 bp, Homo sapien
acactgagagtatctggagaccttc

SEQ ID NO: 442907 - DNA, 25 bp, Homo sapien
tgactgcttctaacagcgaccattt

SEQ ID NO: 442908 - DNA, 25 bp, Homo sapien
gcttctaacagcgaccatttcatta

SEQ ID NO: 442909 - DNA, 25 bp, Homo sapien
taacagcgaccatttcattaagttt

SEQ ID NO: 442910 - DNA, 25 bp, Homo sapien
tcattaagtttttaagtgcctggta

SEQ ID NO: 442911 - DNA, 25 bp, Homo sapien
agtgcctggtaattgcttggttatg

SEQ ID NO: 442912 - DNA, 25 bp, Homo sapien
ttgcttggttatgaccggtgtctgc

SEQ ID NO: 442913 - DNA, 25 bp, Homo sapien
tgaccggtgtctgctccatggcagc

SEQ ID NO: 442914 - DNA, 25 bp, Homo sapien
cttcctgaagaaatgctgaggcagt

SEQ ID NO: 442915 - DNA, 25 bp, Homo sapien
gcagtgtcacgctggtgtctgtcct

SEQ ID NO: 442916 - DNA, 25 bp, Homo sapien
tgtcctccttacagaatgcctgaac

SEQ ID NO: 442917 - DNA, 25 bp, Homo sapien
gtgttctatccacaggtaaaaaaca

SEQ ID NO: 442918 - DNA, 25 bp, Homo sapien
agttgcattctaactctgctgcatc

SEQ ID NO: 442919 - DNA, 25 bp, Homo sapien
tgcatcctctctgggtctttcagca

SEQ ID NO: 442920 - DNA, 25 bp, Homo sapien
acttgtccccactggatctcagttt

SEQ ID NO: 442921 - DNA, 25 bp, Homo sapien
aaagaggaggagtcacctctccctc

SEQ ID NO: 442922 - DNA, 25 bp, Homo sapien
ccctctcagggttcttgtgaggaca

SEQ ID NO: 442923 - DNA, 25 bp, Homo sapien
ggacagagagctcctgacgtgcaat

SEQ ID NO: 442924 - DNA, 25 bp, Homo sapien
tgaacaccatggcaggccaggcata

SEQ ID NO: 442925 - DNA, 25 bp, Homo sapien
caggcatacagcaggagctcggcca

SEQ ID NO: 442926 - DNA, 25 bp, Homo sapien
cagtgtctgctgttggcgttgtttt

SEQ ID NO: 442927 - DNA, 25 bp, Homo sapien
tttgttgttttcattctccagtcag

SEQ ID NO: 442928 - DNA, 25 bp, Homo sapien
cattctccagtcagttgcattctaa

SEQ ID NO: 442929 - DNA, 25 bp, Homo sapien
acacggacctttgcttgctagcgga

SEQ ID NO: 442930 - DNA, 25 bp, Homo sapien
acggacctttgcttgctagcggaga

SEQ ID NO: 442931 - DNA, 25 bp, Homo sapien
ggacctttgcttgctagcggagagt

SEQ ID NO: 442932 - DNA, 25 bp, Homo sapien
acctttgcttgctagcggagagtgc

SEQ ID NO: 442933 - DNA, 25 bp, Homo sapien
cttgctagcggagagtgcggacacc

SEQ ID NO: 442934 - DNA, 25 bp, Homo sapien
tgctagcggagagtgcggacaccat

SEQ ID NO: 442935 - DNA, 25 bp, Homo sapien
gagagtgcggacaccatgttcccag

SEQ ID NO: 442936 - DNA, 25 bp, Homo sapien
atgttcccagctcagtaccaaagag

SEQ ID NO: 442937 - DNA, 25 bp, Homo sapien
agccttcaggctgggcgccatcccg

SEQ ID NO: 442938 - DNA, 25 bp, Homo sapien
gtaaaagcctccattggcaaatgca

SEQ ID NO: 442939 - DNA, 25 bp, Homo sapien
tccattggcaaatgcagtccttccc

SEQ ID NO: 442940 - DNA, 25 bp, Homo sapien
gcatttgccactggatttgcactgc

SEQ ID NO: 442941 - DNA, 25 bp, Homo sapien
tttgcactgcatcgtttggagatac

SEQ ID NO: 442942 - DNA, 25 bp, Homo sapien
gagcagttcttggtcagaaccctcc

SEQ ID NO: 442943 - DNA, 25 bp, Homo sapien
aaccctcctctgcttttcattgtgt

SEQ ID NO: 442944 - DNA, 25 bp, Homo sapien
ataatggttactgggtccttctctc

SEQ ID NO: 442945 - DNA, 25 bp, Homo sapien
cttctctcaagggtagcaaggccaa

SEQ ID NO: 442946 - DNA, 25 bp, Homo sapien
ggctgcttgtttaggaggccatcag

SEQ ID NO: 442947 - DNA, 25 bp, Homo sapien
gccatcagttccttcctgtggagaa

SEQ ID NO: 442948 - DNA, 25 bp, Homo sapien
agggcttacatccactgagttctaa

SEQ ID NO: 442949 - DNA, 25 bp, Homo sapien
gagttctaagattcctttcctgatc

SEQ ID NO: 442950 - DNA, 25 bp, Homo sapien
ctacgcctggtctgtatggtggaat

SEQ ID NO: 442951 - DNA, 25 bp, Homo sapien
cctggacgagatgcggcgcctggtg

SEQ ID NO: 442952 - DNA, 25 bp, Homo sapien
agatgcggcgcctggtggccttcct

SEQ ID NO: 442953 - DNA, 25 bp, Homo sapien
tggccttcctcaaccagggccaggg

SEQ ID NO: 442954 - DNA, 25 bp, Homo sapien
ttcggccaggccactgtgtgcccct

SEQ ID NO: 442955 - DNA, 25 bp, Homo sapien
gggccctgccctgacaagtgcgccg

SEQ ID NO: 442956 - DNA, 25 bp, Homo sapien
cctccgcgctttgcaaacactgtca

SEQ ID NO: 442957 - DNA, 25 bp, Homo sapien
tgtgactgtctctctgcccggacag

SEQ ID NO: 442958 - DNA, 25 bp, Homo sapien
gactgtctctctgcccggacaggaa

SEQ ID NO: 442959 - DNA, 25 bp, Homo sapien
tctctgcccggacaggaaaggcctg

SEQ ID NO: 442960 - DNA, 25 bp, Homo sapien
tctgcccggacaggaaaggcctgga

SEQ ID NO: 442961 - DNA, 25 bp, Homo sapien
caggaaaggcctggagggaccctgc

SEQ ID NO: 442962 - DNA, 25 bp, Homo sapien
gtgcaaacttaaacctacaagatcg

SEQ ID NO: 442963 - DNA, 25 bp, Homo sapien
gtaagttctataagagccaacctat

SEQ ID NO: 442964 - DNA, 25 bp, Homo sapien
agatctgtagtgttccttctgacta

SEQ ID NO: 442965 - DNA, 25 bp, Homo sapien
tagtgttccttctgactatacaggg

SEQ ID NO: 442966 - DNA, 25 bp, Homo sapien
tgcattaacttaactggatcacagg

SEQ ID NO: 442967 - DNA, 25 bp, Homo sapien
acttaactggatcacaggatgccca

SEQ ID NO: 442968 - DNA, 25 bp, Homo sapien
aggatgcccagatgtttagctaaac

SEQ ID NO: 442969 - DNA, 25 bp, Homo sapien
gtttagctaaacattattttgggtg

SEQ ID NO: 442970 - DNA, 25 bp, Homo sapien
gctcaggatgaacggttgtaaatca

SEQ ID NO: 442971 - DNA, 25 bp, Homo sapien
ggttgtaaatcaagggaatcccaag

SEQ ID NO: 442972 - DNA, 25 bp, Homo sapien
aaaacacgttctcattggtttgcca

SEQ ID NO: 442973 - DNA, 25 bp, Homo sapien
aaatgatcccgatgggacacttggg

SEQ ID NO: 442974 - DNA, 25 bp, Homo sapien
gatgtggcagatgtggtcgcattct

SEQ ID NO: 442975 - DNA, 25 bp, Homo sapien
agatgtggtcgcattcttggcatct

SEQ ID NO: 442976 - DNA, 25 bp, Homo sapien
cttggcatctgaagatagtggatac

SEQ ID NO: 442977 - DNA, 25 bp, Homo sapien
tagtggatacatcacagggacctca

SEQ ID NO: 442978 - DNA, 25 bp, Homo sapien
ggtcttttcatgtaactgcctcaag

SEQ ID NO: 442979 - DNA, 25 bp, Homo sapien
atgtaactgcctcaaggaccctgga

SEQ ID NO: 442980 - DNA, 25 bp, Homo sapien
ggcctcctgctgatgaggactctaa

SEQ ID NO: 442981 - DNA, 25 bp, Homo sapien
gaggactctaagttcccaggataca

SEQ ID NO: 442982 - DNA, 25 bp, Homo sapien
tggcagtgtatggttcaggaatgct

SEQ ID NO: 442983 - DNA, 25 bp, Homo sapien
gtgcttgtgaccctaataaattcca

SEQ ID NO: 442984 - DNA, 25 bp, Homo sapien
ccgagatgatgaactccggggtctg

SEQ ID NO: 442985 - DNA, 25 bp, Homo sapien
aactccggggtctgagagtgggcaa

SEQ ID NO: 442986 - DNA, 25 bp, Homo sapien
actccggggtctgagagtgggcaaa

SEQ ID NO: 442987 - DNA, 25 bp, Homo sapien
ctccggggtctgagagtgggcaaac

SEQ ID NO: 442988 - DNA, 25 bp, Homo sapien
tccggggtctgagagtgggcaaaca

SEQ ID NO: 442989 - DNA, 25 bp, Homo sapien
gggtctgagagtgggcaaacaggga

SEQ ID NO: 442990 - DNA, 25 bp, Homo sapien
ggtctgagagtgggcaaacagggaa

SEQ ID NO: 442991 - DNA, 25 bp, Homo sapien
ctgagagtgggcaaacagggaagaa

SEQ ID NO: 442992 - DNA, 25 bp, Homo sapien
tgagagtgggcaaacagggaagaag

SEQ ID NO: 442993 - DNA, 25 bp, Homo sapien
gagagtgggcaaacagggaagaagg

SEQ ID NO: 442994 - DNA, 25 bp, Homo sapien
gaagaaggttgggacctggtgcctg

SEQ ID NO: 442995 - DNA, 25 bp, Homo sapien
gtacataatttcactgtttacgttt

SEQ ID NO: 442996 - DNA, 25 bp, Homo sapien
cactgtttacgtttttagcactcct

SEQ ID NO: 442997 - DNA, 25 bp, Homo sapien
tttttagcactcctatccctgatct

SEQ ID NO: 442998 - DNA, 25 bp, Homo sapien
atccctgatcttcatggtgatgcac

SEQ ID NO: 442999 - DNA, 25 bp, Homo sapien
ggtgatgcacagaatgtcttagact

SEQ ID NO: 443000 - DNA, 25 bp, Homo sapien
gaatgtcttagactccaaaaaggaa

SEQ ID NO: 443001 - DNA, 25 bp, Homo sapien
aatttgtaatgcaaacctgccattt

SEQ ID NO: 443002 - DNA, 25 bp, Homo sapien
gcaaacctgccatttaggagtagaa

SEQ ID NO: 443003 - DNA, 25 bp, Homo sapien
aactcaagtattacatgcagatcat

SEQ ID NO: 443004 - DNA, 25 bp, Homo sapien
actctagacttttaggtacctacat

SEQ ID NO: 443005 - DNA, 25 bp, Homo sapien
ttttaggtacctacatcatgccctg

SEQ ID NO: 443006 - DNA, 25 bp, Homo sapien
ccttacatatgttatctcggttaat

SEQ ID NO: 443007 - DNA, 25 bp, Homo sapien
atgttatctcggttaatcttcacag

SEQ ID NO: 443008 - DNA, 25 bp, Homo sapien
cttcacagcaactctctgaggttag

SEQ ID NO: 443009 - DNA, 25 bp, Homo sapien
gaggttagagagtcaaaccccattt

SEQ ID NO: 443010 - DNA, 25 bp, Homo sapien
acatattataaaatttgcccacttt

SEQ ID NO: 443011 - DNA, 25 bp, Homo sapien
gcccactttaagtgtactattcaat

SEQ ID NO: 443012 - DNA, 25 bp, Homo sapien
atccatcagccacaatccagttgta

SEQ ID NO: 443013 - DNA, 25 bp, Homo sapien
gccacaatccagttgtaaaacattg

SEQ ID NO: 443014 - DNA, 25 bp, Homo sapien
aaaacattgccatcgctgagtggtg

SEQ ID NO: 443015 - DNA, 25 bp, Homo sapien
ccatcgctgagtggtgtggctaaca

SEQ ID NO: 443016 - DNA, 25 bp, Homo sapien
ggtgtggctaacacttgttatccca

SEQ ID NO: 443017 - DNA, 25 bp, Homo sapien
acaagacatacaacagcaggtgtta

SEQ ID NO: 443018 - DNA, 25 bp, Homo sapien
gggaatcacaattacgaacactcat

SEQ ID NO: 443019 - DNA, 25 bp, Homo sapien
tggtagaaggccaccattcttctgt

SEQ ID NO: 443020 - DNA, 25 bp, Homo sapien
attcttctgtttcagccatgggacg

SEQ ID NO: 443021 - DNA, 25 bp, Homo sapien
atgggacgcctttgtccagcccaag

SEQ ID NO: 443022 - DNA, 25 bp, Homo sapien
aattacgaacactcatcctattaaa

SEQ ID NO: 443023 - DNA, 25 bp, Homo sapien
gaaaacacgcagaggctcagtttga

SEQ ID NO: 443024 - DNA, 25 bp, Homo sapien
ttgagaactaggatggcctctccca

SEQ ID NO: 443025 - DNA, 25 bp, Homo sapien
gatggcctctcccaaatatcaaggt

SEQ ID NO: 443026 - DNA, 25 bp, Homo sapien
aactaaccgtaggactgagtagaat

SEQ ID NO: 443027 - DNA, 25 bp, Homo sapien
atgtttaatatgtttgttacctgca

SEQ ID NO: 443028 - DNA, 25 bp, Homo sapien
gaatgtattttatgccaggtgtggt

SEQ ID NO: 443029 - DNA, 25 bp, Homo sapien
aagcaggagaaacgcttcagcgatt

SEQ ID NO: 443030 - DNA, 25 bp, Homo sapien
gcaggagaaacgcttcagcgattta

SEQ ID NO: 443031 - DNA, 25 bp, Homo sapien
caggagaaacgcttcagcgatttag

SEQ ID NO: 443032 - DNA, 25 bp, Homo sapien
ggagaaacgcttcagcgatttagga

SEQ ID NO: 443033 - DNA, 25 bp, Homo sapien
gagaaacgcttcagcgatttaggag

SEQ ID NO: 443034 - DNA, 25 bp, Homo sapien
agaaacgcttcagcgatttaggaga

SEQ ID NO: 443035 - DNA, 25 bp, Homo sapien
aaacgcttcagcgatttaggagaac

SEQ ID NO: 443036 - DNA, 25 bp, Homo sapien
acgcttcagcgatttaggagaacca

SEQ ID NO: 443037 - DNA, 25 bp, Homo sapien
gcttcagcgatttaggagaaccagg

SEQ ID NO: 443038 - DNA, 25 bp, Homo sapien
tcagcgatttaggagaaccaggagg

SEQ ID NO: 443039 - DNA, 25 bp, Homo sapien
gaatagtatacttcttaactaggtt

SEQ ID NO: 443040 - DNA, 25 bp, Homo sapien
taggtttacaactggtggaccacac

SEQ ID NO: 443041 - DNA, 25 bp, Homo sapien
ggtggaccacacaccaggcactaat

SEQ ID NO: 443042 - DNA, 25 bp, Homo sapien
ccaggcactaatcacctggtgagga

SEQ ID NO: 443043 - DNA, 25 bp, Homo sapien
tcacctggtgaggatttggcatatc

SEQ ID NO: 443044 - DNA, 25 bp, Homo sapien
gaggatttggcatatccaccaaaaa

SEQ ID NO: 443045 - DNA, 25 bp, Homo sapien
aatgcatccgatttaaccaacatct

SEQ ID NO: 443046 - DNA, 25 bp, Homo sapien
ctgacatctcttgcagacaatacta

SEQ ID NO: 443047 - DNA, 25 bp, Homo sapien
agacaatactatgctctctacacac

SEQ ID NO: 443048 - DNA, 25 bp, Homo sapien
tactatgctctctacacactgttta

SEQ ID NO: 443049 - DNA, 25 bp, Homo sapien
tgctctctacacactgtttagaaat

SEQ ID NO: 443050 - DNA, 25 bp, Homo sapien
atcagaggtctccagggcaaccctg

SEQ ID NO: 443051 - DNA, 25 bp, Homo sapien
gcaaccctggcggtcagggatgatt

SEQ ID NO: 443052 - DNA, 25 bp, Homo sapien
gtcagggatgattttgatcgctgct

SEQ ID NO: 443053 - DNA, 25 bp, Homo sapien
tttgatcgctgctatgtgacagaag

SEQ ID NO: 443054 - DNA, 25 bp, Homo sapien
agagagtgagccacgaaccctagac

SEQ ID NO: 443055 - DNA, 25 bp, Homo sapien
gaaccctagaccctggagtgcgcca

SEQ ID NO: 443056 - DNA, 25 bp, Homo sapien
agcctggcggcccaaatcctggcag

SEQ ID NO: 443057 - DNA, 25 bp, Homo sapien
agcgtgaccgcagcttcaggtttgc

SEQ ID NO: 443058 - DNA, 25 bp, Homo sapien
ccgcagcttcaggtttgcacaggaa

SEQ ID NO: 443059 - DNA, 25 bp, Homo sapien
tattaaacgtctactgcatgcccta

SEQ ID NO: 443060 - DNA, 25 bp, Homo sapien
tactgcatgccctatcagaggtctc

SEQ ID NO: 443061 - DNA, 25 bp, Homo sapien
gatccagaactgcacccctgttctt

SEQ ID NO: 443062 - DNA, 25 bp, Homo sapien
tgttcttgccccaaaataacctcag

SEQ ID NO: 443063 - DNA, 25 bp, Homo sapien
atagaactaatatcgagccttcaca

SEQ ID NO: 443064 - DNA, 25 bp, Homo sapien
taatatcgagccttcacaaacattt

SEQ ID NO: 443065 - DNA, 25 bp, Homo sapien
taaaatctgctctgcttgcattcct

SEQ ID NO: 443066 - DNA, 25 bp, Homo sapien
attccttcccactcactgaaaagca

SEQ ID NO: 443067 - DNA, 25 bp, Homo sapien
aaaagcactgccatccttccagttg

SEQ ID NO: 443068 - DNA, 25 bp, Homo sapien
cagttgctccactcaaaaactttgg

SEQ ID NO: 443069 - DNA, 25 bp, Homo sapien
tttggagtccccattgacttctctc

SEQ ID NO: 443070 - DNA, 25 bp, Homo sapien
actccatgtatgtccatcagaaatt

SEQ ID NO: 443071 - DNA, 25 bp, Homo sapien
gagatttctgaataacccataggtt

SEQ ID NO: 443072 - DNA, 25 bp, Homo sapien
catccaaatataagccccaggccat

SEQ ID NO: 443073 - DNA, 25 bp, Homo sapien
aggccattccacttagtgtcttttc

SEQ ID NO: 443074 - DNA, 25 bp, Homo sapien
tctgagttgaacttcggtgcttctg

SEQ ID NO: 443075 - DNA, 25 bp, Homo sapien
cggtgcttctgttgtttgagtttac

SEQ ID NO: 443076 - DNA, 25 bp, Homo sapien
ttgagtttactgtgcctggtggtat

SEQ ID NO: 443077 - DNA, 25 bp, Homo sapien
cctggtggtatattgggcattcttt

SEQ ID NO: 443078 - DNA, 25 bp, Homo sapien
gcattctttggattgagtgttctga

SEQ ID NO: 443079 - DNA, 25 bp, Homo sapien
ttctgaggtgagagagtcttcccga

SEQ ID NO: 443080 - DNA, 25 bp, Homo sapien
tccaaccctgaacaagaccttacat

SEQ ID NO: 443081 - DNA, 25 bp, Homo sapien
agatggactgatggactgcggcaat

SEQ ID NO: 443082 - DNA, 25 bp, Homo sapien
tgcggcaatcctgggctgtcaagtg

SEQ ID NO: 443083 - DNA, 25 bp, Homo sapien
tcaggatttaaaaactggaacggtg

SEQ ID NO: 443084 - DNA, 25 bp, Homo sapien
aaactggaacggtgaaggtgacagc

SEQ ID NO: 443085 - DNA, 25 bp, Homo sapien
gtgaaggtgacagcagtcggttgga

SEQ ID NO: 443086 - DNA, 25 bp, Homo sapien
gagcatcccccaaagttcacaatgt

SEQ ID NO: 443087 - DNA, 25 bp, Homo sapien
ccccaaagttcacaatgtggccgag

SEQ ID NO: 443088 - DNA, 25 bp, Homo sapien
ccaaagttcacaatgtggccgagga

SEQ ID NO: 443089 - DNA, 25 bp, Homo sapien
aaagttcacaatgtggccgaggact

SEQ ID NO: 443090 - DNA, 25 bp, Homo sapien
agttcacaatgtggccgaggacttt

SEQ ID NO: 443091 - DNA, 25 bp, Homo sapien
tcacaatgtggccgaggactttgat

SEQ ID NO: 443092 - DNA, 25 bp, Homo sapien
aatagtcattccaaatatgagatgc

SEQ ID NO: 443093 - DNA, 25 bp, Homo sapien
ttgttacaggaagtcccttgccatc

SEQ ID NO: 443094 - DNA, 25 bp, Homo sapien
tatagataggtgcttgaatttgttg

SEQ ID NO: 443095 - DNA, 25 bp, Homo sapien
gaatttgttgaccatgcatttgtta

SEQ ID NO: 443096 - DNA, 25 bp, Homo sapien
ttgttgaccatgcatttgttagaat

SEQ ID NO: 443097 - DNA, 25 bp, Homo sapien
gaccatgcatttgttagaatatcta

SEQ ID NO: 443098 - DNA, 25 bp, Homo sapien
gaatatctatgattgctaattaagt

SEQ ID NO: 443099 - DNA, 25 bp, Homo sapien
ctgtatagattatgatttgttgcaa

SEQ ID NO: 443100 - DNA, 25 bp, Homo sapien
gttgcaaatgtgatgtatctttggt

SEQ ID NO: 443101 - DNA, 25 bp, Homo sapien
aatgtgatgtatctttggttgtata

SEQ ID NO: 443102 - DNA, 25 bp, Homo sapien
ttcagactaattacatcaaacaaca

SEQ ID NO: 443103 - DNA, 25 bp, Homo sapien
aattacatcaaacaacatttaactg

SEQ ID NO: 443104 - DNA, 25 bp, Homo sapien
tccctagattattagttggtattaa

SEQ ID NO: 443105 - DNA, 25 bp, Homo sapien
gtccctgaagtcttgaacatgccga

SEQ ID NO: 443106 - DNA, 25 bp, Homo sapien
gaagtcttgaacatgccgagcacat

SEQ ID NO: 443107 - DNA, 25 bp, Homo sapien
atgccgagcacatcctgcctcgtat

SEQ ID NO: 443108 - DNA, 25 bp, Homo sapien
tgcctcgtatgcttcctggcctgga

SEQ ID NO: 443109 - DNA, 25 bp, Homo sapien
atgcttcctggcctggaatgcactt

SEQ ID NO: 443110 - DNA, 25 bp, Homo sapien
ctggaatgcacttgccccgggacac

SEQ ID NO: 443111 - DNA, 25 bp, Homo sapien
gggacaccctgtgctggctttagtg

SEQ ID NO: 443112 - DNA, 25 bp, Homo sapien
ctgtgctggctttagtgtttccttc

SEQ ID NO: 443113 - DNA, 25 bp, Homo sapien
gtctcctcaagtcaccttattatca

SEQ ID NO: 443114 - DNA, 25 bp, Homo sapien
attatcaaaaggactccgacaggct

SEQ ID NO: 443115 - DNA, 25 bp, Homo sapien
aaaggactccgacaggctaagtgtg

SEQ ID NO: 443116 - DNA, 25 bp, Homo sapien
acctaccacccaaagtgcttgatat

SEQ ID NO: 443117 - DNA, 25 bp, Homo sapien
agaggaaactgcactctcgcttcct

SEQ ID NO: 443118 - DNA, 25 bp, Homo sapien
atgttgccaccatgtgcatgccgac

SEQ ID NO: 443119 - DNA, 25 bp, Homo sapien
atgccgactgggtatccacctgtga

SEQ ID NO: 443120 - DNA, 25 bp, Homo sapien
acctgtgatgtcagttccttgtcta

SEQ ID NO: 443121 - DNA, 25 bp, Homo sapien
agtgggtacaagaaggtcctggctt

SEQ ID NO: 443122 - DNA, 25 bp, Homo sapien
gtcctggctttgtctatggagactg

SEQ ID NO: 443123 - DNA, 25 bp, Homo sapien
tatggagactgagttcaccttcccc

SEQ ID NO: 443124 - DNA, 25 bp, Homo sapien
aaggtcttctttgttgatccggctg

SEQ ID NO: 443125 - DNA, 25 bp, Homo sapien
atccggctgcattggtggttgcttc

SEQ ID NO: 443126 - DNA, 25 bp, Homo sapien
ttccccagccgaggttgaagcaaag

SEQ ID NO: 443127 - DNA, 25 bp, Homo sapien
tactttttaatgaacacgtgtctca

SEQ ID NO: 443128 - DNA, 25 bp, Homo sapien
actttttaatgaacacgtgtctcac

SEQ ID NO: 443129 - DNA, 25 bp, Homo sapien
ctttttaatgaacacgtgtctcaca

SEQ ID NO: 443130 - DNA, 25 bp, Homo sapien
tttttaatgaacacgtgtctcacac

SEQ ID NO: 443131 - DNA, 25 bp, Homo sapien
ttttaatgaacacgtgtctcacaca

SEQ ID NO: 443132 - DNA, 25 bp, Homo sapien
tttaatgaacacgtgtctcacacac

SEQ ID NO: 443133 - DNA, 25 bp, Homo sapien
ctcacacacaaaaagaattaaggat

SEQ ID NO: 443134 - DNA, 25 bp, Homo sapien
tacatacatccatataacatatatc

SEQ ID NO: 443135 - DNA, 25 bp, Homo sapien
aacatatatcacaaacttaaccaag

SEQ ID NO: 443136 - DNA, 25 bp, Homo sapien
atatatcacaaacttaaccaagctt

SEQ ID NO: 443137 - DNA, 25 bp, Homo sapien
tatcacaaacttaaccaagcttatt

SEQ ID NO: 443138 - DNA, 25 bp, Homo sapien
gacgcactgcacgtagtccgagaag

SEQ ID NO: 443139 - DNA, 25 bp, Homo sapien
gtagtccgagaagctgctccactgc

SEQ ID NO: 443140 - DNA, 25 bp, Homo sapien
tcgaagtctgtaaaggagcggcgcc

SEQ ID NO: 443141 - DNA, 25 bp, Homo sapien
gcgttgagctcgttggccacacgga

SEQ ID NO: 443142 - DNA, 25 bp, Homo sapien
tggccacacggacctcggtgcacag

SEQ ID NO: 443143 - DNA, 25 bp, Homo sapien
gcatcagcagcatggtcaggatcat

SEQ ID NO: 443144 - DNA, 25 bp, Homo sapien
tcaggatcatgatggcgctctgcca

SEQ ID NO: 443145 - DNA, 25 bp, Homo sapien
tgatggcgctctgccacagcagcgg

SEQ ID NO: 443146 - DNA, 25 bp, Homo sapien
tcaaagcgccttccaaaccagaaga

SEQ ID NO: 443147 - DNA, 25 bp, Homo sapien
gacaggtaggtgatgtagcccgcca

SEQ ID NO: 443148 - DNA, 25 bp, Homo sapien
gtgaaggccaggacgcactgcacgt

SEQ ID NO: 443149 - DNA, 25 bp, Homo sapien
atggtgtggcaggagaatgaggacc

SEQ ID NO: 443150 - DNA, 25 bp, Homo sapien
aagcctcagagttattgaaatccca

SEQ ID NO: 443151 - DNA, 25 bp, Homo sapien
ctcagagttattgaaatcccaggcc

SEQ ID NO: 443152 - DNA, 25 bp, Homo sapien
ctctgtgagctggtagcagagctct

SEQ ID NO: 443153 - DNA, 25 bp, Homo sapien
tgagctggtagcagagctctgctcc

SEQ ID NO: 443154 - DNA, 25 bp, Homo sapien
agctggtagcagagctctgctccca

SEQ ID NO: 443155 - DNA, 25 bp, Homo sapien
atgcagaaagtcaacacgatgtggc

SEQ ID NO: 443156 - DNA, 25 bp, Homo sapien
cagaaagtcaacacgatgtggcagg

SEQ ID NO: 443157 - DNA, 25 bp, Homo sapien
gaggaagctatttatatggccgggc

SEQ ID NO: 443158 - DNA, 25 bp, Homo sapien
ggaagctatttatatggccgggcgc

SEQ ID NO: 443159 - DNA, 25 bp, Homo sapien
gaagctatttatatggccgggcgcg

SEQ ID NO: 443160 - DNA, 25 bp, Homo sapien
ttctgaaacgattagctgtagccaa

SEQ ID NO: 443161 - DNA, 25 bp, Homo sapien
gtagccaaattatgtggttacgttt

SEQ ID NO: 443162 - DNA, 25 bp, Homo sapien
gtggttacgttttgctacattagaa

SEQ ID NO: 443163 - DNA, 25 bp, Homo sapien
atgcaatatgtgtggtaaatctact

SEQ ID NO: 443164 - DNA, 25 bp, Homo sapien
actgtttgaaatttataatggtctc

SEQ ID NO: 443165 - DNA, 25 bp, Homo sapien
taatggtctctgatatgattcgaat

SEQ ID NO: 443166 - DNA, 25 bp, Homo sapien
tatgattcgaattttggtaactttt

SEQ ID NO: 443167 - DNA, 25 bp, Homo sapien
cccctttagtcatggatttctattt

SEQ ID NO: 443168 - DNA, 25 bp, Homo sapien
gcatctgaattgactaggcttttcc

SEQ ID NO: 443169 - DNA, 25 bp, Homo sapien
gaattgactaggcttttcctatata

SEQ ID NO: 443170 - DNA, 25 bp, Homo sapien
actcaaaacttgttaactctgtact

SEQ ID NO: 443171 - DNA, 25 bp, Homo sapien
gatgcaggacaacaacatgcgagct

SEQ ID NO: 443172 - DNA, 25 bp, Homo sapien
acatgcgagctgaggctatcaaggc

SEQ ID NO: 443173 - DNA, 25 bp, Homo sapien
aagcctatggaagtccagcccaggg

SEQ ID NO: 443174 - DNA, 25 bp, Homo sapien
agggttccaaagagcgccagccgca

SEQ ID NO: 443175 - DNA, 25 bp, Homo sapien
gcaagctcgatttgcctacactgcc

SEQ ID NO: 443176 - DNA, 25 bp, Homo sapien
atgctcgggcccacattgccacggg

SEQ ID NO: 443177 - DNA, 25 bp, Homo sapien
acattgccacgggtctcaggctctg

SEQ ID NO: 443178 - DNA, 25 bp, Homo sapien
acgggtctcaggctctgctggccaa

SEQ ID NO: 443179 - DNA, 25 bp, Homo sapien
aaggcccaggcctcggcttcagctg

SEQ ID NO: 443180 - DNA, 25 bp, Homo sapien
tccagcttcagttctagctcctgct

SEQ ID NO: 443181 - DNA, 25 bp, Homo sapien
tcagttctagctcctgctcaggctt

SEQ ID NO: 443182 - DNA, 25 bp, Homo sapien
cctggagcgctcacctggttgaatt

SEQ ID NO: 443183 - DNA, 25 bp, Homo sapien
ggagcgctcacctggttgaattcaa

SEQ ID NO: 443184 - DNA, 25 bp, Homo sapien
gcgctcacctggttgaattcaaagt

SEQ ID NO: 443185 - DNA, 25 bp, Homo sapien
tcacctggttgaattcaaagtccca

SEQ ID NO: 443186 - DNA, 25 bp, Homo sapien
tgaattcaaagtcccagaaggcccc

SEQ ID NO: 443187 - DNA, 25 bp, Homo sapien
tcaaagtcccagaaggccccgctgg

SEQ ID NO: 443188 - DNA, 25 bp, Homo sapien
agaaggccccgctggcgtgaagccg

SEQ ID NO: 443189 - DNA, 25 bp, Homo sapien
ggccccttacattttgcgaagtgca

SEQ ID NO: 443190 - DNA, 25 bp, Homo sapien
ttgcgaagtgcattatagtccttgt

SEQ ID NO: 443191 - DNA, 25 bp, Homo sapien
agtgcattatagtccttgtttttct

SEQ ID NO: 443192 - DNA, 25 bp, Homo sapien
gggtaggtgactctcgctagatccc

SEQ ID NO: 443193 - DNA, 25 bp, Homo sapien
gagagtcttgaaatacgggcaggtt

SEQ ID NO: 443194 - DNA, 25 bp, Homo sapien
gaaatacgggcaggttttcaacaag

SEQ ID NO: 443195 - DNA, 25 bp, Homo sapien
agtgattaggtagtgatactccaga

SEQ ID NO: 443196 - DNA, 25 bp, Homo sapien
taggtagtgatactccagatgaagt

SEQ ID NO: 443197 - DNA, 25 bp, Homo sapien
gatgaagtaaaacctgggaagcaaa

SEQ ID NO: 443198 - DNA, 25 bp, Homo sapien
gtgttggaggtcagtagcacagttt

SEQ ID NO: 443199 - DNA, 25 bp, Homo sapien
tggaggtcagtagcacagtttggct

SEQ ID NO: 443200 - DNA, 25 bp, Homo sapien
gtagcacagtttggctgagatgcat

SEQ ID NO: 443201 - DNA, 25 bp, Homo sapien
tttggctgagatgcatggtacttgt

SEQ ID NO: 443202 - DNA, 25 bp, Homo sapien
gatgcatggtacttgttagaaaaca

SEQ ID NO: 443203 - DNA, 25 bp, Homo sapien
aaatattactgaaagtggccaggtg

SEQ ID NO: 443204 - DNA, 25 bp, Homo sapien
cctcccttaatagttttacgtgatg

SEQ ID NO: 443205 - DNA, 25 bp, Homo sapien
atagttttacgtgatgctaacaata

SEQ ID NO: 443206 - DNA, 25 bp, Homo sapien
gctaacaataggcttttcagtttga

SEQ ID NO: 443207 - DNA, 25 bp, Homo sapien
tttgaaaacaggcaccagcctacat

SEQ ID NO: 443208 - DNA, 25 bp, Homo sapien
aggcaccagcctacattacagaatg

SEQ ID NO: 443209 - DNA, 25 bp, Homo sapien
ttgaacaaggttcactttgaaagtt

SEQ ID NO: 443210 - DNA, 25 bp, Homo sapien
tgaaagtttaatcagtgacctaggt

SEQ ID NO: 443211 - DNA, 25 bp, Homo sapien
tcagtgacctaggtgtagcaggagt

SEQ ID NO: 443212 - DNA, 25 bp, Homo sapien
gtagcaggagttacctactcttata

SEQ ID NO: 443213 - DNA, 25 bp, Homo sapien
aaagtagtcatttctaattcagatt

SEQ ID NO: 443214 - DNA, 25 bp, Homo sapien
gggagtacttgatccactttttcat

SEQ ID NO: 443215 - DNA, 25 bp, Homo sapien
ttcagtttatactcaaagccctgca

SEQ ID NO: 443216 - DNA, 25 bp, Homo sapien
aaagccctgcagtttcctgacagca

SEQ ID NO: 443217 - DNA, 25 bp, Homo sapien
tttcctgacagcacagagcacacct

SEQ ID NO: 443218 - DNA, 25 bp, Homo sapien
agagcacacctgtcacgcgagcagg

SEQ ID NO: 443219 - DNA, 25 bp, Homo sapien
gtcacgcgagcaggatgaagcccag

SEQ ID NO: 443220 - DNA, 25 bp, Homo sapien
ggcggcgcgctggaaaatccacgta

SEQ ID NO: 443221 - DNA, 25 bp, Homo sapien
gaaaatccacgtagctttgttccct

SEQ ID NO: 443222 - DNA, 25 bp, Homo sapien
aaggccctctcgagcactacgggag

SEQ ID NO: 443223 - DNA, 25 bp, Homo sapien
ctgcacagacttcggagccaggtgc

SEQ ID NO: 443224 - DNA, 25 bp, Homo sapien
gggcctctgagatgagaacatagtt

SEQ ID NO: 443225 - DNA, 25 bp, Homo sapien
acatagttttgctgttttcagttta

SEQ ID NO: 443226 - DNA, 25 bp, Homo sapien
tgcagctacatttgaaagtgataga

SEQ ID NO: 443227 - DNA, 25 bp, Homo sapien
tcactttttcagctgatatattcat

SEQ ID NO: 443228 - DNA, 25 bp, Homo sapien
ttcatgaacacacccgagaaatctt

SEQ ID NO: 443229 - DNA, 25 bp, Homo sapien
gcaatatttaagaacctaatgctgt

SEQ ID NO: 443230 - DNA, 25 bp, Homo sapien
ctgtttaattttggtacagcttcca

SEQ ID NO: 443231 - DNA, 25 bp, Homo sapien
tggtacagcttccacattgcatgtt

SEQ ID NO: 443232 - DNA, 25 bp, Homo sapien
gcttccacattgcatgttcacttta

SEQ ID NO: 443233 - DNA, 25 bp, Homo sapien
gcatgttcactttagtatttgcaat

SEQ ID NO: 443234 - DNA, 25 bp, Homo sapien
atttgatatatttcatggtggcaaa

SEQ ID NO: 443235 - DNA, 25 bp, Homo sapien
tggtggcaaaatattagctctgttt

SEQ ID NO: 443236 - DNA, 25 bp, Homo sapien
gaactatccttgttcgatagcatag

SEQ ID NO: 443237 - DNA, 25 bp, Homo sapien
aaagcagggctcgtagtgcgcgggc

SEQ ID NO: 443238 - DNA, 25 bp, Homo sapien
acatggcacttcacgttctcattca

SEQ ID NO: 443239 - DNA, 25 bp, Homo sapien
ttcacgttctcattcatccctgggc

SEQ ID NO: 443240 - DNA, 25 bp, Homo sapien
cttagcatcccgcagagcgcttggg

SEQ ID NO: 443241 - DNA, 25 bp, Homo sapien
gggagtccctgctcaaaaagtgtgg

SEQ ID NO: 443242 - DNA, 25 bp, Homo sapien
gctcaaaaagtgtgggtcccgcacc

SEQ ID NO: 443243 - DNA, 25 bp, Homo sapien
ccaccttcactttagcagacatctg

SEQ ID NO: 443244 - DNA, 25 bp, Homo sapien
ctcttttctgcagaacgtggtacag

SEQ ID NO: 443245 - DNA, 25 bp, Homo sapien
gcagacatctgctaatgaaaggatt

SEQ ID NO: 443246 - DNA, 25 bp, Homo sapien
tgaaaggattaactgcttttctttt

SEQ ID NO: 443247 - DNA, 25 bp, Homo sapien
gtggtcaaaggctatcttcaaaggg

SEQ ID NO: 443248 - DNA, 25 bp, Homo sapien
gtattggttacaggcacttttggaa

SEQ ID NO: 443249 - DNA, 25 bp, Homo sapien
gaaggtgtttgctttcacatggcag

SEQ ID NO: 443250 - DNA, 25 bp, Homo sapien
gggacagcagtacatcttcacgatt

SEQ ID NO: 443251 - DNA, 25 bp, Homo sapien
atcttcacgatttgagctcaggtct

SEQ ID NO: 443252 - DNA, 25 bp, Homo sapien
tgagctcaggtctatggcaactctc

SEQ ID NO: 443253 - DNA, 25 bp, Homo sapien
aactctcctgttctgtcataagcaa

SEQ ID NO: 443254 - DNA, 25 bp, Homo sapien
gggtcttgataatcacaacatccca

SEQ ID NO: 443255 - DNA, 25 bp, Homo sapien
gagcatgtgacatttctaggagttc

SEQ ID NO: 443256 - DNA, 25 bp, Homo sapien
gtggcctgaggcatgttggttatct

SEQ ID NO: 443257 - DNA, 25 bp, Homo sapien
ggcatgttggttatctccttcaaat

SEQ ID NO: 443258 - DNA, 25 bp, Homo sapien
aattgctgcatcatgtactcctatg

SEQ ID NO: 443259 - DNA, 25 bp, Homo sapien
ggctaagtacttatgatacccaatg

SEQ ID NO: 443260 - DNA, 25 bp, Homo sapien
ggaatggaggtcctaacctcttaga

SEQ ID NO: 443261 - DNA, 25 bp, Homo sapien
ggtcctaacctcttagatcagagaa

SEQ ID NO: 443262 - DNA, 25 bp, Homo sapien
gcgattttaacaagtctggacagta

SEQ ID NO: 443263 - DNA, 25 bp, Homo sapien
gacagtatcaggtgggaactctata

SEQ ID NO: 443264 - DNA, 25 bp, Homo sapien
gaactctatagatgtccggtgtacg

SEQ ID NO: 443265 - DNA, 25 bp, Homo sapien
tgtccggtgtacgtcatgtgcaaac

SEQ ID NO: 443266 - DNA, 25 bp, Homo sapien
tgcaaacacaaatcacctggcgtct

SEQ ID NO: 443267 - DNA, 25 bp, Homo sapien
aatcacctggcgtctatcataatca

SEQ ID NO: 443268 - DNA, 25 bp, Homo sapien
ggcgtctatcataatcacgggatct

SEQ ID NO: 443269 - DNA, 25 bp, Homo sapien
aatcacgggatctatttccccattt

SEQ ID NO: 443270 - DNA, 25 bp, Homo sapien
ttcctctactgcagcttcatcatca

SEQ ID NO: 443271 - DNA, 25 bp, Homo sapien
gcttcatcatcagattcttctttct

SEQ ID NO: 443272 - DNA, 25 bp, Homo sapien
tctcttctttggctgcttcttcttc

SEQ ID NO: 443273 - DNA, 25 bp, Homo sapien
tccatgggctcctcaacagtttcag

SEQ ID NO: 443274 - DNA, 25 bp, Homo sapien
aacagtttcagtcttgctgctccat

SEQ ID NO: 443275 - DNA, 25 bp, Homo sapien
tcagtcttgctgctccatacataaa

SEQ ID NO: 443276 - DNA, 25 bp, Homo sapien
gtcttgctgctccatacataaatag

SEQ ID NO: 443277 - DNA, 25 bp, Homo sapien
gaaagtttatgaacgatatcattca

SEQ ID NO: 443278 - DNA, 25 bp, Homo sapien
atatcattcataagttcccagtccc

SEQ ID NO: 443279 - DNA, 25 bp, Homo sapien
taagttcccagtcccagacagtttt

SEQ ID NO: 443280 - DNA, 25 bp, Homo sapien
ccagtcccagacagttttttcaact

SEQ ID NO: 443281 - DNA, 25 bp, Homo sapien
ataactgggcgaggatgggtgtggt

SEQ ID NO: 443282 - DNA, 25 bp, Homo sapien
taactgggcgaggatgggtgtggtg

SEQ ID NO: 443283 - DNA, 25 bp, Homo sapien
aactgggcgaggatgggtgtggtgg

SEQ ID NO: 443284 - DNA, 25 bp, Homo sapien
actgggcgaggatgggtgtggtggc

SEQ ID NO: 443285 - DNA, 25 bp, Homo sapien
ctgggcgaggatgggtgtggtggct

SEQ ID NO: 443286 - DNA, 25 bp, Homo sapien
tgggcgaggatgggtgtggtggctc

SEQ ID NO: 443287 - DNA, 25 bp, Homo sapien
gtggccagatcccaaggtcagaaga

SEQ ID NO: 443288 - DNA, 25 bp, Homo sapien
tggccagatcccaaggtcagaagat

SEQ ID NO: 443289 - DNA, 25 bp, Homo sapien
ggccagatcccaaggtcagaagatc

SEQ ID NO: 443290 - DNA, 25 bp, Homo sapien
gccagatcccaaggtcagaagatcg

SEQ ID NO: 443291 - DNA, 25 bp, Homo sapien
ccagatcccaaggtcagaagatcga

SEQ ID NO: 443292 - DNA, 25 bp, Homo sapien
gtgttcaaacactataaagggattt

SEQ ID NO: 443293 - DNA, 25 bp, Homo sapien
ttttactttagcaagaaaatccgat

SEQ ID NO: 443294 - DNA, 25 bp, Homo sapien
tggtctctaaatggccgtacgtatt

SEQ ID NO: 443295 - DNA, 25 bp, Homo sapien
ttcactttctgccttggcatgtgaa

SEQ ID NO: 443296 - DNA, 25 bp, Homo sapien
tctgccttggcatgtgaacttctat

SEQ ID NO: 443297 - DNA, 25 bp, Homo sapien
gccttggcatgtgaacttctatctt

SEQ ID NO: 443298 - DNA, 25 bp, Homo sapien
ggcatgtgaacttctatctttttta

SEQ ID NO: 443299 - DNA, 25 bp, Homo sapien
atcttttttactgcactgtgtgtcc

SEQ ID NO: 443300 - DNA, 25 bp, Homo sapien
tgcactgtgtgtcctttatcactat

SEQ ID NO: 443301 - DNA, 25 bp, Homo sapien
ctgtgtgtcctttatcactatggct

SEQ ID NO: 443302 - DNA, 25 bp, Homo sapien
gtcctttatcactatggctgtactt

SEQ ID NO: 443303 - DNA, 25 bp, Homo sapien
gtttctggctgtggttctaaatgga

SEQ ID NO: 443304 - DNA, 25 bp, Homo sapien
cccagggtttgtgctcagtagagcc

SEQ ID NO: 443305 - DNA, 25 bp, Homo sapien
ttgtgctcagtagagccctgtggat

SEQ ID NO: 443306 - DNA, 25 bp, Homo sapien
gtagagccctgtggatcacagtctt

SEQ ID NO: 443307 - DNA, 25 bp, Homo sapien
gatcacagtcttgaggtcctctagc

SEQ ID NO: 443308 - DNA, 25 bp, Homo sapien
gagagcagcgacttcagctgagtcc

SEQ ID NO: 443309 - DNA, 25 bp, Homo sapien
gagtccctgccagtggttaagcaaa

SEQ ID NO: 443310 - DNA, 25 bp, Homo sapien
aaaattcaaggtccccaaatggcag

SEQ ID NO: 443311 - DNA, 25 bp, Homo sapien
tcaaggtccccaaatggcagcattt

SEQ ID NO: 443312 - DNA, 25 bp, Homo sapien
ggcagcattttatgttctgacctgt

SEQ ID NO: 443313 - DNA, 25 bp, Homo sapien
gttctgacctgtttgtgttatatag

SEQ ID NO: 443314 - DNA, 25 bp, Homo sapien
tggtatgaggtattacttaaagaga

SEQ ID NO: 443315 - DNA, 25 bp, Homo sapien
ggtatgaggtattacttaaagagaa

SEQ ID NO: 443316 - DNA, 25 bp, Homo sapien
gtatgaggtattacttaaagagaaa

SEQ ID NO: 443317 - DNA, 25 bp, Homo sapien
ttaaagagaaaccagactgtcagcc

SEQ ID NO: 443318 - DNA, 25 bp, Homo sapien
aagagctgagaagattaagggtgtc

SEQ ID NO: 443319 - DNA, 25 bp, Homo sapien
agagctgagaagattaagggtgtca

SEQ ID NO: 443320 - DNA, 25 bp, Homo sapien
gagctgagaagattaagggtgtcaa

SEQ ID NO: 443321 - DNA, 25 bp, Homo sapien
agctgagaagattaagggtgtcaag

SEQ ID NO: 443322 - DNA, 25 bp, Homo sapien
gctgagaagattaagggtgtcaagg

SEQ ID NO: 443323 - DNA, 25 bp, Homo sapien
taagggtgtcaaggggacctgtgtc

SEQ ID NO: 443324 - DNA, 25 bp, Homo sapien
gtcaaggggacctgtgtcctggtgg

SEQ ID NO: 443325 - DNA, 25 bp, Homo sapien
ggaagaagtttgcacctcggccctg

SEQ ID NO: 443326 - DNA, 25 bp, Homo sapien
cattcctggcagtgaactctgccag

SEQ ID NO: 443327 - DNA, 25 bp, Homo sapien
actctgccaggactgaagctgtggc

SEQ ID NO: 443328 - DNA, 25 bp, Homo sapien
ctgaagctgtggctttatccatcag

SEQ ID NO: 443329 - DNA, 25 bp, Homo sapien
tggctttatccatcagctccctggg

SEQ ID NO: 443330 - DNA, 25 bp, Homo sapien
ggatctggtgcatagatgaacatct

SEQ ID NO: 443331 - DNA, 25 bp, Homo sapien
ccccatacacacctaggcttgaaat

SEQ ID NO: 443332 - DNA, 25 bp, Homo sapien
cacctaggcttgaaatgccctacag

SEQ ID NO: 443333 - DNA, 25 bp, Homo sapien
actttctcacatctgaaatggaggc

SEQ ID NO: 443334 - DNA, 25 bp, Homo sapien
aatgaaaaggcacccacagcatcat

SEQ ID NO: 443335 - DNA, 25 bp, Homo sapien
acagcatcatgcaagtggcatcttg

SEQ ID NO: 443336 - DNA, 25 bp, Homo sapien
ggcgggcggcgcagaactcggagct

SEQ ID NO: 443337 - DNA, 25 bp, Homo sapien
tgggctgggctctgccgtgagggtg

SEQ ID NO: 443338 - DNA, 25 bp, Homo sapien
cctcctagccggaggacctaggaat

SEQ ID NO: 443339 - DNA, 25 bp, Homo sapien
aggacctaggaatcggccggctcta

SEQ ID NO: 443340 - DNA, 25 bp, Homo sapien
gaatcggccggctctactaggtgtc

SEQ ID NO: 443341 - DNA, 25 bp, Homo sapien
ggctctactaggtgtctttgctcgc

SEQ ID NO: 443342 - DNA, 25 bp, Homo sapien
tactaggtgtctttgctcgcggttc

SEQ ID NO: 443343 - DNA, 25 bp, Homo sapien
tttgctcgcggttccgactgtgaat

SEQ ID NO: 443344 - DNA, 25 bp, Homo sapien
cggttccgactgtgaatccggtgaa

SEQ ID NO: 443345 - DNA, 25 bp, Homo sapien
aatccggtgaagaccggtggttgca

SEQ ID NO: 443346 - DNA, 25 bp, Homo sapien
gagccgggatcgcactaccgtactc

SEQ ID NO: 443347 - DNA, 25 bp, Homo sapien
aatgtctatgtatcaggatggccat

SEQ ID NO: 443348 - DNA, 25 bp, Homo sapien
tatcaggatggccatgtatgatcat

SEQ ID NO: 443349 - DNA, 25 bp, Homo sapien
atgagcttgcctttcagaccatgat

SEQ ID NO: 443350 - DNA, 25 bp, Homo sapien
taatgtgtacttggtaggtttccct

SEQ ID NO: 443351 - DNA, 25 bp, Homo sapien
ttccctctgtgttctaaaattttct

SEQ ID NO: 443352 - DNA, 25 bp, Homo sapien
aaattttctgcatggtttgctatgt

SEQ ID NO: 443353 - DNA, 25 bp, Homo sapien
atggtttgctatgttttgatttttg

SEQ ID NO: 443354 - DNA, 25 bp, Homo sapien
tcagaccatgatcatttgccacaga

SEQ ID NO: 443355 - DNA, 25 bp, Homo sapien
atttgccacagaaccttaacaggat

SEQ ID NO: 443356 - DNA, 25 bp, Homo sapien
aacaggattactatacagctgaggg

SEQ ID NO: 443357 - DNA, 25 bp, Homo sapien
ggctttgaagactacgtaacaactt

SEQ ID NO: 443358 - DNA, 25 bp, Homo sapien
ggcactgatgtgtattgcctttaat

SEQ ID NO: 443359 - DNA, 25 bp, Homo sapien
tattgcctttaatggtccttttccg

SEQ ID NO: 443360 - DNA, 25 bp, Homo sapien
taatggtccttttccgcagcagtga

SEQ ID NO: 443361 - DNA, 25 bp, Homo sapien
gtccttttccgcagcagtgatatga

SEQ ID NO: 443362 - DNA, 25 bp, Homo sapien
tccgcagcagtgatatgacagattt

SEQ ID NO: 443363 - DNA, 25 bp, Homo sapien
ttgatcagaaattctcttgcttgag

SEQ ID NO: 443364 - DNA, 25 bp, Homo sapien
ttttttgtcctctgttgactacata

SEQ ID NO: 443365 - DNA, 25 bp, Homo sapien
gtcctctgttgactacatagtttca

SEQ ID NO: 443366 - DNA, 25 bp, Homo sapien
aatctctctttatttcatgatgata

SEQ ID NO: 443367 - DNA, 25 bp, Homo sapien
gatctcattttggatttagtgatta

SEQ ID NO: 443368 - DNA, 25 bp, Homo sapien
tcttagtgcctcaaaaaacacctat

SEQ ID NO: 443369 - DNA, 25 bp, Homo sapien
ggtcatttcctcagtttgtgtatta

SEQ ID NO: 443370 - DNA, 25 bp, Homo sapien
tttcctcagtttgtgtattaaagaa

SEQ ID NO: 443371 - DNA, 25 bp, Homo sapien
ttcctcagtttgtgtattaaagaaa

SEQ ID NO: 443372 - DNA, 25 bp, Homo sapien
tcctcagtttgtgtattaaagaaaa

SEQ ID NO: 443373 - DNA, 25 bp, Homo sapien
gtgtattaaagaaaagctgccccag

SEQ ID NO: 443374 - DNA, 25 bp, Homo sapien
tgtattaaagaaaagctgccccagc

SEQ ID NO: 443375 - DNA, 25 bp, Homo sapien
gtattaaagaaaagctgccccagcc

SEQ ID NO: 443376 - DNA, 25 bp, Homo sapien
tattaaagaaaagctgccccagcca

SEQ ID NO: 443377 - DNA, 25 bp, Homo sapien
ttaaagaaaagctgccccagccaag

SEQ ID NO: 443378 - DNA, 25 bp, Homo sapien
gaaaagctgccccagccaagcgtgg

SEQ ID NO: 443379 - DNA, 25 bp, Homo sapien
aaagctgccccagccaagcgtggtg

SEQ ID NO: 443380 - DNA, 25 bp, Homo sapien
atgaaaatactcctgtaacacaaac

SEQ ID NO: 443381 - DNA, 25 bp, Homo sapien
ataactcactcatatagctctgcct

SEQ ID NO: 443382 - DNA, 25 bp, Homo sapien
tcatatagctctgcctcattctgtg

SEQ ID NO: 443383 - DNA, 25 bp, Homo sapien
gtgttagcagaggtattttactcag

SEQ ID NO: 443384 - DNA, 25 bp, Homo sapien
tatgtctgcttaatcagtgttaaac

SEQ ID NO: 443385 - DNA, 25 bp, Homo sapien
atcagtgttaaactgctatgggaaa

SEQ ID NO: 443386 - DNA, 25 bp, Homo sapien
aacctgaatgttggtctctttgtac

SEQ ID NO: 443387 - DNA, 25 bp, Homo sapien
ggtctctttgtacacatcttttcta

SEQ ID NO: 443388 - DNA, 25 bp, Homo sapien
tacacatcttttctatgactgcaaa

SEQ ID NO: 443389 - DNA, 25 bp, Homo sapien
gactgcaaatcttcactttatgtat

SEQ ID NO: 443390 - DNA, 25 bp, Homo sapien
actttatgtatcatttttactgtca

SEQ ID NO: 443391 - DNA, 25 bp, Homo sapien
gcccatcaggtaataaccaaagtca

SEQ ID NO: 443392 - DNA, 25 bp, Homo sapien
aaccaaagtcaaggcaacatgcaaa

SEQ ID NO: 443393 - DNA, 25 bp, Homo sapien
gagccaaaccaggtctttggttcta

SEQ ID NO: 443394 - DNA, 25 bp, Homo sapien
tggttctagaaataactcttacagt

SEQ ID NO: 443395 - DNA, 25 bp, Homo sapien
agtggttctaattctggtgcagcaa

SEQ ID NO: 443396 - DNA, 25 bp, Homo sapien
aattggttgggaatcagcatcaggc

SEQ ID NO: 443397 - DNA, 25 bp, Homo sapien
gaatcagcatcaggcaatggtttta

SEQ ID NO: 443398 - DNA, 25 bp, Homo sapien
caatcgaggtaccaatacaggtggt

SEQ ID NO: 443399 - DNA, 25 bp, Homo sapien
gatgaattttggtgtgctcagcatt

SEQ ID NO: 443400 - DNA, 25 bp, Homo sapien
ttttggtgtgctcagcattaatcca

SEQ ID NO: 443401 - DNA, 25 bp, Homo sapien
atgagcatgttagccagccagcaga

SEQ ID NO: 443402 - DNA, 25 bp, Homo sapien
tgggcagttggtgagtttatagcct

SEQ ID NO: 443403 - DNA, 25 bp, Homo sapien
gcagttggtgagtttatagcctgga

SEQ ID NO: 443404 - DNA, 25 bp, Homo sapien
agttggtgagtttatagcctggata

SEQ ID NO: 443405 - DNA, 25 bp, Homo sapien
gttggtgagtttatagcctggataa

SEQ ID NO: 443406 - DNA, 25 bp, Homo sapien
tggtgagtttatagcctggataaaa

SEQ ID NO: 443407 - DNA, 25 bp, Homo sapien
tttatagcctggataaaagtcaggt

SEQ ID NO: 443408 - DNA, 25 bp, Homo sapien
gataaaagtcaggtctaagccaggt

SEQ ID NO: 443409 - DNA, 25 bp, Homo sapien
taaaagtcaggtctaagccaggtgt

SEQ ID NO: 443410 - DNA, 25 bp, Homo sapien
aaaagtcaggtctaagccaggtgtg

SEQ ID NO: 443411 - DNA, 25 bp, Homo sapien
aagtcaggtctaagccaggtgtgga

SEQ ID NO: 443412 - DNA, 25 bp, Homo sapien
gtctaagccaggtgtggaggctcac

SEQ ID NO: 443413 - DNA, 25 bp, Homo sapien
ctttgaggagtctttcatcgaagaa

SEQ ID NO: 443414 - DNA, 25 bp, Homo sapien
cagggcctcgagcagtttattaaca

SEQ ID NO: 443415 - DNA, 25 bp, Homo sapien
tgggcacccactggctcagaatgaa

SEQ ID NO: 443416 - DNA, 25 bp, Homo sapien
actggctcagaatgaacgctgccta

SEQ ID NO: 443417 - DNA, 25 bp, Homo sapien
agaatgaacgctgcctacacatgtt

SEQ ID NO: 443418 - DNA, 25 bp, Homo sapien
tgcctacacatgttcctgcaagagg

SEQ ID NO: 443419 - DNA, 25 bp, Homo sapien
gagccggccaagtaggagcccctct

SEQ ID NO: 443420 - DNA, 25 bp, Homo sapien
gaaatgacattggtttttacactaa

SEQ ID NO: 443421 - DNA, 25 bp, Homo sapien
gtttttacactaagcctctctctgt

SEQ ID NO: 443422 - DNA, 25 bp, Homo sapien
cctctctctgtctttgatctgaagt

SEQ ID NO: 443423 - DNA, 25 bp, Homo sapien
ctctctgtctttgatctgaagttgg

SEQ ID NO: 443424 - DNA, 25 bp, Homo sapien
tcaaccttgttttacagttctgcag

SEQ ID NO: 443425 - DNA, 25 bp, Homo sapien
cgggcaacgtgcatgtgcaggctca

SEQ ID NO: 443426 - DNA, 25 bp, Homo sapien
aacgtgcatgtgcaggctcaccact

SEQ ID NO: 443427 - DNA, 25 bp, Homo sapien
actcccaggcctctgacatgaggga

SEQ ID NO: 443428 - DNA, 25 bp, Homo sapien
caggcctctgacatgagggacatgt

SEQ ID NO: 443429 - DNA, 25 bp, Homo sapien
gagggacatgtgacagtgtcattca

SEQ ID NO: 443430 - DNA, 25 bp, Homo sapien
gtgacagtgtcattcagtattatgt

SEQ ID NO: 443431 - DNA, 25 bp, Homo sapien
actctttaagttcatgttatacaag

SEQ ID NO: 443432 - DNA, 25 bp, Homo sapien
gatttactgtattatacttttcctt

SEQ ID NO: 443433 - DNA, 25 bp, Homo sapien
atacagctgcaacattttgattcct

SEQ ID NO: 443434 - DNA, 25 bp, Homo sapien
tgattcctgttaattttgttcttta

SEQ ID NO: 443435 - DNA, 25 bp, Homo sapien
ggtgttctaaaccaacagcaaccag

SEQ ID NO: 443436 - DNA, 25 bp, Homo sapien
tctaaaccaacagcaaccaggtggg

SEQ ID NO: 443437 - DNA, 25 bp, Homo sapien
caggtggggttaatcctctctttat

SEQ ID NO: 443438 - DNA, 25 bp, Homo sapien
tttccccaacctcaatattgagctg

SEQ ID NO: 443439 - DNA, 25 bp, Homo sapien
aacctcaatattgagctgggcaaca

SEQ ID NO: 443440 - DNA, 25 bp, Homo sapien
ggcagtgctccaggtggctagccat

SEQ ID NO: 443441 - DNA, 25 bp, Homo sapien
tgctccaggtggctagccatatcaa

SEQ ID NO: 443442 - DNA, 25 bp, Homo sapien
aggtggctagccatatcaagcagga

SEQ ID NO: 443443 - DNA, 25 bp, Homo sapien
gctagccatatcaagcaggaactgg

SEQ ID NO: 443444 - DNA, 25 bp, Homo sapien
caggaactgggagccgacttgcctt

SEQ ID NO: 443445 - DNA, 25 bp, Homo sapien
aactgggagccgacttgccttggga

SEQ ID NO: 443446 - DNA, 25 bp, Homo sapien
cctcaccagggaccgtaggcacgaa

SEQ ID NO: 443447 - DNA, 25 bp, Homo sapien
tcaccagggaccgtaggcacgaagt

SEQ ID NO: 443448 - DNA, 25 bp, Homo sapien
caccagggaccgtaggcacgaagtg

SEQ ID NO: 443449 - DNA, 25 bp, Homo sapien
accagggaccgtaggcacgaagtgg

SEQ ID NO: 443450 - DNA, 25 bp, Homo sapien
ccagggaccgtaggcacgaagtggc

SEQ ID NO: 443451 - DNA, 25 bp, Homo sapien
agccaacccctccgccaactggctg

SEQ ID NO: 443452 - DNA, 25 bp, Homo sapien
cagggaccgtaggcacgaagtggcc

SEQ ID NO: 443453 - DNA, 25 bp, Homo sapien
tccgccaactggctgcacgctcgct

SEQ ID NO: 443454 - DNA, 25 bp, Homo sapien
gccaactggctgcacgctcgctctt

SEQ ID NO: 443455 - DNA, 25 bp, Homo sapien
tgcacgctcgctcttcccggaaaaa

SEQ ID NO: 443456 - DNA, 25 bp, Homo sapien
gcacgctcgctcttcccggaaaaag

SEQ ID NO: 443457 - DNA, 25 bp, Homo sapien
ctcagggaccaggacgggcagatat

SEQ ID NO: 443458 - DNA, 25 bp, Homo sapien
gggcagatatttggagccttctcct

SEQ ID NO: 443459 - DNA, 25 bp, Homo sapien
ggctatccgactcagcaaaggcttc

SEQ ID NO: 443460 - DNA, 25 bp, Homo sapien
caaaggcttctatggtactggcgag

SEQ ID NO: 443461 - DNA, 25 bp, Homo sapien
atggtactggcgagacattcctctt

SEQ ID NO: 443462 - DNA, 25 bp, Homo sapien
gtggactggaagcaactctttcttt

SEQ ID NO: 443463 - DNA, 25 bp, Homo sapien
aagcaactctttctttgtgaaggga

SEQ ID NO: 443464 - DNA, 25 bp, Homo sapien
agggagacttggattcactgatgat

SEQ ID NO: 443465 - DNA, 25 bp, Homo sapien
ctgtggttggatggagacttgttcc

SEQ ID NO: 443466 - DNA, 25 bp, Homo sapien
ttgcccgaccttcaacaacgaggtg

SEQ ID NO: 443467 - DNA, 25 bp, Homo sapien
ttcaacaacgaggtgctggcccggc

SEQ ID NO: 443468 - DNA, 25 bp, Homo sapien
gaatttaaagaatgtattttatgcc

SEQ ID NO: 443469 - DNA, 25 bp, Homo sapien
gaagcaggagaaacgcttcagcgat

SEQ ID NO: 443470 - DNA, 25 bp, Homo sapien
aagcaggagaaacgcttcagcgatt

SEQ ID NO: 443471 - DNA, 25 bp, Homo sapien
agcaggagaaacgcttcagcgattt

SEQ ID NO: 443472 - DNA, 25 bp, Homo sapien
gcaggagaaacgcttcagcgattta

SEQ ID NO: 443473 - DNA, 25 bp, Homo sapien
caggagaaacgcttcagcgatttag

SEQ ID NO: 443474 - DNA, 25 bp, Homo sapien
aggagaaacgcttcagcgatttagg

SEQ ID NO: 443475 - DNA, 25 bp, Homo sapien
ggagaaacgcttcagcgatttagga

SEQ ID NO: 443476 - DNA, 25 bp, Homo sapien
gagaaacgcttcagcgatttaggag

SEQ ID NO: 443477 - DNA, 25 bp, Homo sapien
agaaacgcttcagcgatttaggaga

SEQ ID NO: 443478 - DNA, 25 bp, Homo sapien
gaaacgcttcagcgatttaggagaa

SEQ ID NO: 443479 - DNA, 25 bp, Homo sapien
gaattcaaccaggtgagcgctccag

SEQ ID NO: 443480 - DNA, 25 bp, Homo sapien
ggtgagcgctccaggtgccccgaca

SEQ ID NO: 443481 - DNA, 25 bp, Homo sapien
aggtgccccgacaggcgcactgtag

SEQ ID NO: 443482 - DNA, 25 bp, Homo sapien
aggcgcactgtagccactgggtgtt

SEQ ID NO: 443483 - DNA, 25 bp, Homo sapien
cgcactgtagccactgggtgttagg

SEQ ID NO: 443484 - DNA, 25 bp, Homo sapien
ggaaggtgacggtagacggccactt

SEQ ID NO: 443485 - DNA, 25 bp, Homo sapien
tagacggccacttgggcccttctgg

SEQ ID NO: 443486 - DNA, 25 bp, Homo sapien
agggctctccgtgctcagagcaagg

SEQ ID NO: 443487 - DNA, 25 bp, Homo sapien
ggtagaggagcaaggccctactttt

SEQ ID NO: 443488 - DNA, 25 bp, Homo sapien
taatgcacttcgcaaaatgtaaggg

SEQ ID NO: 443489 - DNA, 25 bp, Homo sapien
gccttctgggactttgaattcaacc

SEQ ID NO: 443490 - DNA, 25 bp, Homo sapien
ttatcattactaagaaggaggtcct

SEQ ID NO: 443491 - DNA, 25 bp, Homo sapien
gaggtccttcccagttggtggtctt

SEQ ID NO: 443492 - DNA, 25 bp, Homo sapien
ggtcttgccctctctttattgagca

SEQ ID NO: 443493 - DNA, 25 bp, Homo sapien
agcacctactgtgtaaaagttagag

SEQ ID NO: 443494 - DNA, 25 bp, Homo sapien
gttagagttctgctgatgctggtat

SEQ ID NO: 443495 - DNA, 25 bp, Homo sapien
gtatatgtggacacttcagcacctg

SEQ ID NO: 443496 - DNA, 25 bp, Homo sapien
tcagcacctgtccatggaggcccag

SEQ ID NO: 443497 - DNA, 25 bp, Homo sapien
aggaaattcagtggccctcaggtga

SEQ ID NO: 443498 - DNA, 25 bp, Homo sapien
tggccctcaggtgactgaatttctt

SEQ ID NO: 443499 - DNA, 25 bp, Homo sapien
taaaagttgcggcattgctgggcat

SEQ ID NO: 443500 - DNA, 25 bp, Homo sapien
gcattgctgggcatggtagttcaca

SEQ ID NO: 443501 - DNA, 25 bp, Homo sapien
gaagttgtgcagttgatcagtgcac

SEQ ID NO: 443502 - DNA, 25 bp, Homo sapien
cactggcatgtgtggtgtagtttct

SEQ ID NO: 443503 - DNA, 25 bp, Homo sapien
gtagtttctaaaaggcacttcacat

SEQ ID NO: 443504 - DNA, 25 bp, Homo sapien
aaaggcacttcacatttgaaatttt

SEQ ID NO: 443505 - DNA, 25 bp, Homo sapien
gaaagtttctagtgatctaaatgtc

SEQ ID NO: 443506 - DNA, 25 bp, Homo sapien
tctaaatgtctagttttgtattctt

SEQ ID NO: 443507 - DNA, 25 bp, Homo sapien
gtgtgttcactgtttctcagtatta

SEQ ID NO: 443508 - DNA, 25 bp, Homo sapien
ctgtttctcagtattaccacttgaa

SEQ ID NO: 443509 - DNA, 25 bp, Homo sapien
accacttgaataattctctgtacag

SEQ ID NO: 443510 - DNA, 25 bp, Homo sapien
ggtttgtgctatacactgggatgtc

SEQ ID NO: 443511 - DNA, 25 bp, Homo sapien
cactgggatgtctaattgcagcaat

SEQ ID NO: 443512 - DNA, 25 bp, Homo sapien
cctggacgagatgcggcgcctggtg

SEQ ID NO: 443513 - DNA, 25 bp, Homo sapien
gagatgcggcgcctggtggccttcc

SEQ ID NO: 443514 - DNA, 25 bp, Homo sapien
ttcggccaggccactgtgtgcccct

SEQ ID NO: 443515 - DNA, 25 bp, Homo sapien
gggccctgccctgacaagtgcgccg

SEQ ID NO: 443516 - DNA, 25 bp, Homo sapien
tgccctgacaagtgcgccgccttct

SEQ ID NO: 443517 - DNA, 25 bp, Homo sapien
cctccgcgctttgcaaacactgtca

SEQ ID NO: 443518 - DNA, 25 bp, Homo sapien
tgtgactgtctctctgcccggacag

SEQ ID NO: 443519 - DNA, 25 bp, Homo sapien
gactgtctctctgcccggacaggaa

SEQ ID NO: 443520 - DNA, 25 bp, Homo sapien
tctctgcccggacaggaaaggcctg

SEQ ID NO: 443521 - DNA, 25 bp, Homo sapien
tctgcccggacaggaaaggcctgga

SEQ ID NO: 443522 - DNA, 25 bp, Homo sapien
caggaaaggcctggagggaccctgc

SEQ ID NO: 443523 - DNA, 25 bp, Homo sapien
tcatgttttccattccactcaacaa

SEQ ID NO: 443524 - DNA, 25 bp, Homo sapien
catgttttccattccactcaacaaa

SEQ ID NO: 443525 - DNA, 25 bp, Homo sapien
tgttttccattccactcaacaaata

SEQ ID NO: 443526 - DNA, 25 bp, Homo sapien
ccactcaacaaatatcacttaaaaa

SEQ ID NO: 443527 - DNA, 25 bp, Homo sapien
taaaaacagtacagttggtgatttc

SEQ ID NO: 443528 - DNA, 25 bp, Homo sapien
aatcataaatatgtactgcggagtg

SEQ ID NO: 443529 - DNA, 25 bp, Homo sapien
gtactgcggagtgaaaaaaccaact

SEQ ID NO: 443530 - DNA, 25 bp, Homo sapien
aaaaaccaactacttaactatgatg

SEQ ID NO: 443531 - DNA, 25 bp, Homo sapien
aaccaactacttaactatgatgaaa

SEQ ID NO: 443532 - DNA, 25 bp, Homo sapien
cttaactatgatgaaatgggaactt

SEQ ID NO: 443533 - DNA, 25 bp, Homo sapien
gttaaatttgtagggataggccagg

SEQ ID NO: 443534 - DNA, 25 bp, Homo sapien
ctgtctgcctatctaatctatcatc

SEQ ID NO: 443535 - DNA, 25 bp, Homo sapien
gtctgcctatctaatctatcatctg

SEQ ID NO: 443536 - DNA, 25 bp, Homo sapien
tgcctatctaatctatcatctgtca

SEQ ID NO: 443537 - DNA, 25 bp, Homo sapien
gcctatctaatctatcatctgtcag

SEQ ID NO: 443538 - DNA, 25 bp, Homo sapien
tatctaatctatcatctgtcagtct

SEQ ID NO: 443539 - DNA, 25 bp, Homo sapien
tctaatctatcatctgtcagtctat

SEQ ID NO: 443540 - DNA, 25 bp, Homo sapien
atctatcatctgtcagtctatatct

SEQ ID NO: 443541 - DNA, 25 bp, Homo sapien
atcatctgtcagtctatatctaatc

SEQ ID NO: 443542 - DNA, 25 bp, Homo sapien
catctgtcagtctatatctaatcta

SEQ ID NO: 443543 - DNA, 25 bp, Homo sapien
ctgtcagtctatatctaatctagat

SEQ ID NO: 443544 - DNA, 25 bp, Homo sapien
gtcagtctatatctaatctagattt

SEQ ID NO: 443545 - DNA, 25 bp, Homo sapien
gaaaagagagcttttctctcaattt

SEQ ID NO: 443546 - DNA, 25 bp, Homo sapien
gagcttttctctcaattttaagtta

SEQ ID NO: 443547 - DNA, 25 bp, Homo sapien
gttatttacattactcattcatttg

SEQ ID NO: 443548 - DNA, 25 bp, Homo sapien
ctcattcatttgttctatatagcat

SEQ ID NO: 443549 - DNA, 25 bp, Homo sapien
catttgttctatatagcatgtctat

SEQ ID NO: 443550 - DNA, 25 bp, Homo sapien
tagcatgtctatttacttttatcaa

SEQ ID NO: 443551 - DNA, 25 bp, Homo sapien
gattttactatttcttaacatgatt

SEQ ID NO: 443552 - DNA, 25 bp, Homo sapien
actatttcttaacatgattcatttc

SEQ ID NO: 443553 - DNA, 25 bp, Homo sapien
cttaacatgattcatttctatttca

SEQ ID NO: 443554 - DNA, 25 bp, Homo sapien
tctatttcaggtactcccctttact

SEQ ID NO: 443555 - DNA, 25 bp, Homo sapien
gagtataaaattttaagtggccgtg

SEQ ID NO: 443556 - DNA, 25 bp, Homo sapien
atgcctgtggtgagatcccctgtag

SEQ ID NO: 443557 - DNA, 25 bp, Homo sapien
cctgtggtgagatcccctgtagggc

SEQ ID NO: 443558 - DNA, 25 bp, Homo sapien
gggcctctacggtcttccaaagctg

SEQ ID NO: 443559 - DNA, 25 bp, Homo sapien
ctacggtcttccaaagctgtgtcct

SEQ ID NO: 443560 - DNA, 25 bp, Homo sapien
agtggaggcccaaatccgttcccat

SEQ ID NO: 443561 - DNA, 25 bp, Homo sapien
aaatccgttcccatgttgaggcaag

SEQ ID NO: 443562 - DNA, 25 bp, Homo sapien
gttcccatgttgaggcaaggccctg

SEQ ID NO: 443563 - DNA, 25 bp, Homo sapien
cccatgttgaggcaaggccctggct

SEQ ID NO: 443564 - DNA, 25 bp, Homo sapien
tggaaaccgccttgaactcttcctt

SEQ ID NO: 443565 - DNA, 25 bp, Homo sapien
tgcctcctcgaccagccttgaaggg

SEQ ID NO: 443566 - DNA, 25 bp, Homo sapien
ggtgctcctctctcactacctggaa

SEQ ID NO: 443567 - DNA, 25 bp, Homo sapien
gatccatcagtcatgtagctagctg

SEQ ID NO: 443568 - DNA, 25 bp, Homo sapien
atccatcagtcatgtagctagctgt

SEQ ID NO: 443569 - DNA, 25 bp, Homo sapien
tccatcagtcatgtagctagctgta

SEQ ID NO: 443570 - DNA, 25 bp, Homo sapien
ccatcagtcatgtagctagctgtag

SEQ ID NO: 443571 - DNA, 25 bp, Homo sapien
catcagtcatgtagctagctgtaga

SEQ ID NO: 443572 - DNA, 25 bp, Homo sapien
atcagtcatgtagctagctgtagag

SEQ ID NO: 443573 - DNA, 25 bp, Homo sapien
tcagtcatgtagctagctgtagagc

SEQ ID NO: 443574 - DNA, 25 bp, Homo sapien
cagtcatgtagctagctgtagagct

SEQ ID NO: 443575 - DNA, 25 bp, Homo sapien
agtcatgtagctagctgtagagctt

SEQ ID NO: 443576 - DNA, 25 bp, Homo sapien
aggcccgtcaagatgcaggcaggca

SEQ ID NO: 443577 - DNA, 25 bp, Homo sapien
aagatgcaggcaggcattgccaccc

SEQ ID NO: 443578 - DNA, 25 bp, Homo sapien
attgccaccccagggatgaagacag

SEQ ID NO: 443579 - DNA, 25 bp, Homo sapien
atcctgcaaaagctaaaggctgcca

SEQ ID NO: 443580 - DNA, 25 bp, Homo sapien
ccccaagatccgtaactacaacatt

SEQ ID NO: 443581 - DNA, 25 bp, Homo sapien
acaacattatggactgacttcctcc

SEQ ID NO: 443582 - DNA, 25 bp, Homo sapien
gcccaggaggaaggccatgcgtctc

SEQ ID NO: 443583 - DNA, 25 bp, Homo sapien
aaggccatgcgtctctgggtctctt

SEQ ID NO: 443584 - DNA, 25 bp, Homo sapien
tgggtctcttctcgcccaagtgagg

SEQ ID NO: 443585 - DNA, 25 bp, Homo sapien
ttctcgcccaagtgaggcctgtgtg

SEQ ID NO: 443586 - DNA, 25 bp, Homo sapien
tgtgtgcccgccttccgtgatgcag

SEQ ID NO: 443587 - DNA, 25 bp, Homo sapien
gatccctcaaatacactacacagtg

SEQ ID NO: 443588 - DNA, 25 bp, Homo sapien
acactacacagtgtggctgccagga

SEQ ID NO: 443589 - DNA, 25 bp, Homo sapien
gctgccaggagtgcttcaccttagg

SEQ ID NO: 443590 - DNA, 25 bp, Homo sapien
accttaggcctcacaaaccaatgac

SEQ ID NO: 443591 - DNA, 25 bp, Homo sapien
gacatgttctcagccatatttcaaa

SEQ ID NO: 443592 - DNA, 25 bp, Homo sapien
agggaactctgctctggaaggaagc

SEQ ID NO: 443593 - DNA, 25 bp, Homo sapien
gtctgaaaccgtatctttcttcata

SEQ ID NO: 443594 - DNA, 25 bp, Homo sapien
cccacatctctccttgtgtgaaaag

SEQ ID NO: 443595 - DNA, 25 bp, Homo sapien
aaaagctggtgcttgttcgaggtag

SEQ ID NO: 443596 - DNA, 25 bp, Homo sapien
ttgttcgaggtagggcaaccaggcc

SEQ ID NO: 443597 - DNA, 25 bp, Homo sapien
gcaaccaggcccagcatacaagagg

SEQ ID NO: 443598 - DNA, 25 bp, Homo sapien
gtatgagggcctgaaatatgtgaca

SEQ ID NO: 443599 - DNA, 25 bp, Homo sapien
acaaatgaatgtgagtaccccttct

SEQ ID NO: 443600 - DNA, 25 bp, Homo sapien
gaacactgaaagctattctcttgaa

SEQ ID NO: 443601 - DNA, 25 bp, Homo sapien
gaattgatcttaagtgtctccttgc

SEQ ID NO: 443602 - DNA, 25 bp, Homo sapien
gtgtctccttgctctggtaaaagat

SEQ ID NO: 443603 - DNA, 25 bp, Homo sapien
gatagatttgtagctcacttgatga

SEQ ID NO: 443604 - DNA, 25 bp, Homo sapien
tgtagctcacttgatgatggtgctg

SEQ ID NO: 443605 - DNA, 25 bp, Homo sapien
tggtgctggtgaattgctctgctct

SEQ ID NO: 443606 - DNA, 25 bp, Homo sapien
aattgctctgctctgtctgagattt

SEQ ID NO: 443607 - DNA, 25 bp, Homo sapien
ctctgctctgtctgagatttttaaa

SEQ ID NO: 443608 - DNA, 25 bp, Homo sapien
gagagtaatctgcagacaattgata

SEQ ID NO: 443609 - DNA, 25 bp, Homo sapien
cttgaagtctggtgatgctgcccat

SEQ ID NO: 443610 - DNA, 25 bp, Homo sapien
ttgaagtctggtgatgctgcccatt

SEQ ID NO: 443611 - DNA, 25 bp, Homo sapien
tgaagtctggtgatgctgcccattg

SEQ ID NO: 443612 - DNA, 25 bp, Homo sapien
gaagtctggtgatgctgcccattgt

SEQ ID NO: 443613 - DNA, 25 bp, Homo sapien
aagtctggtgatgctgcccattgtt

SEQ ID NO: 443614 - DNA, 25 bp, Homo sapien
agtctggtgatgctgcccattgttg

SEQ ID NO: 443615 - DNA, 25 bp, Homo sapien
gtctggtgatgctgcccattgttga

SEQ ID NO: 443616 - DNA, 25 bp, Homo sapien
tctggtgatgctgcccattgttgat

SEQ ID NO: 443617 - DNA, 25 bp, Homo sapien
gctgcccattgttgatatggttcct

SEQ ID NO: 443618 - DNA, 25 bp, Homo sapien
ccacctttgggtcgctttgctgttc

SEQ ID NO: 443619 - DNA, 25 bp, Homo sapien
ggagctggcaaggtcacccagtctg

SEQ ID NO: 443620 - DNA, 25 bp, Homo sapien
gacatacatataggcatccttcttg

SEQ ID NO: 443621 - DNA, 25 bp, Homo sapien
ataggcatccttcttgatactgaaa

SEQ ID NO: 443622 - DNA, 25 bp, Homo sapien
gatactgaaaactatcttctttgtt

SEQ ID NO: 443623 - DNA, 25 bp, Homo sapien
tgaaaggaactattgctaaatgcag

SEQ ID NO: 443624 - DNA, 25 bp, Homo sapien
gaacaagctcattgcagttacctat

SEQ ID NO: 443625 - DNA, 25 bp, Homo sapien
agttacctattgtgcatctttttaa

SEQ ID NO: 443626 - DNA, 25 bp, Homo sapien
tgtaaccataaatctgacagcatgt

SEQ ID NO: 443627 - DNA, 25 bp, Homo sapien
gacagcatgtctcattggcttatct

SEQ ID NO: 443628 - DNA, 25 bp, Homo sapien
atctggtagcaaatctaggccccgt

SEQ ID NO: 443629 - DNA, 25 bp, Homo sapien
ggtagcaaatctaggccccgtcagc

SEQ ID NO: 443630 - DNA, 25 bp, Homo sapien
gaaaggctccatggaagacatacat

SEQ ID NO: 443631 - DNA, 25 bp, Homo sapien
aactcctcatctatgctaatagcaa

SEQ ID NO: 443632 - DNA, 25 bp, Homo sapien
atctatgctaatagcaaccggccct

SEQ ID NO: 443633 - DNA, 25 bp, Homo sapien
tatgctaatagcaaccggccctcag

SEQ ID NO: 443634 - DNA, 25 bp, Homo sapien
gctgattaatactgccagtcttatg

SEQ ID NO: 443635 - DNA, 25 bp, Homo sapien
taatactgccagtcttatgacagca

SEQ ID NO: 443636 - DNA, 25 bp, Homo sapien
atactgccagtcttatgacagcagc

SEQ ID NO: 443637 - DNA, 25 bp, Homo sapien
actgccagtcttatgacagcagcgt

SEQ ID NO: 443638 - DNA, 25 bp, Homo sapien
tgccagtcttatgacagcagcgtga

SEQ ID NO: 443639 - DNA, 25 bp, Homo sapien
ccagtcttatgacagcagcgtgagt

SEQ ID NO: 443640 - DNA, 25 bp, Homo sapien
gaagtaccttggtatgatgtacact

SEQ ID NO: 443641 - DNA, 25 bp, Homo sapien
agtaccttggtatgatgtacactgg

SEQ ID NO: 443642 - DNA, 25 bp, Homo sapien
gggcatcctgtgatccagttaagtt

SEQ ID NO: 443643 - DNA, 25 bp, Homo sapien
attaaccatcacacccctgtatagt

SEQ ID NO: 443644 - DNA, 25 bp, Homo sapien
aggttggctcttatagaacttacta

SEQ ID NO: 443645 - DNA, 25 bp, Homo sapien
ttactatttaaacttcacctcctcg

SEQ ID NO: 443646 - DNA, 25 bp, Homo sapien
cacctcctcgatcttgtaggtttaa

SEQ ID NO: 443647 - DNA, 25 bp, Homo sapien
ggtttaagtttgcacttatcattca

SEQ ID NO: 443648 - DNA, 25 bp, Homo sapien
atcattcatttcactggcaaaccaa

SEQ ID NO: 443649 - DNA, 25 bp, Homo sapien
ggcaaaccaatgagaacgtgtttta

SEQ ID NO: 443650 - DNA, 25 bp, Homo sapien
ttgggattcccttgatttacaaccg

SEQ ID NO: 443651 - DNA, 25 bp, Homo sapien
taatctctctggaaacagcctcaca

SEQ ID NO: 443652 - DNA, 25 bp, Homo sapien
ttagctaaacatctgggcatcctgt

SEQ ID NO: 443653 - DNA, 25 bp, Homo sapien
gtatgttgtgtattactgacagttc

SEQ ID NO: 443654 - DNA, 25 bp, Homo sapien
tactgacagttctagattaatttct

SEQ ID NO: 443655 - DNA, 25 bp, Homo sapien
gaaaagttttgagagggcactgtca

SEQ ID NO: 443656 - DNA, 25 bp, Homo sapien
gagagggcactgtcaacttgggttt

SEQ ID NO: 443657 - DNA, 25 bp, Homo sapien
gggcactgtcaacttgggtttaaga

SEQ ID NO: 443658 - DNA, 25 bp, Homo sapien
gggtttaagacaggaggacattgca

SEQ ID NO: 443659 - DNA, 25 bp, Homo sapien
ggacattgcaagttcacacctttca

SEQ ID NO: 443660 - DNA, 25 bp, Homo sapien
gcaagttcacacctttcataagcat

SEQ ID NO: 443661 - DNA, 25 bp, Homo sapien
gaaagtattttcatcctgttaggat

SEQ ID NO: 443662 - DNA, 25 bp, Homo sapien
atcctgttaggattcatatctaaga

SEQ ID NO: 443663 - DNA, 25 bp, Homo sapien
gagttatgcattgcacatacacaaa

SEQ ID NO: 443664 - DNA, 25 bp, Homo sapien
attctaagccctgggtctgagtgcc

SEQ ID NO: 443665 - DNA, 25 bp, Homo sapien
tgggatccccaaatgccaggccaac

SEQ ID NO: 443666 - DNA, 25 bp, Homo sapien
agcgcacctcagtgtgtcgacatag

SEQ ID NO: 443667 - DNA, 25 bp, Homo sapien
gtgtgtcgacatagctcctgtccag

SEQ ID NO: 443668 - DNA, 25 bp, Homo sapien
agctcctggcttgagtccacggcag

SEQ ID NO: 443669 - DNA, 25 bp, Homo sapien
gggcttcagaggtccacccttcttt

SEQ ID NO: 443670 - DNA, 25 bp, Homo sapien
gtccacccttctttagagcgagcta

SEQ ID NO: 443671 - DNA, 25 bp, Homo sapien
ttagagcgagctactccccagactt

SEQ ID NO: 443672 - DNA, 25 bp, Homo sapien
gacttcactaggcagcctgtctgac

SEQ ID NO: 443673 - DNA, 25 bp, Homo sapien
taggcagcctgtctgacctcatcta

SEQ ID NO: 443674 - DNA, 25 bp, Homo sapien
agcctgtctgacctcatctatgcct

SEQ ID NO: 443675 - DNA, 25 bp, Homo sapien
caaagctgtttttgtggtggcacca

SEQ ID NO: 443676 - DNA, 25 bp, Homo sapien
tgtggtggcaccaagtccttcagct

SEQ ID NO: 443677 - DNA, 25 bp, Homo sapien
ttcagctctccctcattcagacaga

SEQ ID NO: 443678 - DNA, 25 bp, Homo sapien
gacagagcagaatgactccgtcctg

SEQ ID NO: 443679 - DNA, 25 bp, Homo sapien
atgactccgtcctgacagaatctgt

SEQ ID NO: 443680 - DNA, 25 bp, Homo sapien
atctgtcattcgaattctgctcttg

SEQ ID NO: 443681 - DNA, 25 bp, Homo sapien
ttcgaattctgctcttggttcagag

SEQ ID NO: 443682 - DNA, 25 bp, Homo sapien
gaacctcgtggctgaggagagactc

SEQ ID NO: 443683 - DNA, 25 bp, Homo sapien
gaggagagactcagctctgggatcc

SEQ ID NO: 443684 - DNA, 25 bp, Homo sapien
ttggccggaagtcgcctttgtctaa

SEQ ID NO: 443685 - DNA, 25 bp, Homo sapien
cggaagtcgcctttgtctaacaggt

SEQ ID NO: 443686 - DNA, 25 bp, Homo sapien
gggcctctgacacagttgcaaactc

SEQ ID NO: 443687 - DNA, 25 bp, Homo sapien
cagaagtgacaaatgcctccgagca

SEQ ID NO: 443688 - DNA, 25 bp, Homo sapien
tccgagcagcagcttattgtgaaaa

SEQ ID NO: 443689 - DNA, 25 bp, Homo sapien
gtgaaaagatccatgtaccctactc

SEQ ID NO: 443690 - DNA, 25 bp, Homo sapien
tccatgtaccctactctatactata

SEQ ID NO: 443691 - DNA, 25 bp, Homo sapien
gaaagatcactctcagattctcgct

SEQ ID NO: 443692 - DNA, 25 bp, Homo sapien
cagattctcgctcagactaggtata

SEQ ID NO: 443693 - DNA, 25 bp, Homo sapien
tttttctcaggcatattgacaatgg

SEQ ID NO: 443694 - DNA, 25 bp, Homo sapien
gctcaggatgaacggactgtgacca

SEQ ID NO: 443695 - DNA, 25 bp, Homo sapien
ggagtatatccaaatctattcagtg

SEQ ID NO: 443696 - DNA, 25 bp, Homo sapien
aatctattcagtgttaatacctcac

SEQ ID NO: 443697 - DNA, 25 bp, Homo sapien
tacacttgggtattacttgtttctc

SEQ ID NO: 443698 - DNA, 25 bp, Homo sapien
acttgtttctcttcttgtggctaaa

SEQ ID NO: 443699 - DNA, 25 bp, Homo sapien
gtggctaaaggctcaccaacaaaga

SEQ ID NO: 443700 - DNA, 25 bp, Homo sapien
caacaaagacttaatttcacctgaa

SEQ ID NO: 443701 - DNA, 25 bp, Homo sapien
aaattgtacaatgtctggtttgaaa

SEQ ID NO: 443702 - DNA, 25 bp, Homo sapien
ttttattatggccttcacatcctag

SEQ ID NO: 443703 - DNA, 25 bp, Homo sapien
atggccttcacatcctaggattcaa

SEQ ID NO: 443704 - DNA, 25 bp, Homo sapien
atttgaatgtgatagctggcacacg

SEQ ID NO: 443705 - DNA, 25 bp, Homo sapien
gctggcacacggagggatttattca

SEQ ID NO: 443706 - DNA, 25 bp, Homo sapien
aaaaatggcctgaatcacgttgagc

SEQ ID NO: 443707 - DNA, 25 bp, Homo sapien
cctgaatcacgttgagcagccagca

SEQ ID NO: 443708 - DNA, 25 bp, Homo sapien
tggctccattctgcctgcctgaagg

SEQ ID NO: 443709 - DNA, 25 bp, Homo sapien
aggcctggccaggatgtaaccacct

SEQ ID NO: 443710 - DNA, 25 bp, Homo sapien
ggcctggccaggatgtaaccacctt

SEQ ID NO: 443711 - DNA, 25 bp, Homo sapien
ccaccttctttattgaagactgggt

SEQ ID NO: 443712 - DNA, 25 bp, Homo sapien
ccttctttattgaagactgggtgtc

SEQ ID NO: 443713 - DNA, 25 bp, Homo sapien
attgaagactgggtgtctgccatac

SEQ ID NO: 443714 - DNA, 25 bp, Homo sapien
ttgaagactgggtgtctgccatact

SEQ ID NO: 443715 - DNA, 25 bp, Homo sapien
gaagactgggtgtctgccatacttt

SEQ ID NO: 443716 - DNA, 25 bp, Homo sapien
agactgggtgtctgccatactttaa

SEQ ID NO: 443717 - DNA, 25 bp, Homo sapien
gactgggtgtctgccatactttaaa

SEQ ID NO: 443718 - DNA, 25 bp, Homo sapien
gtctgccatactttaaaaacactta

SEQ ID NO: 443719 - DNA, 25 bp, Homo sapien
ttcagtcagtccatttgtcccttga

SEQ ID NO: 443720 - DNA, 25 bp, Homo sapien
atttgtcccttgatctggccttgct

SEQ ID NO: 443721 - DNA, 25 bp, Homo sapien
acggctcctctcacagatgataaat

SEQ ID NO: 443722 - DNA, 25 bp, Homo sapien
acagatgataaatttcgcccgtagt

SEQ ID NO: 443723 - DNA, 25 bp, Homo sapien
aatttcgcccgtagtatccatattg

SEQ ID NO: 443724 - DNA, 25 bp, Homo sapien
gatttgctctgtttccaacacgctc

SEQ ID NO: 443725 - DNA, 25 bp, Homo sapien
gctcttccttcctctaaacatagga

SEQ ID NO: 443726 - DNA, 25 bp, Homo sapien
tctaaacataggaccccgctctgcg

SEQ ID NO: 443727 - DNA, 25 bp, Homo sapien
gccccagcctagctgtgtaattgta

SEQ ID NO: 443728 - DNA, 25 bp, Homo sapien
ctgtgtaattgtacggcctctgcaa

SEQ ID NO: 443729 - DNA, 25 bp, Homo sapien
tacggcctctgcaatgccagaagat

SEQ ID NO: 443730 - DNA, 25 bp, Homo sapien
agcactagtgcagtgggtgtgggct

SEQ ID NO: 443731 - DNA, 25 bp, Homo sapien
gcactagtgcagtgggtgtgggctg

SEQ ID NO: 443732 - DNA, 25 bp, Homo sapien
cactagtgcagtgggtgtgggctgg

SEQ ID NO: 443733 - DNA, 25 bp, Homo sapien
actagtgcagtgggtgtgggctgga

SEQ ID NO: 443734 - DNA, 25 bp, Homo sapien
ctagtgcagtgggtgtgggctggat

SEQ ID NO: 443735 - DNA, 25 bp, Homo sapien
tagtgcagtgggtgtgggctggatc

SEQ ID NO: 443736 - DNA, 25 bp, Homo sapien
agtgcagtgggtgtgggctggatcc

SEQ ID NO: 443737 - DNA, 25 bp, Homo sapien
ctcactcagcactagtgcagtgggt

SEQ ID NO: 443738 - DNA, 25 bp, Homo sapien
cagcactagtgcagtgggtgtgggc

SEQ ID NO: 443739 - DNA, 25 bp, Homo sapien
cctgccgccggcgatgtaactcggg

SEQ ID NO: 443740 - DNA, 25 bp, Homo sapien
cagctacgaggcgatgatggacgac

SEQ ID NO: 443741 - DNA, 25 bp, Homo sapien
tacgaggcgatgatggacgaccaga

SEQ ID NO: 443742 - DNA, 25 bp, Homo sapien
ggcgatgatggacgaccagaaccac

SEQ ID NO: 443743 - DNA, 25 bp, Homo sapien
atgatggacgaccagaaccacaaca

SEQ ID NO: 443744 - DNA, 25 bp, Homo sapien
agaaccacaacaactgggaggctgc

SEQ ID NO: 443745 - DNA, 25 bp, Homo sapien
accacaacaactgggaggctgcggt

SEQ ID NO: 443746 - DNA, 25 bp, Homo sapien
gtcagccgcgtcttcaagctagtcg

SEQ ID NO: 443747 - DNA, 25 bp, Homo sapien
tcttcaagctagtcggccccgcgga

SEQ ID NO: 443748 - DNA, 25 bp, Homo sapien
gtcggccccgcggagagcgagagac

SEQ ID NO: 443749 - DNA, 25 bp, Homo sapien
agcgagagaccctgcgcaccgcagc

SEQ ID NO: 443750 - DNA, 25 bp, Homo sapien
atggattaatacaagagtcctgtga

SEQ ID NO: 443751 - DNA, 25 bp, Homo sapien
gagtcctgtgataatatacaaccaa

SEQ ID NO: 443752 - DNA, 25 bp, Homo sapien
tatacaaccaagacagggttctttt

SEQ ID NO: 443753 - DNA, 25 bp, Homo sapien
cagggttcttttaacatggattcca

SEQ ID NO: 443754 - DNA, 25 bp, Homo sapien
ggattccatgcagtgaatgaagaca

SEQ ID NO: 443755 - DNA, 25 bp, Homo sapien
gaagacataggtttcttacccaaca

SEQ ID NO: 443756 - DNA, 25 bp, Homo sapien
ataggtttcttacccaacacaaatg

SEQ ID NO: 443757 - DNA, 25 bp, Homo sapien
ttacccaacacaaatggacagtgga

SEQ ID NO: 443758 - DNA, 25 bp, Homo sapien
ggacagtggatttgactttctaaag

SEQ ID NO: 443759 - DNA, 25 bp, Homo sapien
gaaagatggcacactaacccagata

SEQ ID NO: 443760 - DNA, 25 bp, Homo sapien
gataatagtttttatgcctggaatt

SEQ ID NO: 443761 - DNA, 25 bp, Homo sapien
catgatgttgaagagctgcgacgcg

SEQ ID NO: 443762 - DNA, 25 bp, Homo sapien
tataagagcacatactggccaaaat

SEQ ID NO: 443763 - DNA, 25 bp, Homo sapien
atactggccaaaattggatggtgcc

SEQ ID NO: 443764 - DNA, 25 bp, Homo sapien
ggatggtgccatagatcaactttta

SEQ ID NO: 443765 - DNA, 25 bp, Homo sapien
gatcaacttttaactcagagtcctg

SEQ ID NO: 443766 - DNA, 25 bp, Homo sapien
agagtcctggtgactatatccccat

SEQ ID NO: 443767 - DNA, 25 bp, Homo sapien
tggtgactatatccccatatcctat

SEQ ID NO: 443768 - DNA, 25 bp, Homo sapien
atatccccatatcctatgaacagat

SEQ ID NO: 443769 - DNA, 25 bp, Homo sapien
aaatgtgtatgccagcagcactcgg

SEQ ID NO: 443770 - DNA, 25 bp, Homo sapien
tgccagcagcactcggaacagatgt

SEQ ID NO: 443771 - DNA, 25 bp, Homo sapien
gcagcactcggaacagatgtatagt

SEQ ID NO: 443772 - DNA, 25 bp, Homo sapien
ttgttaatccccaccagctagactt

SEQ ID NO: 443773 - DNA, 25 bp, Homo sapien
cccaccagctagactttgaacttaa

SEQ ID NO: 443774 - DNA, 25 bp, Homo sapien
tttgtgtcatttactagacgtgatt

SEQ ID NO: 443775 - DNA, 25 bp, Homo sapien
agacgtgatttttagttctgtttga

SEQ ID NO: 443776 - DNA, 25 bp, Homo sapien
gattatatttcctacacaaacttct

SEQ ID NO: 443777 - DNA, 25 bp, Homo sapien
cttcttatttaacaggatagcctac

SEQ ID NO: 443778 - DNA, 25 bp, Homo sapien
caggatagcctactaaattaaatgt

SEQ ID NO: 443779 - DNA, 25 bp, Homo sapien
tgtttcttatttcacttaactcatt

SEQ ID NO: 443780 - DNA, 25 bp, Homo sapien
actcatttgattaaactgtattcta

SEQ ID NO: 443781 - DNA, 25 bp, Homo sapien
ccctattcagttttaatcttggaat

SEQ ID NO: 443782 - DNA, 25 bp, Homo sapien
aattgtgatgtcattgagactatat

SEQ ID NO: 443783 - DNA, 25 bp, Homo sapien
tctgatttctcatttgagtattaca

SEQ ID NO: 443784 - DNA, 25 bp, Homo sapien
gagtattacaatttttgaacaactg

SEQ ID NO: 443785 - DNA, 25 bp, Homo sapien
tgaacaactgttggaaatgtaactt

SEQ ID NO: 443786 - DNA, 25 bp, Homo sapien
gctgctttaagaagaaatacccact

SEQ ID NO: 443787 - DNA, 25 bp, Homo sapien
gaacaagcattagttttggctgtca

SEQ ID NO: 443788 - DNA, 25 bp, Homo sapien
aagcattagttttggctgtcatcaa

SEQ ID NO: 443789 - DNA, 25 bp, Homo sapien
attagttttggctgtcatcaactta

SEQ ID NO: 443790 - DNA, 25 bp, Homo sapien
gttttggctgtcatcaacttattat

SEQ ID NO: 443791 - DNA, 25 bp, Homo sapien
ttggctgtcatcaacttattatatg

SEQ ID NO: 443792 - DNA, 25 bp, Homo sapien
aattgtttttactgatgatgtagat

SEQ ID NO: 443793 - DNA, 25 bp, Homo sapien
ctgatgatgtagatacttttgtaaa

SEQ ID NO: 443794 - DNA, 25 bp, Homo sapien
actgctgctgatagcctttatcttc

SEQ ID NO: 443795 - DNA, 25 bp, Homo sapien
tgctgatagcctttatcttcctcat

SEQ ID NO: 443796 - DNA, 25 bp, Homo sapien
agaaaatatcactccaagccccagg

SEQ ID NO: 443797 - DNA, 25 bp, Homo sapien
agccaagctttcatccatcccaggg

SEQ ID NO: 443798 - DNA, 25 bp, Homo sapien
gggaatcacttacctatgccagcac

SEQ ID NO: 443799 - DNA, 25 bp, Homo sapien
tatgccagcacaactttcaaactct

SEQ ID NO: 443800 - DNA, 25 bp, Homo sapien
agcacaactttcaaactctcagaag

SEQ ID NO: 443801 - DNA, 25 bp, Homo sapien
gtaacaaactaactcagcttttcca

SEQ ID NO: 443802 - DNA, 25 bp, Homo sapien
cagcttttccaatgaggcttgaatc

SEQ ID NO: 443803 - DNA, 25 bp, Homo sapien
aatgaggcttgaatccatttcctct

SEQ ID NO: 443804 - DNA, 25 bp, Homo sapien
tatcttcacacatcactttcacttt

SEQ ID NO: 443805 - DNA, 25 bp, Homo sapien
ctaggcaataagaatcttagggatc

SEQ ID NO: 443806 - DNA, 25 bp, Homo sapien
gaatcttagggatcacagattgact

SEQ ID NO: 443807 - DNA, 25 bp, Homo sapien
atcttagggatcacagattgactct

SEQ ID NO: 443808 - DNA, 25 bp, Homo sapien
tcttagggatcacagattgactctt

SEQ ID NO: 443809 - DNA, 25 bp, Homo sapien
cttagggatcacagattgactcttg

SEQ ID NO: 443810 - DNA, 25 bp, Homo sapien
ttagggatcacagattgactcttgg

SEQ ID NO: 443811 - DNA, 25 bp, Homo sapien
tagggatcacagattgactcttggc

SEQ ID NO: 443812 - DNA, 25 bp, Homo sapien
agggatcacagattgactcttggct

SEQ ID NO: 443813 - DNA, 25 bp, Homo sapien
gggatcacagattgactcttggctg

SEQ ID NO: 443814 - DNA, 25 bp, Homo sapien
ggatcacagattgactcttggctgg

SEQ ID NO: 443815 - DNA, 25 bp, Homo sapien
gatcacagattgactcttggctggg

SEQ ID NO: 443816 - DNA, 25 bp, Homo sapien
agcttctccaagcatcaccctggga

SEQ ID NO: 443817 - DNA, 25 bp, Homo sapien
aagcatcaccctgggagtttcctga

SEQ ID NO: 443818 - DNA, 25 bp, Homo sapien
gagggttttctcataaatgagggct

SEQ ID NO: 443819 - DNA, 25 bp, Homo sapien
aaatgagggctgcacattgcctgtt

SEQ ID NO: 443820 - DNA, 25 bp, Homo sapien
tgagggctgcacattgcctgttctg

SEQ ID NO: 443821 - DNA, 25 bp, Homo sapien
gggctgcacattgcctgttctgctt

SEQ ID NO: 443822 - DNA, 25 bp, Homo sapien
ctgttctgcttcgaagtattcaata

SEQ ID NO: 443823 - DNA, 25 bp, Homo sapien
ccaaacacttctgctttcacttaag

SEQ ID NO: 443824 - DNA, 25 bp, Homo sapien
acttctgctttcacttaagtgtctg

SEQ ID NO: 443825 - DNA, 25 bp, Homo sapien
ttcacttaagtgtctggcccgcaat

SEQ ID NO: 443826 - DNA, 25 bp, Homo sapien
acttaagtgtctggcccgcaatact

SEQ ID NO: 443827 - DNA, 25 bp, Homo sapien
acccatggaacaatatgcttaggat

SEQ ID NO: 443828 - DNA, 25 bp, Homo sapien
ggaagcagtccttacttacacttct

SEQ ID NO: 443829 - DNA, 25 bp, Homo sapien
acttcttgtctgttttaggtgtact

SEQ ID NO: 443830 - DNA, 25 bp, Homo sapien
gtacttgttaattcttatgtcctaa

SEQ ID NO: 443831 - DNA, 25 bp, Homo sapien
ttaattctgagttccttacacagca

SEQ ID NO: 443832 - DNA, 25 bp, Homo sapien
gagttccttacacagcattttaggg

SEQ ID NO: 443833 - DNA, 25 bp, Homo sapien
acaggcaggatgacactttgtgtta

SEQ ID NO: 443834 - DNA, 25 bp, Homo sapien
gagtaaccaagatacctccagggtg

SEQ ID NO: 443835 - DNA, 25 bp, Homo sapien
atacctccagggtgtcattgggttc

SEQ ID NO: 443836 - DNA, 25 bp, Homo sapien
gtgtcattgggttccagctgctctc

SEQ ID NO: 443837 - DNA, 25 bp, Homo sapien
ctgctctcctccacattgaatgata

SEQ ID NO: 443838 - DNA, 25 bp, Homo sapien
gttcacttttgtaattgatatacag

SEQ ID NO: 443839 - DNA, 25 bp, Homo sapien
ttcacttttgtaattgatatacagc

SEQ ID NO: 443840 - DNA, 25 bp, Homo sapien
tcacttttgtaattgatatacagca

SEQ ID NO: 443841 - DNA, 25 bp, Homo sapien
cacttttgtaattgatatacagcat

SEQ ID NO: 443842 - DNA, 25 bp, Homo sapien
acttttgtaattgatatacagcatt

SEQ ID NO: 443843 - DNA, 25 bp, Homo sapien
cttttgtaattgatatacagcattt

SEQ ID NO: 443844 - DNA, 25 bp, Homo sapien
ttgtaattgatatacagcatttttt

SEQ ID NO: 443845 - DNA, 25 bp, Homo sapien
aagtcaggagcagcagggtttatgt

SEQ ID NO: 443846 - DNA, 25 bp, Homo sapien
tcaggagcagcagggtttatgttgt

SEQ ID NO: 443847 - DNA, 25 bp, Homo sapien
aggagcagcagggtttatgttgttt

SEQ ID NO: 443848 - DNA, 25 bp, Homo sapien
gagcagcagggtttatgttgtttgt

SEQ ID NO: 443849 - DNA, 25 bp, Homo sapien
agcctgtttccaatttaaagcccag

SEQ ID NO: 443850 - DNA, 25 bp, Homo sapien
aaagcccagatttcaatacaaacct

SEQ ID NO: 443851 - DNA, 25 bp, Homo sapien
gggctttcccactctggaatgaagg

SEQ ID NO: 443852 - DNA, 25 bp, Homo sapien
tgtgaatcatagtgtctctgctcct

SEQ ID NO: 443853 - DNA, 25 bp, Homo sapien
atagtgtctctgctcctgggattca

SEQ ID NO: 443854 - DNA, 25 bp, Homo sapien
tcctgggattcagaccaaatttccc

SEQ ID NO: 443855 - DNA, 25 bp, Homo sapien
attctcaggctatttgtttgaatac

SEQ ID NO: 443856 - DNA, 25 bp, Homo sapien
gaatacctgcttacagtggtacaca

SEQ ID NO: 443857 - DNA, 25 bp, Homo sapien
attacgggttggtggtcggcttcat

SEQ ID NO: 443858 - DNA, 25 bp, Homo sapien
tcggcttcatgttaggaggacaccc

SEQ ID NO: 443859 - DNA, 25 bp, Homo sapien
gttaggaggacacccctccatctgt

SEQ ID NO: 443860 - DNA, 25 bp, Homo sapien
ggtagtgtaaggcacaactgtttat

SEQ ID NO: 443861 - DNA, 25 bp, Homo sapien
gtgtaaggcacaactgtttatcaac

SEQ ID NO: 443862 - DNA, 25 bp, Homo sapien
gtaaggcacaactgtttatcaactg

SEQ ID NO: 443863 - DNA, 25 bp, Homo sapien
aaggcacaactgtttatcaactggt

SEQ ID NO: 443864 - DNA, 25 bp, Homo sapien
ggcacaactgtttatcaactggtat

SEQ ID NO: 443865 - DNA, 25 bp, Homo sapien
aactgtttatcaactggtatctaag

SEQ ID NO: 443866 - DNA, 25 bp, Homo sapien
ggtatctaagtatttcaggccagac

SEQ ID NO: 443867 - DNA, 25 bp, Homo sapien
atctaagtatttcaggccagacacg

SEQ ID NO: 443868 - DNA, 25 bp, Homo sapien
ctaagtatttcaggccagacacgtg

SEQ ID NO: 443869 - DNA, 25 bp, Homo sapien
agtatttcaggccagacacgtggct

SEQ ID NO: 443870 - DNA, 25 bp, Homo sapien
gggtcgaggctgtagcaagtcatga

SEQ ID NO: 443871 - DNA, 25 bp, Homo sapien
gtgattattattattcatcctcctt

SEQ ID NO: 443872 - DNA, 25 bp, Homo sapien
tattattattcatcctccttcctct

SEQ ID NO: 443873 - DNA, 25 bp, Homo sapien
tgcaggcctcctctcacttgctggt

SEQ ID NO: 443874 - DNA, 25 bp, Homo sapien
agagactcttctaaatcctcagctc

SEQ ID NO: 443875 - DNA, 25 bp, Homo sapien
taaatcctcagctcctggaaacagg

SEQ ID NO: 443876 - DNA, 25 bp, Homo sapien
aacaggagatttggttctggcctca

SEQ ID NO: 443877 - DNA, 25 bp, Homo sapien
tttggttctggcctcacatttaacc

SEQ ID NO: 443878 - DNA, 25 bp, Homo sapien
ggttctggcctcacatttaaccctc

SEQ ID NO: 443879 - DNA, 25 bp, Homo sapien
ctgctgctccaggagtgcatagact

SEQ ID NO: 443880 - DNA, 25 bp, Homo sapien
aggagtgcatagactcgccccttgt

SEQ ID NO: 443881 - DNA, 25 bp, Homo sapien
agactcgccccttgttctggagcag

SEQ ID NO: 443882 - DNA, 25 bp, Homo sapien
gttctttttgcttatatgtactttt

SEQ ID NO: 443883 - DNA, 25 bp, Homo sapien
actttttaatgaacacgtgtctcac

SEQ ID NO: 443884 - DNA, 25 bp, Homo sapien
tttttaatgaacacgtgtctcacac

SEQ ID NO: 443885 - DNA, 25 bp, Homo sapien
tttaatgaacacgtgtctcacacac

SEQ ID NO: 443886 - DNA, 25 bp, Homo sapien
gtcaaataatttgcaaccagcttat

SEQ ID NO: 443887 - DNA, 25 bp, Homo sapien
gggcacctaaactcttgatgaaaga

SEQ ID NO: 443888 - DNA, 25 bp, Homo sapien
tacatacatccatataacatatatc

SEQ ID NO: 443889 - DNA, 25 bp, Homo sapien
aacatatatcacaaacttaaccaag

SEQ ID NO: 443890 - DNA, 25 bp, Homo sapien
tatcacaaacttaaccaagcttatt

SEQ ID NO: 443891 - DNA, 25 bp, Homo sapien
caaacttaaccaagcttatttctgt

SEQ ID NO: 443892 - DNA, 25 bp, Homo sapien
caagcttatttctgtgtggtgtgaa

SEQ ID NO: 443893 - DNA, 25 bp, Homo sapien
gttatatcataatgagactaccaat

SEQ ID NO: 443894 - DNA, 25 bp, Homo sapien
tatatcataatgagactaccaatta

SEQ ID NO: 443895 - DNA, 25 bp, Homo sapien
taatgagactaccaattattagact

SEQ ID NO: 443896 - DNA, 25 bp, Homo sapien
atgagactaccaattattagacttt

SEQ ID NO: 443897 - DNA, 25 bp, Homo sapien
tgagactaccaattattagactttt

SEQ ID NO: 443898 - DNA, 25 bp, Homo sapien
gagactaccaattattagacttttt

SEQ ID NO: 443899 - DNA, 25 bp, Homo sapien
agggttccaccatgctagcaggatg

SEQ ID NO: 443900 - DNA, 25 bp, Homo sapien
gggttccaccatgctagcaggatgg

SEQ ID NO: 443901 - DNA, 25 bp, Homo sapien
ggttccaccatgctagcaggatggt

SEQ ID NO: 443902 - DNA, 25 bp, Homo sapien
gttccaccatgctagcaggatggtc

SEQ ID NO: 443903 - DNA, 25 bp, Homo sapien
ttccaccatgctagcaggatggtct

SEQ ID NO: 443904 - DNA, 25 bp, Homo sapien
tcaaccgaaaactgggggcaaggca

SEQ ID NO: 443905 - DNA, 25 bp, Homo sapien
ggcagaggacaggttttctcaggtt

SEQ ID NO: 443906 - DNA, 25 bp, Homo sapien
agaggacaggttttctcaggttaag

SEQ ID NO: 443907 - DNA, 25 bp, Homo sapien
gaggacaggttttctcaggttaaga

SEQ ID NO: 443908 - DNA, 25 bp, Homo sapien
aggacaggttttctcaggttaagag

SEQ ID NO: 443909 - DNA, 25 bp, Homo sapien
ggacaggttttctcaggttaagaga

SEQ ID NO: 443910 - DNA, 25 bp, Homo sapien
gacaggttttctcaggttaagagaa

SEQ ID NO: 443911 - DNA, 25 bp, Homo sapien
aaaatactgataaattcggatcaaa

SEQ ID NO: 443912 - DNA, 25 bp, Homo sapien
aatactgataaattcggatcaaatt

SEQ ID NO: 443913 - DNA, 25 bp, Homo sapien
tactgataaattcggatcaaatttg

SEQ ID NO: 443914 - DNA, 25 bp, Homo sapien
ctgataaattcggatcaaatttggg

SEQ ID NO: 443915 - DNA, 25 bp, Homo sapien
acacggacctttgcttgctagcgga

SEQ ID NO: 443916 - DNA, 25 bp, Homo sapien
cacggacctttgcttgctagcggag

SEQ ID NO: 443917 - DNA, 25 bp, Homo sapien
acggacctttgcttgctagcggaga

SEQ ID NO: 443918 - DNA, 25 bp, Homo sapien
cggacctttgcttgctagcggagag

SEQ ID NO: 443919 - DNA, 25 bp, Homo sapien
ggacctttgcttgctagcggagagt

SEQ ID NO: 443920 - DNA, 25 bp, Homo sapien
acctttgcttgctagcggagagtgc

SEQ ID NO: 443921 - DNA, 25 bp, Homo sapien
cctttgcttgctagcggagagtgcg

SEQ ID NO: 443922 - DNA, 25 bp, Homo sapien
cttgctagcggagagtgcggacacc

SEQ ID NO: 443923 - DNA, 25 bp, Homo sapien
ttgctagcggagagtgcggacacca

SEQ ID NO: 443924 - DNA, 25 bp, Homo sapien
tgctagcggagagtgcggacaccat

SEQ ID NO: 443925 - DNA, 25 bp, Homo sapien
agccttcaggctgggcgccatcccg

SEQ ID NO: 443926 - DNA, 25 bp, Homo sapien
gtcttttttaataatagtcatccta

SEQ ID NO: 443927 - DNA, 25 bp, Homo sapien
aatagtcatcctaatgggtataaag

SEQ ID NO: 443928 - DNA, 25 bp, Homo sapien
ataaagtggtatcttcttatgcatc

SEQ ID NO: 443929 - DNA, 25 bp, Homo sapien
tcttcttatgcatctcactaatgaa

SEQ ID NO: 443930 - DNA, 25 bp, Homo sapien
atgcatctcactaatgaaaacattt

SEQ ID NO: 443931 - DNA, 25 bp, Homo sapien
gaactatatatgagcaatgtagaga

SEQ ID NO: 443932 - DNA, 25 bp, Homo sapien
agagaaatatttcgctttaagcaat

SEQ ID NO: 443933 - DNA, 25 bp, Homo sapien
ttaagcaatggttgactggccaggt

SEQ ID NO: 443934 - DNA, 25 bp, Homo sapien
gcaatggttgactggccaggtacaa

SEQ ID NO: 443935 - DNA, 25 bp, Homo sapien
ttgactggccaggtacaatgactca

SEQ ID NO: 443936 - DNA, 25 bp, Homo sapien
gactggccaggtacaatgactcaca

SEQ ID NO: 443937 - DNA, 25 bp, Homo sapien
caactctaaagagtagacacttcag

SEQ ID NO: 443938 - DNA, 25 bp, Homo sapien
tagacacttcagaacaggaaggttc

SEQ ID NO: 443939 - DNA, 25 bp, Homo sapien
aggaaggttctggtcaatgttgaga

SEQ ID NO: 443940 - DNA, 25 bp, Homo sapien
aatgttgagagtagacactttcact

SEQ ID NO: 443941 - DNA, 25 bp, Homo sapien
gtgaaatgtgggtaactaattgctt

SEQ ID NO: 443942 - DNA, 25 bp, Homo sapien
attgcttgtaatctataatttgctg

SEQ ID NO: 443943 - DNA, 25 bp, Homo sapien
aatttgctgtatacttaactattaa

SEQ ID NO: 443944 - DNA, 25 bp, Homo sapien
gttaaaatgtcatttaccatgcttt

SEQ ID NO: 443945 - DNA, 25 bp, Homo sapien
tttaccatgctttttacactaaaag

SEQ ID NO: 443946 - DNA, 25 bp, Homo sapien
taaggtgtaacttctcattgagtaa

SEQ ID NO: 443947 - DNA, 25 bp, Homo sapien
ctcattgagtaatcttaggttttac

SEQ ID NO: 443948 - DNA, 25 bp, Homo sapien
aacggctcatgcatatgaagtccga

SEQ ID NO: 443949 - DNA, 25 bp, Homo sapien
aagtccgaacatgggagtttgccaa

SEQ ID NO: 443950 - DNA, 25 bp, Homo sapien
ggagtttgccaattgcattcatcaa

SEQ ID NO: 443951 - DNA, 25 bp, Homo sapien
attcatcaagtcgttttgcggagtc

SEQ ID NO: 443952 - DNA, 25 bp, Homo sapien
ttgcggagtcagatccctgatggaa

SEQ ID NO: 443953 - DNA, 25 bp, Homo sapien
atggaagagctcacaggctctgcct

SEQ ID NO: 443954 - DNA, 25 bp, Homo sapien
aggctctgccttccaagtcctgggt

SEQ ID NO: 443955 - DNA, 25 bp, Homo sapien
tgggttcctaactggtgaccttagc

SEQ ID NO: 443956 - DNA, 25 bp, Homo sapien
ggcttccaagaaaaccacattccat

SEQ ID NO: 443957 - DNA, 25 bp, Homo sapien
gacaaagctggctctgtatttgcat

SEQ ID NO: 443958 - DNA, 25 bp, Homo sapien
atttttgtgttcttgtcagtttggg

SEQ ID NO: 443959 - DNA, 25 bp, Homo sapien
atgaatactgtttggcagccaaagg

SEQ ID NO: 443960 - DNA, 25 bp, Homo sapien
acaatggtctatgtgtatatacgta

SEQ ID NO: 443961 - DNA, 25 bp, Homo sapien
atacgtaacaaagccatcaccataa

SEQ ID NO: 443962 - DNA, 25 bp, Homo sapien
aaagccatcaccataaatagctgca

SEQ ID NO: 443963 - DNA, 25 bp, Homo sapien
aaatagctgcacaagagtggtagca

SEQ ID NO: 443964 - DNA, 25 bp, Homo sapien
aatgaacttgattatgtccacaatt

SEQ ID NO: 443965 - DNA, 25 bp, Homo sapien
ttatgtccacaattaaccagaagaa

SEQ ID NO: 443966 - DNA, 25 bp, Homo sapien
aaaacagtaagctgagtcctcatgt

SEQ ID NO: 443967 - DNA, 25 bp, Homo sapien
agtaagctgagtcctcatgtaggcc

SEQ ID NO: 443968 - DNA, 25 bp, Homo sapien
gtaggcctccagttgacaatactga

SEQ ID NO: 443969 - DNA, 25 bp, Homo sapien
agttgacaatactgatacaagccaa

SEQ ID NO: 443970 - DNA, 25 bp, Homo sapien
ccctgaggcccgattgttgttacca

SEQ ID NO: 443971 - DNA, 25 bp, Homo sapien
cctgaggcccgattgttgttaccat

SEQ ID NO: 443972 - DNA, 25 bp, Homo sapien
agttccctaagacctctcccaggct

SEQ ID NO: 443973 - DNA, 25 bp, Homo sapien
ctgaggcccgattgttgttaccata

SEQ ID NO: 443974 - DNA, 25 bp, Homo sapien
tgaggcccgattgttgttaccatag

SEQ ID NO: 443975 - DNA, 25 bp, Homo sapien
gaggcccgattgttgttaccataga

SEQ ID NO: 443976 - DNA, 25 bp, Homo sapien
aggcccgattgttgttaccatagat

SEQ ID NO: 443977 - DNA, 25 bp, Homo sapien
ggctgttcctggaagttgcagatac

SEQ ID NO: 443978 - DNA, 25 bp, Homo sapien
ctgttcctggaagttgcagatacca

SEQ ID NO: 443979 - DNA, 25 bp, Homo sapien
ggactggctgtaataatcagcctct

SEQ ID NO: 443980 - DNA, 25 bp, Homo sapien
ggctgtaataatcagcctctacctc

SEQ ID NO: 443981 - DNA, 25 bp, Homo sapien
gcattacttcagctagaggctcctg

SEQ ID NO: 443982 - DNA, 25 bp, Homo sapien
tagaggctcctgagggaaatgttca

SEQ ID NO: 443983 - DNA, 25 bp, Homo sapien
gttcagaggaggttttatcaggatt

SEQ ID NO: 443984 - DNA, 25 bp, Homo sapien
caggaaattcaaagcgtgacgggat

SEQ ID NO: 443985 - DNA, 25 bp, Homo sapien
gcgtgacgggataaaactcatgcct

SEQ ID NO: 443986 - DNA, 25 bp, Homo sapien
ggataaaactcatgcctccctttgt

SEQ ID NO: 443987 - DNA, 25 bp, Homo sapien
cctttgtccaggcttatcagaagta

SEQ ID NO: 443988 - DNA, 25 bp, Homo sapien
gaagtaatacatctgctctgaatag

SEQ ID NO: 443989 - DNA, 25 bp, Homo sapien
tgaatgaatcaatgtgcagttttat

SEQ ID NO: 443990 - DNA, 25 bp, Homo sapien
gcagttttatcagatggcatcatgg

SEQ ID NO: 443991 - DNA, 25 bp, Homo sapien
ataaagatgataatgctgccttttc

SEQ ID NO: 443992 - DNA, 25 bp, Homo sapien
aaaatagtatcagcttttttcactt

SEQ ID NO: 443993 - DNA, 25 bp, Homo sapien
acatcttcattcaaatattcagtgc

SEQ ID NO: 443994 - DNA, 25 bp, Homo sapien
tattcagtgcataaataattgcctt

SEQ ID NO: 443995 - DNA, 25 bp, Homo sapien
taattgccttaaattgagtctttgc

SEQ ID NO: 443996 - DNA, 25 bp, Homo sapien
tttggaaatcaaaggcccttgtgaa

SEQ ID NO: 443997 - DNA, 25 bp, Homo sapien
aggcccttgtgaaacatttcctgtt

SEQ ID NO: 443998 - DNA, 25 bp, Homo sapien
agcaatagcttcaaatgagtgggaa

SEQ ID NO: 443999 - DNA, 25 bp, Homo sapien
gaaagtctacttaggtgaagtggta

SEQ ID NO: 444000 - DNA, 25 bp, Homo sapien
tagcgcattgatgagttgcctaatt

SEQ ID NO: 444001 - DNA, 25 bp, Homo sapien
cattgatgagttgcctaattgtttt

SEQ ID NO: 444002 - DNA, 25 bp, Homo sapien
tttctccaacaataaccactggtcc

SEQ ID NO: 444003 - DNA, 25 bp, Homo sapien
ggcttattcaagtccagagagatct

SEQ ID NO: 444004 - DNA, 25 bp, Homo sapien
gagagatcttatctttccctacaag

SEQ ID NO: 444005 - DNA, 25 bp, Homo sapien
tttccctacaagtctgtgaccttga

SEQ ID NO: 444006 - DNA, 25 bp, Homo sapien
gtgaccttgattctgaacctgcatc

SEQ ID NO: 444007 - DNA, 25 bp, Homo sapien
gaacctgcatctatgggaagggctt

SEQ ID NO: 444008 - DNA, 25 bp, Homo sapien
cttgcagtgtctgagtgagcttgga

SEQ ID NO: 444009 - DNA, 25 bp, Homo sapien
gtgagcttggactgtgtaaactttc

SEQ ID NO: 444010 - DNA, 25 bp, Homo sapien
actaagctacatggctctagagtca

SEQ ID NO: 444011 - DNA, 25 bp, Homo sapien
gtaactggcagtattgttaccagaa

SEQ ID NO: 444012 - DNA, 25 bp, Homo sapien
aatcatgaatggacactgagcagaa

SEQ ID NO: 444013 - DNA, 25 bp, Homo sapien
tttcctggtctttaggatttgttga

SEQ ID NO: 444014 - DNA, 25 bp, Homo sapien
tcaacaggaaatgcttcccagaagc

SEQ ID NO: 444015 - DNA, 25 bp, Homo sapien
ctcctgtcctatcagctagaagcgc

SEQ ID NO: 444016 - DNA, 25 bp, Homo sapien
tatcagctagaagcgcctcgcttgt

SEQ ID NO: 444017 - DNA, 25 bp, Homo sapien
tcgcttgtcccaagaccagcaggga

SEQ ID NO: 444018 - DNA, 25 bp, Homo sapien
cagggacagggaactgtccgagccc

SEQ ID NO: 444019 - DNA, 25 bp, Homo sapien
tggctgtgtggaggaaggcgacccc

SEQ ID NO: 444020 - DNA, 25 bp, Homo sapien
ccccagcacaagattggtttccttt

SEQ ID NO: 444021 - DNA, 25 bp, Homo sapien
cacaagattggtttcctttgggaag

SEQ ID NO: 444022 - DNA, 25 bp, Homo sapien
gggcaacaaccgctgacagctgcaa

SEQ ID NO: 444023 - DNA, 25 bp, Homo sapien
agctgcaacaggtgcatggcatctc

SEQ ID NO: 444024 - DNA, 25 bp, Homo sapien
acaggtgcatggcatctcacaggga

SEQ ID NO: 444025 - DNA, 25 bp, Homo sapien
gcccatcaggtaataaccaaagtca

SEQ ID NO: 444026 - DNA, 25 bp, Homo sapien
aaccaaagtcaaggcaacatgcaaa

SEQ ID NO: 444027 - DNA, 25 bp, Homo sapien
gagccaaaccaggtctttggttcta

SEQ ID NO: 444028 - DNA, 25 bp, Homo sapien
ggtctttggttctagaaataactct

SEQ ID NO: 444029 - DNA, 25 bp, Homo sapien
tggttctagaaataactcttacagt

SEQ ID NO: 444030 - DNA, 25 bp, Homo sapien
aattggttgggaatcagcatcaggc

SEQ ID NO: 444031 - DNA, 25 bp, Homo sapien
gaatcagcatcaggcaatggtttta

SEQ ID NO: 444032 - DNA, 25 bp, Homo sapien
agcatcaggcaatggttttaatgga

SEQ ID NO: 444033 - DNA, 25 bp, Homo sapien
caatcgaggtaccaatacaggtggt

SEQ ID NO: 444034 - DNA, 25 bp, Homo sapien
gatgaattttggtgtgctcagcatt

SEQ ID NO: 444035 - DNA, 25 bp, Homo sapien
ttttggtgtgctcagcattaatcca

SEQ ID NO: 444036 - DNA, 25 bp, Homo sapien
gtatagtcattaaactgagttgggt

SEQ ID NO: 444037 - DNA, 25 bp, Homo sapien
agcatcactcatttgatttacacat

SEQ ID NO: 444038 - DNA, 25 bp, Homo sapien
ttgatttacacattcacattataat

SEQ ID NO: 444039 - DNA, 25 bp, Homo sapien
aattatcatgggtgtatgctttaca

SEQ ID NO: 444040 - DNA, 25 bp, Homo sapien
gttatttatgctatattgaaagtca

SEQ ID NO: 444041 - DNA, 25 bp, Homo sapien
gaaagtcatcttaagaatctccagg

SEQ ID NO: 444042 - DNA, 25 bp, Homo sapien
gtcatcttaagaatctccaggttat

SEQ ID NO: 444043 - DNA, 25 bp, Homo sapien
gaatctccaggttatttaaagtagt

SEQ ID NO: 444044 - DNA, 25 bp, Homo sapien
cctttatcaaaatctggtcctatgt

SEQ ID NO: 444045 - DNA, 25 bp, Homo sapien
aaatctggtcctatgtgccttgctt

SEQ ID NO: 444046 - DNA, 25 bp, Homo sapien
taccaaatacctgatttttctggag

SEQ ID NO: 444047 - DNA, 25 bp, Homo sapien
ggagctgagccctgttgtggcccat

SEQ ID NO: 444048 - DNA, 25 bp, Homo sapien
gagccctgttgtggcccattaaaga

SEQ ID NO: 444049 - DNA, 25 bp, Homo sapien
ttaaagaacagggtcctcaggccct

SEQ ID NO: 444050 - DNA, 25 bp, Homo sapien
agccgagggaatcccgtgggttgct

SEQ ID NO: 444051 - DNA, 25 bp, Homo sapien
gtgggttgcttacctacctataagg

SEQ ID NO: 444052 - DNA, 25 bp, Homo sapien
tgcttacctacctataaggtggttt

SEQ ID NO: 444053 - DNA, 25 bp, Homo sapien
aaggtggtttataagctgctgtcct

SEQ ID NO: 444054 - DNA, 25 bp, Homo sapien
tggtttataagctgctgtcctggcc

SEQ ID NO: 444055 - DNA, 25 bp, Homo sapien
aattccaatgtgtacttcatagtgt

SEQ ID NO: 444056 - DNA, 25 bp, Homo sapien
tattattgtgaggttttttgtcttt

SEQ ID NO: 444057 - DNA, 25 bp, Homo sapien
gctgtatctactttaacttccagaa

SEQ ID NO: 444058 - DNA, 25 bp, Homo sapien
gcagccacccgtttcagttaagtta

SEQ ID NO: 444059 - DNA, 25 bp, Homo sapien
aaattcacagaaacggccagtgctt

SEQ ID NO: 444060 - DNA, 25 bp, Homo sapien
cacagaaacggccagtgctttacat

SEQ ID NO: 444061 - DNA, 25 bp, Homo sapien
cagaaacggccagtgctttacatct

SEQ ID NO: 444062 - DNA, 25 bp, Homo sapien
gaaacggccagtgctttacatctta

SEQ ID NO: 444063 - DNA, 25 bp, Homo sapien
aaacggccagtgctttacatcttat

SEQ ID NO: 444064 - DNA, 25 bp, Homo sapien
aacggccagtgctttacatcttatg

SEQ ID NO: 444065 - DNA, 25 bp, Homo sapien
cggccagtgctttacatcttatgga

SEQ ID NO: 444066 - DNA, 25 bp, Homo sapien
gccagtgctttacatcttatggaat

SEQ ID NO: 444067 - DNA, 25 bp, Homo sapien
gtgctttacatcttatggaatgact

SEQ ID NO: 444068 - DNA, 25 bp, Homo sapien
ctttacatcttatggaatgactcac

SEQ ID NO: 444069 - DNA, 25 bp, Homo sapien
tgtaatattctcccctccccttaag

SEQ ID NO: 444070 - DNA, 25 bp, Homo sapien
ttaagaaggtacttcgaggctgggt

SEQ ID NO: 444071 - DNA, 25 bp, Homo sapien
taagaaggtacttcgaggctgggtg

SEQ ID NO: 444072 - DNA, 25 bp, Homo sapien
aagaaggtacttcgaggctgggtgc

SEQ ID NO: 444073 - DNA, 25 bp, Homo sapien
agaaggtacttcgaggctgggtgcg

SEQ ID NO: 444074 - DNA, 25 bp, Homo sapien
gaaggtacttcgaggctgggtgcgg

SEQ ID NO: 444075 - DNA, 25 bp, Homo sapien
aaggtacttcgaggctgggtgcggt

SEQ ID NO: 444076 - DNA, 25 bp, Homo sapien
aggtacttcgaggctgggtgcggtg

SEQ ID NO: 444077 - DNA, 25 bp, Homo sapien
tccagccccacaagactaaggagag

SEQ ID NO: 444078 - DNA, 25 bp, Homo sapien
agtgagctgtgctgggaccattgtt

SEQ ID NO: 444079 - DNA, 25 bp, Homo sapien
tgggaccattgtttccgtaacctcg

SEQ ID NO: 444080 - DNA, 25 bp, Homo sapien
tccgtaacctcgttttctgtgtcca

SEQ ID NO: 444081 - DNA, 25 bp, Homo sapien
gctgacacaccttcaaagtggcatc

SEQ ID NO: 444082 - DNA, 25 bp, Homo sapien
agtggcatcaggtcctaaactgtag

SEQ ID NO: 444083 - DNA, 25 bp, Homo sapien
taaactgtagcttgcaatgtgcctg

SEQ ID NO: 444084 - DNA, 25 bp, Homo sapien
gcaatgtgcctgtttccagaaacca

SEQ ID NO: 444085 - DNA, 25 bp, Homo sapien
ccttcccagcttttttctggaaatg

SEQ ID NO: 444086 - DNA, 25 bp, Homo sapien
ggaaatgcatgtttctctgaactct

SEQ ID NO: 444087 - DNA, 25 bp, Homo sapien
gtttctctgaactctgagtcccaag

SEQ ID NO: 444088 - DNA, 25 bp, Homo sapien
gcagcccgagggaatggagaccaca

SEQ ID NO: 444089 - DNA, 25 bp, Homo sapien
ggaatggagaccacactcatggctc

SEQ ID NO: 444090 - DNA, 25 bp, Homo sapien
atggagaccacactcatggctcagg

SEQ ID NO: 444091 - DNA, 25 bp, Homo sapien
actacccgctccagagctttaagga

SEQ ID NO: 444092 - DNA, 25 bp, Homo sapien
tacccgctccagagctttaaggaaa

SEQ ID NO: 444093 - DNA, 25 bp, Homo sapien
gagccatagggctggcttctctgtg

SEQ ID NO: 444094 - DNA, 25 bp, Homo sapien
gcttctctgtgggtgcgtggacgtg

SEQ ID NO: 444095 - DNA, 25 bp, Homo sapien
gggttgggagctgggaatctatttt

SEQ ID NO: 444096 - DNA, 25 bp, Homo sapien
gtattatgttttgagctactgtagt

SEQ ID NO: 444097 - DNA, 25 bp, Homo sapien
agctactgtagttttggcgtggcac

SEQ ID NO: 444098 - DNA, 25 bp, Homo sapien
tagttttggcgtggcactattgtaa

SEQ ID NO: 444099 - DNA, 25 bp, Homo sapien
agccatggtaaaaatagggatctgt

SEQ ID NO: 444100 - DNA, 25 bp, Homo sapien
tagggatctgtgaaggaaatttcta

SEQ ID NO: 444101 - DNA, 25 bp, Homo sapien
attggatgtattaggttttgaactc

SEQ ID NO: 444102 - DNA, 25 bp, Homo sapien
gatgtattaggttttgaactctgag

SEQ ID NO: 444103 - DNA, 25 bp, Homo sapien
taggttttgaactctgagattgcac

SEQ ID NO: 444104 - DNA, 25 bp, Homo sapien
ctctgagattgcacaaatattcaat

SEQ ID NO: 444105 - DNA, 25 bp, Homo sapien
ttgcacaaatattcaattaacttga

SEQ ID NO: 444106 - DNA, 25 bp, Homo sapien
ttaacttgaagttgtgtacatagag

SEQ ID NO: 444107 - DNA, 25 bp, Homo sapien
gcaaatgacagagccttcaaaaata

SEQ ID NO: 444108 - DNA, 25 bp, Homo sapien
taatgtgaatcaaccgaaaactggg

SEQ ID NO: 444109 - DNA, 25 bp, Homo sapien
ggcagaggacaggttttctcaggtt

SEQ ID NO: 444110 - DNA, 25 bp, Homo sapien
gtcattaatgagttatcttctgtgg

SEQ ID NO: 444111 - DNA, 25 bp, Homo sapien
tctgtggaggatgactgttctcttt

SEQ ID NO: 444112 - DNA, 25 bp, Homo sapien
gactgttctctttgttaatgttcac

SEQ ID NO: 444113 - DNA, 25 bp, Homo sapien
atcttgggctgagaagaggcccttc

SEQ ID NO: 444114 - DNA, 25 bp, Homo sapien
gagtttgaagtatcacagcgtgtgg

SEQ ID NO: 444115 - DNA, 25 bp, Homo sapien
gggaaccaggatacccattcatttc

SEQ ID NO: 444116 - DNA, 25 bp, Homo sapien
gatacccattcatttccaaccgaga

SEQ ID NO: 444117 - DNA, 25 bp, Homo sapien
tgactgcccagccagagacactgat

SEQ ID NO: 444118 - DNA, 25 bp, Homo sapien
gagacactgatttctgtaacctctt

SEQ ID NO: 444119 - DNA, 25 bp, Homo sapien
atttctgtaacctcttcacttgatc

SEQ ID NO: 444120 - DNA, 25 bp, Homo sapien
ttgatcctgcctcttaagcattaaa

SEQ ID NO: 444121 - DNA, 25 bp, Homo sapien
ggtcatttcctcagtttgtgtatta

SEQ ID NO: 444122 - DNA, 25 bp, Homo sapien
tttcctcagtttgtgtattaaagaa

SEQ ID NO: 444123 - DNA, 25 bp, Homo sapien
ttcctcagtttgtgtattaaagaaa

SEQ ID NO: 444124 - DNA, 25 bp, Homo sapien
tcctcagtttgtgtattaaagaaaa

SEQ ID NO: 444125 - DNA, 25 bp, Homo sapien
cctcagtttgtgtattaaagaaaag

SEQ ID NO: 444126 - DNA, 25 bp, Homo sapien
ctcagtttgtgtattaaagaaaagc

SEQ ID NO: 444127 - DNA, 25 bp, Homo sapien
tcagtttgtgtattaaagaaaagct

SEQ ID NO: 444128 - DNA, 25 bp, Homo sapien
gtgtattaaagaaaagctgccccag

SEQ ID NO: 444129 - DNA, 25 bp, Homo sapien
tgtattaaagaaaagctgccccagc

SEQ ID NO: 444130 - DNA, 25 bp, Homo sapien
gtattaaagaaaagctgccccagcc

SEQ ID NO: 444131 - DNA, 25 bp, Homo sapien
tattaaagaaaagctgccccagcca

SEQ ID NO: 444132 - DNA, 25 bp, Homo sapien
ggaaacccttgtagttggtgccttg

SEQ ID NO: 444133 - DNA, 25 bp, Homo sapien
acccttgtagttggtgccttgccag

SEQ ID NO: 444134 - DNA, 25 bp, Homo sapien
aaaccagactcaaatgttctgggcc

SEQ ID NO: 444135 - DNA, 25 bp, Homo sapien
agaacctctgggacccacggacctg

SEQ ID NO: 444136 - DNA, 25 bp, Homo sapien
tgggacccacggacctgcaaagagg

SEQ ID NO: 444137 - DNA, 25 bp, Homo sapien
ggccggcgcagggatttcaggatga

SEQ ID NO: 444138 - DNA, 25 bp, Homo sapien
ttcaggatgaggtgaaagcgattca

SEQ ID NO: 444139 - DNA, 25 bp, Homo sapien
ggtgaaagcgattcagtgcgcgtct

SEQ ID NO: 444140 - DNA, 25 bp, Homo sapien
gaaagcgattcagtgcgcgtctgcc

SEQ ID NO: 444141 - DNA, 25 bp, Homo sapien
gattcagtgcgcgtctgcccttggc

SEQ ID NO: 444142 - DNA, 25 bp, Homo sapien
gcgcgtctgcccttggccactaggg

SEQ ID NO: 444143 - DNA, 25 bp, Homo sapien
tgattgtgggcaggacagcagctca

SEQ ID NO: 444144 - DNA, 25 bp, Homo sapien
gtgaattcccatacctccagtcatc

SEQ ID NO: 444145 - DNA, 25 bp, Homo sapien
gcagctcaggagagagccctctgac

SEQ ID NO: 444146 - DNA, 25 bp, Homo sapien
agccaaagccaaccagagatacctc

SEQ ID NO: 444147 - DNA, 25 bp, Homo sapien
agccaaccagagatacctcctgcag

SEQ ID NO: 444148 - DNA, 25 bp, Homo sapien
tacctccagtcatcaggcacagtta

SEQ ID NO: 444149 - DNA, 25 bp, Homo sapien
ggcggaggcccctaatgttccttct

SEQ ID NO: 444150 - DNA, 25 bp, Homo sapien
cacagttactggtcggtgcagggca

SEQ ID NO: 444151 - DNA, 25 bp, Homo sapien
gtgaccaaggcccaagagactcaga

SEQ ID NO: 444152 - DNA, 25 bp, Homo sapien
aagagactcagacggccattcacag

SEQ ID NO: 444153 - DNA, 25 bp, Homo sapien
gacggccattcacaggcatcaggca

SEQ ID NO: 444154 - DNA, 25 bp, Homo sapien
tgttttgccgcgtaaaccatccaag

SEQ ID NO: 444155 - DNA, 25 bp, Homo sapien
taaaccatccaagagcaacggcact

SEQ ID NO: 444156 - DNA, 25 bp, Homo sapien
aacggcactcctctgttctaatctg

SEQ ID NO: 444157 - DNA, 25 bp, Homo sapien
cacccgactcgaatgttggctctgt

SEQ ID NO: 444158 - DNA, 25 bp, Homo sapien
ttggctctgtcgttgctccagggat

SEQ ID NO: 444159 - DNA, 25 bp, Homo sapien
aagccctgtctccagtagttgtcaa

SEQ ID NO: 444160 - DNA, 25 bp, Homo sapien
tggtccgtgggtcttgatattcatg

SEQ ID NO: 444161 - DNA, 25 bp, Homo sapien
gtcaagtcttgaatggctccagctg

SEQ ID NO: 444162 - DNA, 25 bp, Homo sapien
tgcagcagtcatactccagtgtgaa

SEQ ID NO: 444163 - DNA, 25 bp, Homo sapien
aatttgcaccctcatagattggcct

SEQ ID NO: 444164 - DNA, 25 bp, Homo sapien
tcctctgaactactcgggctgtttt

SEQ ID NO: 444165 - DNA, 25 bp, Homo sapien
gctccgctcagagcctcaggatgtg

SEQ ID NO: 444166 - DNA, 25 bp, Homo sapien
ggaggcttctacagatgaccagctt

SEQ ID NO: 444167 - DNA, 25 bp, Homo sapien
tgaccagcttggtggcgtcatcatc

SEQ ID NO: 444168 - DNA, 25 bp, Homo sapien
gaggaaggagaccttatctggaacc

SEQ ID NO: 444169 - DNA, 25 bp, Homo sapien
gaggcatgtctgtaagaaactctta

SEQ ID NO: 444170 - DNA, 25 bp, Homo sapien
cttcctgttgttcaacctggtggag

SEQ ID NO: 444171 - DNA, 25 bp, Homo sapien
gagaatgttcctgtgggccttggca

SEQ ID NO: 444172 - DNA, 25 bp, Homo sapien
tggcagcaagtcagcattcttcgtt

SEQ ID NO: 444173 - DNA, 25 bp, Homo sapien
attcttcgttggcatggagtcctag

SEQ ID NO: 444174 - DNA, 25 bp, Homo sapien
ggaaaaagaggctctccaccctgaa

SEQ ID NO: 444175 - DNA, 25 bp, Homo sapien
tgaagccagtcgcatatcaccccaa

SEQ ID NO: 444176 - DNA, 25 bp, Homo sapien
tgtctcatgcctgtctggatggtgc

SEQ ID NO: 444177 - DNA, 25 bp, Homo sapien
tggatggtgctgaatcacttttgcc

SEQ ID NO: 444178 - DNA, 25 bp, Homo sapien
agcatcatattcttggcgatttttt

SEQ ID NO: 444179 - DNA, 25 bp, Homo sapien
gtctcaattcccagcttatcttcaa

SEQ ID NO: 444180 - DNA, 25 bp, Homo sapien
gattttttcgtattcgttttgcttg

SEQ ID NO: 444181 - DNA, 25 bp, Homo sapien
atttgctttttgcactcagcaattt

SEQ ID NO: 444182 - DNA, 25 bp, Homo sapien
caattttttcatgtgctccagctat

SEQ ID NO: 444183 - DNA, 25 bp, Homo sapien
gtgctccagctatgctacattctat

SEQ ID NO: 444184 - DNA, 25 bp, Homo sapien
gctatgctacattctatttccttgt

SEQ ID NO: 444185 - DNA, 25 bp, Homo sapien
ccagcttatcttcaacactttcttt

SEQ ID NO: 444186 - DNA, 25 bp, Homo sapien
agcctctagttcctttaatgtctca

SEQ ID NO: 444187 - DNA, 25 bp, Homo sapien
tgggcagttggtgagtttatagcct

SEQ ID NO: 444188 - DNA, 25 bp, Homo sapien
gcagttggtgagtttatagcctgga

SEQ ID NO: 444189 - DNA, 25 bp, Homo sapien
agttggtgagtttatagcctggata

SEQ ID NO: 444190 - DNA, 25 bp, Homo sapien
gttggtgagtttatagcctggataa

SEQ ID NO: 444191 - DNA, 25 bp, Homo sapien
tggtgagtttatagcctggataaaa

SEQ ID NO: 444192 - DNA, 25 bp, Homo sapien
tttatagcctggataaaagtcaggt

SEQ ID NO: 444193 - DNA, 25 bp, Homo sapien
gataaaagtcaggtctaagccaggt

SEQ ID NO: 444194 - DNA, 25 bp, Homo sapien
taaaagtcaggtctaagccaggtgt

SEQ ID NO: 444195 - DNA, 25 bp, Homo sapien
aaaagtcaggtctaagccaggtgtg

SEQ ID NO: 444196 - DNA, 25 bp, Homo sapien
aaagtcaggtctaagccaggtgtgg

SEQ ID NO: 444197 - DNA, 25 bp, Homo sapien
aagtcaggtctaagccaggtgtgga

SEQ ID NO: 444198 - DNA, 25 bp, Homo sapien
ggctttcttactacaaacctcccag

SEQ ID NO: 444199 - DNA, 25 bp, Homo sapien
ctcccagtccaagttcagctgaaaa

SEQ ID NO: 444200 - DNA, 25 bp, Homo sapien
ataaagatgtagcttcaccattgaa

SEQ ID NO: 444201 - DNA, 25 bp, Homo sapien
ttcaccattgaaggaactgggttta

SEQ ID NO: 444202 - DNA, 25 bp, Homo sapien
gaacagagtgtgcagttactccagt

SEQ ID NO: 444203 - DNA, 25 bp, Homo sapien
gtgtgcagttactccagtgttacct

SEQ ID NO: 444204 - DNA, 25 bp, Homo sapien
agtgttacctgcaagaggactacag

SEQ ID NO: 444205 - DNA, 25 bp, Homo sapien
gggtactcgggactcagtaaagaca

SEQ ID NO: 444206 - DNA, 25 bp, Homo sapien
agaggcagagccaggccttaatcct

SEQ ID NO: 444207 - DNA, 25 bp, Homo sapien
ggccttaatcctgaagattgcagat

SEQ ID NO: 444208 - DNA, 25 bp, Homo sapien
aaagaacctgtattcttcgttgtgt

SEQ ID NO: 444209 - DNA, 25 bp, Homo sapien
tcatcggcgaggacagcccgagtcg

SEQ ID NO: 444210 - DNA, 25 bp, Homo sapien
aggacagcccgagtcgcttggaccg

SEQ ID NO: 444211 - DNA, 25 bp, Homo sapien
aagggccacgtcatctacgaaggca

SEQ ID NO: 444212 - DNA, 25 bp, Homo sapien
agaagggccacgtcttgtcctatga

SEQ ID NO: 444213 - DNA, 25 bp, Homo sapien
acgtcttgtcctatgagggtggcat

SEQ ID NO: 444214 - DNA, 25 bp, Homo sapien
tatgagggtggcatgtctgtgaccc

SEQ ID NO: 444215 - DNA, 25 bp, Homo sapien
ccccaagcgcacctatgacatgatg

SEQ ID NO: 444216 - DNA, 25 bp, Homo sapien
cctatgacatgatggagggccgcgt

SEQ ID NO: 444217 - DNA, 25 bp, Homo sapien
ggccgcgtgggcagagccatctcct

SEQ ID NO: 444218 - DNA, 25 bp, Homo sapien
atctcctcagccagcatcgaaggtc

SEQ ID NO: 444219 - DNA, 25 bp, Homo sapien
atcgaaggtctcatgggccgtgcca

SEQ ID NO: 444220 - DNA, 25 bp, Homo sapien
attactcaagcaaaatcgtggaatt

SEQ ID NO: 444221 - DNA, 25 bp, Homo sapien
tactcaagcaaaatcgtggaattat

SEQ ID NO: 444222 - DNA, 25 bp, Homo sapien
caagcaaaatcgtggaattattggt

SEQ ID NO: 444223 - DNA, 25 bp, Homo sapien
aagcaaaatcgtggaattattggtg

SEQ ID NO: 444224 - DNA, 25 bp, Homo sapien
agcaaaatcgtggaattattggtga

SEQ ID NO: 444225 - DNA, 25 bp, Homo sapien
gcaaaatcgtggaattattggtgat

SEQ ID NO: 444226 - DNA, 25 bp, Homo sapien
atcgtggaattattggtgataaaag

SEQ ID NO: 444227 - DNA, 25 bp, Homo sapien
tcgtggaattattggtgataaaagt

SEQ ID NO: 444228 - DNA, 25 bp, Homo sapien
gaatgaagcttgtgtgtcatccatt

SEQ ID NO: 444229 - DNA, 25 bp, Homo sapien
gaagcttgtgtgtcatccattatca

SEQ ID NO: 444230 - DNA, 25 bp, Homo sapien
cttgtgtgtcatccattatcatgtg

SEQ ID NO: 444231 - DNA, 25 bp, Homo sapien
cctgtgtgccattttaagagttact

SEQ ID NO: 444232 - DNA, 25 bp, Homo sapien
atgtttggtaacttttatgccttca

SEQ ID NO: 444233 - DNA, 25 bp, Homo sapien
tggtaacttttatgccttcacttta

SEQ ID NO: 444234 - DNA, 25 bp, Homo sapien
taacttttatgccttcactttacaa

SEQ ID NO: 444235 - DNA, 25 bp, Homo sapien
tttatgccttcactttacaaattca

SEQ ID NO: 444236 - DNA, 25 bp, Homo sapien
cttagataaaagaaccgagcaattt

SEQ ID NO: 444237 - DNA, 25 bp, Homo sapien
gtccttgatttagcactatttacat

SEQ ID NO: 444238 - DNA, 25 bp, Homo sapien
ttagcactatttacatacaggccat

SEQ ID NO: 444239 - DNA, 25 bp, Homo sapien
actatttacatacaggccatacttt

SEQ ID NO: 444240 - DNA, 25 bp, Homo sapien
gaatggggaccttttgagttgaatt

SEQ ID NO: 444241 - DNA, 25 bp, Homo sapien
tcacctcttctaatcttttaatgta

SEQ ID NO: 444242 - DNA, 25 bp, Homo sapien
gcccactgtgtctctggtgttaaac

SEQ ID NO: 444243 - DNA, 25 bp, Homo sapien
ccactgtgtctctggtgttaaacac

SEQ ID NO: 444244 - DNA, 25 bp, Homo sapien
ggtgttaaacactgtcacttggtct

SEQ ID NO: 444245 - DNA, 25 bp, Homo sapien
gttaaacactgtcacttggtctctg

SEQ ID NO: 444246 - DNA, 25 bp, Homo sapien
taaacactgtcacttggtctctgaa

SEQ ID NO: 444247 - DNA, 25 bp, Homo sapien
aacactgtcacttggtctctgaaat

SEQ ID NO: 444248 - DNA, 25 bp, Homo sapien
acactgtcacttggtctctgaaata

SEQ ID NO: 444249 - DNA, 25 bp, Homo sapien
actgtcacttggtctctgaaataag

SEQ ID NO: 444250 - DNA, 25 bp, Homo sapien
aaggcaatttaaagagtagcatttc

SEQ ID NO: 444251 - DNA, 25 bp, Homo sapien
agcatttcttattgtcacccccagc

SEQ ID NO: 444252 - DNA, 25 bp, Homo sapien
ttcttattgtcacccccagcacttt

SEQ ID NO: 444253 - DNA, 25 bp, Homo sapien
ttgtcctttcactgtatgacttgaa

SEQ ID NO: 444254 - DNA, 25 bp, Homo sapien
aagtgtttcttgtcgtgaggcacct

SEQ ID NO: 444255 - DNA, 25 bp, Homo sapien
tttcttgtcgtgaggcacctgccat

SEQ ID NO: 444256 - DNA, 25 bp, Homo sapien
gcacctgccatgtctgttgcgtttt

SEQ ID NO: 444257 - DNA, 25 bp, Homo sapien
tcggcagcgtgtagggcttcagctt

SEQ ID NO: 444258 - DNA, 25 bp, Homo sapien
cctgggttttcacccttcctgcagg

SEQ ID NO: 444259 - DNA, 25 bp, Homo sapien
agtgggtccatttcacctcttgctg

SEQ ID NO: 444260 - DNA, 25 bp, Homo sapien
ttcacctcttgctgcatgatggtca

SEQ ID NO: 444261 - DNA, 25 bp, Homo sapien
gctgcatgatggtcagtagctgatc

SEQ ID NO: 444262 - DNA, 25 bp, Homo sapien
gtagctgatctgttatggcattcac

SEQ ID NO: 444263 - DNA, 25 bp, Homo sapien
attttccgtgtttgaagtatgtgca

SEQ ID NO: 444264 - DNA, 25 bp, Homo sapien
agcactctcaagtcactgaatgaag

SEQ ID NO: 444265 - DNA, 25 bp, Homo sapien
gaatgaaggcctcctaagcatcaga

SEQ ID NO: 444266 - DNA, 25 bp, Homo sapien
aagcatcagacccagtgccaggtac

SEQ ID NO: 444267 - DNA, 25 bp, Homo sapien
gacccagtgccaggtacaggacaca

SEQ ID NO: 444268 - DNA, 25 bp, Homo sapien
ggtacaggacacacctgatctctac

SEQ ID NO: 444269 - DNA, 25 bp, Homo sapien
aggacacacctgatctctactgcat

SEQ ID NO: 444270 - DNA, 25 bp, Homo sapien
gatctctactgcatctctataatgg

SEQ ID NO: 444271 - DNA, 25 bp, Homo sapien
gcctggaagtggacagcatcagccc

SEQ ID NO: 444272 - DNA, 25 bp, Homo sapien
ttacatgcacatgacatcgttcctg

SEQ ID NO: 444273 - DNA, 25 bp, Homo sapien
tgcacatgacatcgttcctggctaa

SEQ ID NO: 444274 - DNA, 25 bp, Homo sapien
catgacatcgttcctggctaatttt

SEQ ID NO: 444275 - DNA, 25 bp, Homo sapien
agtatcatgcttttcagagttctgt

SEQ ID NO: 444276 - DNA, 25 bp, Homo sapien
gcttttcagagttctgtgggttgtt

SEQ ID NO: 444277 - DNA, 25 bp, Homo sapien
gggttgttatggtgaattatcaaac

SEQ ID NO: 444278 - DNA, 25 bp, Homo sapien
attatcaaacctgaggacgtggtgg

SEQ ID NO: 444279 - DNA, 25 bp, Homo sapien
gacgtggtgggaacctccaaatttg

SEQ ID NO: 444280 - DNA, 25 bp, Homo sapien
gtgggaacctccaaatttgcagcca

SEQ ID NO: 444281 - DNA, 25 bp, Homo sapien
caaatttgcagccagttggtgagaa

SEQ ID NO: 444282 - DNA, 25 bp, Homo sapien
cagccagttggtgagaagtacatgc

SEQ ID NO: 444283 - DNA, 25 bp, Homo sapien
aagtacatgcggtctgtggacaccc

SEQ ID NO: 444284 - DNA, 25 bp, Homo sapien
ggtctgtggacacccaagcttgcag

SEQ ID NO: 444285 - DNA, 25 bp, Homo sapien
acccaagcttgcagctgcatctgaa

SEQ ID NO: 444286 - DNA, 25 bp, Homo sapien
acacaggaggagtatacaagtattt

SEQ ID NO: 444287 - DNA, 25 bp, Homo sapien
ggctaaactgtcctggaaacctgtt

SEQ ID NO: 444288 - DNA, 25 bp, Homo sapien
taaactgtcctggaaacctgttgtt

SEQ ID NO: 444289 - DNA, 25 bp, Homo sapien
attgggtagggcacgagggaattca

SEQ ID NO: 444290 - DNA, 25 bp, Homo sapien
acatctagataacggcttgagtgac

SEQ ID NO: 444291 - DNA, 25 bp, Homo sapien
gataacggcttgagtgacacaactg

SEQ ID NO: 444292 - DNA, 25 bp, Homo sapien
gacacaactgggtgtatttgttaaa

SEQ ID NO: 444293 - DNA, 25 bp, Homo sapien
aaactcatcagataggacgcttgga

SEQ ID NO: 444294 - DNA, 25 bp, Homo sapien
taggacgcttggatttgtgcctttc

SEQ ID NO: 444295 - DNA, 25 bp, Homo sapien
gacgcttggatttgtgcctttcaca

SEQ ID NO: 444296 - DNA, 25 bp, Homo sapien
ttggatttgtgcctttcacagaatg

SEQ ID NO: 444297 - DNA, 25 bp, Homo sapien
aagaaataagtccagttaaaatgag

SEQ ID NO: 444298 - DNA, 25 bp, Homo sapien
gaaataagtccagttaaaatgagag

SEQ ID NO: 444299 - DNA, 25 bp, Homo sapien
aaataagtccagttaaaatgagagt

SEQ ID NO: 444300 - DNA, 25 bp, Homo sapien
aataagtccagttaaaatgagagtt

SEQ ID NO: 444301 - DNA, 25 bp, Homo sapien
ataagtccagttaaaatgagagttg

SEQ ID NO: 444302 - DNA, 25 bp, Homo sapien
taagtccagttaaaatgagagttga

SEQ ID NO: 444303 - DNA, 25 bp, Homo sapien
agtccagttaaaatgagagttgagc

SEQ ID NO: 444304 - DNA, 25 bp, Homo sapien
aatgagagttgagccaggtgccctg

SEQ ID NO: 444305 - DNA, 25 bp, Homo sapien
tgagagttgagccaggtgccctggc

SEQ ID NO: 444306 - DNA, 25 bp, Homo sapien
agttgagccaggtgccctggctcat

SEQ ID NO: 444307 - DNA, 25 bp, Homo sapien
cactttgggaactttgggaggcaga

SEQ ID NO: 444308 - DNA, 25 bp, Homo sapien
ctgctcctcatgcaaaccttgtggg

SEQ ID NO: 444309 - DNA, 25 bp, Homo sapien
gaagcaatgaccaggagcagcacct

SEQ ID NO: 444310 - DNA, 25 bp, Homo sapien
ccctgaggcctgtgagtgtctcgga

SEQ ID NO: 444311 - DNA, 25 bp, Homo sapien
aggcctgtgagtgtctcggatccgc

SEQ ID NO: 444312 - DNA, 25 bp, Homo sapien
agtgtctcggatccgccctggagaa

SEQ ID NO: 444313 - DNA, 25 bp, Homo sapien
atccgccctggagaagtgagtggct

SEQ ID NO: 444314 - DNA, 25 bp, Homo sapien
ccttctgggtcttgtccgggatatg

SEQ ID NO: 444315 - DNA, 25 bp, Homo sapien
ttgtccgggatatggccttcctgaa

SEQ ID NO: 444316 - DNA, 25 bp, Homo sapien
tggccttcctgaaggtcttacctcc

SEQ ID NO: 444317 - DNA, 25 bp, Homo sapien
tgcacttgaccaccaaagcaatctc

SEQ ID NO: 444318 - DNA, 25 bp, Homo sapien
agcaatctctaagcttataaaggag

SEQ ID NO: 444319 - DNA, 25 bp, Homo sapien
ggatgtcctacaggatagtttcata

SEQ ID NO: 444320 - DNA, 25 bp, Homo sapien
gatagtttcatagtgacaggtggca

SEQ ID NO: 444321 - DNA, 25 bp, Homo sapien
gtgacaggtggcacttggctaatag

SEQ ID NO: 444322 - DNA, 25 bp, Homo sapien
caggtggcacttggctaatagaata

SEQ ID NO: 444323 - DNA, 25 bp, Homo sapien
cttggctaatagaatatggctgata

SEQ ID NO: 444324 - DNA, 25 bp, Homo sapien
ttgtcattaatcattttgtaccttg

SEQ ID NO: 444325 - DNA, 25 bp, Homo sapien
taatcattttgtaccttgacatggg

SEQ ID NO: 444326 - DNA, 25 bp, Homo sapien
attttgtaccttgacatgggttgtc

SEQ ID NO: 444327 - DNA, 25 bp, Homo sapien
gtaccttgacatgggttgtctaata

SEQ ID NO: 444328 - DNA, 25 bp, Homo sapien
tgtctaataaaactcggacccttct

SEQ ID NO: 444329 - DNA, 25 bp, Homo sapien
taataaaactcggacccttcttgtg

SEQ ID NO: 444330 - DNA, 25 bp, Homo sapien
tttcagtactaagcaattttagtct

SEQ ID NO: 444331 - DNA, 25 bp, Homo sapien
ttcagtactaagcaattttagtctc

SEQ ID NO: 444332 - DNA, 25 bp, Homo sapien
tcagtactaagcaattttagtctct

SEQ ID NO: 444333 - DNA, 25 bp, Homo sapien
cagtactaagcaattttagtctctg

SEQ ID NO: 444334 - DNA, 25 bp, Homo sapien
agtactaagcaattttagtctctgc

SEQ ID NO: 444335 - DNA, 25 bp, Homo sapien
gtactaagcaattttagtctctgca

SEQ ID NO: 444336 - DNA, 25 bp, Homo sapien
tactaagcaattttagtctctgcag

SEQ ID NO: 444337 - DNA, 25 bp, Homo sapien
gtcttgaattaatacaacttttgtt

SEQ ID NO: 444338 - DNA, 25 bp, Homo sapien
cttttgttaattctcttatgaagtt

SEQ ID NO: 444339 - DNA, 25 bp, Homo sapien
ttttgttaattctcttatgaagtta

SEQ ID NO: 444340 - DNA, 25 bp, Homo sapien
tttgttaattctcttatgaagttaa

SEQ ID NO: 444341 - DNA, 25 bp, Homo sapien
gagggagagatctaggtttatcgat

SEQ ID NO: 444342 - DNA, 25 bp, Homo sapien
gatctaggtttatcgattagggatg

SEQ ID NO: 444343 - DNA, 25 bp, Homo sapien
gaaggggtactggttagtctcctag

SEQ ID NO: 444344 - DNA, 25 bp, Homo sapien
tgagtggagtattgttgccctgcct

SEQ ID NO: 444345 - DNA, 25 bp, Homo sapien
tggagtattgttgccctgcctatat

SEQ ID NO: 444346 - DNA, 25 bp, Homo sapien
tgcctatatcccctaaaggtggagg

SEQ ID NO: 444347 - DNA, 25 bp, Homo sapien
tagagcggagggttagcagtcacct

SEQ ID NO: 444348 - DNA, 25 bp, Homo sapien
ttagcagtcacctgagtaagtcact

SEQ ID NO: 444349 - DNA, 25 bp, Homo sapien
gctgagaggtactccatggtggacc

SEQ ID NO: 444350 - DNA, 25 bp, Homo sapien
catggtggaccggagagttccttcc

SEQ ID NO: 444351 - DNA, 25 bp, Homo sapien
tggaccggagagttccttccctgga

SEQ ID NO: 444352 - DNA, 25 bp, Homo sapien
atgaatggctgttggtgtgcaacaa

SEQ ID NO: 444353 - DNA, 25 bp, Homo sapien
ggtgtgcaacaaatcatacttgcta

SEQ ID NO: 444354 - DNA, 25 bp, Homo sapien
cttgctacatgttgtgaaacctgaa

SEQ ID NO: 444355 - DNA, 25 bp, Homo sapien
aaacctgaagttatttgttagtctg

SEQ ID NO: 444356 - DNA, 25 bp, Homo sapien
aagaatgtaccccagagatgcaccc

SEQ ID NO: 444357 - DNA, 25 bp, Homo sapien
agagatgcaccctgtatctgcctta

SEQ ID NO: 444358 - DNA, 25 bp, Homo sapien
gtatctgccttatgtctcttacaat

SEQ ID NO: 444359 - DNA, 25 bp, Homo sapien
gtctcttacaatggaggttctctcc

SEQ ID NO: 444360 - DNA, 25 bp, Homo sapien
aggttctctcctgttatattgctga

SEQ ID NO: 444361 - DNA, 25 bp, Homo sapien
taaactatgtgaactgctaaattga

SEQ ID NO: 444362 - DNA, 25 bp, Homo sapien
gagagagtgctttcgagaatagtat

SEQ ID NO: 444363 - DNA, 25 bp, Homo sapien
aaagtttggcttgtgatgtttctca

SEQ ID NO: 444364 - DNA, 25 bp, Homo sapien
ggcttgtgatgtttctcatttataa

SEQ ID NO: 444365 - DNA, 25 bp, Homo sapien
gttctcatggtgtgatataccacaa

SEQ ID NO: 444366 - DNA, 25 bp, Homo sapien
gatcaaaaccaaactgttcaatgtg

SEQ ID NO: 444367 - DNA, 25 bp, Homo sapien
aattatatactctacttcattcatg

SEQ ID NO: 444368 - DNA, 25 bp, Homo sapien
acttcattcatgttacacttttttc

SEQ ID NO: 444369 - DNA, 25 bp, Homo sapien
cacttttttctactccttacctgct

SEQ ID NO: 444370 - DNA, 25 bp, Homo sapien
tactccttacctgcttttactaatg

SEQ ID NO: 444371 - DNA, 25 bp, Homo sapien
tttactaatgcatttatccccaaga

SEQ ID NO: 444372 - DNA, 25 bp, Homo sapien
tatccccaagaaaacatccaacaat

SEQ ID NO: 444373 - DNA, 25 bp, Homo sapien
caacaatatgggactaatttggaac

SEQ ID NO: 444374 - DNA, 25 bp, Homo sapien
tgggcaagagtttttttaagactct

SEQ ID NO: 444375 - DNA, 25 bp, Homo sapien
gactcttaaaaaaagagcctgggca

SEQ ID NO: 444376 - DNA, 25 bp, Homo sapien
ctcttaaaaaaagagcctgggcaat

SEQ ID NO: 444377 - DNA, 25 bp, Homo sapien
tcttaaaaaaagagcctgggcaatt

SEQ ID NO: 444378 - DNA, 25 bp, Homo sapien
cttcactctacaggggacaggagac

SEQ ID NO: 444379 - DNA, 25 bp, Homo sapien
ttcactctacaggggacaggagacc

SEQ ID NO: 444380 - DNA, 25 bp, Homo sapien
tcactctacaggggacaggagacca

SEQ ID NO: 444381 - DNA, 25 bp, Homo sapien
cactctacaggggacaggagaccat

SEQ ID NO: 444382 - DNA, 25 bp, Homo sapien
actaacgcttaagaatgcctgtctt

SEQ ID NO: 444383 - DNA, 25 bp, Homo sapien
aacgcttaagaatgcctgtctttga

SEQ ID NO: 444384 - DNA, 25 bp, Homo sapien
ttaagaatgcctgtctttgagagga

SEQ ID NO: 444385 - DNA, 25 bp, Homo sapien
gaatgcctgtctttgagaggaaggt

SEQ ID NO: 444386 - DNA, 25 bp, Homo sapien
tgcctgtctttgagaggaaggtgtt

SEQ ID NO: 444387 - DNA, 25 bp, Homo sapien
agtgccaaatacactgtgcatatct

SEQ ID NO: 444388 - DNA, 25 bp, Homo sapien
gagcatagcaagaagttggaggatt

SEQ ID NO: 444389 - DNA, 25 bp, Homo sapien
gttggaggatttgaattccattccc

SEQ ID NO: 444390 - DNA, 25 bp, Homo sapien
gatttgaattccattcccagttctc

SEQ ID NO: 444391 - DNA, 25 bp, Homo sapien
atttgaattccattcccagttctca

SEQ ID NO: 444392 - DNA, 25 bp, Homo sapien
ttgaattccattcccagttctcatt

SEQ ID NO: 444393 - DNA, 25 bp, Homo sapien
atgctgcctacttctaagagaaatt

SEQ ID NO: 444394 - DNA, 25 bp, Homo sapien
aatgccactgattcatacgggattt

SEQ ID NO: 444395 - DNA, 25 bp, Homo sapien
acgggatttacattaattctatggg

SEQ ID NO: 444396 - DNA, 25 bp, Homo sapien
gttcattttcatctaagatctttat

SEQ ID NO: 444397 - DNA, 25 bp, Homo sapien
gatctttattctctaacgttcttgg

SEQ ID NO: 444398 - DNA, 25 bp, Homo sapien
tctctaacgttcttggtcctattga

SEQ ID NO: 444399 - DNA, 25 bp, Homo sapien
tggtcctattgaaacattgcagtat

SEQ ID NO: 444400 - DNA, 25 bp, Homo sapien
aaactactgcaatgttaaacccaag

SEQ ID NO: 444401 - DNA, 25 bp, Homo sapien
aaagccattatcatgtgtatgctgg

SEQ ID NO: 444402 - DNA, 25 bp, Homo sapien
ttatcatgtgtatgctggtcatcat

SEQ ID NO: 444403 - DNA, 25 bp, Homo sapien
ggtcatcatgatcagtgtggtacaa

SEQ ID NO: 444404 - DNA, 25 bp, Homo sapien
agaccccatcttaaagaccctgtct

SEQ ID NO: 444405 - DNA, 25 bp, Homo sapien
tcaggcatcacatgaaagagtattc

SEQ ID NO: 444406 - DNA, 25 bp, Homo sapien
gagtattcagctgtcgttcttgtga

SEQ ID NO: 444407 - DNA, 25 bp, Homo sapien
tcagctgtcgttcttgtgaaaaagg

SEQ ID NO: 444408 - DNA, 25 bp, Homo sapien
aaatgcattttaactgtggtaacta

SEQ ID NO: 444409 - DNA, 25 bp, Homo sapien
gtggtaactaattcactgacttgaa

SEQ ID NO: 444410 - DNA, 25 bp, Homo sapien
tcactgacttgaagtttgctttgtt

SEQ ID NO: 444411 - DNA, 25 bp, Homo sapien
ttgttttctttggtgcgtagagaag

SEQ ID NO: 444412 - DNA, 25 bp, Homo sapien
gaagaatacttcatactaactcctg

SEQ ID NO: 444413 - DNA, 25 bp, Homo sapien
tacttcatactaactcctgatcatc

SEQ ID NO: 444414 - DNA, 25 bp, Homo sapien
ctcctgatcatcttacagcagacat

SEQ ID NO: 444415 - DNA, 25 bp, Homo sapien
gacattaaggaatttcactttcagt

SEQ ID NO: 444416 - DNA, 25 bp, Homo sapien
tcagttctacccactacttaagtac

SEQ ID NO: 444417 - DNA, 25 bp, Homo sapien
acccactacttaagtacttgtcatg

SEQ ID NO: 444418 - DNA, 25 bp, Homo sapien
tgtcatgtactcttagaggaggcca

SEQ ID NO: 444419 - DNA, 25 bp, Homo sapien
aggaggccagtaatgatcagaacca

SEQ ID NO: 444420 - DNA, 25 bp, Homo sapien
tgatcagaaccattttactttaaaa

SEQ ID NO: 444421 - DNA, 25 bp, Homo sapien
tgtactattagcaatcatatttcat

SEQ ID NO: 444422 - DNA, 25 bp, Homo sapien
tttcatttatccctgtaattagaca

SEQ ID NO: 444423 - DNA, 25 bp, Homo sapien
gcataatatagctctactcatgggt

SEQ ID NO: 444424 - DNA, 25 bp, Homo sapien
agctctactcatgggtacacatacc

SEQ ID NO: 444425 - DNA, 25 bp, Homo sapien
catgggtacacataccagtgtataa

SEQ ID NO: 444426 - DNA, 25 bp, Homo sapien
gttgaagagcatcaggtatccgata

SEQ ID NO: 444427 - DNA, 25 bp, Homo sapien
gtatccgatatacgccagtgtgtag

SEQ ID NO: 444428 - DNA, 25 bp, Homo sapien
aaccagaacttcacgatgggtgcat

SEQ ID NO: 444429 - DNA, 25 bp, Homo sapien
aattcatagatttttctgccgaggg

SEQ ID NO: 444430 - DNA, 25 bp, Homo sapien
ggattaaccggtgcttgctctgaac

SEQ ID NO: 444431 - DNA, 25 bp, Homo sapien
ttgtttcgtcccaacattgctgtga

SEQ ID NO: 444432 - DNA, 25 bp, Homo sapien
aacattgctgtgagctccatgtcct

SEQ ID NO: 444433 - DNA, 25 bp, Homo sapien
ctttttcctttgtgggcttctctgg

SEQ ID NO: 444434 - DNA, 25 bp, Homo sapien
tccttctcttggaggtggatttcct

SEQ ID NO: 444435 - DNA, 25 bp, Homo sapien
cctgggcctgagacatatagggcat

SEQ ID NO: 444436 - DNA, 25 bp, Homo sapien
tatagggcatgtcgtctttgttctt

SEQ ID NO: 444437 - DNA, 25 bp, Homo sapien
gtcaccccattaatcgccagggttg

SEQ ID NO: 444438 - DNA, 25 bp, Homo sapien
gatctggctggctaagtggctgtcc

SEQ ID NO: 444439 - DNA, 25 bp, Homo sapien
ccatgttcatgcctcccaaagctgt

SEQ ID NO: 444440 - DNA, 25 bp, Homo sapien
ccaaagctgtgttctcagtcaaaga

SEQ ID NO: 444441 - DNA, 25 bp, Homo sapien
aagaggacaaccatctccactagaa

SEQ ID NO: 444442 - DNA, 25 bp, Homo sapien
atctccactagaagaggaccagtct

SEQ ID NO: 444443 - DNA, 25 bp, Homo sapien
ccagtctttggtcaagggtatacga

SEQ ID NO: 444444 - DNA, 25 bp, Homo sapien
gacaagctctcaagtccatttgtag

SEQ ID NO: 444445 - DNA, 25 bp, Homo sapien
tagggtagtcaagcttccaagattc

SEQ ID NO: 444446 - DNA, 25 bp, Homo sapien
agcttccaagattccagacacatcc

SEQ ID NO: 444447 - DNA, 25 bp, Homo sapien
aagtgctgcatgtggcagtctgcct

SEQ ID NO: 444448 - DNA, 25 bp, Homo sapien
ttgacctgaagggtctgattccctc

SEQ ID NO: 444449 - DNA, 25 bp, Homo sapien
gccttagggcctaccctggagtgct

SEQ ID NO: 444450 - DNA, 25 bp, Homo sapien
tgctgcttgcttgtttctccactag

SEQ ID NO: 444451 - DNA, 25 bp, Homo sapien
ggcctgctccaaatgcttagccaat

SEQ ID NO: 444452 - DNA, 25 bp, Homo sapien
atgcttagccaatctctggagccga

SEQ ID NO: 444453 - DNA, 25 bp, Homo sapien
tggagccgacacagttgcctacggg

SEQ ID NO: 444454 - DNA, 25 bp, Homo sapien
gtgacttagcaccaggttccattag

SEQ ID NO: 444455 - DNA, 25 bp, Homo sapien
aggttccattagctctccaagtgac

SEQ ID NO: 444456 - DNA, 25 bp, Homo sapien
tccaagtgactgtttccacccagta

SEQ ID NO: 444457 - DNA, 25 bp, Homo sapien
acccagtacttttggcgcttgagga

SEQ ID NO: 444458 - DNA, 25 bp, Homo sapien
gaggtggcagtagaggattcctttt

SEQ ID NO: 444459 - DNA, 25 bp, Homo sapien
tgtcttaaaagtttttcaggctggg

SEQ ID NO: 444460 - DNA, 25 bp, Homo sapien
tgtaatctcaacatgtttagaccaa

SEQ ID NO: 444461 - DNA, 25 bp, Homo sapien
gaatttgaaattgtcctgggcaccg

SEQ ID NO: 444462 - DNA, 25 bp, Homo sapien
ctgggcaccgtagcgagactctgct

SEQ ID NO: 444463 - DNA, 25 bp, Homo sapien
gggcaccgtagcgagactctgcttt

SEQ ID NO: 444464 - DNA, 25 bp, Homo sapien
gcaccgtagcgagactctgctttct

SEQ ID NO: 444465 - DNA, 25 bp, Homo sapien
accgtagcgagactctgctttctac

SEQ ID NO: 444466 - DNA, 25 bp, Homo sapien
cgtagcgagactctgctttctacaa

SEQ ID NO: 444467 - DNA, 25 bp, Homo sapien
gtagcgagactctgctttctacaaa

SEQ ID NO: 444468 - DNA, 25 bp, Homo sapien
ctaactactctaagcctgaggcaag

SEQ ID NO: 444469 - DNA, 25 bp, Homo sapien
taactactctaagcctgaggcaaga

SEQ ID NO: 444470 - DNA, 25 bp, Homo sapien
aaataaccttgtagttctccagata

SEQ ID NO: 444471 - DNA, 25 bp, Homo sapien
ataaccttgtagttctccagatact

SEQ ID NO: 444472 - DNA, 25 bp, Homo sapien
aaccttgtagttctccagatactaa

SEQ ID NO: 444473 - DNA, 25 bp, Homo sapien
gtagttctccagatactaagcttgt

SEQ ID NO: 444474 - DNA, 25 bp, Homo sapien
agttctccagatactaagcttgtat

SEQ ID NO: 444475 - DNA, 25 bp, Homo sapien
tctccagatactaagcttgtatatg

SEQ ID NO: 444476 - DNA, 25 bp, Homo sapien
gcttgtatatgattatggtgggtga

SEQ ID NO: 444477 - DNA, 25 bp, Homo sapien
gggtgatttcagatatataagcaga

SEQ ID NO: 444478 - DNA, 25 bp, Homo sapien
gatatataagcagataagcacagat

SEQ ID NO: 444479 - DNA, 25 bp, Homo sapien
tgtcctttcaagttaagagtatata

SEQ ID NO: 444480 - DNA, 25 bp, Homo sapien
taagagtatataatctggacagaaa

SEQ ID NO: 444481 - DNA, 25 bp, Homo sapien
gggaggtctcaaggtcattgcccta

SEQ ID NO: 444482 - DNA, 25 bp, Homo sapien
ggaggtctcaaggtcattgccctac

SEQ ID NO: 444483 - DNA, 25 bp, Homo sapien
tctcaaggtcattgccctacagaaa

SEQ ID NO: 444484 - DNA, 25 bp, Homo sapien
ctcaaggtcattgccctacagaaac

SEQ ID NO: 444485 - DNA, 25 bp, Homo sapien
aaggtcattgccctacagaaaccag

SEQ ID NO: 444486 - DNA, 25 bp, Homo sapien
aggtcattgccctacagaaaccagg

SEQ ID NO: 444487 - DNA, 25 bp, Homo sapien
gtcattgccctacagaaaccaggct

SEQ ID NO: 444488 - DNA, 25 bp, Homo sapien
cattgccctacagaaaccaggctgg

SEQ ID NO: 444489 - DNA, 25 bp, Homo sapien
attgccctacagaaaccaggctggg

SEQ ID NO: 444490 - DNA, 25 bp, Homo sapien
ttgccctacagaaaccaggctgggt

SEQ ID NO: 444491 - DNA, 25 bp, Homo sapien
gccctacagaaaccaggctgggtgc

SEQ ID NO: 444492 - DNA, 25 bp, Homo sapien
tcccttttattgatgcagttctcaa

SEQ ID NO: 444493 - DNA, 25 bp, Homo sapien
gatgcagttctcaaagacccaggat

SEQ ID NO: 444494 - DNA, 25 bp, Homo sapien
cagttctcaaagacccaggattgca

SEQ ID NO: 444495 - DNA, 25 bp, Homo sapien
acccaggattgcaacatgggcagct

SEQ ID NO: 444496 - DNA, 25 bp, Homo sapien
atgggcagctatttaaccatttagc

SEQ ID NO: 444497 - DNA, 25 bp, Homo sapien
ggaagccaaagcagacacggaaaaa

SEQ ID NO: 444498 - DNA, 25 bp, Homo sapien
aaacagctcacaacttggagaacgt

SEQ ID NO: 444499 - DNA, 25 bp, Homo sapien
tggagaacgtactgatacatttctg

SEQ ID NO: 444500 - DNA, 25 bp, Homo sapien
gactgtcagagatctgtgttgcgaa

SEQ ID NO: 444501 - DNA, 25 bp, Homo sapien
tctgtgttgcgaaaatcagtgagcc

SEQ ID NO: 444502 - DNA, 25 bp, Homo sapien
tgggtgtatctaacctattacaggt

SEQ ID NO: 444503 - DNA, 25 bp, Homo sapien
gtttcaaatacatcaccattggcct

SEQ ID NO: 444504 - DNA, 25 bp, Homo sapien
aaatacatcaccattggcctcttct

SEQ ID NO: 444505 - DNA, 25 bp, Homo sapien
accattggcctcttctttagttctg

SEQ ID NO: 444506 - DNA, 25 bp, Homo sapien
gatttgcatggcaggtgttaggtct

SEQ ID NO: 444507 - DNA, 25 bp, Homo sapien
ggtgttaggtctgagcagtcttcaa

SEQ ID NO: 444508 - DNA, 25 bp, Homo sapien
aggtctgagcagtcttcaagagttt

SEQ ID NO: 444509 - DNA, 25 bp, Homo sapien
gcagtcttcaagagtttcttctgaa

SEQ ID NO: 444510 - DNA, 25 bp, Homo sapien
ttctggcttctcatcacaccgtatt

SEQ ID NO: 444511 - DNA, 25 bp, Homo sapien
gcttctcatcacaccgtatttctgg

SEQ ID NO: 444512 - DNA, 25 bp, Homo sapien
gaattttcatttggcatgctggctt

SEQ ID NO: 444513 - DNA, 25 bp, Homo sapien
tcatttggcatgctggcttcttctt

SEQ ID NO: 444514 - DNA, 25 bp, Homo sapien
gcttttctcaaaagactgtcgcctg

SEQ ID NO: 444515 - DNA, 25 bp, Homo sapien
ttctcaaaagactgtcgcctggcag

SEQ ID NO: 444516 - DNA, 25 bp, Homo sapien
tcaaaagactgtcgcctggcagagg

SEQ ID NO: 444517 - DNA, 25 bp, Homo sapien
aagactgtcgcctggcagaggaaaa

SEQ ID NO: 444518 - DNA, 25 bp, Homo sapien
ggtatgagtgaagacagatcagcca

SEQ ID NO: 444519 - DNA, 25 bp, Homo sapien
gtgaagacagatcagccagacatgg

SEQ ID NO: 444520 - DNA, 25 bp, Homo sapien
gccagacatggtgccgcttgcctga

SEQ ID NO: 444521 - DNA, 25 bp, Homo sapien
gacatggtgccgcttgcctgagatc

SEQ ID NO: 444522 - DNA, 25 bp, Homo sapien
atggtgccgcttgcctgagatctca

SEQ ID NO: 444523 - DNA, 25 bp, Homo sapien
gtgccgcttgcctgagatctcaaca

SEQ ID NO: 444524 - DNA, 25 bp, Homo sapien
gcttgcctgagatctcaacactttg

SEQ ID NO: 444525 - DNA, 25 bp, Homo sapien
agattcatacctctttcctgtttga

SEQ ID NO: 444526 - DNA, 25 bp, Homo sapien
tcatacctctttcctgtttgaaatt

SEQ ID NO: 444527 - DNA, 25 bp, Homo sapien
tttactgtgtttcatcaatctaatg

SEQ ID NO: 444528 - DNA, 25 bp, Homo sapien
ttactgtgtttcatcaatctaatgt

SEQ ID NO: 444529 - DNA, 25 bp, Homo sapien
tactgtgtttcatcaatctaatgtt

SEQ ID NO: 444530 - DNA, 25 bp, Homo sapien
ctgtgtttcatcaatctaatgttta

SEQ ID NO: 444531 - DNA, 25 bp, Homo sapien
tgtgtttcatcaatctaatgtttat

SEQ ID NO: 444532 - DNA, 25 bp, Homo sapien
gtgtttcatcaatctaatgtttatt

SEQ ID NO: 444533 - DNA, 25 bp, Homo sapien
gtttcatcaatctaatgtttatttt

SEQ ID NO: 444534 - DNA, 25 bp, Homo sapien
tttattacaccagtaatttcctcat

SEQ ID NO: 444535 - DNA, 25 bp, Homo sapien
ttataaatctacatgtacctagaaa

SEQ ID NO: 444536 - DNA, 25 bp, Homo sapien
agtacaaagtttggagactcaacaa

SEQ ID NO: 444537 - DNA, 25 bp, Homo sapien
gagactcaacaaatgctctaacctt

SEQ ID NO: 444538 - DNA, 25 bp, Homo sapien
agagacaaaagtcctatttctgttt

SEQ ID NO: 444539 - DNA, 25 bp, Homo sapien
gacaaaagtcctatttctgttttct

SEQ ID NO: 444540 - DNA, 25 bp, Homo sapien
ttttattttcaattagtgacccatt

SEQ ID NO: 444541 - DNA, 25 bp, Homo sapien
ttcaattagtgacccattgttaaat

SEQ ID NO: 444542 - DNA, 25 bp, Homo sapien
gttaaatccaaatccacttttactg

SEQ ID NO: 444543 - DNA, 25 bp, Homo sapien
catgtgtaaaatgttcagttgtttt

SEQ ID NO: 444544 - DNA, 25 bp, Homo sapien
atagtagaacggttgtaactgatac

SEQ ID NO: 444545 - DNA, 25 bp, Homo sapien
gtaactgatactggccaaaatcaat

SEQ ID NO: 444546 - DNA, 25 bp, Homo sapien
gccaaaatcaatgttattccatatt

SEQ ID NO: 444547 - DNA, 25 bp, Homo sapien
acaggcatgtgtaccactgtactac

SEQ ID NO: 444548 - DNA, 25 bp, Homo sapien
aggcatgtgtaccactgtactacct

SEQ ID NO: 444549 - DNA, 25 bp, Homo sapien
gcatgtgtaccactgtactacctgg

SEQ ID NO: 444550 - DNA, 25 bp, Homo sapien
atgtgtaccactgtactacctggct

SEQ ID NO: 444551 - DNA, 25 bp, Homo sapien
gtgtaccactgtactacctggctaa

SEQ ID NO: 444552 - DNA, 25 bp, Homo sapien
gtaccactgtactacctggctaaat

SEQ ID NO: 444553 - DNA, 25 bp, Homo sapien
ccactgtactacctggctaaatttt

SEQ ID NO: 444554 - DNA, 25 bp, Homo sapien
ccatgttctgggtatcattaaggta

SEQ ID NO: 444555 - DNA, 25 bp, Homo sapien
gttctgggtatcattaaggtaatca

SEQ ID NO: 444556 - DNA, 25 bp, Homo sapien
ttaaggtaatcagaatcctcctgct

SEQ ID NO: 444557 - DNA, 25 bp, Homo sapien
tcctgctgtagtcacgcttaccctt

SEQ ID NO: 444558 - DNA, 25 bp, Homo sapien
aagtcataactccatgatgcaaaag

SEQ ID NO: 444559 - DNA, 25 bp, Homo sapien
gaaatatgtttcaatgactgccttt

SEQ ID NO: 444560 - DNA, 25 bp, Homo sapien
atatgtttcaatgactgccttttaa

SEQ ID NO: 444561 - DNA, 25 bp, Homo sapien
gtttcaatgactgccttttaaatta

SEQ ID NO: 444562 - DNA, 25 bp, Homo sapien
gccttttaaattagcggtactccag

SEQ ID NO: 444563 - DNA, 25 bp, Homo sapien
taaattagcggtactccagcacttt

SEQ ID NO: 444564 - DNA, 25 bp, Homo sapien
aattagcggtactccagcactttgg

SEQ ID NO: 444565 - DNA, 25 bp, Homo sapien
atcatagccagaccttgtttctact

SEQ ID NO: 444566 - DNA, 25 bp, Homo sapien
tcatagccagaccttgtttctacta

SEQ ID NO: 444567 - DNA, 25 bp, Homo sapien
ataaataaattttccgggcatggtg

SEQ ID NO: 444568 - DNA, 25 bp, Homo sapien
gaattatgattacaccacgggactc

SEQ ID NO: 444569 - DNA, 25 bp, Homo sapien
tcttaaaaaaagagcctgggcaatt

SEQ ID NO: 444570 - DNA, 25 bp, Homo sapien
gacaggagaccataggatttggacc

SEQ ID NO: 444571 - DNA, 25 bp, Homo sapien
caggagaccataggatttggacccc

SEQ ID NO: 444572 - DNA, 25 bp, Homo sapien
aggagaccataggatttggacccca

SEQ ID NO: 444573 - DNA, 25 bp, Homo sapien
ggagaccataggatttggaccccaa

SEQ ID NO: 444574 - DNA, 25 bp, Homo sapien
agaccataggatttggaccccaaag

SEQ ID NO: 444575 - DNA, 25 bp, Homo sapien
gaccataggatttggaccccaaagg

SEQ ID NO: 444576 - DNA, 25 bp, Homo sapien
gaccccaaagggatgtgaactgatc

SEQ ID NO: 444577 - DNA, 25 bp, Homo sapien
accccaaagggatgtgaactgatct

SEQ ID NO: 444578 - DNA, 25 bp, Homo sapien
ccccaaagggatgtgaactgatctg

SEQ ID NO: 444579 - DNA, 25 bp, Homo sapien
cccaaagggatgtgaactgatctga

SEQ ID NO: 444580 - DNA, 25 bp, Homo sapien
gtgaaataattactcatggccctct

SEQ ID NO: 444581 - DNA, 25 bp, Homo sapien
cacagtgaaattagacccctttact

SEQ ID NO: 444582 - DNA, 25 bp, Homo sapien
ttagacccctttacttcaccattct

SEQ ID NO: 444583 - DNA, 25 bp, Homo sapien
tttacttcaccattctgccactgca

SEQ ID NO: 444584 - DNA, 25 bp, Homo sapien
ttctgccactgcaaattaagtataa

SEQ ID NO: 444585 - DNA, 25 bp, Homo sapien
gagtgtccacaccagtagacagtaa

SEQ ID NO: 444586 - DNA, 25 bp, Homo sapien
tagacagtaagcttctctacctgta

SEQ ID NO: 444587 - DNA, 25 bp, Homo sapien
aagcttctctacctgtaagtgatga

SEQ ID NO: 444588 - DNA, 25 bp, Homo sapien
gaaatcatagctaatgcacttgcca

SEQ ID NO: 444589 - DNA, 25 bp, Homo sapien
aatgcacttgccatggagttttcaa

SEQ ID NO: 444590 - DNA, 25 bp, Homo sapien
atgattggtgtcagacagttttcac

SEQ ID NO: 444591 - DNA, 25 bp, Homo sapien
atgccctaccaacacagacagggac

SEQ ID NO: 444592 - DNA, 25 bp, Homo sapien
aacacagacagggacacagaaatac

SEQ ID NO: 444593 - DNA, 25 bp, Homo sapien
ggacacagaaatacaggctggtctc

SEQ ID NO: 444594 - DNA, 25 bp, Homo sapien
gaaatacaggctggtctctggaaac

SEQ ID NO: 444595 - DNA, 25 bp, Homo sapien
agagctgacacttgcaatatctggg

SEQ ID NO: 444596 - DNA, 25 bp, Homo sapien
gggtaaccaccatctgaggcttaaa

SEQ ID NO: 444597 - DNA, 25 bp, Homo sapien
gtaaccaccatctgaggcttaaact

SEQ ID NO: 444598 - DNA, 25 bp, Homo sapien
accaccatctgaggcttaaactaca

SEQ ID NO: 444599 - DNA, 25 bp, Homo sapien
tgaggcttaaactacaaccaggtaa

SEQ ID NO: 444600 - DNA, 25 bp, Homo sapien
aaatcgtaacaagggcaggcgcagt

SEQ ID NO: 444601 - DNA, 25 bp, Homo sapien
gagtcaggcattgcagggagccgag

SEQ ID NO: 444602 - DNA, 25 bp, Homo sapien
agctgcctcctcaggatgctgggag

SEQ ID NO: 444603 - DNA, 25 bp, Homo sapien
aggatgctgggaggctcagtgtcaa

SEQ ID NO: 444604 - DNA, 25 bp, Homo sapien
cagagcctgtacaaaaggagggcag

SEQ ID NO: 444605 - DNA, 25 bp, Homo sapien
aaaaggagggcagagcctcccacgg

SEQ ID NO: 444606 - DNA, 25 bp, Homo sapien
aaggaggccagcaccactcggcggt

SEQ ID NO: 444607 - DNA, 25 bp, Homo sapien
cactcggcggttcttctggatcaaa

SEQ ID NO: 444608 - DNA, 25 bp, Homo sapien
cttctggatcaaagggtgttgggtc

SEQ ID NO: 444609 - DNA, 25 bp, Homo sapien
tcaaagggtgttgggtccagctgca

SEQ ID NO: 444610 - DNA, 25 bp, Homo sapien
tccagctgcagcaggtgttgtagga

SEQ ID NO: 444611 - DNA, 25 bp, Homo sapien
tgtaggagcgctgggtgctgctgct

SEQ ID NO: 444612 - DNA, 25 bp, Homo sapien
accactgggagctgcggatggaagt

SEQ ID NO: 444613 - DNA, 25 bp, Homo sapien
ctgttggatgcaccagaaactggaa

SEQ ID NO: 444614 - DNA, 25 bp, Homo sapien
ggaccagtggcagagatgcactctc

SEQ ID NO: 444615 - DNA, 25 bp, Homo sapien
agagatgcactctcggtcctgtctc

SEQ ID NO: 444616 - DNA, 25 bp, Homo sapien
atcctgttcgtgtctttctgcagtt

SEQ ID NO: 444617 - DNA, 25 bp, Homo sapien
tctttctgcagttttcggcaataag

SEQ ID NO: 444618 - DNA, 25 bp, Homo sapien
gtagaagatttgctgtcctgctgtc

SEQ ID NO: 444619 - DNA, 25 bp, Homo sapien
gtcctgctgtccaattgtggagcat

SEQ ID NO: 444620 - DNA, 25 bp, Homo sapien
ggagcatcagcaggtttccaactca

SEQ ID NO: 444621 - DNA, 25 bp, Homo sapien
tctccaggcctgtactaaagtttgc

SEQ ID NO: 444622 - DNA, 25 bp, Homo sapien
gagcaggctcacactaagttgtaaa

SEQ ID NO: 444623 - DNA, 25 bp, Homo sapien
cataggagaagcatttggccaataa

SEQ ID NO: 444624 - DNA, 25 bp, Homo sapien
ctgcaggtgggctttaaaatatcgg

SEQ ID NO: 444625 - DNA, 25 bp, Homo sapien
tgcaggtgggctttaaaatatcggc

SEQ ID NO: 444626 - DNA, 25 bp, Homo sapien
gcaggtgggctttaaaatatcggct

SEQ ID NO: 444627 - DNA, 25 bp, Homo sapien
caggtgggctttaaaatatcggctg

SEQ ID NO: 444628 - DNA, 25 bp, Homo sapien
aggtgggctttaaaatatcggctgg

SEQ ID NO: 444629 - DNA, 25 bp, Homo sapien
ggtgggctttaaaatatcggctgga

SEQ ID NO: 444630 - DNA, 25 bp, Homo sapien
gtgggctttaaaatatcggctggag

SEQ ID NO: 444631 - DNA, 25 bp, Homo sapien
tgggctttaaaatatcggctggagc

SEQ ID NO: 444632 - DNA, 25 bp, Homo sapien
gggctttaaaatatcggctggagcc

SEQ ID NO: 444633 - DNA, 25 bp, Homo sapien
gctttaaaatatcggctggagccca

SEQ ID NO: 444634 - DNA, 25 bp, Homo sapien
ctttaaaatatcggctggagcccaa

SEQ ID NO: 444635 - DNA, 25 bp, Homo sapien
aatatcgacaggataaaggtgtcca

SEQ ID NO: 444636 - DNA, 25 bp, Homo sapien
ggtgtccaaggcagctgcagatttg

SEQ ID NO: 444637 - DNA, 25 bp, Homo sapien
tgtccaaggcagctgcagatttgat

SEQ ID NO: 444638 - DNA, 25 bp, Homo sapien
gcagctgcagatttgatggcctact

SEQ ID NO: 444639 - DNA, 25 bp, Homo sapien
ggcctactgtgaagcacatgccaag

SEQ ID NO: 444640 - DNA, 25 bp, Homo sapien
cctactgtgaagcacatgccaagga

SEQ ID NO: 444641 - DNA, 25 bp, Homo sapien
ctgacccctgttccggcttcagaaa

SEQ ID NO: 444642 - DNA, 25 bp, Homo sapien
gagaagaagtttttctgtgccatcc

SEQ ID NO: 444643 - DNA, 25 bp, Homo sapien
gaagaagtttttctgtgccatcctt

SEQ ID NO: 444644 - DNA, 25 bp, Homo sapien
aagaagtttttctgtgccatccttt

SEQ ID NO: 444645 - DNA, 25 bp, Homo sapien
gaagtttttctgtgccatcctttaa

SEQ ID NO: 444646 - DNA, 25 bp, Homo sapien
atgcagcggaaatgtcattatgaac

SEQ ID NO: 444647 - DNA, 25 bp, Homo sapien
attacttgttaacttcttacagcag

SEQ ID NO: 444648 - DNA, 25 bp, Homo sapien
acttcttacagcagtagtaccttct

SEQ ID NO: 444649 - DNA, 25 bp, Homo sapien
tacagcagtagtaccttctttaaaa

SEQ ID NO: 444650 - DNA, 25 bp, Homo sapien
aaaaagtttactgctgtagtgtgaa

SEQ ID NO: 444651 - DNA, 25 bp, Homo sapien
gctgtagtgtgaaatattgtctgga

SEQ ID NO: 444652 - DNA, 25 bp, Homo sapien
tattgtctggaaagggatggtttaa

SEQ ID NO: 444653 - DNA, 25 bp, Homo sapien
aatattaccatgatgtagttgaaat

SEQ ID NO: 444654 - DNA, 25 bp, Homo sapien
ggatttggaaccttattgtgataaa

SEQ ID NO: 444655 - DNA, 25 bp, Homo sapien
ctctccaaagtaaggaacccagctg

SEQ ID NO: 444656 - DNA, 25 bp, Homo sapien
tccaaagtaaggaacccagctgggc

SEQ ID NO: 444657 - DNA, 25 bp, Homo sapien
tacaacatatgtcatgaatttgcat

SEQ ID NO: 444658 - DNA, 25 bp, Homo sapien
aacatatgtcatgaatttgcataca

SEQ ID NO: 444659 - DNA, 25 bp, Homo sapien
ttgcatacaaagattcttgtcattc

SEQ ID NO: 444660 - DNA, 25 bp, Homo sapien
ttaataaactgtggcacttggtatt

SEQ ID NO: 444661 - DNA, 25 bp, Homo sapien
aataaactgtggcacttggtatttg

SEQ ID NO: 444662 - DNA, 25 bp, Homo sapien
aaactgtggcacttggtatttgaat

SEQ ID NO: 444663 - DNA, 25 bp, Homo sapien
actgtggcacttggtatttgaatgt

SEQ ID NO: 444664 - DNA, 25 bp, Homo sapien
tggcacttggtatttgaatgtgtgt

SEQ ID NO: 444665 - DNA, 25 bp, Homo sapien
aagggaagtcaagagattaaatgct

SEQ ID NO: 444666 - DNA, 25 bp, Homo sapien
gtcaagagattaaatgctgaactta

SEQ ID NO: 444667 - DNA, 25 bp, Homo sapien
aaatgctgaacttattaatggaata

SEQ ID NO: 444668 - DNA, 25 bp, Homo sapien
ggatgggacatggaatttacaccta

SEQ ID NO: 444669 - DNA, 25 bp, Homo sapien
tacacctaaaataatcagcgtctga

SEQ ID NO: 444670 - DNA, 25 bp, Homo sapien
atcagcgtctgaaaggacgtcccct

SEQ ID NO: 444671 - DNA, 25 bp, Homo sapien
acgtcccctctctggatatggaaaa

SEQ ID NO: 444672 - DNA, 25 bp, Homo sapien
tgcaggagttgtatgcagctgcctt

SEQ ID NO: 444673 - DNA, 25 bp, Homo sapien
agctgccttgcaatcccatgggaaa

SEQ ID NO: 444674 - DNA, 25 bp, Homo sapien
gggaaacaatgctagctcacaggaa

SEQ ID NO: 444675 - DNA, 25 bp, Homo sapien
aggcaaaagctgactgttgaaaaga

SEQ ID NO: 444676 - DNA, 25 bp, Homo sapien
gaagacattgttaggccccaaacca

SEQ ID NO: 444677 - DNA, 25 bp, Homo sapien
gaaacccatttaccactgaatctag

SEQ ID NO: 444678 - DNA, 25 bp, Homo sapien
ccccttttatttaatccagtctgag

SEQ ID NO: 444679 - DNA, 25 bp, Homo sapien
gatgaggtcttctctctggatacca

SEQ ID NO: 444680 - DNA, 25 bp, Homo sapien
tcttcagagccatctatgggcagag

SEQ ID NO: 444681 - DNA, 25 bp, Homo sapien
gggctgtgggtttgtgtaacatttc

SEQ ID NO: 444682 - DNA, 25 bp, Homo sapien
atttcagaccaccttgaacacaggc

SEQ ID NO: 444683 - DNA, 25 bp, Homo sapien
gaacacaggctcgaacctggtaacc

SEQ ID NO: 444684 - DNA, 25 bp, Homo sapien
gggtgatactcatacccaatcaggg

SEQ ID NO: 444685 - DNA, 25 bp, Homo sapien
taatgaggccccagcaagaagactt

SEQ ID NO: 444686 - DNA, 25 bp, Homo sapien
gctatataccctaaccttggctaga

SEQ ID NO: 444687 - DNA, 25 bp, Homo sapien
agacccacctcagcaaatcgtggtg

SEQ ID NO: 444688 - DNA, 25 bp, Homo sapien
ggtgtagaagccagcacagcgcgaa

SEQ ID NO: 444689 - DNA, 25 bp, Homo sapien
agcacagcgcgaagactcaggatga

SEQ ID NO: 444690 - DNA, 25 bp, Homo sapien
gttgaactgttagtacttccctgaa

SEQ ID NO: 444691 - DNA, 25 bp, Homo sapien
ttccctgaagaccaataatttccag

SEQ ID NO: 444692 - DNA, 25 bp, Homo sapien
cccagtctcatttctattctatgaa

SEQ ID NO: 444693 - DNA, 25 bp, Homo sapien
agattaatcgtgtttactccgtgga

SEQ ID NO: 444694 - DNA, 25 bp, Homo sapien
gtgtttactccgtggatcactatta

SEQ ID NO: 444695 - DNA, 25 bp, Homo sapien
tagcaatactagcaaccaccattct

SEQ ID NO: 444696 - DNA, 25 bp, Homo sapien
ttctttggtatgtctttgttaattt

SEQ ID NO: 444697 - DNA, 25 bp, Homo sapien
agagaattttgtcccagtcttactt

SEQ ID NO: 444698 - DNA, 25 bp, Homo sapien
ttcttgtacaccctgctctcttagc

SEQ ID NO: 444699 - DNA, 25 bp, Homo sapien
ctctcttagccaccttcttgaaata

SEQ ID NO: 444700 - DNA, 25 bp, Homo sapien
accttcttgaaataatcgactgttg

SEQ ID NO: 444701 - DNA, 25 bp, Homo sapien
tatctttaaaaatcccagctttttg

SEQ ID NO: 444702 - DNA, 25 bp, Homo sapien
tttaaaaatcccagctttttggctg

SEQ ID NO: 444703 - DNA, 25 bp, Homo sapien
ttaaaaatcccagctttttggctgg

SEQ ID NO: 444704 - DNA, 25 bp, Homo sapien
taaaaatcccagctttttggctggg

SEQ ID NO: 444705 - DNA, 25 bp, Homo sapien
aggaggcagacattgcagtgggctg

SEQ ID NO: 444706 - DNA, 25 bp, Homo sapien
ggaggcagacattgcagtgggctga

SEQ ID NO: 444707 - DNA, 25 bp, Homo sapien
gaggcagacattgcagtgggctgag

SEQ ID NO: 444708 - DNA, 25 bp, Homo sapien
aggcagacattgcagtgggctgaga

SEQ ID NO: 444709 - DNA, 25 bp, Homo sapien
ggcagacattgcagtgggctgagat

SEQ ID NO: 444710 - DNA, 25 bp, Homo sapien
gcagacattgcagtgggctgagatc

SEQ ID NO: 444711 - DNA, 25 bp, Homo sapien
agacattgcagtgggctgagatcac

SEQ ID NO: 444712 - DNA, 25 bp, Homo sapien
ttagttgtacatttagccagtgtta

SEQ ID NO: 444713 - DNA, 25 bp, Homo sapien
agccagtgttatttgaagtatgtaa

SEQ ID NO: 444714 - DNA, 25 bp, Homo sapien
gaatgttttggtactgtgttttcac

SEQ ID NO: 444715 - DNA, 25 bp, Homo sapien
ggtactgtgttttcactcaaaccac

SEQ ID NO: 444716 - DNA, 25 bp, Homo sapien
gtgttttcactcaaaccactgactt

SEQ ID NO: 444717 - DNA, 25 bp, Homo sapien
accactgacttaacagatactgctg

SEQ ID NO: 444718 - DNA, 25 bp, Homo sapien
gatactgctgtgtataacatgtact

SEQ ID NO: 444719 - DNA, 25 bp, Homo sapien
ttgtgcataacagattgttcctctt

SEQ ID NO: 444720 - DNA, 25 bp, Homo sapien
gattgttcctcttatatttgtgtgt

SEQ ID NO: 444721 - DNA, 25 bp, Homo sapien
tttgtgtgtatacaggcaattcatg

SEQ ID NO: 444722 - DNA, 25 bp, Homo sapien
gtgtatacaggcaattcatgtttta

SEQ ID NO: 444723 - DNA, 25 bp, Homo sapien
ggtacgggcacctcgctggcgctct

SEQ ID NO: 444724 - DNA, 25 bp, Homo sapien
ggatgcagatgtacagccgtcagct

SEQ ID NO: 444725 - DNA, 25 bp, Homo sapien
agatgtacagccgtcagctggcctc

SEQ ID NO: 444726 - DNA, 25 bp, Homo sapien
gtcagctggcctccaccgagtggct

SEQ ID NO: 444727 - DNA, 25 bp, Homo sapien
gcggcctgcttggttcgggtctctt

SEQ ID NO: 444728 - DNA, 25 bp, Homo sapien
tgcttggttcgggtctcttcgtgtt

SEQ ID NO: 444729 - DNA, 25 bp, Homo sapien
ggtctcttcgtgttctcgctcactg

SEQ ID NO: 444730 - DNA, 25 bp, Homo sapien
gccttcaataatctggagaatcttg

SEQ ID NO: 444731 - DNA, 25 bp, Homo sapien
atctggagaatcttgtctttggcaa

SEQ ID NO: 444732 - DNA, 25 bp, Homo sapien
gagaatcttgtctttggcaaaggat

SEQ ID NO: 444733 - DNA, 25 bp, Homo sapien
ctttcttggccagaggcgccggttg

SEQ ID NO: 444734 - DNA, 25 bp, Homo sapien
cttatgcattttccaactatgtatg

SEQ ID NO: 444735 - DNA, 25 bp, Homo sapien
ttttccaactatgtatgcatcacag

SEQ ID NO: 444736 - DNA, 25 bp, Homo sapien
tccaactatgtatgcatcacagcta

SEQ ID NO: 444737 - DNA, 25 bp, Homo sapien
tatgtatgcatcacagctattcttt

SEQ ID NO: 444738 - DNA, 25 bp, Homo sapien
tgagttatagctacagttttcttac

SEQ ID NO: 444739 - DNA, 25 bp, Homo sapien
tactgttgtcttcatgccatttcat

SEQ ID NO: 444740 - DNA, 25 bp, Homo sapien
catttcacatggtactttgtagatt

SEQ ID NO: 444741 - DNA, 25 bp, Homo sapien
tcacatggtactttgtagattttga

SEQ ID NO: 444742 - DNA, 25 bp, Homo sapien
gattttgatgaggaagttggtattt

SEQ ID NO: 444743 - DNA, 25 bp, Homo sapien
gttggtatttttagtgcacacaaaa

SEQ ID NO: 444744 - DNA, 25 bp, Homo sapien
attggttttaactgtagagtttgct

SEQ ID NO: 444745 - DNA, 25 bp, Homo sapien
catcacatgtactgtgcatccactg

SEQ ID NO: 444746 - DNA, 25 bp, Homo sapien
gcatccactgtgattagatagctta

SEQ ID NO: 444747 - DNA, 25 bp, Homo sapien
gtgattagatagcttatgggatcct

SEQ ID NO: 444748 - DNA, 25 bp, Homo sapien
atgggatccttgaaatcacattgac

SEQ ID NO: 444749 - DNA, 25 bp, Homo sapien
gaaatcacattgacaggcactgtaa

SEQ ID NO: 444750 - DNA, 25 bp, Homo sapien
ggcactgtaaagtcacagccaagtt

SEQ ID NO: 444751 - DNA, 25 bp, Homo sapien
cacagccaagttagcaattattagt

SEQ ID NO: 444752 - DNA, 25 bp, Homo sapien
ttattagttgcacctcagagaatgt

SEQ ID NO: 444753 - DNA, 25 bp, Homo sapien
attattgctgtggatttctctctag

SEQ ID NO: 444754 - DNA, 25 bp, Homo sapien
ggatttctctctagcattttagctc

SEQ ID NO: 444755 - DNA, 25 bp, Homo sapien
cattttagctcattccagtaaatga

SEQ ID NO: 444756 - DNA, 25 bp, Homo sapien
ttactgtctatacctcctgaacctt

SEQ ID NO: 444757 - DNA, 25 bp, Homo sapien
tacctcctgaaccttggtattgtaa

SEQ ID NO: 444758 - DNA, 25 bp, Homo sapien
gacctctgggtctgttctgaccatt

SEQ ID NO: 444759 - DNA, 25 bp, Homo sapien
gggtctgttctgaccattccctagt

SEQ ID NO: 444760 - DNA, 25 bp, Homo sapien
attccctagtctccatggccaagca

SEQ ID NO: 444761 - DNA, 25 bp, Homo sapien
catggccaagcactcaaggattgat

SEQ ID NO: 444762 - DNA, 25 bp, Homo sapien
ggattgatggacaccacacaccagc

SEQ ID NO: 444763 - DNA, 25 bp, Homo sapien
acaccagctatattcatttgccaag

SEQ ID NO: 444764 - DNA, 25 bp, Homo sapien
attcatttgccaagatcaacagctc

SEQ ID NO: 444765 - DNA, 25 bp, Homo sapien
gatcaacagctccttctccaaacaa

SEQ ID NO: 444766 - DNA, 25 bp, Homo sapien
ggtgagatgcaactaacagcccctt

SEQ ID NO: 444767 - DNA, 25 bp, Homo sapien
agcactgctaacatagttatgacta

SEQ ID NO: 444768 - DNA, 25 bp, Homo sapien
gttatgactaactggaatcatgaca

SEQ ID NO: 444769 - DNA, 25 bp, Homo sapien
atcatgacaggatcatttgatttcc

SEQ ID NO: 444770 - DNA, 25 bp, Homo sapien
tttgatttccttgtggttatagaac

SEQ ID NO: 444771 - DNA, 25 bp, Homo sapien
catgctgtattattttggttctatt

SEQ ID NO: 444772 - DNA, 25 bp, Homo sapien
tggttctattgatccattttagaag

SEQ ID NO: 444773 - DNA, 25 bp, Homo sapien
tccattttagaaggtatctttctcc

SEQ ID NO: 444774 - DNA, 25 bp, Homo sapien
actggaccaacaagcctgtaactat

SEQ ID NO: 444775 - DNA, 25 bp, Homo sapien
gagagtactgcatatataaatagct

SEQ ID NO: 444776 - DNA, 25 bp, Homo sapien
gaattgaatgccgtgaacttttgtt

SEQ ID NO: 444777 - DNA, 25 bp, Homo sapien
aatgccgtgaacttttgttttggtg

SEQ ID NO: 444778 - DNA, 25 bp, Homo sapien
gctcctgagagaaaccatgcaattt

SEQ ID NO: 444779 - DNA, 25 bp, Homo sapien
tgagaactgcttgtcatgaccagac

SEQ ID NO: 444780 - DNA, 25 bp, Homo sapien
ggaaaccccagaaacgtgctcttca

SEQ ID NO: 444781 - DNA, 25 bp, Homo sapien
agaaacgtgctcttcatctgtcagc

SEQ ID NO: 444782 - DNA, 25 bp, Homo sapien
atctgtcagccttttggaccaagaa

SEQ ID NO: 444783 - DNA, 25 bp, Homo sapien
ggaccaagaagctgtcactatcaca

SEQ ID NO: 444784 - DNA, 25 bp, Homo sapien
tcactatcacacataagcaccattc

SEQ ID NO: 444785 - DNA, 25 bp, Homo sapien
gcaccattcccttagagtggatcca

SEQ ID NO: 444786 - DNA, 25 bp, Homo sapien
ggatccaggtgttgactataaccag

SEQ ID NO: 444787 - DNA, 25 bp, Homo sapien
cagatttactctttgcttactaggt

SEQ ID NO: 444788 - DNA, 25 bp, Homo sapien
tttgcttactaggttttccattgtc

SEQ ID NO: 444789 - DNA, 25 bp, Homo sapien
tttattcatttcctaattttaagat

SEQ ID NO: 444790 - DNA, 25 bp, Homo sapien
ttattcatttcctaattttaagatt

SEQ ID NO: 444791 - DNA, 25 bp, Homo sapien
tattcatttcctaattttaagatta

SEQ ID NO: 444792 - DNA, 25 bp, Homo sapien
ttttaagattaagcatgatcttgtg

SEQ ID NO: 444793 - DNA, 25 bp, Homo sapien
tttaagattaagcatgatcttgtgt

SEQ ID NO: 444794 - DNA, 25 bp, Homo sapien
ttaagattaagcatgatcttgtgta

SEQ ID NO: 444795 - DNA, 25 bp, Homo sapien
taagattaagcatgatcttgtgtat

SEQ ID NO: 444796 - DNA, 25 bp, Homo sapien
tactgtttatataactagaactaaa

SEQ ID NO: 444797 - DNA, 25 bp, Homo sapien
actgtttatataactagaactaaat

SEQ ID NO: 444798 - DNA, 25 bp, Homo sapien
ggccttctcagccacacgcagtgga

SEQ ID NO: 444799 - DNA, 25 bp, Homo sapien
ttctcagccacacgcagtggatcac

SEQ ID NO: 444800 - DNA, 25 bp, Homo sapien
tcagccacacgcagtggatcacact

SEQ ID NO: 444801 - DNA, 25 bp, Homo sapien
agccacacgcagtggatcacactgt

SEQ ID NO: 444802 - DNA, 25 bp, Homo sapien
cacacgcagtggatcacactgtaat

SEQ ID NO: 444803 - DNA, 25 bp, Homo sapien
agtggatcacactgtaatctcagca

SEQ ID NO: 444804 - DNA, 25 bp, Homo sapien
agctacccaggaggcacaagaattg

SEQ ID NO: 444805 - DNA, 25 bp, Homo sapien
tgcagtgagcctgtttgtacccctg

SEQ ID NO: 444806 - DNA, 25 bp, Homo sapien
cagtgagcctgtttgtacccctgca

SEQ ID NO: 444807 - DNA, 25 bp, Homo sapien
gtgagcctgtttgtacccctgcact

SEQ ID NO: 444808 - DNA, 25 bp, Homo sapien
tgagcctgtttgtacccctgcactc

SEQ ID NO: 444809 - DNA, 25 bp, Homo sapien
tatttaaatgccatgctgagcaatt

SEQ ID NO: 444810 - DNA, 25 bp, Homo sapien
aatgccatgctgagcaattgttctc

SEQ ID NO: 444811 - DNA, 25 bp, Homo sapien
atgccatgctgagcaattgttctct

SEQ ID NO: 444812 - DNA, 25 bp, Homo sapien
gccatgctgagcaattgttctctgt

SEQ ID NO: 444813 - DNA, 25 bp, Homo sapien
catgctgagcaattgttctctgtac

SEQ ID NO: 444814 - DNA, 25 bp, Homo sapien
tgctgagcaattgttctctgtacat

SEQ ID NO: 444815 - DNA, 25 bp, Homo sapien
tgttctctgtacatggtaaccaaaa

SEQ ID NO: 444816 - DNA, 25 bp, Homo sapien
gttctctgtacatggtaaccaaaac

SEQ ID NO: 444817 - DNA, 25 bp, Homo sapien
gtaaccaaaacttagagatttcgat

SEQ ID NO: 444818 - DNA, 25 bp, Homo sapien
atatgcaaatattctcatgcaagaa

SEQ ID NO: 444819 - DNA, 25 bp, Homo sapien
caaatattctcatgcaagaagttcc

SEQ ID NO: 444820 - DNA, 25 bp, Homo sapien
tgtagtgttccccagggtccacgtc

SEQ ID NO: 444821 - DNA, 25 bp, Homo sapien
tatccttggcagatatacagggagt

SEQ ID NO: 444822 - DNA, 25 bp, Homo sapien
atatacagggagtcacccaggagaa

SEQ ID NO: 444823 - DNA, 25 bp, Homo sapien
ggagaatcctggcacatcgggaatc

SEQ ID NO: 444824 - DNA, 25 bp, Homo sapien
ctggcacatcgggaatctttccttt

SEQ ID NO: 444825 - DNA, 25 bp, Homo sapien
acaggttgtccatgcaagtttccac

SEQ ID NO: 444826 - DNA, 25 bp, Homo sapien
aagtttccacttgtggttgtcagtg

SEQ ID NO: 444827 - DNA, 25 bp, Homo sapien
agtgttgatatcagtgtgagcatcc

SEQ ID NO: 444828 - DNA, 25 bp, Homo sapien
agtgtgagcatccacccagatgact

SEQ ID NO: 444829 - DNA, 25 bp, Homo sapien
tccacccagatgactccaagatcag

SEQ ID NO: 444830 - DNA, 25 bp, Homo sapien
atgactccaagatcagggtggaccc

SEQ ID NO: 444831 - DNA, 25 bp, Homo sapien
aagaaataagtccagttaaaatgag

SEQ ID NO: 444832 - DNA, 25 bp, Homo sapien
agaaataagtccagttaaaatgaga

SEQ ID NO: 444833 - DNA, 25 bp, Homo sapien
gaaataagtccagttaaaatgagag

SEQ ID NO: 444834 - DNA, 25 bp, Homo sapien
aaataagtccagttaaaatgagagt

SEQ ID NO: 444835 - DNA, 25 bp, Homo sapien
aataagtccagttaaaatgagagtt

SEQ ID NO: 444836 - DNA, 25 bp, Homo sapien
ataagtccagttaaaatgagagttg

SEQ ID NO: 444837 - DNA, 25 bp, Homo sapien
taagtccagttaaaatgagagttga

SEQ ID NO: 444838 - DNA, 25 bp, Homo sapien
aagtccagttaaaatgagagttgag

SEQ ID NO: 444839 - DNA, 25 bp, Homo sapien
agtccagttaaaatgagagttgagc

SEQ ID NO: 444840 - DNA, 25 bp, Homo sapien
aatgagagttgagccaggtgccctg

SEQ ID NO: 444841 - DNA, 25 bp, Homo sapien
tgagagttgagccaggtgccctggc

SEQ ID NO: 444842 - DNA, 25 bp, Homo sapien
caagaaaatgaatactcccctgcag

SEQ ID NO: 444843 - DNA, 25 bp, Homo sapien
agccatataaggcacattttggtat

SEQ ID NO: 444844 - DNA, 25 bp, Homo sapien
ggcacattttggtattctgactccc

SEQ ID NO: 444845 - DNA, 25 bp, Homo sapien
tggtattctgactcccagaactgta

SEQ ID NO: 444846 - DNA, 25 bp, Homo sapien
gttttaaacacccagtctgtgagtt

SEQ ID NO: 444847 - DNA, 25 bp, Homo sapien
aaacacccagtctgtgagtttgtta

SEQ ID NO: 444848 - DNA, 25 bp, Homo sapien
gcagcagtaggaaactaatatacat

SEQ ID NO: 444849 - DNA, 25 bp, Homo sapien
tatacatgacaatagttcccaaatt

SEQ ID NO: 444850 - DNA, 25 bp, Homo sapien
aaattcaacacaatcccttgcaaag

SEQ ID NO: 444851 - DNA, 25 bp, Homo sapien
aacacaatcccttgcaaagtcccag

SEQ ID NO: 444852 - DNA, 25 bp, Homo sapien
cccttgcaaagtcccagctggcttt

SEQ ID NO: 444853 - DNA, 25 bp, Homo sapien
ttagcattcgttttttacctgtttg

SEQ ID NO: 444854 - DNA, 25 bp, Homo sapien
tagcattcgttttttacctgtttgt

SEQ ID NO: 444855 - DNA, 25 bp, Homo sapien
agcattcgttttttacctgtttgtg

SEQ ID NO: 444856 - DNA, 25 bp, Homo sapien
gcattcgttttttacctgtttgtgg

SEQ ID NO: 444857 - DNA, 25 bp, Homo sapien
ttcgttttttacctgtttgtggatg

SEQ ID NO: 444858 - DNA, 25 bp, Homo sapien
tcgttttttacctgtttgtggatgt

SEQ ID NO: 444859 - DNA, 25 bp, Homo sapien
gtgtgtttgtatgtgcatacgtatg

SEQ ID NO: 444860 - DNA, 25 bp, Homo sapien
tgtgtttgtatgtgcatacgtatga

SEQ ID NO: 444861 - DNA, 25 bp, Homo sapien
gtgtttgtatgtgcatacgtatgag

SEQ ID NO: 444862 - DNA, 25 bp, Homo sapien
tgtttgtatgtgcatacgtatgaga

SEQ ID NO: 444863 - DNA, 25 bp, Homo sapien
acagtttccaacagctgtccttcct

SEQ ID NO: 444864 - DNA, 25 bp, Homo sapien
tgtccttcctcagtactctaatggc

SEQ ID NO: 444865 - DNA, 25 bp, Homo sapien
taatggccactccaccgcgagtgga

SEQ ID NO: 444866 - DNA, 25 bp, Homo sapien
caccgcgagtggaagtcactgttgt

SEQ ID NO: 444867 - DNA, 25 bp, Homo sapien
gtgtgtacacaggtggtcccaatca

SEQ ID NO: 444868 - DNA, 25 bp, Homo sapien
aaaactccatcttttgagcccaatt

SEQ ID NO: 444869 - DNA, 25 bp, Homo sapien
gagcccaattatgtccattttgtta

SEQ ID NO: 444870 - DNA, 25 bp, Homo sapien
gtaatgcatcaacataatttctgta

SEQ ID NO: 444871 - DNA, 25 bp, Homo sapien
atttctgtattaaccatcatgcgca

SEQ ID NO: 444872 - DNA, 25 bp, Homo sapien
aaccatcatgcgcacaagaaataca

SEQ ID NO: 444873 - DNA, 25 bp, Homo sapien
gctgaaaactcctggcattggatct

SEQ ID NO: 444874 - DNA, 25 bp, Homo sapien
aaggtggagccggactcgccttctc

SEQ ID NO: 444875 - DNA, 25 bp, Homo sapien
aggtggagccggactcgccttctcg

SEQ ID NO: 444876 - DNA, 25 bp, Homo sapien
cgccttctcgcccaggagcagttgg

SEQ ID NO: 444877 - DNA, 25 bp, Homo sapien
aggaaggaagccatgggctgcccca

SEQ ID NO: 444878 - DNA, 25 bp, Homo sapien
gaaggaagccatgggctgccccagt

SEQ ID NO: 444879 - DNA, 25 bp, Homo sapien
gtccacgttgcccagtccagcagag

SEQ ID NO: 444880 - DNA, 25 bp, Homo sapien
cacgttgcccagtccagcagagcag

SEQ ID NO: 444881 - DNA, 25 bp, Homo sapien
agagctcagtgcaggcactggcaac

SEQ ID NO: 444882 - DNA, 25 bp, Homo sapien
agtgcaggcactggcaacttctatt

SEQ ID NO: 444883 - DNA, 25 bp, Homo sapien
tgcaggcactggcaacttctatttg

SEQ ID NO: 444884 - DNA, 25 bp, Homo sapien
gcaggcactggcaacttctatttgg

SEQ ID NO: 444885 - DNA, 25 bp, Homo sapien
gtccctgcctaatgcgcctggagtc

SEQ ID NO: 444886 - DNA, 25 bp, Homo sapien
aaggaagctcgcgtttgttttgctg

SEQ ID NO: 444887 - DNA, 25 bp, Homo sapien
aagctcgcgtttgttttgctggcgc

SEQ ID NO: 444888 - DNA, 25 bp, Homo sapien
gtttgttttgctggcgccagggata

SEQ ID NO: 444889 - DNA, 25 bp, Homo sapien
ttgctggcgccagggatacggtcca

SEQ ID NO: 444890 - DNA, 25 bp, Homo sapien
gccccgcgctgatcccagggtagtg

SEQ ID NO: 444891 - DNA, 25 bp, Homo sapien
ggtagtgggaaagtgcgctccccaa

SEQ ID NO: 444892 - DNA, 25 bp, Homo sapien
ggaaagtgcgctccccaagaatttg

SEQ ID NO: 444893 - DNA, 25 bp, Homo sapien
gctccccaagaatttgcggtgcagg

SEQ ID NO: 444894 - DNA, 25 bp, Homo sapien
ccttctgtccgcaggtgctgcgagc

SEQ ID NO: 444895 - DNA, 25 bp, Homo sapien
gagttcacgtccctgcctaatgcgc

SEQ ID NO: 444896 - DNA, 25 bp, Homo sapien
cgtcgactccacagggacctttcag

SEQ ID NO: 444897 - DNA, 25 bp, Homo sapien
ttgacatggagagaaccttgactgt

SEQ ID NO: 444898 - DNA, 25 bp, Homo sapien
catggagagaaccttgactgtgttt

SEQ ID NO: 444899 - DNA, 25 bp, Homo sapien
gagaaccttgactgtgttttattat

SEQ ID NO: 444900 - DNA, 25 bp, Homo sapien
gtgttttattatttcatggcttgta

SEQ ID NO: 444901 - DNA, 25 bp, Homo sapien
tttcatggcttgtatgagtgtgact

SEQ ID NO: 444902 - DNA, 25 bp, Homo sapien
agtgtgactgggtgtgtttctttag

SEQ ID NO: 444903 - DNA, 25 bp, Homo sapien
tgactgggtgtgtttctttagggtt

SEQ ID NO: 444904 - DNA, 25 bp, Homo sapien
tgggtgtgtttctttagggttctga

SEQ ID NO: 444905 - DNA, 25 bp, Homo sapien
tttctttagggttctgattgccagt

SEQ ID NO: 444906 - DNA, 25 bp, Homo sapien
attttcatcaataagtcttgcaaag

SEQ ID NO: 444907 - DNA, 25 bp, Homo sapien
agctcaatggcacgacagggctgct

SEQ ID NO: 444908 - DNA, 25 bp, Homo sapien
ctgctctgctgctcttcgatgtaga

SEQ ID NO: 444909 - DNA, 25 bp, Homo sapien
tcttcgatgtagaggcttgccaggg

SEQ ID NO: 444910 - DNA, 25 bp, Homo sapien
ctaaccctcaactgcaatctatttt

SEQ ID NO: 444911 - DNA, 25 bp, Homo sapien
tattttgtatcccttgagctctcag

SEQ ID NO: 444912 - DNA, 25 bp, Homo sapien
gatagcagacttccttactgggaga

SEQ ID NO: 444913 - DNA, 25 bp, Homo sapien
actgggagatacactcattccatgg

SEQ ID NO: 444914 - DNA, 25 bp, Homo sapien
aggcctgacccacacgaactgggtg

SEQ ID NO: 444915 - DNA, 25 bp, Homo sapien
gggctgaaaacatgaggactggact

SEQ ID NO: 444916 - DNA, 25 bp, Homo sapien
gactcaagagtgtccagcttgaact

SEQ ID NO: 444917 - DNA, 25 bp, Homo sapien
gaacttgttttccaactgccttata

SEQ ID NO: 444918 - DNA, 25 bp, Homo sapien
acagaactaaagtagtcatgtcggt

SEQ ID NO: 444919 - DNA, 25 bp, Homo sapien
gaactaaagtagtcatgtcggtaag

SEQ ID NO: 444920 - DNA, 25 bp, Homo sapien
actaaagtagtcatgtcggtaagaa

SEQ ID NO: 444921 - DNA, 25 bp, Homo sapien
ctaaagtagtcatgtcggtaagaat

SEQ ID NO: 444922 - DNA, 25 bp, Homo sapien
aaagtagtcatgtcggtaagaattt

SEQ ID NO: 444923 - DNA, 25 bp, Homo sapien
tagtcatgtcggtaagaatttggga

SEQ ID NO: 444924 - DNA, 25 bp, Homo sapien
gtcatgtcggtaagaatttgggact

SEQ ID NO: 444925 - DNA, 25 bp, Homo sapien
gaatttgggactgcaggccagttac

SEQ ID NO: 444926 - DNA, 25 bp, Homo sapien
tgcaggccagttacgatggctctca

SEQ ID NO: 444927 - DNA, 25 bp, Homo sapien
gcaggccagttacgatggctctcac

SEQ ID NO: 444928 - DNA, 25 bp, Homo sapien
aggccagttacgatggctctcacct

SEQ ID NO: 444929 - DNA, 25 bp, Homo sapien
ccaatatgtggacagtaatcttaat

SEQ ID NO: 444930 - DNA, 25 bp, Homo sapien
atgtggacagtaatcttaatttcaa

SEQ ID NO: 444931 - DNA, 25 bp, Homo sapien
gacagtaatcttaatttcaaagcct

SEQ ID NO: 444932 - DNA, 25 bp, Homo sapien
ttttttgaggatactacggtgtagc

SEQ ID NO: 444933 - DNA, 25 bp, Homo sapien
gaggatactacggtgtagcttaagt

SEQ ID NO: 444934 - DNA, 25 bp, Homo sapien
ctacggtgtagcttaagtgaattta

SEQ ID NO: 444935 - DNA, 25 bp, Homo sapien
aaaagagtgcataaaagcttgtttt

SEQ ID NO: 444936 - DNA, 25 bp, Homo sapien
aaagcacaaattacttctaacaagg

SEQ ID NO: 444937 - DNA, 25 bp, Homo sapien
gcacaaattacttctaacaaggcaa

SEQ ID NO: 444938 - DNA, 25 bp, Homo sapien
tacttctaacaaggcaaatatttat

SEQ ID NO: 444939 - DNA, 25 bp, Homo sapien
ttgacatataagacattctgctagg

SEQ ID NO: 444940 - DNA, 25 bp, Homo sapien
tttgagaagtgcatggagtttccta

SEQ ID NO: 444941 - DNA, 25 bp, Homo sapien
ttgagaagtgcatggagtttcctaa

SEQ ID NO: 444942 - DNA, 25 bp, Homo sapien
tgagaagtgcatggagtttcctaaa

SEQ ID NO: 444943 - DNA, 25 bp, Homo sapien
gagaagtgcatggagtttcctaaac

SEQ ID NO: 444944 - DNA, 25 bp, Homo sapien
ggagtttcctaaactttgcacagaa

SEQ ID NO: 444945 - DNA, 25 bp, Homo sapien
gagtttcctaaactttgcacagaag

SEQ ID NO: 444946 - DNA, 25 bp, Homo sapien
actttgcacagaagaatatcctggg

SEQ ID NO: 444947 - DNA, 25 bp, Homo sapien
tgcacagaagaatatcctggggccg

SEQ ID NO: 444948 - DNA, 25 bp, Homo sapien
agaagaatatcctggggccgggcat

SEQ ID NO: 444949 - DNA, 25 bp, Homo sapien
ggcaggtggatcataggtcaaaaga

SEQ ID NO: 444950 - DNA, 25 bp, Homo sapien
atcataggtcaaaagatcgagacca

SEQ ID NO: 444951 - DNA, 25 bp, Homo sapien
acagtgcgctccttgtgcaagctta

SEQ ID NO: 444952 - DNA, 25 bp, Homo sapien
tgtgcaagcttatcttcctgtccag

SEQ ID NO: 444953 - DNA, 25 bp, Homo sapien
ctgtccagtctgctatcgaaactat

SEQ ID NO: 444954 - DNA, 25 bp, Homo sapien
gatggatgcatgcagtttgtcagaa

SEQ ID NO: 444955 - DNA, 25 bp, Homo sapien
gcagacattggttttgattgtagca

SEQ ID NO: 444956 - DNA, 25 bp, Homo sapien
gattgtagcatgtgcagaccctata

SEQ ID NO: 444957 - DNA, 25 bp, Homo sapien
gaccctatatgcctgcgtctaatgt

SEQ ID NO: 444958 - DNA, 25 bp, Homo sapien
cgtctaatgtgccttcctcagactg

SEQ ID NO: 444959 - DNA, 25 bp, Homo sapien
cctcagactgctgtgaatcttcact

SEQ ID NO: 444960 - DNA, 25 bp, Homo sapien
gtgaatcttcacttgtagcacaaat

SEQ ID NO: 444961 - DNA, 25 bp, Homo sapien
gtaaaagagctagacccacccaaga

SEQ ID NO: 444962 - DNA, 25 bp, Homo sapien
accccttaaatttctgtatagcaga

SEQ ID NO: 444963 - DNA, 25 bp, Homo sapien
tctgtatagcagacttaagagtgaa

SEQ ID NO: 444964 - DNA, 25 bp, Homo sapien
agcagacttaagagtgaatatcacc

SEQ ID NO: 444965 - DNA, 25 bp, Homo sapien
gagtgaatatcaccatatgcagttg

SEQ ID NO: 444966 - DNA, 25 bp, Homo sapien
gaatatcaccatatgcagttgttca

SEQ ID NO: 444967 - DNA, 25 bp, Homo sapien
atatcaccatatgcagttgttcatg

SEQ ID NO: 444968 - DNA, 25 bp, Homo sapien
gctcttgacaaaattctcagggaaa

SEQ ID NO: 444969 - DNA, 25 bp, Homo sapien
gtggatcaaacacaaagggcatcat

SEQ ID NO: 444970 - DNA, 25 bp, Homo sapien
atcaaacacaaagggcatcattcta

SEQ ID NO: 444971 - DNA, 25 bp, Homo sapien
atacagaaccataaaagccccaaat

SEQ ID NO: 444972 - DNA, 25 bp, Homo sapien
taaaagccccaaatagccaaagcaa

SEQ ID NO: 444973 - DNA, 25 bp, Homo sapien
gttctggattttctttacaatgcat

SEQ ID NO: 444974 - DNA, 25 bp, Homo sapien
tacaatgcatccatttgggcataat

SEQ ID NO: 444975 - DNA, 25 bp, Homo sapien
gggcataatgttatccctcttttta

SEQ ID NO: 444976 - DNA, 25 bp, Homo sapien
tatccctctttttatcaggtaaatg

SEQ ID NO: 444977 - DNA, 25 bp, Homo sapien
gtagcatctaaaagtagctttggat

SEQ ID NO: 444978 - DNA, 25 bp, Homo sapien
gtagctttggatcaaatcatgttga

SEQ ID NO: 444979 - DNA, 25 bp, Homo sapien
aatcatgttgaatacctggtcaaag

SEQ ID NO: 444980 - DNA, 25 bp, Homo sapien
ggtcaaagtaatgttttcttccttg

SEQ ID NO: 444981 - DNA, 25 bp, Homo sapien
gttcttgcagagaaacaaattcatc

SEQ ID NO: 444982 - DNA, 25 bp, Homo sapien
aaattcatcagaacattaccacttg

SEQ ID NO: 444983 - DNA, 25 bp, Homo sapien
agaacattaccacttgaccaggttt

SEQ ID NO: 444984 - DNA, 25 bp, Homo sapien
tggcttttgaaagtctgcgagaggc

SEQ ID NO: 444985 - DNA, 25 bp, Homo sapien
ggcttttgaaagtctgcgagaggct

SEQ ID NO: 444986 - DNA, 25 bp, Homo sapien
cttttgaaagtctgcgagaggctgg

SEQ ID NO: 444987 - DNA, 25 bp, Homo sapien
ttgaaagtctgcgagaggctgggca

SEQ ID NO: 444988 - DNA, 25 bp, Homo sapien
aagtctgcgagaggctgggcaccat

SEQ ID NO: 444989 - DNA, 25 bp, Homo sapien
aggtgggatcacttaagtgcagtga

SEQ ID NO: 444990 - DNA, 25 bp, Homo sapien
tgggatcacttaagtgcagtgagcc

SEQ ID NO: 444991 - DNA, 25 bp, Homo sapien
ggatcacttaagtgcagtgagccgt

SEQ ID NO: 444992 - DNA, 25 bp, Homo sapien
gatcacttaagtgcagtgagccgtg

SEQ ID NO: 444993 - DNA, 25 bp, Homo sapien
agagccagaccgtgtcttaaaaatg

SEQ ID NO: 444994 - DNA, 25 bp, Homo sapien
gagccagaccgtgtcttaaaaatga

SEQ ID NO: 444995 - DNA, 25 bp, Homo sapien
ctgaattgcagtaaaaccgtgtgct

SEQ ID NO: 444996 - DNA, 25 bp, Homo sapien
gaattgcagtaaaaccgtgtgcttc

SEQ ID NO: 444997 - DNA, 25 bp, Homo sapien
aattgcagtaaaaccgtgtgcttct

SEQ ID NO: 444998 - DNA, 25 bp, Homo sapien
attgcagtaaaaccgtgtgcttcta

SEQ ID NO: 444999 - DNA, 25 bp, Homo sapien
tgcagtaaaaccgtgtgcttctatg

SEQ ID NO: 445000 - DNA, 25 bp, Homo sapien
cagtaaaaccgtgtgcttctatgag

SEQ ID NO: 445001 - DNA, 25 bp, Homo sapien
agtaaaaccgtgtgcttctatgagg

SEQ ID NO: 445002 - DNA, 25 bp, Homo sapien
gtaaaaccgtgtgcttctatgaggg

SEQ ID NO: 445003 - DNA, 25 bp, Homo sapien
accgtgtgcttctatgaggggataa

SEQ ID NO: 445004 - DNA, 25 bp, Homo sapien
taaagtatttacttgtggctgggca

SEQ ID NO: 445005 - DNA, 25 bp, Homo sapien
gtatttacttgtggctgggcacggt

SEQ ID NO: 445006 - DNA, 25 bp, Homo sapien
aggtagtccgagtgccggatcccga

SEQ ID NO: 445007 - DNA, 25 bp, Homo sapien
cgagtgccggatcccgaaactccag

SEQ ID NO: 445008 - DNA, 25 bp, Homo sapien
gcttccggtgctgatccacgttgta

SEQ ID NO: 445009 - DNA, 25 bp, Homo sapien
gtgctgatccacgttgtaggccgcg

SEQ ID NO: 445010 - DNA, 25 bp, Homo sapien
tgatccacgttgtaggccgcgggcc

SEQ ID NO: 445011 - DNA, 25 bp, Homo sapien
cctggcttccgagtgttgtcttggg

SEQ ID NO: 445012 - DNA, 25 bp, Homo sapien
gaagtccgcgccagaatcgtgaact

SEQ ID NO: 445013 - DNA, 25 bp, Homo sapien
cgggacttgtagacccctggactca

SEQ ID NO: 445014 - DNA, 25 bp, Homo sapien
agacccctggactcacgacctgata

SEQ ID NO: 445015 - DNA, 25 bp, Homo sapien
gaggtcctcgaagaaactgccagcc

SEQ ID NO: 445016 - DNA, 25 bp, Homo sapien
gtcctcgaagaaactgccagccgct

SEQ ID NO: 445017 - DNA, 25 bp, Homo sapien
gcattttatctctacagttctctaa

SEQ ID NO: 445018 - DNA, 25 bp, Homo sapien
gttctctaagagtacatctgagtcc

SEQ ID NO: 445019 - DNA, 25 bp, Homo sapien
tctgagtccaaagtgtatctgaatg

SEQ ID NO: 445020 - DNA, 25 bp, Homo sapien
aatgtgtgctctgaccttattctta

SEQ ID NO: 445021 - DNA, 25 bp, Homo sapien
tgttttctccccatactttatagcc

SEQ ID NO: 445022 - DNA, 25 bp, Homo sapien
tctccccatactttatagccattta

SEQ ID NO: 445023 - DNA, 25 bp, Homo sapien
tgacgtatattcaagtctgagccaa

SEQ ID NO: 445024 - DNA, 25 bp, Homo sapien
ctgagccaaattgaggattgtgtct

SEQ ID NO: 445025 - DNA, 25 bp, Homo sapien
attgtgtctaggaaatctgtaaagc

SEQ ID NO: 445026 - DNA, 25 bp, Homo sapien
gtaaagccatactactgtgttcatt

SEQ ID NO: 445027 - DNA, 25 bp, Homo sapien
ctgtgttcattagcatgagcaattt

SEQ ID NO: 445028 - DNA, 25 bp, Homo sapien
ggctgcacaccagctctaagagcga

SEQ ID NO: 445029 - DNA, 25 bp, Homo sapien
ccagctctaagagcgagagtgaacg

SEQ ID NO: 445030 - DNA, 25 bp, Homo sapien
gcgagcgagatctttggagagattt

SEQ ID NO: 445031 - DNA, 25 bp, Homo sapien
gcctcctacttctgtcttgaagcca

SEQ ID NO: 445032 - DNA, 25 bp, Homo sapien
gtcttgaagccagacaatcgacttc

SEQ ID NO: 445033 - DNA, 25 bp, Homo sapien
gaagccagacaatcgacttcagctc

SEQ ID NO: 445034 - DNA, 25 bp, Homo sapien
ccgaaaccaacaaagctgagccgag

SEQ ID NO: 445035 - DNA, 25 bp, Homo sapien
aagctgagccgagagaaacaaacaa

SEQ ID NO: 445036 - DNA, 25 bp, Homo sapien
caaaacaaacacaccgggccagaca

SEQ ID NO: 445037 - DNA, 25 bp, Homo sapien
cgggccagacaagccatcgacaaaa

SEQ ID NO: 445038 - DNA, 25 bp, Homo sapien
gacaagccatcgacaaaactttgca

SEQ ID NO: 445039 - DNA, 25 bp, Homo sapien
tcttgcatctctccatgtgtgaagt

SEQ ID NO: 445040 - DNA, 25 bp, Homo sapien
cggcagggcgcacggaggaagggct

SEQ ID NO: 445041 - DNA, 25 bp, Homo sapien
gcatctctccatgtgtgaagtggct

SEQ ID NO: 445042 - DNA, 25 bp, Homo sapien
ctgggtgcagggaactgactgcttc

SEQ ID NO: 445043 - DNA, 25 bp, Homo sapien
gtgcagggaactgactgcttctccg

SEQ ID NO: 445044 - DNA, 25 bp, Homo sapien
agggaactgactgcttctccgcatc

SEQ ID NO: 445045 - DNA, 25 bp, Homo sapien
tctctccatgtgtgaagtggctatt

SEQ ID NO: 445046 - DNA, 25 bp, Homo sapien
gaagtggctattggtagcttgagtt

SEQ ID NO: 445047 - DNA, 25 bp, Homo sapien
ggtagcttgagttatatctttctca

SEQ ID NO: 445048 - DNA, 25 bp, Homo sapien
gagttatatctttctcagtattgtc

SEQ ID NO: 445049 - DNA, 25 bp, Homo sapien
ctcagtattgtctttatcacatttt

SEQ ID NO: 445050 - DNA, 25 bp, Homo sapien
ccgaaaccaacaaagctgagccgag

SEQ ID NO: 445051 - DNA, 25 bp, Homo sapien
aaaccaacaaagctgagccgagaga

SEQ ID NO: 445052 - DNA, 25 bp, Homo sapien
caaaacaaacacaccgggccagaca

SEQ ID NO: 445053 - DNA, 25 bp, Homo sapien
accgggccagacaagccatcgacaa

SEQ ID NO: 445054 - DNA, 25 bp, Homo sapien
cgggccagacaagccatcgacaaaa

SEQ ID NO: 445055 - DNA, 25 bp, Homo sapien
gccagacaagccatcgacaaaactt

SEQ ID NO: 445056 - DNA, 25 bp, Homo sapien
cagacaagccatcgacaaaactttg

SEQ ID NO: 445057 - DNA, 25 bp, Homo sapien
gacaagccatcgacaaaactttgca

SEQ ID NO: 445058 - DNA, 25 bp, Homo sapien
acaagccatcgacaaaactttgcaa

SEQ ID NO: 445059 - DNA, 25 bp, Homo sapien
aagccatcgacaaaactttgcaaaa

SEQ ID NO: 445060 - DNA, 25 bp, Homo sapien
gccatcgacaaaactttgcaaaagc

SEQ ID NO: 445061 - DNA, 25 bp, Homo sapien
ttgggaatgtttctccctcgtacca

SEQ ID NO: 445062 - DNA, 25 bp, Homo sapien
tctccctcgtaccacaaaggatgtt

SEQ ID NO: 445063 - DNA, 25 bp, Homo sapien
aaggatgttagtggtcagcctacga

SEQ ID NO: 445064 - DNA, 25 bp, Homo sapien
tggtcagcctacgagttaatccttc

SEQ ID NO: 445065 - DNA, 25 bp, Homo sapien
taatccttcctagcatggctctgag

SEQ ID NO: 445066 - DNA, 25 bp, Homo sapien
gctctgagccttcatgccgagcaga

SEQ ID NO: 445067 - DNA, 25 bp, Homo sapien
gccgagcagacgttattcacatgac

SEQ ID NO: 445068 - DNA, 25 bp, Homo sapien
gacagcaattctttagttccagcca

SEQ ID NO: 445069 - DNA, 25 bp, Homo sapien
gccccactggacaatagcgatttgt

SEQ ID NO: 445070 - DNA, 25 bp, Homo sapien
agcgatttgttagcacagagtcaca

SEQ ID NO: 445071 - DNA, 25 bp, Homo sapien
tgtgggacacaaagcttggagctgc

SEQ ID NO: 445072 - DNA, 25 bp, Homo sapien
agctctttgggtggctgaggcggac

SEQ ID NO: 445073 - DNA, 25 bp, Homo sapien
gctctttgggtggctgaggcggacg

SEQ ID NO: 445074 - DNA, 25 bp, Homo sapien
ctctttgggtggctgaggcggacgg

SEQ ID NO: 445075 - DNA, 25 bp, Homo sapien
tctttgggtggctgaggcggacgga

SEQ ID NO: 445076 - DNA, 25 bp, Homo sapien
gggtggctgaggcggacggatcacc

SEQ ID NO: 445077 - DNA, 25 bp, Homo sapien
ggtggctgaggcggacggatcacct

SEQ ID NO: 445078 - DNA, 25 bp, Homo sapien
gtggctgaggcggacggatcacctg

SEQ ID NO: 445079 - DNA, 25 bp, Homo sapien
tggctgaggcggacggatcacctga

SEQ ID NO: 445080 - DNA, 25 bp, Homo sapien
aagtcataactccatgatgcaaaag

SEQ ID NO: 445081 - DNA, 25 bp, Homo sapien
taactccatgatgcaaaagagaaca

SEQ ID NO: 445082 - DNA, 25 bp, Homo sapien
gaaatatgtttcaatgactgccttt

SEQ ID NO: 445083 - DNA, 25 bp, Homo sapien
atatgtttcaatgactgccttttaa

SEQ ID NO: 445084 - DNA, 25 bp, Homo sapien
gtttcaatgactgccttttaaatta

SEQ ID NO: 445085 - DNA, 25 bp, Homo sapien
gccttttaaattagcggtactccag

SEQ ID NO: 445086 - DNA, 25 bp, Homo sapien
taaattagcggtactccagcacttt

SEQ ID NO: 445087 - DNA, 25 bp, Homo sapien
aaattagcggtactccagcactttg

SEQ ID NO: 445088 - DNA, 25 bp, Homo sapien
aattagcggtactccagcactttgg

SEQ ID NO: 445089 - DNA, 25 bp, Homo sapien
atcatagccagaccttgtttctact

SEQ ID NO: 445090 - DNA, 25 bp, Homo sapien
tcatagccagaccttgtttctacta

SEQ ID NO: 445091 - DNA, 25 bp, Homo sapien
gagctgagagctagcatgccgttta

SEQ ID NO: 445092 - DNA, 25 bp, Homo sapien
agctgagagctagcatgccgtttaa

SEQ ID NO: 445093 - DNA, 25 bp, Homo sapien
ctgagagctagcatgccgtttaact

SEQ ID NO: 445094 - DNA, 25 bp, Homo sapien
gagagctagcatgccgtttaacttg

SEQ ID NO: 445095 - DNA, 25 bp, Homo sapien
agctagcatgccgtttaacttggca

SEQ ID NO: 445096 - DNA, 25 bp, Homo sapien
gctagcatgccgtttaacttggcag

SEQ ID NO: 445097 - DNA, 25 bp, Homo sapien
agcatgccgtttaacttggcaggaa

SEQ ID NO: 445098 - DNA, 25 bp, Homo sapien
atgccgtttaacttggcaggaagca

SEQ ID NO: 445099 - DNA, 25 bp, Homo sapien
tttaacttggcaggaagcaggccgg

SEQ ID NO: 445100 - DNA, 25 bp, Homo sapien
acttggcaggaagcaggccgggcgc

SEQ ID NO: 445101 - DNA, 25 bp, Homo sapien
atcagccgggcgtatgtgcgggcgc

SEQ ID NO: 445102 - DNA, 25 bp, Homo sapien
caccatacagacttgacagcatagt

SEQ ID NO: 445103 - DNA, 25 bp, Homo sapien
gacttgacagcatagtctagaggct

SEQ ID NO: 445104 - DNA, 25 bp, Homo sapien
ggctctgtgactcccattaatgaca

SEQ ID NO: 445105 - DNA, 25 bp, Homo sapien
gactcccattaatgacagtcactgc

SEQ ID NO: 445106 - DNA, 25 bp, Homo sapien
tttccccaggcaggatgtgccagga

SEQ ID NO: 445107 - DNA, 25 bp, Homo sapien
caggagaactgctccatgttggctc

SEQ ID NO: 445108 - DNA, 25 bp, Homo sapien
tgttggctcagcagaatgttattat

SEQ ID NO: 445109 - DNA, 25 bp, Homo sapien
agggaacagggcttctctagattat

SEQ ID NO: 445110 - DNA, 25 bp, Homo sapien
gggcttctctagattatttcaggga

SEQ ID NO: 445111 - DNA, 25 bp, Homo sapien
atttcagggaacgagctattatttg

SEQ ID NO: 445112 - DNA, 25 bp, Homo sapien
aaatgtaaggcccaagaaacttcag

SEQ ID NO: 445113 - DNA, 25 bp, Homo sapien
gtaatctctgaaagcctttttactt

SEQ ID NO: 445114 - DNA, 25 bp, Homo sapien
taatctctgaaagcctttttacttt

SEQ ID NO: 445115 - DNA, 25 bp, Homo sapien
tttttactttaaccaaatctacatg

SEQ ID NO: 445116 - DNA, 25 bp, Homo sapien
tactttaaccaaatctacatggttt

SEQ ID NO: 445117 - DNA, 25 bp, Homo sapien
gttacaataacttagggacattttg

SEQ ID NO: 445118 - DNA, 25 bp, Homo sapien
caataacttagggacattttgacac

SEQ ID NO: 445119 - DNA, 25 bp, Homo sapien
atgccttctcctttttaccgatatt

SEQ ID NO: 445120 - DNA, 25 bp, Homo sapien
tgccttctcctttttaccgatattt

SEQ ID NO: 445121 - DNA, 25 bp, Homo sapien
cttctcctttttaccgatatttctg

SEQ ID NO: 445122 - DNA, 25 bp, Homo sapien
gatatgtatctattcatgattgaaa

SEQ ID NO: 445123 - DNA, 25 bp, Homo sapien
attcatgattgaaaggaagcagtct

SEQ ID NO: 445124 - DNA, 25 bp, Homo sapien
tgggtgatcgcgtacagccgtcctg

SEQ ID NO: 445125 - DNA, 25 bp, Homo sapien
gtacagccgtcctgtctacttctgc

SEQ ID NO: 445126 - DNA, 25 bp, Homo sapien
tacttctgcatctgctgtctgctca

SEQ ID NO: 445127 - DNA, 25 bp, Homo sapien
tgtctgctcatctggctgctggacg

SEQ ID NO: 445128 - DNA, 25 bp, Homo sapien
ttctgtgcccgagacgtggccactg

SEQ ID NO: 445129 - DNA, 25 bp, Homo sapien
gagacgtggccactgtgttcaccct

SEQ ID NO: 445130 - DNA, 25 bp, Homo sapien
gaggctttgccttgcctgcatattt

SEQ ID NO: 445131 - DNA, 25 bp, Homo sapien
tgcctgcatatttgtttcgctctta

SEQ ID NO: 445132 - DNA, 25 bp, Homo sapien
gcatatttgtttcgctcttactcag

SEQ ID NO: 445133 - DNA, 25 bp, Homo sapien
gtttcgctcttactcagtttgggaa

SEQ ID NO: 445134 - DNA, 25 bp, Homo sapien
tcgctcttactcagtttgggaattc

SEQ ID NO: 445135 - DNA, 25 bp, Homo sapien
gatgtcatattatactggactgtga

SEQ ID NO: 445136 - DNA, 25 bp, Homo sapien
attatactggactgtgaagcgagaa

SEQ ID NO: 445137 - DNA, 25 bp, Homo sapien
aagccactaaagcttgtggcagcca

SEQ ID NO: 445138 - DNA, 25 bp, Homo sapien
gtggcagccaccaaattttccaatg

SEQ ID NO: 445139 - DNA, 25 bp, Homo sapien
ccaaattttccaatgccttctgcaa

SEQ ID NO: 445140 - DNA, 25 bp, Homo sapien
atgccttctgcaatcttgcatttaa

SEQ ID NO: 445141 - DNA, 25 bp, Homo sapien
gcaatcttgcatttaactggcttca

SEQ ID NO: 445142 - DNA, 25 bp, Homo sapien
aaaggctttaggagcatttggtcag

SEQ ID NO: 445143 - DNA, 25 bp, Homo sapien
ggtgctgtcagggtttacggttcac

SEQ ID NO: 445144 - DNA, 25 bp, Homo sapien
tcagggtttacggttcaccttcaag

SEQ ID NO: 445145 - DNA, 25 bp, Homo sapien
gttcaccttcaaggaagccctgggt

SEQ ID NO: 445146 - DNA, 25 bp, Homo sapien
cttatgcattttccaactatgtatg

SEQ ID NO: 445147 - DNA, 25 bp, Homo sapien
cattttccaactatgtatgcatcac

SEQ ID NO: 445148 - DNA, 25 bp, Homo sapien
tttccaactatgtatgcatcacagc

SEQ ID NO: 445149 - DNA, 25 bp, Homo sapien
tccaactatgtatgcatcacagcta

SEQ ID NO: 445150 - DNA, 25 bp, Homo sapien
actatgtatgcatcacagctattct

SEQ ID NO: 445151 - DNA, 25 bp, Homo sapien
tatgtatgcatcacagctattcttt

SEQ ID NO: 445152 - DNA, 25 bp, Homo sapien
catttcacatggtactttgtagatt

SEQ ID NO: 445153 - DNA, 25 bp, Homo sapien
tcacatggtactttgtagattttga

SEQ ID NO: 445154 - DNA, 25 bp, Homo sapien
gattttgatgaggaagttggtattt

SEQ ID NO: 445155 - DNA, 25 bp, Homo sapien
gttggtatttttagtgcacacaaaa

SEQ ID NO: 445156 - DNA, 25 bp, Homo sapien
attggttttaactgtagagtttgct

SEQ ID NO: 445157 - DNA, 25 bp, Homo sapien
gaggctttgccttgcctgcatattt

SEQ ID NO: 445158 - DNA, 25 bp, Homo sapien
tttgccttgcctgcatatttgtttc

SEQ ID NO: 445159 - DNA, 25 bp, Homo sapien
gccttgcctgcatatttgtttcgct

SEQ ID NO: 445160 - DNA, 25 bp, Homo sapien
tgcctgcatatttgtttcgctctta

SEQ ID NO: 445161 - DNA, 25 bp, Homo sapien
ctgcatatttgtttcgctcttactc

SEQ ID NO: 445162 - DNA, 25 bp, Homo sapien
gcatatttgtttcgctcttactcag

SEQ ID NO: 445163 - DNA, 25 bp, Homo sapien
atatttgtttcgctcttactcagtt

SEQ ID NO: 445164 - DNA, 25 bp, Homo sapien
atttgtttcgctcttactcagtttg

SEQ ID NO: 445165 - DNA, 25 bp, Homo sapien
ttgtttcgctcttactcagtttggg

SEQ ID NO: 445166 - DNA, 25 bp, Homo sapien
gtttcgctcttactcagtttgggaa

SEQ ID NO: 445167 - DNA, 25 bp, Homo sapien
tcgctcttactcagtttgggaattc

SEQ ID NO: 445168 - DNA, 25 bp, Homo sapien
agaaaattaatgttctgacagttgt

SEQ ID NO: 445169 - DNA, 25 bp, Homo sapien
ctgacagttgtgatcgcctggagta

SEQ ID NO: 445170 - DNA, 25 bp, Homo sapien
tgacagttgtgatcgcctggagtac

SEQ ID NO: 445171 - DNA, 25 bp, Homo sapien
gacagttgtgatcgcctggagtact

SEQ ID NO: 445172 - DNA, 25 bp, Homo sapien
acagttgtgatcgcctggagtactt

SEQ ID NO: 445173 - DNA, 25 bp, Homo sapien
tacgtatgagataggcacatgcatc

SEQ ID NO: 445174 - DNA, 25 bp, Homo sapien
gtatgagataggcacatgcatcttc

SEQ ID NO: 445175 - DNA, 25 bp, Homo sapien
atgagataggcacatgcatcttctg

SEQ ID NO: 445176 - DNA, 25 bp, Homo sapien
tgagataggcacatgcatcttctgt

SEQ ID NO: 445177 - DNA, 25 bp, Homo sapien
gagataggcacatgcatcttctgta

SEQ ID NO: 445178 - DNA, 25 bp, Homo sapien
agataggcacatgcatcttctgtat

SEQ ID NO: 445179 - DNA, 25 bp, Homo sapien
gggacaggagaccataggatttgga

SEQ ID NO: 445180 - DNA, 25 bp, Homo sapien
ggacaggagaccataggatttggac

SEQ ID NO: 445181 - DNA, 25 bp, Homo sapien
gacaggagaccataggatttggacc

SEQ ID NO: 445182 - DNA, 25 bp, Homo sapien
caggagaccataggatttggacccc

SEQ ID NO: 445183 - DNA, 25 bp, Homo sapien
aggagaccataggatttggacccca

SEQ ID NO: 445184 - DNA, 25 bp, Homo sapien
ggaccccaaagggatgtgaactgat

SEQ ID NO: 445185 - DNA, 25 bp, Homo sapien
gaccccaaagggatgtgaactgatc

SEQ ID NO: 445186 - DNA, 25 bp, Homo sapien
accccaaagggatgtgaactgatct

SEQ ID NO: 445187 - DNA, 25 bp, Homo sapien
ccccaaagggatgtgaactgatctg

SEQ ID NO: 445188 - DNA, 25 bp, Homo sapien
cccaaagggatgtgaactgatctga

SEQ ID NO: 445189 - DNA, 25 bp, Homo sapien
tttgactcttttatcacatgctcca

SEQ ID NO: 445190 - DNA, 25 bp, Homo sapien
gactcttttatcacatgctccaatg

SEQ ID NO: 445191 - DNA, 25 bp, Homo sapien
gtatgtacataagtgtctgtggctt

SEQ ID NO: 445192 - DNA, 25 bp, Homo sapien
gtgtctgtggcttaaataatatgtt

SEQ ID NO: 445193 - DNA, 25 bp, Homo sapien
ttgtggtgcaagtaattaatgttat

SEQ ID NO: 445194 - DNA, 25 bp, Homo sapien
gattgttataccatatgtgcccatt

SEQ ID NO: 445195 - DNA, 25 bp, Homo sapien
gttataccatatgtgcccattaaaa

SEQ ID NO: 445196 - DNA, 25 bp, Homo sapien
catatgtgcccattaaaattctttt

SEQ ID NO: 445197 - DNA, 25 bp, Homo sapien
aatataaatgcccttgtacccttca

SEQ ID NO: 445198 - DNA, 25 bp, Homo sapien
taaatgcccttgtacccttcacata

SEQ ID NO: 445199 - DNA, 25 bp, Homo sapien
gcccttgtacccttcacatactatt

SEQ ID NO: 445200 - DNA, 25 bp, Homo sapien
ctgctttcagaaaacccttatcaac

SEQ ID NO: 445201 - DNA, 25 bp, Homo sapien
gaaaacccttatcaacaagtgtaca

SEQ ID NO: 445202 - DNA, 25 bp, Homo sapien
gtgtacaatacttatctaaaactat

SEQ ID NO: 445203 - DNA, 25 bp, Homo sapien
ctatacatttagaatggagcagttt

SEQ ID NO: 445204 - DNA, 25 bp, Homo sapien
ggagcagtttaatactagatctcag

SEQ ID NO: 445205 - DNA, 25 bp, Homo sapien
atactagatctcagaagttttgaaa

SEQ ID NO: 445206 - DNA, 25 bp, Homo sapien
gaaagcatggtctacaattggttgt

SEQ ID NO: 445207 - DNA, 25 bp, Homo sapien
acaattggttgttaaattctgaagc

SEQ ID NO: 445208 - DNA, 25 bp, Homo sapien
aaatgtttcaactttggattatgaa

SEQ ID NO: 445209 - DNA, 25 bp, Homo sapien
ttccctcactgctgattcttagata

SEQ ID NO: 445210 - DNA, 25 bp, Homo sapien
cctcactgctgattcttagatagaa

SEQ ID NO: 445211 - DNA, 25 bp, Homo sapien
atattaagaaatacagtgccaggca

SEQ ID NO: 445212 - DNA, 25 bp, Homo sapien
ttaagaaatacagtgccaggcatgg

SEQ ID NO: 445213 - DNA, 25 bp, Homo sapien
agcctaggcaatgcagcgaggcctt

SEQ ID NO: 445214 - DNA, 25 bp, Homo sapien
ggcaatgcagcgaggccttgtctag

SEQ ID NO: 445215 - DNA, 25 bp, Homo sapien
gcaatgcagcgaggccttgtctaga

SEQ ID NO: 445216 - DNA, 25 bp, Homo sapien
atgcagcgaggccttgtctagaaaa

SEQ ID NO: 445217 - DNA, 25 bp, Homo sapien
gcagcgaggccttgtctagaaaatt

SEQ ID NO: 445218 - DNA, 25 bp, Homo sapien
gcgaggccttgtctagaaaatttaa

SEQ ID NO: 445219 - DNA, 25 bp, Homo sapien
tctcttgagctaagtagttcgaggc

SEQ ID NO: 445220 - DNA, 25 bp, Homo sapien
ttgagctaagtagttcgaggctgaa

SEQ ID NO: 445221 - DNA, 25 bp, Homo sapien
taagtagttcgaggctgaagtgagc

SEQ ID NO: 445222 - DNA, 25 bp, Homo sapien
taattcatcctaactttacctggta

SEQ ID NO: 445223 - DNA, 25 bp, Homo sapien
tacctggtaaatggagtgaccatct

SEQ ID NO: 445224 - DNA, 25 bp, Homo sapien
tctgtgttagcttattggccttatt

SEQ ID NO: 445225 - DNA, 25 bp, Homo sapien
agcttattggccttattcagagaaa

SEQ ID NO: 445226 - DNA, 25 bp, Homo sapien
gcaactggaagcaagatctcaccaa

SEQ ID NO: 445227 - DNA, 25 bp, Homo sapien
gatctcaccaaagttaggaccccac

SEQ ID NO: 445228 - DNA, 25 bp, Homo sapien
accagagctgggagatgtccttgga

SEQ ID NO: 445229 - DNA, 25 bp, Homo sapien
gagatgtccttggaaaatacattct

SEQ ID NO: 445230 - DNA, 25 bp, Homo sapien
tacattcttgcatcataaaggtgac

SEQ ID NO: 445231 - DNA, 25 bp, Homo sapien
aggtgacaaaaagcctatctagtct

SEQ ID NO: 445232 - DNA, 25 bp, Homo sapien
gcctatctagtcttcaaaaggattt

SEQ ID NO: 445233 - DNA, 25 bp, Homo sapien
gacttgtctcggtcacctgtgccct

SEQ ID NO: 445234 - DNA, 25 bp, Homo sapien
tgtgccctgtccagactcgaggcag

SEQ ID NO: 445235 - DNA, 25 bp, Homo sapien
tgtccagactcgaggcagtggtaac

SEQ ID NO: 445236 - DNA, 25 bp, Homo sapien
cagtggtaacactgcacagtgctat

SEQ ID NO: 445237 - DNA, 25 bp, Homo sapien
tgcacagtgctatgtggcttctctt

SEQ ID NO: 445238 - DNA, 25 bp, Homo sapien
gtggcttctctttgaggatttttgg

SEQ ID NO: 445239 - DNA, 25 bp, Homo sapien
tctctttgaggatttttgggttttg

SEQ ID NO: 445240 - DNA, 25 bp, Homo sapien
ttgtaactaaattcttgctgccctc

SEQ ID NO: 445241 - DNA, 25 bp, Homo sapien
taaattcttgctgccctcatacttt

SEQ ID NO: 445242 - DNA, 25 bp, Homo sapien
gctgccctcatactttttatgtatt

SEQ ID NO: 445243 - DNA, 25 bp, Homo sapien
tattagaatcatattcgtattgccc

SEQ ID NO: 445244 - DNA, 25 bp, Homo sapien
agaagctgagttacctaaacgagag

SEQ ID NO: 445245 - DNA, 25 bp, Homo sapien
gagttacctaaacgagagcatttac

SEQ ID NO: 445246 - DNA, 25 bp, Homo sapien
tatttatatgagaagctggcaactg

SEQ ID NO: 445247 - DNA, 25 bp, Homo sapien
ctggtgagagtatagcagtcaaaaa

SEQ ID NO: 445248 - DNA, 25 bp, Homo sapien
gaaaatgctcactcttagataccta

SEQ ID NO: 445249 - DNA, 25 bp, Homo sapien
gatacctaagaattcaaagcgtttc

SEQ ID NO: 445250 - DNA, 25 bp, Homo sapien
aagcgtttcaacctagagcaaccac

SEQ ID NO: 445251 - DNA, 25 bp, Homo sapien
aaccactaaaaaacctgcacagaga

SEQ ID NO: 445252 - DNA, 25 bp, Homo sapien
gatgacagtcaatattacaatagag

SEQ ID NO: 445253 - DNA, 25 bp, Homo sapien
aatgttcaaataacctggttgggtg

SEQ ID NO: 445254 - DNA, 25 bp, Homo sapien
cagcactttgaggtgggcaatggct

SEQ ID NO: 445255 - DNA, 25 bp, Homo sapien
gagtttcatgaactgattactgttg

SEQ ID NO: 445256 - DNA, 25 bp, Homo sapien
gtttcatgaactgattactgttgta

SEQ ID NO: 445257 - DNA, 25 bp, Homo sapien
ctgaaagtaccagcatagactgtat

SEQ ID NO: 445258 - DNA, 25 bp, Homo sapien
gtaccagcatagactgtatgatttc

SEQ ID NO: 445259 - DNA, 25 bp, Homo sapien
gcatagactgtatgatttctgctat

SEQ ID NO: 445260 - DNA, 25 bp, Homo sapien
agactgtatgatttctgctattttg

SEQ ID NO: 445261 - DNA, 25 bp, Homo sapien
tttctgctattttgcatcccaatat

SEQ ID NO: 445262 - DNA, 25 bp, Homo sapien
tctgctattttgcatcccaatatag

SEQ ID NO: 445263 - DNA, 25 bp, Homo sapien
tgctattttgcatcccaatatagga

SEQ ID NO: 445264 - DNA, 25 bp, Homo sapien
tattttgcatcccaatataggagta

SEQ ID NO: 445265 - DNA, 25 bp, Homo sapien
ttgcatcccaatataggagtagaat

SEQ ID NO: 445266 - DNA, 25 bp, Homo sapien
aaagctgctaactcagctcagcagt

SEQ ID NO: 445267 - DNA, 25 bp, Homo sapien
taactcagctcagcagtaaagcgat

SEQ ID NO: 445268 - DNA, 25 bp, Homo sapien
gtaaagcgattactgtacctgtcta

SEQ ID NO: 445269 - DNA, 25 bp, Homo sapien
agcgattactgtacctgtctacaca

SEQ ID NO: 445270 - DNA, 25 bp, Homo sapien
cctgtctacacaggtagtgttcatt

SEQ ID NO: 445271 - DNA, 25 bp, Homo sapien
acaggtagtgttcattgtgtccaaa

SEQ ID NO: 445272 - DNA, 25 bp, Homo sapien
agcatttcagttgcctgtgcaagct

SEQ ID NO: 445273 - DNA, 25 bp, Homo sapien
gttgcctgtgcaagctgtgaattta

SEQ ID NO: 445274 - DNA, 25 bp, Homo sapien
gataaggaaaactattctccacttt

SEQ ID NO: 445275 - DNA, 25 bp, Homo sapien
actattctccacttttatcccaaat

SEQ ID NO: 445276 - DNA, 25 bp, Homo sapien
gaacatcttttcacacaatcaatct

SEQ ID NO: 445277 - DNA, 25 bp, Homo sapien
cagtcatagttcacctgtctcttat

SEQ ID NO: 445278 - DNA, 25 bp, Homo sapien
gtctcttatctattcacttctggtg

SEQ ID NO: 445279 - DNA, 25 bp, Homo sapien
tatctattcacttctggtgccacaa

SEQ ID NO: 445280 - DNA, 25 bp, Homo sapien
tctggtgccacaactgtttatcctt

SEQ ID NO: 445281 - DNA, 25 bp, Homo sapien
gaacagaaatgcctttttgtattgc

SEQ ID NO: 445282 - DNA, 25 bp, Homo sapien
atgcctttttgtattgcaatcgaaa

SEQ ID NO: 445283 - DNA, 25 bp, Homo sapien
gatttattatatacagtgggcgttc

SEQ ID NO: 445284 - DNA, 25 bp, Homo sapien
gtgggcgttcaagtctagtcgagca

SEQ ID NO: 445285 - DNA, 25 bp, Homo sapien
ttcaagtctagtcgagcaagctcag

SEQ ID NO: 445286 - DNA, 25 bp, Homo sapien
ttattttgtatctcacctgtcatgg

SEQ ID NO: 445287 - DNA, 25 bp, Homo sapien
tttgtatctcacctgtcatggatga

SEQ ID NO: 445288 - DNA, 25 bp, Homo sapien
ctccagacttctatgctttggtggc

SEQ ID NO: 445289 - DNA, 25 bp, Homo sapien
agcggctggaacagctggtccaaga

SEQ ID NO: 445290 - DNA, 25 bp, Homo sapien
agctggtccaagagcagctgaaatc

SEQ ID NO: 445291 - DNA, 25 bp, Homo sapien
agggtcccccatcgacagagaagga

SEQ ID NO: 445292 - DNA, 25 bp, Homo sapien
agaaggaagccatactgcggaggct

SEQ ID NO: 445293 - DNA, 25 bp, Homo sapien
ttaaccagaagctggcctcggaccc

SEQ ID NO: 445294 - DNA, 25 bp, Homo sapien
tgcgcagcaagctggtccgcctgtc

SEQ ID NO: 445295 - DNA, 25 bp, Homo sapien
tctttcgcccgcctggtggagctgt

SEQ ID NO: 445296 - DNA, 25 bp, Homo sapien
cccgcctggtggagctgttctgtag

SEQ ID NO: 445297 - DNA, 25 bp, Homo sapien
gagctgttctgtagccgggatgaca

SEQ ID NO: 445298 - DNA, 25 bp, Homo sapien
gatgacagctctcgcccaagccgag

SEQ ID NO: 445299 - DNA, 25 bp, Homo sapien
gaatttgaaattgtcctgggcaccg

SEQ ID NO: 445300 - DNA, 25 bp, Homo sapien
ctgggcaccgtagcgagactctgct

SEQ ID NO: 445301 - DNA, 25 bp, Homo sapien
gggcaccgtagcgagactctgcttt

SEQ ID NO: 445302 - DNA, 25 bp, Homo sapien
ggcaccgtagcgagactctgctttc

SEQ ID NO: 445303 - DNA, 25 bp, Homo sapien
gcaccgtagcgagactctgctttct

SEQ ID NO: 445304 - DNA, 25 bp, Homo sapien
caccgtagcgagactctgctttcta

SEQ ID NO: 445305 - DNA, 25 bp, Homo sapien
accgtagcgagactctgctttctac

SEQ ID NO: 445306 - DNA, 25 bp, Homo sapien
cgtagcgagactctgctttctacaa

SEQ ID NO: 445307 - DNA, 25 bp, Homo sapien
gtagcgagactctgctttctacaaa

SEQ ID NO: 445308 - DNA, 25 bp, Homo sapien
ctaactactctaagcctgaggcaag

SEQ ID NO: 445309 - DNA, 25 bp, Homo sapien
taactactctaagcctgaggcaaga

SEQ ID NO: 445310 - DNA, 25 bp, Homo sapien
tatcaactcatagtggttgagaatc

SEQ ID NO: 445311 - DNA, 25 bp, Homo sapien
atatccttgaggtgtggtgtcccaa

SEQ ID NO: 445312 - DNA, 25 bp, Homo sapien
ttgaggtgtggtgtcccaaataacc

SEQ ID NO: 445313 - DNA, 25 bp, Homo sapien
tgggacataaactagcatagctgga

SEQ ID NO: 445314 - DNA, 25 bp, Homo sapien
gcatagctggagcactaactttcaa

SEQ ID NO: 445315 - DNA, 25 bp, Homo sapien
gctggagcactaactttcaaaataa

SEQ ID NO: 445316 - DNA, 25 bp, Homo sapien
ggaataatagtcagctcttctaaaa

SEQ ID NO: 445317 - DNA, 25 bp, Homo sapien
gctgtagcctcagaataccatttac

SEQ ID NO: 445318 - DNA, 25 bp, Homo sapien
aggattgagaacttcagtggtaaac

SEQ ID NO: 445319 - DNA, 25 bp, Homo sapien
gtggtaaactgtcacctgtatctct

SEQ ID NO: 445320 - DNA, 25 bp, Homo sapien
aaactgtcacctgtatctctatggt

SEQ ID NO: 445321 - DNA, 25 bp, Homo sapien
gggaagtgaagcacaggactccaat

SEQ ID NO: 445322 - DNA, 25 bp, Homo sapien
ggactccaatagatttgccagccac

SEQ ID NO: 445323 - DNA, 25 bp, Homo sapien
atttgccagccacctaaagatagag

SEQ ID NO: 445324 - DNA, 25 bp, Homo sapien
tatgcagagggcttcataaaaacat

SEQ ID NO: 445325 - DNA, 25 bp, Homo sapien
aaaacatttcaagacctaggtgcca

SEQ ID NO: 445326 - DNA, 25 bp, Homo sapien
agacctaggtgccaagaacctggag

SEQ ID NO: 445327 - DNA, 25 bp, Homo sapien
gaacctggagccaattgaagtcgct

SEQ ID NO: 445328 - DNA, 25 bp, Homo sapien
ggagccaattgaagtcgctgttctc

SEQ ID NO: 445329 - DNA, 25 bp, Homo sapien
aagtcgctgttctcttgaagcatcc

SEQ ID NO: 445330 - DNA, 25 bp, Homo sapien
gttctcttgaagcatccttttattc

SEQ ID NO: 445331 - DNA, 25 bp, Homo sapien
tccttttattcaagacctgatttca

SEQ ID NO: 445332 - DNA, 25 bp, Homo sapien
atgtgatgagatgagtctgcttcgc

SEQ ID NO: 445333 - DNA, 25 bp, Homo sapien
tgatgagatgagtctgcttcgcaga

SEQ ID NO: 445334 - DNA, 25 bp, Homo sapien
gatgagatgagtctgcttcgcagat

SEQ ID NO: 445335 - DNA, 25 bp, Homo sapien
gagatgagtctgcttcgcagattgt

SEQ ID NO: 445336 - DNA, 25 bp, Homo sapien
gatgagtctgcttcgcagattgtat

SEQ ID NO: 445337 - DNA, 25 bp, Homo sapien
gagtctgcttcgcagattgtatgta

SEQ ID NO: 445338 - DNA, 25 bp, Homo sapien
gtctgcttcgcagattgtatgtata

SEQ ID NO: 445339 - DNA, 25 bp, Homo sapien
ctgcttcgcagattgtatgtataaa

SEQ ID NO: 445340 - DNA, 25 bp, Homo sapien
ttgtatgtataaatgtctgctcact

SEQ ID NO: 445341 - DNA, 25 bp, Homo sapien
actccagttacagtgaatactcgaa

SEQ ID NO: 445342 - DNA, 25 bp, Homo sapien
ccagttacagtgaatactcgaaaat

SEQ ID NO: 445343 - DNA, 25 bp, Homo sapien
tccctctcagataccagtttaacac

SEQ ID NO: 445344 - DNA, 25 bp, Homo sapien
taccagtttaacacgaagtctccct

SEQ ID NO: 445345 - DNA, 25 bp, Homo sapien
ttaacacgaagtctccctgtttgac

SEQ ID NO: 445346 - DNA, 25 bp, Homo sapien
ccctgtttgactcctgtgagttgtg

SEQ ID NO: 445347 - DNA, 25 bp, Homo sapien
attgtgtatcttgacttctcaatga

SEQ ID NO: 445348 - DNA, 25 bp, Homo sapien
gacttctcaatgatagcaagttaca

SEQ ID NO: 445349 - DNA, 25 bp, Homo sapien
gcaagttacattttgcagttttctt

SEQ ID NO: 445350 - DNA, 25 bp, Homo sapien
tgcagttttcttcctatacccacaa

SEQ ID NO: 445351 - DNA, 25 bp, Homo sapien
cttaaatatcttcctgtgtgcctaa

SEQ ID NO: 445352 - DNA, 25 bp, Homo sapien
tcctgtgtgcctaaacgtttttgtt

SEQ ID NO: 445353 - DNA, 25 bp, Homo sapien
tgttttaagttgctgatccttttaa

SEQ ID NO: 445354 - DNA, 25 bp, Homo sapien
cacctgccttggtctggatcttctc

SEQ ID NO: 445355 - DNA, 25 bp, Homo sapien
ttcttaaagaagtggcgggcaacta

SEQ ID NO: 445356 - DNA, 25 bp, Homo sapien
taattttccttcttgtctcagcaat

SEQ ID NO: 445357 - DNA, 25 bp, Homo sapien
tcagcaatttctcctcttcaaacag

SEQ ID NO: 445358 - DNA, 25 bp, Homo sapien
ttcaaacagcttcttgttttcaggg

SEQ ID NO: 445359 - DNA, 25 bp, Homo sapien
ggatgcatatacagccagtccctga

SEQ ID NO: 445360 - DNA, 25 bp, Homo sapien
gaggaaggagtcgattccggcctaa

SEQ ID NO: 445361 - DNA, 25 bp, Homo sapien
gattccggcctaaagatttcttcac

SEQ ID NO: 445362 - DNA, 25 bp, Homo sapien
atttcttcactgagaccaggtcacc

SEQ ID NO: 445363 - DNA, 25 bp, Homo sapien
cgggcaactatttcagggttcagct

SEQ ID NO: 445364 - DNA, 25 bp, Homo sapien
ggttcagctcccatttgacattgtt

SEQ ID NO: 445365 - DNA, 25 bp, Homo sapien
agttgtgatcgcctggagtactttt

SEQ ID NO: 445366 - DNA, 25 bp, Homo sapien
gagtacttttagacttttagcattc

SEQ ID NO: 445367 - DNA, 25 bp, Homo sapien
ttagcattcgttttttacctgtttg

SEQ ID NO: 445368 - DNA, 25 bp, Homo sapien
tagcattcgttttttacctgtttgt

SEQ ID NO: 445369 - DNA, 25 bp, Homo sapien
agcattcgttttttacctgtttgtg

SEQ ID NO: 445370 - DNA, 25 bp, Homo sapien
gcattcgttttttacctgtttgtgg

SEQ ID NO: 445371 - DNA, 25 bp, Homo sapien
ttcgttttttacctgtttgtggatg

SEQ ID NO: 445372 - DNA, 25 bp, Homo sapien
tcgttttttacctgtttgtggatgt

SEQ ID NO: 445373 - DNA, 25 bp, Homo sapien
tttttacctgtttgtggatgtgtgt

SEQ ID NO: 445374 - DNA, 25 bp, Homo sapien
gtgtgtttgtatgtgcatacgtatg

SEQ ID NO: 445375 - DNA, 25 bp, Homo sapien
gagataggcacatgcatcttctgta

SEQ ID NO: 445376 - DNA, 25 bp, Homo sapien
ggattcaggtgctcccggtagagca

SEQ ID NO: 445377 - DNA, 25 bp, Homo sapien
ctcccggtagagcacagcagtatca

SEQ ID NO: 445378 - DNA, 25 bp, Homo sapien
agagcacagcagtatcactcgggct

SEQ ID NO: 445379 - DNA, 25 bp, Homo sapien
cagcagtatcactcgggctcctgag

SEQ ID NO: 445380 - DNA, 25 bp, Homo sapien
agagcctcccgctttgggctgggca

SEQ ID NO: 445381 - DNA, 25 bp, Homo sapien
aactggcatggaagagtcctggact

SEQ ID NO: 445382 - DNA, 25 bp, Homo sapien
aagagtcctggacttccgcaagtcg

SEQ ID NO: 445383 - DNA, 25 bp, Homo sapien
ggtcaccgcccgatgttcggtgccg

SEQ ID NO: 445384 - DNA, 25 bp, Homo sapien
agcccgtctccgaagtgctgtagga

SEQ ID NO: 445385 - DNA, 25 bp, Homo sapien
gtgctgtaggatcttagcttccttc

SEQ ID NO: 445386 - DNA, 25 bp, Homo sapien
taggatcttagcttccttcccgctg

SEQ ID NO: 445387 - DNA, 25 bp, Homo sapien
acaggcatgtgtaccactgtactac

SEQ ID NO: 445388 - DNA, 25 bp, Homo sapien
atgtgtaccactgtactacctggct

SEQ ID NO: 445389 - DNA, 25 bp, Homo sapien
gtaccactgtactacctggctaaat

SEQ ID NO: 445390 - DNA, 25 bp, Homo sapien
ccactgtactacctggctaaatttt

SEQ ID NO: 445391 - DNA, 25 bp, Homo sapien
tcctacctccatgttctgggtatca

SEQ ID NO: 445392 - DNA, 25 bp, Homo sapien
ccatgttctgggtatcattaaggta

SEQ ID NO: 445393 - DNA, 25 bp, Homo sapien
gttctgggtatcattaaggtaatca

SEQ ID NO: 445394 - DNA, 25 bp, Homo sapien
ttaaggtaatcagaatcctcctgct

SEQ ID NO: 445395 - DNA, 25 bp, Homo sapien
gtaatcagaatcctcctgctgtagt

SEQ ID NO: 445396 - DNA, 25 bp, Homo sapien
tcctgctgtagtcacgcttaccctt

SEQ ID NO: 445397 - DNA, 25 bp, Homo sapien
aggttccccaggattcagagagccc

SEQ ID NO: 445398 - DNA, 25 bp, Homo sapien
gagaatttcagcaaagatgttttaa

SEQ ID NO: 445399 - DNA, 25 bp, Homo sapien
aactgggcaagcatggatgacatat

SEQ ID NO: 445400 - DNA, 25 bp, Homo sapien
cagaattaagtgactcaaagtgcta

SEQ ID NO: 445401 - DNA, 25 bp, Homo sapien
caaagtgctatcgagaggtttttca

SEQ ID NO: 445402 - DNA, 25 bp, Homo sapien
gtttttcaagtatctttgagtttca

SEQ ID NO: 445403 - DNA, 25 bp, Homo sapien
tttgagtttcatggccaaagtgtta

SEQ ID NO: 445404 - DNA, 25 bp, Homo sapien
catggccaaagtgttaactagtttt

SEQ ID NO: 445405 - DNA, 25 bp, Homo sapien
actagttttactacaatgtttggtg

SEQ ID NO: 445406 - DNA, 25 bp, Homo sapien
gtgtttgtgtggaaattatctgcct

SEQ ID NO: 445407 - DNA, 25 bp, Homo sapien
aattatctgcctggtgtgtgcacac

SEQ ID NO: 445408 - DNA, 25 bp, Homo sapien
gcctggtgtgtgcacacaagtctta

SEQ ID NO: 445409 - DNA, 25 bp, Homo sapien
atgtagctgccagtgtgcaagctca

SEQ ID NO: 445410 - DNA, 25 bp, Homo sapien
tgtagctgccagtgtgcaagctcaa

SEQ ID NO: 445411 - DNA, 25 bp, Homo sapien
gtagctgccagtgtgcaagctcaat

SEQ ID NO: 445412 - DNA, 25 bp, Homo sapien
tagctgccagtgtgcaagctcaata

SEQ ID NO: 445413 - DNA, 25 bp, Homo sapien
agctgccagtgtgcaagctcaataa

SEQ ID NO: 445414 - DNA, 25 bp, Homo sapien
gctgccagtgtgcaagctcaataag

SEQ ID NO: 445415 - DNA, 25 bp, Homo sapien
ctgccagtgtgcaagctcaataaga

SEQ ID NO: 445416 - DNA, 25 bp, Homo sapien
gccagtgtgcaagctcaataagaaa

SEQ ID NO: 445417 - DNA, 25 bp, Homo sapien
gtgtgcaagctcaataagaaaacgg

SEQ ID NO: 445418 - DNA, 25 bp, Homo sapien
gtgcaagctcaataagaaaacggtg

SEQ ID NO: 445419 - DNA, 25 bp, Homo sapien
gcaagctcaataagaaaacggtggg

SEQ ID NO: 445420 - DNA, 25 bp, Homo sapien
gtaaaccaaaacatgtactgtgtac

SEQ ID NO: 445421 - DNA, 25 bp, Homo sapien
gtactgtgtacaacggaaataatat

SEQ ID NO: 445422 - DNA, 25 bp, Homo sapien
ataatatggcatattagccaggcat

SEQ ID NO: 445423 - DNA, 25 bp, Homo sapien
gccaggcatgatggttgcccaagac

SEQ ID NO: 445424 - DNA, 25 bp, Homo sapien
tggttgcccaagacagttaaattaa

SEQ ID NO: 445425 - DNA, 25 bp, Homo sapien
gttaaattaagctcaattctgtatt

SEQ ID NO: 445426 - DNA, 25 bp, Homo sapien
attagggctctgttatgtccttcat

SEQ ID NO: 445427 - DNA, 25 bp, Homo sapien
gctctgttatgtccttcatctgaaa

SEQ ID NO: 445428 - DNA, 25 bp, Homo sapien
atgtccttcatctgaaatgtacaca

SEQ ID NO: 445429 - DNA, 25 bp, Homo sapien
cacatttttggtgtatgcttggtac

SEQ ID NO: 445430 - DNA, 25 bp, Homo sapien
atgcttggtactggagattcatata

SEQ ID NO: 445431 - DNA, 25 bp, Homo sapien
tagccacagtattgccacagtttat

SEQ ID NO: 445432 - DNA, 25 bp, Homo sapien
gtttttatttgatttagcgcattca

SEQ ID NO: 445433 - DNA, 25 bp, Homo sapien
tttagcgcattcaaagcttttttct

SEQ ID NO: 445434 - DNA, 25 bp, Homo sapien
ttttctatcacttttgtgttcagaa

SEQ ID NO: 445435 - DNA, 25 bp, Homo sapien
atataacctttgtgtgcgtgtatgt

SEQ ID NO: 445436 - DNA, 25 bp, Homo sapien
ggcgtatatgtgtgttacaggttaa

SEQ ID NO: 445437 - DNA, 25 bp, Homo sapien
gttacaggttaatgccttcttggaa

SEQ ID NO: 445438 - DNA, 25 bp, Homo sapien
aatgccttcttggaattgtgttaat

SEQ ID NO: 445439 - DNA, 25 bp, Homo sapien
gttctcttggtttattatgccatca

SEQ ID NO: 445440 - DNA, 25 bp, Homo sapien
gtaaatgagaacactacaactgtag

SEQ ID NO: 445441 - DNA, 25 bp, Homo sapien
acaactgtagtcagctcacaatttt

SEQ ID NO: 445442 - DNA, 25 bp, Homo sapien
tcctgtgtcttgatagcatgggtgc

SEQ ID NO: 445443 - DNA, 25 bp, Homo sapien
gtgtgtgtctgcattcatgccttaa

SEQ ID NO: 445444 - DNA, 25 bp, Homo sapien
gcattcatgccttaactcgggttac

SEQ ID NO: 445445 - DNA, 25 bp, Homo sapien
ctcgggttactgcacaactttagtt

SEQ ID NO: 445446 - DNA, 25 bp, Homo sapien
tagttcttgacttagtctgcaccgt

SEQ ID NO: 445447 - DNA, 25 bp, Homo sapien
gtctgcaccgtcatctagattgtat

SEQ ID NO: 445448 - DNA, 25 bp, Homo sapien
tgtacatctcggtctgaacttcatc

SEQ ID NO: 445449 - DNA, 25 bp, Homo sapien
tatctggtcaggttgaccctgagcc

SEQ ID NO: 445450 - DNA, 25 bp, Homo sapien
gagccttctttggacttgatttgga

SEQ ID NO: 445451 - DNA, 25 bp, Homo sapien
gacttgatttggaacttagcctgga

SEQ ID NO: 445452 - DNA, 25 bp, Homo sapien
ttagcctggaaagcgaaagtggact

SEQ ID NO: 445453 - DNA, 25 bp, Homo sapien
gggctaaaagtgacacaccaataag

SEQ ID NO: 445454 - DNA, 25 bp, Homo sapien
ggctaaaagtgacacaccaataaga

SEQ ID NO: 445455 - DNA, 25 bp, Homo sapien
gctaaaagtgacacaccaataagat

SEQ ID NO: 445456 - DNA, 25 bp, Homo sapien
ctaaaagtgacacaccaataagatt

SEQ ID NO: 445457 - DNA, 25 bp, Homo sapien
taaaagtgacacaccaataagattg

SEQ ID NO: 445458 - DNA, 25 bp, Homo sapien
aaaagtgacacaccaataagattgc

SEQ ID NO: 445459 - DNA, 25 bp, Homo sapien
aaagtgacacaccaataagattgca

SEQ ID NO: 445460 - DNA, 25 bp, Homo sapien
aagtgacacaccaataagattgcat

SEQ ID NO: 445461 - DNA, 25 bp, Homo sapien
agtgacacaccaataagattgcatc

SEQ ID NO: 445462 - DNA, 25 bp, Homo sapien
ggattacaggtccagattttgaaca

SEQ ID NO: 445463 - DNA, 25 bp, Homo sapien
gattacaggtccagattttgaacaa

SEQ ID NO: 445464 - DNA, 25 bp, Homo sapien
ttacaggtccagattttgaacaaat

SEQ ID NO: 445465 - DNA, 25 bp, Homo sapien
caggtccagattttgaacaaatctc

SEQ ID NO: 445466 - DNA, 25 bp, Homo sapien
gagaaaacacagcaagcccctggat

SEQ ID NO: 445467 - DNA, 25 bp, Homo sapien
atccctcttgctccctggcagagtt

SEQ ID NO: 445468 - DNA, 25 bp, Homo sapien
cttgctccctggcagagttttctag

SEQ ID NO: 445469 - DNA, 25 bp, Homo sapien
tggcagagttttctagtccctctta

SEQ ID NO: 445470 - DNA, 25 bp, Homo sapien
agagttttctagtccctcttacttg

SEQ ID NO: 445471 - DNA, 25 bp, Homo sapien
agtccctcttacttgaagcatgtct

SEQ ID NO: 445472 - DNA, 25 bp, Homo sapien
gaagcatgtctttcagagcccggca

SEQ ID NO: 445473 - DNA, 25 bp, Homo sapien
aacacttggacacagaagggggaat

SEQ ID NO: 445474 - DNA, 25 bp, Homo sapien
agaagggggaatatcacacaccggg

SEQ ID NO: 445475 - DNA, 25 bp, Homo sapien
attttaagaagagaattagctacaa

SEQ ID NO: 445476 - DNA, 25 bp, Homo sapien
ttttaagaagagaattagctacaaa

SEQ ID NO: 445477 - DNA, 25 bp, Homo sapien
ttaagaagagaattagctacaaata

SEQ ID NO: 445478 - DNA, 25 bp, Homo sapien
taagaagagaattagctacaaataa

SEQ ID NO: 445479 - DNA, 25 bp, Homo sapien
aagaagagaattagctacaaataag

SEQ ID NO: 445480 - DNA, 25 bp, Homo sapien
agaagagaattagctacaaataaga

SEQ ID NO: 445481 - DNA, 25 bp, Homo sapien
gaagagaattagctacaaataagaa

SEQ ID NO: 445482 - DNA, 25 bp, Homo sapien
aagagaattagctacaaataagaaa

SEQ ID NO: 445483 - DNA, 25 bp, Homo sapien
gagaattagctacaaataagaaaac

SEQ ID NO: 445484 - DNA, 25 bp, Homo sapien
cagcaagggctgagtcaagtgagac

SEQ ID NO: 445485 - DNA, 25 bp, Homo sapien
aagtgagacttctccccttgctggg

SEQ ID NO: 445486 - DNA, 25 bp, Homo sapien
catccccactggtcagtaaggaagc

SEQ ID NO: 445487 - DNA, 25 bp, Homo sapien
ggtcagtaaggaagctcgtccgctc

SEQ ID NO: 445488 - DNA, 25 bp, Homo sapien
gtccgctcccagagtttcagtggag

SEQ ID NO: 445489 - DNA, 25 bp, Homo sapien
acgtgggaattctggattctcaccc

SEQ ID NO: 445490 - DNA, 25 bp, Homo sapien
ccactcagcagtaaggaggcaccta

SEQ ID NO: 445491 - DNA, 25 bp, Homo sapien
tggccagttgacacccagtagaaaa

SEQ ID NO: 445492 - DNA, 25 bp, Homo sapien
agtagaaaacccagatgcctgcatt

SEQ ID NO: 445493 - DNA, 25 bp, Homo sapien
agatgcctgcattcacctggcggta

SEQ ID NO: 445494 - DNA, 25 bp, Homo sapien
attcacctggcggtaacaagatggt

SEQ ID NO: 445495 - DNA, 25 bp, Homo sapien
tgctgctggctcttctagaggctgg

SEQ ID NO: 445496 - DNA, 25 bp, Homo sapien
ccacctgggctgtgcagagacggat

SEQ ID NO: 445497 - DNA, 25 bp, Homo sapien
ggcaaggccagggacagatgccaca

SEQ ID NO: 445498 - DNA, 25 bp, Homo sapien
gacagatgccacaacggccggcaat

SEQ ID NO: 445499 - DNA, 25 bp, Homo sapien
aacggccggcaatggtcccacgaag

SEQ ID NO: 445500 - DNA, 25 bp, Homo sapien
tggtcccacgaagtgcccttgagag

SEQ ID NO: 445501 - DNA, 25 bp, Homo sapien
agccagggctgggttctcactgatc

SEQ ID NO: 445502 - DNA, 25 bp, Homo sapien
gggttctcactgatcctgtgcctca

SEQ ID NO: 445503 - DNA, 25 bp, Homo sapien
atcctgtgcctcagtgggtcaccgc

SEQ ID NO: 445504 - DNA, 25 bp, Homo sapien
cctcagtgggtcaccgcagcctggg

SEQ ID NO: 445505 - DNA, 25 bp, Homo sapien
cccatctggaaatgagactgacatc

SEQ ID NO: 445506 - DNA, 25 bp, Homo sapien
aagtttcgtggctattaagttctag

SEQ ID NO: 445507 - DNA, 25 bp, Homo sapien
gtcaaatgcaagtctgtctaaatct

SEQ ID NO: 445508 - DNA, 25 bp, Homo sapien
gtctgtctaaatctagagcccatgt

SEQ ID NO: 445509 - DNA, 25 bp, Homo sapien
gcccatgttctttaactgcaacact

SEQ ID NO: 445510 - DNA, 25 bp, Homo sapien
tgcaacactataatgtctcaccccg

SEQ ID NO: 445511 - DNA, 25 bp, Homo sapien
tagtcccaccaattagtcaactctt

SEQ ID NO: 445512 - DNA, 25 bp, Homo sapien
gtcaactcttttagggcagaagtct

SEQ ID NO: 445513 - DNA, 25 bp, Homo sapien
gtctgtctaattcatctttgcttcc

SEQ ID NO: 445514 - DNA, 25 bp, Homo sapien
catctttgcttcctgttactttata

SEQ ID NO: 445515 - DNA, 25 bp, Homo sapien
attttacatttatcttcctgaagga

SEQ ID NO: 445516 - DNA, 25 bp, Homo sapien
ggaaactctgtatcattttgtcttt

SEQ ID NO: 445517 - DNA, 25 bp, Homo sapien
gatggtggacaccagggcggcctgc

SEQ ID NO: 445518 - DNA, 25 bp, Homo sapien
agcccgtgtgactcccagggccagg

SEQ ID NO: 445519 - DNA, 25 bp, Homo sapien
gggaggaacttgatccagcagagca

SEQ ID NO: 445520 - DNA, 25 bp, Homo sapien
aggaacttgatccagcagagcagca

SEQ ID NO: 445521 - DNA, 25 bp, Homo sapien
caccacctcggccaggaagagtagg

SEQ ID NO: 445522 - DNA, 25 bp, Homo sapien
ttgagcttgtggagctcctcgatct

SEQ ID NO: 445523 - DNA, 25 bp, Homo sapien
ccaggaagagtaggatgccaagcac

SEQ ID NO: 445524 - DNA, 25 bp, Homo sapien
ggagctcctcgatctcgcggttgtg

SEQ ID NO: 445525 - DNA, 25 bp, Homo sapien
atctcgcggttgtggcgctccgttt

SEQ ID NO: 445526 - DNA, 25 bp, Homo sapien
gctccgttttgtggcgcaccaggga

SEQ ID NO: 445527 - DNA, 25 bp, Homo sapien
tggatggtgaagaccacgaagatga

SEQ ID NO: 445528 - DNA, 25 bp, Homo sapien
aacaacctacaaatctctttcagtc

SEQ ID NO: 445529 - DNA, 25 bp, Homo sapien
acaacctacaaatctctttcagtcc

SEQ ID NO: 445530 - DNA, 25 bp, Homo sapien
caacctacaaatctctttcagtcct

SEQ ID NO: 445531 - DNA, 25 bp, Homo sapien
gcatttcaagcaaaatattctcttc

SEQ ID NO: 445532 - DNA, 25 bp, Homo sapien
catttcaagcaaaatattctcttca

SEQ ID NO: 445533 - DNA, 25 bp, Homo sapien
atttcaagcaaaatattctcttcag

SEQ ID NO: 445534 - DNA, 25 bp, Homo sapien
tttcaagcaaaatattctcttcaga

SEQ ID NO: 445535 - DNA, 25 bp, Homo sapien
ttcaagcaaaatattctcttcagaa

SEQ ID NO: 445536 - DNA, 25 bp, Homo sapien
tcttcagaaaaatgaccatttcata

SEQ ID NO: 445537 - DNA, 25 bp, Homo sapien
ttcagaaaaatgaccatttcataat

SEQ ID NO: 445538 - DNA, 25 bp, Homo sapien
tcataatatatatccccttctgtcg

SEQ ID NO: 445539 - DNA, 25 bp, Homo sapien
gcaacttctatttggtatgaagcac

SEQ ID NO: 445540 - DNA, 25 bp, Homo sapien
atgaagcactctattcagtcaccac

SEQ ID NO: 445541 - DNA, 25 bp, Homo sapien
ataggtcacttctctcatactcggt

SEQ ID NO: 445542 - DNA, 25 bp, Homo sapien
acttctctcatactcggtcttgagg

SEQ ID NO: 445543 - DNA, 25 bp, Homo sapien
atactcggtcttgaggatattctgg

SEQ ID NO: 445544 - DNA, 25 bp, Homo sapien
tggattaatcctttctatgcagacg

SEQ ID NO: 445545 - DNA, 25 bp, Homo sapien
aatcctttctatgcagacgtttctg

SEQ ID NO: 445546 - DNA, 25 bp, Homo sapien
atgcagacgtttctggtttacaaaa

SEQ ID NO: 445547 - DNA, 25 bp, Homo sapien
tttacaaaaggacgcagccctggac

SEQ ID NO: 445548 - DNA, 25 bp, Homo sapien
gcagccctggactacaagtctggaa

SEQ ID NO: 445549 - DNA, 25 bp, Homo sapien
ctggactacaagtctggaactgaca

SEQ ID NO: 445550 - DNA, 25 bp, Homo sapien
ttcctccagcgctactaccaagtgg

SEQ ID NO: 445551 - DNA, 25 bp, Homo sapien
taccaagtggtccagtgagtcccct

SEQ ID NO: 445552 - DNA, 25 bp, Homo sapien
aagtggtccagtgagtcccctgcag

SEQ ID NO: 445553 - DNA, 25 bp, Homo sapien
cagtgttggtgtccccagagtttgt

SEQ ID NO: 445554 - DNA, 25 bp, Homo sapien
actttgggctgtgggcaggtgctta

SEQ ID NO: 445555 - DNA, 25 bp, Homo sapien
aggtgcttagggatagaccctttct

SEQ ID NO: 445556 - DNA, 25 bp, Homo sapien
atagaccctttctgtctcgtgcagc

SEQ ID NO: 445557 - DNA, 25 bp, Homo sapien
ctctgtgtgcgtgcgaggagtacct

SEQ ID NO: 445558 - DNA, 25 bp, Homo sapien
aggagtaccttagcaacttggccca

SEQ ID NO: 445559 - DNA, 25 bp, Homo sapien
agcaacttggcccacatggacatcg

SEQ ID NO: 445560 - DNA, 25 bp, Homo sapien
acatggacatcgacaaggacctgga

SEQ ID NO: 445561 - DNA, 25 bp, Homo sapien
gaaaagtttagccaagagaatcaga

SEQ ID NO: 445562 - DNA, 25 bp, Homo sapien
aagtttagccaagagaatcagagaa

SEQ ID NO: 445563 - DNA, 25 bp, Homo sapien
gctgcattttataatcaaagcccaa

SEQ ID NO: 445564 - DNA, 25 bp, Homo sapien
gcattttataatcaaagcccaaact

SEQ ID NO: 445565 - DNA, 25 bp, Homo sapien
caaactcctttcttatcttgaccat

SEQ ID NO: 445566 - DNA, 25 bp, Homo sapien
aaactcctttcttatcttgaccata

SEQ ID NO: 445567 - DNA, 25 bp, Homo sapien
aactcctttcttatcttgaccatac

SEQ ID NO: 445568 - DNA, 25 bp, Homo sapien
ctcctttcttatcttgaccatacta

SEQ ID NO: 445569 - DNA, 25 bp, Homo sapien
tcctttcttatcttgaccatactaa

SEQ ID NO: 445570 - DNA, 25 bp, Homo sapien
ctttcttatcttgaccatactaata

SEQ ID NO: 445571 - DNA, 25 bp, Homo sapien
tcttatcttgaccatactaataaat

SEQ ID NO: 445572 - DNA, 25 bp, Homo sapien
ttctaagcaagggactacctgaatt

SEQ ID NO: 445573 - DNA, 25 bp, Homo sapien
agggactacctgaattaagacattt

SEQ ID NO: 445574 - DNA, 25 bp, Homo sapien
attaagacatttggtggacaccatt

SEQ ID NO: 445575 - DNA, 25 bp, Homo sapien
ggtggacaccattttgagatgaaga

SEQ ID NO: 445576 - DNA, 25 bp, Homo sapien
agggagatctctacttactgaagct

SEQ ID NO: 445577 - DNA, 25 bp, Homo sapien
gagatctctacttactgaagcttcc

SEQ ID NO: 445578 - DNA, 25 bp, Homo sapien
gaagcttcccaatgacatagttaag

SEQ ID NO: 445579 - DNA, 25 bp, Homo sapien
gatgttcatcatgccatatctctat

SEQ ID NO: 445580 - DNA, 25 bp, Homo sapien
ataatctgattctcacgggaaagtt

SEQ ID NO: 445581 - DNA, 25 bp, Homo sapien
gattctcacgggaaagttttcatta

SEQ ID NO: 445582 - DNA, 25 bp, Homo sapien
aaagagggctgggttccatggctca

SEQ ID NO: 445583 - DNA, 25 bp, Homo sapien
tcttgctttcgggtccggatgtggt

SEQ ID NO: 445584 - DNA, 25 bp, Homo sapien
ggtgagcacattttggagccctttg

SEQ ID NO: 445585 - DNA, 25 bp, Homo sapien
gcacattttggagccctttgaagct

SEQ ID NO: 445586 - DNA, 25 bp, Homo sapien
gccctttgaagctagatttggatga

SEQ ID NO: 445587 - DNA, 25 bp, Homo sapien
aaaaggcagggagcccattctaaca

SEQ ID NO: 445588 - DNA, 25 bp, Homo sapien
agggagcccattctaacatgctgcc

SEQ ID NO: 445589 - DNA, 25 bp, Homo sapien
ttctaacatgctgcccagaggaaac

SEQ ID NO: 445590 - DNA, 25 bp, Homo sapien
gatgcttttgcagtggtcatgtgat

SEQ ID NO: 445591 - DNA, 25 bp, Homo sapien
tcatgtgattgtgacctggtagcta

SEQ ID NO: 445592 - DNA, 25 bp, Homo sapien
gtgacctggtagctacttatcagag

SEQ ID NO: 445593 - DNA, 25 bp, Homo sapien
cctgggagacaggagcgatgcctca

SEQ ID NO: 445594 - DNA, 25 bp, Homo sapien
aaaattgtccacacactaggaaata

SEQ ID NO: 445595 - DNA, 25 bp, Homo sapien
ccattttataaattgccacctgtga

SEQ ID NO: 445596 - DNA, 25 bp, Homo sapien
gtactttgtaaaatatggagcccat

SEQ ID NO: 445597 - DNA, 25 bp, Homo sapien
atatggagcccattgtaccttcagc

SEQ ID NO: 445598 - DNA, 25 bp, Homo sapien
gtaccttcagctatttgagactata

SEQ ID NO: 445599 - DNA, 25 bp, Homo sapien
gagactatacacagtgcttcttttg

SEQ ID NO: 445600 - DNA, 25 bp, Homo sapien
cacagtgcttcttttgtaactggat

SEQ ID NO: 445601 - DNA, 25 bp, Homo sapien
taactggattactttaactttcgtg

SEQ ID NO: 445602 - DNA, 25 bp, Homo sapien
aactttcgtgaaggcattacattgc

SEQ ID NO: 445603 - DNA, 25 bp, Homo sapien
attacattgcctcacattcactaac

SEQ ID NO: 445604 - DNA, 25 bp, Homo sapien
ctcacattcactaaccaccttgaat

SEQ ID NO: 445605 - DNA, 25 bp, Homo sapien
tccagcgctactaccaagtggtcca

SEQ ID NO: 445606 - DNA, 25 bp, Homo sapien
cagtgttggtgtccccagagtttgt

SEQ ID NO: 445607 - DNA, 25 bp, Homo sapien
ctctgtgtgcgtgcgaggagtacct

SEQ ID NO: 445608 - DNA, 25 bp, Homo sapien
ctgtgtgcgtgcgaggagtacctta

SEQ ID NO: 445609 - DNA, 25 bp, Homo sapien
gcgtgcgaggagtaccttagcaact

SEQ ID NO: 445610 - DNA, 25 bp, Homo sapien
aggagtaccttagcaacttggccca

SEQ ID NO: 445611 - DNA, 25 bp, Homo sapien
agtaccttagcaacttggcccacat

SEQ ID NO: 445612 - DNA, 25 bp, Homo sapien
accttagcaacttggcccacatgga

SEQ ID NO: 445613 - DNA, 25 bp, Homo sapien
agcaacttggcccacatggacatcg

SEQ ID NO: 445614 - DNA, 25 bp, Homo sapien
ccacatggacatcgacaaggacctg

SEQ ID NO: 445615 - DNA, 25 bp, Homo sapien
catggacatcgacaaggacctggag

SEQ ID NO: 445616 - DNA, 25 bp, Homo sapien
cactcctgccagtacctaaagtaaa

SEQ ID NO: 445617 - DNA, 25 bp, Homo sapien
agtaaaatctacacgggcttggcac

SEQ ID NO: 445618 - DNA, 25 bp, Homo sapien
ataagccccagcttggaacccagag

SEQ ID NO: 445619 - DNA, 25 bp, Homo sapien
gaacccagagctgtaatttccggtt

SEQ ID NO: 445620 - DNA, 25 bp, Homo sapien
tgtaatttccggttgtggtccctgt

SEQ ID NO: 445621 - DNA, 25 bp, Homo sapien
tctaagggctcatctctcccaggag

SEQ ID NO: 445622 - DNA, 25 bp, Homo sapien
aggagcccctgtatcatctcagtaa

SEQ ID NO: 445623 - DNA, 25 bp, Homo sapien
gtatcatctcagtaactagaccagt

SEQ ID NO: 445624 - DNA, 25 bp, Homo sapien
actagaccagtaccatatccgactt

SEQ ID NO: 445625 - DNA, 25 bp, Homo sapien
atctgtgctggtttcttctcacgct

SEQ ID NO: 445626 - DNA, 25 bp, Homo sapien
tctcacgcttactctgcatcataat

SEQ ID NO: 445627 - DNA, 25 bp, Homo sapien
ttgttttcagctaacagtaacccca

SEQ ID NO: 445628 - DNA, 25 bp, Homo sapien
ccagatgagggttactaccagggtg

SEQ ID NO: 445629 - DNA, 25 bp, Homo sapien
gaaactgaagttcccgatgcgtaca

SEQ ID NO: 445630 - DNA, 25 bp, Homo sapien
gaagttcccgatgcgtacaacatgg

SEQ ID NO: 445631 - DNA, 25 bp, Homo sapien
gatgcgtacaacatggtgcctccca

SEQ ID NO: 445632 - DNA, 25 bp, Homo sapien
cgtacaacatggtgcctcccaaagt

SEQ ID NO: 445633 - DNA, 25 bp, Homo sapien
tcccaaagtgaaatgcctgaccaag

SEQ ID NO: 445634 - DNA, 25 bp, Homo sapien
ttcaattgatggcactggctgggct

SEQ ID NO: 445635 - DNA, 25 bp, Homo sapien
gctgggctcccacaagaacattaaa

SEQ ID NO: 445636 - DNA, 25 bp, Homo sapien
aactctttgtttactgatcttttga

SEQ ID NO: 445637 - DNA, 25 bp, Homo sapien
gatgatccactgaatattgaagctg

SEQ ID NO: 445638 - DNA, 25 bp, Homo sapien
gggatatatattatgaaatggtcat

SEQ ID NO: 445639 - DNA, 25 bp, Homo sapien
gaatattttgcttgaaatgcaaagg

SEQ ID NO: 445640 - DNA, 25 bp, Homo sapien
atattttgcttgaaatgcaaaggac

SEQ ID NO: 445641 - DNA, 25 bp, Homo sapien
attttgcttgaaatgcaaaggactg

SEQ ID NO: 445642 - DNA, 25 bp, Homo sapien
ttttgcttgaaatgcaaaggactga

SEQ ID NO: 445643 - DNA, 25 bp, Homo sapien
tttgcttgaaatgcaaaggactgaa

SEQ ID NO: 445644 - DNA, 25 bp, Homo sapien
ttgcttgaaatgcaaaggactgaaa

SEQ ID NO: 445645 - DNA, 25 bp, Homo sapien
tgcttgaaatgcaaaggactgaaag

SEQ ID NO: 445646 - DNA, 25 bp, Homo sapien
gcttgaaatgcaaaggactgaaaga

SEQ ID NO: 445647 - DNA, 25 bp, Homo sapien
ttgaaatgcaaaggactgaaagaga

SEQ ID NO: 445648 - DNA, 25 bp, Homo sapien
tgaaatgcaaaggactgaaagagat

SEQ ID NO: 445649 - DNA, 25 bp, Homo sapien
gaaaccatgagctccgtccagcagc

SEQ ID NO: 445650 - DNA, 25 bp, Homo sapien
ttgctcaccccgcaggagaacgagt

SEQ ID NO: 445651 - DNA, 25 bp, Homo sapien
aggagaacgagtccctcttcacttt

SEQ ID NO: 445652 - DNA, 25 bp, Homo sapien
ctcttcactttcctcggcaagaaat

SEQ ID NO: 445653 - DNA, 25 bp, Homo sapien
tcctcggcaagaaatgtgtgactat

SEQ ID NO: 445654 - DNA, 25 bp, Homo sapien
gtgtgactatgtcttcagcagtggt

SEQ ID NO: 445655 - DNA, 25 bp, Homo sapien
gtcttcagcagtggtgcagttatat

SEQ ID NO: 445656 - DNA, 25 bp, Homo sapien
gcagttatatgcagcagatcggaac

SEQ ID NO: 445657 - DNA, 25 bp, Homo sapien
agatcggaactgtatgtggtcaaag

SEQ ID NO: 445658 - DNA, 25 bp, Homo sapien
aagtgcagtggtgttgcttgtcttg

SEQ ID NO: 445659 - DNA, 25 bp, Homo sapien
tgttaaggacaatccacagagatct

SEQ ID NO: 445660 - DNA, 25 bp, Homo sapien
ccagatgagggttactaccagggtg

SEQ ID NO: 445661 - DNA, 25 bp, Homo sapien
gatgagggttactaccagggtggaa

SEQ ID NO: 445662 - DNA, 25 bp, Homo sapien
cctcccaaagtgaaatgcctgacca

SEQ ID NO: 445663 - DNA, 25 bp, Homo sapien
tcccaaagtgaaatgcctgaccaag

SEQ ID NO: 445664 - DNA, 25 bp, Homo sapien
ccaaagtgaaatgcctgaccaagat

SEQ ID NO: 445665 - DNA, 25 bp, Homo sapien
agaacattaaaggatgtcgtttggg

SEQ ID NO: 445666 - DNA, 25 bp, Homo sapien
gggattaaactctttgtttactgat

SEQ ID NO: 445667 - DNA, 25 bp, Homo sapien
tttgaattttgatgatccactgaat

SEQ ID NO: 445668 - DNA, 25 bp, Homo sapien
attttgatgatccactgaatattga

SEQ ID NO: 445669 - DNA, 25 bp, Homo sapien
gatgatccactgaatattgaagctg

SEQ ID NO: 445670 - DNA, 25 bp, Homo sapien
atgatccactgaatattgaagctgc

SEQ ID NO: 445671 - DNA, 25 bp, Homo sapien
caccggaggtcaggaactagaaatc

SEQ ID NO: 445672 - DNA, 25 bp, Homo sapien
accggaggtcaggaactagaaatca

SEQ ID NO: 445673 - DNA, 25 bp, Homo sapien
ccggaggtcaggaactagaaatcag

SEQ ID NO: 445674 - DNA, 25 bp, Homo sapien
cggaggtcaggaactagaaatcagc

SEQ ID NO: 445675 - DNA, 25 bp, Homo sapien
ggaggtcaggaactagaaatcagcc

SEQ ID NO: 445676 - DNA, 25 bp, Homo sapien
gaggtcaggaactagaaatcagcct

SEQ ID NO: 445677 - DNA, 25 bp, Homo sapien
aggtcaggaactagaaatcagcctg

SEQ ID NO: 445678 - DNA, 25 bp, Homo sapien
gtcaggaactagaaatcagcctggc

SEQ ID NO: 445679 - DNA, 25 bp, Homo sapien
tcaggaactagaaatcagcctggcc

SEQ ID NO: 445680 - DNA, 25 bp, Homo sapien
caggaactagaaatcagcctggcca

SEQ ID NO: 445681 - DNA, 25 bp, Homo sapien
ggaactagaaatcagcctggccaac

SEQ ID NO: 445682 - DNA, 25 bp, Homo sapien
gtatatttgcaaaccctttgtatta

SEQ ID NO: 445683 - DNA, 25 bp, Homo sapien
gacaaaaataacactgttggcactt

SEQ ID NO: 445684 - DNA, 25 bp, Homo sapien
aacactgttggcacttataggtaac

SEQ ID NO: 445685 - DNA, 25 bp, Homo sapien
gttggcacttataggtaacgtgatt

SEQ ID NO: 445686 - DNA, 25 bp, Homo sapien
ggtaacgtgattgattcagtatctt

SEQ ID NO: 445687 - DNA, 25 bp, Homo sapien
gattcagtatcttagagtttacagt

SEQ ID NO: 445688 - DNA, 25 bp, Homo sapien
tatcttagagtttacagtttgtgtt

SEQ ID NO: 445689 - DNA, 25 bp, Homo sapien
taagtgcaacatttctgtatactgt

SEQ ID NO: 445690 - DNA, 25 bp, Homo sapien
ataactgaactgtttggtcgagtct

SEQ ID NO: 445691 - DNA, 25 bp, Homo sapien
gaactgtttggtcgagtctttgtgt

SEQ ID NO: 445692 - DNA, 25 bp, Homo sapien
tgtttggtcgagtctttgtgtgtta

SEQ ID NO: 445693 - DNA, 25 bp, Homo sapien
gggctgtcttagagcttactcacta

SEQ ID NO: 445694 - DNA, 25 bp, Homo sapien
ttactcactaccacactcattcata

SEQ ID NO: 445695 - DNA, 25 bp, Homo sapien
cactcattcataataaggcctgtca

SEQ ID NO: 445696 - DNA, 25 bp, Homo sapien
ggagacttggtcatacacctgagtt

SEQ ID NO: 445697 - DNA, 25 bp, Homo sapien
gttatataaatcctcatccagtctc

SEQ ID NO: 445698 - DNA, 25 bp, Homo sapien
atccagtctccctatggttgacaag

SEQ ID NO: 445699 - DNA, 25 bp, Homo sapien
tctccctatggttgacaaggtgtct

SEQ ID NO: 445700 - DNA, 25 bp, Homo sapien
caaggtgtcttgctcataagcgtca

SEQ ID NO: 445701 - DNA, 25 bp, Homo sapien
tgctcataagcgtcagtacctggtg

SEQ ID NO: 445702 - DNA, 25 bp, Homo sapien
ctggtgtcaggtgctctcatataat

SEQ ID NO: 445703 - DNA, 25 bp, Homo sapien
tgctctcatataatcaatcactgtt

SEQ ID NO: 445704 - DNA, 25 bp, Homo sapien
aagtcattatgctttttcattgtaa

SEQ ID NO: 445705 - DNA, 25 bp, Homo sapien
tatgctttttcattgtaacctcaca

SEQ ID NO: 445706 - DNA, 25 bp, Homo sapien
aacctcacaacaaccttctaagctg

SEQ ID NO: 445707 - DNA, 25 bp, Homo sapien
ttctaagctgaaatagttgtgccat

SEQ ID NO: 445708 - DNA, 25 bp, Homo sapien
aatagttgtgccatttgataagagg

SEQ ID NO: 445709 - DNA, 25 bp, Homo sapien
gtcagttactgacaggctgcaggtc

SEQ ID NO: 445710 - DNA, 25 bp, Homo sapien
aggctgcaggtctcctgaccacggg

SEQ ID NO: 445711 - DNA, 25 bp, Homo sapien
aggtctcctgaccacgggaccatag

SEQ ID NO: 445712 - DNA, 25 bp, Homo sapien
tgaaaagtgtcttaccaagacccct

SEQ ID NO: 445713 - DNA, 25 bp, Homo sapien
cctcctggtgtttgcacagctgctg

SEQ ID NO: 445714 - DNA, 25 bp, Homo sapien
tgcacagctgctgctagagagctag

SEQ ID NO: 445715 - DNA, 25 bp, Homo sapien
ttgagcgagaaggacttcctcctgg

SEQ ID NO: 445716 - DNA, 25 bp, Homo sapien
gacttcctcctggatgggaacgagt

SEQ ID NO: 445717 - DNA, 25 bp, Homo sapien
gaacgagttgagtcatccgaatttg

SEQ ID NO: 445718 - DNA, 25 bp, Homo sapien
agaaggcccaatacaggcatccctg

SEQ ID NO: 445719 - DNA, 25 bp, Homo sapien
gtgctcctagtgtacctcggtatga

SEQ ID NO: 445720 - DNA, 25 bp, Homo sapien
tgtacctcggtatgatcaaccacct

SEQ ID NO: 445721 - DNA, 25 bp, Homo sapien
agaaatcagtcccttctggtacctg

SEQ ID NO: 445722 - DNA, 25 bp, Homo sapien
ggtacctgcaaatccatatcatact

SEQ ID NO: 445723 - DNA, 25 bp, Homo sapien
tggcttcaggtttacgcacgagccc

SEQ ID NO: 445724 - DNA, 25 bp, Homo sapien
gcacgagcccctgtgaaatatgacc

SEQ ID NO: 445725 - DNA, 25 bp, Homo sapien
acattctgaagtgggaactcttcca

SEQ ID NO: 445726 - DNA, 25 bp, Homo sapien
ccgcgtcgaccttttatgttaagag

SEQ ID NO: 445727 - DNA, 25 bp, Homo sapien
gagggatcaactccagtttccaatg

SEQ ID NO: 445728 - DNA, 25 bp, Homo sapien
aactccagtttccaatgtctatgtg

SEQ ID NO: 445729 - DNA, 25 bp, Homo sapien
ttccaatgtctatgtgtctatgtgt

SEQ ID NO: 445730 - DNA, 25 bp, Homo sapien
gtatgtgccatacatatgtattcac

SEQ ID NO: 445731 - DNA, 25 bp, Homo sapien
tatgtattcacatgaagaccggcat

SEQ ID NO: 445732 - DNA, 25 bp, Homo sapien
accggcatggccaagttctgctgga

SEQ ID NO: 445733 - DNA, 25 bp, Homo sapien
atggccaagttctgctggaggagca

SEQ ID NO: 445734 - DNA, 25 bp, Homo sapien
ttctgctggaggagcactcaagtgt

SEQ ID NO: 445735 - DNA, 25 bp, Homo sapien
actcaagtgtgacgagcagggccac

SEQ ID NO: 445736 - DNA, 25 bp, Homo sapien
gtggtgtatatagtgcagctttgga

SEQ ID NO: 445737 - DNA, 25 bp, Homo sapien
tcatgctcaagaaccgtaattttgt

SEQ ID NO: 445738 - DNA, 25 bp, Homo sapien
aaccgtaattttgttcagatattga

SEQ ID NO: 445739 - DNA, 25 bp, Homo sapien
aacattggcttaaacctttcatgat

SEQ ID NO: 445740 - DNA, 25 bp, Homo sapien
aaacctttcatgataattctttagt

SEQ ID NO: 445741 - DNA, 25 bp, Homo sapien
gtaatcccagtgactggcatagact

SEQ ID NO: 445742 - DNA, 25 bp, Homo sapien
tggccaatcaaagaaagtctcctgg

SEQ ID NO: 445743 - DNA, 25 bp, Homo sapien
gacagttctgtgaagaaagcctctt

SEQ ID NO: 445744 - DNA, 25 bp, Homo sapien
agcctctttttgctgccactcacat

SEQ ID NO: 445745 - DNA, 25 bp, Homo sapien
ccactcacatttcctgcgtttgaat

SEQ ID NO: 445746 - DNA, 25 bp, Homo sapien
atttcctgcgtttgaatgtggtagt

SEQ ID NO: 445747 - DNA, 25 bp, Homo sapien
aatgtggtagtgtgagtgtgattct

SEQ ID NO: 445748 - DNA, 25 bp, Homo sapien
tactcagcacacagctttatcctgg

SEQ ID NO: 445749 - DNA, 25 bp, Homo sapien
agcacacagctttatcctggtagat

SEQ ID NO: 445750 - DNA, 25 bp, Homo sapien
gattataaggtgagcttccagaacc

SEQ ID NO: 445751 - DNA, 25 bp, Homo sapien
ctggcaggaggctggtgtatccccc

SEQ ID NO: 445752 - DNA, 25 bp, Homo sapien
gtatctgaatgttgtgtatgtggct

SEQ ID NO: 445753 - DNA, 25 bp, Homo sapien
ctgaatgttgtgtatgtggctgata

SEQ ID NO: 445754 - DNA, 25 bp, Homo sapien
atgtggctgatatggaagacataca

SEQ ID NO: 445755 - DNA, 25 bp, Homo sapien
atacatgtatgcaatccatcagcgt

SEQ ID NO: 445756 - DNA, 25 bp, Homo sapien
tatgcaatccatcagcgtttaaaga

SEQ ID NO: 445757 - DNA, 25 bp, Homo sapien
cgtttaaagaagaagattggctcca

SEQ ID NO: 445758 - DNA, 25 bp, Homo sapien
gattacagatctattctgagtattt

SEQ ID NO: 445759 - DNA, 25 bp, Homo sapien
gccatcttccatgtaatttttctat

SEQ ID NO: 445760 - DNA, 25 bp, Homo sapien
cttccatgtaatttttctatcaggt

SEQ ID NO: 445761 - DNA, 25 bp, Homo sapien
ggtaagtacatttttgtggcagctt

SEQ ID NO: 445762 - DNA, 25 bp, Homo sapien
gtggcagctttataaatgtgtttgg

SEQ ID NO: 445763 - DNA, 25 bp, Homo sapien
ggattcaaccaaatcactatttcta

SEQ ID NO: 445764 - DNA, 25 bp, Homo sapien
cactatttctaaacaaaggattctt

SEQ ID NO: 445765 - DNA, 25 bp, Homo sapien
ttggacatcataaaattcagggttt

SEQ ID NO: 445766 - DNA, 25 bp, Homo sapien
gtttaaatgattattgtgctctcct

SEQ ID NO: 445767 - DNA, 25 bp, Homo sapien
gattattgtgctctcctaaaattac

SEQ ID NO: 445768 - DNA, 25 bp, Homo sapien
ctcctaaaattacacaagtcctatg

SEQ ID NO: 445769 - DNA, 25 bp, Homo sapien
aagtcctatgaatgttctaaaccaa

SEQ ID NO: 445770 - DNA, 25 bp, Homo sapien
cctggttttcaatcgctgctgaaca

SEQ ID NO: 445771 - DNA, 25 bp, Homo sapien
ctggttttcaatcgctgctgaacaa

SEQ ID NO: 445772 - DNA, 25 bp, Homo sapien
ggttttcaatcgctgctgaacaaac

SEQ ID NO: 445773 - DNA, 25 bp, Homo sapien
gttttcaatcgctgctgaacaaacc

SEQ ID NO: 445774 - DNA, 25 bp, Homo sapien
tttcaatcgctgctgaacaaaccta

SEQ ID NO: 445775 - DNA, 25 bp, Homo sapien
tcaatcgctgctgaacaaacctatc

SEQ ID NO: 445776 - DNA, 25 bp, Homo sapien
caatcgctgctgaacaaacctatca

SEQ ID NO: 445777 - DNA, 25 bp, Homo sapien
aatcgctgctgaacaaacctatcaa

SEQ ID NO: 445778 - DNA, 25 bp, Homo sapien
atcgctgctgaacaaacctatcaaa

SEQ ID NO: 445779 - DNA, 25 bp, Homo sapien
aaacctatcaaaaatgtagcggctg

SEQ ID NO: 445780 - DNA, 25 bp, Homo sapien
ctatcaaaaatgtagcggctggccg

SEQ ID NO: 445781 - DNA, 25 bp, Homo sapien
aaattaatgcaaggccaggcactgt

SEQ ID NO: 445782 - DNA, 25 bp, Homo sapien
atagaaaaagtcagccaggagtggc

SEQ ID NO: 445783 - DNA, 25 bp, Homo sapien
aaaaagtcagccaggagtggcgcat

SEQ ID NO: 445784 - DNA, 25 bp, Homo sapien
aaagtcagccaggagtggcgcatgc

SEQ ID NO: 445785 - DNA, 25 bp, Homo sapien
ggaggcatacgttgtcatgagctga

SEQ ID NO: 445786 - DNA, 25 bp, Homo sapien
aggcatacgttgtcatgagctgagt

SEQ ID NO: 445787 - DNA, 25 bp, Homo sapien
gcatacgttgtcatgagctgagttt

SEQ ID NO: 445788 - DNA, 25 bp, Homo sapien
atacgttgtcatgagctgagtttgt

SEQ ID NO: 445789 - DNA, 25 bp, Homo sapien
acgttgtcatgagctgagtttgtgc

SEQ ID NO: 445790 - DNA, 25 bp, Homo sapien
gttgtcatgagctgagtttgtgcca

SEQ ID NO: 445791 - DNA, 25 bp, Homo sapien
tgtcatgagctgagtttgtgccact

SEQ ID NO: 445792 - DNA, 25 bp, Homo sapien
gcagtatgtactctatttaaggatc

SEQ ID NO: 445793 - DNA, 25 bp, Homo sapien
tgtactctatttaaggatctgtggt

SEQ ID NO: 445794 - DNA, 25 bp, Homo sapien
ggatctgtggtagtataacatgagt

SEQ ID NO: 445795 - DNA, 25 bp, Homo sapien
gaagtaataactgccacatgtggga

SEQ ID NO: 445796 - DNA, 25 bp, Homo sapien
ggagaatgaattccaatctgtgatt

SEQ ID NO: 445797 - DNA, 25 bp, Homo sapien
aaagtgtaaactatagactctactg

SEQ ID NO: 445798 - DNA, 25 bp, Homo sapien
gactctactgtagtacatttcagga

SEQ ID NO: 445799 - DNA, 25 bp, Homo sapien
gtacatttcaggatctagaagtttt

SEQ ID NO: 445800 - DNA, 25 bp, Homo sapien
gatggtgtccggaagatgttgctaa

SEQ ID NO: 445801 - DNA, 25 bp, Homo sapien
agatgttgctaatgtattttacttc

SEQ ID NO: 445802 - DNA, 25 bp, Homo sapien
gtattttacttcaacatagggaaca

SEQ ID NO: 445803 - DNA, 25 bp, Homo sapien
ttttgcttgaaatgcaaaggactga

SEQ ID NO: 445804 - DNA, 25 bp, Homo sapien
tgcttgaaatgcaaaggactgaaag

SEQ ID NO: 445805 - DNA, 25 bp, Homo sapien
gcttgaaatgcaaaggactgaaaga

SEQ ID NO: 445806 - DNA, 25 bp, Homo sapien
tgaaatgcaaaggactgaaagagat

SEQ ID NO: 445807 - DNA, 25 bp, Homo sapien
gaaagagatttgtaggttgttgatt

SEQ ID NO: 445808 - DNA, 25 bp, Homo sapien
agagatttgtaggttgttgattttg

SEQ ID NO: 445809 - DNA, 25 bp, Homo sapien
gggatatatattatgaaatggtcat

SEQ ID NO: 445810 - DNA, 25 bp, Homo sapien
gaaatggtcatttttctgaagagaa

SEQ ID NO: 445811 - DNA, 25 bp, Homo sapien
aatggtcatttttctgaagagaata

SEQ ID NO: 445812 - DNA, 25 bp, Homo sapien
gaagagaatattttgcttgaaatgc

SEQ ID NO: 445813 - DNA, 25 bp, Homo sapien
gaatattttgcttgaaatgcaaagg

SEQ ID NO: 445814 - DNA, 25 bp, Homo sapien
gcttctgaagagttgtctgcttacc

SEQ ID NO: 445815 - DNA, 25 bp, Homo sapien
gtgtaactcgcagattggcaataag

SEQ ID NO: 445816 - DNA, 25 bp, Homo sapien
gattggcaataagatacccgctaca

SEQ ID NO: 445817 - DNA, 25 bp, Homo sapien
gatacccgctacaaactgtgattgg

SEQ ID NO: 445818 - DNA, 25 bp, Homo sapien
cgctacaaactgtgattggatgcaa

SEQ ID NO: 445819 - DNA, 25 bp, Homo sapien
ggatgcaaaatctcttagcttcttt

SEQ ID NO: 445820 - DNA, 25 bp, Homo sapien
gcaaaatctcttagcttctttcacg

SEQ ID NO: 445821 - DNA, 25 bp, Homo sapien
aatctcttagcttctttcacgaatg

SEQ ID NO: 445822 - DNA, 25 bp, Homo sapien
tagcttctttcacgaatgttggccc

SEQ ID NO: 445823 - DNA, 25 bp, Homo sapien
cttctttcacgaatgttggccctgc

SEQ ID NO: 445824 - DNA, 25 bp, Homo sapien
agatgttgtgaagcctcccagaatg

SEQ ID NO: 445825 - DNA, 25 bp, Homo sapien
tggcttttgaaagtctgcgagaggc

SEQ ID NO: 445826 - DNA, 25 bp, Homo sapien
ggcttttgaaagtctgcgagaggct

SEQ ID NO: 445827 - DNA, 25 bp, Homo sapien
cttttgaaagtctgcgagaggctgg

SEQ ID NO: 445828 - DNA, 25 bp, Homo sapien
ttgaaagtctgcgagaggctgggca

SEQ ID NO: 445829 - DNA, 25 bp, Homo sapien
aggtgggatcacttaagtgcagtga

SEQ ID NO: 445830 - DNA, 25 bp, Homo sapien
gtgggatcacttaagtgcagtgagc

SEQ ID NO: 445831 - DNA, 25 bp, Homo sapien
tgggatcacttaagtgcagtgagcc

SEQ ID NO: 445832 - DNA, 25 bp, Homo sapien
ggatcacttaagtgcagtgagccgt

SEQ ID NO: 445833 - DNA, 25 bp, Homo sapien
gatcacttaagtgcagtgagccgtg

SEQ ID NO: 445834 - DNA, 25 bp, Homo sapien
agagccagaccgtgtcttaaaaatg

SEQ ID NO: 445835 - DNA, 25 bp, Homo sapien
gagccagaccgtgtcttaaaaatga

SEQ ID NO: 445836 - DNA, 25 bp, Homo sapien
attttgcttgaaatgcaaaggactg

SEQ ID NO: 445837 - DNA, 25 bp, Homo sapien
ttttgcttgaaatgcaaaggactga

SEQ ID NO: 445838 - DNA, 25 bp, Homo sapien
tttgcttgaaatgcaaaggactgaa

SEQ ID NO: 445839 - DNA, 25 bp, Homo sapien
ttgcttgaaatgcaaaggactgaaa

SEQ ID NO: 445840 - DNA, 25 bp, Homo sapien
tgcttgaaatgcaaaggactgaaag

SEQ ID NO: 445841 - DNA, 25 bp, Homo sapien
gcttgaaatgcaaaggactgaaaga

SEQ ID NO: 445842 - DNA, 25 bp, Homo sapien
ttgaaatgcaaaggactgaaagaga

SEQ ID NO: 445843 - DNA, 25 bp, Homo sapien
tgaaatgcaaaggactgaaagagat

SEQ ID NO: 445844 - DNA, 25 bp, Homo sapien
gggatatatattatgaaatggtcat

SEQ ID NO: 445845 - DNA, 25 bp, Homo sapien
gaatattttgcttgaaatgcaaagg

SEQ ID NO: 445846 - DNA, 25 bp, Homo sapien
atattttgcttgaaatgcaaaggac

SEQ ID NO: 445847 - DNA, 25 bp, Homo sapien
atagaggcacgctgagaacctggag

SEQ ID NO: 445848 - DNA, 25 bp, Homo sapien
agagtgccttccctgatgctgcagc

SEQ ID NO: 445849 - DNA, 25 bp, Homo sapien
gatgaaaacaccttaccctcacaac

SEQ ID NO: 445850 - DNA, 25 bp, Homo sapien
tttcctctcctttccaaagctcttt

SEQ ID NO: 445851 - DNA, 25 bp, Homo sapien
ctttccaccttgctgcactaagata

SEQ ID NO: 445852 - DNA, 25 bp, Homo sapien
actatatgtcaattccacacacatt

SEQ ID NO: 445853 - DNA, 25 bp, Homo sapien
acacacatttattaggtacctgtga

SEQ ID NO: 445854 - DNA, 25 bp, Homo sapien
gaggtaggatcctatcctctcaaac

SEQ ID NO: 445855 - DNA, 25 bp, Homo sapien
caaacttccatttctcatgctacag

SEQ ID NO: 445856 - DNA, 25 bp, Homo sapien
aggaagatgagcaagtgcctggaat

SEQ ID NO: 445857 - DNA, 25 bp, Homo sapien
agcagtcacacaggcatagaggcac

SEQ ID NO: 445858 - DNA, 25 bp, Homo sapien
aaactcaatgtgatttctgtcagca

SEQ ID NO: 445859 - DNA, 25 bp, Homo sapien
tgtgatttctgtcagcatatcttag

SEQ ID NO: 445860 - DNA, 25 bp, Homo sapien
gcagtgtgaggttctatctgaaaat

SEQ ID NO: 445861 - DNA, 25 bp, Homo sapien
atttagctatcttctgggactattt

SEQ ID NO: 445862 - DNA, 25 bp, Homo sapien
gctatcttctgggactatttaatga

SEQ ID NO: 445863 - DNA, 25 bp, Homo sapien
aaacatttctgttatttgggtatca

SEQ ID NO: 445864 - DNA, 25 bp, Homo sapien
atcagtttgtaagtgtggtaaagcc

SEQ ID NO: 445865 - DNA, 25 bp, Homo sapien
gctttcttggttgttgttactggtc

SEQ ID NO: 445866 - DNA, 25 bp, Homo sapien
ttggttgttgttactggtctaacct

SEQ ID NO: 445867 - DNA, 25 bp, Homo sapien
tgaactagtctgctgtcctgtcaaa

SEQ ID NO: 445868 - DNA, 25 bp, Homo sapien
gtctgctgtcctgtcaaatgcatct

SEQ ID NO: 445869 - DNA, 25 bp, Homo sapien
tctgaagatcaaggcctatataatt

SEQ ID NO: 445870 - DNA, 25 bp, Homo sapien
ggcaagagacaaggtgcttcaaata

SEQ ID NO: 445871 - DNA, 25 bp, Homo sapien
gtgcttcaaatattccatcaggtag

SEQ ID NO: 445872 - DNA, 25 bp, Homo sapien
tccatcaggtagttgtgagtgcact

SEQ ID NO: 445873 - DNA, 25 bp, Homo sapien
gtgagtgcactgaatttttagtaat

SEQ ID NO: 445874 - DNA, 25 bp, Homo sapien
tttccacaactatttgctcttttcc

SEQ ID NO: 445875 - DNA, 25 bp, Homo sapien
acaactatttgctcttttccaattt

SEQ ID NO: 445876 - DNA, 25 bp, Homo sapien
gattttgtaatctatagtccatctt

SEQ ID NO: 445877 - DNA, 25 bp, Homo sapien
tagtccatcttatttttccctcagg

SEQ ID NO: 445878 - DNA, 25 bp, Homo sapien
ttccctcagggcaagcttgtgcata

SEQ ID NO: 445879 - DNA, 25 bp, Homo sapien
gcaagcttgtgcatatcatattttt

SEQ ID NO: 445880 - DNA, 25 bp, Homo sapien
aaatttcaaaacatacaggacaata

SEQ ID NO: 445881 - DNA, 25 bp, Homo sapien
taaaatgaacatttcaggctgggcg

SEQ ID NO: 445882 - DNA, 25 bp, Homo sapien
atttatgctcacctaaaacacttgt

SEQ ID NO: 445883 - DNA, 25 bp, Homo sapien
ttatgctcacctaaaacacttgtgc

SEQ ID NO: 445884 - DNA, 25 bp, Homo sapien
tcacctaaaacacttgtgcctagat

SEQ ID NO: 445885 - DNA, 25 bp, Homo sapien
taaaacacttgtgcctagatggagt

SEQ ID NO: 445886 - DNA, 25 bp, Homo sapien
aacacttgtgcctagatggagtgac

SEQ ID NO: 445887 - DNA, 25 bp, Homo sapien
acttgtgcctagatggagtgacaaa

SEQ ID NO: 445888 - DNA, 25 bp, Homo sapien
gcctagatggagtgacaaatttgtt

SEQ ID NO: 445889 - DNA, 25 bp, Homo sapien
gatggagtgacaaatttgttacata

SEQ ID NO: 445890 - DNA, 25 bp, Homo sapien
acatatagtcagtaaaaatttcaaa

SEQ ID NO: 445891 - DNA, 25 bp, Homo sapien
caagagtgaagacccttttgcatat

SEQ ID NO: 445892 - DNA, 25 bp, Homo sapien
gtgaagacccttttgcatatatttt

SEQ ID NO: 445893 - DNA, 25 bp, Homo sapien
tatatttttgtcaccttgcatgaac

SEQ ID NO: 445894 - DNA, 25 bp, Homo sapien
gtcaccttgcatgaacatatccata

SEQ ID NO: 445895 - DNA, 25 bp, Homo sapien
catatccataaggttgtacatttgt

SEQ ID NO: 445896 - DNA, 25 bp, Homo sapien
taatttcaggagatgaggtcataga

SEQ ID NO: 445897 - DNA, 25 bp, Homo sapien
taatatgagacccttttttggataa

SEQ ID NO: 445898 - DNA, 25 bp, Homo sapien
gattgtacaggagtgcataattttt

SEQ ID NO: 445899 - DNA, 25 bp, Homo sapien
agggtaatttcctttctgcctgatt

SEQ ID NO: 445900 - DNA, 25 bp, Homo sapien
tttcctttctgcctgattagccaaa

SEQ ID NO: 445901 - DNA, 25 bp, Homo sapien
ataccttgccaaaacttacaatagg

SEQ ID NO: 445902 - DNA, 25 bp, Homo sapien
gactcctgaggactacgaaaagctt

SEQ ID NO: 445903 - DNA, 25 bp, Homo sapien
tgaggactacgaaaagcttggcttt

SEQ ID NO: 445904 - DNA, 25 bp, Homo sapien
tggctttcccggtgcccgggacctg

SEQ ID NO: 445905 - DNA, 25 bp, Homo sapien
cggtgcccgggacctggccaacatg

SEQ ID NO: 445906 - DNA, 25 bp, Homo sapien
tatgccctgagacccgaccgtgaca

SEQ ID NO: 445907 - DNA, 25 bp, Homo sapien
tgagacccgaccgtgacatcgagct

SEQ ID NO: 445908 - DNA, 25 bp, Homo sapien
agacccgaccgtgacatcgagctga

SEQ ID NO: 445909 - DNA, 25 bp, Homo sapien
gaccgtgacatcgagctgaccctga

SEQ ID NO: 445910 - DNA, 25 bp, Homo sapien
cgtgacatcgagctgaccctgagac

SEQ ID NO: 445911 - DNA, 25 bp, Homo sapien
ccaaggccctgacgctggaccagtg

SEQ ID NO: 445912 - DNA, 25 bp, Homo sapien
aggccctgacgctggaccagtggct

SEQ ID NO: 445913 - DNA, 25 bp, Homo sapien
aattagctgggactttgggagacca

SEQ ID NO: 445914 - DNA, 25 bp, Homo sapien
attagctgggactttgggagaccaa

SEQ ID NO: 445915 - DNA, 25 bp, Homo sapien
caaggcgagcagatcgtttgagtcc

SEQ ID NO: 445916 - DNA, 25 bp, Homo sapien
aaggcgagcagatcgtttgagtccc

SEQ ID NO: 445917 - DNA, 25 bp, Homo sapien
aggcgagcagatcgtttgagtccca

SEQ ID NO: 445918 - DNA, 25 bp, Homo sapien
ggcgagcagatcgtttgagtcccag

SEQ ID NO: 445919 - DNA, 25 bp, Homo sapien
gcgagcagatcgtttgagtcccaga

SEQ ID NO: 445920 - DNA, 25 bp, Homo sapien
cgagcagatcgtttgagtcccagag

SEQ ID NO: 445921 - DNA, 25 bp, Homo sapien
gagcagatcgtttgagtcccagagt

SEQ ID NO: 445922 - DNA, 25 bp, Homo sapien
agcagatcgtttgagtcccagagtt

SEQ ID NO: 445923 - DNA, 25 bp, Homo sapien
agatcgtttgagtcccagagttcaa

SEQ ID NO: 445924 - DNA, 25 bp, Homo sapien
agtggattgggcgtatctataccag

SEQ ID NO: 445925 - DNA, 25 bp, Homo sapien
gtggattgggcgtatctataccagt

SEQ ID NO: 445926 - DNA, 25 bp, Homo sapien
tggattgggcgtatctataccagtg

SEQ ID NO: 445927 - DNA, 25 bp, Homo sapien
ggattgggcgtatctataccagtgg

SEQ ID NO: 445928 - DNA, 25 bp, Homo sapien
gattgggcgtatctataccagtggg

SEQ ID NO: 445929 - DNA, 25 bp, Homo sapien
attgggcgtatctataccagtggga

SEQ ID NO: 445930 - DNA, 25 bp, Homo sapien
tgggcgtatctataccagtgggagc

SEQ ID NO: 445931 - DNA, 25 bp, Homo sapien
gggcgtatctataccagtgggagca

SEQ ID NO: 445932 - DNA, 25 bp, Homo sapien
gcgtatctataccagtgggagcacc

SEQ ID NO: 445933 - DNA, 25 bp, Homo sapien
gtatctataccagtgggagcaccaa

SEQ ID NO: 445934 - DNA, 25 bp, Homo sapien
gtggctccatcagtagttactactg

SEQ ID NO: 445935 - DNA, 25 bp, Homo sapien
gtatcattaaaatatatgttctgca

SEQ ID NO: 445936 - DNA, 25 bp, Homo sapien
aaggcaactcaaagatgatggaaac

SEQ ID NO: 445937 - DNA, 25 bp, Homo sapien
agatgatggaaacgcacttacaagt

SEQ ID NO: 445938 - DNA, 25 bp, Homo sapien
gaaacgcacttacaagtggtgacca

SEQ ID NO: 445939 - DNA, 25 bp, Homo sapien
cgcacttacaagtggtgaccaaaat

SEQ ID NO: 445940 - DNA, 25 bp, Homo sapien
aatttttaggtgaagtcgagcactc

SEQ ID NO: 445941 - DNA, 25 bp, Homo sapien
ggtgaagtcgagcactctaattaga

SEQ ID NO: 445942 - DNA, 25 bp, Homo sapien
gtcgagcactctaattagagaactg

SEQ ID NO: 445943 - DNA, 25 bp, Homo sapien
gagaactggaggaaccacatataac

SEQ ID NO: 445944 - DNA, 25 bp, Homo sapien
ggaggaaccacatataacacttaac

SEQ ID NO: 445945 - DNA, 25 bp, Homo sapien
cacatataacacttaacttccccta

SEQ ID NO: 445946 - DNA, 25 bp, Homo sapien
gaagatgtgaatcatctattttgct

SEQ ID NO: 445947 - DNA, 25 bp, Homo sapien
ttgctgttgtcatactcttaggtgc

SEQ ID NO: 445948 - DNA, 25 bp, Homo sapien
tgctgttgtcatactcttaggtgcc

SEQ ID NO: 445949 - DNA, 25 bp, Homo sapien
gctgttgtcatactcttaggtgcca

SEQ ID NO: 445950 - DNA, 25 bp, Homo sapien
ctgttgtcatactcttaggtgccaa

SEQ ID NO: 445951 - DNA, 25 bp, Homo sapien
gttgtcatactcttaggtgccaaac

SEQ ID NO: 445952 - DNA, 25 bp, Homo sapien
tgtcatactcttaggtgccaaactg

SEQ ID NO: 445953 - DNA, 25 bp, Homo sapien
gtcatactcttaggtgccaaactgc

SEQ ID NO: 445954 - DNA, 25 bp, Homo sapien
tcatactcttaggtgccaaactgcg

SEQ ID NO: 445955 - DNA, 25 bp, Homo sapien
aaaaactattgctgcagtcattcag

SEQ ID NO: 445956 - DNA, 25 bp, Homo sapien
aaactattgctgcagtcattcagat

SEQ ID NO: 445957 - DNA, 25 bp, Homo sapien
ttaattactaggacaggtttgagat

SEQ ID NO: 445958 - DNA, 25 bp, Homo sapien
acaggtttgagatggtggcagttac

SEQ ID NO: 445959 - DNA, 25 bp, Homo sapien
gtggcagttacaaagagcatctggc

SEQ ID NO: 445960 - DNA, 25 bp, Homo sapien
ctggctggagatgagtttagtgttc

SEQ ID NO: 445961 - DNA, 25 bp, Homo sapien
gagtttagtgttcgcatatacccct

SEQ ID NO: 445962 - DNA, 25 bp, Homo sapien
tagtgttcgcatatacccctactca

SEQ ID NO: 445963 - DNA, 25 bp, Homo sapien
atcttcccctttcagaaaccgagag

SEQ ID NO: 445964 - DNA, 25 bp, Homo sapien
gctgatgataccaataaacttgtta

SEQ ID NO: 445965 - DNA, 25 bp, Homo sapien
taaacttgttatgctttgagatgta

SEQ ID NO: 445966 - DNA, 25 bp, Homo sapien
ttgagatgtatctctgtaactagca

SEQ ID NO: 445967 - DNA, 25 bp, Homo sapien
tgtaactagcaagtgatttccaggc

SEQ ID NO: 445968 - DNA, 25 bp, Homo sapien
ggccttctcagccacacgcagtgga

SEQ ID NO: 445969 - DNA, 25 bp, Homo sapien
gccttctcagccacacgcagtggat

SEQ ID NO: 445970 - DNA, 25 bp, Homo sapien
ttctcagccacacgcagtggatcac

SEQ ID NO: 445971 - DNA, 25 bp, Homo sapien
tcagccacacgcagtggatcacact

SEQ ID NO: 445972 - DNA, 25 bp, Homo sapien
agccacacgcagtggatcacactgt

SEQ ID NO: 445973 - DNA, 25 bp, Homo sapien
gccacacgcagtggatcacactgta

SEQ ID NO: 445974 - DNA, 25 bp, Homo sapien
cacacgcagtggatcacactgtaat

SEQ ID NO: 445975 - DNA, 25 bp, Homo sapien
tgcagtgagcctgtttgtacccctg

SEQ ID NO: 445976 - DNA, 25 bp, Homo sapien
cagtgagcctgtttgtacccctgca

SEQ ID NO: 445977 - DNA, 25 bp, Homo sapien
gtgagcctgtttgtacccctgcact

SEQ ID NO: 445978 - DNA, 25 bp, Homo sapien
tgagcctgtttgtacccctgcactc

SEQ ID NO: 445979 - DNA, 25 bp, Homo sapien
taacaaaccctgttactttgtacag

SEQ ID NO: 445980 - DNA, 25 bp, Homo sapien
aaccctgttactttgtacagatatg

SEQ ID NO: 445981 - DNA, 25 bp, Homo sapien
gttattgaccaaatgctaccaggct

SEQ ID NO: 445982 - DNA, 25 bp, Homo sapien
ttgaccaaatgctaccaggctctgc

SEQ ID NO: 445983 - DNA, 25 bp, Homo sapien
agctcgggggcttataaaatgttca

SEQ ID NO: 445984 - DNA, 25 bp, Homo sapien
atgttcatagggatgttacaatata

SEQ ID NO: 445985 - DNA, 25 bp, Homo sapien
taaccaaaatttcaacctagagtgt

SEQ ID NO: 445986 - DNA, 25 bp, Homo sapien
tttggaaaccgcagtctattagtac

SEQ ID NO: 445987 - DNA, 25 bp, Homo sapien
aaccgcagtctattagtactcaatg

SEQ ID NO: 445988 - DNA, 25 bp, Homo sapien
agtactcaatggttttatacacctt

SEQ ID NO: 445989 - DNA, 25 bp, Homo sapien
tggttttatacaccttacttctgac

SEQ ID NO: 445990 - DNA, 25 bp, Homo sapien
gtgggaagaccacctaagccccagg

SEQ ID NO: 445991 - DNA, 25 bp, Homo sapien
gaagaccacctaagccccaggaggt

SEQ ID NO: 445992 - DNA, 25 bp, Homo sapien
accatatgcctgtgacccactgagg

SEQ ID NO: 445993 - DNA, 25 bp, Homo sapien
atatgcctgtgacccactgaggctt

SEQ ID NO: 445994 - DNA, 25 bp, Homo sapien
tgtgacccactgaggcttgcatact

SEQ ID NO: 445995 - DNA, 25 bp, Homo sapien
gacccactgaggcttgcatactctg

SEQ ID NO: 445996 - DNA, 25 bp, Homo sapien
cactgaggcttgcatactctgcatt

SEQ ID NO: 445997 - DNA, 25 bp, Homo sapien
tgaggcttgcatactctgcattgca

SEQ ID NO: 445998 - DNA, 25 bp, Homo sapien
gaggcttgcatactctgcattgcaa

SEQ ID NO: 445999 - DNA, 25 bp, Homo sapien
ggcttgcatactctgcattgcaatt

SEQ ID NO: 446000 - DNA, 25 bp, Homo sapien
tgcatactctgcattgcaattatgt

SEQ ID NO: 446001 - DNA, 25 bp, Homo sapien
ctgaattgcagtaaaaccgtgtgct

SEQ ID NO: 446002 - DNA, 25 bp, Homo sapien
gaattgcagtaaaaccgtgtgcttc

SEQ ID NO: 446003 - DNA, 25 bp, Homo sapien
aattgcagtaaaaccgtgtgcttct

SEQ ID NO: 446004 - DNA, 25 bp, Homo sapien
attgcagtaaaaccgtgtgcttcta

SEQ ID NO: 446005 - DNA, 25 bp, Homo sapien
tgcagtaaaaccgtgtgcttctatg

SEQ ID NO: 446006 - DNA, 25 bp, Homo sapien
gcagtaaaaccgtgtgcttctatga

SEQ ID NO: 446007 - DNA, 25 bp, Homo sapien
cagtaaaaccgtgtgcttctatgag

SEQ ID NO: 446008 - DNA, 25 bp, Homo sapien
agtaaaaccgtgtgcttctatgagg

SEQ ID NO: 446009 - DNA, 25 bp, Homo sapien
gtaaaaccgtgtgcttctatgaggg

SEQ ID NO: 446010 - DNA, 25 bp, Homo sapien
accgtgtgcttctatgaggggataa

SEQ ID NO: 446011 - DNA, 25 bp, Homo sapien
taaagtatttacttgtggctgggca

SEQ ID NO: 446012 - DNA, 25 bp, Homo sapien
tatgcttacagctgcaggactctgg

SEQ ID NO: 446013 - DNA, 25 bp, Homo sapien
gcaggactctggcaatagggttttt

SEQ ID NO: 446014 - DNA, 25 bp, Homo sapien
ttttgtgtttgcttgtagaaactta

SEQ ID NO: 446015 - DNA, 25 bp, Homo sapien
aacttaatcagcattttgaaccagg

SEQ ID NO: 446016 - DNA, 25 bp, Homo sapien
gcattttgaaccaggttagcttttt

SEQ ID NO: 446017 - DNA, 25 bp, Homo sapien
aaaattctggtactgacacttcaca

SEQ ID NO: 446018 - DNA, 25 bp, Homo sapien
ggtactgacacttcacaggctaagt

SEQ ID NO: 446019 - DNA, 25 bp, Homo sapien
gtgtgcacaattcaagtggactgta

SEQ ID NO: 446020 - DNA, 25 bp, Homo sapien
caagtggactgtaaactgttggtat

SEQ ID NO: 446021 - DNA, 25 bp, Homo sapien
gttggtatattcagtgatgcagttc

SEQ ID NO: 446022 - DNA, 25 bp, Homo sapien
agttctgaacttgtatatggcatga

SEQ ID NO: 446023 - DNA, 25 bp, Homo sapien
tggtttatgccagatcattttccgg

SEQ ID NO: 446024 - DNA, 25 bp, Homo sapien
atcattttccggcacacacggagtg

SEQ ID NO: 446025 - DNA, 25 bp, Homo sapien
cacacggagtggctttgacagattg

SEQ ID NO: 446026 - DNA, 25 bp, Homo sapien
gtggctttgacagattgataacttt

SEQ ID NO: 446027 - DNA, 25 bp, Homo sapien
gatgggagacatctgaaatattcat

SEQ ID NO: 446028 - DNA, 25 bp, Homo sapien
ctgaaatattcatgttttccttttg

SEQ ID NO: 446029 - DNA, 25 bp, Homo sapien
agtcccatctccactatttagaaat

SEQ ID NO: 446030 - DNA, 25 bp, Homo sapien
aatgcacagggcttgagctttctgt

SEQ ID NO: 446031 - DNA, 25 bp, Homo sapien
gaagtttcattcatatttatcctct

SEQ ID NO: 446032 - DNA, 25 bp, Homo sapien
tatcctcttatgtaaaattgcggta

SEQ ID NO: 446033 - DNA, 25 bp, Homo sapien
tgcggtataaagtctcatttccaaa

SEQ ID NO: 446034 - DNA, 25 bp, Homo sapien
agtcctgtgaccatgttgccctgaa

SEQ ID NO: 446035 - DNA, 25 bp, Homo sapien
tcctgtgaccatgttgccctgaaga

SEQ ID NO: 446036 - DNA, 25 bp, Homo sapien
cctgtgaccatgttgccctgaagaa

SEQ ID NO: 446037 - DNA, 25 bp, Homo sapien
aattgaggccagagcttgctttccc

SEQ ID NO: 446038 - DNA, 25 bp, Homo sapien
ttgaggccagagcttgctttccctt

SEQ ID NO: 446039 - DNA, 25 bp, Homo sapien
gaggccagagcttgctttccctttt

SEQ ID NO: 446040 - DNA, 25 bp, Homo sapien
ggccagagcttgctttcccttttcc

SEQ ID NO: 446041 - DNA, 25 bp, Homo sapien
tggttttctgcacaagcgatgctaa

SEQ ID NO: 446042 - DNA, 25 bp, Homo sapien
gttttctgcacaagcgatgctaatg

SEQ ID NO: 446043 - DNA, 25 bp, Homo sapien
ttctgcacaagcgatgctaatgatg

SEQ ID NO: 446044 - DNA, 25 bp, Homo sapien
tgcacaagcgatgctaatgatgtgt

SEQ ID NO: 446045 - DNA, 25 bp, Homo sapien
atggtgcaatcacaggtgtttgaca

SEQ ID NO: 446046 - DNA, 25 bp, Homo sapien
gcaatcacaggtgtttgacaagatt

SEQ ID NO: 446047 - DNA, 25 bp, Homo sapien
gattgtcaacaagttaagtcacata

SEQ ID NO: 446048 - DNA, 25 bp, Homo sapien
acaagttaagtcacatagatggaaa

SEQ ID NO: 446049 - DNA, 25 bp, Homo sapien
atggaaaggcaatcgagagttggtt

SEQ ID NO: 446050 - DNA, 25 bp, Homo sapien
atagcactttatattgatcaattca

SEQ ID NO: 446051 - DNA, 25 bp, Homo sapien
gatcaattcactcattttgtggtaa

SEQ ID NO: 446052 - DNA, 25 bp, Homo sapien
aattcactcattttgtggtaattgc

SEQ ID NO: 446053 - DNA, 25 bp, Homo sapien
aagggaagccagttatatttattat

SEQ ID NO: 446054 - DNA, 25 bp, Homo sapien
ggaagccagttatatttattattaa

SEQ ID NO: 446055 - DNA, 25 bp, Homo sapien
taaatgtacaaccttgaaaagcagc

SEQ ID NO: 446056 - DNA, 25 bp, Homo sapien
gttgaatctgcaaatttggaacccg

SEQ ID NO: 446057 - DNA, 25 bp, Homo sapien
gaatctgcaaatttggaacccgagg

SEQ ID NO: 446058 - DNA, 25 bp, Homo sapien
tgcaaatttggaacccgagggtaca

SEQ ID NO: 446059 - DNA, 25 bp, Homo sapien
gaacccgagggtacagagggctgac

SEQ ID NO: 446060 - DNA, 25 bp, Homo sapien
agagggctgactgtatctgctttgt

SEQ ID NO: 446061 - DNA, 25 bp, Homo sapien
ggctgactgtatctgctttgttgga

SEQ ID NO: 446062 - DNA, 25 bp, Homo sapien
actgtatctgctttgttggagtcca

SEQ ID NO: 446063 - DNA, 25 bp, Homo sapien
gtatctgctttgttggagtccatct

SEQ ID NO: 446064 - DNA, 25 bp, Homo sapien
atctgctttgttggagtccatctga

SEQ ID NO: 446065 - DNA, 25 bp, Homo sapien
ggagtccatctgattcattgtctaa

SEQ ID NO: 446066 - DNA, 25 bp, Homo sapien
ccatctgattcattgtctaaataca

SEQ ID NO: 446067 - DNA, 25 bp, Homo sapien
atctacggccgcagagcggctggca

SEQ ID NO: 446068 - DNA, 25 bp, Homo sapien
agcggctggcagtttcttcgaggac

SEQ ID NO: 446069 - DNA, 25 bp, Homo sapien
tggcagtttcttcgaggacctcagc

SEQ ID NO: 446070 - DNA, 25 bp, Homo sapien
cagtttcttcgaggacctcagcaag

SEQ ID NO: 446071 - DNA, 25 bp, Homo sapien
ccctgcgcctatcaggtcgtgagtc

SEQ ID NO: 446072 - DNA, 25 bp, Homo sapien
agttcacgattctggcgcggacttc

SEQ ID NO: 446073 - DNA, 25 bp, Homo sapien
gggcccgcggcctacaacgtggatc

SEQ ID NO: 446074 - DNA, 25 bp, Homo sapien
acaacgtggatcagcaccggaagcc

SEQ ID NO: 446075 - DNA, 25 bp, Homo sapien
ctggagtttcgggatccggcactcg

SEQ ID NO: 446076 - DNA, 25 bp, Homo sapien
gggatccggcactcggactacctgg

SEQ ID NO: 446077 - DNA, 25 bp, Homo sapien
cgctggtgaccgacgcggacaactg

SEQ ID NO: 446078 - DNA, 25 bp, Homo sapien
ctctgcggccgtagatggagcaagt

SEQ ID NO: 446079 - DNA, 25 bp, Homo sapien
tctgcggccgtagatggagcaagtt

SEQ ID NO: 446080 - DNA, 25 bp, Homo sapien
ctgcggccgtagatggagcaagttg

SEQ ID NO: 446081 - DNA, 25 bp, Homo sapien
gcggccgtagatggagcaagttggg

SEQ ID NO: 446082 - DNA, 25 bp, Homo sapien
cgatgacgcgcggacccaagagcga

SEQ ID NO: 446083 - DNA, 25 bp, Homo sapien
gatgacgcgcggacccaagagcgag

SEQ ID NO: 446084 - DNA, 25 bp, Homo sapien
atgacgcgcggacccaagagcgagg

SEQ ID NO: 446085 - DNA, 25 bp, Homo sapien
gacgcgcggacccaagagcgagggc

SEQ ID NO: 446086 - DNA, 25 bp, Homo sapien
acgcgcggacccaagagcgagggca

SEQ ID NO: 446087 - DNA, 25 bp, Homo sapien
gcggacccaagagcgagggcaccgt

SEQ ID NO: 446088 - DNA, 25 bp, Homo sapien
cggacccaagagcgagggcaccgta

SEQ ID NO: 446089 - DNA, 25 bp, Homo sapien
tacattcttcatgtggatgtggcca

SEQ ID NO: 446090 - DNA, 25 bp, Homo sapien
cttcatgtggatgtggccagtgtca

SEQ ID NO: 446091 - DNA, 25 bp, Homo sapien
tagatttcaaaggagcagttgggta

SEQ ID NO: 446092 - DNA, 25 bp, Homo sapien
gcagttgggtaataatgaactttac

SEQ ID NO: 446093 - DNA, 25 bp, Homo sapien
gaactttaccatatttgcaaaccta

SEQ ID NO: 446094 - DNA, 25 bp, Homo sapien
ttgcaaacctatctggtatctctcc

SEQ ID NO: 446095 - DNA, 25 bp, Homo sapien
ctatctggtatctctcctccctttt

SEQ ID NO: 446096 - DNA, 25 bp, Homo sapien
cttttcctttgaccacctattctgt

SEQ ID NO: 446097 - DNA, 25 bp, Homo sapien
cacctattctgtctagggttaagaa

SEQ ID NO: 446098 - DNA, 25 bp, Homo sapien
gaaaataacaaagccaattctggtt

SEQ ID NO: 446099 - DNA, 25 bp, Homo sapien
gcagtggcgcgattgcagtgaacca

SEQ ID NO: 446100 - DNA, 25 bp, Homo sapien
cctcctcaggatgctgggaggctca

SEQ ID NO: 446101 - DNA, 25 bp, Homo sapien
gatgctgggaggctcagtgtcaagg

SEQ ID NO: 446102 - DNA, 25 bp, Homo sapien
cagagcctgtacaaaaggagggcag

SEQ ID NO: 446103 - DNA, 25 bp, Homo sapien
cctgtacaaaaggagggcagagcct

SEQ ID NO: 446104 - DNA, 25 bp, Homo sapien
aaggaggccagcaccactcggcggt

SEQ ID NO: 446105 - DNA, 25 bp, Homo sapien
cactcggcggttcttctggatcaaa

SEQ ID NO: 446106 - DNA, 25 bp, Homo sapien
cttctggatcaaagggtgttgggtc

SEQ ID NO: 446107 - DNA, 25 bp, Homo sapien
gatcaaagggtgttgggtccagctg

SEQ ID NO: 446108 - DNA, 25 bp, Homo sapien
ctgcagcaggtgttgtaggagcgct

SEQ ID NO: 446109 - DNA, 25 bp, Homo sapien
tgtaggagcgctgggtgctgctgct

SEQ ID NO: 446110 - DNA, 25 bp, Homo sapien
accactgggagctgcggatggaagt

SEQ ID NO: 446111 - DNA, 25 bp, Homo sapien
tcgtcgactccacagggacctttca

SEQ ID NO: 446112 - DNA, 25 bp, Homo sapien
gggacctttcagacaaaaatgcaag

SEQ ID NO: 446113 - DNA, 25 bp, Homo sapien
gggcctgcacaggttaaccgtcaga

SEQ ID NO: 446114 - DNA, 25 bp, Homo sapien
ttgacatggagagaaccttgactgt

SEQ ID NO: 446115 - DNA, 25 bp, Homo sapien
gagagaaccttgactgtgttttatt

SEQ ID NO: 446116 - DNA, 25 bp, Homo sapien
gtgttttattatttcatggcttgta

SEQ ID NO: 446117 - DNA, 25 bp, Homo sapien
tttcatggcttgtatgagtgtgact

SEQ ID NO: 446118 - DNA, 25 bp, Homo sapien
agtgtgactgggtgtgtttctttag

SEQ ID NO: 446119 - DNA, 25 bp, Homo sapien
tgggtgtgtttctttagggttctga

SEQ ID NO: 446120 - DNA, 25 bp, Homo sapien
tttctttagggttctgattgccagt

SEQ ID NO: 446121 - DNA, 25 bp, Homo sapien
attttcatcaataagtcttgcaaag

SEQ ID NO: 446122 - DNA, 25 bp, Homo sapien
gtgattacaaggtgctgaatgtgtt

SEQ ID NO: 446123 - DNA, 25 bp, Homo sapien
gtgctgaatgtgttggtaaccatat

SEQ ID NO: 446124 - DNA, 25 bp, Homo sapien
gtgttggtaaccatatcgcaataca

SEQ ID NO: 446125 - DNA, 25 bp, Homo sapien
ttggtaaccatatcgcaatacacct

SEQ ID NO: 446126 - DNA, 25 bp, Homo sapien
aaccatatcgcaatacacctcaagg

SEQ ID NO: 446127 - DNA, 25 bp, Homo sapien
catatcgcaatacacctcaaggaaa

SEQ ID NO: 446128 - DNA, 25 bp, Homo sapien
aatacacctcaaggaaaaggttcag

SEQ ID NO: 446129 - DNA, 25 bp, Homo sapien
tttcttgaattttatatccgtttgt

SEQ ID NO: 446130 - DNA, 25 bp, Homo sapien
attttatatccgtttgttcactcgt

SEQ ID NO: 446131 - DNA, 25 bp, Homo sapien
atatccgtttgttcactcgtacatg

SEQ ID NO: 446132 - DNA, 25 bp, Homo sapien
atccgtttgttcactcgtacatgcc

SEQ ID NO: 446133 - DNA, 25 bp, Homo sapien
aacaacagggagtccttccaggtca

SEQ ID NO: 446134 - DNA, 25 bp, Homo sapien
agtccttccaggtcactgtatattg

SEQ ID NO: 446135 - DNA, 25 bp, Homo sapien
aactattgtctgttacattccgagg

SEQ ID NO: 446136 - DNA, 25 bp, Homo sapien
gttacattccgaggtcagccttctt

SEQ ID NO: 446137 - DNA, 25 bp, Homo sapien
gtcagccttcttcttaacgttttat

SEQ ID NO: 446138 - DNA, 25 bp, Homo sapien
taatatgcaaatgccagcttctgga

SEQ ID NO: 446139 - DNA, 25 bp, Homo sapien
tgccagcttctggaaagcaagtatc

SEQ ID NO: 446140 - DNA, 25 bp, Homo sapien
gtatcatcatgtaccaaatgcttta

SEQ ID NO: 446141 - DNA, 25 bp, Homo sapien
aatgctttatacaccatcacattca

SEQ ID NO: 446142 - DNA, 25 bp, Homo sapien
tttttagcatggtcagaacttgtgt

SEQ ID NO: 446143 - DNA, 25 bp, Homo sapien
gaacttgtgtaaatatgtctcttag

SEQ ID NO: 446144 - DNA, 25 bp, Homo sapien
atgtcggtgatcaggcctggcattt

SEQ ID NO: 446145 - DNA, 25 bp, Homo sapien
gtgatcaggcctggcatttcgggca

SEQ ID NO: 446146 - DNA, 25 bp, Homo sapien
caggcctggcatttcgggcagcagc

SEQ ID NO: 446147 - DNA, 25 bp, Homo sapien
agcagccagcccttcactttcttgg

SEQ ID NO: 446148 - DNA, 25 bp, Homo sapien
atgtacctccctcgttcttgtagaa

SEQ ID NO: 446149 - DNA, 25 bp, Homo sapien
ccctcgttcttgtagaagcgctgga

SEQ ID NO: 446150 - DNA, 25 bp, Homo sapien
cgttcttgtagaagcgctggatggt

SEQ ID NO: 446151 - DNA, 25 bp, Homo sapien
gtggagctgagtgcgcagcccacaa

SEQ ID NO: 446152 - DNA, 25 bp, Homo sapien
gagtgcgcagcccacaaagccttgg

SEQ ID NO: 446153 - DNA, 25 bp, Homo sapien
aaagccttgggcagcgtctgggttg

SEQ ID NO: 446154 - DNA, 25 bp, Homo sapien
gcagcgtctgggttgtgcaggaagc

SEQ ID NO: 446155 - DNA, 25 bp, Homo sapien
gagaaggtcacagaaatcctctagt

SEQ ID NO: 446156 - DNA, 25 bp, Homo sapien
agaaatcctctagttggtgcctcca

SEQ ID NO: 446157 - DNA, 25 bp, Homo sapien
tggtgcctccacagtcttcatttta

SEQ ID NO: 446158 - DNA, 25 bp, Homo sapien
cattttacagaggaactcagggcta

SEQ ID NO: 446159 - DNA, 25 bp, Homo sapien
tcagggctaatggagttaatgcaac

SEQ ID NO: 446160 - DNA, 25 bp, Homo sapien
gttaatgcaactagatcagggtttt

SEQ ID NO: 446161 - DNA, 25 bp, Homo sapien
tcagggttttgggtctgtgttcttt

SEQ ID NO: 446162 - DNA, 25 bp, Homo sapien
gtctgtgttctttctaccgtcagca

SEQ ID NO: 446163 - DNA, 25 bp, Homo sapien
gtgtggtcaattctggacacttccc

SEQ ID NO: 446164 - DNA, 25 bp, Homo sapien
gagaatcctactcaaatttcactgt

SEQ ID NO: 446165 - DNA, 25 bp, Homo sapien
tattttaagcattcctctcctttcc

SEQ ID NO: 446166 - DNA, 25 bp, Homo sapien
accccttaaatttctgtatagcaga

SEQ ID NO: 446167 - DNA, 25 bp, Homo sapien
agcagacttaagagtgaatatcacc

SEQ ID NO: 446168 - DNA, 25 bp, Homo sapien
gagtgaatatcaccatatgcagttg

SEQ ID NO: 446169 - DNA, 25 bp, Homo sapien
atatcaccatatgcagttgttcatg

SEQ ID NO: 446170 - DNA, 25 bp, Homo sapien
gctcttgacaaaattctcagggaaa

SEQ ID NO: 446171 - DNA, 25 bp, Homo sapien
ttctcagggaaaactcttcagctct

SEQ ID NO: 446172 - DNA, 25 bp, Homo sapien
ttcagctctggatgtctcccttttt

SEQ ID NO: 446173 - DNA, 25 bp, Homo sapien
gtggatcaaacacaaagggcatcat

SEQ ID NO: 446174 - DNA, 25 bp, Homo sapien
atcaaacacaaagggcatcattcta

SEQ ID NO: 446175 - DNA, 25 bp, Homo sapien
atacagaaccataaaagccccaaat

SEQ ID NO: 446176 - DNA, 25 bp, Homo sapien
taaaagccccaaatagccaaagcaa

SEQ ID NO: 446177 - DNA, 25 bp, Homo sapien
ttaagtctttgagaggggcctgaag

SEQ ID NO: 446178 - DNA, 25 bp, Homo sapien
gagcctccgggctcctgggacattg

SEQ ID NO: 446179 - DNA, 25 bp, Homo sapien
agcctccgggctcctgggacattga

SEQ ID NO: 446180 - DNA, 25 bp, Homo sapien
gcctccgggctcctgggacattgat

SEQ ID NO: 446181 - DNA, 25 bp, Homo sapien
ctccgggctcctgggacattgatgt

SEQ ID NO: 446182 - DNA, 25 bp, Homo sapien
ccgggctcctgggacattgatgtag

SEQ ID NO: 446183 - DNA, 25 bp, Homo sapien
cgggctcctgggacattgatgtaga

SEQ ID NO: 446184 - DNA, 25 bp, Homo sapien
ggctcctgggacattgatgtagagt

SEQ ID NO: 446185 - DNA, 25 bp, Homo sapien
gctcctgggacattgatgtagagtt

SEQ ID NO: 446186 - DNA, 25 bp, Homo sapien
tcctgggacattgatgtagagtttt

SEQ ID NO: 446187 - DNA, 25 bp, Homo sapien
acattgatgtagagtttttagtgaa

SEQ ID NO: 446188 - DNA, 25 bp, Homo sapien
actgagtccatcgtggaaagggctg

SEQ ID NO: 446189 - DNA, 25 bp, Homo sapien
actgcctgcggaaggtaggattaga

SEQ ID NO: 446190 - DNA, 25 bp, Homo sapien
ggtaggattagatcattagctcagt

SEQ ID NO: 446191 - DNA, 25 bp, Homo sapien
gctcagtgacctcctagggtttcga

SEQ ID NO: 446192 - DNA, 25 bp, Homo sapien
agggtttcgatgtgctatgttctca

SEQ ID NO: 446193 - DNA, 25 bp, Homo sapien
atgttctcatcctacagttggtttg

SEQ ID NO: 446194 - DNA, 25 bp, Homo sapien
tggtaatgatctgcaagtcccggag

SEQ ID NO: 446195 - DNA, 25 bp, Homo sapien
gcaagtcccggagagcaacagcaca

SEQ ID NO: 446196 - DNA, 25 bp, Homo sapien
tctgcctgacgctctcattaaaatc

SEQ ID NO: 446197 - DNA, 25 bp, Homo sapien
ttaaaatctatgcagccaagctcgg

SEQ ID NO: 446198 - DNA, 25 bp, Homo sapien
tgcagccaagctcggcactttgtag

SEQ ID NO: 446199 - DNA, 25 bp, Homo sapien
atattttgttcactttgctatcaag

SEQ ID NO: 446200 - DNA, 25 bp, Homo sapien
gttcactttgctatcaagatgttca

SEQ ID NO: 446201 - DNA, 25 bp, Homo sapien
gctatcaagatgttcactatcagat

SEQ ID NO: 446202 - DNA, 25 bp, Homo sapien
caagatgttcactatcagatattta

SEQ ID NO: 446203 - DNA, 25 bp, Homo sapien
cagatatttattatatggcagcaat

SEQ ID NO: 446204 - DNA, 25 bp, Homo sapien
taatcattgcccattaatagacgca

SEQ ID NO: 446205 - DNA, 25 bp, Homo sapien
tgcccattaatagacgcagtaaaat

SEQ ID NO: 446206 - DNA, 25 bp, Homo sapien
taaaattgtcttttgtactgtaagt

SEQ ID NO: 446207 - DNA, 25 bp, Homo sapien
gtcttttgtactgtaagttactgtt

SEQ ID NO: 446208 - DNA, 25 bp, Homo sapien
ctccctgtgcctttataatataaag

SEQ ID NO: 446209 - DNA, 25 bp, Homo sapien
gtttctacaacttttaatgatctta

SEQ ID NO: 446210 - DNA, 25 bp, Homo sapien
gtgagctcgggaacataacgatgtt

SEQ ID NO: 446211 - DNA, 25 bp, Homo sapien
aacgatgttttgacttacaataggc

SEQ ID NO: 446212 - DNA, 25 bp, Homo sapien
aataggcatgaaatcgcaactagaa

SEQ ID NO: 446213 - DNA, 25 bp, Homo sapien
gtcatagttatctattgcatgaact

SEQ ID NO: 446214 - DNA, 25 bp, Homo sapien
gcatgaactggagtaattccacctg

SEQ ID NO: 446215 - DNA, 25 bp, Homo sapien
aaaggattgttatttcacacatgaa

SEQ ID NO: 446216 - DNA, 25 bp, Homo sapien
tgaaaaattcatccagttttactaa

SEQ ID NO: 446217 - DNA, 25 bp, Homo sapien
ttgaaagtactgacaactatttgta

SEQ ID NO: 446218 - DNA, 25 bp, Homo sapien
ctatttgtaactaatcttccttaag

SEQ ID NO: 446219 - DNA, 25 bp, Homo sapien
atcttccttaagaactgtatttgag

SEQ ID NO: 446220 - DNA, 25 bp, Homo sapien
gagggtatcaaatcaagcttgtaat

SEQ ID NO: 446221 - DNA, 25 bp, Homo sapien
atctgccgtggaattaactaataag

SEQ ID NO: 446222 - DNA, 25 bp, Homo sapien
ttttacatgatcctcaatatcaact

SEQ ID NO: 446223 - DNA, 25 bp, Homo sapien
ttaaaacatttgaaaccaagtactg

SEQ ID NO: 446224 - DNA, 25 bp, Homo sapien
gtttaatttcaatcagaagatgcaa

SEQ ID NO: 446225 - DNA, 25 bp, Homo sapien
catactttgatctatgtttgatttt

SEQ ID NO: 446226 - DNA, 25 bp, Homo sapien
atttgaaggagattgcctaccaagg

SEQ ID NO: 446227 - DNA, 25 bp, Homo sapien
gcctaccaaggacaaaacaataaat

SEQ ID NO: 446228 - DNA, 25 bp, Homo sapien
aatcaaacgatttctccatacgctc

SEQ ID NO: 446229 - DNA, 25 bp, Homo sapien
aaacgatttctccatacgctcatag

SEQ ID NO: 446230 - DNA, 25 bp, Homo sapien
tctccatacgctcatagtcacatat

SEQ ID NO: 446231 - DNA, 25 bp, Homo sapien
tacgctcatagtcacatatggaatt

SEQ ID NO: 446232 - DNA, 25 bp, Homo sapien
taaggacatattcctgtgggttctt

SEQ ID NO: 446233 - DNA, 25 bp, Homo sapien
gtgtttgccacatcaagattttagg

SEQ ID NO: 446234 - DNA, 25 bp, Homo sapien
tgtagtagggatgccgtttgaaaac

SEQ ID NO: 446235 - DNA, 25 bp, Homo sapien
tgaaaacaggcactcttcccctgag

SEQ ID NO: 446236 - DNA, 25 bp, Homo sapien
ggcactcttcccctgaggatgggaa

SEQ ID NO: 446237 - DNA, 25 bp, Homo sapien
gagctcttcagttggagatctaggc

SEQ ID NO: 446238 - DNA, 25 bp, Homo sapien
ggcagtgggttaagccagaccccta

SEQ ID NO: 446239 - DNA, 25 bp, Homo sapien
gaccctcagaaagacatccaatttt

SEQ ID NO: 446240 - DNA, 25 bp, Homo sapien
ttttaaatccctgtagctccaagcc

SEQ ID NO: 446241 - DNA, 25 bp, Homo sapien
gctccaagcctggtctcatttgctt

SEQ ID NO: 446242 - DNA, 25 bp, Homo sapien
tggtctcatttgcttccctgccagg

SEQ ID NO: 446243 - DNA, 25 bp, Homo sapien
aataaaaaatacataggctgggcgc

SEQ ID NO: 446244 - DNA, 25 bp, Homo sapien
ggccgaggtgatcagatcacttggg

SEQ ID NO: 446245 - DNA, 25 bp, Homo sapien
agatcacttggggtccgtcgggagt

SEQ ID NO: 446246 - DNA, 25 bp, Homo sapien
gatcacttggggtccgtcgggagtt

SEQ ID NO: 446247 - DNA, 25 bp, Homo sapien
ctggcaaacatagtaaaacaccata

SEQ ID NO: 446248 - DNA, 25 bp, Homo sapien
tggcaaacatagtaaaacaccatat

SEQ ID NO: 446249 - DNA, 25 bp, Homo sapien
ggcaaacatagtaaaacaccatatc

SEQ ID NO: 446250 - DNA, 25 bp, Homo sapien
gcaaacatagtaaaacaccatatct

SEQ ID NO: 446251 - DNA, 25 bp, Homo sapien
caaacatagtaaaacaccatatcta

SEQ ID NO: 446252 - DNA, 25 bp, Homo sapien
aaacatagtaaaacaccatatctac

SEQ ID NO: 446253 - DNA, 25 bp, Homo sapien
acatagtaaaacaccatatctacta

SEQ ID NO: 446254 - DNA, 25 bp, Homo sapien
atacagttccgatctgctgcatata

SEQ ID NO: 446255 - DNA, 25 bp, Homo sapien
tgctgcatataactgcaccactgct

SEQ ID NO: 446256 - DNA, 25 bp, Homo sapien
gcaccactgctgaagacatagtcac

SEQ ID NO: 446257 - DNA, 25 bp, Homo sapien
atagtcacacatttcttgccgagga

SEQ ID NO: 446258 - DNA, 25 bp, Homo sapien
agtgaagagggactcgttctcctgc

SEQ ID NO: 446259 - DNA, 25 bp, Homo sapien
gagcaacagagaccccacgttggtg

SEQ ID NO: 446260 - DNA, 25 bp, Homo sapien
gctggacggagctcatggtttcgcc

SEQ ID NO: 446261 - DNA, 25 bp, Homo sapien
gtggattgtccttaacaagacaagc

SEQ ID NO: 446262 - DNA, 25 bp, Homo sapien
caagacaagcaacaccactgcactt

SEQ ID NO: 446263 - DNA, 25 bp, Homo sapien
actgcacttctttgaccacatacag

SEQ ID NO: 446264 - DNA, 25 bp, Homo sapien
tctttgaccacatacagttccgatc

SEQ ID NO: 446265 - DNA, 25 bp, Homo sapien
tacctggagctggaagctccttgct

SEQ ID NO: 446266 - DNA, 25 bp, Homo sapien
tggaagctccttgctcattggtgac

SEQ ID NO: 446267 - DNA, 25 bp, Homo sapien
gctcattggtgacctttttcatatg

SEQ ID NO: 446268 - DNA, 25 bp, Homo sapien
tcttggcattcctagcatactacct

SEQ ID NO: 446269 - DNA, 25 bp, Homo sapien
ggcattcctagcatactaccttgaa

SEQ ID NO: 446270 - DNA, 25 bp, Homo sapien
ctaccttgaaaggactgtgtcttgc

SEQ ID NO: 446271 - DNA, 25 bp, Homo sapien
tgtgtcttgcctcctagaaattctg

SEQ ID NO: 446272 - DNA, 25 bp, Homo sapien
cctagaaattctggacttggtagaa

SEQ ID NO: 446273 - DNA, 25 bp, Homo sapien
ctggacttggtagaatcatttgttt

SEQ ID NO: 446274 - DNA, 25 bp, Homo sapien
tggacttttctgtgtgttgtttctt

SEQ ID NO: 446275 - DNA, 25 bp, Homo sapien
tgtctggagattgattttcaacccc

SEQ ID NO: 446276 - DNA, 25 bp, Homo sapien
tgcatggcacggctcaagacagtcc

SEQ ID NO: 446277 - DNA, 25 bp, Homo sapien
aagacagtcctgaaatacgtgctgt

SEQ ID NO: 446278 - DNA, 25 bp, Homo sapien
ctgaaatacgtgctgtttcttctgg

SEQ ID NO: 446279 - DNA, 25 bp, Homo sapien
gtttcttctgggtacactggtcatc

SEQ ID NO: 446280 - DNA, 25 bp, Homo sapien
tgggtacactggtcatcgccatgtc

SEQ ID NO: 446281 - DNA, 25 bp, Homo sapien
tcatcgccatgtccttgcagctgga

SEQ ID NO: 446282 - DNA, 25 bp, Homo sapien
tttgccttcgtgatcatggcctcca

SEQ ID NO: 446283 - DNA, 25 bp, Homo sapien
gatcatggcctccatgtgggcttac

SEQ ID NO: 446284 - DNA, 25 bp, Homo sapien
ccatgtgggcttaccgctgcgggca

SEQ ID NO: 446285 - DNA, 25 bp, Homo sapien
atctacacctccatgatgactagcg

SEQ ID NO: 446286 - DNA, 25 bp, Homo sapien
gatgactagcgacaactactactac

SEQ ID NO: 446287 - DNA, 25 bp, Homo sapien
gggctaaaagtgacacaccaataag

SEQ ID NO: 446288 - DNA, 25 bp, Homo sapien
ggctaaaagtgacacaccaataaga

SEQ ID NO: 446289 - DNA, 25 bp, Homo sapien
gctaaaagtgacacaccaataagat

SEQ ID NO: 446290 - DNA, 25 bp, Homo sapien
taaaagtgacacaccaataagattg

SEQ ID NO: 446291 - DNA, 25 bp, Homo sapien
aaaagtgacacaccaataagattgc

SEQ ID NO: 446292 - DNA, 25 bp, Homo sapien
aaagtgacacaccaataagattgca

SEQ ID NO: 446293 - DNA, 25 bp, Homo sapien
aagtgacacaccaataagattgcat

SEQ ID NO: 446294 - DNA, 25 bp, Homo sapien
agtgacacaccaataagattgcatc

SEQ ID NO: 446295 - DNA, 25 bp, Homo sapien
gacacaccaataagattgcatcctg

SEQ ID NO: 446296 - DNA, 25 bp, Homo sapien
acaccaataagattgcatcctggct

SEQ ID NO: 446297 - DNA, 25 bp, Homo sapien
ccaataagattgcatcctggctggg

SEQ ID NO: 446298 - DNA, 25 bp, Homo sapien
tttgagaagtgcatggagtttccta

SEQ ID NO: 446299 - DNA, 25 bp, Homo sapien
ttgagaagtgcatggagtttcctaa

SEQ ID NO: 446300 - DNA, 25 bp, Homo sapien
tgagaagtgcatggagtttcctaaa

SEQ ID NO: 446301 - DNA, 25 bp, Homo sapien
gagaagtgcatggagtttcctaaac

SEQ ID NO: 446302 - DNA, 25 bp, Homo sapien
ggagtttcctaaactttgcacagaa

SEQ ID NO: 446303 - DNA, 25 bp, Homo sapien
gagtttcctaaactttgcacagaag

SEQ ID NO: 446304 - DNA, 25 bp, Homo sapien
actttgcacagaagaatatcctggg

SEQ ID NO: 446305 - DNA, 25 bp, Homo sapien
tttgcacagaagaatatcctggggc

SEQ ID NO: 446306 - DNA, 25 bp, Homo sapien
ttgcacagaagaatatcctggggcc

SEQ ID NO: 446307 - DNA, 25 bp, Homo sapien
tgcacagaagaatatcctggggccg

SEQ ID NO: 446308 - DNA, 25 bp, Homo sapien
gcacagaagaatatcctggggccgg

SEQ ID NO: 446309 - DNA, 25 bp, Homo sapien
gcgtgcaagtggatacttcacccgc

SEQ ID NO: 446310 - DNA, 25 bp, Homo sapien
ttacattgtgcagtttggctctact

SEQ ID NO: 446311 - DNA, 25 bp, Homo sapien
gtggccactttcagaacacagagtt

SEQ ID NO: 446312 - DNA, 25 bp, Homo sapien
gtttcatgaactgattactgttgta

SEQ ID NO: 446313 - DNA, 25 bp, Homo sapien
ctgaaagtaccagcatagactgtat

SEQ ID NO: 446314 - DNA, 25 bp, Homo sapien
gtaccagcatagactgtatgatttc

SEQ ID NO: 446315 - DNA, 25 bp, Homo sapien
gcatagactgtatgatttctgctat

SEQ ID NO: 446316 - DNA, 25 bp, Homo sapien
agactgtatgatttctgctattttg

SEQ ID NO: 446317 - DNA, 25 bp, Homo sapien
tttctgctattttgcatcccaatat

SEQ ID NO: 446318 - DNA, 25 bp, Homo sapien
tgctattttgcatcccaatatagga

SEQ ID NO: 446319 - DNA, 25 bp, Homo sapien
ttttgcatcccaatataggagtaga

SEQ ID NO: 446320 - DNA, 25 bp, Homo sapien
ctcccaccatgagtgctgagcttaa

SEQ ID NO: 446321 - DNA, 25 bp, Homo sapien
tgctgagcttaacgtgcctatcgac

SEQ ID NO: 446322 - DNA, 25 bp, Homo sapien
ctgagcccggccataagggcatgga

SEQ ID NO: 446323 - DNA, 25 bp, Homo sapien
cataagggcatggattaccgggact

SEQ ID NO: 446324 - DNA, 25 bp, Homo sapien
attaccgggactgggtccgccgcag

SEQ ID NO: 446325 - DNA, 25 bp, Homo sapien
gccgcagctacctggaactggtcac

SEQ ID NO: 446326 - DNA, 25 bp, Homo sapien
tggaactggtcacctctaaccacca

SEQ ID NO: 446327 - DNA, 25 bp, Homo sapien
accactcggtacaggccctgtcgtg

SEQ ID NO: 446328 - DNA, 25 bp, Homo sapien
tgtcgtggcggaagctctacctgag

SEQ ID NO: 446329 - DNA, 25 bp, Homo sapien
gaagctctacctgagcagggccaag

SEQ ID NO: 446330 - DNA, 25 bp, Homo sapien
tggagacgcagtaccagtacccgcg

SEQ ID NO: 446331 - DNA, 25 bp, Homo sapien
acaacctacaaatctctttcagtcc

SEQ ID NO: 446332 - DNA, 25 bp, Homo sapien
caacctacaaatctctttcagtcct

SEQ ID NO: 446333 - DNA, 25 bp, Homo sapien
acctacaaatctctttcagtccttt

SEQ ID NO: 446334 - DNA, 25 bp, Homo sapien
caaatctctttcagtcctttgcatt

SEQ ID NO: 446335 - DNA, 25 bp, Homo sapien
atctctttcagtcctttgcatttca

SEQ ID NO: 446336 - DNA, 25 bp, Homo sapien
ctctttcagtcctttgcatttcaag

SEQ ID NO: 446337 - DNA, 25 bp, Homo sapien
gcatttcaagcaaaatattctcttc

SEQ ID NO: 446338 - DNA, 25 bp, Homo sapien
atttcaagcaaaatattctcttcag

SEQ ID NO: 446339 - DNA, 25 bp, Homo sapien
ttcaagcaaaatattctcttcagaa

SEQ ID NO: 446340 - DNA, 25 bp, Homo sapien
tcttcagaaaaatgaccatttcata

SEQ ID NO: 446341 - DNA, 25 bp, Homo sapien
tcataatatatatccccttctgtcg

SEQ ID NO: 446342 - DNA, 25 bp, Homo sapien
tagacacacagaccccatgcgacga

SEQ ID NO: 446343 - DNA, 25 bp, Homo sapien
agggtctacctaatcagctacctgt

SEQ ID NO: 446344 - DNA, 25 bp, Homo sapien
ggaacaagtgccaccatctcaacaa

SEQ ID NO: 446345 - DNA, 25 bp, Homo sapien
gagcaaggtcattctgtccattcat

SEQ ID NO: 446346 - DNA, 25 bp, Homo sapien
gtccattcatcttctatggtcatga

SEQ ID NO: 446347 - DNA, 25 bp, Homo sapien
atgaggactctgaaccatccactag

SEQ ID NO: 446348 - DNA, 25 bp, Homo sapien
gaattttcagaagctcctttgtcaa

SEQ ID NO: 446349 - DNA, 25 bp, Homo sapien
tgtaccgtctgaaacaacgtctgat

SEQ ID NO: 446350 - DNA, 25 bp, Homo sapien
taatttacagataaccacccagcct

SEQ ID NO: 446351 - DNA, 25 bp, Homo sapien
ccagccttctgatggtctagaggaa

SEQ ID NO: 446352 - DNA, 25 bp, Homo sapien
aacttgattctgatgacccttctgt

SEQ ID NO: 446353 - DNA, 25 bp, Homo sapien
tgaaaaagcctacctctgcacattg

SEQ ID NO: 446354 - DNA, 25 bp, Homo sapien
agcctacctctgcacattgtttaaa

SEQ ID NO: 446355 - DNA, 25 bp, Homo sapien
tcctacttctgtgttctgatattca

SEQ ID NO: 446356 - DNA, 25 bp, Homo sapien
gagtaaggtgagactcttcctgtgg

SEQ ID NO: 446357 - DNA, 25 bp, Homo sapien
gactcttcctgtggattcagattga

SEQ ID NO: 446358 - DNA, 25 bp, Homo sapien
gggaggccatggtcaacttttgagc

SEQ ID NO: 446359 - DNA, 25 bp, Homo sapien
ttttgagctacccttgagggaagaa

SEQ ID NO: 446360 - DNA, 25 bp, Homo sapien
tgatcaaatattaactgcccaagta

SEQ ID NO: 446361 - DNA, 25 bp, Homo sapien
aagtatattcacaggatggccatcc

SEQ ID NO: 446362 - DNA, 25 bp, Homo sapien
gatggccatccagtaatgagaatga

SEQ ID NO: 446363 - DNA, 25 bp, Homo sapien
gaacagtctccaactaaaggcaaca

SEQ ID NO: 446364 - DNA, 25 bp, Homo sapien
agtcactcagctggatcccaaggaa

SEQ ID NO: 446365 - DNA, 25 bp, Homo sapien
gtcactgcaaggaatcaacacccga

SEQ ID NO: 446366 - DNA, 25 bp, Homo sapien
gaatcaacacccgaaaagccttcag

SEQ ID NO: 446367 - DNA, 25 bp, Homo sapien
cagaagttccaccattcaagaccag

SEQ ID NO: 446368 - DNA, 25 bp, Homo sapien
caagaccagaagctttttgacagaa

SEQ ID NO: 446369 - DNA, 25 bp, Homo sapien
tttgacagaaactctctcccagtgc

SEQ ID NO: 446370 - DNA, 25 bp, Homo sapien
tctcccagtgcctgtcttagaaaca

SEQ ID NO: 446371 - DNA, 25 bp, Homo sapien
aacatacaatacctgtgatactcct

SEQ ID NO: 446372 - DNA, 25 bp, Homo sapien
aatcttaccccttacagggacgatg

SEQ ID NO: 446373 - DNA, 25 bp, Homo sapien
aattctacacagacccttcatactt

SEQ ID NO: 446374 - DNA, 25 bp, Homo sapien
gatgctgcaggacaccaaggatatc

SEQ ID NO: 446375 - DNA, 25 bp, Homo sapien
taagtatgcagtctattatgaaatc

SEQ ID NO: 446376 - DNA, 25 bp, Homo sapien
gtatgcagtctattatgaaatcatg

SEQ ID NO: 446377 - DNA, 25 bp, Homo sapien
gtctattatgaaatcatgttgacaa

SEQ ID NO: 446378 - DNA, 25 bp, Homo sapien
catgttgacaactaagtttcttttc

SEQ ID NO: 446379 - DNA, 25 bp, Homo sapien
tgttgacaactaagtttcttttcaa

SEQ ID NO: 446380 - DNA, 25 bp, Homo sapien
tgacaactaagtttcttttcaaaat

SEQ ID NO: 446381 - DNA, 25 bp, Homo sapien
ttcaaaatttttgaggccgagcact

SEQ ID NO: 446382 - DNA, 25 bp, Homo sapien
caaaatttttgaggccgagcacttc

SEQ ID NO: 446383 - DNA, 25 bp, Homo sapien
atttttgaggccgagcacttctgta

SEQ ID NO: 446384 - DNA, 25 bp, Homo sapien
tttttgaggccgagcacttctgtaa

SEQ ID NO: 446385 - DNA, 25 bp, Homo sapien
ttttgaggccgagcacttctgtaat

SEQ ID NO: 446386 - DNA, 25 bp, Homo sapien
gacacagaagggggaatatcacaca

SEQ ID NO: 446387 - DNA, 25 bp, Homo sapien
attttaagaagagaattagctacaa

SEQ ID NO: 446388 - DNA, 25 bp, Homo sapien
ttttaagaagagaattagctacaaa

SEQ ID NO: 446389 - DNA, 25 bp, Homo sapien
tttaagaagagaattagctacaaat

SEQ ID NO: 446390 - DNA, 25 bp, Homo sapien
ttaagaagagaattagctacaaata

SEQ ID NO: 446391 - DNA, 25 bp, Homo sapien
taagaagagaattagctacaaataa

SEQ ID NO: 446392 - DNA, 25 bp, Homo sapien
aagaagagaattagctacaaataag

SEQ ID NO: 446393 - DNA, 25 bp, Homo sapien
agaagagaattagctacaaataaga

SEQ ID NO: 446394 - DNA, 25 bp, Homo sapien
gaagagaattagctacaaataagaa

SEQ ID NO: 446395 - DNA, 25 bp, Homo sapien
aagagaattagctacaaataagaaa

SEQ ID NO: 446396 - DNA, 25 bp, Homo sapien
gagaattagctacaaataagaaaac

SEQ ID NO: 446397 - DNA, 25 bp, Homo sapien
ggtgttttaatcctggtcttatata

SEQ ID NO: 446398 - DNA, 25 bp, Homo sapien
taaaccagtactttgctgagtgaaa

SEQ ID NO: 446399 - DNA, 25 bp, Homo sapien
atgtgcattcttgttgtgggcttga

SEQ ID NO: 446400 - DNA, 25 bp, Homo sapien
gggcttgatttagatcctattgcgg

SEQ ID NO: 446401 - DNA, 25 bp, Homo sapien
gggtcattacgcgaaaattcaatca

SEQ ID NO: 446402 - DNA, 25 bp, Homo sapien
aattcaatcataccttccatagaca

SEQ ID NO: 446403 - DNA, 25 bp, Homo sapien
ttaaatctgtccgttaggtggcctt

SEQ ID NO: 446404 - DNA, 25 bp, Homo sapien
taggtggcctttccttatctgaggt

SEQ ID NO: 446405 - DNA, 25 bp, Homo sapien
cttatctgaggtgtagtggtctaac

SEQ ID NO: 446406 - DNA, 25 bp, Homo sapien
ggtctaacatttaggaagccttgct

SEQ ID NO: 446407 - DNA, 25 bp, Homo sapien
gaagccttgctttgactttatcggg

SEQ ID NO: 446408 - DNA, 25 bp, Homo sapien
ttagatgggatgatgctcagactca

SEQ ID NO: 446409 - DNA, 25 bp, Homo sapien
gactcatctgatcaaagttccgaga

SEQ ID NO: 446410 - DNA, 25 bp, Homo sapien
gatcaaagttccgagaggcatagaa

SEQ ID NO: 446411 - DNA, 25 bp, Homo sapien
gggcctacaaaccagcaacatgaaa

SEQ ID NO: 446412 - DNA, 25 bp, Homo sapien
gacaaaccaatctgttaagatcctg

SEQ ID NO: 446413 - DNA, 25 bp, Homo sapien
gttaagatcctgtcatagttttaga

SEQ ID NO: 446414 - DNA, 25 bp, Homo sapien
tcctgtcatagttttagatcattgg

SEQ ID NO: 446415 - DNA, 25 bp, Homo sapien
agatcattggttatcctgatttgca

SEQ ID NO: 446416 - DNA, 25 bp, Homo sapien
cattggttatcctgatttgcaaagt

SEQ ID NO: 446417 - DNA, 25 bp, Homo sapien
gtgatcaaaagcatatctagccatg

SEQ ID NO: 446418 - DNA, 25 bp, Homo sapien
gcatatctagccatgtgcaacaaga

SEQ ID NO: 446419 - DNA, 25 bp, Homo sapien
gggccagccagtactcagagaggag

SEQ ID NO: 446420 - DNA, 25 bp, Homo sapien
agaggaggaccttctcaaccacgta

SEQ ID NO: 446421 - DNA, 25 bp, Homo sapien
ttctcaaccacgtacagaacacggg

SEQ ID NO: 446422 - DNA, 25 bp, Homo sapien
agaacacgggttttcatggctgcct

SEQ ID NO: 446423 - DNA, 25 bp, Homo sapien
ataggattggattggattttgcaga

SEQ ID NO: 446424 - DNA, 25 bp, Homo sapien
tgcctgctcagaggcgccctaggga

SEQ ID NO: 446425 - DNA, 25 bp, Homo sapien
gaagggccatgtttgagttttgctt

SEQ ID NO: 446426 - DNA, 25 bp, Homo sapien
gccatgtttgagttttgctttgtat

SEQ ID NO: 446427 - DNA, 25 bp, Homo sapien
tgctttgtatgttgttttgcaagta

SEQ ID NO: 446428 - DNA, 25 bp, Homo sapien
gttttgcaagtatctgcctggtact

SEQ ID NO: 446429 - DNA, 25 bp, Homo sapien
gtatctgcctggtactttgatttaa

SEQ ID NO: 446430 - DNA, 25 bp, Homo sapien
gagtattttttatcagtaagtacaa

SEQ ID NO: 446431 - DNA, 25 bp, Homo sapien
aagtacaaatacaatgcagagctca

SEQ ID NO: 446432 - DNA, 25 bp, Homo sapien
tacaatgcagagctcattttcagtt

SEQ ID NO: 446433 - DNA, 25 bp, Homo sapien
atgcagagctcattttcagttaata

SEQ ID NO: 446434 - DNA, 25 bp, Homo sapien
aatctttactctctatcttgaagca

SEQ ID NO: 446435 - DNA, 25 bp, Homo sapien
tctttactctctatcttgaagcatt

SEQ ID NO: 446436 - DNA, 25 bp, Homo sapien
tttactctctatcttgaagcattag

SEQ ID NO: 446437 - DNA, 25 bp, Homo sapien
actctctatcttgaagcattagatg

SEQ ID NO: 446438 - DNA, 25 bp, Homo sapien
ctctatcttgaagcattagatgtta

SEQ ID NO: 446439 - DNA, 25 bp, Homo sapien
cctataagtggctcattttactgtc

SEQ ID NO: 446440 - DNA, 25 bp, Homo sapien
ctataagtggctcattttactgtct

SEQ ID NO: 446441 - DNA, 25 bp, Homo sapien
caacttcctggtggacttcgggaag

SEQ ID NO: 446442 - DNA, 25 bp, Homo sapien
ggcgattgtagctctgacatctgga

SEQ ID NO: 446443 - DNA, 25 bp, Homo sapien
tgtagctctgacatctggatttgaa

SEQ ID NO: 446444 - DNA, 25 bp, Homo sapien
ctattttgggccctcacttccttgg

SEQ ID NO: 446445 - DNA, 25 bp, Homo sapien
gacccttggcagcatgtaccacaca

SEQ ID NO: 446446 - DNA, 25 bp, Homo sapien
taccacacagccaagctgagactgt

SEQ ID NO: 446447 - DNA, 25 bp, Homo sapien
caagctgagactgtggcaatgtgtt

SEQ ID NO: 446448 - DNA, 25 bp, Homo sapien
gtggcaatgtgttgagtcatataca

SEQ ID NO: 446449 - DNA, 25 bp, Homo sapien
tacatttactgaccactgttgcttg

SEQ ID NO: 446450 - DNA, 25 bp, Homo sapien
tactgaccactgttgcttgttgctc

SEQ ID NO: 446451 - DNA, 25 bp, Homo sapien
tgttgcttgttgctcactgtgctgc

SEQ ID NO: 446452 - DNA, 25 bp, Homo sapien
taacgtttatagttgaattgggcca

SEQ ID NO: 446453 - DNA, 25 bp, Homo sapien
tgggccaaaatgtttcgaatttata

SEQ ID NO: 446454 - DNA, 25 bp, Homo sapien
aacacctgtttccaaaccttgacag

SEQ ID NO: 446455 - DNA, 25 bp, Homo sapien
aaagaggaggcgacaagtccatcag

SEQ ID NO: 446456 - DNA, 25 bp, Homo sapien
agtccatcagcagaaagtcacctgt

SEQ ID NO: 446457 - DNA, 25 bp, Homo sapien
gcagaaagtcacctgtctacataga

SEQ ID NO: 446458 - DNA, 25 bp, Homo sapien
gtctacatagaccaaatggagcacc

SEQ ID NO: 446459 - DNA, 25 bp, Homo sapien
atggagcaccaaggccaagcggaca

SEQ ID NO: 446460 - DNA, 25 bp, Homo sapien
agcaccaaggccaagcggacagagg

SEQ ID NO: 446461 - DNA, 25 bp, Homo sapien
gaggaacggaatctgccgactcaca

SEQ ID NO: 446462 - DNA, 25 bp, Homo sapien
ggaatctgccgactcacatgacagc

SEQ ID NO: 446463 - DNA, 25 bp, Homo sapien
cgtcctggttgggtgctcaaagcaa

SEQ ID NO: 446464 - DNA, 25 bp, Homo sapien
gagcacccctttacgtggcgccccg

SEQ ID NO: 446465 - DNA, 25 bp, Homo sapien
ggagacgcgggtggctgggatggca

SEQ ID NO: 446466 - DNA, 25 bp, Homo sapien
tgggatggcaggatgagcgcgccct

SEQ ID NO: 446467 - DNA, 25 bp, Homo sapien
ttgggtgctcaaagcaaggaggtga

SEQ ID NO: 446468 - DNA, 25 bp, Homo sapien
aaggaggtgaaaggcgaccagcatt

SEQ ID NO: 446469 - DNA, 25 bp, Homo sapien
tgaaaggcgaccagcattggcgaat

SEQ ID NO: 446470 - DNA, 25 bp, Homo sapien
gaaaggcgaccagcattggcgaatg

SEQ ID NO: 446471 - DNA, 25 bp, Homo sapien
tggcgaatggggtaagacttgcaca

SEQ ID NO: 446472 - DNA, 25 bp, Homo sapien
cttgcacaggcccaaggctaggagt

SEQ ID NO: 446473 - DNA, 25 bp, Homo sapien
tgcacaggcccaaggctaggagttg

SEQ ID NO: 446474 - DNA, 25 bp, Homo sapien
aaaggcaagggaagactcaatttgt

SEQ ID NO: 446475 - DNA, 25 bp, Homo sapien
gcaagggaagactcaatttgttgtt

SEQ ID NO: 446476 - DNA, 25 bp, Homo sapien
gggaagactcaatttgttgttgtca

SEQ ID NO: 446477 - DNA, 25 bp, Homo sapien
gaatagtgtactatttcttttctgt

SEQ ID NO: 446478 - DNA, 25 bp, Homo sapien
tttctgtctgcagagattgagcaga

SEQ ID NO: 446479 - DNA, 25 bp, Homo sapien
gattgagcagaaatgctttcaatta

SEQ ID NO: 446480 - DNA, 25 bp, Homo sapien
atgagagaattgttgatagccggta

SEQ ID NO: 446481 - DNA, 25 bp, Homo sapien
agagaattgttgatagccggtaaaa

SEQ ID NO: 446482 - DNA, 25 bp, Homo sapien
gttgatagccggtaaaattatagac

SEQ ID NO: 446483 - DNA, 25 bp, Homo sapien
aattatagactaccaaacctagctg

SEQ ID NO: 446484 - DNA, 25 bp, Homo sapien
atagactaccaaacctagctgggcg

SEQ ID NO: 446485 - DNA, 25 bp, Homo sapien
tggtggacggtgactcacaccgtgc

SEQ ID NO: 446486 - DNA, 25 bp, Homo sapien
tgactcacaccgtgccgcgaagcgg

SEQ ID NO: 446487 - DNA, 25 bp, Homo sapien
ccgtagaaactctgcttgggctcag

SEQ ID NO: 446488 - DNA, 25 bp, Homo sapien
gtagaaactctgcttgggctcagcc

SEQ ID NO: 446489 - DNA, 25 bp, Homo sapien
tagaaactctgcttgggctcagccc

SEQ ID NO: 446490 - DNA, 25 bp, Homo sapien
gaaactctgcttgggctcagcccgt

SEQ ID NO: 446491 - DNA, 25 bp, Homo sapien
tgggctcagcccgtatggatcagct

SEQ ID NO: 446492 - DNA, 25 bp, Homo sapien
ggctcagcccgtatggatcagctcc

SEQ ID NO: 446493 - DNA, 25 bp, Homo sapien
aactccattctgccagtgagagacc

SEQ ID NO: 446494 - DNA, 25 bp, Homo sapien
ggcccagcagaaggccagactctga

SEQ ID NO: 446495 - DNA, 25 bp, Homo sapien
cagcagaaggccagactctgagagc

SEQ ID NO: 446496 - DNA, 25 bp, Homo sapien
gcctccaaaacttgctcttgaagac

SEQ ID NO: 446497 - DNA, 25 bp, Homo sapien
cttgaagacatatcggctgaccctg

SEQ ID NO: 446498 - DNA, 25 bp, Homo sapien
agacatatcggctgaccctgaggac

SEQ ID NO: 446499 - DNA, 25 bp, Homo sapien
tggccacccatcctggtcaggctgg

SEQ ID NO: 446500 - DNA, 25 bp, Homo sapien
ccaagggctcgaccaagtacaccag

SEQ ID NO: 446501 - DNA, 25 bp, Homo sapien
tggtgagcatccgacggcagagtaa

SEQ ID NO: 446502 - DNA, 25 bp, Homo sapien
cagagtaaaggccacctgacagata

SEQ ID NO: 446503 - DNA, 25 bp, Homo sapien
gccacctgacagatagcccggagga

SEQ ID NO: 446504 - DNA, 25 bp, Homo sapien
aagtgtgccccgacatggtggcctt

SEQ ID NO: 446505 - DNA, 25 bp, Homo sapien
ggtggccttttatgagtataccatg

SEQ ID NO: 446506 - DNA, 25 bp, Homo sapien
gagtataccatgtagttgttgagtc

SEQ ID NO: 446507 - DNA, 25 bp, Homo sapien
agaaagtaactgcagtgatgaacat

SEQ ID NO: 446508 - DNA, 25 bp, Homo sapien
ttgttttaaatcttacacctgaaag

SEQ ID NO: 446509 - DNA, 25 bp, Homo sapien
tattgggatcacttttccctgtcta

SEQ ID NO: 446510 - DNA, 25 bp, Homo sapien
cttttccctgtctaaactccaggat

SEQ ID NO: 446511 - DNA, 25 bp, Homo sapien
gtctaaactccaggatacagtatcc

SEQ ID NO: 446512 - DNA, 25 bp, Homo sapien
atacagtatccaatttatccaaaca

SEQ ID NO: 446513 - DNA, 25 bp, Homo sapien
cagaactgtggtgtcaatgtgtaat

SEQ ID NO: 446514 - DNA, 25 bp, Homo sapien
taattgtgtaaaatagccttcccaa

SEQ ID NO: 446515 - DNA, 25 bp, Homo sapien
agtttatttaaaccccatgtcatga

SEQ ID NO: 446516 - DNA, 25 bp, Homo sapien
ccccatgtcatgaggaggtactagt

SEQ ID NO: 446517 - DNA, 25 bp, Homo sapien
ggaggtactagttccaagcaacaaa

SEQ ID NO: 446518 - DNA, 25 bp, Homo sapien
atttgttgttgtcagttattaacaa

SEQ ID NO: 446519 - DNA, 25 bp, Homo sapien
tttgttgttgtcagttattaacaat

SEQ ID NO: 446520 - DNA, 25 bp, Homo sapien
ttgttgttgtcagttattaacaatt

SEQ ID NO: 446521 - DNA, 25 bp, Homo sapien
tgttgttgtcagttattaacaattt

SEQ ID NO: 446522 - DNA, 25 bp, Homo sapien
gttgttgtcagttattaacaattta

SEQ ID NO: 446523 - DNA, 25 bp, Homo sapien
ttgttgtcagttattaacaatttat

SEQ ID NO: 446524 - DNA, 25 bp, Homo sapien
tttctgtctgcagagattgagcaga

SEQ ID NO: 446525 - DNA, 25 bp, Homo sapien
ttctgtctgcagagattgagcagaa

SEQ ID NO: 446526 - DNA, 25 bp, Homo sapien
gcagaaatgctttcaattaaaacaa

SEQ ID NO: 446527 - DNA, 25 bp, Homo sapien
cagaaatgctttcaattaaaacaaa

SEQ ID NO: 446528 - DNA, 25 bp, Homo sapien
agaaatgctttcaattaaaacaaat

SEQ ID NO: 446529 - DNA, 25 bp, Homo sapien
gagcactgaacaggacaagctcagt

SEQ ID NO: 446530 - DNA, 25 bp, Homo sapien
gacaagctcagttttgtccctcaaa

SEQ ID NO: 446531 - DNA, 25 bp, Homo sapien
tcaaacctccacaatcagctatttt

SEQ ID NO: 446532 - DNA, 25 bp, Homo sapien
ctccacaatcagctattttacataa

SEQ ID NO: 446533 - DNA, 25 bp, Homo sapien
aaagtgggtggtgattaacctcaga

SEQ ID NO: 446534 - DNA, 25 bp, Homo sapien
ggtgattaacctcagagtctccagg

SEQ ID NO: 446535 - DNA, 25 bp, Homo sapien
acagactatccaggactgtgcctga

SEQ ID NO: 446536 - DNA, 25 bp, Homo sapien
ggactgtgcctgaaatagaagagga

SEQ ID NO: 446537 - DNA, 25 bp, Homo sapien
tacagaactgaatacggtgactgag

SEQ ID NO: 446538 - DNA, 25 bp, Homo sapien
tgtctccccttttaggaaagaagat

SEQ ID NO: 446539 - DNA, 25 bp, Homo sapien
gagagtcatgtactgtacattaagc

SEQ ID NO: 446540 - DNA, 25 bp, Homo sapien
gtggccactagccatatgcagctat

SEQ ID NO: 446541 - DNA, 25 bp, Homo sapien
gccactagccatatgcagctattta

SEQ ID NO: 446542 - DNA, 25 bp, Homo sapien
taaagattcaggtgcacttgccatg

SEQ ID NO: 446543 - DNA, 25 bp, Homo sapien
ttcaggtgcacttgccatgtttcaa

SEQ ID NO: 446544 - DNA, 25 bp, Homo sapien
ggtgcacttgccatgtttcaagtac

SEQ ID NO: 446545 - DNA, 25 bp, Homo sapien
gtggtcacatgtccttgtcttagca

SEQ ID NO: 446546 - DNA, 25 bp, Homo sapien
gtcacatgtccttgtcttagcacag

SEQ ID NO: 446547 - DNA, 25 bp, Homo sapien
catgtccttgtcttagcacaggttt

SEQ ID NO: 446548 - DNA, 25 bp, Homo sapien
ccttgtcttagcacaggtttgtaac

SEQ ID NO: 446549 - DNA, 25 bp, Homo sapien
agcacaggtttgtaacatttccacc

SEQ ID NO: 446550 - DNA, 25 bp, Homo sapien
ggacagtgctggtaaggatttctac

SEQ ID NO: 446551 - DNA, 25 bp, Homo sapien
ttagcaaaacttctggcttcggcct

SEQ ID NO: 446552 - DNA, 25 bp, Homo sapien
tctggcttcggccttttggaatcct

SEQ ID NO: 446553 - DNA, 25 bp, Homo sapien
ggccttttggaatcctcttagctta

SEQ ID NO: 446554 - DNA, 25 bp, Homo sapien
tggaatcctcttagcttatgactga

SEQ ID NO: 446555 - DNA, 25 bp, Homo sapien
agcttatgactgatagggctatgag

SEQ ID NO: 446556 - DNA, 25 bp, Homo sapien
gatgatttaagtctgtgtaccactt

SEQ ID NO: 446557 - DNA, 25 bp, Homo sapien
gtaccacttctaatctttacttact

SEQ ID NO: 446558 - DNA, 25 bp, Homo sapien
tttcccatttattatacacttgtat

SEQ ID NO: 446559 - DNA, 25 bp, Homo sapien
atacacttgtatttgctaaggaatt

SEQ ID NO: 446560 - DNA, 25 bp, Homo sapien
taagcctaatcctaagtaagttgaa

SEQ ID NO: 446561 - DNA, 25 bp, Homo sapien
gtaagttgaacacatcctaagaaag

SEQ ID NO: 446562 - DNA, 25 bp, Homo sapien
gaggttcaaatgactccatggcaaa

SEQ ID NO: 446563 - DNA, 25 bp, Homo sapien
gggactctggtgctgtaccaaacag

SEQ ID NO: 446564 - DNA, 25 bp, Homo sapien
tctggtgctgtaccaaacagcattc

SEQ ID NO: 446565 - DNA, 25 bp, Homo sapien
aacagcattcaaaaggccccagaaa

SEQ ID NO: 446566 - DNA, 25 bp, Homo sapien
gaaaggcactcagtaatcctcatgg

SEQ ID NO: 446567 - DNA, 25 bp, Homo sapien
ggcactcagtaatcctcatggttgc

SEQ ID NO: 446568 - DNA, 25 bp, Homo sapien
agtaatcctcatggttgctgttaag

SEQ ID NO: 446569 - DNA, 25 bp, Homo sapien
gttgctgttaaggatcacactgaat

SEQ ID NO: 446570 - DNA, 25 bp, Homo sapien
ggaaatcctttatttagaggcagaa

SEQ ID NO: 446571 - DNA, 25 bp, Homo sapien
aatattatatggataaccttgctgt

SEQ ID NO: 446572 - DNA, 25 bp, Homo sapien
gataaccttgctgttcaattttttt

SEQ ID NO: 446573 - DNA, 25 bp, Homo sapien
gtgactgtgagatgacagacacgta

SEQ ID NO: 446574 - DNA, 25 bp, Homo sapien
tctgttgccatcagcctgagtcatc

SEQ ID NO: 446575 - DNA, 25 bp, Homo sapien
gcctgagtcatcctctatctgaaaa

SEQ ID NO: 446576 - DNA, 25 bp, Homo sapien
acttccaggactgaagttcgaattg

SEQ ID NO: 446577 - DNA, 25 bp, Homo sapien
gttcgaattggaagcacgcgttctc

SEQ ID NO: 446578 - DNA, 25 bp, Homo sapien
aagcacgcgttctccttggtgaagt

SEQ ID NO: 446579 - DNA, 25 bp, Homo sapien
ttctccttggtgaagtccgtcctgt

SEQ ID NO: 446580 - DNA, 25 bp, Homo sapien
tggtgaagtccgtcctgtcccagga

SEQ ID NO: 446581 - DNA, 25 bp, Homo sapien
tcctcgtggctctctgtcgtgtgaa

SEQ ID NO: 446582 - DNA, 25 bp, Homo sapien
gggtcaggagcgcacaaatgtttat

SEQ ID NO: 446583 - DNA, 25 bp, Homo sapien
aatgtttatactccacgtgagtcac

SEQ ID NO: 446584 - DNA, 25 bp, Homo sapien
tggggctgccattgccctcagtgac

SEQ ID NO: 446585 - DNA, 25 bp, Homo sapien
tcaagctcatttcctcgtacaacag

SEQ ID NO: 446586 - DNA, 25 bp, Homo sapien
aagctcatttcctcgtacaacagtg

SEQ ID NO: 446587 - DNA, 25 bp, Homo sapien
gctcatttcctcgtacaacagtgaa

SEQ ID NO: 446588 - DNA, 25 bp, Homo sapien
catttcctcgtacaacagtgaattt

SEQ ID NO: 446589 - DNA, 25 bp, Homo sapien
caacagggtggtggcccatatggcc

SEQ ID NO: 446590 - DNA, 25 bp, Homo sapien
gggtggtggcccatatggcctccaa

SEQ ID NO: 446591 - DNA, 25 bp, Homo sapien
ggtggcccatatggcctccaaggag

SEQ ID NO: 446592 - DNA, 25 bp, Homo sapien
tccaaggagtaagactgctcgacaa

SEQ ID NO: 446593 - DNA, 25 bp, Homo sapien
aaggagtaagactgctcgacaacca

SEQ ID NO: 446594 - DNA, 25 bp, Homo sapien
gagtaagactgctcgacaaccagcc

SEQ ID NO: 446595 - DNA, 25 bp, Homo sapien
gtgtggtccttgtctttggttataa

SEQ ID NO: 446596 - DNA, 25 bp, Homo sapien
ggtccttgtctttggttataattgc

SEQ ID NO: 446597 - DNA, 25 bp, Homo sapien
cttgtctttggttataattgctgta

SEQ ID NO: 446598 - DNA, 25 bp, Homo sapien
aattgctgtaaggtgggagccagta

SEQ ID NO: 446599 - DNA, 25 bp, Homo sapien
gggagccagtaattatctgcagcaa

SEQ ID NO: 446600 - DNA, 25 bp, Homo sapien
atctgcagcaagtagtcagcacttt

SEQ ID NO: 446601 - DNA, 25 bp, Homo sapien
gcaagtagtcagcactttcagtgat

SEQ ID NO: 446602 - DNA, 25 bp, Homo sapien
gtagtcagcactttcagtgatatga

SEQ ID NO: 446603 - DNA, 25 bp, Homo sapien
atgaatatcatcttggctggaggcc

SEQ ID NO: 446604 - DNA, 25 bp, Homo sapien
ggaggccaggtggacaacctgtcat

SEQ ID NO: 446605 - DNA, 25 bp, Homo sapien
caggtggacaacctgtcatcactga

SEQ ID NO: 446606 - DNA, 25 bp, Homo sapien
aaaatcttcacttgtcagagggggg

SEQ ID NO: 446607 - DNA, 25 bp, Homo sapien
gggtgcatgaaatttgagagccatg

SEQ ID NO: 446608 - DNA, 25 bp, Homo sapien
gagagccatgtgttatgcatccagc

SEQ ID NO: 446609 - DNA, 25 bp, Homo sapien
tatgcatccagctcttgaactggtc

SEQ ID NO: 446610 - DNA, 25 bp, Homo sapien
gctcttgaactggtctcagcttcag

SEQ ID NO: 446611 - DNA, 25 bp, Homo sapien
ggaaatagttgaggcccagggaact

SEQ ID NO: 446612 - DNA, 25 bp, Homo sapien
agttgaggcccagggaactgatcag

SEQ ID NO: 446613 - DNA, 25 bp, Homo sapien
ccagggaactgatcaggccagagga

SEQ ID NO: 446614 - DNA, 25 bp, Homo sapien
gaagctcaagatcaactgtgcttat

SEQ ID NO: 446615 - DNA, 25 bp, Homo sapien
taaatgccccaaccacctacttggg

SEQ ID NO: 446616 - DNA, 25 bp, Homo sapien
caaccacctacttgggacaggaaat

SEQ ID NO: 446617 - DNA, 25 bp, Homo sapien
cgggaggctggatgggacagtcgct

SEQ ID NO: 446618 - DNA, 25 bp, Homo sapien
gaggctggatgggacagtcgcttga

SEQ ID NO: 446619 - DNA, 25 bp, Homo sapien
aggctggatgggacagtcgcttgaa

SEQ ID NO: 446620 - DNA, 25 bp, Homo sapien
tggatgggacagtcgcttgaacccg

SEQ ID NO: 446621 - DNA, 25 bp, Homo sapien
agaggttgcagcccagctgaggaca

SEQ ID NO: 446622 - DNA, 25 bp, Homo sapien
aggttgcagcccagctgaggacacg

SEQ ID NO: 446623 - DNA, 25 bp, Homo sapien
ggttgcagcccagctgaggacacgc

SEQ ID NO: 446624 - DNA, 25 bp, Homo sapien
gttgcagcccagctgaggacacgcc

SEQ ID NO: 446625 - DNA, 25 bp, Homo sapien
ttgcagcccagctgaggacacgcca

SEQ ID NO: 446626 - DNA, 25 bp, Homo sapien
agcccagctgaggacacgccactgc

SEQ ID NO: 446627 - DNA, 25 bp, Homo sapien
caaacaagacagagttcaagaccaa

SEQ ID NO: 446628 - DNA, 25 bp, Homo sapien
atgtctgcctttttcttacctcaag

SEQ ID NO: 446629 - DNA, 25 bp, Homo sapien
ttacctcaagggaaattctgcatat

SEQ ID NO: 446630 - DNA, 25 bp, Homo sapien
gcatatatctgcagtcaagactgaa

SEQ ID NO: 446631 - DNA, 25 bp, Homo sapien
tttcctgttttgagagttagataac

SEQ ID NO: 446632 - DNA, 25 bp, Homo sapien
agactgaatagagagggatcccgca

SEQ ID NO: 446633 - DNA, 25 bp, Homo sapien
gatcccgcagaagggaaagagctgc

SEQ ID NO: 446634 - DNA, 25 bp, Homo sapien
gaaagagctgcatgctatcatacta

SEQ ID NO: 446635 - DNA, 25 bp, Homo sapien
gagctgcatgctatcatactaataa

SEQ ID NO: 446636 - DNA, 25 bp, Homo sapien
gagttagataacatggttaccagaa

SEQ ID NO: 446637 - DNA, 25 bp, Homo sapien
tggtttccccctggcataatgaaaa

SEQ ID NO: 446638 - DNA, 25 bp, Homo sapien
gagaaaacttagacatgtctgcctt

SEQ ID NO: 446639 - DNA, 25 bp, Homo sapien
gatgctgaaagacaaagtctgccct

SEQ ID NO: 446640 - DNA, 25 bp, Homo sapien
aaagacaaagtctgccctctgtttc

SEQ ID NO: 446641 - DNA, 25 bp, Homo sapien
aagacaaagtctgccctctgtttct

SEQ ID NO: 446642 - DNA, 25 bp, Homo sapien
tgtttctggtcccttaggtcacagt

SEQ ID NO: 446643 - DNA, 25 bp, Homo sapien
tctggtcccttaggtcacagtggaa

SEQ ID NO: 446644 - DNA, 25 bp, Homo sapien
taagaaccttctttgtgttaaggat

SEQ ID NO: 446645 - DNA, 25 bp, Homo sapien
gaaccttctttgtgttaaggatgga

SEQ ID NO: 446646 - DNA, 25 bp, Homo sapien
tgggcttgccccagaagagcttgga

SEQ ID NO: 446647 - DNA, 25 bp, Homo sapien
ttgccccagaagagcttggatgctt

SEQ ID NO: 446648 - DNA, 25 bp, Homo sapien
agagcttggatgctttgttttttag

SEQ ID NO: 446649 - DNA, 25 bp, Homo sapien
gttttttagctttgagatgctgaaa

SEQ ID NO: 446650 - DNA, 25 bp, Homo sapien
tccctccttgttgtccagtgctggg

SEQ ID NO: 446651 - DNA, 25 bp, Homo sapien
ggtcaggctgcccaatcctctgact

SEQ ID NO: 446652 - DNA, 25 bp, Homo sapien
gctgcccaatcctctgactggatca

SEQ ID NO: 446653 - DNA, 25 bp, Homo sapien
tcttgcctcagttcttccctctgag

SEQ ID NO: 446654 - DNA, 25 bp, Homo sapien
aggccctcccgcatctcaggttggg

SEQ ID NO: 446655 - DNA, 25 bp, Homo sapien
cgcctactcctgcaaatgcttgtga

SEQ ID NO: 446656 - DNA, 25 bp, Homo sapien
tactcctgcaaatgcttgtgacaga

SEQ ID NO: 446657 - DNA, 25 bp, Homo sapien
caaatgcttgtgacagatgccagga

SEQ ID NO: 446658 - DNA, 25 bp, Homo sapien
tgcttgtgacagatgccaggaggta

SEQ ID NO: 446659 - DNA, 25 bp, Homo sapien
gaggtagatgtgtgctggccaataa

SEQ ID NO: 446660 - DNA, 25 bp, Homo sapien
tagatgtgtgctggccaataaaggc

SEQ ID NO: 446661 - DNA, 25 bp, Homo sapien
aaactttatccatttgaatataatg

SEQ ID NO: 446662 - DNA, 25 bp, Homo sapien
gaatgttcatatttcttggtgtacc

SEQ ID NO: 446663 - DNA, 25 bp, Homo sapien
atgttcatatttcttggtgtaccaa

SEQ ID NO: 446664 - DNA, 25 bp, Homo sapien
gttcatatttcttggtgtaccaaag

SEQ ID NO: 446665 - DNA, 25 bp, Homo sapien
catatttcttggtgtaccaaagtta

SEQ ID NO: 446666 - DNA, 25 bp, Homo sapien
cagaagatttagttaacacaattgt

SEQ ID NO: 446667 - DNA, 25 bp, Homo sapien
taacttatttgcatatgttgactaa

SEQ ID NO: 446668 - DNA, 25 bp, Homo sapien
gcatatgttgactaagtcatgctgt

SEQ ID NO: 446669 - DNA, 25 bp, Homo sapien
ctaagtcatgctgttgaccctcaat

SEQ ID NO: 446670 - DNA, 25 bp, Homo sapien
aagtcatgctgttgaccctcaataa

SEQ ID NO: 446671 - DNA, 25 bp, Homo sapien
tcatgctgttgaccctcaataaatg

SEQ ID NO: 446672 - DNA, 25 bp, Homo sapien
ggcccttattagctttaatttacat

SEQ ID NO: 446673 - DNA, 25 bp, Homo sapien
tggccaacatgctgactcacccttc

SEQ ID NO: 446674 - DNA, 25 bp, Homo sapien
ctgactcacccttccctactgaaaa

SEQ ID NO: 446675 - DNA, 25 bp, Homo sapien
aggcgcagtggccatccctacagtg

SEQ ID NO: 446676 - DNA, 25 bp, Homo sapien
ggcgcagtggccatccctacagtgc

SEQ ID NO: 446677 - DNA, 25 bp, Homo sapien
cgcagtggccatccctacagtgcta

SEQ ID NO: 446678 - DNA, 25 bp, Homo sapien
cagtggccatccctacagtgctagc

SEQ ID NO: 446679 - DNA, 25 bp, Homo sapien
agtggccatccctacagtgctagct

SEQ ID NO: 446680 - DNA, 25 bp, Homo sapien
gtggccatccctacagtgctagcta

SEQ ID NO: 446681 - DNA, 25 bp, Homo sapien
tggccatccctacagtgctagctac

SEQ ID NO: 446682 - DNA, 25 bp, Homo sapien
ggccatccctacagtgctagctact

SEQ ID NO: 446683 - DNA, 25 bp, Homo sapien
gggcagttagttatttcactttctg

SEQ ID NO: 446684 - DNA, 25 bp, Homo sapien
gaagattcttatatcctacgaggtg

SEQ ID NO: 446685 - DNA, 25 bp, Homo sapien
ctacgaggtgactcatgtttcattt

SEQ ID NO: 446686 - DNA, 25 bp, Homo sapien
ttagaccatgatagcacattgttgt

SEQ ID NO: 446687 - DNA, 25 bp, Homo sapien
agcacattgttgttaactttggtaa

SEQ ID NO: 446688 - DNA, 25 bp, Homo sapien
aactttggtaatcttccatgcagtt

SEQ ID NO: 446689 - DNA, 25 bp, Homo sapien
catgcagtttgcagtgttcccttgc

SEQ ID NO: 446690 - DNA, 25 bp, Homo sapien
gcagtgttcccttgcaagtcacaag

SEQ ID NO: 446691 - DNA, 25 bp, Homo sapien
agatgttggtggcattgctctttct

SEQ ID NO: 446692 - DNA, 25 bp, Homo sapien
tggtggcattgctctttctgaaaag

SEQ ID NO: 446693 - DNA, 25 bp, Homo sapien
attggatatcttatttactttgccc

SEQ ID NO: 446694 - DNA, 25 bp, Homo sapien
gagagccttgtgaacttttagcttt

SEQ ID NO: 446695 - DNA, 25 bp, Homo sapien
tagctttggtgcacagctgatacca

SEQ ID NO: 446696 - DNA, 25 bp, Homo sapien
acagctgataccaggagggaacatc

SEQ ID NO: 446697 - DNA, 25 bp, Homo sapien
gagggaacatcctgaagtgtcagag

SEQ ID NO: 446698 - DNA, 25 bp, Homo sapien
gatgatgccagtcagagccaggcca

SEQ ID NO: 446699 - DNA, 25 bp, Homo sapien
gagccaggccagatggaaattgttt

SEQ ID NO: 446700 - DNA, 25 bp, Homo sapien
aattgttttctgatgttactggttt

SEQ ID NO: 446701 - DNA, 25 bp, Homo sapien
tttcttttccctattagccaaagtg

SEQ ID NO: 446702 - DNA, 25 bp, Homo sapien
aagggagccccatctttatggctga

SEQ ID NO: 446703 - DNA, 25 bp, Homo sapien
tggctgatcaactacaaccctatat

SEQ ID NO: 446704 - DNA, 25 bp, Homo sapien
aaccctatatgcctgaatactctgc

SEQ ID NO: 446705 - DNA, 25 bp, Homo sapien
tggtggacggtgactcacaccgtgc

SEQ ID NO: 446706 - DNA, 25 bp, Homo sapien
tgactcacaccgtgccgcgaagcgg

SEQ ID NO: 446707 - DNA, 25 bp, Homo sapien
ccgtagaaactctgcttgggctcag

SEQ ID NO: 446708 - DNA, 25 bp, Homo sapien
gtagaaactctgcttgggctcagcc

SEQ ID NO: 446709 - DNA, 25 bp, Homo sapien
gaaactctgcttgggctcagcccgt

SEQ ID NO: 446710 - DNA, 25 bp, Homo sapien
tgggctcagcccgtatggatcagct

SEQ ID NO: 446711 - DNA, 25 bp, Homo sapien
ggctcagcccgtatggatcagctcc

SEQ ID NO: 446712 - DNA, 25 bp, Homo sapien
agaactccattctgccagtgagaga

SEQ ID NO: 446713 - DNA, 25 bp, Homo sapien
ccattctgccagtgagagacccggg

SEQ ID NO: 446714 - DNA, 25 bp, Homo sapien
ggcccagcagaaggccagactctga

SEQ ID NO: 446715 - DNA, 25 bp, Homo sapien
cagcagaaggccagactctgagagc

SEQ ID NO: 446716 - DNA, 25 bp, Homo sapien
gaaaacacaaccgaaccttccgcat

SEQ ID NO: 446717 - DNA, 25 bp, Homo sapien
tccgcattacaaacgaacccaaact

SEQ ID NO: 446718 - DNA, 25 bp, Homo sapien
caaactccaaggtgccccttaagcg

SEQ ID NO: 446719 - DNA, 25 bp, Homo sapien
aaggtgccccttaagcgcgagagaa

SEQ ID NO: 446720 - DNA, 25 bp, Homo sapien
ttaagcgcgagagaaccccaaaagt

SEQ ID NO: 446721 - DNA, 25 bp, Homo sapien
agcgcgagagaaccccaaaagtatc

SEQ ID NO: 446722 - DNA, 25 bp, Homo sapien
cccaagccccagaacattttgcaaa

SEQ ID NO: 446723 - DNA, 25 bp, Homo sapien
ttgcttctgtctctccgggagctcc

SEQ ID NO: 446724 - DNA, 25 bp, Homo sapien
agaaatcttccaaacccctcaggtg

SEQ ID NO: 446725 - DNA, 25 bp, Homo sapien
aaattctatgcccaacaaacactcc

SEQ ID NO: 446726 - DNA, 25 bp, Homo sapien
ttctatgcccaacaaacactccaaa

SEQ ID NO: 446727 - DNA, 25 bp, Homo sapien
aaagatggtttgtcctagaaggtct

SEQ ID NO: 446728 - DNA, 25 bp, Homo sapien
tattatgttctggaggaaacctagc

SEQ ID NO: 446729 - DNA, 25 bp, Homo sapien
tggaggaaacctagcaaaaactttg

SEQ ID NO: 446730 - DNA, 25 bp, Homo sapien
tttgctagtttagtacttgtctcta

SEQ ID NO: 446731 - DNA, 25 bp, Homo sapien
gtctctaaattgatgttcacccatt

SEQ ID NO: 446732 - DNA, 25 bp, Homo sapien
tgttcacccatttcaatattgcact

SEQ ID NO: 446733 - DNA, 25 bp, Homo sapien
ggtctttatttttctagcatagata

SEQ ID NO: 446734 - DNA, 25 bp, Homo sapien
ggaggtaattcttgctttctaaaga

SEQ ID NO: 446735 - DNA, 25 bp, Homo sapien
ggaaccattttattcaccagtggat

SEQ ID NO: 446736 - DNA, 25 bp, Homo sapien
accagtggatttacccttagagtat

SEQ ID NO: 446737 - DNA, 25 bp, Homo sapien
tttttagatctgagctgatgacttg

SEQ ID NO: 446738 - DNA, 25 bp, Homo sapien
gagccagggtttcccaacaagccct

SEQ ID NO: 446739 - DNA, 25 bp, Homo sapien
gggtttcccaacaagcccttctcat

SEQ ID NO: 446740 - DNA, 25 bp, Homo sapien
tgccgcgtctctctgttctgcgcat

SEQ ID NO: 446741 - DNA, 25 bp, Homo sapien
tgttctgcgcattcccagggaaagg

SEQ ID NO: 446742 - DNA, 25 bp, Homo sapien
ggtgcttaccttaggtccccagcct

SEQ ID NO: 446743 - DNA, 25 bp, Homo sapien
tgcaatgtccaggtgagggctccag

SEQ ID NO: 446744 - DNA, 25 bp, Homo sapien
aggtgagggctccagtgcctttcaa

SEQ ID NO: 446745 - DNA, 25 bp, Homo sapien
tggaacgaggacctcccccatgtaa

SEQ ID NO: 446746 - DNA, 25 bp, Homo sapien
atgtaacctttccctctagagccct

SEQ ID NO: 446747 - DNA, 25 bp, Homo sapien
gaggggggacattttgatccactta

SEQ ID NO: 446748 - DNA, 25 bp, Homo sapien
gatccacttaggaaagtctcttgtt

SEQ ID NO: 446749 - DNA, 25 bp, Homo sapien
aattgagtgcctctgtatgacagga

SEQ ID NO: 446750 - DNA, 25 bp, Homo sapien
tccctttaggagtttacatgcagca

SEQ ID NO: 446751 - DNA, 25 bp, Homo sapien
catgcagcaactgacgcacattcat

SEQ ID NO: 446752 - DNA, 25 bp, Homo sapien
agcaactgacgcacattcatgtaaa

SEQ ID NO: 446753 - DNA, 25 bp, Homo sapien
ggaaaaacagactccttgtggcaac

SEQ ID NO: 446754 - DNA, 25 bp, Homo sapien
acagactccttgtggcaacaagata

SEQ ID NO: 446755 - DNA, 25 bp, Homo sapien
attacaaacaagacctaaggccacg

SEQ ID NO: 446756 - DNA, 25 bp, Homo sapien
aagacctaaggccacgcaaggcaaa

SEQ ID NO: 446757 - DNA, 25 bp, Homo sapien
gccacgcaaggcaaaggtaaagtta

SEQ ID NO: 446758 - DNA, 25 bp, Homo sapien
taaagttacgccttagaattcataa

SEQ ID NO: 446759 - DNA, 25 bp, Homo sapien
aaaatctcgagaaacaggtctgttt

SEQ ID NO: 446760 - DNA, 25 bp, Homo sapien
gggccccaagttataacatactgtt

SEQ ID NO: 446761 - DNA, 25 bp, Homo sapien
ttttctctaatatgcttcttacaaa

SEQ ID NO: 446762 - DNA, 25 bp, Homo sapien
tagctgtgtggcattgaaattcaat

SEQ ID NO: 446763 - DNA, 25 bp, Homo sapien
tactaattttcctttgacatcaata

SEQ ID NO: 446764 - DNA, 25 bp, Homo sapien
gacatcaatagtaacgttacctcat

SEQ ID NO: 446765 - DNA, 25 bp, Homo sapien
atgtgtatcttttgaaattccgcag

SEQ ID NO: 446766 - DNA, 25 bp, Homo sapien
gtaacgttacctcataatttgatag

SEQ ID NO: 446767 - DNA, 25 bp, Homo sapien
ggaactaatgcccaagattctcaaa

SEQ ID NO: 446768 - DNA, 25 bp, Homo sapien
gaaattccgcagaatctctgcttct

SEQ ID NO: 446769 - DNA, 25 bp, Homo sapien
agaatctctgcttctcttgttttgc

SEQ ID NO: 446770 - DNA, 25 bp, Homo sapien
atgtcttagctaaaagggccccaag

SEQ ID NO: 446771 - DNA, 25 bp, Homo sapien
ggcaaaagattgtctcccattactt

SEQ ID NO: 446772 - DNA, 25 bp, Homo sapien
cttgcaaagatagaggctgttcact

SEQ ID NO: 446773 - DNA, 25 bp, Homo sapien
attgtctcccattacttcttatctg

SEQ ID NO: 446774 - DNA, 25 bp, Homo sapien
tcttatctgcttcactattgcataa

SEQ ID NO: 446775 - DNA, 25 bp, Homo sapien
gtggcatgttggaatgagccttatg

SEQ ID NO: 446776 - DNA, 25 bp, Homo sapien
gaatgagccttatgatccaagtaca

SEQ ID NO: 446777 - DNA, 25 bp, Homo sapien
gatccaagtacattattcccgaact

SEQ ID NO: 446778 - DNA, 25 bp, Homo sapien
aatactaatgcttagcttcagacaa

SEQ ID NO: 446779 - DNA, 25 bp, Homo sapien
gacaatactgatggatcaccaaaga

SEQ ID NO: 446780 - DNA, 25 bp, Homo sapien
actgcacagccatttcaacatggct

SEQ ID NO: 446781 - DNA, 25 bp, Homo sapien
aacatggcttacaaaagcctttctt

SEQ ID NO: 446782 - DNA, 25 bp, Homo sapien
tatagctgccacttgttaggtgctt

SEQ ID NO: 446783 - DNA, 25 bp, Homo sapien
tgttaggtgcttaccctttgccagg

SEQ ID NO: 446784 - DNA, 25 bp, Homo sapien
ggcactgttgtacattttgcacgca

SEQ ID NO: 446785 - DNA, 25 bp, Homo sapien
attttgcacgcattatctgaattta

SEQ ID NO: 446786 - DNA, 25 bp, Homo sapien
tttaatcctcatgagaggcgagtac

SEQ ID NO: 446787 - DNA, 25 bp, Homo sapien
aggcgagtacttatattatcttcac

SEQ ID NO: 446788 - DNA, 25 bp, Homo sapien
atcttcacttcagccctgaggaaat

SEQ ID NO: 446789 - DNA, 25 bp, Homo sapien
gaaattgaagcttgcaaggttaact

SEQ ID NO: 446790 - DNA, 25 bp, Homo sapien
gaagagactgtgacattctggtttt

SEQ ID NO: 446791 - DNA, 25 bp, Homo sapien
ggcaaaatctgtctacaatcacgga

SEQ ID NO: 446792 - DNA, 25 bp, Homo sapien
caatcacggatttccaaatacacaa

SEQ ID NO: 446793 - DNA, 25 bp, Homo sapien
gagggactgatacatgctaaagcat

SEQ ID NO: 446794 - DNA, 25 bp, Homo sapien
gagattgctaaaaaggagtttcctt

SEQ ID NO: 446795 - DNA, 25 bp, Homo sapien
aaggagtttccttctagggtgatga

SEQ ID NO: 446796 - DNA, 25 bp, Homo sapien
gcacaacatggtgaaggtactcaat

SEQ ID NO: 446797 - DNA, 25 bp, Homo sapien
gaaggtactcaatgtcactaatggt

SEQ ID NO: 446798 - DNA, 25 bp, Homo sapien
gtactcaatgtcactaatggtaaat

SEQ ID NO: 446799 - DNA, 25 bp, Homo sapien
ggatgagccttgagcgcatttttgc

SEQ ID NO: 446800 - DNA, 25 bp, Homo sapien
gagccttgagcgcatttttgccaag

SEQ ID NO: 446801 - DNA, 25 bp, Homo sapien
cttgagcgcatttttgccaagtgaa

SEQ ID NO: 446802 - DNA, 25 bp, Homo sapien
aggcagacacaaaaggcaacgtatt

SEQ ID NO: 446803 - DNA, 25 bp, Homo sapien
ggcaacgtattgcatgagtgcattt

SEQ ID NO: 446804 - DNA, 25 bp, Homo sapien
ggaaggcaagttttcctgcttccat

SEQ ID NO: 446805 - DNA, 25 bp, Homo sapien
ttcctgcttccatgacgatggagag

SEQ ID NO: 446806 - DNA, 25 bp, Homo sapien
cgatggagagcaggcatctcctttc

SEQ ID NO: 446807 - DNA, 25 bp, Homo sapien
gtttcagcttgcttctgacagggaa

SEQ ID NO: 446808 - DNA, 25 bp, Homo sapien
atggcagagaacgatcaccagcctg

SEQ ID NO: 446809 - DNA, 25 bp, Homo sapien
agagaacgatcaccagcctgagcct

SEQ ID NO: 446810 - DNA, 25 bp, Homo sapien
cagcctgagccttatttccaggtaa

SEQ ID NO: 446811 - DNA, 25 bp, Homo sapien
gccttatttccaggtaagtagctga

SEQ ID NO: 446812 - DNA, 25 bp, Homo sapien
aagtagctgaattagagttttgtct

SEQ ID NO: 446813 - DNA, 25 bp, Homo sapien
gattatgctgtacaactccttttct

SEQ ID NO: 446814 - DNA, 25 bp, Homo sapien
gctgtacaactccttttctgaagtt

SEQ ID NO: 446815 - DNA, 25 bp, Homo sapien
tgtgcaagctgcgaggatggcttgg

SEQ ID NO: 446816 - DNA, 25 bp, Homo sapien
atggcttgggccgaagggttgctct

SEQ ID NO: 446817 - DNA, 25 bp, Homo sapien
gaagggttgctctgcccgccgcgct

SEQ ID NO: 446818 - DNA, 25 bp, Homo sapien
gccgcgctagctgtgagctgagcaa

SEQ ID NO: 446819 - DNA, 25 bp, Homo sapien
ccgcgctagctgtgagctgagcaaa

SEQ ID NO: 446820 - DNA, 25 bp, Homo sapien
tagctgtgagctgagcaaagccctg

SEQ ID NO: 446821 - DNA, 25 bp, Homo sapien
acagcaccccaaaagcctgtggctt

SEQ ID NO: 446822 - DNA, 25 bp, Homo sapien
caccccaaaagcctgtggcttcagt

SEQ ID NO: 446823 - DNA, 25 bp, Homo sapien
tggcttcagtcctgcgtctgcacca

SEQ ID NO: 446824 - DNA, 25 bp, Homo sapien
gcacatttgatatagctctttttct

SEQ ID NO: 446825 - DNA, 25 bp, Homo sapien
acatttgatatagctctttttctgt

SEQ ID NO: 446826 - DNA, 25 bp, Homo sapien
gtttcctctgactttaacagtgaca

SEQ ID NO: 446827 - DNA, 25 bp, Homo sapien
gccattgccctcagtgaccactttg

SEQ ID NO: 446828 - DNA, 25 bp, Homo sapien
tcaagctcatttcctcgtacaacag

SEQ ID NO: 446829 - DNA, 25 bp, Homo sapien
aagctcatttcctcgtacaacagtg

SEQ ID NO: 446830 - DNA, 25 bp, Homo sapien
gctcatttcctcgtacaacagtgaa

SEQ ID NO: 446831 - DNA, 25 bp, Homo sapien
catttcctcgtacaacagtgaattt

SEQ ID NO: 446832 - DNA, 25 bp, Homo sapien
caacagggtggtggcccatatggcc

SEQ ID NO: 446833 - DNA, 25 bp, Homo sapien
gggtggtggcccatatggcctccaa

SEQ ID NO: 446834 - DNA, 25 bp, Homo sapien
ggtggcccatatggcctccaaggag

SEQ ID NO: 446835 - DNA, 25 bp, Homo sapien
tccaaggagtaagactgctcgacaa

SEQ ID NO: 446836 - DNA, 25 bp, Homo sapien
gagtaagactgctcgacaaccagcc

SEQ ID NO: 446837 - DNA, 25 bp, Homo sapien
gcgttacccctgtggctaaagagat

SEQ ID NO: 446838 - DNA, 25 bp, Homo sapien
agagaagggtctttgcattctcctt

SEQ ID NO: 446839 - DNA, 25 bp, Homo sapien
tttgcattctccttctgcagatctg

SEQ ID NO: 446840 - DNA, 25 bp, Homo sapien
tgcagatctgcatgtctctggattt

SEQ ID NO: 446841 - DNA, 25 bp, Homo sapien
ggatttgtaagccagtgtgacctat

SEQ ID NO: 446842 - DNA, 25 bp, Homo sapien
taagccagtgtgacctatcaggaat

SEQ ID NO: 446843 - DNA, 25 bp, Homo sapien
aggaatcacttatcttccgggagcc

SEQ ID NO: 446844 - DNA, 25 bp, Homo sapien
tcttccgggagcctcagttatccat

SEQ ID NO: 446845 - DNA, 25 bp, Homo sapien
gatgtgatcttcagggccctttatc

SEQ ID NO: 446846 - DNA, 25 bp, Homo sapien
cttcagggccctttatccataataa

SEQ ID NO: 446847 - DNA, 25 bp, Homo sapien
cataataatccatgctctacagtgc

SEQ ID NO: 446848 - DNA, 25 bp, Homo sapien
atgtcatttaccatggttttcccac

SEQ ID NO: 446849 - DNA, 25 bp, Homo sapien
catggttttcccactgaaggcttta

SEQ ID NO: 446850 - DNA, 25 bp, Homo sapien
cccactgaaggctttaacttttctg

SEQ ID NO: 446851 - DNA, 25 bp, Homo sapien
ttttcaaaaacccattcctgaggag

SEQ ID NO: 446852 - DNA, 25 bp, Homo sapien
gaggagaactacttctagcattcct

SEQ ID NO: 446853 - DNA, 25 bp, Homo sapien
gcattccttttcatgatgtgctttt

SEQ ID NO: 446854 - DNA, 25 bp, Homo sapien
gatgtgcttttgtgcagtaagtagc

SEQ ID NO: 446855 - DNA, 25 bp, Homo sapien
gcattttcggctacttaactttaca

SEQ ID NO: 446856 - DNA, 25 bp, Homo sapien
ggctacttaactttacattcctctt

SEQ ID NO: 446857 - DNA, 25 bp, Homo sapien
tatttttcagtttccagtcaagatt

SEQ ID NO: 446858 - DNA, 25 bp, Homo sapien
agagttgtgcctacctttaatggaa

SEQ ID NO: 446859 - DNA, 25 bp, Homo sapien
agagctgatcaccatttgagatacg

SEQ ID NO: 446860 - DNA, 25 bp, Homo sapien
gatcaccatttgagatacgcggctt

SEQ ID NO: 446861 - DNA, 25 bp, Homo sapien
caccatttgagatacgcggcttaac

SEQ ID NO: 446862 - DNA, 25 bp, Homo sapien
gagatacgcggcttaacgcacatgt

SEQ ID NO: 446863 - DNA, 25 bp, Homo sapien
gcggcttaacgcacatgtgagtgta

SEQ ID NO: 446864 - DNA, 25 bp, Homo sapien
gcacatgtgagtgtagcttgctaca

SEQ ID NO: 446865 - DNA, 25 bp, Homo sapien
gctacatgaaaatgctaggctctag

SEQ ID NO: 446866 - DNA, 25 bp, Homo sapien
aggctctagggcatgtaaaacatga

SEQ ID NO: 446867 - DNA, 25 bp, Homo sapien
ctagattgttctaagtaatgtcatt

SEQ ID NO: 446868 - DNA, 25 bp, Homo sapien
agtaatgtcatttcggtttgtgaat

SEQ ID NO: 446869 - DNA, 25 bp, Homo sapien
gtcatttcggtttgtgaatttgatt

SEQ ID NO: 446870 - DNA, 25 bp, Homo sapien
cacaaaaatttagtctgctggctga

SEQ ID NO: 446871 - DNA, 25 bp, Homo sapien
aatttagtctgctggctgactggaa

SEQ ID NO: 446872 - DNA, 25 bp, Homo sapien
aatatgatgaattccaacacaatgg

SEQ ID NO: 446873 - DNA, 25 bp, Homo sapien
gggcaccaaggcctttaggcctctc

SEQ ID NO: 446874 - DNA, 25 bp, Homo sapien
tttaggcctctctttttattttgct

SEQ ID NO: 446875 - DNA, 25 bp, Homo sapien
agagacatgctctttctcatgggac

SEQ ID NO: 446876 - DNA, 25 bp, Homo sapien
atgctctttctcatgggacttgaag

SEQ ID NO: 446877 - DNA, 25 bp, Homo sapien
ggacttgaagtggactcatctttgt

SEQ ID NO: 446878 - DNA, 25 bp, Homo sapien
tgcagtgctggttttgccatactca

SEQ ID NO: 446879 - DNA, 25 bp, Homo sapien
gtggcctttttcattcttgttactt

SEQ ID NO: 446880 - DNA, 25 bp, Homo sapien
cattcttgttacttgtgatgcaatt

SEQ ID NO: 446881 - DNA, 25 bp, Homo sapien
taaacagttacaccttgttttcaat

SEQ ID NO: 446882 - DNA, 25 bp, Homo sapien
gttttcaatgtgtggctgagtgcct

SEQ ID NO: 446883 - DNA, 25 bp, Homo sapien
gtggctgagtgcctcgattttttca

SEQ ID NO: 446884 - DNA, 25 bp, Homo sapien
gtgcctcgattttttcatgtttttg

SEQ ID NO: 446885 - DNA, 25 bp, Homo sapien
catgtttttggtgtatttctgattt

SEQ ID NO: 446886 - DNA, 25 bp, Homo sapien
gtagaagtgtccaaacaggttgtgt

SEQ ID NO: 446887 - DNA, 25 bp, Homo sapien
aggttgtgtgctggagttccttcaa

SEQ ID NO: 446888 - DNA, 25 bp, Homo sapien
gtgctggagttccttcaagacaaaa

SEQ ID NO: 446889 - DNA, 25 bp, Homo sapien
aacaaacccagcttggtcaaggcca

SEQ ID NO: 446890 - DNA, 25 bp, Homo sapien
ttggtcaaggccattacctgtttcc

SEQ ID NO: 446891 - DNA, 25 bp, Homo sapien
ttacctgtttcccatctgtagttat

SEQ ID NO: 446892 - DNA, 25 bp, Homo sapien
aagtctacagcataaacatctttag

SEQ ID NO: 446893 - DNA, 25 bp, Homo sapien
gtctacagcataaacatctttaggc

SEQ ID NO: 446894 - DNA, 25 bp, Homo sapien
tacagcataaacatctttaggcatg

SEQ ID NO: 446895 - DNA, 25 bp, Homo sapien
cataaacatctttaggcatgcataa

SEQ ID NO: 446896 - DNA, 25 bp, Homo sapien
cctggtgcagtgacttgcgctataa

SEQ ID NO: 446897 - DNA, 25 bp, Homo sapien
ctggtgcagtgacttgcgctataat

SEQ ID NO: 446898 - DNA, 25 bp, Homo sapien
tgcagtgacttgcgctataatccca

SEQ ID NO: 446899 - DNA, 25 bp, Homo sapien
agaccagagtgaccaacactgtgaa

SEQ ID NO: 446900 - DNA, 25 bp, Homo sapien
gaccagagtgaccaacactgtgaaa

SEQ ID NO: 446901 - DNA, 25 bp, Homo sapien
ccagagtgaccaacactgtgaaacc

SEQ ID NO: 446902 - DNA, 25 bp, Homo sapien
aatcccacctcactcggaggctgag

SEQ ID NO: 446903 - DNA, 25 bp, Homo sapien
ttttttgcagatgtttccatacaat

SEQ ID NO: 446904 - DNA, 25 bp, Homo sapien
ttttgcagatgtttccatacaattc

SEQ ID NO: 446905 - DNA, 25 bp, Homo sapien
gcagatgtttccatacaattcacat

SEQ ID NO: 446906 - DNA, 25 bp, Homo sapien
gatgtttccatacaattcacataac

SEQ ID NO: 446907 - DNA, 25 bp, Homo sapien
gtttccatacaattcacataacctt

SEQ ID NO: 446908 - DNA, 25 bp, Homo sapien
tttccatacaattcacataaccttt

SEQ ID NO: 446909 - DNA, 25 bp, Homo sapien
tccatacaattcacataaccttttt

SEQ ID NO: 446910 - DNA, 25 bp, Homo sapien
attcacataacctttttgtaaagag

SEQ ID NO: 446911 - DNA, 25 bp, Homo sapien
cacataacctttttgtaaagagaga

SEQ ID NO: 446912 - DNA, 25 bp, Homo sapien
taccactttcatttaagccttatcc

SEQ ID NO: 446913 - DNA, 25 bp, Homo sapien
accactttcatttaagccttatcct

SEQ ID NO: 446914 - DNA, 25 bp, Homo sapien
gtttttggtgtatttctgatttgta

SEQ ID NO: 446915 - DNA, 25 bp, Homo sapien
ttctgatttgtagaagtgtccaaac

SEQ ID NO: 446916 - DNA, 25 bp, Homo sapien
tagaagtgtccaaacaggttgtgtg

SEQ ID NO: 446917 - DNA, 25 bp, Homo sapien
aggttgtgtgctggagttccttcaa

SEQ ID NO: 446918 - DNA, 25 bp, Homo sapien
tgtgtgctggagttccttcaagaca

SEQ ID NO: 446919 - DNA, 25 bp, Homo sapien
gtgctggagttccttcaagacaaaa

SEQ ID NO: 446920 - DNA, 25 bp, Homo sapien
aaacccagcttggtcaaggccatta

SEQ ID NO: 446921 - DNA, 25 bp, Homo sapien
ccagcttggtcaaggccattacctg

SEQ ID NO: 446922 - DNA, 25 bp, Homo sapien
aaggccattacctgtttcccatctg

SEQ ID NO: 446923 - DNA, 25 bp, Homo sapien
ttacctgtttcccatctgtagttat

SEQ ID NO: 446924 - DNA, 25 bp, Homo sapien
tcccatctgtagttattcgatgaag

SEQ ID NO: 446925 - DNA, 25 bp, Homo sapien
aagagcacagttcacatgaggaaaa

SEQ ID NO: 446926 - DNA, 25 bp, Homo sapien
ttcacatgaggaaaacgcccagcgt

SEQ ID NO: 446927 - DNA, 25 bp, Homo sapien
aggaaaacgcccagcgtgtcgctca

SEQ ID NO: 446928 - DNA, 25 bp, Homo sapien
tcacttccgtgcacccggatttaat

SEQ ID NO: 446929 - DNA, 25 bp, Homo sapien
gtgcacccggatttaatgaagattc

SEQ ID NO: 446930 - DNA, 25 bp, Homo sapien
gaagattctcggtgacatcaacagt

SEQ ID NO: 446931 - DNA, 25 bp, Homo sapien
ttctcggtgacatcaacagtgactt

SEQ ID NO: 446932 - DNA, 25 bp, Homo sapien
caacagtgactttaccagagtggat

SEQ ID NO: 446933 - DNA, 25 bp, Homo sapien
gaggtcaagaaactttgtgcaacgc

SEQ ID NO: 446934 - DNA, 25 bp, Homo sapien
gaaactttgtgcaacgcagttcaac

SEQ ID NO: 446935 - DNA, 25 bp, Homo sapien
acgcagttcaacaacatcttcttct

SEQ ID NO: 446936 - DNA, 25 bp, Homo sapien
gaggaagcgtaaggctgaggccgcg

SEQ ID NO: 446937 - DNA, 25 bp, Homo sapien
gcggtggtcgccgtagccgagaagc

SEQ ID NO: 446938 - DNA, 25 bp, Homo sapien
ccgtagccgagaagcgagagaagct

SEQ ID NO: 446939 - DNA, 25 bp, Homo sapien
aagcgagagaagctggcgaacggcg

SEQ ID NO: 446940 - DNA, 25 bp, Homo sapien
ggaggcgaccgttgttatcgagcat

SEQ ID NO: 446941 - DNA, 25 bp, Homo sapien
tatcgagcattgcactagctgacgc

SEQ ID NO: 446942 - DNA, 25 bp, Homo sapien
tagctgacgcgtctatgggcgcaac

SEQ ID NO: 446943 - DNA, 25 bp, Homo sapien
tgacgcgtctatgggcgcaacgccg

SEQ ID NO: 446944 - DNA, 25 bp, Homo sapien
ccccagagcttccagtaaaggtgaa

SEQ ID NO: 446945 - DNA, 25 bp, Homo sapien
tccagtaaaggtgaacccgacgaag

SEQ ID NO: 446946 - DNA, 25 bp, Homo sapien
agcttcgaggtgacgctgctgcgcc

SEQ ID NO: 446947 - DNA, 25 bp, Homo sapien
ttcctcaccctgcagtagcagggtg

SEQ ID NO: 446948 - DNA, 25 bp, Homo sapien
tagcagggtggcagcggcggtctcc

SEQ ID NO: 446949 - DNA, 25 bp, Homo sapien
tgctggtgaagctgctcacaggcag

SEQ ID NO: 446950 - DNA, 25 bp, Homo sapien
tggtgaagctgctcacaggcagccc

SEQ ID NO: 446951 - DNA, 25 bp, Homo sapien
tgcttctcttgaatcttcttcatct

SEQ ID NO: 446952 - DNA, 25 bp, Homo sapien
ttcttcatctcctccgagtacttgc

SEQ ID NO: 446953 - DNA, 25 bp, Homo sapien
gagtacttgcagaaggtgtgtccga

SEQ ID NO: 446954 - DNA, 25 bp, Homo sapien
gaaggtgtgtccgaacttggcccac

SEQ ID NO: 446955 - DNA, 25 bp, Homo sapien
aacttggcccacaccttgtagggca

SEQ ID NO: 446956 - DNA, 25 bp, Homo sapien
ccacaccttgtagggcacggtgatg

SEQ ID NO: 446957 - DNA, 25 bp, Homo sapien
gatggagttgcgataggtgggcttc

SEQ ID NO: 446958 - DNA, 25 bp, Homo sapien
aaaaggctattacatcagagacagt

SEQ ID NO: 446959 - DNA, 25 bp, Homo sapien
gagacagtggcaacaattcaggaga

SEQ ID NO: 446960 - DNA, 25 bp, Homo sapien
aattcaggagaccaggcgacagaag

SEQ ID NO: 446961 - DNA, 25 bp, Homo sapien
aggtggttattcctgtggtactgca

SEQ ID NO: 446962 - DNA, 25 bp, Homo sapien
tattcctgtggtactgcagaatcac

SEQ ID NO: 446963 - DNA, 25 bp, Homo sapien
ggtactgcagaatcacatgacagca

SEQ ID NO: 446964 - DNA, 25 bp, Homo sapien
acatgacagcaaaggcataggcctg

SEQ ID NO: 446965 - DNA, 25 bp, Homo sapien
ataggcctggatgaaagtgaacttg

SEQ ID NO: 446966 - DNA, 25 bp, Homo sapien
agtgaacttgattctgaggctgaac

SEQ ID NO: 446967 - DNA, 25 bp, Homo sapien
ctcatgagaagtatgggattgccac

SEQ ID NO: 446968 - DNA, 25 bp, Homo sapien
gggattgccacttcaatttggtagg

SEQ ID NO: 446969 - DNA, 25 bp, Homo sapien
gaccatggggcccacaaacctaatc

SEQ ID NO: 446970 - DNA, 25 bp, Homo sapien
accatggggcccacaaacctaatca

SEQ ID NO: 446971 - DNA, 25 bp, Homo sapien
ccatggggcccacaaacctaatcag

SEQ ID NO: 446972 - DNA, 25 bp, Homo sapien
catggggcccacaaacctaatcaga

SEQ ID NO: 446973 - DNA, 25 bp, Homo sapien
atggggcccacaaacctaatcagag

SEQ ID NO: 446974 - DNA, 25 bp, Homo sapien
tggggcccacaaacctaatcagagt

SEQ ID NO: 446975 - DNA, 25 bp, Homo sapien
ggggcccacaaacctaatcagagta

SEQ ID NO: 446976 - DNA, 25 bp, Homo sapien
gggcccacaaacctaatcagagtaa

SEQ ID NO: 446977 - DNA, 25 bp, Homo sapien
ggcccacaaacctaatcagagtaac

SEQ ID NO: 446978 - DNA, 25 bp, Homo sapien
gagagtgcagccatcgggtagcaat

SEQ ID NO: 446979 - DNA, 25 bp, Homo sapien
aggaacggatataattgtctctgtt

SEQ ID NO: 446980 - DNA, 25 bp, Homo sapien
gtctctgttcagacagtcgagctgg

SEQ ID NO: 446981 - DNA, 25 bp, Homo sapien
agctgggagacagggctcttattgc

SEQ ID NO: 446982 - DNA, 25 bp, Homo sapien
tattgccagggtggctgatgtccca

SEQ ID NO: 446983 - DNA, 25 bp, Homo sapien
gctgatgtcccagaccttgacgcag

SEQ ID NO: 446984 - DNA, 25 bp, Homo sapien
ccgcctgtgtacacgtgtctcgtgg

SEQ ID NO: 446985 - DNA, 25 bp, Homo sapien
gaggacgtcagctccgccttgatgc

SEQ ID NO: 446986 - DNA, 25 bp, Homo sapien
ttggagccgccaggtcccaaatgga

SEQ ID NO: 446987 - DNA, 25 bp, Homo sapien
aatggacaaagtactggcttcccct

SEQ ID NO: 446988 - DNA, 25 bp, Homo sapien
ttcccctcccactatgagagtgcag

SEQ ID NO: 446989 - DNA, 25 bp, Homo sapien
actagctgacgcgtctatgggcgca

SEQ ID NO: 446990 - DNA, 25 bp, Homo sapien
ctagctgacgcgtctatgggcgcaa

SEQ ID NO: 446991 - DNA, 25 bp, Homo sapien
tagctgacgcgtctatgggcgcaac

SEQ ID NO: 446992 - DNA, 25 bp, Homo sapien
agctgacgcgtctatgggcgcaacg

SEQ ID NO: 446993 - DNA, 25 bp, Homo sapien
gctgacgcgtctatgggcgcaacgc

SEQ ID NO: 446994 - DNA, 25 bp, Homo sapien
ctgacgcgtctatgggcgcaacgcc

SEQ ID NO: 446995 - DNA, 25 bp, Homo sapien
tgacgcgtctatgggcgcaacgccg

SEQ ID NO: 446996 - DNA, 25 bp, Homo sapien
gacgcgtctatgggcgcaacgccgc

SEQ ID NO: 446997 - DNA, 25 bp, Homo sapien
gaaatctgtttaaactaccttgtct

SEQ ID NO: 446998 - DNA, 25 bp, Homo sapien
taaactaccttgtctttatacaact

SEQ ID NO: 446999 - DNA, 25 bp, Homo sapien
gtctttatacaactaccaacaggag

SEQ ID NO: 447000 - DNA, 25 bp, Homo sapien
caggaggattggtaatttgggctct

SEQ ID NO: 447001 - DNA, 25 bp, Homo sapien
ttgggctctgggtgagacatacata

SEQ ID NO: 447002 - DNA, 25 bp, Homo sapien
gacatacataggttcagtttccatg

SEQ ID NO: 447003 - DNA, 25 bp, Homo sapien
agtttccatgtctgcagctgaatgc

SEQ ID NO: 447004 - DNA, 25 bp, Homo sapien
gtctgcagctgaatgcatgacaggg

SEQ ID NO: 447005 - DNA, 25 bp, Homo sapien
gtttcttcacgtgcaaaatgtaatt

SEQ ID NO: 447006 - DNA, 25 bp, Homo sapien
gtaattaacacaacctacctcatgg

SEQ ID NO: 447007 - DNA, 25 bp, Homo sapien
gtaggatacctacacatagtaagct

SEQ ID NO: 447008 - DNA, 25 bp, Homo sapien
aagcattaagttgcacttttttgag

SEQ ID NO: 447009 - DNA, 25 bp, Homo sapien
ggtagtgcagtatttctctggccag

SEQ ID NO: 447010 - DNA, 25 bp, Homo sapien
gcagtatttctctggccagtatgaa

SEQ ID NO: 447011 - DNA, 25 bp, Homo sapien
tctctggccagtatgaatgaagttt

SEQ ID NO: 447012 - DNA, 25 bp, Homo sapien
gaagtttatacttaccatatttgat

SEQ ID NO: 447013 - DNA, 25 bp, Homo sapien
tagatcaagctatggcacagcgact

SEQ ID NO: 447014 - DNA, 25 bp, Homo sapien
tatggcacagcgactcatcagatag

SEQ ID NO: 447015 - DNA, 25 bp, Homo sapien
gcgactcatcagatagctagctttg

SEQ ID NO: 447016 - DNA, 25 bp, Homo sapien
catcagatagctagctttgacgtct

SEQ ID NO: 447017 - DNA, 25 bp, Homo sapien
gactttggtgtatagtgcagtaaac

SEQ ID NO: 447018 - DNA, 25 bp, Homo sapien
tttctatttttacagccacacaatt

SEQ ID NO: 447019 - DNA, 25 bp, Homo sapien
gataggtcccagtttaacactgaat

SEQ ID NO: 447020 - DNA, 25 bp, Homo sapien
aacactgaattgcttgacttctgtg

SEQ ID NO: 447021 - DNA, 25 bp, Homo sapien
aattgcttgacttctgtggcttttc

SEQ ID NO: 447022 - DNA, 25 bp, Homo sapien
ggcttttctttttctggccacattt

SEQ ID NO: 447023 - DNA, 25 bp, Homo sapien
agcaatttttgtatgccttgttatt

SEQ ID NO: 447024 - DNA, 25 bp, Homo sapien
atgccttgttatttcatttccatag

SEQ ID NO: 447025 - DNA, 25 bp, Homo sapien
tgtttatgtaagctggaatcatcct

SEQ ID NO: 447026 - DNA, 25 bp, Homo sapien
catcctcagttttttgctgataatt

SEQ ID NO: 447027 - DNA, 25 bp, Homo sapien
gtaaaatacactaactcttagggtg

SEQ ID NO: 447028 - DNA, 25 bp, Homo sapien
ctcttagggtgttgtagtagctgaa

SEQ ID NO: 447029 - DNA, 25 bp, Homo sapien
aaacatggagatgcgtagctgtcat

SEQ ID NO: 447030 - DNA, 25 bp, Homo sapien
attgttattggcttccataatcccc

SEQ ID NO: 447031 - DNA, 25 bp, Homo sapien
atgtcatctgacctcggattagacc

SEQ ID NO: 447032 - DNA, 25 bp, Homo sapien
gattagacccagtctgccagtctga

SEQ ID NO: 447033 - DNA, 25 bp, Homo sapien
tacctgttgaatttcctgtggatcc

SEQ ID NO: 447034 - DNA, 25 bp, Homo sapien
gatcccctctgttgttctttattag

SEQ ID NO: 447035 - DNA, 25 bp, Homo sapien
gttctttattagctccataatccag

SEQ ID NO: 447036 - DNA, 25 bp, Homo sapien
ttagctccataatccagctggatgt

SEQ ID NO: 447037 - DNA, 25 bp, Homo sapien
cagctggatgttactggttacagtt

SEQ ID NO: 447038 - DNA, 25 bp, Homo sapien
actggttacagtttggctaatgatc

SEQ ID NO: 447039 - DNA, 25 bp, Homo sapien
gaaaggattccttattggcgggcaa

SEQ ID NO: 447040 - DNA, 25 bp, Homo sapien
aatttttgttgagtggtacagccag

SEQ ID NO: 447041 - DNA, 25 bp, Homo sapien
atctctggatgccacagacctgagc

SEQ ID NO: 447042 - DNA, 25 bp, Homo sapien
cattgggctggctgtccgctgctga

SEQ ID NO: 447043 - DNA, 25 bp, Homo sapien
gctgtccgctgctgactggatggca

SEQ ID NO: 447044 - DNA, 25 bp, Homo sapien
cgctgctgactggatggcagcacaa

SEQ ID NO: 447045 - DNA, 25 bp, Homo sapien
aggctgcgggccacagtccagcagc

SEQ ID NO: 447046 - DNA, 25 bp, Homo sapien
gggccacagtccagcagcgccagaa

SEQ ID NO: 447047 - DNA, 25 bp, Homo sapien
agcagcgccagaagcactcatttct

SEQ ID NO: 447048 - DNA, 25 bp, Homo sapien
gaagcactcatttctgaccaccagg

SEQ ID NO: 447049 - DNA, 25 bp, Homo sapien
tctgctcagatacattgagtggcga

SEQ ID NO: 447050 - DNA, 25 bp, Homo sapien
cagatacattgagtggcgattttta

SEQ ID NO: 447051 - DNA, 25 bp, Homo sapien
attgagtggcgatttttagttttgt

SEQ ID NO: 447052 - DNA, 25 bp, Homo sapien
aaaccatgtgtatttgttccctccg

SEQ ID NO: 447053 - DNA, 25 bp, Homo sapien
tgttccctccgtatgttaaagattt

SEQ ID NO: 447054 - DNA, 25 bp, Homo sapien
gatttccttttagtggtacattctg

SEQ ID NO: 447055 - DNA, 25 bp, Homo sapien
gtggtacattctgcactcattttgt

SEQ ID NO: 447056 - DNA, 25 bp, Homo sapien
gcactcattttgtatagtctaccaa

SEQ ID NO: 447057 - DNA, 25 bp, Homo sapien
atagtctaccaaggcgggtatccct

SEQ ID NO: 447058 - DNA, 25 bp, Homo sapien
ggcgggtatccctaggaacaatatt

SEQ ID NO: 447059 - DNA, 25 bp, Homo sapien
ggaagcaggtatactctgatcacat

SEQ ID NO: 447060 - DNA, 25 bp, Homo sapien
gatcacattcaggataagtgtacag

SEQ ID NO: 447061 - DNA, 25 bp, Homo sapien
tactctttagggaactggaaacact

SEQ ID NO: 447062 - DNA, 25 bp, Homo sapien
gaaacactccctgcattgatgtaca

SEQ ID NO: 447063 - DNA, 25 bp, Homo sapien
agtcggcttgactacactgtgtgga

SEQ ID NO: 447064 - DNA, 25 bp, Homo sapien
gtcggcttgactacactgtgtggag

SEQ ID NO: 447065 - DNA, 25 bp, Homo sapien
tcggcttgactacactgtgtggagc

SEQ ID NO: 447066 - DNA, 25 bp, Homo sapien
cggcttgactacactgtgtggagca

SEQ ID NO: 447067 - DNA, 25 bp, Homo sapien
ggcttgactacactgtgtggagcaa

SEQ ID NO: 447068 - DNA, 25 bp, Homo sapien
gcttgactacactgtgtggagcaag

SEQ ID NO: 447069 - DNA, 25 bp, Homo sapien
gactacactgtgtggagcaagtttt

SEQ ID NO: 447070 - DNA, 25 bp, Homo sapien
actacactgtgtggagcaagtttta

SEQ ID NO: 447071 - DNA, 25 bp, Homo sapien
ctacactgtgtggagcaagttttaa

SEQ ID NO: 447072 - DNA, 25 bp, Homo sapien
tacactgtgtggagcaagttttaaa

SEQ ID NO: 447073 - DNA, 25 bp, Homo sapien
cactgtgtggagcaagttttaaaga

SEQ ID NO: 447074 - DNA, 25 bp, Homo sapien
ggcaagtccttcatccgtcctgtgc

SEQ ID NO: 447075 - DNA, 25 bp, Homo sapien
cactgtcctcatctgaacaatggta

SEQ ID NO: 447076 - DNA, 25 bp, Homo sapien
aatggtatgatgacacctgccctct

SEQ ID NO: 447077 - DNA, 25 bp, Homo sapien
tgccctctctttcaatcatgctttg

SEQ ID NO: 447078 - DNA, 25 bp, Homo sapien
ttcaatcatgctttgaggatacagt

SEQ ID NO: 447079 - DNA, 25 bp, Homo sapien
cagtgaaccttcaatgagtagaatg

SEQ ID NO: 447080 - DNA, 25 bp, Homo sapien
tgggttgtagtagatggtgctccct

SEQ ID NO: 447081 - DNA, 25 bp, Homo sapien
ctctgttttcctcaatttgggaaca

SEQ ID NO: 447082 - DNA, 25 bp, Homo sapien
tcacggtgcagtacttttctaccaa

SEQ ID NO: 447083 - DNA, 25 bp, Homo sapien
tttctaccaaagtgtgcccactggt

SEQ ID NO: 447084 - DNA, 25 bp, Homo sapien
tgtgcccactggtgtcacctcctaa

SEQ ID NO: 447085 - DNA, 25 bp, Homo sapien
gagaccaatgaatctttagacagta

SEQ ID NO: 447086 - DNA, 25 bp, Homo sapien
gaatctttagacagtaataatttcc

SEQ ID NO: 447087 - DNA, 25 bp, Homo sapien
aatattcaccttctcggactccctg

SEQ ID NO: 447088 - DNA, 25 bp, Homo sapien
accaggcatggccatgtaatcctac

SEQ ID NO: 447089 - DNA, 25 bp, Homo sapien
gcatggccatgtaatcctacagcac

SEQ ID NO: 447090 - DNA, 25 bp, Homo sapien
gagaagacatcttgctgctatttga

SEQ ID NO: 447091 - DNA, 25 bp, Homo sapien
gaagacatcttgctgctatttgaca

SEQ ID NO: 447092 - DNA, 25 bp, Homo sapien
gcaagaagataaaagctttcctata

SEQ ID NO: 447093 - DNA, 25 bp, Homo sapien
agctttcctataaagatgatggagc

SEQ ID NO: 447094 - DNA, 25 bp, Homo sapien
aatactgggtggattacacagcatc

SEQ ID NO: 447095 - DNA, 25 bp, Homo sapien
gggtggattacacagcatcctgaga

SEQ ID NO: 447096 - DNA, 25 bp, Homo sapien
aggcctatgcctttgctgtcatgtg

SEQ ID NO: 447097 - DNA, 25 bp, Homo sapien
gctgtcatgtgattctgcagtacca

SEQ ID NO: 447098 - DNA, 25 bp, Homo sapien
tgtcgcctggtctcctgaattgttg

SEQ ID NO: 447099 - DNA, 25 bp, Homo sapien
tgaattgttgccactgtctctgatg

SEQ ID NO: 447100 - DNA, 25 bp, Homo sapien
ctgtctctgatgtaatagcctttta

SEQ ID NO: 447101 - DNA, 25 bp, Homo sapien
tgtacaattttcgatcctccacaaa

SEQ ID NO: 447102 - DNA, 25 bp, Homo sapien
aggcacagtatcttacaatcctccc

SEQ ID NO: 447103 - DNA, 25 bp, Homo sapien
aagtggcaatcccatacttctcatg

SEQ ID NO: 447104 - DNA, 25 bp, Homo sapien
atacttctcatgagttcagcctcag

SEQ ID NO: 447105 - DNA, 25 bp, Homo sapien
ttcagcctcagaatcaagttcactt

SEQ ID NO: 447106 - DNA, 25 bp, Homo sapien
aagttcactttcatccaggcctatg

SEQ ID NO: 447107 - DNA, 25 bp, Homo sapien
aaaacgtcttcctataagaatgtag

SEQ ID NO: 447108 - DNA, 25 bp, Homo sapien
aagaatgtagatatcagactggtga

SEQ ID NO: 447109 - DNA, 25 bp, Homo sapien
gattttcgtggaggtgatttttcaa

SEQ ID NO: 447110 - DNA, 25 bp, Homo sapien
ggtttagttactgatgttggttcct

SEQ ID NO: 447111 - DNA, 25 bp, Homo sapien
gttactgatgttggttcctgtgtta

SEQ ID NO: 447112 - DNA, 25 bp, Homo sapien
agtcattcatcattttctagaaaat

SEQ ID NO: 447113 - DNA, 25 bp, Homo sapien
gttggttcctgtgttatttctggta

SEQ ID NO: 447114 - DNA, 25 bp, Homo sapien
gttcctgtgttatttctggtagatg

SEQ ID NO: 447115 - DNA, 25 bp, Homo sapien
gattggcattttgattggaatccct

SEQ ID NO: 447116 - DNA, 25 bp, Homo sapien
tttgattggaatcccttggaattca

SEQ ID NO: 447117 - DNA, 25 bp, Homo sapien
agttagagttgactactgtaggcta

SEQ ID NO: 447118 - DNA, 25 bp, Homo sapien
gagggaccattttggtccacatcga

SEQ ID NO: 447119 - DNA, 25 bp, Homo sapien
actggcccatctcttacacaggctg

SEQ ID NO: 447120 - DNA, 25 bp, Homo sapien
atctcttacacaggctgaccgattt

SEQ ID NO: 447121 - DNA, 25 bp, Homo sapien
tgaccgatttctcctggtgttcaga

SEQ ID NO: 447122 - DNA, 25 bp, Homo sapien
tctcctggtgttcagagtctgtttt

SEQ ID NO: 447123 - DNA, 25 bp, Homo sapien
agtctgtttttgtctagcaccattt

SEQ ID NO: 447124 - DNA, 25 bp, Homo sapien
tttgtctagcaccatttgaaatcgg

SEQ ID NO: 447125 - DNA, 25 bp, Homo sapien
gcaccatttgaaatcggttatgatg

SEQ ID NO: 447126 - DNA, 25 bp, Homo sapien
gggaaaagcagcagcctcgaagcct

SEQ ID NO: 447127 - DNA, 25 bp, Homo sapien
aaagcagcagcctcgaagcctcatg

SEQ ID NO: 447128 - DNA, 25 bp, Homo sapien
gaagcctcatgccaactctgggcag

SEQ ID NO: 447129 - DNA, 25 bp, Homo sapien
gaacaatctgagtatgatctgtcct

SEQ ID NO: 447130 - DNA, 25 bp, Homo sapien
gagtatgatctgtcctcagggtatc

SEQ ID NO: 447131 - DNA, 25 bp, Homo sapien
ctgtcctcagggtatctttatatcc

SEQ ID NO: 447132 - DNA, 25 bp, Homo sapien
cctcagggtatctttatatcctttc

SEQ ID NO: 447133 - DNA, 25 bp, Homo sapien
gaattctgacagcaaaactacttta

SEQ ID NO: 447134 - DNA, 25 bp, Homo sapien
tgccgcaatggttcttgctctcaat

SEQ ID NO: 447135 - DNA, 25 bp, Homo sapien
aatggttcttgctctcaatgtttag

SEQ ID NO: 447136 - DNA, 25 bp, Homo sapien
gttcttgctctcaatgtttagtaga

SEQ ID NO: 447137 - DNA, 25 bp, Homo sapien
agagaaattaagagccacattcaaa

SEQ ID NO: 447138 - DNA, 25 bp, Homo sapien
tgccaaggtaacagattgtacaact

SEQ ID NO: 447139 - DNA, 25 bp, Homo sapien
gtacaacttgagatgaattcatgtt

SEQ ID NO: 447140 - DNA, 25 bp, Homo sapien
tatggtacagtaacaacctaactcc

SEQ ID NO: 447141 - DNA, 25 bp, Homo sapien
cctaactcccttctacctgatgtaa

SEQ ID NO: 447142 - DNA, 25 bp, Homo sapien
aatactgtgtttttaggttgaatca

SEQ ID NO: 447143 - DNA, 25 bp, Homo sapien
attaagcttgttgccagtaggttta

SEQ ID NO: 447144 - DNA, 25 bp, Homo sapien
aaatcatgatctcacatgcctcact

SEQ ID NO: 447145 - DNA, 25 bp, Homo sapien
gcctcactttgacatttatcatgcc

SEQ ID NO: 447146 - DNA, 25 bp, Homo sapien
tatcccttaggaacagtaagtttgc

SEQ ID NO: 447147 - DNA, 25 bp, Homo sapien
gtaagtttgccttaactctctgcat

SEQ ID NO: 447148 - DNA, 25 bp, Homo sapien
gccttaactctctgcatggtttaaa

SEQ ID NO: 447149 - DNA, 25 bp, Homo sapien
taaaaagccattggttttgtgtgtg

SEQ ID NO: 447150 - DNA, 25 bp, Homo sapien
gtgtttacagtaattatgcagatga

SEQ ID NO: 447151 - DNA, 25 bp, Homo sapien
acgttattttgggatcttatagcat

SEQ ID NO: 447152 - DNA, 25 bp, Homo sapien
attggagcctctgttattttcttga

SEQ ID NO: 447153 - DNA, 25 bp, Homo sapien
tgtttctttcaattttgtgcctttt

SEQ ID NO: 447154 - DNA, 25 bp, Homo sapien
gacgttgaaagggaagacatctgtt

SEQ ID NO: 447155 - DNA, 25 bp, Homo sapien
tctgttttcattgagagaagatctt

SEQ ID NO: 447156 - DNA, 25 bp, Homo sapien
gttattttcttgattccctgaagag

SEQ ID NO: 447157 - DNA, 25 bp, Homo sapien
aaacgagctatttcagagttcctat

SEQ ID NO: 447158 - DNA, 25 bp, Homo sapien
gagctatttcagagttcctattata

SEQ ID NO: 447159 - DNA, 25 bp, Homo sapien
ttccctgaagagttctagattccct

SEQ ID NO: 447160 - DNA, 25 bp, Homo sapien
gagttctagattccctgaagagttg

SEQ ID NO: 447161 - DNA, 25 bp, Homo sapien
cctgaagagttgagtctaagtgatt

SEQ ID NO: 447162 - DNA, 25 bp, Homo sapien
tccaacttgaactctctcactgatt

SEQ ID NO: 447163 - DNA, 25 bp, Homo sapien
caacttgaactctctcactgattac

SEQ ID NO: 447164 - DNA, 25 bp, Homo sapien
gaactctctcactgattacttgatg

SEQ ID NO: 447165 - DNA, 25 bp, Homo sapien
ctctcactgattacttgatgacaat

SEQ ID NO: 447166 - DNA, 25 bp, Homo sapien
atatctgatattctgcattcccatg

SEQ ID NO: 447167 - DNA, 25 bp, Homo sapien
ctgatattctgcattcccatgtagc

SEQ ID NO: 447168 - DNA, 25 bp, Homo sapien
gatattctgcattcccatgtagcat

SEQ ID NO: 447169 - DNA, 25 bp, Homo sapien
ttctgcattcccatgtagcatttta

SEQ ID NO: 447170 - DNA, 25 bp, Homo sapien
gtagcattttaattgaagtctgtaa

SEQ ID NO: 447171 - DNA, 25 bp, Homo sapien
ttaattgaagtctgtaaatgtggct

SEQ ID NO: 447172 - DNA, 25 bp, Homo sapien
tgtaaatgtggctaaaagtcttgtc

SEQ ID NO: 447173 - DNA, 25 bp, Homo sapien
cggattccaatacaaattttcactg

SEQ ID NO: 447174 - DNA, 25 bp, Homo sapien
ggatacagttatcaaccccgacgac

SEQ ID NO: 447175 - DNA, 25 bp, Homo sapien
cgacgacagggtatttgaacagggt

SEQ ID NO: 447176 - DNA, 25 bp, Homo sapien
ctctgatagcttggccttcgtgaaa

SEQ ID NO: 447177 - DNA, 25 bp, Homo sapien
gacttcagccaagaactgatccgaa

SEQ ID NO: 447178 - DNA, 25 bp, Homo sapien
gatccgaagctcatttcaagtgttg

SEQ ID NO: 447179 - DNA, 25 bp, Homo sapien
gtgttgaacaatcctcaagcacagc

SEQ ID NO: 447180 - DNA, 25 bp, Homo sapien
agcaaggctgctcctgtgggtcatc

SEQ ID NO: 447181 - DNA, 25 bp, Homo sapien
gggtcatctttctctatcaaacttt

SEQ ID NO: 447182 - DNA, 25 bp, Homo sapien
ctttgatgtgatgactggtgactct

SEQ ID NO: 447183 - DNA, 25 bp, Homo sapien
tctgggattgtcaccagttgtacca

SEQ ID NO: 447184 - DNA, 25 bp, Homo sapien
cttctggagtccaaggcacgccact

SEQ ID NO: 447185 - DNA, 25 bp, Homo sapien
aggcacgccactcgcccaaaaggga

SEQ ID NO: 447186 - DNA, 25 bp, Homo sapien
gggctttgactgtctccagacctca

SEQ ID NO: 447187 - DNA, 25 bp, Homo sapien
ctttgactgtctccagacctcaggg

SEQ ID NO: 447188 - DNA, 25 bp, Homo sapien
agctgggcaggctctaaccagtggt

SEQ ID NO: 447189 - DNA, 25 bp, Homo sapien
tgggcaggctctaaccagtggtcct

SEQ ID NO: 447190 - DNA, 25 bp, Homo sapien
taaccagtggtcctccagagagcag

SEQ ID NO: 447191 - DNA, 25 bp, Homo sapien
gtggtcctccagagagcagcgttga

SEQ ID NO: 447192 - DNA, 25 bp, Homo sapien
tcctccagagagcagcgttgaccac

SEQ ID NO: 447193 - DNA, 25 bp, Homo sapien
ctgcgccacgtgacaggaggctctg

SEQ ID NO: 447194 - DNA, 25 bp, Homo sapien
cacgtgacaggaggctctggtcctg

SEQ ID NO: 447195 - DNA, 25 bp, Homo sapien
ggccatttctaaaagactgctttct

SEQ ID NO: 447196 - DNA, 25 bp, Homo sapien
agactgctttctgtgttttgggtga

SEQ ID NO: 447197 - DNA, 25 bp, Homo sapien
ggtgaatccgtgtatttctgtatca

SEQ ID NO: 447198 - DNA, 25 bp, Homo sapien
aaatgactgactttgaacgttacga

SEQ ID NO: 447199 - DNA, 25 bp, Homo sapien
tgaacgttacgatttttctcctcct

SEQ ID NO: 447200 - DNA, 25 bp, Homo sapien
tccttacgtgtacggtcctgtgata

SEQ ID NO: 447201 - DNA, 25 bp, Homo sapien
actcctcggctcagagtccgtgagg

SEQ ID NO: 447202 - DNA, 25 bp, Homo sapien
tgaggccagaagctgacgtcccaaa

SEQ ID NO: 447203 - DNA, 25 bp, Homo sapien
tggaacttccgtccagagacgagag

SEQ ID NO: 447204 - DNA, 25 bp, Homo sapien
agacgagagaccgactgggaatcct

SEQ ID NO: 447205 - DNA, 25 bp, Homo sapien
gggaatcctctcagtcaaggtccaa

SEQ ID NO: 447206 - DNA, 25 bp, Homo sapien
aatgtgcaggtaacacctgctgcta

SEQ ID NO: 447207 - DNA, 25 bp, Homo sapien
atgtgcaggtaacacctgctgctac

SEQ ID NO: 447208 - DNA, 25 bp, Homo sapien
tactccagccattcgggccctaaat

SEQ ID NO: 447209 - DNA, 25 bp, Homo sapien
ctacattttgtatctaggtcttgag

SEQ ID NO: 447210 - DNA, 25 bp, Homo sapien
tctaaaaatgcaagtccttttggtt

SEQ ID NO: 447211 - DNA, 25 bp, Homo sapien
cctaatcagagtaacgttttcattg

SEQ ID NO: 447212 - DNA, 25 bp, Homo sapien
atcagagtaacgttttcattgagta

SEQ ID NO: 447213 - DNA, 25 bp, Homo sapien
gagtaacgttttcattgagtacaca

SEQ ID NO: 447214 - DNA, 25 bp, Homo sapien
tacacattcagacatgagaatcttc

SEQ ID NO: 447215 - DNA, 25 bp, Homo sapien
acattcagacatgagaatcttcact

SEQ ID NO: 447216 - DNA, 25 bp, Homo sapien
ttcagacatgagaatcttcactttc

SEQ ID NO: 447217 - DNA, 25 bp, Homo sapien
tgggatgaggacatgaacagaacat

SEQ ID NO: 447218 - DNA, 25 bp, Homo sapien
gagctgatccgagaggacatccagg

SEQ ID NO: 447219 - DNA, 25 bp, Homo sapien
gggctctgcacaattaccgctcggg

SEQ ID NO: 447220 - DNA, 25 bp, Homo sapien
ggctctgcacaattaccgctcgggc

SEQ ID NO: 447221 - DNA, 25 bp, Homo sapien
gcacaattaccgctcgggccgcggg

SEQ ID NO: 447222 - DNA, 25 bp, Homo sapien
agggcggcggcgctcagggccacgc

SEQ ID NO: 447223 - DNA, 25 bp, Homo sapien
gcgctcagggccacgcaggaggagt

SEQ ID NO: 447224 - DNA, 25 bp, Homo sapien
caggaggagttgcagcgcgaccgct

SEQ ID NO: 447225 - DNA, 25 bp, Homo sapien
ggtttgagattggacccagggtcaa

SEQ ID NO: 447226 - DNA, 25 bp, Homo sapien
ggacccagggtcaagatagaacatg

SEQ ID NO: 447227 - DNA, 25 bp, Homo sapien
acccagggtcaagatagaacatgaa

SEQ ID NO: 447228 - DNA, 25 bp, Homo sapien
gaaaaatctattactccaacctgag

SEQ ID NO: 447229 - DNA, 25 bp, Homo sapien
ctccaacctgagaatccaagtcttc

SEQ ID NO: 447230 - DNA, 25 bp, Homo sapien
aagtcttctcctttcaagcagagat

SEQ ID NO: 447231 - DNA, 25 bp, Homo sapien
tcaagcagagattggcatcgagaac

SEQ ID NO: 447232 - DNA, 25 bp, Homo sapien
gagaacattgagtcccaccagcaga

SEQ ID NO: 447233 - DNA, 25 bp, Homo sapien
tcttcctccatcattaaagcctcag

SEQ ID NO: 447234 - DNA, 25 bp, Homo sapien
ctcaggctcatagaactcgcttaag

SEQ ID NO: 447235 - DNA, 25 bp, Homo sapien
gtttattgtctataagcactttcag

SEQ ID NO: 447236 - DNA, 25 bp, Homo sapien
aatctgccagtttcttttgcatgag

SEQ ID NO: 447237 - DNA, 25 bp, Homo sapien
agtgcaagataaagccacgctcggc

SEQ ID NO: 447238 - DNA, 25 bp, Homo sapien
gaagatttctgacactagtcgctat

SEQ ID NO: 447239 - DNA, 25 bp, Homo sapien
gagcactgaacaggacaagctcagt

SEQ ID NO: 447240 - DNA, 25 bp, Homo sapien
acaggacaagctcagttttgtccct

SEQ ID NO: 447241 - DNA, 25 bp, Homo sapien
tcaaacctccacaatcagctatttt

SEQ ID NO: 447242 - DNA, 25 bp, Homo sapien
acctccacaatcagctattttacat

SEQ ID NO: 447243 - DNA, 25 bp, Homo sapien
gctattttacataaggaaagtgggt

SEQ ID NO: 447244 - DNA, 25 bp, Homo sapien
gaaagtgggtggtgattaacctcag

SEQ ID NO: 447245 - DNA, 25 bp, Homo sapien
gtgggtggtgattaacctcagagtc

SEQ ID NO: 447246 - DNA, 25 bp, Homo sapien
aggactgtgcctgaaatagaagagg

SEQ ID NO: 447247 - DNA, 25 bp, Homo sapien
acatcatacagaactgaatacggtg

SEQ ID NO: 447248 - DNA, 25 bp, Homo sapien
acagaactgaatacggtgactgagg

SEQ ID NO: 447249 - DNA, 25 bp, Homo sapien
gagagtcatgtactgtacattaagc

SEQ ID NO: 447250 - DNA, 25 bp, Homo sapien
gcaatgcatgatgggcaggctcaat

SEQ ID NO: 447251 - DNA, 25 bp, Homo sapien
acaagtgttggtaggtgccagcttt

SEQ ID NO: 447252 - DNA, 25 bp, Homo sapien
agctttgtttcttgattatcttaaa

SEQ ID NO: 447253 - DNA, 25 bp, Homo sapien
taaacctatggtgtacctcacagcc

SEQ ID NO: 447254 - DNA, 25 bp, Homo sapien
cccctcaaaatccactgctaagttt

SEQ ID NO: 447255 - DNA, 25 bp, Homo sapien
tctattgggcaagtccatttccctt

SEQ ID NO: 447256 - DNA, 25 bp, Homo sapien
tccatttcccttttactaacacttg

SEQ ID NO: 447257 - DNA, 25 bp, Homo sapien
ttctgtttaattgacatggactcac

SEQ ID NO: 447258 - DNA, 25 bp, Homo sapien
catggactcacataagtgttttctt

SEQ ID NO: 447259 - DNA, 25 bp, Homo sapien
cacacaacagtttcctttagtccct

SEQ ID NO: 447260 - DNA, 25 bp, Homo sapien
ttagtccctttggtggattttgatt

SEQ ID NO: 447261 - DNA, 25 bp, Homo sapien
gagagatctggaaatagggaggccc

SEQ ID NO: 447262 - DNA, 25 bp, Homo sapien
aacacacacaacattggtcgattca

SEQ ID NO: 447263 - DNA, 25 bp, Homo sapien
cacacacaacattggtcgattcagt

SEQ ID NO: 447264 - DNA, 25 bp, Homo sapien
cacacaacattggtcgattcagttt

SEQ ID NO: 447265 - DNA, 25 bp, Homo sapien
acacaacattggtcgattcagtttg

SEQ ID NO: 447266 - DNA, 25 bp, Homo sapien
caacattggtcgattcagtttgtca

SEQ ID NO: 447267 - DNA, 25 bp, Homo sapien
acattggtcgattcagtttgtcaac

SEQ ID NO: 447268 - DNA, 25 bp, Homo sapien
attggtcgattcagtttgtcaactt

SEQ ID NO: 447269 - DNA, 25 bp, Homo sapien
tggtcgattcagtttgtcaacttct

SEQ ID NO: 447270 - DNA, 25 bp, Homo sapien
ggtcgattcagtttgtcaacttcta

SEQ ID NO: 447271 - DNA, 25 bp, Homo sapien
ttacacacaacagggacccaaaagg

SEQ ID NO: 447272 - DNA, 25 bp, Homo sapien
tgggatgaggacatgaacagaacat

SEQ ID NO: 447273 - DNA, 25 bp, Homo sapien
ggtttgagattggacccagggtcaa

SEQ ID NO: 447274 - DNA, 25 bp, Homo sapien
gtttgagattggacccagggtcaag

SEQ ID NO: 447275 - DNA, 25 bp, Homo sapien
tttgagattggacccagggtcaaga

SEQ ID NO: 447276 - DNA, 25 bp, Homo sapien
tgagattggacccagggtcaagata

SEQ ID NO: 447277 - DNA, 25 bp, Homo sapien
tggacccagggtcaagatagaacat

SEQ ID NO: 447278 - DNA, 25 bp, Homo sapien
ggacccagggtcaagatagaacatg

SEQ ID NO: 447279 - DNA, 25 bp, Homo sapien
gacccagggtcaagatagaacatga

SEQ ID NO: 447280 - DNA, 25 bp, Homo sapien
acccagggtcaagatagaacatgaa

SEQ ID NO: 447281 - DNA, 25 bp, Homo sapien
cagggtcaagatagaacatgaaggt

SEQ ID NO: 447282 - DNA, 25 bp, Homo sapien
tcaagatagaacatgaaggtgggat

SEQ ID NO: 447283 - DNA, 25 bp, Homo sapien
gggctgttaacattagcaaatattt

SEQ ID NO: 447284 - DNA, 25 bp, Homo sapien
aaccaaactggttcacctgaatcat

SEQ ID NO: 447285 - DNA, 25 bp, Homo sapien
ggttcacctgaatcatgaattgaga

SEQ ID NO: 447286 - DNA, 25 bp, Homo sapien
attaagtcccttttagtttgatcag

SEQ ID NO: 447287 - DNA, 25 bp, Homo sapien
tcccttttagtttgatcagacagct

SEQ ID NO: 447288 - DNA, 25 bp, Homo sapien
ttgatcagacagcttgaatcagcat

SEQ ID NO: 447289 - DNA, 25 bp, Homo sapien
attccccatactccctattttcatt

SEQ ID NO: 447290 - DNA, 25 bp, Homo sapien
aataatataagctacagaaaccagg

SEQ ID NO: 447291 - DNA, 25 bp, Homo sapien
tacagaaaccaggtaagccctttat

SEQ ID NO: 447292 - DNA, 25 bp, Homo sapien
tgttttgccagccacttaccaattg

SEQ ID NO: 447293 - DNA, 25 bp, Homo sapien
tgccagccacttaccaattgctaag

SEQ ID NO: 447294 - DNA, 25 bp, Homo sapien
ccgcgtcgacgaaattattattttg

SEQ ID NO: 447295 - DNA, 25 bp, Homo sapien
gcgtcgacgaaattattattttggc

SEQ ID NO: 447296 - DNA, 25 bp, Homo sapien
tgaaaagtggttgatcaggacaaaa

SEQ ID NO: 447297 - DNA, 25 bp, Homo sapien
aagtggttgatcaggacaaaaatgt

SEQ ID NO: 447298 - DNA, 25 bp, Homo sapien
gaaagtgacttctaaatcctagttg

SEQ ID NO: 447299 - DNA, 25 bp, Homo sapien
aagtgacttctaaatcctagttgga

SEQ ID NO: 447300 - DNA, 25 bp, Homo sapien
agtgacttctaaatcctagttggaa

SEQ ID NO: 447301 - DNA, 25 bp, Homo sapien
gacttctaaatcctagttggaagga

SEQ ID NO: 447302 - DNA, 25 bp, Homo sapien
tcctagttggaaggattaccctttg

SEQ ID NO: 447303 - DNA, 25 bp, Homo sapien
gtttagggcagttaatttgcttaag

SEQ ID NO: 447304 - DNA, 25 bp, Homo sapien
tagggcagttaatttgcttaagtta

SEQ ID NO: 447305 - DNA, 25 bp, Homo sapien
atatctcccaacagtttccttaaag

SEQ ID NO: 447306 - DNA, 25 bp, Homo sapien
tatctcccaacagtttccttaaagt

SEQ ID NO: 447307 - DNA, 25 bp, Homo sapien
tcccaacagtttccttaaagtccat

SEQ ID NO: 447308 - DNA, 25 bp, Homo sapien
caacagtttccttaaagtccataat

SEQ ID NO: 447309 - DNA, 25 bp, Homo sapien
cttaaagtccataattttgggccag

SEQ ID NO: 447310 - DNA, 25 bp, Homo sapien
ttaaagtccataattttgggccagg

SEQ ID NO: 447311 - DNA, 25 bp, Homo sapien
taaagtccataattttgggccaggc

SEQ ID NO: 447312 - DNA, 25 bp, Homo sapien
aaagtccataattttgggccaggca

SEQ ID NO: 447313 - DNA, 25 bp, Homo sapien
agtccataattttgggccaggcacg

SEQ ID NO: 447314 - DNA, 25 bp, Homo sapien
tgagctcacaagtttgagacagcct

SEQ ID NO: 447315 - DNA, 25 bp, Homo sapien
acatgatgacatcccgtctctacaa

SEQ ID NO: 447316 - DNA, 25 bp, Homo sapien
tgtcactgaaggactgagcacgccg

SEQ ID NO: 447317 - DNA, 25 bp, Homo sapien
actgaaggactgagcacgccggaac

SEQ ID NO: 447318 - DNA, 25 bp, Homo sapien
tgaaggactgagcacgccggaacac

SEQ ID NO: 447319 - DNA, 25 bp, Homo sapien
gaaggactgagcacgccggaacacc

SEQ ID NO: 447320 - DNA, 25 bp, Homo sapien
aagcatcacgtctccctgaccaagg

SEQ ID NO: 447321 - DNA, 25 bp, Homo sapien
tgtgctcatggtaccaaggaggcca

SEQ ID NO: 447322 - DNA, 25 bp, Homo sapien
tgctcatggtaccaaggaggccacg

SEQ ID NO: 447323 - DNA, 25 bp, Homo sapien
tcatggtaccaaggaggccacggag

SEQ ID NO: 447324 - DNA, 25 bp, Homo sapien
cacggagacagaggagggcccacct

SEQ ID NO: 447325 - DNA, 25 bp, Homo sapien
ggccttggccttacaccctgggagc

SEQ ID NO: 447326 - DNA, 25 bp, Homo sapien
cttggccttacaccctgggagcgtc

SEQ ID NO: 447327 - DNA, 25 bp, Homo sapien
gttcaaggagggtgcaatattaagt

SEQ ID NO: 447328 - DNA, 25 bp, Homo sapien
aggcctgaactatactttgaagaaa

SEQ ID NO: 447329 - DNA, 25 bp, Homo sapien
tatactttgaagaaacccctataga

SEQ ID NO: 447330 - DNA, 25 bp, Homo sapien
gaaagctccagctaaataggaagaa

SEQ ID NO: 447331 - DNA, 25 bp, Homo sapien
tctctttcctatctttgatggaagg

SEQ ID NO: 447332 - DNA, 25 bp, Homo sapien
ggtaaagaattgaggctttccttct

SEQ ID NO: 447333 - DNA, 25 bp, Homo sapien
gaattgaggctttccttcttggaga

SEQ ID NO: 447334 - DNA, 25 bp, Homo sapien
ttgaggctttccttcttggagagct

SEQ ID NO: 447335 - DNA, 25 bp, Homo sapien
gacaagcattaggaaaggtaccctc

SEQ ID NO: 447336 - DNA, 25 bp, Homo sapien
ggaaaggtaccctcctagattcatt

SEQ ID NO: 447337 - DNA, 25 bp, Homo sapien
ggtaccctcctagattcattattct

SEQ ID NO: 447338 - DNA, 25 bp, Homo sapien
tcctctggagtttgcctaagtgacc

SEQ ID NO: 447339 - DNA, 25 bp, Homo sapien
gcctaagtgaccaccctgagagtaa

SEQ ID NO: 447340 - DNA, 25 bp, Homo sapien
gagagtaacaaccattgcacaacta

SEQ ID NO: 447341 - DNA, 25 bp, Homo sapien
tgcacaactatttcctaatgtcagg

SEQ ID NO: 447342 - DNA, 25 bp, Homo sapien
ggcagttacaggctcttcacggaaa

SEQ ID NO: 447343 - DNA, 25 bp, Homo sapien
gctcttcacggaaaacaagcctata

SEQ ID NO: 447344 - DNA, 25 bp, Homo sapien
acaagcctatactatctgccaggga

SEQ ID NO: 447345 - DNA, 25 bp, Homo sapien
tactatctgccagggaacattctga

SEQ ID NO: 447346 - DNA, 25 bp, Homo sapien
cattctgagcactttatcccacatt

SEQ ID NO: 447347 - DNA, 25 bp, Homo sapien
tttatcccacattcctgcaaggcat

SEQ ID NO: 447348 - DNA, 25 bp, Homo sapien
cctgcaaggcatctgagatgcttac

SEQ ID NO: 447349 - DNA, 25 bp, Homo sapien
catcagtttgcagccttatttattg

SEQ ID NO: 447350 - DNA, 25 bp, Homo sapien
aatatagctagatttgaacctacct

SEQ ID NO: 447351 - DNA, 25 bp, Homo sapien
gaacctacctgtattgtaattcaac

SEQ ID NO: 447352 - DNA, 25 bp, Homo sapien
gtaattcaacactagtgctcttaag

SEQ ID NO: 447353 - DNA, 25 bp, Homo sapien
tgctcttaagcactaccatgtccca

SEQ ID NO: 447354 - DNA, 25 bp, Homo sapien
atgtcccatctctacaatgctagtt

SEQ ID NO: 447355 - DNA, 25 bp, Homo sapien
agatactatctatggtccctttcaa

SEQ ID NO: 447356 - DNA, 25 bp, Homo sapien
atggtccctttcaatcttgacctac

SEQ ID NO: 447357 - DNA, 25 bp, Homo sapien
tcttgacctacctattaacacagtg

SEQ ID NO: 447358 - DNA, 25 bp, Homo sapien
atttattgttgcaccctttctcaag

SEQ ID NO: 447359 - DNA, 25 bp, Homo sapien
aagggtcctgttgttccagcattgc

SEQ ID NO: 447360 - DNA, 25 bp, Homo sapien
gatcagcattgtgacagctgggcag

SEQ ID NO: 447361 - DNA, 25 bp, Homo sapien
cattgtgacagctgggcagagcagt

SEQ ID NO: 447362 - DNA, 25 bp, Homo sapien
agagcagtggtgaactgcacccatg

SEQ ID NO: 447363 - DNA, 25 bp, Homo sapien
tgctcacatctcctaagatctcaga

SEQ ID NO: 447364 - DNA, 25 bp, Homo sapien
tctcctaagatctcagaattgcctg

SEQ ID NO: 447365 - DNA, 25 bp, Homo sapien
attgcctgaggttctagcgtgggct

SEQ ID NO: 447366 - DNA, 25 bp, Homo sapien
aggttctagcgtgggctccttctct

SEQ ID NO: 447367 - DNA, 25 bp, Homo sapien
agcatctgaggcatcctgcactaaa

SEQ ID NO: 447368 - DNA, 25 bp, Homo sapien
tgaggcatcctgcactaaaagatat

SEQ ID NO: 447369 - DNA, 25 bp, Homo sapien
tataaatatacccagatccccgctg

SEQ ID NO: 447370 - DNA, 25 bp, Homo sapien
ccagatccccgctgatttggttact

SEQ ID NO: 447371 - DNA, 25 bp, Homo sapien
agccaaaattctcaaccctagctga

SEQ ID NO: 447372 - DNA, 25 bp, Homo sapien
attgaaatgttattggtctttgggt

SEQ ID NO: 447373 - DNA, 25 bp, Homo sapien
tggtctttgggtcttataccgaaag

SEQ ID NO: 447374 - DNA, 25 bp, Homo sapien
ttgggtcttataccgaaagtgattt

SEQ ID NO: 447375 - DNA, 25 bp, Homo sapien
agtgatttttggctttgctgcagat

SEQ ID NO: 447376 - DNA, 25 bp, Homo sapien
ggctttgctgcagattttaactttt

SEQ ID NO: 447377 - DNA, 25 bp, Homo sapien
agattttaacttttctgtccgcaga

SEQ ID NO: 447378 - DNA, 25 bp, Homo sapien
ttctgtccgcagaaatttaattttg

SEQ ID NO: 447379 - DNA, 25 bp, Homo sapien
gtgaatattttcaggtcgtctaatt

SEQ ID NO: 447380 - DNA, 25 bp, Homo sapien
tcaggtcgtctaattttacatattt

SEQ ID NO: 447381 - DNA, 25 bp, Homo sapien
tttcatctctaagaattcaagccaa

SEQ ID NO: 447382 - DNA, 25 bp, Homo sapien
gattggtggaccttgaaccacatta

SEQ ID NO: 447383 - DNA, 25 bp, Homo sapien
ggaccttgaaccacattatgatatc

SEQ ID NO: 447384 - DNA, 25 bp, Homo sapien
tatgatatcagatgacccagagtca

SEQ ID NO: 447385 - DNA, 25 bp, Homo sapien
gagtcatggttactaagttgcttaa

SEQ ID NO: 447386 - DNA, 25 bp, Homo sapien
gacaggtcaattcaataatggtttt

SEQ ID NO: 447387 - DNA, 25 bp, Homo sapien
atataatccccttaagttgtgctta

SEQ ID NO: 447388 - DNA, 25 bp, Homo sapien
ccccttaagttgtgcttagtcagca

SEQ ID NO: 447389 - DNA, 25 bp, Homo sapien
gcagtatttaatctgttgtctatta

SEQ ID NO: 447390 - DNA, 25 bp, Homo sapien
gtctattatatatctaactggtctg

SEQ ID NO: 447391 - DNA, 25 bp, Homo sapien
attgcttattcatatcttattggag

SEQ ID NO: 447392 - DNA, 25 bp, Homo sapien
acaatatatttcatctcctaggaga

SEQ ID NO: 447393 - DNA, 25 bp, Homo sapien
gaaaagtcatggctatctcgctcct

SEQ ID NO: 447394 - DNA, 25 bp, Homo sapien
gagagtaacagagccttttgaaagt

SEQ ID NO: 447395 - DNA, 25 bp, Homo sapien
ttgaaagtcacacatgctcagtaaa

SEQ ID NO: 447396 - DNA, 25 bp, Homo sapien
ggttgacatcagtaccaaagctggg

SEQ ID NO: 447397 - DNA, 25 bp, Homo sapien
ggaagggctactacagagaactgga

SEQ ID NO: 447398 - DNA, 25 bp, Homo sapien
tgaacctcagacaagacctccaaat

SEQ ID NO: 447399 - DNA, 25 bp, Homo sapien
tccaaatatctgtcctcaagttgct

SEQ ID NO: 447400 - DNA, 25 bp, Homo sapien
gtcctcaagttgcttcatctacaaa

SEQ ID NO: 447401 - DNA, 25 bp, Homo sapien
taaaattcagtatgtttccagtcac

SEQ ID NO: 447402 - DNA, 25 bp, Homo sapien
gtatgtttccagtcacatggtcagg

SEQ ID NO: 447403 - DNA, 25 bp, Homo sapien
cagtcacatggtcagggaaaagtca

SEQ ID NO: 447404 - DNA, 25 bp, Homo sapien
tttttatatttgtgactgcaagtca

SEQ ID NO: 447405 - DNA, 25 bp, Homo sapien
ggtagcattattatccaatggactt

SEQ ID NO: 447406 - DNA, 25 bp, Homo sapien
atagctttcattaggttttcttttg

SEQ ID NO: 447407 - DNA, 25 bp, Homo sapien
atttttcatctatattatgaggcag

SEQ ID NO: 447408 - DNA, 25 bp, Homo sapien
tattatgaggcagtaagagtcttct

SEQ ID NO: 447409 - DNA, 25 bp, Homo sapien
cagtaagagtcttctgtttttccaa

SEQ ID NO: 447410 - DNA, 25 bp, Homo sapien
ctgctttatatttatttcgtattgt

SEQ ID NO: 447411 - DNA, 25 bp, Homo sapien
atttatttcgtattgtctacagctg

SEQ ID NO: 447412 - DNA, 25 bp, Homo sapien
atttcgtattgtctacagctgtagt

SEQ ID NO: 447413 - DNA, 25 bp, Homo sapien
tctacagctgtagtgttcaatacat

SEQ ID NO: 447414 - DNA, 25 bp, Homo sapien
agtgttcaatacattagccactagc

SEQ ID NO: 447415 - DNA, 25 bp, Homo sapien
caggccgcagtgtgggtgggtcagc

SEQ ID NO: 447416 - DNA, 25 bp, Homo sapien
gggtgggtcagcttgaatccagcct

SEQ ID NO: 447417 - DNA, 25 bp, Homo sapien
gtgggtcagcttgaatccagccttc

SEQ ID NO: 447418 - DNA, 25 bp, Homo sapien
ggtcagcttgaatccagccttccta

SEQ ID NO: 447419 - DNA, 25 bp, Homo sapien
cttgaatccagccttcctaccagtt

SEQ ID NO: 447420 - DNA, 25 bp, Homo sapien
tgaatccagccttcctaccagttct

SEQ ID NO: 447421 - DNA, 25 bp, Homo sapien
ctaccagttctctaccagcacttgc

SEQ ID NO: 447422 - DNA, 25 bp, Homo sapien
ttctctaccagcacttgccttcctg

SEQ ID NO: 447423 - DNA, 25 bp, Homo sapien
tcctggtgtcaaagagtctttgtta

SEQ ID NO: 447424 - DNA, 25 bp, Homo sapien
gagtctttgttattatttggctgaa

SEQ ID NO: 447425 - DNA, 25 bp, Homo sapien
agtctttgttattatttggctgaaa

SEQ ID NO: 447426 - DNA, 25 bp, Homo sapien
ctttttaaccactggagactatgtg

SEQ ID NO: 447427 - DNA, 25 bp, Homo sapien
taaccactggagactatgtgaaaat

SEQ ID NO: 447428 - DNA, 25 bp, Homo sapien
gactatgtgaaaatcttgtgttata

SEQ ID NO: 447429 - DNA, 25 bp, Homo sapien
catgttgcatattttccagtgggga

SEQ ID NO: 447430 - DNA, 25 bp, Homo sapien
taaattggaggttcttattactaat

SEQ ID NO: 447431 - DNA, 25 bp, Homo sapien
tattactaataatcctgaaactaaa

SEQ ID NO: 447432 - DNA, 25 bp, Homo sapien
tgaaactaaaatttgcttttcctgc

SEQ ID NO: 447433 - DNA, 25 bp, Homo sapien
gcttttcctgcatagacatcttttg

SEQ ID NO: 447434 - DNA, 25 bp, Homo sapien
ttcctgcatagacatcttttgttag

SEQ ID NO: 447435 - DNA, 25 bp, Homo sapien
tgcatagacatcttttgttagtcca

SEQ ID NO: 447436 - DNA, 25 bp, Homo sapien
ctgcttgaatgatatgaaattctct

SEQ ID NO: 447437 - DNA, 25 bp, Homo sapien
gatttggaggaaggatgcaatcctt

SEQ ID NO: 447438 - DNA, 25 bp, Homo sapien
gtggaatttatgtcctttgggagac

SEQ ID NO: 447439 - DNA, 25 bp, Homo sapien
tcctttgggagactgtagttgactt

SEQ ID NO: 447440 - DNA, 25 bp, Homo sapien
gggtatggacaagttttccatttgg

SEQ ID NO: 447441 - DNA, 25 bp, Homo sapien
acttcatttatgcttatccctaccc

SEQ ID NO: 447442 - DNA, 25 bp, Homo sapien
ggttcttgggtgttctgttactgtc

SEQ ID NO: 447443 - DNA, 25 bp, Homo sapien
gttactgtcctgtgttaacactgca

SEQ ID NO: 447444 - DNA, 25 bp, Homo sapien
gttaacactgcattacaataccatt

SEQ ID NO: 447445 - DNA, 25 bp, Homo sapien
ttgtctttgtccctagtgcttcata

SEQ ID NO: 447446 - DNA, 25 bp, Homo sapien
ttgtccctagtgcttcatacagtgc

SEQ ID NO: 447447 - DNA, 25 bp, Homo sapien
ctagtgcttcatacagtgctttggc

SEQ ID NO: 447448 - DNA, 25 bp, Homo sapien
cctggccaaagacatgacatcaaat

SEQ ID NO: 447449 - DNA, 25 bp, Homo sapien
aagtaatagacatcaccagcaatga

SEQ ID NO: 447450 - DNA, 25 bp, Homo sapien
atgttccaagtacctctattttctg

SEQ ID NO: 447451 - DNA, 25 bp, Homo sapien
gtacctctattttctgagctagaag

SEQ ID NO: 447452 - DNA, 25 bp, Homo sapien
gaagaaaccttagaggccatctgat

SEQ ID NO: 447453 - DNA, 25 bp, Homo sapien
aggccatctgatgatagattcccag

SEQ ID NO: 447454 - DNA, 25 bp, Homo sapien
gattcccagagctggatggatccct

SEQ ID NO: 447455 - DNA, 25 bp, Homo sapien
ggatggatccctagggactacctaa

SEQ ID NO: 447456 - DNA, 25 bp, Homo sapien
gggactacctaatctgactttctgt

SEQ ID NO: 447457 - DNA, 25 bp, Homo sapien
tctgtccactgcatggattcttcta

SEQ ID NO: 447458 - DNA, 25 bp, Homo sapien
tcacttatttccctaccttattaag

SEQ ID NO: 447459 - DNA, 25 bp, Homo sapien
ggactgggctccgactgaaatcact

SEQ ID NO: 447460 - DNA, 25 bp, Homo sapien
gggctccgactgaaatcactgaaga

SEQ ID NO: 447461 - DNA, 25 bp, Homo sapien
cactgaagagcgtgggtttcctctt

SEQ ID NO: 447462 - DNA, 25 bp, Homo sapien
gaagagcgtgggtttcctcttagtc

SEQ ID NO: 447463 - DNA, 25 bp, Homo sapien
caagcccctctgaatatgagtttct

SEQ ID NO: 447464 - DNA, 25 bp, Homo sapien
atatgagtttctccatcctgaaaac

SEQ ID NO: 447465 - DNA, 25 bp, Homo sapien
gtttctccatcctgaaaaccactgg

SEQ ID NO: 447466 - DNA, 25 bp, Homo sapien
atcctgaaaaccactgggctgctac

SEQ ID NO: 447467 - DNA, 25 bp, Homo sapien
aacatttgttgagtattggaggcct

SEQ ID NO: 447468 - DNA, 25 bp, Homo sapien
attggaggcctggaatatatagtga

SEQ ID NO: 447469 - DNA, 25 bp, Homo sapien
aagggataacagtcatctgcagagg

SEQ ID NO: 447470 - DNA, 25 bp, Homo sapien
tatgatcctattattgggttggtgt

SEQ ID NO: 447471 - DNA, 25 bp, Homo sapien
tgatcctattattgggttggtgtgt

SEQ ID NO: 447472 - DNA, 25 bp, Homo sapien
gatcctattattgggttggtgtgtg

SEQ ID NO: 447473 - DNA, 25 bp, Homo sapien
tcctattattgggttggtgtgtgat

SEQ ID NO: 447474 - DNA, 25 bp, Homo sapien
cctattattgggttggtgtgtgatc

SEQ ID NO: 447475 - DNA, 25 bp, Homo sapien
ctattattgggttggtgtgtgatcg

SEQ ID NO: 447476 - DNA, 25 bp, Homo sapien
attattgggttggtgtgtgatcgaa

SEQ ID NO: 447477 - DNA, 25 bp, Homo sapien
ggtgtgtgatcgaatacatggtata

SEQ ID NO: 447478 - DNA, 25 bp, Homo sapien
catggaaaatttaagctcagcagga

SEQ ID NO: 447479 - DNA, 25 bp, Homo sapien
tggcagttcctgtcttaggaagaca

SEQ ID NO: 447480 - DNA, 25 bp, Homo sapien
tttactttttggcatctgttggttg

SEQ ID NO: 447481 - DNA, 25 bp, Homo sapien
ttactgggacagaggattcctgaca

SEQ ID NO: 447482 - DNA, 25 bp, Homo sapien
ggattcctgacactcttcaagtcaa

SEQ ID NO: 447483 - DNA, 25 bp, Homo sapien
caaagctgagatgtgcccctctttt

SEQ ID NO: 447484 - DNA, 25 bp, Homo sapien
atgtgcccctcttttcagaatagtt

SEQ ID NO: 447485 - DNA, 25 bp, Homo sapien
ttttcagaatagttaaggatggcct

SEQ ID NO: 447486 - DNA, 25 bp, Homo sapien
aggatggcctaggaaatgagtaccc

SEQ ID NO: 447487 - DNA, 25 bp, Homo sapien
gaaatgagtacccagatgcttcttg

SEQ ID NO: 447488 - DNA, 25 bp, Homo sapien
gtacccagatgcttcttgggcaaaa

SEQ ID NO: 447489 - DNA, 25 bp, Homo sapien
aaaaatttgcttgccagtcctgttt

SEQ ID NO: 447490 - DNA, 25 bp, Homo sapien
cactgagagtgaccacccctggctt

SEQ ID NO: 447491 - DNA, 25 bp, Homo sapien
cttcccctcaggtgtcttctgctgt

SEQ ID NO: 447492 - DNA, 25 bp, Homo sapien
acaagtaattccctcctggtcccag

SEQ ID NO: 447493 - DNA, 25 bp, Homo sapien
tcctggtcccagacagtctaagagg

SEQ ID NO: 447494 - DNA, 25 bp, Homo sapien
ggacctgaattttccaatgacatca

SEQ ID NO: 447495 - DNA, 25 bp, Homo sapien
ggatgataaggactccagccactat

SEQ ID NO: 447496 - DNA, 25 bp, Homo sapien
ggactccagccactatgacagtgat

SEQ ID NO: 447497 - DNA, 25 bp, Homo sapien
acaacttagttgtggatgtgtctaa

SEQ ID NO: 447498 - DNA, 25 bp, Homo sapien
gtgtctaatgaggacccttcttctc

SEQ ID NO: 447499 - DNA, 25 bp, Homo sapien
cactcgccccgggaaaatggaatcg

SEQ ID NO: 447500 - DNA, 25 bp, Homo sapien
ggaatcgacaaaaatcgcctgctaa

SEQ ID NO: 447501 - DNA, 25 bp, Homo sapien
tcgcctgctaaagaaggatgcttct

SEQ ID NO: 447502 - DNA, 25 bp, Homo sapien
aggatgcttctagcagtccagcttc

SEQ ID NO: 447503 - DNA, 25 bp, Homo sapien
ggaagcttttaccggccgctgtccg

SEQ ID NO: 447504 - DNA, 25 bp, Homo sapien
ttttaccggccgctgtccgagcact

SEQ ID NO: 447505 - DNA, 25 bp, Homo sapien
ggccgctgtccgagcactccctggg

SEQ ID NO: 447506 - DNA, 25 bp, Homo sapien
gacagaggagaaaatactggcttca

SEQ ID NO: 447507 - DNA, 25 bp, Homo sapien
agaggagaaaatactggcttcagaa

SEQ ID NO: 447508 - DNA, 25 bp, Homo sapien
tggcttcagaaaacccctgggccaa

SEQ ID NO: 447509 - DNA, 25 bp, Homo sapien
ggcttcagaaaacccctgggccaag

SEQ ID NO: 447510 - DNA, 25 bp, Homo sapien
gctggatcccgcagccaggccctaa

SEQ ID NO: 447511 - DNA, 25 bp, Homo sapien
agccaggccctaaccaccaggttct

SEQ ID NO: 447512 - DNA, 25 bp, Homo sapien
accaggttctcctgtcgctcggcgg

SEQ ID NO: 447513 - DNA, 25 bp, Homo sapien
gcccaactgccttggggccacaggt

SEQ ID NO: 447514 - DNA, 25 bp, Homo sapien
atcccaaccttgagccccaggagat

SEQ ID NO: 447515 - DNA, 25 bp, Homo sapien
accttgagccccaggagataccgcg

SEQ ID NO: 447516 - DNA, 25 bp, Homo sapien
gacactccctatctggttggaagag

SEQ ID NO: 447517 - DNA, 25 bp, Homo sapien
gaagagagtaaccagtttccagaga

SEQ ID NO: 447518 - DNA, 25 bp, Homo sapien
gaatcagaaacagatcaacagccca

SEQ ID NO: 447519 - DNA, 25 bp, Homo sapien
gatcaacagcccaaagattttcctg

SEQ ID NO: 447520 - DNA, 25 bp, Homo sapien
aaagattttcctgtccctggagtgc

SEQ ID NO: 447521 - DNA, 25 bp, Homo sapien
attttcctgtccctggagtgccagc

SEQ ID NO: 447522 - DNA, 25 bp, Homo sapien
aagctccagggctgagtggtcagga

SEQ ID NO: 447523 - DNA, 25 bp, Homo sapien
gggatgctggcaaatctcagctgtt

SEQ ID NO: 447524 - DNA, 25 bp, Homo sapien
atgctggcaaatctcagctgttgct

SEQ ID NO: 447525 - DNA, 25 bp, Homo sapien
attttcataccttacattcttcacc

SEQ ID NO: 447526 - DNA, 25 bp, Homo sapien
cattcttcaccacaattattaaggt

SEQ ID NO: 447527 - DNA, 25 bp, Homo sapien
tattaacccagcttaatgataagga

SEQ ID NO: 447528 - DNA, 25 bp, Homo sapien
aaggaagctaaatatcaagataccc

SEQ ID NO: 447529 - DNA, 25 bp, Homo sapien
gtattaaggcacattttagttctct

SEQ ID NO: 447530 - DNA, 25 bp, Homo sapien
gttctctagcatttgagggttaggc

SEQ ID NO: 447531 - DNA, 25 bp, Homo sapien
aagctcttactgtgtttataaatct

SEQ ID NO: 447532 - DNA, 25 bp, Homo sapien
gtgtttataaatctcattgcccatt

SEQ ID NO: 447533 - DNA, 25 bp, Homo sapien
tctcattgcccattaatgaacctga

SEQ ID NO: 447534 - DNA, 25 bp, Homo sapien
gaagacataatcatacctggcaaca

SEQ ID NO: 447535 - DNA, 25 bp, Homo sapien
cataatcatacctggcaacaaattc

SEQ ID NO: 447536 - DNA, 25 bp, Homo sapien
ttttacagggatttcgcagggatag

SEQ ID NO: 447537 - DNA, 25 bp, Homo sapien
atttcgcagggatagtgtgtcactc

SEQ ID NO: 447538 - DNA, 25 bp, Homo sapien
gggatagtgtgtcactcaaagtaaa

SEQ ID NO: 447539 - DNA, 25 bp, Homo sapien
tcccacttttaacttgctttagcgt

SEQ ID NO: 447540 - DNA, 25 bp, Homo sapien
acttgctttagcgttaagagtactt

SEQ ID NO: 447541 - DNA, 25 bp, Homo sapien
agagtacttaccagctaataatgtg

SEQ ID NO: 447542 - DNA, 25 bp, Homo sapien
tattctttctcattggagattacag

SEQ ID NO: 447543 - DNA, 25 bp, Homo sapien
atctattcatcttgaatacccactt

SEQ ID NO: 447544 - DNA, 25 bp, Homo sapien
tttttaaagagtccagccattgttc

SEQ ID NO: 447545 - DNA, 25 bp, Homo sapien
ttgttcaagttccaatgaccaaaga

SEQ ID NO: 447546 - DNA, 25 bp, Homo sapien
tgaccaaagattccaaacggcactt

SEQ ID NO: 447547 - DNA, 25 bp, Homo sapien
gaagattcttcaacgtggtaggtgc

SEQ ID NO: 447548 - DNA, 25 bp, Homo sapien
gattcttcaacgtggtaggtgcagt

SEQ ID NO: 447549 - DNA, 25 bp, Homo sapien
cttcaacgtggtaggtgcagtggca

SEQ ID NO: 447550 - DNA, 25 bp, Homo sapien
agcattgctcatcctgcactgtgga

SEQ ID NO: 447551 - DNA, 25 bp, Homo sapien
attgctcatcctgcactgtggatat

SEQ ID NO: 447552 - DNA, 25 bp, Homo sapien
ctcatcctgcactgtggatatcagt

SEQ ID NO: 447553 - DNA, 25 bp, Homo sapien
ggatatcagttgagccacgtgtctc

SEQ ID NO: 447554 - DNA, 25 bp, Homo sapien
tatcagttgagccacgtgtctcctg

SEQ ID NO: 447555 - DNA, 25 bp, Homo sapien
tgagccacgtgtctcctgccctggg

SEQ ID NO: 447556 - DNA, 25 bp, Homo sapien
gataatcgtgaatgggctcaagctt

SEQ ID NO: 447557 - DNA, 25 bp, Homo sapien
tcgtgaatgggctcaagctttaggg

SEQ ID NO: 447558 - DNA, 25 bp, Homo sapien
aaatctgtaatgatgtttgttactc

SEQ ID NO: 447559 - DNA, 25 bp, Homo sapien
gatgtttgttactctaaaccctgaa

SEQ ID NO: 447560 - DNA, 25 bp, Homo sapien
tgttactctaaaccctgaacctact

SEQ ID NO: 447561 - DNA, 25 bp, Homo sapien
ccctgaacctactgatgtttaaact

SEQ ID NO: 447562 - DNA, 25 bp, Homo sapien
gaacctactgatgtttaaactttag

SEQ ID NO: 447563 - DNA, 25 bp, Homo sapien
tagagtgtttttagtacagtaggaa

SEQ ID NO: 447564 - DNA, 25 bp, Homo sapien
aggttaaggcattattcttcccaag

SEQ ID NO: 447565 - DNA, 25 bp, Homo sapien
aaggcattattcttcccaagtcatc

SEQ ID NO: 447566 - DNA, 25 bp, Homo sapien
ggcattattcttcccaagtcatcta

SEQ ID NO: 447567 - DNA, 25 bp, Homo sapien
agaaaatcttcatcatttattctct

SEQ ID NO: 447568 - DNA, 25 bp, Homo sapien
gccgcgtcgacattcagtaaaaaac

SEQ ID NO: 447569 - DNA, 25 bp, Homo sapien
gtaaaacctggtatggacattggaa

SEQ ID NO: 447570 - DNA, 25 bp, Homo sapien
ggacattggaaaatcaggcattctt

SEQ ID NO: 447571 - DNA, 25 bp, Homo sapien
caggcattcttgttctgagttcatt

SEQ ID NO: 447572 - DNA, 25 bp, Homo sapien
atgcaacagatagcaactcctgtgt

SEQ ID NO: 447573 - DNA, 25 bp, Homo sapien
gatagcaactcctgtgttcaggcat

SEQ ID NO: 447574 - DNA, 25 bp, Homo sapien
gttcaggcatgttctaagcactggg

SEQ ID NO: 447575 - DNA, 25 bp, Homo sapien
agacccccacctttaaagatcatag

SEQ ID NO: 447576 - DNA, 25 bp, Homo sapien
aagatcataggttccaactaggtga

SEQ ID NO: 447577 - DNA, 25 bp, Homo sapien
ggttccaactaggtgaaagctgata

SEQ ID NO: 447578 - DNA, 25 bp, Homo sapien
atgaatactgtttcccacatactgg

SEQ ID NO: 447579 - DNA, 25 bp, Homo sapien
gtttcccacatactggattggcaaa

SEQ ID NO: 447580 - DNA, 25 bp, Homo sapien
gaacatgtagctgcactatgccaga

SEQ ID NO: 447581 - DNA, 25 bp, Homo sapien
gaagactttcttcctaagtgcttat

SEQ ID NO: 447582 - DNA, 25 bp, Homo sapien
actacaaggtgtttcaggcgctgat

SEQ ID NO: 447583 - DNA, 25 bp, Homo sapien
caggcgctgataacatgcttcacac

SEQ ID NO: 447584 - DNA, 25 bp, Homo sapien
aacatgcttcacacctgcccttgga

SEQ ID NO: 447585 - DNA, 25 bp, Homo sapien
tgcccttggaggtcacagtactaat

SEQ ID NO: 447586 - DNA, 25 bp, Homo sapien
caaatttagttatgacagtgtcact

SEQ ID NO: 447587 - DNA, 25 bp, Homo sapien
cagtgtcactgtatcctagttatgt

SEQ ID NO: 447588 - DNA, 25 bp, Homo sapien
aatgactgtcatacatccagaggag

SEQ ID NO: 447589 - DNA, 25 bp, Homo sapien
agaggagaccgaacctgcccagctg

SEQ ID NO: 447590 - DNA, 25 bp, Homo sapien
ctgcccagctgatgtactgttttat

SEQ ID NO: 447591 - DNA, 25 bp, Homo sapien
tcacagcagagaagctctcccttca

SEQ ID NO: 447592 - DNA, 25 bp, Homo sapien
aaggaaggtgggaaacatcttctgc

SEQ ID NO: 447593 - DNA, 25 bp, Homo sapien
tcttctgcatttcaaagtcctcact

SEQ ID NO: 447594 - DNA, 25 bp, Homo sapien
tcctcactttgacttatttggcctt

SEQ ID NO: 447595 - DNA, 25 bp, Homo sapien
ctttgacttatttggccttcatctt

SEQ ID NO: 447596 - DNA, 25 bp, Homo sapien
ttcatcttggcatggaaggtggcag

SEQ ID NO: 447597 - DNA, 25 bp, Homo sapien
gtggcaggcagaatggaaatactcc

SEQ ID NO: 447598 - DNA, 25 bp, Homo sapien
aacagatattcttgcgtgtgtaagg

SEQ ID NO: 447599 - DNA, 25 bp, Homo sapien
tattcttgcgtgtgtaagggcagaa

SEQ ID NO: 447600 - DNA, 25 bp, Homo sapien
gggcagaagggacaagctctctatc

SEQ ID NO: 447601 - DNA, 25 bp, Homo sapien
agctctctatcccatgagactaggg

SEQ ID NO: 447602 - DNA, 25 bp, Homo sapien
ctgccacccatcacactagttaggg

SEQ ID NO: 447603 - DNA, 25 bp, Homo sapien
atcacactagttagggctggccatg

SEQ ID NO: 447604 - DNA, 25 bp, Homo sapien
ttagggctggccatgaattctatgc

SEQ ID NO: 447605 - DNA, 25 bp, Homo sapien
ggccatgaattctatgccagagtca

SEQ ID NO: 447606 - DNA, 25 bp, Homo sapien
gaattctatgccagagtcactcctg

SEQ ID NO: 447607 - DNA, 25 bp, Homo sapien
agagtcactcctgcagtctgctagg

SEQ ID NO: 447608 - DNA, 25 bp, Homo sapien
agtctgctagggatgggccttctta

SEQ ID NO: 447609 - DNA, 25 bp, Homo sapien
tagggatgggccttcttatcccact

SEQ ID NO: 447610 - DNA, 25 bp, Homo sapien
tcgcacacatcccagtctagtcttt

SEQ ID NO: 447611 - DNA, 25 bp, Homo sapien
agtctagtctttgccttcacagagt

SEQ ID NO: 447612 - DNA, 25 bp, Homo sapien
tttgccttcacagagtcctccttga

SEQ ID NO: 447613 - DNA, 25 bp, Homo sapien
cttgcactaagagctgatcaccatt

SEQ ID NO: 447614 - DNA, 25 bp, Homo sapien
gatcaccatttgagatacgcggctt

SEQ ID NO: 447615 - DNA, 25 bp, Homo sapien
gagatacgcggcttaacgcacatgt

SEQ ID NO: 447616 - DNA, 25 bp, Homo sapien
gcggcttaacgcacatgtgagtgta

SEQ ID NO: 447617 - DNA, 25 bp, Homo sapien
gcacatgtgagtgtagcttgctaca

SEQ ID NO: 447618 - DNA, 25 bp, Homo sapien
gctacatgaaaatgctaggctctag

SEQ ID NO: 447619 - DNA, 25 bp, Homo sapien
aggctctagggcatgtaaaacatga

SEQ ID NO: 447620 - DNA, 25 bp, Homo sapien
ctagattgttctaagtaatgtcatt

SEQ ID NO: 447621 - DNA, 25 bp, Homo sapien
agtaatgtcatttcggtttgtgaat

SEQ ID NO: 447622 - DNA, 25 bp, Homo sapien
gtcatttcggtttgtgaatttgatt

SEQ ID NO: 447623 - DNA, 25 bp, Homo sapien
tttcccttcatttcatgtcatattg

SEQ ID NO: 447624 - DNA, 25 bp, Homo sapien
aaactttatccatttgaatataatg

SEQ ID NO: 447625 - DNA, 25 bp, Homo sapien
gaatgttcatatttcttggtgtacc

SEQ ID NO: 447626 - DNA, 25 bp, Homo sapien
aatgttcatatttcttggtgtacca

SEQ ID NO: 447627 - DNA, 25 bp, Homo sapien
atgttcatatttcttggtgtaccaa

SEQ ID NO: 447628 - DNA, 25 bp, Homo sapien
tgttcatatttcttggtgtaccaaa

SEQ ID NO: 447629 - DNA, 25 bp, Homo sapien
gttcatatttcttggtgtaccaaag

SEQ ID NO: 447630 - DNA, 25 bp, Homo sapien
tcatatttcttggtgtaccaaagtt

SEQ ID NO: 447631 - DNA, 25 bp, Homo sapien
atatttcttggtgtaccaaagttat

SEQ ID NO: 447632 - DNA, 25 bp, Homo sapien
cagaagatttagttaacacaattgt

SEQ ID NO: 447633 - DNA, 25 bp, Homo sapien
taacttatttgcatatgttgactaa

SEQ ID NO: 447634 - DNA, 25 bp, Homo sapien
gcatatgttgactaagtcatgctgt

SEQ ID NO: 447635 - DNA, 25 bp, Homo sapien
caaggtgtagggtatgaaaatgcaa

SEQ ID NO: 447636 - DNA, 25 bp, Homo sapien
agtttaggagagcactttaccaagc

SEQ ID NO: 447637 - DNA, 25 bp, Homo sapien
caagctggtgtcctccaaactgaaa

SEQ ID NO: 447638 - DNA, 25 bp, Homo sapien
ggtgtcctccaaactgaaattgttt

SEQ ID NO: 447639 - DNA, 25 bp, Homo sapien
gaaattgtttgtaacgatagtcttt

SEQ ID NO: 447640 - DNA, 25 bp, Homo sapien
tgtaacgatagtcttttacaggttt

SEQ ID NO: 447641 - DNA, 25 bp, Homo sapien
ttcctttaaagatgtttgtgtgctt

SEQ ID NO: 447642 - DNA, 25 bp, Homo sapien
agatgtttgtgtgcttttaattgac

SEQ ID NO: 447643 - DNA, 25 bp, Homo sapien
aattgacaactaacttcttgctgct

SEQ ID NO: 447644 - DNA, 25 bp, Homo sapien
aactgctgcatgactatcatctttg

SEQ ID NO: 447645 - DNA, 25 bp, Homo sapien
gcatgactatcatctttgagtgaag

SEQ ID NO: 447646 - DNA, 25 bp, Homo sapien
aaggtttgataattgcatctgttac

SEQ ID NO: 447647 - DNA, 25 bp, Homo sapien
gataattgcatctgttactacttag

SEQ ID NO: 447648 - DNA, 25 bp, Homo sapien
aattgcatctgttactacttagttt

SEQ ID NO: 447649 - DNA, 25 bp, Homo sapien
actacttagtttcataggctttaat

SEQ ID NO: 447650 - DNA, 25 bp, Homo sapien
ataggctttaattctagtatgcatt

SEQ ID NO: 447651 - DNA, 25 bp, Homo sapien
ttctagtatgcattaaatattgggc

SEQ ID NO: 447652 - DNA, 25 bp, Homo sapien
atattgggcaaaattgcacttgact

SEQ ID NO: 447653 - DNA, 25 bp, Homo sapien
aattgcacttgactaattttttgaa

SEQ ID NO: 447654 - DNA, 25 bp, Homo sapien
gtgtatggttaaactgtaaatctta

SEQ ID NO: 447655 - DNA, 25 bp, Homo sapien
ggaaatcactgtattaggaatgtgc

SEQ ID NO: 447656 - DNA, 25 bp, Homo sapien
ctgtattaggaatgtgcaatgactt

SEQ ID NO: 447657 - DNA, 25 bp, Homo sapien
atcttggacatctttccatgccagc

SEQ ID NO: 447658 - DNA, 25 bp, Homo sapien
tggacatctttccatgccagcttgt

SEQ ID NO: 447659 - DNA, 25 bp, Homo sapien
atctttccatgccagcttgtggaga

SEQ ID NO: 447660 - DNA, 25 bp, Homo sapien
gccagcttgtggagaattccttcat

SEQ ID NO: 447661 - DNA, 25 bp, Homo sapien
aattccttcattctttttgccagct

SEQ ID NO: 447662 - DNA, 25 bp, Homo sapien
tttttgccagctacagagcatgcca

SEQ ID NO: 447663 - DNA, 25 bp, Homo sapien
gccagctacagagcatgccaataga

SEQ ID NO: 447664 - DNA, 25 bp, Homo sapien
ctttcaggctttgcactaatgagag

SEQ ID NO: 447665 - DNA, 25 bp, Homo sapien
caggctttgcactaatgagagagaa

SEQ ID NO: 447666 - DNA, 25 bp, Homo sapien
tgtgaaatgggcttgctggtgcaaa

SEQ ID NO: 447667 - DNA, 25 bp, Homo sapien
ggtgcaaagtatacaatcttttcta

SEQ ID NO: 447668 - DNA, 25 bp, Homo sapien
gcttttcaaaattcattgctggtga

SEQ ID NO: 447669 - DNA, 25 bp, Homo sapien
aggtagtccctagggatccatccag

SEQ ID NO: 447670 - DNA, 25 bp, Homo sapien
ttgctggtgatgtctattacttatt

SEQ ID NO: 447671 - DNA, 25 bp, Homo sapien
acttatttgatgtcatgtctttggc

SEQ ID NO: 447672 - DNA, 25 bp, Homo sapien
atgtctttggccaggaatgcaatcc

SEQ ID NO: 447673 - DNA, 25 bp, Homo sapien
gcaatcctaattagcattgttccag

SEQ ID NO: 447674 - DNA, 25 bp, Homo sapien
gcattgttccaggaaaacatttcat

SEQ ID NO: 447675 - DNA, 25 bp, Homo sapien
tatagggagcatatcccagaaacat

SEQ ID NO: 447676 - DNA, 25 bp, Homo sapien
tagaaaatactagtcccaatataag

SEQ ID NO: 447677 - DNA, 25 bp, Homo sapien
gatggcctctaaggtttcttctagc

SEQ ID NO: 447678 - DNA, 25 bp, Homo sapien
ctctaaggtttcttctagctcagaa

SEQ ID NO: 447679 - DNA, 25 bp, Homo sapien
gaggaagcgtaaggctgaggccgcg

SEQ ID NO: 447680 - DNA, 25 bp, Homo sapien
gcggtggtcgccgtagccgagaagc

SEQ ID NO: 447681 - DNA, 25 bp, Homo sapien
cggtggtcgccgtagccgagaagcg

SEQ ID NO: 447682 - DNA, 25 bp, Homo sapien
ggtggtcgccgtagccgagaagcga

SEQ ID NO: 447683 - DNA, 25 bp, Homo sapien
gtggtcgccgtagccgagaagcgag

SEQ ID NO: 447684 - DNA, 25 bp, Homo sapien
tcgccgtagccgagaagcgagagaa

SEQ ID NO: 447685 - DNA, 25 bp, Homo sapien
ccgtagccgagaagcgagagaagct

SEQ ID NO: 447686 - DNA, 25 bp, Homo sapien
cgagaagcgagagaagctggcgaac

SEQ ID NO: 447687 - DNA, 25 bp, Homo sapien
gaagcgagagaagctggcgaacggc

SEQ ID NO: 447688 - DNA, 25 bp, Homo sapien
aagcgagagaagctggcgaacggcg

SEQ ID NO: 447689 - DNA, 25 bp, Homo sapien
gcgagagaagctggcgaacggcggg

SEQ ID NO: 447690 - DNA, 25 bp, Homo sapien
tggccaacatgctgactcacccttc

SEQ ID NO: 447691 - DNA, 25 bp, Homo sapien
ctgactcacccttccctactgaaaa

SEQ ID NO: 447692 - DNA, 25 bp, Homo sapien
aggcgcagtggccatccctacagtg

SEQ ID NO: 447693 - DNA, 25 bp, Homo sapien
ggcgcagtggccatccctacagtgc

SEQ ID NO: 447694 - DNA, 25 bp, Homo sapien
gcgcagtggccatccctacagtgct

SEQ ID NO: 447695 - DNA, 25 bp, Homo sapien
cgcagtggccatccctacagtgcta

SEQ ID NO: 447696 - DNA, 25 bp, Homo sapien
cagtggccatccctacagtgctagc

SEQ ID NO: 447697 - DNA, 25 bp, Homo sapien
agtggccatccctacagtgctagct

SEQ ID NO: 447698 - DNA, 25 bp, Homo sapien
gtggccatccctacagtgctagcta

SEQ ID NO: 447699 - DNA, 25 bp, Homo sapien
tggccatccctacagtgctagctac

SEQ ID NO: 447700 - DNA, 25 bp, Homo sapien
ggccatccctacagtgctagctact

SEQ ID NO: 447701 - DNA, 25 bp, Homo sapien
tggccccagacctcggagaaaggat

SEQ ID NO: 447702 - DNA, 25 bp, Homo sapien
cgctaagcggtgacaaatccttgat

SEQ ID NO: 447703 - DNA, 25 bp, Homo sapien
gtatttccagagatcggcgacgtga

SEQ ID NO: 447704 - DNA, 25 bp, Homo sapien
tcggcgacgtgatgtgtaactctgt

SEQ ID NO: 447705 - DNA, 25 bp, Homo sapien
tgtgtaactctgtcaatgcaggctg

SEQ ID NO: 447706 - DNA, 25 bp, Homo sapien
atgcaggctggaatcacgactcgac

SEQ ID NO: 447707 - DNA, 25 bp, Homo sapien
gactcgacgcacgtcatcaggtttc

SEQ ID NO: 447708 - DNA, 25 bp, Homo sapien
actaaatggctactgtcacctcaac

SEQ ID NO: 447709 - DNA, 25 bp, Homo sapien
ctcagtccaggtcctcgagaggttg

SEQ ID NO: 447710 - DNA, 25 bp, Homo sapien
atttgaaatcgtgggctcctgtggg

SEQ ID NO: 447711 - DNA, 25 bp, Homo sapien
gaggagtagactcgtcccagttcag

SEQ ID NO: 447712 - DNA, 25 bp, Homo sapien
tccagatctctcgtgaatcttctca

SEQ ID NO: 447713 - DNA, 25 bp, Homo sapien
ccagatctctcgtgaatcttctcag

SEQ ID NO: 447714 - DNA, 25 bp, Homo sapien
gatctctcgtgaatcttctcagagg

SEQ ID NO: 447715 - DNA, 25 bp, Homo sapien
atctctcgtgaatcttctcagaggt

SEQ ID NO: 447716 - DNA, 25 bp, Homo sapien
tctctcgtgaatcttctcagaggta

SEQ ID NO: 447717 - DNA, 25 bp, Homo sapien
tctcgtgaatcttctcagaggtagt

SEQ ID NO: 447718 - DNA, 25 bp, Homo sapien
ctcgtgaatcttctcagaggtagtt

SEQ ID NO: 447719 - DNA, 25 bp, Homo sapien
tttccttcctctgctggcttcttgg

SEQ ID NO: 447720 - DNA, 25 bp, Homo sapien
ttccttcctctgctggcttcttggg

SEQ ID NO: 447721 - DNA, 25 bp, Homo sapien
tccttcctctgctggcttcttgggc

SEQ ID NO: 447722 - DNA, 25 bp, Homo sapien
cttcctctgctggcttcttgggcat

SEQ ID NO: 447723 - DNA, 25 bp, Homo sapien
ctttttaaccactggagactatgtg

SEQ ID NO: 447724 - DNA, 25 bp, Homo sapien
gactatgtgaaaatcttgtgttata

SEQ ID NO: 447725 - DNA, 25 bp, Homo sapien
ttccttttacttttcatgttgcata

SEQ ID NO: 447726 - DNA, 25 bp, Homo sapien
catgttgcatattttccagtgggga

SEQ ID NO: 447727 - DNA, 25 bp, Homo sapien
taaattggaggttcttattactaat

SEQ ID NO: 447728 - DNA, 25 bp, Homo sapien
tgaaactaaaatttgcttttcctgc

SEQ ID NO: 447729 - DNA, 25 bp, Homo sapien
gcttttcctgcatagacatcttttg

SEQ ID NO: 447730 - DNA, 25 bp, Homo sapien
ttcctgcatagacatcttttgttag

SEQ ID NO: 447731 - DNA, 25 bp, Homo sapien
tgcatagacatcttttgttagtcca

SEQ ID NO: 447732 - DNA, 25 bp, Homo sapien
tgccatccagtttcatgatcatgtt

SEQ ID NO: 447733 - DNA, 25 bp, Homo sapien
ctgcttgaatgatatgaaattctct

SEQ ID NO: 447734 - DNA, 25 bp, Homo sapien
aacactcagagaaactgccaaccct

SEQ ID NO: 447735 - DNA, 25 bp, Homo sapien
gagaaactgccaaccctaggatgaa

SEQ ID NO: 447736 - DNA, 25 bp, Homo sapien
ctgccaaccctaggatgaagtatat

SEQ ID NO: 447737 - DNA, 25 bp, Homo sapien
atattgttactgtgctttgggatta

SEQ ID NO: 447738 - DNA, 25 bp, Homo sapien
atagaacttttatactgatacacag

SEQ ID NO: 447739 - DNA, 25 bp, Homo sapien
actgatacacagacactaaaaaggg

SEQ ID NO: 447740 - DNA, 25 bp, Homo sapien
aaagggtttagatgagaagctctgc

SEQ ID NO: 447741 - DNA, 25 bp, Homo sapien
gcaatcaagaatctcagccactcat

SEQ ID NO: 447742 - DNA, 25 bp, Homo sapien
atctcagccactcatttctgtaggg

SEQ ID NO: 447743 - DNA, 25 bp, Homo sapien
tagcttcaggtaaccactgatccac

SEQ ID NO: 447744 - DNA, 25 bp, Homo sapien
aggtaaccactgatccacttccagt

SEQ ID NO: 447745 - DNA, 25 bp, Homo sapien
gtggagatgttgtctccagttcctg

SEQ ID NO: 447746 - DNA, 25 bp, Homo sapien
agttcctgcctttggcctccaggca

SEQ ID NO: 447747 - DNA, 25 bp, Homo sapien
taggccacatcgtgcttgcatttgt

SEQ ID NO: 447748 - DNA, 25 bp, Homo sapien
atcgtgcttgcatttgtgattcccg

SEQ ID NO: 447749 - DNA, 25 bp, Homo sapien
tgcttgcatttgtgattcccgtggc

SEQ ID NO: 447750 - DNA, 25 bp, Homo sapien
tgtgattcccgtggcccttatcagg

SEQ ID NO: 447751 - DNA, 25 bp, Homo sapien
gttacgctttatgtggccttttgat

SEQ ID NO: 447752 - DNA, 25 bp, Homo sapien
tatgtggccttttgatttctcccca

SEQ ID NO: 447753 - DNA, 25 bp, Homo sapien
ttgatttctccccacgcggttgtgc

SEQ ID NO: 447754 - DNA, 25 bp, Homo sapien
tccccacgcggttgtgcggtggatc

SEQ ID NO: 447755 - DNA, 25 bp, Homo sapien
tggatctggcggctcctcaggtgga

SEQ ID NO: 447756 - DNA, 25 bp, Homo sapien
atggccgtgaagtgtcctgggcctc

SEQ ID NO: 447757 - DNA, 25 bp, Homo sapien
tcccgaggcctctgacaaataaaca

SEQ ID NO: 447758 - DNA, 25 bp, Homo sapien
aacaagccatgagtggtgaggacac

SEQ ID NO: 447759 - DNA, 25 bp, Homo sapien
gtgaggacacagtctccttacagtt

SEQ ID NO: 447760 - DNA, 25 bp, Homo sapien
tccttacagtttccattgccaacaa

SEQ ID NO: 447761 - DNA, 25 bp, Homo sapien
attgccaacaacagccatccatatt

SEQ ID NO: 447762 - DNA, 25 bp, Homo sapien
aacaccttgaatcaagtttgtttgt

SEQ ID NO: 447763 - DNA, 25 bp, Homo sapien
gtttgtttgtatatggaggttccac

SEQ ID NO: 447764 - DNA, 25 bp, Homo sapien
atggaggttccacgtctttctttag

SEQ ID NO: 447765 - DNA, 25 bp, Homo sapien
gttccacgtctttctttaggcaggg

SEQ ID NO: 447766 - DNA, 25 bp, Homo sapien
ctttctttaggcagggaccaggcag

SEQ ID NO: 447767 - DNA, 25 bp, Homo sapien
gtagttttttcataaatgctcatca

SEQ ID NO: 447768 - DNA, 25 bp, Homo sapien
catcatatttatgttccgctgtaca

SEQ ID NO: 447769 - DNA, 25 bp, Homo sapien
ttatgttccgctgtacatgttcagt

SEQ ID NO: 447770 - DNA, 25 bp, Homo sapien
gtagtgaagctactgtgagtcttta

SEQ ID NO: 447771 - DNA, 25 bp, Homo sapien
gtttggatacacttgatgagagatg

SEQ ID NO: 447772 - DNA, 25 bp, Homo sapien
ttaagactcttaggcagctatgggt

SEQ ID NO: 447773 - DNA, 25 bp, Homo sapien
ggcagctatgggtttcttttgatca

SEQ ID NO: 447774 - DNA, 25 bp, Homo sapien
tgaacacgtttttgaagttcttcaa

SEQ ID NO: 447775 - DNA, 25 bp, Homo sapien
gaagttcttcaaaactagtcagttt

SEQ ID NO: 447776 - DNA, 25 bp, Homo sapien
tcagtttgaattttgacagctattc

SEQ ID NO: 447777 - DNA, 25 bp, Homo sapien
gctattcaatatgtgatctccaagt

SEQ ID NO: 447778 - DNA, 25 bp, Homo sapien
accacgagacactgctgcgggaggt

SEQ ID NO: 447779 - DNA, 25 bp, Homo sapien
aggtgcagaccctgcgcgaccggct

SEQ ID NO: 447780 - DNA, 25 bp, Homo sapien
agaggctgctacaggtgtaccggca

SEQ ID NO: 447781 - DNA, 25 bp, Homo sapien
ccatccaggccgtggagattcaagt

SEQ ID NO: 447782 - DNA, 25 bp, Homo sapien
gattcaagtggaaagctcctctctg

SEQ ID NO: 447783 - DNA, 25 bp, Homo sapien
tcctctctggccgacatttgcaggg

SEQ ID NO: 447784 - DNA, 25 bp, Homo sapien
atttgcagggcgcaccatgccgttg

SEQ ID NO: 447785 - DNA, 25 bp, Homo sapien
accatgccgttgtcgggcgcatgca

SEQ ID NO: 447786 - DNA, 25 bp, Homo sapien
cgcatgcagacgatggtgacagagc

SEQ ID NO: 447787 - DNA, 25 bp, Homo sapien
tcctgatctccgtgtgcagtacctc

SEQ ID NO: 447788 - DNA, 25 bp, Homo sapien
gtgtgcagtacctccgccagatcca

SEQ ID NO: 447789 - DNA, 25 bp, Homo sapien
ttttttgcagatgtttccatacaat

SEQ ID NO: 447790 - DNA, 25 bp, Homo sapien
ttttgcagatgtttccatacaattc

SEQ ID NO: 447791 - DNA, 25 bp, Homo sapien
gcagatgtttccatacaattcacat

SEQ ID NO: 447792 - DNA, 25 bp, Homo sapien
gatgtttccatacaattcacataac

SEQ ID NO: 447793 - DNA, 25 bp, Homo sapien
tttccatacaattcacataaccttt

SEQ ID NO: 447794 - DNA, 25 bp, Homo sapien
tccatacaattcacataaccttttt

SEQ ID NO: 447795 - DNA, 25 bp, Homo sapien
attcacataacctttttgtaaagag

SEQ ID NO: 447796 - DNA, 25 bp, Homo sapien
cacataacctttttgtaaagagaga

SEQ ID NO: 447797 - DNA, 25 bp, Homo sapien
gttttactgtgcattaccactttca

SEQ ID NO: 447798 - DNA, 25 bp, Homo sapien
accactttcatttaagccttatcct

SEQ ID NO: 447799 - DNA, 25 bp, Homo sapien
atttaagccttatccttgtgaattt

SEQ ID NO: 447800 - DNA, 25 bp, Homo sapien
gggttctcatcagccacgagggaga

SEQ ID NO: 447801 - DNA, 25 bp, Homo sapien
agggagacggacatggtccctgcac

SEQ ID NO: 447802 - DNA, 25 bp, Homo sapien
tccctgcaccattggagaccttgta

SEQ ID NO: 447803 - DNA, 25 bp, Homo sapien
ggagaccttgtagagcttggccagc

SEQ ID NO: 447804 - DNA, 25 bp, Homo sapien
cttgtagagcttggccagcttgcgg

SEQ ID NO: 447805 - DNA, 25 bp, Homo sapien
ggtgtcctcggtacctgcaggcaga

SEQ ID NO: 447806 - DNA, 25 bp, Homo sapien
tggagcatcgcctcgggctcagtgc

SEQ ID NO: 447807 - DNA, 25 bp, Homo sapien
cggatgcccttggacacctgtgtgg

SEQ ID NO: 447808 - DNA, 25 bp, Homo sapien
acctgtgtggccttcagtctttcat

SEQ ID NO: 447809 - DNA, 25 bp, Homo sapien
ccttcagtctttcataccgattgct

SEQ ID NO: 447810 - DNA, 25 bp, Homo sapien
taccgattgctgttggaaccacacc

SEQ ID NO: 447811 - DNA, 25 bp, Homo sapien
aaagtagtgttaatgaatccaagag

SEQ ID NO: 447812 - DNA, 25 bp, Homo sapien
gaatccaagagggagcagtcaccat

SEQ ID NO: 447813 - DNA, 25 bp, Homo sapien
atccaagagggagcagtcaccatct

SEQ ID NO: 447814 - DNA, 25 bp, Homo sapien
ccaagagggagcagtcaccatcttc

SEQ ID NO: 447815 - DNA, 25 bp, Homo sapien
cagtcaccatcttcaaatgtgatat

SEQ ID NO: 447816 - DNA, 25 bp, Homo sapien
gtcaccatcttcaaatgtgatattg

SEQ ID NO: 447817 - DNA, 25 bp, Homo sapien
aattagctgggatgtccagttgttt

SEQ ID NO: 447818 - DNA, 25 bp, Homo sapien
gctgggatgtccagttgtttaatcc

SEQ ID NO: 447819 - DNA, 25 bp, Homo sapien
gatgtccagttgtttaatccattaa

SEQ ID NO: 447820 - DNA, 25 bp, Homo sapien
tgtccagttgtttaatccattaaat

SEQ ID NO: 447821 - DNA, 25 bp, Homo sapien
aatccattaaattgtggaaacagtc

SEQ ID NO: 447822 - DNA, 25 bp, Homo sapien
gctactcggtcgggggttgaggtga

SEQ ID NO: 447823 - DNA, 25 bp, Homo sapien
tatgatcctattattgggttggtgt

SEQ ID NO: 447824 - DNA, 25 bp, Homo sapien
atgatcctattattgggttggtgtg

SEQ ID NO: 447825 - DNA, 25 bp, Homo sapien
tgatcctattattgggttggtgtgt

SEQ ID NO: 447826 - DNA, 25 bp, Homo sapien
gatcctattattgggttggtgtgtg

SEQ ID NO: 447827 - DNA, 25 bp, Homo sapien
atcctattattgggttggtgtgtga

SEQ ID NO: 447828 - DNA, 25 bp, Homo sapien
tcctattattgggttggtgtgtgat

SEQ ID NO: 447829 - DNA, 25 bp, Homo sapien
cctattattgggttggtgtgtgatc

SEQ ID NO: 447830 - DNA, 25 bp, Homo sapien
ctattattgggttggtgtgtgatcg

SEQ ID NO: 447831 - DNA, 25 bp, Homo sapien
tattattgggttggtgtgtgatcga

SEQ ID NO: 447832 - DNA, 25 bp, Homo sapien
attattgggttggtgtgtgatcgaa

SEQ ID NO: 447833 - DNA, 25 bp, Homo sapien
agccaggacagagggtggtcgtcgt

SEQ ID NO: 447834 - DNA, 25 bp, Homo sapien
gggtggtcgtcgtggatgatctgct

SEQ ID NO: 447835 - DNA, 25 bp, Homo sapien
acatctccagctggatcccagggaa

SEQ ID NO: 447836 - DNA, 25 bp, Homo sapien
tctccagctggatcccagggaaata

SEQ ID NO: 447837 - DNA, 25 bp, Homo sapien
ggatcccagggaaatatcagccttg

SEQ ID NO: 447838 - DNA, 25 bp, Homo sapien
cagggaaatatcagccttgggcaac

SEQ ID NO: 447839 - DNA, 25 bp, Homo sapien
aatatcagccttgggcaactgcagt

SEQ ID NO: 447840 - DNA, 25 bp, Homo sapien
agccttgggcaactgcagtgaccag

SEQ ID NO: 447841 - DNA, 25 bp, Homo sapien
ccttgggcaactgcagtgaccaggg

SEQ ID NO: 447842 - DNA, 25 bp, Homo sapien
aacacattcctttgctggggttcag

SEQ ID NO: 447843 - DNA, 25 bp, Homo sapien
tggggcaaagctgtgtttcagccac

SEQ ID NO: 447844 - DNA, 25 bp, Homo sapien
tgcacaactggatcgacatgaagcg

SEQ ID NO: 447845 - DNA, 25 bp, Homo sapien
actggatcgacatgaagcgggccct

SEQ ID NO: 447846 - DNA, 25 bp, Homo sapien
gatcgacatgaagcgggccctgatg

SEQ ID NO: 447847 - DNA, 25 bp, Homo sapien
tgaagcgggccctgatgatgatgaa

SEQ ID NO: 447848 - DNA, 25 bp, Homo sapien
tggaggactggctttgctgccagta

SEQ ID NO: 447849 - DNA, 25 bp, Homo sapien
gctgccagtacctggcgtctgcgga

SEQ ID NO: 447850 - DNA, 25 bp, Homo sapien
gggccctcttacagtcgctgaagct

SEQ ID NO: 447851 - DNA, 25 bp, Homo sapien
tcttacagtcgctgaagctcctgca

SEQ ID NO: 447852 - DNA, 25 bp, Homo sapien
cctttcctgtctcgccttggaagca

SEQ ID NO: 447853 - DNA, 25 bp, Homo sapien
gaagcacccatgtctccctgggaaa

SEQ ID NO: 447854 - DNA, 25 bp, Homo sapien
gtacagatgactgggatacctggat

SEQ ID NO: 447855 - DNA, 25 bp, Homo sapien
agacgtcgaagcatatagctccaaa

SEQ ID NO: 447856 - DNA, 25 bp, Homo sapien
atagctccaaagcaccttagccctg

SEQ ID NO: 447857 - DNA, 25 bp, Homo sapien
atctccttgtgtgtggaagtccatt

SEQ ID NO: 447858 - DNA, 25 bp, Homo sapien
tgcggcccaggcttgctgcttgtct

SEQ ID NO: 447859 - DNA, 25 bp, Homo sapien
aggcttgctgcttgtctggctcttc

SEQ ID NO: 447860 - DNA, 25 bp, Homo sapien
ttgtctggctcttcccggtgctggg

SEQ ID NO: 447861 - DNA, 25 bp, Homo sapien
gccgttcagcagcttcccggcagga

SEQ ID NO: 447862 - DNA, 25 bp, Homo sapien
ggaagtccatttgtgttacagcgtt

SEQ ID NO: 447863 - DNA, 25 bp, Homo sapien
tgttacagcgtttgacttccgcaca

SEQ ID NO: 447864 - DNA, 25 bp, Homo sapien
tttagttagaatgactgtggctgtg

SEQ ID NO: 447865 - DNA, 25 bp, Homo sapien
ggctgtgagttagacgtcgaagcat

SEQ ID NO: 447866 - DNA, 25 bp, Homo sapien
ggagacattattgtaccaggcctgt

SEQ ID NO: 447867 - DNA, 25 bp, Homo sapien
gtaccaggcctgttgattgcatact

SEQ ID NO: 447868 - DNA, 25 bp, Homo sapien
ggcctgttgattgcatactgtagaa

SEQ ID NO: 447869 - DNA, 25 bp, Homo sapien
tgttcagactggttcttcttacata

SEQ ID NO: 447870 - DNA, 25 bp, Homo sapien
actatgtttcgtctacagttgccta

SEQ ID NO: 447871 - DNA, 25 bp, Homo sapien
acagttgcctatgctattggcatga

SEQ ID NO: 447872 - DNA, 25 bp, Homo sapien
ggcatgatacttacatttgttgttc

SEQ ID NO: 447873 - DNA, 25 bp, Homo sapien
tctcctctatttagtaccttgcaca

SEQ ID NO: 447874 - DNA, 25 bp, Homo sapien
ttgcacacttattactgcctcagtt

SEQ ID NO: 447875 - DNA, 25 bp, Homo sapien
gcctcagttgttgcctggagacgta

SEQ ID NO: 447876 - DNA, 25 bp, Homo sapien
aacagctatcagatgatggaccatt

SEQ ID NO: 447877 - DNA, 25 bp, Homo sapien
gctcagttgcctctggaagtccttt

SEQ ID NO: 447878 - DNA, 25 bp, Homo sapien
cctctggaagtcctttctggtgtga

SEQ ID NO: 447879 - DNA, 25 bp, Homo sapien
gaagtcctttctggtgtgagaatgt

SEQ ID NO: 447880 - DNA, 25 bp, Homo sapien
gtgagaatgtgtccattgtccttct

SEQ ID NO: 447881 - DNA, 25 bp, Homo sapien
agaatgtgtccattgtccttctcca

SEQ ID NO: 447882 - DNA, 25 bp, Homo sapien
tccattccatggaccacagtggcat

SEQ ID NO: 447883 - DNA, 25 bp, Homo sapien
atggaccacagtggcatcacagctg

SEQ ID NO: 447884 - DNA, 25 bp, Homo sapien
ggaagggccaacactgcaaggtgat

SEQ ID NO: 447885 - DNA, 25 bp, Homo sapien
ggccaacactgcaaggtgatgggaa

SEQ ID NO: 447886 - DNA, 25 bp, Homo sapien
gggacttcgtgtcccctctatgttc

SEQ ID NO: 447887 - DNA, 25 bp, Homo sapien
tcccctctatgttctccttggagag

SEQ ID NO: 447888 - DNA, 25 bp, Homo sapien
tgctctacagtgctatggccgtctc

SEQ ID NO: 447889 - DNA, 25 bp, Homo sapien
gctctacagtgctatggccgtctct

SEQ ID NO: 447890 - DNA, 25 bp, Homo sapien
ctacagtgctatggccgtctctcat

SEQ ID NO: 447891 - DNA, 25 bp, Homo sapien
agtgctatggccgtctctcatcttg

SEQ ID NO: 447892 - DNA, 25 bp, Homo sapien
tgctatggccgtctctcatcttgtg

SEQ ID NO: 447893 - DNA, 25 bp, Homo sapien
tatggccgtctctcatcttgtgtgg

SEQ ID NO: 447894 - DNA, 25 bp, Homo sapien
ggccgtctctcatcttgtgtggctg

SEQ ID NO: 447895 - DNA, 25 bp, Homo sapien
cgtctctcatcttgtgtggctgttt

SEQ ID NO: 447896 - DNA, 25 bp, Homo sapien
ctctcatcttgtgtggctgttttga

SEQ ID NO: 447897 - DNA, 25 bp, Homo sapien
ctcatcttgtgtggctgttttgaga

SEQ ID NO: 447898 - DNA, 25 bp, Homo sapien
tgtgtggctgttttgagaatgggaa

SEQ ID NO: 447899 - DNA, 25 bp, Homo sapien
agtggtcacagtgctgtcactgaag

SEQ ID NO: 447900 - DNA, 25 bp, Homo sapien
tgtcactgaaggactgagcacgccg

SEQ ID NO: 447901 - DNA, 25 bp, Homo sapien
actgaaggactgagcacgccggaac

SEQ ID NO: 447902 - DNA, 25 bp, Homo sapien
gaaggactgagcacgccggaacacc

SEQ ID NO: 447903 - DNA, 25 bp, Homo sapien
aagcatcacgtctccctgaccaagg

SEQ ID NO: 447904 - DNA, 25 bp, Homo sapien
gctgaaggtgtccatgaccaggccc

SEQ ID NO: 447905 - DNA, 25 bp, Homo sapien
tgtgctcatggtaccaaggaggcca

SEQ ID NO: 447906 - DNA, 25 bp, Homo sapien
tcatggtaccaaggaggccacggag

SEQ ID NO: 447907 - DNA, 25 bp, Homo sapien
cacggagacagaggagggcccacct

SEQ ID NO: 447908 - DNA, 25 bp, Homo sapien
ggccttggccttacaccctgggagc

SEQ ID NO: 447909 - DNA, 25 bp, Homo sapien
cttggccttacaccctgggagcgtc

SEQ ID NO: 447910 - DNA, 25 bp, Homo sapien
gactctgactggcaaataatattgt

SEQ ID NO: 447911 - DNA, 25 bp, Homo sapien
tgttttgtaaatgcatgatgattat

SEQ ID NO: 447912 - DNA, 25 bp, Homo sapien
ggtactatatgaaagtgagtcaact

SEQ ID NO: 447913 - DNA, 25 bp, Homo sapien
ttagaaatgtcttaggtgacgatgg

SEQ ID NO: 447914 - DNA, 25 bp, Homo sapien
gagatgatagagttattacagtgtt

SEQ ID NO: 447915 - DNA, 25 bp, Homo sapien
tacagtgttattaagtattcctatg

SEQ ID NO: 447916 - DNA, 25 bp, Homo sapien
gttattaagtattcctatgttgcat

SEQ ID NO: 447917 - DNA, 25 bp, Homo sapien
agtattcctatgttgcattttgcaa

SEQ ID NO: 447918 - DNA, 25 bp, Homo sapien
tcctatgttgcattttgcaaatact

SEQ ID NO: 447919 - DNA, 25 bp, Homo sapien
gatgaaaataatcttgagtcacaat

SEQ ID NO: 447920 - DNA, 25 bp, Homo sapien
tcttgagtcacaataaagtaatgat

SEQ ID NO: 447921 - DNA, 25 bp, Homo sapien
ccccagagcttccagtaaaggtgaa

SEQ ID NO: 447922 - DNA, 25 bp, Homo sapien
tccagtaaaggtgaacccgacgaag

SEQ ID NO: 447923 - DNA, 25 bp, Homo sapien
acgcaaactcaaattccctgagcct

SEQ ID NO: 447924 - DNA, 25 bp, Homo sapien
caaactcaaattccctgagcctcaa

SEQ ID NO: 447925 - DNA, 25 bp, Homo sapien
aagagttgaagaagtacctgtcgta

SEQ ID NO: 447926 - DNA, 25 bp, Homo sapien
aagaagtacctgtcgtagggagatt

SEQ ID NO: 447927 - DNA, 25 bp, Homo sapien
tcgtagggagatttggctttgtgtc

SEQ ID NO: 447928 - DNA, 25 bp, Homo sapien
tgttatcgagcattgcactagctga

SEQ ID NO: 447929 - DNA, 25 bp, Homo sapien
atcgagcattgcactagctgacgcg

SEQ ID NO: 447930 - DNA, 25 bp, Homo sapien
tagctgacgcgtctatgggcgcaac

SEQ ID NO: 447931 - DNA, 25 bp, Homo sapien
tgacgcgtctatgggcgcaacgccg

SEQ ID NO: 447932 - DNA, 25 bp, Homo sapien
catggttcatgtgactctcataata

SEQ ID NO: 447933 - DNA, 25 bp, Homo sapien
tatccactaattagactcttttcct

SEQ ID NO: 447934 - DNA, 25 bp, Homo sapien
acaacacattgtaactttctaaaag

SEQ ID NO: 447935 - DNA, 25 bp, Homo sapien
cagttggtgccagatgagattaaaa

SEQ ID NO: 447936 - DNA, 25 bp, Homo sapien
aaaaatgcagttactctactagata

SEQ ID NO: 447937 - DNA, 25 bp, Homo sapien
agataatattcaccttacacttcgg

SEQ ID NO: 447938 - DNA, 25 bp, Homo sapien
tcaccttacacttcggtaaacactc

SEQ ID NO: 447939 - DNA, 25 bp, Homo sapien
taataactatttgttggtttctcaa

SEQ ID NO: 447940 - DNA, 25 bp, Homo sapien
gtttctcaaaagcaatatcccatat

SEQ ID NO: 447941 - DNA, 25 bp, Homo sapien
aaatgtgacaattcctctgtaacaa

SEQ ID NO: 447942 - DNA, 25 bp, Homo sapien
aattcctctgtaacaaagaagctga

SEQ ID NO: 447943 - DNA, 25 bp, Homo sapien
tgacattttgttcacatcaactaat

SEQ ID NO: 447944 - DNA, 25 bp, Homo sapien
atcaactaatgttcacctgtagaag

SEQ ID NO: 447945 - DNA, 25 bp, Homo sapien
gaacaaatttcgaataatccaggga

SEQ ID NO: 447946 - DNA, 25 bp, Homo sapien
ggaaacccaagagccttactggtct

SEQ ID NO: 447947 - DNA, 25 bp, Homo sapien
ttactggtcttctgtaacttccaag

SEQ ID NO: 447948 - DNA, 25 bp, Homo sapien
aacttccaagactgacagcttttta

SEQ ID NO: 447949 - DNA, 25 bp, Homo sapien
aagcatcacgttgacattagaccaa

SEQ ID NO: 447950 - DNA, 25 bp, Homo sapien
gaccaaatacttttgattcccaact

SEQ ID NO: 447951 - DNA, 25 bp, Homo sapien
aaaactgactttaccgctgcaattt

SEQ ID NO: 447952 - DNA, 25 bp, Homo sapien
gactttaccgctgcaatttttctgt

SEQ ID NO: 447953 - DNA, 25 bp, Homo sapien
ctgttttcctccttactagatactg

SEQ ID NO: 447954 - DNA, 25 bp, Homo sapien
ggatattttagtcttgttgggttag

SEQ ID NO: 447955 - DNA, 25 bp, Homo sapien
agtcttgttgggttagccatgctct

SEQ ID NO: 447956 - DNA, 25 bp, Homo sapien
gttgggttagccatgctctgaagaa

SEQ ID NO: 447957 - DNA, 25 bp, Homo sapien
ggttagccatgctctgaagaatctg

SEQ ID NO: 447958 - DNA, 25 bp, Homo sapien
atgtaaccttttatataaatctcag

SEQ ID NO: 447959 - DNA, 25 bp, Homo sapien
taaatctcagtgctaggttaacttc

SEQ ID NO: 447960 - DNA, 25 bp, Homo sapien
acttctaataagcagacgaacatgt

SEQ ID NO: 447961 - DNA, 25 bp, Homo sapien
aagcagacgaacatgttacataaat

SEQ ID NO: 447962 - DNA, 25 bp, Homo sapien
tataatgtctgtcttgtaaaaaagt

SEQ ID NO: 447963 - DNA, 25 bp, Homo sapien
actctgatatggaagttgtcatatt

SEQ ID NO: 447964 - DNA, 25 bp, Homo sapien
ataaaagcatagtgctgtttggcat

SEQ ID NO: 447965 - DNA, 25 bp, Homo sapien
gaagagttgaagaagtacctgtcgt

SEQ ID NO: 447966 - DNA, 25 bp, Homo sapien
agagttgaagaagtacctgtcgtag

SEQ ID NO: 447967 - DNA, 25 bp, Homo sapien
agttgaagaagtacctgtcgtaggg

SEQ ID NO: 447968 - DNA, 25 bp, Homo sapien
gaagaagtacctgtcgtagggagat

SEQ ID NO: 447969 - DNA, 25 bp, Homo sapien
agaagtacctgtcgtagggagattt

SEQ ID NO: 447970 - DNA, 25 bp, Homo sapien
aagtacctgtcgtagggagatttgg

SEQ ID NO: 447971 - DNA, 25 bp, Homo sapien
actagctgacgcgtctatgggcgca

SEQ ID NO: 447972 - DNA, 25 bp, Homo sapien
ctagctgacgcgtctatgggcgcaa

SEQ ID NO: 447973 - DNA, 25 bp, Homo sapien
tagctgacgcgtctatgggcgcaac

SEQ ID NO: 447974 - DNA, 25 bp, Homo sapien
agctgacgcgtctatgggcgcaacg

SEQ ID NO: 447975 - DNA, 25 bp, Homo sapien
tgacgcgtctatgggcgcaacgccg

SEQ ID NO: 447976 - DNA, 25 bp, Homo sapien
ccattatgtcaacaaatatttctaa

SEQ ID NO: 447977 - DNA, 25 bp, Homo sapien
aaatacaaacatatgggccaggctc

SEQ ID NO: 447978 - DNA, 25 bp, Homo sapien
atacaaacatatgggccaggctcag

SEQ ID NO: 447979 - DNA, 25 bp, Homo sapien
aactcaagcacagcttgtagcacat

SEQ ID NO: 447980 - DNA, 25 bp, Homo sapien
aagcacagcttgtagcacattgagt

SEQ ID NO: 447981 - DNA, 25 bp, Homo sapien
gcacagcttgtagcacattgagtta

SEQ ID NO: 447982 - DNA, 25 bp, Homo sapien
acagcttgtagcacattgagttatt

SEQ ID NO: 447983 - DNA, 25 bp, Homo sapien
gcttgtagcacattgagttattgta

SEQ ID NO: 447984 - DNA, 25 bp, Homo sapien
tagcacattgagttattgtatggtc

SEQ ID NO: 447985 - DNA, 25 bp, Homo sapien
aaaatagaacttgcagcacttttta

SEQ ID NO: 447986 - DNA, 25 bp, Homo sapien
aaatagaacttgcagcactttttat

SEQ ID NO: 447987 - DNA, 25 bp, Homo sapien
tgtacgcagagttttcatcatggat

SEQ ID NO: 447988 - DNA, 25 bp, Homo sapien
gttttcatcatggataactgtgagg

SEQ ID NO: 447989 - DNA, 25 bp, Homo sapien
aactgtgaggagctaatccctgaat

SEQ ID NO: 447990 - DNA, 25 bp, Homo sapien
gagctaatccctgaatatctgaact

SEQ ID NO: 447991 - DNA, 25 bp, Homo sapien
gtggtagactcggaggatctccctc

SEQ ID NO: 447992 - DNA, 25 bp, Homo sapien
ggaggatctccctctaaacatatcc

SEQ ID NO: 447993 - DNA, 25 bp, Homo sapien
taaacatatcccgtgagatgttgca

SEQ ID NO: 447994 - DNA, 25 bp, Homo sapien
aattctatgagcagttctctaaaaa

SEQ ID NO: 447995 - DNA, 25 bp, Homo sapien
agcttggaatacacgaagactctca

SEQ ID NO: 447996 - DNA, 25 bp, Homo sapien
acacgaagactctcaaaatcggaag

SEQ ID NO: 447997 - DNA, 25 bp, Homo sapien
aaatcggaagaagctttcagagctg

SEQ ID NO: 447998 - DNA, 25 bp, Homo sapien
gtgcagattgtaaaagtcctcatcc

SEQ ID NO: 447999 - DNA, 25 bp, Homo sapien
ccagcagaaattttatgtgaatgtg

SEQ ID NO: 448000 - DNA, 25 bp, Homo sapien
aatatccagtattgtcgcaggtgtg

SEQ ID NO: 448001 - DNA, 25 bp, Homo sapien
atccagtattgtcgcaggtgtgaga

SEQ ID NO: 448002 - DNA, 25 bp, Homo sapien
cgcaggtgtgagaaaccgtattttc

SEQ ID NO: 448003 - DNA, 25 bp, Homo sapien
gagggtaaattagaggaaagccatt

SEQ ID NO: 448004 - DNA, 25 bp, Homo sapien
ggaaagccattttagagggcaatgt

SEQ ID NO: 448005 - DNA, 25 bp, Homo sapien
gagggcaatgtggtgttacctgtca

SEQ ID NO: 448006 - DNA, 25 bp, Homo sapien
gtggtgttacctgtcagcattttga

SEQ ID NO: 448007 - DNA, 25 bp, Homo sapien
gttacctgtcagcattttgaatata

SEQ ID NO: 448008 - DNA, 25 bp, Homo sapien
ttgaatataattaccctttgccaca

SEQ ID NO: 448009 - DNA, 25 bp, Homo sapien
tgttataagttcaagtcagctctac

SEQ ID NO: 448010 - DNA, 25 bp, Homo sapien
agtcagctctacttgatatgaatag

SEQ ID NO: 448011 - DNA, 25 bp, Homo sapien
ggttagcaacctttccgtttgcatg

SEQ ID NO: 448012 - DNA, 25 bp, Homo sapien
aacctttccgtttgcatggagactt

SEQ ID NO: 448013 - DNA, 25 bp, Homo sapien
aagtagacctaagtcatcccaccat

SEQ ID NO: 448014 - DNA, 25 bp, Homo sapien
ggagacttgttactgaattaaatac

SEQ ID NO: 448015 - DNA, 25 bp, Homo sapien
acttgtttctctgcatgctgttact

SEQ ID NO: 448016 - DNA, 25 bp, Homo sapien
gctgttacttacatagttcatttgc

SEQ ID NO: 448017 - DNA, 25 bp, Homo sapien
gcattttatttgcttagctctagtt

SEQ ID NO: 448018 - DNA, 25 bp, Homo sapien
caccatcatagccaacctaattaaa

SEQ ID NO: 448019 - DNA, 25 bp, Homo sapien
cagatatccatgaaggtgttgttat

SEQ ID NO: 448020 - DNA, 25 bp, Homo sapien
ccgcagcagcaggtagtgctcatag

SEQ ID NO: 448021 - DNA, 25 bp, Homo sapien
agcagcaggtagtgctcatagctct

SEQ ID NO: 448022 - DNA, 25 bp, Homo sapien
agcaggtagtgctcatagctctctt

SEQ ID NO: 448023 - DNA, 25 bp, Homo sapien
caggtagtgctcatagctctctttg

SEQ ID NO: 448024 - DNA, 25 bp, Homo sapien
ggtagtgctcatagctctctttgtc

SEQ ID NO: 448025 - DNA, 25 bp, Homo sapien
agtgctcatagctctctttgtccag

SEQ ID NO: 448026 - DNA, 25 bp, Homo sapien
tctctttgtccagtgcttcggcctt

SEQ ID NO: 448027 - DNA, 25 bp, Homo sapien
tttgtccagtgcttcggccttggtc

SEQ ID NO: 448028 - DNA, 25 bp, Homo sapien
agtgcttcggccttggtcccagcgc

SEQ ID NO: 448029 - DNA, 25 bp, Homo sapien
acggagcagcactcttcaccctgca

SEQ ID NO: 448030 - DNA, 25 bp, Homo sapien
cctgcacagccttgttagcccaaca

SEQ ID NO: 448031 - DNA, 25 bp, Homo sapien
gagaaatttttctctgcctttcagt

SEQ ID NO: 448032 - DNA, 25 bp, Homo sapien
gaaatttttctctgcctttcagttt

SEQ ID NO: 448033 - DNA, 25 bp, Homo sapien
tttctctgcctttcagttttatgaa

SEQ ID NO: 448034 - DNA, 25 bp, Homo sapien
ctctgcctttcagttttatgaattt

SEQ ID NO: 448035 - DNA, 25 bp, Homo sapien
gacaagactaatcagtattttatta

SEQ ID NO: 448036 - DNA, 25 bp, Homo sapien
ttttttcacctaggtctaaatagct

SEQ ID NO: 448037 - DNA, 25 bp, Homo sapien
ttcacctaggtctaaatagctaact

SEQ ID NO: 448038 - DNA, 25 bp, Homo sapien
aatagctaactaactggtagaccag

SEQ ID NO: 448039 - DNA, 25 bp, Homo sapien
ggtagaccagagtattacatcatct

SEQ ID NO: 448040 - DNA, 25 bp, Homo sapien
gaccagagtattacatcatcttatt

SEQ ID NO: 448041 - DNA, 25 bp, Homo sapien
tcatcttattttggttttataccaa

SEQ ID NO: 448042 - DNA, 25 bp, Homo sapien
cccagagcctcaagaagggccattt

SEQ ID NO: 448043 - DNA, 25 bp, Homo sapien
agggccatttaggagcttgcttcaa

SEQ ID NO: 448044 - DNA, 25 bp, Homo sapien
atttaggagcttgcttcaaccattt

SEQ ID NO: 448045 - DNA, 25 bp, Homo sapien
cattttccaaccattttctgtgaaa

SEQ ID NO: 448046 - DNA, 25 bp, Homo sapien
tttctgtgaaatgctgtcagcccaa

SEQ ID NO: 448047 - DNA, 25 bp, Homo sapien
gtcagcccaaactccaaagggatgt

SEQ ID NO: 448048 - DNA, 25 bp, Homo sapien
aagggatgtgcagcctttcgtttta

SEQ ID NO: 448049 - DNA, 25 bp, Homo sapien
atgtgcagcctttcgttttaccaaa

SEQ ID NO: 448050 - DNA, 25 bp, Homo sapien
ttctttgctgtcgtttggaaaaaat

SEQ ID NO: 448051 - DNA, 25 bp, Homo sapien
aaaatgggccatgtggtggagacct

SEQ ID NO: 448052 - DNA, 25 bp, Homo sapien
ttgctgtaggtgattatccaaacaa

SEQ ID NO: 448053 - DNA, 25 bp, Homo sapien
aattgtcccattcttgttgcttctc

SEQ ID NO: 448054 - DNA, 25 bp, Homo sapien
tgagtacccactaccacaatgtctt

SEQ ID NO: 448055 - DNA, 25 bp, Homo sapien
atgtcttctgtcaaggaattacaag

SEQ ID NO: 448056 - DNA, 25 bp, Homo sapien
aatgtaaggacaggcctagggacct

SEQ ID NO: 448057 - DNA, 25 bp, Homo sapien
cctagggaccttgcaagcacttgat

SEQ ID NO: 448058 - DNA, 25 bp, Homo sapien
agcacttgatatctctcctcttgct

SEQ ID NO: 448059 - DNA, 25 bp, Homo sapien
ctcctcttgctgactttgtcaacat

SEQ ID NO: 448060 - DNA, 25 bp, Homo sapien
tgagggaggcagtcttggccctcat

SEQ ID NO: 448061 - DNA, 25 bp, Homo sapien
ggccctcatccaggtatctggtttt

SEQ ID NO: 448062 - DNA, 25 bp, Homo sapien
ctgactttcattatgtggactggat

SEQ ID NO: 448063 - DNA, 25 bp, Homo sapien
tggactggatggaggctttcaaact

SEQ ID NO: 448064 - DNA, 25 bp, Homo sapien
ctgaggttactctactaacaagcat

SEQ ID NO: 448065 - DNA, 25 bp, Homo sapien
ctctactaacaagcatcacacattt

SEQ ID NO: 448066 - DNA, 25 bp, Homo sapien
ctaacaagcatcacacatttgtatt

SEQ ID NO: 448067 - DNA, 25 bp, Homo sapien
acacatttgtattttgccctgatta

SEQ ID NO: 448068 - DNA, 25 bp, Homo sapien
acatttgtattttgccctgattaat

SEQ ID NO: 448069 - DNA, 25 bp, Homo sapien
gtattttgccctgattaatatgttg

SEQ ID NO: 448070 - DNA, 25 bp, Homo sapien
ccctgattaatatgttggcttcgct

SEQ ID NO: 448071 - DNA, 25 bp, Homo sapien
tgattaatatgttggcttcgctttc

SEQ ID NO: 448072 - DNA, 25 bp, Homo sapien
taatatgttggcttcgctttcaggg

SEQ ID NO: 448073 - DNA, 25 bp, Homo sapien
atatgttggcttcgctttcagggtt

SEQ ID NO: 448074 - DNA, 25 bp, Homo sapien
tgttggcttcgctttcagggttttt

SEQ ID NO: 448075 - DNA, 25 bp, Homo sapien
actagcccacttataagtggctcaa

SEQ ID NO: 448076 - DNA, 25 bp, Homo sapien
agtcagtctgactaatcaaaagaaa

SEQ ID NO: 448077 - DNA, 25 bp, Homo sapien
agaggttatatatcccagttttgac

SEQ ID NO: 448078 - DNA, 25 bp, Homo sapien
ggttatatatcccagttttgacctt

SEQ ID NO: 448079 - DNA, 25 bp, Homo sapien
gaaaatagcccttttactgtatgtg

SEQ ID NO: 448080 - DNA, 25 bp, Homo sapien
atagcccttttactgtatgtgatat

SEQ ID NO: 448081 - DNA, 25 bp, Homo sapien
tgtgatatattattggcatctcatt

SEQ ID NO: 448082 - DNA, 25 bp, Homo sapien
attctgcacagtccaaatgatgtag

SEQ ID NO: 448083 - DNA, 25 bp, Homo sapien
atataactatggacaccgaagatcc

SEQ ID NO: 448084 - DNA, 25 bp, Homo sapien
tggacaccgaagatccactgcaagg

SEQ ID NO: 448085 - DNA, 25 bp, Homo sapien
agtttccagctcaattggtgttgga

SEQ ID NO: 448086 - DNA, 25 bp, Homo sapien
tgtgatgtattgtcaaaactgctat

SEQ ID NO: 448087 - DNA, 25 bp, Homo sapien
aaactgctattgtcagccatggctc

SEQ ID NO: 448088 - DNA, 25 bp, Homo sapien
gctattgtcagccatggctcaatgt

SEQ ID NO: 448089 - DNA, 25 bp, Homo sapien
gattaactgtggctttttctgtcac

SEQ ID NO: 448090 - DNA, 25 bp, Homo sapien
tttttctgtcactttactctacatt

SEQ ID NO: 448091 - DNA, 25 bp, Homo sapien
ctgtcactttactctacattaaata

SEQ ID NO: 448092 - DNA, 25 bp, Homo sapien
gaacagtcaggcagacaaaaaagat

SEQ ID NO: 448093 - DNA, 25 bp, Homo sapien
gatagaaggcattcagattggaaag

SEQ ID NO: 448094 - DNA, 25 bp, Homo sapien
gaagtaaagttgtctctgttttcag

SEQ ID NO: 448095 - DNA, 25 bp, Homo sapien
aaagttgtctctgttttcagatgag

SEQ ID NO: 448096 - DNA, 25 bp, Homo sapien
tcagatgagatgatcttatgcatag

SEQ ID NO: 448097 - DNA, 25 bp, Homo sapien
gttttcagttactaaatagcatatt

SEQ ID NO: 448098 - DNA, 25 bp, Homo sapien
tagcatattattctattctgtgtat

SEQ ID NO: 448099 - DNA, 25 bp, Homo sapien
ttccttccaaatttactttgataat

SEQ ID NO: 448100 - DNA, 25 bp, Homo sapien
aaagataggagtagcacctctggct

SEQ ID NO: 448101 - DNA, 25 bp, Homo sapien
gataggagtagcacctctggctaaa

SEQ ID NO: 448102 - DNA, 25 bp, Homo sapien
aggagtagcacctctggctaaacct

SEQ ID NO: 448103 - DNA, 25 bp, Homo sapien
gagtagcacctctggctaaaccttt

SEQ ID NO: 448104 - DNA, 25 bp, Homo sapien
tagcacctctggctaaacctttttt

SEQ ID NO: 448105 - DNA, 25 bp, Homo sapien
ttttcatacccacttatttccttag

SEQ ID NO: 448106 - DNA, 25 bp, Homo sapien
tcatacccacttatttccttagaat

SEQ ID NO: 448107 - DNA, 25 bp, Homo sapien
tacccacttatttccttagaataga

SEQ ID NO: 448108 - DNA, 25 bp, Homo sapien
agtcaaaaataagaacccaagcctg

SEQ ID NO: 448109 - DNA, 25 bp, Homo sapien
taagaacccaagcctgagtaacatg

SEQ ID NO: 448110 - DNA, 25 bp, Homo sapien
gaacccaagcctgagtaacatggca

SEQ ID NO: 448111 - DNA, 25 bp, Homo sapien
acccaagcctgagtaacatggcaaa

SEQ ID NO: 448112 - DNA, 25 bp, Homo sapien
cccagctgctaaggaagctgatgtg

SEQ ID NO: 448113 - DNA, 25 bp, Homo sapien
agctgctaaggaagctgatgtgaga

SEQ ID NO: 448114 - DNA, 25 bp, Homo sapien
tgatgtgagaggattgtttcagctc

SEQ ID NO: 448115 - DNA, 25 bp, Homo sapien
gatgtgagaggattgtttcagctca

SEQ ID NO: 448116 - DNA, 25 bp, Homo sapien
atgtgagaggattgtttcagctcag

SEQ ID NO: 448117 - DNA, 25 bp, Homo sapien
tgtgagaggattgtttcagctcagg

SEQ ID NO: 448118 - DNA, 25 bp, Homo sapien
aggattgtttcagctcaggaggcag

SEQ ID NO: 448119 - DNA, 25 bp, Homo sapien
actggatgcttggagtccacactaa

SEQ ID NO: 448120 - DNA, 25 bp, Homo sapien
gcttggagtccacactaacagcaca

SEQ ID NO: 448121 - DNA, 25 bp, Homo sapien
agcacaactgattctcggcagctga

SEQ ID NO: 448122 - DNA, 25 bp, Homo sapien
attctcggcagctgacgacgggagt

SEQ ID NO: 448123 - DNA, 25 bp, Homo sapien
tcactgtgaagattggctggaccaa

SEQ ID NO: 448124 - DNA, 25 bp, Homo sapien
gaggaatgacacgagcaattcttcc

SEQ ID NO: 448125 - DNA, 25 bp, Homo sapien
agagtttaatttgcgagtctttgat

SEQ ID NO: 448126 - DNA, 25 bp, Homo sapien
agtctttgatatacaccatgccctg

SEQ ID NO: 448127 - DNA, 25 bp, Homo sapien
gatatacaccatgccctggataaac

SEQ ID NO: 448128 - DNA, 25 bp, Homo sapien
agctctggaacaattcctgtctgga

SEQ ID NO: 448129 - DNA, 25 bp, Homo sapien
ggccgagcatgtgggcagaaacctc

SEQ ID NO: 448130 - DNA, 25 bp, Homo sapien
ggtcccagccaagattcctctttcc

SEQ ID NO: 448131 - DNA, 25 bp, Homo sapien
gtcccagccaagattcctctttcca

SEQ ID NO: 448132 - DNA, 25 bp, Homo sapien
agccaagattcctctttccaccagg

SEQ ID NO: 448133 - DNA, 25 bp, Homo sapien
gccaagattcctctttccaccaggc

SEQ ID NO: 448134 - DNA, 25 bp, Homo sapien
ccaagattcctctttccaccaggca

SEQ ID NO: 448135 - DNA, 25 bp, Homo sapien
agattcctctttccaccaggcacgg

SEQ ID NO: 448136 - DNA, 25 bp, Homo sapien
ttcctctttccaccaggcacggtgt

SEQ ID NO: 448137 - DNA, 25 bp, Homo sapien
ggaggttgcagttgaacccggcagg

SEQ ID NO: 448138 - DNA, 25 bp, Homo sapien
gaggttgcagttgaacccggcaggc

SEQ ID NO: 448139 - DNA, 25 bp, Homo sapien
aggttgcagttgaacccggcaggcg

SEQ ID NO: 448140 - DNA, 25 bp, Homo sapien
gttgcagttgaacccggcaggcgga

SEQ ID NO: 448141 - DNA, 25 bp, Homo sapien
tactgaccttagttttctgacaaga

SEQ ID NO: 448142 - DNA, 25 bp, Homo sapien
tctgacaagattaatccttctcccc

SEQ ID NO: 448143 - DNA, 25 bp, Homo sapien
gtgtatgttcagtgtattgcaaaga

SEQ ID NO: 448144 - DNA, 25 bp, Homo sapien
attataatggctggtcagaggaacc

SEQ ID NO: 448145 - DNA, 25 bp, Homo sapien
gaggaaccagatactgtcatacttt

SEQ ID NO: 448146 - DNA, 25 bp, Homo sapien
aaagtatatttagctctgggcaaaa

SEQ ID NO: 448147 - DNA, 25 bp, Homo sapien
aataacatcaattggctctccttag

SEQ ID NO: 448148 - DNA, 25 bp, Homo sapien
aattggctctccttagttctcagaa

SEQ ID NO: 448149 - DNA, 25 bp, Homo sapien
gttctcagaatctgtcagactggta

SEQ ID NO: 448150 - DNA, 25 bp, Homo sapien
ggtattattagccaagtctgatttt

SEQ ID NO: 448151 - DNA, 25 bp, Homo sapien
ttgtattttattctactgaccttag

SEQ ID NO: 448152 - DNA, 25 bp, Homo sapien
tctgcaccccaaatgcctgttaggg

SEQ ID NO: 448153 - DNA, 25 bp, Homo sapien
ccaaatgcctgttagggaggatagt

SEQ ID NO: 448154 - DNA, 25 bp, Homo sapien
cccatctctctgaggtgaccttgta

SEQ ID NO: 448155 - DNA, 25 bp, Homo sapien
ctgaggtgaccttgtagggcagtcc

SEQ ID NO: 448156 - DNA, 25 bp, Homo sapien
accttgtagggcagtccgtgctgtc

SEQ ID NO: 448157 - DNA, 25 bp, Homo sapien
cagtccgtgctgtctggctggcctg

SEQ ID NO: 448158 - DNA, 25 bp, Homo sapien
tcgctggccttgctctgcgtgctga

SEQ ID NO: 448159 - DNA, 25 bp, Homo sapien
ctctgcgtgctgacttcatcctgat

SEQ ID NO: 448160 - DNA, 25 bp, Homo sapien
gacttcatcctgatagtaccttgat

SEQ ID NO: 448161 - DNA, 25 bp, Homo sapien
atcctgatagtaccttgattttcct

SEQ ID NO: 448162 - DNA, 25 bp, Homo sapien
tagtaccttgattttcctactgtga

SEQ ID NO: 448163 - DNA, 25 bp, Homo sapien
gttgcctcatagaagtataactgcc

SEQ ID NO: 448164 - DNA, 25 bp, Homo sapien
agaagtataactgcccaatctatga

SEQ ID NO: 448165 - DNA, 25 bp, Homo sapien
ctgcccaatctatgagtaaagtgta

SEQ ID NO: 448166 - DNA, 25 bp, Homo sapien
gcagaagcacatttaaagcactttt

SEQ ID NO: 448167 - DNA, 25 bp, Homo sapien
aaaagctagttccttacctgcttgg

SEQ ID NO: 448168 - DNA, 25 bp, Homo sapien
agttccttacctgcttggaaatctt

SEQ ID NO: 448169 - DNA, 25 bp, Homo sapien
ttttgtttgttcttctattcctttg

SEQ ID NO: 448170 - DNA, 25 bp, Homo sapien
gttcttctattcctttgttaatcag

SEQ ID NO: 448171 - DNA, 25 bp, Homo sapien
gttaatcagatgtaatccctttctt

SEQ ID NO: 448172 - DNA, 25 bp, Homo sapien
gatgtaatccctttctttaatgtgt

SEQ ID NO: 448173 - DNA, 25 bp, Homo sapien
ttcttggtccaccatgtttacaggt

SEQ ID NO: 448174 - DNA, 25 bp, Homo sapien
aaaggcaagggaagactcaatttgt

SEQ ID NO: 448175 - DNA, 25 bp, Homo sapien
gcaagggaagactcaatttgttgtt

SEQ ID NO: 448176 - DNA, 25 bp, Homo sapien
gggaagactcaatttgttgttgtca

SEQ ID NO: 448177 - DNA, 25 bp, Homo sapien
atgagagaattgttgatagccggta

SEQ ID NO: 448178 - DNA, 25 bp, Homo sapien
gagagaattgttgatagccggtaaa

SEQ ID NO: 448179 - DNA, 25 bp, Homo sapien
gagaattgttgatagccggtaaaat

SEQ ID NO: 448180 - DNA, 25 bp, Homo sapien
gttgatagccggtaaaattatagac

SEQ ID NO: 448181 - DNA, 25 bp, Homo sapien
gatagccggtaaaattatagactac

SEQ ID NO: 448182 - DNA, 25 bp, Homo sapien
ttatagactaccaaacctagctggg

SEQ ID NO: 448183 - DNA, 25 bp, Homo sapien
tatagactaccaaacctagctgggc

SEQ ID NO: 448184 - DNA, 25 bp, Homo sapien
atagactaccaaacctagctgggcg

SEQ ID NO: 448185 - DNA, 25 bp, Homo sapien
gaccacaacaagcaagcatgcagct

SEQ ID NO: 448186 - DNA, 25 bp, Homo sapien
agcaagcatgcagcttactgcttga

SEQ ID NO: 448187 - DNA, 25 bp, Homo sapien
tgcagtggcctttgaagcttactac

SEQ ID NO: 448188 - DNA, 25 bp, Homo sapien
agtggcctttgaagcttactacagc

SEQ ID NO: 448189 - DNA, 25 bp, Homo sapien
gcctttgaagcttactacagcctca

SEQ ID NO: 448190 - DNA, 25 bp, Homo sapien
tcagcctcccagtggtctttgtaga

SEQ ID NO: 448191 - DNA, 25 bp, Homo sapien
tcccagtggtctttgtagactgcct

SEQ ID NO: 448192 - DNA, 25 bp, Homo sapien
agtggtctttgtagactgcctgatg

SEQ ID NO: 448193 - DNA, 25 bp, Homo sapien
gtagactgcctgatggagtctcatg

SEQ ID NO: 448194 - DNA, 25 bp, Homo sapien
tgcctgatggagtctcatggcacaa

SEQ ID NO: 448195 - DNA, 25 bp, Homo sapien
atggagtctcatggcacaagaagat

SEQ ID NO: 448196 - DNA, 25 bp, Homo sapien
gcgtcgacccaaggctagcaaaaat

SEQ ID NO: 448197 - DNA, 25 bp, Homo sapien
aaatccagacctgattgaagtgcag

SEQ ID NO: 448198 - DNA, 25 bp, Homo sapien
gaagtgcagaatcacatcatcatgt

SEQ ID NO: 448199 - DNA, 25 bp, Homo sapien
atcatcatgtttctgaaagccgctg

SEQ ID NO: 448200 - DNA, 25 bp, Homo sapien
aaagccgctggatttccaacagcct

SEQ ID NO: 448201 - DNA, 25 bp, Homo sapien
caacagcctctgtgtgtcacactaa

SEQ ID NO: 448202 - DNA, 25 bp, Homo sapien
ggagacaacacagcttctctcgtgt

SEQ ID NO: 448203 - DNA, 25 bp, Homo sapien
tctcgtgtctgtagatagtggctct

SEQ ID NO: 448204 - DNA, 25 bp, Homo sapien
gctgctgacttacctcccaggaaga

SEQ ID NO: 448205 - DNA, 25 bp, Homo sapien
cccaggaagacccatcgctgagctt

SEQ ID NO: 448206 - DNA, 25 bp, Homo sapien
gccaaattggataagacactgcaga

SEQ ID NO: 448207 - DNA, 25 bp, Homo sapien
gtggagcatatctaggtgccttctc

SEQ ID NO: 448208 - DNA, 25 bp, Homo sapien
caactcagaccctttgactgtacaa

SEQ ID NO: 448209 - DNA, 25 bp, Homo sapien
catatctcaatgctacagtctttaa

SEQ ID NO: 448210 - DNA, 25 bp, Homo sapien
caatgctacagtctttaagcccctg

SEQ ID NO: 448211 - DNA, 25 bp, Homo sapien
agcatttcaaagcactcttgctgtg

SEQ ID NO: 448212 - DNA, 25 bp, Homo sapien
tttcaaagcactcttgctgtgccgg

SEQ ID NO: 448213 - DNA, 25 bp, Homo sapien
gctacagtctttaagcccctgttat

SEQ ID NO: 448214 - DNA, 25 bp, Homo sapien
taagcccctgttataagaactcgga

SEQ ID NO: 448215 - DNA, 25 bp, Homo sapien
gttataagaactcggaggcttcagg

SEQ ID NO: 448216 - DNA, 25 bp, Homo sapien
gggtgacaggaaacaccagaacgct

SEQ ID NO: 448217 - DNA, 25 bp, Homo sapien
accagaacgctatggtggagcatat

SEQ ID NO: 448218 - DNA, 25 bp, Homo sapien
tacttgttttctaaggtaggtgcat

SEQ ID NO: 448219 - DNA, 25 bp, Homo sapien
gtaggtgcatggatacacaaaccaa

SEQ ID NO: 448220 - DNA, 25 bp, Homo sapien
tatgcattaagtatgtcttgctcat

SEQ ID NO: 448221 - DNA, 25 bp, Homo sapien
agtatctaacagaatgacacagtgt

SEQ ID NO: 448222 - DNA, 25 bp, Homo sapien
aaacgctaacatcgaactcttggca

SEQ ID NO: 448223 - DNA, 25 bp, Homo sapien
aacatcgaactcttggcacactaag

SEQ ID NO: 448224 - DNA, 25 bp, Homo sapien
ggcacactaagaaaaatgacgctca

SEQ ID NO: 448225 - DNA, 25 bp, Homo sapien
aaaatgacgctcaacttttcactgt

SEQ ID NO: 448226 - DNA, 25 bp, Homo sapien
gacgctcaacttttcactgttgtga

SEQ ID NO: 448227 - DNA, 25 bp, Homo sapien
ttcactgttgtgaacacttgctttc

SEQ ID NO: 448228 - DNA, 25 bp, Homo sapien
aacacttgctttcacttgctatgca

SEQ ID NO: 448229 - DNA, 25 bp, Homo sapien
ctggggtcttcttaaccagtacata

SEQ ID NO: 448230 - DNA, 25 bp, Homo sapien
taactttagcttatgtttgaagtag

SEQ ID NO: 448231 - DNA, 25 bp, Homo sapien
gtagtttgtttatagtgtcatggat

SEQ ID NO: 448232 - DNA, 25 bp, Homo sapien
cttcactaaaacctattttcatatg

SEQ ID NO: 448233 - DNA, 25 bp, Homo sapien
aacctattttcatatgatatacatg

SEQ ID NO: 448234 - DNA, 25 bp, Homo sapien
tttcccttttattttggtcatgcat

SEQ ID NO: 448235 - DNA, 25 bp, Homo sapien
cccttttattttggtcatgcatcaa

SEQ ID NO: 448236 - DNA, 25 bp, Homo sapien
ggtcatgcatcaaaataaatttact

SEQ ID NO: 448237 - DNA, 25 bp, Homo sapien
tactaagtactaaagagccaacatt

SEQ ID NO: 448238 - DNA, 25 bp, Homo sapien
gtactaaagagccaacattatttta

SEQ ID NO: 448239 - DNA, 25 bp, Homo sapien
ataggtattcactagttgaatagtt

SEQ ID NO: 448240 - DNA, 25 bp, Homo sapien
atgaaagtgctagccttctttctcg

SEQ ID NO: 448241 - DNA, 25 bp, Homo sapien
gccttctttctcgtggctggaataa

SEQ ID NO: 448242 - DNA, 25 bp, Homo sapien
ctcgtggctggaataagaaatgcaa

SEQ ID NO: 448243 - DNA, 25 bp, Homo sapien
ttaacagagagctgatacccggact

SEQ ID NO: 448244 - DNA, 25 bp, Homo sapien
agagagctgatacccggactggtaa

SEQ ID NO: 448245 - DNA, 25 bp, Homo sapien
gatacccggactggtaatcccacaa

SEQ ID NO: 448246 - DNA, 25 bp, Homo sapien
tggtaatcccacaactcactatttt

SEQ ID NO: 448247 - DNA, 25 bp, Homo sapien
ccacaactcactattttgggaggaa

SEQ ID NO: 448248 - DNA, 25 bp, Homo sapien
ggaaacattccccagagctgtgctc

SEQ ID NO: 448249 - DNA, 25 bp, Homo sapien
gctcctggtctcacctgcaaaaaag

SEQ ID NO: 448250 - DNA, 25 bp, Homo sapien
agaattgcagccacctaagagaaag

SEQ ID NO: 448251 - DNA, 25 bp, Homo sapien
tgggaaaggcagtaccattcctagt

SEQ ID NO: 448252 - DNA, 25 bp, Homo sapien
gtaccattcctagttatgagtgaag

SEQ ID NO: 448253 - DNA, 25 bp, Homo sapien
gtgaagcatccactttcttttgtaa

SEQ ID NO: 448254 - DNA, 25 bp, Homo sapien
ttcttgttaggctgtccatgcccta

SEQ ID NO: 448255 - DNA, 25 bp, Homo sapien
atgccctaaggatgggttcctgttt

SEQ ID NO: 448256 - DNA, 25 bp, Homo sapien
gcttactgcatgtttatatctccca

SEQ ID NO: 448257 - DNA, 25 bp, Homo sapien
tttatatctcccaaggactgttctc

SEQ ID NO: 448258 - DNA, 25 bp, Homo sapien
gcatcacgcagtttcatccaagttg

SEQ ID NO: 448259 - DNA, 25 bp, Homo sapien
atccaagttgtttcaggaattgctg

SEQ ID NO: 448260 - DNA, 25 bp, Homo sapien
ctgggtgcagttctatcccctaaag

SEQ ID NO: 448261 - DNA, 25 bp, Homo sapien
gttctatcccctaaagcctagggtg

SEQ ID NO: 448262 - DNA, 25 bp, Homo sapien
ctgcggggagcggagacgcctttta

SEQ ID NO: 448263 - DNA, 25 bp, Homo sapien
tgcggggagcggagacgccttttat

SEQ ID NO: 448264 - DNA, 25 bp, Homo sapien
gcggggagcggagacgccttttatc

SEQ ID NO: 448265 - DNA, 25 bp, Homo sapien
cggggagcggagacgccttttatct

SEQ ID NO: 448266 - DNA, 25 bp, Homo sapien
ggggagcggagacgccttttatctc

SEQ ID NO: 448267 - DNA, 25 bp, Homo sapien
gggagcggagacgccttttatctct

SEQ ID NO: 448268 - DNA, 25 bp, Homo sapien
ggagcggagacgccttttatctctg

SEQ ID NO: 448269 - DNA, 25 bp, Homo sapien
gagcggagacgccttttatctctgg

SEQ ID NO: 448270 - DNA, 25 bp, Homo sapien
agcggagacgccttttatctctgga

SEQ ID NO: 448271 - DNA, 25 bp, Homo sapien
tatttttcgcaggagcaatcctttt

SEQ ID NO: 448272 - DNA, 25 bp, Homo sapien
ggagcaatccttttataccatgaat

SEQ ID NO: 448273 - DNA, 25 bp, Homo sapien
gcaatccttttataccatgaatatt

SEQ ID NO: 448274 - DNA, 25 bp, Homo sapien
gtcagattctgaatatttcttcttt

SEQ ID NO: 448275 - DNA, 25 bp, Homo sapien
gttattttaccatgtgttaccaaga

SEQ ID NO: 448276 - DNA, 25 bp, Homo sapien
ccatgtgttaccaagatgaaactgt

SEQ ID NO: 448277 - DNA, 25 bp, Homo sapien
gaaactgtatgggtagcttttttgt

SEQ ID NO: 448278 - DNA, 25 bp, Homo sapien
tgtttttagttgtaggtcgcagcgg

SEQ ID NO: 448279 - DNA, 25 bp, Homo sapien
gggaaattttttgcgactgtacaca

SEQ ID NO: 448280 - DNA, 25 bp, Homo sapien
tttttgcgactgtacacatagctgc

SEQ ID NO: 448281 - DNA, 25 bp, Homo sapien
gactgtacacatagctgcagcatta

SEQ ID NO: 448282 - DNA, 25 bp, Homo sapien
agacaaggctgacaagcaatccagg

SEQ ID NO: 448283 - DNA, 25 bp, Homo sapien
ccagggacaagatactcaccaggat

SEQ ID NO: 448284 - DNA, 25 bp, Homo sapien
cagggacaagatactcaccaggatg

SEQ ID NO: 448285 - DNA, 25 bp, Homo sapien
agggacaagatactcaccaggatga

SEQ ID NO: 448286 - DNA, 25 bp, Homo sapien
gggacaagatactcaccaggatgag

SEQ ID NO: 448287 - DNA, 25 bp, Homo sapien
ggacaagatactcaccaggatgagg

SEQ ID NO: 448288 - DNA, 25 bp, Homo sapien
gacaagatactcaccaggatgagga

SEQ ID NO: 448289 - DNA, 25 bp, Homo sapien
agatactcaccaggatgaggaagag

SEQ ID NO: 448290 - DNA, 25 bp, Homo sapien
gatactcaccaggatgaggaagagg

SEQ ID NO: 448291 - DNA, 25 bp, Homo sapien
acgggcttcccctgtgagcagcaga

SEQ ID NO: 448292 - DNA, 25 bp, Homo sapien
gcataataaatgaggccactgtgcc

SEQ ID NO: 448293 - DNA, 25 bp, Homo sapien
tcaggctgtgaatcagagtctagag

SEQ ID NO: 448294 - DNA, 25 bp, Homo sapien
caggctgtgaatcagagtctagagc

SEQ ID NO: 448295 - DNA, 25 bp, Homo sapien
gctgtgaatcagagtctagagccta

SEQ ID NO: 448296 - DNA, 25 bp, Homo sapien
ctgtgaatcagagtctagagcctaa

SEQ ID NO: 448297 - DNA, 25 bp, Homo sapien
tgtgaatcagagtctagagcctaag

SEQ ID NO: 448298 - DNA, 25 bp, Homo sapien
gtgaatcagagtctagagcctaaga

SEQ ID NO: 448299 - DNA, 25 bp, Homo sapien
tgaatcagagtctagagcctaagat

SEQ ID NO: 448300 - DNA, 25 bp, Homo sapien
gaatcagagtctagagcctaagata

SEQ ID NO: 448301 - DNA, 25 bp, Homo sapien
atcagagtctagagcctaagataaa

SEQ ID NO: 448302 - DNA, 25 bp, Homo sapien
tcagagtctagagcctaagataaaa

SEQ ID NO: 448303 - DNA, 25 bp, Homo sapien
aaagaagataccagggctgggccac

SEQ ID NO: 448304 - DNA, 25 bp, Homo sapien
gcagcctgttcttactccagctcaa

SEQ ID NO: 448305 - DNA, 25 bp, Homo sapien
cttactccagctcaacccattgggt

SEQ ID NO: 448306 - DNA, 25 bp, Homo sapien
taggctttatttgtaagagcagttt

SEQ ID NO: 448307 - DNA, 25 bp, Homo sapien
attaggcacaaagggattcccatat

SEQ ID NO: 448308 - DNA, 25 bp, Homo sapien
aaagggattcccatatccctcctct

SEQ ID NO: 448309 - DNA, 25 bp, Homo sapien
cccctctaattagcatgttgcatta

SEQ ID NO: 448310 - DNA, 25 bp, Homo sapien
gcatgttgcattagcatggcacttt

SEQ ID NO: 448311 - DNA, 25 bp, Homo sapien
agcatggcactttgttacaactgat

SEQ ID NO: 448312 - DNA, 25 bp, Homo sapien
ggcactttgttacaactgatgaact

SEQ ID NO: 448313 - DNA, 25 bp, Homo sapien
gaacttgtattcattattagctaca

SEQ ID NO: 448314 - DNA, 25 bp, Homo sapien
ttagctacagtgttcatagtttata

SEQ ID NO: 448315 - DNA, 25 bp, Homo sapien
cggtatgaaagcttgacagatccca

SEQ ID NO: 448316 - DNA, 25 bp, Homo sapien
gacagatcccagtaaattagactct

SEQ ID NO: 448317 - DNA, 25 bp, Homo sapien
gggaaagagctgcatattaacctta

SEQ ID NO: 448318 - DNA, 25 bp, Homo sapien
aagatcgaactctcactattgtgga

SEQ ID NO: 448319 - DNA, 25 bp, Homo sapien
gaatgaccaaggctgacttgatcaa

SEQ ID NO: 448320 - DNA, 25 bp, Homo sapien
gatcaataaccttggtactatcgcc

SEQ ID NO: 448321 - DNA, 25 bp, Homo sapien
gtactatcgccaagtctgggaccaa

SEQ ID NO: 448322 - DNA, 25 bp, Homo sapien
gtctgggaccaaagcgttcatggaa

SEQ ID NO: 448323 - DNA, 25 bp, Homo sapien
tcatggaagctttgcaggctggtgc

SEQ ID NO: 448324 - DNA, 25 bp, Homo sapien
atctctatgattggccagttcggtg

SEQ ID NO: 448325 - DNA, 25 bp, Homo sapien
gttcggtgttggtttttattctgct

SEQ ID NO: 448326 - DNA, 25 bp, Homo sapien
aatgtgcaggtaacacctgctgcta

SEQ ID NO: 448327 - DNA, 25 bp, Homo sapien
cctaatcagagtaacgttttcattg

SEQ ID NO: 448328 - DNA, 25 bp, Homo sapien
atcagagtaacgttttcattgagta

SEQ ID NO: 448329 - DNA, 25 bp, Homo sapien
gagtaacgttttcattgagtacaca

SEQ ID NO: 448330 - DNA, 25 bp, Homo sapien
tacacattcagacatgagaatcttc

SEQ ID NO: 448331 - DNA, 25 bp, Homo sapien
acacattcagacatgagaatcttca

SEQ ID NO: 448332 - DNA, 25 bp, Homo sapien
cacattcagacatgagaatcttcac

SEQ ID NO: 448333 - DNA, 25 bp, Homo sapien
acattcagacatgagaatcttcact

SEQ ID NO: 448334 - DNA, 25 bp, Homo sapien
cattcagacatgagaatcttcactt

SEQ ID NO: 448335 - DNA, 25 bp, Homo sapien
attcagacatgagaatcttcacttt

SEQ ID NO: 448336 - DNA, 25 bp, Homo sapien
ttcagacatgagaatcttcactttc

SEQ ID NO: 448337 - DNA, 25 bp, Homo sapien
tggtcctcgatcttgctctgctgtt

SEQ ID NO: 448338 - DNA, 25 bp, Homo sapien
gtcctcgatcttgctctgctgtttc

SEQ ID NO: 448339 - DNA, 25 bp, Homo sapien
gggattctagaagcagttcggttat

SEQ ID NO: 448340 - DNA, 25 bp, Homo sapien
gaagcagttcggttatacctgggca

SEQ ID NO: 448341 - DNA, 25 bp, Homo sapien
gcagttcggttatacctgggcacca

SEQ ID NO: 448342 - DNA, 25 bp, Homo sapien
ccctagtgttgtgggcggactgggc

SEQ ID NO: 448343 - DNA, 25 bp, Homo sapien
ttgtgggcggactgggccctcagcg

SEQ ID NO: 448344 - DNA, 25 bp, Homo sapien
ttcacggcctggaggccgtcctgca

SEQ ID NO: 448345 - DNA, 25 bp, Homo sapien
aggccgtcctgcaggtggttgccat

SEQ ID NO: 448346 - DNA, 25 bp, Homo sapien
tcctgcaggtggttgccatcgcggc

SEQ ID NO: 448347 - DNA, 25 bp, Homo sapien
aggtggttgccatcgcggccttcac

SEQ ID NO: 448348 - DNA, 25 bp, Homo sapien
ttttaccatgtgttaccaagatgaa

SEQ ID NO: 448349 - DNA, 25 bp, Homo sapien
ccatgtgttaccaagatgaaactgt

SEQ ID NO: 448350 - DNA, 25 bp, Homo sapien
gatgaaactgtatgggtagcttttt

SEQ ID NO: 448351 - DNA, 25 bp, Homo sapien
gaaactgtatgggtagcttttttgt

SEQ ID NO: 448352 - DNA, 25 bp, Homo sapien
tttgtttttagttgtaggtcgcagc

SEQ ID NO: 448353 - DNA, 25 bp, Homo sapien
tgtttttagttgtaggtcgcagcgg

SEQ ID NO: 448354 - DNA, 25 bp, Homo sapien
gggaaattttttgcgactgtacaca

SEQ ID NO: 448355 - DNA, 25 bp, Homo sapien
gaaattttttgcgactgtacacata

SEQ ID NO: 448356 - DNA, 25 bp, Homo sapien
tttttgcgactgtacacatagctgc

SEQ ID NO: 448357 - DNA, 25 bp, Homo sapien
gcgactgtacacatagctgcagcat

SEQ ID NO: 448358 - DNA, 25 bp, Homo sapien
gactgtacacatagctgcagcatta

SEQ ID NO: 448359 - DNA, 25 bp, Homo sapien
ttagcaatttttgtctcatcagaag

SEQ ID NO: 448360 - DNA, 25 bp, Homo sapien
agaagtcttcacatatgctggctag

SEQ ID NO: 448361 - DNA, 25 bp, Homo sapien
acatatgctggctaggaaggaaaac

SEQ ID NO: 448362 - DNA, 25 bp, Homo sapien
aagaagaccgtgttaatgagctaca

SEQ ID NO: 448363 - DNA, 25 bp, Homo sapien
tgagctacactaaactcacgtctcc

SEQ ID NO: 448364 - DNA, 25 bp, Homo sapien
taaactcacgtctccattccatctt

SEQ ID NO: 448365 - DNA, 25 bp, Homo sapien
attccatcttgcatgtactccttac

SEQ ID NO: 448366 - DNA, 25 bp, Homo sapien
atgtactccttaccccatatttgag

SEQ ID NO: 448367 - DNA, 25 bp, Homo sapien
gttatataaagctccatgtacaatt

SEQ ID NO: 448368 - DNA, 25 bp, Homo sapien
gctccatgtacaattctttcatagg

SEQ ID NO: 448369 - DNA, 25 bp, Homo sapien
taaacctctaagacttcctttagca

SEQ ID NO: 448370 - DNA, 25 bp, Homo sapien
tgttccatgccctattctgatttct

SEQ ID NO: 448371 - DNA, 25 bp, Homo sapien
tctgatttctggtgaactttggagc

SEQ ID NO: 448372 - DNA, 25 bp, Homo sapien
gaactttggagcagcctggtttttc

SEQ ID NO: 448373 - DNA, 25 bp, Homo sapien
gtcaggtgtgtctgggaagtcctaa

SEQ ID NO: 448374 - DNA, 25 bp, Homo sapien
gtctgggaagtcctaagagctgcct

SEQ ID NO: 448375 - DNA, 25 bp, Homo sapien
gagctgcctggagtttcaaggcatt

SEQ ID NO: 448376 - DNA, 25 bp, Homo sapien
gcctggagtttcaaggcattcttaa

SEQ ID NO: 448377 - DNA, 25 bp, Homo sapien
gcattcttaaaaacgttcttgccta

SEQ ID NO: 448378 - DNA, 25 bp, Homo sapien
aaacgttcttgcctaatcagatggt

SEQ ID NO: 448379 - DNA, 25 bp, Homo sapien
gttcttgcctaatcagatggtgtca

SEQ ID NO: 448380 - DNA, 25 bp, Homo sapien
ttgcctaatcagatggtgtcagtag

SEQ ID NO: 448381 - DNA, 25 bp, Homo sapien
aagcaaaagctcaccagccagagat

SEQ ID NO: 448382 - DNA, 25 bp, Homo sapien
aagctcaccagccagagataaagtg

SEQ ID NO: 448383 - DNA, 25 bp, Homo sapien
ccagagataaagtgaggccagctca

SEQ ID NO: 448384 - DNA, 25 bp, Homo sapien
gtgagcagtggcgatttattccctc

SEQ ID NO: 448385 - DNA, 25 bp, Homo sapien
agtggcgatttattccctctggtgt

SEQ ID NO: 448386 - DNA, 25 bp, Homo sapien
gatttattccctctggtgttccatg

SEQ ID NO: 448387 - DNA, 25 bp, Homo sapien
tctggtgttccatgttagcctgaca

SEQ ID NO: 448388 - DNA, 25 bp, Homo sapien
tgttccatgttagcctgacacagag

SEQ ID NO: 448389 - DNA, 25 bp, Homo sapien
tccatgttagcctgacacagagccc

SEQ ID NO: 448390 - DNA, 25 bp, Homo sapien
ttctcaggggctcttgatccaaaac

SEQ ID NO: 448391 - DNA, 25 bp, Homo sapien
ttctctcagcttcttctaatgttaa

SEQ ID NO: 448392 - DNA, 25 bp, Homo sapien
cagatgaaaacaccagcaccaggag

SEQ ID NO: 448393 - DNA, 25 bp, Homo sapien
gagtggccctgaaaatagtgcacag

SEQ ID NO: 448394 - DNA, 25 bp, Homo sapien
acagtgctgggtactgccccggccg

SEQ ID NO: 448395 - DNA, 25 bp, Homo sapien
ccggccggaggcacctagttgttga

SEQ ID NO: 448396 - DNA, 25 bp, Homo sapien
ggcacctagttgttgagcattccgg

SEQ ID NO: 448397 - DNA, 25 bp, Homo sapien
agttgttgagcattccggccacagg

SEQ ID NO: 448398 - DNA, 25 bp, Homo sapien
ccgctggcccttccttggtgtggca

SEQ ID NO: 448399 - DNA, 25 bp, Homo sapien
gtgtggcacgagaccacgggcactt

SEQ ID NO: 448400 - DNA, 25 bp, Homo sapien
gagaccacgggcacttgcaggagct

SEQ ID NO: 448401 - DNA, 25 bp, Homo sapien
aggagctccctgcatgctgttttgt

SEQ ID NO: 448402 - DNA, 25 bp, Homo sapien
atcgcggacagtgcctgcagcggga

SEQ ID NO: 448403 - DNA, 25 bp, Homo sapien
gaaatgtgacaaatagtgtgcggat

SEQ ID NO: 448404 - DNA, 25 bp, Homo sapien
tagtgtgcggattaagctgctcctc

SEQ ID NO: 448405 - DNA, 25 bp, Homo sapien
gtgcggattaagctgctcctcaaga

SEQ ID NO: 448406 - DNA, 25 bp, Homo sapien
ggattaagctgctcctcaagacagt

SEQ ID NO: 448407 - DNA, 25 bp, Homo sapien
gctgctcctcaagacagtcattcat

SEQ ID NO: 448408 - DNA, 25 bp, Homo sapien
gacagtcattcatcacctttgtgaa

SEQ ID NO: 448409 - DNA, 25 bp, Homo sapien
gaaaccatcagttcttaattcagag

SEQ ID NO: 448410 - DNA, 25 bp, Homo sapien
gagaatgacaatgcaggttcctata

SEQ ID NO: 448411 - DNA, 25 bp, Homo sapien
gacaatgcaggttcctatatccttt

SEQ ID NO: 448412 - DNA, 25 bp, Homo sapien
tgcaggttcctatatcctttttaaa

SEQ ID NO: 448413 - DNA, 25 bp, Homo sapien
attattttaaaactagctctataca

SEQ ID NO: 448414 - DNA, 25 bp, Homo sapien
atctttgatgtttaccaggccgacg

SEQ ID NO: 448415 - DNA, 25 bp, Homo sapien
ctgtggccacattccgaaagaataa

SEQ ID NO: 448416 - DNA, 25 bp, Homo sapien
aagaataaccctggcaaaccctatg

SEQ ID NO: 448417 - DNA, 25 bp, Homo sapien
accctatgcccggatgtgcattagt

SEQ ID NO: 448418 - DNA, 25 bp, Homo sapien
gtggatttgatgagcctgtcccaga

SEQ ID NO: 448419 - DNA, 25 bp, Homo sapien
agcctcaagcggttgtcttaccaga

SEQ ID NO: 448420 - DNA, 25 bp, Homo sapien
gggatgtccctctgatctttgccct

SEQ ID NO: 448421 - DNA, 25 bp, Homo sapien
tctttgccctggtggatcatggtga

SEQ ID NO: 448422 - DNA, 25 bp, Homo sapien
ggtggatcatggtgacatctccttc

SEQ ID NO: 448423 - DNA, 25 bp, Homo sapien
acatctccttctacagcttcaggga

SEQ ID NO: 448424 - DNA, 25 bp, Homo sapien
gggacttcacgttgccccaggatgt

SEQ ID NO: 448425 - DNA, 25 bp, Homo sapien
cttgctgctacctttgcctccaaag

SEQ ID NO: 448426 - DNA, 25 bp, Homo sapien
ttgctgctacctttgcctccaaagt

SEQ ID NO: 448427 - DNA, 25 bp, Homo sapien
tgctgctacctttgcctccaaagtt

SEQ ID NO: 448428 - DNA, 25 bp, Homo sapien
gcctccaaagttcatgtgattcttg

SEQ ID NO: 448429 - DNA, 25 bp, Homo sapien
cctccaaagttcatgtgattcttgt

SEQ ID NO: 448430 - DNA, 25 bp, Homo sapien
ctccaaagttcatgtgattcttgtg

SEQ ID NO: 448431 - DNA, 25 bp, Homo sapien
tccaaagttcatgtgattcttgtgc

SEQ ID NO: 448432 - DNA, 25 bp, Homo sapien
caaagttcatgtgattcttgtgcct

SEQ ID NO: 448433 - DNA, 25 bp, Homo sapien
ggaattacaggcgtatataccacca

SEQ ID NO: 448434 - DNA, 25 bp, Homo sapien
ttttgtattttgtttctccatgttg

SEQ ID NO: 448435 - DNA, 25 bp, Homo sapien
tttgtattttgtttctccatgttgc

SEQ ID NO: 448436 - DNA, 25 bp, Homo sapien
gttacctctgcatggaacagcatta

SEQ ID NO: 448437 - DNA, 25 bp, Homo sapien
ttacctctgcatggaacagcattac

SEQ ID NO: 448438 - DNA, 25 bp, Homo sapien
tacctctgcatggaacagcattacc

SEQ ID NO: 448439 - DNA, 25 bp, Homo sapien
acctctgcatggaacagcattaccc

SEQ ID NO: 448440 - DNA, 25 bp, Homo sapien
cctctgcatggaacagcattaccct

SEQ ID NO: 448441 - DNA, 25 bp, Homo sapien
ctctgcatggaacagcattaccctc

SEQ ID NO: 448442 - DNA, 25 bp, Homo sapien
tctgcatggaacagcattaccctcc

SEQ ID NO: 448443 - DNA, 25 bp, Homo sapien
ctgcatggaacagcattaccctcct

SEQ ID NO: 448444 - DNA, 25 bp, Homo sapien
tgcatggaacagcattaccctcctc

SEQ ID NO: 448445 - DNA, 25 bp, Homo sapien
gcatggaacagcattaccctcctct

SEQ ID NO: 448446 - DNA, 25 bp, Homo sapien
aaacatgctgcccttcatggcagtg

SEQ ID NO: 448447 - DNA, 25 bp, Homo sapien
cttcatggcagtgggccagcctgtc

SEQ ID NO: 448448 - DNA, 25 bp, Homo sapien
agcctgtcatcgtaaccgcagctga

SEQ ID NO: 448449 - DNA, 25 bp, Homo sapien
aaccgcagctgaggccataacggca

SEQ ID NO: 448450 - DNA, 25 bp, Homo sapien
aggccataacggcacccttgttcat

SEQ ID NO: 448451 - DNA, 25 bp, Homo sapien
ggcacccttgttcatcagcgggatg

SEQ ID NO: 448452 - DNA, 25 bp, Homo sapien
cagcgggatgagagatgattacttc

SEQ ID NO: 448453 - DNA, 25 bp, Homo sapien
gagagatgattacttctgggaccac

SEQ ID NO: 448454 - DNA, 25 bp, Homo sapien
gtgcagatttggtttgagaatagaa

SEQ ID NO: 448455 - DNA, 25 bp, Homo sapien
agagccaaatggaggagacatcaga

SEQ ID NO: 448456 - DNA, 25 bp, Homo sapien
acatcagagggcattaatggcaaga

SEQ ID NO: 448457 - DNA, 25 bp, Homo sapien
ttagtctcccaatgcgccggaatta

SEQ ID NO: 448458 - DNA, 25 bp, Homo sapien
tagtctcccaatgcgccggaattac

SEQ ID NO: 448459 - DNA, 25 bp, Homo sapien
cccaatgcgccggaattacaggtgg

SEQ ID NO: 448460 - DNA, 25 bp, Homo sapien
aatgcgccggaattacaggtggctc

SEQ ID NO: 448461 - DNA, 25 bp, Homo sapien
tgcgccggaattacaggtggctcag

SEQ ID NO: 448462 - DNA, 25 bp, Homo sapien
ccggaattacaggtggctcaggtgt

SEQ ID NO: 448463 - DNA, 25 bp, Homo sapien
atcttgaaatcagatgggaggaggc

SEQ ID NO: 448464 - DNA, 25 bp, Homo sapien
gaggaggcacactgaagtcccccag

SEQ ID NO: 448465 - DNA, 25 bp, Homo sapien
gtcatcggggctgggccattgcctt

SEQ ID NO: 448466 - DNA, 25 bp, Homo sapien
ccaccctgggtagtcgtggacagaa

SEQ ID NO: 448467 - DNA, 25 bp, Homo sapien
cctgggtagtcgtggacagaagctt

SEQ ID NO: 448468 - DNA, 25 bp, Homo sapien
gaaactgctgtttttaagatgatag

SEQ ID NO: 448469 - DNA, 25 bp, Homo sapien
tagactgaaacttcctacatagtat

SEQ ID NO: 448470 - DNA, 25 bp, Homo sapien
ggcgctatatgtaactttgaaggaa

SEQ ID NO: 448471 - DNA, 25 bp, Homo sapien
acctttcacccaactatgatagttt

SEQ ID NO: 448472 - DNA, 25 bp, Homo sapien
cctctttcaaacaactcgggtgtca

SEQ ID NO: 448473 - DNA, 25 bp, Homo sapien
acaactcgggtgtcaatgtgggctc

SEQ ID NO: 448474 - DNA, 25 bp, Homo sapien
gtcaatgtgggctctaatattaatt

SEQ ID NO: 448475 - DNA, 25 bp, Homo sapien
gggctctaatattaattctgtgact

SEQ ID NO: 448476 - DNA, 25 bp, Homo sapien
attctgtgactggatttctaccttc

SEQ ID NO: 448477 - DNA, 25 bp, Homo sapien
tcttcaccagtctcatagggttgtt

SEQ ID NO: 448478 - DNA, 25 bp, Homo sapien
caccagtctcatagggttgtttgat

SEQ ID NO: 448479 - DNA, 25 bp, Homo sapien
atattaactatggttcttcaggaga

SEQ ID NO: 448480 - DNA, 25 bp, Homo sapien
tcttcaggagaaagcttacagtgtt

SEQ ID NO: 448481 - DNA, 25 bp, Homo sapien
gcttacagtgtttcaggttgtgatt

SEQ ID NO: 448482 - DNA, 25 bp, Homo sapien
ggagttgactctgaacatcactttg

SEQ ID NO: 448483 - DNA, 25 bp, Homo sapien
acatcactttgttcacctgcattga

SEQ ID NO: 448484 - DNA, 25 bp, Homo sapien
cactttgttcacctgcattgatgtt

SEQ ID NO: 448485 - DNA, 25 bp, Homo sapien
gatgtttgtatttctagtgtgagca

SEQ ID NO: 448486 - DNA, 25 bp, Homo sapien
tatttctagtgtgagcagtttatgc

SEQ ID NO: 448487 - DNA, 25 bp, Homo sapien
gttaatattgctttgctgatgctat

SEQ ID NO: 448488 - DNA, 25 bp, Homo sapien
tgctatttgcttatttgatgttaaa

SEQ ID NO: 448489 - DNA, 25 bp, Homo sapien
taaagaattctgttgttattgcatc

SEQ ID NO: 448490 - DNA, 25 bp, Homo sapien
ttgggcctccctatttccagatctc

SEQ ID NO: 448491 - DNA, 25 bp, Homo sapien
ctggagcctgccgaaagtcatctga

SEQ ID NO: 448492 - DNA, 25 bp, Homo sapien
gaaagtcatctgaggacgttgaacc

SEQ ID NO: 448493 - DNA, 25 bp, Homo sapien
gaggacgttgaacctgattcccacg

SEQ ID NO: 448494 - DNA, 25 bp, Homo sapien
gttgaacctgattcccacggttagg

SEQ ID NO: 448495 - DNA, 25 bp, Homo sapien
acctgattcccacggttagggtcat

SEQ ID NO: 448496 - DNA, 25 bp, Homo sapien
ccacggttagggtcattatccaaat

SEQ ID NO: 448497 - DNA, 25 bp, Homo sapien
ggtcattatccaaatcattcccctg

SEQ ID NO: 448498 - DNA, 25 bp, Homo sapien
atccaaatcattcccctggaagtct

SEQ ID NO: 448499 - DNA, 25 bp, Homo sapien
agtctgtgacccgtttattacgcat

SEQ ID NO: 448500 - DNA, 25 bp, Homo sapien
gtgacccgtttattacgcatgaaag

SEQ ID NO: 448501 - DNA, 25 bp, Homo sapien
ccgcagcagcaggtagtgctcatag

SEQ ID NO: 448502 - DNA, 25 bp, Homo sapien
agcaggtagtgctcatagctctctt

SEQ ID NO: 448503 - DNA, 25 bp, Homo sapien
aggtagtgctcatagctctctttgt

SEQ ID NO: 448504 - DNA, 25 bp, Homo sapien
agtgctcatagctctctttgtccag

SEQ ID NO: 448505 - DNA, 25 bp, Homo sapien
tttgtccagtgcttcggccttggtc

SEQ ID NO: 448506 - DNA, 25 bp, Homo sapien
agtgcttcggccttggtcccagcgc

SEQ ID NO: 448507 - DNA, 25 bp, Homo sapien
tcttcaccctgcacagccttgttag

SEQ ID NO: 448508 - DNA, 25 bp, Homo sapien
acagccttgttagcccaacagcatg

SEQ ID NO: 448509 - DNA, 25 bp, Homo sapien
gcccaacagcatggtggtggaacac

SEQ ID NO: 448510 - DNA, 25 bp, Homo sapien
catggtggtggaacaccccgagttc

SEQ ID NO: 448511 - DNA, 25 bp, Homo sapien
ccccgagttcctcaaggcagggaag

SEQ ID NO: 448512 - DNA, 25 bp, Homo sapien
cccaacagcatggtggtggaacacc

SEQ ID NO: 448513 - DNA, 25 bp, Homo sapien
acagcatggtggtggaacaccccga

SEQ ID NO: 448514 - DNA, 25 bp, Homo sapien
agcatggtggtggaacaccccgagt

SEQ ID NO: 448515 - DNA, 25 bp, Homo sapien
gcatggtggtggaacaccccgagtt

SEQ ID NO: 448516 - DNA, 25 bp, Homo sapien
catggtggtggaacaccccgagttc

SEQ ID NO: 448517 - DNA, 25 bp, Homo sapien
tggtggtggaacaccccgagttcct

SEQ ID NO: 448518 - DNA, 25 bp, Homo sapien
tggaacaccccgagttcctcaaggc

SEQ ID NO: 448519 - DNA, 25 bp, Homo sapien
aacaccccgagttcctcaaggcagg

SEQ ID NO: 448520 - DNA, 25 bp, Homo sapien
caccccgagttcctcaaggcaggga

SEQ ID NO: 448521 - DNA, 25 bp, Homo sapien
ccccgagttcctcaaggcagggaag

SEQ ID NO: 448522 - DNA, 25 bp, Homo sapien
ccgagttcctcaaggcagggaagga

SEQ ID NO: 448523 - DNA, 25 bp, Homo sapien
agtgcagggcattctggacccggag

SEQ ID NO: 448524 - DNA, 25 bp, Homo sapien
attctggacccggagggccagagaa

SEQ ID NO: 448525 - DNA, 25 bp, Homo sapien
gagtttgtaactgttgctgccacac

SEQ ID NO: 448526 - DNA, 25 bp, Homo sapien
aggagcaccggctgcccctctgggt

SEQ ID NO: 448527 - DNA, 25 bp, Homo sapien
tgggtggcactaccaggtgccccac

SEQ ID NO: 448528 - DNA, 25 bp, Homo sapien
ggtacccttgtcacactgttcacac

SEQ ID NO: 448529 - DNA, 25 bp, Homo sapien
gcccactctgggaccccgaggtagg

SEQ ID NO: 448530 - DNA, 25 bp, Homo sapien
tccctgagaccaaagcacaaaacag

SEQ ID NO: 448531 - DNA, 25 bp, Homo sapien
caaaacagcatgcagggagctcctg

SEQ ID NO: 448532 - DNA, 25 bp, Homo sapien
ggagctcctgcaagtgcccgtggtc

SEQ ID NO: 448533 - DNA, 25 bp, Homo sapien
tgcaagtgcccgtggtctcgtgcca

SEQ ID NO: 448534 - DNA, 25 bp, Homo sapien
agggagcttgtgagcttgatcttga

SEQ ID NO: 448535 - DNA, 25 bp, Homo sapien
gagcttgtgagcttgatcttgaaag

SEQ ID NO: 448536 - DNA, 25 bp, Homo sapien
aagaataagcaaaagggaaccacat

SEQ ID NO: 448537 - DNA, 25 bp, Homo sapien
gggaaccacataactgacaaagcag

SEQ ID NO: 448538 - DNA, 25 bp, Homo sapien
tgacaaagcaggtgtgagtgagcat

SEQ ID NO: 448539 - DNA, 25 bp, Homo sapien
gtgagtgagcatgacttacttggag

SEQ ID NO: 448540 - DNA, 25 bp, Homo sapien
agcatgacttacttggagagtggtt

SEQ ID NO: 448541 - DNA, 25 bp, Homo sapien
acttacttggagagtggttaggtca

SEQ ID NO: 448542 - DNA, 25 bp, Homo sapien
atgaagtctaatttgggaccagatt

SEQ ID NO: 448543 - DNA, 25 bp, Homo sapien
tgggaccagattataaaaggccttt

SEQ ID NO: 448544 - DNA, 25 bp, Homo sapien
ggcaatggggattctataacttttt

SEQ ID NO: 448545 - DNA, 25 bp, Homo sapien
aagtggtcctctgagcttactatac

SEQ ID NO: 448546 - DNA, 25 bp, Homo sapien
ggtcctctgagcttactatacatca

SEQ ID NO: 448547 - DNA, 25 bp, Homo sapien
gaagaatgtgtcagagtctttaaac

SEQ ID NO: 448548 - DNA, 25 bp, Homo sapien
gtctttaaacactcctcaaaactga

SEQ ID NO: 448549 - DNA, 25 bp, Homo sapien
aacactcctcaaaactgaatgaaca

SEQ ID NO: 448550 - DNA, 25 bp, Homo sapien
atgtggcaaaataactcatagtgga

SEQ ID NO: 448551 - DNA, 25 bp, Homo sapien
actcatagtggagaggaatcctaca

SEQ ID NO: 448552 - DNA, 25 bp, Homo sapien
ggcaaaggcttttactgttcctcaa

SEQ ID NO: 448553 - DNA, 25 bp, Homo sapien
cttttactgttcctcaagccttact

SEQ ID NO: 448554 - DNA, 25 bp, Homo sapien
gttcctcaagccttactaagcatat

SEQ ID NO: 448555 - DNA, 25 bp, Homo sapien
gccttactaagcatatgatagttca

SEQ ID NO: 448556 - DNA, 25 bp, Homo sapien
attttcatcttctgtcttgattttt

SEQ ID NO: 448557 - DNA, 25 bp, Homo sapien
gttttcagttactaaatagcatatt

SEQ ID NO: 448558 - DNA, 25 bp, Homo sapien
tagcatattattctattctgtgtat

SEQ ID NO: 448559 - DNA, 25 bp, Homo sapien
tatgtgttttaagttccttccaaat

SEQ ID NO: 448560 - DNA, 25 bp, Homo sapien
ttccttccaaatttactttgataat

SEQ ID NO: 448561 - DNA, 25 bp, Homo sapien
aaagataggagtagcacctctggct

SEQ ID NO: 448562 - DNA, 25 bp, Homo sapien
aggagtagcacctctggctaaacct

SEQ ID NO: 448563 - DNA, 25 bp, Homo sapien
tagcacctctggctaaacctttttt

SEQ ID NO: 448564 - DNA, 25 bp, Homo sapien
ttttcatacccacttatttccttag

SEQ ID NO: 448565 - DNA, 25 bp, Homo sapien
tcatacccacttatttccttagaat

SEQ ID NO: 448566 - DNA, 25 bp, Homo sapien
tacccacttatttccttagaataga

SEQ ID NO: 448567 - DNA, 25 bp, Homo sapien
aggcatgagtgctgaagttcggttt

SEQ ID NO: 448568 - DNA, 25 bp, Homo sapien
tgaagttcggtttgactcatgtcat

SEQ ID NO: 448569 - DNA, 25 bp, Homo sapien
tgtcatgtgttctttacgttccttt

SEQ ID NO: 448570 - DNA, 25 bp, Homo sapien
tgcagtctggtatttccccatgaaa

SEQ ID NO: 448571 - DNA, 25 bp, Homo sapien
tgtggaatagctgccttaggacctt

SEQ ID NO: 448572 - DNA, 25 bp, Homo sapien
atagctgccttaggaccttgaccca

SEQ ID NO: 448573 - DNA, 25 bp, Homo sapien
ttgacccacacttactttaagaaat

SEQ ID NO: 448574 - DNA, 25 bp, Homo sapien
aaaaagacctgtgcagttctgccct

SEQ ID NO: 448575 - DNA, 25 bp, Homo sapien
agttctgccctatttcaccattttg

SEQ ID NO: 448576 - DNA, 25 bp, Homo sapien
gtggaaatgattttgcggccttgta

SEQ ID NO: 448577 - DNA, 25 bp, Homo sapien
ttttgcggccttgtaaggaggctga

SEQ ID NO: 448578 - DNA, 25 bp, Homo sapien
agacggccacattgcctggttgaag

SEQ ID NO: 448579 - DNA, 25 bp, Homo sapien
cctggttgaagatggctgagcgtaa

SEQ ID NO: 448580 - DNA, 25 bp, Homo sapien
gcgtaaaacagaatgcaagtcagct

SEQ ID NO: 448581 - DNA, 25 bp, Homo sapien
aagtcagctggagcacgtactactg

SEQ ID NO: 448582 - DNA, 25 bp, Homo sapien
gcacgtactactggaggcagagccc

SEQ ID NO: 448583 - DNA, 25 bp, Homo sapien
gaacccgcacccatcaaaatcaaga

SEQ ID NO: 448584 - DNA, 25 bp, Homo sapien
gaagaaaggctgaacccggagagaa

SEQ ID NO: 448585 - DNA, 25 bp, Homo sapien
aactgatgttgccatgcagatccct

SEQ ID NO: 448586 - DNA, 25 bp, Homo sapien
gcagatcccttggttgctatgagat

SEQ ID NO: 448587 - DNA, 25 bp, Homo sapien
tgctatgagatggtaacatcactct

SEQ ID NO: 448588 - DNA, 25 bp, Homo sapien
tgtgctcggctgactgcacgtccag

SEQ ID NO: 448589 - DNA, 25 bp, Homo sapien
agagttcgatgttagcgtttacgtt

SEQ ID NO: 448590 - DNA, 25 bp, Homo sapien
gagttcgatgttagcgtttacgttg

SEQ ID NO: 448591 - DNA, 25 bp, Homo sapien
agttcgatgttagcgtttacgttgt

SEQ ID NO: 448592 - DNA, 25 bp, Homo sapien
gttcgatgttagcgtttacgttgta

SEQ ID NO: 448593 - DNA, 25 bp, Homo sapien
ttcgatgttagcgtttacgttgtat

SEQ ID NO: 448594 - DNA, 25 bp, Homo sapien
tcgatgttagcgtttacgttgtatt

SEQ ID NO: 448595 - DNA, 25 bp, Homo sapien
cgatgttagcgtttacgttgtattt

SEQ ID NO: 448596 - DNA, 25 bp, Homo sapien
gatgttagcgtttacgttgtatttt

SEQ ID NO: 448597 - DNA, 25 bp, Homo sapien
tgttagcgtttacgttgtattttct

SEQ ID NO: 448598 - DNA, 25 bp, Homo sapien
ttgagagccagcgtctaaagtgtcc

SEQ ID NO: 448599 - DNA, 25 bp, Homo sapien
gccagcgtctaaagtgtccacggca

SEQ ID NO: 448600 - DNA, 25 bp, Homo sapien
ctaaagtgtccacggcatcctggga

SEQ ID NO: 448601 - DNA, 25 bp, Homo sapien
tgtccacggcatcctgggaggtttt

SEQ ID NO: 448602 - DNA, 25 bp, Homo sapien
gaggttttatccttggtgactctaa

SEQ ID NO: 448603 - DNA, 25 bp, Homo sapien
tatccttggtgactctaatggtaga

SEQ ID NO: 448604 - DNA, 25 bp, Homo sapien
tggtagatttttgtccaccttgttc

SEQ ID NO: 448605 - DNA, 25 bp, Homo sapien
ttgtccaccttgttctatttgcttt

SEQ ID NO: 448606 - DNA, 25 bp, Homo sapien
ccaccttgttctatttgcttttgtt

SEQ ID NO: 448607 - DNA, 25 bp, Homo sapien
atccagcccacattgttctatttgt

SEQ ID NO: 448608 - DNA, 25 bp, Homo sapien
gttctatttgtatttcatgaaagca

SEQ ID NO: 448609 - DNA, 25 bp, Homo sapien
cctcagagcccttcgggtcttcatg

SEQ ID NO: 448610 - DNA, 25 bp, Homo sapien
agtcctcactgtctgtcctcggatt

SEQ ID NO: 448611 - DNA, 25 bp, Homo sapien
actgtctgtcctcggattctggatc

SEQ ID NO: 448612 - DNA, 25 bp, Homo sapien
ttgctcctggtgcaggttatttcca

SEQ ID NO: 448613 - DNA, 25 bp, Homo sapien
tcctggtgcaggttatttccacggg

SEQ ID NO: 448614 - DNA, 25 bp, Homo sapien
ggccatctcaggttccccagggtag

SEQ ID NO: 448615 - DNA, 25 bp, Homo sapien
agacctgcccacacttgttgaacca

SEQ ID NO: 448616 - DNA, 25 bp, Homo sapien
tgcccacacttgttgaaccaaacca

SEQ ID NO: 448617 - DNA, 25 bp, Homo sapien
tgaaccaaaccaagcaccgaggtct

SEQ ID NO: 448618 - DNA, 25 bp, Homo sapien
gtctccccacacaagcagagctggg

SEQ ID NO: 448619 - DNA, 25 bp, Homo sapien
gggcctgatcctcctggtacctgca

SEQ ID NO: 448620 - DNA, 25 bp, Homo sapien
aactgtaattgctattccagcaagc

SEQ ID NO: 448621 - DNA, 25 bp, Homo sapien
tgctattccagcaagcattcctcct

SEQ ID NO: 448622 - DNA, 25 bp, Homo sapien
gaatatagcccaacagctttaccag

SEQ ID NO: 448623 - DNA, 25 bp, Homo sapien
atagcccaacagctttaccagtagc

SEQ ID NO: 448624 - DNA, 25 bp, Homo sapien
acagctttaccagtagctaaacagg

SEQ ID NO: 448625 - DNA, 25 bp, Homo sapien
cagtagctaaacaggaagaactcag

SEQ ID NO: 448626 - DNA, 25 bp, Homo sapien
attttacctggttcagcacttccag

SEQ ID NO: 448627 - DNA, 25 bp, Homo sapien
ggttcagcacttccagggcaattgt

SEQ ID NO: 448628 - DNA, 25 bp, Homo sapien
gggcaattgtcccttgtccagctat

SEQ ID NO: 448629 - DNA, 25 bp, Homo sapien
aattgtcccttgtccagctatcact

SEQ ID NO: 448630 - DNA, 25 bp, Homo sapien
tgtccagctatcactgcaggctcct

SEQ ID NO: 448631 - DNA, 25 bp, Homo sapien
ttgctgaccaccttgaacttcggag

SEQ ID NO: 448632 - DNA, 25 bp, Homo sapien
tgaacttcggagacggtccagacag

SEQ ID NO: 448633 - DNA, 25 bp, Homo sapien
agacaggaacaagacccggacattc

SEQ ID NO: 448634 - DNA, 25 bp, Homo sapien
aggccacagtcctgggaagtcagat

SEQ ID NO: 448635 - DNA, 25 bp, Homo sapien
gaaaggatcttctgcaggacaactg

SEQ ID NO: 448636 - DNA, 25 bp, Homo sapien
ggacaactggtccttatcacagcca

SEQ ID NO: 448637 - DNA, 25 bp, Homo sapien
tggtccttatcacagccagggtgac

SEQ ID NO: 448638 - DNA, 25 bp, Homo sapien
ggaacctgcctatattttagtgctg

SEQ ID NO: 448639 - DNA, 25 bp, Homo sapien
tagtgctgttccaggaatcctaccc

SEQ ID NO: 448640 - DNA, 25 bp, Homo sapien
cacccatatcctgctcagaggaggg

SEQ ID NO: 448641 - DNA, 25 bp, Homo sapien
aatgtgttagtgtctggagccatga

SEQ ID NO: 448642 - DNA, 25 bp, Homo sapien
tgtcctttttgcgtatcatctcaag

SEQ ID NO: 448643 - DNA, 25 bp, Homo sapien
gcgtatcatctcaagcagtacccat

SEQ ID NO: 448644 - DNA, 25 bp, Homo sapien
agcagtacccatgatggctgggatc

SEQ ID NO: 448645 - DNA, 25 bp, Homo sapien
agaacccacctttgagaatgctgcc

SEQ ID NO: 448646 - DNA, 25 bp, Homo sapien
aatgctgccgtatttgcgtgtggtt

SEQ ID NO: 448647 - DNA, 25 bp, Homo sapien
gttgacaaggttgggccagacactc

SEQ ID NO: 448648 - DNA, 25 bp, Homo sapien
ggttgggccagacactcaggaaata

SEQ ID NO: 448649 - DNA, 25 bp, Homo sapien
tcaggaaatagggttgtcgtcctac

SEQ ID NO: 448650 - DNA, 25 bp, Homo sapien
acttcctgtaagaacttcagcccct

SEQ ID NO: 448651 - DNA, 25 bp, Homo sapien
aagaagcatctaaaacaacctgtta

SEQ ID NO: 448652 - DNA, 25 bp, Homo sapien
ttagggaggaaaacgttcatgtcct

SEQ ID NO: 448653 - DNA, 25 bp, Homo sapien
gatcagtttaaggtcttgatgggta

SEQ ID NO: 448654 - DNA, 25 bp, Homo sapien
actcaaaggatgatggcaccctggg

SEQ ID NO: 448655 - DNA, 25 bp, Homo sapien
tgatggcaccctgggagtgatccac

SEQ ID NO: 448656 - DNA, 25 bp, Homo sapien
ggagtgatccacagaaggacagatt

SEQ ID NO: 448657 - DNA, 25 bp, Homo sapien
aaaataaaccattggatctgcctct

SEQ ID NO: 448658 - DNA, 25 bp, Homo sapien
tggatctgcctctggagtccaagaa

SEQ ID NO: 448659 - DNA, 25 bp, Homo sapien
agagttttgcctatagcaggcacca

SEQ ID NO: 448660 - DNA, 25 bp, Homo sapien
atagcaggcaccagactgtgggctt

SEQ ID NO: 448661 - DNA, 25 bp, Homo sapien
gcaccagactgtgggcttggtagta

SEQ ID NO: 448662 - DNA, 25 bp, Homo sapien
ggcttggtagtacatgactattggt

SEQ ID NO: 448663 - DNA, 25 bp, Homo sapien
catgactattggtgattacagatca

SEQ ID NO: 448664 - DNA, 25 bp, Homo sapien
tgagccatgcgccaggactgctttt

SEQ ID NO: 448665 - DNA, 25 bp, Homo sapien
aaacttccaaagcttgttaatcacg

SEQ ID NO: 448666 - DNA, 25 bp, Homo sapien
gcttgttaatcacgattttgcctcg

SEQ ID NO: 448667 - DNA, 25 bp, Homo sapien
taatcacgattttgcctcgtaccca

SEQ ID NO: 448668 - DNA, 25 bp, Homo sapien
gtggagaccgggtcttgcaatgttt

SEQ ID NO: 448669 - DNA, 25 bp, Homo sapien
cttgcaatgttttccagaccagtct

SEQ ID NO: 448670 - DNA, 25 bp, Homo sapien
gcaatgttttccagaccagtctcga

SEQ ID NO: 448671 - DNA, 25 bp, Homo sapien
agaccagtctcgaacttcaaggctc

SEQ ID NO: 448672 - DNA, 25 bp, Homo sapien
acttcaaggctccaataatccactc

SEQ ID NO: 448673 - DNA, 25 bp, Homo sapien
ggctccaataatccactcgccatgg

SEQ ID NO: 448674 - DNA, 25 bp, Homo sapien
caaagccgggtgagccatgcgccag

SEQ ID NO: 448675 - DNA, 25 bp, Homo sapien
gacattttcactgtatacttgcgac

SEQ ID NO: 448676 - DNA, 25 bp, Homo sapien
tgtatacttgcgacttgcaccacaa

SEQ ID NO: 448677 - DNA, 25 bp, Homo sapien
ttgcgacttgcaccacaattcaagt

SEQ ID NO: 448678 - DNA, 25 bp, Homo sapien
attcaagtctgagattacctaactg

SEQ ID NO: 448679 - DNA, 25 bp, Homo sapien
gtctgagattacctaactgatgatg

SEQ ID NO: 448680 - DNA, 25 bp, Homo sapien
aacacttcagtagaattcttcgcag

SEQ ID NO: 448681 - DNA, 25 bp, Homo sapien
gaattcttcgcagcagtgaacagta

SEQ ID NO: 448682 - DNA, 25 bp, Homo sapien
gcagtgaacagtagtgacaggtcat

SEQ ID NO: 448683 - DNA, 25 bp, Homo sapien
gacaggtcattatgtttttcttgct

SEQ ID NO: 448684 - DNA, 25 bp, Homo sapien
ggtcattatgtttttcttgctgttt

SEQ ID NO: 448685 - DNA, 25 bp, Homo sapien
cttgctgttttaaatcttcatctta

SEQ ID NO: 448686 - DNA, 25 bp, Homo sapien
acgcagctgtgaatggccggtgatg

SEQ ID NO: 448687 - DNA, 25 bp, Homo sapien
tgtgaatggccggtgatgtatgtca

SEQ ID NO: 448688 - DNA, 25 bp, Homo sapien
ccggtgatgtatgtcaggaggccac

SEQ ID NO: 448689 - DNA, 25 bp, Homo sapien
cagaaatcccgggtcggactactat

SEQ ID NO: 448690 - DNA, 25 bp, Homo sapien
gcccttcaacaacaagccctgattt

SEQ ID NO: 448691 - DNA, 25 bp, Homo sapien
cccttcaacaacaagccctgatttt

SEQ ID NO: 448692 - DNA, 25 bp, Homo sapien
ccttcaacaacaagccctgattttt

SEQ ID NO: 448693 - DNA, 25 bp, Homo sapien
cttcaacaacaagccctgatttttc

SEQ ID NO: 448694 - DNA, 25 bp, Homo sapien
gccagaaacctggattttaagtctt

SEQ ID NO: 448695 - DNA, 25 bp, Homo sapien
ggtcggactactataactaaattcg

SEQ ID NO: 448696 - DNA, 25 bp, Homo sapien
gtcggactactataactaaattcgg

SEQ ID NO: 448697 - DNA, 25 bp, Homo sapien
aaagtcctcacgtttgcactttcag

SEQ ID NO: 448698 - DNA, 25 bp, Homo sapien
tcctcacgtttgcactttcagaaga

SEQ ID NO: 448699 - DNA, 25 bp, Homo sapien
gcactttcagaagaggtacgtccac

SEQ ID NO: 448700 - DNA, 25 bp, Homo sapien
gaggtacgtccacaggacactgtat

SEQ ID NO: 448701 - DNA, 25 bp, Homo sapien
acaggacactgtatcggtaattggt

SEQ ID NO: 448702 - DNA, 25 bp, Homo sapien
ctgtatcggtaattggtggagtagc

SEQ ID NO: 448703 - DNA, 25 bp, Homo sapien
aggcagcaagcatggtaggaaagct

SEQ ID NO: 448704 - DNA, 25 bp, Homo sapien
gaaagctgcttggaaattcataaag

SEQ ID NO: 448705 - DNA, 25 bp, Homo sapien
ggaaattcataaaggacaactggga

SEQ ID NO: 448706 - DNA, 25 bp, Homo sapien
ggaagaactttataaccgataccag

SEQ ID NO: 448707 - DNA, 25 bp, Homo sapien
taaccgataccagggaggattctta

SEQ ID NO: 448708 - DNA, 25 bp, Homo sapien
agggaaagcccatatgctaccacca

SEQ ID NO: 448709 - DNA, 25 bp, Homo sapien
catatgctaccaccagctgtgtcca

SEQ ID NO: 448710 - DNA, 25 bp, Homo sapien
ctgtgtccaaaaccgccagctctgt

SEQ ID NO: 448711 - DNA, 25 bp, Homo sapien
aggtctcagcccctttcccttgtag

SEQ ID NO: 448712 - DNA, 25 bp, Homo sapien
gagttggccatatttacctcagcct

SEQ ID NO: 448713 - DNA, 25 bp, Homo sapien
atatttacctcagcctgggcgctgg

SEQ ID NO: 448714 - DNA, 25 bp, Homo sapien
tcagcctgggcgctggtcctttctt

SEQ ID NO: 448715 - DNA, 25 bp, Homo sapien
ccctccaaaatgtgcctattgctag

SEQ ID NO: 448716 - DNA, 25 bp, Homo sapien
aatgtgcctattgctagagctcctc

SEQ ID NO: 448717 - DNA, 25 bp, Homo sapien
tcaacacccagtttccttgggagtt

SEQ ID NO: 448718 - DNA, 25 bp, Homo sapien
cccagtttccttgggagttgtcatt

SEQ ID NO: 448719 - DNA, 25 bp, Homo sapien
tacttactgattagttctcactcta

SEQ ID NO: 448720 - DNA, 25 bp, Homo sapien
ttagttctcactctatcttatcact

SEQ ID NO: 448721 - DNA, 25 bp, Homo sapien
acttttatttaatctccagttcaga

SEQ ID NO: 448722 - DNA, 25 bp, Homo sapien
ggaattcgtagacagatataacagt

SEQ ID NO: 448723 - DNA, 25 bp, Homo sapien
cagtgtaagtgatagctgtacttct

SEQ ID NO: 448724 - DNA, 25 bp, Homo sapien
gctgtacttcttgactttgaagcat

SEQ ID NO: 448725 - DNA, 25 bp, Homo sapien
atccctaggttagaaggtgaaacat

SEQ ID NO: 448726 - DNA, 25 bp, Homo sapien
gtgaaacattattatgccaaaggat

SEQ ID NO: 448727 - DNA, 25 bp, Homo sapien
aaatcaccttaaatccctagcactg

SEQ ID NO: 448728 - DNA, 25 bp, Homo sapien
atccctagcactgaagtcatctact

SEQ ID NO: 448729 - DNA, 25 bp, Homo sapien
gcactgaagtcatctacttactgat

SEQ ID NO: 448730 - DNA, 25 bp, Homo sapien
caggaatcatgcttgctcccctggg

SEQ ID NO: 448731 - DNA, 25 bp, Homo sapien
atcatgcttgctcccctgggccatt

SEQ ID NO: 448732 - DNA, 25 bp, Homo sapien
tgggcttctggagggttccccgcca

SEQ ID NO: 448733 - DNA, 25 bp, Homo sapien
ttctggagggttccccgccatccag

SEQ ID NO: 448734 - DNA, 25 bp, Homo sapien
tggtctccctcccttaaggaggttg

SEQ ID NO: 448735 - DNA, 25 bp, Homo sapien
ctcccttaaggaggttggtgcccag

SEQ ID NO: 448736 - DNA, 25 bp, Homo sapien
cccttaaggaggttggtgcccagag

SEQ ID NO: 448737 - DNA, 25 bp, Homo sapien
ttggtgcccagagtgggcggtggcc

SEQ ID NO: 448738 - DNA, 25 bp, Homo sapien
cggtggcctgtctagaatgccgccg

SEQ ID NO: 448739 - DNA, 25 bp, Homo sapien
tggcctgtctagaatgccgccggga

SEQ ID NO: 448740 - DNA, 25 bp, Homo sapien
gcctgtctagaatgccgccgggagt

SEQ ID NO: 448741 - DNA, 25 bp, Homo sapien
gtgggttaccacatattaacaggga

SEQ ID NO: 448742 - DNA, 25 bp, Homo sapien
gaataatatcaacagaggcacccat

SEQ ID NO: 448743 - DNA, 25 bp, Homo sapien
cagaggcacccataagcaagcaaga

SEQ ID NO: 448744 - DNA, 25 bp, Homo sapien
gcaagcaagacacaactgagacaga

SEQ ID NO: 448745 - DNA, 25 bp, Homo sapien
aactgagacagatgtaccaggtgaa

SEQ ID NO: 448746 - DNA, 25 bp, Homo sapien
aaatcttcagtatggatacacatgg

SEQ ID NO: 448747 - DNA, 25 bp, Homo sapien
gatacacatgggtattctgaaggct

SEQ ID NO: 448748 - DNA, 25 bp, Homo sapien
caatgaatggtttagtctttgacat

SEQ ID NO: 448749 - DNA, 25 bp, Homo sapien
ttatactgtgtaatctaatctggct

SEQ ID NO: 448750 - DNA, 25 bp, Homo sapien
gaattttctacatgaagtgggctac

SEQ ID NO: 448751 - DNA, 25 bp, Homo sapien
gaagtgggctacttctgattttaat

SEQ ID NO: 448752 - DNA, 25 bp, Homo sapien
ggcctgcagtggatagagcctagca

SEQ ID NO: 448753 - DNA, 25 bp, Homo sapien
agagcctagcagatcctggacaata

SEQ ID NO: 448754 - DNA, 25 bp, Homo sapien
ctaaaagctacatctctgacagtga

SEQ ID NO: 448755 - DNA, 25 bp, Homo sapien
tctgacagtgatttccagcgacttt

SEQ ID NO: 448756 - DNA, 25 bp, Homo sapien
tttccagcgactttgtcaacacggt

SEQ ID NO: 448757 - DNA, 25 bp, Homo sapien
aaatgtctttactgccttgtctttc

SEQ ID NO: 448758 - DNA, 25 bp, Homo sapien
ccccttgccacttgtcattattcaa

SEQ ID NO: 448759 - DNA, 25 bp, Homo sapien
agttttgtaagttcctgatttccat

SEQ ID NO: 448760 - DNA, 25 bp, Homo sapien
attcagtgcagctgcaaggttacca

SEQ ID NO: 448761 - DNA, 25 bp, Homo sapien
aaggttaccagctgtgcttgcgttg

SEQ ID NO: 448762 - DNA, 25 bp, Homo sapien
gcttgcgttgcaagacctgtcacag

SEQ ID NO: 448763 - DNA, 25 bp, Homo sapien
ggccgcgtcgacaggaaattaatga

SEQ ID NO: 448764 - DNA, 25 bp, Homo sapien
tacttttgagagtctgacatgcata

SEQ ID NO: 448765 - DNA, 25 bp, Homo sapien
gagagtctgacatgcatatcataat

SEQ ID NO: 448766 - DNA, 25 bp, Homo sapien
gatattttgaaatggtgactgactc

SEQ ID NO: 448767 - DNA, 25 bp, Homo sapien
gaaatggtgactgactcttttgaaa

SEQ ID NO: 448768 - DNA, 25 bp, Homo sapien
ggtgactgactcttttgaaatttta

SEQ ID NO: 448769 - DNA, 25 bp, Homo sapien
agttctttagaatgtgacgctttta

SEQ ID NO: 448770 - DNA, 25 bp, Homo sapien
gacgcttttaatatagcctctggtt

SEQ ID NO: 448771 - DNA, 25 bp, Homo sapien
atagcctctggttttagatggagaa

SEQ ID NO: 448772 - DNA, 25 bp, Homo sapien
gatggagaaacactatgctattgtc

SEQ ID NO: 448773 - DNA, 25 bp, Homo sapien
gaaacactatgctattgtcattaaa

SEQ ID NO: 448774 - DNA, 25 bp, Homo sapien
gagtagaagctcaggtgaggaacct

SEQ ID NO: 448775 - DNA, 25 bp, Homo sapien
gaccaggctgattgacagcagtgga

SEQ ID NO: 448776 - DNA, 25 bp, Homo sapien
agagactgccatacaaccaaaccat

SEQ ID NO: 448777 - DNA, 25 bp, Homo sapien
gactgccatacaaccaaaccatggg

SEQ ID NO: 448778 - DNA, 25 bp, Homo sapien
atggggacacatgaacttctttgga

SEQ ID NO: 448779 - DNA, 25 bp, Homo sapien
aactggcctgtctgggtcacagtgt

SEQ ID NO: 448780 - DNA, 25 bp, Homo sapien
gcctgtctgggtcacagtgtgtcct

SEQ ID NO: 448781 - DNA, 25 bp, Homo sapien
tgtgtcctctgcttgttaagaagat

SEQ ID NO: 448782 - DNA, 25 bp, Homo sapien
tgcttgttaagaagatgcctggcac

SEQ ID NO: 448783 - DNA, 25 bp, Homo sapien
tgcctggcacagcagtagttagatt

SEQ ID NO: 448784 - DNA, 25 bp, Homo sapien
gcacagcagtagttagattacttgt

SEQ ID NO: 448785 - DNA, 25 bp, Homo sapien
accactaatgtattaagccctgcag

SEQ ID NO: 448786 - DNA, 25 bp, Homo sapien
actgacttctcgcacgcataaaatg

SEQ ID NO: 448787 - DNA, 25 bp, Homo sapien
gaaccgggagaagccagtgttgata

SEQ ID NO: 448788 - DNA, 25 bp, Homo sapien
gaagaggttcaagagctggcttttc

SEQ ID NO: 448789 - DNA, 25 bp, Homo sapien
gctggcttttcagacaactaagacc

SEQ ID NO: 448790 - DNA, 25 bp, Homo sapien
gaccatttttagcagaataactcct

SEQ ID NO: 448791 - DNA, 25 bp, Homo sapien
tagcagaataactccttcagaaagg

SEQ ID NO: 448792 - DNA, 25 bp, Homo sapien
gaaaggcctggctgaagatcttttt

SEQ ID NO: 448793 - DNA, 25 bp, Homo sapien
attgtctcacctatataaatttcag

SEQ ID NO: 448794 - DNA, 25 bp, Homo sapien
atttcagggttcttataagtcatct

SEQ ID NO: 448795 - DNA, 25 bp, Homo sapien
acacacaggcttacagtctttgttt

SEQ ID NO: 448796 - DNA, 25 bp, Homo sapien
gcaatgagctacaatcacacccctg

SEQ ID NO: 448797 - DNA, 25 bp, Homo sapien
aatgagctacaatcacacccctgca

SEQ ID NO: 448798 - DNA, 25 bp, Homo sapien
gtataatcatattgcaattttcttt

SEQ ID NO: 448799 - DNA, 25 bp, Homo sapien
gcaattttctttgcattactgatga

SEQ ID NO: 448800 - DNA, 25 bp, Homo sapien
ttctttgcattactgatgaggaaaa

SEQ ID NO: 448801 - DNA, 25 bp, Homo sapien
ctttgcattactgatgaggaaaaat

SEQ ID NO: 448802 - DNA, 25 bp, Homo sapien
gtaattgtaaaaaatcctggatatc

SEQ ID NO: 448803 - DNA, 25 bp, Homo sapien
aaaatcctggatatcacatagttga

SEQ ID NO: 448804 - DNA, 25 bp, Homo sapien
aatcctggatatcacatagttgaga

SEQ ID NO: 448805 - DNA, 25 bp, Homo sapien
atcctggatatcacatagttgagaa

SEQ ID NO: 448806 - DNA, 25 bp, Homo sapien
cctggatatcacatagttgagaaac

SEQ ID NO: 448807 - DNA, 25 bp, Homo sapien
aatatcttttaactctcagttgtta

SEQ ID NO: 448808 - DNA, 25 bp, Homo sapien
gttgttatagatgaaacagccagca

SEQ ID NO: 448809 - DNA, 25 bp, Homo sapien
gaaacagccagcaaaaactcaccct

SEQ ID NO: 448810 - DNA, 25 bp, Homo sapien
agcaaaaactcaccctacttcactt

SEQ ID NO: 448811 - DNA, 25 bp, Homo sapien
tacttcacttcttccataatctttg

SEQ ID NO: 448812 - DNA, 25 bp, Homo sapien
gcggaatcaacaacaatgtaaactg

SEQ ID NO: 448813 - DNA, 25 bp, Homo sapien
agccaccgtgactgacctattatct

SEQ ID NO: 448814 - DNA, 25 bp, Homo sapien
ccaccgtgactgacctattatctga

SEQ ID NO: 448815 - DNA, 25 bp, Homo sapien
gacctattatctgattttagccaac

SEQ ID NO: 448816 - DNA, 25 bp, Homo sapien
tctgattttagccaacaatgttgtt

SEQ ID NO: 448817 - DNA, 25 bp, Homo sapien
gtttttcttaatattctttcactgt

SEQ ID NO: 448818 - DNA, 25 bp, Homo sapien
gtccaacaggtgactattcagaagt

SEQ ID NO: 448819 - DNA, 25 bp, Homo sapien
attcagaagtctaacattgtggctc

SEQ ID NO: 448820 - DNA, 25 bp, Homo sapien
agaagtctaacattgtggctcctgt

SEQ ID NO: 448821 - DNA, 25 bp, Homo sapien
aagtctaacattgtggctcctgttt

SEQ ID NO: 448822 - DNA, 25 bp, Homo sapien
gtctaacattgtggctcctgtttgg

SEQ ID NO: 448823 - DNA, 25 bp, Homo sapien
taacattgtggctcctgtttggtgt

SEQ ID NO: 448824 - DNA, 25 bp, Homo sapien
acattgtggctcctgtttggtgtcc

SEQ ID NO: 448825 - DNA, 25 bp, Homo sapien
attgtggctcctgtttggtgtccta

SEQ ID NO: 448826 - DNA, 25 bp, Homo sapien
tgtggctcctgtttggtgtcctaag

SEQ ID NO: 448827 - DNA, 25 bp, Homo sapien
atttgaaaacgagaactctaccagc

SEQ ID NO: 448828 - DNA, 25 bp, Homo sapien
gtgaacactcaactgttctaaccca

SEQ ID NO: 448829 - DNA, 25 bp, Homo sapien
gttatggtgtcactgtcattttgac

SEQ ID NO: 448830 - DNA, 25 bp, Homo sapien
gacataccctatggaatgctttgtg

SEQ ID NO: 448831 - DNA, 25 bp, Homo sapien
tggtgggaatctttcatcggttttc

SEQ ID NO: 448832 - DNA, 25 bp, Homo sapien
tcatcggttttccacattgttgtaa

SEQ ID NO: 448833 - DNA, 25 bp, Homo sapien
tgatggtcatcactgtagccacgct

SEQ ID NO: 448834 - DNA, 25 bp, Homo sapien
tagccacgcttgtgtcattgctgat

SEQ ID NO: 448835 - DNA, 25 bp, Homo sapien
gattgcctcgggatagttctagaac

SEQ ID NO: 448836 - DNA, 25 bp, Homo sapien
gaactcaatggtgtgctctgtgcaa

SEQ ID NO: 448837 - DNA, 25 bp, Homo sapien
tgcaactcccctcatttttatcatt

SEQ ID NO: 448838 - DNA, 25 bp, Homo sapien
tttatcattccatcagcctgttatc

SEQ ID NO: 448839 - DNA, 25 bp, Homo sapien
gaaccaaggacacactccgataaga

SEQ ID NO: 448840 - DNA, 25 bp, Homo sapien
tgaaacattcatatttccacatgac

SEQ ID NO: 448841 - DNA, 25 bp, Homo sapien
catatttccacatgacctgacttcc

SEQ ID NO: 448842 - DNA, 25 bp, Homo sapien
ctgacttccccaatcttggcaaaaa

SEQ ID NO: 448843 - DNA, 25 bp, Homo sapien
aaagttggaagcttattctccagag

SEQ ID NO: 448844 - DNA, 25 bp, Homo sapien
agttggaagcttattctccagaggg

SEQ ID NO: 448845 - DNA, 25 bp, Homo sapien
gaaggtttctggactaggagccctc

SEQ ID NO: 448846 - DNA, 25 bp, Homo sapien
gtttctggactaggagccctcccag

SEQ ID NO: 448847 - DNA, 25 bp, Homo sapien
taggagccctcccagagacctggat

SEQ ID NO: 448848 - DNA, 25 bp, Homo sapien
ggaactgaatgtggacatactagaa

SEQ ID NO: 448849 - DNA, 25 bp, Homo sapien
aatgtggacatactagaatgctgaa

SEQ ID NO: 448850 - DNA, 25 bp, Homo sapien
gaatgctgaaattctcaccctcttc

SEQ ID NO: 448851 - DNA, 25 bp, Homo sapien
tcatccttcctctgtcaaactaaca

SEQ ID NO: 448852 - DNA, 25 bp, Homo sapien
ttactatactatatcatgccacact

SEQ ID NO: 448853 - DNA, 25 bp, Homo sapien
tatcatgccacactatactatactg

SEQ ID NO: 448854 - DNA, 25 bp, Homo sapien
acactatactatactgtatttactg

SEQ ID NO: 448855 - DNA, 25 bp, Homo sapien
gtatttactgtaaaaactgcagagg

SEQ ID NO: 448856 - DNA, 25 bp, Homo sapien
cttggtggttaaattaatcacagca

SEQ ID NO: 448857 - DNA, 25 bp, Homo sapien
aaattaatcacagcatttgtctaga

SEQ ID NO: 448858 - DNA, 25 bp, Homo sapien
atcacagcatttgtctagattctgc

SEQ ID NO: 448859 - DNA, 25 bp, Homo sapien
acagcatttgtctagattctgcaag

SEQ ID NO: 448860 - DNA, 25 bp, Homo sapien
gcatttgtctagattctgcaagaat

SEQ ID NO: 448861 - DNA, 25 bp, Homo sapien
gaatgaattcatgaggatggattta

SEQ ID NO: 448862 - DNA, 25 bp, Homo sapien
tttaactggttctcatacctaactc

SEQ ID NO: 448863 - DNA, 25 bp, Homo sapien
taactggttctcatacctaactcta

SEQ ID NO: 448864 - DNA, 25 bp, Homo sapien
aactggttctcatacctaactctac

SEQ ID NO: 448865 - DNA, 25 bp, Homo sapien
actggttctcatacctaactctaca

SEQ ID NO: 448866 - DNA, 25 bp, Homo sapien
ctggttctcatacctaactctacat

SEQ ID NO: 448867 - DNA, 25 bp, Homo sapien
tggttctcatacctaactctacata

SEQ ID NO: 448868 - DNA, 25 bp, Homo sapien
tctcatacctaactctacataaaag

SEQ ID NO: 448869 - DNA, 25 bp, Homo sapien
ctcatacctaactctacataaaaga

SEQ ID NO: 448870 - DNA, 25 bp, Homo sapien
tttaaccagtgttcaaacctcacta

SEQ ID NO: 448871 - DNA, 25 bp, Homo sapien
ttaaccagtgttcaaacctcactaa

SEQ ID NO: 448872 - DNA, 25 bp, Homo sapien
agtgttcaaacctcactaaacataa

SEQ ID NO: 448873 - DNA, 25 bp, Homo sapien
gtatttaacatgaatggtatccata

SEQ ID NO: 448874 - DNA, 25 bp, Homo sapien
atgaatggtatccatagttgtcatc

SEQ ID NO: 448875 - DNA, 25 bp, Homo sapien
gttgtcatcatcataaatactggag

SEQ ID NO: 448876 - DNA, 25 bp, Homo sapien
gtcatcatcataaatactggagttt

SEQ ID NO: 448877 - DNA, 25 bp, Homo sapien
taaacatagtaggtgcattaacata

SEQ ID NO: 448878 - DNA, 25 bp, Homo sapien
ggtgcattaacataaatcagtctcc

SEQ ID NO: 448879 - DNA, 25 bp, Homo sapien
aacataaatcagtctccacacagta

SEQ ID NO: 448880 - DNA, 25 bp, Homo sapien
agtaacatttaactgataattcatt

SEQ ID NO: 448881 - DNA, 25 bp, Homo sapien
gataattcattaatcagctttgaaa

SEQ ID NO: 448882 - DNA, 25 bp, Homo sapien
tatgcatatattgtgtctgacttaa

SEQ ID NO: 448883 - DNA, 25 bp, Homo sapien
gcatatattgtgtctgacttaaaat

SEQ ID NO: 448884 - DNA, 25 bp, Homo sapien
ttatgcaaagtgttaaccattggag

SEQ ID NO: 448885 - DNA, 25 bp, Homo sapien
gcaaagtgttaaccattggagggaa

SEQ ID NO: 448886 - DNA, 25 bp, Homo sapien
ctctccttttttcatacaactccat

SEQ ID NO: 448887 - DNA, 25 bp, Homo sapien
ccttttttcatacaactccatgtga

SEQ ID NO: 448888 - DNA, 25 bp, Homo sapien
atacaactccatgtgaatttacaat

SEQ ID NO: 448889 - DNA, 25 bp, Homo sapien
attttaacatatagtgtctgcgagc

SEQ ID NO: 448890 - DNA, 25 bp, Homo sapien
aacatatagtgtctgcgagcacttt

SEQ ID NO: 448891 - DNA, 25 bp, Homo sapien
atagtgtctgcgagcactttgaata

SEQ ID NO: 448892 - DNA, 25 bp, Homo sapien
tgtctgcgagcactttgaataatgg

SEQ ID NO: 448893 - DNA, 25 bp, Homo sapien
actatgcacaagagagggtcgtatt

SEQ ID NO: 448894 - DNA, 25 bp, Homo sapien
gagagggtcgtattggaagtataaa

SEQ ID NO: 448895 - DNA, 25 bp, Homo sapien
ggcctgagagactttcactaaagga

SEQ ID NO: 448896 - DNA, 25 bp, Homo sapien
ggaacctgtagataatttacttctg

SEQ ID NO: 448897 - DNA, 25 bp, Homo sapien
taaaggtgctaagttttctacaata

SEQ ID NO: 448898 - DNA, 25 bp, Homo sapien
atgcaactggtactaatcaggcttt

SEQ ID NO: 448899 - DNA, 25 bp, Homo sapien
atcaggcttttttccaaacaattct

SEQ ID NO: 448900 - DNA, 25 bp, Homo sapien
aacaattctgtctatgccttgctgg

SEQ ID NO: 448901 - DNA, 25 bp, Homo sapien
gtctatgccttgctggttcacagat

SEQ ID NO: 448902 - DNA, 25 bp, Homo sapien
tggttcacagatggcattatcattt

SEQ ID NO: 448903 - DNA, 25 bp, Homo sapien
gatggcattatcatttatagcacat

SEQ ID NO: 448904 - DNA, 25 bp, Homo sapien
catttatagcacatgacagccaatc

SEQ ID NO: 448905 - DNA, 25 bp, Homo sapien
tgacagccaatcaattagtaacttg

SEQ ID NO: 448906 - DNA, 25 bp, Homo sapien
gaaggaaacttgctcagcaccgtga

SEQ ID NO: 448907 - DNA, 25 bp, Homo sapien
gagccccacagtgaaagcacttttt

SEQ ID NO: 448908 - DNA, 25 bp, Homo sapien
aaagcactttttggcaagactagag

SEQ ID NO: 448909 - DNA, 25 bp, Homo sapien
aagactagagtctcaccgattttcc

SEQ ID NO: 448910 - DNA, 25 bp, Homo sapien
actagagtctcaccgattttccctt

SEQ ID NO: 448911 - DNA, 25 bp, Homo sapien
agagtctcaccgattttccctttct

SEQ ID NO: 448912 - DNA, 25 bp, Homo sapien
tcgatctcctttccagcctcttatt

SEQ ID NO: 448913 - DNA, 25 bp, Homo sapien
ggaccaggctttccaatagggccca

SEQ ID NO: 448914 - DNA, 25 bp, Homo sapien
caggctttccaatagggcccatggg

SEQ ID NO: 448915 - DNA, 25 bp, Homo sapien
ccttggcccctcaggaccagtggga

SEQ ID NO: 448916 - DNA, 25 bp, Homo sapien
cagtgggacccacgtcacccttatt

SEQ ID NO: 448917 - DNA, 25 bp, Homo sapien
tggccactaccgcaggctcgagaca

SEQ ID NO: 448918 - DNA, 25 bp, Homo sapien
ggctcgagacaacccaggtgcgtat

SEQ ID NO: 448919 - DNA, 25 bp, Homo sapien
cgcgcacacggaacagcacaggctg

SEQ ID NO: 448920 - DNA, 25 bp, Homo sapien
ggtggcaagcctgaagtaatttcta

SEQ ID NO: 448921 - DNA, 25 bp, Homo sapien
ttaagaggcagacggcttttctcct

SEQ ID NO: 448922 - DNA, 25 bp, Homo sapien
ggcttttctccttgcaaatgacctg

SEQ ID NO: 448923 - DNA, 25 bp, Homo sapien
aaatgacctgccacacagtccgtca

SEQ ID NO: 448924 - DNA, 25 bp, Homo sapien
gtccacagcccacgtgggagacctt

SEQ ID NO: 448925 - DNA, 25 bp, Homo sapien
gggagaccttttcacgggatctact

SEQ ID NO: 448926 - DNA, 25 bp, Homo sapien
ttttcacgggatctactcggatgtc

SEQ ID NO: 448927 - DNA, 25 bp, Homo sapien
tactcggatgtctgggatctggcca

SEQ ID NO: 448928 - DNA, 25 bp, Homo sapien
gtcagtatttttcttagtgaggatt

SEQ ID NO: 448929 - DNA, 25 bp, Homo sapien
gattggttttagtttatcatctatc

SEQ ID NO: 448930 - DNA, 25 bp, Homo sapien
atcatctatctgcttctatttttcc

SEQ ID NO: 448931 - DNA, 25 bp, Homo sapien
ctatttttccatgttagactaactg

SEQ ID NO: 448932 - DNA, 25 bp, Homo sapien
agactaactgcctattgaccctgaa

SEQ ID NO: 448933 - DNA, 25 bp, Homo sapien
aactgcctattgaccctgaaaaatg

SEQ ID NO: 448934 - DNA, 25 bp, Homo sapien
atgagagtcaaagccattactgtgg

SEQ ID NO: 448935 - DNA, 25 bp, Homo sapien
gccattactgtggacttaactgtgt

SEQ ID NO: 448936 - DNA, 25 bp, Homo sapien
ttagctcctaaaccaactttcttct

SEQ ID NO: 448937 - DNA, 25 bp, Homo sapien
tctttgttcttgaatgttgtctctt

SEQ ID NO: 448938 - DNA, 25 bp, Homo sapien
cttggcccagtttgaaaaagattca

SEQ ID NO: 448939 - DNA, 25 bp, Homo sapien
atatccagactaataaagctatcag

SEQ ID NO: 448940 - DNA, 25 bp, Homo sapien
aaagctatcagttgagggatttgca

SEQ ID NO: 448941 - DNA, 25 bp, Homo sapien
cagttgagggatttgcagttgataa

SEQ ID NO: 448942 - DNA, 25 bp, Homo sapien
ctggagaggttaaggctttcttcga

SEQ ID NO: 448943 - DNA, 25 bp, Homo sapien
gaggttaaggctttcttcgagagtc

SEQ ID NO: 448944 - DNA, 25 bp, Homo sapien
ttaaggctttcttcgagagtcaccc

SEQ ID NO: 448945 - DNA, 25 bp, Homo sapien
aaggctttcttcgagagtcacccag

SEQ ID NO: 448946 - DNA, 25 bp, Homo sapien
ttcttcgagagtcacccagctcctt

SEQ ID NO: 448947 - DNA, 25 bp, Homo sapien
agctccttcagctgagcgtaccatc

SEQ ID NO: 448948 - DNA, 25 bp, Homo sapien
ttcagctgagcgtaccatccagcag

SEQ ID NO: 448949 - DNA, 25 bp, Homo sapien
cagcagtgttgtgaaaatattctgc

SEQ ID NO: 448950 - DNA, 25 bp, Homo sapien
cgcgtcgacactttttgtgctttaa

SEQ ID NO: 448951 - DNA, 25 bp, Homo sapien
aatcatacattatacactgctttat

SEQ ID NO: 448952 - DNA, 25 bp, Homo sapien
atcagatttctcatattagcccata

SEQ ID NO: 448953 - DNA, 25 bp, Homo sapien
attagcccataataaggtagacatt

SEQ ID NO: 448954 - DNA, 25 bp, Homo sapien
ggtagacattactatcctgatttta

SEQ ID NO: 448955 - DNA, 25 bp, Homo sapien
actatcctgattttacattgaagaa

SEQ ID NO: 448956 - DNA, 25 bp, Homo sapien
aggtcacacaggtaagattaaagtt

SEQ ID NO: 448957 - DNA, 25 bp, Homo sapien
gtttaggtttcaaattcaggtatgt

SEQ ID NO: 448958 - DNA, 25 bp, Homo sapien
gtttgctacaaaaccttgtcactgt

SEQ ID NO: 448959 - DNA, 25 bp, Homo sapien
ttgtcactgtgttagactgcctcta

SEQ ID NO: 448960 - DNA, 25 bp, Homo sapien
gactgcctctaaagtgagtaaggta

SEQ ID NO: 448961 - DNA, 25 bp, Homo sapien
gcccatgcctccctgggatgaagag

SEQ ID NO: 448962 - DNA, 25 bp, Homo sapien
atgcctccctgggatgaagagtccc

SEQ ID NO: 448963 - DNA, 25 bp, Homo sapien
ctcctggcagaatgtctgggctttg

SEQ ID NO: 448964 - DNA, 25 bp, Homo sapien
tggcagaatgtctgggctttgcaga

SEQ ID NO: 448965 - DNA, 25 bp, Homo sapien
gggtgaagtcgcagcttcacttaca

SEQ ID NO: 448966 - DNA, 25 bp, Homo sapien
gaagtcgcagcttcacttacaccag

SEQ ID NO: 448967 - DNA, 25 bp, Homo sapien
agctgctctgtgagcaaggcttggt

SEQ ID NO: 448968 - DNA, 25 bp, Homo sapien
agcaaggcttggtgccctggacaag

SEQ ID NO: 448969 - DNA, 25 bp, Homo sapien
tttagggaggtccagcctcgcaagc

SEQ ID NO: 448970 - DNA, 25 bp, Homo sapien
gaggtccagcctcgcaagctgaaac

SEQ ID NO: 448971 - DNA, 25 bp, Homo sapien
tataccaggcggccacagcaggact

SEQ ID NO: 448972 - DNA, 25 bp, Homo sapien
gagccccacagtgaaagcacttttt

SEQ ID NO: 448973 - DNA, 25 bp, Homo sapien
aaagcactttttggcaagactagag

SEQ ID NO: 448974 - DNA, 25 bp, Homo sapien
gcactttttggcaagactagagtct

SEQ ID NO: 448975 - DNA, 25 bp, Homo sapien
aagactagagtctcaccgattttcc

SEQ ID NO: 448976 - DNA, 25 bp, Homo sapien
actagagtctcaccgattttccctt

SEQ ID NO: 448977 - DNA, 25 bp, Homo sapien
agagtctcaccgattttccctttct

SEQ ID NO: 448978 - DNA, 25 bp, Homo sapien
cgatctcctttccagcctcttattc

SEQ ID NO: 448979 - DNA, 25 bp, Homo sapien
tcttattccccggactcctggctca

SEQ ID NO: 448980 - DNA, 25 bp, Homo sapien
ggaccaggctttccaatagggccca

SEQ ID NO: 448981 - DNA, 25 bp, Homo sapien
caggctttccaatagggcccatggg

SEQ ID NO: 448982 - DNA, 25 bp, Homo sapien
cagtgggacccacgtcacccttatt

SEQ ID NO: 448983 - DNA, 25 bp, Homo sapien
tcatgagcgattccatatctccact

SEQ ID NO: 448984 - DNA, 25 bp, Homo sapien
actcagaccctgtggactacagtgt

SEQ ID NO: 448985 - DNA, 25 bp, Homo sapien
acagtgttccgctgtggtggctgcc

SEQ ID NO: 448986 - DNA, 25 bp, Homo sapien
agatgccttcttaaacttatgcaag

SEQ ID NO: 448987 - DNA, 25 bp, Homo sapien
tggaagaagaggcttctcacccttc

SEQ ID NO: 448988 - DNA, 25 bp, Homo sapien
tttttcaccacaatcaccttgagct

SEQ ID NO: 448989 - DNA, 25 bp, Homo sapien
ttgagctcgtcctgacagagtctca

SEQ ID NO: 448990 - DNA, 25 bp, Homo sapien
acagagtctcacagttcagtaaatc

SEQ ID NO: 448991 - DNA, 25 bp, Homo sapien
aatctgcgtggctgatgagctgctt

SEQ ID NO: 448992 - DNA, 25 bp, Homo sapien
gctgcttgcattctgtgacatttcc

SEQ ID NO: 448993 - DNA, 25 bp, Homo sapien
tttccagatatgattctcagtggga

SEQ ID NO: 448994 - DNA, 25 bp, Homo sapien
cgcgtcgcgtgcacggagcgcttca

SEQ ID NO: 448995 - DNA, 25 bp, Homo sapien
gggccggaacctcaaaagcaactgg

SEQ ID NO: 448996 - DNA, 25 bp, Homo sapien
aagcaactggatgagcacaacgcgg

SEQ ID NO: 448997 - DNA, 25 bp, Homo sapien
agcacaacgcggacgccccggagaa

SEQ ID NO: 448998 - DNA, 25 bp, Homo sapien
agaagcggcgcaagcgggcccaaaa

SEQ ID NO: 448999 - DNA, 25 bp, Homo sapien
agcgggcccaaaatggttgctgatc

SEQ ID NO: 449000 - DNA, 25 bp, Homo sapien
gttgctgatcagacgagtggcatct

SEQ ID NO: 449001 - DNA, 25 bp, Homo sapien
gatcagacgagtggcatctctcgcc

SEQ ID NO: 449002 - DNA, 25 bp, Homo sapien
taccgcgggaattgggacctccaga

SEQ ID NO: 449003 - DNA, 25 bp, Homo sapien
gcgggaattgggacctccagactgt

SEQ ID NO: 449004 - DNA, 25 bp, Homo sapien
gggatcggcaagtggttcccctctg

SEQ ID NO: 449005 - DNA, 25 bp, Homo sapien
cagagtattggattcagtgattgta

SEQ ID NO: 449006 - DNA, 25 bp, Homo sapien
gattcagtgattgtacaagagcagt

SEQ ID NO: 449007 - DNA, 25 bp, Homo sapien
gagcagtggagttttctccacaaag

SEQ ID NO: 449008 - DNA, 25 bp, Homo sapien
gttatgcaaatagcttacagaacta

SEQ ID NO: 449009 - DNA, 25 bp, Homo sapien
tgtaatttcttatgtaactagtcca

SEQ ID NO: 449010 - DNA, 25 bp, Homo sapien
tgtaactagtccatttgctttcacc

SEQ ID NO: 449011 - DNA, 25 bp, Homo sapien
ccatttgctttcacccagtgatgag

SEQ ID NO: 449012 - DNA, 25 bp, Homo sapien
acccagtgatgagcatcttacctgc

SEQ ID NO: 449013 - DNA, 25 bp, Homo sapien
atcttacctgcttcactcggtagcg

SEQ ID NO: 449014 - DNA, 25 bp, Homo sapien
tgcttcactcggtagcgctccattc

SEQ ID NO: 449015 - DNA, 25 bp, Homo sapien
agcgctccattcctaatctttttaa

SEQ ID NO: 449016 - DNA, 25 bp, Homo sapien
ccaccgcgtcccacttgttttccat

SEQ ID NO: 449017 - DNA, 25 bp, Homo sapien
attttctgtcattttaggggctagg

SEQ ID NO: 449018 - DNA, 25 bp, Homo sapien
gaggaagcagaggtgaacgtcatca

SEQ ID NO: 449019 - DNA, 25 bp, Homo sapien
gaagcagaggtgaacgtcatcatgc

SEQ ID NO: 449020 - DNA, 25 bp, Homo sapien
gcagaggtgaacgtcatcatgcatc

SEQ ID NO: 449021 - DNA, 25 bp, Homo sapien
agaggtgaacgtcatcatgcatctt

SEQ ID NO: 449022 - DNA, 25 bp, Homo sapien
gaggtgaacgtcatcatgcatcttt

SEQ ID NO: 449023 - DNA, 25 bp, Homo sapien
ggtgaacgtcatcatgcatcttttt

SEQ ID NO: 449024 - DNA, 25 bp, Homo sapien
gtgaacgtcatcatgcatctttttc

SEQ ID NO: 449025 - DNA, 25 bp, Homo sapien
tttcagaaaagcattgagctggccg

SEQ ID NO: 449026 - DNA, 25 bp, Homo sapien
cagaaaagcattgagctggccgggc

SEQ ID NO: 449027 - DNA, 25 bp, Homo sapien
aatgatgtttaccagtccatttcag

SEQ ID NO: 449028 - DNA, 25 bp, Homo sapien
gatgtttaccagtccatttcagttc

SEQ ID NO: 449029 - DNA, 25 bp, Homo sapien
ctcttatagccccacataggttaga

SEQ ID NO: 449030 - DNA, 25 bp, Homo sapien
tttaccagtccatttcagttcttca

SEQ ID NO: 449031 - DNA, 25 bp, Homo sapien
tatagccccacataggttagatttt

SEQ ID NO: 449032 - DNA, 25 bp, Homo sapien
atactacttttgctgtataccaagc

SEQ ID NO: 449033 - DNA, 25 bp, Homo sapien
tacttttgctgtataccaagctaca

SEQ ID NO: 449034 - DNA, 25 bp, Homo sapien
ttgctgtataccaagctacagttgt

SEQ ID NO: 449035 - DNA, 25 bp, Homo sapien
gctacagttgtagatattgattcaa

SEQ ID NO: 449036 - DNA, 25 bp, Homo sapien
atgcttaagaaattacctcacataa

SEQ ID NO: 449037 - DNA, 25 bp, Homo sapien
attacctcacataaacattttacca

SEQ ID NO: 449038 - DNA, 25 bp, Homo sapien
gtataacaaaaagctctctccagat

SEQ ID NO: 449039 - DNA, 25 bp, Homo sapien
tctctccagatcatccctgtgaatg

SEQ ID NO: 449040 - DNA, 25 bp, Homo sapien
cagatcatccctgtgaatgccaaag

SEQ ID NO: 449041 - DNA, 25 bp, Homo sapien
attctaatgattggctcctggaagt

SEQ ID NO: 449042 - DNA, 25 bp, Homo sapien
ttggctcctggaagtatagaaaact

SEQ ID NO: 449043 - DNA, 25 bp, Homo sapien
gtatagaaaactcccattaacataa

SEQ ID NO: 449044 - DNA, 25 bp, Homo sapien
aattttacactctaatggtagttga

SEQ ID NO: 449045 - DNA, 25 bp, Homo sapien
atggtagttgatcttcatagtcaag

SEQ ID NO: 449046 - DNA, 25 bp, Homo sapien
gatcttcatagtcaagaggcactgt

SEQ ID NO: 449047 - DNA, 25 bp, Homo sapien
gaggcactgttcaagatcatgactt

SEQ ID NO: 449048 - DNA, 25 bp, Homo sapien
caagatcatgacttagtgtttcaat

SEQ ID NO: 449049 - DNA, 25 bp, Homo sapien
acaaggtatatttctctcacataac

SEQ ID NO: 449050 - DNA, 25 bp, Homo sapien
aaggtatatttctctcacataaccc

SEQ ID NO: 449051 - DNA, 25 bp, Homo sapien
aggtatatttctctcacataaccca

SEQ ID NO: 449052 - DNA, 25 bp, Homo sapien
ggtatatttctctcacataacccac

SEQ ID NO: 449053 - DNA, 25 bp, Homo sapien
gtatatttctctcacataacccacc

SEQ ID NO: 449054 - DNA, 25 bp, Homo sapien
ataacccaccccaccatttatatca

SEQ ID NO: 449055 - DNA, 25 bp, Homo sapien
caccatttatatcactcaacttgag

SEQ ID NO: 449056 - DNA, 25 bp, Homo sapien
accatttatatcactcaacttgagt

SEQ ID NO: 449057 - DNA, 25 bp, Homo sapien
atatcactcaacttgagttatggaa

SEQ ID NO: 449058 - DNA, 25 bp, Homo sapien
cactcaacttgagttatggaaatta

SEQ ID NO: 449059 - DNA, 25 bp, Homo sapien
aacttgagttatggaaattatcact

SEQ ID NO: 449060 - DNA, 25 bp, Homo sapien
acgcagctgtgaatggccggtgatg

SEQ ID NO: 449061 - DNA, 25 bp, Homo sapien
tgtgaatggccggtgatgtatgtca

SEQ ID NO: 449062 - DNA, 25 bp, Homo sapien
ccggtgatgtatgtcaggaggccac

SEQ ID NO: 449063 - DNA, 25 bp, Homo sapien
cagaaatcccgggtcggactactat

SEQ ID NO: 449064 - DNA, 25 bp, Homo sapien
gcccttcaacaacaagccctgattt

SEQ ID NO: 449065 - DNA, 25 bp, Homo sapien
cccttcaacaacaagccctgatttt

SEQ ID NO: 449066 - DNA, 25 bp, Homo sapien
cttcaacaacaagccctgatttttc

SEQ ID NO: 449067 - DNA, 25 bp, Homo sapien
aacaacaagccctgatttttccagc

SEQ ID NO: 449068 - DNA, 25 bp, Homo sapien
gatttttccagcaatgccagaaacc

SEQ ID NO: 449069 - DNA, 25 bp, Homo sapien
gccagaaacctggattttaagtctt

SEQ ID NO: 449070 - DNA, 25 bp, Homo sapien
gtcggactactataactaaattcgg

SEQ ID NO: 449071 - DNA, 25 bp, Homo sapien
ccgcgtcgacgctccggaactcggg

SEQ ID NO: 449072 - DNA, 25 bp, Homo sapien
tcgacgctccggaactcggggaaga

SEQ ID NO: 449073 - DNA, 25 bp, Homo sapien
gggagccgggtctgggttccgcact

SEQ ID NO: 449074 - DNA, 25 bp, Homo sapien
gccgggtctgggttccgcactccgt

SEQ ID NO: 449075 - DNA, 25 bp, Homo sapien
agagagtgagatacggacgccccgg

SEQ ID NO: 449076 - DNA, 25 bp, Homo sapien
gtgagatacggacgccccgggacga

SEQ ID NO: 449077 - DNA, 25 bp, Homo sapien
tcaggacccggctacggacacctgc

SEQ ID NO: 449078 - DNA, 25 bp, Homo sapien
ggctacggacacctgcctccatctc

SEQ ID NO: 449079 - DNA, 25 bp, Homo sapien
ctccctccagataacacaagtgtga

SEQ ID NO: 449080 - DNA, 25 bp, Homo sapien
tccctccagataacacaagtgtgaa

SEQ ID NO: 449081 - DNA, 25 bp, Homo sapien
cctccagataacacaagtgtgaaga

SEQ ID NO: 449082 - DNA, 25 bp, Homo sapien
gcatacagttgcataattttagatt

SEQ ID NO: 449083 - DNA, 25 bp, Homo sapien
ttgttttagggcagcataagttttg

SEQ ID NO: 449084 - DNA, 25 bp, Homo sapien
gatttctgttttactctctttggcc

SEQ ID NO: 449085 - DNA, 25 bp, Homo sapien
tttactctctttggcctgtttgcaa

SEQ ID NO: 449086 - DNA, 25 bp, Homo sapien
ggcctgtttgcaaaaataatccctc

SEQ ID NO: 449087 - DNA, 25 bp, Homo sapien
atacacagttgcaatgtctggccct

SEQ ID NO: 449088 - DNA, 25 bp, Homo sapien
cacagttgcaatgtctggcccttaa

SEQ ID NO: 449089 - DNA, 25 bp, Homo sapien
gtatcaactatcacataaaaccagt

SEQ ID NO: 449090 - DNA, 25 bp, Homo sapien
aaaccagttgaatgttattcacaga

SEQ ID NO: 449091 - DNA, 25 bp, Homo sapien
gaatgttattcacagatttggaatc

SEQ ID NO: 449092 - DNA, 25 bp, Homo sapien
gatttggaatctatttgtgtgagga

SEQ ID NO: 449093 - DNA, 25 bp, Homo sapien
agctctgctctgctcagggaagata

SEQ ID NO: 449094 - DNA, 25 bp, Homo sapien
gcattcattttatagtgtatctggt

SEQ ID NO: 449095 - DNA, 25 bp, Homo sapien
gtgtatctggttttggtagaggcca

SEQ ID NO: 449096 - DNA, 25 bp, Homo sapien
tataaaaagactaccatcccctgca

SEQ ID NO: 449097 - DNA, 25 bp, Homo sapien
atcccctgcaactttcaagtgtttt

SEQ ID NO: 449098 - DNA, 25 bp, Homo sapien
caagtgttttgtcatggtagtgatc

SEQ ID NO: 449099 - DNA, 25 bp, Homo sapien
tggtagtgatcaattccattccttg

SEQ ID NO: 449100 - DNA, 25 bp, Homo sapien
atttttcaatcattgttgccagtgg

SEQ ID NO: 449101 - DNA, 25 bp, Homo sapien
gaggagaatttcacaggcttcccct

SEQ ID NO: 449102 - DNA, 25 bp, Homo sapien
gaatttcacaggcttccccttggtt

SEQ ID NO: 449103 - DNA, 25 bp, Homo sapien
tccccttggttctgctctaataatg

SEQ ID NO: 449104 - DNA, 25 bp, Homo sapien
gttatgctgaatggtaagagcctaa

SEQ ID NO: 449105 - DNA, 25 bp, Homo sapien
tatacaatgtacttggtcccaactt

SEQ ID NO: 449106 - DNA, 25 bp, Homo sapien
tacttggtcccaacttgattgtgat

SEQ ID NO: 449107 - DNA, 25 bp, Homo sapien
gtcccaacttgattgtgatgtcaga

SEQ ID NO: 449108 - DNA, 25 bp, Homo sapien
aaggagctggtctcccttgaaccag

SEQ ID NO: 449109 - DNA, 25 bp, Homo sapien
aattttgcttggttataggttgatc

SEQ ID NO: 449110 - DNA, 25 bp, Homo sapien
agccccttgcagtcattgttctcct

SEQ ID NO: 449111 - DNA, 25 bp, Homo sapien
gatgttatcagagatcctatgcagg

SEQ ID NO: 449112 - DNA, 25 bp, Homo sapien
gttgatcattgaagcccagtggaat

SEQ ID NO: 449113 - DNA, 25 bp, Homo sapien
ccagtggaattttgcccaactcttt

SEQ ID NO: 449114 - DNA, 25 bp, Homo sapien
gcccaactcttttattatacatccc

SEQ ID NO: 449115 - DNA, 25 bp, Homo sapien
ggccatatggagtggatattccttc

SEQ ID NO: 449116 - DNA, 25 bp, Homo sapien
tatggagtggatattccttccagaa

SEQ ID NO: 449117 - DNA, 25 bp, Homo sapien
ggaaattacagaccactctctgttt

SEQ ID NO: 449118 - DNA, 25 bp, Homo sapien
tctctgtttctactcaactgctttt

SEQ ID NO: 449119 - DNA, 25 bp, Homo sapien
aactgcttttcactccaggatgctt

SEQ ID NO: 449120 - DNA, 25 bp, Homo sapien
tttcactccaggatgcttcacctct

SEQ ID NO: 449121 - DNA, 25 bp, Homo sapien
agaggcccaggatcacctgcaaaag

SEQ ID NO: 449122 - DNA, 25 bp, Homo sapien
aagcagggctgcagatatgtgtcct

SEQ ID NO: 449123 - DNA, 25 bp, Homo sapien
gctgcagatatgtgtcctgaacctc

SEQ ID NO: 449124 - DNA, 25 bp, Homo sapien
atatgtgtcctgaacctcccatgga

SEQ ID NO: 449125 - DNA, 25 bp, Homo sapien
attcttgcttcaggccatatggagt

SEQ ID NO: 449126 - DNA, 25 bp, Homo sapien
tggtctgtttaatatattcatctat

SEQ ID NO: 449127 - DNA, 25 bp, Homo sapien
gatgatgaacatttagattactttt

SEQ ID NO: 449128 - DNA, 25 bp, Homo sapien
gataataactagaaccaggagtggt

SEQ ID NO: 449129 - DNA, 25 bp, Homo sapien
aatttaatttacacatctactccct

SEQ ID NO: 449130 - DNA, 25 bp, Homo sapien
atctactccctgtgttatttgcctg

SEQ ID NO: 449131 - DNA, 25 bp, Homo sapien
tatttgcctgctcttagtgtgccaa

SEQ ID NO: 449132 - DNA, 25 bp, Homo sapien
gcctgctcttagtgtgccaaatgtt

SEQ ID NO: 449133 - DNA, 25 bp, Homo sapien
aaaggatgaatctcagtatagactg

SEQ ID NO: 449134 - DNA, 25 bp, Homo sapien
ctgagtttgtattgtggtccccaat

SEQ ID NO: 449135 - DNA, 25 bp, Homo sapien
gtggtccccaatgtttagatcatat

SEQ ID NO: 449136 - DNA, 25 bp, Homo sapien
gtttagatcatatatctgtatacct

SEQ ID NO: 449137 - DNA, 25 bp, Homo sapien
gaacagtgagctcctacataaagat

SEQ ID NO: 449138 - DNA, 25 bp, Homo sapien
aaagatcaacatttgtttctccttt

SEQ ID NO: 449139 - DNA, 25 bp, Homo sapien
aagtgcctgtctctgccaaagattt

SEQ ID NO: 449140 - DNA, 25 bp, Homo sapien
tttcagtaatttctgctgcagcaat

SEQ ID NO: 449141 - DNA, 25 bp, Homo sapien
tctgctgcagcaatgggaataatgg

SEQ ID NO: 449142 - DNA, 25 bp, Homo sapien
tgcactggcctgcttctatcaaacc

SEQ ID NO: 449143 - DNA, 25 bp, Homo sapien
ttctatcaaacccaagcagagcagg

SEQ ID NO: 449144 - DNA, 25 bp, Homo sapien
agagcagggtctgcaacttcccttt

SEQ ID NO: 449145 - DNA, 25 bp, Homo sapien
cttccctttgaaacaagggctgacg

SEQ ID NO: 449146 - DNA, 25 bp, Homo sapien
gtgcataaaaagtcacacttctctg

SEQ ID NO: 449147 - DNA, 25 bp, Homo sapien
aagtcacacttctctgtcttttatc

SEQ ID NO: 449148 - DNA, 25 bp, Homo sapien
gtcccacttgttttccattttctgt

SEQ ID NO: 449149 - DNA, 25 bp, Homo sapien
attttctgtcattttaggggctagg

SEQ ID NO: 449150 - DNA, 25 bp, Homo sapien
gaggaagcagaggtgaacgtcatca

SEQ ID NO: 449151 - DNA, 25 bp, Homo sapien
cagaggtgaacgtcatcatgcatct

SEQ ID NO: 449152 - DNA, 25 bp, Homo sapien
gaggtgaacgtcatcatgcatcttt

SEQ ID NO: 449153 - DNA, 25 bp, Homo sapien
ggtgaacgtcatcatgcatcttttt

SEQ ID NO: 449154 - DNA, 25 bp, Homo sapien
gtgaacgtcatcatgcatctttttc

SEQ ID NO: 449155 - DNA, 25 bp, Homo sapien
acgtcatcatgcatctttttctaac

SEQ ID NO: 449156 - DNA, 25 bp, Homo sapien
tttttctaactgtcttcttgctcac

SEQ ID NO: 449157 - DNA, 25 bp, Homo sapien
tttcagaaaagcattgagctggccg

SEQ ID NO: 449158 - DNA, 25 bp, Homo sapien
cagaaaagcattgagctggccgggc

SEQ ID NO: 449159 - DNA, 25 bp, Homo sapien
gatgaagaagtacttctgtgtctca

SEQ ID NO: 449160 - DNA, 25 bp, Homo sapien
tgtgtctcacccaagtgctccggag

SEQ ID NO: 449161 - DNA, 25 bp, Homo sapien
gtctcacccaagtgctccggagagt

SEQ ID NO: 449162 - DNA, 25 bp, Homo sapien
agcgtcctgcggtctcgctggcaca

SEQ ID NO: 449163 - DNA, 25 bp, Homo sapien
tcctacagctacgtggccgtgggca

SEQ ID NO: 449164 - DNA, 25 bp, Homo sapien
ctacagctacgtggccgtgggcagt

SEQ ID NO: 449165 - DNA, 25 bp, Homo sapien
gggaagccacacatcgcacgtttta

SEQ ID NO: 449166 - DNA, 25 bp, Homo sapien
gaagccacacatcgcacgttttact

SEQ ID NO: 449167 - DNA, 25 bp, Homo sapien
acacatcgcacgttttactccacga

SEQ ID NO: 449168 - DNA, 25 bp, Homo sapien
atcgcacgttttactccacgacgca

SEQ ID NO: 449169 - DNA, 25 bp, Homo sapien
cacgttttactccacgacgcacggg

SEQ ID NO: 449170 - DNA, 25 bp, Homo sapien
gaatatgtaatttgggtctgtgttt

SEQ ID NO: 449171 - DNA, 25 bp, Homo sapien
ttgggtctgtgttttttacatataa

SEQ ID NO: 449172 - DNA, 25 bp, Homo sapien
aagatctgcttaatagttctgctac

SEQ ID NO: 449173 - DNA, 25 bp, Homo sapien
tgcttaatagttctgctactgcagt

SEQ ID NO: 449174 - DNA, 25 bp, Homo sapien
agttctgctactgcagttttcatta

SEQ ID NO: 449175 - DNA, 25 bp, Homo sapien
gctactgcagttttcattattagat

SEQ ID NO: 449176 - DNA, 25 bp, Homo sapien
gcagtggtttatatcaatttcagtg

SEQ ID NO: 449177 - DNA, 25 bp, Homo sapien
gtggtttatatcaatttcagtggtt

SEQ ID NO: 449178 - DNA, 25 bp, Homo sapien
aatgtagtgaatctcatattccaga

SEQ ID NO: 449179 - DNA, 25 bp, Homo sapien
tgattgatttgatgctatttgtgac

SEQ ID NO: 449180 - DNA, 25 bp, Homo sapien
atttgatgctatttgtgacagacag

SEQ ID NO: 449181 - DNA, 25 bp, Homo sapien
gatccacctccgtgaggacctggtg

SEQ ID NO: 449182 - DNA, 25 bp, Homo sapien
gaggccatccgcaagcaggacctgg

SEQ ID NO: 449183 - DNA, 25 bp, Homo sapien
gagctgtacctgactaactgcgaga

SEQ ID NO: 449184 - DNA, 25 bp, Homo sapien
aactgcgagaagctgtccgccaaga

SEQ ID NO: 449185 - DNA, 25 bp, Homo sapien
caagagcctgcagacactgaggagc

SEQ ID NO: 449186 - DNA, 25 bp, Homo sapien
tgaggagcttcagccacaccctggt

SEQ ID NO: 449187 - DNA, 25 bp, Homo sapien
gtgtccttgagcctcttcggctgta

SEQ ID NO: 449188 - DNA, 25 bp, Homo sapien
gcctcttcggctgtacaaacatttt

SEQ ID NO: 449189 - DNA, 25 bp, Homo sapien
tgaagatgagtacctcgtcaacccc

SEQ ID NO: 449190 - DNA, 25 bp, Homo sapien
ccacctgccaggtgctggttaagga

SEQ ID NO: 449191 - DNA, 25 bp, Homo sapien
aaggatttcaccttcgagggcttca

SEQ ID NO: 449192 - DNA, 25 bp, Homo sapien
ggtaatgcgcaaagagaaagggatc

SEQ ID NO: 449193 - DNA, 25 bp, Homo sapien
aaagggatcgcgagggctgcagtgc

SEQ ID NO: 449194 - DNA, 25 bp, Homo sapien
cagtgcgcacgggtcggatttgaaa

SEQ ID NO: 449195 - DNA, 25 bp, Homo sapien
gatttgaaatcggtggccttgagca

SEQ ID NO: 449196 - DNA, 25 bp, Homo sapien
atcggtggccttgagcaggtacttt

SEQ ID NO: 449197 - DNA, 25 bp, Homo sapien
agcaggtactttgagaacatcccca

SEQ ID NO: 449198 - DNA, 25 bp, Homo sapien
actttgagaacatccccaagggtct

SEQ ID NO: 449199 - DNA, 25 bp, Homo sapien
gaacatccccaagggtctagaccag

SEQ ID NO: 449200 - DNA, 25 bp, Homo sapien
atccccaagggtctagaccaggaag

SEQ ID NO: 449201 - DNA, 25 bp, Homo sapien
tcagccagccggtcagctgcatgga

SEQ ID NO: 449202 - DNA, 25 bp, Homo sapien
acgtgggaagaaccctgacctcagc

SEQ ID NO: 449203 - DNA, 25 bp, Homo sapien
tccagatggtggagtaccgcgcaga

SEQ ID NO: 449204 - DNA, 25 bp, Homo sapien
tggagtaccgcgcagacattaaaag

SEQ ID NO: 449205 - DNA, 25 bp, Homo sapien
gtaccgcgcagacattaaaagtcat

SEQ ID NO: 449206 - DNA, 25 bp, Homo sapien
tctgactgaaagaaaaatgctcctt

SEQ ID NO: 449207 - DNA, 25 bp, Homo sapien
gaaaaatgctccttgaatattaaaa

SEQ ID NO: 449208 - DNA, 25 bp, Homo sapien
aatatgggtgtatgcttgtatacgt

SEQ ID NO: 449209 - DNA, 25 bp, Homo sapien
gcttgtatacgtagagcagataaaa

SEQ ID NO: 449210 - DNA, 25 bp, Homo sapien
gacggaaggcatactaaaaaatgtt

SEQ ID NO: 449211 - DNA, 25 bp, Homo sapien
tgagtggttatctttgtatggtgga

SEQ ID NO: 449212 - DNA, 25 bp, Homo sapien
gtatggtggaacaaagtcactgtaa

SEQ ID NO: 449213 - DNA, 25 bp, Homo sapien
gtcactgtaattttcatctttggtt

SEQ ID NO: 449214 - DNA, 25 bp, Homo sapien
atgcatattccagaccacatttcca

SEQ ID NO: 449215 - DNA, 25 bp, Homo sapien
gaccacatttccactggagcagttg

SEQ ID NO: 449216 - DNA, 25 bp, Homo sapien
gatgggaatgggactcacccgaacc

SEQ ID NO: 449217 - DNA, 25 bp, Homo sapien
ggactcacccgaaccagaggaattt

SEQ ID NO: 449218 - DNA, 25 bp, Homo sapien
tgcgctagtggccagatcccagaca

SEQ ID NO: 449219 - DNA, 25 bp, Homo sapien
ggaacaaggatgtgcacctcagaaa

SEQ ID NO: 449220 - DNA, 25 bp, Homo sapien
agagctcagtggaaaatcagtttgc

SEQ ID NO: 449221 - DNA, 25 bp, Homo sapien
atcagtttgcttctatttgtttaaa

SEQ ID NO: 449222 - DNA, 25 bp, Homo sapien
cagacatccgagtagatcccgtgaa

SEQ ID NO: 449223 - DNA, 25 bp, Homo sapien
gatcccgtgaaaagcttctacttgg

SEQ ID NO: 449224 - DNA, 25 bp, Homo sapien
ggtttcttcgtacattctggatcca

SEQ ID NO: 449225 - DNA, 25 bp, Homo sapien
gacccaagaggcagtgttgctgtct

SEQ ID NO: 449226 - DNA, 25 bp, Homo sapien
tgtccaccttggaatctggctgaac

SEQ ID NO: 449227 - DNA, 25 bp, Homo sapien
accttggaatctggctgaactggct

SEQ ID NO: 449228 - DNA, 25 bp, Homo sapien
ctgctgtgagggatcttggagcttc

SEQ ID NO: 449229 - DNA, 25 bp, Homo sapien
ttggagcttccctgtagcccacctt

SEQ ID NO: 449230 - DNA, 25 bp, Homo sapien
ttccccttgcttcatgtttgtagag

SEQ ID NO: 449231 - DNA, 25 bp, Homo sapien
ccttgcttcatgtttgtagaggaac

SEQ ID NO: 449232 - DNA, 25 bp, Homo sapien
ttgtagaggaaccttgtgccggcca

SEQ ID NO: 449233 - DNA, 25 bp, Homo sapien
agaggaaccttgtgccggccaggcc

SEQ ID NO: 449234 - DNA, 25 bp, Homo sapien
agtttccttgtgtgatacactaatg

SEQ ID NO: 449235 - DNA, 25 bp, Homo sapien
tgtgtgatacactaatgtatttgct

SEQ ID NO: 449236 - DNA, 25 bp, Homo sapien
tgtgtttatcaagaatgccagggcc

SEQ ID NO: 449237 - DNA, 25 bp, Homo sapien
gtgtttatcaagaatgccagggccg

SEQ ID NO: 449238 - DNA, 25 bp, Homo sapien
tgtttatcaagaatgccagggccgg

SEQ ID NO: 449239 - DNA, 25 bp, Homo sapien
gtttatcaagaatgccagggccggg

SEQ ID NO: 449240 - DNA, 25 bp, Homo sapien
tttatcaagaatgccagggccgggc

SEQ ID NO: 449241 - DNA, 25 bp, Homo sapien
ttatcaagaatgccagggccgggcg

SEQ ID NO: 449242 - DNA, 25 bp, Homo sapien
tatcaagaatgccagggccgggcgc

SEQ ID NO: 449243 - DNA, 25 bp, Homo sapien
atcaagaatgccagggccgggcgcg

SEQ ID NO: 449244 - DNA, 25 bp, Homo sapien
tcaagaatgccagggccgggcgcgg

SEQ ID NO: 449245 - DNA, 25 bp, Homo sapien
gagcctagatcgcacaaccgcactc

SEQ ID NO: 449246 - DNA, 25 bp, Homo sapien
agcctagatcgcacaaccgcactcc

SEQ ID NO: 449247 - DNA, 25 bp, Homo sapien
gcagacattacaataaccaatagct

SEQ ID NO: 449248 - DNA, 25 bp, Homo sapien
aaccaatagctgttgcagaccagga

SEQ ID NO: 449249 - DNA, 25 bp, Homo sapien
gctgttgcagaccaggagctcattt

SEQ ID NO: 449250 - DNA, 25 bp, Homo sapien
gttgcagaccaggagctcattttat

SEQ ID NO: 449251 - DNA, 25 bp, Homo sapien
gcagaccaggagctcattttatctc

SEQ ID NO: 449252 - DNA, 25 bp, Homo sapien
aggagctcattttatctccttcgca

SEQ ID NO: 449253 - DNA, 25 bp, Homo sapien
gctcattttatctccttcgcaggga

SEQ ID NO: 449254 - DNA, 25 bp, Homo sapien
attttatctccttcgcagggagctt

SEQ ID NO: 449255 - DNA, 25 bp, Homo sapien
ttatctccttcgcagggagcttagg

SEQ ID NO: 449256 - DNA, 25 bp, Homo sapien
ccttcgcagggagcttagggagcac

SEQ ID NO: 449257 - DNA, 25 bp, Homo sapien
gcacaggtcagagcggaagaggcca

SEQ ID NO: 449258 - DNA, 25 bp, Homo sapien
ttttactccattttctaattacatg

SEQ ID NO: 449259 - DNA, 25 bp, Homo sapien
ggactactccagaagggcttgctat

SEQ ID NO: 449260 - DNA, 25 bp, Homo sapien
gaagggcttgctattagccccatgt

SEQ ID NO: 449261 - DNA, 25 bp, Homo sapien
tgctattagccccatgtttcagatg

SEQ ID NO: 449262 - DNA, 25 bp, Homo sapien
attagccccatgtttcagatgagaa

SEQ ID NO: 449263 - DNA, 25 bp, Homo sapien
gtgtccagggacacaattgggactt

SEQ ID NO: 449264 - DNA, 25 bp, Homo sapien
cacaattgggacttgggacccagtc

SEQ ID NO: 449265 - DNA, 25 bp, Homo sapien
cttgccctgtcttagttgccctgag

SEQ ID NO: 449266 - DNA, 25 bp, Homo sapien
ttagttgccctgagctacggttctt

SEQ ID NO: 449267 - DNA, 25 bp, Homo sapien
ccctgagctacggttcttgtggagg

SEQ ID NO: 449268 - DNA, 25 bp, Homo sapien
cagagggagaactgagctcagccaa

SEQ ID NO: 449269 - DNA, 25 bp, Homo sapien
atttgccaactgatatttttcctgt

SEQ ID NO: 449270 - DNA, 25 bp, Homo sapien
gcaaggacctgcatatcaagctgtt

SEQ ID NO: 449271 - DNA, 25 bp, Homo sapien
atcaagctgttagacactgagttgt

SEQ ID NO: 449272 - DNA, 25 bp, Homo sapien
gaatcacactttcatgacacttcta

SEQ ID NO: 449273 - DNA, 25 bp, Homo sapien
taagagtggttgtattattcagtac

SEQ ID NO: 449274 - DNA, 25 bp, Homo sapien
tattcagtactagtcagtgcaaaac

SEQ ID NO: 449275 - DNA, 25 bp, Homo sapien
gacacttctaacatatcccatcaag

SEQ ID NO: 449276 - DNA, 25 bp, Homo sapien
aacatatcccatcaaggctgcttat

SEQ ID NO: 449277 - DNA, 25 bp, Homo sapien
aaggctgcttatagacacaacatca

SEQ ID NO: 449278 - DNA, 25 bp, Homo sapien
atcagaaagattttcattccagttc

SEQ ID NO: 449279 - DNA, 25 bp, Homo sapien
tccagttcacccacctttagcttaa

SEQ ID NO: 449280 - DNA, 25 bp, Homo sapien
agcagcacctcacagtcagtcagac

SEQ ID NO: 449281 - DNA, 25 bp, Homo sapien
acagtcagtcagacgctgcaggcac

SEQ ID NO: 449282 - DNA, 25 bp, Homo sapien
taaaccgagacaccagtaacagcag

SEQ ID NO: 449283 - DNA, 25 bp, Homo sapien
tgattcccagtgacagtgcagcaag

SEQ ID NO: 449284 - DNA, 25 bp, Homo sapien
gtgcagcaagactagtgggactcct

SEQ ID NO: 449285 - DNA, 25 bp, Homo sapien
agactagtgggactcctctttccca

SEQ ID NO: 449286 - DNA, 25 bp, Homo sapien
tgcaaaagtcagatgcttctatcca

SEQ ID NO: 449287 - DNA, 25 bp, Homo sapien
tgcttctatccattgctttctgtga

SEQ ID NO: 449288 - DNA, 25 bp, Homo sapien
attgctttctgtgattagggcggcc

SEQ ID NO: 449289 - DNA, 25 bp, Homo sapien
ggccctgcagcatatctcacagcag

SEQ ID NO: 449290 - DNA, 25 bp, Homo sapien
atctcacagcagacacagtgttcat

SEQ ID NO: 449291 - DNA, 25 bp, Homo sapien
ccgcgtcgacgctccggaactcggg

SEQ ID NO: 449292 - DNA, 25 bp, Homo sapien
tcgacgctccggaactcggggaaga

SEQ ID NO: 449293 - DNA, 25 bp, Homo sapien
gggagccgggtctgggttccgcact

SEQ ID NO: 449294 - DNA, 25 bp, Homo sapien
gccgggtctgggttccgcactccgt

SEQ ID NO: 449295 - DNA, 25 bp, Homo sapien
agagagtgagatacggacgccccgg

SEQ ID NO: 449296 - DNA, 25 bp, Homo sapien
gtgagatacggacgccccgggacga

SEQ ID NO: 449297 - DNA, 25 bp, Homo sapien
tcaggacccggctacggacacctgc

SEQ ID NO: 449298 - DNA, 25 bp, Homo sapien
ctccctccagataacacaagtgtga

SEQ ID NO: 449299 - DNA, 25 bp, Homo sapien
tccctccagataacacaagtgtgaa

SEQ ID NO: 449300 - DNA, 25 bp, Homo sapien
cctccagataacacaagtgtgaaga

SEQ ID NO: 449301 - DNA, 25 bp, Homo sapien
tatagggaaagctggacggcctgca

SEQ ID NO: 449302 - DNA, 25 bp, Homo sapien
gttagaatttcgtaggagctgggat

SEQ ID NO: 449303 - DNA, 25 bp, Homo sapien
ggagctgggatacctgaaatattga

SEQ ID NO: 449304 - DNA, 25 bp, Homo sapien
gctgggatacctgaaatattgattt

SEQ ID NO: 449305 - DNA, 25 bp, Homo sapien
gggatacctgaaatattgatttaca

SEQ ID NO: 449306 - DNA, 25 bp, Homo sapien
attgatttacatttccaagtacctg

SEQ ID NO: 449307 - DNA, 25 bp, Homo sapien
tgatttacatttccaagtacctgag

SEQ ID NO: 449308 - DNA, 25 bp, Homo sapien
taaaataacaactgcaacaaaactt

SEQ ID NO: 449309 - DNA, 25 bp, Homo sapien
gcaacaaaactttgatatctatatc

SEQ ID NO: 449310 - DNA, 25 bp, Homo sapien
ataacagctttatcgagaaatagaa

SEQ ID NO: 449311 - DNA, 25 bp, Homo sapien
cgcgtcgacctcaaggttgagtgga

SEQ ID NO: 449312 - DNA, 25 bp, Homo sapien
gtggaattaaattgcagggagagaa

SEQ ID NO: 449313 - DNA, 25 bp, Homo sapien
acatttcgcagagttatatctatag

SEQ ID NO: 449314 - DNA, 25 bp, Homo sapien
gtattctggataactgaaaacaact

SEQ ID NO: 449315 - DNA, 25 bp, Homo sapien
aataattgtgagcagtaagattact

SEQ ID NO: 449316 - DNA, 25 bp, Homo sapien
gtaatatgtatgttggactgaagta

SEQ ID NO: 449317 - DNA, 25 bp, Homo sapien
gttggactgaagtatttctttataa

SEQ ID NO: 449318 - DNA, 25 bp, Homo sapien
gtatgttaaagcatgtttttacatc

SEQ ID NO: 449319 - DNA, 25 bp, Homo sapien
tttacatcagtaaagtcatttgtcg

SEQ ID NO: 449320 - DNA, 25 bp, Homo sapien
aagtcatttgtcgaccttctggaaa

SEQ ID NO: 449321 - DNA, 25 bp, Homo sapien
gtcatttgtcgaccttctggaaatg

SEQ ID NO: 449322 - DNA, 25 bp, Homo sapien
tgaaaggtttttacctagatactgt

SEQ ID NO: 449323 - DNA, 25 bp, Homo sapien
tagatactgtaagttacacctcctt

SEQ ID NO: 449324 - DNA, 25 bp, Homo sapien
cacatgggaaggtcgttagctgcta

SEQ ID NO: 449325 - DNA, 25 bp, Homo sapien
gaaggtcgttagctgctagcaccgt

SEQ ID NO: 449326 - DNA, 25 bp, Homo sapien
tagctgctagcaccgtgttcatcag

SEQ ID NO: 449327 - DNA, 25 bp, Homo sapien
gttcatcaggaaaggtcttattcca

SEQ ID NO: 449328 - DNA, 25 bp, Homo sapien
agtggccgtgagagtgccatccgaa

SEQ ID NO: 449329 - DNA, 25 bp, Homo sapien
gtgccatccgaaagaagctaaacct

SEQ ID NO: 449330 - DNA, 25 bp, Homo sapien
accccagggagagttcccgtgtgtg

SEQ ID NO: 449331 - DNA, 25 bp, Homo sapien
cacattgcactctgacttgcctggg

SEQ ID NO: 449332 - DNA, 25 bp, Homo sapien
gggctgttggcagtgtcacatcact

SEQ ID NO: 449333 - DNA, 25 bp, Homo sapien
gtcacatcactgagtttatccaccg

SEQ ID NO: 449334 - DNA, 25 bp, Homo sapien
atcactgagtttatccaccgccatc

SEQ ID NO: 449335 - DNA, 25 bp, Homo sapien
ttctttccaacagtttcatgttcac

SEQ ID NO: 449336 - DNA, 25 bp, Homo sapien
gtttcatgttcactactggactctt

SEQ ID NO: 449337 - DNA, 25 bp, Homo sapien
atgttcactactggactcttacggg

SEQ ID NO: 449338 - DNA, 25 bp, Homo sapien
tactggactcttacgggctcagtat

SEQ ID NO: 449339 - DNA, 25 bp, Homo sapien
ttacgggctcagtatctctccctta

SEQ ID NO: 449340 - DNA, 25 bp, Homo sapien
tatctctcccttagccatgagctgg

SEQ ID NO: 449341 - DNA, 25 bp, Homo sapien
atttattgcatggttcctgggaaca

SEQ ID NO: 449342 - DNA, 25 bp, Homo sapien
gttcctgggaacatgtggcacaagt

SEQ ID NO: 449343 - DNA, 25 bp, Homo sapien
cttctacctaggactcttccctgga

SEQ ID NO: 449344 - DNA, 25 bp, Homo sapien
gggctgagaggtttctacactcgag

SEQ ID NO: 449345 - DNA, 25 bp, Homo sapien
agaggtttctacactcgaggagcag

SEQ ID NO: 449346 - DNA, 25 bp, Homo sapien
acaggcctgtgccacaatgcttgac

SEQ ID NO: 449347 - DNA, 25 bp, Homo sapien
aggcctgtgccacaatgcttgacca

SEQ ID NO: 449348 - DNA, 25 bp, Homo sapien
gcctgtgccacaatgcttgaccaat

SEQ ID NO: 449349 - DNA, 25 bp, Homo sapien
ctgtgccacaatgcttgaccaattt

SEQ ID NO: 449350 - DNA, 25 bp, Homo sapien
tgtggagatcgggtcttgccacatt

SEQ ID NO: 449351 - DNA, 25 bp, Homo sapien
aggcttaagccactacatccggaca

SEQ ID NO: 449352 - DNA, 25 bp, Homo sapien
gcttaagccactacatccggacagt

SEQ ID NO: 449353 - DNA, 25 bp, Homo sapien
ttaagccactacatccggacagtgc

SEQ ID NO: 449354 - DNA, 25 bp, Homo sapien
aagccactacatccggacagtgctc

SEQ ID NO: 449355 - DNA, 25 bp, Homo sapien
actacatccggacagtgctctttat

SEQ ID NO: 449356 - DNA, 25 bp, Homo sapien
ctacatccggacagtgctctttatt

SEQ ID NO: 449357 - DNA, 25 bp, Homo sapien
ttattttcctggtttcctcctgcaa

SEQ ID NO: 449358 - DNA, 25 bp, Homo sapien
tttcctcctgcaagatcatgtcatg

SEQ ID NO: 449359 - DNA, 25 bp, Homo sapien
agatcatgtcatgttggctctccca

SEQ ID NO: 449360 - DNA, 25 bp, Homo sapien
tcccagagggcatggctcatatcat

SEQ ID NO: 449361 - DNA, 25 bp, Homo sapien
gtctttccaagcctgtagatgatag

SEQ ID NO: 449362 - DNA, 25 bp, Homo sapien
cagcttcaggaggttgcactatctt

SEQ ID NO: 449363 - DNA, 25 bp, Homo sapien
ggaggttgcactatcttttgactgt

SEQ ID NO: 449364 - DNA, 25 bp, Homo sapien
cacccttcacaccttgtaaatagtc

SEQ ID NO: 449365 - DNA, 25 bp, Homo sapien
ctgggatcctgatggctgtgttgcc

SEQ ID NO: 449366 - DNA, 25 bp, Homo sapien
gtgttgcccaaacctaaatgtcagt

SEQ ID NO: 449367 - DNA, 25 bp, Homo sapien
atgtcagtcatgcttgcagttacag

SEQ ID NO: 449368 - DNA, 25 bp, Homo sapien
ggcacaaactgttcaagccttgatt

SEQ ID NO: 449369 - DNA, 25 bp, Homo sapien
tgattatcaatatgtgtgcactggg

SEQ ID NO: 449370 - DNA, 25 bp, Homo sapien
gactgggtgtatcagagccagatat

SEQ ID NO: 449371 - DNA, 25 bp, Homo sapien
actagtattgagagcagtatccgtg

SEQ ID NO: 449372 - DNA, 25 bp, Homo sapien
ttctgacctagaatgactttagctg

SEQ ID NO: 449373 - DNA, 25 bp, Homo sapien
ggtctcgatgattaatgtgctgtat

SEQ ID NO: 449374 - DNA, 25 bp, Homo sapien
aaatgcatttgtacatgttctgtac

SEQ ID NO: 449375 - DNA, 25 bp, Homo sapien
tacatgttctgtactccggactgaa

SEQ ID NO: 449376 - DNA, 25 bp, Homo sapien
tactccggactgaattactctgttg

SEQ ID NO: 449377 - DNA, 25 bp, Homo sapien
tactctgttgccagcaataagccag

SEQ ID NO: 449378 - DNA, 25 bp, Homo sapien
ataagccagggcacaaactgttcaa

SEQ ID NO: 449379 - DNA, 25 bp, Homo sapien
acttcgaaggcttaactctgaaaca

SEQ ID NO: 449380 - DNA, 25 bp, Homo sapien
cttcgaaggcttaactctgaaacat

SEQ ID NO: 449381 - DNA, 25 bp, Homo sapien
ttcgaaggcttaactctgaaacatc

SEQ ID NO: 449382 - DNA, 25 bp, Homo sapien
tcgaaggcttaactctgaaacatca

SEQ ID NO: 449383 - DNA, 25 bp, Homo sapien
cgaaggcttaactctgaaacatcac

SEQ ID NO: 449384 - DNA, 25 bp, Homo sapien
gaaggcttaactctgaaacatcaca

SEQ ID NO: 449385 - DNA, 25 bp, Homo sapien
ctacctcaggttgaaacttttggct

SEQ ID NO: 449386 - DNA, 25 bp, Homo sapien
tacctcaggttgaaacttttggctt

SEQ ID NO: 449387 - DNA, 25 bp, Homo sapien
ctcaggttgaaacttttggctttcg

SEQ ID NO: 449388 - DNA, 25 bp, Homo sapien
tcaggttgaaacttttggctttcgg

SEQ ID NO: 449389 - DNA, 25 bp, Homo sapien
tacctgccacgtatcggcgaaggtt

SEQ ID NO: 449390 - DNA, 25 bp, Homo sapien
catctgtcatgcagttactatgtaa

SEQ ID NO: 449391 - DNA, 25 bp, Homo sapien
agttactatgtaagggccagattct

SEQ ID NO: 449392 - DNA, 25 bp, Homo sapien
aagggccagattctgacctttctgt

SEQ ID NO: 449393 - DNA, 25 bp, Homo sapien
ctgttctttttatctgaaggaaatt

SEQ ID NO: 449394 - DNA, 25 bp, Homo sapien
gaaggaaatttgaacatgccacccc

SEQ ID NO: 449395 - DNA, 25 bp, Homo sapien
gccgatttggcatactgattatttc

SEQ ID NO: 449396 - DNA, 25 bp, Homo sapien
ggcatactgattatttcgagctaaa

SEQ ID NO: 449397 - DNA, 25 bp, Homo sapien
agctaaaggtgcttgactaacagta

SEQ ID NO: 449398 - DNA, 25 bp, Homo sapien
acatttagatgtttagtccaactga

SEQ ID NO: 449399 - DNA, 25 bp, Homo sapien
catatttatagctgttcctccaagt

SEQ ID NO: 449400 - DNA, 25 bp, Homo sapien
gttcctccaagtatcaatttttcaa

SEQ ID NO: 449401 - DNA, 25 bp, Homo sapien
gaaaccctccttcatcactgtgtgc

SEQ ID NO: 449402 - DNA, 25 bp, Homo sapien
aggtttgtgagcgtcatgccagtca

SEQ ID NO: 449403 - DNA, 25 bp, Homo sapien
cagtcatcttggcagctctggtgaa

SEQ ID NO: 449404 - DNA, 25 bp, Homo sapien
gaattcctacacttcagagtctcta

SEQ ID NO: 449405 - DNA, 25 bp, Homo sapien
cttcagagtctctaccctttgatgt

SEQ ID NO: 449406 - DNA, 25 bp, Homo sapien
ttgatgtagacagcgcatgtttcca

SEQ ID NO: 449407 - DNA, 25 bp, Homo sapien
ggagtgcagcccagaaccctaaaat

SEQ ID NO: 449408 - DNA, 25 bp, Homo sapien
agacacagatgatgtttctccaggt

SEQ ID NO: 449409 - DNA, 25 bp, Homo sapien
ttctccaggtggcacgttctaagca

SEQ ID NO: 449410 - DNA, 25 bp, Homo sapien
taagcatgccccacatcagttctga

SEQ ID NO: 449411 - DNA, 25 bp, Homo sapien
cataaatatcatctccctcttggct

SEQ ID NO: 449412 - DNA, 25 bp, Homo sapien
tccctgcttcccgaggttgtggtat

SEQ ID NO: 449413 - DNA, 25 bp, Homo sapien
tgcttcccgaggttgtggtattggt

SEQ ID NO: 449414 - DNA, 25 bp, Homo sapien
cttcccgaggttgtggtattggtag

SEQ ID NO: 449415 - DNA, 25 bp, Homo sapien
gtaacaggccaatcggtgtggcttc

SEQ ID NO: 449416 - DNA, 25 bp, Homo sapien
acaggccaatcggtgtggcttcagc

SEQ ID NO: 449417 - DNA, 25 bp, Homo sapien
caggccaatcggtgtggcttcagct

SEQ ID NO: 449418 - DNA, 25 bp, Homo sapien
gtgtggcttcagcttctgaggatct

SEQ ID NO: 449419 - DNA, 25 bp, Homo sapien
gtggcttcagcttctgaggatctgc

SEQ ID NO: 449420 - DNA, 25 bp, Homo sapien
ggcttcagcttctgaggatctgccg

SEQ ID NO: 449421 - DNA, 25 bp, Homo sapien
ttcagcttctgaggatctgccgggt

SEQ ID NO: 449422 - DNA, 25 bp, Homo sapien
agcttctgaggatctgccgggtgct

SEQ ID NO: 449423 - DNA, 25 bp, Homo sapien
aataactgtctgagctgggattcgt

SEQ ID NO: 449424 - DNA, 25 bp, Homo sapien
aactgtctgagctgggattcgtaac

SEQ ID NO: 449425 - DNA, 25 bp, Homo sapien
ctgagctgggattcgtaaccaggca

SEQ ID NO: 449426 - DNA, 25 bp, Homo sapien
ctctattgttatgatggagaaaggc

SEQ ID NO: 449427 - DNA, 25 bp, Homo sapien
attttagaaggacaaatggtcgcaa

SEQ ID NO: 449428 - DNA, 25 bp, Homo sapien
gatgatatctcatttgaaaactcgt

SEQ ID NO: 449429 - DNA, 25 bp, Homo sapien
tctcatttgaaaactcgtgtaacat

SEQ ID NO: 449430 - DNA, 25 bp, Homo sapien
gtgatttacccatgttagtctcata

SEQ ID NO: 449431 - DNA, 25 bp, Homo sapien
tacccatgttagtctcataacaact

SEQ ID NO: 449432 - DNA, 25 bp, Homo sapien
acaactctatgagatcagtaccgta

SEQ ID NO: 449433 - DNA, 25 bp, Homo sapien
atgagatcagtaccgtacacatggg

SEQ ID NO: 449434 - DNA, 25 bp, Homo sapien
ctgccaagtgctttgtgatactatg

SEQ ID NO: 449435 - DNA, 25 bp, Homo sapien
gctttgtgatactatgcatttgttc

SEQ ID NO: 449436 - DNA, 25 bp, Homo sapien
catttgttcaatgcagattgggaaa

SEQ ID NO: 449437 - DNA, 25 bp, Homo sapien
agagggtctgactcttgcctatgct

SEQ ID NO: 449438 - DNA, 25 bp, Homo sapien
gattatgttgatgggctttggcagt

SEQ ID NO: 449439 - DNA, 25 bp, Homo sapien
tgggctttggcagttcatttggata

SEQ ID NO: 449440 - DNA, 25 bp, Homo sapien
atgagaagctcttgggacttgtgac

SEQ ID NO: 449441 - DNA, 25 bp, Homo sapien
agctcttgggacttgtgactggaca

SEQ ID NO: 449442 - DNA, 25 bp, Homo sapien
gacttgtgactggacaaagcattcc

SEQ ID NO: 449443 - DNA, 25 bp, Homo sapien
gactcttgcctatgctggcttcaaa

SEQ ID NO: 449444 - DNA, 25 bp, Homo sapien
aattaagccatattactccactcat

SEQ ID NO: 449445 - DNA, 25 bp, Homo sapien
tttgtttttgagacttgagcatttc

SEQ ID NO: 449446 - DNA, 25 bp, Homo sapien
gagtccggaagaggcagatattttc

SEQ ID NO: 449447 - DNA, 25 bp, Homo sapien
ccaagtatttacatgagcaaccaca

SEQ ID NO: 449448 - DNA, 25 bp, Homo sapien
gagcaaccacaagagtactttaggt

SEQ ID NO: 449449 - DNA, 25 bp, Homo sapien
gagtactttaggttgctggatgcga

SEQ ID NO: 449450 - DNA, 25 bp, Homo sapien
aggttgctggatgcgatacagttgt

SEQ ID NO: 449451 - DNA, 25 bp, Homo sapien
gatacagttgtggtgtggtcacagc

SEQ ID NO: 449452 - DNA, 25 bp, Homo sapien
acagctggatgtacccagaggtgcg

SEQ ID NO: 449453 - DNA, 25 bp, Homo sapien
cccagaggtgcggtacagtacagag

SEQ ID NO: 449454 - DNA, 25 bp, Homo sapien
tacagtacagagtagcagaagttct

SEQ ID NO: 449455 - DNA, 25 bp, Homo sapien
gaagttctgccattagcattttgga

SEQ ID NO: 449456 - DNA, 25 bp, Homo sapien
gtctagttcagcttttatgttgatc

SEQ ID NO: 449457 - DNA, 25 bp, Homo sapien
ttatgttgatccatcctgacttatt

SEQ ID NO: 449458 - DNA, 25 bp, Homo sapien
gatccatcctgacttattttagaca

SEQ ID NO: 449459 - DNA, 25 bp, Homo sapien
catcctgacttattttagacattga

SEQ ID NO: 449460 - DNA, 25 bp, Homo sapien
gacattgaatttatctcaccacaag

SEQ ID NO: 449461 - DNA, 25 bp, Homo sapien
gaatttatctcaccacaagtaaaag

SEQ ID NO: 449462 - DNA, 25 bp, Homo sapien
ttgactgtctttgctaagtttccta

SEQ ID NO: 449463 - DNA, 25 bp, Homo sapien
ctgtctttgctaagtttcctaattt

SEQ ID NO: 449464 - DNA, 25 bp, Homo sapien
tcctaatttttcctaattatggcaa

SEQ ID NO: 449465 - DNA, 25 bp, Homo sapien
gaatactgatgctgtacaaatattt

SEQ ID NO: 449466 - DNA, 25 bp, Homo sapien
tggaaatgtaccttgttaatgtgac

SEQ ID NO: 449467 - DNA, 25 bp, Homo sapien
atagctaattgtgtccaagcaacca

SEQ ID NO: 449468 - DNA, 25 bp, Homo sapien
ttgtgtccaagcaaccaagggcctt

SEQ ID NO: 449469 - DNA, 25 bp, Homo sapien
aagggccttgagtctgcttggttct

SEQ ID NO: 449470 - DNA, 25 bp, Homo sapien
agtctgcttggttctgcttatggcc

SEQ ID NO: 449471 - DNA, 25 bp, Homo sapien
tctgcttatggcctcacatcaagaa

SEQ ID NO: 449472 - DNA, 25 bp, Homo sapien
ttatggcctcacatcaagaaatgga

SEQ ID NO: 449473 - DNA, 25 bp, Homo sapien
tggagctagtccatgtctgtagtcc

SEQ ID NO: 449474 - DNA, 25 bp, Homo sapien
ggtgaccagtgtagccaggactcca

SEQ ID NO: 449475 - DNA, 25 bp, Homo sapien
ccaggttttcctgactcagaagact

SEQ ID NO: 449476 - DNA, 25 bp, Homo sapien
gactcagaagactgagctttttcct

SEQ ID NO: 449477 - DNA, 25 bp, Homo sapien
tttcctggatgttattaatagctaa

SEQ ID NO: 449478 - DNA, 25 bp, Homo sapien
tggaaaatcgcttggttaaaacctg

SEQ ID NO: 449479 - DNA, 25 bp, Homo sapien
taaaacctgacacttttaacagtga

SEQ ID NO: 449480 - DNA, 25 bp, Homo sapien
taacagtgaacagcgttctgagtgt

SEQ ID NO: 449481 - DNA, 25 bp, Homo sapien
ttctgagtgtggacgagtagccagt

SEQ ID NO: 449482 - DNA, 25 bp, Homo sapien
gaatgtcgaatgtgactgactagca

SEQ ID NO: 449483 - DNA, 25 bp, Homo sapien
gtgactgactagcagcttcattttg

SEQ ID NO: 449484 - DNA, 25 bp, Homo sapien
tgcaacgatttctggctagtgccac

SEQ ID NO: 449485 - DNA, 25 bp, Homo sapien
ggctagtgccacgaggtttacttga

SEQ ID NO: 449486 - DNA, 25 bp, Homo sapien
acgaggtttacttgactgttgtgtg

SEQ ID NO: 449487 - DNA, 25 bp, Homo sapien
catccagaaaaaagctcttcgtttt

SEQ ID NO: 449488 - DNA, 25 bp, Homo sapien
aaagctcttcgttttacaaacatga

SEQ ID NO: 449489 - DNA, 25 bp, Homo sapien
gaaccctcagaagtggtgctgctta

SEQ ID NO: 449490 - DNA, 25 bp, Homo sapien
ggtgctgcttagagtgtgccaccac

SEQ ID NO: 449491 - DNA, 25 bp, Homo sapien
agtgtgccaccaccgagtccgtgtg

SEQ ID NO: 449492 - DNA, 25 bp, Homo sapien
tccgtgtgggcctgcctcaagtgct

SEQ ID NO: 449493 - DNA, 25 bp, Homo sapien
gctatattgaggaccacgccctgaa

SEQ ID NO: 449494 - DNA, 25 bp, Homo sapien
accacgccctgaaacactttgagga

SEQ ID NO: 449495 - DNA, 25 bp, Homo sapien
gggacacccgctagccatggaagtc

SEQ ID NO: 449496 - DNA, 25 bp, Homo sapien
atggaagtccgggatctctacgtgt

SEQ ID NO: 449497 - DNA, 25 bp, Homo sapien
tctacgtgttctgttacctgtgcaa

SEQ ID NO: 449498 - DNA, 25 bp, Homo sapien
ctgttacctgtgcaaggactacgtg

SEQ ID NO: 449499 - DNA, 25 bp, Homo sapien
gactacgtgctcaatgataacccag

SEQ ID NO: 449500 - DNA, 25 bp, Homo sapien
gaaagcgttgaacttgttccagcaa

SEQ ID NO: 449501 - DNA, 25 bp, Homo sapien
tgaacttgttccagcaacagtaaga

SEQ ID NO: 449502 - DNA, 25 bp, Homo sapien
gtggagcccattgaagacctatgca

SEQ ID NO: 449503 - DNA, 25 bp, Homo sapien
gaagacctatgcaccttgctaagga

SEQ ID NO: 449504 - DNA, 25 bp, Homo sapien
tatgcaccttgctaaggaggttaga

SEQ ID NO: 449505 - DNA, 25 bp, Homo sapien
ttcttatatggtgagaagcccagag

SEQ ID NO: 449506 - DNA, 25 bp, Homo sapien
agcccagagaggttccgaatctagg

SEQ ID NO: 449507 - DNA, 25 bp, Homo sapien
gaggttccgaatctaggatatgtaa

SEQ ID NO: 449508 - DNA, 25 bp, Homo sapien
ggatatatgtgctttaggatgacca

SEQ ID NO: 449509 - DNA, 25 bp, Homo sapien
ttaggatgaccattctgtcggctgt

SEQ ID NO: 449510 - DNA, 25 bp, Homo sapien
atgaccattctgtcggctgtttaaa

SEQ ID NO: 449511 - DNA, 25 bp, Homo sapien
tagaggaactgaggctccacccatt

SEQ ID NO: 449512 - DNA, 25 bp, Homo sapien
cacccattcattcagttgctctaag

SEQ ID NO: 449513 - DNA, 25 bp, Homo sapien
attcagttgctctaagcaccagagg

SEQ ID NO: 449514 - DNA, 25 bp, Homo sapien
gcaccagaggacttgtttcagaaaa

SEQ ID NO: 449515 - DNA, 25 bp, Homo sapien
agcatctctgggacgcagggagtct

SEQ ID NO: 449516 - DNA, 25 bp, Homo sapien
ggagtctggctagcgttaataggaa

SEQ ID NO: 449517 - DNA, 25 bp, Homo sapien
ttaataggaaaggttgctcggcaga

SEQ ID NO: 449518 - DNA, 25 bp, Homo sapien
ttgctcggcagagctgccctggagt

SEQ ID NO: 449519 - DNA, 25 bp, Homo sapien
tggagtactgacttgtctctccctc

SEQ ID NO: 449520 - DNA, 25 bp, Homo sapien
tttctggctcttcctgcacactcat

SEQ ID NO: 449521 - DNA, 25 bp, Homo sapien
ctgcacactcatccctagattatga

SEQ ID NO: 449522 - DNA, 25 bp, Homo sapien
tacaccaaagtgataggctccgagg

SEQ ID NO: 449523 - DNA, 25 bp, Homo sapien
accaaagtgataggctccgaggatt

SEQ ID NO: 449524 - DNA, 25 bp, Homo sapien
aagtgataggctccgaggatttcag

SEQ ID NO: 449525 - DNA, 25 bp, Homo sapien
agtggcttctcccagttgagtgcac

SEQ ID NO: 449526 - DNA, 25 bp, Homo sapien
tccatgatttccagctagtgccgca

SEQ ID NO: 449527 - DNA, 25 bp, Homo sapien
atgatttccagctagtgccgcacca

SEQ ID NO: 449528 - DNA, 25 bp, Homo sapien
tgatttccagctagtgccgcaccac

SEQ ID NO: 449529 - DNA, 25 bp, Homo sapien
tcccgccgagcagagacattgtatg

SEQ ID NO: 449530 - DNA, 25 bp, Homo sapien
agcagagacattgtatggactcctc

SEQ ID NO: 449531 - DNA, 25 bp, Homo sapien
agagacattgtatggactcctctca

SEQ ID NO: 449532 - DNA, 25 bp, Homo sapien
agagagcaaatagctctccagatgg

SEQ ID NO: 449533 - DNA, 25 bp, Homo sapien
gcagacattacaataaccaatagct

SEQ ID NO: 449534 - DNA, 25 bp, Homo sapien
aaccaatagctgttgcagaccagga

SEQ ID NO: 449535 - DNA, 25 bp, Homo sapien
gctgttgcagaccaggagctcattt

SEQ ID NO: 449536 - DNA, 25 bp, Homo sapien
tgcagaccaggagctcattttatct

SEQ ID NO: 449537 - DNA, 25 bp, Homo sapien
aggagctcattttatctccttcgca

SEQ ID NO: 449538 - DNA, 25 bp, Homo sapien
gctcattttatctccttcgcaggga

SEQ ID NO: 449539 - DNA, 25 bp, Homo sapien
ttatctccttcgcagggagcttagg

SEQ ID NO: 449540 - DNA, 25 bp, Homo sapien
ccttcgcagggagcttagggagcac

SEQ ID NO: 449541 - DNA, 25 bp, Homo sapien
gcacaggtcagagcggaagaggcca

SEQ ID NO: 449542 - DNA, 25 bp, Homo sapien
aagaggccagcctgcaaggtcagct

SEQ ID NO: 449543 - DNA, 25 bp, Homo sapien
gcctgcaaggtcagctggagctgca

SEQ ID NO: 449544 - DNA, 25 bp, Homo sapien
caggctgaaatggtcccaagttctt

SEQ ID NO: 449545 - DNA, 25 bp, Homo sapien
ccacatccagaagaataaggttatg

SEQ ID NO: 449546 - DNA, 25 bp, Homo sapien
aaaaacttctattgcatgatggaac

SEQ ID NO: 449547 - DNA, 25 bp, Homo sapien
tgcatgatggaacagctcccagcgt

SEQ ID NO: 449548 - DNA, 25 bp, Homo sapien
tgatggaacagctcccagcgttgag

SEQ ID NO: 449549 - DNA, 25 bp, Homo sapien
aagcatcattataaactgctgatct

SEQ ID NO: 449550 - DNA, 25 bp, Homo sapien
actgctgatctactgtttctttgtc

SEQ ID NO: 449551 - DNA, 25 bp, Homo sapien
gctgatctactgtttctttgtcaaa

SEQ ID NO: 449552 - DNA, 25 bp, Homo sapien
gatctactgtttctttgtcaaacgg

SEQ ID NO: 449553 - DNA, 25 bp, Homo sapien
tactgtttctttgtcaaacgggagg

SEQ ID NO: 449554 - DNA, 25 bp, Homo sapien
tgtttctttgtcaaacgggaggaga

SEQ ID NO: 449555 - DNA, 25 bp, Homo sapien
aatttggaccaaaagtgagtttatg

SEQ ID NO: 449556 - DNA, 25 bp, Homo sapien
ttgtcctgcagccagtgtctgatgt

SEQ ID NO: 449557 - DNA, 25 bp, Homo sapien
agccagtgtctgatgtgccccagct

SEQ ID NO: 449558 - DNA, 25 bp, Homo sapien
tgcacagggattccgtaactacttt

SEQ ID NO: 449559 - DNA, 25 bp, Homo sapien
ttttctccttttagagaagtgcctt

SEQ ID NO: 449560 - DNA, 25 bp, Homo sapien
agtgccttggctctcttaccaaaag

SEQ ID NO: 449561 - DNA, 25 bp, Homo sapien
ggctctcttaccaaaagcactgcga

SEQ ID NO: 449562 - DNA, 25 bp, Homo sapien
cttgccttttgtgttgttcagtcat

SEQ ID NO: 449563 - DNA, 25 bp, Homo sapien
tgtgttgttcagtcatccaggtgcc

SEQ ID NO: 449564 - DNA, 25 bp, Homo sapien
ctttgccctctgtaagccattaaac

SEQ ID NO: 449565 - DNA, 25 bp, Homo sapien
ctctgtaagccattaaaccttttga

SEQ ID NO: 449566 - DNA, 25 bp, Homo sapien
aaactcatcgtcgtgaccttcaaaa

SEQ ID NO: 449567 - DNA, 25 bp, Homo sapien
ggactccagtatcacagtctgtctc

SEQ ID NO: 449568 - DNA, 25 bp, Homo sapien
agtctgtctctcagccacaatttat

SEQ ID NO: 449569 - DNA, 25 bp, Homo sapien
ttattttgcccctagagtttgctgt

SEQ ID NO: 449570 - DNA, 25 bp, Homo sapien
gagtttgctgtgcttataacacttc

SEQ ID NO: 449571 - DNA, 25 bp, Homo sapien
ataacacttctttttcccatatgtc

SEQ ID NO: 449572 - DNA, 25 bp, Homo sapien
atgtcattcatttctcaagtctaag

SEQ ID NO: 449573 - DNA, 25 bp, Homo sapien
gcagttaccatcttagacgaccgtt

SEQ ID NO: 449574 - DNA, 25 bp, Homo sapien
gggttaagtcccagaatccttgaat

SEQ ID NO: 449575 - DNA, 25 bp, Homo sapien
gaatccttgaatttgccgttcctga

SEQ ID NO: 449576 - DNA, 25 bp, Homo sapien
tgaatttgccgttcctgatacataa

SEQ ID NO: 449577 - DNA, 25 bp, Homo sapien
tcatatccaaccctcattcagtatt

SEQ ID NO: 449578 - DNA, 25 bp, Homo sapien
tccaaccctcattcagtatttctat

SEQ ID NO: 449579 - DNA, 25 bp, Homo sapien
accctcattcagtatttctatcaag

SEQ ID NO: 449580 - DNA, 25 bp, Homo sapien
ttatgtatacagacgtaaacctcag

SEQ ID NO: 449581 - DNA, 25 bp, Homo sapien
cagacgtaaacctcagaatgtatgt

SEQ ID NO: 449582 - DNA, 25 bp, Homo sapien
agaatgtatgttgagtccccactgt

SEQ ID NO: 449583 - DNA, 25 bp, Homo sapien
cacgggccctcagcactttgtgttt

SEQ ID NO: 449584 - DNA, 25 bp, Homo sapien
agcaccgtgtcttgtgaactcccat

SEQ ID NO: 449585 - DNA, 25 bp, Homo sapien
tgtgaactcccatcaccttcaagaa

SEQ ID NO: 449586 - DNA, 25 bp, Homo sapien
aagcttccgaggtaagaattttatg

SEQ ID NO: 449587 - DNA, 25 bp, Homo sapien
ctgggacaacttaaatctcccttct

SEQ ID NO: 449588 - DNA, 25 bp, Homo sapien
atacaataccacgtttttctgttgc

SEQ ID NO: 449589 - DNA, 25 bp, Homo sapien
ataccacgtttttctgttgctttgt

SEQ ID NO: 449590 - DNA, 25 bp, Homo sapien
acgtttttctgttgctttgttctag

SEQ ID NO: 449591 - DNA, 25 bp, Homo sapien
ctgttgctttgttctagcttcagct

SEQ ID NO: 449592 - DNA, 25 bp, Homo sapien
agcttcagcttttgagggctatcta

SEQ ID NO: 449593 - DNA, 25 bp, Homo sapien
gcttttgagggctatctacttgatt

SEQ ID NO: 449594 - DNA, 25 bp, Homo sapien
gggagatttatctcttctctctcat

SEQ ID NO: 449595 - DNA, 25 bp, Homo sapien
attttccggcactataatatattct

SEQ ID NO: 449596 - DNA, 25 bp, Homo sapien
cttatcttgtgtattttctgcccca

SEQ ID NO: 449597 - DNA, 25 bp, Homo sapien
ttattcaaccatttatttctatcaa

SEQ ID NO: 449598 - DNA, 25 bp, Homo sapien
tttctatcaatatggactcgtgggc

SEQ ID NO: 449599 - DNA, 25 bp, Homo sapien
gctattgggcagcaactcatgagaa

SEQ ID NO: 449600 - DNA, 25 bp, Homo sapien
gcaactcatgagaactggccaataa

SEQ ID NO: 449601 - DNA, 25 bp, Homo sapien
actggccaataagactctacggtta

SEQ ID NO: 449602 - DNA, 25 bp, Homo sapien
tcaatcccattaactgcctccaaaa

SEQ ID NO: 449603 - DNA, 25 bp, Homo sapien
gtggctctggagaccttaaagttat

SEQ ID NO: 449604 - DNA, 25 bp, Homo sapien
ggactcaaacaatctgacatcagtg

SEQ ID NO: 449605 - DNA, 25 bp, Homo sapien
gacatcagtgggaagagcgtataca

SEQ ID NO: 449606 - DNA, 25 bp, Homo sapien
tgtctttggacactctctgtactca

SEQ ID NO: 449607 - DNA, 25 bp, Homo sapien
cactctctgtactcaggtcttttga

SEQ ID NO: 449608 - DNA, 25 bp, Homo sapien
gaaactggccaagagaccctttggt

SEQ ID NO: 449609 - DNA, 25 bp, Homo sapien
gagaccctttggtattttgtttgct

SEQ ID NO: 449610 - DNA, 25 bp, Homo sapien
aatggttgtgatggaacatgccaca

SEQ ID NO: 449611 - DNA, 25 bp, Homo sapien
catgccacaaagaatgggtctggtt

SEQ ID NO: 449612 - DNA, 25 bp, Homo sapien
gaaatttgtccagggatttcccagt

SEQ ID NO: 449613 - DNA, 25 bp, Homo sapien
tttcccagtataaatcagatgcttt

SEQ ID NO: 449614 - DNA, 25 bp, Homo sapien
agatgctttctcaatctcatgtttt

SEQ ID NO: 449615 - DNA, 25 bp, Homo sapien
ctcatgtttttccttgtaagattca

SEQ ID NO: 449616 - DNA, 25 bp, Homo sapien
tacccagaggaataacagatgcagt

SEQ ID NO: 449617 - DNA, 25 bp, Homo sapien
aacagatgcagtgcttgaacagttt

SEQ ID NO: 449618 - DNA, 25 bp, Homo sapien
tcatctgaagagtttgttagtttta

SEQ ID NO: 449619 - DNA, 25 bp, Homo sapien
tagttttagtactgatatccgggaa

SEQ ID NO: 449620 - DNA, 25 bp, Homo sapien
gatatccgggaaaacactatagaac

SEQ ID NO: 449621 - DNA, 25 bp, Homo sapien
ggatagtgttaggaaatcatatttt

SEQ ID NO: 449622 - DNA, 25 bp, Homo sapien
cccaggttctcagcaatacttgctt

SEQ ID NO: 449623 - DNA, 25 bp, Homo sapien
tcagcaatacttgcttattcacttt

SEQ ID NO: 449624 - DNA, 25 bp, Homo sapien
attcactttatccaacaatacgtac

SEQ ID NO: 449625 - DNA, 25 bp, Homo sapien
atacgtacaaaatagtttcagcata

SEQ ID NO: 449626 - DNA, 25 bp, Homo sapien
aacaatactaatactgctaccaaca

SEQ ID NO: 449627 - DNA, 25 bp, Homo sapien
gctaccaacagcaaactacttagta

SEQ ID NO: 449628 - DNA, 25 bp, Homo sapien
gcaaactacttagtacaactgtttt

SEQ ID NO: 449629 - DNA, 25 bp, Homo sapien
acggagcatcgttatttttaggact

SEQ ID NO: 449630 - DNA, 25 bp, Homo sapien
ggagcatcgttatttttaggacttt

SEQ ID NO: 449631 - DNA, 25 bp, Homo sapien
taggacttttctaaggatagtgtta

SEQ ID NO: 449632 - DNA, 25 bp, Homo sapien
gccgcgtcgacgtaagcacttctca

SEQ ID NO: 449633 - DNA, 25 bp, Homo sapien
gcgtcgacgtaagcacttctcagag

SEQ ID NO: 449634 - DNA, 25 bp, Homo sapien
gtcgacgtaagcacttctcagagaa

SEQ ID NO: 449635 - DNA, 25 bp, Homo sapien
cgacgtaagcacttctcagagaatg

SEQ ID NO: 449636 - DNA, 25 bp, Homo sapien
gtaagcacttctcagagaatgctat

SEQ ID NO: 449637 - DNA, 25 bp, Homo sapien
taacgcccagggaacaatgaagagg

SEQ ID NO: 449638 - DNA, 25 bp, Homo sapien
gaagaagctgcaattctgcctgggt

SEQ ID NO: 449639 - DNA, 25 bp, Homo sapien
ctgcaattctgcctgggtgccttgg

SEQ ID NO: 449640 - DNA, 25 bp, Homo sapien
tgccttggggtgtattttacttata

SEQ ID NO: 449641 - DNA, 25 bp, Homo sapien
gtattttacttataacctgtgtgtt

SEQ ID NO: 449642 - DNA, 25 bp, Homo sapien
tgtgtgttttccacagtccctgctt

SEQ ID NO: 449643 - DNA, 25 bp, Homo sapien
ctctctgcaggagtgctaatcactg

SEQ ID NO: 449644 - DNA, 25 bp, Homo sapien
gtgctaatcactgtggcttctgtta

SEQ ID NO: 449645 - DNA, 25 bp, Homo sapien
ctgtggcttctgttaagaattccca

SEQ ID NO: 449646 - DNA, 25 bp, Homo sapien
gctggaaggatggaaccgtcatctc

SEQ ID NO: 449647 - DNA, 25 bp, Homo sapien
tcactgacaggcattcttagatttt

SEQ ID NO: 449648 - DNA, 25 bp, Homo sapien
tttccactttctttaactgattcct

SEQ ID NO: 449649 - DNA, 25 bp, Homo sapien
gctgaaaactatctttgtcccttac

SEQ ID NO: 449650 - DNA, 25 bp, Homo sapien
ttctttttgtacctcccagacccag

SEQ ID NO: 449651 - DNA, 25 bp, Homo sapien
ttaactgattcctcatcctcatgct

SEQ ID NO: 449652 - DNA, 25 bp, Homo sapien
atgctgctcctgagttctgtcttcc

SEQ ID NO: 449653 - DNA, 25 bp, Homo sapien
ctgtcttccgacttcttttcttgaa

SEQ ID NO: 449654 - DNA, 25 bp, Homo sapien
gtgtctgggcgctagggatgatctt

SEQ ID NO: 449655 - DNA, 25 bp, Homo sapien
ctgaatgtggtgagcccggtgtcca

SEQ ID NO: 449656 - DNA, 25 bp, Homo sapien
gtaatcataactcgcacatcaacct

SEQ ID NO: 449657 - DNA, 25 bp, Homo sapien
tggtgagcccggtgtccacaggact

SEQ ID NO: 449658 - DNA, 25 bp, Homo sapien
ataactcgcacatcaacctcaaatt

SEQ ID NO: 449659 - DNA, 25 bp, Homo sapien
aactcgcacatcaacctcaaattac

SEQ ID NO: 449660 - DNA, 25 bp, Homo sapien
tcaaattaccctctatcaatcactc

SEQ ID NO: 449661 - DNA, 25 bp, Homo sapien
actctcttgcctagaaacttgctgg

SEQ ID NO: 449662 - DNA, 25 bp, Homo sapien
ttgcctagaaacttgctgggctcct

SEQ ID NO: 449663 - DNA, 25 bp, Homo sapien
tgcctagaaacttgctgggctcctc

SEQ ID NO: 449664 - DNA, 25 bp, Homo sapien
ctgccctgggtgtgtcatgcagagt

SEQ ID NO: 449665 - DNA, 25 bp, Homo sapien
ggatcatacagcagatgtccagtta

SEQ ID NO: 449666 - DNA, 25 bp, Homo sapien
gcagatgtccagttacacgcatggg

SEQ ID NO: 449667 - DNA, 25 bp, Homo sapien
actctggaggaagcatttgagcaat

SEQ ID NO: 449668 - DNA, 25 bp, Homo sapien
gtgcaatggccatgtttggttacat

SEQ ID NO: 449669 - DNA, 25 bp, Homo sapien
tttggttacatgacagatactggga

SEQ ID NO: 449670 - DNA, 25 bp, Homo sapien
agatactgggacagtggagcccctc

SEQ ID NO: 449671 - DNA, 25 bp, Homo sapien
ggagcccctccaaacagtagaagta

SEQ ID NO: 449672 - DNA, 25 bp, Homo sapien
gatgacttacagtctcttctgtttc

SEQ ID NO: 449673 - DNA, 25 bp, Homo sapien
cactttttggatgaatggctttata

SEQ ID NO: 449674 - DNA, 25 bp, Homo sapien
aaggccaagtatccgccagtcaata

SEQ ID NO: 449675 - DNA, 25 bp, Homo sapien
ccgccagtcaataggaagtacgagt

SEQ ID NO: 449676 - DNA, 25 bp, Homo sapien
ggattcttttaccatccacacgaac

SEQ ID NO: 449677 - DNA, 25 bp, Homo sapien
catccacacgaacagcagcctaagg

SEQ ID NO: 449678 - DNA, 25 bp, Homo sapien
gcagcctaaggaactactttgtgaa

SEQ ID NO: 449679 - DNA, 25 bp, Homo sapien
gcaagagtttggttatctgggacaa

SEQ ID NO: 449680 - DNA, 25 bp, Homo sapien
tctgggacaatgacaggctcacctg

SEQ ID NO: 449681 - DNA, 25 bp, Homo sapien
caggctcacctgtatccagaaggga

SEQ ID NO: 449682 - DNA, 25 bp, Homo sapien
gaacagaggctggacccattggatc

SEQ ID NO: 449683 - DNA, 25 bp, Homo sapien
tggacccattggatcgaaggagaca

SEQ ID NO: 449684 - DNA, 25 bp, Homo sapien
aaactccacctggaaatgttctgtg

SEQ ID NO: 449685 - DNA, 25 bp, Homo sapien
gtcaagtgtgcaaacagacattcca

SEQ ID NO: 449686 - DNA, 25 bp, Homo sapien
agacattccagagagcctgatccac

SEQ ID NO: 449687 - DNA, 25 bp, Homo sapien
tgggcatcagattctctctgagaaa

SEQ ID NO: 449688 - DNA, 25 bp, Homo sapien
attctctctgagaaatcttggttct

SEQ ID NO: 449689 - DNA, 25 bp, Homo sapien
ctctctgagaaatcttggttcttga

SEQ ID NO: 449690 - DNA, 25 bp, Homo sapien
gaaatcttggttcttgatatgtgtg

SEQ ID NO: 449691 - DNA, 25 bp, Homo sapien
tcttggttcttgatatgtgtgttat

SEQ ID NO: 449692 - DNA, 25 bp, Homo sapien
ggttcttgatatgtgtgttatgtca

SEQ ID NO: 449693 - DNA, 25 bp, Homo sapien
atatgtgtgttatgtcaggaaggac

SEQ ID NO: 449694 - DNA, 25 bp, Homo sapien
gttatgtcaggaaggacttttacat

SEQ ID NO: 449695 - DNA, 25 bp, Homo sapien
gggttattgagcttaacttgaaatt

SEQ ID NO: 449696 - DNA, 25 bp, Homo sapien
ctcagattttgtttaagtttcctat

SEQ ID NO: 449697 - DNA, 25 bp, Homo sapien
gaaaggagccttagggcagaaccaa

SEQ ID NO: 449698 - DNA, 25 bp, Homo sapien
cactatttcgtagaagagaacactt

SEQ ID NO: 449699 - DNA, 25 bp, Homo sapien
gaaattactcagattggacctttaa

SEQ ID NO: 449700 - DNA, 25 bp, Homo sapien
ggacctttaaataaggctgactcca

SEQ ID NO: 449701 - DNA, 25 bp, Homo sapien
taaggctgactccaaagaccatatt

SEQ ID NO: 449702 - DNA, 25 bp, Homo sapien
gaccatattctttctacaacaccac

SEQ ID NO: 449703 - DNA, 25 bp, Homo sapien
ttctacaacaccacaatatgctctc

SEQ ID NO: 449704 - DNA, 25 bp, Homo sapien
accacaatatgctctcttgctatct

SEQ ID NO: 449705 - DNA, 25 bp, Homo sapien
cttgctatcttgagaggctctacca

SEQ ID NO: 449706 - DNA, 25 bp, Homo sapien
tgagaggctctaccaatttaaatag

SEQ ID NO: 449707 - DNA, 25 bp, Homo sapien
agcattaatggcattcatggttcat

SEQ ID NO: 449708 - DNA, 25 bp, Homo sapien
ggcattcatggttcattgtttttta

SEQ ID NO: 449709 - DNA, 25 bp, Homo sapien
cttccttgccgctctgtagtttcca

SEQ ID NO: 449710 - DNA, 25 bp, Homo sapien
aatttgcttgccataactccatttg

SEQ ID NO: 449711 - DNA, 25 bp, Homo sapien
gcttgccataactccatttgagggt

SEQ ID NO: 449712 - DNA, 25 bp, Homo sapien
ctccatttgagggtgactgcgattt

SEQ ID NO: 449713 - DNA, 25 bp, Homo sapien
ggtgactgcgattttgttagcataa

SEQ ID NO: 449714 - DNA, 25 bp, Homo sapien
gattgaagctaatctcctaaagagt

SEQ ID NO: 449715 - DNA, 25 bp, Homo sapien
gtagagtaacataaagccaccaatt

SEQ ID NO: 449716 - DNA, 25 bp, Homo sapien
aagccaccaattgtagaactgatgt

SEQ ID NO: 449717 - DNA, 25 bp, Homo sapien
tgtgaattgtactgagggttggcat

SEQ ID NO: 449718 - DNA, 25 bp, Homo sapien
gagggttggcatgaatgcttttctt

SEQ ID NO: 449719 - DNA, 25 bp, Homo sapien
gaatgcttttctttttcacgtgtaa

SEQ ID NO: 449720 - DNA, 25 bp, Homo sapien
gcccggccctggcattcttgataaa

SEQ ID NO: 449721 - DNA, 25 bp, Homo sapien
ttttttttttgctctctctgtcacc

SEQ ID NO: 449722 - DNA, 25 bp, Homo sapien
tttttttttgctctctctgtcaccc

SEQ ID NO: 449723 - DNA, 25 bp, Homo sapien
gctggagtgcggttgtgcgatctag

SEQ ID NO: 449724 - DNA, 25 bp, Homo sapien
ctggagtgcggttgtgcgatctagg

SEQ ID NO: 449725 - DNA, 25 bp, Homo sapien
tggagtgcggttgtgcgatctaggc

SEQ ID NO: 449726 - DNA, 25 bp, Homo sapien
ggagtgcggttgtgcgatctaggct

SEQ ID NO: 449727 - DNA, 25 bp, Homo sapien
gagtgcggttgtgcgatctaggctc

SEQ ID NO: 449728 - DNA, 25 bp, Homo sapien
gtgcggttgtgcgatctaggctcac

SEQ ID NO: 449729 - DNA, 25 bp, Homo sapien
tgcggttgtgcgatctaggctcact

SEQ ID NO: 449730 - DNA, 25 bp, Homo sapien
gcggttgtgcgatctaggctcactg

SEQ ID NO: 449731 - DNA, 25 bp, Homo sapien
gacgacattgcctgtatgatcgggt

SEQ ID NO: 449732 - DNA, 25 bp, Homo sapien
gacattgcctgtatgatcgggtacc

SEQ ID NO: 449733 - DNA, 25 bp, Homo sapien
cattgcctgtatgatcgggtaccga

SEQ ID NO: 449734 - DNA, 25 bp, Homo sapien
attgcctgtatgatcgggtaccgac

SEQ ID NO: 449735 - DNA, 25 bp, Homo sapien
ttgcctgtatgatcgggtaccgacc

SEQ ID NO: 449736 - DNA, 25 bp, Homo sapien
tgtatgatcgggtaccgaccttgcc

SEQ ID NO: 449737 - DNA, 25 bp, Homo sapien
gtatgatcgggtaccgaccttgccc

SEQ ID NO: 449738 - DNA, 25 bp, Homo sapien
gaccttgcccctggatgaaatggtg

SEQ ID NO: 449739 - DNA, 25 bp, Homo sapien
ccttgcccctggatgaaatggtgct

SEQ ID NO: 449740 - DNA, 25 bp, Homo sapien
atcttcatcttcaacgttgtgtact

SEQ ID NO: 449741 - DNA, 25 bp, Homo sapien
cttcatcttcaacgttgtgtactac

SEQ ID NO: 449742 - DNA, 25 bp, Homo sapien
ttcttaatattctttcactgttaat

SEQ ID NO: 449743 - DNA, 25 bp, Homo sapien
actctcagttgttatagatgaaaca

SEQ ID NO: 449744 - DNA, 25 bp, Homo sapien
gttgttatagatgaaacagccagca

SEQ ID NO: 449745 - DNA, 25 bp, Homo sapien
gaaacagccagcaaaaactcaccct

SEQ ID NO: 449746 - DNA, 25 bp, Homo sapien
agcaaaaactcaccctacttcactt

SEQ ID NO: 449747 - DNA, 25 bp, Homo sapien
gcggaatcaacaacaatgtaaactg

SEQ ID NO: 449748 - DNA, 25 bp, Homo sapien
agccaccgtgactgacctattatct

SEQ ID NO: 449749 - DNA, 25 bp, Homo sapien
ccaccgtgactgacctattatctga

SEQ ID NO: 449750 - DNA, 25 bp, Homo sapien
gacctattatctgattttagccaac

SEQ ID NO: 449751 - DNA, 25 bp, Homo sapien
tattatctgattttagccaacaatg

SEQ ID NO: 449752 - DNA, 25 bp, Homo sapien
tctgattttagccaacaatgttgtt

SEQ ID NO: 449753 - DNA, 25 bp, Homo sapien
gaaaaagacttacagtccccttcat

SEQ ID NO: 449754 - DNA, 25 bp, Homo sapien
tctaaaactatgtggttgaacccca

SEQ ID NO: 449755 - DNA, 25 bp, Homo sapien
tatgtggttgaaccccaacacaggg

SEQ ID NO: 449756 - DNA, 25 bp, Homo sapien
ccagaacacactgtctagtagaatt

SEQ ID NO: 449757 - DNA, 25 bp, Homo sapien
ctgtctagtagaattgtgggtattt

SEQ ID NO: 449758 - DNA, 25 bp, Homo sapien
cttttgaatcgaacacagttgtgca

SEQ ID NO: 449759 - DNA, 25 bp, Homo sapien
attccccattgagtatttctatcaa

SEQ ID NO: 449760 - DNA, 25 bp, Homo sapien
tccctgtgtattcagacacagacct

SEQ ID NO: 449761 - DNA, 25 bp, Homo sapien
acagacctcagagcgtatgttgagt

SEQ ID NO: 449762 - DNA, 25 bp, Homo sapien
atgttgagtccccattgtcatagaa

SEQ ID NO: 449763 - DNA, 25 bp, Homo sapien
gagtccccattgtcatagaaaaaga

SEQ ID NO: 449764 - DNA, 25 bp, Homo sapien
ttactgtccatcagaagcttgttaa

SEQ ID NO: 449765 - DNA, 25 bp, Homo sapien
actgtccatcagaagcttgttaaaa

SEQ ID NO: 449766 - DNA, 25 bp, Homo sapien
gtccatcagaagcttgttaaaaaat

SEQ ID NO: 449767 - DNA, 25 bp, Homo sapien
aaaatattcttgagcaccaccccca

SEQ ID NO: 449768 - DNA, 25 bp, Homo sapien
ataaactgggcagatagtaaagcat

SEQ ID NO: 449769 - DNA, 25 bp, Homo sapien
tagtaaagcattgcccacagaggtt

SEQ ID NO: 449770 - DNA, 25 bp, Homo sapien
aaagcattgcccacagaggttgaaa

SEQ ID NO: 449771 - DNA, 25 bp, Homo sapien
gcattgcccacagaggttgaaagag

SEQ ID NO: 449772 - DNA, 25 bp, Homo sapien
gagactttcagattcatcgagtcta

SEQ ID NO: 449773 - DNA, 25 bp, Homo sapien
tcagattcatcgagtctaatctcat

SEQ ID NO: 449774 - DNA, 25 bp, Homo sapien
caaaatccccaccaagtgggtctct

SEQ ID NO: 449775 - DNA, 25 bp, Homo sapien
gaattatacttcaatgtttatctta

SEQ ID NO: 449776 - DNA, 25 bp, Homo sapien
cttcaatgtttatcttatactttct

SEQ ID NO: 449777 - DNA, 25 bp, Homo sapien
tctgtttttctcagcgaactgtatg

SEQ ID NO: 449778 - DNA, 25 bp, Homo sapien
ttttctcagcgaactgtatgagata

SEQ ID NO: 449779 - DNA, 25 bp, Homo sapien
gtatgagatacagatccactgatct

SEQ ID NO: 449780 - DNA, 25 bp, Homo sapien
gatccactgatctttttctagatag

SEQ ID NO: 449781 - DNA, 25 bp, Homo sapien
gatctttttctagatagctctccag

SEQ ID NO: 449782 - DNA, 25 bp, Homo sapien
ctttttctagatagctctccagttg

SEQ ID NO: 449783 - DNA, 25 bp, Homo sapien
tttctagatagctctccagttgtcc

SEQ ID NO: 449784 - DNA, 25 bp, Homo sapien
tctagatagctctccagttgtccca

SEQ ID NO: 449785 - DNA, 25 bp, Homo sapien
ttttaagtctatttgtaactcactg

SEQ ID NO: 449786 - DNA, 25 bp, Homo sapien
taaatgacaagaccgggatgccaac

SEQ ID NO: 449787 - DNA, 25 bp, Homo sapien
gtttggttgcagaacccatgcactg

SEQ ID NO: 449788 - DNA, 25 bp, Homo sapien
catgcactgacagctgtactgtagt

SEQ ID NO: 449789 - DNA, 25 bp, Homo sapien
ctgtactgtagtgctgactgctaaa

SEQ ID NO: 449790 - DNA, 25 bp, Homo sapien
tagtgctgactgctaaagttcccca

SEQ ID NO: 449791 - DNA, 25 bp, Homo sapien
cagcacacacctttattgttagtct

SEQ ID NO: 449792 - DNA, 25 bp, Homo sapien
ttattgttagtcttccttttcatgg

SEQ ID NO: 449793 - DNA, 25 bp, Homo sapien
acccctacgaggtcgacactcttat

SEQ ID NO: 449794 - DNA, 25 bp, Homo sapien
gacatgtcctcaatatccatttact

SEQ ID NO: 449795 - DNA, 25 bp, Homo sapien
actaaattgattggctctgtaacag

SEQ ID NO: 449796 - DNA, 25 bp, Homo sapien
cactcttatctccattttcttacaa

SEQ ID NO: 449797 - DNA, 25 bp, Homo sapien
gccgcgtcgacgtaagcacttctca

SEQ ID NO: 449798 - DNA, 25 bp, Homo sapien
ccgcgtcgacgtaagcacttctcag

SEQ ID NO: 449799 - DNA, 25 bp, Homo sapien
cgcgtcgacgtaagcacttctcaga

SEQ ID NO: 449800 - DNA, 25 bp, Homo sapien
gcgtcgacgtaagcacttctcagag

SEQ ID NO: 449801 - DNA, 25 bp, Homo sapien
cgtcgacgtaagcacttctcagaga

SEQ ID NO: 449802 - DNA, 25 bp, Homo sapien
gtcgacgtaagcacttctcagagaa

SEQ ID NO: 449803 - DNA, 25 bp, Homo sapien
tcgacgtaagcacttctcagagaat

SEQ ID NO: 449804 - DNA, 25 bp, Homo sapien
cgacgtaagcacttctcagagaatg

SEQ ID NO: 449805 - DNA, 25 bp, Homo sapien
taacgcccagggaacaatgaagagg

SEQ ID NO: 449806 - DNA, 25 bp, Homo sapien
gtgccttggggtgtattttacttat

SEQ ID NO: 449807 - DNA, 25 bp, Homo sapien
tgccttggggtgtattttacttata

SEQ ID NO: 449808 - DNA, 25 bp, Homo sapien
aaatctgaatggcatattgtacatg

SEQ ID NO: 449809 - DNA, 25 bp, Homo sapien
acatgtagaaatttgtggtgttcac

SEQ ID NO: 449810 - DNA, 25 bp, Homo sapien
gtggtgttcactttttatcagaact

SEQ ID NO: 449811 - DNA, 25 bp, Homo sapien
cactttttatcagaactaaatccgg

SEQ ID NO: 449812 - DNA, 25 bp, Homo sapien
gagggtgcataacccatctgtcatt

SEQ ID NO: 449813 - DNA, 25 bp, Homo sapien
gtgcataacccatctgtcattgcta

SEQ ID NO: 449814 - DNA, 25 bp, Homo sapien
tgtcattgctaaccgcctcctgtgg

SEQ ID NO: 449815 - DNA, 25 bp, Homo sapien
taaccgcctcctgtggacaatagga

SEQ ID NO: 449816 - DNA, 25 bp, Homo sapien
gcctcctgtggacaataggaccatg

SEQ ID NO: 449817 - DNA, 25 bp, Homo sapien
aataggaccatgatttccaagtgtc

SEQ ID NO: 449818 - DNA, 25 bp, Homo sapien
aggaccatgatttccaagtgtcctt

SEQ ID NO: 449819 - DNA, 25 bp, Homo sapien
gtatttaagatgttatgtcagctga

SEQ ID NO: 449820 - DNA, 25 bp, Homo sapien
gtcagctgacacatgggacactcct

SEQ ID NO: 449821 - DNA, 25 bp, Homo sapien
tgtttggcggtgagtttccgcacca

SEQ ID NO: 449822 - DNA, 25 bp, Homo sapien
tcagaagtgtccctcttgcttcgtc

SEQ ID NO: 449823 - DNA, 25 bp, Homo sapien
gtctcttgttcgcttgctttgtaaa

SEQ ID NO: 449824 - DNA, 25 bp, Homo sapien
gtaaatactttggtcccaagctgag

SEQ ID NO: 449825 - DNA, 25 bp, Homo sapien
ggtcccaagctgagacaattgctgt

SEQ ID NO: 449826 - DNA, 25 bp, Homo sapien
aaacgtgaagagtcaatcccaaagg

SEQ ID NO: 449827 - DNA, 25 bp, Homo sapien
caatcccaaagggtgttatttgtca

SEQ ID NO: 449828 - DNA, 25 bp, Homo sapien
gtcagaagaacttgccgtgtgcctt

SEQ ID NO: 449829 - DNA, 25 bp, Homo sapien
aacttgccgtgtgccttcaccgaag

SEQ ID NO: 449830 - DNA, 25 bp, Homo sapien
gtaaggatacagcagttaaaacagt

SEQ ID NO: 449831 - DNA, 25 bp, Homo sapien
ggatacagcagttaaaacagttact

SEQ ID NO: 449832 - DNA, 25 bp, Homo sapien
atcttccaagtcaaatgagggttct

SEQ ID NO: 449833 - DNA, 25 bp, Homo sapien
atgagggttctgactcagagtgaca

SEQ ID NO: 449834 - DNA, 25 bp, Homo sapien
ggttctgactcagagtgacaaggat

SEQ ID NO: 449835 - DNA, 25 bp, Homo sapien
actcagagtgacaaggatgtgactt

SEQ ID NO: 449836 - DNA, 25 bp, Homo sapien
gttcaacattctcttctcaaacact

SEQ ID NO: 449837 - DNA, 25 bp, Homo sapien
caacattctcttctcaaacactgac

SEQ ID NO: 449838 - DNA, 25 bp, Homo sapien
acattctcttctcaaacactgacca

SEQ ID NO: 449839 - DNA, 25 bp, Homo sapien
ctcttctcaaacactgaccaaggaa

SEQ ID NO: 449840 - DNA, 25 bp, Homo sapien
tctcaaacactgaccaaggaacaga

SEQ ID NO: 449841 - DNA, 25 bp, Homo sapien
gagccagcataggtgcaacaagtag

SEQ ID NO: 449842 - DNA, 25 bp, Homo sapien
agccagcataggtgcaacaagtagt

SEQ ID NO: 449843 - DNA, 25 bp, Homo sapien
gccagcataggtgcaacaagtagta

SEQ ID NO: 449844 - DNA, 25 bp, Homo sapien
ccagcataggtgcaacaagtagtaa

SEQ ID NO: 449845 - DNA, 25 bp, Homo sapien
cagcataggtgcaacaagtagtaaa

SEQ ID NO: 449846 - DNA, 25 bp, Homo sapien
gcataggtgcaacaagtagtaaaga

SEQ ID NO: 449847 - DNA, 25 bp, Homo sapien
gtgcaacaagtagtaaagaaaccct

SEQ ID NO: 449848 - DNA, 25 bp, Homo sapien
gcaacaagtagtaaagaaaccctgg

SEQ ID NO: 449849 - DNA, 25 bp, Homo sapien
caagtagtaaagaaaccctggatat

SEQ ID NO: 449850 - DNA, 25 bp, Homo sapien
tctacgcccggcaaaagattgttgt

SEQ ID NO: 449851 - DNA, 25 bp, Homo sapien
ctacgcccggcaaaagattgttgtc

SEQ ID NO: 449852 - DNA, 25 bp, Homo sapien
gacttggaagatttgtgcttccgtt

SEQ ID NO: 449853 - DNA, 25 bp, Homo sapien
gtttctctttaccttcagaggaact

SEQ ID NO: 449854 - DNA, 25 bp, Homo sapien
tggagctgctcctatcttcatctga

SEQ ID NO: 449855 - DNA, 25 bp, Homo sapien
gctcctatcttcatctgaggtagaa

SEQ ID NO: 449856 - DNA, 25 bp, Homo sapien
tgaggtagaatcctccagtaactgt

SEQ ID NO: 449857 - DNA, 25 bp, Homo sapien
aactgctgtatccttacgtcctttt

SEQ ID NO: 449858 - DNA, 25 bp, Homo sapien
gtatccttacgtccttttcatgtcg

SEQ ID NO: 449859 - DNA, 25 bp, Homo sapien
gtccttttcatgtcgtttattgtct

SEQ ID NO: 449860 - DNA, 25 bp, Homo sapien
gtttattgtctcgtatgatgtcata

SEQ ID NO: 449861 - DNA, 25 bp, Homo sapien
atgggatcttcatgtgccactctga

SEQ ID NO: 449862 - DNA, 25 bp, Homo sapien
tcttcatgtgccactctgaactgct

SEQ ID NO: 449863 - DNA, 25 bp, Homo sapien
gggctactgtagatgctcagcacag

SEQ ID NO: 449864 - DNA, 25 bp, Homo sapien
atgctcagcacagaacctcttagct

SEQ ID NO: 449865 - DNA, 25 bp, Homo sapien
gaacctcttagctgtggttgtgact

SEQ ID NO: 449866 - DNA, 25 bp, Homo sapien
ctcttagctgtggttgtgacttcct

SEQ ID NO: 449867 - DNA, 25 bp, Homo sapien
aagtgctgtggcgagctctgtgact

SEQ ID NO: 449868 - DNA, 25 bp, Homo sapien
agccaggacatgacgtcctgcacga

SEQ ID NO: 449869 - DNA, 25 bp, Homo sapien
atgacgtcctgcacgactgcctggg

SEQ ID NO: 449870 - DNA, 25 bp, Homo sapien
aagtatagagatgattgtcctgtga

SEQ ID NO: 449871 - DNA, 25 bp, Homo sapien
atgattgtcctgtgaaatggcccca

SEQ ID NO: 449872 - DNA, 25 bp, Homo sapien
attgtcctgtgaaatggccccaagc

SEQ ID NO: 449873 - DNA, 25 bp, Homo sapien
gtgaaatggccccaagcctcagacc

SEQ ID NO: 449874 - DNA, 25 bp, Homo sapien
gcttatctctgaatttatctgcata

SEQ ID NO: 449875 - DNA, 25 bp, Homo sapien
ttatctctgaatttatctgcatatt

SEQ ID NO: 449876 - DNA, 25 bp, Homo sapien
ttcactttaagtgttgtaatgacaa

SEQ ID NO: 449877 - DNA, 25 bp, Homo sapien
gttgtaatgacaatagctatcaatc

SEQ ID NO: 449878 - DNA, 25 bp, Homo sapien
tgacaatagctatcaatcattgagt

SEQ ID NO: 449879 - DNA, 25 bp, Homo sapien
tatcaatcattgagtactgtgtact

SEQ ID NO: 449880 - DNA, 25 bp, Homo sapien
cattgagtactgtgtactaagcatt

SEQ ID NO: 449881 - DNA, 25 bp, Homo sapien
ttatcaacaagtacttacatgtggg

SEQ ID NO: 449882 - DNA, 25 bp, Homo sapien
acatgtgggataagtactgttatta

SEQ ID NO: 449883 - DNA, 25 bp, Homo sapien
atgaggacacatatagaatgcagtt

SEQ ID NO: 449884 - DNA, 25 bp, Homo sapien
tggagaattatctggaactaataag

SEQ ID NO: 449885 - DNA, 25 bp, Homo sapien
tgaggtaatcaggaccatgctgtta

SEQ ID NO: 449886 - DNA, 25 bp, Homo sapien
aatcaggaccatgctgttagtcaaa

SEQ ID NO: 449887 - DNA, 25 bp, Homo sapien
ggaccatgctgttagtcaaatagaa

SEQ ID NO: 449888 - DNA, 25 bp, Homo sapien
aagctggagtgctctctgtcacata

SEQ ID NO: 449889 - DNA, 25 bp, Homo sapien
gagtgctctctgtcacataatgtac

SEQ ID NO: 449890 - DNA, 25 bp, Homo sapien
acataatgtactgcatgtgtgtggg

SEQ ID NO: 449891 - DNA, 25 bp, Homo sapien
gtaattctgataacacgcaaagtaa

SEQ ID NO: 449892 - DNA, 25 bp, Homo sapien
agtatgggaattcttggtagcttaa

SEQ ID NO: 449893 - DNA, 25 bp, Homo sapien
ggaattcttggtagcttaaagcttc

SEQ ID NO: 449894 - DNA, 25 bp, Homo sapien
gggttaacttcagtgtatgaacacc

SEQ ID NO: 449895 - DNA, 25 bp, Homo sapien
gaagctccaagattggcataaaact

SEQ ID NO: 449896 - DNA, 25 bp, Homo sapien
tcatatccaaccctcattcagtatt

SEQ ID NO: 449897 - DNA, 25 bp, Homo sapien
atatccaaccctcattcagtatttc

SEQ ID NO: 449898 - DNA, 25 bp, Homo sapien
tccaaccctcattcagtatttctat

SEQ ID NO: 449899 - DNA, 25 bp, Homo sapien
accctcattcagtatttctatcaag

SEQ ID NO: 449900 - DNA, 25 bp, Homo sapien
tctatcaagaaagagatgctacaaa

SEQ ID NO: 449901 - DNA, 25 bp, Homo sapien
ttatgtatacagacgtaaacctcag

SEQ ID NO: 449902 - DNA, 25 bp, Homo sapien
gtatacagacgtaaacctcagaatg

SEQ ID NO: 449903 - DNA, 25 bp, Homo sapien
cagacgtaaacctcagaatgtatgt

SEQ ID NO: 449904 - DNA, 25 bp, Homo sapien
acgtaaacctcagaatgtatgttga

SEQ ID NO: 449905 - DNA, 25 bp, Homo sapien
aagcttccgaggtaagaattttatg

SEQ ID NO: 449906 - DNA, 25 bp, Homo sapien
ctgggacaacttaaatctcccttct

SEQ ID NO: 449907 - DNA, 25 bp, Homo sapien
gcaaggccgcttgcatcagcagcgt

SEQ ID NO: 449908 - DNA, 25 bp, Homo sapien
aaggccgcttgcatcagcagcgtgc

SEQ ID NO: 449909 - DNA, 25 bp, Homo sapien
gcttgcatcagcagcgtgcgtgagc

SEQ ID NO: 449910 - DNA, 25 bp, Homo sapien
gcatcagcagcgtgcgtgagcagat

SEQ ID NO: 449911 - DNA, 25 bp, Homo sapien
cgtgcgtgagcagatgcgccagcaa

SEQ ID NO: 449912 - DNA, 25 bp, Homo sapien
gcgtgagcagatgcgccagcaagat

SEQ ID NO: 449913 - DNA, 25 bp, Homo sapien
agagccagccggaagacaagtacct

SEQ ID NO: 449914 - DNA, 25 bp, Homo sapien
agccagccggaagacaagtacctct

SEQ ID NO: 449915 - DNA, 25 bp, Homo sapien
agccggaagacaagtacctctgaag

SEQ ID NO: 449916 - DNA, 25 bp, Homo sapien
gaagacaagtacctctgaagatgga

SEQ ID NO: 449917 - DNA, 25 bp, Homo sapien
caacgttgcagttacgtcagaccag

SEQ ID NO: 449918 - DNA, 25 bp, Homo sapien
cttttgcccagaaaatgcttcgtct

SEQ ID NO: 449919 - DNA, 25 bp, Homo sapien
aatgcttcgtctgctattttagtat

SEQ ID NO: 449920 - DNA, 25 bp, Homo sapien
gcctgtagttgagagagatacccaa

SEQ ID NO: 449921 - DNA, 25 bp, Homo sapien
agatacccaatctaaacagcactat

SEQ ID NO: 449922 - DNA, 25 bp, Homo sapien
acagcactatccagtagaattttat

SEQ ID NO: 449923 - DNA, 25 bp, Homo sapien
gaaaacagtctatatctccactctc

SEQ ID NO: 449924 - DNA, 25 bp, Homo sapien
atatctccactctccaatacagcgg

SEQ ID NO: 449925 - DNA, 25 bp, Homo sapien
aatacagcggccactagtcactttt

SEQ ID NO: 449926 - DNA, 25 bp, Homo sapien
gcggccactagtcacttttgattat

SEQ ID NO: 449927 - DNA, 25 bp, Homo sapien
ttggagtgtggctaatacgactgag

SEQ ID NO: 449928 - DNA, 25 bp, Homo sapien
gtggctaatacgactgagaaactca

SEQ ID NO: 449929 - DNA, 25 bp, Homo sapien
gtcttctccaaatatgacagcaaga

SEQ ID NO: 449930 - DNA, 25 bp, Homo sapien
aattggcctcctcaaagtttagcgt

SEQ ID NO: 449931 - DNA, 25 bp, Homo sapien
gtttagcgtcttgcataatgatgat

SEQ ID NO: 449932 - DNA, 25 bp, Homo sapien
aatgatgatgtacgtctctggcata

SEQ ID NO: 449933 - DNA, 25 bp, Homo sapien
ctctggcatattacattttcctttg

SEQ ID NO: 449934 - DNA, 25 bp, Homo sapien
ttgtctgatatgacccaaagaggca

SEQ ID NO: 449935 - DNA, 25 bp, Homo sapien
gaggcaaaactcagcacagtccttt

SEQ ID NO: 449936 - DNA, 25 bp, Homo sapien
cagtcctttctgcagtattctaaag

SEQ ID NO: 449937 - DNA, 25 bp, Homo sapien
aaacttcagcctagtgagtctgctt

SEQ ID NO: 449938 - DNA, 25 bp, Homo sapien
gagtctgcttgtttgatttggccgg

SEQ ID NO: 449939 - DNA, 25 bp, Homo sapien
gatttggccggacattttaagcatg

SEQ ID NO: 449940 - DNA, 25 bp, Homo sapien
ggatttcttaattaagctatgtaca

SEQ ID NO: 449941 - DNA, 25 bp, Homo sapien
attaagctatgtacatttttagatg

SEQ ID NO: 449942 - DNA, 25 bp, Homo sapien
agatgtaatgctattgacaactaac

SEQ ID NO: 449943 - DNA, 25 bp, Homo sapien
gtaatgctattgacaactaacaggc

SEQ ID NO: 449944 - DNA, 25 bp, Homo sapien
gctattgacaactaacaggctatgg

SEQ ID NO: 449945 - DNA, 25 bp, Homo sapien
ttgacaactaacaggctatggtatg

SEQ ID NO: 449946 - DNA, 25 bp, Homo sapien
caactaacaggctatggtatggcat

SEQ ID NO: 449947 - DNA, 25 bp, Homo sapien
ctaacaggctatggtatggcataaa

SEQ ID NO: 449948 - DNA, 25 bp, Homo sapien
caggctatggtatggcataaagata

SEQ ID NO: 449949 - DNA, 25 bp, Homo sapien
caatagttgctttattgtgatggtc

SEQ ID NO: 449950 - DNA, 25 bp, Homo sapien
tgatggtctggaaatgaacctgcaa

SEQ ID NO: 449951 - DNA, 25 bp, Homo sapien
ggccgcgtcgacatgaaattggatt

SEQ ID NO: 449952 - DNA, 25 bp, Homo sapien
aattggattctgttgctttaagcat

SEQ ID NO: 449953 - DNA, 25 bp, Homo sapien
ctgttgctttaagcatttcatgact

SEQ ID NO: 449954 - DNA, 25 bp, Homo sapien
gctgctgtctggatgctacctgaag

SEQ ID NO: 449955 - DNA, 25 bp, Homo sapien
gatgctacctgaagagattctcatt

SEQ ID NO: 449956 - DNA, 25 bp, Homo sapien
gaagagattctcattgaatatcatt

SEQ ID NO: 449957 - DNA, 25 bp, Homo sapien
attttctttaagctccatctatgta

SEQ ID NO: 449958 - DNA, 25 bp, Homo sapien
taagctccatctatgtaaatatttt

SEQ ID NO: 449959 - DNA, 25 bp, Homo sapien
aattttgcacaagtacagggccaca

SEQ ID NO: 449960 - DNA, 25 bp, Homo sapien
gtacagggccacatacctatttgtt

SEQ ID NO: 449961 - DNA, 25 bp, Homo sapien
gggccacatacctatttgttataaa

SEQ ID NO: 449962 - DNA, 25 bp, Homo sapien
ttacctttcagtttgttccaaagat

SEQ ID NO: 449963 - DNA, 25 bp, Homo sapien
ttgttccaaagattgcatgcatcat

SEQ ID NO: 449964 - DNA, 25 bp, Homo sapien
aagcttgagtctttttactcccctg

SEQ ID NO: 449965 - DNA, 25 bp, Homo sapien
tttttactcccctgtcttgttgaga

SEQ ID NO: 449966 - DNA, 25 bp, Homo sapien
tcccctgtcttgttgagatacctac

SEQ ID NO: 449967 - DNA, 25 bp, Homo sapien
gagatacctactacttgagcatact

SEQ ID NO: 449968 - DNA, 25 bp, Homo sapien
actacttgagcatactctggaatga

SEQ ID NO: 449969 - DNA, 25 bp, Homo sapien
ttatcgattaacatgctgcttacgc

SEQ ID NO: 449970 - DNA, 25 bp, Homo sapien
gctgcttacgcagataggattagca

SEQ ID NO: 449971 - DNA, 25 bp, Homo sapien
ggattagcatttccttaatttagta

SEQ ID NO: 449972 - DNA, 25 bp, Homo sapien
acattgcttgtggtattaattctca

SEQ ID NO: 449973 - DNA, 25 bp, Homo sapien
gaggagaagactttcgagccagcat

SEQ ID NO: 449974 - DNA, 25 bp, Homo sapien
gaagactttcgagccagcataggtg

SEQ ID NO: 449975 - DNA, 25 bp, Homo sapien
ggtgtacattgactttcgagatgga

SEQ ID NO: 449976 - DNA, 25 bp, Homo sapien
cattgactttcgagatggagctggg

SEQ ID NO: 449977 - DNA, 25 bp, Homo sapien
acagtcacgagaaggagccgccatg

SEQ ID NO: 449978 - DNA, 25 bp, Homo sapien
catgggcttcactggtaagcaggtg

SEQ ID NO: 449979 - DNA, 25 bp, Homo sapien
cactggtaagcaggtgattcaccct

SEQ ID NO: 449980 - DNA, 25 bp, Homo sapien
aggtgattcaccctaaccaaattgc

SEQ ID NO: 449981 - DNA, 25 bp, Homo sapien
attcaccctaaccaaattgccgtgg

SEQ ID NO: 449982 - DNA, 25 bp, Homo sapien
aaccaaattgccgtggtccaggagc

SEQ ID NO: 449983 - DNA, 25 bp, Homo sapien
tggtccaggagcagttttctccttc

SEQ ID NO: 449984 - DNA, 25 bp, Homo sapien
agtgcggcgcagctgcctcctctta

SEQ ID NO: 449985 - DNA, 25 bp, Homo sapien
tcttaaccgggacaccttgcaggaa

SEQ ID NO: 449986 - DNA, 25 bp, Homo sapien
taaccgggacaccttgcaggaatgt

SEQ ID NO: 449987 - DNA, 25 bp, Homo sapien
gagctaacgggagcggatagaaacc

SEQ ID NO: 449988 - DNA, 25 bp, Homo sapien
aagagagcgcgaaggcttggccgga

SEQ ID NO: 449989 - DNA, 25 bp, Homo sapien
gaagagagttaccacaacaagcagt

SEQ ID NO: 449990 - DNA, 25 bp, Homo sapien
acaagcagtacctagttccagttct

SEQ ID NO: 449991 - DNA, 25 bp, Homo sapien
tagttccagttcttggtcccaggag

SEQ ID NO: 449992 - DNA, 25 bp, Homo sapien
gtggttgttgctgctttcatcttcc

SEQ ID NO: 449993 - DNA, 25 bp, Homo sapien
ttcatcttcctcagccaacacaaaa

SEQ ID NO: 449994 - DNA, 25 bp, Homo sapien
ggcgattcctaggaccttcagtgca

SEQ ID NO: 449995 - DNA, 25 bp, Homo sapien
gccataggtaggtgccctggcagtg

SEQ ID NO: 449996 - DNA, 25 bp, Homo sapien
tggcagtggcagctcaggtgctgtg

SEQ ID NO: 449997 - DNA, 25 bp, Homo sapien
gctccagtgggaggcaccataggca

SEQ ID NO: 449998 - DNA, 25 bp, Homo sapien
gcaggttagaagtgtatggcatcca

SEQ ID NO: 449999 - DNA, 25 bp, Homo sapien
gtatggcatccatgactgggattat

SEQ ID NO: 450000 - DNA, 25 bp, Homo sapien
tgggattattaccatttttgggatt

SEQ ID NO: 450001 - DNA, 25 bp, Homo sapien
catttttgggatttctttaggccat

SEQ ID NO: 450002 - DNA, 25 bp, Homo sapien
gggatttctttaggccatatattac

SEQ ID NO: 450003 - DNA, 25 bp, Homo sapien
atattacttggaacctaaacatgtg

SEQ ID NO: 450004 - DNA, 25 bp, Homo sapien
aaatgagattaactttgagtctaag

SEQ ID NO: 450005 - DNA, 25 bp, Homo sapien
gagtctaagttttctaatgtgtaag

SEQ ID NO: 450006 - DNA, 25 bp, Homo sapien
tgtaaagcaaacagaacccaatgcc

SEQ ID NO: 450007 - DNA, 25 bp, Homo sapien
caggaatcatgcttgctcccctggg

SEQ ID NO: 450008 - DNA, 25 bp, Homo sapien
atcatgcttgctcccctgggccatt

SEQ ID NO: 450009 - DNA, 25 bp, Homo sapien
tgggcttctggagggttccccgcca

SEQ ID NO: 450010 - DNA, 25 bp, Homo sapien
ttctggagggttccccgccatccag

SEQ ID NO: 450011 - DNA, 25 bp, Homo sapien
tggtctccctcccttaaggaggttg

SEQ ID NO: 450012 - DNA, 25 bp, Homo sapien
cccttaaggaggttggtgcccagag

SEQ ID NO: 450013 - DNA, 25 bp, Homo sapien
cagagtgggcggtggcctgtctaga

SEQ ID NO: 450014 - DNA, 25 bp, Homo sapien
tggcctgtctagaatgccgccggga

SEQ ID NO: 450015 - DNA, 25 bp, Homo sapien
gcctgtctagaatgccgccgggagt

SEQ ID NO: 450016 - DNA, 25 bp, Homo sapien
ggcatggtgggcacagttctccctg

SEQ ID NO: 450017 - DNA, 25 bp, Homo sapien
tgataaatcatttcctcatcctgcc

SEQ ID NO: 450018 - DNA, 25 bp, Homo sapien
taaatcatttcctcatcctgccatt

SEQ ID NO: 450019 - DNA, 25 bp, Homo sapien
tttattccttaagtcacatatccca

SEQ ID NO: 450020 - DNA, 25 bp, Homo sapien
gttgtgaatcatttgccagcgagcc

SEQ ID NO: 450021 - DNA, 25 bp, Homo sapien
ttcaactaccaagttttgtttcatt

SEQ ID NO: 450022 - DNA, 25 bp, Homo sapien
tcatttgccagcgagccaagggaga

SEQ ID NO: 450023 - DNA, 25 bp, Homo sapien
gcagggattcccttgaaatgtactc

SEQ ID NO: 450024 - DNA, 25 bp, Homo sapien
gattcccttgaaatgtactcttaca

SEQ ID NO: 450025 - DNA, 25 bp, Homo sapien
gaaatgtactcttacacttttttat

SEQ ID NO: 450026 - DNA, 25 bp, Homo sapien
tttaatgtacatttgtgtgcaccag

SEQ ID NO: 450027 - DNA, 25 bp, Homo sapien
atttgtgtgcaccagaatggaatgt

SEQ ID NO: 450028 - DNA, 25 bp, Homo sapien
taaatttcaacctaagcactacctt

SEQ ID NO: 450029 - DNA, 25 bp, Homo sapien
gtgatgaatgttaaagctgggcctt

SEQ ID NO: 450030 - DNA, 25 bp, Homo sapien
ttaaagctgggccttgggtacatga

SEQ ID NO: 450031 - DNA, 25 bp, Homo sapien
ggccttgggtacatgagtgtttata

SEQ ID NO: 450032 - DNA, 25 bp, Homo sapien
ttatctagtctttttgtgttcatgc

SEQ ID NO: 450033 - DNA, 25 bp, Homo sapien
gtgttcatgcttaacattttctaaa

SEQ ID NO: 450034 - DNA, 25 bp, Homo sapien
gttttctatgactcaagggtcatca

SEQ ID NO: 450035 - DNA, 25 bp, Homo sapien
aaaattggctttaactggatagtgt

SEQ ID NO: 450036 - DNA, 25 bp, Homo sapien
tctcctacctaaggctgactttatg

SEQ ID NO: 450037 - DNA, 25 bp, Homo sapien
taaggctgactttatgctttgagta

SEQ ID NO: 450038 - DNA, 25 bp, Homo sapien
aaataatgcatttaccacttcctca

SEQ ID NO: 450039 - DNA, 25 bp, Homo sapien
ctcttgaaggctgggttttcccagc

SEQ ID NO: 450040 - DNA, 25 bp, Homo sapien
atttcctttacccatcagggtatgg

SEQ ID NO: 450041 - DNA, 25 bp, Homo sapien
ctttacccatcagggtatggtctgg

SEQ ID NO: 450042 - DNA, 25 bp, Homo sapien
gtatggtctggctggtaatactgac

SEQ ID NO: 450043 - DNA, 25 bp, Homo sapien
gtctggctggtaatactgactccaa

SEQ ID NO: 450044 - DNA, 25 bp, Homo sapien
gttcaccatggcgagactcactgca

SEQ ID NO: 450045 - DNA, 25 bp, Homo sapien
atggcgagactcactgcagaatttt

SEQ ID NO: 450046 - DNA, 25 bp, Homo sapien
gagactcactgcagaatttttaacc

SEQ ID NO: 450047 - DNA, 25 bp, Homo sapien
taagtcattcattctaggaacagtc

SEQ ID NO: 450048 - DNA, 25 bp, Homo sapien
ttcattctaggaacagtcaagcccc

SEQ ID NO: 450049 - DNA, 25 bp, Homo sapien
taggaacagtcaagcccctaccaca

SEQ ID NO: 450050 - DNA, 25 bp, Homo sapien
acaagaaaacttggatctgtgcatt

SEQ ID NO: 450051 - DNA, 25 bp, Homo sapien
aacttggatctgtgcattatcacca

SEQ ID NO: 450052 - DNA, 25 bp, Homo sapien
ggatctgtgcattatcaccatctag

SEQ ID NO: 450053 - DNA, 25 bp, Homo sapien
gtgcattatcaccatctagtggcta

SEQ ID NO: 450054 - DNA, 25 bp, Homo sapien
atctagtggctaaactcaggcaaca

SEQ ID NO: 450055 - DNA, 25 bp, Homo sapien
tggctaaactcaggcaacacgaact

SEQ ID NO: 450056 - DNA, 25 bp, Homo sapien
taaactcaggcaacacgaacttcta

SEQ ID NO: 450057 - DNA, 25 bp, Homo sapien
aacacgaacttctaccaaactcagg

SEQ ID NO: 450058 - DNA, 25 bp, Homo sapien
aactcaggaaattgctctggaaaaa

SEQ ID NO: 450059 - DNA, 25 bp, Homo sapien
aggaaattgctctggaaaaactaca

SEQ ID NO: 450060 - DNA, 25 bp, Homo sapien
ttttggatttccagaactgccttga

SEQ ID NO: 450061 - DNA, 25 bp, Homo sapien
ggcataagagccatcagacatcaag

SEQ ID NO: 450062 - DNA, 25 bp, Homo sapien
tggcttctgtccagggtaggagcta

SEQ ID NO: 450063 - DNA, 25 bp, Homo sapien
cagggtaggagctaacacagagata

SEQ ID NO: 450064 - DNA, 25 bp, Homo sapien
taagagccatcagacatcaaggact

SEQ ID NO: 450065 - DNA, 25 bp, Homo sapien
gataggtctgaatggtgaaactccc

SEQ ID NO: 450066 - DNA, 25 bp, Homo sapien
aatggtgaaactccctttggcctgg

SEQ ID NO: 450067 - DNA, 25 bp, Homo sapien
tttggcctggcctctcaatagtgtg

SEQ ID NO: 450068 - DNA, 25 bp, Homo sapien
cctggcctctcaatagtgtgggtta

SEQ ID NO: 450069 - DNA, 25 bp, Homo sapien
atagtgtgggttaggctgatcttga

SEQ ID NO: 450070 - DNA, 25 bp, Homo sapien
gcctcccaaattgcctggacaacat

SEQ ID NO: 450071 - DNA, 25 bp, Homo sapien
cacccaaatacccattgccaaggga

SEQ ID NO: 450072 - DNA, 25 bp, Homo sapien
tcctgcccttgacaatgctgtgatg

SEQ ID NO: 450073 - DNA, 25 bp, Homo sapien
cccttgacaatgctgtgatggctca

SEQ ID NO: 450074 - DNA, 25 bp, Homo sapien
tgctgtgatggctcaggttcaggct

SEQ ID NO: 450075 - DNA, 25 bp, Homo sapien
atggctcaggttcaggctatcacag

SEQ ID NO: 450076 - DNA, 25 bp, Homo sapien
ggttcaggctatcacagctcagtta

SEQ ID NO: 450077 - DNA, 25 bp, Homo sapien
caggctatcacagctcagttaaaga

SEQ ID NO: 450078 - DNA, 25 bp, Homo sapien
actcctacacaaccatctgaacaaa

SEQ ID NO: 450079 - DNA, 25 bp, Homo sapien
ctgtggctcagctgtttcagacaac

SEQ ID NO: 450080 - DNA, 25 bp, Homo sapien
ctcagctgtttcagacaactcaagg

SEQ ID NO: 450081 - DNA, 25 bp, Homo sapien
agcagatccttcagacttttcaaca

SEQ ID NO: 450082 - DNA, 25 bp, Homo sapien
gacttttcaacagcctccaaaacca

SEQ ID NO: 450083 - DNA, 25 bp, Homo sapien
tctttctctctgactgaggctcacg

SEQ ID NO: 450084 - DNA, 25 bp, Homo sapien
ctttctctctgactgaggctcacgt

SEQ ID NO: 450085 - DNA, 25 bp, Homo sapien
tttctctctgactgaggctcacgtg

SEQ ID NO: 450086 - DNA, 25 bp, Homo sapien
ttctctctgactgaggctcacgtgg

SEQ ID NO: 450087 - DNA, 25 bp, Homo sapien
ctctctgactgaggctcacgtggga

SEQ ID NO: 450088 - DNA, 25 bp, Homo sapien
ctctgactgaggctcacgtgggaaa

SEQ ID NO: 450089 - DNA, 25 bp, Homo sapien
tctgactgaggctcacgtgggaaat

SEQ ID NO: 450090 - DNA, 25 bp, Homo sapien
tgactgaggctcacgtgggaaatat

SEQ ID NO: 450091 - DNA, 25 bp, Homo sapien
actgaggctcacgtgggaaatatga

SEQ ID NO: 450092 - DNA, 25 bp, Homo sapien
tgaggctcacgtgggaaatatgagt

SEQ ID NO: 450093 - DNA, 25 bp, Homo sapien
tcacgtgggaaatatgagtgagcat

SEQ ID NO: 450094 - DNA, 25 bp, Homo sapien
atcagagatgcttactgcagccctg

SEQ ID NO: 450095 - DNA, 25 bp, Homo sapien
aatccacagtgtagtcagaaaagct

SEQ ID NO: 450096 - DNA, 25 bp, Homo sapien
gaaaagctgttgacttctcttaaat

SEQ ID NO: 450097 - DNA, 25 bp, Homo sapien
gacttctcttaaatcagcttccctg

SEQ ID NO: 450098 - DNA, 25 bp, Homo sapien
ctgctgggcccctgaaagtggactg

SEQ ID NO: 450099 - DNA, 25 bp, Homo sapien
actgggtgattctgtctggcagaga

SEQ ID NO: 450100 - DNA, 25 bp, Homo sapien
aaaagacgcggtttccagcttgcag

SEQ ID NO: 450101 - DNA, 25 bp, Homo sapien
ggtttccagcttgcagatttgttaa

SEQ ID NO: 450102 - DNA, 25 bp, Homo sapien
gatttgttaagtttctcaggcagat

SEQ ID NO: 450103 - DNA, 25 bp, Homo sapien
caggcagattttgactttcagcctt

SEQ ID NO: 450104 - DNA, 25 bp, Homo sapien
gactttcagcctttcatacttgttt

SEQ ID NO: 450105 - DNA, 25 bp, Homo sapien
gtacgttatgactgctaatgacttt

SEQ ID NO: 450106 - DNA, 25 bp, Homo sapien
gttatgactgctaatgacttttaaa

SEQ ID NO: 450107 - DNA, 25 bp, Homo sapien
gctagaggatactagtttcgaacct

SEQ ID NO: 450108 - DNA, 25 bp, Homo sapien
taactatggtgtcacagccctgtgg

SEQ ID NO: 450109 - DNA, 25 bp, Homo sapien
gtgacaagagctggtcgcaacactt

SEQ ID NO: 450110 - DNA, 25 bp, Homo sapien
gagctggtcgcaacacttagtagga

SEQ ID NO: 450111 - DNA, 25 bp, Homo sapien
acttagtaggaagcacagtggcata

SEQ ID NO: 450112 - DNA, 25 bp, Homo sapien
cagtggcataaggaaacctggacta

SEQ ID NO: 450113 - DNA, 25 bp, Homo sapien
gactagtggggcctttatatctaaa

SEQ ID NO: 450114 - DNA, 25 bp, Homo sapien
gtattattccttataggcagaatct

SEQ ID NO: 450115 - DNA, 25 bp, Homo sapien
aggcagaatctgtaagtacgttatg

SEQ ID NO: 450116 - DNA, 25 bp, Homo sapien
gtagggactgcttatttcttaggat

SEQ ID NO: 450117 - DNA, 25 bp, Homo sapien
actgcttatttcttaggattcctca

SEQ ID NO: 450118 - DNA, 25 bp, Homo sapien
ggattcctcataaactgtgggctat

SEQ ID NO: 450119 - DNA, 25 bp, Homo sapien
ctcataaactgtgggctatagatct

SEQ ID NO: 450120 - DNA, 25 bp, Homo sapien
atcttaaaaggcagggatcgaggaa

SEQ ID NO: 450121 - DNA, 25 bp, Homo sapien
attctgccataacacaaacctctat

SEQ ID NO: 450122 - DNA, 25 bp, Homo sapien
gagatatctcagaattccagtctat

SEQ ID NO: 450123 - DNA, 25 bp, Homo sapien
tcagaattccagtctatccagtggc

SEQ ID NO: 450124 - DNA, 25 bp, Homo sapien
ctatccagtggcctacttatttcac

SEQ ID NO: 450125 - DNA, 25 bp, Homo sapien
agtggcctacttatttcacacagtt

SEQ ID NO: 450126 - DNA, 25 bp, Homo sapien
ggccgcgtcgacataaaagtaggga

SEQ ID NO: 450127 - DNA, 25 bp, Homo sapien
gggcggatgactgggtctttttatt

SEQ ID NO: 450128 - DNA, 25 bp, Homo sapien
tttcctttctctcttggattttggt

SEQ ID NO: 450129 - DNA, 25 bp, Homo sapien
cctttctctcttggattttggtgtt

SEQ ID NO: 450130 - DNA, 25 bp, Homo sapien
ctgcaggctcgtgccgttctttttt

SEQ ID NO: 450131 - DNA, 25 bp, Homo sapien
tctcttggattttggtgtttgaact

SEQ ID NO: 450132 - DNA, 25 bp, Homo sapien
cttggattttggtgtttgaacttga

SEQ ID NO: 450133 - DNA, 25 bp, Homo sapien
gaaataagttgatttcattcttttg

SEQ ID NO: 450134 - DNA, 25 bp, Homo sapien
ttgatttatcttgtttctcattggg

SEQ ID NO: 450135 - DNA, 25 bp, Homo sapien
atctatttcttattttggacatgca

SEQ ID NO: 450136 - DNA, 25 bp, Homo sapien
tcttattttggacatgcagggatca

SEQ ID NO: 450137 - DNA, 25 bp, Homo sapien
acatgcagggatcaattgagattct

SEQ ID NO: 450138 - DNA, 25 bp, Homo sapien
gctctgcgaggtgcaagaaagcctt

SEQ ID NO: 450139 - DNA, 25 bp, Homo sapien
aggtgcaagaaagcctttgaggtga

SEQ ID NO: 450140 - DNA, 25 bp, Homo sapien
aaaactactaggatcacgcggcatg

SEQ ID NO: 450141 - DNA, 25 bp, Homo sapien
gatcacgcggcatgtattgagcata

SEQ ID NO: 450142 - DNA, 25 bp, Homo sapien
gagcatataggttgctgtagatgaa

SEQ ID NO: 450143 - DNA, 25 bp, Homo sapien
tgtagatgaatgttcttagctgtca

SEQ ID NO: 450144 - DNA, 25 bp, Homo sapien
gaatgttcttagctgtcatgtttaa

SEQ ID NO: 450145 - DNA, 25 bp, Homo sapien
aaaatacttctgcttcgttacctca

SEQ ID NO: 450146 - DNA, 25 bp, Homo sapien
tgcttcgttacctcaagtgtggcat

SEQ ID NO: 450147 - DNA, 25 bp, Homo sapien
gaagcgcgaagagccgttagtcatg

SEQ ID NO: 450148 - DNA, 25 bp, Homo sapien
aagagccgttagtcatgccggtgtg

SEQ ID NO: 450149 - DNA, 25 bp, Homo sapien
gaattcagggttgtgaagattacat

SEQ ID NO: 450150 - DNA, 25 bp, Homo sapien
taaagcacagtgcttgtgacagagt

SEQ ID NO: 450151 - DNA, 25 bp, Homo sapien
gtttctttaacttcattagcacctt

SEQ ID NO: 450152 - DNA, 25 bp, Homo sapien
ttaacttcattagcaccttccctgt

SEQ ID NO: 450153 - DNA, 25 bp, Homo sapien
ttagcaccttccctgtgacttcaag

SEQ ID NO: 450154 - DNA, 25 bp, Homo sapien
accttccctgtgacttcaagtatag

SEQ ID NO: 450155 - DNA, 25 bp, Homo sapien
ttccctgtgacttcaagtatagaca

SEQ ID NO: 450156 - DNA, 25 bp, Homo sapien
acaggacttttatacattagaatgg

SEQ ID NO: 450157 - DNA, 25 bp, Homo sapien
gaatggaatatttgtttaactttgt

SEQ ID NO: 450158 - DNA, 25 bp, Homo sapien
tgtttatgtctcttgttttctcctt

SEQ ID NO: 450159 - DNA, 25 bp, Homo sapien
tttatgtctcttgttttctccttcc

SEQ ID NO: 450160 - DNA, 25 bp, Homo sapien
ggctttcaaatctttaattagtgtg

SEQ ID NO: 450161 - DNA, 25 bp, Homo sapien
attagtgtgtcttttatttccatta

SEQ ID NO: 450162 - DNA, 25 bp, Homo sapien
aaaaatttcagctccaatattaaga

SEQ ID NO: 450163 - DNA, 25 bp, Homo sapien
taagattatcttttgaggaagcata

SEQ ID NO: 450164 - DNA, 25 bp, Homo sapien
caataattagcaccatttgaatgtt

SEQ ID NO: 450165 - DNA, 25 bp, Homo sapien
gtagaagttgatatctggctagaat

SEQ ID NO: 450166 - DNA, 25 bp, Homo sapien
gtcaaataatttgtggcccttaaga

SEQ ID NO: 450167 - DNA, 25 bp, Homo sapien
ttgtggcccttaagacagagttggt

SEQ ID NO: 450168 - DNA, 25 bp, Homo sapien
acagagttggtggatgtttccttgt

SEQ ID NO: 450169 - DNA, 25 bp, Homo sapien
gtggatgtttccttgtgttcaatac

SEQ ID NO: 450170 - DNA, 25 bp, Homo sapien
tgtttccttgtgttcaatacatgaa

SEQ ID NO: 450171 - DNA, 25 bp, Homo sapien
atgataaacaacttgcaggttgttg

SEQ ID NO: 450172 - DNA, 25 bp, Homo sapien
cttgcaggttgttgtgtggtataat

SEQ ID NO: 450173 - DNA, 25 bp, Homo sapien
caggttgttgtgtggtataatggtc

SEQ ID NO: 450174 - DNA, 25 bp, Homo sapien
gttgtgtggtataatggtcattcat

SEQ ID NO: 450175 - DNA, 25 bp, Homo sapien
tattttctactctttctggtaaaga

SEQ ID NO: 450176 - DNA, 25 bp, Homo sapien
ttctggtaaagagttggtgtgtcat

SEQ ID NO: 450177 - DNA, 25 bp, Homo sapien
gtgtgtcatggaaagtacctgttct

SEQ ID NO: 450178 - DNA, 25 bp, Homo sapien
gtgtcatggaaagtacctgttctat

SEQ ID NO: 450179 - DNA, 25 bp, Homo sapien
catggaaagtacctgttctatgtgt

SEQ ID NO: 450180 - DNA, 25 bp, Homo sapien
gtgtctgtgtgtataattcggtgtg

SEQ ID NO: 450181 - DNA, 25 bp, Homo sapien
tctgtgtgtataattcggtgtgaaa

SEQ ID NO: 450182 - DNA, 25 bp, Homo sapien
gaaacatttcaattcccagttcaac

SEQ ID NO: 450183 - DNA, 25 bp, Homo sapien
tcaattcccagttcaacaaaaggtt

SEQ ID NO: 450184 - DNA, 25 bp, Homo sapien
ttgactcaatgaccaccttcaggaa

SEQ ID NO: 450185 - DNA, 25 bp, Homo sapien
caatgaccaccttcaggaaagttaa

SEQ ID NO: 450186 - DNA, 25 bp, Homo sapien
ttaacttaagcagacagcagcacat

SEQ ID NO: 450187 - DNA, 25 bp, Homo sapien
taagcagacagcagcacattaacct

SEQ ID NO: 450188 - DNA, 25 bp, Homo sapien
gcacattaacctgagttacacctgt

SEQ ID NO: 450189 - DNA, 25 bp, Homo sapien
aacctgagttacacctgtgaggaaa

SEQ ID NO: 450190 - DNA, 25 bp, Homo sapien
gaaatgaccttctaaatttgatttt

SEQ ID NO: 450191 - DNA, 25 bp, Homo sapien
atctccagggccttaataagagtgt

SEQ ID NO: 450192 - DNA, 25 bp, Homo sapien
gtgttaacacacgactattttacaa

SEQ ID NO: 450193 - DNA, 25 bp, Homo sapien
aaggtgagctgctattttaggaaac

SEQ ID NO: 450194 - DNA, 25 bp, Homo sapien
gaaactggaccagacaccaacttgg

SEQ ID NO: 450195 - DNA, 25 bp, Homo sapien
aaactggaccagacaccaacttggg

SEQ ID NO: 450196 - DNA, 25 bp, Homo sapien
taagtcaaacaacctcaaacccatc

SEQ ID NO: 450197 - DNA, 25 bp, Homo sapien
aagtcaaacaacctcaaacccatct

SEQ ID NO: 450198 - DNA, 25 bp, Homo sapien
catctcttcctgtgtaggggtgcaa

SEQ ID NO: 450199 - DNA, 25 bp, Homo sapien
aagcctctgaagctctcactcccac

SEQ ID NO: 450200 - DNA, 25 bp, Homo sapien
actcccacccttagtctgcatggaa

SEQ ID NO: 450201 - DNA, 25 bp, Homo sapien
tcccacccttagtctgcatggaaaa

SEQ ID NO: 450202 - DNA, 25 bp, Homo sapien
cacccttagtctgcatggaaaatgt

SEQ ID NO: 450203 - DNA, 25 bp, Homo sapien
cttagtctgcatggaaaatgtactg

SEQ ID NO: 450204 - DNA, 25 bp, Homo sapien
aggctgaagtaaccttattcctatt

SEQ ID NO: 450205 - DNA, 25 bp, Homo sapien
gctgaagtaaccttattcctattgt

SEQ ID NO: 450206 - DNA, 25 bp, Homo sapien
tgaagtaaccttattcctattgttt

SEQ ID NO: 450207 - DNA, 25 bp, Homo sapien
accttattcctattgtttagtagct

SEQ ID NO: 450208 - DNA, 25 bp, Homo sapien
tattcctattgtttagtagctaata

SEQ ID NO: 450209 - DNA, 25 bp, Homo sapien
gtagctaatagcatgcttttgatat

SEQ ID NO: 450210 - DNA, 25 bp, Homo sapien
catgcttttgatatgcttatgatca

SEQ ID NO: 450211 - DNA, 25 bp, Homo sapien
gatatgcttatgatcatactaataa

SEQ ID NO: 450212 - DNA, 25 bp, Homo sapien
caattcagtatcattttacatatgg

SEQ ID NO: 450213 - DNA, 25 bp, Homo sapien
attgtgatgctgtatcatattttat

SEQ ID NO: 450214 - DNA, 25 bp, Homo sapien
atcatattttatgttacggtttata

SEQ ID NO: 450215 - DNA, 25 bp, Homo sapien
caccaactgataatcagggtattgc

SEQ ID NO: 450216 - DNA, 25 bp, Homo sapien
aactgataatcagggtattgcacct

SEQ ID NO: 450217 - DNA, 25 bp, Homo sapien
actgataatcagggtattgcaccta

SEQ ID NO: 450218 - DNA, 25 bp, Homo sapien
tggaagcttttcaacaggaactggc

SEQ ID NO: 450219 - DNA, 25 bp, Homo sapien
ggaagcttttcaacaggaactggct

SEQ ID NO: 450220 - DNA, 25 bp, Homo sapien
gaagcttttcaacaggaactggctc

SEQ ID NO: 450221 - DNA, 25 bp, Homo sapien
aagcttttcaacaggaactggctct

SEQ ID NO: 450222 - DNA, 25 bp, Homo sapien
agcttttcaacaggaactggctctg

SEQ ID NO: 450223 - DNA, 25 bp, Homo sapien
aacaagatcccaatcctcagaaaga

SEQ ID NO: 450224 - DNA, 25 bp, Homo sapien
acaagatcccaatcctcagaaagag

SEQ ID NO: 450225 - DNA, 25 bp, Homo sapien
caagatcccaatcctcagaaagagg

SEQ ID NO: 450226 - DNA, 25 bp, Homo sapien
ggctgggcctgtatctcagaaggga

SEQ ID NO: 450227 - DNA, 25 bp, Homo sapien
ggcacagctacacactcaccaaagg

SEQ ID NO: 450228 - DNA, 25 bp, Homo sapien
ccctgcacattgtatctctgatctt

SEQ ID NO: 450229 - DNA, 25 bp, Homo sapien
attgtatctctgatcttgggctgtc

SEQ ID NO: 450230 - DNA, 25 bp, Homo sapien
ttgggctgtctgcactgtcacaggt

SEQ ID NO: 450231 - DNA, 25 bp, Homo sapien
tgcttcccagcacacacttctttgg

SEQ ID NO: 450232 - DNA, 25 bp, Homo sapien
agcacacacttctttggcctaaggg

SEQ ID NO: 450233 - DNA, 25 bp, Homo sapien
acacacttctttggcctaagggctt

SEQ ID NO: 450234 - DNA, 25 bp, Homo sapien
ctaagggcttctctctcaggacctc

SEQ ID NO: 450235 - DNA, 25 bp, Homo sapien
ctctcaggacctctaatttgaccac

SEQ ID NO: 450236 - DNA, 25 bp, Homo sapien
ggacctctaatttgaccacaaccaa

SEQ ID NO: 450237 - DNA, 25 bp, Homo sapien
atagcggctaccctaaaatgtcctg

SEQ ID NO: 450238 - DNA, 25 bp, Homo sapien
aaaatgtcctgtcggtacaacgctt

SEQ ID NO: 450239 - DNA, 25 bp, Homo sapien
caacgcttcccctgcgagagtgaat

SEQ ID NO: 450240 - DNA, 25 bp, Homo sapien
gcgagagtgaattaactcccctcct

SEQ ID NO: 450241 - DNA, 25 bp, Homo sapien
tccagagctaccctgatggctaagt

SEQ ID NO: 450242 - DNA, 25 bp, Homo sapien
taccctgatggctaagtttcgtttc

SEQ ID NO: 450243 - DNA, 25 bp, Homo sapien
gctaagtttcgtttctcttttaatg

SEQ ID NO: 450244 - DNA, 25 bp, Homo sapien
agagttcatgagtctccgttggaca

SEQ ID NO: 450245 - DNA, 25 bp, Homo sapien
atgagtctccgttggacacaactta

SEQ ID NO: 450246 - DNA, 25 bp, Homo sapien
gttggacacaacttaattctatcag

SEQ ID NO: 450247 - DNA, 25 bp, Homo sapien
aattctatcagccacagctgatatt

SEQ ID NO: 450248 - DNA, 25 bp, Homo sapien
tgcagtgaagatgtgaccccaggag

SEQ ID NO: 450249 - DNA, 25 bp, Homo sapien
tgaccccaggagagggagtgtctcc

SEQ ID NO: 450250 - DNA, 25 bp, Homo sapien
agggagtgtctccttccaggtgcta

SEQ ID NO: 450251 - DNA, 25 bp, Homo sapien
ttccaggtgctagctctggacagca

SEQ ID NO: 450252 - DNA, 25 bp, Homo sapien
gacagcagctgattttaggcaggaa

SEQ ID NO: 450253 - DNA, 25 bp, Homo sapien
gaaagtttcttcatcgttgtcctcc

SEQ ID NO: 450254 - DNA, 25 bp, Homo sapien
tccctgctggtcacatgagtttacg

SEQ ID NO: 450255 - DNA, 25 bp, Homo sapien
tggtcacatgagtttacgattcctt

SEQ ID NO: 450256 - DNA, 25 bp, Homo sapien
agtgtctcccacagggtggcaggac

SEQ ID NO: 450257 - DNA, 25 bp, Homo sapien
ggagaatctctgaggcgtgtcttcc

SEQ ID NO: 450258 - DNA, 25 bp, Homo sapien
aatctctgaggcgtgtcttccaggc

SEQ ID NO: 450259 - DNA, 25 bp, Homo sapien
tcttccaatgccgtgggagaggtga

SEQ ID NO: 450260 - DNA, 25 bp, Homo sapien
gggagaggtgatcccagtcttctct

SEQ ID NO: 450261 - DNA, 25 bp, Homo sapien
agtcttctctgtacatcttgtgctt

SEQ ID NO: 450262 - DNA, 25 bp, Homo sapien
gtgcttttccattaagacttgttcc

SEQ ID NO: 450263 - DNA, 25 bp, Homo sapien
gacttgttccagtgggaaggagctt

SEQ ID NO: 450264 - DNA, 25 bp, Homo sapien
aattgcaaaggtctgaatcttcagg

SEQ ID NO: 450265 - DNA, 25 bp, Homo sapien
aatcttcagggcattttcatgacag

SEQ ID NO: 450266 - DNA, 25 bp, Homo sapien
agggcattttcatgacaggacttgc

SEQ ID NO: 450267 - DNA, 25 bp, Homo sapien
ttctcaagtcatttcagtgatatca

SEQ ID NO: 450268 - DNA, 25 bp, Homo sapien
atcattgaaacgtttttgtggtact

SEQ ID NO: 450269 - DNA, 25 bp, Homo sapien
tccctttgtctttcactgtttcatt

SEQ ID NO: 450270 - DNA, 25 bp, Homo sapien
gttctgtgaactctcattacctttt

SEQ ID NO: 450271 - DNA, 25 bp, Homo sapien
ttccctgggtggctgctatatatcc

SEQ ID NO: 450272 - DNA, 25 bp, Homo sapien
ggctgctatatatcctgactggttt

SEQ ID NO: 450273 - DNA, 25 bp, Homo sapien
tgactggtttctctatccctagtct

SEQ ID NO: 450274 - DNA, 25 bp, Homo sapien
tatccctagtctcatttcagatcca

SEQ ID NO: 450275 - DNA, 25 bp, Homo sapien
gtctcatttcagatccattctcaac

SEQ ID NO: 450276 - DNA, 25 bp, Homo sapien
atccattctcaacactcctttagaa

SEQ ID NO: 450277 - DNA, 25 bp, Homo sapien
aaatctgagtttccacttctgctac

SEQ ID NO: 450278 - DNA, 25 bp, Homo sapien
tgctactggcagaatagttcctata

SEQ ID NO: 450279 - DNA, 25 bp, Homo sapien
gaatagttcctataagaccaaccct

SEQ ID NO: 450280 - DNA, 25 bp, Homo sapien
ctataagaccaacccttccacaaat

SEQ ID NO: 450281 - DNA, 25 bp, Homo sapien
tcttttattgactaccataaacatt

SEQ ID NO: 450282 - DNA, 25 bp, Homo sapien
ttgaaccacccctctaatttattca

SEQ ID NO: 450283 - DNA, 25 bp, Homo sapien
gaaccacccctctaatttattcatc

SEQ ID NO: 450284 - DNA, 25 bp, Homo sapien
ccacccctctaatttattcatctta

SEQ ID NO: 450285 - DNA, 25 bp, Homo sapien
acccctctaatttattcatcttagt

SEQ ID NO: 450286 - DNA, 25 bp, Homo sapien
tattcatcttagttctgaaaacatg

SEQ ID NO: 450287 - DNA, 25 bp, Homo sapien
gagttaatcatgttactgaatctaa

SEQ ID NO: 450288 - DNA, 25 bp, Homo sapien
atcatgttactgaatctaatttaaa

SEQ ID NO: 450289 - DNA, 25 bp, Homo sapien
gtgagagggaaagtactgaatattt

SEQ ID NO: 450290 - DNA, 25 bp, Homo sapien
gataatttgcatcaatcaacagaat

SEQ ID NO: 450291 - DNA, 25 bp, Homo sapien
tttgcatcaatcaacagaatagaag

SEQ ID NO: 450292 - DNA, 25 bp, Homo sapien
aaatacgtgtttgcattccatagag

SEQ ID NO: 450293 - DNA, 25 bp, Homo sapien
attccatagaggtctgctcaccaac

SEQ ID NO: 450294 - DNA, 25 bp, Homo sapien
tttaagcctcattgacataagtcgt

SEQ ID NO: 450295 - DNA, 25 bp, Homo sapien
gtcgtttcttgattgaactcttcag

SEQ ID NO: 450296 - DNA, 25 bp, Homo sapien
acactggaatttctgtagttgtctt

SEQ ID NO: 450297 - DNA, 25 bp, Homo sapien
gtagttgtcttgaaagctgcatgtc

SEQ ID NO: 450298 - DNA, 25 bp, Homo sapien
agctgcatgtcacatcactgtacac

SEQ ID NO: 450299 - DNA, 25 bp, Homo sapien
ggtattactcatgcaccgtggatag

SEQ ID NO: 450300 - DNA, 25 bp, Homo sapien
gatagtgatttctgtgtcgttttca

SEQ ID NO: 450301 - DNA, 25 bp, Homo sapien
gcagttacagtatttccgaagttgg

SEQ ID NO: 450302 - DNA, 25 bp, Homo sapien
ggagttctctttgtaggcctttcaa

SEQ ID NO: 450303 - DNA, 25 bp, Homo sapien
ggtgcccatgatgggctgtgcaaaa

SEQ ID NO: 450304 - DNA, 25 bp, Homo sapien
gcaaaagtggtggtgagatttctcc

SEQ ID NO: 450305 - DNA, 25 bp, Homo sapien
gtggtgagatttctccaccttcacg

SEQ ID NO: 450306 - DNA, 25 bp, Homo sapien
agatttctccaccttcacggaggtg

SEQ ID NO: 450307 - DNA, 25 bp, Homo sapien
caccttcacggaggtggtacccagg

SEQ ID NO: 450308 - DNA, 25 bp, Homo sapien
tggacttcagcagcgagaatgggct

SEQ ID NO: 450309 - DNA, 25 bp, Homo sapien
gattcaggctcagtgtatgcccaca

SEQ ID NO: 450310 - DNA, 25 bp, Homo sapien
tgttcgagaccatgggagaccctgt

SEQ ID NO: 450311 - DNA, 25 bp, Homo sapien
gtgtatgcccacagttctttggcaa

SEQ ID NO: 450312 - DNA, 25 bp, Homo sapien
atgcccacagttctttggcaaaccc

SEQ ID NO: 450313 - DNA, 25 bp, Homo sapien
atcgggtcctgatgggtgcccatga

SEQ ID NO: 450314 - DNA, 25 bp, Homo sapien
gagcaagatgtgttttcccaggatg

SEQ ID NO: 450315 - DNA, 25 bp, Homo sapien
gaggaaaggaaggttagcccacact

SEQ ID NO: 450316 - DNA, 25 bp, Homo sapien
aaaggaaggttagcccacactgctg

SEQ ID NO: 450317 - DNA, 25 bp, Homo sapien
gaagggaaaccatgatacttttgta

SEQ ID NO: 450318 - DNA, 25 bp, Homo sapien
gatacttttgtagtcgaaggcctaa

SEQ ID NO: 450319 - DNA, 25 bp, Homo sapien
ttttgtagtcgaaggcctaactggg

SEQ ID NO: 450320 - DNA, 25 bp, Homo sapien
tgcttcctttccactgggagtgcca

SEQ ID NO: 450321 - DNA, 25 bp, Homo sapien
ttcctttccactgggagtgccagaa

SEQ ID NO: 450322 - DNA, 25 bp, Homo sapien
tttccactgggagtgccagaaatca

SEQ ID NO: 450323 - DNA, 25 bp, Homo sapien
ccagaaatcacagggcagcagtcgc

SEQ ID NO: 450324 - DNA, 25 bp, Homo sapien
aaatcacagggcagcagtcgctcac

SEQ ID NO: 450325 - DNA, 25 bp, Homo sapien
acacccctgacagcaatgtgttgca

SEQ ID NO: 450326 - DNA, 25 bp, Homo sapien
aatgtgttgcacttggctcactcca

SEQ ID NO: 450327 - DNA, 25 bp, Homo sapien
gaaaatatcaggatcccactgggat

SEQ ID NO: 450328 - DNA, 25 bp, Homo sapien
atcccactgggatcccgtaaattga

SEQ ID NO: 450329 - DNA, 25 bp, Homo sapien
aacaaggtcttggtcctccagtaag

SEQ ID NO: 450330 - DNA, 25 bp, Homo sapien
aatttgtgttcctgattccttaatc

SEQ ID NO: 450331 - DNA, 25 bp, Homo sapien
ttaatccccaagaaaggtccctctg

SEQ ID NO: 450332 - DNA, 25 bp, Homo sapien
agaaaggtccctctgctaacattca

SEQ ID NO: 450333 - DNA, 25 bp, Homo sapien
tgctaacattcacatatctcttcct

SEQ ID NO: 450334 - DNA, 25 bp, Homo sapien
atatctcttcctagccaaagtctgt

SEQ ID NO: 450335 - DNA, 25 bp, Homo sapien
aaagtctgtccatttcaaccctcta

SEQ ID NO: 450336 - DNA, 25 bp, Homo sapien
gttcgtccataccaccctgtgaata

SEQ ID NO: 450337 - DNA, 25 bp, Homo sapien
tcgtccataccaccctgtgaataat

SEQ ID NO: 450338 - DNA, 25 bp, Homo sapien
gtccataccaccctgtgaataattt

SEQ ID NO: 450339 - DNA, 25 bp, Homo sapien
tttgtatcctacagtttatatatta

SEQ ID NO: 450340 - DNA, 25 bp, Homo sapien
gtatcctacagtttatatattaagt

SEQ ID NO: 450341 - DNA, 25 bp, Homo sapien
aagttataatcagtttacttgacaa

SEQ ID NO: 450342 - DNA, 25 bp, Homo sapien
gtttacttgacaactacttctccac

SEQ ID NO: 450343 - DNA, 25 bp, Homo sapien
tttacttgacaactacttctccact

SEQ ID NO: 450344 - DNA, 25 bp, Homo sapien
ttacttgacaactacttctccactc

SEQ ID NO: 450345 - DNA, 25 bp, Homo sapien
tttttattctctcagtgtttgttat

SEQ ID NO: 450346 - DNA, 25 bp, Homo sapien
ttttattctctcagtgtttgttatt

SEQ ID NO: 450347 - DNA, 25 bp, Homo sapien
gaaaagcaagatcaacctaccaagg

SEQ ID NO: 450348 - DNA, 25 bp, Homo sapien
acctaccaaggaagagttgatggag

SEQ ID NO: 450349 - DNA, 25 bp, Homo sapien
taattttcctacttaacacccactg

SEQ ID NO: 450350 - DNA, 25 bp, Homo sapien
ctacttaacacccactgcaaattta

SEQ ID NO: 450351 - DNA, 25 bp, Homo sapien
atttaaatatgtgttctagggctgt

SEQ ID NO: 450352 - DNA, 25 bp, Homo sapien
gttctagggctgtttgttaattcta

SEQ ID NO: 450353 - DNA, 25 bp, Homo sapien
gttaattctattatggtctttacta

SEQ ID NO: 450354 - DNA, 25 bp, Homo sapien
ggtctttactaattgtgattcccag

SEQ ID NO: 450355 - DNA, 25 bp, Homo sapien
gtaattgtgatcaacactatgcttg

SEQ ID NO: 450356 - DNA, 25 bp, Homo sapien
aaagctatttctaccaccatgatgt

SEQ ID NO: 450357 - DNA, 25 bp, Homo sapien
atttctaccaccatgatgtttacaa

SEQ ID NO: 450358 - DNA, 25 bp, Homo sapien
ataagaaccctgaaatttatatagg

SEQ ID NO: 450359 - DNA, 25 bp, Homo sapien
ggagttattctgctaaaaatggtct

SEQ ID NO: 450360 - DNA, 25 bp, Homo sapien
agttattctgctaaaaatggtctta

SEQ ID NO: 450361 - DNA, 25 bp, Homo sapien
taaaaatggtcttagttgtctgaaa

SEQ ID NO: 450362 - DNA, 25 bp, Homo sapien
atggtcttagttgtctgaaaagcca

SEQ ID NO: 450363 - DNA, 25 bp, Homo sapien
gtctgaaaagccagctcttgaacct

SEQ ID NO: 450364 - DNA, 25 bp, Homo sapien
tgaaaagccagctcttgaacctctt

SEQ ID NO: 450365 - DNA, 25 bp, Homo sapien
ctcttgaacctcttcacaacagtat

SEQ ID NO: 450366 - DNA, 25 bp, Homo sapien
gaacctcttcacaacagtatcaaca

SEQ ID NO: 450367 - DNA, 25 bp, Homo sapien
ttcacaacagtatcaacactggctt

SEQ ID NO: 450368 - DNA, 25 bp, Homo sapien
aacagtatcaacactggcttctccc

SEQ ID NO: 450369 - DNA, 25 bp, Homo sapien
actagttttctggtcctcccactag

SEQ ID NO: 450370 - DNA, 25 bp, Homo sapien
ctcccactagcttggtgttcattag

SEQ ID NO: 450371 - DNA, 25 bp, Homo sapien
gtgttcattaggcatgccaactcct

SEQ ID NO: 450372 - DNA, 25 bp, Homo sapien
atgccaactcctattccttttctaa

SEQ ID NO: 450373 - DNA, 25 bp, Homo sapien
ttccttttctaacactctggcttga

SEQ ID NO: 450374 - DNA, 25 bp, Homo sapien
actctggcttgattggttacctaac

SEQ ID NO: 450375 - DNA, 25 bp, Homo sapien
ggtggacctggaaattgatcttatt

SEQ ID NO: 450376 - DNA, 25 bp, Homo sapien
aaaggaatgccatagtcgcaacagt

SEQ ID NO: 450377 - DNA, 25 bp, Homo sapien
gtcgcaacagtggttttgtagacaa

SEQ ID NO: 450378 - DNA, 25 bp, Homo sapien
gtagacaaacctgggttcaattcat

SEQ ID NO: 450379 - DNA, 25 bp, Homo sapien
aatgataaccatttgcccaagccaa

SEQ ID NO: 450380 - DNA, 25 bp, Homo sapien
atctgactcgggtgacccccatggg

SEQ ID NO: 450381 - DNA, 25 bp, Homo sapien
ggaaacccgtgaaggctgcgcctgt

SEQ ID NO: 450382 - DNA, 25 bp, Homo sapien
aaggctgcgcctgtgaggtcttcaa

SEQ ID NO: 450383 - DNA, 25 bp, Homo sapien
gcgcctgtgaggtcttcaacttggg

SEQ ID NO: 450384 - DNA, 25 bp, Homo sapien
gggaacagtcaaggactcactgaaa

SEQ ID NO: 450385 - DNA, 25 bp, Homo sapien
gtcaaggactcactgaaagccctct

SEQ ID NO: 450386 - DNA, 25 bp, Homo sapien
tgaaagccctctcctcttgtgtctg

SEQ ID NO: 450387 - DNA, 25 bp, Homo sapien
agccctctcctcttgtgtctgtggg

SEQ ID NO: 450388 - DNA, 25 bp, Homo sapien
tgtgggcaggccgattagctggaag

SEQ ID NO: 450389 - DNA, 25 bp, Homo sapien
cgattagctggaagggccgggctct

SEQ ID NO: 450390 - DNA, 25 bp, Homo sapien
agaggctgcaattcccagggcctgg

SEQ ID NO: 450391 - DNA, 25 bp, Homo sapien
actgtttaggcattgtaatacttta

SEQ ID NO: 450392 - DNA, 25 bp, Homo sapien
gttgtgaaataacagtccttcccaa

SEQ ID NO: 450393 - DNA, 25 bp, Homo sapien
gtgaaataacagtccttcccaaggg

SEQ ID NO: 450394 - DNA, 25 bp, Homo sapien
aaacactgtgtacttggagaaatga

SEQ ID NO: 450395 - DNA, 25 bp, Homo sapien
gattgatttattattggcatgctta

SEQ ID NO: 450396 - DNA, 25 bp, Homo sapien
tgatttattattggcatgcttagtt

SEQ ID NO: 450397 - DNA, 25 bp, Homo sapien
gttttaaacctgagtttgccaactg

SEQ ID NO: 450398 - DNA, 25 bp, Homo sapien
taaacctgagtttgccaactgtatg

SEQ ID NO: 450399 - DNA, 25 bp, Homo sapien
acctgagtttgccaactgtatgttt

SEQ ID NO: 450400 - DNA, 25 bp, Homo sapien
gagtttgccaactgtatgtttttta

SEQ ID NO: 450401 - DNA, 25 bp, Homo sapien
gtttgccaactgtatgttttttaat

SEQ ID NO: 450402 - DNA, 25 bp, Homo sapien
taaggtgacaaacatcacaccaaag

SEQ ID NO: 450403 - DNA, 25 bp, Homo sapien
ccaaagatgagggtagcgagcaact

SEQ ID NO: 450404 - DNA, 25 bp, Homo sapien
tagcgagcaactggcttgagcagac

SEQ ID NO: 450405 - DNA, 25 bp, Homo sapien
gcaactggcttgagcagacagaacg

SEQ ID NO: 450406 - DNA, 25 bp, Homo sapien
accctgccctgaggtccttgtgtgg

SEQ ID NO: 450407 - DNA, 25 bp, Homo sapien
cccgcaaacaatggtgtgtgcgttt

SEQ ID NO: 450408 - DNA, 25 bp, Homo sapien
ggtgtgtgcgtttttacagcccttt

SEQ ID NO: 450409 - DNA, 25 bp, Homo sapien
tgtgcgtttttacagccctttttag

SEQ ID NO: 450410 - DNA, 25 bp, Homo sapien
tttttaggaacccaatatgggcata

SEQ ID NO: 450411 - DNA, 25 bp, Homo sapien
ggcataaatgtaacacctgtagcgg

SEQ ID NO: 450412 - DNA, 25 bp, Homo sapien
ggcagattctctgtatgttcagtta

SEQ ID NO: 450413 - DNA, 25 bp, Homo sapien
ggaatatggcatactttgtttaaaa

SEQ ID NO: 450414 - DNA, 25 bp, Homo sapien
tacttgcaattcatacacagaactt

SEQ ID NO: 450415 - DNA, 25 bp, Homo sapien
atagtttttcatctctaagccctca

SEQ ID NO: 450416 - DNA, 25 bp, Homo sapien
atctctaagccctcaaagactcgtt

SEQ ID NO: 450417 - DNA, 25 bp, Homo sapien
caaagactcgttttgttcctctgct

SEQ ID NO: 450418 - DNA, 25 bp, Homo sapien
ccactgcgtaatccgtctttgggaa

SEQ ID NO: 450419 - DNA, 25 bp, Homo sapien
gaatagcttgtaaatgccctgggta

SEQ ID NO: 450420 - DNA, 25 bp, Homo sapien
gccctgggtattgtgaacctctgaa

SEQ ID NO: 450421 - DNA, 25 bp, Homo sapien
aacctctgaagttgaaatctcacaa

SEQ ID NO: 450422 - DNA, 25 bp, Homo sapien
aatctcacaatgcatctctaggtgc

SEQ ID NO: 450423 - DNA, 25 bp, Homo sapien
atctctaggtgctaagtgcatttct

SEQ ID NO: 450424 - DNA, 25 bp, Homo sapien
ggagcccactgaggaaaaacgtcaa

SEQ ID NO: 450425 - DNA, 25 bp, Homo sapien
tttccaccatcttgattctttctct

SEQ ID NO: 450426 - DNA, 25 bp, Homo sapien
ttcaagggcctgacatggaagcttt

SEQ ID NO: 450427 - DNA, 25 bp, Homo sapien
gggcctgacatggaagcttttcaac

SEQ ID NO: 450428 - DNA, 25 bp, Homo sapien
tctttctctctgactgaggctcacg

SEQ ID NO: 450429 - DNA, 25 bp, Homo sapien
tttctctctgactgaggctcacgtg

SEQ ID NO: 450430 - DNA, 25 bp, Homo sapien
ctctgactgaggctcacgtgggaaa

SEQ ID NO: 450431 - DNA, 25 bp, Homo sapien
tgactgaggctcacgtgggaaatat

SEQ ID NO: 450432 - DNA, 25 bp, Homo sapien
actgaggctcacgtgggaaatatga

SEQ ID NO: 450433 - DNA, 25 bp, Homo sapien
tcacgtgggaaatatgagtgagcat

SEQ ID NO: 450434 - DNA, 25 bp, Homo sapien
gaacaagatcccaatcctcagaaag

SEQ ID NO: 450435 - DNA, 25 bp, Homo sapien
aatacctctccctgaaaggtgagct

SEQ ID NO: 450436 - DNA, 25 bp, Homo sapien
aaggtgagctgctattttaggaaac

SEQ ID NO: 450437 - DNA, 25 bp, Homo sapien
gctgctattttaggaaactggacca

SEQ ID NO: 450438 - DNA, 25 bp, Homo sapien
aaactggaccagacaccaacttggg

SEQ ID NO: 450439 - DNA, 25 bp, Homo sapien
taagtcaaacaacctcaaacccatc

SEQ ID NO: 450440 - DNA, 25 bp, Homo sapien
caaacccatctcttcctgtgtaggg

SEQ ID NO: 450441 - DNA, 25 bp, Homo sapien
gggtgcaagcctctgaagctctcac

SEQ ID NO: 450442 - DNA, 25 bp, Homo sapien
tcccacccttagtctgcatggaaaa

SEQ ID NO: 450443 - DNA, 25 bp, Homo sapien
cacccttagtctgcatggaaaatgt

SEQ ID NO: 450444 - DNA, 25 bp, Homo sapien
cttagtctgcatggaaaatgtactg

SEQ ID NO: 450445 - DNA, 25 bp, Homo sapien
gttcctgcttttctgagtcagattt

SEQ ID NO: 450446 - DNA, 25 bp, Homo sapien
agcagcacatcctcagacttgtcaa

SEQ ID NO: 450447 - DNA, 25 bp, Homo sapien
gcacatcctcagacttgtcaattta

SEQ ID NO: 450448 - DNA, 25 bp, Homo sapien
atcctcagacttgtcaatttatcaa

SEQ ID NO: 450449 - DNA, 25 bp, Homo sapien
gacttgtcaatttatcaaaaactag

SEQ ID NO: 450450 - DNA, 25 bp, Homo sapien
aactagagattggagacagggagac

SEQ ID NO: 450451 - DNA, 25 bp, Homo sapien
gagaccagataggaggccaggttca

SEQ ID NO: 450452 - DNA, 25 bp, Homo sapien
aggaggccaggttcaatcgcctcat

SEQ ID NO: 450453 - DNA, 25 bp, Homo sapien
aggttcaatcgcctcattgcagcta

SEQ ID NO: 450454 - DNA, 25 bp, Homo sapien
gttcaatcgcctcattgcagctact

SEQ ID NO: 450455 - DNA, 25 bp, Homo sapien
agctgtgatgcgtcattacacttca

SEQ ID NO: 450456 - DNA, 25 bp, Homo sapien
tgtgatgcgtcattacacttcagcc

SEQ ID NO: 450457 - DNA, 25 bp, Homo sapien
gcgtcgacgagcacaagatcacaat

SEQ ID NO: 450458 - DNA, 25 bp, Homo sapien
gagcacaagatcacaattaaccata

SEQ ID NO: 450459 - DNA, 25 bp, Homo sapien
acacatcttactgtgtgaggtcatt

SEQ ID NO: 450460 - DNA, 25 bp, Homo sapien
gtcattgagcaatacaggagggatt

SEQ ID NO: 450461 - DNA, 25 bp, Homo sapien
tatacattttagcaactatcttcaa

SEQ ID NO: 450462 - DNA, 25 bp, Homo sapien
ttagcaactatcttcaaaacctgag

SEQ ID NO: 450463 - DNA, 25 bp, Homo sapien
aactatcttcaaaacctgagctata

SEQ ID NO: 450464 - DNA, 25 bp, Homo sapien
ctgagctatagttgtattctgcccc

SEQ ID NO: 450465 - DNA, 25 bp, Homo sapien
cttcctctgggcaaaagtgtaaaag

SEQ ID NO: 450466 - DNA, 25 bp, Homo sapien
aagtgtaaaagtttgctgctacaaa

SEQ ID NO: 450467 - DNA, 25 bp, Homo sapien
gtttgctgctacaaagaatacagaa

SEQ ID NO: 450468 - DNA, 25 bp, Homo sapien
tctctataaaagtacaaaagggcat

SEQ ID NO: 450469 - DNA, 25 bp, Homo sapien
tactcagtaggctggagcgggagaa

SEQ ID NO: 450470 - DNA, 25 bp, Homo sapien
agcgtgggcgacagcaagagacttc

SEQ ID NO: 450471 - DNA, 25 bp, Homo sapien
cgtgggcgacagcaagagacttcat

SEQ ID NO: 450472 - DNA, 25 bp, Homo sapien
gggcgacagcaagagacttcatttc

SEQ ID NO: 450473 - DNA, 25 bp, Homo sapien
gacagcaagagacttcatttcgata

SEQ ID NO: 450474 - DNA, 25 bp, Homo sapien
gcaagagacttcatttcgataaata

SEQ ID NO: 450475 - DNA, 25 bp, Homo sapien
aataaagtctgaagctccactggtc

SEQ ID NO: 450476 - DNA, 25 bp, Homo sapien
aaagtctgaagctccactggtcact

SEQ ID NO: 450477 - DNA, 25 bp, Homo sapien
gaagctccactggtcactcctttta

SEQ ID NO: 450478 - DNA, 25 bp, Homo sapien
tccactggtcactccttttattgat

SEQ ID NO: 450479 - DNA, 25 bp, Homo sapien
cagcgattgctaagttaaatatata

SEQ ID NO: 450480 - DNA, 25 bp, Homo sapien
gggccttgtgagttgaaacaaaaat

SEQ ID NO: 450481 - DNA, 25 bp, Homo sapien
ataatcaaacctggaacactttcca

SEQ ID NO: 450482 - DNA, 25 bp, Homo sapien
ggaacactttccatttattgtatta

SEQ ID NO: 450483 - DNA, 25 bp, Homo sapien
gtattagatatcttcatttcaataa

SEQ ID NO: 450484 - DNA, 25 bp, Homo sapien
aattttattgtcctcctagttcaag

SEQ ID NO: 450485 - DNA, 25 bp, Homo sapien
gtcctcctagttcaagtggtattct

SEQ ID NO: 450486 - DNA, 25 bp, Homo sapien
tcaagtggtattctacttttatttc

SEQ ID NO: 450487 - DNA, 25 bp, Homo sapien
tagggaaagggtaaacttgcattat

SEQ ID NO: 450488 - DNA, 25 bp, Homo sapien
ataagtttgtattttctcacgaagg

SEQ ID NO: 450489 - DNA, 25 bp, Homo sapien
tgtattttctcacgaagggacagga

SEQ ID NO: 450490 - DNA, 25 bp, Homo sapien
attctccacctgttacatcgttcac

SEQ ID NO: 450491 - DNA, 25 bp, Homo sapien
ttacatcgttcactggaactttcct

SEQ ID NO: 450492 - DNA, 25 bp, Homo sapien
tttcctacaaaatacagcctcgctg

SEQ ID NO: 450493 - DNA, 25 bp, Homo sapien
cgtggaaaaatgaagcagcctgaag

SEQ ID NO: 450494 - DNA, 25 bp, Homo sapien
ctctaatattgggaccgagtggaga

SEQ ID NO: 450495 - DNA, 25 bp, Homo sapien
ggaagagcatcatcagagtggtgcc

SEQ ID NO: 450496 - DNA, 25 bp, Homo sapien
aggcgtcccaggcagcattgctctt

SEQ ID NO: 450497 - DNA, 25 bp, Homo sapien
aggcagcattgctctttgtacatga

SEQ ID NO: 450498 - DNA, 25 bp, Homo sapien
tttgtacatgagacaggataccact

SEQ ID NO: 450499 - DNA, 25 bp, Homo sapien
acaggataccactgtcttttatgca

SEQ ID NO: 450500 - DNA, 25 bp, Homo sapien
tttatgcattagactggtaaccaga

SEQ ID NO: 450501 - DNA, 25 bp, Homo sapien
aactgcgggacgtgattgagtctca

SEQ ID NO: 450502 - DNA, 25 bp, Homo sapien
gagtctcaggaggaactaatccacc

SEQ ID NO: 450503 - DNA, 25 bp, Homo sapien
ggaggaactaatccaccagctgagg

SEQ ID NO: 450504 - DNA, 25 bp, Homo sapien
caccagctgaggaacgtgatggttc

SEQ ID NO: 450505 - DNA, 25 bp, Homo sapien
aacgtgatggttctccaggacgaaa

SEQ ID NO: 450506 - DNA, 25 bp, Homo sapien
gttctccaggacgaaaattttgtca

SEQ ID NO: 450507 - DNA, 25 bp, Homo sapien
ttgtcagtaaagaagagttccaggc

SEQ ID NO: 450508 - DNA, 25 bp, Homo sapien
aaagctgcccatgccaaaaccaagg

SEQ ID NO: 450509 - DNA, 25 bp, Homo sapien
agaagttacagtttgccctcggaga

SEQ ID NO: 450510 - DNA, 25 bp, Homo sapien
tacagtttgccctcggagaggtaga

SEQ ID NO: 450511 - DNA, 25 bp, Homo sapien
tagaggtgctatccaagcagctgga

SEQ ID NO: 450512 - DNA, 25 bp, Homo sapien
tatgatacataaagaccactaggtc

SEQ ID NO: 450513 - DNA, 25 bp, Homo sapien
cataaagaccactaggtcaacttaa

SEQ ID NO: 450514 - DNA, 25 bp, Homo sapien
tgtaaaaacactgttgatttgcaat

SEQ ID NO: 450515 - DNA, 25 bp, Homo sapien
tttgcaattctgtctttccatagaa

SEQ ID NO: 450516 - DNA, 25 bp, Homo sapien
gcaattctgtctttccatagaaatg

SEQ ID NO: 450517 - DNA, 25 bp, Homo sapien
tctgtctttccatagaaatgaactt

SEQ ID NO: 450518 - DNA, 25 bp, Homo sapien
agaaatgaactttttctatcgaaat

SEQ ID NO: 450519 - DNA, 25 bp, Homo sapien
aattcatccttatatatacccctta

SEQ ID NO: 450520 - DNA, 25 bp, Homo sapien
tataccccttaatcacgtagtcatg

SEQ ID NO: 450521 - DNA, 25 bp, Homo sapien
accccttaatcacgtagtcatgaga

SEQ ID NO: 450522 - DNA, 25 bp, Homo sapien
gtcatgagaagataactttgctttc

SEQ ID NO: 450523 - DNA, 25 bp, Homo sapien
atttccgttagaatagggacatcct

SEQ ID NO: 450524 - DNA, 25 bp, Homo sapien
agggacatcctacttaagagttggt

SEQ ID NO: 450525 - DNA, 25 bp, Homo sapien
tcctacttaagagttggtgcagctc

SEQ ID NO: 450526 - DNA, 25 bp, Homo sapien
agttggtgcagctccaaggagctga

SEQ ID NO: 450527 - DNA, 25 bp, Homo sapien
aggagctgacttgtccttgcttggg

SEQ ID NO: 450528 - DNA, 25 bp, Homo sapien
accttctcaagtttccatggccttt

SEQ ID NO: 450529 - DNA, 25 bp, Homo sapien
ttctcaagtttccatggcctttgtg

SEQ ID NO: 450530 - DNA, 25 bp, Homo sapien
agtttccatggcctttgtgtgttct

SEQ ID NO: 450531 - DNA, 25 bp, Homo sapien
ggtgtggactcatcaatttccgtta

SEQ ID NO: 450532 - DNA, 25 bp, Homo sapien
gtggactcatcaatttccgttagaa

SEQ ID NO: 450533 - DNA, 25 bp, Homo sapien
gactcatcaatttccgttagaatag

SEQ ID NO: 450534 - DNA, 25 bp, Homo sapien
tcccgcgggcctgttttcaggtgtt

SEQ ID NO: 450535 - DNA, 25 bp, Homo sapien
gcctgttttcaggtgttcctagcat

SEQ ID NO: 450536 - DNA, 25 bp, Homo sapien
gttttcaggtgttcctagcatttct

SEQ ID NO: 450537 - DNA, 25 bp, Homo sapien
tcaggtgttcctagcatttctgcct

SEQ ID NO: 450538 - DNA, 25 bp, Homo sapien
tgttcctagcatttctgcctccagg

SEQ ID NO: 450539 - DNA, 25 bp, Homo sapien
ctttgggagagacacctggcctttt

SEQ ID NO: 450540 - DNA, 25 bp, Homo sapien
ccagcttggcagatgggctgcatgc

SEQ ID NO: 450541 - DNA, 25 bp, Homo sapien
agatgggctgcatgcggcgctccct

SEQ ID NO: 450542 - DNA, 25 bp, Homo sapien
tggcagacttcacacctcattgctt

SEQ ID NO: 450543 - DNA, 25 bp, Homo sapien
agacttcacacctcattgctttacc

SEQ ID NO: 450544 - DNA, 25 bp, Homo sapien
ggaaatgtctgtactttgggaagtc

SEQ ID NO: 450545 - DNA, 25 bp, Homo sapien
aaaatgacaacacagtcgacctgag

SEQ ID NO: 450546 - DNA, 25 bp, Homo sapien
atgacaacacagtcgacctgagcta

SEQ ID NO: 450547 - DNA, 25 bp, Homo sapien
gacaacacagtcgacctgagctata

SEQ ID NO: 450548 - DNA, 25 bp, Homo sapien
aacacagtcgacctgagctataaga

SEQ ID NO: 450549 - DNA, 25 bp, Homo sapien
acagtcgacctgagctataagaagt

SEQ ID NO: 450550 - DNA, 25 bp, Homo sapien
gtcgacctgagctataagaagtgct

SEQ ID NO: 450551 - DNA, 25 bp, Homo sapien
gacctgagctataagaagtgctaaa

SEQ ID NO: 450552 - DNA, 25 bp, Homo sapien
ttctttacaatacccacaatggatt

SEQ ID NO: 450553 - DNA, 25 bp, Homo sapien
caatacccacaatggattaatacaa

SEQ ID NO: 450554 - DNA, 25 bp, Homo sapien
aattgtaacagtcttatggagtttc

SEQ ID NO: 450555 - DNA, 25 bp, Homo sapien
aacagtcttatggagtttctaatgt

SEQ ID NO: 450556 - DNA, 25 bp, Homo sapien
caaggcgtaaatagccccctgtgga

SEQ ID NO: 450557 - DNA, 25 bp, Homo sapien
tgtggactggatgttctgactcctg

SEQ ID NO: 450558 - DNA, 25 bp, Homo sapien
gatgttctgactcctggatggcctc

SEQ ID NO: 450559 - DNA, 25 bp, Homo sapien
tggcctccagaaggatgccttttac

SEQ ID NO: 450560 - DNA, 25 bp, Homo sapien
aggatgccttttacggtctgtgaaa

SEQ ID NO: 450561 - DNA, 25 bp, Homo sapien
agctcagggaccaagatgctcaaag

SEQ ID NO: 450562 - DNA, 25 bp, Homo sapien
ggaccaagatgctcaaagcccttca

SEQ ID NO: 450563 - DNA, 25 bp, Homo sapien
gacaaaaaccacactcaaatcatta

SEQ ID NO: 450564 - DNA, 25 bp, Homo sapien
tcctcaggctgggacacgggaagca

SEQ ID NO: 450565 - DNA, 25 bp, Homo sapien
ggaactcgtgactgtgtatgggcac

SEQ ID NO: 450566 - DNA, 25 bp, Homo sapien
attagtgtacggtatgcactgctca

SEQ ID NO: 450567 - DNA, 25 bp, Homo sapien
aaaattctaagtctcccgcctaatg

SEQ ID NO: 450568 - DNA, 25 bp, Homo sapien
aatgctgctgtggtgtgtcatgcca

SEQ ID NO: 450569 - DNA, 25 bp, Homo sapien
agtgggctactcaggttagaccaat

SEQ ID NO: 450570 - DNA, 25 bp, Homo sapien
tatttacaagaacagctggtgggcc

SEQ ID NO: 450571 - DNA, 25 bp, Homo sapien
gaccaatgacttcagaaccacaggg

SEQ ID NO: 450572 - DNA, 25 bp, Homo sapien
aaggagcttctttctgcagagctga

SEQ ID NO: 450573 - DNA, 25 bp, Homo sapien
agagctgattcctggaaagccacca

SEQ ID NO: 450574 - DNA, 25 bp, Homo sapien
gggtcatagtttattatcccttgag

SEQ ID NO: 450575 - DNA, 25 bp, Homo sapien
tattatcccttgagctaggctgctg

SEQ ID NO: 450576 - DNA, 25 bp, Homo sapien
taggctgctgcctgaggttgattca

SEQ ID NO: 450577 - DNA, 25 bp, Homo sapien
aggttgattcaacatcccagctcca

SEQ ID NO: 450578 - DNA, 25 bp, Homo sapien
tttcttaccctctaaatggtcgcat

SEQ ID NO: 450579 - DNA, 25 bp, Homo sapien
cttaccctctaaatggtcgcatttc

SEQ ID NO: 450580 - DNA, 25 bp, Homo sapien
taaatggtcgcatttccctttcact

SEQ ID NO: 450581 - DNA, 25 bp, Homo sapien
atggtcgcatttccctttcacttac

SEQ ID NO: 450582 - DNA, 25 bp, Homo sapien
gaccatgtattgagttacaccactg

SEQ ID NO: 450583 - DNA, 25 bp, Homo sapien
gtattgagttacaccactgaatctg

SEQ ID NO: 450584 - DNA, 25 bp, Homo sapien
gagttacaccactgaatctgtttga

SEQ ID NO: 450585 - DNA, 25 bp, Homo sapien
gttacaccactgaatctgtttgaat

SEQ ID NO: 450586 - DNA, 25 bp, Homo sapien
gtattagtttgaaattagagcagct

SEQ ID NO: 450587 - DNA, 25 bp, Homo sapien
aaattagagcagctaacacactggg

SEQ ID NO: 450588 - DNA, 25 bp, Homo sapien
aattagctagttcatagacttaaaa

SEQ ID NO: 450589 - DNA, 25 bp, Homo sapien
atttccgttagaatagggacatcct

SEQ ID NO: 450590 - DNA, 25 bp, Homo sapien
agggacatcctacttaagagttggt

SEQ ID NO: 450591 - DNA, 25 bp, Homo sapien
tcctacttaagagttggtgcagctc

SEQ ID NO: 450592 - DNA, 25 bp, Homo sapien
agttggtgcagctccaaggagctga

SEQ ID NO: 450593 - DNA, 25 bp, Homo sapien
aggagctgacttgtccttgcttggg

SEQ ID NO: 450594 - DNA, 25 bp, Homo sapien
accttctcaagtttccatggccttt

SEQ ID NO: 450595 - DNA, 25 bp, Homo sapien
agtttccatggcctttgtgtgttct

SEQ ID NO: 450596 - DNA, 25 bp, Homo sapien
ggcctttgtgtgttctttttatgtt

SEQ ID NO: 450597 - DNA, 25 bp, Homo sapien
atatggttttccacaaatcccttct

SEQ ID NO: 450598 - DNA, 25 bp, Homo sapien
ggtgtggactcatcaatttccgtta

SEQ ID NO: 450599 - DNA, 25 bp, Homo sapien
gtggactcatcaatttccgttagaa

SEQ ID NO: 450600 - DNA, 25 bp, Homo sapien
tattcttgtgatattcaaccagttt

SEQ ID NO: 450601 - DNA, 25 bp, Homo sapien
caaccagttttcatttcataaatca

SEQ ID NO: 450602 - DNA, 25 bp, Homo sapien
aaatcatttctttcttgcactctct

SEQ ID NO: 450603 - DNA, 25 bp, Homo sapien
atttctttcttgcactctctttagt

SEQ ID NO: 450604 - DNA, 25 bp, Homo sapien
tttcttgcactctctttagtaactt

SEQ ID NO: 450605 - DNA, 25 bp, Homo sapien
tgcactctctttagtaacttaattt

SEQ ID NO: 450606 - DNA, 25 bp, Homo sapien
aggaatttttggtcattattatatt

SEQ ID NO: 450607 - DNA, 25 bp, Homo sapien
aatcagagtctcataaaatacataa

SEQ ID NO: 450608 - DNA, 25 bp, Homo sapien
gatgttatcacatatgacaaaggtt

SEQ ID NO: 450609 - DNA, 25 bp, Homo sapien
gacaaaggttgatattaagtatgct

SEQ ID NO: 450610 - DNA, 25 bp, Homo sapien
aaaatctctttgatggctaaaaaag

SEQ ID NO: 450611 - DNA, 25 bp, Homo sapien
aaaatttcagcctaaagcaaagatc

SEQ ID NO: 450612 - DNA, 25 bp, Homo sapien
aagatcttgtttagtttgccagtgc

SEQ ID NO: 450613 - DNA, 25 bp, Homo sapien
gtttgccagtgctatcttagaatca

SEQ ID NO: 450614 - DNA, 25 bp, Homo sapien
taaactaccttgtgcactggttcat

SEQ ID NO: 450615 - DNA, 25 bp, Homo sapien
gtgcactggttcatatttggttcaa

SEQ ID NO: 450616 - DNA, 25 bp, Homo sapien
aattcaaggctctagtaggcttcta

SEQ ID NO: 450617 - DNA, 25 bp, Homo sapien
gggaaataagatgtgcccaggaatt

SEQ ID NO: 450618 - DNA, 25 bp, Homo sapien
tgtgcccaggaatttctaatacagg

SEQ ID NO: 450619 - DNA, 25 bp, Homo sapien
actcagttataatctgcttaatatg

SEQ ID NO: 450620 - DNA, 25 bp, Homo sapien
tgaaatcacattcattactatgctg

SEQ ID NO: 450621 - DNA, 25 bp, Homo sapien
actatgctgagctgataaaatttca

SEQ ID NO: 450622 - DNA, 25 bp, Homo sapien
ccgcaacccggaggctgtaaaaatg

SEQ ID NO: 450623 - DNA, 25 bp, Homo sapien
agaagtgactgttgttaagatagac

SEQ ID NO: 450624 - DNA, 25 bp, Homo sapien
ttaagatagacattgaaggacagca

SEQ ID NO: 450625 - DNA, 25 bp, Homo sapien
ttaggtatcataaagagcatagtct

SEQ ID NO: 450626 - DNA, 25 bp, Homo sapien
gagcatagtctttgaatccaaggtt

SEQ ID NO: 450627 - DNA, 25 bp, Homo sapien
tgaatccaaggttcagtttaccccg

SEQ ID NO: 450628 - DNA, 25 bp, Homo sapien
cagtttaccccgaatctagatgttg

SEQ ID NO: 450629 - DNA, 25 bp, Homo sapien
accccgaatctagatgttggatact

SEQ ID NO: 450630 - DNA, 25 bp, Homo sapien
ctagatgttggatacttcaagagta

SEQ ID NO: 450631 - DNA, 25 bp, Homo sapien
aatatctttgtagtctcattcacag

SEQ ID NO: 450632 - DNA, 25 bp, Homo sapien
gtagtctcattcacagaattcctaa

SEQ ID NO: 450633 - DNA, 25 bp, Homo sapien
atgtgtttctgattccaccgtgaca

SEQ ID NO: 450634 - DNA, 25 bp, Homo sapien
tgtgtttctgattccaccgtgacaa

SEQ ID NO: 450635 - DNA, 25 bp, Homo sapien
gtgtttctgattccaccgtgacaac

SEQ ID NO: 450636 - DNA, 25 bp, Homo sapien
gtttctgattccaccgtgacaacta

SEQ ID NO: 450637 - DNA, 25 bp, Homo sapien
tttctgattccaccgtgacaactac

SEQ ID NO: 450638 - DNA, 25 bp, Homo sapien
tctgattccaccgtgacaactacag

SEQ ID NO: 450639 - DNA, 25 bp, Homo sapien
tgattccaccgtgacaactacagtg

SEQ ID NO: 450640 - DNA, 25 bp, Homo sapien
gattccaccgtgacaactacagtgg

SEQ ID NO: 450641 - DNA, 25 bp, Homo sapien
ttccaccgtgacaactacagtggtg

SEQ ID NO: 450642 - DNA, 25 bp, Homo sapien
tggtgcagtcaaaaagaactacatg

SEQ ID NO: 450643 - DNA, 25 bp, Homo sapien
cagtcaaaaagaactacatgggtgt

SEQ ID NO: 450644 - DNA, 25 bp, Homo sapien
cctctcacacttttgttaagtggct

SEQ ID NO: 450645 - DNA, 25 bp, Homo sapien
tgttaagtggctgcccattaaaggc

SEQ ID NO: 450646 - DNA, 25 bp, Homo sapien
gtggctgcccattaaaggcatgtaa

SEQ ID NO: 450647 - DNA, 25 bp, Homo sapien
aaatctatctgcacaatgaaaggtt

SEQ ID NO: 450648 - DNA, 25 bp, Homo sapien
ggttagtttcattagaatcacctag

SEQ ID NO: 450649 - DNA, 25 bp, Homo sapien
agattacaaagcctcacctgtgaag

SEQ ID NO: 450650 - DNA, 25 bp, Homo sapien
agcctcacctgtgaagctttttatt

SEQ ID NO: 450651 - DNA, 25 bp, Homo sapien
ttggtgtaagaatcagggctctcat

SEQ ID NO: 450652 - DNA, 25 bp, Homo sapien
agaatcagggctctcatcattctca

SEQ ID NO: 450653 - DNA, 25 bp, Homo sapien
catcattctcagtttacccctttct

SEQ ID NO: 450654 - DNA, 25 bp, Homo sapien
gggtttacaacagggctgcctctca

SEQ ID NO: 450655 - DNA, 25 bp, Homo sapien
tcctccaagcctcagagtacttcga

SEQ ID NO: 450656 - DNA, 25 bp, Homo sapien
cctccaagcctcagagtacttcgag

SEQ ID NO: 450657 - DNA, 25 bp, Homo sapien
ctccaagcctcagagtacttcgagt

SEQ ID NO: 450658 - DNA, 25 bp, Homo sapien
tccaagcctcagagtacttcgagtc

SEQ ID NO: 450659 - DNA, 25 bp, Homo sapien
aagcctcagagtacttcgagtctcc

SEQ ID NO: 450660 - DNA, 25 bp, Homo sapien
agcctcagagtacttcgagtctccc

SEQ ID NO: 450661 - DNA, 25 bp, Homo sapien
ctcagagtacttcgagtctcccttc

SEQ ID NO: 450662 - DNA, 25 bp, Homo sapien
tcagagtacttcgagtctcccttcc

SEQ ID NO: 450663 - DNA, 25 bp, Homo sapien
cagagtacttcgagtctcccttccc

SEQ ID NO: 450664 - DNA, 25 bp, Homo sapien
gtacttcgagtctcccttccccatt

SEQ ID NO: 450665 - DNA, 25 bp, Homo sapien
tacttcgagtctcccttccccattt

SEQ ID NO: 450666 - DNA, 25 bp, Homo sapien
ctctgtatttccctcgtgcttcatt

SEQ ID NO: 450667 - DNA, 25 bp, Homo sapien
atttccctcgtgcttcattcctttt

SEQ ID NO: 450668 - DNA, 25 bp, Homo sapien
cctttttatggctctgtaatactcc

SEQ ID NO: 450669 - DNA, 25 bp, Homo sapien
gtaatactccattgcgtgggtagct

SEQ ID NO: 450670 - DNA, 25 bp, Homo sapien
actccattgcgtgggtagctacgtt

SEQ ID NO: 450671 - DNA, 25 bp, Homo sapien
gaacatttcatcttccaaaaaggag

SEQ ID NO: 450672 - DNA, 25 bp, Homo sapien
gctgtggctgccttatagagattgt

SEQ ID NO: 450673 - DNA, 25 bp, Homo sapien
tacaagtttttgttccgtgtccctg

SEQ ID NO: 450674 - DNA, 25 bp, Homo sapien
tttgttccgtgtccctgttgacaaa

SEQ ID NO: 450675 - DNA, 25 bp, Homo sapien
gtccctgttgacaaacctttcttga

SEQ ID NO: 450676 - DNA, 25 bp, Homo sapien
catcttccaaaaaggagaccccatc

SEQ ID NO: 450677 - DNA, 25 bp, Homo sapien
ggacccaagaggcagtgttgctgtc

SEQ ID NO: 450678 - DNA, 25 bp, Homo sapien
tgtccaccttggaatctggctgaac

SEQ ID NO: 450679 - DNA, 25 bp, Homo sapien
accttggaatctggctgaactggct

SEQ ID NO: 450680 - DNA, 25 bp, Homo sapien
gctgctgtgagggatcttggagctt

SEQ ID NO: 450681 - DNA, 25 bp, Homo sapien
ttggagcttccctgtagcccacctt

SEQ ID NO: 450682 - DNA, 25 bp, Homo sapien
ttccccttgcttcatgtttgtagag

SEQ ID NO: 450683 - DNA, 25 bp, Homo sapien
ccttgcttcatgtttgtagaggaac

SEQ ID NO: 450684 - DNA, 25 bp, Homo sapien
ttgtagaggaaccttgtgccggcca

SEQ ID NO: 450685 - DNA, 25 bp, Homo sapien
agaggaaccttgtgccggccaggcc

SEQ ID NO: 450686 - DNA, 25 bp, Homo sapien
agtttccttgtgtgatacactaatg

SEQ ID NO: 450687 - DNA, 25 bp, Homo sapien
tgtgtgatacactaatgtatttgct

SEQ ID NO: 450688 - DNA, 25 bp, Homo sapien
aatactttgtttgaatttctaatca

SEQ ID NO: 450689 - DNA, 25 bp, Homo sapien
ctttgtttgaatttctaatcatcat

SEQ ID NO: 450690 - DNA, 25 bp, Homo sapien
tctaatcatcattcaaaagagcagt

SEQ ID NO: 450691 - DNA, 25 bp, Homo sapien
aatcatcattcaaaagagcagtaaa

SEQ ID NO: 450692 - DNA, 25 bp, Homo sapien
aatggttacttgttcttgtacaagc

SEQ ID NO: 450693 - DNA, 25 bp, Homo sapien
gttcttgtacaagctactaattaga

SEQ ID NO: 450694 - DNA, 25 bp, Homo sapien
tcttgtacaagctactaattagact

SEQ ID NO: 450695 - DNA, 25 bp, Homo sapien
gtacaagctactaattagactatag

SEQ ID NO: 450696 - DNA, 25 bp, Homo sapien
ctaattagactatagtaggatattt

SEQ ID NO: 450697 - DNA, 25 bp, Homo sapien
ggatattttaaagagctgaatcact

SEQ ID NO: 450698 - DNA, 25 bp, Homo sapien
gctgaatcacttttggtattttggt

SEQ ID NO: 450699 - DNA, 25 bp, Homo sapien
gaacagctggacttgcaggtctatc

SEQ ID NO: 450700 - DNA, 25 bp, Homo sapien
gacagttttaggtctggcaggatct

SEQ ID NO: 450701 - DNA, 25 bp, Homo sapien
gcaggtctatcttctgttgtttctc

SEQ ID NO: 450702 - DNA, 25 bp, Homo sapien
aagtagacaagtccatctgatgggt

SEQ ID NO: 450703 - DNA, 25 bp, Homo sapien
ccatctgatgggtgtttagtagggt

SEQ ID NO: 450704 - DNA, 25 bp, Homo sapien
gtagggtatgacttgtgagtccaca

SEQ ID NO: 450705 - DNA, 25 bp, Homo sapien
gtgagtccacaaggccagcagtata

SEQ ID NO: 450706 - DNA, 25 bp, Homo sapien
gtatatatgctgaatggactgctta

SEQ ID NO: 450707 - DNA, 25 bp, Homo sapien
gactgcttagcagtaacacactgga

SEQ ID NO: 450708 - DNA, 25 bp, Homo sapien
gaatgggatctgcatccctgagctt

SEQ ID NO: 450709 - DNA, 25 bp, Homo sapien
gagcttcatccacaaagggtgggaa

SEQ ID NO: 450710 - DNA, 25 bp, Homo sapien
aaaatttattagtctccactggata

SEQ ID NO: 450711 - DNA, 25 bp, Homo sapien
tccactggatattgttaatgaaccc

SEQ ID NO: 450712 - DNA, 25 bp, Homo sapien
ggatattgttaatgaacccattcat

SEQ ID NO: 450713 - DNA, 25 bp, Homo sapien
tgaacccattcattacccttataat

SEQ ID NO: 450714 - DNA, 25 bp, Homo sapien
aaacacttatctcacctttcctgta

SEQ ID NO: 450715 - DNA, 25 bp, Homo sapien
acttatctcacctttcctgtatgag

SEQ ID NO: 450716 - DNA, 25 bp, Homo sapien
ttatctcacctttcctgtatgagat

SEQ ID NO: 450717 - DNA, 25 bp, Homo sapien
gatatattccaagataacccaataa

SEQ ID NO: 450718 - DNA, 25 bp, Homo sapien
gataacccaataactgatgatagaa

SEQ ID NO: 450719 - DNA, 25 bp, Homo sapien
ttcaatagatcaaattataccaagt

SEQ ID NO: 450720 - DNA, 25 bp, Homo sapien
taccaagtatatataactccatgag

SEQ ID NO: 450721 - DNA, 25 bp, Homo sapien
aaagattatgaccttgctctgccag

SEQ ID NO: 450722 - DNA, 25 bp, Homo sapien
ctgccagctgagagcagtgtggcct

SEQ ID NO: 450723 - DNA, 25 bp, Homo sapien
ataccactagctctctgcagtacct

SEQ ID NO: 450724 - DNA, 25 bp, Homo sapien
acaaaagtgcttggtcaactgtcaa

SEQ ID NO: 450725 - DNA, 25 bp, Homo sapien
gaaagatgttcaaatgcacctcaaa

SEQ ID NO: 450726 - DNA, 25 bp, Homo sapien
aaatgcacctcaaatttctcaacat

SEQ ID NO: 450727 - DNA, 25 bp, Homo sapien
ttctcaacattttccaaagccaacc

SEQ ID NO: 450728 - DNA, 25 bp, Homo sapien
atgctttcgggcagcgtcctaaact

SEQ ID NO: 450729 - DNA, 25 bp, Homo sapien
ggcagcgtcctaaactgatgatgac

SEQ ID NO: 450730 - DNA, 25 bp, Homo sapien
gatgatgacaccttgatacttttaa

SEQ ID NO: 450731 - DNA, 25 bp, Homo sapien
acttttaagttgctaaggagtctca

SEQ ID NO: 450732 - DNA, 25 bp, Homo sapien
ctgatctttattagtaggcctcaag

SEQ ID NO: 450733 - DNA, 25 bp, Homo sapien
gtaggcctcaagtgaatccttgctg

SEQ ID NO: 450734 - DNA, 25 bp, Homo sapien
gaatccttgctgacatttaaggttt

SEQ ID NO: 450735 - DNA, 25 bp, Homo sapien
gtttatgacatttccttcacgttcg

SEQ ID NO: 450736 - DNA, 25 bp, Homo sapien
ccttcacgttcgttcttgactggaa

SEQ ID NO: 450737 - DNA, 25 bp, Homo sapien
aaaacattttcagggacatctgcct

SEQ ID NO: 450738 - DNA, 25 bp, Homo sapien
tgcctttattgctccccagatgaga

SEQ ID NO: 450739 - DNA, 25 bp, Homo sapien
tgctccccagatgagagtacagcct

SEQ ID NO: 450740 - DNA, 25 bp, Homo sapien
gagtacagcctgtttcttatgtgtt

SEQ ID NO: 450741 - DNA, 25 bp, Homo sapien
tgtgttccaaagatgatttccctat

SEQ ID NO: 450742 - DNA, 25 bp, Homo sapien
atttccctatcagctttttggtcag

SEQ ID NO: 450743 - DNA, 25 bp, Homo sapien
gagagtggagatatagactgttttc

SEQ ID NO: 450744 - DNA, 25 bp, Homo sapien
tagactgttttctgtattgcataaa

SEQ ID NO: 450745 - DNA, 25 bp, Homo sapien
aaattctactggatagtgctgttta

SEQ ID NO: 450746 - DNA, 25 bp, Homo sapien
gtgctgtttagattgggtatctctc

SEQ ID NO: 450747 - DNA, 25 bp, Homo sapien
gattgggtatctctctcaactacag

SEQ ID NO: 450748 - DNA, 25 bp, Homo sapien
atctctctcaactacaggcagacta

SEQ ID NO: 450749 - DNA, 25 bp, Homo sapien
ctgccagttccacctatactaaaat

SEQ ID NO: 450750 - DNA, 25 bp, Homo sapien
agacgaagcattttctgggcaaaag

SEQ ID NO: 450751 - DNA, 25 bp, Homo sapien
gtaatttgcatgacaaatgtgtcct

SEQ ID NO: 450752 - DNA, 25 bp, Homo sapien
tgtgtccttgaataataactaatag

SEQ ID NO: 450753 - DNA, 25 bp, Homo sapien
atagattgatatcatctgttgtcga

SEQ ID NO: 450754 - DNA, 25 bp, Homo sapien
gacccgcctgtctctgtaggagcct

SEQ ID NO: 450755 - DNA, 25 bp, Homo sapien
tgtctctgtaggagcctccattcgt

SEQ ID NO: 450756 - DNA, 25 bp, Homo sapien
ctctgtaggagcctccattcgtggg

SEQ ID NO: 450757 - DNA, 25 bp, Homo sapien
ggacgtggcttagttgcctggacaa

SEQ ID NO: 450758 - DNA, 25 bp, Homo sapien
acgtggcttagttgcctggacaagc

SEQ ID NO: 450759 - DNA, 25 bp, Homo sapien
cttagttgcctggacaagcggaaat

SEQ ID NO: 450760 - DNA, 25 bp, Homo sapien
ttgcctggacaagcggaaatacatc

SEQ ID NO: 450761 - DNA, 25 bp, Homo sapien
acaagcggaaatacatcctgcctgc

SEQ ID NO: 450762 - DNA, 25 bp, Homo sapien
cttgggcctcagtaggctccaggtg

SEQ ID NO: 450763 - DNA, 25 bp, Homo sapien
caggaagtggctgttcagtggtaaa

SEQ ID NO: 450764 - DNA, 25 bp, Homo sapien
gttcagtggtaaaaagactgtgccg

SEQ ID NO: 450765 - DNA, 25 bp, Homo sapien
gattatgtagtagctacctggatcc

SEQ ID NO: 450766 - DNA, 25 bp, Homo sapien
atgtagtagctacctggatccttaa

SEQ ID NO: 450767 - DNA, 25 bp, Homo sapien
gtagtagctacctggatccttaatg

SEQ ID NO: 450768 - DNA, 25 bp, Homo sapien
gtagctacctggatccttaatgaca

SEQ ID NO: 450769 - DNA, 25 bp, Homo sapien
agctacctggatccttaatgacacc

SEQ ID NO: 450770 - DNA, 25 bp, Homo sapien
ctacctggatccttaatgacaccgg

SEQ ID NO: 450771 - DNA, 25 bp, Homo sapien
acctggatccttaatgacaccgggt

SEQ ID NO: 450772 - DNA, 25 bp, Homo sapien
ctggatccttaatgacaccgggttg

SEQ ID NO: 450773 - DNA, 25 bp, Homo sapien
ggatccttaatgacaccgggttggg

SEQ ID NO: 450774 - DNA, 25 bp, Homo sapien
gatggtgttggtaagataaagagca

SEQ ID NO: 450775 - DNA, 25 bp, Homo sapien
aagagcaaagagtccgggtgtggtg

SEQ ID NO: 450776 - DNA, 25 bp, Homo sapien
ataagggcatggcttacctggctac

SEQ ID NO: 450777 - DNA, 25 bp, Homo sapien
tacctggctactttgattcacagtc

SEQ ID NO: 450778 - DNA, 25 bp, Homo sapien
ttgtcgtcaaggtgttagctgggtt

SEQ ID NO: 450779 - DNA, 25 bp, Homo sapien
tagctgggttggaatctgatctgaa

SEQ ID NO: 450780 - DNA, 25 bp, Homo sapien
gaaagatgcagttctaagctcactt

SEQ ID NO: 450781 - DNA, 25 bp, Homo sapien
aagctcacttatgtggttgttggga

SEQ ID NO: 450782 - DNA, 25 bp, Homo sapien
tgttgggaggattcatttccagaat

SEQ ID NO: 450783 - DNA, 25 bp, Homo sapien
gtttagttgaggtcctcagtttcta

SEQ ID NO: 450784 - DNA, 25 bp, Homo sapien
agtttctacctgtctgtttgtcaaa

SEQ ID NO: 450785 - DNA, 25 bp, Homo sapien
gtctgtttgtcaaagcccactttta

SEQ ID NO: 450786 - DNA, 25 bp, Homo sapien
ttagttttttgtcacatgcacctcc

SEQ ID NO: 450787 - DNA, 25 bp, Homo sapien
gatttaaactgatacacattccaca

SEQ ID NO: 450788 - DNA, 25 bp, Homo sapien
ttgaagtataagcagtcattgcagc

SEQ ID NO: 450789 - DNA, 25 bp, Homo sapien
attgcagcttgatgccagatcatgt

SEQ ID NO: 450790 - DNA, 25 bp, Homo sapien
ggtgctataaattctgattgtttac

SEQ ID NO: 450791 - DNA, 25 bp, Homo sapien
gattctgcttatgctccaaagtgtg

SEQ ID NO: 450792 - DNA, 25 bp, Homo sapien
gctccaaagtgtgcatgatgtattt

SEQ ID NO: 450793 - DNA, 25 bp, Homo sapien
gtattttacgtagtactctgaggaa

SEQ ID NO: 450794 - DNA, 25 bp, Homo sapien
agtactctgaggaagtctctttata

SEQ ID NO: 450795 - DNA, 25 bp, Homo sapien
tctctttataaaacctactaccact

SEQ ID NO: 450796 - DNA, 25 bp, Homo sapien
tactgtaaattcagcttattccaat

SEQ ID NO: 450797 - DNA, 25 bp, Homo sapien
gcttattccaattaggttggcacag

SEQ ID NO: 450798 - DNA, 25 bp, Homo sapien
aaagaatgcttttactatgttagaa

SEQ ID NO: 450799 - DNA, 25 bp, Homo sapien
gaagtgattccagtctttctgttgt

SEQ ID NO: 450800 - DNA, 25 bp, Homo sapien
gattccagtctttctgttgttattc

SEQ ID NO: 450801 - DNA, 25 bp, Homo sapien
tgttattccgatgttttagctattt

SEQ ID NO: 450802 - DNA, 25 bp, Homo sapien
ttttttgtttcattgcctttctaca

SEQ ID NO: 450803 - DNA, 25 bp, Homo sapien
gtttcattgcctttctacataattg

SEQ ID NO: 450804 - DNA, 25 bp, Homo sapien
cattgcctttctacataattggata

SEQ ID NO: 450805 - DNA, 25 bp, Homo sapien
tacataattggataaccttgttagt

SEQ ID NO: 450806 - DNA, 25 bp, Homo sapien
gttagtatctgcagaatgccctgat

SEQ ID NO: 450807 - DNA, 25 bp, Homo sapien
gaatgccctgattaggaaatgtgtt

SEQ ID NO: 450808 - DNA, 25 bp, Homo sapien
taaccctatgtgtcaatttggtata

SEQ ID NO: 450809 - DNA, 25 bp, Homo sapien
taaagatgccatagaaccactaaat

SEQ ID NO: 450810 - DNA, 25 bp, Homo sapien
tttgtcacctctcagccaataatag

SEQ ID NO: 450811 - DNA, 25 bp, Homo sapien
cacctctcagccaataatagtcatt

SEQ ID NO: 450812 - DNA, 25 bp, Homo sapien
gtcattgatatactctccataccac

SEQ ID NO: 450813 - DNA, 25 bp, Homo sapien
gatatactctccataccacaaattt

SEQ ID NO: 450814 - DNA, 25 bp, Homo sapien
gtgaactgtacatgcaatagccaag

SEQ ID NO: 450815 - DNA, 25 bp, Homo sapien
gtacatgcaatagccaagtttattt

SEQ ID NO: 450816 - DNA, 25 bp, Homo sapien
aactttagtcattactggatcccag

SEQ ID NO: 450817 - DNA, 25 bp, Homo sapien
tactggatcccagagattttctttc

SEQ ID NO: 450818 - DNA, 25 bp, Homo sapien
atttatgtcacttcagtatgcccag

SEQ ID NO: 450819 - DNA, 25 bp, Homo sapien
atgtcacttcagtatgcccagtcca

SEQ ID NO: 450820 - DNA, 25 bp, Homo sapien
ttgaacgtctctcacctggctcaat

SEQ ID NO: 450821 - DNA, 25 bp, Homo sapien
ccaatatatttctctctccacaaat

SEQ ID NO: 450822 - DNA, 25 bp, Homo sapien
atcactcattgctttcaactcagga

SEQ ID NO: 450823 - DNA, 25 bp, Homo sapien
agagcgcgagcttcactgtgtacag

SEQ ID NO: 450824 - DNA, 25 bp, Homo sapien
actgtgtacagagtcatctccgagg

SEQ ID NO: 450825 - DNA, 25 bp, Homo sapien
gagtcatctccgagggattacacag

SEQ ID NO: 450826 - DNA, 25 bp, Homo sapien
tccgagggattacacagagtacaac

SEQ ID NO: 450827 - DNA, 25 bp, Homo sapien
agatatctgcggacagttgactgta

SEQ ID NO: 450828 - DNA, 25 bp, Homo sapien
tattgttttcttaagagcatagcct

SEQ ID NO: 450829 - DNA, 25 bp, Homo sapien
ttgcacccacagtcttgtttttgga

SEQ ID NO: 450830 - DNA, 25 bp, Homo sapien
acccacagtcttgtttttggagtgt

SEQ ID NO: 450831 - DNA, 25 bp, Homo sapien
atgatgctgctcttggaaggctcaa

SEQ ID NO: 450832 - DNA, 25 bp, Homo sapien
gaaggctcaatgctggtctgccccg

SEQ ID NO: 450833 - DNA, 25 bp, Homo sapien
gcttcctcttccatcttggagatgc

SEQ ID NO: 450834 - DNA, 25 bp, Homo sapien
agatgctgcagttctctaggatcat

SEQ ID NO: 450835 - DNA, 25 bp, Homo sapien
agttctctaggatcatgtggccaga

SEQ ID NO: 450836 - DNA, 25 bp, Homo sapien
tgtggccagagatgtccagggacat

SEQ ID NO: 450837 - DNA, 25 bp, Homo sapien
cagggacattaggttccccagcttc

SEQ ID NO: 450838 - DNA, 25 bp, Homo sapien
ttctgcacaaagaggctcagcacct

SEQ ID NO: 450839 - DNA, 25 bp, Homo sapien
tcccgagtcagcttgaacttgtagt

SEQ ID NO: 450840 - DNA, 25 bp, Homo sapien
gagagttctcaaagagcccgaggaa

SEQ ID NO: 450841 - DNA, 25 bp, Homo sapien
gcccggaaaggtatgatgctgctct

SEQ ID NO: 450842 - DNA, 25 bp, Homo sapien
gagactaccatatagctatgccaat

SEQ ID NO: 450843 - DNA, 25 bp, Homo sapien
gccaatttacgtgttccttggagtg

SEQ ID NO: 450844 - DNA, 25 bp, Homo sapien
ggtggaaaaatacctcttctttcag

SEQ ID NO: 450845 - DNA, 25 bp, Homo sapien
tcttctttcagagtttatgtggatt

SEQ ID NO: 450846 - DNA, 25 bp, Homo sapien
ctatagggtgttttaaactgtgctt

SEQ ID NO: 450847 - DNA, 25 bp, Homo sapien
gttacatgttttgttactgtgttac

SEQ ID NO: 450848 - DNA, 25 bp, Homo sapien
gttactgtgttactttattgaggac

SEQ ID NO: 450849 - DNA, 25 bp, Homo sapien
tattgaggacagctagtccctttgt

SEQ ID NO: 450850 - DNA, 25 bp, Homo sapien
gctagtccctttgtgttgttaaacg

SEQ ID NO: 450851 - DNA, 25 bp, Homo sapien
gagaagcttcataactctgttcatt

SEQ ID NO: 450852 - DNA, 25 bp, Homo sapien
gttcattgtaaatcttagctttctt

SEQ ID NO: 450853 - DNA, 25 bp, Homo sapien
gaggctgcagtcagctgtgttcaca

SEQ ID NO: 450854 - DNA, 25 bp, Homo sapien
aggctgcagtcagctgtgttcacac

SEQ ID NO: 450855 - DNA, 25 bp, Homo sapien
ggctgcagtcagctgtgttcacacc

SEQ ID NO: 450856 - DNA, 25 bp, Homo sapien
gctgcagtcagctgtgttcacacca

SEQ ID NO: 450857 - DNA, 25 bp, Homo sapien
ctgcagtcagctgtgttcacaccac

SEQ ID NO: 450858 - DNA, 25 bp, Homo sapien
tgcagtcagctgtgttcacaccact

SEQ ID NO: 450859 - DNA, 25 bp, Homo sapien
gcagtcagctgtgttcacaccactg

SEQ ID NO: 450860 - DNA, 25 bp, Homo sapien
cagtcagctgtgttcacaccactgc

SEQ ID NO: 450861 - DNA, 25 bp, Homo sapien
tctaattccagcacattgtgaagct

SEQ ID NO: 450862 - DNA, 25 bp, Homo sapien
ctaattccagcacattgtgaagctg

SEQ ID NO: 450863 - DNA, 25 bp, Homo sapien
ttccagcacattgtgaagctgaggt

SEQ ID NO: 450864 - DNA, 25 bp, Homo sapien
ttaacatcttgtaaaaactgggagc

SEQ ID NO: 450865 - DNA, 25 bp, Homo sapien
taacatcttgtaaaaactgggagca

SEQ ID NO: 450866 - DNA, 25 bp, Homo sapien
aacatcttgtaaaaactgggagcag

SEQ ID NO: 450867 - DNA, 25 bp, Homo sapien
acatcttgtaaaaactgggagcagg

SEQ ID NO: 450868 - DNA, 25 bp, Homo sapien
catcttgtaaaaactgggagcaggc

SEQ ID NO: 450869 - DNA, 25 bp, Homo sapien
atcttgtaaaaactgggagcaggcc

SEQ ID NO: 450870 - DNA, 25 bp, Homo sapien
tcttgtaaaaactgggagcaggcca

SEQ ID NO: 450871 - DNA, 25 bp, Homo sapien
gtaaaaactgggagcaggccaggta

SEQ ID NO: 450872 - DNA, 25 bp, Homo sapien
cgggtggttcgtctgaggtcagtca

SEQ ID NO: 450873 - DNA, 25 bp, Homo sapien
gtggttcgtctgaggtcagtcagga

SEQ ID NO: 450874 - DNA, 25 bp, Homo sapien
gaagcaggagaatcgtttaaacaca

SEQ ID NO: 450875 - DNA, 25 bp, Homo sapien
tgggctgaacatggaccacgcagtt

SEQ ID NO: 450876 - DNA, 25 bp, Homo sapien
ccacgcagttgcgacaggaggccag

SEQ ID NO: 450877 - DNA, 25 bp, Homo sapien
ggaaaaacccctgctcacttgtttg

SEQ ID NO: 450878 - DNA, 25 bp, Homo sapien
acttgtttgccctcaggcagccaaa

SEQ ID NO: 450879 - DNA, 25 bp, Homo sapien
aaagcactttaacccctgcataggg

SEQ ID NO: 450880 - DNA, 25 bp, Homo sapien
tacggcttctggattgtttcactgt

SEQ ID NO: 450881 - DNA, 25 bp, Homo sapien
gtttcactgtgattcctaggttttt

SEQ ID NO: 450882 - DNA, 25 bp, Homo sapien
tcctaggttttttcgatgccacgca

SEQ ID NO: 450883 - DNA, 25 bp, Homo sapien
tttttcgatgccacgcagtgtgtgc

SEQ ID NO: 450884 - DNA, 25 bp, Homo sapien
gcctttctgggtagggagctgtcta

SEQ ID NO: 450885 - DNA, 25 bp, Homo sapien
ggagctgtctaatccaagtcccagg

SEQ ID NO: 450886 - DNA, 25 bp, Homo sapien
gtttacacacatactcttccaagag

SEQ ID NO: 450887 - DNA, 25 bp, Homo sapien
ctcttccaagagttagagtggctaa

SEQ ID NO: 450888 - DNA, 25 bp, Homo sapien
tttccttttcctagataaactacat

SEQ ID NO: 450889 - DNA, 25 bp, Homo sapien
gataaactacatcttaagactacca

SEQ ID NO: 450890 - DNA, 25 bp, Homo sapien
acatcttaagactaccaaattgtaa

SEQ ID NO: 450891 - DNA, 25 bp, Homo sapien
atgatcttgagaattcacatcactc

SEQ ID NO: 450892 - DNA, 25 bp, Homo sapien
gagaattcacatcactcatttaggc

SEQ ID NO: 450893 - DNA, 25 bp, Homo sapien
gtcatcaaaactctgtcattaagtc

SEQ ID NO: 450894 - DNA, 25 bp, Homo sapien
ctctgtcattaagtcaatattggga

SEQ ID NO: 450895 - DNA, 25 bp, Homo sapien
ttaagtcaatattgggaaacatggc

SEQ ID NO: 450896 - DNA, 25 bp, Homo sapien
ttgggaaacatggcagcagcatggt

SEQ ID NO: 450897 - DNA, 25 bp, Homo sapien
aaatgcgtaatgctttggaaataat

SEQ ID NO: 450898 - DNA, 25 bp, Homo sapien
aatgggtaacagatagcgagaggat

SEQ ID NO: 450899 - DNA, 25 bp, Homo sapien
aaagtgagcatgttggtcccattta

SEQ ID NO: 450900 - DNA, 25 bp, Homo sapien
gagcatgttggtcccatttataaat

SEQ ID NO: 450901 - DNA, 25 bp, Homo sapien
tatttttctaaaatgtgcacagctg

SEQ ID NO: 450902 - DNA, 25 bp, Homo sapien
atgtgcacagctgtattttacatga

SEQ ID NO: 450903 - DNA, 25 bp, Homo sapien
ctgtattttacatgaaggctctttc

SEQ ID NO: 450904 - DNA, 25 bp, Homo sapien
aaaccctatagctccttacgctggg

SEQ ID NO: 450905 - DNA, 25 bp, Homo sapien
gaaggctctttctaatgggttgtta

SEQ ID NO: 450906 - DNA, 25 bp, Homo sapien
ctttctaatgggttgttatactgta

SEQ ID NO: 450907 - DNA, 25 bp, Homo sapien
gctccttacgctgggaaagctggtt

SEQ ID NO: 450908 - DNA, 25 bp, Homo sapien
aaagaacatctgcactcctgaacac

SEQ ID NO: 450909 - DNA, 25 bp, Homo sapien
tgaacacaccctgaagaaatcctgg

SEQ ID NO: 450910 - DNA, 25 bp, Homo sapien
gaaatcctgggaattgaccttgtaa

SEQ ID NO: 450911 - DNA, 25 bp, Homo sapien
gaccttgtaatcgatttgtctgtca

SEQ ID NO: 450912 - DNA, 25 bp, Homo sapien
tcgatttgtctgtcaaggtcctaaa

SEQ ID NO: 450913 - DNA, 25 bp, Homo sapien
aattcagccaacatgtgactaattg

SEQ ID NO: 450914 - DNA, 25 bp, Homo sapien
attttgcccaatctaatgctctcag

SEQ ID NO: 450915 - DNA, 25 bp, Homo sapien
ggagatcagaggttactagggttta

SEQ ID NO: 450916 - DNA, 25 bp, Homo sapien
tctaatgctctcaggaaaagcctct

SEQ ID NO: 450917 - DNA, 25 bp, Homo sapien
agcctctggaagatagctttctcct

SEQ ID NO: 450918 - DNA, 25 bp, Homo sapien
aaggtcatccaaagaacatctgcac

SEQ ID NO: 450919 - DNA, 25 bp, Homo sapien
gcagtggcgcgatatattttcagtt

SEQ ID NO: 450920 - DNA, 25 bp, Homo sapien
cagtggcgcgatatattttcagttt

SEQ ID NO: 450921 - DNA, 25 bp, Homo sapien
agtggcgcgatatattttcagtttt

SEQ ID NO: 450922 - DNA, 25 bp, Homo sapien
gtggcgcgatatattttcagttttt

SEQ ID NO: 450923 - DNA, 25 bp, Homo sapien
tggcgcgatatattttcagttttta

SEQ ID NO: 450924 - DNA, 25 bp, Homo sapien
ggcgcgatatattttcagtttttaa

SEQ ID NO: 450925 - DNA, 25 bp, Homo sapien
gcgcgatatattttcagtttttaaa

SEQ ID NO: 450926 - DNA, 25 bp, Homo sapien
tcagaatttttgtttaaaatgcctt

SEQ ID NO: 450927 - DNA, 25 bp, Homo sapien
aaaatgcctttttgggctgggcaca

SEQ ID NO: 450928 - DNA, 25 bp, Homo sapien
aaatgcctttttgggctgggcacag

SEQ ID NO: 450929 - DNA, 25 bp, Homo sapien
aatgcctttttgggctgggcacagt

SEQ ID NO: 450930 - DNA, 25 bp, Homo sapien
gaatgtgtggcaaccttgccaaaca

SEQ ID NO: 450931 - DNA, 25 bp, Homo sapien
ttgccaaacagcaccactcagagtg

SEQ ID NO: 450932 - DNA, 25 bp, Homo sapien
cagcaccactcagagtgtgactctg

SEQ ID NO: 450933 - DNA, 25 bp, Homo sapien
tgactgtgaccttggccttaatgag

SEQ ID NO: 450934 - DNA, 25 bp, Homo sapien
gaccttggccttaatgaggaacttc

SEQ ID NO: 450935 - DNA, 25 bp, Homo sapien
gaggaacttcttaggagagtttgag

SEQ ID NO: 450936 - DNA, 25 bp, Homo sapien
ggccaacatcgtcatctgggctcgc

SEQ ID NO: 450937 - DNA, 25 bp, Homo sapien
caacatcgtcatctgggctcgctgc

SEQ ID NO: 450938 - DNA, 25 bp, Homo sapien
tggcttcaggagacatcattcctga

SEQ ID NO: 450939 - DNA, 25 bp, Homo sapien
gagacatcattcctgaacacactgt

SEQ ID NO: 450940 - DNA, 25 bp, Homo sapien
attcctgaacacactgtagggtgaa

SEQ ID NO: 450941 - DNA, 25 bp, Homo sapien
gggcactcatgcagagtttctgtgc

SEQ ID NO: 450942 - DNA, 25 bp, Homo sapien
gcagagtttctgtgctcagcaataa

SEQ ID NO: 450943 - DNA, 25 bp, Homo sapien
tctgtgctcagcaataatagcaact

SEQ ID NO: 450944 - DNA, 25 bp, Homo sapien
atagcaactgctaatacttggacag

SEQ ID NO: 450945 - DNA, 25 bp, Homo sapien
actgctaatacttggacaggccttt

SEQ ID NO: 450946 - DNA, 25 bp, Homo sapien
acttggacaggccttttgcatcatc

SEQ ID NO: 450947 - DNA, 25 bp, Homo sapien
cttttgcatcatcttattagaaggg

SEQ ID NO: 450948 - DNA, 25 bp, Homo sapien
gggtccaactataattgtcaggtga

SEQ ID NO: 450949 - DNA, 25 bp, Homo sapien
ttgtcaggtgagctaataatctata

SEQ ID NO: 450950 - DNA, 25 bp, Homo sapien
caaattcacaatgatcaatgatctg

SEQ ID NO: 450951 - DNA, 25 bp, Homo sapien
gcaaaaactaattaatgtcgacgcg

SEQ ID NO: 450952 - DNA, 25 bp, Homo sapien
gtcatcatatttatcagcttattaa

SEQ ID NO: 450953 - DNA, 25 bp, Homo sapien
tttcaagaactatttaggaacccag

SEQ ID NO: 450954 - DNA, 25 bp, Homo sapien
caggaaagtcctgctttttaggatg

SEQ ID NO: 450955 - DNA, 25 bp, Homo sapien
aaagtcctgctttttaggatgagta

SEQ ID NO: 450956 - DNA, 25 bp, Homo sapien
ctgctttttaggatgagtatttata

SEQ ID NO: 450957 - DNA, 25 bp, Homo sapien
ccctacccttgaacatcgacattta

SEQ ID NO: 450958 - DNA, 25 bp, Homo sapien
tacccttgaacatcgacatttaaat

SEQ ID NO: 450959 - DNA, 25 bp, Homo sapien
gacatttaaatggactagattcgtg

SEQ ID NO: 450960 - DNA, 25 bp, Homo sapien
tttaaatggactagattcgtgaggg

SEQ ID NO: 450961 - DNA, 25 bp, Homo sapien
aattggtatgttaaatgcttcagga

SEQ ID NO: 450962 - DNA, 25 bp, Homo sapien
aaatgcttcaggaaacactaggttt

SEQ ID NO: 450963 - DNA, 25 bp, Homo sapien
tgtgtatccaaaaagggaagcctgc

SEQ ID NO: 450964 - DNA, 25 bp, Homo sapien
ataattctgggaaacatgagttgaa

SEQ ID NO: 450965 - DNA, 25 bp, Homo sapien
agttgaaatgcagagtaaactcagt

SEQ ID NO: 450966 - DNA, 25 bp, Homo sapien
gagtaaactcagtactgcaatccat

SEQ ID NO: 450967 - DNA, 25 bp, Homo sapien
actcagtactgcaatccatagcaat

SEQ ID NO: 450968 - DNA, 25 bp, Homo sapien
atattattttattgcacttggctcc

SEQ ID NO: 450969 - DNA, 25 bp, Homo sapien
cccatcctgtgctctgaagtcagag

SEQ ID NO: 450970 - DNA, 25 bp, Homo sapien
gaagtcagagtattatttgtggctc

SEQ ID NO: 450971 - DNA, 25 bp, Homo sapien
atttgtggctctatgaaatgtccat

SEQ ID NO: 450972 - DNA, 25 bp, Homo sapien
tgaaatgtccattgcttgtatacgg

SEQ ID NO: 450973 - DNA, 25 bp, Homo sapien
aatgtccattgcttgtatacggtat

SEQ ID NO: 450974 - DNA, 25 bp, Homo sapien
ggcttctgtctctttagagccaaga

SEQ ID NO: 450975 - DNA, 25 bp, Homo sapien
agggcagaataagcacttactcccc

SEQ ID NO: 450976 - DNA, 25 bp, Homo sapien
gcaggccaaccctcaataattgcaa

SEQ ID NO: 450977 - DNA, 25 bp, Homo sapien
attgcaagcctgaagagaagtgatc

SEQ ID NO: 450978 - DNA, 25 bp, Homo sapien
tggactggatagacatcttgactct

SEQ ID NO: 450979 - DNA, 25 bp, Homo sapien
atcttgactctattcagcccgtagt

SEQ ID NO: 450980 - DNA, 25 bp, Homo sapien
attcagcccgtagtctgtgatctgg

SEQ ID NO: 450981 - DNA, 25 bp, Homo sapien
cgtagtctgtgatctggagagtcca

SEQ ID NO: 450982 - DNA, 25 bp, Homo sapien
gagagtccagttaaggtaacccaga

SEQ ID NO: 450983 - DNA, 25 bp, Homo sapien
taacccagatttttgacaaccgcct

SEQ ID NO: 450984 - DNA, 25 bp, Homo sapien
aagttttctcattacccctccactg

SEQ ID NO: 450985 - DNA, 25 bp, Homo sapien
ttcccttgacgcctacatttctagg

SEQ ID NO: 450986 - DNA, 25 bp, Homo sapien
gacgcctacatttctaggcacatgt

SEQ ID NO: 450987 - DNA, 25 bp, Homo sapien
acatttctaggcacatgtgaggcat

SEQ ID NO: 450988 - DNA, 25 bp, Homo sapien
gcacatgtgaggcatctttcctgga

SEQ ID NO: 450989 - DNA, 25 bp, Homo sapien
atgtgaggcatctttcctggagccc

SEQ ID NO: 450990 - DNA, 25 bp, Homo sapien
gaggcatctttcctggagccccgag

SEQ ID NO: 450991 - DNA, 25 bp, Homo sapien
ggcactcaggagatacaggctggac

SEQ ID NO: 450992 - DNA, 25 bp, Homo sapien
gggtgggccatgtgccaggacagga

SEQ ID NO: 450993 - DNA, 25 bp, Homo sapien
agccccggactcatcgtgacattga

SEQ ID NO: 450994 - DNA, 25 bp, Homo sapien
atcgtgacattgagatcccactgga

SEQ ID NO: 450995 - DNA, 25 bp, Homo sapien
cattgagatcccactggagggtagg

SEQ ID NO: 450996 - DNA, 25 bp, Homo sapien
tggttatgatgtggaccccagtccc

SEQ ID NO: 450997 - DNA, 25 bp, Homo sapien
agtccctaacacagagatgtcttgg

SEQ ID NO: 450998 - DNA, 25 bp, Homo sapien
aagagggtaaatatgcaatggcgtg

SEQ ID NO: 450999 - DNA, 25 bp, Homo sapien
gaaacaaacgtatggttcgtgtaga

SEQ ID NO: 451000 - DNA, 25 bp, Homo sapien
gttcgtgtagaaagcaacggcatta

SEQ ID NO: 451001 - DNA, 25 bp, Homo sapien
aacggcattatgcttcacatactgg

SEQ ID NO: 451002 - DNA, 25 bp, Homo sapien
cagtgggtgccagtagtgtcctgct

SEQ ID NO: 451003 - DNA, 25 bp, Homo sapien
ggaatcattgtttctatcatatgta

SEQ ID NO: 451004 - DNA, 25 bp, Homo sapien
gtaacatgcaatctgttggcctcaa

SEQ ID NO: 451005 - DNA, 25 bp, Homo sapien
ttggcctcaatagcaccgctttgaa

SEQ ID NO: 451006 - DNA, 25 bp, Homo sapien
agcaccgctttgaagattgcccttg

SEQ ID NO: 451007 - DNA, 25 bp, Homo sapien
ggaatcactctgtagtagttgtgtt

SEQ ID NO: 451008 - DNA, 25 bp, Homo sapien
gaatcactctgtagtagttgtgttc

SEQ ID NO: 451009 - DNA, 25 bp, Homo sapien
aatcactctgtagtagttgtgttca

SEQ ID NO: 451010 - DNA, 25 bp, Homo sapien
atcactctgtagtagttgtgttcat

SEQ ID NO: 451011 - DNA, 25 bp, Homo sapien
tcactctgtagtagttgtgttcatt

SEQ ID NO: 451012 - DNA, 25 bp, Homo sapien
cactctgtagtagttgtgttcattt

SEQ ID NO: 451013 - DNA, 25 bp, Homo sapien
actctgtagtagttgtgttcatttt

SEQ ID NO: 451014 - DNA, 25 bp, Homo sapien
ctctgtagtagttgtgttcattttc

SEQ ID NO: 451015 - DNA, 25 bp, Homo sapien
tctgtagtagttgtgttcattttct

SEQ ID NO: 451016 - DNA, 25 bp, Homo sapien
ctgtagtagttgtgttcattttctt

SEQ ID NO: 451017 - DNA, 25 bp, Homo sapien
tgtagtagttgtgttcattttcttt

SEQ ID NO: 451018 - DNA, 25 bp, Homo sapien
cctcattgctggctgggtgtgctct

SEQ ID NO: 451019 - DNA, 25 bp, Homo sapien
gggcttgcttggttaaccacagaag

SEQ ID NO: 451020 - DNA, 25 bp, Homo sapien
ggaagcacggttactgtgttctcta

SEQ ID NO: 451021 - DNA, 25 bp, Homo sapien
actgtgttctctaatgttcatgtat

SEQ ID NO: 451022 - DNA, 25 bp, Homo sapien
ccgcaaagcttttcccagcagatct

SEQ ID NO: 451023 - DNA, 25 bp, Homo sapien
taaagatgtaacctccacacctttc

SEQ ID NO: 451024 - DNA, 25 bp, Homo sapien
agcagatctcatgctctcagatagg

SEQ ID NO: 451025 - DNA, 25 bp, Homo sapien
tctcagataggtgggacaagttctt

SEQ ID NO: 451026 - DNA, 25 bp, Homo sapien
acaagttcttttgtcacagtgctgg

SEQ ID NO: 451027 - DNA, 25 bp, Homo sapien
tcacagtgctggctctgtcctgagg

SEQ ID NO: 451028 - DNA, 25 bp, Homo sapien
tgtcctgaggcctcattgctggctg

SEQ ID NO: 451029 - DNA, 25 bp, Homo sapien
agaaaatatgcaaatccagtcattt

SEQ ID NO: 451030 - DNA, 25 bp, Homo sapien
gaaaatatgcaaatccagtcatttc

SEQ ID NO: 451031 - DNA, 25 bp, Homo sapien
aaaatatgcaaatccagtcatttcc

SEQ ID NO: 451032 - DNA, 25 bp, Homo sapien
aaatatgcaaatccagtcatttccc

SEQ ID NO: 451033 - DNA, 25 bp, Homo sapien
aatatgcaaatccagtcatttccca

SEQ ID NO: 451034 - DNA, 25 bp, Homo sapien
atatgcaaatccagtcatttcccag

SEQ ID NO: 451035 - DNA, 25 bp, Homo sapien
tatgcaaatccagtcatttcccagg

SEQ ID NO: 451036 - DNA, 25 bp, Homo sapien
atgcaaatccagtcatttcccaggt

SEQ ID NO: 451037 - DNA, 25 bp, Homo sapien
tgcaaatccagtcatttcccaggta

SEQ ID NO: 451038 - DNA, 25 bp, Homo sapien
gcaaatccagtcatttcccaggtac

SEQ ID NO: 451039 - DNA, 25 bp, Homo sapien
caaatccagtcatttcccaggtact

SEQ ID NO: 451040 - DNA, 25 bp, Homo sapien
ggcgtcttaacagtctccggtgtcc

SEQ ID NO: 451041 - DNA, 25 bp, Homo sapien
gcgtcttaacagtctccggtgtcca

SEQ ID NO: 451042 - DNA, 25 bp, Homo sapien
gtgtccatgcgttgactgccatgta

SEQ ID NO: 451043 - DNA, 25 bp, Homo sapien
tgtccatgcgttgactgccatgtat

SEQ ID NO: 451044 - DNA, 25 bp, Homo sapien
tgactgccatgtatgactccaggta

SEQ ID NO: 451045 - DNA, 25 bp, Homo sapien
gactgccatgtatgactccaggtat

SEQ ID NO: 451046 - DNA, 25 bp, Homo sapien
tgccatgtatgactccaggtattga

SEQ ID NO: 451047 - DNA, 25 bp, Homo sapien
gtatgactccaggtattgagttcat

SEQ ID NO: 451048 - DNA, 25 bp, Homo sapien
tgactccaggtattgagttcatctt

SEQ ID NO: 451049 - DNA, 25 bp, Homo sapien
ctccaggtattgagttcatcttcaa

SEQ ID NO: 451050 - DNA, 25 bp, Homo sapien
caggtattgagttcatcttcaactt

SEQ ID NO: 451051 - DNA, 25 bp, Homo sapien
ggaagatgaggtcatctgccacttt

SEQ ID NO: 451052 - DNA, 25 bp, Homo sapien
atctgccactttcaggacattgtcc

SEQ ID NO: 451053 - DNA, 25 bp, Homo sapien
tttcaggacattgtccgggagccct

SEQ ID NO: 451054 - DNA, 25 bp, Homo sapien
ggagcccttcatttaggacaaaacg

SEQ ID NO: 451055 - DNA, 25 bp, Homo sapien
tcatttaggacaaaacgggcgcgat

SEQ ID NO: 451056 - DNA, 25 bp, Homo sapien
aaaacgggcgcgatgatgccctggc

SEQ ID NO: 451057 - DNA, 25 bp, Homo sapien
gtggtcagaactggatacggtgttt

SEQ ID NO: 451058 - DNA, 25 bp, Homo sapien
ggatacggtgtttacaattccaatc

SEQ ID NO: 451059 - DNA, 25 bp, Homo sapien
ggtgtttacaattccaatctctcta

SEQ ID NO: 451060 - DNA, 25 bp, Homo sapien
attccaatctctctatttctgggtg

SEQ ID NO: 451061 - DNA, 25 bp, Homo sapien
ctctatttctgggtgaagggtcttg

SEQ ID NO: 451062 - DNA, 25 bp, Homo sapien
aagagacttacacgaggtcacatag

SEQ ID NO: 451063 - DNA, 25 bp, Homo sapien
agagacttacacgaggtcacatagc

SEQ ID NO: 451064 - DNA, 25 bp, Homo sapien
gagacttacacgaggtcacatagct

SEQ ID NO: 451065 - DNA, 25 bp, Homo sapien
gacttacacgaggtcacatagctaa

SEQ ID NO: 451066 - DNA, 25 bp, Homo sapien
gccctattcgcttgccccattatcc

SEQ ID NO: 451067 - DNA, 25 bp, Homo sapien
catgctgcctttctaagagccagaa

SEQ ID NO: 451068 - DNA, 25 bp, Homo sapien
atgctgcctttctaagagccagaaa

SEQ ID NO: 451069 - DNA, 25 bp, Homo sapien
tgctgcctttctaagagccagaaaa

SEQ ID NO: 451070 - DNA, 25 bp, Homo sapien
gctgcctttctaagagccagaaaag

SEQ ID NO: 451071 - DNA, 25 bp, Homo sapien
tgcctttctaagagccagaaaagtt

SEQ ID NO: 451072 - DNA, 25 bp, Homo sapien
taagagccagaaaagttagaggtag

SEQ ID NO: 451073 - DNA, 25 bp, Homo sapien
gtctgaattgtaagtcataacacta

SEQ ID NO: 451074 - DNA, 25 bp, Homo sapien
ctctcccaggagcatttacttttga

SEQ ID NO: 451075 - DNA, 25 bp, Homo sapien
gagcttgacattgggtggacagatc

SEQ ID NO: 451076 - DNA, 25 bp, Homo sapien
aaggaatgcatttttagtagcaaaa

SEQ ID NO: 451077 - DNA, 25 bp, Homo sapien
gtagcaaaatgttggagtccttggt

SEQ ID NO: 451078 - DNA, 25 bp, Homo sapien
aattgggtgtgatgtccttccagtc

SEQ ID NO: 451079 - DNA, 25 bp, Homo sapien
tccttccagtccttcagataacgca

SEQ ID NO: 451080 - DNA, 25 bp, Homo sapien
agtccttcagataacgcacccggtg

SEQ ID NO: 451081 - DNA, 25 bp, Homo sapien
taacgcacccggtgagtgaccgtga

SEQ ID NO: 451082 - DNA, 25 bp, Homo sapien
aacatagccctaataagtcattaag

SEQ ID NO: 451083 - DNA, 25 bp, Homo sapien
aagtcattaaggctatagtctgaat

SEQ ID NO: 451084 - DNA, 25 bp, Homo sapien
gtctccctcttctaccgcaatgact

SEQ ID NO: 451085 - DNA, 25 bp, Homo sapien
tgccatggcccctatgaggctgcca

SEQ ID NO: 451086 - DNA, 25 bp, Homo sapien
gccatggcccctatgaggctgccat

SEQ ID NO: 451087 - DNA, 25 bp, Homo sapien
ccctgctggccggagctgtagctgt

SEQ ID NO: 451088 - DNA, 25 bp, Homo sapien
tggccggagctgtagctgtgctggt

SEQ ID NO: 451089 - DNA, 25 bp, Homo sapien
tgtagctgtgctggtggcactcagc

SEQ ID NO: 451090 - DNA, 25 bp, Homo sapien
tcttctaccgcaatgactccgccca

SEQ ID NO: 451091 - DNA, 25 bp, Homo sapien
gcctgctggcctggagaccagggtg

SEQ ID NO: 451092 - DNA, 25 bp, Homo sapien
gggccccgtgtgagccagaaaccag

SEQ ID NO: 451093 - DNA, 25 bp, Homo sapien
ggccccgtgtgagccagaaaccagg

SEQ ID NO: 451094 - DNA, 25 bp, Homo sapien
taggccgcttctaccagctgactgc

SEQ ID NO: 451095 - DNA, 25 bp, Homo sapien
gctgattctaattgtgtgtaggtct

SEQ ID NO: 451096 - DNA, 25 bp, Homo sapien
gtaggtcttgaggattaagcacaca

SEQ ID NO: 451097 - DNA, 25 bp, Homo sapien
agcacacaaatttcacaaacttctg

SEQ ID NO: 451098 - DNA, 25 bp, Homo sapien
gagtaaacaaactcagccttctgta

SEQ ID NO: 451099 - DNA, 25 bp, Homo sapien
aaactcagccttctgtaaatataca

SEQ ID NO: 451100 - DNA, 25 bp, Homo sapien
tgtaaaaactccttttctgccacac

SEQ ID NO: 451101 - DNA, 25 bp, Homo sapien
tgccacactaaaaatgcaagccatt

SEQ ID NO: 451102 - DNA, 25 bp, Homo sapien
gcaagccatttatgggaatcctaaa

SEQ ID NO: 451103 - DNA, 25 bp, Homo sapien
gtattgaactaaaactttgctaatg

SEQ ID NO: 451104 - DNA, 25 bp, Homo sapien
gatctttattagaggatcgtccaac

SEQ ID NO: 451105 - DNA, 25 bp, Homo sapien
agaggatcgtccaacttttcactta

SEQ ID NO: 451106 - DNA, 25 bp, Homo sapien
ttcaaggccagctttgacaaaatag

SEQ ID NO: 451107 - DNA, 25 bp, Homo sapien
tcaaggccagctttgacaaaatagt

SEQ ID NO: 451108 - DNA, 25 bp, Homo sapien
caaggccagctttgacaaaatagtg

SEQ ID NO: 451109 - DNA, 25 bp, Homo sapien
aaggccagctttgacaaaatagtga

SEQ ID NO: 451110 - DNA, 25 bp, Homo sapien
aggccagctttgacaaaatagtgag

SEQ ID NO: 451111 - DNA, 25 bp, Homo sapien
ggccagctttgacaaaatagtgaga

SEQ ID NO: 451112 - DNA, 25 bp, Homo sapien
tgatggtgcacacctctagtggcta

SEQ ID NO: 451113 - DNA, 25 bp, Homo sapien
gatggtgcacacctctagtggctac

SEQ ID NO: 451114 - DNA, 25 bp, Homo sapien
atggtgcacacctctagtggctact

SEQ ID NO: 451115 - DNA, 25 bp, Homo sapien
tatgatgataccaccacactccacc

SEQ ID NO: 451116 - DNA, 25 bp, Homo sapien
tgatgataccaccacactccaccct

SEQ ID NO: 451117 - DNA, 25 bp, Homo sapien
ccagttctgaaaatggcatgtcttt

SEQ ID NO: 451118 - DNA, 25 bp, Homo sapien
cagttctgaaaatggcatgtctttc

SEQ ID NO: 451119 - DNA, 25 bp, Homo sapien
atcctggccaacaggatgtacaaca

SEQ ID NO: 451120 - DNA, 25 bp, Homo sapien
tcctggccaacaggatgtacaacag

SEQ ID NO: 451121 - DNA, 25 bp, Homo sapien
ctggccaacaggatgtacaacagga

SEQ ID NO: 451122 - DNA, 25 bp, Homo sapien
tggccaacaggatgtacaacaggat

SEQ ID NO: 451123 - DNA, 25 bp, Homo sapien
ggccaacaggatgtacaacaggatg

SEQ ID NO: 451124 - DNA, 25 bp, Homo sapien
gccaacaggatgtacaacaggatgt

SEQ ID NO: 451125 - DNA, 25 bp, Homo sapien
ccaacaggatgtacaacaggatgta

SEQ ID NO: 451126 - DNA, 25 bp, Homo sapien
caggatgtacaacaggatgtactaa

SEQ ID NO: 451127 - DNA, 25 bp, Homo sapien
ggatgtacaacaggatgtactaaaa

SEQ ID NO: 451128 - DNA, 25 bp, Homo sapien
ctggctaatttgtgtctcattttca

SEQ ID NO: 451129 - DNA, 25 bp, Homo sapien
ggctaatttgtgtctcattttcaag

SEQ ID NO: 451130 - DNA, 25 bp, Homo sapien
gctaatttgtgtctcattttcaaga

SEQ ID NO: 451131 - DNA, 25 bp, Homo sapien
atttgtgtctcattttcaagagtag

SEQ ID NO: 451132 - DNA, 25 bp, Homo sapien
gtgtctcattttcaagagtagaaac

SEQ ID NO: 451133 - DNA, 25 bp, Homo sapien
tcattttcaagagtagaaaccctaa

SEQ ID NO: 451134 - DNA, 25 bp, Homo sapien
cattccttttccaaattgctatgaa

SEQ ID NO: 451135 - DNA, 25 bp, Homo sapien
ttccttttccaaattgctatgaatg

SEQ ID NO: 451136 - DNA, 25 bp, Homo sapien
tttccaaattgctatgaatgggatt

SEQ ID NO: 451137 - DNA, 25 bp, Homo sapien
ccaaattgctatgaatgggattaaa

SEQ ID NO: 451138 - DNA, 25 bp, Homo sapien
gggattaaaggattacagatgtaaa

SEQ ID NO: 451139 - DNA, 25 bp, Homo sapien
actgcattcataagactttgctctt

SEQ ID NO: 451140 - DNA, 25 bp, Homo sapien
cgggagcacagttccgccgagtgac

SEQ ID NO: 451141 - DNA, 25 bp, Homo sapien
gactttgctcttgtgagaattcgct

SEQ ID NO: 451142 - DNA, 25 bp, Homo sapien
tgagaattcgctcatgccccaaaag

SEQ ID NO: 451143 - DNA, 25 bp, Homo sapien
gattgaagggtttgccatcctcatc

SEQ ID NO: 451144 - DNA, 25 bp, Homo sapien
ggtttgccatcctcatcatatctgc

SEQ ID NO: 451145 - DNA, 25 bp, Homo sapien
accttgtttgcgcattctgatcttg

SEQ ID NO: 451146 - DNA, 25 bp, Homo sapien
gagtgacactgtttatggaccgtaa

SEQ ID NO: 451147 - DNA, 25 bp, Homo sapien
ttatggaccgtaagagctgaccgct

SEQ ID NO: 451148 - DNA, 25 bp, Homo sapien
agagctgaccgctgtctgaaggctt

SEQ ID NO: 451149 - DNA, 25 bp, Homo sapien
tgaaggcttgcccacagaccttaca

SEQ ID NO: 451150 - DNA, 25 bp, Homo sapien
aactaattctacttgaaatcaggag

SEQ ID NO: 451151 - DNA, 25 bp, Homo sapien
ttggtttccatcatctcttcccctt

SEQ ID NO: 451152 - DNA, 25 bp, Homo sapien
cgggtattctttgggaagctatcct

SEQ ID NO: 451153 - DNA, 25 bp, Homo sapien
gaagctatcctttctcagctatgtg

SEQ ID NO: 451154 - DNA, 25 bp, Homo sapien
agctatgtggtttggcaccaccacc

SEQ ID NO: 451155 - DNA, 25 bp, Homo sapien
accaccaccatcttcatgagtggac

SEQ ID NO: 451156 - DNA, 25 bp, Homo sapien
tcttcatgagtggaccctgtttggc

SEQ ID NO: 451157 - DNA, 25 bp, Homo sapien
gaccctgtttggcttgtgtcaatca

SEQ ID NO: 451158 - DNA, 25 bp, Homo sapien
tcaatcagtttatcccatccccttg

SEQ ID NO: 451159 - DNA, 25 bp, Homo sapien
ccttggccacagagccattgtgata

SEQ ID NO: 451160 - DNA, 25 bp, Homo sapien
gatactggctcttctggaaaagaga

SEQ ID NO: 451161 - DNA, 25 bp, Homo sapien
caggcatgtgatatgatgctcggct

SEQ ID NO: 451162 - DNA, 25 bp, Homo sapien
catgtgatatgatgctcggctgatt

SEQ ID NO: 451163 - DNA, 25 bp, Homo sapien
tgatatgatgctcggctgatttttg

SEQ ID NO: 451164 - DNA, 25 bp, Homo sapien
ccatatttgccaggctggtttgaac

SEQ ID NO: 451165 - DNA, 25 bp, Homo sapien
gcgcccagctagctcctgtgttttg

SEQ ID NO: 451166 - DNA, 25 bp, Homo sapien
cccagctagctcctgtgttttgttt

SEQ ID NO: 451167 - DNA, 25 bp, Homo sapien
ttgttttgtaactttggttgatgtt

SEQ ID NO: 451168 - DNA, 25 bp, Homo sapien
ctttggttgatgttaaggccctcca

SEQ ID NO: 451169 - DNA, 25 bp, Homo sapien
ttggttgatgttaaggccctccatt

SEQ ID NO: 451170 - DNA, 25 bp, Homo sapien
ggttgatgttaaggccctccatttt

SEQ ID NO: 451171 - DNA, 25 bp, Homo sapien
ggccctccattttggaaagcaggaa

SEQ ID NO: 451172 - DNA, 25 bp, Homo sapien
gccttctgggggtcaaattcgattt

SEQ ID NO: 451173 - DNA, 25 bp, Homo sapien
ggtcaaattcgatttttaagattct

SEQ ID NO: 451174 - DNA, 25 bp, Homo sapien
aatttggtccagaatcctatttgtt

SEQ ID NO: 451175 - DNA, 25 bp, Homo sapien
tttggtccagaatcctatttgttta

SEQ ID NO: 451176 - DNA, 25 bp, Homo sapien
tggtccagaatcctatttgtttatt

SEQ ID NO: 451177 - DNA, 25 bp, Homo sapien
ccagaatcctatttgtttattcctg

SEQ ID NO: 451178 - DNA, 25 bp, Homo sapien
tattcctgtagtatacatacatctg

SEQ ID NO: 451179 - DNA, 25 bp, Homo sapien
tagtatacatacatctgtagttacc

SEQ ID NO: 451180 - DNA, 25 bp, Homo sapien
tagtctttgttgtctttgggccatc

SEQ ID NO: 451181 - DNA, 25 bp, Homo sapien
gtctttgggccatctaaagtatatt

SEQ ID NO: 451182 - DNA, 25 bp, Homo sapien
ggccatctaaagtatatttgggctg

SEQ ID NO: 451183 - DNA, 25 bp, Homo sapien
atgcaaagggacagttaaagcttca

SEQ ID NO: 451184 - DNA, 25 bp, Homo sapien
gcaaagggacagttaaagcttcata

SEQ ID NO: 451185 - DNA, 25 bp, Homo sapien
aagagtgacaaattgagcgttcaac

SEQ ID NO: 451186 - DNA, 25 bp, Homo sapien
gagtgacaaattgagcgttcaactc

SEQ ID NO: 451187 - DNA, 25 bp, Homo sapien
agtgacaaattgagcgttcaactca

SEQ ID NO: 451188 - DNA, 25 bp, Homo sapien
gtgacaaattgagcgttcaactcaa

SEQ ID NO: 451189 - DNA, 25 bp, Homo sapien
gacaaattgagcgttcaactcaaga

SEQ ID NO: 451190 - DNA, 25 bp, Homo sapien
aaattgagcgttcaactcaagaagt

SEQ ID NO: 451191 - DNA, 25 bp, Homo sapien
ggaagtaataatagcacaacttagt

SEQ ID NO: 451192 - DNA, 25 bp, Homo sapien
gtaataatagcacaacttagtgaaa

SEQ ID NO: 451193 - DNA, 25 bp, Homo sapien
aaactaaaacatatcagcaaaactg

SEQ ID NO: 451194 - DNA, 25 bp, Homo sapien
atatggcacctaagaatttccatgg

SEQ ID NO: 451195 - DNA, 25 bp, Homo sapien
aatttccatggatgtgccctgaggt

SEQ ID NO: 451196 - DNA, 25 bp, Homo sapien
tgaggtgctccatgtcttggtaagc

SEQ ID NO: 451197 - DNA, 25 bp, Homo sapien
ggtgcagcggaaagagtaccactct

SEQ ID NO: 451198 - DNA, 25 bp, Homo sapien
agagtaccactctcggtgggaccca

SEQ ID NO: 451199 - DNA, 25 bp, Homo sapien
gtgggacccaagtttgaatccagat

SEQ ID NO: 451200 - DNA, 25 bp, Homo sapien
tggctagggaccagtttttgtaact

SEQ ID NO: 451201 - DNA, 25 bp, Homo sapien
tgtaacttctttgaacctcactctt

SEQ ID NO: 451202 - DNA, 25 bp, Homo sapien
acctcactctttctcactggtagaa

SEQ ID NO: 451203 - DNA, 25 bp, Homo sapien
gtaatatacctagcacagaacctgg

SEQ ID NO: 451204 - DNA, 25 bp, Homo sapien
ataatggtttatgctatctacacat

SEQ ID NO: 451205 - DNA, 25 bp, Homo sapien
acctagaagtgcttgccacattaag

SEQ ID NO: 451206 - DNA, 25 bp, Homo sapien
ctagaagtgcttgccacattaagga

SEQ ID NO: 451207 - DNA, 25 bp, Homo sapien
gaagtgcttgccacattaaggatgc

SEQ ID NO: 451208 - DNA, 25 bp, Homo sapien
aagtgcttgccacattaaggatgct

SEQ ID NO: 451209 - DNA, 25 bp, Homo sapien
agtgcttgccacattaaggatgctc

SEQ ID NO: 451210 - DNA, 25 bp, Homo sapien
gtgcttgccacattaaggatgctct

SEQ ID NO: 451211 - DNA, 25 bp, Homo sapien
cttgccacattaaggatgctctggg

SEQ ID NO: 451212 - DNA, 25 bp, Homo sapien
aaggatgctctgggccaggtacagt

SEQ ID NO: 451213 - DNA, 25 bp, Homo sapien
ttgcttgaggcaatcctggacagga

SEQ ID NO: 451214 - DNA, 25 bp, Homo sapien
aggcaatcctggacaggaggtccag

SEQ ID NO: 451215 - DNA, 25 bp, Homo sapien
tggacaggaggtccaggcagcagtg

SEQ ID NO: 451216 - DNA, 25 bp, Homo sapien
gaaaatatgcaaatccagtcatttc

SEQ ID NO: 451217 - DNA, 25 bp, Homo sapien
aatatgcaaatccagtcatttccca

SEQ ID NO: 451218 - DNA, 25 bp, Homo sapien
atatgcaaatccagtcatttcccag

SEQ ID NO: 451219 - DNA, 25 bp, Homo sapien
tatgcaaatccagtcatttcccagg

SEQ ID NO: 451220 - DNA, 25 bp, Homo sapien
atgcaaatccagtcatttcccaggt

SEQ ID NO: 451221 - DNA, 25 bp, Homo sapien
tgcaaatccagtcatttcccaggta

SEQ ID NO: 451222 - DNA, 25 bp, Homo sapien
gcaaatccagtcatttcccaggtac

SEQ ID NO: 451223 - DNA, 25 bp, Homo sapien
caaatccagtcatttcccaggtact

SEQ ID NO: 451224 - DNA, 25 bp, Homo sapien
tgggctctgtggtgggatcaactaa

SEQ ID NO: 451225 - DNA, 25 bp, Homo sapien
atccttctccccaggataagtccag

SEQ ID NO: 451226 - DNA, 25 bp, Homo sapien
cccaggataagtccagaagaataca

SEQ ID NO: 451227 - DNA, 25 bp, Homo sapien
accttgaatggttgtcagtgtcact

SEQ ID NO: 451228 - DNA, 25 bp, Homo sapien
aatggtgagcttagggtcttcctct

SEQ ID NO: 451229 - DNA, 25 bp, Homo sapien
ttagggtcttcctctgactccttac

SEQ ID NO: 451230 - DNA, 25 bp, Homo sapien
tgactccttactcctcaaggaggca

SEQ ID NO: 451231 - DNA, 25 bp, Homo sapien
caaggaggcagttagggtccctctt

SEQ ID NO: 451232 - DNA, 25 bp, Homo sapien
agggtccctcttaagcaggcttcta

SEQ ID NO: 451233 - DNA, 25 bp, Homo sapien
caggcttctatttcttaccactaaa

SEQ ID NO: 451234 - DNA, 25 bp, Homo sapien
gtttcctttttcatccagaagttag

SEQ ID NO: 451235 - DNA, 25 bp, Homo sapien
gaagttagaactccccagatattca

SEQ ID NO: 451236 - DNA, 25 bp, Homo sapien
taggatctgaattccgagattctaa

SEQ ID NO: 451237 - DNA, 25 bp, Homo sapien
gagaaaatctagttctgcctcagcc

SEQ ID NO: 451238 - DNA, 25 bp, Homo sapien
cctgaagtctctcaactagtagaga

SEQ ID NO: 451239 - DNA, 25 bp, Homo sapien
gaagtctctcaactagtagagaaaa

SEQ ID NO: 451240 - DNA, 25 bp, Homo sapien
gtagagaaaataaccgtgatttagc

SEQ ID NO: 451241 - DNA, 25 bp, Homo sapien
aataaccgtgatttagcaagaagcg

SEQ ID NO: 451242 - DNA, 25 bp, Homo sapien
taaccgtgatttagcaagaagcgac

SEQ ID NO: 451243 - DNA, 25 bp, Homo sapien
accgtgatttagcaagaagcgacat

SEQ ID NO: 451244 - DNA, 25 bp, Homo sapien
cgacatggggaagggtgacaacaat

SEQ ID NO: 451245 - DNA, 25 bp, Homo sapien
ttggaatagtgggtagcaccacttc

SEQ ID NO: 451246 - DNA, 25 bp, Homo sapien
gaatagtgggtagcaccacttcacc

SEQ ID NO: 451247 - DNA, 25 bp, Homo sapien
aatagtgggtagcaccacttcacca

SEQ ID NO: 451248 - DNA, 25 bp, Homo sapien
atagtgggtagcaccacttcaccag

SEQ ID NO: 451249 - DNA, 25 bp, Homo sapien
tgttgtgatttccataaatatgtgc

SEQ ID NO: 451250 - DNA, 25 bp, Homo sapien
gtgcagttactcttgataatacttg

SEQ ID NO: 451251 - DNA, 25 bp, Homo sapien
atacttgtcttattcatttcaggtt

SEQ ID NO: 451252 - DNA, 25 bp, Homo sapien
ttgtcttattcatttcaggttgcta

SEQ ID NO: 451253 - DNA, 25 bp, Homo sapien
ctgagatcagattaccagcatggtt

SEQ ID NO: 451254 - DNA, 25 bp, Homo sapien
gttgggttctggtgagagccgtctt

SEQ ID NO: 451255 - DNA, 25 bp, Homo sapien
gagagccgtcttggttgcagactgc

SEQ ID NO: 451256 - DNA, 25 bp, Homo sapien
tgcagactgccatcttcttgtatcc

SEQ ID NO: 451257 - DNA, 25 bp, Homo sapien
gtttgataagagcatgaatcccatt

SEQ ID NO: 451258 - DNA, 25 bp, Homo sapien
gagcatgaatcccattacatcttca

SEQ ID NO: 451259 - DNA, 25 bp, Homo sapien
atcccattacatcttcacatggctc

SEQ ID NO: 451260 - DNA, 25 bp, Homo sapien
atcacccgtcacactgataaagtga

SEQ ID NO: 451261 - DNA, 25 bp, Homo sapien
aaagtgatgcactcagtactcccta

SEQ ID NO: 451262 - DNA, 25 bp, Homo sapien
tgcactcagtactccctaatgttaa

SEQ ID NO: 451263 - DNA, 25 bp, Homo sapien
ctccctaatgttaatcacacagtgt

SEQ ID NO: 451264 - DNA, 25 bp, Homo sapien
actagtagttacacgatccctttca

SEQ ID NO: 451265 - DNA, 25 bp, Homo sapien
gtagttacacgatccctttcaagtt

SEQ ID NO: 451266 - DNA, 25 bp, Homo sapien
tacacgatccctttcaagtttctct

SEQ ID NO: 451267 - DNA, 25 bp, Homo sapien
ctcttaagttgtgcagatttccttt

SEQ ID NO: 451268 - DNA, 25 bp, Homo sapien
agatttcctttgtggtttggcttgg

SEQ ID NO: 451269 - DNA, 25 bp, Homo sapien
aagtaaagcatctcgatgtgcccag

SEQ ID NO: 451270 - DNA, 25 bp, Homo sapien
aaagcatctcgatgtgcccaggact

SEQ ID NO: 451271 - DNA, 25 bp, Homo sapien
agaatggagagtgaggctaccacat

SEQ ID NO: 451272 - DNA, 25 bp, Homo sapien
gaggctaccacatgaagcgtcacca

SEQ ID NO: 451273 - DNA, 25 bp, Homo sapien
acatgaagcgtcaccagagctgctc

SEQ ID NO: 451274 - DNA, 25 bp, Homo sapien
ggatccactgttcaatctgcacaag

SEQ ID NO: 451275 - DNA, 25 bp, Homo sapien
gtccagacatgggagacttcagctg

SEQ ID NO: 451276 - DNA, 25 bp, Homo sapien
gacagggaaggccagcctcgcatcc

SEQ ID NO: 451277 - DNA, 25 bp, Homo sapien
atccctctgtccatgcctggaatga

SEQ ID NO: 451278 - DNA, 25 bp, Homo sapien
gtccatgcctggaatgactttaata

SEQ ID NO: 451279 - DNA, 25 bp, Homo sapien
gaatttgtagctgtcgttcactttt

SEQ ID NO: 451280 - DNA, 25 bp, Homo sapien
tagctgtcgttcactttttacccac

SEQ ID NO: 451281 - DNA, 25 bp, Homo sapien
ccacccattcaataaaccttacaga

SEQ ID NO: 451282 - DNA, 25 bp, Homo sapien
taaaggttggtgttggcccaggcat

SEQ ID NO: 451283 - DNA, 25 bp, Homo sapien
ccagccactttctttaatactataa

SEQ ID NO: 451284 - DNA, 25 bp, Homo sapien
cagccactttctttaatactataac

SEQ ID NO: 451285 - DNA, 25 bp, Homo sapien
gccactttctttaatactataacta

SEQ ID NO: 451286 - DNA, 25 bp, Homo sapien
tattaaaatgcacaaattgtctaag

SEQ ID NO: 451287 - DNA, 25 bp, Homo sapien
attgtctaagactgtaaagtttatt

SEQ ID NO: 451288 - DNA, 25 bp, Homo sapien
gagaggccatgactacctctgaatt

SEQ ID NO: 451289 - DNA, 25 bp, Homo sapien
agaggccatgactacctctgaattt

SEQ ID NO: 451290 - DNA, 25 bp, Homo sapien
gaggccatgactacctctgaattta

SEQ ID NO: 451291 - DNA, 25 bp, Homo sapien
aggccatgactacctctgaatttag

SEQ ID NO: 451292 - DNA, 25 bp, Homo sapien
ggccatgactacctctgaatttagt

SEQ ID NO: 451293 - DNA, 25 bp, Homo sapien
aaggaggacgactttgctgtctaca

SEQ ID NO: 451294 - DNA, 25 bp, Homo sapien
gactttgctgtctacaccaacatgc

SEQ ID NO: 451295 - DNA, 25 bp, Homo sapien
ttttcatcaccccaggaggacattg

SEQ ID NO: 451296 - DNA, 25 bp, Homo sapien
gaggacattgccagaccaagtggaa

SEQ ID NO: 451297 - DNA, 25 bp, Homo sapien
gaccaagtggaatatgtctccattg

SEQ ID NO: 451298 - DNA, 25 bp, Homo sapien
gtctccattgtattccactgatggg

SEQ ID NO: 451299 - DNA, 25 bp, Homo sapien
ccactgatgggaagctaatgagatg

SEQ ID NO: 451300 - DNA, 25 bp, Homo sapien
cagctgaatcttggcataccctttg

SEQ ID NO: 451301 - DNA, 25 bp, Homo sapien
aatcttggcataccctttgctttag

SEQ ID NO: 451302 - DNA, 25 bp, Homo sapien
ggcataccctttgctttagatttat

SEQ ID NO: 451303 - DNA, 25 bp, Homo sapien
taccctttgctttagatttatgtgt

SEQ ID NO: 451304 - DNA, 25 bp, Homo sapien
gcctggaaggtttatagatactgtc

SEQ ID NO: 451305 - DNA, 25 bp, Homo sapien
gatactgtcaattgtcagctaggaa

SEQ ID NO: 451306 - DNA, 25 bp, Homo sapien
ggaaaagagctagcatcttgtacta

SEQ ID NO: 451307 - DNA, 25 bp, Homo sapien
tactagctggaaaaagagtcttgcc

SEQ ID NO: 451308 - DNA, 25 bp, Homo sapien
ttgccaataagactgaccgatccct

SEQ ID NO: 451309 - DNA, 25 bp, Homo sapien
actgaccgatccctcattgaggaaa

SEQ ID NO: 451310 - DNA, 25 bp, Homo sapien
ttgagtcagtgtgcacgcattatgc

SEQ ID NO: 451311 - DNA, 25 bp, Homo sapien
gtgcacgcattatgcaaagtcgcat

SEQ ID NO: 451312 - DNA, 25 bp, Homo sapien
gcaaagtcgcattccaaatattcat

SEQ ID NO: 451313 - DNA, 25 bp, Homo sapien
gataaaccatttgttacatagcatt

SEQ ID NO: 451314 - DNA, 25 bp, Homo sapien
gttacatagcattactcattgagag

SEQ ID NO: 451315 - DNA, 25 bp, Homo sapien
gatggtaaactccagctctttctag

SEQ ID NO: 451316 - DNA, 25 bp, Homo sapien
tctagctgagtaaccactgacctgt

SEQ ID NO: 451317 - DNA, 25 bp, Homo sapien
gctgagtaaccactgacctgtgagc

SEQ ID NO: 451318 - DNA, 25 bp, Homo sapien
cctgtgagctgggtccaggaatgct

SEQ ID NO: 451319 - DNA, 25 bp, Homo sapien
ccaggaatgctgtgaggaacaactt

SEQ ID NO: 451320 - DNA, 25 bp, Homo sapien
agaagtagtggttcatccatcaggg

SEQ ID NO: 451321 - DNA, 25 bp, Homo sapien
gcagcaactgtttttcatattttga

SEQ ID NO: 451322 - DNA, 25 bp, Homo sapien
tttgagacttgcctcagatttcccc

SEQ ID NO: 451323 - DNA, 25 bp, Homo sapien
ggctggctgggcacacagacactgt

SEQ ID NO: 451324 - DNA, 25 bp, Homo sapien
tgggcacacagacactgtcactgga

SEQ ID NO: 451325 - DNA, 25 bp, Homo sapien
ttgccacagctaccttggatggtaa

SEQ ID NO: 451326 - DNA, 25 bp, Homo sapien
tttgtacgaatcttacttatttgtt

SEQ ID NO: 451327 - DNA, 25 bp, Homo sapien
caaaagatcatctctgggatagtct

SEQ ID NO: 451328 - DNA, 25 bp, Homo sapien
gatcatctctgggatagtctaaaag

SEQ ID NO: 451329 - DNA, 25 bp, Homo sapien
ctctgggatagtctaaaagcctgtt

SEQ ID NO: 451330 - DNA, 25 bp, Homo sapien
gatagtctaaaagcctgtttgtagg

SEQ ID NO: 451331 - DNA, 25 bp, Homo sapien
gtacatttgtacctctggctacttt

SEQ ID NO: 451332 - DNA, 25 bp, Homo sapien
gataaataatgtgcttacctaagat

SEQ ID NO: 451333 - DNA, 25 bp, Homo sapien
tgtgcttacctaagatattatcttt

SEQ ID NO: 451334 - DNA, 25 bp, Homo sapien
tagaatagaaactttatgatcatgt

SEQ ID NO: 451335 - DNA, 25 bp, Homo sapien
gatcatgtttaattgcaacagtaat

SEQ ID NO: 451336 - DNA, 25 bp, Homo sapien
gatagtaactaattctaccttcctg

SEQ ID NO: 451337 - DNA, 25 bp, Homo sapien
acccattgcctgtccctagagtaaa

SEQ ID NO: 451338 - DNA, 25 bp, Homo sapien
ttgcctgtccctagagtaaaggtcg

SEQ ID NO: 451339 - DNA, 25 bp, Homo sapien
gcctgtccctagagtaaaggtcgtt

SEQ ID NO: 451340 - DNA, 25 bp, Homo sapien
tgtccctagagtaaaggtcgttcgg

SEQ ID NO: 451341 - DNA, 25 bp, Homo sapien
ctagagtaaaggtcgttcggagcct

SEQ ID NO: 451342 - DNA, 25 bp, Homo sapien
gtgtgaagggcattttcactaaggg

SEQ ID NO: 451343 - DNA, 25 bp, Homo sapien
cactaaggggtaggttcctcctgtg

SEQ ID NO: 451344 - DNA, 25 bp, Homo sapien
ttttatttgagcgtaggttccctca

SEQ ID NO: 451345 - DNA, 25 bp, Homo sapien
tgagcgtaggttccctcaaagaaag

SEQ ID NO: 451346 - DNA, 25 bp, Homo sapien
cctcaaagaaagaagtgcgttatgt

SEQ ID NO: 451347 - DNA, 25 bp, Homo sapien
agaagtgcgttatgtatgttatata

SEQ ID NO: 451348 - DNA, 25 bp, Homo sapien
gtttatttcagacatgtaatgatga

SEQ ID NO: 451349 - DNA, 25 bp, Homo sapien
ccaggaaatctgtcaacataattta

SEQ ID NO: 451350 - DNA, 25 bp, Homo sapien
ggaaatctgtcaacataatttattc

SEQ ID NO: 451351 - DNA, 25 bp, Homo sapien
cataatttattctatcaaagggaca

SEQ ID NO: 451352 - DNA, 25 bp, Homo sapien
ttctatcaaagggacaaataatcat

SEQ ID NO: 451353 - DNA, 25 bp, Homo sapien
agggacaaataatcatagaagctat

SEQ ID NO: 451354 - DNA, 25 bp, Homo sapien
gaagctattctcatgagaatttgaa

SEQ ID NO: 451355 - DNA, 25 bp, Homo sapien
taaaatgggtataagaaggcagtta

SEQ ID NO: 451356 - DNA, 25 bp, Homo sapien
gagcctggtaggtggagtttgcaat

SEQ ID NO: 451357 - DNA, 25 bp, Homo sapien
agactgtgtcactgtacttgagcct

SEQ ID NO: 451358 - DNA, 25 bp, Homo sapien
actgtgtcactgtacttgagcctgg

SEQ ID NO: 451359 - DNA, 25 bp, Homo sapien
tctagctatctattgaacatttact

SEQ ID NO: 451360 - DNA, 25 bp, Homo sapien
gctgaggcaggaagccctttagtca

SEQ ID NO: 451361 - DNA, 25 bp, Homo sapien
ggcaggaagccctttagtcacttgc

SEQ ID NO: 451362 - DNA, 25 bp, Homo sapien
aggaagccctttagtcacttgccga

SEQ ID NO: 451363 - DNA, 25 bp, Homo sapien
aagccctttagtcacttgccgaagg

SEQ ID NO: 451364 - DNA, 25 bp, Homo sapien
tagtcacttgccgaaggccacgctg

SEQ ID NO: 451365 - DNA, 25 bp, Homo sapien
gaaggccacgctgttacccatggga

SEQ ID NO: 451366 - DNA, 25 bp, Homo sapien
gctgttacccatgggaccggttttg

SEQ ID NO: 451367 - DNA, 25 bp, Homo sapien
ttttgggcggccgaagagcactcat

SEQ ID NO: 451368 - DNA, 25 bp, Homo sapien
tttgggcggccgaagagcactcatg

SEQ ID NO: 451369 - DNA, 25 bp, Homo sapien
aagagcactcatggggccggattca

SEQ ID NO: 451370 - DNA, 25 bp, Homo sapien
tggctcaggatgtgcccttgggaac

SEQ ID NO: 451371 - DNA, 25 bp, Homo sapien
tgtgcccttgggaactaaagcaggt

SEQ ID NO: 451372 - DNA, 25 bp, Homo sapien
aggtgatggccaaacaccccagaaa

SEQ ID NO: 451373 - DNA, 25 bp, Homo sapien
tctgggcccgtgtctgtggcttcaa

SEQ ID NO: 451374 - DNA, 25 bp, Homo sapien
gtgtctgtggcttcaatgccatcct

SEQ ID NO: 451375 - DNA, 25 bp, Homo sapien
atgccatcctcctcatgtgtgtcaa

SEQ ID NO: 451376 - DNA, 25 bp, Homo sapien
atattcttttatgcctacttcgcct

SEQ ID NO: 451377 - DNA, 25 bp, Homo sapien
ggagctctgagtcctcaggtccacc

SEQ ID NO: 451378 - DNA, 25 bp, Homo sapien
gtgtccagattgagaaccttacctg

SEQ ID NO: 451379 - DNA, 25 bp, Homo sapien
ttgagaaccttacctggtggaccct

SEQ ID NO: 451380 - DNA, 25 bp, Homo sapien
ttacctggtggaccctggctcagga

SEQ ID NO: 451381 - DNA, 25 bp, Homo sapien
aacagtttgaggtactctgagtttc

SEQ ID NO: 451382 - DNA, 25 bp, Homo sapien
ggtactctgagtttcttacaactat

SEQ ID NO: 451383 - DNA, 25 bp, Homo sapien
gtttcttacaactatttgtctctga

SEQ ID NO: 451384 - DNA, 25 bp, Homo sapien
tctctgaatagttttctcttaaaat

SEQ ID NO: 451385 - DNA, 25 bp, Homo sapien
tgtttatctgtggtttccgtactgc

SEQ ID NO: 451386 - DNA, 25 bp, Homo sapien
ttatctgtggtttccgtactgccta

SEQ ID NO: 451387 - DNA, 25 bp, Homo sapien
taaaaacattgtccttccttctttg

SEQ ID NO: 451388 - DNA, 25 bp, Homo sapien
tctttggttacagtggagtctcttc

SEQ ID NO: 451389 - DNA, 25 bp, Homo sapien
tgtggtttccgtactgcctatgata

SEQ ID NO: 451390 - DNA, 25 bp, Homo sapien
ggtttccgtactgcctatgatacat

SEQ ID NO: 451391 - DNA, 25 bp, Homo sapien
gtactgcctatgatacattataaga

SEQ ID NO: 451392 - DNA, 25 bp, Homo sapien
ggttggtagaatcactataatgtaa

SEQ ID NO: 451393 - DNA, 25 bp, Homo sapien
atgtaatgtgacttaaaccttagac

SEQ ID NO: 451394 - DNA, 25 bp, Homo sapien
gtgacttaaaccttagacatcaatc

SEQ ID NO: 451395 - DNA, 25 bp, Homo sapien
gacatcaatcattattttggtactt

SEQ ID NO: 451396 - DNA, 25 bp, Homo sapien
atataactgatgttttattccttgt

SEQ ID NO: 451397 - DNA, 25 bp, Homo sapien
tattccttgtgactacactatttag

SEQ ID NO: 451398 - DNA, 25 bp, Homo sapien
taatattgttttgcatagagaggat

SEQ ID NO: 451399 - DNA, 25 bp, Homo sapien
gaggatactgtagacagaacccagt

SEQ ID NO: 451400 - DNA, 25 bp, Homo sapien
acagaacccagtgatggagccttaa

SEQ ID NO: 451401 - DNA, 25 bp, Homo sapien
acccagtgatggagccttaagtaaa

SEQ ID NO: 451402 - DNA, 25 bp, Homo sapien
ttttggtgtgtggttggtagaatca

SEQ ID NO: 451403 - DNA, 25 bp, Homo sapien
tcacatttttacatctgagacgggt

SEQ ID NO: 451404 - DNA, 25 bp, Homo sapien
tctgagacgggttttttaagttcat

SEQ ID NO: 451405 - DNA, 25 bp, Homo sapien
tattggtaatacaacctcttcatta

SEQ ID NO: 451406 - DNA, 25 bp, Homo sapien
atacaacctcttcattaaataacaa

SEQ ID NO: 451407 - DNA, 25 bp, Homo sapien
tgtagttttcattccatattaagat

SEQ ID NO: 451408 - DNA, 25 bp, Homo sapien
ccatattaagatacagtttctgaga

SEQ ID NO: 451409 - DNA, 25 bp, Homo sapien
gaatcattgaatggactagaatatg

SEQ ID NO: 451410 - DNA, 25 bp, Homo sapien
gtcaaaaattgatcctgtgtagttt

SEQ ID NO: 451411 - DNA, 25 bp, Homo sapien
attgatcctgtgtagtttgggttca

SEQ ID NO: 451412 - DNA, 25 bp, Homo sapien
tgtagtttgggttcagggctgactt

SEQ ID NO: 451413 - DNA, 25 bp, Homo sapien
ggttcagggctgacttaaaataaag

SEQ ID NO: 451414 - DNA, 25 bp, Homo sapien
gtgttgtattctttttcattgggtg

SEQ ID NO: 451415 - DNA, 25 bp, Homo sapien
attctttttcattgggtgatgtcag

SEQ ID NO: 451416 - DNA, 25 bp, Homo sapien
cattgggtgatgtcagggtgataac

SEQ ID NO: 451417 - DNA, 25 bp, Homo sapien
gtcagggtgataaccagacattcat

SEQ ID NO: 451418 - DNA, 25 bp, Homo sapien
ggtgataaccagacattcatggaaa

SEQ ID NO: 451419 - DNA, 25 bp, Homo sapien
gacattcatggaaaggcatgcagtt

SEQ ID NO: 451420 - DNA, 25 bp, Homo sapien
aggcatgcagtttgtccattgtgac

SEQ ID NO: 451421 - DNA, 25 bp, Homo sapien
agtttgtccattgtgacagtttgtt

SEQ ID NO: 451422 - DNA, 25 bp, Homo sapien
atctaactggaaagtcagcttggaa

SEQ ID NO: 451423 - DNA, 25 bp, Homo sapien
atggacatttccaagtatgtttggt

SEQ ID NO: 451424 - DNA, 25 bp, Homo sapien
caagtatgtttggtgagtcacagat

SEQ ID NO: 451425 - DNA, 25 bp, Homo sapien
gggatcaagaatgatgcccagattc

SEQ ID NO: 451426 - DNA, 25 bp, Homo sapien
gaatgatgcccagattctgggtgag

SEQ ID NO: 451427 - DNA, 25 bp, Homo sapien
cagtgctgtggtgcacaagtagtga

SEQ ID NO: 451428 - DNA, 25 bp, Homo sapien
ctgtggtgcacaagtagtgatgtta

SEQ ID NO: 451429 - DNA, 25 bp, Homo sapien
agtgatgttatgtttccgggtgacc

SEQ ID NO: 451430 - DNA, 25 bp, Homo sapien
gatgttatgtttccgggtgacctgc

SEQ ID NO: 451431 - DNA, 25 bp, Homo sapien
atgtttccgggtgacctgctgttta

SEQ ID NO: 451432 - DNA, 25 bp, Homo sapien
tttccgggtgacctgctgtttagca

SEQ ID NO: 451433 - DNA, 25 bp, Homo sapien
tgacctgctgtttagcaggagccca

SEQ ID NO: 451434 - DNA, 25 bp, Homo sapien
tgtttagcaggagcccagcctgtgg

SEQ ID NO: 451435 - DNA, 25 bp, Homo sapien
gaactgaaactagctccctagggat

SEQ ID NO: 451436 - DNA, 25 bp, Homo sapien
tcactttcttagctggtcctatttt

SEQ ID NO: 451437 - DNA, 25 bp, Homo sapien
cttagctggtcctattttttcacat

SEQ ID NO: 451438 - DNA, 25 bp, Homo sapien
cctcttcaatgatatttcagcagtt

SEQ ID NO: 451439 - DNA, 25 bp, Homo sapien
attctggcatgtggctatcaagtta

SEQ ID NO: 451440 - DNA, 25 bp, Homo sapien
tatcaagttagattgctgtaggcat

SEQ ID NO: 451441 - DNA, 25 bp, Homo sapien
ggcatcatattgtcatggtaactac

SEQ ID NO: 451442 - DNA, 25 bp, Homo sapien
ttgtcatggtaactactgaacctaa

SEQ ID NO: 451443 - DNA, 25 bp, Homo sapien
atttcagcagtttccctcttggtcc

SEQ ID NO: 451444 - DNA, 25 bp, Homo sapien
tcttggtcctagttttgtgcacatt

SEQ ID NO: 451445 - DNA, 25 bp, Homo sapien
ggttcagattaattatatttctctc

SEQ ID NO: 451446 - DNA, 25 bp, Homo sapien
ttctctcactttcttagctggtcct

SEQ ID NO: 451447 - DNA, 25 bp, Homo sapien
acaggttttccttaattgcattagt

SEQ ID NO: 451448 - DNA, 25 bp, Homo sapien
attgcattagtcagggcttgcctcc

SEQ ID NO: 451449 - DNA, 25 bp, Homo sapien
actccccttacattacagtagttct

SEQ ID NO: 451450 - DNA, 25 bp, Homo sapien
acagtagttctgagggacttcaccc

SEQ ID NO: 451451 - DNA, 25 bp, Homo sapien
agagagcgggcttagcctggattct

SEQ ID NO: 451452 - DNA, 25 bp, Homo sapien
tagcctggattctgggagaagctct

SEQ ID NO: 451453 - DNA, 25 bp, Homo sapien
tctgggagaagctcttgcttggtcc

SEQ ID NO: 451454 - DNA, 25 bp, Homo sapien
ggtcccagacccaagtaaaacagca

SEQ ID NO: 451455 - DNA, 25 bp, Homo sapien
aacagcagtttctgttgtgtttggg

SEQ ID NO: 451456 - DNA, 25 bp, Homo sapien
ctgttctctgccctatacagaaaat

SEQ ID NO: 451457 - DNA, 25 bp, Homo sapien
gaaaataggacgtgttattcacttt

SEQ ID NO: 451458 - DNA, 25 bp, Homo sapien
ctttttttagaactgttgatatgat

SEQ ID NO: 451459 - DNA, 25 bp, Homo sapien
ttttttagaactgttgatatgattt

SEQ ID NO: 451460 - DNA, 25 bp, Homo sapien
tttttagaactgttgatatgattta

SEQ ID NO: 451461 - DNA, 25 bp, Homo sapien
ttttagaactgttgatatgatttaa

SEQ ID NO: 451462 - DNA, 25 bp, Homo sapien
tttagaactgttgatatgatttaaa

SEQ ID NO: 451463 - DNA, 25 bp, Homo sapien
agaactgttgatatgatttaaaaga

SEQ ID NO: 451464 - DNA, 25 bp, Homo sapien
gaactgttgatatgatttaaaagat

SEQ ID NO: 451465 - DNA, 25 bp, Homo sapien
taaaagataagattaatgggccggg

SEQ ID NO: 451466 - DNA, 25 bp, Homo sapien
aaagataagattaatgggccgggcg

SEQ ID NO: 451467 - DNA, 25 bp, Homo sapien
aagataagattaatgggccgggcgc

SEQ ID NO: 451468 - DNA, 25 bp, Homo sapien
agataagattaatgggccgggcgca

SEQ ID NO: 451469 - DNA, 25 bp, Homo sapien
atgcaaagggacagttaaagcttca

SEQ ID NO: 451470 - DNA, 25 bp, Homo sapien
gcaaagggacagttaaagcttcata

SEQ ID NO: 451471 - DNA, 25 bp, Homo sapien
gacagttaaagcttcatatgcatta

SEQ ID NO: 451472 - DNA, 25 bp, Homo sapien
aagagtgacaaattgagcgttcaac

SEQ ID NO: 451473 - DNA, 25 bp, Homo sapien
agtgacaaattgagcgttcaactca

SEQ ID NO: 451474 - DNA, 25 bp, Homo sapien
gacaaattgagcgttcaactcaaga

SEQ ID NO: 451475 - DNA, 25 bp, Homo sapien
aaattgagcgttcaactcaagaagt

SEQ ID NO: 451476 - DNA, 25 bp, Homo sapien
ggaagtaataatagcacaacttagt

SEQ ID NO: 451477 - DNA, 25 bp, Homo sapien
gtaataatagcacaacttagtgaaa

SEQ ID NO: 451478 - DNA, 25 bp, Homo sapien
aaactaaaacatatcagcaaaactg

SEQ ID NO: 451479 - DNA, 25 bp, Homo sapien
gcaaaactgaaagtgtttctttgaa

SEQ ID NO: 451480 - DNA, 25 bp, Homo sapien
gaagggatcaagaatgatgcccaga

SEQ ID NO: 451481 - DNA, 25 bp, Homo sapien
ggatcaagaatgatgcccagattct

SEQ ID NO: 451482 - DNA, 25 bp, Homo sapien
gaatgatgcccagattctgggtgag

SEQ ID NO: 451483 - DNA, 25 bp, Homo sapien
cagtgctgtggtgcacaagtagtga

SEQ ID NO: 451484 - DNA, 25 bp, Homo sapien
ctgtggtgcacaagtagtgatgtta

SEQ ID NO: 451485 - DNA, 25 bp, Homo sapien
agtgatgttatgtttccgggtgacc

SEQ ID NO: 451486 - DNA, 25 bp, Homo sapien
gatgttatgtttccgggtgacctgc

SEQ ID NO: 451487 - DNA, 25 bp, Homo sapien
atgtttccgggtgacctgctgttta

SEQ ID NO: 451488 - DNA, 25 bp, Homo sapien
tttccgggtgacctgctgtttagca

SEQ ID NO: 451489 - DNA, 25 bp, Homo sapien
gacctgctgtttagcaggagcccag

SEQ ID NO: 451490 - DNA, 25 bp, Homo sapien
gtggctaagaagtatagagaactga

SEQ ID NO: 451491 - DNA, 25 bp, Homo sapien
taccctttgtcttcctagaagtaat

SEQ ID NO: 451492 - DNA, 25 bp, Homo sapien
ttcctagaagtaatccctggagcct

SEQ ID NO: 451493 - DNA, 25 bp, Homo sapien
cctgtgtccagcactaatctatgag

SEQ ID NO: 451494 - DNA, 25 bp, Homo sapien
gtccagcactaatctatgagcttgt

SEQ ID NO: 451495 - DNA, 25 bp, Homo sapien
ctaatctatgagcttgtgatatttc

SEQ ID NO: 451496 - DNA, 25 bp, Homo sapien
atttctttctttaagctagtcatat

SEQ ID NO: 451497 - DNA, 25 bp, Homo sapien
taagctagtcatatttagcagtggg

SEQ ID NO: 451498 - DNA, 25 bp, Homo sapien
cttgtgatatttctggtttcctgat

SEQ ID NO: 451499 - DNA, 25 bp, Homo sapien
atatttctggtttcctgatctctct

SEQ ID NO: 451500 - DNA, 25 bp, Homo sapien
atacaaggatcctggaggctctctg

SEQ ID NO: 451501 - DNA, 25 bp, Homo sapien
aatctgcgcagataagcaagtgtgt

SEQ ID NO: 451502 - DNA, 25 bp, Homo sapien
tgggtggatcaagagaccgagacca

SEQ ID NO: 451503 - DNA, 25 bp, Homo sapien
gggtggatcaagagaccgagaccat

SEQ ID NO: 451504 - DNA, 25 bp, Homo sapien
ggtggatcaagagaccgagaccatc

SEQ ID NO: 451505 - DNA, 25 bp, Homo sapien
tttctactaaaaatagccgggcgag

SEQ ID NO: 451506 - DNA, 25 bp, Homo sapien
tctactaaaaatagccgggcgaggt

SEQ ID NO: 451507 - DNA, 25 bp, Homo sapien
tactaaaaatagccgggcgaggttg

SEQ ID NO: 451508 - DNA, 25 bp, Homo sapien
ctaaaaatagccgggcgaggttgca

SEQ ID NO: 451509 - DNA, 25 bp, Homo sapien
taaaaatagccgggcgaggttgcat

SEQ ID NO: 451510 - DNA, 25 bp, Homo sapien
aaaaatagccgggcgaggttgcatt

SEQ ID NO: 451511 - DNA, 25 bp, Homo sapien
aaatagccgggcgaggttgcattga

SEQ ID NO: 451512 - DNA, 25 bp, Homo sapien
atagccgggcgaggttgcattgagc

SEQ ID NO: 451513 - DNA, 25 bp, Homo sapien
gaatccttttttgtctcatggactg

SEQ ID NO: 451514 - DNA, 25 bp, Homo sapien
ataactaaggttggattatcccaca

SEQ ID NO: 451515 - DNA, 25 bp, Homo sapien
ttggattatcccacaatttgctctg

SEQ ID NO: 451516 - DNA, 25 bp, Homo sapien
atttgctctgtgtctaattattctg

SEQ ID NO: 451517 - DNA, 25 bp, Homo sapien
gtgtctaattattctgaggtggatt

SEQ ID NO: 451518 - DNA, 25 bp, Homo sapien
aggtggattgtaatgaagccagcaa

SEQ ID NO: 451519 - DNA, 25 bp, Homo sapien
agccagcaagacttatacattggaa

SEQ ID NO: 451520 - DNA, 25 bp, Homo sapien
gataagatatgcctgcagatctgct

SEQ ID NO: 451521 - DNA, 25 bp, Homo sapien
gcagatctgcttcagatttcctgag

SEQ ID NO: 451522 - DNA, 25 bp, Homo sapien
gcttcagatttcctgagggcagtag

SEQ ID NO: 451523 - DNA, 25 bp, Homo sapien
ctttttcaccactgctctttaagta

SEQ ID NO: 451524 - DNA, 25 bp, Homo sapien
gtgtgtagctcagagttccttttac

SEQ ID NO: 451525 - DNA, 25 bp, Homo sapien
agttccttttacagtgaggtgtctc

SEQ ID NO: 451526 - DNA, 25 bp, Homo sapien
ggatcctgagcagactggacacaat

SEQ ID NO: 451527 - DNA, 25 bp, Homo sapien
agactggacacaatcatctctccct

SEQ ID NO: 451528 - DNA, 25 bp, Homo sapien
tcccttcctctatgtcaagcactgt

SEQ ID NO: 451529 - DNA, 25 bp, Homo sapien
gactgtgagcaaatttccatctaaa

SEQ ID NO: 451530 - DNA, 25 bp, Homo sapien
ctgttgaatgcaagcgatacctatt

SEQ ID NO: 451531 - DNA, 25 bp, Homo sapien
gatacctattgttgaagaaacccac

SEQ ID NO: 451532 - DNA, 25 bp, Homo sapien
aaacccacaaatttctgattctaag

SEQ ID NO: 451533 - DNA, 25 bp, Homo sapien
gggatacaacaaaatctacaagtca

SEQ ID NO: 451534 - DNA, 25 bp, Homo sapien
aagtcatttcaaatagcacacagga

SEQ ID NO: 451535 - DNA, 25 bp, Homo sapien
gaccaggcaggcaggcgatgaccac

SEQ ID NO: 451536 - DNA, 25 bp, Homo sapien
ggcaggcaggcgatgaccacgttcc

SEQ ID NO: 451537 - DNA, 25 bp, Homo sapien
aggcgatgaccacgttcccatctgg

SEQ ID NO: 451538 - DNA, 25 bp, Homo sapien
gaccacgttcccatctggctgggtg

SEQ ID NO: 451539 - DNA, 25 bp, Homo sapien
aagggagcgacagcagccggtacta

SEQ ID NO: 451540 - DNA, 25 bp, Homo sapien
ggagcgacagcagccggtactatat

SEQ ID NO: 451541 - DNA, 25 bp, Homo sapien
acagcagccggtactatatgatccc

SEQ ID NO: 451542 - DNA, 25 bp, Homo sapien
acagccgtgtcgtcggctctcaatt

SEQ ID NO: 451543 - DNA, 25 bp, Homo sapien
tcggctctcaattcgttcatttgca

SEQ ID NO: 451544 - DNA, 25 bp, Homo sapien
gctctcaattcgttcatttgcagaa

SEQ ID NO: 451545 - DNA, 25 bp, Homo sapien
aaacaatatattcttggcgttgtct

SEQ ID NO: 451546 - DNA, 25 bp, Homo sapien
gaacaaggacctaagactgctcttt

SEQ ID NO: 451547 - DNA, 25 bp, Homo sapien
gctcctggaaacgtttgccttcata

SEQ ID NO: 451548 - DNA, 25 bp, Homo sapien
cattttcttggtagaaacagccact

SEQ ID NO: 451549 - DNA, 25 bp, Homo sapien
aaacagccactttcccattaatata

SEQ ID NO: 451550 - DNA, 25 bp, Homo sapien
gccactttcccattaatatatctga

SEQ ID NO: 451551 - DNA, 25 bp, Homo sapien
ttcccattaatatatctgagcatca

SEQ ID NO: 451552 - DNA, 25 bp, Homo sapien
aaagctaagaacagattgaagtact

SEQ ID NO: 451553 - DNA, 25 bp, Homo sapien
tgaagtactagttactacctgaaaa

SEQ ID NO: 451554 - DNA, 25 bp, Homo sapien
tgcaggattatggttctatagtcac

SEQ ID NO: 451555 - DNA, 25 bp, Homo sapien
gattatggttctatagtcaccaatt

SEQ ID NO: 451556 - DNA, 25 bp, Homo sapien
gtcaccaattttatagaccagaaat

SEQ ID NO: 451557 - DNA, 25 bp, Homo sapien
atagtttctctctaaaaaccagaag

SEQ ID NO: 451558 - DNA, 25 bp, Homo sapien
gatctgttaacactgatcccacact

SEQ ID NO: 451559 - DNA, 25 bp, Homo sapien
gatcccacacttctatttggcaatg

SEQ ID NO: 451560 - DNA, 25 bp, Homo sapien
tttggcaatgactggcccctaagac

SEQ ID NO: 451561 - DNA, 25 bp, Homo sapien
gggtacgtcctctagctcaccacag

SEQ ID NO: 451562 - DNA, 25 bp, Homo sapien
tgcatccctgctgagacaaagtggt

SEQ ID NO: 451563 - DNA, 25 bp, Homo sapien
gacaaagtggtacatgccatttatt

SEQ ID NO: 451564 - DNA, 25 bp, Homo sapien
ttaatcctcatttgcattacctgcc

SEQ ID NO: 451565 - DNA, 25 bp, Homo sapien
acctgccttcattctggaggtattt

SEQ ID NO: 451566 - DNA, 25 bp, Homo sapien
gaggtatttgagtttgcatctcctg

SEQ ID NO: 451567 - DNA, 25 bp, Homo sapien
tttgagtttgcatctcctgataaag

SEQ ID NO: 451568 - DNA, 25 bp, Homo sapien
aggttgcatgctgcttatgacaatc

SEQ ID NO: 451569 - DNA, 25 bp, Homo sapien
ggttgcatgctgcttatgacaatct

SEQ ID NO: 451570 - DNA, 25 bp, Homo sapien
gttgcatgctgcttatgacaatcta

SEQ ID NO: 451571 - DNA, 25 bp, Homo sapien
ttgcatgctgcttatgacaatctaa

SEQ ID NO: 451572 - DNA, 25 bp, Homo sapien
tgacaatctaatgcccggccgggtg

SEQ ID NO: 451573 - DNA, 25 bp, Homo sapien
gacaatctaatgcccggccgggtgc

SEQ ID NO: 451574 - DNA, 25 bp, Homo sapien
aatctaatgcccggccgggtgcggt

SEQ ID NO: 451575 - DNA, 25 bp, Homo sapien
gaagtcaagagatagaaacgatcct

SEQ ID NO: 451576 - DNA, 25 bp, Homo sapien
agtcaagagatagaaacgatcctgg

SEQ ID NO: 451577 - DNA, 25 bp, Homo sapien
agatagaaacgatcctggccaacgt

SEQ ID NO: 451578 - DNA, 25 bp, Homo sapien
gatagaaacgatcctggccaacgtg

SEQ ID NO: 451579 - DNA, 25 bp, Homo sapien
aggtggcccatgaggtgtcagcaac

SEQ ID NO: 451580 - DNA, 25 bp, Homo sapien
catgaggtgtcagcaacatcccaac

SEQ ID NO: 451581 - DNA, 25 bp, Homo sapien
tcagggcactgatttgctatagctg

SEQ ID NO: 451582 - DNA, 25 bp, Homo sapien
actgatttgctatagctggagctac

SEQ ID NO: 451583 - DNA, 25 bp, Homo sapien
tagctggagctacatgcacctctcc

SEQ ID NO: 451584 - DNA, 25 bp, Homo sapien
agggcagatttgtaacctctggttc

SEQ ID NO: 451585 - DNA, 25 bp, Homo sapien
taacctctggttctctgcagggatc

SEQ ID NO: 451586 - DNA, 25 bp, Homo sapien
gatgaatgccttttaaaactccagc

SEQ ID NO: 451587 - DNA, 25 bp, Homo sapien
aaaactccagcttttccaagcatca

SEQ ID NO: 451588 - DNA, 25 bp, Homo sapien
tccagcttttccaagcatcattcac

SEQ ID NO: 451589 - DNA, 25 bp, Homo sapien
ccaaagcatttggttaggcttagag

SEQ ID NO: 451590 - DNA, 25 bp, Homo sapien
gggaccctgttgtaaaggacttcag

SEQ ID NO: 451591 - DNA, 25 bp, Homo sapien
tgtttcattgaatccttcagcgatc

SEQ ID NO: 451592 - DNA, 25 bp, Homo sapien
tccaggaagatttcagcatccccag

SEQ ID NO: 451593 - DNA, 25 bp, Homo sapien
agatttcagcatccccagacagagg

SEQ ID NO: 451594 - DNA, 25 bp, Homo sapien
ccccagacagaggtgggtgtcattt

SEQ ID NO: 451595 - DNA, 25 bp, Homo sapien
ttttctcttctatcatcctctgcga

SEQ ID NO: 451596 - DNA, 25 bp, Homo sapien
atcatcctctgcgatacgggtggcc

SEQ ID NO: 451597 - DNA, 25 bp, Homo sapien
gtctgccaagccgactgttgactaa

SEQ ID NO: 451598 - DNA, 25 bp, Homo sapien
agccgactgttgactaagcattttc

SEQ ID NO: 451599 - DNA, 25 bp, Homo sapien
gggttgcctttctttcaagtagcaa

SEQ ID NO: 451600 - DNA, 25 bp, Homo sapien
gtagcaaatcacttcctgtgttctt

SEQ ID NO: 451601 - DNA, 25 bp, Homo sapien
gtttatttctgagttaggcaccaaa

SEQ ID NO: 451602 - DNA, 25 bp, Homo sapien
gagttaggcaccaaaggaaggacag

SEQ ID NO: 451603 - DNA, 25 bp, Homo sapien
gacagtaggctaaaaagagatcaca

SEQ ID NO: 451604 - DNA, 25 bp, Homo sapien
gaagggcagtgacaccctgagggtc

SEQ ID NO: 451605 - DNA, 25 bp, Homo sapien
agggtccactcctcaagcacaggga

SEQ ID NO: 451606 - DNA, 25 bp, Homo sapien
aagcacagggacaggccgattccaa

SEQ ID NO: 451607 - DNA, 25 bp, Homo sapien
agggacaggccgattccaagaccaa

SEQ ID NO: 451608 - DNA, 25 bp, Homo sapien
tccaagaccaacctaaacactcaag

SEQ ID NO: 451609 - DNA, 25 bp, Homo sapien
cactcaagagcaggcaggtaattat

SEQ ID NO: 451610 - DNA, 25 bp, Homo sapien
aatctggattctgctcttgtttagc

SEQ ID NO: 451611 - DNA, 25 bp, Homo sapien
tctgctcttgtttagctttggtttt

SEQ ID NO: 451612 - DNA, 25 bp, Homo sapien
tgatcgtgggtttcttcccttcctc

SEQ ID NO: 451613 - DNA, 25 bp, Homo sapien
tgcacaatcgcttcccttcactgaa

SEQ ID NO: 451614 - DNA, 25 bp, Homo sapien
tcccttcactgaattcccttcaaag

SEQ ID NO: 451615 - DNA, 25 bp, Homo sapien
caaagccaaagtttcttgagcactt

SEQ ID NO: 451616 - DNA, 25 bp, Homo sapien
agtttcttgagcactttttcttgtg

SEQ ID NO: 451617 - DNA, 25 bp, Homo sapien
tttcttgtgtgcagtcttgtgtgtt

SEQ ID NO: 451618 - DNA, 25 bp, Homo sapien
tctctccatgtcgttacgcagctga

SEQ ID NO: 451619 - DNA, 25 bp, Homo sapien
catgtcgttacgcagctgagcactg

SEQ ID NO: 451620 - DNA, 25 bp, Homo sapien
gctgagcactggttgggatgcattc

SEQ ID NO: 451621 - DNA, 25 bp, Homo sapien
ggatgcattcgaatgacttcagcaa

SEQ ID NO: 451622 - DNA, 25 bp, Homo sapien
agcccccgctctgttttatttattg

SEQ ID NO: 451623 - DNA, 25 bp, Homo sapien
aggccggatgcagtgattcctgcct

SEQ ID NO: 451624 - DNA, 25 bp, Homo sapien
ggccggatgcagtgattcctgcctg

SEQ ID NO: 451625 - DNA, 25 bp, Homo sapien
gccggatgcagtgattcctgcctgt

SEQ ID NO: 451626 - DNA, 25 bp, Homo sapien
ccggatgcagtgattcctgcctgtg

SEQ ID NO: 451627 - DNA, 25 bp, Homo sapien
cggatgcagtgattcctgcctgtgc

SEQ ID NO: 451628 - DNA, 25 bp, Homo sapien
ggatgcagtgattcctgcctgtgct

SEQ ID NO: 451629 - DNA, 25 bp, Homo sapien
ttcaagaccaactggggcaacgtgg

SEQ ID NO: 451630 - DNA, 25 bp, Homo sapien
aagaccaactggggcaacgtggtga

SEQ ID NO: 451631 - DNA, 25 bp, Homo sapien
agaccaactggggcaacgtggtgag

SEQ ID NO: 451632 - DNA, 25 bp, Homo sapien
atgctgtttctcatcgtctttctgt

SEQ ID NO: 451633 - DNA, 25 bp, Homo sapien
gtttctcatcgtctttctgtgtatc

SEQ ID NO: 451634 - DNA, 25 bp, Homo sapien
atcgtctttctgtgtatcttcatca

SEQ ID NO: 451635 - DNA, 25 bp, Homo sapien
ctgtgtatcttcatcactgtagtta

SEQ ID NO: 451636 - DNA, 25 bp, Homo sapien
cttcatcactgtagttaatcatcta

SEQ ID NO: 451637 - DNA, 25 bp, Homo sapien
atgataccgccaagctctaatccgc

SEQ ID NO: 451638 - DNA, 25 bp, Homo sapien
agatttgtcattactatcaactaga

SEQ ID NO: 451639 - DNA, 25 bp, Homo sapien
tagaatacctacaagcactgactgc

SEQ ID NO: 451640 - DNA, 25 bp, Homo sapien
agcactgactgctatcagacatcta

SEQ ID NO: 451641 - DNA, 25 bp, Homo sapien
ctgctatcagacatctatctgcctg

SEQ ID NO: 451642 - DNA, 25 bp, Homo sapien
atctatctgcctgatgtttgtcata

SEQ ID NO: 451643 - DNA, 25 bp, Homo sapien
gtctgttatgtatttcttcacctag

SEQ ID NO: 451644 - DNA, 25 bp, Homo sapien
tcttcacctagcttcttgtaatatt

SEQ ID NO: 451645 - DNA, 25 bp, Homo sapien
tatttatggacgtttccagtttttg

SEQ ID NO: 451646 - DNA, 25 bp, Homo sapien
tccagtttttgtaccttcttagcta

SEQ ID NO: 451647 - DNA, 25 bp, Homo sapien
ttcttagctaaagcagttgcctttt

SEQ ID NO: 451648 - DNA, 25 bp, Homo sapien
aactttgtatccactgtagttgaca

SEQ ID NO: 451649 - DNA, 25 bp, Homo sapien
gtattggttgctaattaactgccat

SEQ ID NO: 451650 - DNA, 25 bp, Homo sapien
taattaactgccatattgccctgtc

SEQ ID NO: 451651 - DNA, 25 bp, Homo sapien
taagtcccttttcctactttcatgt

SEQ ID NO: 451652 - DNA, 25 bp, Homo sapien
ttcatgtaaagtgccacaggtgtct

SEQ ID NO: 451653 - DNA, 25 bp, Homo sapien
acaggtgtcttggtttgcatattca

SEQ ID NO: 451654 - DNA, 25 bp, Homo sapien
taagaccatgttttaaccctaatga

SEQ ID NO: 451655 - DNA, 25 bp, Homo sapien
tgaatgaaggcacaagcagcccctg

SEQ ID NO: 451656 - DNA, 25 bp, Homo sapien
acaagcagcccctgaaactcgtgta

SEQ ID NO: 451657 - DNA, 25 bp, Homo sapien
ttgggtaccctgatgggctttccca

SEQ ID NO: 451658 - DNA, 25 bp, Homo sapien
ccctgatgggctttcccatggtaaa

SEQ ID NO: 451659 - DNA, 25 bp, Homo sapien
tttcccatggtaaaacagctcgatc

SEQ ID NO: 451660 - DNA, 25 bp, Homo sapien
tggtaaaacagctcgatcctggata

SEQ ID NO: 451661 - DNA, 25 bp, Homo sapien
ctcgatcctggataacacatacttt

SEQ ID NO: 451662 - DNA, 25 bp, Homo sapien
tttttgggttcactgtaaattacag

SEQ ID NO: 451663 - DNA, 25 bp, Homo sapien
agtcgtcgccgtggaggtgactact

SEQ ID NO: 451664 - DNA, 25 bp, Homo sapien
ctcaggacttgaagctgtcaggtca

SEQ ID NO: 451665 - DNA, 25 bp, Homo sapien
gaaaatacatggcttgtgcccatca

SEQ ID NO: 451666 - DNA, 25 bp, Homo sapien
tacatggcttgtgcccatcataaaa

SEQ ID NO: 451667 - DNA, 25 bp, Homo sapien
gattcagactgaaggcttagctttg

SEQ ID NO: 451668 - DNA, 25 bp, Homo sapien
tgaaggcttagctttggttttttca

SEQ ID NO: 451669 - DNA, 25 bp, Homo sapien
aaatcacaggtgactcatctgatca

SEQ ID NO: 451670 - DNA, 25 bp, Homo sapien
ggtgactcatctgatcattctatat

SEQ ID NO: 451671 - DNA, 25 bp, Homo sapien
ggcaatttatgcctctcttaagtat

SEQ ID NO: 451672 - DNA, 25 bp, Homo sapien
ttatgcctctcttaagtatgtactg

SEQ ID NO: 451673 - DNA, 25 bp, Homo sapien
atgtactgacataacctaatatact

SEQ ID NO: 451674 - DNA, 25 bp, Homo sapien
tttagtcactgaaatatgcatcgtg

SEQ ID NO: 451675 - DNA, 25 bp, Homo sapien
gaaatatgcatcgtgtaacaaagat

SEQ ID NO: 451676 - DNA, 25 bp, Homo sapien
tggatggcacatcagtataataaat

SEQ ID NO: 451677 - DNA, 25 bp, Homo sapien
gatggcacatcagtataataaatga

SEQ ID NO: 451678 - DNA, 25 bp, Homo sapien
gttcctaaaaattcatccctttcat

SEQ ID NO: 451679 - DNA, 25 bp, Homo sapien
ttcctaaaaattcatccctttcata

SEQ ID NO: 451680 - DNA, 25 bp, Homo sapien
cctaaaaattcatccctttcataag

SEQ ID NO: 451681 - DNA, 25 bp, Homo sapien
aaaaattcatccctttcataagagg

SEQ ID NO: 451682 - DNA, 25 bp, Homo sapien
aaaattcatccctttcataagaggg

SEQ ID NO: 451683 - DNA, 25 bp, Homo sapien
gggaagaatgagtgcctgatattgt

SEQ ID NO: 451684 - DNA, 25 bp, Homo sapien
ggaagaatgagtgcctgatattgtt

SEQ ID NO: 451685 - DNA, 25 bp, Homo sapien
tgcctgatattgttaatacctccct

SEQ ID NO: 451686 - DNA, 25 bp, Homo sapien
gcctgatattgttaatacctccctt

SEQ ID NO: 451687 - DNA, 25 bp, Homo sapien
taagcagcctaaggacactgagatc

SEQ ID NO: 451688 - DNA, 25 bp, Homo sapien
aaggacactgagatcaaggcaaaga

SEQ ID NO: 451689 - DNA, 25 bp, Homo sapien
agagagggcaatttaggtctataat

SEQ ID NO: 451690 - DNA, 25 bp, Homo sapien
aagtcaccattatttatcgttatat

SEQ ID NO: 451691 - DNA, 25 bp, Homo sapien
attatttatcgttatatctgtggcg

SEQ ID NO: 451692 - DNA, 25 bp, Homo sapien
gttagccaagaggtctgaaatgctc

SEQ ID NO: 451693 - DNA, 25 bp, Homo sapien
aaatgctcttgcctatttctcaaaa

SEQ ID NO: 451694 - DNA, 25 bp, Homo sapien
gctcttgcctatttctcaaaagtct

SEQ ID NO: 451695 - DNA, 25 bp, Homo sapien
attattaccttagaactggcctacg

SEQ ID NO: 451696 - DNA, 25 bp, Homo sapien
actggcctacgatcatggaacttag

SEQ ID NO: 451697 - DNA, 25 bp, Homo sapien
ggaacttagatacagggacccaggt

SEQ ID NO: 451698 - DNA, 25 bp, Homo sapien
cagcccttgtggaattgataaagga

SEQ ID NO: 451699 - DNA, 25 bp, Homo sapien
atgtgaggagctgaggtctctctct

SEQ ID NO: 451700 - DNA, 25 bp, Homo sapien
tctctctctgttgctgactgagtcc

SEQ ID NO: 451701 - DNA, 25 bp, Homo sapien
tgttgctgactgagtccttctgaaa

SEQ ID NO: 451702 - DNA, 25 bp, Homo sapien
ctgactgagtccttctgaaagctgg

SEQ ID NO: 451703 - DNA, 25 bp, Homo sapien
gagtccttctgaaagctggacacag

SEQ ID NO: 451704 - DNA, 25 bp, Homo sapien
agctggacacagacacttttactca

SEQ ID NO: 451705 - DNA, 25 bp, Homo sapien
ggacacagacacttttactcaggaa

SEQ ID NO: 451706 - DNA, 25 bp, Homo sapien
gacacttttactcaggaacgcagtt

SEQ ID NO: 451707 - DNA, 25 bp, Homo sapien
tactcaggaacgcagttactcgctg

SEQ ID NO: 451708 - DNA, 25 bp, Homo sapien
ggaacgcagttactcgctggtcatc

SEQ ID NO: 451709 - DNA, 25 bp, Homo sapien
gtagtgatatttaatccaatccaac

SEQ ID NO: 451710 - DNA, 25 bp, Homo sapien
gtgatatttaatccaatccaacaac

SEQ ID NO: 451711 - DNA, 25 bp, Homo sapien
atttaatccaatccaacaactatag

SEQ ID NO: 451712 - DNA, 25 bp, Homo sapien
ttaatccaatccaacaactataggc

SEQ ID NO: 451713 - DNA, 25 bp, Homo sapien
caacaactataggctgggttaaata

SEQ ID NO: 451714 - DNA, 25 bp, Homo sapien
aaaggtcattattgtctatattcca

SEQ ID NO: 451715 - DNA, 25 bp, Homo sapien
aggtcattattgtctatattccaag

SEQ ID NO: 451716 - DNA, 25 bp, Homo sapien
ggtcattattgtctatattccaagt

SEQ ID NO: 451717 - DNA, 25 bp, Homo sapien
gtcattattgtctatattccaagtg

SEQ ID NO: 451718 - DNA, 25 bp, Homo sapien
cattattgtctatattccaagtgga

SEQ ID NO: 451719 - DNA, 25 bp, Homo sapien
ttattgtctatattccaagtggaat

SEQ ID NO: 451720 - DNA, 25 bp, Homo sapien
gaccttgaagatgacccaggttgct

SEQ ID NO: 451721 - DNA, 25 bp, Homo sapien
aggttgcttggctgattatgttgaa

SEQ ID NO: 451722 - DNA, 25 bp, Homo sapien
gttacgatgatgtccatggctttgt

SEQ ID NO: 451723 - DNA, 25 bp, Homo sapien
gagatgagcttccagatgacatcat

SEQ ID NO: 451724 - DNA, 25 bp, Homo sapien
gtacaggaaatgtcatgaccttgaa

SEQ ID NO: 451725 - DNA, 25 bp, Homo sapien
tctaagtgatgcttcagtgacagct

SEQ ID NO: 451726 - DNA, 25 bp, Homo sapien
agtgacagctggaggtttccaaatc

SEQ ID NO: 451727 - DNA, 25 bp, Homo sapien
aatatgttgcaatggatcctgtatc

SEQ ID NO: 451728 - DNA, 25 bp, Homo sapien
gatcctgtatccaaatccagtcaag

SEQ ID NO: 451729 - DNA, 25 bp, Homo sapien
tacaagtactacttctactggaaat

SEQ ID NO: 451730 - DNA, 25 bp, Homo sapien
ttagctggaagatttagccacttat

SEQ ID NO: 451731 - DNA, 25 bp, Homo sapien
ttaagaaatatggatggggccggcc

SEQ ID NO: 451732 - DNA, 25 bp, Homo sapien
taagaaatatggatggggccggcca

SEQ ID NO: 451733 - DNA, 25 bp, Homo sapien
aagaaatatggatggggccggccac

SEQ ID NO: 451734 - DNA, 25 bp, Homo sapien
agaaatatggatggggccggccaca

SEQ ID NO: 451735 - DNA, 25 bp, Homo sapien
aaatatggatggggccggccacagt

SEQ ID NO: 451736 - DNA, 25 bp, Homo sapien
aatatggatggggccggccacagtg

SEQ ID NO: 451737 - DNA, 25 bp, Homo sapien
tatggatggggccggccacagtggc

SEQ ID NO: 451738 - DNA, 25 bp, Homo sapien
tggatggggccggccacagtggctc

SEQ ID NO: 451739 - DNA, 25 bp, Homo sapien
gccaagatggcaaaaaccccgactc

SEQ ID NO: 451740 - DNA, 25 bp, Homo sapien
ccaagatggcaaaaaccccgactct

SEQ ID NO: 451741 - DNA, 25 bp, Homo sapien
caagatggcaaaaaccccgactcta

SEQ ID NO: 451742 - DNA, 25 bp, Homo sapien
ggacaggatgaccttcccgaggaac

SEQ ID NO: 451743 - DNA, 25 bp, Homo sapien
gacaggatgaccttcccgaggaact

SEQ ID NO: 451744 - DNA, 25 bp, Homo sapien
acctcctgctaacccaaccagagat

SEQ ID NO: 451745 - DNA, 25 bp, Homo sapien
agagatccccttccttgctgagagg

SEQ ID NO: 451746 - DNA, 25 bp, Homo sapien
gatccccttccttgctgagagggtt

SEQ ID NO: 451747 - DNA, 25 bp, Homo sapien
ccccttccttgctgagagggttggg

SEQ ID NO: 451748 - DNA, 25 bp, Homo sapien
agatttggcagtgcctgcaggttgc

SEQ ID NO: 451749 - DNA, 25 bp, Homo sapien
tttggcagtgcctgcaggttgcctg

SEQ ID NO: 451750 - DNA, 25 bp, Homo sapien
gcaccgtgggtgtaagatgcctttc

SEQ ID NO: 451751 - DNA, 25 bp, Homo sapien
tgtgccaccaagacagccttttcca

SEQ ID NO: 451752 - DNA, 25 bp, Homo sapien
tgccaccaagacagccttttccagt

SEQ ID NO: 451753 - DNA, 25 bp, Homo sapien
gccacaagcaggcaggacacaggag

SEQ ID NO: 451754 - DNA, 25 bp, Homo sapien
gacacaggagggatggcactgccca

SEQ ID NO: 451755 - DNA, 25 bp, Homo sapien
cacaggagggatggcactgcccacg

SEQ ID NO: 451756 - DNA, 25 bp, Homo sapien
agccctgggctcatggcaccttctg

SEQ ID NO: 451757 - DNA, 25 bp, Homo sapien
gctcatggcaccttctgcagagtga

SEQ ID NO: 451758 - DNA, 25 bp, Homo sapien
agagagcctcttttccccactctgt

SEQ ID NO: 451759 - DNA, 25 bp, Homo sapien
ttccccactctgtgaggccgggcat

SEQ ID NO: 451760 - DNA, 25 bp, Homo sapien
cccactctgtgaggccgggcatttt

SEQ ID NO: 451761 - DNA, 25 bp, Homo sapien
gtgaggccgggcattttcctcagcc

SEQ ID NO: 451762 - DNA, 25 bp, Homo sapien
caccattcctgtgatgggcccaggt

SEQ ID NO: 451763 - DNA, 25 bp, Homo sapien
cattcctgtgatgggcccaggtgct

SEQ ID NO: 451764 - DNA, 25 bp, Homo sapien
tcttatgtttattcggagaatttgg

SEQ ID NO: 451765 - DNA, 25 bp, Homo sapien
gaagtgattgaacttttcaagacat

SEQ ID NO: 451766 - DNA, 25 bp, Homo sapien
gggaaccaagaggaacttacttgtg

SEQ ID NO: 451767 - DNA, 25 bp, Homo sapien
gaggaacttacttgtgtaactgaca

SEQ ID NO: 451768 - DNA, 25 bp, Homo sapien
acttgtgtaactgacaatttctgca

SEQ ID NO: 451769 - DNA, 25 bp, Homo sapien
tgtgtaactgacaatttctgcagaa

SEQ ID NO: 451770 - DNA, 25 bp, Homo sapien
aatttctgcagaaatcccccttcct

SEQ ID NO: 451771 - DNA, 25 bp, Homo sapien
taaatcagaactgcacactccttcc

SEQ ID NO: 451772 - DNA, 25 bp, Homo sapien
acactccttccctgatgatagagga

SEQ ID NO: 451773 - DNA, 25 bp, Homo sapien
gaagtgcctttaggatggtgatact

SEQ ID NO: 451774 - DNA, 25 bp, Homo sapien
agtgcctttaggatggtgatactgg

SEQ ID NO: 451775 - DNA, 25 bp, Homo sapien
gatctggttttaaaactcaaatcca

SEQ ID NO: 451776 - DNA, 25 bp, Homo sapien
atccattaagacgtttgagcacttt

SEQ ID NO: 451777 - DNA, 25 bp, Homo sapien
taagacgtttgagcactttaaaaag

SEQ ID NO: 451778 - DNA, 25 bp, Homo sapien
gcactttaaaaagaagcttcatatg

SEQ ID NO: 451779 - DNA, 25 bp, Homo sapien
catatggtttttagggatctgaata

SEQ ID NO: 451780 - DNA, 25 bp, Homo sapien
tagtatgttttttgccttgctaata

SEQ ID NO: 451781 - DNA, 25 bp, Homo sapien
gttttttgccttgctaataattcaa

SEQ ID NO: 451782 - DNA, 25 bp, Homo sapien
taattcaaatcatagtattggcaga

SEQ ID NO: 451783 - DNA, 25 bp, Homo sapien
catagtattggcagaataattcttc

SEQ ID NO: 451784 - DNA, 25 bp, Homo sapien
tctcattcatctttatacctaattt

SEQ ID NO: 451785 - DNA, 25 bp, Homo sapien
tatacctaatttacacatttgtcca

SEQ ID NO: 451786 - DNA, 25 bp, Homo sapien
tcgacacgaggcaatcaaacggtac

SEQ ID NO: 451787 - DNA, 25 bp, Homo sapien
gaggcaatcaaacggtacagggcca

SEQ ID NO: 451788 - DNA, 25 bp, Homo sapien
ttcgaatttttcttacgctcttgtt

SEQ ID NO: 451789 - DNA, 25 bp, Homo sapien
tttttcttacgctcttgttgaaaga

SEQ ID NO: 451790 - DNA, 25 bp, Homo sapien
aagaattcgatttttgtacacacac

SEQ ID NO: 451791 - DNA, 25 bp, Homo sapien
gatttttgtacacacacgtaaaagg

SEQ ID NO: 451792 - DNA, 25 bp, Homo sapien
tgagttggttatgaccatgtcagtt

SEQ ID NO: 451793 - DNA, 25 bp, Homo sapien
catgtcagttttgtcaccgtggcca

SEQ ID NO: 451794 - DNA, 25 bp, Homo sapien
gtggtgactgagacatcactgaaat

SEQ ID NO: 451795 - DNA, 25 bp, Homo sapien
gacatcactgaaattgcctcctaat

SEQ ID NO: 451796 - DNA, 25 bp, Homo sapien
ttccaagacgttaaaggtgtcttag

SEQ ID NO: 451797 - DNA, 25 bp, Homo sapien
gatattactgtcataattgcttggg

SEQ ID NO: 451798 - DNA, 25 bp, Homo sapien
ttactgtcataattgcttggggggc

SEQ ID NO: 451799 - DNA, 25 bp, Homo sapien
tcataattgcttggggggcaccatg

SEQ ID NO: 451800 - DNA, 25 bp, Homo sapien
gacagcaaactgagtcgataaatgt

SEQ ID NO: 451801 - DNA, 25 bp, Homo sapien
gttttatgtgttctgaccactgcac

SEQ ID NO: 451802 - DNA, 25 bp, Homo sapien
tgaccagctgcctccctatctctct

SEQ ID NO: 451803 - DNA, 25 bp, Homo sapien
tgctcagacctccctatccttgaga

SEQ ID NO: 451804 - DNA, 25 bp, Homo sapien
tccctatccttgagacacagcaata

SEQ ID NO: 451805 - DNA, 25 bp, Homo sapien
cctatccttgagacacagcaatact

SEQ ID NO: 451806 - DNA, 25 bp, Homo sapien
tatccttgagacacagcaatactga

SEQ ID NO: 451807 - DNA, 25 bp, Homo sapien
atccttgagacacagcaatactgaa

SEQ ID NO: 451808 - DNA, 25 bp, Homo sapien
acctctacttcaagtgtgtatcacg

SEQ ID NO: 451809 - DNA, 25 bp, Homo sapien
aggaggaattctttcaatgtggaga

SEQ ID NO: 451810 - DNA, 25 bp, Homo sapien
gaggaatctttttcgacatcaggtc

SEQ ID NO: 451811 - DNA, 25 bp, Homo sapien
tctttttcgacatcaggtcattcac

SEQ ID NO: 451812 - DNA, 25 bp, Homo sapien
actggaagccaaccctaccaatgtg

SEQ ID NO: 451813 - DNA, 25 bp, Homo sapien
gccaaccctaccaatgtgtcatatg

SEQ ID NO: 451814 - DNA, 25 bp, Homo sapien
aatctttcaagtggcacacaagctt

SEQ ID NO: 451815 - DNA, 25 bp, Homo sapien
gctttattaagcaccagggcactca

SEQ ID NO: 451816 - DNA, 25 bp, Homo sapien
cagggcactcacaaaggacagatat

SEQ ID NO: 451817 - DNA, 25 bp, Homo sapien
ggacagatatccacatgatgttaat

SEQ ID NO: 451818 - DNA, 25 bp, Homo sapien
gcagtcattggagaactagaactta

SEQ ID NO: 451819 - DNA, 25 bp, Homo sapien
tcaacagttaccaatagggcatttt

SEQ ID NO: 451820 - DNA, 25 bp, Homo sapien
tatcactagaaatcctttgtcacat

SEQ ID NO: 451821 - DNA, 25 bp, Homo sapien
atcctttgtcacatatacataccta

SEQ ID NO: 451822 - DNA, 25 bp, Homo sapien
tatacatacctatattgcagatatt

SEQ ID NO: 451823 - DNA, 25 bp, Homo sapien
tttttcctcaaaggcatgtcttgct

SEQ ID NO: 451824 - DNA, 25 bp, Homo sapien
aaaggcatgtcttgcttattcattt

SEQ ID NO: 451825 - DNA, 25 bp, Homo sapien
gagcagaaatgtcttgatcatggta

SEQ ID NO: 451826 - DNA, 25 bp, Homo sapien
gatcatggtagttttatagtagtct

SEQ ID NO: 451827 - DNA, 25 bp, Homo sapien
tagtagtcttgaaatcaggtgatgt

SEQ ID NO: 451828 - DNA, 25 bp, Homo sapien
caggtgatgtaagttatctttttca

SEQ ID NO: 451829 - DNA, 25 bp, Homo sapien
taatgtggcaatcaacctttcctgc

SEQ ID NO: 451830 - DNA, 25 bp, Homo sapien
gacggtccactcatgagaggtgcta

SEQ ID NO: 451831 - DNA, 25 bp, Homo sapien
aggtgctatgtgactccagggagtc

SEQ ID NO: 451832 - DNA, 25 bp, Homo sapien
aagctcagatgacccagcctgtgtc

SEQ ID NO: 451833 - DNA, 25 bp, Homo sapien
ctgtgtccctttagcggccgaggag

SEQ ID NO: 451834 - DNA, 25 bp, Homo sapien
ggccgaggagccaccacctgttcgg

SEQ ID NO: 451835 - DNA, 25 bp, Homo sapien
tggcttcccagaggacctgggacac

SEQ ID NO: 451836 - DNA, 25 bp, Homo sapien
tgggacactcacctagctcgttcat

SEQ ID NO: 451837 - DNA, 25 bp, Homo sapien
tagctcgttcatggcacggcggtac

SEQ ID NO: 451838 - DNA, 25 bp, Homo sapien
ggcggtactcctcatcaaaggacag

SEQ ID NO: 451839 - DNA, 25 bp, Homo sapien
gcttcataacagcacaggtggcctg

SEQ ID NO: 451840 - DNA, 25 bp, Homo sapien
tggcctggcagatctgcggctcgat

SEQ ID NO: 451841 - DNA, 25 bp, Homo sapien
agtattgttttatctaagcagtgga

SEQ ID NO: 451842 - DNA, 25 bp, Homo sapien
gagtgaaggtcatgagcctctgagc

SEQ ID NO: 451843 - DNA, 25 bp, Homo sapien
aaggtcatgagcctctgagctggcc

SEQ ID NO: 451844 - DNA, 25 bp, Homo sapien
tctgagctggcctgagttacggcca

SEQ ID NO: 451845 - DNA, 25 bp, Homo sapien
atgggataagtctgtgcctgggcaa

SEQ ID NO: 451846 - DNA, 25 bp, Homo sapien
tgtgcctgggcaaacctagataacg

SEQ ID NO: 451847 - DNA, 25 bp, Homo sapien
tgggcaaacctagataacggacatc

SEQ ID NO: 451848 - DNA, 25 bp, Homo sapien
taacggacatctgggttgcttggca

SEQ ID NO: 451849 - DNA, 25 bp, Homo sapien
atctgggttgcttggcaacggtcac

SEQ ID NO: 451850 - DNA, 25 bp, Homo sapien
aacggtcacgtgcaatcctgagttt

SEQ ID NO: 451851 - DNA, 25 bp, Homo sapien
acgtgcaatcctgagtttgtcctgc

SEQ ID NO: 451852 - DNA, 25 bp, Homo sapien
aaatccaaaccttcctgaacgctat

SEQ ID NO: 451853 - DNA, 25 bp, Homo sapien
atccaaaccttcctgaacgctatga

SEQ ID NO: 451854 - DNA, 25 bp, Homo sapien
caaaccttcctgaacgctatgacac

SEQ ID NO: 451855 - DNA, 25 bp, Homo sapien
aaccttcctgaacgctatgacacca

SEQ ID NO: 451856 - DNA, 25 bp, Homo sapien
cttcctgaacgctatgacaccatga

SEQ ID NO: 451857 - DNA, 25 bp, Homo sapien
tcctgaacgctatgacaccatgagt

SEQ ID NO: 451858 - DNA, 25 bp, Homo sapien
ctgaacgctatgacaccatgagtgg

SEQ ID NO: 451859 - DNA, 25 bp, Homo sapien
gaacgctatgacaccatgagtggaa

SEQ ID NO: 451860 - DNA, 25 bp, Homo sapien
gctatgacaccatgagtggaaaatt

SEQ ID NO: 451861 - DNA, 25 bp, Homo sapien
attccacacctaacaaacacatttg

SEQ ID NO: 451862 - DNA, 25 bp, Homo sapien
ccacacctaacaaacacatttgctt

SEQ ID NO: 451863 - DNA, 25 bp, Homo sapien
gaattgttctttaatatctttccaa

SEQ ID NO: 451864 - DNA, 25 bp, Homo sapien
aaatgactttggttaaatggaccag

SEQ ID NO: 451865 - DNA, 25 bp, Homo sapien
aatggaccagatgtatattagttaa

SEQ ID NO: 451866 - DNA, 25 bp, Homo sapien
agttgttgatattctttgagtttac

SEQ ID NO: 451867 - DNA, 25 bp, Homo sapien
gagtttacaagttaatccttattgg

SEQ ID NO: 451868 - DNA, 25 bp, Homo sapien
ggagatgtgccaatatacagttaga

SEQ ID NO: 451869 - DNA, 25 bp, Homo sapien
atatcattaatttgcactgtttggg

SEQ ID NO: 451870 - DNA, 25 bp, Homo sapien
gggaccccatttaagaatgctgaat

SEQ ID NO: 451871 - DNA, 25 bp, Homo sapien
gaatgctgaattttgccaactaaga

SEQ ID NO: 451872 - DNA, 25 bp, Homo sapien
agtaaatttgagcattctgtattaa

SEQ ID NO: 451873 - DNA, 25 bp, Homo sapien
atgaagaaacgcagtgtgtcgggct

SEQ ID NO: 451874 - DNA, 25 bp, Homo sapien
cctcctgagctcaaaagttcttccc

SEQ ID NO: 451875 - DNA, 25 bp, Homo sapien
tgagctcaaaagttcttcccacctc

SEQ ID NO: 451876 - DNA, 25 bp, Homo sapien
agctcaaaagttcttcccacctcag

SEQ ID NO: 451877 - DNA, 25 bp, Homo sapien
atcttttgtagataacagtgatatg

SEQ ID NO: 451878 - DNA, 25 bp, Homo sapien
tcttttgtagataacagtgatatgg

SEQ ID NO: 451879 - DNA, 25 bp, Homo sapien
taatcctcaggtatcaagggtggga

SEQ ID NO: 451880 - DNA, 25 bp, Homo sapien
aatcctcaggtatcaagggtgggac

SEQ ID NO: 451881 - DNA, 25 bp, Homo sapien
atcctcaggtatcaagggtgggacc

SEQ ID NO: 451882 - DNA, 25 bp, Homo sapien
tcctcaggtatcaagggtgggacca

SEQ ID NO: 451883 - DNA, 25 bp, Homo sapien
cctcaggtatcaagggtgggaccag

SEQ ID NO: 451884 - DNA, 25 bp, Homo sapien
caggtatcaagggtgggaccaggtg

SEQ ID NO: 451885 - DNA, 25 bp, Homo sapien
gatatttagacacttcctcttccat

SEQ ID NO: 451886 - DNA, 25 bp, Homo sapien
ttcctcttccattgctgtttcctat

SEQ ID NO: 451887 - DNA, 25 bp, Homo sapien
cattgctgtttcctatgactcatgc

SEQ ID NO: 451888 - DNA, 25 bp, Homo sapien
gtttcctatgactcatgcacagtta

SEQ ID NO: 451889 - DNA, 25 bp, Homo sapien
gcacagttatttgttcaggtttcat

SEQ ID NO: 451890 - DNA, 25 bp, Homo sapien
tgttcaggtttcatggaatttccca

SEQ ID NO: 451891 - DNA, 25 bp, Homo sapien
tggaatttcccaagtgtatttacct

SEQ ID NO: 451892 - DNA, 25 bp, Homo sapien
aaatgtaaattatattgccccaata

SEQ ID NO: 451893 - DNA, 25 bp, Homo sapien
tgccccaataaatgagtatgtgtgt

SEQ ID NO: 451894 - DNA, 25 bp, Homo sapien
gagaactcctagaagagctttactt

SEQ ID NO: 451895 - DNA, 25 bp, Homo sapien
gaagagctttacttaactatgaaaa

SEQ ID NO: 451896 - DNA, 25 bp, Homo sapien
gagtgagtcacaatgtaacttggct

SEQ ID NO: 451897 - DNA, 25 bp, Homo sapien
gtaacttggctcagacaagaagaat

SEQ ID NO: 451898 - DNA, 25 bp, Homo sapien
gcaaggattactatgcagatggaat

SEQ ID NO: 451899 - DNA, 25 bp, Homo sapien
tgcagatggaattggctgttactat

SEQ ID NO: 451900 - DNA, 25 bp, Homo sapien
caggatcctgaagaaacttaaccca

SEQ ID NO: 451901 - DNA, 25 bp, Homo sapien
ttaacccaaatctacatctgttccc

SEQ ID NO: 451902 - DNA, 25 bp, Homo sapien
aaatctacatctgttcccttttcat

SEQ ID NO: 451903 - DNA, 25 bp, Homo sapien
cattgaaatctaacctcccattggc

SEQ ID NO: 451904 - DNA, 25 bp, Homo sapien
cacagagcctcaagcctaatatttg

SEQ ID NO: 451905 - DNA, 25 bp, Homo sapien
aggacagtcagcatgcacgcaagaa

SEQ ID NO: 451906 - DNA, 25 bp, Homo sapien
aagaatgctttacctcataagtagg

SEQ ID NO: 451907 - DNA, 25 bp, Homo sapien
gtttatttcagacatgtaatgatga

SEQ ID NO: 451908 - DNA, 25 bp, Homo sapien
ccaggaaatctgtcaacataattta

SEQ ID NO: 451909 - DNA, 25 bp, Homo sapien
ggaaatctgtcaacataatttattc

SEQ ID NO: 451910 - DNA, 25 bp, Homo sapien
gaaatctgtcaacataatttattct

SEQ ID NO: 451911 - DNA, 25 bp, Homo sapien
acataatttattctatcaaagggac

SEQ ID NO: 451912 - DNA, 25 bp, Homo sapien
ataatttattctatcaaagggacaa

SEQ ID NO: 451913 - DNA, 25 bp, Homo sapien
ttctatcaaagggacaaataatcat

SEQ ID NO: 451914 - DNA, 25 bp, Homo sapien
agggacaaataatcatagaagctat

SEQ ID NO: 451915 - DNA, 25 bp, Homo sapien
ggacaaataatcatagaagctattc

SEQ ID NO: 451916 - DNA, 25 bp, Homo sapien
gaagctattctcatgagaatttgaa

SEQ ID NO: 451917 - DNA, 25 bp, Homo sapien
taaaatgggtataagaaggcagtta

SEQ ID NO: 451918 - DNA, 25 bp, Homo sapien
gcagtgaggagctgttttcatctgt

SEQ ID NO: 451919 - DNA, 25 bp, Homo sapien
gatcaagatgattgctattccctgt

SEQ ID NO: 451920 - DNA, 25 bp, Homo sapien
attgctattccctgttagatgatca

SEQ ID NO: 451921 - DNA, 25 bp, Homo sapien
atgatcaggacttcacttcttttga

SEQ ID NO: 451922 - DNA, 25 bp, Homo sapien
tcttctattagcacttactgggatt

SEQ ID NO: 451923 - DNA, 25 bp, Homo sapien
agcacttactgggattggtcagata

SEQ ID NO: 451924 - DNA, 25 bp, Homo sapien
tagcgagtttgaatggcagttacca

SEQ ID NO: 451925 - DNA, 25 bp, Homo sapien
cattgccagtgggagtgatgtactt

SEQ ID NO: 451926 - DNA, 25 bp, Homo sapien
gatgtactttctgatgtcataccca

SEQ ID NO: 451927 - DNA, 25 bp, Homo sapien
gatgtcatacccagtattccaagtt

SEQ ID NO: 451928 - DNA, 25 bp, Homo sapien
cagtattccaagttcaccttgcctg

SEQ ID NO: 451929 - DNA, 25 bp, Homo sapien
ttccctctatcacagttaggtgatt

SEQ ID NO: 451930 - DNA, 25 bp, Homo sapien
gaccataaagaatccaacaactgaa

SEQ ID NO: 451931 - DNA, 25 bp, Homo sapien
aagattcaaaaacatcccttctgga

SEQ ID NO: 451932 - DNA, 25 bp, Homo sapien
aaacatcccttctggattcctatag

SEQ ID NO: 451933 - DNA, 25 bp, Homo sapien
ggattcctatagtgtccatcttaaa

SEQ ID NO: 451934 - DNA, 25 bp, Homo sapien
gtgtccatcttaaaatcataactag

SEQ ID NO: 451935 - DNA, 25 bp, Homo sapien
ataactaggtagttctacctgctgc

SEQ ID NO: 451936 - DNA, 25 bp, Homo sapien
tacctgctgcagttgcactgaagtg

SEQ ID NO: 451937 - DNA, 25 bp, Homo sapien
tgaagtgattagttccctctggctt

SEQ ID NO: 451938 - DNA, 25 bp, Homo sapien
tattatggcatgatggcaaggttgt

SEQ ID NO: 451939 - DNA, 25 bp, Homo sapien
cctaaagctcatcacttttgtaggt

SEQ ID NO: 451940 - DNA, 25 bp, Homo sapien
cccattttcttggtagaaacagcca

SEQ ID NO: 451941 - DNA, 25 bp, Homo sapien
gaaacagccactttcccattaatat

SEQ ID NO: 451942 - DNA, 25 bp, Homo sapien
aacagccactttcccattaatatat

SEQ ID NO: 451943 - DNA, 25 bp, Homo sapien
gccactttcccattaatatatctga

SEQ ID NO: 451944 - DNA, 25 bp, Homo sapien
ttcccattaatatatctgagcatca

SEQ ID NO: 451945 - DNA, 25 bp, Homo sapien
aaagctaagaacagattgaagtact

SEQ ID NO: 451946 - DNA, 25 bp, Homo sapien
gattgaagtactagttactacctga

SEQ ID NO: 451947 - DNA, 25 bp, Homo sapien
tgaagtactagttactacctgaaaa

SEQ ID NO: 451948 - DNA, 25 bp, Homo sapien
tgcaggattatggttctatagtcac

SEQ ID NO: 451949 - DNA, 25 bp, Homo sapien
gattatggttctatagtcaccaatt

SEQ ID NO: 451950 - DNA, 25 bp, Homo sapien
gtcaccaattttatagaccagaaat

SEQ ID NO: 451951 - DNA, 25 bp, Homo sapien
aaaaaatcaaagcaggtatccgcgg

SEQ ID NO: 451952 - DNA, 25 bp, Homo sapien
caaaaattaaagcaggtatccgagg

SEQ ID NO: 451953 - DNA, 25 bp, Homo sapien
tccgaggccccgatgggcaaggaaa

SEQ ID NO: 451954 - DNA, 25 bp, Homo sapien
aaaagcaggtatccgaagctccgat

SEQ ID NO: 451955 - DNA, 25 bp, Homo sapien
atccgaagctccgatgggccaaaaa

SEQ ID NO: 451956 - DNA, 25 bp, Homo sapien
taaaaagcagatatccgtcaccccg

SEQ ID NO: 451957 - DNA, 25 bp, Homo sapien
agatatccgtcaccccgatgggcca

SEQ ID NO: 451958 - DNA, 25 bp, Homo sapien
aagggaatcagcaggtatccgatac

SEQ ID NO: 451959 - DNA, 25 bp, Homo sapien
aggtatccgataccccgatgggcta

SEQ ID NO: 451960 - DNA, 25 bp, Homo sapien
tccgataccccgatgggctaaggaa

SEQ ID NO: 451961 - DNA, 25 bp, Homo sapien
aaaagcaggtatcaacggccccgat

SEQ ID NO: 451962 - DNA, 25 bp, Homo sapien
ggattagaagtagaaactggagcca

SEQ ID NO: 451963 - DNA, 25 bp, Homo sapien
gattagaagtagaaactggagccag

SEQ ID NO: 451964 - DNA, 25 bp, Homo sapien
ttagaagtagaaactggagccagga

SEQ ID NO: 451965 - DNA, 25 bp, Homo sapien
aagtagaaactggagccaggagcta

SEQ ID NO: 451966 - DNA, 25 bp, Homo sapien
gtagaaactggagccaggagctata

SEQ ID NO: 451967 - DNA, 25 bp, Homo sapien
agaaactggagccaggagctatagt

SEQ ID NO: 451968 - DNA, 25 bp, Homo sapien
aactggagccaggagctatagtgcc

SEQ ID NO: 451969 - DNA, 25 bp, Homo sapien
actggagccaggagctatagtgcca

SEQ ID NO: 451970 - DNA, 25 bp, Homo sapien
ctggagccaggagctatagtgccag

SEQ ID NO: 451971 - DNA, 25 bp, Homo sapien
ggagccaggagctatagtgccagct

SEQ ID NO: 451972 - DNA, 25 bp, Homo sapien
gagccaggagctatagtgccagcta

SEQ ID NO: 451973 - DNA, 25 bp, Homo sapien
ctgtccctcattacccaaggcaagg

SEQ ID NO: 451974 - DNA, 25 bp, Homo sapien
tgtccctcattacccaaggcaaggg

SEQ ID NO: 451975 - DNA, 25 bp, Homo sapien
ctgctgccctgactgggatgagggt

SEQ ID NO: 451976 - DNA, 25 bp, Homo sapien
tagcccatcttcaatgaccccttaa

SEQ ID NO: 451977 - DNA, 25 bp, Homo sapien
agcccatcttcaatgaccccttaat

SEQ ID NO: 451978 - DNA, 25 bp, Homo sapien
ccatcttcaatgaccccttaatctg

SEQ ID NO: 451979 - DNA, 25 bp, Homo sapien
catcttcaatgaccccttaatctgc

SEQ ID NO: 451980 - DNA, 25 bp, Homo sapien
ttcaatgaccccttaatctgcagca

SEQ ID NO: 451981 - DNA, 25 bp, Homo sapien
tcaatgaccccttaatctgcagcag

SEQ ID NO: 451982 - DNA, 25 bp, Homo sapien
caatgaccccttaatctgcagcagc

SEQ ID NO: 451983 - DNA, 25 bp, Homo sapien
accccttaatctgcagcagctcaca

SEQ ID NO: 451984 - DNA, 25 bp, Homo sapien
agttcttcgggcatggaaattctat

SEQ ID NO: 451985 - DNA, 25 bp, Homo sapien
ggaaattctatagcattctttggta

SEQ ID NO: 451986 - DNA, 25 bp, Homo sapien
ttctttggtataaccaacccactga

SEQ ID NO: 451987 - DNA, 25 bp, Homo sapien
tgaattccattcaactcgagctgaa

SEQ ID NO: 451988 - DNA, 25 bp, Homo sapien
actcgagctgaagtattctttttga

SEQ ID NO: 451989 - DNA, 25 bp, Homo sapien
gtatatcttttctagtgtcccactt

SEQ ID NO: 451990 - DNA, 25 bp, Homo sapien
tctagtgtcccacttttagaaaggt

SEQ ID NO: 451991 - DNA, 25 bp, Homo sapien
aatatctgaaggctattaccagttg

SEQ ID NO: 451992 - DNA, 25 bp, Homo sapien
ctattaccagttgtgcttcagcctc

SEQ ID NO: 451993 - DNA, 25 bp, Homo sapien
ttgcaattctcccagggtggcatcc

SEQ ID NO: 451994 - DNA, 25 bp, Homo sapien
tggcatcctctacggagtcttgttg

SEQ ID NO: 451995 - DNA, 25 bp, Homo sapien
atttgttcacttttgaaccctgtgg

SEQ ID NO: 451996 - DNA, 25 bp, Homo sapien
ttcacttttgaaccctgtggtgtct

SEQ ID NO: 451997 - DNA, 25 bp, Homo sapien
cacttttgaaccctgtggtgtcttt

SEQ ID NO: 451998 - DNA, 25 bp, Homo sapien
tgaaccctgtggtgtcttttaactt

SEQ ID NO: 451999 - DNA, 25 bp, Homo sapien
tgtggtgtcttttaactttgttaag

SEQ ID NO: 452000 - DNA, 25 bp, Homo sapien
agggcccttggttagcaaaattatg

SEQ ID NO: 452001 - DNA, 25 bp, Homo sapien
ggcccttggttagcaaaattatgaa

SEQ ID NO: 452002 - DNA, 25 bp, Homo sapien
taggaaatttggctattgagtatat

SEQ ID NO: 452003 - DNA, 25 bp, Homo sapien
ggctattgagtatattaagtacaac

SEQ ID NO: 452004 - DNA, 25 bp, Homo sapien
acaaaatcctctgagttctccagga

SEQ ID NO: 452005 - DNA, 25 bp, Homo sapien
aaaatcctctgagttctccaggaag

SEQ ID NO: 452006 - DNA, 25 bp, Homo sapien
gatcaaggtgggaacaagcgtcctg

SEQ ID NO: 452007 - DNA, 25 bp, Homo sapien
gcatttgctatttacctggagcctt

SEQ ID NO: 452008 - DNA, 25 bp, Homo sapien
ggagccttggcatttagacatcttt

SEQ ID NO: 452009 - DNA, 25 bp, Homo sapien
gacatctttgaattccttgatttaa

SEQ ID NO: 452010 - DNA, 25 bp, Homo sapien
agcgtgccagagatcttttctttgc

SEQ ID NO: 452011 - DNA, 25 bp, Homo sapien
tttgctctttggattccggatctct

SEQ ID NO: 452012 - DNA, 25 bp, Homo sapien
gattccggatctcttcatgaaacga

SEQ ID NO: 452013 - DNA, 25 bp, Homo sapien
aaacgagtggagactaatcaggact

SEQ ID NO: 452014 - DNA, 25 bp, Homo sapien
aatcaggactggtctttgatgtgtc

SEQ ID NO: 452015 - DNA, 25 bp, Homo sapien
gtgtccaaatgagtgtcctggtctg

SEQ ID NO: 452016 - DNA, 25 bp, Homo sapien
gaaacaaggtcgtgtccgcaaagtt

SEQ ID NO: 452017 - DNA, 25 bp, Homo sapien
cattctcactcgctatgtatgccag

SEQ ID NO: 452018 - DNA, 25 bp, Homo sapien
cgctatgtatgccagctttccctgc

SEQ ID NO: 452019 - DNA, 25 bp, Homo sapien
atgcacgctgcgtctgtggcccttt

SEQ ID NO: 452020 - DNA, 25 bp, Homo sapien
aactagatagcttttgggtcttaat

SEQ ID NO: 452021 - DNA, 25 bp, Homo sapien
tgggtcttaattccaaatgcttagg

SEQ ID NO: 452022 - DNA, 25 bp, Homo sapien
caaatgcttaggagtgaatcggtta

SEQ ID NO: 452023 - DNA, 25 bp, Homo sapien
gaatcggttagctcagaagtccaac

SEQ ID NO: 452024 - DNA, 25 bp, Homo sapien
agctcagaagtccaaccagttcaaa

SEQ ID NO: 452025 - DNA, 25 bp, Homo sapien
aaacacctgtgtcaatctagcacat

SEQ ID NO: 452026 - DNA, 25 bp, Homo sapien
tagcacattaattctcaaccttggc

SEQ ID NO: 452027 - DNA, 25 bp, Homo sapien
atttgatgtcactgggagctttaat

SEQ ID NO: 452028 - DNA, 25 bp, Homo sapien
gatgtcctgttactggaagggcacc

SEQ ID NO: 452029 - DNA, 25 bp, Homo sapien
gaagggcaccatagtttatcctgca

SEQ ID NO: 452030 - DNA, 25 bp, Homo sapien
agtttatcctgcacctaacactaat

SEQ ID NO: 452031 - DNA, 25 bp, Homo sapien
tgcacctaacactaatacacctact

SEQ ID NO: 452032 - DNA, 25 bp, Homo sapien
taacactaatacacctactctggga

SEQ ID NO: 452033 - DNA, 25 bp, Homo sapien
ctctgggaattcttctacctacaac

SEQ ID NO: 452034 - DNA, 25 bp, Homo sapien
ggaattcttctacctacaactattt

SEQ ID NO: 452035 - DNA, 25 bp, Homo sapien
atttatttatctgatcccatctggt

SEQ ID NO: 452036 - DNA, 25 bp, Homo sapien
gatcccatctggtattaaagttcta

SEQ ID NO: 452037 - DNA, 25 bp, Homo sapien
gaattcttaaaggttcccaatgcct

SEQ ID NO: 452038 - DNA, 25 bp, Homo sapien
taaaggttcccaatgcctcccagaa

SEQ ID NO: 452039 - DNA, 25 bp, Homo sapien
cagctgattccaggcgaattcttct

SEQ ID NO: 452040 - DNA, 25 bp, Homo sapien
tgattccaggcgaattcttctctga

SEQ ID NO: 452041 - DNA, 25 bp, Homo sapien
attccaggcgaattcttctctgatg

SEQ ID NO: 452042 - DNA, 25 bp, Homo sapien
tccaggcgaattcttctctgatggg

SEQ ID NO: 452043 - DNA, 25 bp, Homo sapien
caggcgaattcttctctgatgggcg

SEQ ID NO: 452044 - DNA, 25 bp, Homo sapien
ggcgaattcttctctgatgggcggg

SEQ ID NO: 452045 - DNA, 25 bp, Homo sapien
tgatgggcgggcgagggtgtgttcg

SEQ ID NO: 452046 - DNA, 25 bp, Homo sapien
gtgtgttcgtgtgatgggttggagt

SEQ ID NO: 452047 - DNA, 25 bp, Homo sapien
tgtgtgtgtctgagtacacagatga

SEQ ID NO: 452048 - DNA, 25 bp, Homo sapien
gtgtgtctgagtacacagatgatgt

SEQ ID NO: 452049 - DNA, 25 bp, Homo sapien
acagatgatgtgttttcccttcagc

SEQ ID NO: 452050 - DNA, 25 bp, Homo sapien
tctttctgccaattgttgcccgttt

SEQ ID NO: 452051 - DNA, 25 bp, Homo sapien
attgttgcccgtttgctgtgttgaa

SEQ ID NO: 452052 - DNA, 25 bp, Homo sapien
atagaactcatgcatcagactccct

SEQ ID NO: 452053 - DNA, 25 bp, Homo sapien
agactcccttcactaatgctttttg

SEQ ID NO: 452054 - DNA, 25 bp, Homo sapien
tcactaatgctttttgcatgccttc

SEQ ID NO: 452055 - DNA, 25 bp, Homo sapien
tggctgcctctgcacatcccgtgaa

SEQ ID NO: 452056 - DNA, 25 bp, Homo sapien
catcccgtgaacactttgtgcctgt

SEQ ID NO: 452057 - DNA, 25 bp, Homo sapien
acactttgtgcctgttttctatggt

SEQ ID NO: 452058 - DNA, 25 bp, Homo sapien
gtgcctgttttctatggttgtggag

SEQ ID NO: 452059 - DNA, 25 bp, Homo sapien
gttttccttatggtattggtcacag

SEQ ID NO: 452060 - DNA, 25 bp, Homo sapien
tggtcacagttatcctagtgtttgt

SEQ ID NO: 452061 - DNA, 25 bp, Homo sapien
gaaatatgttctacacatctaattt

SEQ ID NO: 452062 - DNA, 25 bp, Homo sapien
gtgatctaaattgagatgcctttga

SEQ ID NO: 452063 - DNA, 25 bp, Homo sapien
tttaccaacattatatgcactcgtg

SEQ ID NO: 452064 - DNA, 25 bp, Homo sapien
atgcactcgtgccttcaatgtggaa

SEQ ID NO: 452065 - DNA, 25 bp, Homo sapien
caatgtggaatcaaactggttaacc

SEQ ID NO: 452066 - DNA, 25 bp, Homo sapien
aactggttaacctcagcacagtcct

SEQ ID NO: 452067 - DNA, 25 bp, Homo sapien
agcacagtcctctcgtttctgtgtt

SEQ ID NO: 452068 - DNA, 25 bp, Homo sapien
cgtttctgtgtttctgctgcactaa

SEQ ID NO: 452069 - DNA, 25 bp, Homo sapien
gtttctgctgcactaattgccaggg

SEQ ID NO: 452070 - DNA, 25 bp, Homo sapien
ttaattcatagtaggaggcggcgat

SEQ ID NO: 452071 - DNA, 25 bp, Homo sapien
ataggtgcagcaaagggcagccaca

SEQ ID NO: 452072 - DNA, 25 bp, Homo sapien
cgcgtcgacattaattagtttttgc

SEQ ID NO: 452073 - DNA, 25 bp, Homo sapien
taattagtttttgcctgtctttaga

SEQ ID NO: 452074 - DNA, 25 bp, Homo sapien
atagattattagctcacctgacaat

SEQ ID NO: 452075 - DNA, 25 bp, Homo sapien
gacaattatagttggaccccttcta

SEQ ID NO: 452076 - DNA, 25 bp, Homo sapien
gttggaccccttctaataagatgat

SEQ ID NO: 452077 - DNA, 25 bp, Homo sapien
gatgatgcaaaaggcctgtccaagt

SEQ ID NO: 452078 - DNA, 25 bp, Homo sapien
aggcctgtccaagtattagcagttg

SEQ ID NO: 452079 - DNA, 25 bp, Homo sapien
agcagttgctattattgctgagcac

SEQ ID NO: 452080 - DNA, 25 bp, Homo sapien
ttattgctgagcacagaaactctgc

SEQ ID NO: 452081 - DNA, 25 bp, Homo sapien
gaaactctgcatgagtgccccttat

SEQ ID NO: 452082 - DNA, 25 bp, Homo sapien
aaacagcccaatggctgggcacagt

SEQ ID NO: 452083 - DNA, 25 bp, Homo sapien
acatacatttaacatataactggca

SEQ ID NO: 452084 - DNA, 25 bp, Homo sapien
ataactggcatttgtactacttgac

SEQ ID NO: 452085 - DNA, 25 bp, Homo sapien
tggcatttgtactacttgacagtta

SEQ ID NO: 452086 - DNA, 25 bp, Homo sapien
ttgtactacttgacagttatccctg

SEQ ID NO: 452087 - DNA, 25 bp, Homo sapien
gtactacttgacagttatccctgag

SEQ ID NO: 452088 - DNA, 25 bp, Homo sapien
tacttgacagttatccctgagaagt

SEQ ID NO: 452089 - DNA, 25 bp, Homo sapien
gacagttatccctgagaagttaaaa

SEQ ID NO: 452090 - DNA, 25 bp, Homo sapien
cacaaatgttacatagcaccttcat

SEQ ID NO: 452091 - DNA, 25 bp, Homo sapien
gttacatagcaccttcatttataat

SEQ ID NO: 452092 - DNA, 25 bp, Homo sapien
caacctggatgtccttcaaaaagag

SEQ ID NO: 452093 - DNA, 25 bp, Homo sapien
aaaagagtgaatggtttagtatgtc

SEQ ID NO: 452094 - DNA, 25 bp, Homo sapien
gtatgttgtataccagagttacagt

SEQ ID NO: 452095 - DNA, 25 bp, Homo sapien
gttacagttactgtgggaatcataa

SEQ ID NO: 452096 - DNA, 25 bp, Homo sapien
gactcctgtgtttctggaatcttta

SEQ ID NO: 452097 - DNA, 25 bp, Homo sapien
gtttctggaatctttacaacaaatg

SEQ ID NO: 452098 - DNA, 25 bp, Homo sapien
aaaattaagcccatctttagtagat

SEQ ID NO: 452099 - DNA, 25 bp, Homo sapien
gcccatctttagtagatactgtttt

SEQ ID NO: 452100 - DNA, 25 bp, Homo sapien
taaacataccacaagatatggctat

SEQ ID NO: 452101 - DNA, 25 bp, Homo sapien
gagatcagtatccatttttgcttta

SEQ ID NO: 452102 - DNA, 25 bp, Homo sapien
atcagtatccatttttgctttaaag

SEQ ID NO: 452103 - DNA, 25 bp, Homo sapien
aaagaattggccttattgcttcagt

SEQ ID NO: 452104 - DNA, 25 bp, Homo sapien
ttggccttattgcttcagtgtcaca

SEQ ID NO: 452105 - DNA, 25 bp, Homo sapien
tagagattgggtttcgccacgttac

SEQ ID NO: 452106 - DNA, 25 bp, Homo sapien
ggcctcgtctcctactttctttgct

SEQ ID NO: 452107 - DNA, 25 bp, Homo sapien
tctcctactttctttgctccaaggt

SEQ ID NO: 452108 - DNA, 25 bp, Homo sapien
ctcctactttctttgctccaaggta

SEQ ID NO: 452109 - DNA, 25 bp, Homo sapien
tcctactttctttgctccaaggtag

SEQ ID NO: 452110 - DNA, 25 bp, Homo sapien
tactttctttgctccaaggtaggat

SEQ ID NO: 452111 - DNA, 25 bp, Homo sapien
tttctttgctccaaggtaggattag

SEQ ID NO: 452112 - DNA, 25 bp, Homo sapien
tttgctccaaggtaggattagaagt

SEQ ID NO: 452113 - DNA, 25 bp, Homo sapien
gattagaagtagaaactggagccag

SEQ ID NO: 452114 - DNA, 25 bp, Homo sapien
actggagccaggagctatagtgcca

SEQ ID NO: 452115 - DNA, 25 bp, Homo sapien
gagccaggagctatagtgccagcta

SEQ ID NO: 452116 - DNA, 25 bp, Homo sapien
agatggtaattggttcagatcggac

SEQ ID NO: 452117 - DNA, 25 bp, Homo sapien
accgccacgcgtttgcttgttggaa

SEQ ID NO: 452118 - DNA, 25 bp, Homo sapien
gccacgcgtttgcttgttggaattt

SEQ ID NO: 452119 - DNA, 25 bp, Homo sapien
cacgcgtttgcttgttggaatttgg

SEQ ID NO: 452120 - DNA, 25 bp, Homo sapien
cgcgtttgcttgttggaatttggaa

SEQ ID NO: 452121 - DNA, 25 bp, Homo sapien
gaatttggaagctttgtgcatgacc

SEQ ID NO: 452122 - DNA, 25 bp, Homo sapien
ttggaagctttgtgcatgaccttga

SEQ ID NO: 452123 - DNA, 25 bp, Homo sapien
gaagctttgtgcatgaccttgaatg

SEQ ID NO: 452124 - DNA, 25 bp, Homo sapien
gctttgtgcatgaccttgaatgcac

SEQ ID NO: 452125 - DNA, 25 bp, Homo sapien
ttccctcaaggaagaatactctgat

SEQ ID NO: 452126 - DNA, 25 bp, Homo sapien
atactctgatgaaaagagtccttta

SEQ ID NO: 452127 - DNA, 25 bp, Homo sapien
tgaatgacggctctacgtcctcatg

SEQ ID NO: 452128 - DNA, 25 bp, Homo sapien
tgctgccctgtacatgtccaactgc

SEQ ID NO: 452129 - DNA, 25 bp, Homo sapien
atgtccaactgcacggagcacttta

SEQ ID NO: 452130 - DNA, 25 bp, Homo sapien
gagcactttacatcctctaaaacca

SEQ ID NO: 452131 - DNA, 25 bp, Homo sapien
gtaaattgctccatttcctaaatta

SEQ ID NO: 452132 - DNA, 25 bp, Homo sapien
aacctgtttggtcattttattgata

SEQ ID NO: 452133 - DNA, 25 bp, Homo sapien
aggttctgaaacagggtgaggtcca

SEQ ID NO: 452134 - DNA, 25 bp, Homo sapien
caggatcctgcctttctaaggagct

SEQ ID NO: 452135 - DNA, 25 bp, Homo sapien
taaggagctcccacgttgtgcagtt

SEQ ID NO: 452136 - DNA, 25 bp, Homo sapien
acgttgtgcagttgctgctggcccg

SEQ ID NO: 452137 - DNA, 25 bp, Homo sapien
gggaccacattgaatgacggctcta

SEQ ID NO: 452138 - DNA, 25 bp, Homo sapien
ttaacatcttgtaaaaactgggagc

SEQ ID NO: 452139 - DNA, 25 bp, Homo sapien
taacatcttgtaaaaactgggagca

SEQ ID NO: 452140 - DNA, 25 bp, Homo sapien
aacatcttgtaaaaactgggagcag

SEQ ID NO: 452141 - DNA, 25 bp, Homo sapien
acatcttgtaaaaactgggagcagg

SEQ ID NO: 452142 - DNA, 25 bp, Homo sapien
catcttgtaaaaactgggagcaggc

SEQ ID NO: 452143 - DNA, 25 bp, Homo sapien
atcttgtaaaaactgggagcaggcc

SEQ ID NO: 452144 - DNA, 25 bp, Homo sapien
tcttgtaaaaactgggagcaggcca

SEQ ID NO: 452145 - DNA, 25 bp, Homo sapien
tgtaaaaactgggagcaggccaggt

SEQ ID NO: 452146 - DNA, 25 bp, Homo sapien
gtaaaaactgggagcaggccaggta

SEQ ID NO: 452147 - DNA, 25 bp, Homo sapien
cgggtggttcgtctgaggtcagtca

SEQ ID NO: 452148 - DNA, 25 bp, Homo sapien
gtggttcgtctgaggtcagtcagga

SEQ ID NO: 452149 - DNA, 25 bp, Homo sapien
ccagttctgaaaatggcatgtcttt

SEQ ID NO: 452150 - DNA, 25 bp, Homo sapien
cagttctgaaaatggcatgtctttc

SEQ ID NO: 452151 - DNA, 25 bp, Homo sapien
atggcatgtctttctggttacatta

SEQ ID NO: 452152 - DNA, 25 bp, Homo sapien
gtctttctggttacattatataaaa

SEQ ID NO: 452153 - DNA, 25 bp, Homo sapien
atcctggccaacaggatgtacaaca

SEQ ID NO: 452154 - DNA, 25 bp, Homo sapien
tggccaacaggatgtacaacaggat

SEQ ID NO: 452155 - DNA, 25 bp, Homo sapien
ggccaacaggatgtacaacaggatg

SEQ ID NO: 452156 - DNA, 25 bp, Homo sapien
gccaacaggatgtacaacaggatgt

SEQ ID NO: 452157 - DNA, 25 bp, Homo sapien
ccaacaggatgtacaacaggatgta

SEQ ID NO: 452158 - DNA, 25 bp, Homo sapien
caggatgtacaacaggatgtactaa

SEQ ID NO: 452159 - DNA, 25 bp, Homo sapien
ggagaattccttgaatacaggaggg

SEQ ID NO: 452160 - DNA, 25 bp, Homo sapien
tgtctctactactaataaagaaaat

SEQ ID NO: 452161 - DNA, 25 bp, Homo sapien
gtctctactactaataaagaaaatt

SEQ ID NO: 452162 - DNA, 25 bp, Homo sapien
gaaacccgtctctgctgaaaatgca

SEQ ID NO: 452163 - DNA, 25 bp, Homo sapien
aacccgtctctgctgaaaatgcaaa

SEQ ID NO: 452164 - DNA, 25 bp, Homo sapien
acccgtctctgctgaaaatgcaaaa

SEQ ID NO: 452165 - DNA, 25 bp, Homo sapien
ctgctgaaaatgcaaaaattggccg

SEQ ID NO: 452166 - DNA, 25 bp, Homo sapien
tgctgaaaatgcaaaaattggccgg

SEQ ID NO: 452167 - DNA, 25 bp, Homo sapien
gctgaaaatgcaaaaattggccggg

SEQ ID NO: 452168 - DNA, 25 bp, Homo sapien
ctgaaaatgcaaaaattggccgggc

SEQ ID NO: 452169 - DNA, 25 bp, Homo sapien
tgaaaatgcaaaaattggccgggca

SEQ ID NO: 452170 - DNA, 25 bp, Homo sapien
gaaaatgcaaaaattggccgggcat

SEQ ID NO: 452171 - DNA, 25 bp, Homo sapien
gtagtccctgctgctcagaaggcta

SEQ ID NO: 452172 - DNA, 25 bp, Homo sapien
aagagacttacacgaggtcacatag

SEQ ID NO: 452173 - DNA, 25 bp, Homo sapien
gacttacacgaggtcacatagctaa

SEQ ID NO: 452174 - DNA, 25 bp, Homo sapien
tagggaagagaacccttgtccctct

SEQ ID NO: 452175 - DNA, 25 bp, Homo sapien
ttgtccctctactttaaggccctat

SEQ ID NO: 452176 - DNA, 25 bp, Homo sapien
tactttaaggccctattcgcttgcc

SEQ ID NO: 452177 - DNA, 25 bp, Homo sapien
aggccctattcgcttgccccattat

SEQ ID NO: 452178 - DNA, 25 bp, Homo sapien
attatcccatgctgcctttctaaga

SEQ ID NO: 452179 - DNA, 25 bp, Homo sapien
catgctgcctttctaagagccagaa

SEQ ID NO: 452180 - DNA, 25 bp, Homo sapien
gctgcctttctaagagccagaaaag

SEQ ID NO: 452181 - DNA, 25 bp, Homo sapien
taagagccagaaaagttagaggtag

SEQ ID NO: 452182 - DNA, 25 bp, Homo sapien
acttggtgttacgaaaggatctatc

SEQ ID NO: 452183 - DNA, 25 bp, Homo sapien
aaggatctatcacaagctccgttct

SEQ ID NO: 452184 - DNA, 25 bp, Homo sapien
tctatcacaagctccgttctcctgg

SEQ ID NO: 452185 - DNA, 25 bp, Homo sapien
cactggtagcgcaggcttgtcacgc

SEQ ID NO: 452186 - DNA, 25 bp, Homo sapien
gtagcgcaggcttgtcacgcggcca

SEQ ID NO: 452187 - DNA, 25 bp, Homo sapien
acagccgcttacctccaagagctgg

SEQ ID NO: 452188 - DNA, 25 bp, Homo sapien
gcatgcgcaaagtggtcctcgaggc

SEQ ID NO: 452189 - DNA, 25 bp, Homo sapien
gcaaagtggtcctcgaggccccaga

SEQ ID NO: 452190 - DNA, 25 bp, Homo sapien
gaggccccagatgagaccaccctaa

SEQ ID NO: 452191 - DNA, 25 bp, Homo sapien
ggcctttcgggtggtcaggaagatg

SEQ ID NO: 452192 - DNA, 25 bp, Homo sapien
aggtcctggtacaatacttggtgtt

SEQ ID NO: 452193 - DNA, 25 bp, Homo sapien
gtgtgtgactccagtcggcgtctca

SEQ ID NO: 452194 - DNA, 25 bp, Homo sapien
agtcggcgtctcaacagtctccggt

SEQ ID NO: 452195 - DNA, 25 bp, Homo sapien
agtctccggtgtccacgcgttgact

SEQ ID NO: 452196 - DNA, 25 bp, Homo sapien
gcgttgactgccgtgtgtgactcca

SEQ ID NO: 452197 - DNA, 25 bp, Homo sapien
tgtgactccagtcggcgtcttaaca

SEQ ID NO: 452198 - DNA, 25 bp, Homo sapien
gcgtcttaacagtctccggtgtcca

SEQ ID NO: 452199 - DNA, 25 bp, Homo sapien
gtgtccatgcgttgactgccatgta

SEQ ID NO: 452200 - DNA, 25 bp, Homo sapien
tgactgccatgtatgactccaggta

SEQ ID NO: 452201 - DNA, 25 bp, Homo sapien
tgccatgtatgactccaggtattga

SEQ ID NO: 452202 - DNA, 25 bp, Homo sapien
gactccaggtattgagttcatcttc

SEQ ID NO: 452203 - DNA, 25 bp, Homo sapien
caggtattgagttcatcttcaactt

SEQ ID NO: 452204 - DNA, 25 bp, Homo sapien
tggagatccgtgaactgcaggccac

SEQ ID NO: 452205 - DNA, 25 bp, Homo sapien
tgaactgcaggccacgtacccatga

SEQ ID NO: 452206 - DNA, 25 bp, Homo sapien
gtacccatgacgtaaacggcggcac

SEQ ID NO: 452207 - DNA, 25 bp, Homo sapien
attccagagtccttttggaaaactg

SEQ ID NO: 452208 - DNA, 25 bp, Homo sapien
gtaaacggcggcactggagcaagct

SEQ ID NO: 452209 - DNA, 25 bp, Homo sapien
agcaggccccaagtggcttgtaaat

SEQ ID NO: 452210 - DNA, 25 bp, Homo sapien
ctgactttagtctgctgggctgtat

SEQ ID NO: 452211 - DNA, 25 bp, Homo sapien
tgggctgtattgacctctggcaggc

SEQ ID NO: 452212 - DNA, 25 bp, Homo sapien
aggctcgaagcctcactgggtatgc

SEQ ID NO: 452213 - DNA, 25 bp, Homo sapien
aagcctcactgggtatgcagtcaac

SEQ ID NO: 452214 - DNA, 25 bp, Homo sapien
ggtatgcagtcaacaggatgggcct

SEQ ID NO: 452215 - DNA, 25 bp, Homo sapien
gccccaactttgcagtaaggtggta

SEQ ID NO: 452216 - DNA, 25 bp, Homo sapien
caactttgcagtaaggtggtagaaa

SEQ ID NO: 452217 - DNA, 25 bp, Homo sapien
ggcgcgattgcttctcttcctcttc

SEQ ID NO: 452218 - DNA, 25 bp, Homo sapien
ttctgcccaagaccaagactctagg

SEQ ID NO: 452219 - DNA, 25 bp, Homo sapien
tctgcccaagaccaagactctaggt

SEQ ID NO: 452220 - DNA, 25 bp, Homo sapien
gaccaagactctaggtctgatatcc

SEQ ID NO: 452221 - DNA, 25 bp, Homo sapien
gactctaggtctgatatccttttta

SEQ ID NO: 452222 - DNA, 25 bp, Homo sapien
ggtctgatatcctttttagccacac

SEQ ID NO: 452223 - DNA, 25 bp, Homo sapien
gtctgatatcctttttagccacaca

SEQ ID NO: 452224 - DNA, 25 bp, Homo sapien
ctgatatcctttttagccacacaca

SEQ ID NO: 452225 - DNA, 25 bp, Homo sapien
gatatcctttttagccacacacaca

SEQ ID NO: 452226 - DNA, 25 bp, Homo sapien
gtacttcttcctatggttcatgata

SEQ ID NO: 452227 - DNA, 25 bp, Homo sapien
gagttaccagatgttagctgttgca

SEQ ID NO: 452228 - DNA, 25 bp, Homo sapien
agctgttgcatatgtgcacattcct

SEQ ID NO: 452229 - DNA, 25 bp, Homo sapien
aatttaagtgggtcattggttgtct

SEQ ID NO: 452230 - DNA, 25 bp, Homo sapien
ggtcattggttgtcttgggaagatc

SEQ ID NO: 452231 - DNA, 25 bp, Homo sapien
atatgttttgagtgtttcttagtaa

SEQ ID NO: 452232 - DNA, 25 bp, Homo sapien
aaatgtgtgatcttccaccttccac

SEQ ID NO: 452233 - DNA, 25 bp, Homo sapien
accttccacattcagactgcggact

SEQ ID NO: 452234 - DNA, 25 bp, Homo sapien
ttcagactgcggactacacttcata

SEQ ID NO: 452235 - DNA, 25 bp, Homo sapien
gcggactacacttcataaatgcctt

SEQ ID NO: 452236 - DNA, 25 bp, Homo sapien
aatgcctttttatttccagttatgg

SEQ ID NO: 452237 - DNA, 25 bp, Homo sapien
ttacatttctcctctatcactgatt

SEQ ID NO: 452238 - DNA, 25 bp, Homo sapien
atcactgattaattgtacgaccttg

SEQ ID NO: 452239 - DNA, 25 bp, Homo sapien
aattgtgcagcttctccatcttggt

SEQ ID NO: 452240 - DNA, 25 bp, Homo sapien
tgaggatagcattacccatcttaag

SEQ ID NO: 452241 - DNA, 25 bp, Homo sapien
gcattacccatcttaagagcttctg

SEQ ID NO: 452242 - DNA, 25 bp, Homo sapien
ttaagagcttctgttttggttttgt

SEQ ID NO: 452243 - DNA, 25 bp, Homo sapien
gaaacacatttgcaccatagctaat

SEQ ID NO: 452244 - DNA, 25 bp, Homo sapien
atttgcaccatagctaatacttagt

SEQ ID NO: 452245 - DNA, 25 bp, Homo sapien
aaacacatatgcttttcttccctgc

SEQ ID NO: 452246 - DNA, 25 bp, Homo sapien
ccctgcctctgtagatttctaacaa

SEQ ID NO: 452247 - DNA, 25 bp, Homo sapien
gttgggcctggttatttactgattg

SEQ ID NO: 452248 - DNA, 25 bp, Homo sapien
atcagtggacggaggtgatgttcat

SEQ ID NO: 452249 - DNA, 25 bp, Homo sapien
acggaggtgatgttcatggcaacac

SEQ ID NO: 452250 - DNA, 25 bp, Homo sapien
ggtgatgttcatggcaacacgagaa

SEQ ID NO: 452251 - DNA, 25 bp, Homo sapien
tggcaacacgagaacttctgcggat

SEQ ID NO: 452252 - DNA, 25 bp, Homo sapien
acgagaacttctgcggattccccaa

SEQ ID NO: 452253 - DNA, 25 bp, Homo sapien
gaacttctgcggattccccaagcag

SEQ ID NO: 452254 - DNA, 25 bp, Homo sapien
tacaaacctagtgtccctcttttct

SEQ ID NO: 452255 - DNA, 25 bp, Homo sapien
tagtgtccctcttttctcgctatgt

SEQ ID NO: 452256 - DNA, 25 bp, Homo sapien
gaccggcagaaactgaacttgctgg

SEQ ID NO: 452257 - DNA, 25 bp, Homo sapien
gaaactgaacttgctggagacaaaa

SEQ ID NO: 452258 - DNA, 25 bp, Homo sapien
gagacaaaactgcagctagttcagg

SEQ ID NO: 452259 - DNA, 25 bp, Homo sapien
tacaatatgtgaactgttagaccag

SEQ ID NO: 452260 - DNA, 25 bp, Homo sapien
gaccagttttcctatttactcttgt

SEQ ID NO: 452261 - DNA, 25 bp, Homo sapien
tcttgttaattttttgacttcctgt

SEQ ID NO: 452262 - DNA, 25 bp, Homo sapien
gacttcctgtattttcaacctgcaa

SEQ ID NO: 452263 - DNA, 25 bp, Homo sapien
gtattttcaacctgcaatattctgt

SEQ ID NO: 452264 - DNA, 25 bp, Homo sapien
tttctcctcctgactacactttaag

SEQ ID NO: 452265 - DNA, 25 bp, Homo sapien
caaggtaaggagcatgcttcatctc

SEQ ID NO: 452266 - DNA, 25 bp, Homo sapien
aggagcatgcttcatctcctttgtc

SEQ ID NO: 452267 - DNA, 25 bp, Homo sapien
tcctttgtccttcctcagcataaat

SEQ ID NO: 452268 - DNA, 25 bp, Homo sapien
ttcctcagcataaatgcctggccca

SEQ ID NO: 452269 - DNA, 25 bp, Homo sapien
gcctggcccatacaggtaggttgtt

SEQ ID NO: 452270 - DNA, 25 bp, Homo sapien
tggtctctctgggtgggtactataa

SEQ ID NO: 452271 - DNA, 25 bp, Homo sapien
tgagttattgtgacccacagctgtg

SEQ ID NO: 452272 - DNA, 25 bp, Homo sapien
gtgtgggaccacatcacttgttaat

SEQ ID NO: 452273 - DNA, 25 bp, Homo sapien
ttcatgttgccactcctttttaagg

SEQ ID NO: 452274 - DNA, 25 bp, Homo sapien
ttttaaggacaaactcaggcaagga

SEQ ID NO: 452275 - DNA, 25 bp, Homo sapien
aatctagcagactgtgggtatccat

SEQ ID NO: 452276 - DNA, 25 bp, Homo sapien
gcagactgtgggtatccatatttta

SEQ ID NO: 452277 - DNA, 25 bp, Homo sapien
ccatattttaattgtcgggtgacac

SEQ ID NO: 452278 - DNA, 25 bp, Homo sapien
gggtgacacatgttcttggtaacta

SEQ ID NO: 452279 - DNA, 25 bp, Homo sapien
ggtaactaaactcaaatatgtcttt

SEQ ID NO: 452280 - DNA, 25 bp, Homo sapien
atgtcttttctcatatatgttgctg

SEQ ID NO: 452281 - DNA, 25 bp, Homo sapien
tgtcaggtgactacttttctaatgt

SEQ ID NO: 452282 - DNA, 25 bp, Homo sapien
caggtgactacttttctaatgtgtt

SEQ ID NO: 452283 - DNA, 25 bp, Homo sapien
gtgactacttttctaatgtgttttc

SEQ ID NO: 452284 - DNA, 25 bp, Homo sapien
tacttttctaatgtgttttcagagc

SEQ ID NO: 452285 - DNA, 25 bp, Homo sapien
ttttcagagctgtgtatttaagatt

SEQ ID NO: 452286 - DNA, 25 bp, Homo sapien
cagagctgtgtatttaagattgagt

SEQ ID NO: 452287 - DNA, 25 bp, Homo sapien
aagattgagtttggctctgggagat

SEQ ID NO: 452288 - DNA, 25 bp, Homo sapien
attgagtttggctctgggagataga

SEQ ID NO: 452289 - DNA, 25 bp, Homo sapien
tggctctgggagatagaaaactcaa

SEQ ID NO: 452290 - DNA, 25 bp, Homo sapien
gaaaactcaaaacagcagagtgctg

SEQ ID NO: 452291 - DNA, 25 bp, Homo sapien
aaaacagcagagtgctgtggtgtgc

SEQ ID NO: 452292 - DNA, 25 bp, Homo sapien
tagagaagggttcttcctattttgc

SEQ ID NO: 452293 - DNA, 25 bp, Homo sapien
aggctggtcttgagcaactaggttc

SEQ ID NO: 452294 - DNA, 25 bp, Homo sapien
gctggtcttgagcaactaggttcaa

SEQ ID NO: 452295 - DNA, 25 bp, Homo sapien
cccagcctgttttaacagcagctat

SEQ ID NO: 452296 - DNA, 25 bp, Homo sapien
gcctgttttaacagcagctatagca

SEQ ID NO: 452297 - DNA, 25 bp, Homo sapien
aacagcagctatagcaatggtttta

SEQ ID NO: 452298 - DNA, 25 bp, Homo sapien
aataagttatctgtattgctatagt

SEQ ID NO: 452299 - DNA, 25 bp, Homo sapien
gattacagatgcgtaccacaacgct

SEQ ID NO: 452300 - DNA, 25 bp, Homo sapien
agatgcgtaccacaacgctcagctt

SEQ ID NO: 452301 - DNA, 25 bp, Homo sapien
gtaccacaacgctcagcttactttt

SEQ ID NO: 452302 - DNA, 25 bp, Homo sapien
ccacaacgctcagcttactttttat

SEQ ID NO: 452303 - DNA, 25 bp, Homo sapien
ggctccactgccagcggcaaaacga

SEQ ID NO: 452304 - DNA, 25 bp, Homo sapien
atgggagcgagcctatttctttgtg

SEQ ID NO: 452305 - DNA, 25 bp, Homo sapien
catgcctatgtgtttaatatgcaaa

SEQ ID NO: 452306 - DNA, 25 bp, Homo sapien
gaatacaacctgaaacgccactatg

SEQ ID NO: 452307 - DNA, 25 bp, Homo sapien
gaaacgccactatgaatcaaagcat

SEQ ID NO: 452308 - DNA, 25 bp, Homo sapien
gcatagtaagagctacgaccagtac

SEQ ID NO: 452309 - DNA, 25 bp, Homo sapien
gagctacgaccagtacacagaacag

SEQ ID NO: 452310 - DNA, 25 bp, Homo sapien
gtacacagaacagactcgacgaatt

SEQ ID NO: 452311 - DNA, 25 bp, Homo sapien
gacgaattcgagctcggccgatttg

SEQ ID NO: 452312 - DNA, 25 bp, Homo sapien
ggccgatttggcctgatccataact

SEQ ID NO: 452313 - DNA, 25 bp, Homo sapien
ggcctgatccataacttcgtataat

SEQ ID NO: 452314 - DNA, 25 bp, Homo sapien
aattttaacagcttagcctctagag

SEQ ID NO: 452315 - DNA, 25 bp, Homo sapien
tttaacagcttagcctctagagagt

SEQ ID NO: 452316 - DNA, 25 bp, Homo sapien
aacagcttagcctctagagagttac

SEQ ID NO: 452317 - DNA, 25 bp, Homo sapien
gcttagcctctagagagttactgaa

SEQ ID NO: 452318 - DNA, 25 bp, Homo sapien
gcctctagagagttactgaacgtgg

SEQ ID NO: 452319 - DNA, 25 bp, Homo sapien
gagagttactgaacgtggttacctt

SEQ ID NO: 452320 - DNA, 25 bp, Homo sapien
gagttactgaacgtggttaccttgg

SEQ ID NO: 452321 - DNA, 25 bp, Homo sapien
tactgaacgtggttaccttgggaat

SEQ ID NO: 452322 - DNA, 25 bp, Homo sapien
tgaacgtggttaccttgggaatgta

SEQ ID NO: 452323 - DNA, 25 bp, Homo sapien
tgggaatgtaaatagaactgcaaat

SEQ ID NO: 452324 - DNA, 25 bp, Homo sapien
tgactggccacttcaactgggtaag

SEQ ID NO: 452325 - DNA, 25 bp, Homo sapien
gtctgcctggaatacgctgaccgtg

SEQ ID NO: 452326 - DNA, 25 bp, Homo sapien
tggaatacgctgaccgtgccttggc

SEQ ID NO: 452327 - DNA, 25 bp, Homo sapien
gtgccttggccttctatgctgtacg

SEQ ID NO: 452328 - DNA, 25 bp, Homo sapien
ccttctatgctgtacgggacggcaa

SEQ ID NO: 452329 - DNA, 25 bp, Homo sapien
tacgggacggcaagatgagcctcct

SEQ ID NO: 452330 - DNA, 25 bp, Homo sapien
gagccgcctggacagtcactttgcg

SEQ ID NO: 452331 - DNA, 25 bp, Homo sapien
tggagagtgtggacgcccacttgca

SEQ ID NO: 452332 - DNA, 25 bp, Homo sapien
gtggacgcccacttgcagatcgggc

SEQ ID NO: 452333 - DNA, 25 bp, Homo sapien
agatcgggcccctcaagaagtcctg

SEQ ID NO: 452334 - DNA, 25 bp, Homo sapien
aagaagtcctgcatatccgtgctga

SEQ ID NO: 452335 - DNA, 25 bp, Homo sapien
agtcctgcatatccgtgctgaagag

SEQ ID NO: 452336 - DNA, 25 bp, Homo sapien
taaaaaatcaggacacccatggcat

SEQ ID NO: 452337 - DNA, 25 bp, Homo sapien
aatcaggacacccatggcatcgtag

SEQ ID NO: 452338 - DNA, 25 bp, Homo sapien
caggacacccatggcatcgtagtag

SEQ ID NO: 452339 - DNA, 25 bp, Homo sapien
atggcatcgtagtagcccctcgcgt

SEQ ID NO: 452340 - DNA, 25 bp, Homo sapien
gtagtagcccctcgcgtccagcagg

SEQ ID NO: 452341 - DNA, 25 bp, Homo sapien
cctaagggtagggaagcattgtcaa

SEQ ID NO: 452342 - DNA, 25 bp, Homo sapien
tagggaagcattgtcaatttctggg

SEQ ID NO: 452343 - DNA, 25 bp, Homo sapien
ggatagaatgagacccaggcatagc

SEQ ID NO: 452344 - DNA, 25 bp, Homo sapien
caggcatagctggagtttgaagctt

SEQ ID NO: 452345 - DNA, 25 bp, Homo sapien
gtagaacatcttaaacgtgaccaaa

SEQ ID NO: 452346 - DNA, 25 bp, Homo sapien
tgatgttaaaatcagcaactcttta

SEQ ID NO: 452347 - DNA, 25 bp, Homo sapien
ctcaagtgggaagagcgctgttcaa

SEQ ID NO: 452348 - DNA, 25 bp, Homo sapien
tcaagtgggaagagcgctgttcaag

SEQ ID NO: 452349 - DNA, 25 bp, Homo sapien
gtgggaagagcgctgttcaaggacc

SEQ ID NO: 452350 - DNA, 25 bp, Homo sapien
atccggaaacacattccggcccgag

SEQ ID NO: 452351 - DNA, 25 bp, Homo sapien
tccggaaacacattccggcccgagg

SEQ ID NO: 452352 - DNA, 25 bp, Homo sapien
attccggcccgaggtccacctgctg

SEQ ID NO: 452353 - DNA, 25 bp, Homo sapien
cctgaacgagctggtgacgctgacg

SEQ ID NO: 452354 - DNA, 25 bp, Homo sapien
ctgaacgagctggtgacgctgacgt

SEQ ID NO: 452355 - DNA, 25 bp, Homo sapien
gaacgagctggtgacgctgacgtgc

SEQ ID NO: 452356 - DNA, 25 bp, Homo sapien
ctggtgacgctgacgtgcctggcac

SEQ ID NO: 452357 - DNA, 25 bp, Homo sapien
tggtgacgctgacgtgcctggcacg

SEQ ID NO: 452358 - DNA, 25 bp, Homo sapien
gggtgcagtatttttaactcattga

SEQ ID NO: 452359 - DNA, 25 bp, Homo sapien
tctactaacttttttgaatgtgctc

SEQ ID NO: 452360 - DNA, 25 bp, Homo sapien
ttgaatgtgctcttttcccactagt

SEQ ID NO: 452361 - DNA, 25 bp, Homo sapien
ttttcccactagttgcactaaggaa

SEQ ID NO: 452362 - DNA, 25 bp, Homo sapien
gccaaggtagccatagtaagaagtc

SEQ ID NO: 452363 - DNA, 25 bp, Homo sapien
aaatttttgttcatggaagcctgtc

SEQ ID NO: 452364 - DNA, 25 bp, Homo sapien
ggaagcctgtcagacatgaagatgt

SEQ ID NO: 452365 - DNA, 25 bp, Homo sapien
tgtgggtcttgtgaattggagattc

SEQ ID NO: 452366 - DNA, 25 bp, Homo sapien
gattcagtgcgtgaggaaaacagcc

SEQ ID NO: 452367 - DNA, 25 bp, Homo sapien
gaaaacagcctaactatccataatt

SEQ ID NO: 452368 - DNA, 25 bp, Homo sapien
aaggtaactactgtcagatatttgt

SEQ ID NO: 452369 - DNA, 25 bp, Homo sapien
tgtccctcattacccaaggcaaggg

SEQ ID NO: 452370 - DNA, 25 bp, Homo sapien
gcaggacaggccctcagaagcagct

SEQ ID NO: 452371 - DNA, 25 bp, Homo sapien
ctcagaagcagctcttggaggagat

SEQ ID NO: 452372 - DNA, 25 bp, Homo sapien
tgttttgcacaggaagatgctgctg

SEQ ID NO: 452373 - DNA, 25 bp, Homo sapien
ctgctgccctgactgggatgagggt

SEQ ID NO: 452374 - DNA, 25 bp, Homo sapien
tagcccatcttcaatgaccccttaa

SEQ ID NO: 452375 - DNA, 25 bp, Homo sapien
catcttcaatgaccccttaatctgc

SEQ ID NO: 452376 - DNA, 25 bp, Homo sapien
ttcaatgaccccttaatctgcagca

SEQ ID NO: 452377 - DNA, 25 bp, Homo sapien
tcaatgaccccttaatctgcagcag

SEQ ID NO: 452378 - DNA, 25 bp, Homo sapien
caatgaccccttaatctgcagcagc

SEQ ID NO: 452379 - DNA, 25 bp, Homo sapien
accccttaatctgcagcagctcaca

SEQ ID NO: 452380 - DNA, 25 bp, Homo sapien
agtagaaagcaagaaagtgtctctg

SEQ ID NO: 452381 - DNA, 25 bp, Homo sapien
aaagtgtctctgtacaggtaggcat

SEQ ID NO: 452382 - DNA, 25 bp, Homo sapien
gtctctgtacaggtaggcatgaaat

SEQ ID NO: 452383 - DNA, 25 bp, Homo sapien
gtaggcatgaaatgaatccttctct

SEQ ID NO: 452384 - DNA, 25 bp, Homo sapien
catgaaatgaatccttctcttcctc

SEQ ID NO: 452385 - DNA, 25 bp, Homo sapien
ttaaccccttctcctgcaatgtctt

SEQ ID NO: 452386 - DNA, 25 bp, Homo sapien
cccttctcctgcaatgtcttgaagt

SEQ ID NO: 452387 - DNA, 25 bp, Homo sapien
tctcctgcaatgtcttgaagtaaat

SEQ ID NO: 452388 - DNA, 25 bp, Homo sapien
tgaagtaaattactgtcattacaga

SEQ ID NO: 452389 - DNA, 25 bp, Homo sapien
tacagaagagcaatgcactgcatcc

SEQ ID NO: 452390 - DNA, 25 bp, Homo sapien
tgagttgagatcgagattgtgccac

SEQ ID NO: 452391 - DNA, 25 bp, Homo sapien
gaaacatcatctgtaggttcattaa

SEQ ID NO: 452392 - DNA, 25 bp, Homo sapien
taggttcattaatcagctcactggt

SEQ ID NO: 452393 - DNA, 25 bp, Homo sapien
aatcagctcactggttgtcactgtt

SEQ ID NO: 452394 - DNA, 25 bp, Homo sapien
ttgtcactgtttcaccgtctgaagg

SEQ ID NO: 452395 - DNA, 25 bp, Homo sapien
gaaggactatcccttttttgtagat

SEQ ID NO: 452396 - DNA, 25 bp, Homo sapien
ggaggacaagagttgcttcaaggca

SEQ ID NO: 452397 - DNA, 25 bp, Homo sapien
ttcaaggcagagctgcactcactct

SEQ ID NO: 452398 - DNA, 25 bp, Homo sapien
ctggccagaagcctgctcttataat

SEQ ID NO: 452399 - DNA, 25 bp, Homo sapien
gcctgctcttataatgactggttct

SEQ ID NO: 452400 - DNA, 25 bp, Homo sapien
taatgactggttcttttgtaggatg

SEQ ID NO: 452401 - DNA, 25 bp, Homo sapien
ggttcttttgtaggatgtggccctg

SEQ ID NO: 452402 - DNA, 25 bp, Homo sapien
gagcaagtttgtctaactaatacca

SEQ ID NO: 452403 - DNA, 25 bp, Homo sapien
gtttgtctaactaataccaacctga

SEQ ID NO: 452404 - DNA, 25 bp, Homo sapien
taactaataccaacctgacaacttg

SEQ ID NO: 452405 - DNA, 25 bp, Homo sapien
taataccaacctgacaacttgaata

SEQ ID NO: 452406 - DNA, 25 bp, Homo sapien
gtcattcacctcagtggagtgactt

SEQ ID NO: 452407 - DNA, 25 bp, Homo sapien
attcacctcagtggagtgacttgat

SEQ ID NO: 452408 - DNA, 25 bp, Homo sapien
cacctcagtggagtgacttgatatt

SEQ ID NO: 452409 - DNA, 25 bp, Homo sapien
cagtggagtgacttgatattaggtg

SEQ ID NO: 452410 - DNA, 25 bp, Homo sapien
tcttggggctcgtaattacctttca

SEQ ID NO: 452411 - DNA, 25 bp, Homo sapien
ttacctttcactttaatgtcactta

SEQ ID NO: 452412 - DNA, 25 bp, Homo sapien
gtcacttaaagatataacacagaaa

SEQ ID NO: 452413 - DNA, 25 bp, Homo sapien
caaaccacaaaggaaatctgcacaa

SEQ ID NO: 452414 - DNA, 25 bp, Homo sapien
atctgcacaacttaagagaaacttg

SEQ ID NO: 452415 - DNA, 25 bp, Homo sapien
cagcgtttgtccctgggcatgtgat

SEQ ID NO: 452416 - DNA, 25 bp, Homo sapien
acttgaaagggatcgtgtaactact

SEQ ID NO: 452417 - DNA, 25 bp, Homo sapien
gatcgtgtaactactagtttgtact

SEQ ID NO: 452418 - DNA, 25 bp, Homo sapien
tacactgtgtgattaacattaggga

SEQ ID NO: 452419 - DNA, 25 bp, Homo sapien
tagggagtactgagtgcatcacttt

SEQ ID NO: 452420 - DNA, 25 bp, Homo sapien
gagtgcatcactttatcagtgtgac

SEQ ID NO: 452421 - DNA, 25 bp, Homo sapien
tttatcagtgtgacgggtgatgtcc

SEQ ID NO: 452422 - DNA, 25 bp, Homo sapien
ggagtcctgggcacatcgagatgct

SEQ ID NO: 452423 - DNA, 25 bp, Homo sapien
tgggcacatcgagatgctttacttc

SEQ ID NO: 452424 - DNA, 25 bp, Homo sapien
ctgctgttgtcatgcctaccatggg

SEQ ID NO: 452425 - DNA, 25 bp, Homo sapien
ctgttgtcatgcctaccatgggccg

SEQ ID NO: 452426 - DNA, 25 bp, Homo sapien
acaagtttgtttaagactgactcca

SEQ ID NO: 452427 - DNA, 25 bp, Homo sapien
cctgagtaatctccctttatttttg

SEQ ID NO: 452428 - DNA, 25 bp, Homo sapien
cctttatttttgaccagcttcattt

SEQ ID NO: 452429 - DNA, 25 bp, Homo sapien
ttttgaccagcttcatttgtcagct

SEQ ID NO: 452430 - DNA, 25 bp, Homo sapien
gaccagcttcatttgtcagctttgc

SEQ ID NO: 452431 - DNA, 25 bp, Homo sapien
gtcagctttgctcagatcagatcga

SEQ ID NO: 452432 - DNA, 25 bp, Homo sapien
cagctttgctcagatcagatcgatg

SEQ ID NO: 452433 - DNA, 25 bp, Homo sapien
ctcagatcagatcgatgggattgga

SEQ ID NO: 452434 - DNA, 25 bp, Homo sapien
gatgggattggaatacattgtaact

SEQ ID NO: 452435 - DNA, 25 bp, Homo sapien
tgacactcaccacctggagttagca

SEQ ID NO: 452436 - DNA, 25 bp, Homo sapien
gactccacagggatgagggttcagt

SEQ ID NO: 452437 - DNA, 25 bp, Homo sapien
atgagggttcagtcccacgagtctg

SEQ ID NO: 452438 - DNA, 25 bp, Homo sapien
tgcccttgctgcagatgcgagtagc

SEQ ID NO: 452439 - DNA, 25 bp, Homo sapien
acacttctgtctgacttgcctgaaa

SEQ ID NO: 452440 - DNA, 25 bp, Homo sapien
agagtttgttgccaggccccttgct

SEQ ID NO: 452441 - DNA, 25 bp, Homo sapien
ggccccttgctttcaggtctgataa

SEQ ID NO: 452442 - DNA, 25 bp, Homo sapien
tttcaggtctgataacttgctaggt

SEQ ID NO: 452443 - DNA, 25 bp, Homo sapien
gttgaaattagaacggcctcactca

SEQ ID NO: 452444 - DNA, 25 bp, Homo sapien
aattccagaaagtagttgacgtcct

SEQ ID NO: 452445 - DNA, 25 bp, Homo sapien
ttgacgtcctattactggtttaccg

SEQ ID NO: 452446 - DNA, 25 bp, Homo sapien
caagtgtactgttggccgcagcatc

SEQ ID NO: 452447 - DNA, 25 bp, Homo sapien
gcagcatccagtctgtgctatcaga

SEQ ID NO: 452448 - DNA, 25 bp, Homo sapien
agcaaggcgctatggtcaggagacc

SEQ ID NO: 452449 - DNA, 25 bp, Homo sapien
tcaggagacccttagccaccaaagg

SEQ ID NO: 452450 - DNA, 25 bp, Homo sapien
caaaggtctgttgtctcctggtgtc

SEQ ID NO: 452451 - DNA, 25 bp, Homo sapien
tcctggtgtctttgcctgaagactt

SEQ ID NO: 452452 - DNA, 25 bp, Homo sapien
aagacttctggccttcttgtgtttc

SEQ ID NO: 452453 - DNA, 25 bp, Homo sapien
ggccttcttgtgtttcatcactaag

SEQ ID NO: 452454 - DNA, 25 bp, Homo sapien
aagtgcatctataagctgacccgct

SEQ ID NO: 452455 - DNA, 25 bp, Homo sapien
cgctgccaggtatcatgtctgagca

SEQ ID NO: 452456 - DNA, 25 bp, Homo sapien
atgtctgagcattttggcaaggaga

SEQ ID NO: 452457 - DNA, 25 bp, Homo sapien
gacaacacgttgtttgatgccaatc

SEQ ID NO: 452458 - DNA, 25 bp, Homo sapien
gttgtttgatgccaatcatcctcga

SEQ ID NO: 452459 - DNA, 25 bp, Homo sapien
gtttgatgccaatcatcctcgaaga

SEQ ID NO: 452460 - DNA, 25 bp, Homo sapien
gatgccaatcatcctcgaagataag

SEQ ID NO: 452461 - DNA, 25 bp, Homo sapien
atcctcgaagataagaatgtgcctt

SEQ ID NO: 452462 - DNA, 25 bp, Homo sapien
aagataagaatgtgccttttgatga

SEQ ID NO: 452463 - DNA, 25 bp, Homo sapien
ttctacaatgaagagtggaatttct

SEQ ID NO: 452464 - DNA, 25 bp, Homo sapien
ataagaagccactatatcaatgttg

SEQ ID NO: 452465 - DNA, 25 bp, Homo sapien
aacaacctttaatttgctgttgcaa

SEQ ID NO: 452466 - DNA, 25 bp, Homo sapien
gctgttgcaataaataccgtatcct

SEQ ID NO: 452467 - DNA, 25 bp, Homo sapien
taccgtatccttttattatatcttt

SEQ ID NO: 452468 - DNA, 25 bp, Homo sapien
gtcagaggaaatcatacatatgctt

SEQ ID NO: 452469 - DNA, 25 bp, Homo sapien
gctttgtaaatagactttgcagata

SEQ ID NO: 452470 - DNA, 25 bp, Homo sapien
gcaattgcataaatatttggtttct

SEQ ID NO: 452471 - DNA, 25 bp, Homo sapien
tagagtctgtgagtaaagtcaagta

SEQ ID NO: 452472 - DNA, 25 bp, Homo sapien
taaaccttgaaacttgctttgatgg

SEQ ID NO: 452473 - DNA, 25 bp, Homo sapien
gaaacttgctttgatggtagagaaa

SEQ ID NO: 452474 - DNA, 25 bp, Homo sapien
atcattgaagatttacatactgtat

SEQ ID NO: 452475 - DNA, 25 bp, Homo sapien
agatgtaaaatgtacgctgcttatt

SEQ ID NO: 452476 - DNA, 25 bp, Homo sapien
aaatgtacgctgcttattaccctca

SEQ ID NO: 452477 - DNA, 25 bp, Homo sapien
gcttattaccctcaattttccagaa

SEQ ID NO: 452478 - DNA, 25 bp, Homo sapien
tattaccctcaattttccagaagca

SEQ ID NO: 452479 - DNA, 25 bp, Homo sapien
gttgcatgctgcttatgacaatcta

SEQ ID NO: 452480 - DNA, 25 bp, Homo sapien
ttgcatgctgcttatgacaatctaa

SEQ ID NO: 452481 - DNA, 25 bp, Homo sapien
tgacaatctaatgcccggccgggtg

SEQ ID NO: 452482 - DNA, 25 bp, Homo sapien
gacaatctaatgcccggccgggtgc

SEQ ID NO: 452483 - DNA, 25 bp, Homo sapien
acaatctaatgcccggccgggtgcg

SEQ ID NO: 452484 - DNA, 25 bp, Homo sapien
caatctaatgcccggccgggtgcgg

SEQ ID NO: 452485 - DNA, 25 bp, Homo sapien
acgaagtcaagagatagaaacgatc

SEQ ID NO: 452486 - DNA, 25 bp, Homo sapien
cgaagtcaagagatagaaacgatcc

SEQ ID NO: 452487 - DNA, 25 bp, Homo sapien
gaagtcaagagatagaaacgatcct

SEQ ID NO: 452488 - DNA, 25 bp, Homo sapien
aagtcaagagatagaaacgatcctg

SEQ ID NO: 452489 - DNA, 25 bp, Homo sapien
agtcaagagatagaaacgatcctgg

SEQ ID NO: 452490 - DNA, 25 bp, Homo sapien
ttctctggctggttccactaaatgt

SEQ ID NO: 452491 - DNA, 25 bp, Homo sapien
ggttccactaaatgtgccagcccaa

SEQ ID NO: 452492 - DNA, 25 bp, Homo sapien
gagcgaggatatgcaggcactcatg

SEQ ID NO: 452493 - DNA, 25 bp, Homo sapien
aggcactcatgcttaccgggactgg

SEQ ID NO: 452494 - DNA, 25 bp, Homo sapien
gggcagctcactaggattctatcct

SEQ ID NO: 452495 - DNA, 25 bp, Homo sapien
taggattctatcctttccaatcggc

SEQ ID NO: 452496 - DNA, 25 bp, Homo sapien
ttctatcctttccaatcggcatcag

SEQ ID NO: 452497 - DNA, 25 bp, Homo sapien
ccaatcggcatcagccagctcttgt

SEQ ID NO: 452498 - DNA, 25 bp, Homo sapien
agctcttgtcccctgataagtgagg

SEQ ID NO: 452499 - DNA, 25 bp, Homo sapien
tcccctgataagtgaggacagcctg

SEQ ID NO: 452500 - DNA, 25 bp, Homo sapien
agagcctggcgcctctgtttgccac

SEQ ID NO: 452501 - DNA, 25 bp, Homo sapien
accttcctcactgcagatgtattcg

SEQ ID NO: 452502 - DNA, 25 bp, Homo sapien
agatgtattcgaccccttgcagtaa

SEQ ID NO: 452503 - DNA, 25 bp, Homo sapien
attcgaccccttgcagtaaatttag

SEQ ID NO: 452504 - DNA, 25 bp, Homo sapien
aatattacagttgcggaggagaccc

SEQ ID NO: 452505 - DNA, 25 bp, Homo sapien
agttgcggaggagaccctatctgga

SEQ ID NO: 452506 - DNA, 25 bp, Homo sapien
agggcgtgcaggtaggctaacaact

SEQ ID NO: 452507 - DNA, 25 bp, Homo sapien
aacaactgaaggatgtcctctgccc

SEQ ID NO: 452508 - DNA, 25 bp, Homo sapien
tttgctccagccctgagaactgatt

SEQ ID NO: 452509 - DNA, 25 bp, Homo sapien
tgattcaaccttttttcctcctact

SEQ ID NO: 452510 - DNA, 25 bp, Homo sapien
ctcctacttgtgaggaaagagtgcc

SEQ ID NO: 452511 - DNA, 25 bp, Homo sapien
aagagtgccataaatgtttaacatt

SEQ ID NO: 452512 - DNA, 25 bp, Homo sapien
aagcatagatttgtgtttcagcata

SEQ ID NO: 452513 - DNA, 25 bp, Homo sapien
tttcagcatatgacaaacatcaggc

SEQ ID NO: 452514 - DNA, 25 bp, Homo sapien
gcatatgacaaacatcaggcagata

SEQ ID NO: 452515 - DNA, 25 bp, Homo sapien
tcaggcagatagatgtctgatagca

SEQ ID NO: 452516 - DNA, 25 bp, Homo sapien
agatgtctgatagcagtcagtgctt

SEQ ID NO: 452517 - DNA, 25 bp, Homo sapien
gcagtcagtgcttgtaggtattcta

SEQ ID NO: 452518 - DNA, 25 bp, Homo sapien
gtcagtgcttgtaggtattctagtt

SEQ ID NO: 452519 - DNA, 25 bp, Homo sapien
gtgcttgtaggtattctagttgata

SEQ ID NO: 452520 - DNA, 25 bp, Homo sapien
tagatgattaactacagtgatgaag

SEQ ID NO: 452521 - DNA, 25 bp, Homo sapien
gatacacagaaagacgatgagaaac

SEQ ID NO: 452522 - DNA, 25 bp, Homo sapien
aaacagcatgagcagatagaaaagg

SEQ ID NO: 452523 - DNA, 25 bp, Homo sapien
aacggtgacattttcagctcttaaa

SEQ ID NO: 452524 - DNA, 25 bp, Homo sapien
ctagagtatctctatcagaaggcat

SEQ ID NO: 452525 - DNA, 25 bp, Homo sapien
atcagaaggcataggacattgtgtc

SEQ ID NO: 452526 - DNA, 25 bp, Homo sapien
aggacattgtgtccaaagtctcaag

SEQ ID NO: 452527 - DNA, 25 bp, Homo sapien
ttccttctgacctggtccaaaagtc

SEQ ID NO: 452528 - DNA, 25 bp, Homo sapien
aagtcagcaaacagcaagcaggcag

SEQ ID NO: 452529 - DNA, 25 bp, Homo sapien
ggcagaggccctcataaggactttt

SEQ ID NO: 452530 - DNA, 25 bp, Homo sapien
ataaggacttttctgtcctcctttg

SEQ ID NO: 452531 - DNA, 25 bp, Homo sapien
tgtcctcctttgaccaaactgttta

SEQ ID NO: 452532 - DNA, 25 bp, Homo sapien
gaccaaactgtttaaccgagcctag

SEQ ID NO: 452533 - DNA, 25 bp, Homo sapien
aagctggcatctttctctacggaga

SEQ ID NO: 452534 - DNA, 25 bp, Homo sapien
tgggttcagagctcctcccgcaggg

SEQ ID NO: 452535 - DNA, 25 bp, Homo sapien
agcctcagaagtggaggcagctgct

SEQ ID NO: 452536 - DNA, 25 bp, Homo sapien
gcagctgctgatgggtgagtttaca

SEQ ID NO: 452537 - DNA, 25 bp, Homo sapien
gagtttacaacttcttatcctgcct

SEQ ID NO: 452538 - DNA, 25 bp, Homo sapien
aacttcttatcctgcctaaggcgag

SEQ ID NO: 452539 - DNA, 25 bp, Homo sapien
ttttattccgtttccagtccttgag

SEQ ID NO: 452540 - DNA, 25 bp, Homo sapien
tttccagtccttgagctcagcagat

SEQ ID NO: 452541 - DNA, 25 bp, Homo sapien
gtccttgagctcagcagatcaaaat

SEQ ID NO: 452542 - DNA, 25 bp, Homo sapien
aaataacagtgaccctgcaacccca

SEQ ID NO: 452543 - DNA, 25 bp, Homo sapien
tttagtccccgctctggaaggccag

SEQ ID NO: 452544 - DNA, 25 bp, Homo sapien
gaaggccaggcagtttaggtgtaaa

SEQ ID NO: 452545 - DNA, 25 bp, Homo sapien
tggcccagagtgttcttgaattcct

SEQ ID NO: 452546 - DNA, 25 bp, Homo sapien
ggcccagagtgttcttgaattcctg

SEQ ID NO: 452547 - DNA, 25 bp, Homo sapien
cccagagtgttcttgaattcctggc

SEQ ID NO: 452548 - DNA, 25 bp, Homo sapien
tacttttttacacttgcttttctgg

SEQ ID NO: 452549 - DNA, 25 bp, Homo sapien
ttttttacacttgcttttctggaat

SEQ ID NO: 452550 - DNA, 25 bp, Homo sapien
ggaatcaggatctaaacatattgca

SEQ ID NO: 452551 - DNA, 25 bp, Homo sapien
ggatctaaacatattgcatgcggtt

SEQ ID NO: 452552 - DNA, 25 bp, Homo sapien
tctaaacatattgcatgcggttgat

SEQ ID NO: 452553 - DNA, 25 bp, Homo sapien
aacatattgcatgcggttgatatat

SEQ ID NO: 452554 - DNA, 25 bp, Homo sapien
catgcggttgatatattaagcctgt

SEQ ID NO: 452555 - DNA, 25 bp, Homo sapien
ggttgatatattaagcctgttttat

SEQ ID NO: 452556 - DNA, 25 bp, Homo sapien
tcccccctttagaaatgttggatat

SEQ ID NO: 452557 - DNA, 25 bp, Homo sapien
gatataaacacttcttttaactccg

SEQ ID NO: 452558 - DNA, 25 bp, Homo sapien
ttttaactccgaaaatcttctgaga

SEQ ID NO: 452559 - DNA, 25 bp, Homo sapien
gaaatcacaaaattcacggtatgct

SEQ ID NO: 452560 - DNA, 25 bp, Homo sapien
aaattcacggtatgcttggaacgat

SEQ ID NO: 452561 - DNA, 25 bp, Homo sapien
cacggtatgcttggaacgattgaga

SEQ ID NO: 452562 - DNA, 25 bp, Homo sapien
gaacgattgagattttctaggtaga

SEQ ID NO: 452563 - DNA, 25 bp, Homo sapien
ttttctaggtagatgctgaatagcc

SEQ ID NO: 452564 - DNA, 25 bp, Homo sapien
atgctgaatagcctagacatcaaag

SEQ ID NO: 452565 - DNA, 25 bp, Homo sapien
gaagactgaactctgttcaaatgct

SEQ ID NO: 452566 - DNA, 25 bp, Homo sapien
ttcaaatgctttcatgaacctggtt

SEQ ID NO: 452567 - DNA, 25 bp, Homo sapien
gcttctctcggcacacacacggttt

SEQ ID NO: 452568 - DNA, 25 bp, Homo sapien
ttctctcggcacacacacggtttct

SEQ ID NO: 452569 - DNA, 25 bp, Homo sapien
tcggcacacacacggtttctctctg

SEQ ID NO: 452570 - DNA, 25 bp, Homo sapien
acacacacggtttctctctgctctt

SEQ ID NO: 452571 - DNA, 25 bp, Homo sapien
cgctctctagtgaggctttgggaac

SEQ ID NO: 452572 - DNA, 25 bp, Homo sapien
ctctagtgaggctttgggaaccctg

SEQ ID NO: 452573 - DNA, 25 bp, Homo sapien
tctagtgaggctttgggaaccctgc

SEQ ID NO: 452574 - DNA, 25 bp, Homo sapien
tagtgaggctttgggaaccctgccg

SEQ ID NO: 452575 - DNA, 25 bp, Homo sapien
gaggctttgggaaccctgccggagt

SEQ ID NO: 452576 - DNA, 25 bp, Homo sapien
gaaccctgccggagtcggaaggagt

SEQ ID NO: 452577 - DNA, 25 bp, Homo sapien
agagaaaagggcctcctcacacacc

SEQ ID NO: 452578 - DNA, 25 bp, Homo sapien
gtcaaatctgactgctacagttggt

SEQ ID NO: 452579 - DNA, 25 bp, Homo sapien
gactgctacagttggtattaattaa

SEQ ID NO: 452580 - DNA, 25 bp, Homo sapien
aaaaacagttgttctcccatggtgt

SEQ ID NO: 452581 - DNA, 25 bp, Homo sapien
cagttgttctcccatggtgtatgta

SEQ ID NO: 452582 - DNA, 25 bp, Homo sapien
tctcccatggtgtatgtatcttcat

SEQ ID NO: 452583 - DNA, 25 bp, Homo sapien
gtatcttcatgtttgtccttagtgg

SEQ ID NO: 452584 - DNA, 25 bp, Homo sapien
tcatgtttgtccttagtggttataa

SEQ ID NO: 452585 - DNA, 25 bp, Homo sapien
tgtccttagtggttataataatctg

SEQ ID NO: 452586 - DNA, 25 bp, Homo sapien
tatgaagagaatctgctggaatgat

SEQ ID NO: 452587 - DNA, 25 bp, Homo sapien
gctggaatgattagtaaggtgcttt

SEQ ID NO: 452588 - DNA, 25 bp, Homo sapien
aggtgctttatttgtgggccaaata

SEQ ID NO: 452589 - DNA, 25 bp, Homo sapien
actgctgcccaccccgagttgaaga

SEQ ID NO: 452590 - DNA, 25 bp, Homo sapien
ctgctgcccaccccgagttgaagac

SEQ ID NO: 452591 - DNA, 25 bp, Homo sapien
tgctgcccaccccgagttgaagacc

SEQ ID NO: 452592 - DNA, 25 bp, Homo sapien
gctgcccaccccgagttgaagaccc

SEQ ID NO: 452593 - DNA, 25 bp, Homo sapien
ttgaagaccccactaaccgccaaca

SEQ ID NO: 452594 - DNA, 25 bp, Homo sapien
tgaagaccccactaaccgccaacat

SEQ ID NO: 452595 - DNA, 25 bp, Homo sapien
gaagaccccactaaccgccaacatc

SEQ ID NO: 452596 - DNA, 25 bp, Homo sapien
aagaccccactaaccgccaacatca

SEQ ID NO: 452597 - DNA, 25 bp, Homo sapien
agaccccactaaccgccaacatcac

SEQ ID NO: 452598 - DNA, 25 bp, Homo sapien
gaccccactaaccgccaacatcaca

SEQ ID NO: 452599 - DNA, 25 bp, Homo sapien
accccactaaccgccaacatcacaa

SEQ ID NO: 452600 - DNA, 25 bp, Homo sapien
gccccaatccttcagcaaccggtcc

SEQ ID NO: 452601 - DNA, 25 bp, Homo sapien
gcttctctcggcacacacacggttt

SEQ ID NO: 452602 - DNA, 25 bp, Homo sapien
ttctctcggcacacacacggtttct

SEQ ID NO: 452603 - DNA, 25 bp, Homo sapien
tcggcacacacacggtttctctctg

SEQ ID NO: 452604 - DNA, 25 bp, Homo sapien
acacacacggtttctctctgctctt

SEQ ID NO: 452605 - DNA, 25 bp, Homo sapien
ctctagtgaggctttgggaaccctg

SEQ ID NO: 452606 - DNA, 25 bp, Homo sapien
tctagtgaggctttgggaaccctgc

SEQ ID NO: 452607 - DNA, 25 bp, Homo sapien
ctagtgaggctttgggaaccctgcc

SEQ ID NO: 452608 - DNA, 25 bp, Homo sapien
tagtgaggctttgggaaccctgccg

SEQ ID NO: 452609 - DNA, 25 bp, Homo sapien
gaggctttgggaaccctgccggagt

SEQ ID NO: 452610 - DNA, 25 bp, Homo sapien
gaaccctgccggagtcggaaggagt

SEQ ID NO: 452611 - DNA, 25 bp, Homo sapien
gtacactgccttatgtgaaatttgg

SEQ ID NO: 452612 - DNA, 25 bp, Homo sapien
aatttggtcatggaatgtactcata

SEQ ID NO: 452613 - DNA, 25 bp, Homo sapien
gtactcataagagataagtgctgac

SEQ ID NO: 452614 - DNA, 25 bp, Homo sapien
aaaagatgagtatggcccttccctg

SEQ ID NO: 452615 - DNA, 25 bp, Homo sapien
atgagtatggcccttccctggagat

SEQ ID NO: 452616 - DNA, 25 bp, Homo sapien
ccctggagatgcttaacagtctagt

SEQ ID NO: 452617 - DNA, 25 bp, Homo sapien
aattcccatgagatactatgttggc

SEQ ID NO: 452618 - DNA, 25 bp, Homo sapien
gttggcatgagaggcatatttttac

SEQ ID NO: 452619 - DNA, 25 bp, Homo sapien
ttacagaattttgaagacgacttat

SEQ ID NO: 452620 - DNA, 25 bp, Homo sapien
tgagttttggttctattactacaaa

SEQ ID NO: 452621 - DNA, 25 bp, Homo sapien
gtcatatggttatttagacatctaa

SEQ ID NO: 452622 - DNA, 25 bp, Homo sapien
caaagtatcctgtgtaatgttgctg

SEQ ID NO: 452623 - DNA, 25 bp, Homo sapien
tgttgctgacataaagcactttggg

SEQ ID NO: 452624 - DNA, 25 bp, Homo sapien
gttttccataaatcacacagactct

SEQ ID NO: 452625 - DNA, 25 bp, Homo sapien
aaatcacacagactcttgtacatag

SEQ ID NO: 452626 - DNA, 25 bp, Homo sapien
cacagactcttgtacatagttatat

SEQ ID NO: 452627 - DNA, 25 bp, Homo sapien
atagttatatacactcacgtagaga

SEQ ID NO: 452628 - DNA, 25 bp, Homo sapien
acactcacgtagagaaatgaactgc

SEQ ID NO: 452629 - DNA, 25 bp, Homo sapien
atatggggccgattttactctagag

SEQ ID NO: 452630 - DNA, 25 bp, Homo sapien
tactctagaggcacatctggtgctt

SEQ ID NO: 452631 - DNA, 25 bp, Homo sapien
gcacatctggtgcttattgtcataa

SEQ ID NO: 452632 - DNA, 25 bp, Homo sapien
ggtgcttattgtcataaatctttta

SEQ ID NO: 452633 - DNA, 25 bp, Homo sapien
taggcagtgcgaagtgctcatccgc

SEQ ID NO: 452634 - DNA, 25 bp, Homo sapien
agtgcgaagtgctcatccgcgagct

SEQ ID NO: 452635 - DNA, 25 bp, Homo sapien
ctcatccgcgagctgtggaatacca

SEQ ID NO: 452636 - DNA, 25 bp, Homo sapien
gctagctttcccagggaccaagaag

SEQ ID NO: 452637 - DNA, 25 bp, Homo sapien
aagaagccacgcatttccccaaggt

SEQ ID NO: 452638 - DNA, 25 bp, Homo sapien
atttccccaaggtctccaccaagag

SEQ ID NO: 452639 - DNA, 25 bp, Homo sapien
caagagcctctccaagaaatgcctg

SEQ ID NO: 452640 - DNA, 25 bp, Homo sapien
gcactgaagcagaccccgaagaaca

SEQ ID NO: 452641 - DNA, 25 bp, Homo sapien
aagcagaccccgaagaacaactttg

SEQ ID NO: 452642 - DNA, 25 bp, Homo sapien
gaccccgaagaacaactttgccgag

SEQ ID NO: 452643 - DNA, 25 bp, Homo sapien
gaagaacaactttgccgagaggcag

SEQ ID NO: 452644 - DNA, 25 bp, Homo sapien
atcacaattgacctggacattccaa

SEQ ID NO: 452645 - DNA, 25 bp, Homo sapien
cagcatttctcttccgtagtccagt

SEQ ID NO: 452646 - DNA, 25 bp, Homo sapien
cgtagtccagtcagctcatttggta

SEQ ID NO: 452647 - DNA, 25 bp, Homo sapien
tcagctcatttggtagatgcgcttt

SEQ ID NO: 452648 - DNA, 25 bp, Homo sapien
tttttcctcctttgcgcttattcat

SEQ ID NO: 452649 - DNA, 25 bp, Homo sapien
ctcctttgcgcttattcatccataa

SEQ ID NO: 452650 - DNA, 25 bp, Homo sapien
gaactggcaggtgttgatttcataa

SEQ ID NO: 452651 - DNA, 25 bp, Homo sapien
gtactttctaatttcgcttgcttca

SEQ ID NO: 452652 - DNA, 25 bp, Homo sapien
aatttcgcttgcttcagacttgact

SEQ ID NO: 452653 - DNA, 25 bp, Homo sapien
gcttgcttcagacttgactttggaa

SEQ ID NO: 452654 - DNA, 25 bp, Homo sapien
gaagttcgaaggcatcacaattgac

SEQ ID NO: 452655 - DNA, 25 bp, Homo sapien
atctctgccgctctgggactgatga

SEQ ID NO: 452656 - DNA, 25 bp, Homo sapien
gtgtgtaactgggtgatcttggaca

SEQ ID NO: 452657 - DNA, 25 bp, Homo sapien
aactgggtgatcttggacatgggat

SEQ ID NO: 452658 - DNA, 25 bp, Homo sapien
gtgaggaggcttaccaatgctgaga

SEQ ID NO: 452659 - DNA, 25 bp, Homo sapien
tgagaggagtggaagccccaacccc

SEQ ID NO: 452660 - DNA, 25 bp, Homo sapien
aaccccagctaatgctagacaccag

SEQ ID NO: 452661 - DNA, 25 bp, Homo sapien
atgctagacaccagactccaaattt

SEQ ID NO: 452662 - DNA, 25 bp, Homo sapien
agactccaaatttaaacacacagtg

SEQ ID NO: 452663 - DNA, 25 bp, Homo sapien
aacacacagtggaaactggcaagaa

SEQ ID NO: 452664 - DNA, 25 bp, Homo sapien
tactgacttcaatacagatttcaag

SEQ ID NO: 452665 - DNA, 25 bp, Homo sapien
gagacatgacattagcactggtgga

SEQ ID NO: 452666 - DNA, 25 bp, Homo sapien
atggaacttctaattaatgtgcaaa

SEQ ID NO: 452667 - DNA, 25 bp, Homo sapien
agaaattttaagtcagatcatgctg

SEQ ID NO: 452668 - DNA, 25 bp, Homo sapien
gtgtaattcattgacctcttccttc

SEQ ID NO: 452669 - DNA, 25 bp, Homo sapien
tcattgacctcttccttccaaaata

SEQ ID NO: 452670 - DNA, 25 bp, Homo sapien
ataacatcaagtagccacctcagtg

SEQ ID NO: 452671 - DNA, 25 bp, Homo sapien
gccacctcagtgtgacaatatccag

SEQ ID NO: 452672 - DNA, 25 bp, Homo sapien
gacaatatccagtcaatagtagaga

SEQ ID NO: 452673 - DNA, 25 bp, Homo sapien
gagaatttaatccttggtcctataa

SEQ ID NO: 452674 - DNA, 25 bp, Homo sapien
aaattcattgtcgtatttatagcac

SEQ ID NO: 452675 - DNA, 25 bp, Homo sapien
tgttgtggtttctgcggaacgttta

SEQ ID NO: 452676 - DNA, 25 bp, Homo sapien
tctgcggaacgtttacaagtgaagt

SEQ ID NO: 452677 - DNA, 25 bp, Homo sapien
atctaaagagagtagcctggactta

SEQ ID NO: 452678 - DNA, 25 bp, Homo sapien
gaaatcagcttatgcgtgcctttta

SEQ ID NO: 452679 - DNA, 25 bp, Homo sapien
cagcttatgcgtgccttttaatttt

SEQ ID NO: 452680 - DNA, 25 bp, Homo sapien
aagtttcttactgccacatatggtg

SEQ ID NO: 452681 - DNA, 25 bp, Homo sapien
gtgaagtgacagtaagttgcttaat

SEQ ID NO: 452682 - DNA, 25 bp, Homo sapien
atcctgcagtatctgcttgcttttg

SEQ ID NO: 452683 - DNA, 25 bp, Homo sapien
atctgcttgcttttggagactccag

SEQ ID NO: 452684 - DNA, 25 bp, Homo sapien
agtgagatgttgaaattgttcctgt

SEQ ID NO: 452685 - DNA, 25 bp, Homo sapien
tcctgtgcttggtaactactttcct

SEQ ID NO: 452686 - DNA, 25 bp, Homo sapien
taactactttcctctgccaggctat

SEQ ID NO: 452687 - DNA, 25 bp, Homo sapien
ccaggctatgggaaagaggatgtaa

SEQ ID NO: 452688 - DNA, 25 bp, Homo sapien
gccgggagccactttgatgctgcga

SEQ ID NO: 452689 - DNA, 25 bp, Homo sapien
gagccactttgatgctgcgaaggcc

SEQ ID NO: 452690 - DNA, 25 bp, Homo sapien
cactttgatgctgcgaaggccgtgg

SEQ ID NO: 452691 - DNA, 25 bp, Homo sapien
gcgaaggccgtggaggaacagctga

SEQ ID NO: 452692 - DNA, 25 bp, Homo sapien
acagctgagaaagtcgttccagatc

SEQ ID NO: 452693 - DNA, 25 bp, Homo sapien
tgagaaagtcgttccagatccgctg

SEQ ID NO: 452694 - DNA, 25 bp, Homo sapien
gaaagtcgttccagatccgctgcgg

SEQ ID NO: 452695 - DNA, 25 bp, Homo sapien
aggggctgaacgtgccgcgctccaa

SEQ ID NO: 452696 - DNA, 25 bp, Homo sapien
ccaagcggctcttccgggacctggt

SEQ ID NO: 452697 - DNA, 25 bp, Homo sapien
ggaacaggttctgaatgccgcgctc

SEQ ID NO: 452698 - DNA, 25 bp, Homo sapien
caggttctgaatgccgcgctcaggg

SEQ ID NO: 452699 - DNA, 25 bp, Homo sapien
taaatctcttagtggttacattgcc

SEQ ID NO: 452700 - DNA, 25 bp, Homo sapien
agtggttacattgccatttggtagc

SEQ ID NO: 452701 - DNA, 25 bp, Homo sapien
tgccatttggtagcatcatgtatat

SEQ ID NO: 452702 - DNA, 25 bp, Homo sapien
ataagtttgcattatgactcctgta

SEQ ID NO: 452703 - DNA, 25 bp, Homo sapien
gtttgcattatgactcctgtaaaat

SEQ ID NO: 452704 - DNA, 25 bp, Homo sapien
gcattatgactcctgtaaaatatga

SEQ ID NO: 452705 - DNA, 25 bp, Homo sapien
gcaataaaagtgttatctttcttac

SEQ ID NO: 452706 - DNA, 25 bp, Homo sapien
caatatttctagtagcacaactgat

SEQ ID NO: 452707 - DNA, 25 bp, Homo sapien
gtagcacaactgataatattgatat

SEQ ID NO: 452708 - DNA, 25 bp, Homo sapien
atgttacttctaaaattacagacaa

SEQ ID NO: 452709 - DNA, 25 bp, Homo sapien
tacttacacaattcagttaagatgc

SEQ ID NO: 452710 - DNA, 25 bp, Homo sapien
aattttgccaagtcgagacccagct

SEQ ID NO: 452711 - DNA, 25 bp, Homo sapien
tgccaagtcgagacccagctctcta

SEQ ID NO: 452712 - DNA, 25 bp, Homo sapien
agctctctaccatgatttcctcaac

SEQ ID NO: 452713 - DNA, 25 bp, Homo sapien
aacctctcacctaaaccagtattgc

SEQ ID NO: 452714 - DNA, 25 bp, Homo sapien
aaccagtattgcaaagactttttca

SEQ ID NO: 452715 - DNA, 25 bp, Homo sapien
tcatggctaaataaacacatacgtt

SEQ ID NO: 452716 - DNA, 25 bp, Homo sapien
tagctaaaatgtacactctggtttg

SEQ ID NO: 452717 - DNA, 25 bp, Homo sapien
aaatgtacactctggtttgtgctga

SEQ ID NO: 452718 - DNA, 25 bp, Homo sapien
tggtttgtgctgacatttctggctt

SEQ ID NO: 452719 - DNA, 25 bp, Homo sapien
gctgacatttctggcttgtgtgaca

SEQ ID NO: 452720 - DNA, 25 bp, Homo sapien
aaatacatgacaattttgccaagtc

SEQ ID NO: 452721 - DNA, 25 bp, Homo sapien
agactaagatccaagtttacttcca

SEQ ID NO: 452722 - DNA, 25 bp, Homo sapien
agtttacttccagcatttctttatc

SEQ ID NO: 452723 - DNA, 25 bp, Homo sapien
tccagcatttctttatctttatcct

SEQ ID NO: 452724 - DNA, 25 bp, Homo sapien
tttatccttcttcatttgcagcttc

SEQ ID NO: 452725 - DNA, 25 bp, Homo sapien
ttgcagcttcttcttgtttatgctt

SEQ ID NO: 452726 - DNA, 25 bp, Homo sapien
tgtttatgctttgggaaaccagatg

SEQ ID NO: 452727 - DNA, 25 bp, Homo sapien
gaatttacagggtctctgtggcaga

SEQ ID NO: 452728 - DNA, 25 bp, Homo sapien
atggagttcccgcttgtaaataaat

SEQ ID NO: 452729 - DNA, 25 bp, Homo sapien
ttactaggttcttaaggttcactct

SEQ ID NO: 452730 - DNA, 25 bp, Homo sapien
ggttcactcttttaagagagtttct

SEQ ID NO: 452731 - DNA, 25 bp, Homo sapien
tctttcccattgtctaagtctagac

SEQ ID NO: 452732 - DNA, 25 bp, Homo sapien
tccctgctaaagacgttttcattag

SEQ ID NO: 452733 - DNA, 25 bp, Homo sapien
tagtcttagagggtatatgctttct

SEQ ID NO: 452734 - DNA, 25 bp, Homo sapien
gagggtatatgctttctagaacttg

SEQ ID NO: 452735 - DNA, 25 bp, Homo sapien
gtatatgctttctagaacttgtttt

SEQ ID NO: 452736 - DNA, 25 bp, Homo sapien
gaacttgtttttgttaacatgtgct

SEQ ID NO: 452737 - DNA, 25 bp, Homo sapien
aacatgtgctttgatgtaaagaaca

SEQ ID NO: 452738 - DNA, 25 bp, Homo sapien
tatggttgtacaatacactatattg

SEQ ID NO: 452739 - DNA, 25 bp, Homo sapien
tattgtttagggattccggaaagca

SEQ ID NO: 452740 - DNA, 25 bp, Homo sapien
gggattccggaaagcagtttaatgc

SEQ ID NO: 452741 - DNA, 25 bp, Homo sapien
aactatatctagtatgcagttcata

SEQ ID NO: 452742 - DNA, 25 bp, Homo sapien
ctagtatgcagttcatattgtgaat

SEQ ID NO: 452743 - DNA, 25 bp, Homo sapien
ccagccactttctttaatactataa

SEQ ID NO: 452744 - DNA, 25 bp, Homo sapien
cagccactttctttaatactataac

SEQ ID NO: 452745 - DNA, 25 bp, Homo sapien
agccactttctttaatactataact

SEQ ID NO: 452746 - DNA, 25 bp, Homo sapien
gccactttctttaatactataacta

SEQ ID NO: 452747 - DNA, 25 bp, Homo sapien
tattaaaatgcacaaattgtctaag

SEQ ID NO: 452748 - DNA, 25 bp, Homo sapien
attgtctaagactgtaaagtttatt

SEQ ID NO: 452749 - DNA, 25 bp, Homo sapien
gagaggccatgactacctctgaatt

SEQ ID NO: 452750 - DNA, 25 bp, Homo sapien
agaggccatgactacctctgaattt

SEQ ID NO: 452751 - DNA, 25 bp, Homo sapien
gaggccatgactacctctgaattta

SEQ ID NO: 452752 - DNA, 25 bp, Homo sapien
aggccatgactacctctgaatttag

SEQ ID NO: 452753 - DNA, 25 bp, Homo sapien
ggccatgactacctctgaatttagt

SEQ ID NO: 452754 - DNA, 25 bp, Homo sapien
gaattcttcaactataatccagtgg

SEQ ID NO: 452755 - DNA, 25 bp, Homo sapien
ataatccagtggaggacttctcgat

SEQ ID NO: 452756 - DNA, 25 bp, Homo sapien
aatccagtggaggacttctcgatgc

SEQ ID NO: 452757 - DNA, 25 bp, Homo sapien
tccagtggaggacttctcgatgcca

SEQ ID NO: 452758 - DNA, 25 bp, Homo sapien
agtggaggacttctcgatgccaccc

SEQ ID NO: 452759 - DNA, 25 bp, Homo sapien
tggaggacttctcgatgccacccca

SEQ ID NO: 452760 - DNA, 25 bp, Homo sapien
tgtggccctggagtgaactttgtgc

SEQ ID NO: 452761 - DNA, 25 bp, Homo sapien
gccctggagtgaactttgtgcctgg

SEQ ID NO: 452762 - DNA, 25 bp, Homo sapien
ctggagtgaactttgtgcctggccc

SEQ ID NO: 452763 - DNA, 25 bp, Homo sapien
ggagtgaactttgtgcctggccctc

SEQ ID NO: 452764 - DNA, 25 bp, Homo sapien
cctaatccccatggtcagcactggg

SEQ ID NO: 452765 - DNA, 25 bp, Homo sapien
acttcactgtggagccggagtctgc

SEQ ID NO: 452766 - DNA, 25 bp, Homo sapien
tgtggagccggagtctgcattttcc

SEQ ID NO: 452767 - DNA, 25 bp, Homo sapien
aaatcagagaatgccgagtggtcct

SEQ ID NO: 452768 - DNA, 25 bp, Homo sapien
ctatccagctccttacttggatgaa

SEQ ID NO: 452769 - DNA, 25 bp, Homo sapien
agctccttacttggatgaatatgga

SEQ ID NO: 452770 - DNA, 25 bp, Homo sapien
ccccttcatttatctcgtgagcggt

SEQ ID NO: 452771 - DNA, 25 bp, Homo sapien
atttatctcgtgagcggtatcggaa

SEQ ID NO: 452772 - DNA, 25 bp, Homo sapien
agcggtatcggaagctccatttggt

SEQ ID NO: 452773 - DNA, 25 bp, Homo sapien
ggaagctccatttggtctggcaaca

SEQ ID NO: 452774 - DNA, 25 bp, Homo sapien
tccatttggtctggcaacaacactg

SEQ ID NO: 452775 - DNA, 25 bp, Homo sapien
ttgcatttttcacgcacttcactgt

SEQ ID NO: 452776 - DNA, 25 bp, Homo sapien
acatgcggattgtggcagcctctgt

SEQ ID NO: 452777 - DNA, 25 bp, Homo sapien
ttgtggcagcctctgtgaccaagag

SEQ ID NO: 452778 - DNA, 25 bp, Homo sapien
gacaacagcagcatagaaacctcaa

SEQ ID NO: 452779 - DNA, 25 bp, Homo sapien
gctactaatttagccaaccttggca

SEQ ID NO: 452780 - DNA, 25 bp, Homo sapien
atcagctatctctggtcttagtata

SEQ ID NO: 452781 - DNA, 25 bp, Homo sapien
cttagtatatgaggcgataagcccc

SEQ ID NO: 452782 - DNA, 25 bp, Homo sapien
ccactgttcaagttgggtgtctatc

SEQ ID NO: 452783 - DNA, 25 bp, Homo sapien
ttgggtgtctatcaattgctgcaga

SEQ ID NO: 452784 - DNA, 25 bp, Homo sapien
ccttgctgtgtctggatattgtcac

SEQ ID NO: 452785 - DNA, 25 bp, Homo sapien
gtctggatattgtcacatgaggact

SEQ ID NO: 452786 - DNA, 25 bp, Homo sapien
cacatgaggacttgacatgcggatt

SEQ ID NO: 452787 - DNA, 25 bp, Homo sapien
aacagtcactttacaacaatcatgt

SEQ ID NO: 452788 - DNA, 25 bp, Homo sapien
aatcatgtaaagacgtgtgcctgca

SEQ ID NO: 452789 - DNA, 25 bp, Homo sapien
gtaaagacgtgtgcctgcagttgag

SEQ ID NO: 452790 - DNA, 25 bp, Homo sapien
tttttgcatttctgagcctgctttg

SEQ ID NO: 452791 - DNA, 25 bp, Homo sapien
atttctgagcctgctttgtattcat

SEQ ID NO: 452792 - DNA, 25 bp, Homo sapien
gagcctgctttgtattcatgagaaa

SEQ ID NO: 452793 - DNA, 25 bp, Homo sapien
gttttagataagcagcattgtaagt

SEQ ID NO: 452794 - DNA, 25 bp, Homo sapien
ggatgtcaaagtattaacgaagggt

SEQ ID NO: 452795 - DNA, 25 bp, Homo sapien
ttatgatctgatttcttaattttct

SEQ ID NO: 452796 - DNA, 25 bp, Homo sapien
gaaatcttgcaaattaggaatatct

SEQ ID NO: 452797 - DNA, 25 bp, Homo sapien
gcaaattaggaatatctacatctat

SEQ ID NO: 452798 - DNA, 25 bp, Homo sapien
ggaagtcctgtcatagtgtgctcaa

SEQ ID NO: 452799 - DNA, 25 bp, Homo sapien
catagtgtgctcaagatagttcctc

SEQ ID NO: 452800 - DNA, 25 bp, Homo sapien
aagatagttcctctgcccttacctt

SEQ ID NO: 452801 - DNA, 25 bp, Homo sapien
ccttaccttccctgtgaagcagaag

SEQ ID NO: 452802 - DNA, 25 bp, Homo sapien
tagcaagatttggagtgtgaacata

SEQ ID NO: 452803 - DNA, 25 bp, Homo sapien
gtgtgaacatagaagatacctatct

SEQ ID NO: 452804 - DNA, 25 bp, Homo sapien
gatacctatctgaaagcttctctag

SEQ ID NO: 452805 - DNA, 25 bp, Homo sapien
agcttctctagcagtttacaattct

SEQ ID NO: 452806 - DNA, 25 bp, Homo sapien
tagttatttcctagattatcatgta

SEQ ID NO: 452807 - DNA, 25 bp, Homo sapien
gggataatacagtagtagcatcact

SEQ ID NO: 452808 - DNA, 25 bp, Homo sapien
agtagtagcatcacttaaagtacat

SEQ ID NO: 452809 - DNA, 25 bp, Homo sapien
ctgacaacctatagtatatttgctt

SEQ ID NO: 452810 - DNA, 25 bp, Homo sapien
agtgccaagaagttcataatgtgtt

SEQ ID NO: 452811 - DNA, 25 bp, Homo sapien
caattttgccgaaagctagctggga

SEQ ID NO: 452812 - DNA, 25 bp, Homo sapien
agctagctgggataataggatcatc

SEQ ID NO: 452813 - DNA, 25 bp, Homo sapien
aataggatcatcacaagttgcagtt

SEQ ID NO: 452814 - DNA, 25 bp, Homo sapien
gattgaaatctcttctgacctagaa

SEQ ID NO: 452815 - DNA, 25 bp, Homo sapien
tttacttcaggcattcagcagattt

SEQ ID NO: 452816 - DNA, 25 bp, Homo sapien
tcaggcattcagcagatttcagaaa

SEQ ID NO: 452817 - DNA, 25 bp, Homo sapien
actgaaaacagtcctaccattttag

SEQ ID NO: 452818 - DNA, 25 bp, Homo sapien
aggtaagaccaaacagagtctctaa

SEQ ID NO: 452819 - DNA, 25 bp, Homo sapien
gagtctctaacccaaggacttgtta

SEQ ID NO: 452820 - DNA, 25 bp, Homo sapien
attagcctggcatggcacttagctg

SEQ ID NO: 452821 - DNA, 25 bp, Homo sapien
gcctggcatggcacttagctgtggt

SEQ ID NO: 452822 - DNA, 25 bp, Homo sapien
ggcatggcacttagctgtggtctca

SEQ ID NO: 452823 - DNA, 25 bp, Homo sapien
atggcacttagctgtggtctcagcc

SEQ ID NO: 452824 - DNA, 25 bp, Homo sapien
ggcacttagctgtggtctcagccac

SEQ ID NO: 452825 - DNA, 25 bp, Homo sapien
cttagctgtggtctcagccacttag

SEQ ID NO: 452826 - DNA, 25 bp, Homo sapien
caaggctgctgcgagccatgttagt

SEQ ID NO: 452827 - DNA, 25 bp, Homo sapien
gctgctgcgagccatgttagtatca

SEQ ID NO: 452828 - DNA, 25 bp, Homo sapien
gctgcgagccatgttagtatcactg

SEQ ID NO: 452829 - DNA, 25 bp, Homo sapien
gcgagccatgttagtatcactgcat

SEQ ID NO: 452830 - DNA, 25 bp, Homo sapien
agccatgttagtatcactgcattcc

SEQ ID NO: 452831 - DNA, 25 bp, Homo sapien
gagtttgccgtgagtcaaaatcgtg

SEQ ID NO: 452832 - DNA, 25 bp, Homo sapien
gtttgccgtgagtcaaaatcgtgcc

SEQ ID NO: 452833 - DNA, 25 bp, Homo sapien
tttgccgtgagtcaaaatcgtgcca

SEQ ID NO: 452834 - DNA, 25 bp, Homo sapien
gccgtgagtcaaaatcgtgccactc

SEQ ID NO: 452835 - DNA, 25 bp, Homo sapien
ccgtgagtcaaaatcgtgccactct

SEQ ID NO: 452836 - DNA, 25 bp, Homo sapien
cgtgagtcaaaatcgtgccactcta

SEQ ID NO: 452837 - DNA, 25 bp, Homo sapien
atatttcaggccaggaatagtggct

SEQ ID NO: 452838 - DNA, 25 bp, Homo sapien
ttcaggccaggaatagtggctccca

SEQ ID NO: 452839 - DNA, 25 bp, Homo sapien
ttttccccttctctgtggcgcaaga

SEQ ID NO: 452840 - DNA, 25 bp, Homo sapien
tttccccttctctgtggcgcaagac

SEQ ID NO: 452841 - DNA, 25 bp, Homo sapien
tctctgtggcgcaagacctcatctc

SEQ ID NO: 452842 - DNA, 25 bp, Homo sapien
ctttttttagaactgttgatatgat

SEQ ID NO: 452843 - DNA, 25 bp, Homo sapien
tttttttagaactgttgatatgatt

SEQ ID NO: 452844 - DNA, 25 bp, Homo sapien
ttttttagaactgttgatatgattt

SEQ ID NO: 452845 - DNA, 25 bp, Homo sapien
tttttagaactgttgatatgattta

SEQ ID NO: 452846 - DNA, 25 bp, Homo sapien
ttttagaactgttgatatgatttaa

SEQ ID NO: 452847 - DNA, 25 bp, Homo sapien
tttagaactgttgatatgatttaaa

SEQ ID NO: 452848 - DNA, 25 bp, Homo sapien
tttaaaagataagattaatgggccg

SEQ ID NO: 452849 - DNA, 25 bp, Homo sapien
ttaaaagataagattaatgggccgg

SEQ ID NO: 452850 - DNA, 25 bp, Homo sapien
taaaagataagattaatgggccggg

SEQ ID NO: 452851 - DNA, 25 bp, Homo sapien
aactcattccaaccaggaagctttt

SEQ ID NO: 452852 - DNA, 25 bp, Homo sapien
gaagcttttttatacattgcctaaa

SEQ ID NO: 452853 - DNA, 25 bp, Homo sapien
attgcctaaatctacgccaaccaga

SEQ ID NO: 452854 - DNA, 25 bp, Homo sapien
aaccagaaaatagtctcatctcttt

SEQ ID NO: 452855 - DNA, 25 bp, Homo sapien
gagatccgtgttttattttagcatt

SEQ ID NO: 452856 - DNA, 25 bp, Homo sapien
gttacactgtgatgactggcctatt

SEQ ID NO: 452857 - DNA, 25 bp, Homo sapien
atgactggcctattacctgactcag

SEQ ID NO: 452858 - DNA, 25 bp, Homo sapien
agctccctctaccttgaaattgaca

SEQ ID NO: 452859 - DNA, 25 bp, Homo sapien
gtggttaatagtgtgtgacgctcaa

SEQ ID NO: 452860 - DNA, 25 bp, Homo sapien
gaaaggttgtgtgtcgttgcttttt

SEQ ID NO: 452861 - DNA, 25 bp, Homo sapien
tgtgttttggttaggcttggttttg

SEQ ID NO: 452862 - DNA, 25 bp, Homo sapien
tgcgtcttcccaagttagcaggtgt

SEQ ID NO: 452863 - DNA, 25 bp, Homo sapien
ggaggacatgtgagtcctggcagaa

SEQ ID NO: 452864 - DNA, 25 bp, Homo sapien
ggacagaaggcccagctcacatgtg

SEQ ID NO: 452865 - DNA, 25 bp, Homo sapien
agaaggcccagctcacatgtgagtc

SEQ ID NO: 452866 - DNA, 25 bp, Homo sapien
gctcacatgtgagtcctggcagaag

SEQ ID NO: 452867 - DNA, 25 bp, Homo sapien
agtcctggcagaagccatggcccat

SEQ ID NO: 452868 - DNA, 25 bp, Homo sapien
ctggcagaagccatggcccatgtct

SEQ ID NO: 452869 - DNA, 25 bp, Homo sapien
gaagccatggcccatgtctgcacat

SEQ ID NO: 452870 - DNA, 25 bp, Homo sapien
atggcccatgtctgcacatccaggg

SEQ ID NO: 452871 - DNA, 25 bp, Homo sapien
ccatgtctgcacatccagggaggag

SEQ ID NO: 452872 - DNA, 25 bp, Homo sapien
aggaggacagaaggcccagctcaca

SEQ ID NO: 452873 - DNA, 25 bp, Homo sapien
gcttctaccagctgactgccccggc

SEQ ID NO: 452874 - DNA, 25 bp, Homo sapien
gtctccctcttctaccgcaatgact

SEQ ID NO: 452875 - DNA, 25 bp, Homo sapien
tgccatggcccctatgaggctgcca

SEQ ID NO: 452876 - DNA, 25 bp, Homo sapien
gccatggcccctatgaggctgccat

SEQ ID NO: 452877 - DNA, 25 bp, Homo sapien
atggcccctatgaggctgccatccc

SEQ ID NO: 452878 - DNA, 25 bp, Homo sapien
ccctgctggccggagctgtagctgt

SEQ ID NO: 452879 - DNA, 25 bp, Homo sapien
ggccggagctgtagctgtgctggtg

SEQ ID NO: 452880 - DNA, 25 bp, Homo sapien
tcttctaccgcaatgactccgccca

SEQ ID NO: 452881 - DNA, 25 bp, Homo sapien
gggccccgtgtgagccagaaaccag

SEQ ID NO: 452882 - DNA, 25 bp, Homo sapien
ggccccgtgtgagccagaaaccagg

SEQ ID NO: 452883 - DNA, 25 bp, Homo sapien
ctgtccactaggccgcttctaccag

SEQ ID NO: 452884 - DNA, 25 bp, Homo sapien
agtgctttcttacaccaaaatacat

SEQ ID NO: 452885 - DNA, 25 bp, Homo sapien
gtgctttcttacaccaaaatacatg

SEQ ID NO: 452886 - DNA, 25 bp, Homo sapien
tgctttcttacaccaaaatacatgt

SEQ ID NO: 452887 - DNA, 25 bp, Homo sapien
gctttcttacaccaaaatacatgta

SEQ ID NO: 452888 - DNA, 25 bp, Homo sapien
ctttcttacaccaaaatacatgtat

SEQ ID NO: 452889 - DNA, 25 bp, Homo sapien
tttcttacaccaaaatacatgtata

SEQ ID NO: 452890 - DNA, 25 bp, Homo sapien
ttcttacaccaaaatacatgtatac

SEQ ID NO: 452891 - DNA, 25 bp, Homo sapien
tcttacaccaaaatacatgtataca

SEQ ID NO: 452892 - DNA, 25 bp, Homo sapien
cttacaccaaaatacatgtatacaa

SEQ ID NO: 452893 - DNA, 25 bp, Homo sapien
tacaccaaaatacatgtatacaaag

SEQ ID NO: 452894 - DNA, 25 bp, Homo sapien
tatacaaagatttaaaacactttcg

SEQ ID NO: 452895 - DNA, 25 bp, Homo sapien
gatgacatccagtgagatgccctct

SEQ ID NO: 452896 - DNA, 25 bp, Homo sapien
catccagtgagatgccctctggctg

SEQ ID NO: 452897 - DNA, 25 bp, Homo sapien
gggccaagcccttggtacagagccg

SEQ ID NO: 452898 - DNA, 25 bp, Homo sapien
aagcccttggtacagagccgcagtg

SEQ ID NO: 452899 - DNA, 25 bp, Homo sapien
ccttggtacagagccgcagtgtgag

SEQ ID NO: 452900 - DNA, 25 bp, Homo sapien
gtacagagccgcagtgtgagcctgc

SEQ ID NO: 452901 - DNA, 25 bp, Homo sapien
tgtgagcctgcgcaggacagtttca

SEQ ID NO: 452902 - DNA, 25 bp, Homo sapien
tgcgcaggacagtttcaggtggttt

SEQ ID NO: 452903 - DNA, 25 bp, Homo sapien
gcaggacagtttcaggtggttttaa

SEQ ID NO: 452904 - DNA, 25 bp, Homo sapien
ttaaagaacacgtggaaatcccttg

SEQ ID NO: 452905 - DNA, 25 bp, Homo sapien
agaacacgtggaaatcccttgaatt

SEQ ID NO: 452906 - DNA, 25 bp, Homo sapien
acagagcttcatttcctgtcttaaa

SEQ ID NO: 452907 - DNA, 25 bp, Homo sapien
gtcttaaaatctcgttttctcttct

SEQ ID NO: 452908 - DNA, 25 bp, Homo sapien
tttaaatttcatatcctcactccct

SEQ ID NO: 452909 - DNA, 25 bp, Homo sapien
tatccaatttccttcttatcgtgca

SEQ ID NO: 452910 - DNA, 25 bp, Homo sapien
cttcttatcgtgcattcatactctg

SEQ ID NO: 452911 - DNA, 25 bp, Homo sapien
gtgcattcatactctgtaagcccat

SEQ ID NO: 452912 - DNA, 25 bp, Homo sapien
tgtaagcccatctgtaacacaccta

SEQ ID NO: 452913 - DNA, 25 bp, Homo sapien
gtaacacacctagatcaaggcttta

SEQ ID NO: 452914 - DNA, 25 bp, Homo sapien
gactcactgtgatgcctctatgaaa

SEQ ID NO: 452915 - DNA, 25 bp, Homo sapien
gcattcctagagaaagattgttcca

SEQ ID NO: 452916 - DNA, 25 bp, Homo sapien
tcaagtttgtatactgcacatgact

SEQ ID NO: 452917 - DNA, 25 bp, Homo sapien
gtttactctgagattctgtagtcct

SEQ ID NO: 452918 - DNA, 25 bp, Homo sapien
gattctgtagtcctaatattgtatc

SEQ ID NO: 452919 - DNA, 25 bp, Homo sapien
atattgtatcattgtgctgtctgca

SEQ ID NO: 452920 - DNA, 25 bp, Homo sapien
gtgctgtctgcaaaacaacttgaat

SEQ ID NO: 452921 - DNA, 25 bp, Homo sapien
ttgttacatgtaacgcagctgtact

SEQ ID NO: 452922 - DNA, 25 bp, Homo sapien
gtaacgcagctgtactttatgttct

SEQ ID NO: 452923 - DNA, 25 bp, Homo sapien
atgttctttgcaactgtttccatta

SEQ ID NO: 452924 - DNA, 25 bp, Homo sapien
gtttccattatgagaacgctgtgct

SEQ ID NO: 452925 - DNA, 25 bp, Homo sapien
acgctgtgctatttacaaggttaca

SEQ ID NO: 452926 - DNA, 25 bp, Homo sapien
aggttacatttttcttggccaggcg

SEQ ID NO: 452927 - DNA, 25 bp, Homo sapien
ttacatttttcttggccaggcgagg

SEQ ID NO: 452928 - DNA, 25 bp, Homo sapien
tatgatagatatataaggaccctcc

SEQ ID NO: 452929 - DNA, 25 bp, Homo sapien
acccattgcctgtccctagagtaaa

SEQ ID NO: 452930 - DNA, 25 bp, Homo sapien
gcctgtccctagagtaaaggtcgtt

SEQ ID NO: 452931 - DNA, 25 bp, Homo sapien
ctagagtaaaggtcgttcggagcct

SEQ ID NO: 452932 - DNA, 25 bp, Homo sapien
gtgtgaagggcattttcactaaggg

SEQ ID NO: 452933 - DNA, 25 bp, Homo sapien
cactaaggggtaggttcctcctgtg

SEQ ID NO: 452934 - DNA, 25 bp, Homo sapien
tcctcctgtgggtggttttatttga

SEQ ID NO: 452935 - DNA, 25 bp, Homo sapien
ttttatttgagcgtaggttccctca

SEQ ID NO: 452936 - DNA, 25 bp, Homo sapien
tgagcgtaggttccctcaaagaaag

SEQ ID NO: 452937 - DNA, 25 bp, Homo sapien
cctcaaagaaagaagtgcgttatgt

SEQ ID NO: 452938 - DNA, 25 bp, Homo sapien
agaagtgcgttatgtatgttatata

SEQ ID NO: 452939 - DNA, 25 bp, Homo sapien
gtttacacacatactcttccaagag

SEQ ID NO: 452940 - DNA, 25 bp, Homo sapien
ctcttccaagagttagagtggctaa

SEQ ID NO: 452941 - DNA, 25 bp, Homo sapien
tttccttttcctagataaactacat

SEQ ID NO: 452942 - DNA, 25 bp, Homo sapien
gataaactacatcttaagactacca

SEQ ID NO: 452943 - DNA, 25 bp, Homo sapien
acatcttaagactaccaaattgtaa

SEQ ID NO: 452944 - DNA, 25 bp, Homo sapien
atgatcttgagaattcacatcactc

SEQ ID NO: 452945 - DNA, 25 bp, Homo sapien
gagaattcacatcactcatttaggc

SEQ ID NO: 452946 - DNA, 25 bp, Homo sapien
attttactcttttgattttgctctc

SEQ ID NO: 452947 - DNA, 25 bp, Homo sapien
ttgctctcacagtcatcaaaactct

SEQ ID NO: 452948 - DNA, 25 bp, Homo sapien
gtcatcaaaactctgtcattaagtc

SEQ ID NO: 452949 - DNA, 25 bp, Homo sapien
ctctgtcattaagtcaatattggga

SEQ ID NO: 452950 - DNA, 25 bp, Homo sapien
gggaaaggttctgctgaagttgaat

SEQ ID NO: 452951 - DNA, 25 bp, Homo sapien
gactgttctttcatcacaaacttga

SEQ ID NO: 452952 - DNA, 25 bp, Homo sapien
gagtttcctggacatttgtttgcag

SEQ ID NO: 452953 - DNA, 25 bp, Homo sapien
tgccttaacctcgtgggtttattat

SEQ ID NO: 452954 - DNA, 25 bp, Homo sapien
gggcgttaggaagctccaacaggat

SEQ ID NO: 452955 - DNA, 25 bp, Homo sapien
tgggtttattattacctcataggga

SEQ ID NO: 452956 - DNA, 25 bp, Homo sapien
tagggactttgcctcctgacagcag

SEQ ID NO: 452957 - DNA, 25 bp, Homo sapien
tcctgacagcagtttatgggtgttc

SEQ ID NO: 452958 - DNA, 25 bp, Homo sapien
agtttatgggtgttcattgtggcac

SEQ ID NO: 452959 - DNA, 25 bp, Homo sapien
ttgtggcacttgagttttcttgcat

SEQ ID NO: 452960 - DNA, 25 bp, Homo sapien
gaagctccaacaggatggtacttaa

SEQ ID NO: 452961 - DNA, 25 bp, Homo sapien
gaaagatctggaaactatttgggtt

SEQ ID NO: 452962 - DNA, 25 bp, Homo sapien
ttcatttggatgtttggcgttgcac

SEQ ID NO: 452963 - DNA, 25 bp, Homo sapien
gatgtttggcgttgcacacacacat

SEQ ID NO: 452964 - DNA, 25 bp, Homo sapien
acacacacatccaccggtggaagag

SEQ ID NO: 452965 - DNA, 25 bp, Homo sapien
agagacgcccggtgaaaacacctgt

SEQ ID NO: 452966 - DNA, 25 bp, Homo sapien
cggtgaaaacacctgtctgctttct

SEQ ID NO: 452967 - DNA, 25 bp, Homo sapien
tgctttctaagccagtgaggttgag

SEQ ID NO: 452968 - DNA, 25 bp, Homo sapien
ttgccagagtttgtctacctctggg

SEQ ID NO: 452969 - DNA, 25 bp, Homo sapien
tacctctgggtatccctttgtctgg

SEQ ID NO: 452970 - DNA, 25 bp, Homo sapien
gggatggaatggatgcaccgcaaat

SEQ ID NO: 452971 - DNA, 25 bp, Homo sapien
atgcattttctgagttttcttgtta

SEQ ID NO: 452972 - DNA, 25 bp, Homo sapien
atgtctcagacagagatagtatctt

SEQ ID NO: 452973 - DNA, 25 bp, Homo sapien
tctggttaaagcacaagaagttctt

SEQ ID NO: 452974 - DNA, 25 bp, Homo sapien
agttctttcattggttcagcttgga

SEQ ID NO: 452975 - DNA, 25 bp, Homo sapien
gttcagcttggattattcctggtcc

SEQ ID NO: 452976 - DNA, 25 bp, Homo sapien
gattattcctggtccaatcagtggg

SEQ ID NO: 452977 - DNA, 25 bp, Homo sapien
gggtgtgaatggtgtacccacctcc

SEQ ID NO: 452978 - DNA, 25 bp, Homo sapien
atggtgtacccacctccctaatggg

SEQ ID NO: 452979 - DNA, 25 bp, Homo sapien
tatagggtggttaaccatcccttat

SEQ ID NO: 452980 - DNA, 25 bp, Homo sapien
gtggttaaccatcccttatcaccat

SEQ ID NO: 452981 - DNA, 25 bp, Homo sapien
cttatcaccatccataccctatgga

SEQ ID NO: 452982 - DNA, 25 bp, Homo sapien
accctatggatagattttctgataa

SEQ ID NO: 452983 - DNA, 25 bp, Homo sapien
taagaggtaaacgagcctagcctac

SEQ ID NO: 452984 - DNA, 25 bp, Homo sapien
ggtaaacgagcctagcctacagcct

SEQ ID NO: 452985 - DNA, 25 bp, Homo sapien
aacatcccagtttatacttagcaag

SEQ ID NO: 452986 - DNA, 25 bp, Homo sapien
ggcctcacacaaggagtgtttggct

SEQ ID NO: 452987 - DNA, 25 bp, Homo sapien
tttggcttacagtgaattgtccggg

SEQ ID NO: 452988 - DNA, 25 bp, Homo sapien
tcatctccgtattcttcagcttcat

SEQ ID NO: 452989 - DNA, 25 bp, Homo sapien
gtattcttcagcttcatccaaaact

SEQ ID NO: 452990 - DNA, 25 bp, Homo sapien
atacttagcaaggattaggtgacat

SEQ ID NO: 452991 - DNA, 25 bp, Homo sapien
ggtgacatgaagacgatcctggctt

SEQ ID NO: 452992 - DNA, 25 bp, Homo sapien
acatgaagacgatcctggcttgatg

SEQ ID NO: 452993 - DNA, 25 bp, Homo sapien
gcttgatgggtcatgaggctctgaa

SEQ ID NO: 452994 - DNA, 25 bp, Homo sapien
cttcatttctaaggcagccaggcag

SEQ ID NO: 452995 - DNA, 25 bp, Homo sapien
ctagggtggcaggagtctttggatt

SEQ ID NO: 452996 - DNA, 25 bp, Homo sapien
tctttggattgggtagctctggctg

SEQ ID NO: 452997 - DNA, 25 bp, Homo sapien
ggattgggtagctctggctgcaaac

SEQ ID NO: 452998 - DNA, 25 bp, Homo sapien
aacagcatgtatttactccagtttg

SEQ ID NO: 452999 - DNA, 25 bp, Homo sapien
gtatttactccagtttgatgttaaa

SEQ ID NO: 453000 - DNA, 25 bp, Homo sapien
attatggggcactaggcttagtacc

SEQ ID NO: 453001 - DNA, 25 bp, Homo sapien
gtgatgaaagaatttgtacaacccc

SEQ ID NO: 453002 - DNA, 25 bp, Homo sapien
gtacaacccccatgacataagttta

SEQ ID NO: 453003 - DNA, 25 bp, Homo sapien
aacacatgtaccctataacctgcac

SEQ ID NO: 453004 - DNA, 25 bp, Homo sapien
acatgtaccctataacctgcacgtg

SEQ ID NO: 453005 - DNA, 25 bp, Homo sapien
ctggagatgcccgtgctgaagagca

SEQ ID NO: 453006 - DNA, 25 bp, Homo sapien
gccgggagccactttgatgctgcga

SEQ ID NO: 453007 - DNA, 25 bp, Homo sapien
gagccactttgatgctgcgaaggcc

SEQ ID NO: 453008 - DNA, 25 bp, Homo sapien
cactttgatgctgcgaaggccgtgg

SEQ ID NO: 453009 - DNA, 25 bp, Homo sapien
gcgaaggccgtggaggaacagctga

SEQ ID NO: 453010 - DNA, 25 bp, Homo sapien
tgagaaagtcgttccagatccgctg

SEQ ID NO: 453011 - DNA, 25 bp, Homo sapien
gaaagtcgttccagatccgctgcgg

SEQ ID NO: 453012 - DNA, 25 bp, Homo sapien
tccaagcggctcttccgggacctgg

SEQ ID NO: 453013 - DNA, 25 bp, Homo sapien
cttccgggacctggtgagcctgcag

SEQ ID NO: 453014 - DNA, 25 bp, Homo sapien
ggaacaggttctgaatgccgcgctc

SEQ ID NO: 453015 - DNA, 25 bp, Homo sapien
caggttctgaatgccgcgctcaggg

SEQ ID NO: 453016 - DNA, 25 bp, Homo sapien
gtggctagcttttctgtaacatcct

SEQ ID NO: 453017 - DNA, 25 bp, Homo sapien
gaaaagtctacagaacaggatcact

SEQ ID NO: 453018 - DNA, 25 bp, Homo sapien
ggatcactgaatgccactttagccc

SEQ ID NO: 453019 - DNA, 25 bp, Homo sapien
gcaggctctgttttaattagcgtca

SEQ ID NO: 453020 - DNA, 25 bp, Homo sapien
ttaattagcgtcaaacaggttactg

SEQ ID NO: 453021 - DNA, 25 bp, Homo sapien
actgaacatttcttcagctgcggaa

SEQ ID NO: 453022 - DNA, 25 bp, Homo sapien
tctgaatgggtgacagctgcccgga

SEQ ID NO: 453023 - DNA, 25 bp, Homo sapien
agtggctctacctggttccatttta

SEQ ID NO: 453024 - DNA, 25 bp, Homo sapien
cagtcagtgtggtttcttgccaaac

SEQ ID NO: 453025 - DNA, 25 bp, Homo sapien
ttcttgccaaacaacacctaacgtt

SEQ ID NO: 453026 - DNA, 25 bp, Homo sapien
ttttaccccttattcctgcagggag

SEQ ID NO: 453027 - DNA, 25 bp, Homo sapien
gcaatacttgagtgcctttcttatt

SEQ ID NO: 453028 - DNA, 25 bp, Homo sapien
acaagacctgtcagttgttttataa

SEQ ID NO: 453029 - DNA, 25 bp, Homo sapien
aaatgcttttgaacttgatccctag

SEQ ID NO: 453030 - DNA, 25 bp, Homo sapien
aacttgatccctagttgagctcctt

SEQ ID NO: 453031 - DNA, 25 bp, Homo sapien
gagtctgatacaaattaccctttat

SEQ ID NO: 453032 - DNA, 25 bp, Homo sapien
gagtatttgctcattagtcctgtga

SEQ ID NO: 453033 - DNA, 25 bp, Homo sapien
tgctcattagtcctgtgaactctac

SEQ ID NO: 453034 - DNA, 25 bp, Homo sapien
gaactctacattcagactcattgct

SEQ ID NO: 453035 - DNA, 25 bp, Homo sapien
gactcattgcttcctccagatagag

SEQ ID NO: 453036 - DNA, 25 bp, Homo sapien
gaggagcttgtaccataatattctg

SEQ ID NO: 453037 - DNA, 25 bp, Homo sapien
aatattctgtgtccatttatgttag

SEQ ID NO: 453038 - DNA, 25 bp, Homo sapien
acatccatgcgggcccggtatggtg

SEQ ID NO: 453039 - DNA, 25 bp, Homo sapien
ggaatgtggaagatcccgttagatg

SEQ ID NO: 453040 - DNA, 25 bp, Homo sapien
aatgtggaagatcccgttagatgga

SEQ ID NO: 453041 - DNA, 25 bp, Homo sapien
gaagatcccgttagatggatgcaat

SEQ ID NO: 453042 - DNA, 25 bp, Homo sapien
cccgttagatggatgcaatggagct

SEQ ID NO: 453043 - DNA, 25 bp, Homo sapien
tagatggatgcaatggagctggtta

SEQ ID NO: 453044 - DNA, 25 bp, Homo sapien
gtctgtgttaatggacttcatcctc

SEQ ID NO: 453045 - DNA, 25 bp, Homo sapien
ctgtgttaatggacttcatcctcca

SEQ ID NO: 453046 - DNA, 25 bp, Homo sapien
tgaaagaatttaacgtgcactacat

SEQ ID NO: 453047 - DNA, 25 bp, Homo sapien
gaatttaacgtgcactacatttggt

SEQ ID NO: 453048 - DNA, 25 bp, Homo sapien
aatttaacgtgcactacatttggtg

SEQ ID NO: 453049 - DNA, 25 bp, Homo sapien
agcaggtcctgcttctgctttccca

SEQ ID NO: 453050 - DNA, 25 bp, Homo sapien
tttcccaccggcagagcgtagtcgt

SEQ ID NO: 453051 - DNA, 25 bp, Homo sapien
accggcagagcgtagtcgtggtcac

SEQ ID NO: 453052 - DNA, 25 bp, Homo sapien
gtagtcgtggtcaccggcgggcgag

SEQ ID NO: 453053 - DNA, 25 bp, Homo sapien
agcgaggtggtcagccgcagtccca

SEQ ID NO: 453054 - DNA, 25 bp, Homo sapien
ggctcagcaagcgagccagtccagt

SEQ ID NO: 453055 - DNA, 25 bp, Homo sapien
gccagtccagtctcgttggctaaga

SEQ ID NO: 453056 - DNA, 25 bp, Homo sapien
cgttggctaagactgcccgtaggta

SEQ ID NO: 453057 - DNA, 25 bp, Homo sapien
aagactgcccgtaggtagcgactct

SEQ ID NO: 453058 - DNA, 25 bp, Homo sapien
taggtagcgactctcctcctgcagt

SEQ ID NO: 453059 - DNA, 25 bp, Homo sapien
tgcagtgcctgtacgcgtttgccca

SEQ ID NO: 453060 - DNA, 25 bp, Homo sapien
tttaaactggatctattacctttga

SEQ ID NO: 453061 - DNA, 25 bp, Homo sapien
tacactgaaaaattctgacatcttc

SEQ ID NO: 453062 - DNA, 25 bp, Homo sapien
ctgacatcttcaggaaaccaatatg

SEQ ID NO: 453063 - DNA, 25 bp, Homo sapien
tatgatggataagctaaatgttgac

SEQ ID NO: 453064 - DNA, 25 bp, Homo sapien
tattatttcactgcttaagttcagc

SEQ ID NO: 453065 - DNA, 25 bp, Homo sapien
cactgcttaagttcagcatctgaat

SEQ ID NO: 453066 - DNA, 25 bp, Homo sapien
tcagcatctgaataacaaaggtaac

SEQ ID NO: 453067 - DNA, 25 bp, Homo sapien
agtacttaagatcccaaaggcccat

SEQ ID NO: 453068 - DNA, 25 bp, Homo sapien
ttaagatcccaaaggcccattacat

SEQ ID NO: 453069 - DNA, 25 bp, Homo sapien
atcccaaaggcccattacattctat

SEQ ID NO: 453070 - DNA, 25 bp, Homo sapien
cccatccctcttaatgtagaccctg

SEQ ID NO: 453071 - DNA, 25 bp, Homo sapien
attatattttagtcccaagaagaca

SEQ ID NO: 453072 - DNA, 25 bp, Homo sapien
agacaaagtcgcagattaacaacac

SEQ ID NO: 453073 - DNA, 25 bp, Homo sapien
agtcgcagattaacaacactttaaa

SEQ ID NO: 453074 - DNA, 25 bp, Homo sapien
actcccattttattgtgttagattg

SEQ ID NO: 453075 - DNA, 25 bp, Homo sapien
tgtgttagattgcagtacaatgaat

SEQ ID NO: 453076 - DNA, 25 bp, Homo sapien
agatcttaactttcttgactgattt

SEQ ID NO: 453077 - DNA, 25 bp, Homo sapien
ttaaagccagaaatgttctcctctg

SEQ ID NO: 453078 - DNA, 25 bp, Homo sapien
gaaatgttctcctctgggaaagcaa

SEQ ID NO: 453079 - DNA, 25 bp, Homo sapien
gttctcctctgggaaagcaatttct

SEQ ID NO: 453080 - DNA, 25 bp, Homo sapien
ggaaagcaatttctatctatttatc

SEQ ID NO: 453081 - DNA, 25 bp, Homo sapien
tatctatttatctaccaatccccac

SEQ ID NO: 453082 - DNA, 25 bp, Homo sapien
tggtttaccagtgacaccccatatt

SEQ ID NO: 453083 - DNA, 25 bp, Homo sapien
gacaccccatattcatcacaaaatt

SEQ ID NO: 453084 - DNA, 25 bp, Homo sapien
aagcaagaagtccatagtaatttat

SEQ ID NO: 453085 - DNA, 25 bp, Homo sapien
gtggatttttaatgctcagagtttc

SEQ ID NO: 453086 - DNA, 25 bp, Homo sapien
tgaggtcaaattttatcttttcact

SEQ ID NO: 453087 - DNA, 25 bp, Homo sapien
ttcacttacaagctctatgatctta

SEQ ID NO: 453088 - DNA, 25 bp, Homo sapien
tttcctcaaattaatattggtgttc

SEQ ID NO: 453089 - DNA, 25 bp, Homo sapien
ggtgttcaagactatatctaattcc

SEQ ID NO: 453090 - DNA, 25 bp, Homo sapien
gactatatctaattcctctgatcac

SEQ ID NO: 453091 - DNA, 25 bp, Homo sapien
aattcctctgatcactttgagaaac

SEQ ID NO: 453092 - DNA, 25 bp, Homo sapien
gtaaggcacttttctatgaatttta

SEQ ID NO: 453093 - DNA, 25 bp, Homo sapien
agtttacaacctgttctgaaactat

SEQ ID NO: 453094 - DNA, 25 bp, Homo sapien
gagaggacagcaaaccttttcagca

SEQ ID NO: 453095 - DNA, 25 bp, Homo sapien
actggttgtaagtgtaccccaatct

SEQ ID NO: 453096 - DNA, 25 bp, Homo sapien
agtgtaccccaatctcagggagtat

SEQ ID NO: 453097 - DNA, 25 bp, Homo sapien
acactcatttgcctgaacttactcg

SEQ ID NO: 453098 - DNA, 25 bp, Homo sapien
gaacttactcgaagggctgcatttc

SEQ ID NO: 453099 - DNA, 25 bp, Homo sapien
aaaccttttcagcacttctctcaga

SEQ ID NO: 453100 - DNA, 25 bp, Homo sapien
aagggctgcatttctctgagtttac

SEQ ID NO: 453101 - DNA, 25 bp, Homo sapien
ttatggtccccatacagtggtattt

SEQ ID NO: 453102 - DNA, 25 bp, Homo sapien
cacagtaagtagctttctgactaca

SEQ ID NO: 453103 - DNA, 25 bp, Homo sapien
agctttctgactacattattttctg

SEQ ID NO: 453104 - DNA, 25 bp, Homo sapien
aaaaagctaattatatgcactgaaa

SEQ ID NO: 453105 - DNA, 25 bp, Homo sapien
tatgcactgaaatggtgggaatttt

SEQ ID NO: 453106 - DNA, 25 bp, Homo sapien
tagtgatgcagtaattgaggagtct

SEQ ID NO: 453107 - DNA, 25 bp, Homo sapien
gtctggagttttgtatttggaccaa

SEQ ID NO: 453108 - DNA, 25 bp, Homo sapien
gatgaggatctttttctgagtgttc

SEQ ID NO: 453109 - DNA, 25 bp, Homo sapien
ttctgagtgttctaaagggcttctt

SEQ ID NO: 453110 - DNA, 25 bp, Homo sapien
gagtgttctaaagggcttcttgagg

SEQ ID NO: 453111 - DNA, 25 bp, Homo sapien
gggagtggtttaaagcacttcatga

SEQ ID NO: 453112 - DNA, 25 bp, Homo sapien
agaaggtaccttgggctgagacagc

SEQ ID NO: 453113 - DNA, 25 bp, Homo sapien
gggctgagacagcattctaggtaca

SEQ ID NO: 453114 - DNA, 25 bp, Homo sapien
gcattctaggtacagatggcactct

SEQ ID NO: 453115 - DNA, 25 bp, Homo sapien
gcaacaagtgggaccgccgctgccg

SEQ ID NO: 453116 - DNA, 25 bp, Homo sapien
ccgcgagcacagcagggtgcagcgt

SEQ ID NO: 453117 - DNA, 25 bp, Homo sapien
gtgcagcgtggtggcagaactggct

SEQ ID NO: 453118 - DNA, 25 bp, Homo sapien
agaactggctggtttctctttgccc

SEQ ID NO: 453119 - DNA, 25 bp, Homo sapien
atgtccactccgagacccacaactt

SEQ ID NO: 453120 - DNA, 25 bp, Homo sapien
tcaccaaaagaccatacccgactcc

SEQ ID NO: 453121 - DNA, 25 bp, Homo sapien
tgagtgggatccagcactcggcccc

SEQ ID NO: 453122 - DNA, 25 bp, Homo sapien
gcgcccctttcctccgagaagatca

SEQ ID NO: 453123 - DNA, 25 bp, Homo sapien
ccgactttctttgctggatgaccag

SEQ ID NO: 453124 - DNA, 25 bp, Homo sapien
ctttctttgctggatgaccagtgtt

SEQ ID NO: 453125 - DNA, 25 bp, Homo sapien
tgctggatgaccagtgtttggcaag

SEQ ID NO: 453126 - DNA, 25 bp, Homo sapien
gacatgctcagcagatccaagagat

SEQ ID NO: 453127 - DNA, 25 bp, Homo sapien
acatgctcagcagatccaagagata

SEQ ID NO: 453128 - DNA, 25 bp, Homo sapien
catgctcagcagatccaagagatat

SEQ ID NO: 453129 - DNA, 25 bp, Homo sapien
atgctcagcagatccaagagatata

SEQ ID NO: 453130 - DNA, 25 bp, Homo sapien
tgctcagcagatccaagagatatat

SEQ ID NO: 453131 - DNA, 25 bp, Homo sapien
gctcagcagatccaagagatatatt

SEQ ID NO: 453132 - DNA, 25 bp, Homo sapien
gcagatccaagagatatattggcaa

SEQ ID NO: 453133 - DNA, 25 bp, Homo sapien
gatccaagagatatattggcaactt

SEQ ID NO: 453134 - DNA, 25 bp, Homo sapien
caagagatatattggcaactttttc

SEQ ID NO: 453135 - DNA, 25 bp, Homo sapien
gagatatattggcaactttttctag

SEQ ID NO: 453136 - DNA, 25 bp, Homo sapien
gatatattggcaactttttctagaa

SEQ ID NO: 453137 - DNA, 25 bp, Homo sapien
cagttttaagagcaggttgtattga

SEQ ID NO: 453138 - DNA, 25 bp, Homo sapien
accatcagcatgcacggagcgcata

SEQ ID NO: 453139 - DNA, 25 bp, Homo sapien
cggagcgcataaaacaagccctgct

SEQ ID NO: 453140 - DNA, 25 bp, Homo sapien
aagccctgctcctaatggcagtgaa

SEQ ID NO: 453141 - DNA, 25 bp, Homo sapien
gcagtgaaacctcggatggcctcca

SEQ ID NO: 453142 - DNA, 25 bp, Homo sapien
gatggcctccatcaggtcaatacaa

SEQ ID NO: 453143 - DNA, 25 bp, Homo sapien
ggcctccatcaggtcaatacaactg

SEQ ID NO: 453144 - DNA, 25 bp, Homo sapien
aatacaactgaattgctgggctgac

SEQ ID NO: 453145 - DNA, 25 bp, Homo sapien
attgctgggctgacttaagattgaa

SEQ ID NO: 453146 - DNA, 25 bp, Homo sapien
gactctgaaaatgcatcctttatga

SEQ ID NO: 453147 - DNA, 25 bp, Homo sapien
aaatgcatcctttatgagagggagt

SEQ ID NO: 453148 - DNA, 25 bp, Homo sapien
ctgaagcaggtgaaggtccccataa

SEQ ID NO: 453149 - DNA, 25 bp, Homo sapien
tgaagcaggtgaaggtccccataat

SEQ ID NO: 453150 - DNA, 25 bp, Homo sapien
aagcaggtgaaggtccccataatgg

SEQ ID NO: 453151 - DNA, 25 bp, Homo sapien
caggtgaaggtccccataatggaaa

SEQ ID NO: 453152 - DNA, 25 bp, Homo sapien
aaaaccacatttgtgacgcaaaata

SEQ ID NO: 453153 - DNA, 25 bp, Homo sapien
tttgtgacgcaaaataccaccttgg

SEQ ID NO: 453154 - DNA, 25 bp, Homo sapien
gtgacgcaaaataccaccttggcgc

SEQ ID NO: 453155 - DNA, 25 bp, Homo sapien
gcaaaataccaccttggcgcctaca

SEQ ID NO: 453156 - DNA, 25 bp, Homo sapien
accttggcgcctacacgggagacga

SEQ ID NO: 453157 - DNA, 25 bp, Homo sapien
cttggcgcctacacgggagacgacg

SEQ ID NO: 453158 - DNA, 25 bp, Homo sapien
ctacacgggagacgacgtccgcatc

SEQ ID NO: 453159 - DNA, 25 bp, Homo sapien
tcgagaccgcgctgagcacgttctt

SEQ ID NO: 453160 - DNA, 25 bp, Homo sapien
gcgctgagcacgttcttccaagaaa

SEQ ID NO: 453161 - DNA, 25 bp, Homo sapien
gctgagcacgttcttccaagaaacc

SEQ ID NO: 453162 - DNA, 25 bp, Homo sapien
tgagcacgttcttccaagaaaccaa

SEQ ID NO: 453163 - DNA, 25 bp, Homo sapien
gcacgttcttccaagaaaccaacat

SEQ ID NO: 453164 - DNA, 25 bp, Homo sapien
cagatgatgtgcactcccagcaaca

SEQ ID NO: 453165 - DNA, 25 bp, Homo sapien
agatgatgtgcactcccagcaacac

SEQ ID NO: 453166 - DNA, 25 bp, Homo sapien
gatgatgtgcactcccagcaacacc

SEQ ID NO: 453167 - DNA, 25 bp, Homo sapien
ttccccgatgcgctggccatgttct

SEQ ID NO: 453168 - DNA, 25 bp, Homo sapien
cgatgcgctggccatgttctccaag

SEQ ID NO: 453169 - DNA, 25 bp, Homo sapien
ctccgagggcctgcagagcagcaac

SEQ ID NO: 453170 - DNA, 25 bp, Homo sapien
agcaaaatgctgaaactaccaaacc

SEQ ID NO: 453171 - DNA, 25 bp, Homo sapien
aatgctgaaactaccaaaccagtgg

SEQ ID NO: 453172 - DNA, 25 bp, Homo sapien
gctgaaactaccaaaccagtggatg

SEQ ID NO: 453173 - DNA, 25 bp, Homo sapien
aaaccagtggatgaagaccactaag

SEQ ID NO: 453174 - DNA, 25 bp, Homo sapien
gaccactaagaactttgcacataat

SEQ ID NO: 453175 - DNA, 25 bp, Homo sapien
gaactttgcacataatcatacaatc

SEQ ID NO: 453176 - DNA, 25 bp, Homo sapien
gcacataatcatacaatcttttgaa

SEQ ID NO: 453177 - DNA, 25 bp, Homo sapien
atgtgtttagacaataagatggact

SEQ ID NO: 453178 - DNA, 25 bp, Homo sapien
taagatggactagagttcgacaaaa

SEQ ID NO: 453179 - DNA, 25 bp, Homo sapien
ggactagagttcgacaaaatgattt

SEQ ID NO: 453180 - DNA, 25 bp, Homo sapien
ctagagttcgacaaaatgatttctt

SEQ ID NO: 453181 - DNA, 25 bp, Homo sapien
cctccctcaacaggaggcgcagaaa

SEQ ID NO: 453182 - DNA, 25 bp, Homo sapien
aaccaccccatggacgcagaagtta

SEQ ID NO: 453183 - DNA, 25 bp, Homo sapien
ccaccccatggacgcagaagttact

SEQ ID NO: 453184 - DNA, 25 bp, Homo sapien
accccatggacgcagaagttactaa

SEQ ID NO: 453185 - DNA, 25 bp, Homo sapien
cccatggacgcagaagttactaagg

SEQ ID NO: 453186 - DNA, 25 bp, Homo sapien
ggacgcagaagttactaaggccaag

SEQ ID NO: 453187 - DNA, 25 bp, Homo sapien
cgcagaagttactaaggccaagctt

SEQ ID NO: 453188 - DNA, 25 bp, Homo sapien
agaagttactaaggccaagcttctg

SEQ ID NO: 453189 - DNA, 25 bp, Homo sapien
aggtgggctgtctgcttcggctgga

SEQ ID NO: 453190 - DNA, 25 bp, Homo sapien
caatgcccaggcccagatgtaccgg

SEQ ID NO: 453191 - DNA, 25 bp, Homo sapien
accggctgaccctgcgcaccagcaa

SEQ ID NO: 453192 - DNA, 25 bp, Homo sapien
ggtatatgggacaggttgctcatca

SEQ ID NO: 453193 - DNA, 25 bp, Homo sapien
ttgctcatcaactcccaacctaagt

SEQ ID NO: 453194 - DNA, 25 bp, Homo sapien
taagtccagaaagacctccactctt

SEQ ID NO: 453195 - DNA, 25 bp, Homo sapien
cctccactcttcaaacagttcggat

SEQ ID NO: 453196 - DNA, 25 bp, Homo sapien
cagttcggatagagaggagtccctt

SEQ ID NO: 453197 - DNA, 25 bp, Homo sapien
ggagtcccttattggaccaggtaca

SEQ ID NO: 453198 - DNA, 25 bp, Homo sapien
aggtacagacatttctcccacagat

SEQ ID NO: 453199 - DNA, 25 bp, Homo sapien
tctcccacagatggcacgggcaaat

SEQ ID NO: 453200 - DNA, 25 bp, Homo sapien
gaaaagaaatggcagctgcaccacc

SEQ ID NO: 453201 - DNA, 25 bp, Homo sapien
aggctagcccgagttgttcgtcgcc

SEQ ID NO: 453202 - DNA, 25 bp, Homo sapien
aggagtcccagtgtccaaggagctg

SEQ ID NO: 453203 - DNA, 25 bp, Homo sapien
aagttacactgccagcagttcccca

SEQ ID NO: 453204 - DNA, 25 bp, Homo sapien
ggcacatggttctagcctggacctg

SEQ ID NO: 453205 - DNA, 25 bp, Homo sapien
agaatgagttgcctccaccctgtcc

SEQ ID NO: 453206 - DNA, 25 bp, Homo sapien
tgtcccaacagctgacagccaggag

SEQ ID NO: 453207 - DNA, 25 bp, Homo sapien
tgcaggcctttgtggtccatcttgt

SEQ ID NO: 453208 - DNA, 25 bp, Homo sapien
gtctgggccaccctagtgtgctaag

SEQ ID NO: 453209 - DNA, 25 bp, Homo sapien
gccaccctagtgtgctaagctgagc

SEQ ID NO: 453210 - DNA, 25 bp, Homo sapien
taagctgagcagtgcagtgtgaaca

SEQ ID NO: 453211 - DNA, 25 bp, Homo sapien
gtgaacagggcccatggtgtattct

SEQ ID NO: 453212 - DNA, 25 bp, Homo sapien
atggtgtattctaggccacagccca

SEQ ID NO: 453213 - DNA, 25 bp, Homo sapien
tctgggctgctctcaaaccatgtcc

SEQ ID NO: 453214 - DNA, 25 bp, Homo sapien
cccaagaccacgcttagcggtggct

SEQ ID NO: 453215 - DNA, 25 bp, Homo sapien
ccaagaccacgcttagcggtggctt

SEQ ID NO: 453216 - DNA, 25 bp, Homo sapien
caagaccacgcttagcggtggcttc

SEQ ID NO: 453217 - DNA, 25 bp, Homo sapien
aagaccacgcttagcggtggcttct

SEQ ID NO: 453218 - DNA, 25 bp, Homo sapien
agaccacgcttagcggtggcttctt

SEQ ID NO: 453219 - DNA, 25 bp, Homo sapien
gaccacgcttagcggtggcttcttc

SEQ ID NO: 453220 - DNA, 25 bp, Homo sapien
accacgcttagcggtggcttcttcg

SEQ ID NO: 453221 - DNA, 25 bp, Homo sapien
ccacgcttagcggtggcttcttcgt

SEQ ID NO: 453222 - DNA, 25 bp, Homo sapien
cacgcttagcggtggcttcttcgtt

SEQ ID NO: 453223 - DNA, 25 bp, Homo sapien
acgcttagcggtggcttcttcgttg

SEQ ID NO: 453224 - DNA, 25 bp, Homo sapien
tgcccagaggaggtcctacacatta

SEQ ID NO: 453225 - DNA, 25 bp, Homo sapien
gaggaggtcctacacattaaaggat

SEQ ID NO: 453226 - DNA, 25 bp, Homo sapien
ttaaaggataaagccccccagtgat

SEQ ID NO: 453227 - DNA, 25 bp, Homo sapien
gagttcttaaatcttcatttggttt

SEQ ID NO: 453228 - DNA, 25 bp, Homo sapien
ttttctgttcaggattttaattgca

SEQ ID NO: 453229 - DNA, 25 bp, Homo sapien
ttcccaatagtttcctctgcattta

SEQ ID NO: 453230 - DNA, 25 bp, Homo sapien
gtttcctctgcatttatatactctg

SEQ ID NO: 453231 - DNA, 25 bp, Homo sapien
ctctgcatttatatactctgtagtg

SEQ ID NO: 453232 - DNA, 25 bp, Homo sapien
actctgtagtgtttaggcaaccctg

SEQ ID NO: 453233 - DNA, 25 bp, Homo sapien
taggcaaccctgttataagtttatt

SEQ ID NO: 453234 - DNA, 25 bp, Homo sapien
gtaaatatactcagagcttttttcc

SEQ ID NO: 453235 - DNA, 25 bp, Homo sapien
ttatttgccaaagaagattcatgaa

SEQ ID NO: 453236 - DNA, 25 bp, Homo sapien
gattcatgaaaaatttacgtccaat

SEQ ID NO: 453237 - DNA, 25 bp, Homo sapien
gcaaatagttaatttcatttggctt

SEQ ID NO: 453238 - DNA, 25 bp, Homo sapien
ttggctttttaccatgttccttcct

SEQ ID NO: 453239 - DNA, 25 bp, Homo sapien
taatttaaaccctggcaaacattct

SEQ ID NO: 453240 - DNA, 25 bp, Homo sapien
taaaccctggcaaacattctttaga

SEQ ID NO: 453241 - DNA, 25 bp, Homo sapien
atattgatacaatttcacctctaaa

SEQ ID NO: 453242 - DNA, 25 bp, Homo sapien
ttgatacaatttcacctctaaaatg

SEQ ID NO: 453243 - DNA, 25 bp, Homo sapien
atggatttgaagaaatgcaacttta

SEQ ID NO: 453244 - DNA, 25 bp, Homo sapien
gaagaaatgcaactttatatcaaaa

SEQ ID NO: 453245 - DNA, 25 bp, Homo sapien
atgtcatctgatttcctttgtttct

SEQ ID NO: 453246 - DNA, 25 bp, Homo sapien
tcctttcttggtctgccagctttgt

SEQ ID NO: 453247 - DNA, 25 bp, Homo sapien
agctttgtcctttctgagtgattct

SEQ ID NO: 453248 - DNA, 25 bp, Homo sapien
gtgattctctttctgtattgagagg

SEQ ID NO: 453249 - DNA, 25 bp, Homo sapien
aagtgtgggtctacatagggatgtt

SEQ ID NO: 453250 - DNA, 25 bp, Homo sapien
tagggatgtttggatgctatggcaa

SEQ ID NO: 453251 - DNA, 25 bp, Homo sapien
ggagtgtagtccatttgcaatagaa

SEQ ID NO: 453252 - DNA, 25 bp, Homo sapien
aaatccgtcaccaaattgtaacctg

SEQ ID NO: 453253 - DNA, 25 bp, Homo sapien
gtaacctggatgttatagcccagca

SEQ ID NO: 453254 - DNA, 25 bp, Homo sapien
tgtattagcacaatatcttgccatt

SEQ ID NO: 453255 - DNA, 25 bp, Homo sapien
tcttgccattgtcccatctaggaaa

SEQ ID NO: 453256 - DNA, 25 bp, Homo sapien
aagtgaggaggaaagccatgccgaa

SEQ ID NO: 453257 - DNA, 25 bp, Homo sapien
ggccaaactgatcccttaataagtc

SEQ ID NO: 453258 - DNA, 25 bp, Homo sapien
aactgatcccttaataagtccaata

SEQ ID NO: 453259 - DNA, 25 bp, Homo sapien
aagtccaataggtctttcttctggg

SEQ ID NO: 453260 - DNA, 25 bp, Homo sapien
tgaactggcatacatagatctctaa

SEQ ID NO: 453261 - DNA, 25 bp, Homo sapien
gataatattcaacactattcaactg

SEQ ID NO: 453262 - DNA, 25 bp, Homo sapien
tcaacactattcaactgtatataag

SEQ ID NO: 453263 - DNA, 25 bp, Homo sapien
aaacagagaatatgctcttttcagt

SEQ ID NO: 453264 - DNA, 25 bp, Homo sapien
atatgctcttttcagtgtccatgat

SEQ ID NO: 453265 - DNA, 25 bp, Homo sapien
tatgctcttttcagtgtccatgata

SEQ ID NO: 453266 - DNA, 25 bp, Homo sapien
taaaaactggccaaactgatccctt

SEQ ID NO: 453267 - DNA, 25 bp, Homo sapien
actggccaaactgatcccttaataa

SEQ ID NO: 453268 - DNA, 25 bp, Homo sapien
aagggatatctgtaggcacctactt

SEQ ID NO: 453269 - DNA, 25 bp, Homo sapien
tattctggtccccagtcagctgcac

SEQ ID NO: 453270 - DNA, 25 bp, Homo sapien
ggcaattgcccaaaagccaggccat

SEQ ID NO: 453271 - DNA, 25 bp, Homo sapien
taggcacctacttcacagggtccat

SEQ ID NO: 453272 - DNA, 25 bp, Homo sapien
aagagccacgtgcttcacctaggcc

SEQ ID NO: 453273 - DNA, 25 bp, Homo sapien
gtgcttcacctaggcccaagtggtt

SEQ ID NO: 453274 - DNA, 25 bp, Homo sapien
ttcacagggtccatgctgaaagact

SEQ ID NO: 453275 - DNA, 25 bp, Homo sapien
gctgaaagactgcaaccaatacaca

SEQ ID NO: 453276 - DNA, 25 bp, Homo sapien
tgcaaccaatacacagcgcttatct

SEQ ID NO: 453277 - DNA, 25 bp, Homo sapien
gggcatacactggaccgatatagtt

SEQ ID NO: 453278 - DNA, 25 bp, Homo sapien
ggaccgatatagtttcacaatcaaa

SEQ ID NO: 453279 - DNA, 25 bp, Homo sapien
aaaaagccaagcctctgtcactttt

SEQ ID NO: 453280 - DNA, 25 bp, Homo sapien
cctagactcctaggcacagctatgg

SEQ ID NO: 453281 - DNA, 25 bp, Homo sapien
cctaggcacagctatggagtctttg

SEQ ID NO: 453282 - DNA, 25 bp, Homo sapien
tggagtctttgcacagtgcccatac

SEQ ID NO: 453283 - DNA, 25 bp, Homo sapien
tgaaaaccaaacctcaagaacctag

SEQ ID NO: 453284 - DNA, 25 bp, Homo sapien
tcaccttagtttggtttgtcctaat

SEQ ID NO: 453285 - DNA, 25 bp, Homo sapien
agagcagctctctacttgccaccat

SEQ ID NO: 453286 - DNA, 25 bp, Homo sapien
catggactccagtggtcagcataag

SEQ ID NO: 453287 - DNA, 25 bp, Homo sapien
aagcagatagttgcattctatttag

SEQ ID NO: 453288 - DNA, 25 bp, Homo sapien
ttggtttgtcctaatgccctcatta

SEQ ID NO: 453289 - DNA, 25 bp, Homo sapien
ggacttgaaaatgacttggctgaac

SEQ ID NO: 453290 - DNA, 25 bp, Homo sapien
tacaaagttggcatacagggtcaat

SEQ ID NO: 453291 - DNA, 25 bp, Homo sapien
aagttggcatacagggtcaatatct

SEQ ID NO: 453292 - DNA, 25 bp, Homo sapien
gggtcaatatctaatttactgttgt

SEQ ID NO: 453293 - DNA, 25 bp, Homo sapien
tatctaatttactgttgtgtttttc

SEQ ID NO: 453294 - DNA, 25 bp, Homo sapien
tgtatggtcatactttttaaatttg

SEQ ID NO: 453295 - DNA, 25 bp, Homo sapien
tgttaagtttgtacctaatagaaat

SEQ ID NO: 453296 - DNA, 25 bp, Homo sapien
atgtctatcacaaatctttattggt

SEQ ID NO: 453297 - DNA, 25 bp, Homo sapien
tatatacttttccagcttgataatt

SEQ ID NO: 453298 - DNA, 25 bp, Homo sapien
tacttttccagcttgataattttca

SEQ ID NO: 453299 - DNA, 25 bp, Homo sapien
tccagcttgataattttcacaatag

SEQ ID NO: 453300 - DNA, 25 bp, Homo sapien
gaagtaaatgacaactctaccttgg

SEQ ID NO: 453301 - DNA, 25 bp, Homo sapien
ggccgagacactcactcttaacatt

SEQ ID NO: 453302 - DNA, 25 bp, Homo sapien
tttttctctctgcacattttttatc

SEQ ID NO: 453303 - DNA, 25 bp, Homo sapien
gcacattttttatccagctgacttt

SEQ ID NO: 453304 - DNA, 25 bp, Homo sapien
ttttatccagctgactttattttgt

SEQ ID NO: 453305 - DNA, 25 bp, Homo sapien
gactttattttgtctcctgaaatct

SEQ ID NO: 453306 - DNA, 25 bp, Homo sapien
ttgtctcctgaaatcttcattttta

SEQ ID NO: 453307 - DNA, 25 bp, Homo sapien
ttatagcttcagcatttaagaaaat

SEQ ID NO: 453308 - DNA, 25 bp, Homo sapien
atgtgtctaacaaagtcttcgcaag

SEQ ID NO: 453309 - DNA, 25 bp, Homo sapien
gtcttcgcaagcatacatttttccc

SEQ ID NO: 453310 - DNA, 25 bp, Homo sapien
acatttttcccatagttagtatact

SEQ ID NO: 453311 - DNA, 25 bp, Homo sapien
agaatttatttgtcaagcaattttg

SEQ ID NO: 453312 - DNA, 25 bp, Homo sapien
aattcctgcgcgcacttgaagggag

SEQ ID NO: 453313 - DNA, 25 bp, Homo sapien
atgactctgagcttgaccattcaac

SEQ ID NO: 453314 - DNA, 25 bp, Homo sapien
aacatcaatggatcagcacacactg

SEQ ID NO: 453315 - DNA, 25 bp, Homo sapien
acacactggtgtacggtctgctatg

SEQ ID NO: 453316 - DNA, 25 bp, Homo sapien
ggtctgctatgcatgcagccctgtg

SEQ ID NO: 453317 - DNA, 25 bp, Homo sapien
gtatcagaccaggaactgacagcct

SEQ ID NO: 453318 - DNA, 25 bp, Homo sapien
tgacagcctcactgcaacaggaaga

SEQ ID NO: 453319 - DNA, 25 bp, Homo sapien
gagaggcttcacacaataagcgttt

SEQ ID NO: 453320 - DNA, 25 bp, Homo sapien
aagcgtttcattcaaccaggctgga

SEQ ID NO: 453321 - DNA, 25 bp, Homo sapien
gctggacctgtgcttattgagttga

SEQ ID NO: 453322 - DNA, 25 bp, Homo sapien
ttgagttgaacatcactgagcacaa

SEQ ID NO: 453323 - DNA, 25 bp, Homo sapien
tccttgtcagtaaggccgagggaaa

SEQ ID NO: 453324 - DNA, 25 bp, Homo sapien
taaggccgagggaaaattcctcttg

SEQ ID NO: 453325 - DNA, 25 bp, Homo sapien
tcttgcctgtgtgacccaaactcta

SEQ ID NO: 453326 - DNA, 25 bp, Homo sapien
gcctgtgtgacccaaactctacatg

SEQ ID NO: 453327 - DNA, 25 bp, Homo sapien
aaactctacatgtttgactcaactc

SEQ ID NO: 453328 - DNA, 25 bp, Homo sapien
ctgctgctgagggcacatatgtatc

SEQ ID NO: 453329 - DNA, 25 bp, Homo sapien
ggcacatatgtatcccggaggagct

SEQ ID NO: 453330 - DNA, 25 bp, Homo sapien
gtttctcccccaactgagtagagga

SEQ ID NO: 453331 - DNA, 25 bp, Homo sapien
ggtgctttgtaaggcaggtgtaatt

SEQ ID NO: 453332 - DNA, 25 bp, Homo sapien
aaagaaattgtactccaaatattgg

SEQ ID NO: 453333 - DNA, 25 bp, Homo sapien
gagacctatattggaagagtcaatt

SEQ ID NO: 453334 - DNA, 25 bp, Homo sapien
ttcaatctgacgttcggggcttcca

SEQ ID NO: 453335 - DNA, 25 bp, Homo sapien
tggctattgggaccaacactacctc

SEQ ID NO: 453336 - DNA, 25 bp, Homo sapien
tattgggaccaacactacctcagct

SEQ ID NO: 453337 - DNA, 25 bp, Homo sapien
tgggaccaacactacctcagctggt

SEQ ID NO: 453338 - DNA, 25 bp, Homo sapien
aacactacctcagctggtcgatgct

SEQ ID NO: 453339 - DNA, 25 bp, Homo sapien
tcagctggtcgatgctcctgggtgt

SEQ ID NO: 453340 - DNA, 25 bp, Homo sapien
tgggtgtgggcttccctccagtgga

SEQ ID NO: 453341 - DNA, 25 bp, Homo sapien
cagtggacggcttgtccccactagt

SEQ ID NO: 453342 - DNA, 25 bp, Homo sapien
acggcttgtccccactagtcctggg

SEQ ID NO: 453343 - DNA, 25 bp, Homo sapien
catcatggcagtggccctgggtgcc

SEQ ID NO: 453344 - DNA, 25 bp, Homo sapien
gcggcttggttctgctgctgcacca

SEQ ID NO: 453345 - DNA, 25 bp, Homo sapien
caaatcatgttgtggccattgctgt

SEQ ID NO: 453346 - DNA, 25 bp, Homo sapien
ggcagtatctattcaccatacataa

SEQ ID NO: 453347 - DNA, 25 bp, Homo sapien
gaaggcggctgtggacaccctgttc

SEQ ID NO: 453348 - DNA, 25 bp, Homo sapien
cctgttcctcttggcagcacaggaa

SEQ ID NO: 453349 - DNA, 25 bp, Homo sapien
ctcttggcagcacaggaatggaagt

SEQ ID NO: 453350 - DNA, 25 bp, Homo sapien
aatggaagtgggtcccagtcctgat

SEQ ID NO: 453351 - DNA, 25 bp, Homo sapien
ggtcccagtcctgatgattaacact

SEQ ID NO: 453352 - DNA, 25 bp, Homo sapien
ttaacactgaaaagggagactgctg

SEQ ID NO: 453353 - DNA, 25 bp, Homo sapien
gagactgctggtagcttctggaaaa

SEQ ID NO: 453354 - DNA, 25 bp, Homo sapien
atttcctcaagcctaagaaagaagc

SEQ ID NO: 453355 - DNA, 25 bp, Homo sapien
gaagcagagcaagagatgctccttt

SEQ ID NO: 453356 - DNA, 25 bp, Homo sapien
tgcacttgcccttgccacacttgat

SEQ ID NO: 453357 - DNA, 25 bp, Homo sapien
ttgccacacttgatctcaagggcat

SEQ ID NO: 453358 - DNA, 25 bp, Homo sapien
acttgatctcaagggcatcttggaa

SEQ ID NO: 453359 - DNA, 25 bp, Homo sapien
atcttggaagtatttgaccatttct

SEQ ID NO: 453360 - DNA, 25 bp, Homo sapien
agtatttgaccatttcttgagatat

SEQ ID NO: 453361 - DNA, 25 bp, Homo sapien
ttggcatcttggttccagactcccc

SEQ ID NO: 453362 - DNA, 25 bp, Homo sapien
agtgacctttgagcatacccaagat

SEQ ID NO: 453363 - DNA, 25 bp, Homo sapien
tttgagcatacccaagatccctttc

SEQ ID NO: 453364 - DNA, 25 bp, Homo sapien
acccaagatccctttctcactgttg

SEQ ID NO: 453365 - DNA, 25 bp, Homo sapien
taggtaggtaaggaatgatcacatt

SEQ ID NO: 453366 - DNA, 25 bp, Homo sapien
aaggaatgatcacattggagtttgg

SEQ ID NO: 453367 - DNA, 25 bp, Homo sapien
gtacaactcaaacaagccatggttc

SEQ ID NO: 453368 - DNA, 25 bp, Homo sapien
agccatggttccttgatgacaaaca

SEQ ID NO: 453369 - DNA, 25 bp, Homo sapien
ggaaacacaagagggacgcgcccct

SEQ ID NO: 453370 - DNA, 25 bp, Homo sapien
tggactgtcttctctgtgcaatgat

SEQ ID NO: 453371 - DNA, 25 bp, Homo sapien
aatgatctcatgctcaggacagttg

SEQ ID NO: 453372 - DNA, 25 bp, Homo sapien
gctcaggacagttgcgcagggactc

SEQ ID NO: 453373 - DNA, 25 bp, Homo sapien
ttgcgcagggactcctgggagatat

SEQ ID NO: 453374 - DNA, 25 bp, Homo sapien
gagcctcacactgttcagacgttga

SEQ ID NO: 453375 - DNA, 25 bp, Homo sapien
cactgttcagacgttgacttagcaa

SEQ ID NO: 453376 - DNA, 25 bp, Homo sapien
gacttagcaactgcgttttttccca

SEQ ID NO: 453377 - DNA, 25 bp, Homo sapien
ccagctcgccacagaatggatcatg

SEQ ID NO: 453378 - DNA, 25 bp, Homo sapien
taaaatgaggttggcagtgaagaaa

SEQ ID NO: 453379 - DNA, 25 bp, Homo sapien
aaatacattttcactatgtgttcat

SEQ ID NO: 453380 - DNA, 25 bp, Homo sapien
acattttcactatgtgttcataaac

SEQ ID NO: 453381 - DNA, 25 bp, Homo sapien
tttcactatgtgttcataaactttt

SEQ ID NO: 453382 - DNA, 25 bp, Homo sapien
acttttaatgaagctgtttgtcttt

SEQ ID NO: 453383 - DNA, 25 bp, Homo sapien
gtgatgtttaggctttatttctgtt

SEQ ID NO: 453384 - DNA, 25 bp, Homo sapien
gatgtttaggctttatttctgttaa

SEQ ID NO: 453385 - DNA, 25 bp, Homo sapien
ttctgttaataaggctttttaccat

SEQ ID NO: 453386 - DNA, 25 bp, Homo sapien
gttaataaggctttttaccattgat

SEQ ID NO: 453387 - DNA, 25 bp, Homo sapien
aaggctttttaccattgattaaatg

SEQ ID NO: 453388 - DNA, 25 bp, Homo sapien
cgttgtaacaataaagttgagttct

SEQ ID NO: 453389 - DNA, 25 bp, Homo sapien
agctaggacctaaatcagaatcata

SEQ ID NO: 453390 - DNA, 25 bp, Homo sapien
atcagaatcatagttgcctgcatat

SEQ ID NO: 453391 - DNA, 25 bp, Homo sapien
tagttgcctgcatatatggtaacaa

SEQ ID NO: 453392 - DNA, 25 bp, Homo sapien
atggtaacaaggtcgtgtgcatttg

SEQ ID NO: 453393 - DNA, 25 bp, Homo sapien
gtggttgaatagaagacacctttct

SEQ ID NO: 453394 - DNA, 25 bp, Homo sapien
tagaagacacctttcttttgtcttt

SEQ ID NO: 453395 - DNA, 25 bp, Homo sapien
tgtctttaggtttaggaggagatac

SEQ ID NO: 453396 - DNA, 25 bp, Homo sapien
ggagatactaagatactggatgttt

SEQ ID NO: 453397 - DNA, 25 bp, Homo sapien
ggatgtttatcctatcttagtttgg

SEQ ID NO: 453398 - DNA, 25 bp, Homo sapien
cctatcttagtttggttggagtaat

SEQ ID NO: 453399 - DNA, 25 bp, Homo sapien
aagagggtggactttggcttttcag

SEQ ID NO: 453400 - DNA, 25 bp, Homo sapien
taacagctccatcagttcagggact

SEQ ID NO: 453401 - DNA, 25 bp, Homo sapien
acagctccatcagttcagggactgc

SEQ ID NO: 453402 - DNA, 25 bp, Homo sapien
gctccatcagttcagggactgcctg

SEQ ID NO: 453403 - DNA, 25 bp, Homo sapien
tcagggactgcctgacccagcctga

SEQ ID NO: 453404 - DNA, 25 bp, Homo sapien
gcaagtaatgggtgtgacataattt

SEQ ID NO: 453405 - DNA, 25 bp, Homo sapien
aatgggtgtgacataatttgacatg

SEQ ID NO: 453406 - DNA, 25 bp, Homo sapien
atagaggcgaataccacgctgtgaa

SEQ ID NO: 453407 - DNA, 25 bp, Homo sapien
agaggcgaataccacgctgtgaact

SEQ ID NO: 453408 - DNA, 25 bp, Homo sapien
aggcgaataccacgctgtgaactat

SEQ ID NO: 453409 - DNA, 25 bp, Homo sapien
aactcctgagaagctgttccagcgt

SEQ ID NO: 453410 - DNA, 25 bp, Homo sapien
gttccagcgtcaggagagcagcaga

SEQ ID NO: 453411 - DNA, 25 bp, Homo sapien
gtctttgatgctgtgacggacgtca

SEQ ID NO: 453412 - DNA, 25 bp, Homo sapien
gtgacggacgtcatcatcgccaaaa

SEQ ID NO: 453413 - DNA, 25 bp, Homo sapien
ggacgtcatcatcgccaaaaacctg

SEQ ID NO: 453414 - DNA, 25 bp, Homo sapien
gtcatcatcgccaaaaacctgcggg

SEQ ID NO: 453415 - DNA, 25 bp, Homo sapien
ggctgtggactctactgagcccagc

SEQ ID NO: 453416 - DNA, 25 bp, Homo sapien
tgtggactctactgagcccagccgc

SEQ ID NO: 453417 - DNA, 25 bp, Homo sapien
tcagaccactctttgcacttgagga

SEQ ID NO: 453418 - DNA, 25 bp, Homo sapien
agaccactctttgcacttgaggaag

SEQ ID NO: 453419 - DNA, 25 bp, Homo sapien
agaagacctcagaggctggcaccaa

SEQ ID NO: 453420 - DNA, 25 bp, Homo sapien
gaggagggagcatcctccacccgca

SEQ ID NO: 453421 - DNA, 25 bp, Homo sapien
caacagaacttgtggtaacgcaggg

SEQ ID NO: 453422 - DNA, 25 bp, Homo sapien
gcctgtttgcagggcccgcctggca

SEQ ID NO: 453423 - DNA, 25 bp, Homo sapien
ccgcctggcaggacgactgagcaag

SEQ ID NO: 453424 - DNA, 25 bp, Homo sapien
cgcctggcaggacgactgagcaagt

SEQ ID NO: 453425 - DNA, 25 bp, Homo sapien
aaaaccagagatattagagcggtga

SEQ ID NO: 453426 - DNA, 25 bp, Homo sapien
accagagatattagagcggtgaatc

SEQ ID NO: 453427 - DNA, 25 bp, Homo sapien
cagagatattagagcggtgaatcgc

SEQ ID NO: 453428 - DNA, 25 bp, Homo sapien
gatattagagcggtgaatcgcgctg

SEQ ID NO: 453429 - DNA, 25 bp, Homo sapien
attagagcggtgaatcgcgctggtc

SEQ ID NO: 453430 - DNA, 25 bp, Homo sapien
ttagagcggtgaatcgcgctggtca

SEQ ID NO: 453431 - DNA, 25 bp, Homo sapien
tagagcggtgaatcgcgctggtcac

SEQ ID NO: 453432 - DNA, 25 bp, Homo sapien
agagcggtgaatcgcgctggtcacg

SEQ ID NO: 453433 - DNA, 25 bp, Homo sapien
gagcatgtgtgcaggggaattcccc

SEQ ID NO: 453434 - DNA, 25 bp, Homo sapien
tcatgggagcagcatgagaaagact

SEQ ID NO: 453435 - DNA, 25 bp, Homo sapien
gcatgagaaagactcacctccgtga

SEQ ID NO: 453436 - DNA, 25 bp, Homo sapien
atgagaaagactcacctccgtgatt

SEQ ID NO: 453437 - DNA, 25 bp, Homo sapien
gagaaagactcacctccgtgattca

SEQ ID NO: 453438 - DNA, 25 bp, Homo sapien
agaaagactcacctccgtgattcag

SEQ ID NO: 453439 - DNA, 25 bp, Homo sapien
gaaagactcacctccgtgattcagt

SEQ ID NO: 453440 - DNA, 25 bp, Homo sapien
aaagactcacctccgtgattcagtt

SEQ ID NO: 453441 - DNA, 25 bp, Homo sapien
agactcacctccgtgattcagttac

SEQ ID NO: 453442 - DNA, 25 bp, Homo sapien
tgtgtccctgccacaacatgtggga

SEQ ID NO: 453443 - DNA, 25 bp, Homo sapien
tgaatgaggagcaaagtcacatctt

SEQ ID NO: 453444 - DNA, 25 bp, Homo sapien
ttattttgcatctttgaagtgtctt

SEQ ID NO: 453445 - DNA, 25 bp, Homo sapien
tattttgcatctttgaagtgtctta

SEQ ID NO: 453446 - DNA, 25 bp, Homo sapien
attttgcatctttgaagtgtcttaa

SEQ ID NO: 453447 - DNA, 25 bp, Homo sapien
ttttgcatctttgaagtgtcttaaa

SEQ ID NO: 453448 - DNA, 25 bp, Homo sapien
tttgcatctttgaagtgtcttaaat

SEQ ID NO: 453449 - DNA, 25 bp, Homo sapien
ttgcatctttgaagtgtcttaaatt

SEQ ID NO: 453450 - DNA, 25 bp, Homo sapien
tgcatctttgaagtgtcttaaattt

SEQ ID NO: 453451 - DNA, 25 bp, Homo sapien
gcatctttgaagtgtcttaaatttt

SEQ ID NO: 453452 - DNA, 25 bp, Homo sapien
catctttgaagtgtcttaaatttta

SEQ ID NO: 453453 - DNA, 25 bp, Homo sapien
taaaaattggtcttggccaggtgcg

SEQ ID NO: 453454 - DNA, 25 bp, Homo sapien
aaaaattggtcttggccaggtgcgg

SEQ ID NO: 453455 - DNA, 25 bp, Homo sapien
ggatactagagaaagtcatttgctt

SEQ ID NO: 453456 - DNA, 25 bp, Homo sapien
gtactattgccattttagaaagctc

SEQ ID NO: 453457 - DNA, 25 bp, Homo sapien
gaaagctctgatgtgaattcaaatt

SEQ ID NO: 453458 - DNA, 25 bp, Homo sapien
gggaatgaagtataccaacttcttt

SEQ ID NO: 453459 - DNA, 25 bp, Homo sapien
aagtataccaacttctttcagagca

SEQ ID NO: 453460 - DNA, 25 bp, Homo sapien
agtataccaacttctttcagagcat

SEQ ID NO: 453461 - DNA, 25 bp, Homo sapien
gtataccaacttctttcagagcatt

SEQ ID NO: 453462 - DNA, 25 bp, Homo sapien
tataccaacttctttcagagcattt

SEQ ID NO: 453463 - DNA, 25 bp, Homo sapien
taccaacttctttcagagcatttta

SEQ ID NO: 453464 - DNA, 25 bp, Homo sapien
tctttcagagcattttaggacatta

SEQ ID NO: 453465 - DNA, 25 bp, Homo sapien
ctttcagagcattttaggacattat

SEQ ID NO: 453466 - DNA, 25 bp, Homo sapien
cgggtgctcccgctctgccatagca

SEQ ID NO: 453467 - DNA, 25 bp, Homo sapien
gggcaactaaacaaacacaaagtat

SEQ ID NO: 453468 - DNA, 25 bp, Homo sapien
ggcaactaaacaaacacaaagtatt

SEQ ID NO: 453469 - DNA, 25 bp, Homo sapien
gcaactaaacaaacacaaagtattc

SEQ ID NO: 453470 - DNA, 25 bp, Homo sapien
caactaaacaaacacaaagtattct

SEQ ID NO: 453471 - DNA, 25 bp, Homo sapien
aactaaacaaacacaaagtattctg

SEQ ID NO: 453472 - DNA, 25 bp, Homo sapien
actaaacaaacacaaagtattctgt

SEQ ID NO: 453473 - DNA, 25 bp, Homo sapien
ctaaacaaacacaaagtattctgtg

SEQ ID NO: 453474 - DNA, 25 bp, Homo sapien
taaacaaacacaaagtattctgtgt

SEQ ID NO: 453475 - DNA, 25 bp, Homo sapien
aaacaaacacaaagtattctgtgtc

SEQ ID NO: 453476 - DNA, 25 bp, Homo sapien
gctggacagggcagttgtgtgttgg

SEQ ID NO: 453477 - DNA, 25 bp, Homo sapien
taaaggcaagcaggtgtgaagagca

SEQ ID NO: 453478 - DNA, 25 bp, Homo sapien
gagcagggctcagcagcaagtcaca

SEQ ID NO: 453479 - DNA, 25 bp, Homo sapien
agggctcagcagcaagtcacatttt

SEQ ID NO: 453480 - DNA, 25 bp, Homo sapien
catttttctactatttgaccaaaag

SEQ ID NO: 453481 - DNA, 25 bp, Homo sapien
gaactctggagtggtctaagactga

SEQ ID NO: 453482 - DNA, 25 bp, Homo sapien
gtggtctaagactgataatagcaga

SEQ ID NO: 453483 - DNA, 25 bp, Homo sapien
atcttagacattcattcttaagtag

SEQ ID NO: 453484 - DNA, 25 bp, Homo sapien
aatcagaccaacagattttcccaac

SEQ ID NO: 453485 - DNA, 25 bp, Homo sapien
ttcccaacccaagactattgtaaca

SEQ ID NO: 453486 - DNA, 25 bp, Homo sapien
aacccaagactattgtaacacataa

SEQ ID NO: 453487 - DNA, 25 bp, Homo sapien
gacagcaagaattcttatttctata

SEQ ID NO: 453488 - DNA, 25 bp, Homo sapien
aaaggcacaggtagctcagtttatt

SEQ ID NO: 453489 - DNA, 25 bp, Homo sapien
gctcagtttatttgctttctaccct

SEQ ID NO: 453490 - DNA, 25 bp, Homo sapien
tttcttcagtttctaatttgagctg

SEQ ID NO: 453491 - DNA, 25 bp, Homo sapien
atttgagctgtaactacacaaggaa

SEQ ID NO: 453492 - DNA, 25 bp, Homo sapien
gaaagaatccacaaagccaaaggag

SEQ ID NO: 453493 - DNA, 25 bp, Homo sapien
cagttactgtgtgttatacgttgaa

SEQ ID NO: 453494 - DNA, 25 bp, Homo sapien
ggagactggcctatactcattttat

SEQ ID NO: 453495 - DNA, 25 bp, Homo sapien
gtgtgttatacgttgaaaggtcttc

SEQ ID NO: 453496 - DNA, 25 bp, Homo sapien
aaggtcttcactaatatctcactaa

SEQ ID NO: 453497 - DNA, 25 bp, Homo sapien
tcactaagtaatgagaatgcctaca

SEQ ID NO: 453498 - DNA, 25 bp, Homo sapien
gaatgcctacatatcagaatttttt

SEQ ID NO: 453499 - DNA, 25 bp, Homo sapien
gatgggcatcttttgtattaagaaa

SEQ ID NO: 453500 - DNA, 25 bp, Homo sapien
aaaataattctgagttttgtgtttg

SEQ ID NO: 453501 - DNA, 25 bp, Homo sapien
tgtttttgccgtgggagtgtgtgcc

SEQ ID NO: 453502 - DNA, 25 bp, Homo sapien
ggagtgtgtgcctgcgtgggtgtgt

SEQ ID NO: 453503 - DNA, 25 bp, Homo sapien
taactgacaagccatcttgagtggt

SEQ ID NO: 453504 - DNA, 25 bp, Homo sapien
tgacaagccatcttgagtggtcatg

SEQ ID NO: 453505 - DNA, 25 bp, Homo sapien
tggtcatgggccactgcttttccct

SEQ ID NO: 453506 - DNA, 25 bp, Homo sapien
ccctttgtgagtcaatacatagtgc

SEQ ID NO: 453507 - DNA, 25 bp, Homo sapien
gtgagtcaatacatagtgctgctgt

SEQ ID NO: 453508 - DNA, 25 bp, Homo sapien
caatacatagtgctgctgtgtgctt

SEQ ID NO: 453509 - DNA, 25 bp, Homo sapien
tgctttttttgtgtgtatttgctaa

SEQ ID NO: 453510 - DNA, 25 bp, Homo sapien
ctttcgtctgcgcattggtgatctg

SEQ ID NO: 453511 - DNA, 25 bp, Homo sapien
cattggtgatctgcaggtcgcagtc

SEQ ID NO: 453512 - DNA, 25 bp, Homo sapien
gtcgcagtcggcagctttcagcttc

SEQ ID NO: 453513 - DNA, 25 bp, Homo sapien
tctccccataatctgcttctttaag

SEQ ID NO: 453514 - DNA, 25 bp, Homo sapien
gcttctttaagtcgcagagggagat

SEQ ID NO: 453515 - DNA, 25 bp, Homo sapien
gcccatcaaaggtgacggtatcata

SEQ ID NO: 453516 - DNA, 25 bp, Homo sapien
aatgcacacaggacatggtgccaag

SEQ ID NO: 453517 - DNA, 25 bp, Homo sapien
ggacatggtgccaagggattcctaa

SEQ ID NO: 453518 - DNA, 25 bp, Homo sapien
aagggattcctaaggttcagcgagg

SEQ ID NO: 453519 - DNA, 25 bp, Homo sapien
ttcagcgaggagacgtggacactct

SEQ ID NO: 453520 - DNA, 25 bp, Homo sapien
gtggacactctcaatatacgtatat

SEQ ID NO: 453521 - DNA, 25 bp, Homo sapien
taacagattctgtgttggaagtaca

SEQ ID NO: 453522 - DNA, 25 bp, Homo sapien
acagattctgtgttggaagtacagc

SEQ ID NO: 453523 - DNA, 25 bp, Homo sapien
gattctgtgttggaagtacagctac

SEQ ID NO: 453524 - DNA, 25 bp, Homo sapien
tctgtgttggaagtacagctactat

SEQ ID NO: 453525 - DNA, 25 bp, Homo sapien
gtgttggaagtacagctactattac

SEQ ID NO: 453526 - DNA, 25 bp, Homo sapien
gttggaagtacagctactattacaa

SEQ ID NO: 453527 - DNA, 25 bp, Homo sapien
ggaagtacagctactattacaagct

SEQ ID NO: 453528 - DNA, 25 bp, Homo sapien
gtacagctactattacaagctgaca

SEQ ID NO: 453529 - DNA, 25 bp, Homo sapien
agctactattacaagctgacatagg

SEQ ID NO: 453530 - DNA, 25 bp, Homo sapien
gctactattacaagctgacataggt

SEQ ID NO: 453531 - DNA, 25 bp, Homo sapien
tattacaagctgacataggtattac

SEQ ID NO: 453532 - DNA, 25 bp, Homo sapien
ttcctcgcagcaagcggctggagat

SEQ ID NO: 453533 - DNA, 25 bp, Homo sapien
aagagcttactggtgcgagcgtccg

SEQ ID NO: 453534 - DNA, 25 bp, Homo sapien
cgtcgccgctgacctagagatggca

SEQ ID NO: 453535 - DNA, 25 bp, Homo sapien
ctagagatggcagccggtctcaccg

SEQ ID NO: 453536 - DNA, 25 bp, Homo sapien
ggtctcaccgacatatttcagcatg

SEQ ID NO: 453537 - DNA, 25 bp, Homo sapien
catactgtggtgatgtctggaacac

SEQ ID NO: 453538 - DNA, 25 bp, Homo sapien
tggaacaccaacaaacgccagaatg

SEQ ID NO: 453539 - DNA, 25 bp, Homo sapien
gaatggcagactcatgtggctctat

SEQ ID NO: 453540 - DNA, 25 bp, Homo sapien
agactcatgtggctctatctcaaat

SEQ ID NO: 453541 - DNA, 25 bp, Homo sapien
tactgggaactcgttgtcgaactga

SEQ ID NO: 453542 - DNA, 25 bp, Homo sapien
aactgcttttagtgactcgaggcca

SEQ ID NO: 453543 - DNA, 25 bp, Homo sapien
cagtctctacagtgtgaactccatc

SEQ ID NO: 453544 - DNA, 25 bp, Homo sapien
gtgaactccatctgattttctttgt

SEQ ID NO: 453545 - DNA, 25 bp, Homo sapien
tcaaaaactaaggttttgccttctg

SEQ ID NO: 453546 - DNA, 25 bp, Homo sapien
aatcaatatctaatcctgctccatc

SEQ ID NO: 453547 - DNA, 25 bp, Homo sapien
ctaatcctgctccatctaaaacttg

SEQ ID NO: 453548 - DNA, 25 bp, Homo sapien
aaaacttggtactcgatctccagcg

SEQ ID NO: 453549 - DNA, 25 bp, Homo sapien
gcatgggctggtagaagcactcctt

SEQ ID NO: 453550 - DNA, 25 bp, Homo sapien
ctggtagaagcactccttctggccg

SEQ ID NO: 453551 - DNA, 25 bp, Homo sapien
agggtaaaggtgaagtcgctatcga

SEQ ID NO: 453552 - DNA, 25 bp, Homo sapien
cagaaatggtgctgaatgtattgtc

SEQ ID NO: 453553 - DNA, 25 bp, Homo sapien
catgtaatcaccaacttcagtctct

SEQ ID NO: 453554 - DNA, 25 bp, Homo sapien
gatacgaagcagactattttcaaca

SEQ ID NO: 453555 - DNA, 25 bp, Homo sapien
tgtgtgagagccaaacaagtgccat

SEQ ID NO: 453556 - DNA, 25 bp, Homo sapien
gagagccaaacaagtgccatacaga

SEQ ID NO: 453557 - DNA, 25 bp, Homo sapien
gtgccatacagaaagggacctcttc

SEQ ID NO: 453558 - DNA, 25 bp, Homo sapien
cagcatttaagtgtggtggctccat

SEQ ID NO: 453559 - DNA, 25 bp, Homo sapien
gtggtggctccatagaagtcactat

SEQ ID NO: 453560 - DNA, 25 bp, Homo sapien
aagtcactatagcatggacgagcca

SEQ ID NO: 453561 - DNA, 25 bp, Homo sapien
atagcatggacgagccacttggctt

SEQ ID NO: 453562 - DNA, 25 bp, Homo sapien
gacgagccacttggcttgctttttc

SEQ ID NO: 453563 - DNA, 25 bp, Homo sapien
gttatatatgttttgtctaatttgc

SEQ ID NO: 453564 - DNA, 25 bp, Homo sapien
gtctaatttgcaatattacagtctc

SEQ ID NO: 453565 - DNA, 25 bp, Homo sapien
aaatcctgcctatattttactcagt

SEQ ID NO: 453566 - DNA, 25 bp, Homo sapien
tattttactcagtttcaaactttat

SEQ ID NO: 453567 - DNA, 25 bp, Homo sapien
ttactcagtttcaaactttattagt

SEQ ID NO: 453568 - DNA, 25 bp, Homo sapien
ttgttttttaatgtcagatctgttg

SEQ ID NO: 453569 - DNA, 25 bp, Homo sapien
gttttttaatgtcagatctgttgag

SEQ ID NO: 453570 - DNA, 25 bp, Homo sapien
tttaatgtcagatctgttgagttgg

SEQ ID NO: 453571 - DNA, 25 bp, Homo sapien
taatgtcagatctgttgagttggtt

SEQ ID NO: 453572 - DNA, 25 bp, Homo sapien
atgtcagatctgttgagttggtttt

SEQ ID NO: 453573 - DNA, 25 bp, Homo sapien
tgtcagatctgttgagttggttttt

SEQ ID NO: 453574 - DNA, 25 bp, Homo sapien
gtcagatctgttgagttggtttttt

SEQ ID NO: 453575 - DNA, 25 bp, Homo sapien
gatctgttgagttggtttttttggt

SEQ ID NO: 453576 - DNA, 25 bp, Homo sapien
taacagctccatcagttcagggact

SEQ ID NO: 453577 - DNA, 25 bp, Homo sapien
aacagctccatcagttcagggactg

SEQ ID NO: 453578 - DNA, 25 bp, Homo sapien
acagctccatcagttcagggactgc

SEQ ID NO: 453579 - DNA, 25 bp, Homo sapien
cagctccatcagttcagggactgcc

SEQ ID NO: 453580 - DNA, 25 bp, Homo sapien
tcagggactgcctgacccagcctga

SEQ ID NO: 453581 - DNA, 25 bp, Homo sapien
gcaagtaatgggtgtgacataattt

SEQ ID NO: 453582 - DNA, 25 bp, Homo sapien
aatgggtgtgacataatttgacatg

SEQ ID NO: 453583 - DNA, 25 bp, Homo sapien
atagaggcgaataccacgctgtgaa

SEQ ID NO: 453584 - DNA, 25 bp, Homo sapien
agaggcgaataccacgctgtgaact

SEQ ID NO: 453585 - DNA, 25 bp, Homo sapien
gaggcgaataccacgctgtgaacta

SEQ ID NO: 453586 - DNA, 25 bp, Homo sapien
aggcgaataccacgctgtgaactat

SEQ ID NO: 453587 - DNA, 25 bp, Homo sapien
ctggatccgagggatgctacctctc

SEQ ID NO: 453588 - DNA, 25 bp, Homo sapien
gaggaagtgagatctccgcttgcag

SEQ ID NO: 453589 - DNA, 25 bp, Homo sapien
gaagtgagatctccgcttgcaggtc

SEQ ID NO: 453590 - DNA, 25 bp, Homo sapien
gtgagatctccgcttgcaggtcagc

SEQ ID NO: 453591 - DNA, 25 bp, Homo sapien
gagatctccgcttgcaggtcagccc

SEQ ID NO: 453592 - DNA, 25 bp, Homo sapien
ggctggcttgactcaggccctgtga

SEQ ID NO: 453593 - DNA, 25 bp, Homo sapien
tggcttgactcaggccctgtgagat

SEQ ID NO: 453594 - DNA, 25 bp, Homo sapien
ttgactcaggccctgtgagatagag

SEQ ID NO: 453595 - DNA, 25 bp, Homo sapien
cctgtgagatagagggcccagccca

SEQ ID NO: 453596 - DNA, 25 bp, Homo sapien
ttgtaaatcatttggcgagactgta

SEQ ID NO: 453597 - DNA, 25 bp, Homo sapien
atcatttggcgagactgtattttag

SEQ ID NO: 453598 - DNA, 25 bp, Homo sapien
cttgacttgctactggtacctggaa

SEQ ID NO: 453599 - DNA, 25 bp, Homo sapien
gagatgtaacacctgaccatgggac

SEQ ID NO: 453600 - DNA, 25 bp, Homo sapien
gaccatgggacatcaagtgactgtg

SEQ ID NO: 453601 - DNA, 25 bp, Homo sapien
actgtgtgaatcaaactgcccatca

SEQ ID NO: 453602 - DNA, 25 bp, Homo sapien
ctgcccatcatgaattgttgttatt

SEQ ID NO: 453603 - DNA, 25 bp, Homo sapien
ataagttctcgcgagacgcagtaag

SEQ ID NO: 453604 - DNA, 25 bp, Homo sapien
tgaacacaggagcagtgcactacat

SEQ ID NO: 453605 - DNA, 25 bp, Homo sapien
gtgcactacatatgggactggaacc

SEQ ID NO: 453606 - DNA, 25 bp, Homo sapien
gacgcagtaaggcaccggctcgaac

SEQ ID NO: 453607 - DNA, 25 bp, Homo sapien
actgccaggaaagcaacgccctgaa

SEQ ID NO: 453608 - DNA, 25 bp, Homo sapien
aacgccctgaatgcttatgccggtg

SEQ ID NO: 453609 - DNA, 25 bp, Homo sapien
tacggtggagtgtccttattctcaa

SEQ ID NO: 453610 - DNA, 25 bp, Homo sapien
tgtccttattctcaaagccactgtg

SEQ ID NO: 453611 - DNA, 25 bp, Homo sapien
ttctcaaagccactgtgtgccaact

SEQ ID NO: 453612 - DNA, 25 bp, Homo sapien
tgccaactggtggacccagtgcatt

SEQ ID NO: 453613 - DNA, 25 bp, Homo sapien
cagtgcatttctggcctagctaact

SEQ ID NO: 453614 - DNA, 25 bp, Homo sapien
ggcctagctaactctacacacagaa

SEQ ID NO: 453615 - DNA, 25 bp, Homo sapien
aactctacacacagaatctcaggca

SEQ ID NO: 453616 - DNA, 25 bp, Homo sapien
ccatgtgcgagtgccctgtgggtta

SEQ ID NO: 453617 - DNA, 25 bp, Homo sapien
ggaaacacttgacctagaagccttt

SEQ ID NO: 453618 - DNA, 25 bp, Homo sapien
cccttgctgttcatgtcaccagagg

SEQ ID NO: 453619 - DNA, 25 bp, Homo sapien
tcatgtcaccagaggcccttggaag

SEQ ID NO: 453620 - DNA, 25 bp, Homo sapien
ggaaaactcattcaccatttactag

SEQ ID NO: 453621 - DNA, 25 bp, Homo sapien
caccatttactagctttgtgcaata

SEQ ID NO: 453622 - DNA, 25 bp, Homo sapien
tagcacattgtgctttgcttggctt

SEQ ID NO: 453623 - DNA, 25 bp, Homo sapien
ttgcttggcttgtaaggatggcttt

SEQ ID NO: 453624 - DNA, 25 bp, Homo sapien
ggatggctttagtaccattacatta

SEQ ID NO: 453625 - DNA, 25 bp, Homo sapien
atggacagtgtgcacagtgtattgt

SEQ ID NO: 453626 - DNA, 25 bp, Homo sapien
gtgtattgtaaatgccaactcttgc

SEQ ID NO: 453627 - DNA, 25 bp, Homo sapien
aaatgccaactcttgcaaatttaca

SEQ ID NO: 453628 - DNA, 25 bp, Homo sapien
gcatgaataattaattgcccattag

SEQ ID NO: 453629 - DNA, 25 bp, Homo sapien
ccattagggctaaggagactgacat

SEQ ID NO: 453630 - DNA, 25 bp, Homo sapien
gactgacatgatttttatcggttct

SEQ ID NO: 453631 - DNA, 25 bp, Homo sapien
gagcatgtgtgcaggggaattcccc

SEQ ID NO: 453632 - DNA, 25 bp, Homo sapien
tcatgggagcagcatgagaaagact

SEQ ID NO: 453633 - DNA, 25 bp, Homo sapien
gcatgagaaagactcacctccgtga

SEQ ID NO: 453634 - DNA, 25 bp, Homo sapien
catgagaaagactcacctccgtgat

SEQ ID NO: 453635 - DNA, 25 bp, Homo sapien
atgagaaagactcacctccgtgatt

SEQ ID NO: 453636 - DNA, 25 bp, Homo sapien
tgagaaagactcacctccgtgattc

SEQ ID NO: 453637 - DNA, 25 bp, Homo sapien
gagaaagactcacctccgtgattca

SEQ ID NO: 453638 - DNA, 25 bp, Homo sapien
agaaagactcacctccgtgattcag

SEQ ID NO: 453639 - DNA, 25 bp, Homo sapien
gaaagactcacctccgtgattcagt

SEQ ID NO: 453640 - DNA, 25 bp, Homo sapien
aaagactcacctccgtgattcagtt

SEQ ID NO: 453641 - DNA, 25 bp, Homo sapien
agactcacctccgtgattcagttac

SEQ ID NO: 453642 - DNA, 25 bp, Homo sapien
atcctgtaactaatttttcataact

SEQ ID NO: 453643 - DNA, 25 bp, Homo sapien
ttatcctgtaactttttcatcccac

SEQ ID NO: 453644 - DNA, 25 bp, Homo sapien
ctgtaactttttcatcccacaactt

SEQ ID NO: 453645 - DNA, 25 bp, Homo sapien
gttcttttaataaacacacttacat

SEQ ID NO: 453646 - DNA, 25 bp, Homo sapien
aataaacacacttacatagttacaa

SEQ ID NO: 453647 - DNA, 25 bp, Homo sapien
gccaagcatgccgagaatttgcaga

SEQ ID NO: 453648 - DNA, 25 bp, Homo sapien
atttgcagagtctcaatacccagta

SEQ ID NO: 453649 - DNA, 25 bp, Homo sapien
ttgcagagtctcaatacccagtact

SEQ ID NO: 453650 - DNA, 25 bp, Homo sapien
tgcagagtctcaatacccagtacta

SEQ ID NO: 453651 - DNA, 25 bp, Homo sapien
gcagagtctcaatacccagtactat

SEQ ID NO: 453652 - DNA, 25 bp, Homo sapien
agagtctcaatacccagtactatag

SEQ ID NO: 453653 - DNA, 25 bp, Homo sapien
agagatgggtacttcttgttcccct

SEQ ID NO: 453654 - DNA, 25 bp, Homo sapien
ttgttccccttggatttcggaagca

SEQ ID NO: 453655 - DNA, 25 bp, Homo sapien
gaagcaaagcaatgggaccctacgc

SEQ ID NO: 453656 - DNA, 25 bp, Homo sapien
gaccctacgcttcagagtcttaatg

SEQ ID NO: 453657 - DNA, 25 bp, Homo sapien
ggcagtgtccattgaggtgtcctgt

SEQ ID NO: 453658 - DNA, 25 bp, Homo sapien
tccattgaggtgtcctgtcgggaat

SEQ ID NO: 453659 - DNA, 25 bp, Homo sapien
gtcctgtcgggaatgacaagtccag

SEQ ID NO: 453660 - DNA, 25 bp, Homo sapien
caagtccagggcagattatgaggca

SEQ ID NO: 453661 - DNA, 25 bp, Homo sapien
ttatgaggcaggcatcctttggagt

SEQ ID NO: 453662 - DNA, 25 bp, Homo sapien
tatttttgccaaagcgtagtaccca

SEQ ID NO: 453663 - DNA, 25 bp, Homo sapien
agcgtagtacccaatatgtgtagaa

SEQ ID NO: 453664 - DNA, 25 bp, Homo sapien
atggagtgttttctgttgaacacta

SEQ ID NO: 453665 - DNA, 25 bp, Homo sapien
gttgaacactaagtactgccacaag

SEQ ID NO: 453666 - DNA, 25 bp, Homo sapien
tttacaatgttgctggaggtgatct

SEQ ID NO: 453667 - DNA, 25 bp, Homo sapien
gaaaatcatgtcagtgagtgagtct

SEQ ID NO: 453668 - DNA, 25 bp, Homo sapien
gtcagtgagtgagtctttcaaataa

SEQ ID NO: 453669 - DNA, 25 bp, Homo sapien
taatccttcggcatgaaacctgagc

SEQ ID NO: 453670 - DNA, 25 bp, Homo sapien
tgaaacctgagcctagtaaactatg

SEQ ID NO: 453671 - DNA, 25 bp, Homo sapien
gtaaactcggcacattacccgaaag

SEQ ID NO: 453672 - DNA, 25 bp, Homo sapien
attacccgaaagtctcaatgtcata

SEQ ID NO: 453673 - DNA, 25 bp, Homo sapien
agtctcaatgtcatattttcacccc

SEQ ID NO: 453674 - DNA, 25 bp, Homo sapien
gatgattgctcattttctaatgtgg

SEQ ID NO: 453675 - DNA, 25 bp, Homo sapien
tcctttaacagccatgccttctgga

SEQ ID NO: 453676 - DNA, 25 bp, Homo sapien
acagccatgccttctggaatctgga

SEQ ID NO: 453677 - DNA, 25 bp, Homo sapien
gaatctggaagaggacaccactcct

SEQ ID NO: 453678 - DNA, 25 bp, Homo sapien
gaagaggacaccactcctgcagtca

SEQ ID NO: 453679 - DNA, 25 bp, Homo sapien
gccacatagcagctgcaggtcccag

SEQ ID NO: 453680 - DNA, 25 bp, Homo sapien
aactaatgtgcgtgagaatgggcct

SEQ ID NO: 453681 - DNA, 25 bp, Homo sapien
tgagaatgggcctggcacacctggg

SEQ ID NO: 453682 - DNA, 25 bp, Homo sapien
tagggctgccatgctgcagagctga

SEQ ID NO: 453683 - DNA, 25 bp, Homo sapien
tgccatgctgcagagctgatggagt

SEQ ID NO: 453684 - DNA, 25 bp, Homo sapien
gttgtgggcacaaggcatctgtcag

SEQ ID NO: 453685 - DNA, 25 bp, Homo sapien
aaggcatctgtcagctgcctccttt

SEQ ID NO: 453686 - DNA, 25 bp, Homo sapien
gagacagagtccaccctttgtgcaa

SEQ ID NO: 453687 - DNA, 25 bp, Homo sapien
agtccaccctttgtgcaaggcgaga

SEQ ID NO: 453688 - DNA, 25 bp, Homo sapien
ccctttgtgcaaggcgagaaccaat

SEQ ID NO: 453689 - DNA, 25 bp, Homo sapien
gagaaccaatgaatggactccttgt

SEQ ID NO: 453690 - DNA, 25 bp, Homo sapien
ggactccttgtgtgaattattgcat

SEQ ID NO: 453691 - DNA, 25 bp, Homo sapien
attattgcatcttcttccaaagcag

SEQ ID NO: 453692 - DNA, 25 bp, Homo sapien
gcatcttcttccaaagcaggttcat

SEQ ID NO: 453693 - DNA, 25 bp, Homo sapien
gcaggttcatcaagactttcacaga

SEQ ID NO: 453694 - DNA, 25 bp, Homo sapien
ctagtgataaaagtgtccaagcaat

SEQ ID NO: 453695 - DNA, 25 bp, Homo sapien
tattttagggacataccaacatctt

SEQ ID NO: 453696 - DNA, 25 bp, Homo sapien
tctgctaatttcatgctccaaagat

SEQ ID NO: 453697 - DNA, 25 bp, Homo sapien
tgtttttattcgctttctggtaact

SEQ ID NO: 453698 - DNA, 25 bp, Homo sapien
attcgctttctggtaacttctgtag

SEQ ID NO: 453699 - DNA, 25 bp, Homo sapien
tttctggtaacttctgtaggccctg

SEQ ID NO: 453700 - DNA, 25 bp, Homo sapien
gtaacttctgtaggccctggctcaa

SEQ ID NO: 453701 - DNA, 25 bp, Homo sapien
taggccctggctcaaggacttagca

SEQ ID NO: 453702 - DNA, 25 bp, Homo sapien
aggacttagcatttcgtctcatgta

SEQ ID NO: 453703 - DNA, 25 bp, Homo sapien
gcatttcgtctcatgtacatctttt

SEQ ID NO: 453704 - DNA, 25 bp, Homo sapien
gtctcatgtacatctttttcttaag

SEQ ID NO: 453705 - DNA, 25 bp, Homo sapien
gcatccgcatccagcatcagatggc

SEQ ID NO: 453706 - DNA, 25 bp, Homo sapien
aaacattgataactcagtttgaagc

SEQ ID NO: 453707 - DNA, 25 bp, Homo sapien
gcatgtgtaatatggctctatacaa

SEQ ID NO: 453708 - DNA, 25 bp, Homo sapien
aaatcaatcagttaagtgctaccag

SEQ ID NO: 453709 - DNA, 25 bp, Homo sapien
gtgctaccagaaagtgtaccaattt

SEQ ID NO: 453710 - DNA, 25 bp, Homo sapien
gcaatattttcatttaatgcatgtg

SEQ ID NO: 453711 - DNA, 25 bp, Homo sapien
agatgtagcttaaactgtcttctta

SEQ ID NO: 453712 - DNA, 25 bp, Homo sapien
gcttaaactgtcttcttaatccaac

SEQ ID NO: 453713 - DNA, 25 bp, Homo sapien
gtcttcttaatccaacaacttacat

SEQ ID NO: 453714 - DNA, 25 bp, Homo sapien
aacttacattccgttgttgctgcat

SEQ ID NO: 453715 - DNA, 25 bp, Homo sapien
ttacattccgttgttgctgcatcct

SEQ ID NO: 453716 - DNA, 25 bp, Homo sapien
attccgttgttgctgcatcctttta

SEQ ID NO: 453717 - DNA, 25 bp, Homo sapien
tgttgctgcatccttttatttaagg

SEQ ID NO: 453718 - DNA, 25 bp, Homo sapien
ttttgtcactccttggaaaattctt

SEQ ID NO: 453719 - DNA, 25 bp, Homo sapien
cgctgaggcatctcctgggcacaga

SEQ ID NO: 453720 - DNA, 25 bp, Homo sapien
tctaagccggctggcctgggagtta

SEQ ID NO: 453721 - DNA, 25 bp, Homo sapien
ctgcccacctcacctgggagttggg

SEQ ID NO: 453722 - DNA, 25 bp, Homo sapien
ggtcctgcccacctggagtttagca

SEQ ID NO: 453723 - DNA, 25 bp, Homo sapien
tggagtttagcacgctggtcgctca

SEQ ID NO: 453724 - DNA, 25 bp, Homo sapien
tggtcgctcactttgctttggtctg

SEQ ID NO: 453725 - DNA, 25 bp, Homo sapien
gctttggtctgcacacctggtgtgt

SEQ ID NO: 453726 - DNA, 25 bp, Homo sapien
tatactgcttgtgccatctgtgtac

SEQ ID NO: 453727 - DNA, 25 bp, Homo sapien
ctctccctggagtacacttgtggtc

SEQ ID NO: 453728 - DNA, 25 bp, Homo sapien
acacttgtggtcacactacagtggg

SEQ ID NO: 453729 - DNA, 25 bp, Homo sapien
tatggattgctgcatgattcttaaa

SEQ ID NO: 453730 - DNA, 25 bp, Homo sapien
aagcaggttcatcaagactttcaca

SEQ ID NO: 453731 - DNA, 25 bp, Homo sapien
gcaggttcatcaagactttcacaga

SEQ ID NO: 453732 - DNA, 25 bp, Homo sapien
caggttcatcaagactttcacagag

SEQ ID NO: 453733 - DNA, 25 bp, Homo sapien
atttggatccaaatctagtgataaa

SEQ ID NO: 453734 - DNA, 25 bp, Homo sapien
aatctagtgataaaagtgtccaagc

SEQ ID NO: 453735 - DNA, 25 bp, Homo sapien
ctagtgataaaagtgtccaagcaat

SEQ ID NO: 453736 - DNA, 25 bp, Homo sapien
aaaagtgtccaagcaatcaaaaagt

SEQ ID NO: 453737 - DNA, 25 bp, Homo sapien
gtgtccaagcaatcaaaaagtaaga

SEQ ID NO: 453738 - DNA, 25 bp, Homo sapien
gtaagatattttagggacataccaa

SEQ ID NO: 453739 - DNA, 25 bp, Homo sapien
agatattttagggacataccaacat

SEQ ID NO: 453740 - DNA, 25 bp, Homo sapien
tattttagggacataccaacatctt

SEQ ID NO: 453741 - DNA, 25 bp, Homo sapien
tatttacccctaaatggtccattct

SEQ ID NO: 453742 - DNA, 25 bp, Homo sapien
atggtccattctgcattgtatttca

SEQ ID NO: 453743 - DNA, 25 bp, Homo sapien
tctgcattgtatttcaggctggaaa

SEQ ID NO: 453744 - DNA, 25 bp, Homo sapien
atgaattattctttaccagttttga

SEQ ID NO: 453745 - DNA, 25 bp, Homo sapien
cctaaggtaacttggaagctgtgta

SEQ ID NO: 453746 - DNA, 25 bp, Homo sapien
agtaaatatctttgtggtcacccac

SEQ ID NO: 453747 - DNA, 25 bp, Homo sapien
atctttgtggtcacccacattgggt

SEQ ID NO: 453748 - DNA, 25 bp, Homo sapien
acccacattgggtgagacagaaaat

SEQ ID NO: 453749 - DNA, 25 bp, Homo sapien
ttgtaatttgctaacttgatttgag

SEQ ID NO: 453750 - DNA, 25 bp, Homo sapien
aactggtacagtgttctgcttgatt

SEQ ID NO: 453751 - DNA, 25 bp, Homo sapien
gtgttctgcttgatttacaacatgt

SEQ ID NO: 453752 - DNA, 25 bp, Homo sapien
atgttaccgtatattcacaaaagaa

SEQ ID NO: 453753 - DNA, 25 bp, Homo sapien
ttacaaggtttcagaggtagccaat

SEQ ID NO: 453754 - DNA, 25 bp, Homo sapien
tactgtactgtttcaatgtgttaag

SEQ ID NO: 453755 - DNA, 25 bp, Homo sapien
taagtctagattcattattttcctg

SEQ ID NO: 453756 - DNA, 25 bp, Homo sapien
agattcattattttcctgacatata

SEQ ID NO: 453757 - DNA, 25 bp, Homo sapien
gatatctactgtatgctattgtgat

SEQ ID NO: 453758 - DNA, 25 bp, Homo sapien
gtgatagttttatgaaatgcttaca

SEQ ID NO: 453759 - DNA, 25 bp, Homo sapien
tgtaaatttcagaagctcttttttc

SEQ ID NO: 453760 - DNA, 25 bp, Homo sapien
ctacccaccagtaccttaatcattg

SEQ ID NO: 453761 - DNA, 25 bp, Homo sapien
gtaccttaatcattggtttatcaca

SEQ ID NO: 453762 - DNA, 25 bp, Homo sapien
ggtttatcacattggattcaaattc

SEQ ID NO: 453763 - DNA, 25 bp, Homo sapien
gggccctacatgctgttaaggttgt

SEQ ID NO: 453764 - DNA, 25 bp, Homo sapien
tggttaggaatggtgcaatgctgca

SEQ ID NO: 453765 - DNA, 25 bp, Homo sapien
gaacaaagctacaccaaggaacaga

SEQ ID NO: 453766 - DNA, 25 bp, Homo sapien
gaggaggccttaaatgctttgagct

SEQ ID NO: 453767 - DNA, 25 bp, Homo sapien
aatgctttgagcttttgccttcagt

SEQ ID NO: 453768 - DNA, 25 bp, Homo sapien
ttttgccttcagtctaaagctgtag

SEQ ID NO: 453769 - DNA, 25 bp, Homo sapien
aagagcttaggctgaccacagggaa

SEQ ID NO: 453770 - DNA, 25 bp, Homo sapien
gaccacagggaagtttacaagctag

SEQ ID NO: 453771 - DNA, 25 bp, Homo sapien
aagctagagcgaatatctggactgc

SEQ ID NO: 453772 - DNA, 25 bp, Homo sapien
atctggactgctaatatctgacaac

SEQ ID NO: 453773 - DNA, 25 bp, Homo sapien
atctgacaacagtaggcgaaattta

SEQ ID NO: 453774 - DNA, 25 bp, Homo sapien
ctggaacagttttcgttaagtatag

SEQ ID NO: 453775 - DNA, 25 bp, Homo sapien
ttctgtgtcaggtatagggctggac

SEQ ID NO: 453776 - DNA, 25 bp, Homo sapien
ggatggtaaattactctatttaaag

SEQ ID NO: 453777 - DNA, 25 bp, Homo sapien
actctatttaaagtaggtcttgtgt

SEQ ID NO: 453778 - DNA, 25 bp, Homo sapien
ctatttaaagtaggtcttgtgttct

SEQ ID NO: 453779 - DNA, 25 bp, Homo sapien
aaagtaggtcttgtgttctaataat

SEQ ID NO: 453780 - DNA, 25 bp, Homo sapien
gtaggtcttgtgttctaataatgtt

SEQ ID NO: 453781 - DNA, 25 bp, Homo sapien
aggtcttgtgttctaataatgttta

SEQ ID NO: 453782 - DNA, 25 bp, Homo sapien
ggtcttgtgttctaataatgtttac

SEQ ID NO: 453783 - DNA, 25 bp, Homo sapien
acaatcttgctcaatcactctgtcg

SEQ ID NO: 453784 - DNA, 25 bp, Homo sapien
tgctcaatcactctgtcgtttataa

SEQ ID NO: 453785 - DNA, 25 bp, Homo sapien
gggaagtcacgggcgtgctctttct

SEQ ID NO: 453786 - DNA, 25 bp, Homo sapien
acatcttccttgtcttttcagcttg

SEQ ID NO: 453787 - DNA, 25 bp, Homo sapien
tccttgtcttttcagcttgggaaaa

SEQ ID NO: 453788 - DNA, 25 bp, Homo sapien
aaggcatggaatgcccacagtggtc

SEQ ID NO: 453789 - DNA, 25 bp, Homo sapien
tgcccacagtggtcagttcaaagaa

SEQ ID NO: 453790 - DNA, 25 bp, Homo sapien
cagttcaaagaacaaacgtgcaatt

SEQ ID NO: 453791 - DNA, 25 bp, Homo sapien
attaaaaaactgtagtcagccaggc

SEQ ID NO: 453792 - DNA, 25 bp, Homo sapien
gggatttatcattctatgtctacct

SEQ ID NO: 453793 - DNA, 25 bp, Homo sapien
cattctatgtctaccttttcttgag

SEQ ID NO: 453794 - DNA, 25 bp, Homo sapien
gtctaccttttcttgagtacagctt

SEQ ID NO: 453795 - DNA, 25 bp, Homo sapien
tgagtacagctttgatatgcacctg

SEQ ID NO: 453796 - DNA, 25 bp, Homo sapien
aagcctatttcttgactgtcagcct

SEQ ID NO: 453797 - DNA, 25 bp, Homo sapien
tgactgtcagcctgttctcttgaaa

SEQ ID NO: 453798 - DNA, 25 bp, Homo sapien
gtcagcctgttctcttgaaactaca

SEQ ID NO: 453799 - DNA, 25 bp, Homo sapien
gcctgttctcttgaaactacaatat

SEQ ID NO: 453800 - DNA, 25 bp, Homo sapien
acaatatatgttgctttaaggtatc

SEQ ID NO: 453801 - DNA, 25 bp, Homo sapien
gtaactattttctcttagctggtag

SEQ ID NO: 453802 - DNA, 25 bp, Homo sapien
ttttctcttagctggtagtggatga

SEQ ID NO: 453803 - DNA, 25 bp, Homo sapien
gctggtagtggatgataattccatt

SEQ ID NO: 453804 - DNA, 25 bp, Homo sapien
gaaatacttctctacaactatcctc

SEQ ID NO: 453805 - DNA, 25 bp, Homo sapien
aactatcctctctcaactctgaggc

SEQ ID NO: 453806 - DNA, 25 bp, Homo sapien
ctgaggctcctagataaacaataat

SEQ ID NO: 453807 - DNA, 25 bp, Homo sapien
tccggggatcgctctgcagagagaa

SEQ ID NO: 453808 - DNA, 25 bp, Homo sapien
ctcacactggatgcgcaggttcttg

SEQ ID NO: 453809 - DNA, 25 bp, Homo sapien
gcaggttcttggtcccagactgggt

SEQ ID NO: 453810 - DNA, 25 bp, Homo sapien
gttcttggtcccagactgggtcttg

SEQ ID NO: 453811 - DNA, 25 bp, Homo sapien
gatcagaaaggtgccggcgggctcg

SEQ ID NO: 453812 - DNA, 25 bp, Homo sapien
tcggcactgagcagcaggttcgcct

SEQ ID NO: 453813 - DNA, 25 bp, Homo sapien
gcactgagcagcaggttcgcctcgc

SEQ ID NO: 453814 - DNA, 25 bp, Homo sapien
gcggcatgtagtggtgcaccagctt

SEQ ID NO: 453815 - DNA, 25 bp, Homo sapien
catgtagtggtgcaccagcttgagc

SEQ ID NO: 453816 - DNA, 25 bp, Homo sapien
gcaccagcttgagcacgcagtcgaa

SEQ ID NO: 453817 - DNA, 25 bp, Homo sapien
ccagcttgagcacgcagtcgaagcg

SEQ ID NO: 453818 - DNA, 25 bp, Homo sapien
atgactttcaatacttcccctgaag

SEQ ID NO: 453819 - DNA, 25 bp, Homo sapien
aaatgtctgttttgaggaaagggct

SEQ ID NO: 453820 - DNA, 25 bp, Homo sapien
ggaaagggctttgaattccccagat

SEQ ID NO: 453821 - DNA, 25 bp, Homo sapien
gaattccccagatactgaacaattt

SEQ ID NO: 453822 - DNA, 25 bp, Homo sapien
gtgtttgtgactgatggagaatttc

SEQ ID NO: 453823 - DNA, 25 bp, Homo sapien
gagaaagcctttgcgaaactatgca

SEQ ID NO: 453824 - DNA, 25 bp, Homo sapien
atgcaacagtttacatcagtcatgt

SEQ ID NO: 453825 - DNA, 25 bp, Homo sapien
tgaagaccaaattattctcctgttg

SEQ ID NO: 453826 - DNA, 25 bp, Homo sapien
ttattctcctgttgaggtccgtgga

SEQ ID NO: 453827 - DNA, 25 bp, Homo sapien
tgggcttgcgtttctctcctctagt

SEQ ID NO: 453828 - DNA, 25 bp, Homo sapien
gcgtttctctcctctagtgggtggg

SEQ ID NO: 453829 - DNA, 25 bp, Homo sapien
aagcctttaattgagagccgctctc

SEQ ID NO: 453830 - DNA, 25 bp, Homo sapien
agagccgctctctgtaagtgtttgc

SEQ ID NO: 453831 - DNA, 25 bp, Homo sapien
ccgctctctgtaagtgtttgcttgt

SEQ ID NO: 453832 - DNA, 25 bp, Homo sapien
ttgtgcaaaagggaatagtgccgtg

SEQ ID NO: 453833 - DNA, 25 bp, Homo sapien
tgtgtgtgtccatggcatccggagc

SEQ ID NO: 453834 - DNA, 25 bp, Homo sapien
gcatccggagcgaggcgactgtcct

SEQ ID NO: 453835 - DNA, 25 bp, Homo sapien
gactgtcctgcgtgggtagccctcg

SEQ ID NO: 453836 - DNA, 25 bp, Homo sapien
gagtgaggccaccaaccaaagtcag

SEQ ID NO: 453837 - DNA, 25 bp, Homo sapien
tgaggccaccaaccaaagtcagttc

SEQ ID NO: 453838 - DNA, 25 bp, Homo sapien
aaagtcagttccttcccacctgtgt

SEQ ID NO: 453839 - DNA, 25 bp, Homo sapien
tcccacctgtgtttctgtttcgttt

SEQ ID NO: 453840 - DNA, 25 bp, Homo sapien
tgtccttcccatggcactcggttga

SEQ ID NO: 453841 - DNA, 25 bp, Homo sapien
ttcccatggcactcggttgacctgg

SEQ ID NO: 453842 - DNA, 25 bp, Homo sapien
gtgaggcctggtgtgcacagacact

SEQ ID NO: 453843 - DNA, 25 bp, Homo sapien
ggtgtgcacagacactctgccattg

SEQ ID NO: 453844 - DNA, 25 bp, Homo sapien
cagacactctgccattgctagaagg

SEQ ID NO: 453845 - DNA, 25 bp, Homo sapien
tgtgccccctgctaagatatcagta

SEQ ID NO: 453846 - DNA, 25 bp, Homo sapien
agatatcagtaggtccttcacagcc

SEQ ID NO: 453847 - DNA, 25 bp, Homo sapien
atatatacagtttatttagcttacg

SEQ ID NO: 453848 - DNA, 25 bp, Homo sapien
tagcttacgtaaacatttggtgcac

SEQ ID NO: 453849 - DNA, 25 bp, Homo sapien
gatcatgatgtctcttttgtggttt

SEQ ID NO: 453850 - DNA, 25 bp, Homo sapien
atgatgtctcttttgtggttttata

SEQ ID NO: 453851 - DNA, 25 bp, Homo sapien
gaatattcgttcatgttaacaatgt

SEQ ID NO: 453852 - DNA, 25 bp, Homo sapien
acaatgtagatctagttttcttttt

SEQ ID NO: 453853 - DNA, 25 bp, Homo sapien
tatgacatacacttgttgttataca

SEQ ID NO: 453854 - DNA, 25 bp, Homo sapien
tggtatgtaaagtcacgatggcaga

SEQ ID NO: 453855 - DNA, 25 bp, Homo sapien
agtcacgatggcagagatttttgaa

SEQ ID NO: 453856 - DNA, 25 bp, Homo sapien
attacatttacagcgtcagtgccca

SEQ ID NO: 453857 - DNA, 25 bp, Homo sapien
cagtgcccacttcaaggtttatgaa

SEQ ID NO: 453858 - DNA, 25 bp, Homo sapien
gtttatgaaaatttggatgcccaga

SEQ ID NO: 453859 - DNA, 25 bp, Homo sapien
ggatgcccagaaacaagtacttcgt

SEQ ID NO: 453860 - DNA, 25 bp, Homo sapien
acaagtacttcgtagttggaggaat

SEQ ID NO: 453861 - DNA, 25 bp, Homo sapien
aaaattctgtctgttgtgcagctta

SEQ ID NO: 453862 - DNA, 25 bp, Homo sapien
tttctctggatctgttatgaacacc

SEQ ID NO: 453863 - DNA, 25 bp, Homo sapien
ctgttatgaacacctttgttggctt

SEQ ID NO: 453864 - DNA, 25 bp, Homo sapien
gttatgaacacctttgttggcttgg

SEQ ID NO: 453865 - DNA, 25 bp, Homo sapien
tatgaacacctttgttggcttggtt

SEQ ID NO: 453866 - DNA, 25 bp, Homo sapien
atgaacacctttgttggcttggttc

SEQ ID NO: 453867 - DNA, 25 bp, Homo sapien
tgaacacctttgttggcttggttca

SEQ ID NO: 453868 - DNA, 25 bp, Homo sapien
gtcaaatgacttaattctgtatttt

SEQ ID NO: 453869 - DNA, 25 bp, Homo sapien
taacccggttcatgacagacccttg

SEQ ID NO: 453870 - DNA, 25 bp, Homo sapien
acccggttcatgacagacccttgga

SEQ ID NO: 453871 - DNA, 25 bp, Homo sapien
ccggttcatgacagacccttggact

SEQ ID NO: 453872 - DNA, 25 bp, Homo sapien
ggttcatgacagacccttggacttt

SEQ ID NO: 453873 - DNA, 25 bp, Homo sapien
gcttggttattgacttcctacccag

SEQ ID NO: 453874 - DNA, 25 bp, Homo sapien
tggttattgacttcctacccagcac

SEQ ID NO: 453875 - DNA, 25 bp, Homo sapien
tacccagcactcagttttattcact

SEQ ID NO: 453876 - DNA, 25 bp, Homo sapien
cagcactcagttttattcactgctg

SEQ ID NO: 453877 - DNA, 25 bp, Homo sapien
tatcctcagtgcctaggacgatgct

SEQ ID NO: 453878 - DNA, 25 bp, Homo sapien
ggacgatgcttggaacgtgattcat

SEQ ID NO: 453879 - DNA, 25 bp, Homo sapien
tgcttggaacgtgattcattgattc

SEQ ID NO: 453880 - DNA, 25 bp, Homo sapien
ggtaaatcagaggaacaagcaacat

SEQ ID NO: 453881 - DNA, 25 bp, Homo sapien
ttgttgtttcagaagtccagcatct

SEQ ID NO: 453882 - DNA, 25 bp, Homo sapien
gtccagcatctggtgcacttaacaa

SEQ ID NO: 453883 - DNA, 25 bp, Homo sapien
tcctacctgtgttgtaagtgttttg

SEQ ID NO: 453884 - DNA, 25 bp, Homo sapien
gggaagcccgcctgagcagtgtttt

SEQ ID NO: 453885 - DNA, 25 bp, Homo sapien
agcccgcctgagcagtgttttgaga

SEQ ID NO: 453886 - DNA, 25 bp, Homo sapien
gcagtgttttgagagtgcgtacatt

SEQ ID NO: 453887 - DNA, 25 bp, Homo sapien
agtgcgtacattggaggactgcccc

SEQ ID NO: 453888 - DNA, 25 bp, Homo sapien
gtacattggaggactgccccacgtc

SEQ ID NO: 453889 - DNA, 25 bp, Homo sapien
gaggactgccccacgtccgtttgca

SEQ ID NO: 453890 - DNA, 25 bp, Homo sapien
cgtccgtttgcactctgccttgcaa

SEQ ID NO: 453891 - DNA, 25 bp, Homo sapien
aaacttactgtggagacgtgcccca

SEQ ID NO: 453892 - DNA, 25 bp, Homo sapien
ggagacgtgccccagactggtctca

SEQ ID NO: 453893 - DNA, 25 bp, Homo sapien
tcagaccagagtttgtggcacagga

SEQ ID NO: 453894 - DNA, 25 bp, Homo sapien
attggaagcctgataatttcgggag

SEQ ID NO: 453895 - DNA, 25 bp, Homo sapien
gactgcttcacggactctttgctgt

SEQ ID NO: 453896 - DNA, 25 bp, Homo sapien
ctctttgctgttgacgttgatctcc

SEQ ID NO: 453897 - DNA, 25 bp, Homo sapien
gtagcatgaccttttggcctttgta

SEQ ID NO: 453898 - DNA, 25 bp, Homo sapien
tgtaagacacacagcctttctgtat

SEQ ID NO: 453899 - DNA, 25 bp, Homo sapien
ctttctgtatcaagcccctgtctaa

SEQ ID NO: 453900 - DNA, 25 bp, Homo sapien
tgtctaacctacgaccccagagtga

SEQ ID NO: 453901 - DNA, 25 bp, Homo sapien
aacctacgaccccagagtgactgac

SEQ ID NO: 453902 - DNA, 25 bp, Homo sapien
agtgactgacggctgtgtatttctg

SEQ ID NO: 453903 - DNA, 25 bp, Homo sapien
ctgacggctgtgtatttctgtagaa

SEQ ID NO: 453904 - DNA, 25 bp, Homo sapien
gtagaatgctgtagaatccggtttt

SEQ ID NO: 453905 - DNA, 25 bp, Homo sapien
atccggttttagttgagtcttcaca

SEQ ID NO: 453906 - DNA, 25 bp, Homo sapien
ttgattccaggtaaatcagaggaac

SEQ ID NO: 453907 - DNA, 25 bp, Homo sapien
ggtaaatcagaggaacaagcaacat

SEQ ID NO: 453908 - DNA, 25 bp, Homo sapien
gaggaacaagcaacatgaacagaaa

SEQ ID NO: 453909 - DNA, 25 bp, Homo sapien
gcagaagcataattgttgtttcaga

SEQ ID NO: 453910 - DNA, 25 bp, Homo sapien
ttgttgtttcagaagtccagcatct

SEQ ID NO: 453911 - DNA, 25 bp, Homo sapien
ttgtttcagaagtccagcatctggt

SEQ ID NO: 453912 - DNA, 25 bp, Homo sapien
agaagtccagcatctggtgcactta

SEQ ID NO: 453913 - DNA, 25 bp, Homo sapien
gtccagcatctggtgcacttaacaa

SEQ ID NO: 453914 - DNA, 25 bp, Homo sapien
gcatctggtgcacttaacaatagag

SEQ ID NO: 453915 - DNA, 25 bp, Homo sapien
ggtgcacttaacaatagagaatata

SEQ ID NO: 453916 - DNA, 25 bp, Homo sapien
gaatatattaaactctttccaaaat

SEQ ID NO: 453917 - DNA, 25 bp, Homo sapien
ttcaatctgacgttcggggcttcca

SEQ ID NO: 453918 - DNA, 25 bp, Homo sapien
aggccctggctattgggaccaacac

SEQ ID NO: 453919 - DNA, 25 bp, Homo sapien
tattgggaccaacactacctcagct

SEQ ID NO: 453920 - DNA, 25 bp, Homo sapien
aacactacctcagctggtcgatgct

SEQ ID NO: 453921 - DNA, 25 bp, Homo sapien
tcagctggtcgatgctcctgggtgt

SEQ ID NO: 453922 - DNA, 25 bp, Homo sapien
gatgctcctgggtgtgggcttccct

SEQ ID NO: 453923 - DNA, 25 bp, Homo sapien
tgtgggcttccctccagtggacggc

SEQ ID NO: 453924 - DNA, 25 bp, Homo sapien
agtggacggcttgtccccactagtc

SEQ ID NO: 453925 - DNA, 25 bp, Homo sapien
tccccactagtcctgggcatcatgg

SEQ ID NO: 453926 - DNA, 25 bp, Homo sapien
catcatggcagtggccctgggtgcc

SEQ ID NO: 453927 - DNA, 25 bp, Homo sapien
gcggcttggttctgctgctgcacca

SEQ ID NO: 453928 - DNA, 25 bp, Homo sapien
tactgtgctacagttagcctcaatg

SEQ ID NO: 453929 - DNA, 25 bp, Homo sapien
agttagcctcaatgaagattctatt

SEQ ID NO: 453930 - DNA, 25 bp, Homo sapien
acatcctgtcaatagtttgtcaagt

SEQ ID NO: 453931 - DNA, 25 bp, Homo sapien
agtttgtcaagtaacttcattgctt

SEQ ID NO: 453932 - DNA, 25 bp, Homo sapien
gtgaaattttttcccaagtgatatt

SEQ ID NO: 453933 - DNA, 25 bp, Homo sapien
ataggatgagtcttttatattggaa

SEQ ID NO: 453934 - DNA, 25 bp, Homo sapien
ggaaaattgccaaatcccttcttag

SEQ ID NO: 453935 - DNA, 25 bp, Homo sapien
ttgccaaatcccttcttagtatatt

SEQ ID NO: 453936 - DNA, 25 bp, Homo sapien
tagtatattttaagcaccctacaac

SEQ ID NO: 453937 - DNA, 25 bp, Homo sapien
ttaagcaccctacaacactttacct

SEQ ID NO: 453938 - DNA, 25 bp, Homo sapien
cctgcctttagtggtatttaaacat

SEQ ID NO: 453939 - DNA, 25 bp, Homo sapien
aactcccttacaccatgtcaaactt

SEQ ID NO: 453940 - DNA, 25 bp, Homo sapien
ttacaccatgtcaaacttaccttag

SEQ ID NO: 453941 - DNA, 25 bp, Homo sapien
aacttaccttagtgggacatcttca

SEQ ID NO: 453942 - DNA, 25 bp, Homo sapien
gaatgtgacacagtaaccaactcct

SEQ ID NO: 453943 - DNA, 25 bp, Homo sapien
gtaaccaactcctaatgataacatg

SEQ ID NO: 453944 - DNA, 25 bp, Homo sapien
acatgtgactattaaatctctctga

SEQ ID NO: 453945 - DNA, 25 bp, Homo sapien
taaatctctctgacagtttcttttt

SEQ ID NO: 453946 - DNA, 25 bp, Homo sapien
tcttttttaggtgatttccttcctg

SEQ ID NO: 453947 - DNA, 25 bp, Homo sapien
cttcctgccaggctccgttgtaggg

SEQ ID NO: 453948 - DNA, 25 bp, Homo sapien
ggttacagaacagtcgttcccgcct

SEQ ID NO: 453949 - DNA, 25 bp, Homo sapien
agaagagacgggaccagctgctggc

SEQ ID NO: 453950 - DNA, 25 bp, Homo sapien
tgggaggcgctcatcattgtccaca

SEQ ID NO: 453951 - DNA, 25 bp, Homo sapien
acgtggctggagacgttcaccggct

SEQ ID NO: 453952 - DNA, 25 bp, Homo sapien
tccagctccagcagggcgatgtccg

SEQ ID NO: 453953 - DNA, 25 bp, Homo sapien
agcagggcgatgtccgctccgatct

SEQ ID NO: 453954 - DNA, 25 bp, Homo sapien
tgtccgctccgatctgggcggtgta

SEQ ID NO: 453955 - DNA, 25 bp, Homo sapien
aactgtgggtgcacgatgatcctgc

SEQ ID NO: 453956 - DNA, 25 bp, Homo sapien
acgatgatcctgctgaccggcagca

SEQ ID NO: 453957 - DNA, 25 bp, Homo sapien
gtcctggtagtagaggtgctgctcc

SEQ ID NO: 453958 - DNA, 25 bp, Homo sapien
tagaggtgctgctcccgcagttgca

SEQ ID NO: 453959 - DNA, 25 bp, Homo sapien
agttgcaccggtcccacgcagtgcg

SEQ ID NO: 453960 - DNA, 25 bp, Homo sapien
tgcgctgcggtcagcacccactggg

SEQ ID NO: 453961 - DNA, 25 bp, Homo sapien
aaaaggtgacccatattaattgcat

SEQ ID NO: 453962 - DNA, 25 bp, Homo sapien
tattaattgcatggccttaaaaggc

SEQ ID NO: 453963 - DNA, 25 bp, Homo sapien
gcaggagtgtagcaagcatcatttt

SEQ ID NO: 453964 - DNA, 25 bp, Homo sapien
tttagatggctatggttcctcttcc

SEQ ID NO: 453965 - DNA, 25 bp, Homo sapien
ttccgcatctgtcagtagttcactt

SEQ ID NO: 453966 - DNA, 25 bp, Homo sapien
gtagttcacttatgttcagtcttag

SEQ ID NO: 453967 - DNA, 25 bp, Homo sapien
gttcagtcttagaacctactggagg

SEQ ID NO: 453968 - DNA, 25 bp, Homo sapien
tgaagtaatttctctgtctcgtgca

SEQ ID NO: 453969 - DNA, 25 bp, Homo sapien
tctctgtctcgtgcagaggcactaa

SEQ ID NO: 453970 - DNA, 25 bp, Homo sapien
ggcactaaggagctgagttacctct

SEQ ID NO: 453971 - DNA, 25 bp, Homo sapien
gagctgagttacctcttaatctggg

SEQ ID NO: 453972 - DNA, 25 bp, Homo sapien
agcacagccgagagacctgatctct

SEQ ID NO: 453973 - DNA, 25 bp, Homo sapien
gagagacctgatctctggattcagt

SEQ ID NO: 453974 - DNA, 25 bp, Homo sapien
gattcagtgcttttagctcttcgag

SEQ ID NO: 453975 - DNA, 25 bp, Homo sapien
ttagctcttcgagtttaccctaaga

SEQ ID NO: 453976 - DNA, 25 bp, Homo sapien
tcgagtttaccctaagataccttcg

SEQ ID NO: 453977 - DNA, 25 bp, Homo sapien
cctaagataccttcgggcaatattt

SEQ ID NO: 453978 - DNA, 25 bp, Homo sapien
aaaagctcttcaggtcatttctgaa

SEQ ID NO: 453979 - DNA, 25 bp, Homo sapien
gtgaatcttggcttggaacaccatt

SEQ ID NO: 453980 - DNA, 25 bp, Homo sapien
cttggcttggaacaccatttttggg

SEQ ID NO: 453981 - DNA, 25 bp, Homo sapien
ccatttttgggctcttgctactgaa

SEQ ID NO: 453982 - DNA, 25 bp, Homo sapien
tgggctcttgctactgaatgaatca

SEQ ID NO: 453983 - DNA, 25 bp, Homo sapien
tgtgaaatccagacccagacgtcct

SEQ ID NO: 453984 - DNA, 25 bp, Homo sapien
ctggcgggaggagctaccattactt

SEQ ID NO: 453985 - DNA, 25 bp, Homo sapien
aggagctaccattacttggtccgtt

SEQ ID NO: 453986 - DNA, 25 bp, Homo sapien
ttggtccgtttgtcagacgactgca

SEQ ID NO: 453987 - DNA, 25 bp, Homo sapien
acgactgcagtctttacttgtggcc

SEQ ID NO: 453988 - DNA, 25 bp, Homo sapien
ttgtggcctctgactgttctacagg

SEQ ID NO: 453989 - DNA, 25 bp, Homo sapien
agaagctgtagtcctgctggtactt

SEQ ID NO: 453990 - DNA, 25 bp, Homo sapien
gcagaggcctgagactgctgctgct

SEQ ID NO: 453991 - DNA, 25 bp, Homo sapien
gctgctggtactgagccaactgctg

SEQ ID NO: 453992 - DNA, 25 bp, Homo sapien
agaatggtactctgcataccctcta

SEQ ID NO: 453993 - DNA, 25 bp, Homo sapien
agttcatcctgactgcttttaagct

SEQ ID NO: 453994 - DNA, 25 bp, Homo sapien
gtggcgggcccacaaaagaggtgct

SEQ ID NO: 453995 - DNA, 25 bp, Homo sapien
gaaggttcacagtacgcggtttgtc

SEQ ID NO: 453996 - DNA, 25 bp, Homo sapien
gtacgcggtttgtccgaacgtcacg

SEQ ID NO: 453997 - DNA, 25 bp, Homo sapien
gaacgtcacggcttttattgggagt

SEQ ID NO: 453998 - DNA, 25 bp, Homo sapien
gtgccctgtcaggtgatcagaacat

SEQ ID NO: 453999 - DNA, 25 bp, Homo sapien
ggactcaacgtaaaataatcttctg

SEQ ID NO: 454000 - DNA, 25 bp, Homo sapien
aataatcttctggacccttctagga

SEQ ID NO: 454001 - DNA, 25 bp, Homo sapien
ttctggacccttctaggacgacatg

SEQ ID NO: 454002 - DNA, 25 bp, Homo sapien
ttctaggacgacatggccgtgaccg

SEQ ID NO: 454003 - DNA, 25 bp, Homo sapien
ggccgtgaccggtagtgctagaaac

SEQ ID NO: 454004 - DNA, 25 bp, Homo sapien
gtgctagaaaccagtcttcgagccc

SEQ ID NO: 454005 - DNA, 25 bp, Homo sapien
attcacttgcatgacgttactgcca

SEQ ID NO: 454006 - DNA, 25 bp, Homo sapien
gcatgacgttactgccaaatatgaa

SEQ ID NO: 454007 - DNA, 25 bp, Homo sapien
tttgtgccatggtgaaaactttgat

SEQ ID NO: 454008 - DNA, 25 bp, Homo sapien
aactttgatgtttgtctgtgttcat

SEQ ID NO: 454009 - DNA, 25 bp, Homo sapien
gtttgtctgtgttcattggatccat

SEQ ID NO: 454010 - DNA, 25 bp, Homo sapien
gtgttcattggatccatctttttaa

SEQ ID NO: 454011 - DNA, 25 bp, Homo sapien
aatgacattaccatgagtctgttgt

SEQ ID NO: 454012 - DNA, 25 bp, Homo sapien
gagtctgttgtcaaacctaaatatc

SEQ ID NO: 454013 - DNA, 25 bp, Homo sapien
gggactctatattgttgtagttcag

SEQ ID NO: 454014 - DNA, 25 bp, Homo sapien
gtagttcaggtcttcattgactaag

SEQ ID NO: 454015 - DNA, 25 bp, Homo sapien
aaaatattgttttcactgcaggaat

SEQ ID NO: 454016 - DNA, 25 bp, Homo sapien
agtactctgaaaagcaattgccctg

SEQ ID NO: 454017 - DNA, 25 bp, Homo sapien
gcaattgccctgtaacttatctaga

SEQ ID NO: 454018 - DNA, 25 bp, Homo sapien
ttgccctgtaacttatctagaaaga

SEQ ID NO: 454019 - DNA, 25 bp, Homo sapien
agaaagaaaagaccctgagactcca

SEQ ID NO: 454020 - DNA, 25 bp, Homo sapien
agaatctgctgttgccatagcccca

SEQ ID NO: 454021 - DNA, 25 bp, Homo sapien
ttgccatagccccatatgtgtgaat

SEQ ID NO: 454022 - DNA, 25 bp, Homo sapien
ccatagccccatatgtgtgaattct

SEQ ID NO: 454023 - DNA, 25 bp, Homo sapien
gtgaattctgcaactagccaaggct

SEQ ID NO: 454024 - DNA, 25 bp, Homo sapien
agccaaggctagttcctttcaattc

SEQ ID NO: 454025 - DNA, 25 bp, Homo sapien
tggctcatggcgtaatgggcctgcc

SEQ ID NO: 454026 - DNA, 25 bp, Homo sapien
gcgtaatgggcctgcccaatgcttt

SEQ ID NO: 454027 - DNA, 25 bp, Homo sapien
taaacttgtgccaaccatcaacaac

SEQ ID NO: 454028 - DNA, 25 bp, Homo sapien
caaccatcaacaacatctccataga

SEQ ID NO: 454029 - DNA, 25 bp, Homo sapien
atttattccaagttctcgtagaggc

SEQ ID NO: 454030 - DNA, 25 bp, Homo sapien
tcgtagaggcatatagatttcagtc

SEQ ID NO: 454031 - DNA, 25 bp, Homo sapien
gatttcagtctgtgcttgtatggga

SEQ ID NO: 454032 - DNA, 25 bp, Homo sapien
agatgatctgagtggctttctggcc

SEQ ID NO: 454033 - DNA, 25 bp, Homo sapien
aacatgtttgtgaggttattccact

SEQ ID NO: 454034 - DNA, 25 bp, Homo sapien
attccactagtactgtgatcacgtg

SEQ ID NO: 454035 - DNA, 25 bp, Homo sapien
atcacgtgggtgtcagtatctttaa

SEQ ID NO: 454036 - DNA, 25 bp, Homo sapien
gtcagtatctttaacggccttcatt

SEQ ID NO: 454037 - DNA, 25 bp, Homo sapien
atctttaacggccttcattcttggt

SEQ ID NO: 454038 - DNA, 25 bp, Homo sapien
agtgaggatgaagctctgcagcggg

SEQ ID NO: 454039 - DNA, 25 bp, Homo sapien
ggaaatgtccctggcagaaaccaaa

SEQ ID NO: 454040 - DNA, 25 bp, Homo sapien
accccaggttccaagttgtcaggag

SEQ ID NO: 454041 - DNA, 25 bp, Homo sapien
ccaggttccaagttgtcaggaggaa

SEQ ID NO: 454042 - DNA, 25 bp, Homo sapien
ggaagaagacctagctttagcacaa

SEQ ID NO: 454043 - DNA, 25 bp, Homo sapien
tttagcacaagcactgtcagccagt

SEQ ID NO: 454044 - DNA, 25 bp, Homo sapien
agcactgtcagccagtgaggcagaa

SEQ ID NO: 454045 - DNA, 25 bp, Homo sapien
gtgaggcagaataccagcggcagca

SEQ ID NO: 454046 - DNA, 25 bp, Homo sapien
aataccagcggcagcaggcccagag

SEQ ID NO: 454047 - DNA, 25 bp, Homo sapien
agagccgcagctcgaagccgtccaa

SEQ ID NO: 454048 - DNA, 25 bp, Homo sapien
ggttcacctgaggaggactgtggcc

SEQ ID NO: 454049 - DNA, 25 bp, Homo sapien
ggaatgcttgtgtctgtggaaccca

SEQ ID NO: 454050 - DNA, 25 bp, Homo sapien
gtggaacccaagcatgtggcatgct

SEQ ID NO: 454051 - DNA, 25 bp, Homo sapien
tgaattcatctgtgcgtgaggccgc

SEQ ID NO: 454052 - DNA, 25 bp, Homo sapien
gtgaggccgcacgtttgacgcatct

SEQ ID NO: 454053 - DNA, 25 bp, Homo sapien
tgacgcatctccaccaacataggga

SEQ ID NO: 454054 - DNA, 25 bp, Homo sapien
aacatagggattgcttcccggcatg

SEQ ID NO: 454055 - DNA, 25 bp, Homo sapien
aggaaacttcacttaactatcaata

SEQ ID NO: 454056 - DNA, 25 bp, Homo sapien
gcacaaaatcgaattgaccacctgg

SEQ ID NO: 454057 - DNA, 25 bp, Homo sapien
gaccacctggaacaaatgcagctga

SEQ ID NO: 454058 - DNA, 25 bp, Homo sapien
gctgataccattaaaaacacaccat

SEQ ID NO: 454059 - DNA, 25 bp, Homo sapien
cacaccatacagatcttttagtttt

SEQ ID NO: 454060 - DNA, 25 bp, Homo sapien
gctatgcccaggtgcgtcgggcaca

SEQ ID NO: 454061 - DNA, 25 bp, Homo sapien
atggccagaagatagcctgccttgt

SEQ ID NO: 454062 - DNA, 25 bp, Homo sapien
aagatagcctgccttgtgctggcca

SEQ ID NO: 454063 - DNA, 25 bp, Homo sapien
agatcagcctcttctacattttcaa

SEQ ID NO: 454064 - DNA, 25 bp, Homo sapien
gcctcttctacattttcaatttcct

SEQ ID NO: 454065 - DNA, 25 bp, Homo sapien
aatttcctcaagtacaccctctggc

SEQ ID NO: 454066 - DNA, 25 bp, Homo sapien
cagcctagccttcaagtggtgtgag

SEQ ID NO: 454067 - DNA, 25 bp, Homo sapien
ccttcaagtggtgtgagcggcctga

SEQ ID NO: 454068 - DNA, 25 bp, Homo sapien
cggcctgagtggatacacgtggata

SEQ ID NO: 454069 - DNA, 25 bp, Homo sapien
atacacgtggatagccggccctttg

SEQ ID NO: 454070 - DNA, 25 bp, Homo sapien
tttgcctccctgagccgtgactcag

SEQ ID NO: 454071 - DNA, 25 bp, Homo sapien
tttttctgtacctcatgcctatctg

SEQ ID NO: 454072 - DNA, 25 bp, Homo sapien
acctcatgcctatctggtaatgttt

SEQ ID NO: 454073 - DNA, 25 bp, Homo sapien
gcctatctggtaatgtttaatgggt

SEQ ID NO: 454074 - DNA, 25 bp, Homo sapien
tatttctctttgagggtggctttct

SEQ ID NO: 454075 - DNA, 25 bp, Homo sapien
tctggaacattggttagagcagctt

SEQ ID NO: 454076 - DNA, 25 bp, Homo sapien
tagagcagctttgttgtcgtgtttc

SEQ ID NO: 454077 - DNA, 25 bp, Homo sapien
ttgttgtcgtgtttctggattctct

SEQ ID NO: 454078 - DNA, 25 bp, Homo sapien
tctcttccccattttgcgtaaatat

SEQ ID NO: 454079 - DNA, 25 bp, Homo sapien
tggtcttatatattcttgcctattt

SEQ ID NO: 454080 - DNA, 25 bp, Homo sapien
ttgcctattttgtggcatatgccac

SEQ ID NO: 454081 - DNA, 25 bp, Homo sapien
gatatagacaagtactaccttttca

SEQ ID NO: 454082 - DNA, 25 bp, Homo sapien
tggtcagcacttgttattggcctat

SEQ ID NO: 454083 - DNA, 25 bp, Homo sapien
gttattggcctatgaactaaaagca

SEQ ID NO: 454084 - DNA, 25 bp, Homo sapien
aaatcaaagctcatcagttcccata

SEQ ID NO: 454085 - DNA, 25 bp, Homo sapien
gatttggttgccatagtcataagca

SEQ ID NO: 454086 - DNA, 25 bp, Homo sapien
tttcctcagtacaattttgctggcc

SEQ ID NO: 454087 - DNA, 25 bp, Homo sapien
ttttgctggccttaactggtatcaa

SEQ ID NO: 454088 - DNA, 25 bp, Homo sapien
ttaactggtatcaaacgctgtcatt

SEQ ID NO: 454089 - DNA, 25 bp, Homo sapien
aacgctgtcattgagatgttttcaa

SEQ ID NO: 454090 - DNA, 25 bp, Homo sapien
acattgagttgtatttaatcagcgt

SEQ ID NO: 454091 - DNA, 25 bp, Homo sapien
taatcagcgtgtactccatttgcat

SEQ ID NO: 454092 - DNA, 25 bp, Homo sapien
cgtgtactccatttgcattgaagca

SEQ ID NO: 454093 - DNA, 25 bp, Homo sapien
gacttcctgatggtgagtagcccga

SEQ ID NO: 454094 - DNA, 25 bp, Homo sapien
tcctgatggtgagtagcccgaggct

SEQ ID NO: 454095 - DNA, 25 bp, Homo sapien
tgagtagcccgaggctgcaagatga

SEQ ID NO: 454096 - DNA, 25 bp, Homo sapien
aggctgcaagatgagtaactccaga

SEQ ID NO: 454097 - DNA, 25 bp, Homo sapien
acacagctgtccactaccttacaca

SEQ ID NO: 454098 - DNA, 25 bp, Homo sapien
taccttacacagcttctcctgcatc

SEQ ID NO: 454099 - DNA, 25 bp, Homo sapien
tacttgatgcatgttagaataataa

SEQ ID NO: 454100 - DNA, 25 bp, Homo sapien
aataagtgtctttggtacagcccat

SEQ ID NO: 454101 - DNA, 25 bp, Homo sapien
taagtgtctttggtacagcccatat

SEQ ID NO: 454102 - DNA, 25 bp, Homo sapien
gtacagcccatatctatccaaaagt

SEQ ID NO: 454103 - DNA, 25 bp, Homo sapien
gcccatatctatccaaaagtgagct

SEQ ID NO: 454104 - DNA, 25 bp, Homo sapien
acactgtcttgggatcttgctgaga

SEQ ID NO: 454105 - DNA, 25 bp, Homo sapien
gtcttgggatcttgctgagaattca

SEQ ID NO: 454106 - DNA, 25 bp, Homo sapien
gaattcagactgctcgaaacagtga

SEQ ID NO: 454107 - DNA, 25 bp, Homo sapien
gaaacagtgacaaaccccagccatc

SEQ ID NO: 454108 - DNA, 25 bp, Homo sapien
cagtcattcgtggagcacaatttgg

SEQ ID NO: 454109 - DNA, 25 bp, Homo sapien
aaatacccaaattcttcatggttct

SEQ ID NO: 454110 - DNA, 25 bp, Homo sapien
gggcatctgtcccattcagagaacc

SEQ ID NO: 454111 - DNA, 25 bp, Homo sapien
ttcagagaaccttggcagtgcgatg

SEQ ID NO: 454112 - DNA, 25 bp, Homo sapien
agtgcgatggccactgttcccaggc

SEQ ID NO: 454113 - DNA, 25 bp, Homo sapien
tgttcccaggcttcaacctcagtga

SEQ ID NO: 454114 - DNA, 25 bp, Homo sapien
aacaactccccatggagagtccctg

SEQ ID NO: 454115 - DNA, 25 bp, Homo sapien
atgagcggcgtctgtgtagggaccc

SEQ ID NO: 454116 - DNA, 25 bp, Homo sapien
tggtgtgctcccaggactggcatga

SEQ ID NO: 454117 - DNA, 25 bp, Homo sapien
tgctcccaggactggcatgacaggt

SEQ ID NO: 454118 - DNA, 25 bp, Homo sapien
aggactggcatgacaggtgtctcct

SEQ ID NO: 454119 - DNA, 25 bp, Homo sapien
tggcatgacaggtgtctcctcctca

SEQ ID NO: 454120 - DNA, 25 bp, Homo sapien
cctgtgcagaccagtgggcaaggca

SEQ ID NO: 454121 - DNA, 25 bp, Homo sapien
gatctcaggccagccgtttgtgctc

SEQ ID NO: 454122 - DNA, 25 bp, Homo sapien
agccgtttgtgctcctagcagggtt

SEQ ID NO: 454123 - DNA, 25 bp, Homo sapien
tttgtgctcctagcagggttgctgt

SEQ ID NO: 454124 - DNA, 25 bp, Homo sapien
acggagaggccctagagagcctcat

SEQ ID NO: 454125 - DNA, 25 bp, Homo sapien
gagagcctcatggattgtaactaaa

SEQ ID NO: 454126 - DNA, 25 bp, Homo sapien
gatccgagagtttagatgaggcaaa

SEQ ID NO: 454127 - DNA, 25 bp, Homo sapien
aatggcttcaggtagtcggtaaaat

SEQ ID NO: 454128 - DNA, 25 bp, Homo sapien
atttgaacaggtagaatcagctagg

SEQ ID NO: 454129 - DNA, 25 bp, Homo sapien
gagtgaatatcctaggcaaatgcag

SEQ ID NO: 454130 - DNA, 25 bp, Homo sapien
aaggacagagtgatttgtaggcctc

SEQ ID NO: 454131 - DNA, 25 bp, Homo sapien
gatttgtaggcctcttatctcacac

SEQ ID NO: 454132 - DNA, 25 bp, Homo sapien
ggcctcttatctcacactcttgaaa

SEQ ID NO: 454133 - DNA, 25 bp, Homo sapien
gggtctaccctcagtgcagtgttca

SEQ ID NO: 454134 - DNA, 25 bp, Homo sapien
taccctcagtgcagtgttcagaaat

SEQ ID NO: 454135 - DNA, 25 bp, Homo sapien
aaagttacctgtcttatctgcacaa

SEQ ID NO: 454136 - DNA, 25 bp, Homo sapien
acctgtcttatctgcacaatgaatt

SEQ ID NO: 454137 - DNA, 25 bp, Homo sapien
tccatttcctctgaagaagctaggg

SEQ ID NO: 454138 - DNA, 25 bp, Homo sapien
gacataagggtctgctaaagaaagt

SEQ ID NO: 454139 - DNA, 25 bp, Homo sapien
gttgacagactcttgttttctggag

SEQ ID NO: 454140 - DNA, 25 bp, Homo sapien
ttttctggaggttaaccttgtctct

SEQ ID NO: 454141 - DNA, 25 bp, Homo sapien
gttaaccttgtctctggtccaaatt

SEQ ID NO: 454142 - DNA, 25 bp, Homo sapien
ggttcatagaattttgtccacaatc

SEQ ID NO: 454143 - DNA, 25 bp, Homo sapien
tgtccacaatctgttatgaaccctg

SEQ ID NO: 454144 - DNA, 25 bp, Homo sapien
tatgaaccctggactggtgagcctt

SEQ ID NO: 454145 - DNA, 25 bp, Homo sapien
gactggtgagccttgttatctgtgg

SEQ ID NO: 454146 - DNA, 25 bp, Homo sapien
gttatctgtggccaacctagggaat

SEQ ID NO: 454147 - DNA, 25 bp, Homo sapien
tgtggccaacctagggaattttaat

SEQ ID NO: 454148 - DNA, 25 bp, Homo sapien
ggaaacgccatgtagtaatgcctga

SEQ ID NO: 454149 - DNA, 25 bp, Homo sapien
taatgcctgagatagtcgatggttc

SEQ ID NO: 454150 - DNA, 25 bp, Homo sapien
atagtcgatggttcttaccacctca

SEQ ID NO: 454151 - DNA, 25 bp, Homo sapien
tggttcttaccacctcactaatttt

SEQ ID NO: 454152 - DNA, 25 bp, Homo sapien
gtatgaaatgctcattctattgccc

SEQ ID NO: 454153 - DNA, 25 bp, Homo sapien
attctattgcccaactggtgctctc

SEQ ID NO: 454154 - DNA, 25 bp, Homo sapien
tggtgctctctgtttaaagttacag

SEQ ID NO: 454155 - DNA, 25 bp, Homo sapien
agatcttgcgaaactggaactattt

SEQ ID NO: 454156 - DNA, 25 bp, Homo sapien
gttcttagtctgttagtggctgtcc

SEQ ID NO: 454157 - DNA, 25 bp, Homo sapien
tagtggctgtcctgtagtgggaaat

SEQ ID NO: 454158 - DNA, 25 bp, Homo sapien
taaaaggattcttcactcccttctc

SEQ ID NO: 454159 - DNA, 25 bp, Homo sapien
ttgccaacaacctccggggctgcgg

SEQ ID NO: 454160 - DNA, 25 bp, Homo sapien
gggctgcggcttgtactgacctctt

SEQ ID NO: 454161 - DNA, 25 bp, Homo sapien
gctgcggcttgtactgacctcttgt

SEQ ID NO: 454162 - DNA, 25 bp, Homo sapien
tgcggcttgtactgacctcttgtcc

SEQ ID NO: 454163 - DNA, 25 bp, Homo sapien
ttgtactgacctcttgtcctgtata

SEQ ID NO: 454164 - DNA, 25 bp, Homo sapien
gtactgacctcttgtcctgtatagc

SEQ ID NO: 454165 - DNA, 25 bp, Homo sapien
actgacctcttgtcctgtatagcaa

SEQ ID NO: 454166 - DNA, 25 bp, Homo sapien
gacctcttgtcctgtatagcaacct

SEQ ID NO: 454167 - DNA, 25 bp, Homo sapien
atagcaacctattttgactgcttca

SEQ ID NO: 454168 - DNA, 25 bp, Homo sapien
gcaacctattttgactgcttcacgg

SEQ ID NO: 454169 - DNA, 25 bp, Homo sapien
aacctattttgactgcttcacggac

SEQ ID NO: 454170 - DNA, 25 bp, Homo sapien
gggagttgtgaaccagacatccaga

SEQ ID NO: 454171 - DNA, 25 bp, Homo sapien
gagttgtgaaccagacatccagacc

SEQ ID NO: 454172 - DNA, 25 bp, Homo sapien
agacctcctgaagggctcgtgcaga

SEQ ID NO: 454173 - DNA, 25 bp, Homo sapien
cctgaagggctcgtgcagacgtaca

SEQ ID NO: 454174 - DNA, 25 bp, Homo sapien
tcgtgcagacgtacaggcgggatct

SEQ ID NO: 454175 - DNA, 25 bp, Homo sapien
tgcagacgtacaggcgggatcttct

SEQ ID NO: 454176 - DNA, 25 bp, Homo sapien
cgtacaggcgggatcttctggaagt

SEQ ID NO: 454177 - DNA, 25 bp, Homo sapien
gaaagagccccaaactcgaggacct

SEQ ID NO: 454178 - DNA, 25 bp, Homo sapien
gagccccaaactcgaggacctattg

SEQ ID NO: 454179 - DNA, 25 bp, Homo sapien
aggacctattgctccccaagaataa

SEQ ID NO: 454180 - DNA, 25 bp, Homo sapien
attgctccccaagaataacatcttc

SEQ ID NO: 454181 - DNA, 25 bp, Homo sapien
cttaattattactactggttgaaca

SEQ ID NO: 454182 - DNA, 25 bp, Homo sapien
actggttgaacaattatttcttcca

SEQ ID NO: 454183 - DNA, 25 bp, Homo sapien
attttcttcctgcactactgtttgt

SEQ ID NO: 454184 - DNA, 25 bp, Homo sapien
tactgtttgtatttgatcctttgtc

SEQ ID NO: 454185 - DNA, 25 bp, Homo sapien
tttgatcctttgtctattcagtcac

SEQ ID NO: 454186 - DNA, 25 bp, Homo sapien
gaaattaaattgtcaagcctcttat

SEQ ID NO: 454187 - DNA, 25 bp, Homo sapien
caagcctcttattctgacttcaaag

SEQ ID NO: 454188 - DNA, 25 bp, Homo sapien
gaattaatgtatcttccaacaataa

SEQ ID NO: 454189 - DNA, 25 bp, Homo sapien
ttccaacaataaaatcacttctgat

SEQ ID NO: 454190 - DNA, 25 bp, Homo sapien
gaaaacctaaattgtggctatggat

SEQ ID NO: 454191 - DNA, 25 bp, Homo sapien
ggctatggatccaaagctgtttgtt

SEQ ID NO: 454192 - DNA, 25 bp, Homo sapien
gcctccgggcctcccctgagaccac

SEQ ID NO: 454193 - DNA, 25 bp, Homo sapien
cctgagaccacactcagcagtggct

SEQ ID NO: 454194 - DNA, 25 bp, Homo sapien
ctgagaccacactcagcagtggctt

SEQ ID NO: 454195 - DNA, 25 bp, Homo sapien
tgagaccacactcagcagtggcttc

SEQ ID NO: 454196 - DNA, 25 bp, Homo sapien
gaggagaatgaagacgtggtgcgag

SEQ ID NO: 454197 - DNA, 25 bp, Homo sapien
aggagaatgaagacgtggtgcgaga

SEQ ID NO: 454198 - DNA, 25 bp, Homo sapien
ggagaatgaagacgtggtgcgagat

SEQ ID NO: 454199 - DNA, 25 bp, Homo sapien
gagaatgaagacgtggtgcgagatg

SEQ ID NO: 454200 - DNA, 25 bp, Homo sapien
agaatgaagacgtggtgcgagatgc

SEQ ID NO: 454201 - DNA, 25 bp, Homo sapien
tgaagacgtggtgcgagatgcgctg

SEQ ID NO: 454202 - DNA, 25 bp, Homo sapien
gaagacgtggtgcgagatgcgctgc

SEQ ID NO: 454203 - DNA, 25 bp, Homo sapien
caggtctaaaaagcgacaggtccga

SEQ ID NO: 454204 - DNA, 25 bp, Homo sapien
acaggtccgagactgggtctgtcac

SEQ ID NO: 454205 - DNA, 25 bp, Homo sapien
ctgggcattttcaaagaggacattt

SEQ ID NO: 454206 - DNA, 25 bp, Homo sapien
tgcacttaacatacttcattacaga

SEQ ID NO: 454207 - DNA, 25 bp, Homo sapien
gatgggatggaatcagttctgcctg

SEQ ID NO: 454208 - DNA, 25 bp, Homo sapien
gttctgcctgggaaactaatccgaa

SEQ ID NO: 454209 - DNA, 25 bp, Homo sapien
aatccgaatcatttacctttctgta

SEQ ID NO: 454210 - DNA, 25 bp, Homo sapien
ttctgtattaaccttggcctgtcct

SEQ ID NO: 454211 - DNA, 25 bp, Homo sapien
taaccttggcctgtcctaaaaagag

SEQ ID NO: 454212 - DNA, 25 bp, Homo sapien
gagaacgactgtttcatcatgagtt

SEQ ID NO: 454213 - DNA, 25 bp, Homo sapien
catcatgagttgctctgagttttgt

SEQ ID NO: 454214 - DNA, 25 bp, Homo sapien
gattcatgaaaaatttacgtccaat

SEQ ID NO: 454215 - DNA, 25 bp, Homo sapien
catgaaaaatttacgtccaattatt

SEQ ID NO: 454216 - DNA, 25 bp, Homo sapien
gcaaatagttaatttcatttggctt

SEQ ID NO: 454217 - DNA, 25 bp, Homo sapien
atgtaatttaaaccctggcaaacat

SEQ ID NO: 454218 - DNA, 25 bp, Homo sapien
taatttaaaccctggcaaacattct

SEQ ID NO: 454219 - DNA, 25 bp, Homo sapien
taaaccctggcaaacattctttaga

SEQ ID NO: 454220 - DNA, 25 bp, Homo sapien
atattgatacaatttcacctctaaa

SEQ ID NO: 454221 - DNA, 25 bp, Homo sapien
ttgatacaatttcacctctaaaatg

SEQ ID NO: 454222 - DNA, 25 bp, Homo sapien
atggatttgaagaaatgcaacttta

SEQ ID NO: 454223 - DNA, 25 bp, Homo sapien
gaagaaatgcaactttatatcaaaa

SEQ ID NO: 454224 - DNA, 25 bp, Homo sapien
gcaactttatatcaaaaaatgtcat

SEQ ID NO: 454225 - DNA, 25 bp, Homo sapien
gatcaggctgagcatgtgccagtct

SEQ ID NO: 454226 - DNA, 25 bp, Homo sapien
tccctcaagaaacctatggagatga

SEQ ID NO: 454227 - DNA, 25 bp, Homo sapien
atagccatttataacgtacacagag

SEQ ID NO: 454228 - DNA, 25 bp, Homo sapien
gtacacagagcacaactgtggtgga

SEQ ID NO: 454229 - DNA, 25 bp, Homo sapien
gactcagggtgggtcttgacaacat

SEQ ID NO: 454230 - DNA, 25 bp, Homo sapien
cagggtgggtcttgacaacatccca

SEQ ID NO: 454231 - DNA, 25 bp, Homo sapien
cctggtggcgaaggaagtgctccca

SEQ ID NO: 454232 - DNA, 25 bp, Homo sapien
gtgctcccaggatcattgtcatgtc

SEQ ID NO: 454233 - DNA, 25 bp, Homo sapien
atcattgtcatgtcaccagagccca

SEQ ID NO: 454234 - DNA, 25 bp, Homo sapien
ggagctcacctcaaggaagccgagc

SEQ ID NO: 454235 - DNA, 25 bp, Homo sapien
tcaaggaagccgagctaatgagaca

SEQ ID NO: 454236 - DNA, 25 bp, Homo sapien
ttaaactgactcagtgacagctggg

SEQ ID NO: 454237 - DNA, 25 bp, Homo sapien
tggaatggcaagaacacttacaacc

SEQ ID NO: 454238 - DNA, 25 bp, Homo sapien
gaacacttacaaccaaactcatggg

SEQ ID NO: 454239 - DNA, 25 bp, Homo sapien
aaactcatgggctgctgcaatttga

SEQ ID NO: 454240 - DNA, 25 bp, Homo sapien
ctcatgggctgctgcaatttgaaga

SEQ ID NO: 454241 - DNA, 25 bp, Homo sapien
catattaaaatagttcagtgttcaa

SEQ ID NO: 454242 - DNA, 25 bp, Homo sapien
gtgtttatgtggatatttttctctt

SEQ ID NO: 454243 - DNA, 25 bp, Homo sapien
taaaccattaaaatacagtcatccc

SEQ ID NO: 454244 - DNA, 25 bp, Homo sapien
tcatcccttgtatacgctagggact

SEQ ID NO: 454245 - DNA, 25 bp, Homo sapien
gtatacgctagggactggttccagg

SEQ ID NO: 454246 - DNA, 25 bp, Homo sapien
ctagggactggttccagggccacac

SEQ ID NO: 454247 - DNA, 25 bp, Homo sapien
tcacctgcaaacaggcagtcctcag

SEQ ID NO: 454248 - DNA, 25 bp, Homo sapien
tcctcagctctggacttctggatca

SEQ ID NO: 454249 - DNA, 25 bp, Homo sapien
agctctggacttctggatcacgacg

SEQ ID NO: 454250 - DNA, 25 bp, Homo sapien
ggacttctggatcacgacgtcgata

SEQ ID NO: 454251 - DNA, 25 bp, Homo sapien
gatcacgacgtcgatatccttctga

SEQ ID NO: 454252 - DNA, 25 bp, Homo sapien
acgacgtcgatatccttctgaattc

SEQ ID NO: 454253 - DNA, 25 bp, Homo sapien
atatccttctgaattcggtcttgcc

SEQ ID NO: 454254 - DNA, 25 bp, Homo sapien
ttctgaattcggtcttgccttgaac

SEQ ID NO: 454255 - DNA, 25 bp, Homo sapien
gaattcggtcttgccttgaacacat

SEQ ID NO: 454256 - DNA, 25 bp, Homo sapien
tgccttgaacacatccccattaaat

SEQ ID NO: 454257 - DNA, 25 bp, Homo sapien
cacatccccattaaataaatccttg

SEQ ID NO: 454258 - DNA, 25 bp, Homo sapien
ggaagagcttaggaccaaaatattt

SEQ ID NO: 454259 - DNA, 25 bp, Homo sapien
gaagaggaaaccatagtagccataa

SEQ ID NO: 454260 - DNA, 25 bp, Homo sapien
tagtagccataaactttttccaagt

SEQ ID NO: 454261 - DNA, 25 bp, Homo sapien
gtaattgaagagttgtcctgcaaaa

SEQ ID NO: 454262 - DNA, 25 bp, Homo sapien
gaaacacctagtagactatcttggt

SEQ ID NO: 454263 - DNA, 25 bp, Homo sapien
ctatcttggtgagttactggtcagt

SEQ ID NO: 454264 - DNA, 25 bp, Homo sapien
cattcataaaatcttgctctgtttg

SEQ ID NO: 454265 - DNA, 25 bp, Homo sapien
tctgtttgcttgtcaatattggctt

SEQ ID NO: 454266 - DNA, 25 bp, Homo sapien
ttggcttagagggattcacaaatct

SEQ ID NO: 454267 - DNA, 25 bp, Homo sapien
tgtcccacaattacacttgtgctta

SEQ ID NO: 454268 - DNA, 25 bp, Homo sapien
acttgtgcttacaccatgaccaggg

SEQ ID NO: 454269 - DNA, 25 bp, Homo sapien
cctgcgcaggaacacatgttgctta

SEQ ID NO: 454270 - DNA, 25 bp, Homo sapien
gaaaagccaaatccagccttgtctc

SEQ ID NO: 454271 - DNA, 25 bp, Homo sapien
tcctctggtctcatgatgtgcatct

SEQ ID NO: 454272 - DNA, 25 bp, Homo sapien
gcatctgttaccttgaaactggaaa

SEQ ID NO: 454273 - DNA, 25 bp, Homo sapien
aaccagtctatcaatgtctgtgcca

SEQ ID NO: 454274 - DNA, 25 bp, Homo sapien
atcaatgtctgtgccaattttttat

SEQ ID NO: 454275 - DNA, 25 bp, Homo sapien
atgtgtgctgtctaatgatgggatg

SEQ ID NO: 454276 - DNA, 25 bp, Homo sapien
tgggatgaccacacttttccatgtt

SEQ ID NO: 454277 - DNA, 25 bp, Homo sapien
tccatgttctaaaagtgctcctctc

SEQ ID NO: 454278 - DNA, 25 bp, Homo sapien
ctggtggttgctttgggtctacagc

SEQ ID NO: 454279 - DNA, 25 bp, Homo sapien
ctttgggtctacagctacgtcttac

SEQ ID NO: 454280 - DNA, 25 bp, Homo sapien
tgaacagttcaagacagcatgggat

SEQ ID NO: 454281 - DNA, 25 bp, Homo sapien
ggatccaagttaatcactgaacctg

SEQ ID NO: 454282 - DNA, 25 bp, Homo sapien
gaacctgcagaaattatggcctaac

SEQ ID NO: 454283 - DNA, 25 bp, Homo sapien
atggcctaacttcctgagagaccga

SEQ ID NO: 454284 - DNA, 25 bp, Homo sapien
gagctagaagttgcagtagccccta

SEQ ID NO: 454285 - DNA, 25 bp, Homo sapien
agtagcccctactgctttagctttg

SEQ ID NO: 454286 - DNA, 25 bp, Homo sapien
tagctttggcctccaacgattctgt

SEQ ID NO: 454287 - DNA, 25 bp, Homo sapien
agatacagcactgtttctggcacgc

SEQ ID NO: 454288 - DNA, 25 bp, Homo sapien
ggcacgcctcgtgggcattttgaaa

SEQ ID NO: 454289 - DNA, 25 bp, Homo sapien
taacgtttcctcatgatttgccttt

SEQ ID NO: 454290 - DNA, 25 bp, Homo sapien
atgatttgcctttgtgtgtgatttt

SEQ ID NO: 454291 - DNA, 25 bp, Homo sapien
gagacagagtccaccctttgtgcaa

SEQ ID NO: 454292 - DNA, 25 bp, Homo sapien
agagtccaccctttgtgcaaggcga

SEQ ID NO: 454293 - DNA, 25 bp, Homo sapien
gtccaccctttgtgcaaggcgagaa

SEQ ID NO: 454294 - DNA, 25 bp, Homo sapien
ccctttgtgcaaggcgagaaccaat

SEQ ID NO: 454295 - DNA, 25 bp, Homo sapien
gagaaccaatgaatggactccttgt

SEQ ID NO: 454296 - DNA, 25 bp, Homo sapien
accaatgaatggactccttgtgtga

SEQ ID NO: 454297 - DNA, 25 bp, Homo sapien
gaatggactccttgtgtgaattatt

SEQ ID NO: 454298 - DNA, 25 bp, Homo sapien
ggactccttgtgtgaattattgcat

SEQ ID NO: 454299 - DNA, 25 bp, Homo sapien
tgtgtgaattattgcatcttcttcc

SEQ ID NO: 454300 - DNA, 25 bp, Homo sapien
tattgcatcttcttccaaagcaggt

SEQ ID NO: 454301 - DNA, 25 bp, Homo sapien
gcatcttcttccaaagcaggttcat

SEQ ID NO: 454302 - DNA, 25 bp, Homo sapien
aatgttatgctgttctttcatgtga

SEQ ID NO: 454303 - DNA, 25 bp, Homo sapien
tgctgttctttcatgtgaatgtcaa

SEQ ID NO: 454304 - DNA, 25 bp, Homo sapien
ttaatccttcttacacataatggtg

SEQ ID NO: 454305 - DNA, 25 bp, Homo sapien
gagcacttacaattgtatgtctcct

SEQ ID NO: 454306 - DNA, 25 bp, Homo sapien
caattgtatgtctcctcaaatgaaa

SEQ ID NO: 454307 - DNA, 25 bp, Homo sapien
aagacattgattccgcatgtaagga

SEQ ID NO: 454308 - DNA, 25 bp, Homo sapien
gtaaggatttttcatctgaagtaca

SEQ ID NO: 454309 - DNA, 25 bp, Homo sapien
taatgcacaatcagtgttgctcaaa

SEQ ID NO: 454310 - DNA, 25 bp, Homo sapien
gttgctcaaactgctttatacttat

SEQ ID NO: 454311 - DNA, 25 bp, Homo sapien
ttatacttataaacagccatcttaa

SEQ ID NO: 454312 - DNA, 25 bp, Homo sapien
gcaacgtattgtgagtactgatatg

SEQ ID NO: 454313 - DNA, 25 bp, Homo sapien
gtgtgaacatatctgatgctgcaat

SEQ ID NO: 454314 - DNA, 25 bp, Homo sapien
atgctgcaatgaaatgttacaagtt

SEQ ID NO: 454315 - DNA, 25 bp, Homo sapien
agttccttacttgtgctgatttttc

SEQ ID NO: 454316 - DNA, 25 bp, Homo sapien
gctgatttttcatcataactccttg

SEQ ID NO: 454317 - DNA, 25 bp, Homo sapien
tccttgacctcataaaagcggtgtc

SEQ ID NO: 454318 - DNA, 25 bp, Homo sapien
gtcaaaatctgacctggttcgcttt

SEQ ID NO: 454319 - DNA, 25 bp, Homo sapien
atctgacctggttcgctttgtgcct

SEQ ID NO: 454320 - DNA, 25 bp, Homo sapien
cctctgtcagcctacttacagtgat

SEQ ID NO: 454321 - DNA, 25 bp, Homo sapien
gtcagcctacttacagtgataaatg

SEQ ID NO: 454322 - DNA, 25 bp, Homo sapien
atgtacacacaagtccagtgttgcc

SEQ ID NO: 454323 - DNA, 25 bp, Homo sapien
cagtgttgccaaggagctttgttta

SEQ ID NO: 454324 - DNA, 25 bp, Homo sapien
ttttatcttttcagtacatagtgct

SEQ ID NO: 454325 - DNA, 25 bp, Homo sapien
agtgctgaaaaatctgcaacttctt

SEQ ID NO: 454326 - DNA, 25 bp, Homo sapien
gcaacttcttggatcatatttaatg

SEQ ID NO: 454327 - DNA, 25 bp, Homo sapien
atagtataatgcttgcaggcccagt

SEQ ID NO: 454328 - DNA, 25 bp, Homo sapien
gcaggcccagtacaagcatatatat

SEQ ID NO: 454329 - DNA, 25 bp, Homo sapien
tatatattgtgcctcttacagcctt

SEQ ID NO: 454330 - DNA, 25 bp, Homo sapien
gtgcctcttacagcctttggaatac

SEQ ID NO: 454331 - DNA, 25 bp, Homo sapien
tacagcctttggaatacattgtttc

SEQ ID NO: 454332 - DNA, 25 bp, Homo sapien
ttaatgctcatgtaccaaggttttg

SEQ ID NO: 454333 - DNA, 25 bp, Homo sapien
gctcatgtaccaaggttttgctata

SEQ ID NO: 454334 - DNA, 25 bp, Homo sapien
atttttcaactgtaaacttattctg

SEQ ID NO: 454335 - DNA, 25 bp, Homo sapien
tatttatgtaggatgtgtgctgtct

SEQ ID NO: 454336 - DNA, 25 bp, Homo sapien
atgtgtgctgtctaatgatgggatg

SEQ ID NO: 454337 - DNA, 25 bp, Homo sapien
atgatgggatgaccacacttttcca

SEQ ID NO: 454338 - DNA, 25 bp, Homo sapien
accacacttttccatgttctaaaag

SEQ ID NO: 454339 - DNA, 25 bp, Homo sapien
tccatgttctaaaagtgctcctctc

SEQ ID NO: 454340 - DNA, 25 bp, Homo sapien
ccatgttctaaaagtgctcctctcc

SEQ ID NO: 454341 - DNA, 25 bp, Homo sapien
ctggtggttgctttgggtctacagc

SEQ ID NO: 454342 - DNA, 25 bp, Homo sapien
tggttgctttgggtctacagctacg

SEQ ID NO: 454343 - DNA, 25 bp, Homo sapien
gttgctttgggtctacagctacgtc

SEQ ID NO: 454344 - DNA, 25 bp, Homo sapien
ctttgggtctacagctacgtcttac

SEQ ID NO: 454345 - DNA, 25 bp, Homo sapien
ttgggtctacagctacgtcttaccc

SEQ ID NO: 454346 - DNA, 25 bp, Homo sapien
gagcctggcaggaaggaaatcacct

SEQ ID NO: 454347 - DNA, 25 bp, Homo sapien
agcctggcaggaaggaaatcaccta

SEQ ID NO: 454348 - DNA, 25 bp, Homo sapien
gcctggcaggaaggaaatcacctaa

SEQ ID NO: 454349 - DNA, 25 bp, Homo sapien
cctggcaggaaggaaatcacctaaa

SEQ ID NO: 454350 - DNA, 25 bp, Homo sapien
tggcaggaaggaaatcacctaaaaa

SEQ ID NO: 454351 - DNA, 25 bp, Homo sapien
ttttaagagaagacgacgccttccg

SEQ ID NO: 454352 - DNA, 25 bp, Homo sapien
ttaagagaagacgacgccttccggg

SEQ ID NO: 454353 - DNA, 25 bp, Homo sapien
taagagaagacgacgccttccgggc

SEQ ID NO: 454354 - DNA, 25 bp, Homo sapien
agaagacgacgccttccgggcgcac

SEQ ID NO: 454355 - DNA, 25 bp, Homo sapien
gaagacgacgccttccgggcgcacg

SEQ ID NO: 454356 - DNA, 25 bp, Homo sapien
ccttccgggcgcacgccgagcagaa

SEQ ID NO: 454357 - DNA, 25 bp, Homo sapien
gcctgagcacgttcccgggtgccga

SEQ ID NO: 454358 - DNA, 25 bp, Homo sapien
tgagaccacactcagcagtggcttc

SEQ ID NO: 454359 - DNA, 25 bp, Homo sapien
cttcttcgttgctgtaattgaacgg

SEQ ID NO: 454360 - DNA, 25 bp, Homo sapien
attgaacgggtcgaggtgccaagct

SEQ ID NO: 454361 - DNA, 25 bp, Homo sapien
ggtcgaggtgccaagctcagcctca

SEQ ID NO: 454362 - DNA, 25 bp, Homo sapien
gtcgaggtgccaagctcagcctcac

SEQ ID NO: 454363 - DNA, 25 bp, Homo sapien
cgaggtgccaagctcagcctcacag

SEQ ID NO: 454364 - DNA, 25 bp, Homo sapien
agcagcgagccctgtgccacgcgct

SEQ ID NO: 454365 - DNA, 25 bp, Homo sapien
tgctccctctgccaggaggagaatg

SEQ ID NO: 454366 - DNA, 25 bp, Homo sapien
aagacgtggtgcgagatgcgctgca

SEQ ID NO: 454367 - DNA, 25 bp, Homo sapien
agatgcgctgcagcagaacccgggc

SEQ ID NO: 454368 - DNA, 25 bp, Homo sapien
gcaacaagtgggaccgccgctgccg

SEQ ID NO: 454369 - DNA, 25 bp, Homo sapien
ccgcgagcacagcagggtgcagcgt

SEQ ID NO: 454370 - DNA, 25 bp, Homo sapien
gtgcagcgtggtggcagaactggct

SEQ ID NO: 454371 - DNA, 25 bp, Homo sapien
agaactggctggtttctctttgccc

SEQ ID NO: 454372 - DNA, 25 bp, Homo sapien
tctttgccccagtggaaaccaggaa

SEQ ID NO: 454373 - DNA, 25 bp, Homo sapien
gagacccacaacttcaccaaaagac

SEQ ID NO: 454374 - DNA, 25 bp, Homo sapien
tgagtgggatccagcactcggcccc

SEQ ID NO: 454375 - DNA, 25 bp, Homo sapien
gcgcccctttcctccgagaagatca

SEQ ID NO: 454376 - DNA, 25 bp, Homo sapien
ccgactttctttgctggatgaccag

SEQ ID NO: 454377 - DNA, 25 bp, Homo sapien
ctttctttgctggatgaccagtgtt

SEQ ID NO: 454378 - DNA, 25 bp, Homo sapien
tgctggatgaccagtgtttggcaag

SEQ ID NO: 454379 - DNA, 25 bp, Homo sapien
ttcagaaacttttaccaaagtcacg

SEQ ID NO: 454380 - DNA, 25 bp, Homo sapien
cttttaccaaagtcacgattagctg

SEQ ID NO: 454381 - DNA, 25 bp, Homo sapien
tttaccaaagtcacgattagctgct

SEQ ID NO: 454382 - DNA, 25 bp, Homo sapien
taccaaagtcacgattagctgcttg

SEQ ID NO: 454383 - DNA, 25 bp, Homo sapien
accaaagtcacgattagctgcttgt

SEQ ID NO: 454384 - DNA, 25 bp, Homo sapien
caaagtcacgattagctgcttgtgg

SEQ ID NO: 454385 - DNA, 25 bp, Homo sapien
cagcttggggtgagttgaagacctc

SEQ ID NO: 454386 - DNA, 25 bp, Homo sapien
ggccctggccgcacaggatggcctt

SEQ ID NO: 454387 - DNA, 25 bp, Homo sapien
gccgcacaggatggccttcagggaa

SEQ ID NO: 454388 - DNA, 25 bp, Homo sapien
atggccttcagggaaggtggtcttg

SEQ ID NO: 454389 - DNA, 25 bp, Homo sapien
caggtgaccggagggaatcggtgac

SEQ ID NO: 454390 - DNA, 25 bp, Homo sapien
cttcacaagagggttgccaagaact

SEQ ID NO: 454391 - DNA, 25 bp, Homo sapien
gagggttgccaagaacttacacaag

SEQ ID NO: 454392 - DNA, 25 bp, Homo sapien
acaaagagatcaactgagggcagat

SEQ ID NO: 454393 - DNA, 25 bp, Homo sapien
gagggcagatatcagtattatcaaa

SEQ ID NO: 454394 - DNA, 25 bp, Homo sapien
tatcaaaggcagataccggagccaa

SEQ ID NO: 454395 - DNA, 25 bp, Homo sapien
gcagataccggagccaaagtggaga

SEQ ID NO: 454396 - DNA, 25 bp, Homo sapien
gaggacgaatccatgaaccaaccag

SEQ ID NO: 454397 - DNA, 25 bp, Homo sapien
actggctattagtcagtcacattta

SEQ ID NO: 454398 - DNA, 25 bp, Homo sapien
gtcacatttaatgactgcacttggt

SEQ ID NO: 454399 - DNA, 25 bp, Homo sapien
taatgactgcacttggtcacacaag

SEQ ID NO: 454400 - DNA, 25 bp, Homo sapien
gtcacacaagaccatccattagtga

SEQ ID NO: 454401 - DNA, 25 bp, Homo sapien
tacctggaacctgatcgatacgatg

SEQ ID NO: 454402 - DNA, 25 bp, Homo sapien
aggaaggcgaggagtccatcagctt

SEQ ID NO: 454403 - DNA, 25 bp, Homo sapien
gtccatcagcttggctgccattaaa

SEQ ID NO: 454404 - DNA, 25 bp, Homo sapien
tcgagaggaacgagccagaatctat

SEQ ID NO: 454405 - DNA, 25 bp, Homo sapien
cagaatctattcatcagacagtgat

SEQ ID NO: 454406 - DNA, 25 bp, Homo sapien
gtgatcctgaatgccaacgcacaga

SEQ ID NO: 454407 - DNA, 25 bp, Homo sapien
aagaacgtttgagggcttccatacg

SEQ ID NO: 454408 - DNA, 25 bp, Homo sapien
gcttccatacgtagggaatctcagc

SEQ ID NO: 454409 - DNA, 25 bp, Homo sapien
agggaatctcagcagcgccgaatga

SEQ ID NO: 454410 - DNA, 25 bp, Homo sapien
cagcagcgccgaatgagagagaaac

SEQ ID NO: 454411 - DNA, 25 bp, Homo sapien
gggctgagcgccagttacctggaac

SEQ ID NO: 454412 - DNA, 25 bp, Homo sapien
ctgggctggaactggcggatctcct

SEQ ID NO: 454413 - DNA, 25 bp, Homo sapien
tggaactggcggatctcctggaccc

SEQ ID NO: 454414 - DNA, 25 bp, Homo sapien
aggcaaccggactggcacctggacc

SEQ ID NO: 454415 - DNA, 25 bp, Homo sapien
acgatgacgatgaggccgcggctgc

SEQ ID NO: 454416 - DNA, 25 bp, Homo sapien
ccgcggctgctgaaatgcagcgctt

SEQ ID NO: 454417 - DNA, 25 bp, Homo sapien
tgaaatgcagcgcttctctgacctg

SEQ ID NO: 454418 - DNA, 25 bp, Homo sapien
gcttctctgacctgctgcaaaggct

SEQ ID NO: 454419 - DNA, 25 bp, Homo sapien
gcaaaggctgttaaacggtatcgga

SEQ ID NO: 454420 - DNA, 25 bp, Homo sapien
tgttaaacggtatcggaggctgcag

SEQ ID NO: 454421 - DNA, 25 bp, Homo sapien
agtgacagtggcagcgccgaaaaga

SEQ ID NO: 454422 - DNA, 25 bp, Homo sapien
aagaggcggagaaagtccccaggag

SEQ ID NO: 454423 - DNA, 25 bp, Homo sapien
tggctcatacgctacatgaggcacc

SEQ ID NO: 454424 - DNA, 25 bp, Homo sapien
atacgctacatgaggcaccagctca

SEQ ID NO: 454425 - DNA, 25 bp, Homo sapien
gaggcaccagctcatgtaggcactg

SEQ ID NO: 454426 - DNA, 25 bp, Homo sapien
accagctcatgtaggcactgtcagt

SEQ ID NO: 454427 - DNA, 25 bp, Homo sapien
agctcatgtaggcactgtcagttcc

SEQ ID NO: 454428 - DNA, 25 bp, Homo sapien
atgtaggcactgtcagttcctatgt

SEQ ID NO: 454429 - DNA, 25 bp, Homo sapien
gtaggcactgtcagttcctatgtgc

SEQ ID NO: 454430 - DNA, 25 bp, Homo sapien
tcagttcctatgtgccccacaggaa

SEQ ID NO: 454431 - DNA, 25 bp, Homo sapien
gtgccccacaggaaagcgcccttaa

SEQ ID NO: 454432 - DNA, 25 bp, Homo sapien
gaactattaaacttaccagcacttt

SEQ ID NO: 454433 - DNA, 25 bp, Homo sapien
tattaaacttaccagcactttcttt

SEQ ID NO: 454434 - DNA, 25 bp, Homo sapien
gcctgttgactcttgttattatcat

SEQ ID NO: 454435 - DNA, 25 bp, Homo sapien
gactcttgttattatcatgatattc

SEQ ID NO: 454436 - DNA, 25 bp, Homo sapien
tcatgatattcacaaaacgccgcat

SEQ ID NO: 454437 - DNA, 25 bp, Homo sapien
tgatattcacaaaacgccgcatgtt

SEQ ID NO: 454438 - DNA, 25 bp, Homo sapien
atattcacaaaacgccgcatgttta

SEQ ID NO: 454439 - DNA, 25 bp, Homo sapien
cacaaaacgccgcatgtttaaaaag

SEQ ID NO: 454440 - DNA, 25 bp, Homo sapien
agtcatagatgtcatcttctctctg

SEQ ID NO: 454441 - DNA, 25 bp, Homo sapien
gaggaaagccaccttctcttgcccc

SEQ ID NO: 454442 - DNA, 25 bp, Homo sapien
gggcctctgcgattgccggaaggtt

SEQ ID NO: 454443 - DNA, 25 bp, Homo sapien
ccggaaggttgcatggctggtccca

SEQ ID NO: 454444 - DNA, 25 bp, Homo sapien
cgaggccgggctgcctggttttatt

SEQ ID NO: 454445 - DNA, 25 bp, Homo sapien
gggagttgtgaaccagacatccaga

SEQ ID NO: 454446 - DNA, 25 bp, Homo sapien
gagttgtgaaccagacatccagacc

SEQ ID NO: 454447 - DNA, 25 bp, Homo sapien
agacctcctgaagggctcgtgcaga

SEQ ID NO: 454448 - DNA, 25 bp, Homo sapien
ctcctgaagggctcgtgcagacgta

SEQ ID NO: 454449 - DNA, 25 bp, Homo sapien
cctgaagggctcgtgcagacgtaca

SEQ ID NO: 454450 - DNA, 25 bp, Homo sapien
ctgaagggctcgtgcagacgtacag

SEQ ID NO: 454451 - DNA, 25 bp, Homo sapien
tcgtgcagacgtacaggcgggatct

SEQ ID NO: 454452 - DNA, 25 bp, Homo sapien
tgcagacgtacaggcgggatcttct

SEQ ID NO: 454453 - DNA, 25 bp, Homo sapien
acgtacaggcgggatcttctggaag

SEQ ID NO: 454454 - DNA, 25 bp, Homo sapien
cgtacaggcgggatcttctggaagt

SEQ ID NO: 454455 - DNA, 25 bp, Homo sapien
cttctggaagtgagaattgtttttg

SEQ ID NO: 454456 - DNA, 25 bp, Homo sapien
gaagggctgccttattttagagcac

SEQ ID NO: 454457 - DNA, 25 bp, Homo sapien
tattttgacaggttcgatcctctcc

SEQ ID NO: 454458 - DNA, 25 bp, Homo sapien
cttctgtcgattttcaatgtcttga

SEQ ID NO: 454459 - DNA, 25 bp, Homo sapien
attttcaatgtcttgatggtgtccc

SEQ ID NO: 454460 - DNA, 25 bp, Homo sapien
gtgtcccacctgagtggcctttaga

SEQ ID NO: 454461 - DNA, 25 bp, Homo sapien
acctgagtggcctttagagatgtga

SEQ ID NO: 454462 - DNA, 25 bp, Homo sapien
ttagagatgtgagttgtgaggcact

SEQ ID NO: 454463 - DNA, 25 bp, Homo sapien
tccagcccaagactgcctaatttaa

SEQ ID NO: 454464 - DNA, 25 bp, Homo sapien
actgcctaatttaacagggatttct

SEQ ID NO: 454465 - DNA, 25 bp, Homo sapien
ttaacagggatttctgcattctgga

SEQ ID NO: 454466 - DNA, 25 bp, Homo sapien
gatttctgcattctggaacaagcct

SEQ ID NO: 454467 - DNA, 25 bp, Homo sapien
atcctgtaactaatttttcataact

SEQ ID NO: 454468 - DNA, 25 bp, Homo sapien
tcctgtaactaatttttcataactt

SEQ ID NO: 454469 - DNA, 25 bp, Homo sapien
gttcttttaataaacacacttacat

SEQ ID NO: 454470 - DNA, 25 bp, Homo sapien
aataaacacacttacatagttacaa

SEQ ID NO: 454471 - DNA, 25 bp, Homo sapien
atttgcagagtctcaatacccagta

SEQ ID NO: 454472 - DNA, 25 bp, Homo sapien
tttgcagagtctcaatacccagtac

SEQ ID NO: 454473 - DNA, 25 bp, Homo sapien
ttgcagagtctcaatacccagtact

SEQ ID NO: 454474 - DNA, 25 bp, Homo sapien
tgcagagtctcaatacccagtacta

SEQ ID NO: 454475 - DNA, 25 bp, Homo sapien
gcagagtctcaatacccagtactat

SEQ ID NO: 454476 - DNA, 25 bp, Homo sapien
cagagtctcaatacccagtactata

SEQ ID NO: 454477 - DNA, 25 bp, Homo sapien
agagtctcaatacccagtactatag

SEQ ID NO: 454478 - DNA, 25 bp, Homo sapien
gacatgctcagcagatccaagagat

SEQ ID NO: 454479 - DNA, 25 bp, Homo sapien
acatgctcagcagatccaagagata

SEQ ID NO: 454480 - DNA, 25 bp, Homo sapien
aatcctcccaccttgtagctgggac

SEQ ID NO: 454481 - DNA, 25 bp, Homo sapien
catgctcagcagatccaagagatat

SEQ ID NO: 454482 - DNA, 25 bp, Homo sapien
atgctcagcagatccaagagatata

SEQ ID NO: 454483 - DNA, 25 bp, Homo sapien
tgggactacagctcacagcacacct

SEQ ID NO: 454484 - DNA, 25 bp, Homo sapien
cagctcacagcacacctggctaaaa

SEQ ID NO: 454485 - DNA, 25 bp, Homo sapien
gctcagcagatccaagagatatatt

SEQ ID NO: 454486 - DNA, 25 bp, Homo sapien
gatccaagagatatattggcaactt

SEQ ID NO: 454487 - DNA, 25 bp, Homo sapien
gagatatattggcaactttttctag

SEQ ID NO: 454488 - DNA, 25 bp, Homo sapien
gatatattggcaactttttctagaa

SEQ ID NO: 454489 - DNA, 25 bp, Homo sapien
gggtggtgggccctaactggctggc

SEQ ID NO: 454490 - DNA, 25 bp, Homo sapien
gccctctgccgtccagatgctgcag

SEQ ID NO: 454491 - DNA, 25 bp, Homo sapien
tgtggccagatttaccttccagtaa

SEQ ID NO: 454492 - DNA, 25 bp, Homo sapien
tggccagatttaccttccagtaaca

SEQ ID NO: 454493 - DNA, 25 bp, Homo sapien
gccagatttaccttccagtaacata

SEQ ID NO: 454494 - DNA, 25 bp, Homo sapien
tcctcctgcgaagtgatctgcagtg

SEQ ID NO: 454495 - DNA, 25 bp, Homo sapien
tcctgcgaagtgatctgcagtggct

SEQ ID NO: 454496 - DNA, 25 bp, Homo sapien
ttcacatctcctgagcttagtgtcc

SEQ ID NO: 454497 - DNA, 25 bp, Homo sapien
acatctcctgagcttagtgtccgtg

SEQ ID NO: 454498 - DNA, 25 bp, Homo sapien
atctcctgagcttagtgtccgtggc

SEQ ID NO: 454499 - DNA, 25 bp, Homo sapien
ctgagcttagtgtccgtggctgtcc

SEQ ID NO: 454500 - DNA, 25 bp, Homo sapien
agtattcagtatgccttttcctcaa

SEQ ID NO: 454501 - DNA, 25 bp, Homo sapien
tattcagtatgccttttcctcaagt

SEQ ID NO: 454502 - DNA, 25 bp, Homo sapien
ttttcctcaagttactttccttcat

SEQ ID NO: 454503 - DNA, 25 bp, Homo sapien
ctcaagttactttccttcattttct

SEQ ID NO: 454504 - DNA, 25 bp, Homo sapien
aaatgtttctcacatatctcacata

SEQ ID NO: 454505 - DNA, 25 bp, Homo sapien
gtttctcacatatctcacatataat

SEQ ID NO: 454506 - DNA, 25 bp, Homo sapien
ctcacatataatgtaatttccctaa

SEQ ID NO: 454507 - DNA, 25 bp, Homo sapien
atttccctaaatgaagttgtctcta

SEQ ID NO: 454508 - DNA, 25 bp, Homo sapien
aaatgaagttgtctctacttctgct

SEQ ID NO: 454509 - DNA, 25 bp, Homo sapien
acttctgctcatcaaattgctgtga

SEQ ID NO: 454510 - DNA, 25 bp, Homo sapien
aggacagaattaccaagcgttacaa

SEQ ID NO: 454511 - DNA, 25 bp, Homo sapien
actgtcagagagatttaatagtcac

SEQ ID NO: 454512 - DNA, 25 bp, Homo sapien
aatagtcacatgttatcattaggag

SEQ ID NO: 454513 - DNA, 25 bp, Homo sapien
cattaggagttggttactgtgtcac

SEQ ID NO: 454514 - DNA, 25 bp, Homo sapien
ggagttggttactgtgtcacattca

SEQ ID NO: 454515 - DNA, 25 bp, Homo sapien
actgtgtcacattcatgcttttagc

SEQ ID NO: 454516 - DNA, 25 bp, Homo sapien
catgcttttagctaaacactttaag

SEQ ID NO: 454517 - DNA, 25 bp, Homo sapien
gaagatgtcccactaaggtaagttt

SEQ ID NO: 454518 - DNA, 25 bp, Homo sapien
ctaaggtaagtttgacatggtgtaa

SEQ ID NO: 454519 - DNA, 25 bp, Homo sapien
gtaaacgcggataaagagcagatta

SEQ ID NO: 454520 - DNA, 25 bp, Homo sapien
gagcagattacttgaccctacattt

SEQ ID NO: 454521 - DNA, 25 bp, Homo sapien
ttgaccctacattttaagagaagac

SEQ ID NO: 454522 - DNA, 25 bp, Homo sapien
ctggaacagttttcgttaagtatag

SEQ ID NO: 454523 - DNA, 25 bp, Homo sapien
tggaacagttttcgttaagtatagt

SEQ ID NO: 454524 - DNA, 25 bp, Homo sapien
ggatggtaaattactctatttaaag

SEQ ID NO: 454525 - DNA, 25 bp, Homo sapien
actctatttaaagtaggtcttgtgt

SEQ ID NO: 454526 - DNA, 25 bp, Homo sapien
ctatttaaagtaggtcttgtgttct

SEQ ID NO: 454527 - DNA, 25 bp, Homo sapien
ttaaagtaggtcttgtgttctaata

SEQ ID NO: 454528 - DNA, 25 bp, Homo sapien
aaagtaggtcttgtgttctaataat

SEQ ID NO: 454529 - DNA, 25 bp, Homo sapien
aagtaggtcttgtgttctaataatg

SEQ ID NO: 454530 - DNA, 25 bp, Homo sapien
gtaggtcttgtgttctaataatgtt

SEQ ID NO: 454531 - DNA, 25 bp, Homo sapien
aggtcttgtgttctaataatgttta

SEQ ID NO: 454532 - DNA, 25 bp, Homo sapien
ggtcttgtgttctaataatgtttac

SEQ ID NO: 454533 - DNA, 25 bp, Homo sapien
tcagggcttatatgaagaggtgttt

SEQ ID NO: 454534 - DNA, 25 bp, Homo sapien
ggtgttttaaggttagcacatgcac

SEQ ID NO: 454535 - DNA, 25 bp, Homo sapien
tagcacatgcacaaaggaacgagtt

SEQ ID NO: 454536 - DNA, 25 bp, Homo sapien
gaatgaaattggcttattcacatca

SEQ ID NO: 454537 - DNA, 25 bp, Homo sapien
ggcttattcacatcaaaactagata

SEQ ID NO: 454538 - DNA, 25 bp, Homo sapien
gatatgaaacagaactaacctatag

SEQ ID NO: 454539 - DNA, 25 bp, Homo sapien
tagtttcctgaaatcagtacagttt

SEQ ID NO: 454540 - DNA, 25 bp, Homo sapien
gaagctagaaagtaatgcaccttga

SEQ ID NO: 454541 - DNA, 25 bp, Homo sapien
aagtaatgcaccttgattgttttag

SEQ ID NO: 454542 - DNA, 25 bp, Homo sapien
aaagcatgtctactgtgtttgtcct

SEQ ID NO: 454543 - DNA, 25 bp, Homo sapien
agcatgtctactgtgtttgtcctaa

SEQ ID NO: 454544 - DNA, 25 bp, Homo sapien
ttcatcatgatgcagcattcacaaa

SEQ ID NO: 454545 - DNA, 25 bp, Homo sapien
atgcagcattcacaaatcttattag

SEQ ID NO: 454546 - DNA, 25 bp, Homo sapien
aataggataagcaggtgattcattt

SEQ ID NO: 454547 - DNA, 25 bp, Homo sapien
ggtgattcatttggaacttatggga

SEQ ID NO: 454548 - DNA, 25 bp, Homo sapien
gggatgcagcataaccaggtgaaat

SEQ ID NO: 454549 - DNA, 25 bp, Homo sapien
ttccaaagaccaccaggtttgttca

SEQ ID NO: 454550 - DNA, 25 bp, Homo sapien
ccaggtttgttcaagtgcattgcta

SEQ ID NO: 454551 - DNA, 25 bp, Homo sapien
agtgcattgctagtctgtgtttgtg

SEQ ID NO: 454552 - DNA, 25 bp, Homo sapien
gtgtttgtgtttaacccatgcaaca

SEQ ID NO: 454553 - DNA, 25 bp, Homo sapien
gcaacaatcctcatgacagtaacaa

SEQ ID NO: 454554 - DNA, 25 bp, Homo sapien
gacagtaacaaggattatgaccaat

SEQ ID NO: 454555 - DNA, 25 bp, Homo sapien
gggtggtgggccctaactggctggc

SEQ ID NO: 454556 - DNA, 25 bp, Homo sapien
tgtggccagatttaccttccagtaa

SEQ ID NO: 454557 - DNA, 25 bp, Homo sapien
gccagatttaccttccagtaacata

SEQ ID NO: 454558 - DNA, 25 bp, Homo sapien
tcctcctgcgaagtgatctgcagtg

SEQ ID NO: 454559 - DNA, 25 bp, Homo sapien
tcctgcgaagtgatctgcagtggct

SEQ ID NO: 454560 - DNA, 25 bp, Homo sapien
ctgcagtggctgtttgaccagacca

SEQ ID NO: 454561 - DNA, 25 bp, Homo sapien
tgaccagaccacaaagttcacatct

SEQ ID NO: 454562 - DNA, 25 bp, Homo sapien
ttcacatctcctgagcttagtgtcc

SEQ ID NO: 454563 - DNA, 25 bp, Homo sapien
acatctcctgagcttagtgtccgtg

SEQ ID NO: 454564 - DNA, 25 bp, Homo sapien
atctcctgagcttagtgtccgtggc

SEQ ID NO: 454565 - DNA, 25 bp, Homo sapien
ctgagcttagtgtccgtggctgtcc

SEQ ID NO: 454566 - DNA, 25 bp, Homo sapien
aagcaccagggcacggacaggaata

SEQ ID NO: 454567 - DNA, 25 bp, Homo sapien
atccagaagacgcatatttacaggg

SEQ ID NO: 454568 - DNA, 25 bp, Homo sapien
actgaattagccactttctccatag

SEQ ID NO: 454569 - DNA, 25 bp, Homo sapien
tttctccatagccaagttgcgaatg

SEQ ID NO: 454570 - DNA, 25 bp, Homo sapien
agttgcgaatggatcccaaagggcc

SEQ ID NO: 454571 - DNA, 25 bp, Homo sapien
agggccccggcaagttggacaacat

SEQ ID NO: 454572 - DNA, 25 bp, Homo sapien
gacaacatgtgagctttgggcgaca

SEQ ID NO: 454573 - DNA, 25 bp, Homo sapien
gagctttgggcgacagttgctacaa

SEQ ID NO: 454574 - DNA, 25 bp, Homo sapien
gttgctacaaacaagatggccactc

SEQ ID NO: 454575 - DNA, 25 bp, Homo sapien
gatggccactctgacattgaagaat

SEQ ID NO: 454576 - DNA, 25 bp, Homo sapien
gaatgggcggtaacacatagtcaaa

SEQ ID NO: 454577 - DNA, 25 bp, Homo sapien
gaaagtgtgctttgctcacagaaga

SEQ ID NO: 454578 - DNA, 25 bp, Homo sapien
tgctcacagaagaatgggatgtcct

SEQ ID NO: 454579 - DNA, 25 bp, Homo sapien
agaagaatgggatgtccttttttct

SEQ ID NO: 454580 - DNA, 25 bp, Homo sapien
gacatatcaaatacagttctgaggg

SEQ ID NO: 454581 - DNA, 25 bp, Homo sapien
aatacagttctgagggtaaggtcat

SEQ ID NO: 454582 - DNA, 25 bp, Homo sapien
ggagctcggacccagtggcgttggg

SEQ ID NO: 454583 - DNA, 25 bp, Homo sapien
acccagtggcgttgggtgcggttga

SEQ ID NO: 454584 - DNA, 25 bp, Homo sapien
gagagagatgacagtggtcctcctc

SEQ ID NO: 454585 - DNA, 25 bp, Homo sapien
agatgacagtggtcctcctctgaga

SEQ ID NO: 454586 - DNA, 25 bp, Homo sapien
tcctctgagagcctgagctgtctcc

SEQ ID NO: 454587 - DNA, 25 bp, Homo sapien
tgagagcctgagctgtctccccgtc

SEQ ID NO: 454588 - DNA, 25 bp, Homo sapien
gggcccagaagattgagcttctaga

SEQ ID NO: 454589 - DNA, 25 bp, Homo sapien
gattgagcttctagagcctcagaga

SEQ ID NO: 454590 - DNA, 25 bp, Homo sapien
gcctcagagatggaattcgccgttt

SEQ ID NO: 454591 - DNA, 25 bp, Homo sapien
agagatggaattcgccgttttgccg

SEQ ID NO: 454592 - DNA, 25 bp, Homo sapien
atggaattcgccgttttgccgcgat

SEQ ID NO: 454593 - DNA, 25 bp, Homo sapien
aattcgccgttttgccgcgatttgg

SEQ ID NO: 454594 - DNA, 25 bp, Homo sapien
gttttgccgcgatttggcgttaact

SEQ ID NO: 454595 - DNA, 25 bp, Homo sapien
gcgatttggcgttaacttattgacc

SEQ ID NO: 454596 - DNA, 25 bp, Homo sapien
tggcgttaacttattgacccatggg

SEQ ID NO: 454597 - DNA, 25 bp, Homo sapien
catacacaccctcgctggaaagttc

SEQ ID NO: 454598 - DNA, 25 bp, Homo sapien
tcgctggaaagttcgccctgcccgg

SEQ ID NO: 454599 - DNA, 25 bp, Homo sapien
gattacatctgctagaaccttttgc

SEQ ID NO: 454600 - DNA, 25 bp, Homo sapien
atctgctagaaccttttgccttaac

SEQ ID NO: 454601 - DNA, 25 bp, Homo sapien
gctagaaccttttgccttaactatt

SEQ ID NO: 454602 - DNA, 25 bp, Homo sapien
tgccttaactattcaccaatatatg

SEQ ID NO: 454603 - DNA, 25 bp, Homo sapien
attagaatcttgtcttggttccatt

SEQ ID NO: 454604 - DNA, 25 bp, Homo sapien
gatggctaatatttgttatcttaat

SEQ ID NO: 454605 - DNA, 25 bp, Homo sapien
atttctgaggtcatgattacttgaa

SEQ ID NO: 454606 - DNA, 25 bp, Homo sapien
atattgactaaaactgggtccttag

SEQ ID NO: 454607 - DNA, 25 bp, Homo sapien
tgggtccttagaaattccaggtgga

SEQ ID NO: 454608 - DNA, 25 bp, Homo sapien
attccaggtggagctgatttaccta

SEQ ID NO: 454609 - DNA, 25 bp, Homo sapien
gtggagctgatttacctatgactga

SEQ ID NO: 454610 - DNA, 25 bp, Homo sapien
tgtggcttctgtgtaccatgggaaa

SEQ ID NO: 454611 - DNA, 25 bp, Homo sapien
attctcataggcaccgtatttcaca

SEQ ID NO: 454612 - DNA, 25 bp, Homo sapien
agttgggcaccttagtggataacct

SEQ ID NO: 454613 - DNA, 25 bp, Homo sapien
tggataacctgactgtcgatcctgc

SEQ ID NO: 454614 - DNA, 25 bp, Homo sapien
gatgccatcctaatcctatgaagct

SEQ ID NO: 454615 - DNA, 25 bp, Homo sapien
gaagctactgaactataaccctgag

SEQ ID NO: 454616 - DNA, 25 bp, Homo sapien
ctgaggaccctccaggatcagaagt

SEQ ID NO: 454617 - DNA, 25 bp, Homo sapien
tcagaagtacttcgcatccagaatg

SEQ ID NO: 454618 - DNA, 25 bp, Homo sapien
gaatgttttgtctgagaagcccagg

SEQ ID NO: 454619 - DNA, 25 bp, Homo sapien
ggtgagcaccgtgtatgccaacaat

SEQ ID NO: 454620 - DNA, 25 bp, Homo sapien
tgccaacaatggctctgtgcttcag

SEQ ID NO: 454621 - DNA, 25 bp, Homo sapien
aaccagcagatattcctgcgggaca

SEQ ID NO: 454622 - DNA, 25 bp, Homo sapien
tgcgggacatagaacaggtgccaca

SEQ ID NO: 454623 - DNA, 25 bp, Homo sapien
aggtgccacagcagccgacatacgt

SEQ ID NO: 454624 - DNA, 25 bp, Homo sapien
cgacatacgtccaggccctctttga

SEQ ID NO: 454625 - DNA, 25 bp, Homo sapien
atgtcatggataactcagaccccaa

SEQ ID NO: 454626 - DNA, 25 bp, Homo sapien
taactcagaccccaactggtggaaa

SEQ ID NO: 454627 - DNA, 25 bp, Homo sapien
ccaactggtggaaaggagcttgcca

SEQ ID NO: 454628 - DNA, 25 bp, Homo sapien
ttgccacgggcagaccggcatgttt

SEQ ID NO: 454629 - DNA, 25 bp, Homo sapien
agaccggcatgtttccccgcaatta

SEQ ID NO: 454630 - DNA, 25 bp, Homo sapien
atgtttccccgcaattatgtcaccc

SEQ ID NO: 454631 - DNA, 25 bp, Homo sapien
gtgaaccggaacgtctaagagtcaa

SEQ ID NO: 454632 - DNA, 25 bp, Homo sapien
gtggacactgcaggtgagcccgttt

SEQ ID NO: 454633 - DNA, 25 bp, Homo sapien
gacactgcaggtgagcccgtttggt

SEQ ID NO: 454634 - DNA, 25 bp, Homo sapien
cactgcaggtgagcccgtttggtcg

SEQ ID NO: 454635 - DNA, 25 bp, Homo sapien
cgtttggtcggctgcgggcgcggct

SEQ ID NO: 454636 - DNA, 25 bp, Homo sapien
tgctggtcgcggtgtgcggcgtgga

SEQ ID NO: 454637 - DNA, 25 bp, Homo sapien
ctgcaggtgaagtacgacgaggatc

SEQ ID NO: 454638 - DNA, 25 bp, Homo sapien
aagtacgacgaggatctggaggaga

SEQ ID NO: 454639 - DNA, 25 bp, Homo sapien
ggccattgtgtctgatactatccac

SEQ ID NO: 454640 - DNA, 25 bp, Homo sapien
cattgtgtctgatactatccacccc

SEQ ID NO: 454641 - DNA, 25 bp, Homo sapien
ccgtggaggtgaacgcgcccctgaa

SEQ ID NO: 454642 - DNA, 25 bp, Homo sapien
gcccctgaagtttggcaagtgaagt

SEQ ID NO: 454643 - DNA, 25 bp, Homo sapien
gcgggcacgtcacagtctgacattt

SEQ ID NO: 454644 - DNA, 25 bp, Homo sapien
gtctgacatttctaggtggctggga

SEQ ID NO: 454645 - DNA, 25 bp, Homo sapien
gacatttctaggtggctgggactcg

SEQ ID NO: 454646 - DNA, 25 bp, Homo sapien
atttctaggtggctgggactcgctc

SEQ ID NO: 454647 - DNA, 25 bp, Homo sapien
ttggcctccaccagtgtctcgggtg

SEQ ID NO: 454648 - DNA, 25 bp, Homo sapien
cctccaccagtgtctcgggtgtcag

SEQ ID NO: 454649 - DNA, 25 bp, Homo sapien
ggtgcagggttctgtccggcccggg

SEQ ID NO: 454650 - DNA, 25 bp, Homo sapien
ttcaggcccctccacaaagtctgga

SEQ ID NO: 454651 - DNA, 25 bp, Homo sapien
cctccacaaagtctggacactcaga

SEQ ID NO: 454652 - DNA, 25 bp, Homo sapien
aagtctggacactcagagggctctg

SEQ ID NO: 454653 - DNA, 25 bp, Homo sapien
agggctctgcgcagctctgcccggt

SEQ ID NO: 454654 - DNA, 25 bp, Homo sapien
gtctgcctctccaggattgtatgtt

SEQ ID NO: 454655 - DNA, 25 bp, Homo sapien
gattgtatgtttcaagccttgtcct

SEQ ID NO: 454656 - DNA, 25 bp, Homo sapien
gttcctttgtctgacgctctgtgta

SEQ ID NO: 454657 - DNA, 25 bp, Homo sapien
acgctctgtgtattgctctttgaat

SEQ ID NO: 454658 - DNA, 25 bp, Homo sapien
catgttggtagtgccggacttcctg

SEQ ID NO: 454659 - DNA, 25 bp, Homo sapien
ggacttcctgtttcaagttttctgg

SEQ ID NO: 454660 - DNA, 25 bp, Homo sapien
gggcctcgctaattgaatgtggaaa

SEQ ID NO: 454661 - DNA, 25 bp, Homo sapien
tggaaagtagcaccacttgacggct

SEQ ID NO: 454662 - DNA, 25 bp, Homo sapien
gctacaagtgccgactcctgaattt

SEQ ID NO: 454663 - DNA, 25 bp, Homo sapien
gactcctgaattttcccatggtgtt

SEQ ID NO: 454664 - DNA, 25 bp, Homo sapien
ttcccatggtgttctgacttcaagg

SEQ ID NO: 454665 - DNA, 25 bp, Homo sapien
cacatgctggccctttgagtgagaa

SEQ ID NO: 454666 - DNA, 25 bp, Homo sapien
tgctggccctttgagtgagaatgct

SEQ ID NO: 454667 - DNA, 25 bp, Homo sapien
ccctttgagtgagaatgctgcatct

SEQ ID NO: 454668 - DNA, 25 bp, Homo sapien
gagtgagaatgctgcatctttctac

SEQ ID NO: 454669 - DNA, 25 bp, Homo sapien
gctgcatctttctacatatcttcat

SEQ ID NO: 454670 - DNA, 25 bp, Homo sapien
gcatctttctacatatcttcatgag

SEQ ID NO: 454671 - DNA, 25 bp, Homo sapien
gaatactgagaattggattttcctt

SEQ ID NO: 454672 - DNA, 25 bp, Homo sapien
gatgaagcgtagtgaattgtacagc

SEQ ID NO: 454673 - DNA, 25 bp, Homo sapien
gcgtagtgaattgtacagctgttgt

SEQ ID NO: 454674 - DNA, 25 bp, Homo sapien
acagctgttgtaataatgacctatt

SEQ ID NO: 454675 - DNA, 25 bp, Homo sapien
tttgtatctgagataccagttcctt

SEQ ID NO: 454676 - DNA, 25 bp, Homo sapien
gtcatttctaaggtgtgttgcccgt

SEQ ID NO: 454677 - DNA, 25 bp, Homo sapien
tgttgcccgtggatctgggcacaat

SEQ ID NO: 454678 - DNA, 25 bp, Homo sapien
attggaattccttggagccactggg

SEQ ID NO: 454679 - DNA, 25 bp, Homo sapien
gagccactgggattcatggctttgt

SEQ ID NO: 454680 - DNA, 25 bp, Homo sapien
atggctttgtatccaactgcatcca

SEQ ID NO: 454681 - DNA, 25 bp, Homo sapien
ctgaggctgctgacgtttgacacca

SEQ ID NO: 454682 - DNA, 25 bp, Homo sapien
gccagtagagagtgcccttttgtat

SEQ ID NO: 454683 - DNA, 25 bp, Homo sapien
gtgcccttttgtatcttaagccaag

SEQ ID NO: 454684 - DNA, 25 bp, Homo sapien
tgggagccaatactgagtgcctgca

SEQ ID NO: 454685 - DNA, 25 bp, Homo sapien
agtgcctgcagcatctactactctg

SEQ ID NO: 454686 - DNA, 25 bp, Homo sapien
ctgtcttcactattcagaacttgta

SEQ ID NO: 454687 - DNA, 25 bp, Homo sapien
ttagagtctccttgaaatacacatg

SEQ ID NO: 454688 - DNA, 25 bp, Homo sapien
gtgatttcctaaactttatttcttg

SEQ ID NO: 454689 - DNA, 25 bp, Homo sapien
tttcttgtaaggatttatctcaggg

SEQ ID NO: 454690 - DNA, 25 bp, Homo sapien
ccagcatcctgaacctctaagtatg

SEQ ID NO: 454691 - DNA, 25 bp, Homo sapien
ctaagtatgaggacagtaagcctta

SEQ ID NO: 454692 - DNA, 25 bp, Homo sapien
tataaaataaactgttcttctctct

SEQ ID NO: 454693 - DNA, 25 bp, Homo sapien
gttcttctctctgccggtggaagtg

SEQ ID NO: 454694 - DNA, 25 bp, Homo sapien
tgccggtggaagtgtgccctgtcta

SEQ ID NO: 454695 - DNA, 25 bp, Homo sapien
tggaagtgtgccctgtctattcctg

SEQ ID NO: 454696 - DNA, 25 bp, Homo sapien
aaattgcttgtttgagacgcatgag

SEQ ID NO: 454697 - DNA, 25 bp, Homo sapien
gagacgcatgagacgtgcagcacat

SEQ ID NO: 454698 - DNA, 25 bp, Homo sapien
gggcaagaggtctctcttggtactc

SEQ ID NO: 454699 - DNA, 25 bp, Homo sapien
aagaggtctctcttggtactctttt

SEQ ID NO: 454700 - DNA, 25 bp, Homo sapien
aggtctctcttggtactcttttatt

SEQ ID NO: 454701 - DNA, 25 bp, Homo sapien
tccaccttcatgacctattcatctc

SEQ ID NO: 454702 - DNA, 25 bp, Homo sapien
tattcatctcccagaggccctacct

SEQ ID NO: 454703 - DNA, 25 bp, Homo sapien
cctacctgcagataccatcgtatgg

SEQ ID NO: 454704 - DNA, 25 bp, Homo sapien
atgggggatttgatttcagcctgtg

SEQ ID NO: 454705 - DNA, 25 bp, Homo sapien
ggaagcgggacaaacattcgttttg

SEQ ID NO: 454706 - DNA, 25 bp, Homo sapien
gggacaaacattcgttttgtagcaa

SEQ ID NO: 454707 - DNA, 25 bp, Homo sapien
gagtagagtaatatctgccaataac

SEQ ID NO: 454708 - DNA, 25 bp, Homo sapien
aatatctgccaataactggaggaaa

SEQ ID NO: 454709 - DNA, 25 bp, Homo sapien
ggcagccgtgcccaggctgctgcag

SEQ ID NO: 454710 - DNA, 25 bp, Homo sapien
atggatggtgatgacaccgagtctc

SEQ ID NO: 454711 - DNA, 25 bp, Homo sapien
ggatggtgatgacaccgagtctcac

SEQ ID NO: 454712 - DNA, 25 bp, Homo sapien
gatggtgatgacaccgagtctcact

SEQ ID NO: 454713 - DNA, 25 bp, Homo sapien
atggtgatgacaccgagtctcactt

SEQ ID NO: 454714 - DNA, 25 bp, Homo sapien
ggtgatgacaccgagtctcactttc

SEQ ID NO: 454715 - DNA, 25 bp, Homo sapien
gtgatgacaccgagtctcactttct

SEQ ID NO: 454716 - DNA, 25 bp, Homo sapien
tgatgacaccgagtctcactttctc

SEQ ID NO: 454717 - DNA, 25 bp, Homo sapien
gatgacaccgagtctcactttctcc

SEQ ID NO: 454718 - DNA, 25 bp, Homo sapien
atgacaccgagtctcactttctcct

SEQ ID NO: 454719 - DNA, 25 bp, Homo sapien
tgacaccgagtctcactttctcctt

SEQ ID NO: 454720 - DNA, 25 bp, Homo sapien
agctttaggtgctttgcttatcaag

SEQ ID NO: 454721 - DNA, 25 bp, Homo sapien
atcaagaaatcctacactgtccact

SEQ ID NO: 454722 - DNA, 25 bp, Homo sapien
gacatccatgtttttacttggctct

SEQ ID NO: 454723 - DNA, 25 bp, Homo sapien
ttagtggtccctgtgaaccttacct

SEQ ID NO: 454724 - DNA, 25 bp, Homo sapien
agatccttacttgcttggtggttac

SEQ ID NO: 454725 - DNA, 25 bp, Homo sapien
gaatgtcatctttgtgattgttcct

SEQ ID NO: 454726 - DNA, 25 bp, Homo sapien
gattgttcctgaaatagttcacgag

SEQ ID NO: 454727 - DNA, 25 bp, Homo sapien
gttcacgagaaatccatgaccgtaa

SEQ ID NO: 454728 - DNA, 25 bp, Homo sapien
tgatgtctaccactgtgagcttcca

SEQ ID NO: 454729 - DNA, 25 bp, Homo sapien
tgtgagcttccagtactaggtgatt

SEQ ID NO: 454730 - DNA, 25 bp, Homo sapien
gtactaggtgattggtctgcattca

SEQ ID NO: 454731 - DNA, 25 bp, Homo sapien
gtctgggtatttccatttgcatctg

SEQ ID NO: 454732 - DNA, 25 bp, Homo sapien
tgggtatttccatttgcatctggat

SEQ ID NO: 454733 - DNA, 25 bp, Homo sapien
agggacaaaattacctacatgtgat

SEQ ID NO: 454734 - DNA, 25 bp, Homo sapien
gtgataagttgaactcttcctaatg

SEQ ID NO: 454735 - DNA, 25 bp, Homo sapien
aactcttcctaatgactattcttat

SEQ ID NO: 454736 - DNA, 25 bp, Homo sapien
tattcttctcttatttcatctttat

SEQ ID NO: 454737 - DNA, 25 bp, Homo sapien
aattcagcaaatcaagtatttccct

SEQ ID NO: 454738 - DNA, 25 bp, Homo sapien
agtatttccctagaaagctatgtat

SEQ ID NO: 454739 - DNA, 25 bp, Homo sapien
taaaacatagagttgcctaaactga

SEQ ID NO: 454740 - DNA, 25 bp, Homo sapien
gaatttcactccctcgctaatattg

SEQ ID NO: 454741 - DNA, 25 bp, Homo sapien
actccctcgctaatattgtatgtga

SEQ ID NO: 454742 - DNA, 25 bp, Homo sapien
gaaggctgtcttgtttctagccaag

SEQ ID NO: 454743 - DNA, 25 bp, Homo sapien
ggatactagagaaagtcatttgctt

SEQ ID NO: 454744 - DNA, 25 bp, Homo sapien
gtactattgccattttagaaagctc

SEQ ID NO: 454745 - DNA, 25 bp, Homo sapien
gaaagctctgatgtgaattcaaatt

SEQ ID NO: 454746 - DNA, 25 bp, Homo sapien
agccaacaattttaaggcagtagtt

SEQ ID NO: 454747 - DNA, 25 bp, Homo sapien
tttagtccagtgttaccaaggtaag

SEQ ID NO: 454748 - DNA, 25 bp, Homo sapien
gggaatgaagtataccaacttcttt

SEQ ID NO: 454749 - DNA, 25 bp, Homo sapien
aagtataccaacttctttcagagca

SEQ ID NO: 454750 - DNA, 25 bp, Homo sapien
gtataccaacttctttcagagcatt

SEQ ID NO: 454751 - DNA, 25 bp, Homo sapien
taccaacttctttcagagcatttta

SEQ ID NO: 454752 - DNA, 25 bp, Homo sapien
ctttcagagcattttaggacattat

SEQ ID NO: 454753 - DNA, 25 bp, Homo sapien
catagcatggagagttagttcatag

SEQ ID NO: 454754 - DNA, 25 bp, Homo sapien
tagcatggagagttagttcatagtt

SEQ ID NO: 454755 - DNA, 25 bp, Homo sapien
gcatggagagttagttcatagttta

SEQ ID NO: 454756 - DNA, 25 bp, Homo sapien
catggagagttagttcatagtttat

SEQ ID NO: 454757 - DNA, 25 bp, Homo sapien
tggagagttagttcatagtttataa

SEQ ID NO: 454758 - DNA, 25 bp, Homo sapien
ggagagttagttcatagtttataaa

SEQ ID NO: 454759 - DNA, 25 bp, Homo sapien
atagtttataaaaccacatccctgg

SEQ ID NO: 454760 - DNA, 25 bp, Homo sapien
tagtttataaaaccacatccctggc

SEQ ID NO: 454761 - DNA, 25 bp, Homo sapien
aattttggaaggtagagaggcgagc

SEQ ID NO: 454762 - DNA, 25 bp, Homo sapien
ttggaaggtagagaggcgagcgagc

SEQ ID NO: 454763 - DNA, 25 bp, Homo sapien
gaattgcttgaacgccggggtcgga

SEQ ID NO: 454764 - DNA, 25 bp, Homo sapien
atcttgagtctactctgtcgctctt

SEQ ID NO: 454765 - DNA, 25 bp, Homo sapien
actctgtcgctcttgtgccctagca

SEQ ID NO: 454766 - DNA, 25 bp, Homo sapien
tagcaccccgagaaccgtcagtttg

SEQ ID NO: 454767 - DNA, 25 bp, Homo sapien
accgtcagtttgagccagatggaag

SEQ ID NO: 454768 - DNA, 25 bp, Homo sapien
tgagctgaacacattacgatggatg

SEQ ID NO: 454769 - DNA, 25 bp, Homo sapien
atccaagtggtaatgggcgaagttt

SEQ ID NO: 454770 - DNA, 25 bp, Homo sapien
ggcgaagtttattcagcatccggca

SEQ ID NO: 454771 - DNA, 25 bp, Homo sapien
gcatccggcaatggacttatcgtag

SEQ ID NO: 454772 - DNA, 25 bp, Homo sapien
acgggtgttccgaataatatcctgg

SEQ ID NO: 454773 - DNA, 25 bp, Homo sapien
ctggaagttatcaggacacctattt

SEQ ID NO: 454774 - DNA, 25 bp, Homo sapien
gtaatatttaaggtggtccgtgata

SEQ ID NO: 454775 - DNA, 25 bp, Homo sapien
tgttgaaagtaaccgcagacctgcc

SEQ ID NO: 454776 - DNA, 25 bp, Homo sapien
taaccgcagacctgcccttgtacaa

SEQ ID NO: 454777 - DNA, 25 bp, Homo sapien
ggaacaactcgcttgctcagggtag

SEQ ID NO: 454778 - DNA, 25 bp, Homo sapien
caactcgcttgctcagggtaggcgg

SEQ ID NO: 454779 - DNA, 25 bp, Homo sapien
ctgtccttctggttttgctcccaaa

SEQ ID NO: 454780 - DNA, 25 bp, Homo sapien
ttctggttttgctcccaaactgccc

SEQ ID NO: 454781 - DNA, 25 bp, Homo sapien
gggcagcacagccatacagccactg

SEQ ID NO: 454782 - DNA, 25 bp, Homo sapien
tacagccactgtccccgaagaagta

SEQ ID NO: 454783 - DNA, 25 bp, Homo sapien
agaagtaggatcctctctgtctcct

SEQ ID NO: 454784 - DNA, 25 bp, Homo sapien
acccggctgcttccgctggaataaa

SEQ ID NO: 454785 - DNA, 25 bp, Homo sapien
gcttccgctggaataaacagtgttg

SEQ ID NO: 454786 - DNA, 25 bp, Homo sapien
ttaagtccacctctgcctaaatagg

SEQ ID NO: 454787 - DNA, 25 bp, Homo sapien
ctaaataggcttcccatgctgctga

SEQ ID NO: 454788 - DNA, 25 bp, Homo sapien
atgctgctgatgtttgctacagggc

SEQ ID NO: 454789 - DNA, 25 bp, Homo sapien
acagggcaggtgctttagctgaccc

SEQ ID NO: 454790 - DNA, 25 bp, Homo sapien
aagcctcttaattacaaagcctgca

SEQ ID NO: 454791 - DNA, 25 bp, Homo sapien
agcctgcatcaagtcacatgtgcct

SEQ ID NO: 454792 - DNA, 25 bp, Homo sapien
gtggccaaacgggacaattaatcag

SEQ ID NO: 454793 - DNA, 25 bp, Homo sapien
agtttaccatggcatctggtcacca

SEQ ID NO: 454794 - DNA, 25 bp, Homo sapien
tggtcaccaggcttcacacttgcaa

SEQ ID NO: 454795 - DNA, 25 bp, Homo sapien
tctcctccccttaaagacagttggc

SEQ ID NO: 454796 - DNA, 25 bp, Homo sapien
agacagttggcctttaagtccacct

SEQ ID NO: 454797 - DNA, 25 bp, Homo sapien
atgtgctcttttggatggagaacag

SEQ ID NO: 454798 - DNA, 25 bp, Homo sapien
gaaatctgaaacaactgaacttatg

SEQ ID NO: 454799 - DNA, 25 bp, Homo sapien
gattttggatcatctaaaccggaaa

SEQ ID NO: 454800 - DNA, 25 bp, Homo sapien
gacctgttggatgttgaaagcaaac

SEQ ID NO: 454801 - DNA, 25 bp, Homo sapien
gcaaacactttgaagacctggagtt

SEQ ID NO: 454802 - DNA, 25 bp, Homo sapien
ggagttccagcagcttgaacatgag

SEQ ID NO: 454803 - DNA, 25 bp, Homo sapien
ttgaacatgagagccgtctagatga

SEQ ID NO: 454804 - DNA, 25 bp, Homo sapien
aaaggagaacttgactcaacagctc

SEQ ID NO: 454805 - DNA, 25 bp, Homo sapien
gactcaacagctcctgcgtgaagtt

SEQ ID NO: 454806 - DNA, 25 bp, Homo sapien
gctcctgcgtgaagttgctgaatat

SEQ ID NO: 454807 - DNA, 25 bp, Homo sapien
ttgctgaatatcaacggaacatcgt

SEQ ID NO: 454808 - DNA, 25 bp, Homo sapien
ccttgctcagaaagtacctgtaatt

SEQ ID NO: 454809 - DNA, 25 bp, Homo sapien
tttaacaaacagactgcctgtaggt

SEQ ID NO: 454810 - DNA, 25 bp, Homo sapien
ctgcctgtaggtatagtgcaattac

SEQ ID NO: 454811 - DNA, 25 bp, Homo sapien
gtgcaattacaaatgctctaatcat

SEQ ID NO: 454812 - DNA, 25 bp, Homo sapien
cattgtacatacatctctcttgata

SEQ ID NO: 454813 - DNA, 25 bp, Homo sapien
tctctcttgatattgcagcatccat

SEQ ID NO: 454814 - DNA, 25 bp, Homo sapien
tttttggcagattgaatgtgctgta

SEQ ID NO: 454815 - DNA, 25 bp, Homo sapien
gaatgtgctgtattgatatgtatct

SEQ ID NO: 454816 - DNA, 25 bp, Homo sapien
gtaattgtattgtatgtctatagct

SEQ ID NO: 454817 - DNA, 25 bp, Homo sapien
atgtctatagctaattcacgttttg

SEQ ID NO: 454818 - DNA, 25 bp, Homo sapien
tatttctgactagggatattttctt

SEQ ID NO: 454819 - DNA, 25 bp, Homo sapien
ttggtttgggactgagagctctttc

SEQ ID NO: 454820 - DNA, 25 bp, Homo sapien
gctctttcattttctaccagtcaaa

SEQ ID NO: 454821 - DNA, 25 bp, Homo sapien
accagtcaaaccactattagagtct

SEQ ID NO: 454822 - DNA, 25 bp, Homo sapien
attagagtcttcatgttacttcccc

SEQ ID NO: 454823 - DNA, 25 bp, Homo sapien
gttacttccccaatttgctagcaag

SEQ ID NO: 454824 - DNA, 25 bp, Homo sapien
ctagcaaggtagaatcagcatggat

SEQ ID NO: 454825 - DNA, 25 bp, Homo sapien
ggatagcttattttccttattggaa

SEQ ID NO: 454826 - DNA, 25 bp, Homo sapien
ttctgttttggaagaggcaggtctt

SEQ ID NO: 454827 - DNA, 25 bp, Homo sapien
gcaggtcttatagcagggcagacta

SEQ ID NO: 454828 - DNA, 25 bp, Homo sapien
agactaattaatgtgctgaactcat

SEQ ID NO: 454829 - DNA, 25 bp, Homo sapien
ccgcgtcgacgattgtatctgcctg

SEQ ID NO: 454830 - DNA, 25 bp, Homo sapien
ttaaactgactcagtgacagctggg

SEQ ID NO: 454831 - DNA, 25 bp, Homo sapien
tggaatggcaagaacacttacaacc

SEQ ID NO: 454832 - DNA, 25 bp, Homo sapien
gaacacttacaaccaaactcatggg

SEQ ID NO: 454833 - DNA, 25 bp, Homo sapien
aactcatgggctgctgcaatttgaa

SEQ ID NO: 454834 - DNA, 25 bp, Homo sapien
catattaaaatagttcagtgttcaa

SEQ ID NO: 454835 - DNA, 25 bp, Homo sapien
gtgtttatgtggatatttttctctt

SEQ ID NO: 454836 - DNA, 25 bp, Homo sapien
taaaccattaaaatacagtcatccc

SEQ ID NO: 454837 - DNA, 25 bp, Homo sapien
acagtcatcccttgtatacgctagg

SEQ ID NO: 454838 - DNA, 25 bp, Homo sapien
ttgtatacgctagggactggttcca

SEQ ID NO: 454839 - DNA, 25 bp, Homo sapien
gctagggactggttccagggccaca

SEQ ID NO: 454840 - DNA, 25 bp, Homo sapien
gttccagggccacacatataccaaa

SEQ ID NO: 454841 - DNA, 25 bp, Homo sapien
acagagcgtgttgttagagctgtgt

SEQ ID NO: 454842 - DNA, 25 bp, Homo sapien
aaaaagccgcaagcgtttcactctt

SEQ ID NO: 454843 - DNA, 25 bp, Homo sapien
gccgcaagcgtttcactcttttatt

SEQ ID NO: 454844 - DNA, 25 bp, Homo sapien
tatttttataatccccttcaatttg

SEQ ID NO: 454845 - DNA, 25 bp, Homo sapien
aggtgccttttaaaagatcgttgct

SEQ ID NO: 454846 - DNA, 25 bp, Homo sapien
gccttttaaaagatcgttgctgtga

SEQ ID NO: 454847 - DNA, 25 bp, Homo sapien
aagatcgttgctgtgaagtgaaaaa

SEQ ID NO: 454848 - DNA, 25 bp, Homo sapien
gtgtttgggttgttggctgctttct

SEQ ID NO: 454849 - DNA, 25 bp, Homo sapien
tgggttgttggctgctttcttcccc

SEQ ID NO: 454850 - DNA, 25 bp, Homo sapien
attattttgaggtggtgttcgcaga

SEQ ID NO: 454851 - DNA, 25 bp, Homo sapien
ttttgaggtggtgttcgcagagttt

SEQ ID NO: 454852 - DNA, 25 bp, Homo sapien
agaatcttaattacatacaaggcac

SEQ ID NO: 454853 - DNA, 25 bp, Homo sapien
aaggcactaacctctcacctgtttt

SEQ ID NO: 454854 - DNA, 25 bp, Homo sapien
cagctttgtgtaaagacaagggatc

SEQ ID NO: 454855 - DNA, 25 bp, Homo sapien
atcaaaacatccctttctgctattt

SEQ ID NO: 454856 - DNA, 25 bp, Homo sapien
catccctttctgctatttcatactt

SEQ ID NO: 454857 - DNA, 25 bp, Homo sapien
acttaagtgtgggagctgatccaaa

SEQ ID NO: 454858 - DNA, 25 bp, Homo sapien
tttccttgaatgattctcacctggc

SEQ ID NO: 454859 - DNA, 25 bp, Homo sapien
gaatgattctcacctggcagatcta

SEQ ID NO: 454860 - DNA, 25 bp, Homo sapien
catttttaagagtttgcctttctga

SEQ ID NO: 454861 - DNA, 25 bp, Homo sapien
tttccaccggaaatgatactatcag

SEQ ID NO: 454862 - DNA, 25 bp, Homo sapien
cagtatcatactcagaatcttaatt

SEQ ID NO: 454863 - DNA, 25 bp, Homo sapien
ccaaaggttagataaatgcagtgtg

SEQ ID NO: 454864 - DNA, 25 bp, Homo sapien
gtatgggaatcccttgagtttttca

SEQ ID NO: 454865 - DNA, 25 bp, Homo sapien
taaaattctatttgggtggctgtca

SEQ ID NO: 454866 - DNA, 25 bp, Homo sapien
atttgggtggctgtcaagtccagtc

SEQ ID NO: 454867 - DNA, 25 bp, Homo sapien
tggctgtcaagtccagtctgcatag

SEQ ID NO: 454868 - DNA, 25 bp, Homo sapien
aagtccagtctgcatagtcttgaca

SEQ ID NO: 454869 - DNA, 25 bp, Homo sapien
gtctgcatagtcttgacatgtcttg

SEQ ID NO: 454870 - DNA, 25 bp, Homo sapien
gtcttgacatgtcttggataagatc

SEQ ID NO: 454871 - DNA, 25 bp, Homo sapien
ggataagatccttatactatcactt

SEQ ID NO: 454872 - DNA, 25 bp, Homo sapien
tccttatactatcacttttcctgtc

SEQ ID NO: 454873 - DNA, 25 bp, Homo sapien
cctgtcatggacactacaaattata

SEQ ID NO: 454874 - DNA, 25 bp, Homo sapien
ctgcccctagtcgtggacaatgaaa

SEQ ID NO: 454875 - DNA, 25 bp, Homo sapien
gtggctggtgaattagatcagattc

SEQ ID NO: 454876 - DNA, 25 bp, Homo sapien
tcagattcaaactaagccattcctt

SEQ ID NO: 454877 - DNA, 25 bp, Homo sapien
aaactaagccattccttgatgctat

SEQ ID NO: 454878 - DNA, 25 bp, Homo sapien
gacatgtcaggcactcagttttttg

SEQ ID NO: 454879 - DNA, 25 bp, Homo sapien
tttggagctgtcttaaaggtgaggt

SEQ ID NO: 454880 - DNA, 25 bp, Homo sapien
gagatgattttgctctaattaccca

SEQ ID NO: 454881 - DNA, 25 bp, Homo sapien
ttttgctctaattacccacacattc

SEQ ID NO: 454882 - DNA, 25 bp, Homo sapien
aatttgatggtaattaccctacttg

SEQ ID NO: 454883 - DNA, 25 bp, Homo sapien
taccctacttgtaaagttgacattc

SEQ ID NO: 454884 - DNA, 25 bp, Homo sapien
tgacattcatactggctaatcctcc

SEQ ID NO: 454885 - DNA, 25 bp, Homo sapien
aagtttcctttctctgaggaaatgt

SEQ ID NO: 454886 - DNA, 25 bp, Homo sapien
aaatgtgaatgaggacatccataac

SEQ ID NO: 454887 - DNA, 25 bp, Homo sapien
gaggacatccataactcaggttgtg

SEQ ID NO: 454888 - DNA, 25 bp, Homo sapien
atccataactcaggttgtgtctggc

SEQ ID NO: 454889 - DNA, 25 bp, Homo sapien
cataactcaggttgtgtctggcagc

SEQ ID NO: 454890 - DNA, 25 bp, Homo sapien
tcaggttgtgtctggcagccatctt

SEQ ID NO: 454891 - DNA, 25 bp, Homo sapien
agccatcttgtgatcatctggcaag

SEQ ID NO: 454892 - DNA, 25 bp, Homo sapien
tgatcatctggcaagacagcccaag

SEQ ID NO: 454893 - DNA, 25 bp, Homo sapien
gacagcccaagaataaagccgtcac

SEQ ID NO: 454894 - DNA, 25 bp, Homo sapien
aaagccgtcaccatggagactaaga

SEQ ID NO: 454895 - DNA, 25 bp, Homo sapien
cctatcatcctagctccagagattg

SEQ ID NO: 454896 - DNA, 25 bp, Homo sapien
tcagttttttgtttgcgagcttgcc

SEQ ID NO: 454897 - DNA, 25 bp, Homo sapien
ttttgtttgcgagcttgccctgtcc

SEQ ID NO: 454898 - DNA, 25 bp, Homo sapien
acacacccagcagtctgccaaggag

SEQ ID NO: 454899 - DNA, 25 bp, Homo sapien
caaggagctgcttttcctgactact

SEQ ID NO: 454900 - DNA, 25 bp, Homo sapien
gagctgcttttcctgactactgtct

SEQ ID NO: 454901 - DNA, 25 bp, Homo sapien
ttttcctgactactgtctctccatg

SEQ ID NO: 454902 - DNA, 25 bp, Homo sapien
actgtctctccatgcctagggaagt

SEQ ID NO: 454903 - DNA, 25 bp, Homo sapien
gtgtccttgaagtggtgaagtgccc

SEQ ID NO: 454904 - DNA, 25 bp, Homo sapien
agtgcccaccacatgaaccaaggag

SEQ ID NO: 454905 - DNA, 25 bp, Homo sapien
aaggagagacgccaaagcagctgcc

SEQ ID NO: 454906 - DNA, 25 bp, Homo sapien
aaagcagctgccatggactctggcc

SEQ ID NO: 454907 - DNA, 25 bp, Homo sapien
caggcgtgtggatgggaccagctca

SEQ ID NO: 454908 - DNA, 25 bp, Homo sapien
agctcaggcagacgctgtctcatac

SEQ ID NO: 454909 - DNA, 25 bp, Homo sapien
aggcagacgctgtctcatacccact

SEQ ID NO: 454910 - DNA, 25 bp, Homo sapien
tgtctctcaggagcctgggcatgag

SEQ ID NO: 454911 - DNA, 25 bp, Homo sapien
tgggcatgagacaaaagcagagatt

SEQ ID NO: 454912 - DNA, 25 bp, Homo sapien
ggtaccacaggctgtaaccagtcca

SEQ ID NO: 454913 - DNA, 25 bp, Homo sapien
gtaaccagtccacccagtgttgttt

SEQ ID NO: 454914 - DNA, 25 bp, Homo sapien
cagtccacccagtgttgttttagaa

SEQ ID NO: 454915 - DNA, 25 bp, Homo sapien
atcggttgcccatctttttaaattg

SEQ ID NO: 454916 - DNA, 25 bp, Homo sapien
taaattggcaacatcgtttaccaca

SEQ ID NO: 454917 - DNA, 25 bp, Homo sapien
ggcaacatcgtttaccacattaaaa

SEQ ID NO: 454918 - DNA, 25 bp, Homo sapien
aggcatggctgagcagcgcctcgct

SEQ ID NO: 454919 - DNA, 25 bp, Homo sapien
ctgagcagcgcctcgctgcagacgg

SEQ ID NO: 454920 - DNA, 25 bp, Homo sapien
gggcactgatgctgcactcagaccc

SEQ ID NO: 454921 - DNA, 25 bp, Homo sapien
tgatgctgcactcagaccccagcat

SEQ ID NO: 454922 - DNA, 25 bp, Homo sapien
gggtactccctgcacggatcttctg

SEQ ID NO: 454923 - DNA, 25 bp, Homo sapien
ccctgcacggatcttctggtgagat

SEQ ID NO: 454924 - DNA, 25 bp, Homo sapien
atcttctggtgagatcgagagcgtg

SEQ ID NO: 454925 - DNA, 25 bp, Homo sapien
tcgagagcgtggatgactactgacc

SEQ ID NO: 454926 - DNA, 25 bp, Homo sapien
gtggatgactactgaccagcccgga

SEQ ID NO: 454927 - DNA, 25 bp, Homo sapien
agggcagccacagcggcgtggaccg

SEQ ID NO: 454928 - DNA, 25 bp, Homo sapien
gtggaccgagggtcccagcctgcag

SEQ ID NO: 454929 - DNA, 25 bp, Homo sapien
aggaacacaccccgagagctggtgc

SEQ ID NO: 454930 - DNA, 25 bp, Homo sapien
gagctggtgctgtaggacccagttt

SEQ ID NO: 454931 - DNA, 25 bp, Homo sapien
gctgtaggacccagttttcccgcga

SEQ ID NO: 454932 - DNA, 25 bp, Homo sapien
ccgagcgaggcctacttctggttta

SEQ ID NO: 454933 - DNA, 25 bp, Homo sapien
gaggcctacttctggtttacgcacg

SEQ ID NO: 454934 - DNA, 25 bp, Homo sapien
tacttctggtttacgcacgggcgct

SEQ ID NO: 454935 - DNA, 25 bp, Homo sapien
tctggtttacgcacgggcgctgaaa

SEQ ID NO: 454936 - DNA, 25 bp, Homo sapien
ggcgctgaaagaagcggcactgtcc

SEQ ID NO: 454937 - DNA, 25 bp, Homo sapien
gagccacgtacgagcgccgctgtga

SEQ ID NO: 454938 - DNA, 25 bp, Homo sapien
gtacgagcgccgctgtgattggtga

SEQ ID NO: 454939 - DNA, 25 bp, Homo sapien
gaactctgggtctcgcggtttggga

SEQ ID NO: 454940 - DNA, 25 bp, Homo sapien
aaatcctgcctatattttactcagt

SEQ ID NO: 454941 - DNA, 25 bp, Homo sapien
tattttactcagtttcaaactttat

SEQ ID NO: 454942 - DNA, 25 bp, Homo sapien
ttactcagtttcaaactttattagt

SEQ ID NO: 454943 - DNA, 25 bp, Homo sapien
cagtttcaaactttattagtctatt

SEQ ID NO: 454944 - DNA, 25 bp, Homo sapien
ttgttttttaatgtcagatctgttg

SEQ ID NO: 454945 - DNA, 25 bp, Homo sapien
gttttttaatgtcagatctgttgag

SEQ ID NO: 454946 - DNA, 25 bp, Homo sapien
taatgtcagatctgttgagttggtt

SEQ ID NO: 454947 - DNA, 25 bp, Homo sapien
atgtcagatctgttgagttggtttt

SEQ ID NO: 454948 - DNA, 25 bp, Homo sapien
gtcagatctgttgagttggtttttt

SEQ ID NO: 454949 - DNA, 25 bp, Homo sapien
gatctgttgagttggtttttttggt

SEQ ID NO: 454950 - DNA, 25 bp, Homo sapien
ttttactgagaaaggaagggccaag

SEQ ID NO: 454951 - DNA, 25 bp, Homo sapien
agccatcttgtgatcatctggcaag

SEQ ID NO: 454952 - DNA, 25 bp, Homo sapien
gccatcttgtgatcatctggcaaga

SEQ ID NO: 454953 - DNA, 25 bp, Homo sapien
catcttgtgatcatctggcaagaca

SEQ ID NO: 454954 - DNA, 25 bp, Homo sapien
ttgtgatcatctggcaagacagccc

SEQ ID NO: 454955 - DNA, 25 bp, Homo sapien
gtgatcatctggcaagacagcccaa

SEQ ID NO: 454956 - DNA, 25 bp, Homo sapien
gatcatctggcaagacagcccaaga

SEQ ID NO: 454957 - DNA, 25 bp, Homo sapien
taaagccgtcaccatggagactaag

SEQ ID NO: 454958 - DNA, 25 bp, Homo sapien
aaagccgtcaccatggagactaaga

SEQ ID NO: 454959 - DNA, 25 bp, Homo sapien
aagccgtcaccatggagactaagaa

SEQ ID NO: 454960 - DNA, 25 bp, Homo sapien
agccgtcaccatggagactaagaag

SEQ ID NO: 454961 - DNA, 25 bp, Homo sapien
ccgtcaccatggagactaagaagag

SEQ ID NO: 454962 - DNA, 25 bp, Homo sapien
attttgatatgtttatgaagctttt

SEQ ID NO: 454963 - DNA, 25 bp, Homo sapien
tgaagctttttatgtgatttttgac

SEQ ID NO: 454964 - DNA, 25 bp, Homo sapien
gtgatttttgactctcatacagcca

SEQ ID NO: 454965 - DNA, 25 bp, Homo sapien
atttttgactctcatacagccagaa

SEQ ID NO: 454966 - DNA, 25 bp, Homo sapien
ttttgactctcatacagccagaaaa

SEQ ID NO: 454967 - DNA, 25 bp, Homo sapien
gactctcatacagccagaaaactgt

SEQ ID NO: 454968 - DNA, 25 bp, Homo sapien
cagaaaactgtattaaactggttag

SEQ ID NO: 454969 - DNA, 25 bp, Homo sapien
caaattatggtgattgtggatattt

SEQ ID NO: 454970 - DNA, 25 bp, Homo sapien
gattcagtgaagtacatttaatatt

SEQ ID NO: 454971 - DNA, 25 bp, Homo sapien
ttaatattaacaatggcagggcacg

SEQ ID NO: 454972 - DNA, 25 bp, Homo sapien
aatattaacaatggcagggcacggt

SEQ ID NO: 454973 - DNA, 25 bp, Homo sapien
tgctccgtactagcgtttacaggtc

SEQ ID NO: 454974 - DNA, 25 bp, Homo sapien
actagcgtttacaggtcttaattca

SEQ ID NO: 454975 - DNA, 25 bp, Homo sapien
ggtcttaattcaaaccagatgcctg

SEQ ID NO: 454976 - DNA, 25 bp, Homo sapien
accagatgcctgtactagtttttag

SEQ ID NO: 454977 - DNA, 25 bp, Homo sapien
tgcctgtactagtttttagacccca

SEQ ID NO: 454978 - DNA, 25 bp, Homo sapien
gagccacagcttcccgctgggaata

SEQ ID NO: 454979 - DNA, 25 bp, Homo sapien
tctgcatggaatcttgccccggact

SEQ ID NO: 454980 - DNA, 25 bp, Homo sapien
cccggactcctgaagactgcacaag

SEQ ID NO: 454981 - DNA, 25 bp, Homo sapien
gacaacctgggaactgaataacttt

SEQ ID NO: 454982 - DNA, 25 bp, Homo sapien
aataactttcaaagccagtgctcag

SEQ ID NO: 454983 - DNA, 25 bp, Homo sapien
tttcaaagccagtgctcagcttctc

SEQ ID NO: 454984 - DNA, 25 bp, Homo sapien
atcattgttctcactgtatcatctt

SEQ ID NO: 454985 - DNA, 25 bp, Homo sapien
atttcttgtaatctgtccattccct

SEQ ID NO: 454986 - DNA, 25 bp, Homo sapien
gtaatctgtccattcccttttaata

SEQ ID NO: 454987 - DNA, 25 bp, Homo sapien
ttttaataagtttaggtcagcctct

SEQ ID NO: 454988 - DNA, 25 bp, Homo sapien
aggtcagcctcttagaaccatttct

SEQ ID NO: 454989 - DNA, 25 bp, Homo sapien
gggagttaaagcttgcttgtccaca

SEQ ID NO: 454990 - DNA, 25 bp, Homo sapien
cttgtccacaactgagttacttata

SEQ ID NO: 454991 - DNA, 25 bp, Homo sapien
gagattgtatgtctaattctgcaag

SEQ ID NO: 454992 - DNA, 25 bp, Homo sapien
ctgaaggcatggctcttaaaggatg

SEQ ID NO: 454993 - DNA, 25 bp, Homo sapien
gatgccatcatgtagtttagaagcc

SEQ ID NO: 454994 - DNA, 25 bp, Homo sapien
gaagccactaatttccgaggagtaa

SEQ ID NO: 454995 - DNA, 25 bp, Homo sapien
ggacatatataccatttgtttttca

SEQ ID NO: 454996 - DNA, 25 bp, Homo sapien
tttttcatatactcagttttagttt

SEQ ID NO: 454997 - DNA, 25 bp, Homo sapien
aaaaagcataaggaaccagcattct

SEQ ID NO: 454998 - DNA, 25 bp, Homo sapien
aaagcatacctatttaattgagtct

SEQ ID NO: 454999 - DNA, 25 bp, Homo sapien
attgagtctgaacagtacttctcag

SEQ ID NO: 455000 - DNA, 25 bp, Homo sapien
gtctgaacagtacttctcaggagtt

SEQ ID NO: 455001 - DNA, 25 bp, Homo sapien
tgttgaggctgctgttatataaggc

SEQ ID NO: 455002 - DNA, 25 bp, Homo sapien
atataaggcagtaacaacagattgt

SEQ ID NO: 455003 - DNA, 25 bp, Homo sapien
aacagattgtttgtacttgccctct

SEQ ID NO: 455004 - DNA, 25 bp, Homo sapien
gggttgcgcaaactatggctatttt

SEQ ID NO: 455005 - DNA, 25 bp, Homo sapien
gcaaactatggctattttgtaagaa

SEQ ID NO: 455006 - DNA, 25 bp, Homo sapien
gggaagggcgcactcactgaactaa

SEQ ID NO: 455007 - DNA, 25 bp, Homo sapien
gaaagagccccaaactcgaggacct

SEQ ID NO: 455008 - DNA, 25 bp, Homo sapien
gagccccaaactcgaggacctattg

SEQ ID NO: 455009 - DNA, 25 bp, Homo sapien
aagggcgcactcactgaactaactc

SEQ ID NO: 455010 - DNA, 25 bp, Homo sapien
aggacctattgctccccaagaataa

SEQ ID NO: 455011 - DNA, 25 bp, Homo sapien
attgctccccaagaataacatcttc

SEQ ID NO: 455012 - DNA, 25 bp, Homo sapien
gaactagacagaaaactaggcgtct

SEQ ID NO: 455013 - DNA, 25 bp, Homo sapien
aaaggacttgctcccattgtttgct

SEQ ID NO: 455014 - DNA, 25 bp, Homo sapien
ttgctcccattgtttgcttgttcca

SEQ ID NO: 455015 - DNA, 25 bp, Homo sapien
caggaccaccgagcaaggccttgga

SEQ ID NO: 455016 - DNA, 25 bp, Homo sapien
aaaccagagagattagagcgcagaa

SEQ ID NO: 455017 - DNA, 25 bp, Homo sapien
atgagcaacgcacaatatctattac

SEQ ID NO: 455018 - DNA, 25 bp, Homo sapien
aaaatgtacagatacctaggtccca

SEQ ID NO: 455019 - DNA, 25 bp, Homo sapien
agatacctaggtcccaactttgtag

SEQ ID NO: 455020 - DNA, 25 bp, Homo sapien
ggtcccaactttgtagactgattca

SEQ ID NO: 455021 - DNA, 25 bp, Homo sapien
gactgattcaagagtgtttgggatt

SEQ ID NO: 455022 - DNA, 25 bp, Homo sapien
ctcacagggtgttctgatgcataat

SEQ ID NO: 455023 - DNA, 25 bp, Homo sapien
gggtctagaataacctttagggcag

SEQ ID NO: 455024 - DNA, 25 bp, Homo sapien
gaataacctttagggcagtcaggtc

SEQ ID NO: 455025 - DNA, 25 bp, Homo sapien
gcagtcaggtccactggagctgaga

SEQ ID NO: 455026 - DNA, 25 bp, Homo sapien
aggtccactggagctgagagtagaa

SEQ ID NO: 455027 - DNA, 25 bp, Homo sapien
agtggaggccacatgagggatatat

SEQ ID NO: 455028 - DNA, 25 bp, Homo sapien
ctggatccgagggatgctacctctc

SEQ ID NO: 455029 - DNA, 25 bp, Homo sapien
gaggaagtgagatctccgcttgcag

SEQ ID NO: 455030 - DNA, 25 bp, Homo sapien
gaagtgagatctccgcttgcaggtc

SEQ ID NO: 455031 - DNA, 25 bp, Homo sapien
tgagatctccgcttgcaggtcagcc

SEQ ID NO: 455032 - DNA, 25 bp, Homo sapien
ggctggcttgactcaggccctgtga

SEQ ID NO: 455033 - DNA, 25 bp, Homo sapien
tggcttgactcaggccctgtgagat

SEQ ID NO: 455034 - DNA, 25 bp, Homo sapien
cctgtgagatagagggcccagccca

SEQ ID NO: 455035 - DNA, 25 bp, Homo sapien
agatcccctgctcctgttgtgttct

SEQ ID NO: 455036 - DNA, 25 bp, Homo sapien
ttgtaaatcatttggcgagactgta

SEQ ID NO: 455037 - DNA, 25 bp, Homo sapien
atcatttggcgagactgtattttag

SEQ ID NO: 455038 - DNA, 25 bp, Homo sapien
tgttctatttgagaggcgcctgtct

SEQ ID NO: 455039 - DNA, 25 bp, Homo sapien
accatttatccaagtatgtatacac

SEQ ID NO: 455040 - DNA, 25 bp, Homo sapien
aagtatgtatacacgggcttgctta

SEQ ID NO: 455041 - DNA, 25 bp, Homo sapien
tatacacgggcttgcttaaacctgc

SEQ ID NO: 455042 - DNA, 25 bp, Homo sapien
atttatgcacgaacatacacacata

SEQ ID NO: 455043 - DNA, 25 bp, Homo sapien
gtacatagacttgcttaaacctgcc

SEQ ID NO: 455044 - DNA, 25 bp, Homo sapien
agacacacacccctatccaggtatg

SEQ ID NO: 455045 - DNA, 25 bp, Homo sapien
acccctatccaggtatgtacataca

SEQ ID NO: 455046 - DNA, 25 bp, Homo sapien
aatactcacaaatcacctatccaag

SEQ ID NO: 455047 - DNA, 25 bp, Homo sapien
atcacctatccaagtatgtacacac

SEQ ID NO: 455048 - DNA, 25 bp, Homo sapien
gtatgtacacacaggctcacttaaa

SEQ ID NO: 455049 - DNA, 25 bp, Homo sapien
gtacacacaggctcacttaaacccg

SEQ ID NO: 455050 - DNA, 25 bp, Homo sapien
gaaagagccccaaactcgaggacct

SEQ ID NO: 455051 - DNA, 25 bp, Homo sapien
aagagccccaaactcgaggacctat

SEQ ID NO: 455052 - DNA, 25 bp, Homo sapien
gagccccaaactcgaggacctattg

SEQ ID NO: 455053 - DNA, 25 bp, Homo sapien
gccccaaactcgaggacctattgct

SEQ ID NO: 455054 - DNA, 25 bp, Homo sapien
aaactcgaggacctattgctcccca

SEQ ID NO: 455055 - DNA, 25 bp, Homo sapien
tcgaggacctattgctccccaagaa

SEQ ID NO: 455056 - DNA, 25 bp, Homo sapien
gaggacctattgctccccaagaata

SEQ ID NO: 455057 - DNA, 25 bp, Homo sapien
ggacctattgctccccaagaataac

SEQ ID NO: 455058 - DNA, 25 bp, Homo sapien
cctattgctccccaagaataacatc

SEQ ID NO: 455059 - DNA, 25 bp, Homo sapien
attgctccccaagaataacatcttc

SEQ ID NO: 455060 - DNA, 25 bp, Homo sapien
gaactagacagaaaactaggcgtct

SEQ ID NO: 455061 - DNA, 25 bp, Homo sapien
gaaggttttccttcagaggccacag

SEQ ID NO: 455062 - DNA, 25 bp, Homo sapien
agaggccacagagtctccacgggaa

SEQ ID NO: 455063 - DNA, 25 bp, Homo sapien
ggccacagagtctccacgggaacag

SEQ ID NO: 455064 - DNA, 25 bp, Homo sapien
cccgcttcagcattcctgtagagtg

SEQ ID NO: 455065 - DNA, 25 bp, Homo sapien
cattcctgtagagtgcttctgttgt

SEQ ID NO: 455066 - DNA, 25 bp, Homo sapien
gtagagtgcttctgttgtatatcag

SEQ ID NO: 455067 - DNA, 25 bp, Homo sapien
gaatctataaattgtggagcactcg

SEQ ID NO: 455068 - DNA, 25 bp, Homo sapien
gatagatgtgattgccttatttgtc

SEQ ID NO: 455069 - DNA, 25 bp, Homo sapien
gtgattgccttatttgtcatgaatt

SEQ ID NO: 455070 - DNA, 25 bp, Homo sapien
tctcctagagcaagaggcagcgcgg

SEQ ID NO: 455071 - DNA, 25 bp, Homo sapien
ggaactaggaagctggtgcaccact

SEQ ID NO: 455072 - DNA, 25 bp, Homo sapien
atatttgatatacttctgcctaaca

SEQ ID NO: 455073 - DNA, 25 bp, Homo sapien
atacttctgcctaacaacatggaaa

SEQ ID NO: 455074 - DNA, 25 bp, Homo sapien
gttttcttttccctgcaagctacat

SEQ ID NO: 455075 - DNA, 25 bp, Homo sapien
tttccctgcaagctacatcctactg

SEQ ID NO: 455076 - DNA, 25 bp, Homo sapien
catcctactgctttgaacttccaag

SEQ ID NO: 455077 - DNA, 25 bp, Homo sapien
cctactgctttgaacttccaagtat

SEQ ID NO: 455078 - DNA, 25 bp, Homo sapien
ttccaagtatgtctagtcacctttt

SEQ ID NO: 455079 - DNA, 25 bp, Homo sapien
gtatgtctagtcaccttttaaaatg

SEQ ID NO: 455080 - DNA, 25 bp, Homo sapien
gaaaaatgaggattgccttccttgt

SEQ ID NO: 455081 - DNA, 25 bp, Homo sapien
tccttgtatgcgctttttaccttga

SEQ ID NO: 455082 - DNA, 25 bp, Homo sapien
gtatgcgctttttaccttgactacc

SEQ ID NO: 455083 - DNA, 25 bp, Homo sapien
aagagttgttttctcatgttcatta

SEQ ID NO: 455084 - DNA, 25 bp, Homo sapien
gttttctcatgttcattatagttca

SEQ ID NO: 455085 - DNA, 25 bp, Homo sapien
ttacagttacatagtccgaaggtct

SEQ ID NO: 455086 - DNA, 25 bp, Homo sapien
tacatagtccgaaggtcttacaact

SEQ ID NO: 455087 - DNA, 25 bp, Homo sapien
gaaggtcttacaactaatcactggt

SEQ ID NO: 455088 - DNA, 25 bp, Homo sapien
ttacaactaatcactggtagcaata

SEQ ID NO: 455089 - DNA, 25 bp, Homo sapien
gcaataaatgcttcaggcccacatg

SEQ ID NO: 455090 - DNA, 25 bp, Homo sapien
atgcttcaggcccacatgatgctga

SEQ ID NO: 455091 - DNA, 25 bp, Homo sapien
gcccacatgatgctgattagttctc

SEQ ID NO: 455092 - DNA, 25 bp, Homo sapien
agttctcagttttcattcagttcac

SEQ ID NO: 455093 - DNA, 25 bp, Homo sapien
tcagttttcattcagttcacaatat

SEQ ID NO: 455094 - DNA, 25 bp, Homo sapien
aggagcaagcccctcacaatgcagc

SEQ ID NO: 455095 - DNA, 25 bp, Homo sapien
aagcccctcacaatgcagctgcatg

SEQ ID NO: 455096 - DNA, 25 bp, Homo sapien
gcagctgcatgggtttttagtgcct

SEQ ID NO: 455097 - DNA, 25 bp, Homo sapien
catgggtttttagtgcctactgaat

SEQ ID NO: 455098 - DNA, 25 bp, Homo sapien
ttagtgcctactgaattatatatat

SEQ ID NO: 455099 - DNA, 25 bp, Homo sapien
tatttgaaatgactaactttgtgct

SEQ ID NO: 455100 - DNA, 25 bp, Homo sapien
actaactttgtgctatctttatgaa

SEQ ID NO: 455101 - DNA, 25 bp, Homo sapien
gttaaatgtagcttttttgaaacag

SEQ ID NO: 455102 - DNA, 25 bp, Homo sapien
ttttgaaacagaagccttgaattga

SEQ ID NO: 455103 - DNA, 25 bp, Homo sapien
tataattttgtgcagtaccaatgac

SEQ ID NO: 455104 - DNA, 25 bp, Homo sapien
gtgcagtaccaatgacaaaaatatg

SEQ ID NO: 455105 - DNA, 25 bp, Homo sapien
aatttggaccttactcatccagtag

SEQ ID NO: 455106 - DNA, 25 bp, Homo sapien
ggaccttactcatccagtagaagat

SEQ ID NO: 455107 - DNA, 25 bp, Homo sapien
tgagcaatttctacgggagaaggtt

SEQ ID NO: 455108 - DNA, 25 bp, Homo sapien
gaaacacaaccaagacgcgaggatc

SEQ ID NO: 455109 - DNA, 25 bp, Homo sapien
ggttaaagtcaatggcaaaactgga

SEQ ID NO: 455110 - DNA, 25 bp, Homo sapien
caaaactggaaatctcgggaatgtt

SEQ ID NO: 455111 - DNA, 25 bp, Homo sapien
gaaatctcgggaatgttgttcacat

SEQ ID NO: 455112 - DNA, 25 bp, Homo sapien
aaaatcacagttgtttctgagaaac

SEQ ID NO: 455113 - DNA, 25 bp, Homo sapien
gaaacagttctctaaaaggtatttg

SEQ ID NO: 455114 - DNA, 25 bp, Homo sapien
agatggcgccgcagaaagacaggaa

SEQ ID NO: 455115 - DNA, 25 bp, Homo sapien
caagaggtcaacctggaggtttaat

SEQ ID NO: 455116 - DNA, 25 bp, Homo sapien
ctagggcccatcatggcagtcacag

SEQ ID NO: 455117 - DNA, 25 bp, Homo sapien
atcatggcagtcacagcagccccag

SEQ ID NO: 455118 - DNA, 25 bp, Homo sapien
gaaggagctgccttaaatggcccag

SEQ ID NO: 455119 - DNA, 25 bp, Homo sapien
ggagctgccttaaatggcccagtgt

SEQ ID NO: 455120 - DNA, 25 bp, Homo sapien
gctgccttaaatggcccagtgtgat

SEQ ID NO: 455121 - DNA, 25 bp, Homo sapien
ccttaaatggcccagtgtgatgctg

SEQ ID NO: 455122 - DNA, 25 bp, Homo sapien
tggtcaggctgcctccttaatcgag

SEQ ID NO: 455123 - DNA, 25 bp, Homo sapien
tcaggctgcctccttaatcgagaaa

SEQ ID NO: 455124 - DNA, 25 bp, Homo sapien
ggctgcctccttaatcgagaaaact

SEQ ID NO: 455125 - DNA, 25 bp, Homo sapien
aatcgagaaaactacctggtgatgc

SEQ ID NO: 455126 - DNA, 25 bp, Homo sapien
actacctggtgatgcaatctttttt

SEQ ID NO: 455127 - DNA, 25 bp, Homo sapien
tcgagaccgcgctgagcacgttctt

SEQ ID NO: 455128 - DNA, 25 bp, Homo sapien
gcgctgagcacgttcttccaagaaa

SEQ ID NO: 455129 - DNA, 25 bp, Homo sapien
gctgagcacgttcttccaagaaacc

SEQ ID NO: 455130 - DNA, 25 bp, Homo sapien
tgagcacgttcttccaagaaaccaa

SEQ ID NO: 455131 - DNA, 25 bp, Homo sapien
gcacgttcttccaagaaaccaacat

SEQ ID NO: 455132 - DNA, 25 bp, Homo sapien
cagatgatgtgcactcccagcaaca

SEQ ID NO: 455133 - DNA, 25 bp, Homo sapien
gatgatgtgcactcccagcaacacc

SEQ ID NO: 455134 - DNA, 25 bp, Homo sapien
ttccccgatgcgctggccatgttct

SEQ ID NO: 455135 - DNA, 25 bp, Homo sapien
cgatgcgctggccatgttctccaag

SEQ ID NO: 455136 - DNA, 25 bp, Homo sapien
tccgagggcctgcagagcagcaaca

SEQ ID NO: 455137 - DNA, 25 bp, Homo sapien
cagagcagcaacagccccatgacag

SEQ ID NO: 455138 - DNA, 25 bp, Homo sapien
gagatggcggcccaggatttcttcc

SEQ ID NO: 455139 - DNA, 25 bp, Homo sapien
gatggcggcccaggatttcttccag

SEQ ID NO: 455140 - DNA, 25 bp, Homo sapien
tggcggcccaggatttcttccagcg

SEQ ID NO: 455141 - DNA, 25 bp, Homo sapien
gcccaggatttcttccagcgctgga

SEQ ID NO: 455142 - DNA, 25 bp, Homo sapien
ccaggatttcttccagcgctggaag

SEQ ID NO: 455143 - DNA, 25 bp, Homo sapien
ggatttcttccagcgctggaagcag

SEQ ID NO: 455144 - DNA, 25 bp, Homo sapien
tccagcgctggaagcagctgagcct

SEQ ID NO: 455145 - DNA, 25 bp, Homo sapien
tggaagcagctgagcctccctcaac

SEQ ID NO: 455146 - DNA, 25 bp, Homo sapien
aagcttctggggtttggctctgctc

SEQ ID NO: 455147 - DNA, 25 bp, Homo sapien
atccagactaaagccctgcaggtgg

SEQ ID NO: 455148 - DNA, 25 bp, Homo sapien
cagactaaagccctgcaggtgggct

SEQ ID NO: 455149 - DNA, 25 bp, Homo sapien
ggtaatcaaacaacagttgtactaa

SEQ ID NO: 455150 - DNA, 25 bp, Homo sapien
agctaggacctaaatcagaatcata

SEQ ID NO: 455151 - DNA, 25 bp, Homo sapien
atcagaatcatagttgcctgcatat

SEQ ID NO: 455152 - DNA, 25 bp, Homo sapien
tagttgcctgcatatatggtaacaa

SEQ ID NO: 455153 - DNA, 25 bp, Homo sapien
atggtaacaaggtcgtgtgcatttg

SEQ ID NO: 455154 - DNA, 25 bp, Homo sapien
gtggttgaatagaagacacctttct

SEQ ID NO: 455155 - DNA, 25 bp, Homo sapien
tgtctttaggtttaggaggagatac

SEQ ID NO: 455156 - DNA, 25 bp, Homo sapien
ggagatactaagatactggatgttt

SEQ ID NO: 455157 - DNA, 25 bp, Homo sapien
ggatgtttatcctatcttagtttgg

SEQ ID NO: 455158 - DNA, 25 bp, Homo sapien
gtttatcctatcttagtttggttgg

SEQ ID NO: 455159 - DNA, 25 bp, Homo sapien
cctatcttagtttggttggagtaat

SEQ ID NO: 455160 - DNA, 25 bp, Homo sapien
tcctttaacagccatgccttctgga

SEQ ID NO: 455161 - DNA, 25 bp, Homo sapien
acagccatgccttctggaatctgga

SEQ ID NO: 455162 - DNA, 25 bp, Homo sapien
ggaatctggaagaggacaccactcc

SEQ ID NO: 455163 - DNA, 25 bp, Homo sapien
tggaagaggacaccactcctgcagt

SEQ ID NO: 455164 - DNA, 25 bp, Homo sapien
aagaggacaccactcctgcagtcac

SEQ ID NO: 455165 - DNA, 25 bp, Homo sapien
gccacatagcagctgcaggtcccag

SEQ ID NO: 455166 - DNA, 25 bp, Homo sapien
aactaatgtgcgtgagaatgggcct

SEQ ID NO: 455167 - DNA, 25 bp, Homo sapien
tgagaatgggcctggcacacctggg

SEQ ID NO: 455168 - DNA, 25 bp, Homo sapien
tagggctgccatgctgcagagctga

SEQ ID NO: 455169 - DNA, 25 bp, Homo sapien
tgccatgctgcagagctgatggagt

SEQ ID NO: 455170 - DNA, 25 bp, Homo sapien
gtgatgttgtgggcacaaggcatct

SEQ ID NO: 455171 - DNA, 25 bp, Homo sapien
ttcttgtacagctgtgcagtttctt

SEQ ID NO: 455172 - DNA, 25 bp, Homo sapien
gtacagctgtgcagtttcttgtaac

SEQ ID NO: 455173 - DNA, 25 bp, Homo sapien
tgtgcagtttcttgtaacagctgag

SEQ ID NO: 455174 - DNA, 25 bp, Homo sapien
cagtttcttgtaacagctgaggaca

SEQ ID NO: 455175 - DNA, 25 bp, Homo sapien
acaaagctaagacaggcggacaatt

SEQ ID NO: 455176 - DNA, 25 bp, Homo sapien
aagacaggcggacaatttagacaaa

SEQ ID NO: 455177 - DNA, 25 bp, Homo sapien
ggcggacaatttagacaaagatcat

SEQ ID NO: 455178 - DNA, 25 bp, Homo sapien
ccctagcaactcatgaggacagaca

SEQ ID NO: 455179 - DNA, 25 bp, Homo sapien
tcatgaggacagacaaccaagtggc

SEQ ID NO: 455180 - DNA, 25 bp, Homo sapien
actcccaatgggatggcagactttt

SEQ ID NO: 455181 - DNA, 25 bp, Homo sapien
tgggatggcagacttttcttctctc

SEQ ID NO: 455182 - DNA, 25 bp, Homo sapien
acactttagtaaggtataacgatat

SEQ ID NO: 455183 - DNA, 25 bp, Homo sapien
ggattctacttgatacagattgtta

SEQ ID NO: 455184 - DNA, 25 bp, Homo sapien
gccttgaaaacactggccgagttac

SEQ ID NO: 455185 - DNA, 25 bp, Homo sapien
aacactggccgagttaccagaggaa

SEQ ID NO: 455186 - DNA, 25 bp, Homo sapien
ttaccagaggaatatagggacttct

SEQ ID NO: 455187 - DNA, 25 bp, Homo sapien
atatagggacttctatgcacgacga

SEQ ID NO: 455188 - DNA, 25 bp, Homo sapien
tagggacttctatgcacgacgaatg

SEQ ID NO: 455189 - DNA, 25 bp, Homo sapien
ggacttctatgcacgacgaatggtc

SEQ ID NO: 455190 - DNA, 25 bp, Homo sapien
ttctatgcacgacgaatggtcctac

SEQ ID NO: 455191 - DNA, 25 bp, Homo sapien
tgcacgacgaatggtcctacacatt

SEQ ID NO: 455192 - DNA, 25 bp, Homo sapien
gaatgcaatgcacattaacacttta

SEQ ID NO: 455193 - DNA, 25 bp, Homo sapien
atttcacccttagtagctttgcatt

SEQ ID NO: 455194 - DNA, 25 bp, Homo sapien
tagtagttgctatacattttttaac

SEQ ID NO: 455195 - DNA, 25 bp, Homo sapien
catgattatggtaagtactttggaa

SEQ ID NO: 455196 - DNA, 25 bp, Homo sapien
gtactttggaagatatccttttcag

SEQ ID NO: 455197 - DNA, 25 bp, Homo sapien
tgctaaaatacctctttttcaaagg

SEQ ID NO: 455198 - DNA, 25 bp, Homo sapien
gaagaaggctctatgctcatcgtga

SEQ ID NO: 455199 - DNA, 25 bp, Homo sapien
aaggctctatgctcatcgtgataaa

SEQ ID NO: 455200 - DNA, 25 bp, Homo sapien
gctcatcgtgataaagtggagtttt

SEQ ID NO: 455201 - DNA, 25 bp, Homo sapien
gtaagctttaagctgcttttaccag

SEQ ID NO: 455202 - DNA, 25 bp, Homo sapien
gctgcttttaccagttgaactccaa

SEQ ID NO: 455203 - DNA, 25 bp, Homo sapien
taccagttgaactccaaaaataatg

SEQ ID NO: 455204 - DNA, 25 bp, Homo sapien
taaagccctggtgaaaactccttct

SEQ ID NO: 455205 - DNA, 25 bp, Homo sapien
ttaggattatccaaccaatgtattt

SEQ ID NO: 455206 - DNA, 25 bp, Homo sapien
gtatttggcccattgttttgctgaa

SEQ ID NO: 455207 - DNA, 25 bp, Homo sapien
ttgctgaagccaccttgagttgatt

SEQ ID NO: 455208 - DNA, 25 bp, Homo sapien
agccaccttgagttgatttctgttc

SEQ ID NO: 455209 - DNA, 25 bp, Homo sapien
gttccttgcaaccacaagaatccta

SEQ ID NO: 455210 - DNA, 25 bp, Homo sapien
aagaatcctaacttacgagtagcaa

SEQ ID NO: 455211 - DNA, 25 bp, Homo sapien
caatccttacatgcgtttaacactg

SEQ ID NO: 455212 - DNA, 25 bp, Homo sapien
gcgtttaacactgtgcacatttaca

SEQ ID NO: 455213 - DNA, 25 bp, Homo sapien
gttttcccagttcacagttctcatt

SEQ ID NO: 455214 - DNA, 25 bp, Homo sapien
cagttcacagttctcattcttctgg

SEQ ID NO: 455215 - DNA, 25 bp, Homo sapien
gaatcagagtattagggtagttaac

SEQ ID NO: 455216 - DNA, 25 bp, Homo sapien
agggtagttaacttacacatttgca

SEQ ID NO: 455217 - DNA, 25 bp, Homo sapien
acatttgcattcttagtttaactgc

SEQ ID NO: 455218 - DNA, 25 bp, Homo sapien
gtttaactgcaagtggtgtaactat

SEQ ID NO: 455219 - DNA, 25 bp, Homo sapien
ctgcaagtggtgtaactatgttttt

SEQ ID NO: 455220 - DNA, 25 bp, Homo sapien
aactatgtttttcaatgatcgcatt

SEQ ID NO: 455221 - DNA, 25 bp, Homo sapien
gatcgcatttgaaacataagtccta

SEQ ID NO: 455222 - DNA, 25 bp, Homo sapien
gtcctattataccattaagttccta

SEQ ID NO: 455223 - DNA, 25 bp, Homo sapien
aagttcctattatgcagcaattata

SEQ ID NO: 455224 - DNA, 25 bp, Homo sapien
atataataaaaagtactgcccaagt

SEQ ID NO: 455225 - DNA, 25 bp, Homo sapien
gtactgcccaagttatagtaatgtg

SEQ ID NO: 455226 - DNA, 25 bp, Homo sapien
taaaatgaggttggcagtgaagaaa

SEQ ID NO: 455227 - DNA, 25 bp, Homo sapien
aaacagcctcattcatgtaactggt

SEQ ID NO: 455228 - DNA, 25 bp, Homo sapien
aatacattttcactatgtgttcata

SEQ ID NO: 455229 - DNA, 25 bp, Homo sapien
tttcactatgtgttcataaactttt

SEQ ID NO: 455230 - DNA, 25 bp, Homo sapien
acttttaatgaagctgtttgtcttt

SEQ ID NO: 455231 - DNA, 25 bp, Homo sapien
tgaagctgtttgtctttcagttcaa

SEQ ID NO: 455232 - DNA, 25 bp, Homo sapien
gtgatgtttaggctttatttctgtt

SEQ ID NO: 455233 - DNA, 25 bp, Homo sapien
gatgtttaggctttatttctgttaa

SEQ ID NO: 455234 - DNA, 25 bp, Homo sapien
gttaataaggctttttaccattgat

SEQ ID NO: 455235 - DNA, 25 bp, Homo sapien
aaggctttttaccattgattaaatg

SEQ ID NO: 455236 - DNA, 25 bp, Homo sapien
cgttgtaacaataaagttgagttct

SEQ ID NO: 455237 - DNA, 25 bp, Homo sapien
ccttaacgtgcctttggtttatcat

SEQ ID NO: 455238 - DNA, 25 bp, Homo sapien
ggtttatcatgggtttcaccagata

SEQ ID NO: 455239 - DNA, 25 bp, Homo sapien
tatttcctatcagaattgtccacgg

SEQ ID NO: 455240 - DNA, 25 bp, Homo sapien
ttgtccacggataccataactcatc

SEQ ID NO: 455241 - DNA, 25 bp, Homo sapien
aactcatctgctcactatgaatgtg

SEQ ID NO: 455242 - DNA, 25 bp, Homo sapien
ttgcatattttctaagccagatgat

SEQ ID NO: 455243 - DNA, 25 bp, Homo sapien
aagcccaatggttctacaattcttt

SEQ ID NO: 455244 - DNA, 25 bp, Homo sapien
gagaacagcatagctctccaactgg

SEQ ID NO: 455245 - DNA, 25 bp, Homo sapien
ttgctgacagcaacacaaatgcact

SEQ ID NO: 455246 - DNA, 25 bp, Homo sapien
gcactagctacttgaagagttcctt

SEQ ID NO: 455247 - DNA, 25 bp, Homo sapien
agagttccttcatgcttattcttct

SEQ ID NO: 455248 - DNA, 25 bp, Homo sapien
tactgccaagcaacccaaactcaaa

SEQ ID NO: 455249 - DNA, 25 bp, Homo sapien
gcaacccaaactcaaaggtctgcga

SEQ ID NO: 455250 - DNA, 25 bp, Homo sapien
aggtctgcgacctgcaagttcagat

SEQ ID NO: 455251 - DNA, 25 bp, Homo sapien
gaaactgtctcaagcttccaagata

SEQ ID NO: 455252 - DNA, 25 bp, Homo sapien
aactgtctcaagcttccaagataat

SEQ ID NO: 455253 - DNA, 25 bp, Homo sapien
gtctcaagcttccaagataataact

SEQ ID NO: 455254 - DNA, 25 bp, Homo sapien
gataataactggtgaagacagagtc

SEQ ID NO: 455255 - DNA, 25 bp, Homo sapien
agagtcagactgacccaagcaaagg

SEQ ID NO: 455256 - DNA, 25 bp, Homo sapien
gagctgcatgaacagaaattctcta

SEQ ID NO: 455257 - DNA, 25 bp, Homo sapien
aaattctctaaagatcagggatgga

SEQ ID NO: 455258 - DNA, 25 bp, Homo sapien
gaactataaaaacatgaacctgggt

SEQ ID NO: 455259 - DNA, 25 bp, Homo sapien
cctgtcttgtttctcatccaatatt

SEQ ID NO: 455260 - DNA, 25 bp, Homo sapien
gtttctcatccaatatttcttttca

SEQ ID NO: 455261 - DNA, 25 bp, Homo sapien
atttcttttcagtattatcacagtt

SEQ ID NO: 455262 - DNA, 25 bp, Homo sapien
gtttggacttaaatcaagcatagca

SEQ ID NO: 455263 - DNA, 25 bp, Homo sapien
tgattctttgacattagctcccaag

SEQ ID NO: 455264 - DNA, 25 bp, Homo sapien
atggtttcagtggtcctgaactttg

SEQ ID NO: 455265 - DNA, 25 bp, Homo sapien
gaactttggaagatgctgatcaggt

SEQ ID NO: 455266 - DNA, 25 bp, Homo sapien
ggtaataactgttctgtgccctaca

SEQ ID NO: 455267 - DNA, 25 bp, Homo sapien
taactgttctgtgccctacaaggag

SEQ ID NO: 455268 - DNA, 25 bp, Homo sapien
ctacaaggaggatgccacctgtaaa

SEQ ID NO: 455269 - DNA, 25 bp, Homo sapien
aaggcactgagaagttttattgtct

SEQ ID NO: 455270 - DNA, 25 bp, Homo sapien
tgcgcccggcctgatccatgaaaat

SEQ ID NO: 455271 - DNA, 25 bp, Homo sapien
gcgcccggcctgatccatgaaaatt

SEQ ID NO: 455272 - DNA, 25 bp, Homo sapien
cgcccggcctgatccatgaaaattg

SEQ ID NO: 455273 - DNA, 25 bp, Homo sapien
cccggcctgatccatgaaaattgag

SEQ ID NO: 455274 - DNA, 25 bp, Homo sapien
ccggcctgatccatgaaaattgaga

SEQ ID NO: 455275 - DNA, 25 bp, Homo sapien
cggcctgatccatgaaaattgagag

SEQ ID NO: 455276 - DNA, 25 bp, Homo sapien
ggcctgatccatgaaaattgagaga

SEQ ID NO: 455277 - DNA, 25 bp, Homo sapien
gcctgatccatgaaaattgagagag

SEQ ID NO: 455278 - DNA, 25 bp, Homo sapien
cctgatccatgaaaattgagagaga

SEQ ID NO: 455279 - DNA, 25 bp, Homo sapien
ctgatccatgaaaattgagagagaa

SEQ ID NO: 455280 - DNA, 25 bp, Homo sapien
gatccatgaaaattgagagagaata

SEQ ID NO: 455281 - DNA, 25 bp, Homo sapien
tgagactgggacagggtgtgagatt

SEQ ID NO: 455282 - DNA, 25 bp, Homo sapien
actgggacagggtgtgagattgaga

SEQ ID NO: 455283 - DNA, 25 bp, Homo sapien
gattgagagagtttaaatggcatgc

SEQ ID NO: 455284 - DNA, 25 bp, Homo sapien
attgagagagtttaaatggcatgca

SEQ ID NO: 455285 - DNA, 25 bp, Homo sapien
ttgagagagtttaaatggcatgcaa

SEQ ID NO: 455286 - DNA, 25 bp, Homo sapien
tgagagagtttaaatggcatgcaag

SEQ ID NO: 455287 - DNA, 25 bp, Homo sapien
agtttaaatggcatgcaaggccagg

SEQ ID NO: 455288 - DNA, 25 bp, Homo sapien
gtttaaatggcatgcaaggccaggc

SEQ ID NO: 455289 - DNA, 25 bp, Homo sapien
tttaaatggcatgcaaggccaggcg

SEQ ID NO: 455290 - DNA, 25 bp, Homo sapien
ttaaatggcatgcaaggccaggcgc

SEQ ID NO: 455291 - DNA, 25 bp, Homo sapien
taaatggcatgcaaggccaggcgcg

SEQ ID NO: 455292 - DNA, 25 bp, Homo sapien
atatttatttaacattcagtggtag

SEQ ID NO: 455293 - DNA, 25 bp, Homo sapien
tttaacattcagtggtagtaaacac

SEQ ID NO: 455294 - DNA, 25 bp, Homo sapien
gtggtagtaaacactgggattagta

SEQ ID NO: 455295 - DNA, 25 bp, Homo sapien
gtaaacactgggattagtacttaat

SEQ ID NO: 455296 - DNA, 25 bp, Homo sapien
aacactgggattagtacttaattag

SEQ ID NO: 455297 - DNA, 25 bp, Homo sapien
gtacttaattagagttgatcctcat

SEQ ID NO: 455298 - DNA, 25 bp, Homo sapien
cttaattagagttgatcctcataat

SEQ ID NO: 455299 - DNA, 25 bp, Homo sapien
gagttgatcctcataataaacttga

SEQ ID NO: 455300 - DNA, 25 bp, Homo sapien
tcctcataataaacttgatccccat

SEQ ID NO: 455301 - DNA, 25 bp, Homo sapien
tatacacatctccagttattacaaa

SEQ ID NO: 455302 - DNA, 25 bp, Homo sapien
acaaagtgaactgctaggaatgtga

SEQ ID NO: 455303 - DNA, 25 bp, Homo sapien
tgagctgtggaggtaggtccattat

SEQ ID NO: 455304 - DNA, 25 bp, Homo sapien
aggtccattatgaaactcgtagagt

SEQ ID NO: 455305 - DNA, 25 bp, Homo sapien
caaagccagagggttgggaactgtt

SEQ ID NO: 455306 - DNA, 25 bp, Homo sapien
ttgggaactgttgacacaacctctc

SEQ ID NO: 455307 - DNA, 25 bp, Homo sapien
tctcctcctgctttatgatcttctg

SEQ ID NO: 455308 - DNA, 25 bp, Homo sapien
gctttatgatcttctgccagggaat

SEQ ID NO: 455309 - DNA, 25 bp, Homo sapien
agggaattaattaccatcgccaact

SEQ ID NO: 455310 - DNA, 25 bp, Homo sapien
aattaccatcgccaactggaagcaa

SEQ ID NO: 455311 - DNA, 25 bp, Homo sapien
aatgaaatctagagctgtcagcctt

SEQ ID NO: 455312 - DNA, 25 bp, Homo sapien
tctagagctgtcagccttctacaca

SEQ ID NO: 455313 - DNA, 25 bp, Homo sapien
acagctacctatttactacattcca

SEQ ID NO: 455314 - DNA, 25 bp, Homo sapien
aacaaatgcagtgtggttgctggat

SEQ ID NO: 455315 - DNA, 25 bp, Homo sapien
gtcccagaacagaaagggcacgcat

SEQ ID NO: 455316 - DNA, 25 bp, Homo sapien
gcacgcatgggaaagccacagtctt

SEQ ID NO: 455317 - DNA, 25 bp, Homo sapien
gggaaagccacagtcttcagttagt

SEQ ID NO: 455318 - DNA, 25 bp, Homo sapien
gtcttcagttagtgtggtctgcaga

SEQ ID NO: 455319 - DNA, 25 bp, Homo sapien
ggtctgcagagtgtcccaatgtggc

SEQ ID NO: 455320 - DNA, 25 bp, Homo sapien
tcccaatgtggctctgtgactgtga

SEQ ID NO: 455321 - DNA, 25 bp, Homo sapien
tgtgactgtgacacataacaccaca

SEQ ID NO: 455322 - DNA, 25 bp, Homo sapien
acaccacagtgaagaacagtgacca

SEQ ID NO: 455323 - DNA, 25 bp, Homo sapien
aacagtgaccacaccaagggaggcc

SEQ ID NO: 455324 - DNA, 25 bp, Homo sapien
ttttctttttgatacaggatcttgg

SEQ ID NO: 455325 - DNA, 25 bp, Homo sapien
cctgggacagacagagcacctggta

SEQ ID NO: 455326 - DNA, 25 bp, Homo sapien
agacttaaacattcctgcctgctga

SEQ ID NO: 455327 - DNA, 25 bp, Homo sapien
gacttaaacattcctgcctgctgac

SEQ ID NO: 455328 - DNA, 25 bp, Homo sapien
acttaaacattcctgcctgctgact

SEQ ID NO: 455329 - DNA, 25 bp, Homo sapien
ttaaacattcctgcctgctgactct

SEQ ID NO: 455330 - DNA, 25 bp, Homo sapien
aacattcctgcctgctgactctgaa

SEQ ID NO: 455331 - DNA, 25 bp, Homo sapien
attcctgcctgctgactctgaagag

SEQ ID NO: 455332 - DNA, 25 bp, Homo sapien
tgcctgctgactctgaagagagcag

SEQ ID NO: 455333 - DNA, 25 bp, Homo sapien
atagtgctcaagctctgctgaggga

SEQ ID NO: 455334 - DNA, 25 bp, Homo sapien
tagtgctcaagctctgctgagggac

SEQ ID NO: 455335 - DNA, 25 bp, Homo sapien
tcaagtgtgtccctgacccccatgc

SEQ ID NO: 455336 - DNA, 25 bp, Homo sapien
tttaaaatatattccagccaggtgc

SEQ ID NO: 455337 - DNA, 25 bp, Homo sapien
cgcgctcttggctgcgatccagact

SEQ ID NO: 455338 - DNA, 25 bp, Homo sapien
gcgctcttggctgcgatccagactg

SEQ ID NO: 455339 - DNA, 25 bp, Homo sapien
cgctcttggctgcgatccagactgc

SEQ ID NO: 455340 - DNA, 25 bp, Homo sapien
gctcttggctgcgatccagactgca

SEQ ID NO: 455341 - DNA, 25 bp, Homo sapien
ctcttggctgcgatccagactgcac

SEQ ID NO: 455342 - DNA, 25 bp, Homo sapien
tcttggctgcgatccagactgcact

SEQ ID NO: 455343 - DNA, 25 bp, Homo sapien
cttggctgcgatccagactgcactc

SEQ ID NO: 455344 - DNA, 25 bp, Homo sapien
ttggctgcgatccagactgcactcc

SEQ ID NO: 455345 - DNA, 25 bp, Homo sapien
taaacagtaggcaaaggattcgaag

SEQ ID NO: 455346 - DNA, 25 bp, Homo sapien
ggattcgaagagacctttgtccaaa

SEQ ID NO: 455347 - DNA, 25 bp, Homo sapien
atgaccaatgagtacgtgaaaagat

SEQ ID NO: 455348 - DNA, 25 bp, Homo sapien
gatactcagcagctactcattatgg

SEQ ID NO: 455349 - DNA, 25 bp, Homo sapien
cagcagctactcattatggaagtac

SEQ ID NO: 455350 - DNA, 25 bp, Homo sapien
atggaagtaccactttccactcatg

SEQ ID NO: 455351 - DNA, 25 bp, Homo sapien
ctttccactcatgctgagggctata

SEQ ID NO: 455352 - DNA, 25 bp, Homo sapien
aactggatttctcatagattgctgg

SEQ ID NO: 455353 - DNA, 25 bp, Homo sapien
atttctcatagattgctggtgggaa

SEQ ID NO: 455354 - DNA, 25 bp, Homo sapien
tggtgggaaagtaacatggtgcaac

SEQ ID NO: 455355 - DNA, 25 bp, Homo sapien
aacatggtgcaaccaatgtagaaac

SEQ ID NO: 455356 - DNA, 25 bp, Homo sapien
gaaaattttagtatccctatattga

SEQ ID NO: 455357 - DNA, 25 bp, Homo sapien
gtatccctatattgattagagaagc

SEQ ID NO: 455358 - DNA, 25 bp, Homo sapien
aaattattccaccaagacaatgtga

SEQ ID NO: 455359 - DNA, 25 bp, Homo sapien
ttccaccaagacaatgtgaagccta

SEQ ID NO: 455360 - DNA, 25 bp, Homo sapien
gtgaagcctaaatggccacactaat

SEQ ID NO: 455361 - DNA, 25 bp, Homo sapien
atggccacactaataaattttatca

SEQ ID NO: 455362 - DNA, 25 bp, Homo sapien
tgtgaatcttatgtaaagtcttcca

SEQ ID NO: 455363 - DNA, 25 bp, Homo sapien
atgagaatacttcttaactcatttt

SEQ ID NO: 455364 - DNA, 25 bp, Homo sapien
ggtaactatcattgttactgtgata

SEQ ID NO: 455365 - DNA, 25 bp, Homo sapien
gttactgtgatactaaaattcaaca

SEQ ID NO: 455366 - DNA, 25 bp, Homo sapien
gaatcagtattcttcatggatatag

SEQ ID NO: 455367 - DNA, 25 bp, Homo sapien
tgctcaaggtcacatacccactagg

SEQ ID NO: 455368 - DNA, 25 bp, Homo sapien
acccactaggtgacagatttgaatc

SEQ ID NO: 455369 - DNA, 25 bp, Homo sapien
gatttgaatccagaattgtactcct

SEQ ID NO: 455370 - DNA, 25 bp, Homo sapien
agaattgtactcctcaacacagagc

SEQ ID NO: 455371 - DNA, 25 bp, Homo sapien
tcactatgccggagatgctgagttt

SEQ ID NO: 455372 - DNA, 25 bp, Homo sapien
agatgctgagtttcttggcctgggc

SEQ ID NO: 455373 - DNA, 25 bp, Homo sapien
gcagccccacacagccggttttgag

SEQ ID NO: 455374 - DNA, 25 bp, Homo sapien
ttttgagctccccaggtgaatctac

SEQ ID NO: 455375 - DNA, 25 bp, Homo sapien
aggtgaatctactgggctccctggg

SEQ ID NO: 455376 - DNA, 25 bp, Homo sapien
agaaccactgctctacatcagcctt

SEQ ID NO: 455377 - DNA, 25 bp, Homo sapien
acatcagccttcttacatgaatcag

SEQ ID NO: 455378 - DNA, 25 bp, Homo sapien
gaatgaaattcactacaacccgtca

SEQ ID NO: 455379 - DNA, 25 bp, Homo sapien
caacccgtcacccaaagatgactat

SEQ ID NO: 455380 - DNA, 25 bp, Homo sapien
gactattcaaatactaggatacatc

SEQ ID NO: 455381 - DNA, 25 bp, Homo sapien
gatattttgaaccttatgcttttta

SEQ ID NO: 455382 - DNA, 25 bp, Homo sapien
aatgtcataagtgccatttattgag

SEQ ID NO: 455383 - DNA, 25 bp, Homo sapien
acttactatatgtgaggcatgttgc

SEQ ID NO: 455384 - DNA, 25 bp, Homo sapien
ggcatgttgcgaagtgctttgtaca

SEQ ID NO: 455385 - DNA, 25 bp, Homo sapien
agtgctttgtacatgcgacattcat

SEQ ID NO: 455386 - DNA, 25 bp, Homo sapien
gcgacattcattctcaacagcataa

SEQ ID NO: 455387 - DNA, 25 bp, Homo sapien
tcaacagcataactagaaggaaggt

SEQ ID NO: 455388 - DNA, 25 bp, Homo sapien
actgttgttgtcagctctgtttaaa

SEQ ID NO: 455389 - DNA, 25 bp, Homo sapien
cagtccaggccacagttcagggtca

SEQ ID NO: 455390 - DNA, 25 bp, Homo sapien
aggccacagttcagggtcacttgta

SEQ ID NO: 455391 - DNA, 25 bp, Homo sapien
agttcagggtcacttgtaccacaca

SEQ ID NO: 455392 - DNA, 25 bp, Homo sapien
ggtcacttgtaccacacagcccggg

SEQ ID NO: 455393 - DNA, 25 bp, Homo sapien
cttctgctgaaggttctgttgtata

SEQ ID NO: 455394 - DNA, 25 bp, Homo sapien
attaattttaagttgcagtgtctgc

SEQ ID NO: 455395 - DNA, 25 bp, Homo sapien
gtctgcactgcaagatgacaccact

SEQ ID NO: 455396 - DNA, 25 bp, Homo sapien
gatgacaccactcgcattttgatta

SEQ ID NO: 455397 - DNA, 25 bp, Homo sapien
cactcgcattttgattaaggatttt

SEQ ID NO: 455398 - DNA, 25 bp, Homo sapien
cattatctgagttcccagagacctc

SEQ ID NO: 455399 - DNA, 25 bp, Homo sapien
ggcacatgagtgtgccctgcactac

SEQ ID NO: 455400 - DNA, 25 bp, Homo sapien
aacctggcaagtgagtgttttctct

SEQ ID NO: 455401 - DNA, 25 bp, Homo sapien
gggcgtgcacctcaggcctactcag

SEQ ID NO: 455402 - DNA, 25 bp, Homo sapien
aggcctactcagagccagatctcaa

SEQ ID NO: 455403 - DNA, 25 bp, Homo sapien
actcagagccagatctcaagagcag

SEQ ID NO: 455404 - DNA, 25 bp, Homo sapien
atctcaagagcagaggtgtcacctt

SEQ ID NO: 455405 - DNA, 25 bp, Homo sapien
gagcagaggtgtcaccttcagcacc

SEQ ID NO: 455406 - DNA, 25 bp, Homo sapien
ttcagcacctgcatagcgctaggtt

SEQ ID NO: 455407 - DNA, 25 bp, Homo sapien
acctgcatagcgctaggttgtatgg

SEQ ID NO: 455408 - DNA, 25 bp, Homo sapien
aaagcacccagttgggagcacccct

SEQ ID NO: 455409 - DNA, 25 bp, Homo sapien
gggagcaccccttgaggccattgat

SEQ ID NO: 455410 - DNA, 25 bp, Homo sapien
ttgaggccattgatcctggcacctc

SEQ ID NO: 455411 - DNA, 25 bp, Homo sapien
ttccctcttacagtttatctggata

SEQ ID NO: 455412 - DNA, 25 bp, Homo sapien
tccctcttacagtttatctggatac

SEQ ID NO: 455413 - DNA, 25 bp, Homo sapien
ccctcttacagtttatctggatacg

SEQ ID NO: 455414 - DNA, 25 bp, Homo sapien
ctcttacagtttatctggatacggt

SEQ ID NO: 455415 - DNA, 25 bp, Homo sapien
cttacagtttatctggatacggtgt

SEQ ID NO: 455416 - DNA, 25 bp, Homo sapien
tacagtttatctggatacggtgttt

SEQ ID NO: 455417 - DNA, 25 bp, Homo sapien
tggatacggtgtttaaaatgacaat

SEQ ID NO: 455418 - DNA, 25 bp, Homo sapien
ttaaaatgacaatacagccaggcgc

SEQ ID NO: 455419 - DNA, 25 bp, Homo sapien
taaaatgacaatacagccaggcgcg

SEQ ID NO: 455420 - DNA, 25 bp, Homo sapien
aaaatgacaatacagccaggcgcgg

SEQ ID NO: 455421 - DNA, 25 bp, Homo sapien
gatcagcctagccaatgtggaaaaa

SEQ ID NO: 455422 - DNA, 25 bp, Homo sapien
aactacctaagattattttcacagc

SEQ ID NO: 455423 - DNA, 25 bp, Homo sapien
ttcacagctaccaatttgtcagaaa

SEQ ID NO: 455424 - DNA, 25 bp, Homo sapien
aagactctaagacacgatcctgatt

SEQ ID NO: 455425 - DNA, 25 bp, Homo sapien
gacacgatcctgatttgtgtcattt

SEQ ID NO: 455426 - DNA, 25 bp, Homo sapien
tctaagtatcagatttgttctccct

SEQ ID NO: 455427 - DNA, 25 bp, Homo sapien
atttgttctcccttcatttgacagg

SEQ ID NO: 455428 - DNA, 25 bp, Homo sapien
atttgacaggtgttctcagtctctc

SEQ ID NO: 455429 - DNA, 25 bp, Homo sapien
tctcctcctgtaagattctgtcctt

SEQ ID NO: 455430 - DNA, 25 bp, Homo sapien
taagattctgtccttcccctgatga

SEQ ID NO: 455431 - DNA, 25 bp, Homo sapien
gatgacaagccaatagttcttggtg

SEQ ID NO: 455432 - DNA, 25 bp, Homo sapien
ttgcatgtctcctagagccccagga

SEQ ID NO: 455433 - DNA, 25 bp, Homo sapien
aacaatcatatgtacttaaggagta

SEQ ID NO: 455434 - DNA, 25 bp, Homo sapien
aggagtatactgtttcaatgcatgt

SEQ ID NO: 455435 - DNA, 25 bp, Homo sapien
gggtaattagcaaattcctcacctc

SEQ ID NO: 455436 - DNA, 25 bp, Homo sapien
aattcctcacctcaaacattatcat

SEQ ID NO: 455437 - DNA, 25 bp, Homo sapien
aaacattatcatttcattgtggtga

SEQ ID NO: 455438 - DNA, 25 bp, Homo sapien
tgaaatatacattatcactaactat

SEQ ID NO: 455439 - DNA, 25 bp, Homo sapien
atcactaactatagtcgtcctactg

SEQ ID NO: 455440 - DNA, 25 bp, Homo sapien
ctaactatagtcgtcctactgtgca

SEQ ID NO: 455441 - DNA, 25 bp, Homo sapien
acttgttcctcctatctaagtgtag

SEQ ID NO: 455442 - DNA, 25 bp, Homo sapien
gttcctcctatctaagtgtagctta

SEQ ID NO: 455443 - DNA, 25 bp, Homo sapien
agtgtagcttactttgtacctgttg

SEQ ID NO: 455444 - DNA, 25 bp, Homo sapien
acaccctccagaatagcactgttga

SEQ ID NO: 455445 - DNA, 25 bp, Homo sapien
ccaatcctgtctcaggtcaatgctt

SEQ ID NO: 455446 - DNA, 25 bp, Homo sapien
gagataataggtctgattcaacttg

SEQ ID NO: 455447 - DNA, 25 bp, Homo sapien
gaatcagatattcactcctgctcca

SEQ ID NO: 455448 - DNA, 25 bp, Homo sapien
tgctccaaccagttgtggctgtgga

SEQ ID NO: 455449 - DNA, 25 bp, Homo sapien
gtggctgtggagttagagtcacata

SEQ ID NO: 455450 - DNA, 25 bp, Homo sapien
gagtcacatagcaggaacacagttg

SEQ ID NO: 455451 - DNA, 25 bp, Homo sapien
aacacagttgctgataagccatttt

SEQ ID NO: 455452 - DNA, 25 bp, Homo sapien
ataagccatttttgtggacagagtg

SEQ ID NO: 455453 - DNA, 25 bp, Homo sapien
acctatgatcaattcttggtcacat

SEQ ID NO: 455454 - DNA, 25 bp, Homo sapien
cacattgtgaggcagttgaagtttc

SEQ ID NO: 455455 - DNA, 25 bp, Homo sapien
agcctctctctgattcttgcacaag

SEQ ID NO: 455456 - DNA, 25 bp, Homo sapien
ctgattcttgcacaagggcacctac

SEQ ID NO: 455457 - DNA, 25 bp, Homo sapien
ctacatctcagagccagcgagagtg

SEQ ID NO: 455458 - DNA, 25 bp, Homo sapien
tggaatccttctcacgaggcctcat

SEQ ID NO: 455459 - DNA, 25 bp, Homo sapien
tcatctctctgactttcgtcgggaa

SEQ ID NO: 455460 - DNA, 25 bp, Homo sapien
gactttcgtcgggaaatgttctctg

SEQ ID NO: 455461 - DNA, 25 bp, Homo sapien
gtaattattttgagcctacccgata

SEQ ID NO: 455462 - DNA, 25 bp, Homo sapien
gagcctacccgataatccaggataa

SEQ ID NO: 455463 - DNA, 25 bp, Homo sapien
aatcccctcatctaaaaatctgtta

SEQ ID NO: 455464 - DNA, 25 bp, Homo sapien
aaatctgttaccttaaccacatctg

SEQ ID NO: 455465 - DNA, 25 bp, Homo sapien
aaagtccctgttgccgtgtaaagag

SEQ ID NO: 455466 - DNA, 25 bp, Homo sapien
agagggacccccacagcggcagctg

SEQ ID NO: 455467 - DNA, 25 bp, Homo sapien
ccacagcggcagctgcgagctgaag

SEQ ID NO: 455468 - DNA, 25 bp, Homo sapien
agcggcagctgcgagctgaagggct

SEQ ID NO: 455469 - DNA, 25 bp, Homo sapien
ctccttgagcgtggccagagtggac

SEQ ID NO: 455470 - DNA, 25 bp, Homo sapien
cagagtggacgccaatgccaaagag

SEQ ID NO: 455471 - DNA, 25 bp, Homo sapien
agagtggacgccaatgccaaagagg

SEQ ID NO: 455472 - DNA, 25 bp, Homo sapien
agtggacgccaatgccaaagaggca

SEQ ID NO: 455473 - DNA, 25 bp, Homo sapien
gacgccaatgccaaagaggcaccga

SEQ ID NO: 455474 - DNA, 25 bp, Homo sapien
ccaatgccaaagaggcaccgagagt

SEQ ID NO: 455475 - DNA, 25 bp, Homo sapien
tgccaaagaggcaccgagagtgagc

SEQ ID NO: 455476 - DNA, 25 bp, Homo sapien
gagcgagggctgctagcacgttgtc

SEQ ID NO: 455477 - DNA, 25 bp, Homo sapien
gactgaaaatagtaactctccctgg

SEQ ID NO: 455478 - DNA, 25 bp, Homo sapien
tagtaactctccctggttatttcca

SEQ ID NO: 455479 - DNA, 25 bp, Homo sapien
ggttatttccacagtcactttaggc

SEQ ID NO: 455480 - DNA, 25 bp, Homo sapien
cacagtcactttaggcacttgggaa

SEQ ID NO: 455481 - DNA, 25 bp, Homo sapien
aggcacttgggaaaatgcattctcc

SEQ ID NO: 455482 - DNA, 25 bp, Homo sapien
taggaatgaggcaagtacagtacaa

SEQ ID NO: 455483 - DNA, 25 bp, Homo sapien
ccaggaatcaacaaaggaccaccaa

SEQ ID NO: 455484 - DNA, 25 bp, Homo sapien
aaggaccaccaagagaatttaaatg

SEQ ID NO: 455485 - DNA, 25 bp, Homo sapien
tggatttcagccattgtaaacagaa

SEQ ID NO: 455486 - DNA, 25 bp, Homo sapien
cagaagacaatttaagtccaattca

SEQ ID NO: 455487 - DNA, 25 bp, Homo sapien
ttgaaaacttaattgaggctgggca

SEQ ID NO: 455488 - DNA, 25 bp, Homo sapien
ggaacatcctggtaatgccaaacta

SEQ ID NO: 455489 - DNA, 25 bp, Homo sapien
acatcctggtaatgccaaactataa

SEQ ID NO: 455490 - DNA, 25 bp, Homo sapien
gatggagacatatcaaaggtcacag

SEQ ID NO: 455491 - DNA, 25 bp, Homo sapien
aggaacaatctgatgttcacatcaa

SEQ ID NO: 455492 - DNA, 25 bp, Homo sapien
tcatacatacggtttaaacaccatg

SEQ ID NO: 455493 - DNA, 25 bp, Homo sapien
tacggtttaaacaccatgtatacaa

SEQ ID NO: 455494 - DNA, 25 bp, Homo sapien
aacaccatgtatacaaataagctac

SEQ ID NO: 455495 - DNA, 25 bp, Homo sapien
taagctacatttgtaagtcacacat

SEQ ID NO: 455496 - DNA, 25 bp, Homo sapien
atttgtaagtcacacatacacactt

SEQ ID NO: 455497 - DNA, 25 bp, Homo sapien
atgagtctaagtgataagtggcgga

SEQ ID NO: 455498 - DNA, 25 bp, Homo sapien
tggcggagtgggaaagctcattttt

SEQ ID NO: 455499 - DNA, 25 bp, Homo sapien
caagcacattccacttattgtgtac

SEQ ID NO: 455500 - DNA, 25 bp, Homo sapien
aagcacattccacttattgtgtact

SEQ ID NO: 455501 - DNA, 25 bp, Homo sapien
attgtgtactttattatcgcattgt

SEQ ID NO: 455502 - DNA, 25 bp, Homo sapien
ttgtgtactttattatcgcattgta

SEQ ID NO: 455503 - DNA, 25 bp, Homo sapien
gtgtactttattatcgcattgtaat

SEQ ID NO: 455504 - DNA, 25 bp, Homo sapien
actttattatcgcattgtaatggat

SEQ ID NO: 455505 - DNA, 25 bp, Homo sapien
atcgcattgtaatggataatgaaac

SEQ ID NO: 455506 - DNA, 25 bp, Homo sapien
gaaacaattctataactcaccatca

SEQ ID NO: 455507 - DNA, 25 bp, Homo sapien
aacaattctataactcaccatcatg

SEQ ID NO: 455508 - DNA, 25 bp, Homo sapien
caattctataactcaccatcatgta

SEQ ID NO: 455509 - DNA, 25 bp, Homo sapien
attctcataaggaggccaggcacgg

SEQ ID NO: 455510 - DNA, 25 bp, Homo sapien
agagtttttgaggtaaagactacat

SEQ ID NO: 455511 - DNA, 25 bp, Homo sapien
gagtttttgaggtaaagactacatg

SEQ ID NO: 455512 - DNA, 25 bp, Homo sapien
agtttttgaggtaaagactacatga

SEQ ID NO: 455513 - DNA, 25 bp, Homo sapien
tttgaggtaaagactacatgaaggg

SEQ ID NO: 455514 - DNA, 25 bp, Homo sapien
ttgaggtaaagactacatgaagggc

SEQ ID NO: 455515 - DNA, 25 bp, Homo sapien
tgaggtaaagactacatgaagggct

SEQ ID NO: 455516 - DNA, 25 bp, Homo sapien
gaggtaaagactacatgaagggctg

SEQ ID NO: 455517 - DNA, 25 bp, Homo sapien
gtaaagactacatgaagggctgggt

SEQ ID NO: 455518 - DNA, 25 bp, Homo sapien
taaagactacatgaagggctgggtg

SEQ ID NO: 455519 - DNA, 25 bp, Homo sapien
aaagactacatgaagggctgggtgc

SEQ ID NO: 455520 - DNA, 25 bp, Homo sapien
aagactacatgaagggctgggtgcg

SEQ ID NO: 455521 - DNA, 25 bp, Homo sapien
cgcccggccttagaagtttcaggat

SEQ ID NO: 455522 - DNA, 25 bp, Homo sapien
tcaggataacggtactgccatctta

SEQ ID NO: 455523 - DNA, 25 bp, Homo sapien
ggtactgccatcttacttcttataa

SEQ ID NO: 455524 - DNA, 25 bp, Homo sapien
aaagcagtaattcgtattttatgta

SEQ ID NO: 455525 - DNA, 25 bp, Homo sapien
aatgagccataggatgaatcagaca

SEQ ID NO: 455526 - DNA, 25 bp, Homo sapien
gaatcagacaggtttgcttctagtt

SEQ ID NO: 455527 - DNA, 25 bp, Homo sapien
tgcttctagttttcaccactctatt

SEQ ID NO: 455528 - DNA, 25 bp, Homo sapien
tagttttcaccactctatttgacct

SEQ ID NO: 455529 - DNA, 25 bp, Homo sapien
gacaagagagttaattcccgagcct

SEQ ID NO: 455530 - DNA, 25 bp, Homo sapien
ctcataggaagtgtgcaagaattaa

SEQ ID NO: 455531 - DNA, 25 bp, Homo sapien
atacagtatttagctcatatagaaa

SEQ ID NO: 455532 - DNA, 25 bp, Homo sapien
gaggaatgtccatcatactgtaaaa

SEQ ID NO: 455533 - DNA, 25 bp, Homo sapien
gtagcaaaatattgatgcagccatc

SEQ ID NO: 455534 - DNA, 25 bp, Homo sapien
gagagacacagcctgacatacacat

SEQ ID NO: 455535 - DNA, 25 bp, Homo sapien
gacatacacatatcatctcatgaaa

SEQ ID NO: 455536 - DNA, 25 bp, Homo sapien
cagtacaatctgtgaggaaggagcc

SEQ ID NO: 455537 - DNA, 25 bp, Homo sapien
ggaaggagcccttcttaactccatt

SEQ ID NO: 455538 - DNA, 25 bp, Homo sapien
agcccttcttaactccattttatag

SEQ ID NO: 455539 - DNA, 25 bp, Homo sapien
gtcaaaagttttgtcctagctgggc

SEQ ID NO: 455540 - DNA, 25 bp, Homo sapien
aagttttgtcctagctgggcacagt

SEQ ID NO: 455541 - DNA, 25 bp, Homo sapien
agaccgaggtgagagctttaaggcc

SEQ ID NO: 455542 - DNA, 25 bp, Homo sapien
gctttaaggccggagttcatgacca

SEQ ID NO: 455543 - DNA, 25 bp, Homo sapien
atttataagacaggcatttaagagt

SEQ ID NO: 455544 - DNA, 25 bp, Homo sapien
ttataagacaggcatttaagagtca

SEQ ID NO: 455545 - DNA, 25 bp, Homo sapien
ataagacaggcatttaagagtcaaa

SEQ ID NO: 455546 - DNA, 25 bp, Homo sapien
aagacaggcatttaagagtcaaaaa

SEQ ID NO: 455547 - DNA, 25 bp, Homo sapien
agacaggcatttaagagtcaaaaaa

SEQ ID NO: 455548 - DNA, 25 bp, Homo sapien
aacaaacaatgttgctttactctta

SEQ ID NO: 455549 - DNA, 25 bp, Homo sapien
acaaacaatgttgctttactcttaa

SEQ ID NO: 455550 - DNA, 25 bp, Homo sapien
atgttgctttactcttaatagccaa

SEQ ID NO: 455551 - DNA, 25 bp, Homo sapien
tgttgctttactcttaatagccaaa

SEQ ID NO: 455552 - DNA, 25 bp, Homo sapien
gttgctttactcttaatagccaaaa

SEQ ID NO: 455553 - DNA, 25 bp, Homo sapien
aactggaaacaaccccagcactttg

SEQ ID NO: 455554 - DNA, 25 bp, Homo sapien
tctttcttggcttggtcctgggcgt

SEQ ID NO: 455555 - DNA, 25 bp, Homo sapien
tgggcgtggatgtcagatttgcttt

SEQ ID NO: 455556 - DNA, 25 bp, Homo sapien
gtcagatttgctttgttcatgtaaa

SEQ ID NO: 455557 - DNA, 25 bp, Homo sapien
aatgtggtgggatcatgtctccctc

SEQ ID NO: 455558 - DNA, 25 bp, Homo sapien
gatcatgtctccctcaaatcaaatt

SEQ ID NO: 455559 - DNA, 25 bp, Homo sapien
aacaaatcaagcgtctcagtgaaga

SEQ ID NO: 455560 - DNA, 25 bp, Homo sapien
tgaagacagccctgagggttctgtt

SEQ ID NO: 455561 - DNA, 25 bp, Homo sapien
agggttctgttgtctcagcctggga

SEQ ID NO: 455562 - DNA, 25 bp, Homo sapien
tcgacctcacctgcttttcagattt

SEQ ID NO: 455563 - DNA, 25 bp, Homo sapien
gccatgtttattgcagacgtccccg

SEQ ID NO: 455564 - DNA, 25 bp, Homo sapien
ggccactcatcttcattacaggtta

SEQ ID NO: 455565 - DNA, 25 bp, Homo sapien
atgtctacccaggtcctctgcaaga

SEQ ID NO: 455566 - DNA, 25 bp, Homo sapien
aggtcctctgcaagactgactgctg

SEQ ID NO: 455567 - DNA, 25 bp, Homo sapien
actgactgctgtgagaaccctgcac

SEQ ID NO: 455568 - DNA, 25 bp, Homo sapien
ctgtgagaaccctgcactctgtggg

SEQ ID NO: 455569 - DNA, 25 bp, Homo sapien
cccaagggcacctggaagcaggcat

SEQ ID NO: 455570 - DNA, 25 bp, Homo sapien
gttgaggtacatctgggctcagaat

SEQ ID NO: 455571 - DNA, 25 bp, Homo sapien
actctctgtggcaggcttccaaaga

SEQ ID NO: 455572 - DNA, 25 bp, Homo sapien
ggcttccaaagaaaccctctcagaa

SEQ ID NO: 455573 - DNA, 25 bp, Homo sapien
agaaaccctctcagaaacacacaat

SEQ ID NO: 455574 - DNA, 25 bp, Homo sapien
aagctgtgacaactgcttgaggtga

SEQ ID NO: 455575 - DNA, 25 bp, Homo sapien
gaggctcacctggaccagtgaggtt

SEQ ID NO: 455576 - DNA, 25 bp, Homo sapien
ggaaggaccaggactgctcatatgc

SEQ ID NO: 455577 - DNA, 25 bp, Homo sapien
gaaggaccaggactgctcatatgca

SEQ ID NO: 455578 - DNA, 25 bp, Homo sapien
aggaccaggactgctcatatgcagt

SEQ ID NO: 455579 - DNA, 25 bp, Homo sapien
gaccaggactgctcatatgcagtgg

SEQ ID NO: 455580 - DNA, 25 bp, Homo sapien
aggactgctcatatgcagtggcagt

SEQ ID NO: 455581 - DNA, 25 bp, Homo sapien
tgcagtggcagtctttggctaacaa

SEQ ID NO: 455582 - DNA, 25 bp, Homo sapien
gcagtggcagtctttggctaacaag

SEQ ID NO: 455583 - DNA, 25 bp, Homo sapien
agtggcagtctttggctaacaagtc

SEQ ID NO: 455584 - DNA, 25 bp, Homo sapien
ggcagtctttggctaacaagtcatc

SEQ ID NO: 455585 - DNA, 25 bp, Homo sapien
gtctttggctaacaagtcatcatag

SEQ ID NO: 455586 - DNA, 25 bp, Homo sapien
taacaagtcatcataggtctggagc

SEQ ID NO: 455587 - DNA, 25 bp, Homo sapien
aggtgaggtcacaatgagaatctac

SEQ ID NO: 455588 - DNA, 25 bp, Homo sapien
gaggtcacaatgagaatctacacta

SEQ ID NO: 455589 - DNA, 25 bp, Homo sapien
agaatctacactattgtacttcggg

SEQ ID NO: 455590 - DNA, 25 bp, Homo sapien
gaacttaaattatgtagcgcatgat

SEQ ID NO: 455591 - DNA, 25 bp, Homo sapien
gtagcgcatgatttttaattgagta

SEQ ID NO: 455592 - DNA, 25 bp, Homo sapien
attttaatccacattttctgctagt

SEQ ID NO: 455593 - DNA, 25 bp, Homo sapien
aatccacattttctgctagttaact

SEQ ID NO: 455594 - DNA, 25 bp, Homo sapien
ccacattttctgctagttaactata

SEQ ID NO: 455595 - DNA, 25 bp, Homo sapien
ttaaaactgatctaaaagcctattt

SEQ ID NO: 455596 - DNA, 25 bp, Homo sapien
taaaaatataagttgcggccgggca

SEQ ID NO: 455597 - DNA, 25 bp, Homo sapien
aaaatataagttgcggccgggcacg

SEQ ID NO: 455598 - DNA, 25 bp, Homo sapien
agcagctcaaggtccaggatataga

SEQ ID NO: 455599 - DNA, 25 bp, Homo sapien
gaatctacagagtccaaatgcccct

SEQ ID NO: 455600 - DNA, 25 bp, Homo sapien
tacagagtccaaatgccccttagag

SEQ ID NO: 455601 - DNA, 25 bp, Homo sapien
caaatgccccttagaggtttcccat

SEQ ID NO: 455602 - DNA, 25 bp, Homo sapien
attggccacttggtgttcacccggt

SEQ ID NO: 455603 - DNA, 25 bp, Homo sapien
gttcacccggtgtaaatgaagtggc

SEQ ID NO: 455604 - DNA, 25 bp, Homo sapien
tacaaagttacgctcctatgcaaca

SEQ ID NO: 455605 - DNA, 25 bp, Homo sapien
ttacgctcctatgcaacatctgatt

SEQ ID NO: 455606 - DNA, 25 bp, Homo sapien
caacatctgattggttgcacaaagc

SEQ ID NO: 455607 - DNA, 25 bp, Homo sapien
gcaaccaatcagaggtattttcagt

SEQ ID NO: 455608 - DNA, 25 bp, Homo sapien
tattttcagtttcgcatctgctgca

SEQ ID NO: 455609 - DNA, 25 bp, Homo sapien
ttgccacgcctcctattttctatct

SEQ ID NO: 455610 - DNA, 25 bp, Homo sapien
atctcccttttgattttcacaattg

SEQ ID NO: 455611 - DNA, 25 bp, Homo sapien
gattttcacaattggtcctgttctt

SEQ ID NO: 455612 - DNA, 25 bp, Homo sapien
gtcctgttcttatatgtctgggtga

SEQ ID NO: 455613 - DNA, 25 bp, Homo sapien
gaagatctgtggtttttggtaggat

SEQ ID NO: 455614 - DNA, 25 bp, Homo sapien
agagtttcatgtgccatcatctcct

SEQ ID NO: 455615 - DNA, 25 bp, Homo sapien
ctccttccttgccattattgtaaag

SEQ ID NO: 455616 - DNA, 25 bp, Homo sapien
tattgtaaagattcctccactagag

SEQ ID NO: 455617 - DNA, 25 bp, Homo sapien
gattcctccactagagttagtgatg

SEQ ID NO: 455618 - DNA, 25 bp, Homo sapien
aggtttgggttatctctcatattat

SEQ ID NO: 455619 - DNA, 25 bp, Homo sapien
gcaaaaagcttctgtaagggccaag

SEQ ID NO: 455620 - DNA, 25 bp, Homo sapien
ttagcactggtgcatgtttccttca

SEQ ID NO: 455621 - DNA, 25 bp, Homo sapien
gtgcatgtttccttcagcctcagaa

SEQ ID NO: 455622 - DNA, 25 bp, Homo sapien
aatggaggtgtctgcgtgttgccca

SEQ ID NO: 455623 - DNA, 25 bp, Homo sapien
gtgttgcccagatctaccttgaaaa

SEQ ID NO: 455624 - DNA, 25 bp, Homo sapien
gaaaactctagttgcttcctaacac

SEQ ID NO: 455625 - DNA, 25 bp, Homo sapien
gttgcttcctaacacctaggttgta

SEQ ID NO: 455626 - DNA, 25 bp, Homo sapien
aaagccaagtctggtctgtgaggac

SEQ ID NO: 455627 - DNA, 25 bp, Homo sapien
aggatttcctcatcttaactctaat

SEQ ID NO: 455628 - DNA, 25 bp, Homo sapien
tctaatttggcctgcaatgtctggg

SEQ ID NO: 455629 - DNA, 25 bp, Homo sapien
ctgcagtttgatttccttgtaccat

SEQ ID NO: 455630 - DNA, 25 bp, Homo sapien
tgatttccttgtaccattttcagta

SEQ ID NO: 455631 - DNA, 25 bp, Homo sapien
cgatggagatcagattcagctgcca

SEQ ID NO: 455632 - DNA, 25 bp, Homo sapien
agctgaccacagcagtgtgaccctc

SEQ ID NO: 455633 - DNA, 25 bp, Homo sapien
gaccctcttgaactgccagatggat

SEQ ID NO: 455634 - DNA, 25 bp, Homo sapien
ggaagtgccccggtgccatcaggca

SEQ ID NO: 455635 - DNA, 25 bp, Homo sapien
tgccatcaggcacgttgacatcagc

SEQ ID NO: 455636 - DNA, 25 bp, Homo sapien
tcaggcacgttgacatcagccccgt

SEQ ID NO: 455637 - DNA, 25 bp, Homo sapien
ttcagggtgtccaggaatccagtgc

SEQ ID NO: 455638 - DNA, 25 bp, Homo sapien
caggaatccagtgcgggctgcgtca

SEQ ID NO: 455639 - DNA, 25 bp, Homo sapien
gctgcgtcatggactggactggtac

SEQ ID NO: 455640 - DNA, 25 bp, Homo sapien
cgtcatggactggactggtaccgga

SEQ ID NO: 455641 - DNA, 25 bp, Homo sapien
tggtaccggaggtgtcctggacatt

SEQ ID NO: 455642 - DNA, 25 bp, Homo sapien
agacgccatgctctcacggacttgt

SEQ ID NO: 455643 - DNA, 25 bp, Homo sapien
atgctctcacggacttgtttgctgc

SEQ ID NO: 455644 - DNA, 25 bp, Homo sapien
tcacggacttgtttgctgctctgta

SEQ ID NO: 455645 - DNA, 25 bp, Homo sapien
ggacttgtttgctgctctgtaccct

SEQ ID NO: 455646 - DNA, 25 bp, Homo sapien
ttgtttgctgctctgtaccctgcag

SEQ ID NO: 455647 - DNA, 25 bp, Homo sapien
ccgaggtgctgtggcggtggagttt

SEQ ID NO: 455648 - DNA, 25 bp, Homo sapien
gagtttctcacttttaagattctcc

SEQ ID NO: 455649 - DNA, 25 bp, Homo sapien
ttttaagattctccaaatccaagat

SEQ ID NO: 455650 - DNA, 25 bp, Homo sapien
gaagtcatgctgtgctttggaatgg

SEQ ID NO: 455651 - DNA, 25 bp, Homo sapien
ctgtgctttggaatggtagatgctc

SEQ ID NO: 455652 - DNA, 25 bp, Homo sapien
atggtagatgctcatttatgtaaaa

SEQ ID NO: 455653 - DNA, 25 bp, Homo sapien
gcttttgtgctacaggcgtttctta

SEQ ID NO: 455654 - DNA, 25 bp, Homo sapien
cttttgtgctacaggcgtttcttat

SEQ ID NO: 455655 - DNA, 25 bp, Homo sapien
ttttgtgctacaggcgtttcttatc

SEQ ID NO: 455656 - DNA, 25 bp, Homo sapien
tttgtgctacaggcgtttcttatct

SEQ ID NO: 455657 - DNA, 25 bp, Homo sapien
tgtgctacaggcgtttcttatcttt

SEQ ID NO: 455658 - DNA, 25 bp, Homo sapien
gtgctacaggcgtttcttatcttta

SEQ ID NO: 455659 - DNA, 25 bp, Homo sapien
tgctacaggcgtttcttatctttag

SEQ ID NO: 455660 - DNA, 25 bp, Homo sapien
gctacaggcgtttcttatctttagg

SEQ ID NO: 455661 - DNA, 25 bp, Homo sapien
tatctttaggaagaatgggccgggc

SEQ ID NO: 455662 - DNA, 25 bp, Homo sapien
tctttaggaagaatgggccgggcgc

SEQ ID NO: 455663 - DNA, 25 bp, Homo sapien
ctttaggaagaatgggccgggcgcg

SEQ ID NO: 455664 - DNA, 25 bp, Homo sapien
atgtgcggtttcctcctagcctctt

SEQ ID NO: 455665 - DNA, 25 bp, Homo sapien
agacctcatattgccctgtgttgga

SEQ ID NO: 455666 - DNA, 25 bp, Homo sapien
cctgtgttggagagagtgccaccct

SEQ ID NO: 455667 - DNA, 25 bp, Homo sapien
agagtgccaccctttagcctgggct

SEQ ID NO: 455668 - DNA, 25 bp, Homo sapien
ggctcctgctgactgagacactctg

SEQ ID NO: 455669 - DNA, 25 bp, Homo sapien
gagacactctggcagaaggctcttc

SEQ ID NO: 455670 - DNA, 25 bp, Homo sapien
tttcttcccataggacatgctctca

SEQ ID NO: 455671 - DNA, 25 bp, Homo sapien
ccaagtcctagcaatcagctacaag

SEQ ID NO: 455672 - DNA, 25 bp, Homo sapien
aagaatctgcttcattactttcatc

SEQ ID NO: 455673 - DNA, 25 bp, Homo sapien
gaggaccaggcaggctgctctcagc

SEQ ID NO: 455674 - DNA, 25 bp, Homo sapien
ctcagctgcctgatctattattggg

SEQ ID NO: 455675 - DNA, 25 bp, Homo sapien
ggtcatgcatgaagggagcactgca

SEQ ID NO: 455676 - DNA, 25 bp, Homo sapien
gtcatgcatgaagggagcactgcag

SEQ ID NO: 455677 - DNA, 25 bp, Homo sapien
tcatgcatgaagggagcactgcaga

SEQ ID NO: 455678 - DNA, 25 bp, Homo sapien
catgcatgaagggagcactgcagag

SEQ ID NO: 455679 - DNA, 25 bp, Homo sapien
atgcatgaagggagcactgcagaga

SEQ ID NO: 455680 - DNA, 25 bp, Homo sapien
tgcatgaagggagcactgcagagaa

SEQ ID NO: 455681 - DNA, 25 bp, Homo sapien
catgaagggagcactgcagagaaga

SEQ ID NO: 455682 - DNA, 25 bp, Homo sapien
gaagggagcactgcagagaagacgg

SEQ ID NO: 455683 - DNA, 25 bp, Homo sapien
aagggagcactgcagagaagacggt

SEQ ID NO: 455684 - DNA, 25 bp, Homo sapien
ggagcactgcagagaagacggtggc

SEQ ID NO: 455685 - DNA, 25 bp, Homo sapien
gagcactgcagagaagacggtggcc

SEQ ID NO: 455686 - DNA, 25 bp, Homo sapien
gaatacctaataaatgctgggctta

SEQ ID NO: 455687 - DNA, 25 bp, Homo sapien
tacctaataaatgctgggcttaata

SEQ ID NO: 455688 - DNA, 25 bp, Homo sapien
ctaggtgatgggtggagcaaaccac

SEQ ID NO: 455689 - DNA, 25 bp, Homo sapien
aaagtattgggcatgaggtccaaaa

SEQ ID NO: 455690 - DNA, 25 bp, Homo sapien
tgggcatgaggtccaaaagagaatt

SEQ ID NO: 455691 - DNA, 25 bp, Homo sapien
gaattggtatcaactaagtaccgtt

SEQ ID NO: 455692 - DNA, 25 bp, Homo sapien
gtatcaactaagtaccgttaacata

SEQ ID NO: 455693 - DNA, 25 bp, Homo sapien
gtaccgttaacatacaagatatgac

SEQ ID NO: 455694 - DNA, 25 bp, Homo sapien
aattaatactgattagctgctagat

SEQ ID NO: 455695 - DNA, 25 bp, Homo sapien
gctgctagatacgaagatgcttaca

SEQ ID NO: 455696 - DNA, 25 bp, Homo sapien
gatacgaagatgcttacatataaac

SEQ ID NO: 455697 - DNA, 25 bp, Homo sapien
attttctcatgcatattattttaaa

SEQ ID NO: 455698 - DNA, 25 bp, Homo sapien
tttaaaatatattccagccaggtgc

SEQ ID NO: 455699 - DNA, 25 bp, Homo sapien
ttaaaatatattccagccaggtgca

SEQ ID NO: 455700 - DNA, 25 bp, Homo sapien
aaatatattccagccaggtgcagtg

SEQ ID NO: 455701 - DNA, 25 bp, Homo sapien
cgcgctcttggctgcgatccagact

SEQ ID NO: 455702 - DNA, 25 bp, Homo sapien
gcgctcttggctgcgatccagactg

SEQ ID NO: 455703 - DNA, 25 bp, Homo sapien
gctcttggctgcgatccagactgca

SEQ ID NO: 455704 - DNA, 25 bp, Homo sapien
ctcttggctgcgatccagactgcac

SEQ ID NO: 455705 - DNA, 25 bp, Homo sapien
tcttggctgcgatccagactgcact

SEQ ID NO: 455706 - DNA, 25 bp, Homo sapien
cttggctgcgatccagactgcactc

SEQ ID NO: 455707 - DNA, 25 bp, Homo sapien
ttggctgcgatccagactgcactcc

SEQ ID NO: 455708 - DNA, 25 bp, Homo sapien
aaagatctcaggtacctagactttt

SEQ ID NO: 455709 - DNA, 25 bp, Homo sapien
ctcaggtacctagactttttctatt

SEQ ID NO: 455710 - DNA, 25 bp, Homo sapien
atttcttttcactgtgtctagcctc

SEQ ID NO: 455711 - DNA, 25 bp, Homo sapien
tgtctagcctccattctgaagctga

SEQ ID NO: 455712 - DNA, 25 bp, Homo sapien
cctccattctgaagctgacctcatg

SEQ ID NO: 455713 - DNA, 25 bp, Homo sapien
tcatggtccaggatggctgctttac

SEQ ID NO: 455714 - DNA, 25 bp, Homo sapien
aggatggctgctttacttcctgcta

SEQ ID NO: 455715 - DNA, 25 bp, Homo sapien
attaaaattccagccatcagaagag

SEQ ID NO: 455716 - DNA, 25 bp, Homo sapien
gatggtgcaaaacaagcactgcagc

SEQ ID NO: 455717 - DNA, 25 bp, Homo sapien
caagcactgcagcagacctttcaga

SEQ ID NO: 455718 - DNA, 25 bp, Homo sapien
ttagaactgctgcatgggccggcac

SEQ ID NO: 455719 - DNA, 25 bp, Homo sapien
gatcgaccatagtggtgaacaatat

SEQ ID NO: 455720 - DNA, 25 bp, Homo sapien
gtattcggtagagaacagcccagca

SEQ ID NO: 455721 - DNA, 25 bp, Homo sapien
agagaacagcccagcacatgctttt

SEQ ID NO: 455722 - DNA, 25 bp, Homo sapien
agcccagcacatgcttttgcagttt

SEQ ID NO: 455723 - DNA, 25 bp, Homo sapien
catgcttttgcagtttggagatatt

SEQ ID NO: 455724 - DNA, 25 bp, Homo sapien
gattaggatatgtccttacgtgtaa

SEQ ID NO: 455725 - DNA, 25 bp, Homo sapien
cttacgtgtaaggatatgtttttat

SEQ ID NO: 455726 - DNA, 25 bp, Homo sapien
tattgatccctaaacatgcactatt

SEQ ID NO: 455727 - DNA, 25 bp, Homo sapien
gtgggcacttatttaattggtaata

SEQ ID NO: 455728 - DNA, 25 bp, Homo sapien
atatgctgtctggttgatggtggta

SEQ ID NO: 455729 - DNA, 25 bp, Homo sapien
aaatacccaagaaactagtgatagt

SEQ ID NO: 455730 - DNA, 25 bp, Homo sapien
aagatagccaggtgcatggaacctt

SEQ ID NO: 455731 - DNA, 25 bp, Homo sapien
ggtgcatggaacctttgccattcaa

SEQ ID NO: 455732 - DNA, 25 bp, Homo sapien
ggaacctttgccattcaatataaga

SEQ ID NO: 455733 - DNA, 25 bp, Homo sapien
aaatctctaccacagtctctaagca

SEQ ID NO: 455734 - DNA, 25 bp, Homo sapien
gagaattttaggaagctggctgatc

SEQ ID NO: 455735 - DNA, 25 bp, Homo sapien
tggctgatccggatcttggatatct

SEQ ID NO: 455736 - DNA, 25 bp, Homo sapien
ccggatcttggatatctggctgtca

SEQ ID NO: 455737 - DNA, 25 bp, Homo sapien
gatatctggctgtcaaagtctttat

SEQ ID NO: 455738 - DNA, 25 bp, Homo sapien
ggaagtaagaaaacgcacattgtgc

SEQ ID NO: 455739 - DNA, 25 bp, Homo sapien
cgcacattgtgctctgggatttata

SEQ ID NO: 455740 - DNA, 25 bp, Homo sapien
aagagattcgagtgttgtttatgtt

SEQ ID NO: 455741 - DNA, 25 bp, Homo sapien
gtttcctcatgggtaaaatatagac

SEQ ID NO: 455742 - DNA, 25 bp, Homo sapien
gaaattcacaggatcatggagacga

SEQ ID NO: 455743 - DNA, 25 bp, Homo sapien
ggagacgaactaaaccatcatggag

SEQ ID NO: 455744 - DNA, 25 bp, Homo sapien
ggagactaactaaaccagatgcatc

SEQ ID NO: 455745 - DNA, 25 bp, Homo sapien
taaaccagatgcatctagcccctca

SEQ ID NO: 455746 - DNA, 25 bp, Homo sapien
atctagcccctcatgttagagttga

SEQ ID NO: 455747 - DNA, 25 bp, Homo sapien
gggactcccttgaagtcatcaagtt

SEQ ID NO: 455748 - DNA, 25 bp, Homo sapien
gaagtcatcaagttcctgttgatgg

SEQ ID NO: 455749 - DNA, 25 bp, Homo sapien
aatcaggaccaagcttctgatcctc

SEQ ID NO: 455750 - DNA, 25 bp, Homo sapien
aagcttctgatcctcccaaatattc

SEQ ID NO: 455751 - DNA, 25 bp, Homo sapien
aaatattccttcacttctcagtgct

SEQ ID NO: 455752 - DNA, 25 bp, Homo sapien
agttcctgcgcctctgggagcagtt

SEQ ID NO: 455753 - DNA, 25 bp, Homo sapien
gcctctgggagcagttcagtgacat

SEQ ID NO: 455754 - DNA, 25 bp, Homo sapien
gttcagtgacatgggcttccagcag

SEQ ID NO: 455755 - DNA, 25 bp, Homo sapien
gcttccagcaggaccggatcaagga

SEQ ID NO: 455756 - DNA, 25 bp, Homo sapien
gctgctggtccatggcaaccgccga

SEQ ID NO: 455757 - DNA, 25 bp, Homo sapien
ggtccatggcaaccgccgagagcaa

SEQ ID NO: 455758 - DNA, 25 bp, Homo sapien
tggcaaccgccgagagcaagccctg

SEQ ID NO: 455759 - DNA, 25 bp, Homo sapien
tggcctgtgcccagtgaccacggag

SEQ ID NO: 455760 - DNA, 25 bp, Homo sapien
gtgcccagtgaccacggaggcactc

SEQ ID NO: 455761 - DNA, 25 bp, Homo sapien
tgcctgggcatctaggcccaatgcc

SEQ ID NO: 455762 - DNA, 25 bp, Homo sapien
atctaggcccaatgccagacctggc

SEQ ID NO: 455763 - DNA, 25 bp, Homo sapien
taataataaaatgggtcagacacgg

SEQ ID NO: 455764 - DNA, 25 bp, Homo sapien
ataataaaatgggtcagacacggtg

SEQ ID NO: 455765 - DNA, 25 bp, Homo sapien
taataaaatgggtcagacacggtgg

SEQ ID NO: 455766 - DNA, 25 bp, Homo sapien
aataaaatgggtcagacacggtggc

SEQ ID NO: 455767 - DNA, 25 bp, Homo sapien
ataaaatgggtcagacacggtggct

SEQ ID NO: 455768 - DNA, 25 bp, Homo sapien
taaaatgggtcagacacggtggctt

SEQ ID NO: 455769 - DNA, 25 bp, Homo sapien
aaaatgggtcagacacggtggctta

SEQ ID NO: 455770 - DNA, 25 bp, Homo sapien
aaatgggtcagacacggtggcttac

SEQ ID NO: 455771 - DNA, 25 bp, Homo sapien
cattccacagggcaggacaactgag

SEQ ID NO: 455772 - DNA, 25 bp, Homo sapien
cgcgcaggtgcacagtggaaggacc

SEQ ID NO: 455773 - DNA, 25 bp, Homo sapien
gcgcaggtgcacagtggaaggacca

SEQ ID NO: 455774 - DNA, 25 bp, Homo sapien
cgcaggtgcacagtggaaggaccag

SEQ ID NO: 455775 - DNA, 25 bp, Homo sapien
aataaatacacagttccatcagacc

SEQ ID NO: 455776 - DNA, 25 bp, Homo sapien
ataaatacacagttccatcagacca

SEQ ID NO: 455777 - DNA, 25 bp, Homo sapien
taaatacacagttccatcagaccag

SEQ ID NO: 455778 - DNA, 25 bp, Homo sapien
aaatacacagttccatcagaccagc

SEQ ID NO: 455779 - DNA, 25 bp, Homo sapien
aatacacagttccatcagaccagcc

SEQ ID NO: 455780 - DNA, 25 bp, Homo sapien
agttccatcagaccagcccccgagt

SEQ ID NO: 455781 - DNA, 25 bp, Homo sapien
aagatgagtctctggtctttcttca

SEQ ID NO: 455782 - DNA, 25 bp, Homo sapien
atgagtctctggtctttcttcagac

SEQ ID NO: 455783 - DNA, 25 bp, Homo sapien
ctttcttcagacctactaaagtaga

SEQ ID NO: 455784 - DNA, 25 bp, Homo sapien
tagaatgtacactttaacaagatcc

SEQ ID NO: 455785 - DNA, 25 bp, Homo sapien
ggtaatttgtatgcttactagaaat

SEQ ID NO: 455786 - DNA, 25 bp, Homo sapien
aattgtgaaggacttctctaggtga

SEQ ID NO: 455787 - DNA, 25 bp, Homo sapien
tctctaggtgagatttgatgcttgc

SEQ ID NO: 455788 - DNA, 25 bp, Homo sapien
gatgcttgcttatctagggtgatgt

SEQ ID NO: 455789 - DNA, 25 bp, Homo sapien
ggaagaaatccagcatgataagtta

SEQ ID NO: 455790 - DNA, 25 bp, Homo sapien
gataagttaggtttctagcttgagt

SEQ ID NO: 455791 - DNA, 25 bp, Homo sapien
ctagcttgagtaacatagtggtggt

SEQ ID NO: 455792 - DNA, 25 bp, Homo sapien
tttagatataacctggtgcagtcag

SEQ ID NO: 455793 - DNA, 25 bp, Homo sapien
ggtgcagtcaggtaaccccaaacag

SEQ ID NO: 455794 - DNA, 25 bp, Homo sapien
aaagtttccacacccttctttgctg

SEQ ID NO: 455795 - DNA, 25 bp, Homo sapien
tgcatcatgctgtcgctgtgaggag

SEQ ID NO: 455796 - DNA, 25 bp, Homo sapien
gtgaggagggacttgttccagatct

SEQ ID NO: 455797 - DNA, 25 bp, Homo sapien
gtcacacagcttccacggaacatta

SEQ ID NO: 455798 - DNA, 25 bp, Homo sapien
ccacggaacattactggaagctcag

SEQ ID NO: 455799 - DNA, 25 bp, Homo sapien
ggaagctcagtgagggccttctgcc

SEQ ID NO: 455800 - DNA, 25 bp, Homo sapien
agggccttctgcctctgaaacttgc

SEQ ID NO: 455801 - DNA, 25 bp, Homo sapien
tgaaacttgctctatttccctcaag

SEQ ID NO: 455802 - DNA, 25 bp, Homo sapien
ggtttaagacattagttcctgagaa

SEQ ID NO: 455803 - DNA, 25 bp, Homo sapien
gttcccctcttagagaacgaaggag

SEQ ID NO: 455804 - DNA, 25 bp, Homo sapien
gaacgaaggagcctataagcttatt

SEQ ID NO: 455805 - DNA, 25 bp, Homo sapien
gaaggagcctataagcttattaata

SEQ ID NO: 455806 - DNA, 25 bp, Homo sapien
attaatggctctaagaagcccttca

SEQ ID NO: 455807 - DNA, 25 bp, Homo sapien
taatccagtatttctccaaatttac

SEQ ID NO: 455808 - DNA, 25 bp, Homo sapien
cagtatttctccaaatttacttggt

SEQ ID NO: 455809 - DNA, 25 bp, Homo sapien
atgacccagggcagttatctctgtc

SEQ ID NO: 455810 - DNA, 25 bp, Homo sapien
cccagggcagttatctctgtctttg

SEQ ID NO: 455811 - DNA, 25 bp, Homo sapien
tatctctgtctttgtaatactgtgt

SEQ ID NO: 455812 - DNA, 25 bp, Homo sapien
gtaatactgtgtgtcatcggcttaa

SEQ ID NO: 455813 - DNA, 25 bp, Homo sapien
actgtgtgtcatcggcttaaaaaag

SEQ ID NO: 455814 - DNA, 25 bp, Homo sapien
ctgtataaaacattcagagatattt

SEQ ID NO: 455815 - DNA, 25 bp, Homo sapien
tttttgtgccaaatttgatattcaa

SEQ ID NO: 455816 - DNA, 25 bp, Homo sapien
tttgtgccaaatttgatattcaatt

SEQ ID NO: 455817 - DNA, 25 bp, Homo sapien
attcaatttgatttctgaagttgct

SEQ ID NO: 455818 - DNA, 25 bp, Homo sapien
aagttgctttttaaagatgttcatt

SEQ ID NO: 455819 - DNA, 25 bp, Homo sapien
aagatgttcatttaagatgtaaaga

SEQ ID NO: 455820 - DNA, 25 bp, Homo sapien
ttaacttttaaagtgcagttcattt

SEQ ID NO: 455821 - DNA, 25 bp, Homo sapien
ttttttgagtgttctagagagcact

SEQ ID NO: 455822 - DNA, 25 bp, Homo sapien
gtgttctagagagcactcaaataat

SEQ ID NO: 455823 - DNA, 25 bp, Homo sapien
gagagcactcaaataatgatggtta

SEQ ID NO: 455824 - DNA, 25 bp, Homo sapien
gagcactcaaataatgatggttaaa

SEQ ID NO: 455825 - DNA, 25 bp, Homo sapien
cactgagaatatgttggtcccaagg

SEQ ID NO: 455826 - DNA, 25 bp, Homo sapien
atgttggtcccaagggcaatgttcc

SEQ ID NO: 455827 - DNA, 25 bp, Homo sapien
ggtcccaagggcaatgttccaaaat

SEQ ID NO: 455828 - DNA, 25 bp, Homo sapien
gttccaaaatgaatagtgaccccac

SEQ ID NO: 455829 - DNA, 25 bp, Homo sapien
aatgaatagtgaccccaccgaggcg

SEQ ID NO: 455830 - DNA, 25 bp, Homo sapien
gttaaatgcagataccaattccact

SEQ ID NO: 455831 - DNA, 25 bp, Homo sapien
aatgcagataccaattccacttccc

SEQ ID NO: 455832 - DNA, 25 bp, Homo sapien
actgttgtcacttccgatctgtctt

SEQ ID NO: 455833 - DNA, 25 bp, Homo sapien
tgtcacttccgatctgtctttatat

SEQ ID NO: 455834 - DNA, 25 bp, Homo sapien
atctgtctttatatttctccttatc

SEQ ID NO: 455835 - DNA, 25 bp, Homo sapien
tatatttctccttatcatttatcac

SEQ ID NO: 455836 - DNA, 25 bp, Homo sapien
attcttgtcctagtctagcctcagt

SEQ ID NO: 455837 - DNA, 25 bp, Homo sapien
tagtctagcctcagttttgggcagg

SEQ ID NO: 455838 - DNA, 25 bp, Homo sapien
tttctcaaatatcctgccccttttc

SEQ ID NO: 455839 - DNA, 25 bp, Homo sapien
aagtgcggatgatctggactcagga

SEQ ID NO: 455840 - DNA, 25 bp, Homo sapien
ggactcaggatcatttcttgctact

SEQ ID NO: 455841 - DNA, 25 bp, Homo sapien
ttcttgctactcctctaggcataga

SEQ ID NO: 455842 - DNA, 25 bp, Homo sapien
cctgtgccctgggataacatggctt

SEQ ID NO: 455843 - DNA, 25 bp, Homo sapien
gataacatggcttgttgcccttttc

SEQ ID NO: 455844 - DNA, 25 bp, Homo sapien
cttgttgcccttttccagaggagct

SEQ ID NO: 455845 - DNA, 25 bp, Homo sapien
agaggagcttaagatgttttgtttc

SEQ ID NO: 455846 - DNA, 25 bp, Homo sapien
gggtggagcttggagcttcccctaa

SEQ ID NO: 455847 - DNA, 25 bp, Homo sapien
tttaagaaaactcataggtatggcc

SEQ ID NO: 455848 - DNA, 25 bp, Homo sapien
taagaaaactcataggtatggccac

SEQ ID NO: 455849 - DNA, 25 bp, Homo sapien
aagaaaactcataggtatggccaca

SEQ ID NO: 455850 - DNA, 25 bp, Homo sapien
agaaaactcataggtatggccacac

SEQ ID NO: 455851 - DNA, 25 bp, Homo sapien
gaaaactcataggtatggccacacg

SEQ ID NO: 455852 - DNA, 25 bp, Homo sapien
aaaactcataggtatggccacacgt

SEQ ID NO: 455853 - DNA, 25 bp, Homo sapien
aaactcataggtatggccacacgtg

SEQ ID NO: 455854 - DNA, 25 bp, Homo sapien
aactcataggtatggccacacgtgg

SEQ ID NO: 455855 - DNA, 25 bp, Homo sapien
actcataggtatggccacacgtggt

SEQ ID NO: 455856 - DNA, 25 bp, Homo sapien
ctcataggtatggccacacgtggtg

SEQ ID NO: 455857 - DNA, 25 bp, Homo sapien
ataggtatggccacacgtggtggct

SEQ ID NO: 455858 - DNA, 25 bp, Homo sapien
agaatgatgtgaacccgggaggcca

SEQ ID NO: 455859 - DNA, 25 bp, Homo sapien
aaagagtggcagaagaaatgctagc

SEQ ID NO: 455860 - DNA, 25 bp, Homo sapien
aagagtggcagaagaaatgctagcc

SEQ ID NO: 455861 - DNA, 25 bp, Homo sapien
agagtggcagaagaaatgctagcca

SEQ ID NO: 455862 - DNA, 25 bp, Homo sapien
gagtggcagaagaaatgctagccaa

SEQ ID NO: 455863 - DNA, 25 bp, Homo sapien
agtggcagaagaaatgctagccaaa

SEQ ID NO: 455864 - DNA, 25 bp, Homo sapien
gtggcagaagaaatgctagccaaac

SEQ ID NO: 455865 - DNA, 25 bp, Homo sapien
tggcagaagaaatgctagccaaact

SEQ ID NO: 455866 - DNA, 25 bp, Homo sapien
atgctagccaaactgcaggcagatc

SEQ ID NO: 455867 - DNA, 25 bp, Homo sapien
tgctagccaaactgcaggcagatca

SEQ ID NO: 455868 - DNA, 25 bp, Homo sapien
gctagccaaactgcaggcagatcaa

SEQ ID NO: 455869 - DNA, 25 bp, Homo sapien
ccaggcatatttcaggacaggacgt

SEQ ID NO: 455870 - DNA, 25 bp, Homo sapien
caggcatatttcaggacaggacgtt

SEQ ID NO: 455871 - DNA, 25 bp, Homo sapien
ggcatatttcaggacaggacgttaa

SEQ ID NO: 455872 - DNA, 25 bp, Homo sapien
gcatatttcaggacaggacgttaaa

SEQ ID NO: 455873 - DNA, 25 bp, Homo sapien
tttcaggacaggacgttaaaatcaa

SEQ ID NO: 455874 - DNA, 25 bp, Homo sapien
tcaggacaggacgttaaaatcaaat

SEQ ID NO: 455875 - DNA, 25 bp, Homo sapien
aaaatcaaatatgggctggacacag

SEQ ID NO: 455876 - DNA, 25 bp, Homo sapien
aatcaaatatgggctggacacagtg

SEQ ID NO: 455877 - DNA, 25 bp, Homo sapien
aattagccatgtgttttggctcatg

SEQ ID NO: 455878 - DNA, 25 bp, Homo sapien
ttagccatgtgttttggctcatgct

SEQ ID NO: 455879 - DNA, 25 bp, Homo sapien
agccatgtgttttggctcatgcttg

SEQ ID NO: 455880 - DNA, 25 bp, Homo sapien
aagaaaactcataggtatggccaca

SEQ ID NO: 455881 - DNA, 25 bp, Homo sapien
agaaaactcataggtatggccacac

SEQ ID NO: 455882 - DNA, 25 bp, Homo sapien
gaaaactcataggtatggccacacg

SEQ ID NO: 455883 - DNA, 25 bp, Homo sapien
aaaactcataggtatggccacacgt

SEQ ID NO: 455884 - DNA, 25 bp, Homo sapien
aaactcataggtatggccacacgtg

SEQ ID NO: 455885 - DNA, 25 bp, Homo sapien
aactcataggtatggccacacgtgg

SEQ ID NO: 455886 - DNA, 25 bp, Homo sapien
actcataggtatggccacacgtggt

SEQ ID NO: 455887 - DNA, 25 bp, Homo sapien
ataggtatggccacacgtggtggct

SEQ ID NO: 455888 - DNA, 25 bp, Homo sapien
aggtatggccacacgtggtggctca

SEQ ID NO: 455889 - DNA, 25 bp, Homo sapien
gtatggccacacgtggtggctcacg

SEQ ID NO: 455890 - DNA, 25 bp, Homo sapien
ggaaaatggtgtgggcccaggaggt

SEQ ID NO: 455891 - DNA, 25 bp, Homo sapien
gtaagggtcagggtccacagccaat

SEQ ID NO: 455892 - DNA, 25 bp, Homo sapien
aggctgtgccagcatgaccaaggct

SEQ ID NO: 455893 - DNA, 25 bp, Homo sapien
gaccaaggcttaaacatagtgacag

SEQ ID NO: 455894 - DNA, 25 bp, Homo sapien
atagtgacaggcatcaatgccctca

SEQ ID NO: 455895 - DNA, 25 bp, Homo sapien
aatgccctcacctgtaagctgagat

SEQ ID NO: 455896 - DNA, 25 bp, Homo sapien
agctgagataatacacactggcaaa

SEQ ID NO: 455897 - DNA, 25 bp, Homo sapien
cactggcaaagctataggatcattc

SEQ ID NO: 455898 - DNA, 25 bp, Homo sapien
taaattgcctagcagtgggcctgac

SEQ ID NO: 455899 - DNA, 25 bp, Homo sapien
tgggcctgacacatggcagtagctt

SEQ ID NO: 455900 - DNA, 25 bp, Homo sapien
atggcagtagcttaggaaattcctt

SEQ ID NO: 455901 - DNA, 25 bp, Homo sapien
ttactcctaccctctcagtttcttt

SEQ ID NO: 455902 - DNA, 25 bp, Homo sapien
gatgcttcagtaagcccagatcaca

SEQ ID NO: 455903 - DNA, 25 bp, Homo sapien
atgcttcagtaagcccagatcacac

SEQ ID NO: 455904 - DNA, 25 bp, Homo sapien
aaaaaagacatagagccaggcgcct

SEQ ID NO: 455905 - DNA, 25 bp, Homo sapien
aaaaagacatagagccaggcgcctg

SEQ ID NO: 455906 - DNA, 25 bp, Homo sapien
aaaagacatagagccaggcgcctgg

SEQ ID NO: 455907 - DNA, 25 bp, Homo sapien
aagacatagagccaggcgcctggct

SEQ ID NO: 455908 - DNA, 25 bp, Homo sapien
aggcgcctggctctcagcactttgg

SEQ ID NO: 455909 - DNA, 25 bp, Homo sapien
ggcgcctggctctcagcactttgga

SEQ ID NO: 455910 - DNA, 25 bp, Homo sapien
ccaaggcgtgaggactgtttgaggt

SEQ ID NO: 455911 - DNA, 25 bp, Homo sapien
caaggcgtgaggactgtttgaggtc

SEQ ID NO: 455912 - DNA, 25 bp, Homo sapien
aaggcgtgaggactgtttgaggtca

SEQ ID NO: 455913 - DNA, 25 bp, Homo sapien
agagataaaagtacctgtctatttc

SEQ ID NO: 455914 - DNA, 25 bp, Homo sapien
gagataaaagtacctgtctatttca

SEQ ID NO: 455915 - DNA, 25 bp, Homo sapien
agataaaagtacctgtctatttcag

SEQ ID NO: 455916 - DNA, 25 bp, Homo sapien
taaaagtacctgtctatttcaggcc

SEQ ID NO: 455917 - DNA, 25 bp, Homo sapien
aaaagtacctgtctatttcaggccg

SEQ ID NO: 455918 - DNA, 25 bp, Homo sapien
aaagtacctgtctatttcaggccgg

SEQ ID NO: 455919 - DNA, 25 bp, Homo sapien
aagtacctgtctatttcaggccggg

SEQ ID NO: 455920 - DNA, 25 bp, Homo sapien
agtacctgtctatttcaggccgggc

SEQ ID NO: 455921 - DNA, 25 bp, Homo sapien
gtacctgtctatttcaggccgggca

SEQ ID NO: 455922 - DNA, 25 bp, Homo sapien
tacctgtctatttcaggccgggcac

SEQ ID NO: 455923 - DNA, 25 bp, Homo sapien
acgccacggcattgcagcctgagtg

SEQ ID NO: 455924 - DNA, 25 bp, Homo sapien
tggagccctccgcagctcagcaaag

SEQ ID NO: 455925 - DNA, 25 bp, Homo sapien
tccgcagctcagcaaagctactgta

SEQ ID NO: 455926 - DNA, 25 bp, Homo sapien
gcagctcagcaaagctactgtagct

SEQ ID NO: 455927 - DNA, 25 bp, Homo sapien
agctcagcaaagctactgtagctag

SEQ ID NO: 455928 - DNA, 25 bp, Homo sapien
gctactgtagctagactgcctctct

SEQ ID NO: 455929 - DNA, 25 bp, Homo sapien
gcttatagatgaagccatctccctg

SEQ ID NO: 455930 - DNA, 25 bp, Homo sapien
ggacagatcacctggggcaaatgct

SEQ ID NO: 455931 - DNA, 25 bp, Homo sapien
caaatgctggctgtgggtgcagctt

SEQ ID NO: 455932 - DNA, 25 bp, Homo sapien
gcttcagcagtctcaaaggtccctg

SEQ ID NO: 455933 - DNA, 25 bp, Homo sapien
ttcagcagtctcaaaggtccctgcc

SEQ ID NO: 455934 - DNA, 25 bp, Homo sapien
agtctcaaaggtccctgcctgccag

SEQ ID NO: 455935 - DNA, 25 bp, Homo sapien
gaatcaggagtaaagtaacattaaa

SEQ ID NO: 455936 - DNA, 25 bp, Homo sapien
gaatacatttaaagaaccatctact

SEQ ID NO: 455937 - DNA, 25 bp, Homo sapien
gaaccatctactaatttctaaccat

SEQ ID NO: 455938 - DNA, 25 bp, Homo sapien
aaccatctactaatttctaaccata

SEQ ID NO: 455939 - DNA, 25 bp, Homo sapien
ccatctactaatttctaaccatata

SEQ ID NO: 455940 - DNA, 25 bp, Homo sapien
ctttttctatagacaccaaatctgg

SEQ ID NO: 455941 - DNA, 25 bp, Homo sapien
agacaccaaatctggctgaatgaaa

SEQ ID NO: 455942 - DNA, 25 bp, Homo sapien
caccaaatctggctgaatgaaataa

SEQ ID NO: 455943 - DNA, 25 bp, Homo sapien
atctggctgaatgaaataaattggt

SEQ ID NO: 455944 - DNA, 25 bp, Homo sapien
gaaaaaccaatgattcataacaatg

SEQ ID NO: 455945 - DNA, 25 bp, Homo sapien
gaatgttactttggaatgactataa

SEQ ID NO: 455946 - DNA, 25 bp, Homo sapien
taaatgccactatgtaatgaggcat

SEQ ID NO: 455947 - DNA, 25 bp, Homo sapien
gaaggacttggagcacatacctgtt

SEQ ID NO: 455948 - DNA, 25 bp, Homo sapien
aggacttggagcacatacctgttac

SEQ ID NO: 455949 - DNA, 25 bp, Homo sapien
gacttggagcacatacctgttacgg

SEQ ID NO: 455950 - DNA, 25 bp, Homo sapien
acttggagcacatacctgttacggg

SEQ ID NO: 455951 - DNA, 25 bp, Homo sapien
ttggagcacatacctgttacgggtt

SEQ ID NO: 455952 - DNA, 25 bp, Homo sapien
ggagcacatacctgttacgggttta

SEQ ID NO: 455953 - DNA, 25 bp, Homo sapien
gagcacatacctgttacgggtttaa

SEQ ID NO: 455954 - DNA, 25 bp, Homo sapien
gcacatacctgttacgggtttaaag

SEQ ID NO: 455955 - DNA, 25 bp, Homo sapien
taaagcctactttagtcttggccgg

SEQ ID NO: 455956 - DNA, 25 bp, Homo sapien
agcctactttagtcttggccgggtg

SEQ ID NO: 455957 - DNA, 25 bp, Homo sapien
tgctcgtccgcgtctgcagtcagcg

SEQ ID NO: 455958 - DNA, 25 bp, Homo sapien
gctcgtccgcgtctgcagtcagcgt

SEQ ID NO: 455959 - DNA, 25 bp, Homo sapien
gtccccaacctgtgcgtctctgtgt

SEQ ID NO: 455960 - DNA, 25 bp, Homo sapien
caacctgtgcgtctctgtgtccggg

SEQ ID NO: 455961 - DNA, 25 bp, Homo sapien
aacctgtgcgtctctgtgtccgggc

SEQ ID NO: 455962 - DNA, 25 bp, Homo sapien
tgcgtctctgtgtccgggccggcct

SEQ ID NO: 455963 - DNA, 25 bp, Homo sapien
gccacctggtgccttagtccttggg

SEQ ID NO: 455964 - DNA, 25 bp, Homo sapien
acctggtgccttagtccttgggctg

SEQ ID NO: 455965 - DNA, 25 bp, Homo sapien
cctggtgccttagtccttgggctgg

SEQ ID NO: 455966 - DNA, 25 bp, Homo sapien
gagtggagggtttgacgggcctgga

SEQ ID NO: 455967 - DNA, 25 bp, Homo sapien
tgacgggcctggagggtattaaaga

SEQ ID NO: 455968 - DNA, 25 bp, Homo sapien
ttctgaggccctagtcatatgttgc

SEQ ID NO: 455969 - DNA, 25 bp, Homo sapien
aggccctagtcatatgttgctaact

SEQ ID NO: 455970 - DNA, 25 bp, Homo sapien
gttgctaactatagaggagtcatta

SEQ ID NO: 455971 - DNA, 25 bp, Homo sapien
ggagtcattagataaaagtgtgtac

SEQ ID NO: 455972 - DNA, 25 bp, Homo sapien
aaagtgtgtacatttggaagcaaac

SEQ ID NO: 455973 - DNA, 25 bp, Homo sapien
gaagcaaacaaagactgcatcccat

SEQ ID NO: 455974 - DNA, 25 bp, Homo sapien
aagactgcatcccatgagatttcat

SEQ ID NO: 455975 - DNA, 25 bp, Homo sapien
gcatcccatgagatttcataagcta

SEQ ID NO: 455976 - DNA, 25 bp, Homo sapien
tagctagtatttaaaggctcataaa

SEQ ID NO: 455977 - DNA, 25 bp, Homo sapien
gaacaggtattagccatttaagaag

SEQ ID NO: 455978 - DNA, 25 bp, Homo sapien
ataggtcagagaacagtccttggaa

SEQ ID NO: 455979 - DNA, 25 bp, Homo sapien
agacaccaaatctggctgaatgaaa

SEQ ID NO: 455980 - DNA, 25 bp, Homo sapien
gacaccaaatctggctgaatgaaat

SEQ ID NO: 455981 - DNA, 25 bp, Homo sapien
caccaaatctggctgaatgaaataa

SEQ ID NO: 455982 - DNA, 25 bp, Homo sapien
accaaatctggctgaatgaaataaa

SEQ ID NO: 455983 - DNA, 25 bp, Homo sapien
ccaaatctggctgaatgaaataaat

SEQ ID NO: 455984 - DNA, 25 bp, Homo sapien
atctggctgaatgaaataaattggt

SEQ ID NO: 455985 - DNA, 25 bp, Homo sapien
ctggctgaatgaaataaattggtga

SEQ ID NO: 455986 - DNA, 25 bp, Homo sapien
gaaaaaccaatgattcataacaatg

SEQ ID NO: 455987 - DNA, 25 bp, Homo sapien
ccaatgattcataacaatgtatgtg

SEQ ID NO: 455988 - DNA, 25 bp, Homo sapien
gaatgttactttggaatgactataa

SEQ ID NO: 455989 - DNA, 25 bp, Homo sapien
aatgttactttggaatgactataaa

SEQ ID NO: 455990 - DNA, 25 bp, Homo sapien
ggaagcttgacctaaattaccgtca

SEQ ID NO: 455991 - DNA, 25 bp, Homo sapien
ttacaagtgagcagtgccccagagt

SEQ ID NO: 455992 - DNA, 25 bp, Homo sapien
gccccagagtctcagaggagctcag

SEQ ID NO: 455993 - DNA, 25 bp, Homo sapien
tcagaatcccaaaatcactatcctc

SEQ ID NO: 455994 - DNA, 25 bp, Homo sapien
ataccgaaacacttcgctgcctaac

SEQ ID NO: 455995 - DNA, 25 bp, Homo sapien
tgcctaacccctcttcagatgtggg

SEQ ID NO: 455996 - DNA, 25 bp, Homo sapien
gtcccgagagactaaatcaaagctg

SEQ ID NO: 455997 - DNA, 25 bp, Homo sapien
aatttgtgtgtggtagtttctcgtt

SEQ ID NO: 455998 - DNA, 25 bp, Homo sapien
tctcgtttgtgatcagtagcttccc

SEQ ID NO: 455999 - DNA, 25 bp, Homo sapien
caccccacttctactgtacgtttat

SEQ ID NO: 456000 - DNA, 25 bp, Homo sapien
gtacgtttattaacactggttcttg

SEQ ID NO: 456001 - DNA, 25 bp, Homo sapien
gctgtcttcctttgtgatttgttga

SEQ ID NO: 456002 - DNA, 25 bp, Homo sapien
ttttttctttcgtgtatcttctata

SEQ ID NO: 456003 - DNA, 25 bp, Homo sapien
ttctttcgtgtatcttctataggta

SEQ ID NO: 456004 - DNA, 25 bp, Homo sapien
cgtgtatcttctataggtattttct

SEQ ID NO: 456005 - DNA, 25 bp, Homo sapien
ttgtggttaccaaagtcttaacaga

SEQ ID NO: 456006 - DNA, 25 bp, Homo sapien
gaaaacaacttatagctacagcgaa

SEQ ID NO: 456007 - DNA, 25 bp, Homo sapien
cttatagctacagcgaaagcaattt

SEQ ID NO: 456008 - DNA, 25 bp, Homo sapien
tagacaaacaggactgcatctaatt

SEQ ID NO: 456009 - DNA, 25 bp, Homo sapien
caaacaggactgcatctaattaaaa

SEQ ID NO: 456010 - DNA, 25 bp, Homo sapien
gttaagagactgaactggtaatcta

SEQ ID NO: 456011 - DNA, 25 bp, Homo sapien
gactgaactggtaatctatggaata

SEQ ID NO: 456012 - DNA, 25 bp, Homo sapien
gtacttattcttgattgccacgtct

SEQ ID NO: 456013 - DNA, 25 bp, Homo sapien
gattgccacgtctcatttggattcc

SEQ ID NO: 456014 - DNA, 25 bp, Homo sapien
atttggattccccagactctgatta

SEQ ID NO: 456015 - DNA, 25 bp, Homo sapien
gactctgattagaggcactgccacc

SEQ ID NO: 456016 - DNA, 25 bp, Homo sapien
aggcactgccaccaggagagatttt

SEQ ID NO: 456017 - DNA, 25 bp, Homo sapien
tatctaaccaatagtacttccagga

SEQ ID NO: 456018 - DNA, 25 bp, Homo sapien
aggaagatcctcacccttgtacttt

SEQ ID NO: 456019 - DNA, 25 bp, Homo sapien
gcacttgtaattaatgttcagcttc

SEQ ID NO: 456020 - DNA, 25 bp, Homo sapien
ttcagcttcctgaacactgagtggt

SEQ ID NO: 456021 - DNA, 25 bp, Homo sapien
tggtacttgaaaatctctgtggttt

SEQ ID NO: 456022 - DNA, 25 bp, Homo sapien
ttatagccttacagaagctactctg

SEQ ID NO: 456023 - DNA, 25 bp, Homo sapien
ccttgctggtgcagatgaaacggca

SEQ ID NO: 456024 - DNA, 25 bp, Homo sapien
cttgctggtgcagatgaaacggcag

SEQ ID NO: 456025 - DNA, 25 bp, Homo sapien
ctggtgcagatgaaacggcaggctc

SEQ ID NO: 456026 - DNA, 25 bp, Homo sapien
tggtgcagatgaaacggcaggctct

SEQ ID NO: 456027 - DNA, 25 bp, Homo sapien
ggtgcagatgaaacggcaggctctg

SEQ ID NO: 456028 - DNA, 25 bp, Homo sapien
gtgcagatgaaacggcaggctctgg

SEQ ID NO: 456029 - DNA, 25 bp, Homo sapien
tgcagatgaaacggcaggctctgga

SEQ ID NO: 456030 - DNA, 25 bp, Homo sapien
agatgaaacggcaggctctggagaa

SEQ ID NO: 456031 - DNA, 25 bp, Homo sapien
gatgaaacggcaggctctggagaag

SEQ ID NO: 456032 - DNA, 25 bp, Homo sapien
atgaaacggcaggctctggagaaga

SEQ ID NO: 456033 - DNA, 25 bp, Homo sapien
tgaaacggcaggctctggagaagat

SEQ ID NO: 456034 - DNA, 25 bp, Homo sapien
tcctcattctccaagatggtggccc

SEQ ID NO: 456035 - DNA, 25 bp, Homo sapien
tcattctccaagatggtggccctcc

SEQ ID NO: 456036 - DNA, 25 bp, Homo sapien
aagatggtggccctccctcttgtgc

SEQ ID NO: 456037 - DNA, 25 bp, Homo sapien
aaagaacccagatgctcaggcctca

SEQ ID NO: 456038 - DNA, 25 bp, Homo sapien
cccagatgctcaggcctcatggatt

SEQ ID NO: 456039 - DNA, 25 bp, Homo sapien
aaggccccagcaagtgacatcccta

SEQ ID NO: 456040 - DNA, 25 bp, Homo sapien
agcaagtgacatccctattagccgg

SEQ ID NO: 456041 - DNA, 25 bp, Homo sapien
ggagaaggccctggctattgttctg

SEQ ID NO: 456042 - DNA, 25 bp, Homo sapien
taacaatttcacttacagcccttaa

SEQ ID NO: 456043 - DNA, 25 bp, Homo sapien
gggctctggagaactgcatcattag

SEQ ID NO: 456044 - DNA, 25 bp, Homo sapien
gctctggagaactgcatcattagca

SEQ ID NO: 456045 - DNA, 25 bp, Homo sapien
ttatgaattttgatatcctgttgta

SEQ ID NO: 456046 - DNA, 25 bp, Homo sapien
atgaattttgatatcctgttgtata

SEQ ID NO: 456047 - DNA, 25 bp, Homo sapien
gaattttgatatcctgttgtataat

SEQ ID NO: 456048 - DNA, 25 bp, Homo sapien
attttgatatcctgttgtataatac

SEQ ID NO: 456049 - DNA, 25 bp, Homo sapien
ttgatatcctgttgtataatactag

SEQ ID NO: 456050 - DNA, 25 bp, Homo sapien
tatcctgttgtataatactagaaat

SEQ ID NO: 456051 - DNA, 25 bp, Homo sapien
ctagaaatatagagatgcagtatgc

SEQ ID NO: 456052 - DNA, 25 bp, Homo sapien
agatgcagtatgcttcgtgtctttc

SEQ ID NO: 456053 - DNA, 25 bp, Homo sapien
gatgcagtatgcttcgtgtctttct

SEQ ID NO: 456054 - DNA, 25 bp, Homo sapien
cttcgtgtctttctaggaaattcag

SEQ ID NO: 456055 - DNA, 25 bp, Homo sapien
ttcgtgtctttctaggaaattcagt

SEQ ID NO: 456056 - DNA, 25 bp, Homo sapien
cttagatttgatagctgggttggaa

SEQ ID NO: 456057 - DNA, 25 bp, Homo sapien
gctgggttggaattgaacctttagg

SEQ ID NO: 456058 - DNA, 25 bp, Homo sapien
caggatttatctctgcttcattaat

SEQ ID NO: 456059 - DNA, 25 bp, Homo sapien
ttatctctgcttcattaatacatag

SEQ ID NO: 456060 - DNA, 25 bp, Homo sapien
atacatagcattaatttggcatttt

SEQ ID NO: 456061 - DNA, 25 bp, Homo sapien
tggcatttttattctccactttaaa

SEQ ID NO: 456062 - DNA, 25 bp, Homo sapien
ttctccactttaaatagaacacggg

SEQ ID NO: 456063 - DNA, 25 bp, Homo sapien
aataattttctttcagcaacaagaa

SEQ ID NO: 456064 - DNA, 25 bp, Homo sapien
gtaaagcagtagcaggaaatctaga

SEQ ID NO: 456065 - DNA, 25 bp, Homo sapien
ttttttcctcaattagagtcctagc

SEQ ID NO: 456066 - DNA, 25 bp, Homo sapien
gagtcctagccaataaacattcaag

SEQ ID NO: 456067 - DNA, 25 bp, Homo sapien
tccgcagctcagcaaagctactgta

SEQ ID NO: 456068 - DNA, 25 bp, Homo sapien
ccgcagctcagcaaagctactgtag

SEQ ID NO: 456069 - DNA, 25 bp, Homo sapien
cgcagctcagcaaagctactgtagc

SEQ ID NO: 456070 - DNA, 25 bp, Homo sapien
gcagctcagcaaagctactgtagct

SEQ ID NO: 456071 - DNA, 25 bp, Homo sapien
cagctcagcaaagctactgtagcta

SEQ ID NO: 456072 - DNA, 25 bp, Homo sapien
agctcagcaaagctactgtagctag

SEQ ID NO: 456073 - DNA, 25 bp, Homo sapien
ggacagatcacctggggcaaatgct

SEQ ID NO: 456074 - DNA, 25 bp, Homo sapien
gacagatcacctggggcaaatgctg

SEQ ID NO: 456075 - DNA, 25 bp, Homo sapien
gcttcagcagtctcaaaggtccctg

SEQ ID NO: 456076 - DNA, 25 bp, Homo sapien
cttcagcagtctcaaaggtccctgc

SEQ ID NO: 456077 - DNA, 25 bp, Homo sapien
ttcagcagtctcaaaggtccctgcc

SEQ ID NO: 456078 - DNA, 25 bp, Homo sapien
aaatatatgtttctgtttaagcatc

SEQ ID NO: 456079 - DNA, 25 bp, Homo sapien
tatatgtttctgtttaagcatcaaa

SEQ ID NO: 456080 - DNA, 25 bp, Homo sapien
atatgtttctgtttaagcatcaaaa

SEQ ID NO: 456081 - DNA, 25 bp, Homo sapien
tatgtttctgtttaagcatcaaaag

SEQ ID NO: 456082 - DNA, 25 bp, Homo sapien
tgtttctgtttaagcatcaaaagtc

SEQ ID NO: 456083 - DNA, 25 bp, Homo sapien
gtttctgtttaagcatcaaaagtct

SEQ ID NO: 456084 - DNA, 25 bp, Homo sapien
ttctgtttaagcatcaaaagtcttt

SEQ ID NO: 456085 - DNA, 25 bp, Homo sapien
ctgtttaagcatcaaaagtcttttg

SEQ ID NO: 456086 - DNA, 25 bp, Homo sapien
aagcatcaaaagtcttttgctgggc

SEQ ID NO: 456087 - DNA, 25 bp, Homo sapien
gcatcaaaagtcttttgctgggcac

SEQ ID NO: 456088 - DNA, 25 bp, Homo sapien
caaaagtcttttgctgggcacggtg

SEQ ID NO: 456089 - DNA, 25 bp, Homo sapien
agatattgtgtctggcactcagtaa

SEQ ID NO: 456090 - DNA, 25 bp, Homo sapien
tctggcactcagtaaacgtttagga

SEQ ID NO: 456091 - DNA, 25 bp, Homo sapien
atgaatgctgttgagggttttgtgt

SEQ ID NO: 456092 - DNA, 25 bp, Homo sapien
gggttttgtgtgttgtgcaagtatt

SEQ ID NO: 456093 - DNA, 25 bp, Homo sapien
attgagatgtcttaggctttgctct

SEQ ID NO: 456094 - DNA, 25 bp, Homo sapien
atgtcttaggctttgctctggcgtc

SEQ ID NO: 456095 - DNA, 25 bp, Homo sapien
tctggcgtcctctagagcctgaaaa

SEQ ID NO: 456096 - DNA, 25 bp, Homo sapien
gagcctgaaaagttgcttcatttct

SEQ ID NO: 456097 - DNA, 25 bp, Homo sapien
agcagcatttaccaaccacttattt

SEQ ID NO: 456098 - DNA, 25 bp, Homo sapien
ggcatatgaataaaccaggcaattt

SEQ ID NO: 456099 - DNA, 25 bp, Homo sapien
ggcaatttagagaattatttccttc

SEQ ID NO: 456100 - DNA, 25 bp, Homo sapien
gaagaagggtcaaggacgactccaa

SEQ ID NO: 456101 - DNA, 25 bp, Homo sapien
ggacgactccaagggttacggactg

SEQ ID NO: 456102 - DNA, 25 bp, Homo sapien
gactccaagggttacggactgagca

SEQ ID NO: 456103 - DNA, 25 bp, Homo sapien
caagggttacggactgagcaactaa

SEQ ID NO: 456104 - DNA, 25 bp, Homo sapien
gttacggactgagcaactaaagaat

SEQ ID NO: 456105 - DNA, 25 bp, Homo sapien
taaagaatataacttggccgggcgt

SEQ ID NO: 456106 - DNA, 25 bp, Homo sapien
atgcttgtaataccatctttgagag

SEQ ID NO: 456107 - DNA, 25 bp, Homo sapien
aataccatctttgagagaatcccca

SEQ ID NO: 456108 - DNA, 25 bp, Homo sapien
gacccccttgagctcaaggttacag

SEQ ID NO: 456109 - DNA, 25 bp, Homo sapien
tgacccatgatccttcactgtagtc

SEQ ID NO: 456110 - DNA, 25 bp, Homo sapien
acccatgatccttcactgtagtcca

SEQ ID NO: 456111 - DNA, 25 bp, Homo sapien
ttattattacctccaattcgtcacc

SEQ ID NO: 456112 - DNA, 25 bp, Homo sapien
tcaccctcccttaattacttacatt

SEQ ID NO: 456113 - DNA, 25 bp, Homo sapien
attacttacattttgccttagcata

SEQ ID NO: 456114 - DNA, 25 bp, Homo sapien
atataagcggattttcagaagacta

SEQ ID NO: 456115 - DNA, 25 bp, Homo sapien
aaatctcagtgcatcaagttcacag

SEQ ID NO: 456116 - DNA, 25 bp, Homo sapien
agtgttttaatgcatatttctggat

SEQ ID NO: 456117 - DNA, 25 bp, Homo sapien
tatttctggattaatgtacacatgg

SEQ ID NO: 456118 - DNA, 25 bp, Homo sapien
ggtagaccaagtataacactccaaa

SEQ ID NO: 456119 - DNA, 25 bp, Homo sapien
aatgcagttagtgtgatttacttaa

SEQ ID NO: 456120 - DNA, 25 bp, Homo sapien
ttacttaaatatgcagggtcctgat

SEQ ID NO: 456121 - DNA, 25 bp, Homo sapien
gggtcctgatgaagagtaactattt

SEQ ID NO: 456122 - DNA, 25 bp, Homo sapien
aaaccagaatattaggcatgtcaaa

SEQ ID NO: 456123 - DNA, 25 bp, Homo sapien
tacaagcaattctgatgatccatat

SEQ ID NO: 456124 - DNA, 25 bp, Homo sapien
tgatgatccatattatttcagatat

SEQ ID NO: 456125 - DNA, 25 bp, Homo sapien
tcattctctccctagtgggtcaagg

SEQ ID NO: 456126 - DNA, 25 bp, Homo sapien
atgacttcctccaagattgttccag

SEQ ID NO: 456127 - DNA, 25 bp, Homo sapien
gattgttccagatctattgaggcct

SEQ ID NO: 456128 - DNA, 25 bp, Homo sapien
ttccagatctattgaggcctgctct

SEQ ID NO: 456129 - DNA, 25 bp, Homo sapien
tgaggcctgctctgtctaaatagtg

SEQ ID NO: 456130 - DNA, 25 bp, Homo sapien
ggcctgctctgtctaaatagtgctt

SEQ ID NO: 456131 - DNA, 25 bp, Homo sapien
gtctaaatagtgcttccaggaacag

SEQ ID NO: 456132 - DNA, 25 bp, Homo sapien
agtgcttccaggaacagcagggtct

SEQ ID NO: 456133 - DNA, 25 bp, Homo sapien
gatccactgatggttgagaaagcct

SEQ ID NO: 456134 - DNA, 25 bp, Homo sapien
gaaagcctaggatctttctccccag

SEQ ID NO: 456135 - DNA, 25 bp, Homo sapien
tccccagagagaatgccactagaga

SEQ ID NO: 456136 - DNA, 25 bp, Homo sapien
ggcagaacatgaccctgcctgttga

SEQ ID NO: 456137 - DNA, 25 bp, Homo sapien
cctgttgaccccaactgtgacactt

SEQ ID NO: 456138 - DNA, 25 bp, Homo sapien
gtgacacttctgaaaccaatcttag

SEQ ID NO: 456139 - DNA, 25 bp, Homo sapien
aggaaagcctctcatgggaatggca

SEQ ID NO: 456140 - DNA, 25 bp, Homo sapien
gtgggacctccctgttgaaaagttg

SEQ ID NO: 456141 - DNA, 25 bp, Homo sapien
tgaaaagttgtcctgccctctgtca

SEQ ID NO: 456142 - DNA, 25 bp, Homo sapien
cctctgtcagctagacatgccataa

SEQ ID NO: 456143 - DNA, 25 bp, Homo sapien
gagcaagaggctgaacacatggaac

SEQ ID NO: 456144 - DNA, 25 bp, Homo sapien
gacatcatcctatatttctagcctt

SEQ ID NO: 456145 - DNA, 25 bp, Homo sapien
aatattcataccgactacctactgc

SEQ ID NO: 456146 - DNA, 25 bp, Homo sapien
gactacctactgctttctatacagg

SEQ ID NO: 456147 - DNA, 25 bp, Homo sapien
gaaacatttcaaggcctccgaggtc

SEQ ID NO: 456148 - DNA, 25 bp, Homo sapien
gaggtctgcttggaattctcccatc

SEQ ID NO: 456149 - DNA, 25 bp, Homo sapien
ctgctgcctattaatattccaccta

SEQ ID NO: 456150 - DNA, 25 bp, Homo sapien
aaatattccttgaatgagtgccagg

SEQ ID NO: 456151 - DNA, 25 bp, Homo sapien
gagtgccaggtgtcagatacctcag

SEQ ID NO: 456152 - DNA, 25 bp, Homo sapien
tcagttccaaggtcctttcttttgt

SEQ ID NO: 456153 - DNA, 25 bp, Homo sapien
gaagcttttcttggaagctcccttt

SEQ ID NO: 456154 - DNA, 25 bp, Homo sapien
ctttctgagctcacactctaattgg

SEQ ID NO: 456155 - DNA, 25 bp, Homo sapien
actagaatcagataaaggctaccaa

SEQ ID NO: 456156 - DNA, 25 bp, Homo sapien
aattagcttagctttaagggatata

SEQ ID NO: 456157 - DNA, 25 bp, Homo sapien
gacattttatctataggcaacagat

SEQ ID NO: 456158 - DNA, 25 bp, Homo sapien
gcaacagatactttactgaacagtt

SEQ ID NO: 456159 - DNA, 25 bp, Homo sapien
gaacagttcaatagtacttcactaa

SEQ ID NO: 456160 - DNA, 25 bp, Homo sapien
gtacttcactaaacttgtcaaatgt

SEQ ID NO: 456161 - DNA, 25 bp, Homo sapien
aatgtgcaaggatagcgcccaagct

SEQ ID NO: 456162 - DNA, 25 bp, Homo sapien
agcgcccaagctattttgcatacca

SEQ ID NO: 456163 - DNA, 25 bp, Homo sapien
gctattttgcataccaggattcctt

SEQ ID NO: 456164 - DNA, 25 bp, Homo sapien
tttgcataccaggattccttccctt

SEQ ID NO: 456165 - DNA, 25 bp, Homo sapien
tagtgataccccttttctcctggtt

SEQ ID NO: 456166 - DNA, 25 bp, Homo sapien
tttatctctgtataaaacattcaga

SEQ ID NO: 456167 - DNA, 25 bp, Homo sapien
tttttgtgccaaatttgatattcaa

SEQ ID NO: 456168 - DNA, 25 bp, Homo sapien
tttgtgccaaatttgatattcaatt

SEQ ID NO: 456169 - DNA, 25 bp, Homo sapien
attcaatttgatttctgaagttgct

SEQ ID NO: 456170 - DNA, 25 bp, Homo sapien
aagttgctttttaaagatgttcatt

SEQ ID NO: 456171 - DNA, 25 bp, Homo sapien
aagatgttcatttaagatgtaaaga

SEQ ID NO: 456172 - DNA, 25 bp, Homo sapien
ttaacttttaaagtgcagttcattt

SEQ ID NO: 456173 - DNA, 25 bp, Homo sapien
ttttttgagtgttctagagagcact

SEQ ID NO: 456174 - DNA, 25 bp, Homo sapien
gtgttctagagagcactcaaataat

SEQ ID NO: 456175 - DNA, 25 bp, Homo sapien
gagagcactcaaataatgatggtta

SEQ ID NO: 456176 - DNA, 25 bp, Homo sapien
gagcactcaaataatgatggttaaa

SEQ ID NO: 456177 - DNA, 25 bp, Homo sapien
acagatgttatgcatcctgactttt

SEQ ID NO: 456178 - DNA, 25 bp, Homo sapien
catcctgactttttggctagtgtta

SEQ ID NO: 456179 - DNA, 25 bp, Homo sapien
ttggctagtgttactcattttgccc

SEQ ID NO: 456180 - DNA, 25 bp, Homo sapien
ttactcattttgccccagttaagtc

SEQ ID NO: 456181 - DNA, 25 bp, Homo sapien
gacactgaagtcaactaagaacaaa

SEQ ID NO: 456182 - DNA, 25 bp, Homo sapien
ctttaaaatactttctcagccgctc

SEQ ID NO: 456183 - DNA, 25 bp, Homo sapien
aaaatactttctcagccgctccctg

SEQ ID NO: 456184 - DNA, 25 bp, Homo sapien
aagtactttcccttgccgggtgcag

SEQ ID NO: 456185 - DNA, 25 bp, Homo sapien
gtgcagtgtctcacagccataatca

SEQ ID NO: 456186 - DNA, 25 bp, Homo sapien
gtgtctcacagccataatcatagca

SEQ ID NO: 456187 - DNA, 25 bp, Homo sapien
tcacagccataatcatagcattttg

SEQ ID NO: 456188 - DNA, 25 bp, Homo sapien
caagcacattccacttattgtgtac

SEQ ID NO: 456189 - DNA, 25 bp, Homo sapien
aagcacattccacttattgtgtact

SEQ ID NO: 456190 - DNA, 25 bp, Homo sapien
attgtgtactttattatcgcattgt

SEQ ID NO: 456191 - DNA, 25 bp, Homo sapien
gtgtactttattatcgcattgtaat

SEQ ID NO: 456192 - DNA, 25 bp, Homo sapien
actttattatcgcattgtaatggat

SEQ ID NO: 456193 - DNA, 25 bp, Homo sapien
gaaacaattctataactcaccatca

SEQ ID NO: 456194 - DNA, 25 bp, Homo sapien
aacaattctataactcaccatcatg

SEQ ID NO: 456195 - DNA, 25 bp, Homo sapien
caattctataactcaccatcatgta

SEQ ID NO: 456196 - DNA, 25 bp, Homo sapien
ctataactcaccatcatgtagaatc

SEQ ID NO: 456197 - DNA, 25 bp, Homo sapien
caactaggtggtcccatctggaggt

SEQ ID NO: 456198 - DNA, 25 bp, Homo sapien
attctcataaggaggccaggcacgg

SEQ ID NO: 456199 - DNA, 25 bp, Homo sapien
tcagcagtctcttactaggcctgat

SEQ ID NO: 456200 - DNA, 25 bp, Homo sapien
cagtctcttactaggcctgattggt

SEQ ID NO: 456201 - DNA, 25 bp, Homo sapien
gtttggaaaggcccacatattatct

SEQ ID NO: 456202 - DNA, 25 bp, Homo sapien
cacatattatcttttgttagtaaca

SEQ ID NO: 456203 - DNA, 25 bp, Homo sapien
cttttgttagtaacagttattcctg

SEQ ID NO: 456204 - DNA, 25 bp, Homo sapien
cagcaattgagattccctgtcagat

SEQ ID NO: 456205 - DNA, 25 bp, Homo sapien
gcaattgagattccctgtcagatat

SEQ ID NO: 456206 - DNA, 25 bp, Homo sapien
cctgtcagatattccaccctgaagg

SEQ ID NO: 456207 - DNA, 25 bp, Homo sapien
agatattccaccctgaaggtgctat

SEQ ID NO: 456208 - DNA, 25 bp, Homo sapien
agtaaagcaattcccacaaggcgta

SEQ ID NO: 456209 - DNA, 25 bp, Homo sapien
agcaattcccacaaggcgtagtaaa

SEQ ID NO: 456210 - DNA, 25 bp, Homo sapien
aaaaaagtcattctactacattgaa

SEQ ID NO: 456211 - DNA, 25 bp, Homo sapien
aaaaagtcattctactacattgaag

SEQ ID NO: 456212 - DNA, 25 bp, Homo sapien
aaaagtcattctactacattgaaga

SEQ ID NO: 456213 - DNA, 25 bp, Homo sapien
aaagtcattctactacattgaagat

SEQ ID NO: 456214 - DNA, 25 bp, Homo sapien
gctaccccatcaaaccaaataaact

SEQ ID NO: 456215 - DNA, 25 bp, Homo sapien
tataaaatacaacttcacctgcctg

SEQ ID NO: 456216 - DNA, 25 bp, Homo sapien
ataaaatacaacttcacctgcctgg

SEQ ID NO: 456217 - DNA, 25 bp, Homo sapien
taaaatacaacttcacctgcctggg

SEQ ID NO: 456218 - DNA, 25 bp, Homo sapien
agtgagcagtgttcgtgccaccgca

SEQ ID NO: 456219 - DNA, 25 bp, Homo sapien
gtgagcagtgttcgtgccaccgcac

SEQ ID NO: 456220 - DNA, 25 bp, Homo sapien
tgagcagtgttcgtgccaccgcact

SEQ ID NO: 456221 - DNA, 25 bp, Homo sapien
gaaacctagatcaagtttttacaga

SEQ ID NO: 456222 - DNA, 25 bp, Homo sapien
cctagatcaagtttttacagatgta

SEQ ID NO: 456223 - DNA, 25 bp, Homo sapien
atatgtgaatttttcctagatgtaa

SEQ ID NO: 456224 - DNA, 25 bp, Homo sapien
atgtgaatttttcctagatgtaaaa

SEQ ID NO: 456225 - DNA, 25 bp, Homo sapien
ttaacttggcaactggccggtcgtt

SEQ ID NO: 456226 - DNA, 25 bp, Homo sapien
taacttggcaactggccggtcgttt

SEQ ID NO: 456227 - DNA, 25 bp, Homo sapien
ttggcaactggccggtcgttttaca

SEQ ID NO: 456228 - DNA, 25 bp, Homo sapien
acttaaatcggcctttgcagcacaa

SEQ ID NO: 456229 - DNA, 25 bp, Homo sapien
cttaaatcggcctttgcagcacaat

SEQ ID NO: 456230 - DNA, 25 bp, Homo sapien
ttaaatcggcctttgcagcacaatc

SEQ ID NO: 456231 - DNA, 25 bp, Homo sapien
taaatcggcctttgcagcacaatcc

SEQ ID NO: 456232 - DNA, 25 bp, Homo sapien
aagactttaccagttctctttgctg

SEQ ID NO: 456233 - DNA, 25 bp, Homo sapien
agactttaccagttctctttgctgc

SEQ ID NO: 456234 - DNA, 25 bp, Homo sapien
actttaccagttctctttgctgcct

SEQ ID NO: 456235 - DNA, 25 bp, Homo sapien
tttaccagttctctttgctgccttt

SEQ ID NO: 456236 - DNA, 25 bp, Homo sapien
taccagttctctttgctgcctttga

SEQ ID NO: 456237 - DNA, 25 bp, Homo sapien
ccagttctctttgctgcctttgaag

SEQ ID NO: 456238 - DNA, 25 bp, Homo sapien
gttctgtaatttctaggtagggtca

SEQ ID NO: 456239 - DNA, 25 bp, Homo sapien
ttctaggtagggtcaattttctggg

SEQ ID NO: 456240 - DNA, 25 bp, Homo sapien
catgggaattttgatacacagcctg

SEQ ID NO: 456241 - DNA, 25 bp, Homo sapien
gggaattttgatacacagcctgggt

SEQ ID NO: 456242 - DNA, 25 bp, Homo sapien
aattttgatacacagcctgggtgac

SEQ ID NO: 456243 - DNA, 25 bp, Homo sapien
gcactacattttggcaaagcatgca

SEQ ID NO: 456244 - DNA, 25 bp, Homo sapien
ggagctcccatgaatttttgcctag

SEQ ID NO: 456245 - DNA, 25 bp, Homo sapien
atttttgcctaggaaatgacctggt

SEQ ID NO: 456246 - DNA, 25 bp, Homo sapien
aatgacctggtagatcggatagtta

SEQ ID NO: 456247 - DNA, 25 bp, Homo sapien
gatcggatagttaccatgttgatag

SEQ ID NO: 456248 - DNA, 25 bp, Homo sapien
gatagattgccaagtgccttttctc

SEQ ID NO: 456249 - DNA, 25 bp, Homo sapien
tgccaagtgccttttctcatgtgtg

SEQ ID NO: 456250 - DNA, 25 bp, Homo sapien
tgatgccatcatcagctggaagctc

SEQ ID NO: 456251 - DNA, 25 bp, Homo sapien
agctggaagctcagttggtcttgtg

SEQ ID NO: 456252 - DNA, 25 bp, Homo sapien
gtggcatgctgcaccagttgtctga

SEQ ID NO: 456253 - DNA, 25 bp, Homo sapien
tgcaccagttgtctgattcagcaat

SEQ ID NO: 456254 - DNA, 25 bp, Homo sapien
gtgccggcagctctgacatcagttg

SEQ ID NO: 456255 - DNA, 25 bp, Homo sapien
atccatgtcctcaggagccgtattt

SEQ ID NO: 456256 - DNA, 25 bp, Homo sapien
tcctcaggagccgtatttggtgtct

SEQ ID NO: 456257 - DNA, 25 bp, Homo sapien
gagccgtatttggtgtctgatccca

SEQ ID NO: 456258 - DNA, 25 bp, Homo sapien
gtgtctgatcccaaagtgtctgagc

SEQ ID NO: 456259 - DNA, 25 bp, Homo sapien
gagcagctggaaatctgaactggtt

SEQ ID NO: 456260 - DNA, 25 bp, Homo sapien
ggtgtctgtctctttaaatgcactt

SEQ ID NO: 456261 - DNA, 25 bp, Homo sapien
ctgtctctttaaatgcactttgtgt

SEQ ID NO: 456262 - DNA, 25 bp, Homo sapien
actttgtgtcagtgcgataaggaat

SEQ ID NO: 456263 - DNA, 25 bp, Homo sapien
atttgatggctttatcagaaatacc

SEQ ID NO: 456264 - DNA, 25 bp, Homo sapien
ttagcagggtgaggctcacaccact

SEQ ID NO: 456265 - DNA, 25 bp, Homo sapien
gatgcttcagtaagcccagatcaca

SEQ ID NO: 456266 - DNA, 25 bp, Homo sapien
atgcttcagtaagcccagatcacac

SEQ ID NO: 456267 - DNA, 25 bp, Homo sapien
aaaaaaagacatagagccaggcgcc

SEQ ID NO: 456268 - DNA, 25 bp, Homo sapien
aaaaaagacatagagccaggcgcct

SEQ ID NO: 456269 - DNA, 25 bp, Homo sapien
aaaaagacatagagccaggcgcctg

SEQ ID NO: 456270 - DNA, 25 bp, Homo sapien
caggcgcctggctctcagcactttg

SEQ ID NO: 456271 - DNA, 25 bp, Homo sapien
aggcgcctggctctcagcactttgg

SEQ ID NO: 456272 - DNA, 25 bp, Homo sapien
ggcgcctggctctcagcactttgga

SEQ ID NO: 456273 - DNA, 25 bp, Homo sapien
ccaaggcgtgaggactgtttgaggt

SEQ ID NO: 456274 - DNA, 25 bp, Homo sapien
caaggcgtgaggactgtttgaggtc

SEQ ID NO: 456275 - DNA, 25 bp, Homo sapien
aaggcgtgaggactgtttgaggtca

SEQ ID NO: 456276 - DNA, 25 bp, Homo sapien
gagctacgtggaaatgctgcctttt

SEQ ID NO: 456277 - DNA, 25 bp, Homo sapien
gctgccttttgggatttcctgtaat

SEQ ID NO: 456278 - DNA, 25 bp, Homo sapien
gtaatgcagttacgtgcctccaaga

SEQ ID NO: 456279 - DNA, 25 bp, Homo sapien
aaagaccagaacgacttcacggcac

SEQ ID NO: 456280 - DNA, 25 bp, Homo sapien
accgtgcgtagttttcagttcctgg

SEQ ID NO: 456281 - DNA, 25 bp, Homo sapien
cagttcctggcttttggcatgttgg

SEQ ID NO: 456282 - DNA, 25 bp, Homo sapien
gagacctgtgcttattggatggagt

SEQ ID NO: 456283 - DNA, 25 bp, Homo sapien
gagaaactaatacccatccaggcct

SEQ ID NO: 456284 - DNA, 25 bp, Homo sapien
tcagttgggtcttttccttagccct

SEQ ID NO: 456285 - DNA, 25 bp, Homo sapien
cttagccctgcgattagcacgggat

SEQ ID NO: 456286 - DNA, 25 bp, Homo sapien
tcatctgctttttggactcactgac

SEQ ID NO: 456287 - DNA, 25 bp, Homo sapien
cacaggatacgtccttttgtgtctg

SEQ ID NO: 456288 - DNA, 25 bp, Homo sapien
tttgtgtctggatcctctcactgag

SEQ ID NO: 456289 - DNA, 25 bp, Homo sapien
tgagcgtgaggtcctcaaggttcat

SEQ ID NO: 456290 - DNA, 25 bp, Homo sapien
tgtagcccgtgtctggattcccttc

SEQ ID NO: 456291 - DNA, 25 bp, Homo sapien
gctgcgtaatattccactgtctggt

SEQ ID NO: 456292 - DNA, 25 bp, Homo sapien
cactgtctggttggaccatgctgtg

SEQ ID NO: 456293 - DNA, 25 bp, Homo sapien
ggaccatgctgtgtttatccactga

SEQ ID NO: 456294 - DNA, 25 bp, Homo sapien
gtttatccactgatgggcgcctggg

SEQ ID NO: 456295 - DNA, 25 bp, Homo sapien
gaatcatgccgctgtgcacttgtgt

SEQ ID NO: 456296 - DNA, 25 bp, Homo sapien
cttgtgtgtgcaaacacctctttca

SEQ ID NO: 456297 - DNA, 25 bp, Homo sapien
tttcagtccctgctgtcagttctgt

SEQ ID NO: 456298 - DNA, 25 bp, Homo sapien
gggattctccatgttgctcacgcct

SEQ ID NO: 456299 - DNA, 25 bp, Homo sapien
ggattctccatgttgctcacgcctg

SEQ ID NO: 456300 - DNA, 25 bp, Homo sapien
gattctccatgttgctcacgcctgt

SEQ ID NO: 456301 - DNA, 25 bp, Homo sapien
attctccatgttgctcacgcctgta

SEQ ID NO: 456302 - DNA, 25 bp, Homo sapien
ttctccatgttgctcacgcctgtaa

SEQ ID NO: 456303 - DNA, 25 bp, Homo sapien
tctccatgttgctcacgcctgtaat

SEQ ID NO: 456304 - DNA, 25 bp, Homo sapien
caggcatggtggcacgcacctatag

SEQ ID NO: 456305 - DNA, 25 bp, Homo sapien
aggcatggtggcacgcacctatagt

SEQ ID NO: 456306 - DNA, 25 bp, Homo sapien
ggcatggtggcacgcacctatagtc

SEQ ID NO: 456307 - DNA, 25 bp, Homo sapien
gcatggtggcacgcacctatagtcc

SEQ ID NO: 456308 - DNA, 25 bp, Homo sapien
catggtggcacgcacctatagtccc

SEQ ID NO: 456309 - DNA, 25 bp, Homo sapien
catttttcctgtagagtcagggcca

SEQ ID NO: 456310 - DNA, 25 bp, Homo sapien
atttttcctgtagagtcagggccag

SEQ ID NO: 456311 - DNA, 25 bp, Homo sapien
tttttcctgtagagtcagggccagg

SEQ ID NO: 456312 - DNA, 25 bp, Homo sapien
ttttcctgtagagtcagggccaggc

SEQ ID NO: 456313 - DNA, 25 bp, Homo sapien
tttcctgtagagtcagggccaggca

SEQ ID NO: 456314 - DNA, 25 bp, Homo sapien
ttcctgtagagtcagggccaggcac

SEQ ID NO: 456315 - DNA, 25 bp, Homo sapien
tcctgtagagtcagggccaggcacg

SEQ ID NO: 456316 - DNA, 25 bp, Homo sapien
cctgtagagtcagggccaggcacgg

SEQ ID NO: 456317 - DNA, 25 bp, Homo sapien
ctgtagagtcagggccaggcacggt

SEQ ID NO: 456318 - DNA, 25 bp, Homo sapien
cattgtgaatactgctgttataaac

SEQ ID NO: 456319 - DNA, 25 bp, Homo sapien
gcaaatctctttgatgtactgactt

SEQ ID NO: 456320 - DNA, 25 bp, Homo sapien
gtactgacttattttcttatgggta

SEQ ID NO: 456321 - DNA, 25 bp, Homo sapien
ggatcatatggtaggcgtgttttca

SEQ ID NO: 456322 - DNA, 25 bp, Homo sapien
catatggtaggcgtgttttcagatt

SEQ ID NO: 456323 - DNA, 25 bp, Homo sapien
gtaggcgtgttttcagatttttggg

SEQ ID NO: 456324 - DNA, 25 bp, Homo sapien
agcaacggtgtatgagtggtcccct

SEQ ID NO: 456325 - DNA, 25 bp, Homo sapien
acggtgtatgagtggtcccctttct

SEQ ID NO: 456326 - DNA, 25 bp, Homo sapien
tccttgccaacatttattacttttt

SEQ ID NO: 456327 - DNA, 25 bp, Homo sapien
gaaagtagccatttaacaggtgaga

SEQ ID NO: 456328 - DNA, 25 bp, Homo sapien
gtagccatttaacaggtgagataat

SEQ ID NO: 456329 - DNA, 25 bp, Homo sapien
ggactttgatctgccatacggaggt

SEQ ID NO: 456330 - DNA, 25 bp, Homo sapien
tctgccatacggaggttcggaacct

SEQ ID NO: 456331 - DNA, 25 bp, Homo sapien
aaagcatgagcttgttcagagtgag

SEQ ID NO: 456332 - DNA, 25 bp, Homo sapien
atttgcattcccacagcatcctgaa

SEQ ID NO: 456333 - DNA, 25 bp, Homo sapien
agcatcctgaataccgactacctct

SEQ ID NO: 456334 - DNA, 25 bp, Homo sapien
actacctcttcacttgctaaagcag

SEQ ID NO: 456335 - DNA, 25 bp, Homo sapien
aagcagctaaactgtgaagctctaa

SEQ ID NO: 456336 - DNA, 25 bp, Homo sapien
gaagctctaagtggtttgggtttgt

SEQ ID NO: 456337 - DNA, 25 bp, Homo sapien
gttgtttaaccttagcgagatcctt

SEQ ID NO: 456338 - DNA, 25 bp, Homo sapien
agcgagatcctttaactgcagcaat

SEQ ID NO: 456339 - DNA, 25 bp, Homo sapien
taactgcagcaatattcaagccaga

SEQ ID NO: 456340 - DNA, 25 bp, Homo sapien
gtgtgtctcatgaataactttatcc

SEQ ID NO: 456341 - DNA, 25 bp, Homo sapien
gtctcatgaataactttatccggga

SEQ ID NO: 456342 - DNA, 25 bp, Homo sapien
catgaataactttatccgggaatct

SEQ ID NO: 456343 - DNA, 25 bp, Homo sapien
atccgggaatcttgatggtgacctg

SEQ ID NO: 456344 - DNA, 25 bp, Homo sapien
tccgggaatcttgatggtgacctgg

SEQ ID NO: 456345 - DNA, 25 bp, Homo sapien
cgggaatcttgatggtgacctggaa

SEQ ID NO: 456346 - DNA, 25 bp, Homo sapien
gaatcttgatggtgacctggaaggc

SEQ ID NO: 456347 - DNA, 25 bp, Homo sapien
ctggaaggcagatggtaccctcatc

SEQ ID NO: 456348 - DNA, 25 bp, Homo sapien
gaaggcagatggtaccctcatcacc

SEQ ID NO: 456349 - DNA, 25 bp, Homo sapien
gcagatggtaccctcatcacccaga

SEQ ID NO: 456350 - DNA, 25 bp, Homo sapien
gatggtaccctcatcacccagagcg

SEQ ID NO: 456351 - DNA, 25 bp, Homo sapien
acaacctgttaggtactatgcttat

SEQ ID NO: 456352 - DNA, 25 bp, Homo sapien
ggctgacaaaataatatgcacacca

SEQ ID NO: 456353 - DNA, 25 bp, Homo sapien
aaaaacaacctgtgcacatacccct

SEQ ID NO: 456354 - DNA, 25 bp, Homo sapien
gtgcacatacccctgaaactgaaat

SEQ ID NO: 456355 - DNA, 25 bp, Homo sapien
acatacccctgaaactgaaataaat

SEQ ID NO: 456356 - DNA, 25 bp, Homo sapien
gcctggtaatttgactggcatgcag

SEQ ID NO: 456357 - DNA, 25 bp, Homo sapien
tggcatgcagaacataatagcctgt

SEQ ID NO: 456358 - DNA, 25 bp, Homo sapien
acataatagcctgtcctgcatttgg

SEQ ID NO: 456359 - DNA, 25 bp, Homo sapien
aatagcctgtcctgcatttgggttc

SEQ ID NO: 456360 - DNA, 25 bp, Homo sapien
agcctgtcctgcatttgggttctgt

SEQ ID NO: 456361 - DNA, 25 bp, Homo sapien
tgtcctgcatttgggttctgtgcag

SEQ ID NO: 456362 - DNA, 25 bp, Homo sapien
tatgtagtggccctcagcagtctga

SEQ ID NO: 456363 - DNA, 25 bp, Homo sapien
cagtctgataggagctgaggctgct

SEQ ID NO: 456364 - DNA, 25 bp, Homo sapien
ggctgctggccactaagtagctgat

SEQ ID NO: 456365 - DNA, 25 bp, Homo sapien
gctgatgctagtcttcatgatcctt

SEQ ID NO: 456366 - DNA, 25 bp, Homo sapien
atgatccttgctcttgatggccgat

SEQ ID NO: 456367 - DNA, 25 bp, Homo sapien
tgatggccgattccattaaagagga

SEQ ID NO: 456368 - DNA, 25 bp, Homo sapien
gtaatgccatagctccttcttaaga

SEQ ID NO: 456369 - DNA, 25 bp, Homo sapien
gaggctttagtacaaacttgggaat

SEQ ID NO: 456370 - DNA, 25 bp, Homo sapien
ttgggaattcatgtcacctggtgga

SEQ ID NO: 456371 - DNA, 25 bp, Homo sapien
ggtggacaattgaaaggcagctgct

SEQ ID NO: 456372 - DNA, 25 bp, Homo sapien
gaaaggcagctgctttcttggccag

SEQ ID NO: 456373 - DNA, 25 bp, Homo sapien
tttcttcatctacaagttgggaaaa

SEQ ID NO: 456374 - DNA, 25 bp, Homo sapien
aaattgcttagagtttctagcacat

SEQ ID NO: 456375 - DNA, 25 bp, Homo sapien
gcttagagtttctagcacatagcaa

SEQ ID NO: 456376 - DNA, 25 bp, Homo sapien
gagtttctagcacatagcaaataat

SEQ ID NO: 456377 - DNA, 25 bp, Homo sapien
gcttaaagtcttggatttgatgcat

SEQ ID NO: 456378 - DNA, 25 bp, Homo sapien
aaagtcttggatttgatgcatatga

SEQ ID NO: 456379 - DNA, 25 bp, Homo sapien
taatttgtatttgtgctagtagctg

SEQ ID NO: 456380 - DNA, 25 bp, Homo sapien
gtgctagtagctgtaatgtcagtga

SEQ ID NO: 456381 - DNA, 25 bp, Homo sapien
gtcagtgacaggataacaagcaaat

SEQ ID NO: 456382 - DNA, 25 bp, Homo sapien
aatctaatagtaatgcttgttcctt

SEQ ID NO: 456383 - DNA, 25 bp, Homo sapien
gtaatgcttgttcctttgctatcta

SEQ ID NO: 456384 - DNA, 25 bp, Homo sapien
ctcctttcctgcatatgattctagt

SEQ ID NO: 456385 - DNA, 25 bp, Homo sapien
tcctttcctgcatatgattctagtg

SEQ ID NO: 456386 - DNA, 25 bp, Homo sapien
cctttcctgcatatgattctagtgg

SEQ ID NO: 456387 - DNA, 25 bp, Homo sapien
tttcctgcatatgattctagtggct

SEQ ID NO: 456388 - DNA, 25 bp, Homo sapien
ttcctgcatatgattctagtggctt

SEQ ID NO: 456389 - DNA, 25 bp, Homo sapien
cctgcatatgattctagtggcttaa

SEQ ID NO: 456390 - DNA, 25 bp, Homo sapien
tgcatatgattctagtggcttaatt

SEQ ID NO: 456391 - DNA, 25 bp, Homo sapien
taaattttacaaaggacttggccag

SEQ ID NO: 456392 - DNA, 25 bp, Homo sapien
ttttacaaaggacttggccaggtgc

SEQ ID NO: 456393 - DNA, 25 bp, Homo sapien
tttacaaaggacttggccaggtgcg

SEQ ID NO: 456394 - DNA, 25 bp, Homo sapien
gggacaggtggatcgagaccatcat

SEQ ID NO: 456395 - DNA, 25 bp, Homo sapien
tctcctaccaactcattgttttttc

SEQ ID NO: 456396 - DNA, 25 bp, Homo sapien
ctcctaccaactcattgttttttca

SEQ ID NO: 456397 - DNA, 25 bp, Homo sapien
ctaccaactcattgttttttcaacg

SEQ ID NO: 456398 - DNA, 25 bp, Homo sapien
accaactcattgttttttcaacgtg

SEQ ID NO: 456399 - DNA, 25 bp, Homo sapien
ccaactcattgttttttcaacgtga

SEQ ID NO: 456400 - DNA, 25 bp, Homo sapien
caactcattgttttttcaacgtgac

SEQ ID NO: 456401 - DNA, 25 bp, Homo sapien
aactcattgttttttcaacgtgaca

SEQ ID NO: 456402 - DNA, 25 bp, Homo sapien
ctcattgttttttcaacgtgacaaa

SEQ ID NO: 456403 - DNA, 25 bp, Homo sapien
cattgttttttcaacgtgacaaaat

SEQ ID NO: 456404 - DNA, 25 bp, Homo sapien
aaataaaagccctgagctgggcgcg

SEQ ID NO: 456405 - DNA, 25 bp, Homo sapien
aataaaagccctgagctgggcgcgg

SEQ ID NO: 456406 - DNA, 25 bp, Homo sapien
gggaggccttttcaacaatcacaaa

SEQ ID NO: 456407 - DNA, 25 bp, Homo sapien
tgatccatgtaatctgcaagctcag

SEQ ID NO: 456408 - DNA, 25 bp, Homo sapien
gcaagctcagctctagcaatctctg

SEQ ID NO: 456409 - DNA, 25 bp, Homo sapien
tagcaatctctgaggtgcaggttca

SEQ ID NO: 456410 - DNA, 25 bp, Homo sapien
gcaggttcagaagtatgttgtgttt

SEQ ID NO: 456411 - DNA, 25 bp, Homo sapien
gtatgttgtgtttcatcttgtgtca

SEQ ID NO: 456412 - DNA, 25 bp, Homo sapien
gtgtttcatcttgtgtcacatgtta

SEQ ID NO: 456413 - DNA, 25 bp, Homo sapien
agtgtaaggcagagcagcctggccc

SEQ ID NO: 456414 - DNA, 25 bp, Homo sapien
agcctggcccatgatggtctggatg

SEQ ID NO: 456415 - DNA, 25 bp, Homo sapien
tggtctggatgttatgatgccttaa

SEQ ID NO: 456416 - DNA, 25 bp, Homo sapien
gatgccttaagtacagtaggagtaa

SEQ ID NO: 456417 - DNA, 25 bp, Homo sapien
ctttttaaattactctggattcaga

SEQ ID NO: 456418 - DNA, 25 bp, Homo sapien
agccacacagtttcatcacttactg

SEQ ID NO: 456419 - DNA, 25 bp, Homo sapien
tgagctgaaggtttcctcatctgaa

SEQ ID NO: 456420 - DNA, 25 bp, Homo sapien
gggtaatgatagcatctccttctta

SEQ ID NO: 456421 - DNA, 25 bp, Homo sapien
gcatctccttcttaggattgctgtg

SEQ ID NO: 456422 - DNA, 25 bp, Homo sapien
gataaacctcaaattagcacatgcc

SEQ ID NO: 456423 - DNA, 25 bp, Homo sapien
cctccaagggctccatagaaaggtg

SEQ ID NO: 456424 - DNA, 25 bp, Homo sapien
gggtattactgtcttaccgtgtaat

SEQ ID NO: 456425 - DNA, 25 bp, Homo sapien
accgtgtaattgaatggtggcatta

SEQ ID NO: 456426 - DNA, 25 bp, Homo sapien
ggtggcattataacgctatttttca

SEQ ID NO: 456427 - DNA, 25 bp, Homo sapien
aacgctatttttcaggaggcttgtg

SEQ ID NO: 456428 - DNA, 25 bp, Homo sapien
agtaatccttacatgcccagaccct

SEQ ID NO: 456429 - DNA, 25 bp, Homo sapien
gaccctaaaatggagttgccacagc

SEQ ID NO: 456430 - DNA, 25 bp, Homo sapien
catggcagtctgaaatccttgtgat

SEQ ID NO: 456431 - DNA, 25 bp, Homo sapien
atccttgtgatgttcagctggcaga

SEQ ID NO: 456432 - DNA, 25 bp, Homo sapien
tttggatgagtagggctggccaact

SEQ ID NO: 456433 - DNA, 25 bp, Homo sapien
ggtattgctggtgggtcctgtcatt

SEQ ID NO: 456434 - DNA, 25 bp, Homo sapien
gtcctgtcattgtgtgggtggctcc

SEQ ID NO: 456435 - DNA, 25 bp, Homo sapien
ctaaattctgggagggttcttgtga

SEQ ID NO: 456436 - DNA, 25 bp, Homo sapien
ggcaagaggacaccaatcttcttcc

SEQ ID NO: 456437 - DNA, 25 bp, Homo sapien
accaatcttcttccaggcagtagga

SEQ ID NO: 456438 - DNA, 25 bp, Homo sapien
gctggagaggccaagctcccaagta

SEQ ID NO: 456439 - DNA, 25 bp, Homo sapien
aaagaggcctttgcttttgtgctac

SEQ ID NO: 456440 - DNA, 25 bp, Homo sapien
gcttttgtgctacaggcgtttctta

SEQ ID NO: 456441 - DNA, 25 bp, Homo sapien
cttttgtgctacaggcgtttcttat

SEQ ID NO: 456442 - DNA, 25 bp, Homo sapien
ttttgtgctacaggcgtttcttatc

SEQ ID NO: 456443 - DNA, 25 bp, Homo sapien
tgtgctacaggcgtttcttatcttt

SEQ ID NO: 456444 - DNA, 25 bp, Homo sapien
gtgctacaggcgtttcttatcttta

SEQ ID NO: 456445 - DNA, 25 bp, Homo sapien
tgctacaggcgtttcttatctttag

SEQ ID NO: 456446 - DNA, 25 bp, Homo sapien
gctacaggcgtttcttatctttagg

SEQ ID NO: 456447 - DNA, 25 bp, Homo sapien
acaggcgtttcttatctttaggaag

SEQ ID NO: 456448 - DNA, 25 bp, Homo sapien
tatctttaggaagaatgggccgggc

SEQ ID NO: 456449 - DNA, 25 bp, Homo sapien
ctttaggaagaatgggccgggcgcg

SEQ ID NO: 456450 - DNA, 25 bp, Homo sapien
tttttccttgaatatgcagataaat

SEQ ID NO: 456451 - DNA, 25 bp, Homo sapien
tttccttgaatatgcagataaataa

SEQ ID NO: 456452 - DNA, 25 bp, Homo sapien
taataataaaatgggtcagacacgg

SEQ ID NO: 456453 - DNA, 25 bp, Homo sapien
ataataaaatgggtcagacacggtg

SEQ ID NO: 456454 - DNA, 25 bp, Homo sapien
taataaaatgggtcagacacggtgg

SEQ ID NO: 456455 - DNA, 25 bp, Homo sapien
aataaaatgggtcagacacggtggc

SEQ ID NO: 456456 - DNA, 25 bp, Homo sapien
ataaaatgggtcagacacggtggct

SEQ ID NO: 456457 - DNA, 25 bp, Homo sapien
taaaatgggtcagacacggtggctt

SEQ ID NO: 456458 - DNA, 25 bp, Homo sapien
aaaatgggtcagacacggtggctta

SEQ ID NO: 456459 - DNA, 25 bp, Homo sapien
aaatgggtcagacacggtggcttac

SEQ ID NO: 456460 - DNA, 25 bp, Homo sapien
aatgggtcagacacggtggcttacg

SEQ ID NO: 456461 - DNA, 25 bp, Homo sapien
agacaaatactttgtcctctctggg

SEQ ID NO: 456462 - DNA, 25 bp, Homo sapien
aaaataactattggtcactagcctt

SEQ ID NO: 456463 - DNA, 25 bp, Homo sapien
aataactattggtcactagccttag

SEQ ID NO: 456464 - DNA, 25 bp, Homo sapien
aactattggtcactagccttagtac

SEQ ID NO: 456465 - DNA, 25 bp, Homo sapien
tattggtcactagccttagtacctg

SEQ ID NO: 456466 - DNA, 25 bp, Homo sapien
ttggtcactagccttagtacctgtg

SEQ ID NO: 456467 - DNA, 25 bp, Homo sapien
tggtcactagccttagtacctgtgt

SEQ ID NO: 456468 - DNA, 25 bp, Homo sapien
ggtcactagccttagtacctgtgtg

SEQ ID NO: 456469 - DNA, 25 bp, Homo sapien
tcactagccttagtacctgtgtgat

SEQ ID NO: 456470 - DNA, 25 bp, Homo sapien
gtacagcaaacccccgtgacatgag

SEQ ID NO: 456471 - DNA, 25 bp, Homo sapien
aagctaaaatgcaagtttgtttgtt

SEQ ID NO: 456472 - DNA, 25 bp, Homo sapien
atatccattgttgaagaatataggg

SEQ ID NO: 456473 - DNA, 25 bp, Homo sapien
gattaatgtattgtaacctgatgta

SEQ ID NO: 456474 - DNA, 25 bp, Homo sapien
gtaacctgatgtaaatccttagttc

SEQ ID NO: 456475 - DNA, 25 bp, Homo sapien
gtaaatccttagttcttttctcatt

SEQ ID NO: 456476 - DNA, 25 bp, Homo sapien
tctcatttctgcattgacatcatac

SEQ ID NO: 456477 - DNA, 25 bp, Homo sapien
tcatttctgcattgacatcatacta

SEQ ID NO: 456478 - DNA, 25 bp, Homo sapien
gaaagtgttgatagcacatctatat

SEQ ID NO: 456479 - DNA, 25 bp, Homo sapien
gtgttgatagcacatctatatttaa

SEQ ID NO: 456480 - DNA, 25 bp, Homo sapien
atttaaatacttagtaccacagcaa

SEQ ID NO: 456481 - DNA, 25 bp, Homo sapien
gtaccacagcaagtagtttatatga

SEQ ID NO: 456482 - DNA, 25 bp, Homo sapien
atgacttgagaatgatactgtagga

SEQ ID NO: 456483 - DNA, 25 bp, Homo sapien
gaatatgaatttgcaccaaagaagg

SEQ ID NO: 456484 - DNA, 25 bp, Homo sapien
agaaggctgcttctcatagggcact

SEQ ID NO: 456485 - DNA, 25 bp, Homo sapien
aggctgcttctcatagggcacttga

SEQ ID NO: 456486 - DNA, 25 bp, Homo sapien
ctgcttctcatagggcacttgatga

SEQ ID NO: 456487 - DNA, 25 bp, Homo sapien
aggaaattcagttcatgaagataag

SEQ ID NO: 456488 - DNA, 25 bp, Homo sapien
gtttcttgacaaatacatgccccag

SEQ ID NO: 456489 - DNA, 25 bp, Homo sapien
tcttgacaaatacatgccccagttc

SEQ ID NO: 456490 - DNA, 25 bp, Homo sapien
atacatgccccagttcatgaaacat

SEQ ID NO: 456491 - DNA, 25 bp, Homo sapien
atagaataattgatgtgagcactgt

SEQ ID NO: 456492 - DNA, 25 bp, Homo sapien
actgttaaagaactgtgcagacgct

SEQ ID NO: 456493 - DNA, 25 bp, Homo sapien
gaactgtgcagacgctggtatccag

SEQ ID NO: 456494 - DNA, 25 bp, Homo sapien
gcagtattgcctcacgaatcgattg

SEQ ID NO: 456495 - DNA, 25 bp, Homo sapien
cctcacgaatcgattgcttctctga

SEQ ID NO: 456496 - DNA, 25 bp, Homo sapien
tctgaggtgcccacgagtgtattcg

SEQ ID NO: 456497 - DNA, 25 bp, Homo sapien
aacaagttgaagagcgactgtcctt

SEQ ID NO: 456498 - DNA, 25 bp, Homo sapien
gcgactgtccttctatgagactgga

SEQ ID NO: 456499 - DNA, 25 bp, Homo sapien
gagactggagagataccacgaaaga

SEQ ID NO: 456500 - DNA, 25 bp, Homo sapien
gaatctggatgtcatgaaggaagca

SEQ ID NO: 456501 - DNA, 25 bp, Homo sapien
gaagcggctgctgagattactagga

SEQ ID NO: 456502 - DNA, 25 bp, Homo sapien
aaaagaaacggctggctgcacttgc

SEQ ID NO: 456503 - DNA, 25 bp, Homo sapien
ttgccctcgcgtcttcagaaaacag

SEQ ID NO: 456504 - DNA, 25 bp, Homo sapien
aacagcagtagtactccagaggagt

SEQ ID NO: 456505 - DNA, 25 bp, Homo sapien
gttcctcaaacacagacccagggtg

SEQ ID NO: 456506 - DNA, 25 bp, Homo sapien
ttcctcaaacacagacccagggtgc

SEQ ID NO: 456507 - DNA, 25 bp, Homo sapien
ggcagctcccctgtaagctgggtga

SEQ ID NO: 456508 - DNA, 25 bp, Homo sapien
gcagctcccctgtaagctgggtgag

SEQ ID NO: 456509 - DNA, 25 bp, Homo sapien
gctcccctgtaagctgggtgagcta

SEQ ID NO: 456510 - DNA, 25 bp, Homo sapien
tcccctgtaagctgggtgagctact

SEQ ID NO: 456511 - DNA, 25 bp, Homo sapien
cccctgtaagctgggtgagctactg

SEQ ID NO: 456512 - DNA, 25 bp, Homo sapien
cctgtaagctgggtgagctactgaa

SEQ ID NO: 456513 - DNA, 25 bp, Homo sapien
taagctgggtgagctactgaagcca

SEQ ID NO: 456514 - DNA, 25 bp, Homo sapien
agctgggtgagctactgaagccaag

SEQ ID NO: 456515 - DNA, 25 bp, Homo sapien
caaatcccggaccaggcagaaacca

SEQ ID NO: 456516 - DNA, 25 bp, Homo sapien
gttggttggttcagggagcactaaa

SEQ ID NO: 456517 - DNA, 25 bp, Homo sapien
aaagctgagagcttcttctagcccg

SEQ ID NO: 456518 - DNA, 25 bp, Homo sapien
ccaggcatcatgctgttggcttatg

SEQ ID NO: 456519 - DNA, 25 bp, Homo sapien
tgctgttggcttatgattggagatc

SEQ ID NO: 456520 - DNA, 25 bp, Homo sapien
tatgattggagatcgcagactgccg

SEQ ID NO: 456521 - DNA, 25 bp, Homo sapien
cgcagactgccgaggtataaggaca

SEQ ID NO: 456522 - DNA, 25 bp, Homo sapien
ggccacatggtggtcttcattcagg

SEQ ID NO: 456523 - DNA, 25 bp, Homo sapien
ggtggtcttcattcagggacatttt

SEQ ID NO: 456524 - DNA, 25 bp, Homo sapien
cattcagggacattttactcttcat

SEQ ID NO: 456525 - DNA, 25 bp, Homo sapien
ttttactcttcatcacactgttttg

SEQ ID NO: 456526 - DNA, 25 bp, Homo sapien
atcacactgttttgcctagaaacag

SEQ ID NO: 456527 - DNA, 25 bp, Homo sapien
tggtgtaatcgtggcaggtctctgc

SEQ ID NO: 456528 - DNA, 25 bp, Homo sapien
aggtctctgcctgaagtgctatgtg

SEQ ID NO: 456529 - DNA, 25 bp, Homo sapien
atatttttacactcatcactcctca

SEQ ID NO: 456530 - DNA, 25 bp, Homo sapien
gggctgtacaatcatgtagaaattg

SEQ ID NO: 456531 - DNA, 25 bp, Homo sapien
gtagaaattgtttaatgtgcctgtc

SEQ ID NO: 456532 - DNA, 25 bp, Homo sapien
gtttaatgtgcctgtcaaatagcca

SEQ ID NO: 456533 - DNA, 25 bp, Homo sapien
atagccaaagagtgttaaaccctga

SEQ ID NO: 456534 - DNA, 25 bp, Homo sapien
gagttcccacccatgtgtgtggtat

SEQ ID NO: 456535 - DNA, 25 bp, Homo sapien
gtgtggtatggttaggattcatcca

SEQ ID NO: 456536 - DNA, 25 bp, Homo sapien
aggattcatccagatacacagagag

SEQ ID NO: 456537 - DNA, 25 bp, Homo sapien
agcgggcccccaatatggtgtaatc

SEQ ID NO: 456538 - DNA, 25 bp, Homo sapien
gcaggcccagtgaagaatgtgctgt

SEQ ID NO: 456539 - DNA, 25 bp, Homo sapien
gaatgtgctgttggcatccatacgg

SEQ ID NO: 456540 - DNA, 25 bp, Homo sapien
catccatacggctagatgggccagt

SEQ ID NO: 456541 - DNA, 25 bp, Homo sapien
atgggccagtactgtggattcttaa

SEQ ID NO: 456542 - DNA, 25 bp, Homo sapien
ttaaagcatctctttgccactgttc

SEQ ID NO: 456543 - DNA, 25 bp, Homo sapien
ttcttgcctttcttttacacctcca

SEQ ID NO: 456544 - DNA, 25 bp, Homo sapien
gcaacagattaacaccggctactta

SEQ ID NO: 456545 - DNA, 25 bp, Homo sapien
ttaacaccggctacttactgtgctg

SEQ ID NO: 456546 - DNA, 25 bp, Homo sapien
tactgtgctgctttggacattattc

SEQ ID NO: 456547 - DNA, 25 bp, Homo sapien
gacattattcagatccagtgtgact

SEQ ID NO: 456548 - DNA, 25 bp, Homo sapien
atccagtgtgactgttagtttgacc

SEQ ID NO: 456549 - DNA, 25 bp, Homo sapien
ctttgggactgtgaagatcaacatc

SEQ ID NO: 456550 - DNA, 25 bp, Homo sapien
agatcaacatctccatgggaccttt

SEQ ID NO: 456551 - DNA, 25 bp, Homo sapien
acatctccatgggacctttcaggtt

SEQ ID NO: 456552 - DNA, 25 bp, Homo sapien
ggacctttcaggtttcactataaca

SEQ ID NO: 456553 - DNA, 25 bp, Homo sapien
cacagtgtgctctggatgcatcgga

SEQ ID NO: 456554 - DNA, 25 bp, Homo sapien
tggatgcatcggagggccccacaga

SEQ ID NO: 456555 - DNA, 25 bp, Homo sapien
gagggccccacagaactttgcctgg

SEQ ID NO: 456556 - DNA, 25 bp, Homo sapien
actttgcctggttgtggtttgtgac

SEQ ID NO: 456557 - DNA, 25 bp, Homo sapien
gtggtttgtgacttgtggttttcat

SEQ ID NO: 456558 - DNA, 25 bp, Homo sapien
aagctagcaccccttacgggctggg

SEQ ID NO: 456559 - DNA, 25 bp, Homo sapien
ggaggttgcattgaccagagattat

SEQ ID NO: 456560 - DNA, 25 bp, Homo sapien
gtgttaccttactccttcactgctt

SEQ ID NO: 456561 - DNA, 25 bp, Homo sapien
ttactccttcactgcttcttagaag

SEQ ID NO: 456562 - DNA, 25 bp, Homo sapien
taagtttctggaattgcacctacat

SEQ ID NO: 456563 - DNA, 25 bp, Homo sapien
gtttctggaattgcacctacatgtt

SEQ ID NO: 456564 - DNA, 25 bp, Homo sapien
ggaattgcacctacatgttttctta

SEQ ID NO: 456565 - DNA, 25 bp, Homo sapien
attgcacctacatgttttcttatta

SEQ ID NO: 456566 - DNA, 25 bp, Homo sapien
ttttccagtgagtagttttctgaaa

SEQ ID NO: 456567 - DNA, 25 bp, Homo sapien
gaattacacagttctaataaaacct

SEQ ID NO: 456568 - DNA, 25 bp, Homo sapien
tgccttttcattacatctaatttga

SEQ ID NO: 456569 - DNA, 25 bp, Homo sapien
cattacatctaatttgaactctcaa

SEQ ID NO: 456570 - DNA, 25 bp, Homo sapien
gaactctcaacttcatgttacagaa

SEQ ID NO: 456571 - DNA, 25 bp, Homo sapien
caggtgacccaccctcttttggcct

SEQ ID NO: 456572 - DNA, 25 bp, Homo sapien
aagggtttccaaggttgagcactag

SEQ ID NO: 456573 - DNA, 25 bp, Homo sapien
agggtttccaaggttgagcactagg

SEQ ID NO: 456574 - DNA, 25 bp, Homo sapien
gggtttccaaggttgagcactaggt

SEQ ID NO: 456575 - DNA, 25 bp, Homo sapien
ggtttccaaggttgagcactaggtg

SEQ ID NO: 456576 - DNA, 25 bp, Homo sapien
gtttccaaggttgagcactaggtga

SEQ ID NO: 456577 - DNA, 25 bp, Homo sapien
tttccaaggttgagcactaggtgag

SEQ ID NO: 456578 - DNA, 25 bp, Homo sapien
ttccaaggttgagcactaggtgagg

SEQ ID NO: 456579 - DNA, 25 bp, Homo sapien
caaggttgagcactaggtgagggac

SEQ ID NO: 456580 - DNA, 25 bp, Homo sapien
aaggttgagcactaggtgagggaca

SEQ ID NO: 456581 - DNA, 25 bp, Homo sapien
agcactaggtgagggacagtggcca

SEQ ID NO: 456582 - DNA, 25 bp, Homo sapien
ctgtcccaaatactcaagtctctct

SEQ ID NO: 456583 - DNA, 25 bp, Homo sapien
tgtcccaaatactcaagtctctctc

SEQ ID NO: 456584 - DNA, 25 bp, Homo sapien
gtcccaaatactcaagtctctctca

SEQ ID NO: 456585 - DNA, 25 bp, Homo sapien
tcccaaatactcaagtctctctcat

SEQ ID NO: 456586 - DNA, 25 bp, Homo sapien
cccaaatactcaagtctctctcatt

SEQ ID NO: 456587 - DNA, 25 bp, Homo sapien
ccaaatactcaagtctctctcatta

SEQ ID NO: 456588 - DNA, 25 bp, Homo sapien
caaatactcaagtctctctcattaa

SEQ ID NO: 456589 - DNA, 25 bp, Homo sapien
aaatactcaagtctctctcattaaa

SEQ ID NO: 456590 - DNA, 25 bp, Homo sapien
aatactcaagtctctctcattaaaa

SEQ ID NO: 456591 - DNA, 25 bp, Homo sapien
atactcaagtctctctcattaaaaa

SEQ ID NO: 456592 - DNA, 25 bp, Homo sapien
tactcaagtctctctcattaaaaat

SEQ ID NO: 456593 - DNA, 25 bp, Homo sapien
taccattattagaaatagctgcggg

SEQ ID NO: 456594 - DNA, 25 bp, Homo sapien
gggaggcattggaacaccaagtaaa

SEQ ID NO: 456595 - DNA, 25 bp, Homo sapien
tgtccgctggccctggaatcactct

SEQ ID NO: 456596 - DNA, 25 bp, Homo sapien
tggccctggaatcactctttttgag

SEQ ID NO: 456597 - DNA, 25 bp, Homo sapien
tggaatcactctttttgagctcggg

SEQ ID NO: 456598 - DNA, 25 bp, Homo sapien
ccacaaggcatgagggttccaccaa

SEQ ID NO: 456599 - DNA, 25 bp, Homo sapien
atgagggttccaccaaagccagcta

SEQ ID NO: 456600 - DNA, 25 bp, Homo sapien
agggttccaccaaagccagctaatg

SEQ ID NO: 456601 - DNA, 25 bp, Homo sapien
aagccagctaatgcgacggctgtca

SEQ ID NO: 456602 - DNA, 25 bp, Homo sapien
taatgcgacggctgtcagctccact

SEQ ID NO: 456603 - DNA, 25 bp, Homo sapien
taattcctcctttcatcttccttct

SEQ ID NO: 456604 - DNA, 25 bp, Homo sapien
agctggaactgagcccaagacttca

SEQ ID NO: 456605 - DNA, 25 bp, Homo sapien
ataacagcagcccttattgagcacc

SEQ ID NO: 456606 - DNA, 25 bp, Homo sapien
tgagcacctggtctttgtgtggcat

SEQ ID NO: 456607 - DNA, 25 bp, Homo sapien
tgtgtggcattatcccttttgcctc

SEQ ID NO: 456608 - DNA, 25 bp, Homo sapien
acagcaagcctgtgatgtgaacatc

SEQ ID NO: 456609 - DNA, 25 bp, Homo sapien
atcacgtctctcactctggacaagg

SEQ ID NO: 456610 - DNA, 25 bp, Homo sapien
gactctctagcattcagtgtcagtg

SEQ ID NO: 456611 - DNA, 25 bp, Homo sapien
ttcagtgtcagtgcaggacgtccat

SEQ ID NO: 456612 - DNA, 25 bp, Homo sapien
aggacgtccatctgagctcattttg

SEQ ID NO: 456613 - DNA, 25 bp, Homo sapien
attttggtcactgtcatgctgcttc

SEQ ID NO: 456614 - DNA, 25 bp, Homo sapien
atgctgcttccgaaggtcttcccaa

SEQ ID NO: 456615 - DNA, 25 bp, Homo sapien
gctcccagccccttctttgtatttt

SEQ ID NO: 456616 - DNA, 25 bp, Homo sapien
aatttctttagtaatgaacaaacat

SEQ ID NO: 456617 - DNA, 25 bp, Homo sapien
gctgttttaaaatttctcttaagca

SEQ ID NO: 456618 - DNA, 25 bp, Homo sapien
atttctcttaagcaaaaggccaaca

SEQ ID NO: 456619 - DNA, 25 bp, Homo sapien
tttctcttaagcaaaaggccaacaa

SEQ ID NO: 456620 - DNA, 25 bp, Homo sapien
ttctcttaagcaaaaggccaacaat

SEQ ID NO: 456621 - DNA, 25 bp, Homo sapien
tctcttaagcaaaaggccaacaatc

SEQ ID NO: 456622 - DNA, 25 bp, Homo sapien
ctcttaagcaaaaggccaacaatca

SEQ ID NO: 456623 - DNA, 25 bp, Homo sapien
tcttaagcaaaaggccaacaatcat

SEQ ID NO: 456624 - DNA, 25 bp, Homo sapien
taagcaaaaggccaacaatcattta

SEQ ID NO: 456625 - DNA, 25 bp, Homo sapien
aagcaaaaggccaacaatcatttaa

SEQ ID NO: 456626 - DNA, 25 bp, Homo sapien
ttaaatgttccctagcacttaaatt

SEQ ID NO: 456627 - DNA, 25 bp, Homo sapien
tgttccctagcacttaaattttaag

SEQ ID NO: 456628 - DNA, 25 bp, Homo sapien
aaatcacattattcagttgcacagt

SEQ ID NO: 456629 - DNA, 25 bp, Homo sapien
agttgcacagtttcagttgcccagc

SEQ ID NO: 456630 - DNA, 25 bp, Homo sapien
gtttcagttgcccagcagtatcatt

SEQ ID NO: 456631 - DNA, 25 bp, Homo sapien
gttgcccagcagtatcattaaatcc

SEQ ID NO: 456632 - DNA, 25 bp, Homo sapien
cattaaatcctctggagtgattcca

SEQ ID NO: 456633 - DNA, 25 bp, Homo sapien
gagtgattccagtcccacaaaaatt

SEQ ID NO: 456634 - DNA, 25 bp, Homo sapien
gacccctttacattgtttccatatt

SEQ ID NO: 456635 - DNA, 25 bp, Homo sapien
tctctctccctccatttattagaaa

SEQ ID NO: 456636 - DNA, 25 bp, Homo sapien
ttacgaaaaaactgctaaagccaat

SEQ ID NO: 456637 - DNA, 25 bp, Homo sapien
tgaatttcctgcctcaagcaatgct

SEQ ID NO: 456638 - DNA, 25 bp, Homo sapien
ctgagtagccaggattatagctgtg

SEQ ID NO: 456639 - DNA, 25 bp, Homo sapien
gccaggattatagctgtgagctacc

SEQ ID NO: 456640 - DNA, 25 bp, Homo sapien
taaatgccactatgtaatgaggcat

SEQ ID NO: 456641 - DNA, 25 bp, Homo sapien
gaaggacttggagcacatacctgtt

SEQ ID NO: 456642 - DNA, 25 bp, Homo sapien
ggacttggagcacatacctgttacg

SEQ ID NO: 456643 - DNA, 25 bp, Homo sapien
acttggagcacatacctgttacggg

SEQ ID NO: 456644 - DNA, 25 bp, Homo sapien
ggagcacatacctgttacgggttta

SEQ ID NO: 456645 - DNA, 25 bp, Homo sapien
gcacatacctgttacgggtttaaag

SEQ ID NO: 456646 - DNA, 25 bp, Homo sapien
taaagcctactttagtcttggccgg

SEQ ID NO: 456647 - DNA, 25 bp, Homo sapien
agcctactttagtcttggccgggtg

SEQ ID NO: 456648 - DNA, 25 bp, Homo sapien
caggtgacccaccctcttttggcct

SEQ ID NO: 456649 - DNA, 25 bp, Homo sapien
aagggtttccaaggttgagcactag

SEQ ID NO: 456650 - DNA, 25 bp, Homo sapien
agggtttccaaggttgagcactagg

SEQ ID NO: 456651 - DNA, 25 bp, Homo sapien
gggtttccaaggttgagcactaggt

SEQ ID NO: 456652 - DNA, 25 bp, Homo sapien
ggtttccaaggttgagcactaggtg

SEQ ID NO: 456653 - DNA, 25 bp, Homo sapien
gtttccaaggttgagcactaggtga

SEQ ID NO: 456654 - DNA, 25 bp, Homo sapien
tttccaaggttgagcactaggtgag

SEQ ID NO: 456655 - DNA, 25 bp, Homo sapien
ttccaaggttgagcactaggtgagg

SEQ ID NO: 456656 - DNA, 25 bp, Homo sapien
aaggttgagcactaggtgagggaca

SEQ ID NO: 456657 - DNA, 25 bp, Homo sapien
agcactaggtgagggacagtggcca

SEQ ID NO: 456658 - DNA, 25 bp, Homo sapien
ggtgagggacagtggccaggtgaca

SEQ ID NO: 456659 - DNA, 25 bp, Homo sapien
agagggacccccacagcggcagctg

SEQ ID NO: 456660 - DNA, 25 bp, Homo sapien
ccacagcggcagctgcgagctgaag

SEQ ID NO: 456661 - DNA, 25 bp, Homo sapien
agcggcagctgcgagctgaagggct

SEQ ID NO: 456662 - DNA, 25 bp, Homo sapien
cagagtggacgccaatgccaaagag

SEQ ID NO: 456663 - DNA, 25 bp, Homo sapien
agagtggacgccaatgccaaagagg

SEQ ID NO: 456664 - DNA, 25 bp, Homo sapien
agtggacgccaatgccaaagaggca

SEQ ID NO: 456665 - DNA, 25 bp, Homo sapien
gtggacgccaatgccaaagaggcac

SEQ ID NO: 456666 - DNA, 25 bp, Homo sapien
gacgccaatgccaaagaggcaccga

SEQ ID NO: 456667 - DNA, 25 bp, Homo sapien
acgccaatgccaaagaggcaccgag

SEQ ID NO: 456668 - DNA, 25 bp, Homo sapien
gccaatgccaaagaggcaccgagag

SEQ ID NO: 456669 - DNA, 25 bp, Homo sapien
caatgccaaagaggcaccgagagtg

SEQ ID NO: 456670 - DNA, 25 bp, Homo sapien
aagaactcccaagaaaccaggcagg

SEQ ID NO: 456671 - DNA, 25 bp, Homo sapien
accaggcaggcagaagctcctgaat

SEQ ID NO: 456672 - DNA, 25 bp, Homo sapien
gaagctcctgaatgctggactagac

SEQ ID NO: 456673 - DNA, 25 bp, Homo sapien
gaatgctggactagacaaactacat

SEQ ID NO: 456674 - DNA, 25 bp, Homo sapien
gacaaactacatgctggctaaacat

SEQ ID NO: 456675 - DNA, 25 bp, Homo sapien
ctttcttcccattgcaaacaagtag

SEQ ID NO: 456676 - DNA, 25 bp, Homo sapien
tatactttgatatttatgctggaaa

SEQ ID NO: 456677 - DNA, 25 bp, Homo sapien
ggatagaagttcaatcagacagttc

SEQ ID NO: 456678 - DNA, 25 bp, Homo sapien
gttcagcttcacgaactgatgtctc

SEQ ID NO: 456679 - DNA, 25 bp, Homo sapien
acgaactgatgtctctctgtattga

SEQ ID NO: 456680 - DNA, 25 bp, Homo sapien
ttttagagtaaaatccatccctggg

SEQ ID NO: 456681 - DNA, 25 bp, Homo sapien
gaagaagggtcaaggacgactccaa

SEQ ID NO: 456682 - DNA, 25 bp, Homo sapien
ggacgactccaagggttacggactg

SEQ ID NO: 456683 - DNA, 25 bp, Homo sapien
caagggttacggactgagcaactaa

SEQ ID NO: 456684 - DNA, 25 bp, Homo sapien
gttacggactgagcaactaaagaat

SEQ ID NO: 456685 - DNA, 25 bp, Homo sapien
taaagaatataacttggccgggcgt

SEQ ID NO: 456686 - DNA, 25 bp, Homo sapien
atgcttgtaataccatctttgagag

SEQ ID NO: 456687 - DNA, 25 bp, Homo sapien
aataccatctttgagagaatcccca

SEQ ID NO: 456688 - DNA, 25 bp, Homo sapien
atctttgagagaatccccagcctgg

SEQ ID NO: 456689 - DNA, 25 bp, Homo sapien
gagctcaaggttacagtgacccatg

SEQ ID NO: 456690 - DNA, 25 bp, Homo sapien
tgacccatgatccttcactgtagtc

SEQ ID NO: 456691 - DNA, 25 bp, Homo sapien
acccatgatccttcactgtagtcca

SEQ ID NO: 456692 - DNA, 25 bp, Homo sapien
ttaggagagggctgccacactggaa

SEQ ID NO: 456693 - DNA, 25 bp, Homo sapien
ggctgccacactggaactcatacag

SEQ ID NO: 456694 - DNA, 25 bp, Homo sapien
agcacagatgctgacattatctgaa

SEQ ID NO: 456695 - DNA, 25 bp, Homo sapien
tgacattatctgaagccaggcagcc

SEQ ID NO: 456696 - DNA, 25 bp, Homo sapien
agccctctctgtctccaggttctgg

SEQ ID NO: 456697 - DNA, 25 bp, Homo sapien
caggttctggtgactgctccatcct

SEQ ID NO: 456698 - DNA, 25 bp, Homo sapien
ttctgctattacttgtggtttcact

SEQ ID NO: 456699 - DNA, 25 bp, Homo sapien
gtggtttcactatactctttctata

SEQ ID NO: 456700 - DNA, 25 bp, Homo sapien
agattatccagtttgaatacaccat

SEQ ID NO: 456701 - DNA, 25 bp, Homo sapien
tccagtttgaatacaccatctattt

SEQ ID NO: 456702 - DNA, 25 bp, Homo sapien
tttcctgaaggaaacctgacataca

SEQ ID NO: 456703 - DNA, 25 bp, Homo sapien
ctgcctttagtcagttttcatgtat

SEQ ID NO: 456704 - DNA, 25 bp, Homo sapien
acttatgattgatatgtcctcctga

SEQ ID NO: 456705 - DNA, 25 bp, Homo sapien
gattgatatgtcctcctgatgaact

SEQ ID NO: 456706 - DNA, 25 bp, Homo sapien
atatgtcctcctgatgaacttttgt

SEQ ID NO: 456707 - DNA, 25 bp, Homo sapien
gaagaatccacattacctgatacaa

SEQ ID NO: 456708 - DNA, 25 bp, Homo sapien
acaaaatttttctgttgcaatctat

SEQ ID NO: 456709 - DNA, 25 bp, Homo sapien
gttgcaatctattttacctgatatt

SEQ ID NO: 456710 - DNA, 25 bp, Homo sapien
gtcacttcaatcttttactgttttc

SEQ ID NO: 456711 - DNA, 25 bp, Homo sapien
ttattttcaacttacctgtgtctag

SEQ ID NO: 456712 - DNA, 25 bp, Homo sapien
acctgtgtctagtatttctctgtaa

SEQ ID NO: 456713 - DNA, 25 bp, Homo sapien
tttttgggataagtctggctctgtc

SEQ ID NO: 456714 - DNA, 25 bp, Homo sapien
ttgctttgtctactgctcctgccta

SEQ ID NO: 456715 - DNA, 25 bp, Homo sapien
tgctcctgcctatctcccttaaaag

SEQ ID NO: 456716 - DNA, 25 bp, Homo sapien
taaaagcattagcttctctcccttc

SEQ ID NO: 456717 - DNA, 25 bp, Homo sapien
tctcccttctcctgtgacatacata

SEQ ID NO: 456718 - DNA, 25 bp, Homo sapien
gacatacatagcgtattcctcactc

SEQ ID NO: 456719 - DNA, 25 bp, Homo sapien
tattcctcactccatgacattgtca

SEQ ID NO: 456720 - DNA, 25 bp, Homo sapien
catgacattgtcataggactgaaag

SEQ ID NO: 456721 - DNA, 25 bp, Homo sapien
agttgtgtacaagtaagctctgttt

SEQ ID NO: 456722 - DNA, 25 bp, Homo sapien
gtacaagtaagctctgttttctgtt

SEQ ID NO: 456723 - DNA, 25 bp, Homo sapien
ttctgttttaaagcgcaatcatcca

SEQ ID NO: 456724 - DNA, 25 bp, Homo sapien
aagcgcaatcatccactgaaagaaa

SEQ ID NO: 456725 - DNA, 25 bp, Homo sapien
gctgatgcagggaaactctccccta

SEQ ID NO: 456726 - DNA, 25 bp, Homo sapien
actctcccctacaaaatcatcagat

SEQ ID NO: 456727 - DNA, 25 bp, Homo sapien
agatctcctgagactcattcatcac

SEQ ID NO: 456728 - DNA, 25 bp, Homo sapien
tcctgagactcattcatcaccatga

SEQ ID NO: 456729 - DNA, 25 bp, Homo sapien
ctgtgggagccacaagtcaagatga

SEQ ID NO: 456730 - DNA, 25 bp, Homo sapien
gccaaaccctatcaaaatggccaaa

SEQ ID NO: 456731 - DNA, 25 bp, Homo sapien
tagactatgaggtacttataatccc

SEQ ID NO: 456732 - DNA, 25 bp, Homo sapien
ggtacttataatccctcaagcccct

SEQ ID NO: 456733 - DNA, 25 bp, Homo sapien
tcaagcccctgaagattgtcaaaca

SEQ ID NO: 456734 - DNA, 25 bp, Homo sapien
attgtcaaacactgaacttgccttt

SEQ ID NO: 456735 - DNA, 25 bp, Homo sapien
caaacactgaacttgcctttcagct

SEQ ID NO: 456736 - DNA, 25 bp, Homo sapien
tgtcaaaacatcataatataccgaa

SEQ ID NO: 456737 - DNA, 25 bp, Homo sapien
gtcaaaacatcataatataccgaac

SEQ ID NO: 456738 - DNA, 25 bp, Homo sapien
tcaaaacatcataatataccgaaca

SEQ ID NO: 456739 - DNA, 25 bp, Homo sapien
caaaacatcataatataccgaacat

SEQ ID NO: 456740 - DNA, 25 bp, Homo sapien
aaaacatcataatataccgaacatt

SEQ ID NO: 456741 - DNA, 25 bp, Homo sapien
aaacatcataatataccgaacatta

SEQ ID NO: 456742 - DNA, 25 bp, Homo sapien
aacatcataatataccgaacattaa

SEQ ID NO: 456743 - DNA, 25 bp, Homo sapien
acatcataatataccgaacattaaa

SEQ ID NO: 456744 - DNA, 25 bp, Homo sapien
catcataatataccgaacattaaaa

SEQ ID NO: 456745 - DNA, 25 bp, Homo sapien
tcataatataccgaacattaaaaag

SEQ ID NO: 456746 - DNA, 25 bp, Homo sapien
cataatataccgaacattaaaaaga

SEQ ID NO: 456747 - DNA, 25 bp, Homo sapien
tgggagcgctaacacggccccatcc

SEQ ID NO: 456748 - DNA, 25 bp, Homo sapien
gttgcaccacagacatctaggaagt

SEQ ID NO: 456749 - DNA, 25 bp, Homo sapien
accacagacatctaggaagtcctcg

SEQ ID NO: 456750 - DNA, 25 bp, Homo sapien
agacatctaggaagtcctcgacttt

SEQ ID NO: 456751 - DNA, 25 bp, Homo sapien
atctaggaagtcctcgactttctgc

SEQ ID NO: 456752 - DNA, 25 bp, Homo sapien
aggaagtcctcgactttctgctggg

SEQ ID NO: 456753 - DNA, 25 bp, Homo sapien
gggccagcaggactagccctgcact

SEQ ID NO: 456754 - DNA, 25 bp, Homo sapien
ccagccaagccaaacatcaacttaa

SEQ ID NO: 456755 - DNA, 25 bp, Homo sapien
tgctctggctggttcccagccactg

SEQ ID NO: 456756 - DNA, 25 bp, Homo sapien
ccactcactgcacagagttactgtc

SEQ ID NO: 456757 - DNA, 25 bp, Homo sapien
actcactgcacagagttactgtcag

SEQ ID NO: 456758 - DNA, 25 bp, Homo sapien
ctggtgggattcagttttctggacc

SEQ ID NO: 456759 - DNA, 25 bp, Homo sapien
ggattcagttttctggacccatttc

SEQ ID NO: 456760 - DNA, 25 bp, Homo sapien
ctgtcaagcgtctctgttgctcaat

SEQ ID NO: 456761 - DNA, 25 bp, Homo sapien
tcccagcggcgacttagaggtggct

SEQ ID NO: 456762 - DNA, 25 bp, Homo sapien
ggcgtccctacaggagaatgggcca

SEQ ID NO: 456763 - DNA, 25 bp, Homo sapien
atgtggcatctccattgaggctctt

SEQ ID NO: 456764 - DNA, 25 bp, Homo sapien
cattgaggctcttcatggaatccct

SEQ ID NO: 456765 - DNA, 25 bp, Homo sapien
atccctggaggtgaaacctcggtgt

SEQ ID NO: 456766 - DNA, 25 bp, Homo sapien
ggtgaaacctcggtgtccggttgct

SEQ ID NO: 456767 - DNA, 25 bp, Homo sapien
ggtgtccggttgctccaaaccagtg

SEQ ID NO: 456768 - DNA, 25 bp, Homo sapien
gctccaaaccagtgctggtgggatt

SEQ ID NO: 456769 - DNA, 25 bp, Homo sapien
gaaggatctttctacagtctggtct

SEQ ID NO: 456770 - DNA, 25 bp, Homo sapien
agtctggtcttacccatgttcctag

SEQ ID NO: 456771 - DNA, 25 bp, Homo sapien
atgttcctagcaaccctgagatgat

SEQ ID NO: 456772 - DNA, 25 bp, Homo sapien
ttccatttaccaaagcagccgggtc

SEQ ID NO: 456773 - DNA, 25 bp, Homo sapien
agccgggtcagtgctttctcacgtt

SEQ ID NO: 456774 - DNA, 25 bp, Homo sapien
tcacgttgccgtattcttcaggtat

SEQ ID NO: 456775 - DNA, 25 bp, Homo sapien
attcttcaggtattagtcagcttca

SEQ ID NO: 456776 - DNA, 25 bp, Homo sapien
ttagtcagcttcagaagccctgctc

SEQ ID NO: 456777 - DNA, 25 bp, Homo sapien
gatgcgggtttatgatccagaccac

SEQ ID NO: 456778 - DNA, 25 bp, Homo sapien
gatccagaccacaatcagaattata

SEQ ID NO: 456779 - DNA, 25 bp, Homo sapien
atcagaattatatcttgggtcattt

SEQ ID NO: 456780 - DNA, 25 bp, Homo sapien
tccccaccgagtttttctgatgtac

SEQ ID NO: 456781 - DNA, 25 bp, Homo sapien
gagtttttctgatgtacccacaaga

SEQ ID NO: 456782 - DNA, 25 bp, Homo sapien
gaacttagtcaacaagagtccaaat

SEQ ID NO: 456783 - DNA, 25 bp, Homo sapien
gaaaaatcattgctgcatatgcagt

SEQ ID NO: 456784 - DNA, 25 bp, Homo sapien
gcaataaactgttttaactcccttg

SEQ ID NO: 456785 - DNA, 25 bp, Homo sapien
taactcccttgatccaaaaaacgca

SEQ ID NO: 456786 - DNA, 25 bp, Homo sapien
attcccaataagctttacccctgct

SEQ ID NO: 456787 - DNA, 25 bp, Homo sapien
tgctcgtccccaaaggtggaaccat

SEQ ID NO: 456788 - DNA, 25 bp, Homo sapien
gtggaaccataagcgagaacggctt

SEQ ID NO: 456789 - DNA, 25 bp, Homo sapien
agaacggctttgtgtggtagccaaa

SEQ ID NO: 456790 - DNA, 25 bp, Homo sapien
gtggtagccaaaagcacatcttcat

SEQ ID NO: 456791 - DNA, 25 bp, Homo sapien
tcatttctgaattggaagagttttt

SEQ ID NO: 456792 - DNA, 25 bp, Homo sapien
agagtttttgaggtaaagactacat

SEQ ID NO: 456793 - DNA, 25 bp, Homo sapien
gagtttttgaggtaaagactacatg

SEQ ID NO: 456794 - DNA, 25 bp, Homo sapien
agtttttgaggtaaagactacatga

SEQ ID NO: 456795 - DNA, 25 bp, Homo sapien
ttgaggtaaagactacatgaagggc

SEQ ID NO: 456796 - DNA, 25 bp, Homo sapien
tgaggtaaagactacatgaagggct

SEQ ID NO: 456797 - DNA, 25 bp, Homo sapien
gaggtaaagactacatgaagggctg

SEQ ID NO: 456798 - DNA, 25 bp, Homo sapien
gtaaagactacatgaagggctgggt

SEQ ID NO: 456799 - DNA, 25 bp, Homo sapien
taaagactacatgaagggctgggtg

SEQ ID NO: 456800 - DNA, 25 bp, Homo sapien
aaagactacatgaagggctgggtgc

SEQ ID NO: 456801 - DNA, 25 bp, Homo sapien
aagactacatgaagggctgggtgcg

SEQ ID NO: 456802 - DNA, 25 bp, Homo sapien
taacagcagtgcaggttcacaaaga

SEQ ID NO: 456803 - DNA, 25 bp, Homo sapien
gtggctcatgcgtgcagtctcacca

SEQ ID NO: 456804 - DNA, 25 bp, Homo sapien
gcagtctcaccactttgaatggtct

SEQ ID NO: 456805 - DNA, 25 bp, Homo sapien
ctcaccactttgaatggtcttgaac

SEQ ID NO: 456806 - DNA, 25 bp, Homo sapien
ggccaggtctggtggactcttaagc

SEQ ID NO: 456807 - DNA, 25 bp, Homo sapien
ggtctggtggactcttaagcaccta

SEQ ID NO: 456808 - DNA, 25 bp, Homo sapien
gtggactcttaagcacctaaagcta

SEQ ID NO: 456809 - DNA, 25 bp, Homo sapien
ttaagcacctaaagctagatgagct

SEQ ID NO: 456810 - DNA, 25 bp, Homo sapien
gagcttaaatctcatctaagccaat

SEQ ID NO: 456811 - DNA, 25 bp, Homo sapien
aatctcatctaagccaatatttata

SEQ ID NO: 456812 - DNA, 25 bp, Homo sapien
gtatttgaccacaacatatggtaaa

SEQ ID NO: 456813 - DNA, 25 bp, Homo sapien
tctctccccatttaggaacttcaag

SEQ ID NO: 456814 - DNA, 25 bp, Homo sapien
gaacttcaagattcctacctgttgc

SEQ ID NO: 456815 - DNA, 25 bp, Homo sapien
tacctgttgcccatctcggaggaca

SEQ ID NO: 456816 - DNA, 25 bp, Homo sapien
tgcccatctcggaggacaaggtcat

SEQ ID NO: 456817 - DNA, 25 bp, Homo sapien
tttgaccccgctcacaagcatacgg

SEQ ID NO: 456818 - DNA, 25 bp, Homo sapien
gctcacaagcatacggctgtcttgg

SEQ ID NO: 456819 - DNA, 25 bp, Homo sapien
acggctgtcttggtgggtgagtatc

SEQ ID NO: 456820 - DNA, 25 bp, Homo sapien
tactttctccagtcacgctgtgaaa

SEQ ID NO: 456821 - DNA, 25 bp, Homo sapien
attacagagttttccaaaaggcagg

SEQ ID NO: 456822 - DNA, 25 bp, Homo sapien
tgatgcgtgcatatggtcccagtta

SEQ ID NO: 456823 - DNA, 25 bp, Homo sapien
tggtcccagttatttggaagctgaa

SEQ ID NO: 456824 - DNA, 25 bp, Homo sapien
tgtcaaaacatcataatataccgaa

SEQ ID NO: 456825 - DNA, 25 bp, Homo sapien
gtcaaaacatcataatataccgaac

SEQ ID NO: 456826 - DNA, 25 bp, Homo sapien
aaaacatcataatataccgaacatt

SEQ ID NO: 456827 - DNA, 25 bp, Homo sapien
aacatcataatataccgaacattaa

SEQ ID NO: 456828 - DNA, 25 bp, Homo sapien
aaaagaacactcacagctagctggg

SEQ ID NO: 456829 - DNA, 25 bp, Homo sapien
agaacactcacagctagctgggtgt

SEQ ID NO: 456830 - DNA, 25 bp, Homo sapien
gaacactcacagctagctgggtgtg

SEQ ID NO: 456831 - DNA, 25 bp, Homo sapien
caggctgatgccttgagcccaggag

SEQ ID NO: 456832 - DNA, 25 bp, Homo sapien
aggagttcaactccatctctgcaaa

SEQ ID NO: 456833 - DNA, 25 bp, Homo sapien
ggagttcaactccatctctgcaaaa

SEQ ID NO: 456834 - DNA, 25 bp, Homo sapien
tggtggccgagatcacggcattgca

SEQ ID NO: 456835 - DNA, 25 bp, Homo sapien
ttgacaagttccacatacaaaaggt

SEQ ID NO: 456836 - DNA, 25 bp, Homo sapien
gacaagttccacatacaaaaggtgc

SEQ ID NO: 456837 - DNA, 25 bp, Homo sapien
caagttccacatacaaaaggtgctt

SEQ ID NO: 456838 - DNA, 25 bp, Homo sapien
aagttccacatacaaaaggtgcttt

SEQ ID NO: 456839 - DNA, 25 bp, Homo sapien
gttccacatacaaaaggtgctttta

SEQ ID NO: 456840 - DNA, 25 bp, Homo sapien
tccacatacaaaaggtgcttttaaa

SEQ ID NO: 456841 - DNA, 25 bp, Homo sapien
tcctggctaacactatgagacctcg

SEQ ID NO: 456842 - DNA, 25 bp, Homo sapien
cctggctaacactatgagacctcgt

SEQ ID NO: 456843 - DNA, 25 bp, Homo sapien
ctggctaacactatgagacctcgtc

SEQ ID NO: 456844 - DNA, 25 bp, Homo sapien
tggctaacactatgagacctcgtct

SEQ ID NO: 456845 - DNA, 25 bp, Homo sapien
ggctaacactatgagacctcgtctc

SEQ ID NO: 456846 - DNA, 25 bp, Homo sapien
cagaagatggtgcaggtgctttcta

SEQ ID NO: 456847 - DNA, 25 bp, Homo sapien
gaagatggtgcaggtgctttctatt

SEQ ID NO: 456848 - DNA, 25 bp, Homo sapien
aagatggtgcaggtgctttctatta

SEQ ID NO: 456849 - DNA, 25 bp, Homo sapien
gatggtgcaggtgctttctattatt

SEQ ID NO: 456850 - DNA, 25 bp, Homo sapien
tggtgcaggtgctttctattattta

SEQ ID NO: 456851 - DNA, 25 bp, Homo sapien
ggtgcaggtgctttctattatttaa

SEQ ID NO: 456852 - DNA, 25 bp, Homo sapien
gtgcaggtgctttctattatttaat

SEQ ID NO: 456853 - DNA, 25 bp, Homo sapien
attatttaatagttcacctggccag

SEQ ID NO: 456854 - DNA, 25 bp, Homo sapien
atttaatagttcacctggccaggca

SEQ ID NO: 456855 - DNA, 25 bp, Homo sapien
tttaatagttcacctggccaggcac

SEQ ID NO: 456856 - DNA, 25 bp, Homo sapien
ttaatagttcacctggccaggcaca

SEQ ID NO: 456857 - DNA, 25 bp, Homo sapien
ttattggaattttagcccccaggct

SEQ ID NO: 456858 - DNA, 25 bp, Homo sapien
tagcccccaggctgaaagcttggca

SEQ ID NO: 456859 - DNA, 25 bp, Homo sapien
caggtccctgagaaggtaggtgtaa

SEQ ID NO: 456860 - DNA, 25 bp, Homo sapien
aggtaggtgtaaggactctggactt

SEQ ID NO: 456861 - DNA, 25 bp, Homo sapien
gaggacagcatctgatcgttgggat

SEQ ID NO: 456862 - DNA, 25 bp, Homo sapien
cagcatctgatcgttgggatcactt

SEQ ID NO: 456863 - DNA, 25 bp, Homo sapien
gatcgttgggatcacttgttggaat

SEQ ID NO: 456864 - DNA, 25 bp, Homo sapien
cacttgttggaatggccaggtttct

SEQ ID NO: 456865 - DNA, 25 bp, Homo sapien
tggaatggccaggtttcttttgttc

SEQ ID NO: 456866 - DNA, 25 bp, Homo sapien
ttcttttgttcttggaatgtacata

SEQ ID NO: 456867 - DNA, 25 bp, Homo sapien
ggaatgtacataaacagcatctttt

SEQ ID NO: 456868 - DNA, 25 bp, Homo sapien
tgggagcgctaacacggccccatcc

SEQ ID NO: 456869 - DNA, 25 bp, Homo sapien
gttgcaccacagacatctaggaagt

SEQ ID NO: 456870 - DNA, 25 bp, Homo sapien
agacatctaggaagtcctcgacttt

SEQ ID NO: 456871 - DNA, 25 bp, Homo sapien
aggaagtcctcgactttctgctggg

SEQ ID NO: 456872 - DNA, 25 bp, Homo sapien
gggccagcaggactagccctgcact

SEQ ID NO: 456873 - DNA, 25 bp, Homo sapien
agccctgcactccaaggatttttat

SEQ ID NO: 456874 - DNA, 25 bp, Homo sapien
ttattacggaaacccagccaagcca

SEQ ID NO: 456875 - DNA, 25 bp, Homo sapien
ccagccaagccaaacatcaacttaa

SEQ ID NO: 456876 - DNA, 25 bp, Homo sapien
ataaggaggaggaccccatcctggg

SEQ ID NO: 456877 - DNA, 25 bp, Homo sapien
tgctctggctggttcccagccactg

SEQ ID NO: 456878 - DNA, 25 bp, Homo sapien
actcactgcacagagttactgtcag

SEQ ID NO: 456879 - DNA, 25 bp, Homo sapien
cgagcagtggaggtcccgcagaagc

SEQ ID NO: 456880 - DNA, 25 bp, Homo sapien
ggtcatgcatgaagggagcactgca

SEQ ID NO: 456881 - DNA, 25 bp, Homo sapien
gtcatgcatgaagggagcactgcag

SEQ ID NO: 456882 - DNA, 25 bp, Homo sapien
catgcatgaagggagcactgcagag

SEQ ID NO: 456883 - DNA, 25 bp, Homo sapien
atgcatgaagggagcactgcagaga

SEQ ID NO: 456884 - DNA, 25 bp, Homo sapien
tgcatgaagggagcactgcagagaa

SEQ ID NO: 456885 - DNA, 25 bp, Homo sapien
catgaagggagcactgcagagaaga

SEQ ID NO: 456886 - DNA, 25 bp, Homo sapien
aagggagcactgcagagaagacggt

SEQ ID NO: 456887 - DNA, 25 bp, Homo sapien
gagcactgcagagaagacggtggcc

SEQ ID NO: 456888 - DNA, 25 bp, Homo sapien
actgcagagaagacggtggcccctg

SEQ ID NO: 456889 - DNA, 25 bp, Homo sapien
ggaggcgtctctctctgcatcccaa

SEQ ID NO: 456890 - DNA, 25 bp, Homo sapien
gcactggcctcccttggtgtggtca

SEQ ID NO: 456891 - DNA, 25 bp, Homo sapien
cactgttcttcactgtggtgttatg

SEQ ID NO: 456892 - DNA, 25 bp, Homo sapien
cttcactgtggtgttatgtgtcaca

SEQ ID NO: 456893 - DNA, 25 bp, Homo sapien
gtgtcacagtcacagagccacattg

SEQ ID NO: 456894 - DNA, 25 bp, Homo sapien
gagccacattgggacactctgcaga

SEQ ID NO: 456895 - DNA, 25 bp, Homo sapien
actctgcagaccacactaactgaag

SEQ ID NO: 456896 - DNA, 25 bp, Homo sapien
cactaactgaagactgtggctttcc

SEQ ID NO: 456897 - DNA, 25 bp, Homo sapien
tgtggctttcccatgcgtgcccttt

SEQ ID NO: 456898 - DNA, 25 bp, Homo sapien
ccatgcgtgccctttctgttctggg

SEQ ID NO: 456899 - DNA, 25 bp, Homo sapien
atccagcaaccacactgcatttgtt

SEQ ID NO: 456900 - DNA, 25 bp, Homo sapien
ggtggaatctcagcttttaatatac

SEQ ID NO: 456901 - DNA, 25 bp, Homo sapien
aaacctgtgggagcacgagctgagc

SEQ ID NO: 456902 - DNA, 25 bp, Homo sapien
gattcactggcaaagaccaaacttg

SEQ ID NO: 456903 - DNA, 25 bp, Homo sapien
gaagctatagctctgggtacctctc

SEQ ID NO: 456904 - DNA, 25 bp, Homo sapien
atagctctgggtacctctcaattat

SEQ ID NO: 456905 - DNA, 25 bp, Homo sapien
cctctcaattatccctactggctga

SEQ ID NO: 456906 - DNA, 25 bp, Homo sapien
actggctgaggcaacactttaatgg

SEQ ID NO: 456907 - DNA, 25 bp, Homo sapien
ttaatggtagcctgaggcgccagcc

SEQ ID NO: 456908 - DNA, 25 bp, Homo sapien
agacatttgacaactcacagcacaa

SEQ ID NO: 456909 - DNA, 25 bp, Homo sapien
acaacaaccctcctatgagcgggat

SEQ ID NO: 456910 - DNA, 25 bp, Homo sapien
tatgagcgggattcctcgtctgggc

SEQ ID NO: 456911 - DNA, 25 bp, Homo sapien
gattcctcgtctgggcgcagtggct

SEQ ID NO: 456912 - DNA, 25 bp, Homo sapien
gacaaaaaatgtgatccagaactgt

SEQ ID NO: 456913 - DNA, 25 bp, Homo sapien
ggagttcgaacccagcctttacaat

SEQ ID NO: 456914 - DNA, 25 bp, Homo sapien
gagttcgaacccagcctttacaatg

SEQ ID NO: 456915 - DNA, 25 bp, Homo sapien
agttcgaacccagcctttacaatgt

SEQ ID NO: 456916 - DNA, 25 bp, Homo sapien
ttcgaacccagcctttacaatgtaa

SEQ ID NO: 456917 - DNA, 25 bp, Homo sapien
tcgaacccagcctttacaatgtaat

SEQ ID NO: 456918 - DNA, 25 bp, Homo sapien
cgaacccagcctttacaatgtaatg

SEQ ID NO: 456919 - DNA, 25 bp, Homo sapien
gaacccagcctttacaatgtaatga

SEQ ID NO: 456920 - DNA, 25 bp, Homo sapien
aacccagcctttacaatgtaatgaa

SEQ ID NO: 456921 - DNA, 25 bp, Homo sapien
tttacaatgtaatgaaaccctgcct

SEQ ID NO: 456922 - DNA, 25 bp, Homo sapien
ttacaatgtaatgaaaccctgcctc

SEQ ID NO: 456923 - DNA, 25 bp, Homo sapien
tataatgctgacaaaaacaccaaaa

SEQ ID NO: 456924 - DNA, 25 bp, Homo sapien
aaaaagtcattctactacattgaag

SEQ ID NO: 456925 - DNA, 25 bp, Homo sapien
aaagtcattctactacattgaagat

SEQ ID NO: 456926 - DNA, 25 bp, Homo sapien
ataaataagctaccccatcaaacca

SEQ ID NO: 456927 - DNA, 25 bp, Homo sapien
gctaccccatcaaaccaaataaact

SEQ ID NO: 456928 - DNA, 25 bp, Homo sapien
ataaaatacaacttcacctgcctgg

SEQ ID NO: 456929 - DNA, 25 bp, Homo sapien
taaaatacaacttcacctgcctggg

SEQ ID NO: 456930 - DNA, 25 bp, Homo sapien
gtggtggcatgcgactgtgatctca

SEQ ID NO: 456931 - DNA, 25 bp, Homo sapien
agtgagcagtgttcgtgccaccgca

SEQ ID NO: 456932 - DNA, 25 bp, Homo sapien
gtgagcagtgttcgtgccaccgcac

SEQ ID NO: 456933 - DNA, 25 bp, Homo sapien
tgagcagtgttcgtgccaccgcact

SEQ ID NO: 456934 - DNA, 25 bp, Homo sapien
tgacaggcaaacatctggatgtatc

SEQ ID NO: 456935 - DNA, 25 bp, Homo sapien
aacatctggatgtatctgtcacagc

SEQ ID NO: 456936 - DNA, 25 bp, Homo sapien
tatctgtcacagcaactaatgtctt

SEQ ID NO: 456937 - DNA, 25 bp, Homo sapien
gtcacagcaactaatgtcttagaga

SEQ ID NO: 456938 - DNA, 25 bp, Homo sapien
gagaataaggtatagcttcaccaaa

SEQ ID NO: 456939 - DNA, 25 bp, Homo sapien
aggtatagcttcaccaaacatttga

SEQ ID NO: 456940 - DNA, 25 bp, Homo sapien
ggaacagaaaggtcttgaacagcta

SEQ ID NO: 456941 - DNA, 25 bp, Homo sapien
gtcttgaacagctaaccgatatatt

SEQ ID NO: 456942 - DNA, 25 bp, Homo sapien
gaacaaatagacttgcccggcatgg

SEQ ID NO: 456943 - DNA, 25 bp, Homo sapien
gacttgcccggcatggtgctatgta

SEQ ID NO: 456944 - DNA, 25 bp, Homo sapien
cccggcatggtgctatgtatctgta

SEQ ID NO: 456945 - DNA, 25 bp, Homo sapien
gaccctggcgtcttgactatttcca

SEQ ID NO: 456946 - DNA, 25 bp, Homo sapien
tcaagggtcccgaagcattagccac

SEQ ID NO: 456947 - DNA, 25 bp, Homo sapien
tggccacatcatactccacctgaaa

SEQ ID NO: 456948 - DNA, 25 bp, Homo sapien
tactccacctgaaagagtgcctcgt

SEQ ID NO: 456949 - DNA, 25 bp, Homo sapien
aaagagtgcctcgtggctgcactgc

SEQ ID NO: 456950 - DNA, 25 bp, Homo sapien
ctggccccgtgcagcgggattccat

SEQ ID NO: 456951 - DNA, 25 bp, Homo sapien
gggattccatcgacgctgagcagcc

SEQ ID NO: 456952 - DNA, 25 bp, Homo sapien
ccgggccgcacgtaggtcaggacaa

SEQ ID NO: 456953 - DNA, 25 bp, Homo sapien
acaagcgggcgggacttgtgcccat

SEQ ID NO: 456954 - DNA, 25 bp, Homo sapien
ggcgggacttgtgcccatcttcatg

SEQ ID NO: 456955 - DNA, 25 bp, Homo sapien
atgggcacctcctctaaggacaaag

SEQ ID NO: 456956 - DNA, 25 bp, Homo sapien
ggaggcacaggccatcagcatttct

SEQ ID NO: 456957 - DNA, 25 bp, Homo sapien
gcatttcttattgctactagctagc

SEQ ID NO: 456958 - DNA, 25 bp, Homo sapien
gctagctatgtgttgcagagcctaa

SEQ ID NO: 456959 - DNA, 25 bp, Homo sapien
aaattccatggaggtgtggcctaga

SEQ ID NO: 456960 - DNA, 25 bp, Homo sapien
agccagggtgtttcttaattaagag

SEQ ID NO: 456961 - DNA, 25 bp, Homo sapien
gaggaggcttgcaccttaatgagaa

SEQ ID NO: 456962 - DNA, 25 bp, Homo sapien
cagttagtttacaagggagagccag

SEQ ID NO: 456963 - DNA, 25 bp, Homo sapien
gagagccagaggacaatgcaggtaa

SEQ ID NO: 456964 - DNA, 25 bp, Homo sapien
atgcaggtaaaacgtgccctcctgg

SEQ ID NO: 456965 - DNA, 25 bp, Homo sapien
aaaacgtgccctcctggagtcataa

SEQ ID NO: 456966 - DNA, 25 bp, Homo sapien
aacagatatcacagactagcctcaa

SEQ ID NO: 456967 - DNA, 25 bp, Homo sapien
tcaaacttttcaaacttctgggaca

SEQ ID NO: 456968 - DNA, 25 bp, Homo sapien
gtgaagggcaggactctgcctctct

SEQ ID NO: 456969 - DNA, 25 bp, Homo sapien
ccttcaccttattccacttaaattg

SEQ ID NO: 456970 - DNA, 25 bp, Homo sapien
attccacttaaattgtgtgattcta

SEQ ID NO: 456971 - DNA, 25 bp, Homo sapien
gtgtgattctacaagcttatgttta

SEQ ID NO: 456972 - DNA, 25 bp, Homo sapien
ggaatatgttcctccattacaaaga

SEQ ID NO: 456973 - DNA, 25 bp, Homo sapien
atgttcctccattacaaagagttta

SEQ ID NO: 456974 - DNA, 25 bp, Homo sapien
ggatatggactgacattgaggagtt

SEQ ID NO: 456975 - DNA, 25 bp, Homo sapien
gactgacattgaggagttattgtta

SEQ ID NO: 456976 - DNA, 25 bp, Homo sapien
tgttagaaatgcatactgaagtact

SEQ ID NO: 456977 - DNA, 25 bp, Homo sapien
tactgaagtacttgtgggtaaaatt

SEQ ID NO: 456978 - DNA, 25 bp, Homo sapien
gataatgctggaattcatacttaaa

SEQ ID NO: 456979 - DNA, 25 bp, Homo sapien
tcagacataccctcaagaaattcag

SEQ ID NO: 456980 - DNA, 25 bp, Homo sapien
gacataccctcaagaaattcagaag

SEQ ID NO: 456981 - DNA, 25 bp, Homo sapien
ataccctcaagaaattcagaagtag

SEQ ID NO: 456982 - DNA, 25 bp, Homo sapien
tacaaaagtgtcatcaattcatcat

SEQ ID NO: 456983 - DNA, 25 bp, Homo sapien
gtgtcatcaattcatcattgttgtt

SEQ ID NO: 456984 - DNA, 25 bp, Homo sapien
attcatcattgttgttatctttatc

SEQ ID NO: 456985 - DNA, 25 bp, Homo sapien
cattgttgttatctttatcacagtc

SEQ ID NO: 456986 - DNA, 25 bp, Homo sapien
cacagtcaataatattgttgcccaa

SEQ ID NO: 456987 - DNA, 25 bp, Homo sapien
gtcaataatattgttgcccaaatta

SEQ ID NO: 456988 - DNA, 25 bp, Homo sapien
ttgcccaaattagaatggtttaaca

SEQ ID NO: 456989 - DNA, 25 bp, Homo sapien
gtagactcagggtgactttaagcca

SEQ ID NO: 456990 - DNA, 25 bp, Homo sapien
tgactttaagccacatgtcacatgg

SEQ ID NO: 456991 - DNA, 25 bp, Homo sapien
gtacatgtacatggatagttctgat

SEQ ID NO: 456992 - DNA, 25 bp, Homo sapien
tggatagttctgatggcacaccctt

SEQ ID NO: 456993 - DNA, 25 bp, Homo sapien
tagttctgatggcacacccttgtta

SEQ ID NO: 456994 - DNA, 25 bp, Homo sapien
atggcacacccttgttagctttgta

SEQ ID NO: 456995 - DNA, 25 bp, Homo sapien
acacccttgttagctttgtagcttt

SEQ ID NO: 456996 - DNA, 25 bp, Homo sapien
gtagcttttagctaaagggccatat

SEQ ID NO: 456997 - DNA, 25 bp, Homo sapien
gggccatatggtgaaggtgcatttt

SEQ ID NO: 456998 - DNA, 25 bp, Homo sapien
ctttgtcaatatatccattctagaa

SEQ ID NO: 456999 - DNA, 25 bp, Homo sapien
tagaaaatgagatgagccaggcaca

SEQ ID NO: 457000 - DNA, 25 bp, Homo sapien
cctctttacagtctccatgtatata

SEQ ID NO: 457001 - DNA, 25 bp, Homo sapien
atgttaacagttcattgtttggact

SEQ ID NO: 457002 - DNA, 25 bp, Homo sapien
tggactgtgtcctttttacagacaa

SEQ ID NO: 457003 - DNA, 25 bp, Homo sapien
ataaaaggctgaagggcttttccag

SEQ ID NO: 457004 - DNA, 25 bp, Homo sapien
ggcttttccagtatatccctagtac

SEQ ID NO: 457005 - DNA, 25 bp, Homo sapien
cagtatatccctagtactacaaagt

SEQ ID NO: 457006 - DNA, 25 bp, Homo sapien
acaaagtacgttttggagtcagaca

SEQ ID NO: 457007 - DNA, 25 bp, Homo sapien
gagtttgaattctgtttctgagaca

SEQ ID NO: 457008 - DNA, 25 bp, Homo sapien
tgagacattaacttgtaatttcagc

SEQ ID NO: 457009 - DNA, 25 bp, Homo sapien
tacaatagggttacttatacctcct

SEQ ID NO: 457010 - DNA, 25 bp, Homo sapien
ggttacttatacctcctaattagat

SEQ ID NO: 457011 - DNA, 25 bp, Homo sapien
ctgcagttgatcaaagcatggttga

SEQ ID NO: 457012 - DNA, 25 bp, Homo sapien
ctgggctcatgcgagggtgtgtgag

SEQ ID NO: 457013 - DNA, 25 bp, Homo sapien
tgattgtgcatcaacatgaaggatc

SEQ ID NO: 457014 - DNA, 25 bp, Homo sapien
tgcatcaacatgaaggatcactggg

SEQ ID NO: 457015 - DNA, 25 bp, Homo sapien
aaggttcattggaagtctgggactc

SEQ ID NO: 457016 - DNA, 25 bp, Homo sapien
gaagtctgggactcagctatgattg

SEQ ID NO: 457017 - DNA, 25 bp, Homo sapien
ctgggactcagctatgattgaggtc

SEQ ID NO: 457018 - DNA, 25 bp, Homo sapien
attgaggtcagatacctagttcagg

SEQ ID NO: 457019 - DNA, 25 bp, Homo sapien
gataagaccatatcatcttgaaatg

SEQ ID NO: 457020 - DNA, 25 bp, Homo sapien
atcttgaaatgatgggctgctgaag

SEQ ID NO: 457021 - DNA, 25 bp, Homo sapien
ttaaagaatcatgggtacagtggct

SEQ ID NO: 457022 - DNA, 25 bp, Homo sapien
gctgtcttcctttgtgatttgttga

SEQ ID NO: 457023 - DNA, 25 bp, Homo sapien
gattttgctttgatccttccttttt

SEQ ID NO: 457024 - DNA, 25 bp, Homo sapien
ttttttctttcgtgtatcttctata

SEQ ID NO: 457025 - DNA, 25 bp, Homo sapien
ttctttcgtgtatcttctataggta

SEQ ID NO: 457026 - DNA, 25 bp, Homo sapien
cgtgtatcttctataggtattttct

SEQ ID NO: 457027 - DNA, 25 bp, Homo sapien
ttgtggttaccaaagtcttaacaga

SEQ ID NO: 457028 - DNA, 25 bp, Homo sapien
gaaaacaacttatagctacagcgaa

SEQ ID NO: 457029 - DNA, 25 bp, Homo sapien
cttatagctacagcgaaagcaattt

SEQ ID NO: 457030 - DNA, 25 bp, Homo sapien
tagacaaacaggactgcatctaatt

SEQ ID NO: 457031 - DNA, 25 bp, Homo sapien
gagactgaactggtaatctatggaa

SEQ ID NO: 457032 - DNA, 25 bp, Homo sapien
ttgcaaaccatgtatctaatgaggg

SEQ ID NO: 457033 - DNA, 25 bp, Homo sapien
agtcatgtcaggcacttttttccat

SEQ ID NO: 457034 - DNA, 25 bp, Homo sapien
gtcatgtcaggcacttttttccatt

SEQ ID NO: 457035 - DNA, 25 bp, Homo sapien
tcatgtcaggcacttttttccattc

SEQ ID NO: 457036 - DNA, 25 bp, Homo sapien
catgtcaggcacttttttccattct

SEQ ID NO: 457037 - DNA, 25 bp, Homo sapien
ttccattcttaaaaagtgcctcttc

SEQ ID NO: 457038 - DNA, 25 bp, Homo sapien
attcttaaaaagtgcctcttccatt

SEQ ID NO: 457039 - DNA, 25 bp, Homo sapien
taaaaagtgcctcttccattggctg

SEQ ID NO: 457040 - DNA, 25 bp, Homo sapien
aaaaagtgcctcttccattggctgg

SEQ ID NO: 457041 - DNA, 25 bp, Homo sapien
aaaagtgcctcttccattggctggg

SEQ ID NO: 457042 - DNA, 25 bp, Homo sapien
aagtgcctcttccattggctgggtg

SEQ ID NO: 457043 - DNA, 25 bp, Homo sapien
gtgcctcttccattggctgggtgtg

SEQ ID NO: 457044 - DNA, 25 bp, Homo sapien
agctttctacattggttggccagtt

SEQ ID NO: 457045 - DNA, 25 bp, Homo sapien
acattggttggccagttttcccagc

SEQ ID NO: 457046 - DNA, 25 bp, Homo sapien
gcggcgttattatttctgaggcaca

SEQ ID NO: 457047 - DNA, 25 bp, Homo sapien
tatttctgaggcacagcctctttct

SEQ ID NO: 457048 - DNA, 25 bp, Homo sapien
tttcctcatctcttgctctaattgg

SEQ ID NO: 457049 - DNA, 25 bp, Homo sapien
ctcttgctctaattggagaatttga

SEQ ID NO: 457050 - DNA, 25 bp, Homo sapien
gaatttgacaactctgaacctctga

SEQ ID NO: 457051 - DNA, 25 bp, Homo sapien
tgactgtggataaccccaactccag

SEQ ID NO: 457052 - DNA, 25 bp, Homo sapien
ccaactccagcaagcctgggcaaga

SEQ ID NO: 457053 - DNA, 25 bp, Homo sapien
caagagtgggacagttgcagcccaa

SEQ ID NO: 457054 - DNA, 25 bp, Homo sapien
agtgggacagttgcagcccaaggta

SEQ ID NO: 457055 - DNA, 25 bp, Homo sapien
gcaaccactgctaggccctgtgtac

SEQ ID NO: 457056 - DNA, 25 bp, Homo sapien
cagccttcagccaaaaaccagcaat

SEQ ID NO: 457057 - DNA, 25 bp, Homo sapien
ttcatcaagacttctggaaaccctt

SEQ ID NO: 457058 - DNA, 25 bp, Homo sapien
tggaaacccttgtcctcagcttctg

SEQ ID NO: 457059 - DNA, 25 bp, Homo sapien
agcttctgctcttgcacttggctcc

SEQ ID NO: 457060 - DNA, 25 bp, Homo sapien
ttggctccccaaatctcagctgctt

SEQ ID NO: 457061 - DNA, 25 bp, Homo sapien
gtgaggccacagttctgctggagat

SEQ ID NO: 457062 - DNA, 25 bp, Homo sapien
agatgtgcaggaaacggtcccaggc

SEQ ID NO: 457063 - DNA, 25 bp, Homo sapien
agcatctcctggtggtgcatagcaa

SEQ ID NO: 457064 - DNA, 25 bp, Homo sapien
ggtggtgcatagcaataatgccttc

SEQ ID NO: 457065 - DNA, 25 bp, Homo sapien
agcaataatgccttcattcattccc

SEQ ID NO: 457066 - DNA, 25 bp, Homo sapien
gagaggaacttgtactcagcattca

SEQ ID NO: 457067 - DNA, 25 bp, Homo sapien
aacttgtactcagcattcagcatca

SEQ ID NO: 457068 - DNA, 25 bp, Homo sapien
ttcagcatcacaaaagcaatgtcag

SEQ ID NO: 457069 - DNA, 25 bp, Homo sapien
gcaatgtcagcatcacagtaaagca

SEQ ID NO: 457070 - DNA, 25 bp, Homo sapien
aagcaatgaagagcagttttccaat

SEQ ID NO: 457071 - DNA, 25 bp, Homo sapien
gagcatcaacaagtacaaaattctt

SEQ ID NO: 457072 - DNA, 25 bp, Homo sapien
aagagattaggttggatacttcaag

SEQ ID NO: 457073 - DNA, 25 bp, Homo sapien
atacttcaagtgaagcctcccactg

SEQ ID NO: 457074 - DNA, 25 bp, Homo sapien
gaagcctcccactggaaacaagctg

SEQ ID NO: 457075 - DNA, 25 bp, Homo sapien
gctgcagttgttttagataatccca

SEQ ID NO: 457076 - DNA, 25 bp, Homo sapien
agataatcccatccaggttgaaatg

SEQ ID NO: 457077 - DNA, 25 bp, Homo sapien
tctgtgcaaactctgatgatacctg

SEQ ID NO: 457078 - DNA, 25 bp, Homo sapien
aactctgatgatacctgcttatgtg

SEQ ID NO: 457079 - DNA, 25 bp, Homo sapien
gatgatacctgcttatgtggattct

SEQ ID NO: 457080 - DNA, 25 bp, Homo sapien
tatgtggattcttttccacactgct

SEQ ID NO: 457081 - DNA, 25 bp, Homo sapien
aaagtatgtgatgttctgggttttt

SEQ ID NO: 457082 - DNA, 25 bp, Homo sapien
tgtcctttttggtaccaaacctgag

SEQ ID NO: 457083 - DNA, 25 bp, Homo sapien
tagaaccctgtatttaaacaagcct

SEQ ID NO: 457084 - DNA, 25 bp, Homo sapien
ttgaaatttaagtctcagatcttct

SEQ ID NO: 457085 - DNA, 25 bp, Homo sapien
aaaccactacctattgaaggcctgt

SEQ ID NO: 457086 - DNA, 25 bp, Homo sapien
gcctgttttggctaatctgtgcaaa

SEQ ID NO: 457087 - DNA, 25 bp, Homo sapien
ttggctaatctgtgcaaactctgat

SEQ ID NO: 457088 - DNA, 25 bp, Homo sapien
aaaaaagagctatactgtgttgaaa

SEQ ID NO: 457089 - DNA, 25 bp, Homo sapien
gagctatactgtgttgaaagagtcc

SEQ ID NO: 457090 - DNA, 25 bp, Homo sapien
ctatactgtgttgaaagagtcctgt

SEQ ID NO: 457091 - DNA, 25 bp, Homo sapien
tactgtgttgaaagagtcctgtata

SEQ ID NO: 457092 - DNA, 25 bp, Homo sapien
ctgtgttgaaagagtcctgtataaa

SEQ ID NO: 457093 - DNA, 25 bp, Homo sapien
gagtcctgtataaaggaggatgtct

SEQ ID NO: 457094 - DNA, 25 bp, Homo sapien
ggaggatgtcttaaatttgccattt

SEQ ID NO: 457095 - DNA, 25 bp, Homo sapien
aaatttgccattttgactctgtttt

SEQ ID NO: 457096 - DNA, 25 bp, Homo sapien
aatttgccattttgactctgttttg

SEQ ID NO: 457097 - DNA, 25 bp, Homo sapien
gactctgttttgaacaggtcaccag

SEQ ID NO: 457098 - DNA, 25 bp, Homo sapien
ctgttttgaacaggtcaccaggaaa

SEQ ID NO: 457099 - DNA, 25 bp, Homo sapien
gcattttgaggcgtttttaacaaat

SEQ ID NO: 457100 - DNA, 25 bp, Homo sapien
atgagaaataacaccttcagaaagc

SEQ ID NO: 457101 - DNA, 25 bp, Homo sapien
gcatgtgactactttgatgcaacta

SEQ ID NO: 457102 - DNA, 25 bp, Homo sapien
tgatgcaactatttacaatgtattc

SEQ ID NO: 457103 - DNA, 25 bp, Homo sapien
gaagtcattaacctgtagagttctt

SEQ ID NO: 457104 - DNA, 25 bp, Homo sapien
aacctgtagagttcttagacatgtg

SEQ ID NO: 457105 - DNA, 25 bp, Homo sapien
gacatgtggaacctttaacaattat

SEQ ID NO: 457106 - DNA, 25 bp, Homo sapien
gagtacatacaaaatacagagctat

SEQ ID NO: 457107 - DNA, 25 bp, Homo sapien
attagaagttaagcctactatctgt

SEQ ID NO: 457108 - DNA, 25 bp, Homo sapien
gtaaaaatatgtcctgattcatttt

SEQ ID NO: 457109 - DNA, 25 bp, Homo sapien
gtatatacctgagcctttaaaaagt

SEQ ID NO: 457110 - DNA, 25 bp, Homo sapien
aggccctccctcatagattttcagt

SEQ ID NO: 457111 - DNA, 25 bp, Homo sapien
tccctcatagattttcagtttcaat

SEQ ID NO: 457112 - DNA, 25 bp, Homo sapien
gtttcaatttatactctgtgtggtc

SEQ ID NO: 457113 - DNA, 25 bp, Homo sapien
atactctgtgtggtctggcaatttc

SEQ ID NO: 457114 - DNA, 25 bp, Homo sapien
tctgtgtggtctggcaatttccaag

SEQ ID NO: 457115 - DNA, 25 bp, Homo sapien
ttccaagctgtgaaacttatttaaa

SEQ ID NO: 457116 - DNA, 25 bp, Homo sapien
atttaaaacagtctgatggtactca

SEQ ID NO: 457117 - DNA, 25 bp, Homo sapien
gatggtactcacataaatcaccaag

SEQ ID NO: 457118 - DNA, 25 bp, Homo sapien
caaaagggctcagattgatttaaaa

SEQ ID NO: 457119 - DNA, 25 bp, Homo sapien
gaaacacagacaattctttaagact

SEQ ID NO: 457120 - DNA, 25 bp, Homo sapien
atggactaaagaactcattcatgta

SEQ ID NO: 457121 - DNA, 25 bp, Homo sapien
aatcaaccaacaagagacttttctg

SEQ ID NO: 457122 - DNA, 25 bp, Homo sapien
acaagagacttttctgaggaggaac

SEQ ID NO: 457123 - DNA, 25 bp, Homo sapien
tttgtatttgaacaagatccttggt

SEQ ID NO: 457124 - DNA, 25 bp, Homo sapien
aagatccttggtgtgtagttcagtc

SEQ ID NO: 457125 - DNA, 25 bp, Homo sapien
ccttggtgtgtagttcagtcttgca

SEQ ID NO: 457126 - DNA, 25 bp, Homo sapien
gtgtgtagttcagtcttgcagtata

SEQ ID NO: 457127 - DNA, 25 bp, Homo sapien
gttcagtcttgcagtatacaagctt

SEQ ID NO: 457128 - DNA, 25 bp, Homo sapien
gtcttgcagtatacaagcttttgtg

SEQ ID NO: 457129 - DNA, 25 bp, Homo sapien
aatgttttatgatatgattccctgt

SEQ ID NO: 457130 - DNA, 25 bp, Homo sapien
gaggagtttgtaatcaccttataac

SEQ ID NO: 457131 - DNA, 25 bp, Homo sapien
gtttgtaatcaccttataacatgaa

SEQ ID NO: 457132 - DNA, 25 bp, Homo sapien
ctgtgcccggccctaagattaattt

SEQ ID NO: 457133 - DNA, 25 bp, Homo sapien
tgtgcccggccctaagattaatttt

SEQ ID NO: 457134 - DNA, 25 bp, Homo sapien
tgcccggccctaagattaattttca

SEQ ID NO: 457135 - DNA, 25 bp, Homo sapien
ttttcaaacaatgtgcatcagtatg

SEQ ID NO: 457136 - DNA, 25 bp, Homo sapien
caatgtgcatcagtatgttagaaat

SEQ ID NO: 457137 - DNA, 25 bp, Homo sapien
gtgcatcagtatgttagaaatacct

SEQ ID NO: 457138 - DNA, 25 bp, Homo sapien
gttagaaatacctagtgttagccgg

SEQ ID NO: 457139 - DNA, 25 bp, Homo sapien
tagaaatacctagtgttagccgggt

SEQ ID NO: 457140 - DNA, 25 bp, Homo sapien
gaaatacctagtgttagccgggtgt

SEQ ID NO: 457141 - DNA, 25 bp, Homo sapien
aatacctagtgttagccgggtgtgg

SEQ ID NO: 457142 - DNA, 25 bp, Homo sapien
gttcaggggcgcagtgaactatgat

SEQ ID NO: 457143 - DNA, 25 bp, Homo sapien
ctgtcccaaatactcaagtctctct

SEQ ID NO: 457144 - DNA, 25 bp, Homo sapien
tgtcccaaatactcaagtctctctc

SEQ ID NO: 457145 - DNA, 25 bp, Homo sapien
gtcccaaatactcaagtctctctca

SEQ ID NO: 457146 - DNA, 25 bp, Homo sapien
tcccaaatactcaagtctctctcat

SEQ ID NO: 457147 - DNA, 25 bp, Homo sapien
cccaaatactcaagtctctctcatt

SEQ ID NO: 457148 - DNA, 25 bp, Homo sapien
aaatactcaagtctctctcattaaa

SEQ ID NO: 457149 - DNA, 25 bp, Homo sapien
aatactcaagtctctctcattaaaa

SEQ ID NO: 457150 - DNA, 25 bp, Homo sapien
tactcaagtctctctcattaaaaat

SEQ ID NO: 457151 - DNA, 25 bp, Homo sapien
ctcaagtctctctcattaaaaataa

SEQ ID NO: 457152 - DNA, 25 bp, Homo sapien
attaaaaataaagagcaggccaggt

SEQ ID NO: 457153 - DNA, 25 bp, Homo sapien
atcatctgggcatggaggcacacgc

SEQ ID NO: 457154 - DNA, 25 bp, Homo sapien
aaatatatgtttctgtttaagcatc

SEQ ID NO: 457155 - DNA, 25 bp, Homo sapien
tatatgtttctgtttaagcatcaaa

SEQ ID NO: 457156 - DNA, 25 bp, Homo sapien
atatgtttctgtttaagcatcaaaa

SEQ ID NO: 457157 - DNA, 25 bp, Homo sapien
tatgtttctgtttaagcatcaaaag

SEQ ID NO: 457158 - DNA, 25 bp, Homo sapien
tgtttctgtttaagcatcaaaagtc

SEQ ID NO: 457159 - DNA, 25 bp, Homo sapien
gtttctgtttaagcatcaaaagtct

SEQ ID NO: 457160 - DNA, 25 bp, Homo sapien
ttctgtttaagcatcaaaagtcttt

SEQ ID NO: 457161 - DNA, 25 bp, Homo sapien
ctgtttaagcatcaaaagtcttttg

SEQ ID NO: 457162 - DNA, 25 bp, Homo sapien
gtttaagcatcaaaagtcttttgct

SEQ ID NO: 457163 - DNA, 25 bp, Homo sapien
aagcatcaaaagtcttttgctgggc

SEQ ID NO: 457164 - DNA, 25 bp, Homo sapien
gcatcaaaagtcttttgctgggcac

SEQ ID NO: 457165 - DNA, 25 bp, Homo sapien
caccaaagactttaggttggcagac

SEQ ID NO: 457166 - DNA, 25 bp, Homo sapien
ggttggcagacaatgattcagttat

SEQ ID NO: 457167 - DNA, 25 bp, Homo sapien
gttgatctgatataactatgttgtt

SEQ ID NO: 457168 - DNA, 25 bp, Homo sapien
acatatatttgggtttctgaagaca

SEQ ID NO: 457169 - DNA, 25 bp, Homo sapien
tcaagttattagcatcttccaggtg

SEQ ID NO: 457170 - DNA, 25 bp, Homo sapien
ttattagcatcttccaggtggtagt

SEQ ID NO: 457171 - DNA, 25 bp, Homo sapien
ccaggtggtagttggaatactgaaa

SEQ ID NO: 457172 - DNA, 25 bp, Homo sapien
atggattaaatcacctgatcatctg

SEQ ID NO: 457173 - DNA, 25 bp, Homo sapien
cacctgatcatctgtagacattaaa

SEQ ID NO: 457174 - DNA, 25 bp, Homo sapien
aaagaaggctaaggacagagtccct

SEQ ID NO: 457175 - DNA, 25 bp, Homo sapien
aggacagagtccctgaagtaacaac

SEQ ID NO: 457176 - DNA, 25 bp, Homo sapien
gaatcaggagtaaagtaacattaaa

SEQ ID NO: 457177 - DNA, 25 bp, Homo sapien
gaatacatttaaagaaccatctact

SEQ ID NO: 457178 - DNA, 25 bp, Homo sapien
atacatttaaagaaccatctactaa

SEQ ID NO: 457179 - DNA, 25 bp, Homo sapien
tacatttaaagaaccatctactaat

SEQ ID NO: 457180 - DNA, 25 bp, Homo sapien
catttaaagaaccatctactaattt

SEQ ID NO: 457181 - DNA, 25 bp, Homo sapien
gaaccatctactaatttctaaccat

SEQ ID NO: 457182 - DNA, 25 bp, Homo sapien
aaccatctactaatttctaaccata

SEQ ID NO: 457183 - DNA, 25 bp, Homo sapien
accatctactaatttctaaccatat

SEQ ID NO: 457184 - DNA, 25 bp, Homo sapien
ccatctactaatttctaaccatata

SEQ ID NO: 457185 - DNA, 25 bp, Homo sapien
tctttttctatagacaccaaatctg

SEQ ID NO: 457186 - DNA, 25 bp, Homo sapien
ctttttctatagacaccaaatctgg

SEQ ID NO: 457187 - DNA, 25 bp, Homo sapien
aacatgttaccaaatgcatttttcc

SEQ ID NO: 457188 - DNA, 25 bp, Homo sapien
acatgttaccaaatgcatttttcct

SEQ ID NO: 457189 - DNA, 25 bp, Homo sapien
catttttcctgtagagtcagggcca

SEQ ID NO: 457190 - DNA, 25 bp, Homo sapien
atttttcctgtagagtcagggccag

SEQ ID NO: 457191 - DNA, 25 bp, Homo sapien
tttttcctgtagagtcagggccagg

SEQ ID NO: 457192 - DNA, 25 bp, Homo sapien
ttttcctgtagagtcagggccaggc

SEQ ID NO: 457193 - DNA, 25 bp, Homo sapien
tttcctgtagagtcagggccaggca

SEQ ID NO: 457194 - DNA, 25 bp, Homo sapien
ttcctgtagagtcagggccaggcac

SEQ ID NO: 457195 - DNA, 25 bp, Homo sapien
tcctgtagagtcagggccaggcacg

SEQ ID NO: 457196 - DNA, 25 bp, Homo sapien
cctgtagagtcagggccaggcacgg

SEQ ID NO: 457197 - DNA, 25 bp, Homo sapien
ctgtagagtcagggccaggcacggt

SEQ ID NO: 457198 - DNA, 25 bp, Homo sapien
ttgctggtgcagatgaaacggcagg

SEQ ID NO: 457199 - DNA, 25 bp, Homo sapien
tgctggtgcagatgaaacggcaggc

SEQ ID NO: 457200 - DNA, 25 bp, Homo sapien
gctggtgcagatgaaacggcaggct

SEQ ID NO: 457201 - DNA, 25 bp, Homo sapien
ctggtgcagatgaaacggcaggctc

SEQ ID NO: 457202 - DNA, 25 bp, Homo sapien
tggtgcagatgaaacggcaggctct

SEQ ID NO: 457203 - DNA, 25 bp, Homo sapien
ggtgcagatgaaacggcaggctctg

SEQ ID NO: 457204 - DNA, 25 bp, Homo sapien
gtgcagatgaaacggcaggctctgg

SEQ ID NO: 457205 - DNA, 25 bp, Homo sapien
tgcagatgaaacggcaggctctgga

SEQ ID NO: 457206 - DNA, 25 bp, Homo sapien
gcagatgaaacggcaggctctggag

SEQ ID NO: 457207 - DNA, 25 bp, Homo sapien
agatgaaacggcaggctctggagaa

SEQ ID NO: 457208 - DNA, 25 bp, Homo sapien
gatgaaacggcaggctctggagaag

SEQ ID NO: 457209 - DNA, 25 bp, Homo sapien
ttcataattttagtcaaagccacct

SEQ ID NO: 457210 - DNA, 25 bp, Homo sapien
ttagtcaaagccacctagtaacctt

SEQ ID NO: 457211 - DNA, 25 bp, Homo sapien
gccacctagtaacctttaattatat

SEQ ID NO: 457212 - DNA, 25 bp, Homo sapien
agcttgattaagcagtgggtcagat

SEQ ID NO: 457213 - DNA, 25 bp, Homo sapien
gaaccaccttgattcttagaaggtc

SEQ ID NO: 457214 - DNA, 25 bp, Homo sapien
catgaaaaaatgttgcctatagtta

SEQ ID NO: 457215 - DNA, 25 bp, Homo sapien
gtaattattttatgagcctctgatg

SEQ ID NO: 457216 - DNA, 25 bp, Homo sapien
gttttagtacgacattccaccagtg

SEQ ID NO: 457217 - DNA, 25 bp, Homo sapien
agtggaaacatgctcccctttatta

SEQ ID NO: 457218 - DNA, 25 bp, Homo sapien
gctcccctttattatgtggcaagaa

SEQ ID NO: 457219 - DNA, 25 bp, Homo sapien
gcaagaatgataattcgggccaggt

SEQ ID NO: 457220 - DNA, 25 bp, Homo sapien
gacggggtttccatttaaggcgatg

SEQ ID NO: 457221 - DNA, 25 bp, Homo sapien
ccatttaaggcgatgaaacagttct

SEQ ID NO: 457222 - DNA, 25 bp, Homo sapien
atgaaacagttctggaattcagcca

SEQ ID NO: 457223 - DNA, 25 bp, Homo sapien
acagttctggaattcagccagcaca

SEQ ID NO: 457224 - DNA, 25 bp, Homo sapien
agaattttaagttagccgtgcatgc

SEQ ID NO: 457225 - DNA, 25 bp, Homo sapien
aagttagccgtgcatgctggttcat

SEQ ID NO: 457226 - DNA, 25 bp, Homo sapien
tagccgtgcatgctggttcatgtct

SEQ ID NO: 457227 - DNA, 25 bp, Homo sapien
aggaattcaaggcttcaccgagata

SEQ ID NO: 457228 - DNA, 25 bp, Homo sapien
attcaaggcttcaccgagataagga

SEQ ID NO: 457229 - DNA, 25 bp, Homo sapien
caaggcttcaccgagataaggaggt

SEQ ID NO: 457230 - DNA, 25 bp, Homo sapien
ccgagataaggaggtgccactgtag

SEQ ID NO: 457231 - DNA, 25 bp, Homo sapien
gagcctgaccttgtctataaagaca

SEQ ID NO: 457232 - DNA, 25 bp, Homo sapien
gaataggctctaaagtcaggcagac

SEQ ID NO: 457233 - DNA, 25 bp, Homo sapien
gagcttgggcaagcaagttcaccat

SEQ ID NO: 457234 - DNA, 25 bp, Homo sapien
gcaagttcaccatgcctggtaccta

SEQ ID NO: 457235 - DNA, 25 bp, Homo sapien
ctgtgggcctctattctggagggac

SEQ ID NO: 457236 - DNA, 25 bp, Homo sapien
ggacagcagggccttacgaaaccag

SEQ ID NO: 457237 - DNA, 25 bp, Homo sapien
gggccttacgaaaccagcatgagat

SEQ ID NO: 457238 - DNA, 25 bp, Homo sapien
atgccttgcaggctggattttcaag

SEQ ID NO: 457239 - DNA, 25 bp, Homo sapien
ttttctccaacatctctggcaaaat

SEQ ID NO: 457240 - DNA, 25 bp, Homo sapien
ctctggcaaaattgctaacccaaag

SEQ ID NO: 457241 - DNA, 25 bp, Homo sapien
taacccaaaggtactaggcccagct

SEQ ID NO: 457242 - DNA, 25 bp, Homo sapien
tggctgacgactgcctggagtccaa

SEQ ID NO: 457243 - DNA, 25 bp, Homo sapien
agtccaactggtctcctggagttca

SEQ ID NO: 457244 - DNA, 25 bp, Homo sapien
gttcataagaggtttgaccccttct

SEQ ID NO: 457245 - DNA, 25 bp, Homo sapien
gaccccttctgagctgaatgtgtcc

SEQ ID NO: 457246 - DNA, 25 bp, Homo sapien
gagctgaatgtgtcctgatttaggg

SEQ ID NO: 457247 - DNA, 25 bp, Homo sapien
tctggaactcctactaattagtgtg

SEQ ID NO: 457248 - DNA, 25 bp, Homo sapien
gtgtatgtatgtggccaccagtggt

SEQ ID NO: 457249 - DNA, 25 bp, Homo sapien
gccaccagtggttagcagatgaggt

SEQ ID NO: 457250 - DNA, 25 bp, Homo sapien
gggacagtgactgtatctgttctga

SEQ ID NO: 457251 - DNA, 25 bp, Homo sapien
gactgtatctgttctgatgaaggag

SEQ ID NO: 457252 - DNA, 25 bp, Homo sapien
tgaaggagattgtgcagttacatgc

SEQ ID NO: 457253 - DNA, 25 bp, Homo sapien
atcagtacagaagcgacaaggagca

SEQ ID NO: 457254 - DNA, 25 bp, Homo sapien
gagaatgcagtcctatagaaaccaa

SEQ ID NO: 457255 - DNA, 25 bp, Homo sapien
gaaggaggcagcagtccactgtttc

SEQ ID NO: 457256 - DNA, 25 bp, Homo sapien
agtccactgtttctagcggacctaa

SEQ ID NO: 457257 - DNA, 25 bp, Homo sapien
ttctagcggacctaagagatgctta

SEQ ID NO: 457258 - DNA, 25 bp, Homo sapien
atgatgtccatggatttagctacat

SEQ ID NO: 457259 - DNA, 25 bp, Homo sapien
gctacatgaggatatctggctacac

SEQ ID NO: 457260 - DNA, 25 bp, Homo sapien
gatatctggctacacgcctgatggg

SEQ ID NO: 457261 - DNA, 25 bp, Homo sapien
tttacgggaggcaagggcactccat

SEQ ID NO: 457262 - DNA, 25 bp, Homo sapien
agggcactccattctgacacggaga

SEQ ID NO: 457263 - DNA, 25 bp, Homo sapien
acacggagagtccaagggaatgtaa

SEQ ID NO: 457264 - DNA, 25 bp, Homo sapien
gccgtgcggacgaagattctgccag

SEQ ID NO: 457265 - DNA, 25 bp, Homo sapien
gcggacgaagattctgccagcagtt

SEQ ID NO: 457266 - DNA, 25 bp, Homo sapien
agattctgccagcagttggtccgac

SEQ ID NO: 457267 - DNA, 25 bp, Homo sapien
gccagcagttggtccgactgcgacg

SEQ ID NO: 457268 - DNA, 25 bp, Homo sapien
agtcgcaggtgcagcgcgggcgcct

SEQ ID NO: 457269 - DNA, 25 bp, Homo sapien
ttgcaaggctgagctgacgccgcag

SEQ ID NO: 457270 - DNA, 25 bp, Homo sapien
gtcgtgtcacgtcccacgaccttga

SEQ ID NO: 457271 - DNA, 25 bp, Homo sapien
gacagccggaacagagcccggtgaa

SEQ ID NO: 457272 - DNA, 25 bp, Homo sapien
agggcggcccgagagatacgcaggt

SEQ ID NO: 457273 - DNA, 25 bp, Homo sapien
cagccgcacttctggcgtgagtatc

SEQ ID NO: 457274 - DNA, 25 bp, Homo sapien
ttctggcgtgagtatccggactgca

SEQ ID NO: 457275 - DNA, 25 bp, Homo sapien
taagtcgccgctgggactggcctgc

SEQ ID NO: 457276 - DNA, 25 bp, Homo sapien
tggcctgccccattgagcaacagag

SEQ ID NO: 457277 - DNA, 25 bp, Homo sapien
gagcaacagagacgcttgacagccg

SEQ ID NO: 457278 - DNA, 25 bp, Homo sapien
aacagagacgcttgacagccgcccg

SEQ ID NO: 457279 - DNA, 25 bp, Homo sapien
cattccttgacttcacccagaaatg

SEQ ID NO: 457280 - DNA, 25 bp, Homo sapien
ggtccagaaaactgaatcccaccag

SEQ ID NO: 457281 - DNA, 25 bp, Homo sapien
cactggtttggagcaaccggacacc

SEQ ID NO: 457282 - DNA, 25 bp, Homo sapien
ggagcaaccggacaccgaggtttca

SEQ ID NO: 457283 - DNA, 25 bp, Homo sapien
gacaccgaggtttcacctccaggga

SEQ ID NO: 457284 - DNA, 25 bp, Homo sapien
gtttcacctccagggattccatgaa

SEQ ID NO: 457285 - DNA, 25 bp, Homo sapien
aagagcctcaatggagatgccacat

SEQ ID NO: 457286 - DNA, 25 bp, Homo sapien
cctgcctgcctatgcattttgggaa

SEQ ID NO: 457287 - DNA, 25 bp, Homo sapien
tatgcattttgggaacagcccctgt

SEQ ID NO: 457288 - DNA, 25 bp, Homo sapien
gtatttttctctggctgagattaga

SEQ ID NO: 457289 - DNA, 25 bp, Homo sapien
tctctggctgagattagaacacatt

SEQ ID NO: 457290 - DNA, 25 bp, Homo sapien
gattagaacacattccttgtaaagt

SEQ ID NO: 457291 - DNA, 25 bp, Homo sapien
acatcgggttttcttagggctctcg

SEQ ID NO: 457292 - DNA, 25 bp, Homo sapien
gggctgtattgcaaaggccgcttat

SEQ ID NO: 457293 - DNA, 25 bp, Homo sapien
tgcaaaggccgcttatggtctgttt

SEQ ID NO: 457294 - DNA, 25 bp, Homo sapien
aaaggccgcttatggtctgtttggg

SEQ ID NO: 457295 - DNA, 25 bp, Homo sapien
ggccctcgtctaagtctttgtccca

SEQ ID NO: 457296 - DNA, 25 bp, Homo sapien
cgtctaagtctttgtcccaccaggg

SEQ ID NO: 457297 - DNA, 25 bp, Homo sapien
agtctgcaatgttccccagcatgcc

SEQ ID NO: 457298 - DNA, 25 bp, Homo sapien
gtctgcaatgttccccagcatgccg

SEQ ID NO: 457299 - DNA, 25 bp, Homo sapien
tgcaatgttccccagcatgccgttg

SEQ ID NO: 457300 - DNA, 25 bp, Homo sapien
gcaatgttccccagcatgccgttgg

SEQ ID NO: 457301 - DNA, 25 bp, Homo sapien
catattgagcacaggaagcactcta

SEQ ID NO: 457302 - DNA, 25 bp, Homo sapien
agccgagatggcttcctgagacgcg

SEQ ID NO: 457303 - DNA, 25 bp, Homo sapien
gccgagatggcttcctgagacgcgt

SEQ ID NO: 457304 - DNA, 25 bp, Homo sapien
gagatggcttcctgagacgcgtgaa

SEQ ID NO: 457305 - DNA, 25 bp, Homo sapien
agatggcttcctgagacgcgtgaag

SEQ ID NO: 457306 - DNA, 25 bp, Homo sapien
atggcttcctgagacgcgtgaagga

SEQ ID NO: 457307 - DNA, 25 bp, Homo sapien
tggcttcctgagacgcgtgaaggaa

SEQ ID NO: 457308 - DNA, 25 bp, Homo sapien
gtaaacaattatttcccagtggact

SEQ ID NO: 457309 - DNA, 25 bp, Homo sapien
ggactaattacaaagttcctgtgac

SEQ ID NO: 457310 - DNA, 25 bp, Homo sapien
gttcctgtgacatcaagatcattcc

SEQ ID NO: 457311 - DNA, 25 bp, Homo sapien
gatcattccttctcaaggcttttca

SEQ ID NO: 457312 - DNA, 25 bp, Homo sapien
ggcttttcactatatattgagacgt

SEQ ID NO: 457313 - DNA, 25 bp, Homo sapien
gagacgtgtagtcttaatttcattt

SEQ ID NO: 457314 - DNA, 25 bp, Homo sapien
ttcattttggtttgccccaagactt

SEQ ID NO: 457315 - DNA, 25 bp, Homo sapien
gggatctgtacggaactatcctttc

SEQ ID NO: 457316 - DNA, 25 bp, Homo sapien
ggaactatcctttcccaaggtacat

SEQ ID NO: 457317 - DNA, 25 bp, Homo sapien
ggtacatcatgcatactttctgcta

SEQ ID NO: 457318 - DNA, 25 bp, Homo sapien
cagtctgtcccttgtggtcaatcaa

SEQ ID NO: 457319 - DNA, 25 bp, Homo sapien
agcatttaagttgtattgcgcatta

SEQ ID NO: 457320 - DNA, 25 bp, Homo sapien
ttaagttgtattgcgcattataaat

SEQ ID NO: 457321 - DNA, 25 bp, Homo sapien
gacttgagcatttgaggactttggt

SEQ ID NO: 457322 - DNA, 25 bp, Homo sapien
gagcatttgaggactttggtatcca

SEQ ID NO: 457323 - DNA, 25 bp, Homo sapien
actttggtatccaagggaggtcctg

SEQ ID NO: 457324 - DNA, 25 bp, Homo sapien
tggaaccaatctcccacagatgccg

SEQ ID NO: 457325 - DNA, 25 bp, Homo sapien
aatctcccacagatgccgagggaca

SEQ ID NO: 457326 - DNA, 25 bp, Homo sapien
cagatgccgagggacaggaaagact

SEQ ID NO: 457327 - DNA, 25 bp, Homo sapien
cgagggacaggaaagactgtacctt

SEQ ID NO: 457328 - DNA, 25 bp, Homo sapien
gtcagtactgaacatgtatagactc

SEQ ID NO: 457329 - DNA, 25 bp, Homo sapien
acatgtatagactcttttttgtcat

SEQ ID NO: 457330 - DNA, 25 bp, Homo sapien
ttggcacttcgtactttcattcatt

SEQ ID NO: 457331 - DNA, 25 bp, Homo sapien
gagggatgatgaacctgtcaggcca

SEQ ID NO: 457332 - DNA, 25 bp, Homo sapien
aacctgtcaggccataatagctagc

SEQ ID NO: 457333 - DNA, 25 bp, Homo sapien
ggccataatagctagcctggaattt

SEQ ID NO: 457334 - DNA, 25 bp, Homo sapien
gctagcctggaattttccttgccaa

SEQ ID NO: 457335 - DNA, 25 bp, Homo sapien
tggaattttccttgccaagtctgtc

SEQ ID NO: 457336 - DNA, 25 bp, Homo sapien
agtctgtcctccttgaatagtttgc

SEQ ID NO: 457337 - DNA, 25 bp, Homo sapien
tgtcctccttgaatagtttgctatt

SEQ ID NO: 457338 - DNA, 25 bp, Homo sapien
gtttgctatttatgctgatgatttg

SEQ ID NO: 457339 - DNA, 25 bp, Homo sapien
tcatattatttgtccctacaaggga

SEQ ID NO: 457340 - DNA, 25 bp, Homo sapien
taaaatgataatgacgccaggcgca

SEQ ID NO: 457341 - DNA, 25 bp, Homo sapien
tcacacagttcaaggcagaggtgcg

SEQ ID NO: 457342 - DNA, 25 bp, Homo sapien
gctgagattgagtacgccatggcct

SEQ ID NO: 457343 - DNA, 25 bp, Homo sapien
tgagtacgccatggcctactctaaa

SEQ ID NO: 457344 - DNA, 25 bp, Homo sapien
gcctactctaaagccgcatttgaaa

SEQ ID NO: 457345 - DNA, 25 bp, Homo sapien
taaagccgcatttgaaagggaaagt

SEQ ID NO: 457346 - DNA, 25 bp, Homo sapien
gtgatgtccctctgaaaactgagga

SEQ ID NO: 457347 - DNA, 25 bp, Homo sapien
tgaccaaaacagcagtggctcacag

SEQ ID NO: 457348 - DNA, 25 bp, Homo sapien
aacagcagtggctcacaggcccggg

SEQ ID NO: 457349 - DNA, 25 bp, Homo sapien
agctgagctgtccaagctggtgatt

SEQ ID NO: 457350 - DNA, 25 bp, Homo sapien
ggaccagcgaagaccaccagcactt

SEQ ID NO: 457351 - DNA, 25 bp, Homo sapien
gtcctatctgtacttcacacagttc

SEQ ID NO: 457352 - DNA, 25 bp, Homo sapien
agccaacagtaccaccagcttaaaa

SEQ ID NO: 457353 - DNA, 25 bp, Homo sapien
agtaccaccagcttaaaaccctgca

SEQ ID NO: 457354 - DNA, 25 bp, Homo sapien
ctgcagccatgcctaaatcctctat

SEQ ID NO: 457355 - DNA, 25 bp, Homo sapien
tgcctaaatcctctatcttcctgta

SEQ ID NO: 457356 - DNA, 25 bp, Homo sapien
acgaccaacccttgctgattttatg

SEQ ID NO: 457357 - DNA, 25 bp, Homo sapien
tgattttatggctaaatccctctct

SEQ ID NO: 457358 - DNA, 25 bp, Homo sapien
gtcaggaccagctgcagaatttgca

SEQ ID NO: 457359 - DNA, 25 bp, Homo sapien
tgcagaatttgcaaggcccagtgca

SEQ ID NO: 457360 - DNA, 25 bp, Homo sapien
ggaaaagcactgctgaagtattacc

SEQ ID NO: 457361 - DNA, 25 bp, Homo sapien
tttcttctgtggtctctgcgtctca

SEQ ID NO: 457362 - DNA, 25 bp, Homo sapien
ggtctctgcgtctcaatttatcatg

SEQ ID NO: 457363 - DNA, 25 bp, Homo sapien
acttttttggccgtgtggtcatcta

SEQ ID NO: 457364 - DNA, 25 bp, Homo sapien
tggtcatctaccacctgcgggtgct

SEQ ID NO: 457365 - DNA, 25 bp, Homo sapien
gaagccctccgggaagcacagcaaa

SEQ ID NO: 457366 - DNA, 25 bp, Homo sapien
ggaagcacagcaaagtccctcattc

SEQ ID NO: 457367 - DNA, 25 bp, Homo sapien
gcaaagtccctcattctgcacagaa

SEQ ID NO: 457368 - DNA, 25 bp, Homo sapien
gcacagaaggtttattggttcctct

SEQ ID NO: 457369 - DNA, 25 bp, Homo sapien
tgaagtcagttctgggtttccccag

SEQ ID NO: 457370 - DNA, 25 bp, Homo sapien
cagctctggctgaccattttgttcc

SEQ ID NO: 457371 - DNA, 25 bp, Homo sapien
attttgttccctgagtgtctgagtc

SEQ ID NO: 457372 - DNA, 25 bp, Homo sapien
ctgagtgtctgagtccccggcaggc

SEQ ID NO: 457373 - DNA, 25 bp, Homo sapien
cggcaggcggccttcactcagggtc

SEQ ID NO: 457374 - DNA, 25 bp, Homo sapien
cagatggtggtgatgctttagtgca

SEQ ID NO: 457375 - DNA, 25 bp, Homo sapien
atgctttagtgcaccagctcacttt

SEQ ID NO: 457376 - DNA, 25 bp, Homo sapien
agctcactttccagttatgttctct

SEQ ID NO: 457377 - DNA, 25 bp, Homo sapien
agttatgttctctttctctgggaga

SEQ ID NO: 457378 - DNA, 25 bp, Homo sapien
aaaaaagaggtggatgacatgcagc

SEQ ID NO: 457379 - DNA, 25 bp, Homo sapien
gacatgcagcatgagctgtgcacta

SEQ ID NO: 457380 - DNA, 25 bp, Homo sapien
tgagctgtgcactagttgtggagaa

SEQ ID NO: 457381 - DNA, 25 bp, Homo sapien
gttgtggagaatacgactgcctgtt

SEQ ID NO: 457382 - DNA, 25 bp, Homo sapien
gagaatacgactgcctgttggtcca

SEQ ID NO: 457383 - DNA, 25 bp, Homo sapien
cctgttggtccacggcaaattctaa

SEQ ID NO: 457384 - DNA, 25 bp, Homo sapien
tggtccacggcaaattctaaattaa

SEQ ID NO: 457385 - DNA, 25 bp, Homo sapien
atttataagacaggcatttaagagt

SEQ ID NO: 457386 - DNA, 25 bp, Homo sapien
ttataagacaggcatttaagagtca

SEQ ID NO: 457387 - DNA, 25 bp, Homo sapien
ataagacaggcatttaagagtcaaa

SEQ ID NO: 457388 - DNA, 25 bp, Homo sapien
taagacaggcatttaagagtcaaaa

SEQ ID NO: 457389 - DNA, 25 bp, Homo sapien
aagacaggcatttaagagtcaaaaa

SEQ ID NO: 457390 - DNA, 25 bp, Homo sapien
agacaggcatttaagagtcaaaaaa

SEQ ID NO: 457391 - DNA, 25 bp, Homo sapien
caggcatttaagagtcaaaaaaaca

SEQ ID NO: 457392 - DNA, 25 bp, Homo sapien
aacaaacaatgttgctttactctta

SEQ ID NO: 457393 - DNA, 25 bp, Homo sapien
acaaacaatgttgctttactcttaa

SEQ ID NO: 457394 - DNA, 25 bp, Homo sapien
atgttgctttactcttaatagccaa

SEQ ID NO: 457395 - DNA, 25 bp, Homo sapien
tgttgctttactcttaatagccaaa

SEQ ID NO: 457396 - DNA, 25 bp, Homo sapien
ttcttccaaaaattttagcacgtat

SEQ ID NO: 457397 - DNA, 25 bp, Homo sapien
ttagcacgtattttcatatgttagt

SEQ ID NO: 457398 - DNA, 25 bp, Homo sapien
catatgttagtgtgtagatcaattc

SEQ ID NO: 457399 - DNA, 25 bp, Homo sapien
ctgtaatatgttgtgtaccttgtaa

SEQ ID NO: 457400 - DNA, 25 bp, Homo sapien
gtgtaccttgtaattattccagctg

SEQ ID NO: 457401 - DNA, 25 bp, Homo sapien
ttgtaattattccagctgtattgca

SEQ ID NO: 457402 - DNA, 25 bp, Homo sapien
gatcatttgcaagtactacatgctc

SEQ ID NO: 457403 - DNA, 25 bp, Homo sapien
agtactacatgctcttgaataatat

SEQ ID NO: 457404 - DNA, 25 bp, Homo sapien
atatttagtgtacaacccctgtctc

SEQ ID NO: 457405 - DNA, 25 bp, Homo sapien
gtacaacccctgtctcccagtaatt

SEQ ID NO: 457406 - DNA, 25 bp, Homo sapien
cccagtaattctgctgcccaaggaa

SEQ ID NO: 457407 - DNA, 25 bp, Homo sapien
gaataatcagtacggtgatcagcaa

SEQ ID NO: 457408 - DNA, 25 bp, Homo sapien
cagtacggtgatcagcaaggataaa

SEQ ID NO: 457409 - DNA, 25 bp, Homo sapien
ggcaagattaacatgctactgttta

SEQ ID NO: 457410 - DNA, 25 bp, Homo sapien
gtttatgaagctctctaactttgat

SEQ ID NO: 457411 - DNA, 25 bp, Homo sapien
agctctctaactttgatactcataa

SEQ ID NO: 457412 - DNA, 25 bp, Homo sapien
ataacaactctgaaaggcacctaga

SEQ ID NO: 457413 - DNA, 25 bp, Homo sapien
ggcacctagagtgtccttggagttt

SEQ ID NO: 457414 - DNA, 25 bp, Homo sapien
gagtgtccttggagtttaattacct

SEQ ID NO: 457415 - DNA, 25 bp, Homo sapien
ttaattacctttttccataggagct

SEQ ID NO: 457416 - DNA, 25 bp, Homo sapien
gttaataatatgactcttaggccca

SEQ ID NO: 457417 - DNA, 25 bp, Homo sapien
cttaggcccagagtgatggctcaca

SEQ ID NO: 457418 - DNA, 25 bp, Homo sapien
aaactggccaggcacattggcacac

SEQ ID NO: 457419 - DNA, 25 bp, Homo sapien
aactggccaggcacattggcacacg

SEQ ID NO: 457420 - DNA, 25 bp, Homo sapien
actggccaggcacattggcacacgg

SEQ ID NO: 457421 - DNA, 25 bp, Homo sapien
tggccaggcacattggcacacggct

SEQ ID NO: 457422 - DNA, 25 bp, Homo sapien
caggcacattggcacacggctcaca

SEQ ID NO: 457423 - DNA, 25 bp, Homo sapien
aggcacattggcacacggctcacac

SEQ ID NO: 457424 - DNA, 25 bp, Homo sapien
ccttgagcccaggaaacctgtctgg

SEQ ID NO: 457425 - DNA, 25 bp, Homo sapien
ttgagcccaggaaacctgtctgggc

SEQ ID NO: 457426 - DNA, 25 bp, Homo sapien
gagcccaggaaacctgtctgggcaa

SEQ ID NO: 457427 - DNA, 25 bp, Homo sapien
ccaggaaacctgtctgggcaatata

SEQ ID NO: 457428 - DNA, 25 bp, Homo sapien
caggaaacctgtctgggcaatatag

SEQ ID NO: 457429 - DNA, 25 bp, Homo sapien
gggaaggacctgtggtactcctaca

SEQ ID NO: 457430 - DNA, 25 bp, Homo sapien
ggacctgtggtactcctacaaactt

SEQ ID NO: 457431 - DNA, 25 bp, Homo sapien
ggaacagtggtggtctccacagata

SEQ ID NO: 457432 - DNA, 25 bp, Homo sapien
tggtggtctccacagatagctagaa

SEQ ID NO: 457433 - DNA, 25 bp, Homo sapien
taaactgtttcatccagctgctttc

SEQ ID NO: 457434 - DNA, 25 bp, Homo sapien
gctgctttctgcctgttaacctttg

SEQ ID NO: 457435 - DNA, 25 bp, Homo sapien
gttaacctttgccacttccattcct

SEQ ID NO: 457436 - DNA, 25 bp, Homo sapien
attccttcaagtgtgtaatccccag

SEQ ID NO: 457437 - DNA, 25 bp, Homo sapien
atccccagggttgtcttgtattaca

SEQ ID NO: 457438 - DNA, 25 bp, Homo sapien
ttgtattacacacatccttgttaag

SEQ ID NO: 457439 - DNA, 25 bp, Homo sapien
ataccactgttgatttcttcttcca

SEQ ID NO: 457440 - DNA, 25 bp, Homo sapien
gtgtgtcacacgtctatagtaaacc

SEQ ID NO: 457441 - DNA, 25 bp, Homo sapien
cacacgtctatagtaaaccagttct

SEQ ID NO: 457442 - DNA, 25 bp, Homo sapien
aaaagccctgatttattgcatttgg

SEQ ID NO: 457443 - DNA, 25 bp, Homo sapien
cagcttctgtggtgtaaattctccc

SEQ ID NO: 457444 - DNA, 25 bp, Homo sapien
ggtgtaaattctcccagcagtgtcc

SEQ ID NO: 457445 - DNA, 25 bp, Homo sapien
agtgtcccatgtcatgctgccagca

SEQ ID NO: 457446 - DNA, 25 bp, Homo sapien
tgccagcatcactgaatgcactgaa

SEQ ID NO: 457447 - DNA, 25 bp, Homo sapien
actgaatgcactgaactcagagttg

SEQ ID NO: 457448 - DNA, 25 bp, Homo sapien
agagatgcacataatcgctctcccg

SEQ ID NO: 457449 - DNA, 25 bp, Homo sapien
gttgaagtctcaactgtctctgttc

SEQ ID NO: 457450 - DNA, 25 bp, Homo sapien
gtctcaactgtctctgttcacaaga

SEQ ID NO: 457451 - DNA, 25 bp, Homo sapien
ggtcaccacccgacgcaggtcagtg

SEQ ID NO: 457452 - DNA, 25 bp, Homo sapien
ccgacgcaggtcagtgcctcgtggt

SEQ ID NO: 457453 - DNA, 25 bp, Homo sapien
tcagtgcctcgtggtggaggagcgt

SEQ ID NO: 457454 - DNA, 25 bp, Homo sapien
gcagaggagccgaagaccgtcccct

SEQ ID NO: 457455 - DNA, 25 bp, Homo sapien
gggcagctcctgtgcggctctgcac

SEQ ID NO: 457456 - DNA, 25 bp, Homo sapien
ggacagcgctggcatcgacggcggc

SEQ ID NO: 457457 - DNA, 25 bp, Homo sapien
aaaatgaagggagcgacgtttgccg

SEQ ID NO: 457458 - DNA, 25 bp, Homo sapien
aagggagcgacgtttgccgaactga

SEQ ID NO: 457459 - DNA, 25 bp, Homo sapien
ggagcgacgtttgccgaactgaaaa

SEQ ID NO: 457460 - DNA, 25 bp, Homo sapien
ttgccgaactgaaaagggtcgcccg

SEQ ID NO: 457461 - DNA, 25 bp, Homo sapien
gaactgaaaagggtcgcccggtcag

SEQ ID NO: 457462 - DNA, 25 bp, Homo sapien
tatttaagcctaaaacgactctttg

SEQ ID NO: 457463 - DNA, 25 bp, Homo sapien
agcctaaaacgactctttgatccct

SEQ ID NO: 457464 - DNA, 25 bp, Homo sapien
gcctaaaacgactctttgatccctc

SEQ ID NO: 457465 - DNA, 25 bp, Homo sapien
ggtatcccccaccaggtatgagaag

SEQ ID NO: 457466 - DNA, 25 bp, Homo sapien
accaggtatgagaaggaggagtctt

SEQ ID NO: 457467 - DNA, 25 bp, Homo sapien
aggagagttattcaatggccagaga

SEQ ID NO: 457468 - DNA, 25 bp, Homo sapien
agagttattcaatggccagagacac

SEQ ID NO: 457469 - DNA, 25 bp, Homo sapien
tattcaatggccagagacaccctgc

SEQ ID NO: 457470 - DNA, 25 bp, Homo sapien
ttcaatggccagagacaccctgcgg

SEQ ID NO: 457471 - DNA, 25 bp, Homo sapien
aatggccagagacaccctgcggctt

SEQ ID NO: 457472 - DNA, 25 bp, Homo sapien
ggctgacaaatatccatatatacat

SEQ ID NO: 457473 - DNA, 25 bp, Homo sapien
atacgaatagcaaggtgcttccctc

SEQ ID NO: 457474 - DNA, 25 bp, Homo sapien
tttaactcccctaaatgacatttag

SEQ ID NO: 457475 - DNA, 25 bp, Homo sapien
tagagaactcgtgttatgcctaatt

SEQ ID NO: 457476 - DNA, 25 bp, Homo sapien
aactcgtgttatgcctaattcttct

SEQ ID NO: 457477 - DNA, 25 bp, Homo sapien
ttctgctgttggctctgctttgagc

SEQ ID NO: 457478 - DNA, 25 bp, Homo sapien
ggtgggcctaggtttgagagccctg

SEQ ID NO: 457479 - DNA, 25 bp, Homo sapien
ccagcccatgctgggtgaaggcgga

SEQ ID NO: 457480 - DNA, 25 bp, Homo sapien
cagggccctttccaatgaatctgcc

SEQ ID NO: 457481 - DNA, 25 bp, Homo sapien
tgccggaaaggaaccaatctttcag

SEQ ID NO: 457482 - DNA, 25 bp, Homo sapien
ggaaccaatctttcagtggcagctg

SEQ ID NO: 457483 - DNA, 25 bp, Homo sapien
ctttcagtggcagctgattttacaa

SEQ ID NO: 457484 - DNA, 25 bp, Homo sapien
caggctgcgcggattgttgctgggt

SEQ ID NO: 457485 - DNA, 25 bp, Homo sapien
gctgcgcggattgttgctgggtgaa

SEQ ID NO: 457486 - DNA, 25 bp, Homo sapien
agagaaaaagccaacgcccccattg

SEQ ID NO: 457487 - DNA, 25 bp, Homo sapien
aacgcccccattgtgcagaggtgga

SEQ ID NO: 457488 - DNA, 25 bp, Homo sapien
cccccattgtgcagaggtggagact

SEQ ID NO: 457489 - DNA, 25 bp, Homo sapien
ggtggagactgaggaaccccgcggc

SEQ ID NO: 457490 - DNA, 25 bp, Homo sapien
ggagactgaggaaccccgcggccgg

SEQ ID NO: 457491 - DNA, 25 bp, Homo sapien
ccgcggccggcacggtttggactgg

SEQ ID NO: 457492 - DNA, 25 bp, Homo sapien
tcacacaaatcccagacagaaagcc

SEQ ID NO: 457493 - DNA, 25 bp, Homo sapien
cacacaaatcccagacagaaagcct

SEQ ID NO: 457494 - DNA, 25 bp, Homo sapien
acaaatcccagacagaaagcctcac

SEQ ID NO: 457495 - DNA, 25 bp, Homo sapien
ttcaggcaggtctagacactctcag

SEQ ID NO: 457496 - DNA, 25 bp, Homo sapien
gactgtggtaagaaagcatccccag

SEQ ID NO: 457497 - DNA, 25 bp, Homo sapien
gaaagcatccccaggtggacacgtc

SEQ ID NO: 457498 - DNA, 25 bp, Homo sapien
caggtggacacgtcctgctcctctg

SEQ ID NO: 457499 - DNA, 25 bp, Homo sapien
tctgtcccctgttcagtaagacaca

SEQ ID NO: 457500 - DNA, 25 bp, Homo sapien
ccccagacctttgtataatgcagac

SEQ ID NO: 457501 - DNA, 25 bp, Homo sapien
gtataatgcagacaggtaccagctg

SEQ ID NO: 457502 - DNA, 25 bp, Homo sapien
gtaccagctgtgtgaaatgagtgat

SEQ ID NO: 457503 - DNA, 25 bp, Homo sapien
aatgctgactccaaatccctatttt

SEQ ID NO: 457504 - DNA, 25 bp, Homo sapien
tgaggtaagagacccagttcctatc

SEQ ID NO: 457505 - DNA, 25 bp, Homo sapien
tgacctttctgaaattcttcaggca

SEQ ID NO: 457506 - DNA, 25 bp, Homo sapien
gtattatataacaacgtgatccaga

SEQ ID NO: 457507 - DNA, 25 bp, Homo sapien
tatataacaacgtgatccagacagt

SEQ ID NO: 457508 - DNA, 25 bp, Homo sapien
tataacaacgtgatccagacagtga

SEQ ID NO: 457509 - DNA, 25 bp, Homo sapien
cagacagtgagttctaagtgtatta

SEQ ID NO: 457510 - DNA, 25 bp, Homo sapien
cagtgagttctaagtgtattaatta

SEQ ID NO: 457511 - DNA, 25 bp, Homo sapien
gagggagggttgccaacctgaagtc

SEQ ID NO: 457512 - DNA, 25 bp, Homo sapien
tccttctttgaacattgtctgaaat

SEQ ID NO: 457513 - DNA, 25 bp, Homo sapien
cttctttgaacattgtctgaaattt

SEQ ID NO: 457514 - DNA, 25 bp, Homo sapien
taaatcaagacttcttgtacaaaga

SEQ ID NO: 457515 - DNA, 25 bp, Homo sapien
caagacttcttgtacaaagaatgat

SEQ ID NO: 457516 - DNA, 25 bp, Homo sapien
atgggacatatgtaataattcaggc

SEQ ID NO: 457517 - DNA, 25 bp, Homo sapien
gacagatgttgcctgatgcctggat

SEQ ID NO: 457518 - DNA, 25 bp, Homo sapien
gcctgatgcctggataatgctgaat

SEQ ID NO: 457519 - DNA, 25 bp, Homo sapien
gacaaaaccagcgagacacattaag

SEQ ID NO: 457520 - DNA, 25 bp, Homo sapien
tctccttttcttgaactgtcaggtc

SEQ ID NO: 457521 - DNA, 25 bp, Homo sapien
aactgtcaggtcaactataaagcga

SEQ ID NO: 457522 - DNA, 25 bp, Homo sapien
aaagcgatgaagtccatagtacaat

SEQ ID NO: 457523 - DNA, 25 bp, Homo sapien
taatagatcttctgtatggcatgga

SEQ ID NO: 457524 - DNA, 25 bp, Homo sapien
gtaaggtagactttatcttcaagat

SEQ ID NO: 457525 - DNA, 25 bp, Homo sapien
attaagatccttcaacagtgtgtgg

SEQ ID NO: 457526 - DNA, 25 bp, Homo sapien
tgtatggcatggacagcttctagtg

SEQ ID NO: 457527 - DNA, 25 bp, Homo sapien
gtctgttcttgatgaagacaacact

SEQ ID NO: 457528 - DNA, 25 bp, Homo sapien
ctttgatgttctcccccaagttggg

SEQ ID NO: 457529 - DNA, 25 bp, Homo sapien
ccaagttgggcagcctagaggtgtt

SEQ ID NO: 457530 - DNA, 25 bp, Homo sapien
gcagcctagaggtgttgggaaccct

SEQ ID NO: 457531 - DNA, 25 bp, Homo sapien
tgtttccttccgttgcccaggacac

SEQ ID NO: 457532 - DNA, 25 bp, Homo sapien
aggaaccctggcctcaccaaaacag

SEQ ID NO: 457533 - DNA, 25 bp, Homo sapien
caaaacagcagcagctcgttggctc

SEQ ID NO: 457534 - DNA, 25 bp, Homo sapien
agcagcagctcgttggctccaaaac

SEQ ID NO: 457535 - DNA, 25 bp, Homo sapien
agctcgttggctccaaaaccaggga

SEQ ID NO: 457536 - DNA, 25 bp, Homo sapien
aaaccagggagcagaccatgccctc

SEQ ID NO: 457537 - DNA, 25 bp, Homo sapien
ctcccaaccctggagttgtcaggga

SEQ ID NO: 457538 - DNA, 25 bp, Homo sapien
agttgtcagggagggcctgcccatc

SEQ ID NO: 457539 - DNA, 25 bp, Homo sapien
gtttgtttttgagagctgttaagta

SEQ ID NO: 457540 - DNA, 25 bp, Homo sapien
gagagctgttaagtaattccaggag

SEQ ID NO: 457541 - DNA, 25 bp, Homo sapien
gctgttaagtaattccaggagagta

SEQ ID NO: 457542 - DNA, 25 bp, Homo sapien
gattggtcttgatagtcattgctat

SEQ ID NO: 457543 - DNA, 25 bp, Homo sapien
ttggtcttgatagtcattgctataa

SEQ ID NO: 457544 - DNA, 25 bp, Homo sapien
gttataaaatttggcaggaccaggc

SEQ ID NO: 457545 - DNA, 25 bp, Homo sapien
gcctataatcccgaggccaaggcag

SEQ ID NO: 457546 - DNA, 25 bp, Homo sapien
gtcattgctataaagtcatggtatg

SEQ ID NO: 457547 - DNA, 25 bp, Homo sapien
tatgaagggcatacaaggcagaagg

SEQ ID NO: 457548 - DNA, 25 bp, Homo sapien
gcatacaaggcagaaggagcagcat

SEQ ID NO: 457549 - DNA, 25 bp, Homo sapien
aaggcagaaggagcagcataaggca

SEQ ID NO: 457550 - DNA, 25 bp, Homo sapien
gctatcttaagtgctttttctttat

SEQ ID NO: 457551 - DNA, 25 bp, Homo sapien
ccccagtggtagcatctgaagtatt

SEQ ID NO: 457552 - DNA, 25 bp, Homo sapien
gaagtattggagtgtttctgccacg

SEQ ID NO: 457553 - DNA, 25 bp, Homo sapien
attggagtgtttctgccacgaagca

SEQ ID NO: 457554 - DNA, 25 bp, Homo sapien
gagtgtttctgccacgaagcaaagc

SEQ ID NO: 457555 - DNA, 25 bp, Homo sapien
ttctgccacgaagcaaagctccatt

SEQ ID NO: 457556 - DNA, 25 bp, Homo sapien
gaagcaaagctccattcatggccgt

SEQ ID NO: 457557 - DNA, 25 bp, Homo sapien
aaagctccattcatggccgtcatgg

SEQ ID NO: 457558 - DNA, 25 bp, Homo sapien
agctccattcatggccgtcatggaa

SEQ ID NO: 457559 - DNA, 25 bp, Homo sapien
ttcatggccgtcatggaaggttatt

SEQ ID NO: 457560 - DNA, 25 bp, Homo sapien
ggaaggttatttattaatgttacat

SEQ ID NO: 457561 - DNA, 25 bp, Homo sapien
ttaagatgatcattatgggccaggc

SEQ ID NO: 457562 - DNA, 25 bp, Homo sapien
aagatgatcattatgggccaggcac

SEQ ID NO: 457563 - DNA, 25 bp, Homo sapien
gatgatcattatgggccaggcacaa

SEQ ID NO: 457564 - DNA, 25 bp, Homo sapien
tgatcattatgggccaggcacaatg

SEQ ID NO: 457565 - DNA, 25 bp, Homo sapien
taatagtagtactttgggagtccaa

SEQ ID NO: 457566 - DNA, 25 bp, Homo sapien
agccttcacggcaaaacctagtctg

SEQ ID NO: 457567 - DNA, 25 bp, Homo sapien
ccttcacggcaaaacctagtctgta

SEQ ID NO: 457568 - DNA, 25 bp, Homo sapien
ttcacggcaaaacctagtctgtact

SEQ ID NO: 457569 - DNA, 25 bp, Homo sapien
tcacggcaaaacctagtctgtacta

SEQ ID NO: 457570 - DNA, 25 bp, Homo sapien
tagggtgtggtgatgcgctcctata

SEQ ID NO: 457571 - DNA, 25 bp, Homo sapien
agggtgtggtgatgcgctcctataa

SEQ ID NO: 457572 - DNA, 25 bp, Homo sapien
cttctagcgtgccttacatcaggta

SEQ ID NO: 457573 - DNA, 25 bp, Homo sapien
ctagcgtgccttacatcaggtactt

SEQ ID NO: 457574 - DNA, 25 bp, Homo sapien
tccagttccacgaggcactgtgcca

SEQ ID NO: 457575 - DNA, 25 bp, Homo sapien
cctgcacaagtgtgacatctaccag

SEQ ID NO: 457576 - DNA, 25 bp, Homo sapien
acatctaccagtccaaggaggccgg

SEQ ID NO: 457577 - DNA, 25 bp, Homo sapien
ctggcgaccgccatgaagctgggct

SEQ ID NO: 457578 - DNA, 25 bp, Homo sapien
atgaagctgggcttcagtaggccgt

SEQ ID NO: 457579 - DNA, 25 bp, Homo sapien
aacatgagcgcctcggccatgttga

SEQ ID NO: 457580 - DNA, 25 bp, Homo sapien
ggccatgttgagctacttcaagccg

SEQ ID NO: 457581 - DNA, 25 bp, Homo sapien
tacttcaagccgctgctggactggc

SEQ ID NO: 457582 - DNA, 25 bp, Homo sapien
tccgcacggagaacgagctgcatgg

SEQ ID NO: 457583 - DNA, 25 bp, Homo sapien
cggtgatctggccattataccctgc

SEQ ID NO: 457584 - DNA, 25 bp, Homo sapien
ggattatgctgtctatcgaaacatt

SEQ ID NO: 457585 - DNA, 25 bp, Homo sapien
tatgctgtctatcgaaacattgcca

SEQ ID NO: 457586 - DNA, 25 bp, Homo sapien
gctgtctatcgaaacattgccaatg

SEQ ID NO: 457587 - DNA, 25 bp, Homo sapien
tgtctatcgaaacattgccaatgag

SEQ ID NO: 457588 - DNA, 25 bp, Homo sapien
cgaaacattgccaatgagaccagta

SEQ ID NO: 457589 - DNA, 25 bp, Homo sapien
gtgtcattagaaaaggagactgttt

SEQ ID NO: 457590 - DNA, 25 bp, Homo sapien
gagactgtttgatgcccttcaacca

SEQ ID NO: 457591 - DNA, 25 bp, Homo sapien
ctgtttgatgcccttcaaccacagc

SEQ ID NO: 457592 - DNA, 25 bp, Homo sapien
tggggtcccgtctgtattgcacaga

SEQ ID NO: 457593 - DNA, 25 bp, Homo sapien
gaatcaaaccaaacggatccaccat

SEQ ID NO: 457594 - DNA, 25 bp, Homo sapien
ttttaatgtcttgactcttcagagt

SEQ ID NO: 457595 - DNA, 25 bp, Homo sapien
gactcttcagagttcgtacctcaaa

SEQ ID NO: 457596 - DNA, 25 bp, Homo sapien
ttgctttctgctgaatccctaatct

SEQ ID NO: 457597 - DNA, 25 bp, Homo sapien
gaatccctaatctcaacaatctata

SEQ ID NO: 457598 - DNA, 25 bp, Homo sapien
aacaatctatacctggactgtccag

SEQ ID NO: 457599 - DNA, 25 bp, Homo sapien
gctatcttctcttctatccaagtag

SEQ ID NO: 457600 - DNA, 25 bp, Homo sapien
caggagctccttccctctagcaatt

SEQ ID NO: 457601 - DNA, 25 bp, Homo sapien
tccctctagcaatttctactaaaat

SEQ ID NO: 457602 - DNA, 25 bp, Homo sapien
gtttccttttacaatcaaattactg

SEQ ID NO: 457603 - DNA, 25 bp, Homo sapien
tccagtaaatcattttggtagctct

SEQ ID NO: 457604 - DNA, 25 bp, Homo sapien
ggtagctctggctgtgctatcaata

SEQ ID NO: 457605 - DNA, 25 bp, Homo sapien
tgatgccagttgataaacttccctg

SEQ ID NO: 457606 - DNA, 25 bp, Homo sapien
atttggcaaacttgcttctctgtca

SEQ ID NO: 457607 - DNA, 25 bp, Homo sapien
ttctctgtcaatatttcatcctcct

SEQ ID NO: 457608 - DNA, 25 bp, Homo sapien
attggtcttctttatgcttgatcag

SEQ ID NO: 457609 - DNA, 25 bp, Homo sapien
aaaagtgttctgctgtgtatatcaa

SEQ ID NO: 457610 - DNA, 25 bp, Homo sapien
gtgtatatcaactcagtagcccaca

SEQ ID NO: 457611 - DNA, 25 bp, Homo sapien
gtagcccacacccagttatctggga

SEQ ID NO: 457612 - DNA, 25 bp, Homo sapien
ggagctgatggttcagtcactgtat

SEQ ID NO: 457613 - DNA, 25 bp, Homo sapien
actgtattacccaaatctttcctgc

SEQ ID NO: 457614 - DNA, 25 bp, Homo sapien
gccagctgcctttcagacatttgtt

SEQ ID NO: 457615 - DNA, 25 bp, Homo sapien
ttgttaaatcccaaccagagaccgg

SEQ ID NO: 457616 - DNA, 25 bp, Homo sapien
ggccaggccagaaaagggtgggcct

SEQ ID NO: 457617 - DNA, 25 bp, Homo sapien
gccaggccagaaaagggtgggcctg

SEQ ID NO: 457618 - DNA, 25 bp, Homo sapien
ccaggccagaaaagggtgggcctgc

SEQ ID NO: 457619 - DNA, 25 bp, Homo sapien
tgggcctgcagcctgcaccccccac

SEQ ID NO: 457620 - DNA, 25 bp, Homo sapien
gggcctgcagcctgcaccccccacc

SEQ ID NO: 457621 - DNA, 25 bp, Homo sapien
ggcctgcagcctgcaccccccacct

SEQ ID NO: 457622 - DNA, 25 bp, Homo sapien
gcctgcagcctgcaccccccacctt

SEQ ID NO: 457623 - DNA, 25 bp, Homo sapien
cctgcagcctgcaccccccaccttc

SEQ ID NO: 457624 - DNA, 25 bp, Homo sapien
ctgcagcctgcaccccccaccttcc

SEQ ID NO: 457625 - DNA, 25 bp, Homo sapien
gactgtgcttcatatcatgtacctc

SEQ ID NO: 457626 - DNA, 25 bp, Homo sapien
atcatgtacctctctagtcaaagtg

SEQ ID NO: 457627 - DNA, 25 bp, Homo sapien
gtggtattacagacattcagtgaca

SEQ ID NO: 457628 - DNA, 25 bp, Homo sapien
tctaaatccttgatcctctgcaatg

SEQ ID NO: 457629 - DNA, 25 bp, Homo sapien
ttgatcctctgcaatgtgcttgaaa

SEQ ID NO: 457630 - DNA, 25 bp, Homo sapien
gtgcttgaaaacacaaaccttttgg

SEQ ID NO: 457631 - DNA, 25 bp, Homo sapien
ctgtgggtttggaatcttggatttt

SEQ ID NO: 457632 - DNA, 25 bp, Homo sapien
atgaactgtactggctgttgaccac

SEQ ID NO: 457633 - DNA, 25 bp, Homo sapien
gacacctgaccgcaaatatcttttc

SEQ ID NO: 457634 - DNA, 25 bp, Homo sapien
aatatcttttcttgtattcccatat

SEQ ID NO: 457635 - DNA, 25 bp, Homo sapien
gtattcccatatttctagacaatga

SEQ ID NO: 457636 - DNA, 25 bp, Homo sapien
ccttgaacgcaaagtggaatctttg

SEQ ID NO: 457637 - DNA, 25 bp, Homo sapien
gattcaggaacagcatgtccaaatc

SEQ ID NO: 457638 - DNA, 25 bp, Homo sapien
ggaacagcatgtccaaatcgatgtg

SEQ ID NO: 457639 - DNA, 25 bp, Homo sapien
cagcatgtccaaatcgatgtggatg

SEQ ID NO: 457640 - DNA, 25 bp, Homo sapien
gatgtggatgtttccaagcctgacc

SEQ ID NO: 457641 - DNA, 25 bp, Homo sapien
ggatgtttccaagcctgacctcacg

SEQ ID NO: 457642 - DNA, 25 bp, Homo sapien
tgccctgcgtgacgtacgtcagcaa

SEQ ID NO: 457643 - DNA, 25 bp, Homo sapien
gtgacgtacgtcagcaatatgaaag

SEQ ID NO: 457644 - DNA, 25 bp, Homo sapien
gaaagtgtggctgccaagaacctgc

SEQ ID NO: 457645 - DNA, 25 bp, Homo sapien
gtgtggctgccaagaacctgcagga

SEQ ID NO: 457646 - DNA, 25 bp, Homo sapien
agtttgctgacctctctgaggctgc

SEQ ID NO: 457647 - DNA, 25 bp, Homo sapien
atgacttgctaattttgtccaaagg

SEQ ID NO: 457648 - DNA, 25 bp, Homo sapien
taatgataattagggcattcttccc

SEQ ID NO: 457649 - DNA, 25 bp, Homo sapien
ggcattcttcccacacgaagatgac

SEQ ID NO: 457650 - DNA, 25 bp, Homo sapien
gaagatgacacaattgacccaatat

SEQ ID NO: 457651 - DNA, 25 bp, Homo sapien
gtttttccagtagtatgacagtgac

SEQ ID NO: 457652 - DNA, 25 bp, Homo sapien
tgacagtgacggtgtgtcaaccgca

SEQ ID NO: 457653 - DNA, 25 bp, Homo sapien
acggtgtgtcaaccgcaggacctca

SEQ ID NO: 457654 - DNA, 25 bp, Homo sapien
aggacctcacccacatttctttggg

SEQ ID NO: 457655 - DNA, 25 bp, Homo sapien
acatttctttgggacctaggagtgt

SEQ ID NO: 457656 - DNA, 25 bp, Homo sapien
aatagcagccagatttgaggtacaa

SEQ ID NO: 457657 - DNA, 25 bp, Homo sapien
tttgaggtacaaatcatggtgtcca

SEQ ID NO: 457658 - DNA, 25 bp, Homo sapien
atctgtgcttaactaaaccccactg

SEQ ID NO: 457659 - DNA, 25 bp, Homo sapien
tgtgcttaactaaaccccactgtct

SEQ ID NO: 457660 - DNA, 25 bp, Homo sapien
gtcaggttggccatccgcaggcgta

SEQ ID NO: 457661 - DNA, 25 bp, Homo sapien
tggccatccgcaggcgtagttgcta

SEQ ID NO: 457662 - DNA, 25 bp, Homo sapien
ccatccgcaggcgtagttgctagga

SEQ ID NO: 457663 - DNA, 25 bp, Homo sapien
atccgcaggcgtagttgctaggaag

SEQ ID NO: 457664 - DNA, 25 bp, Homo sapien
tgattcagacgttcccaggatttgg

SEQ ID NO: 457665 - DNA, 25 bp, Homo sapien
gattcagacgttcccaggatttgga

SEQ ID NO: 457666 - DNA, 25 bp, Homo sapien
tcagacgttcccaggatttggagca

SEQ ID NO: 457667 - DNA, 25 bp, Homo sapien
agacgttcccaggatttggagcaag

SEQ ID NO: 457668 - DNA, 25 bp, Homo sapien
gaagagcaaggaaggccaggcgcgg

SEQ ID NO: 457669 - DNA, 25 bp, Homo sapien
gggcagaaagatgatcattgttgaa

SEQ ID NO: 457670 - DNA, 25 bp, Homo sapien
gatcattgttgaagctggttgatga

SEQ ID NO: 457671 - DNA, 25 bp, Homo sapien
ctggttgatgagtctttagggagtt

SEQ ID NO: 457672 - DNA, 25 bp, Homo sapien
gatgagtctttagggagttcataga

SEQ ID NO: 457673 - DNA, 25 bp, Homo sapien
gagttcatagactattctgggttgt

SEQ ID NO: 457674 - DNA, 25 bp, Homo sapien
catagactattctgggttgtgtata

SEQ ID NO: 457675 - DNA, 25 bp, Homo sapien
actattctgggttgtgtatagtttc

SEQ ID NO: 457676 - DNA, 25 bp, Homo sapien
gagagaaagagagttggccagcaca

SEQ ID NO: 457677 - DNA, 25 bp, Homo sapien
agagagttggccagcacagtgcctc

SEQ ID NO: 457678 - DNA, 25 bp, Homo sapien
gagttggccagcacagtgcctcgtg

SEQ ID NO: 457679 - DNA, 25 bp, Homo sapien
gttggccagcacagtgcctcgtgcc

SEQ ID NO: 457680 - DNA, 25 bp, Homo sapien
gggccgcaggccaaggggtgcttgc

SEQ ID NO: 457681 - DNA, 25 bp, Homo sapien
cagatgcaaggcatcccggcgccct

SEQ ID NO: 457682 - DNA, 25 bp, Homo sapien
agatgcaaggcatcccggcgccctc

SEQ ID NO: 457683 - DNA, 25 bp, Homo sapien
gatgcaaggcatcccggcgccctcc

SEQ ID NO: 457684 - DNA, 25 bp, Homo sapien
caaggcatcccggcgccctcccagg

SEQ ID NO: 457685 - DNA, 25 bp, Homo sapien
cctcccaggcgctccaggagccggc

SEQ ID NO: 457686 - DNA, 25 bp, Homo sapien
gagccggcgccctggtctgcactcc

SEQ ID NO: 457687 - DNA, 25 bp, Homo sapien
agccggcgccctggtctgcactccc

SEQ ID NO: 457688 - DNA, 25 bp, Homo sapien
cggcgccctggtctgcactcccctg

SEQ ID NO: 457689 - DNA, 25 bp, Homo sapien
ctggtctgcactcccctgcggcctg

SEQ ID NO: 457690 - DNA, 25 bp, Homo sapien
gtctgcactcccctgcggcctgctg

SEQ ID NO: 457691 - DNA, 25 bp, Homo sapien
ttgtcatataccaatctcagcttcc

SEQ ID NO: 457692 - DNA, 25 bp, Homo sapien
gttggcgaagattatcctgtagctt

SEQ ID NO: 457693 - DNA, 25 bp, Homo sapien
tatcctgtagctttgttaaccggtc

SEQ ID NO: 457694 - DNA, 25 bp, Homo sapien
gtagctttgttaaccggtcttgata

SEQ ID NO: 457695 - DNA, 25 bp, Homo sapien
accggtcttgatatgttccagtgtg

SEQ ID NO: 457696 - DNA, 25 bp, Homo sapien
gtaagtgacaccatttggcagctgc

SEQ ID NO: 457697 - DNA, 25 bp, Homo sapien
ggaagatctccatggtgcggtacac

SEQ ID NO: 457698 - DNA, 25 bp, Homo sapien
tgcggtacacgatgtcctgcactgt

SEQ ID NO: 457699 - DNA, 25 bp, Homo sapien
atgcggcacagcgacgccgtgttga

SEQ ID NO: 457700 - DNA, 25 bp, Homo sapien
atggaataagttgctcgactggaat

SEQ ID NO: 457701 - DNA, 25 bp, Homo sapien
atcccaccacagttttcattgcatt

SEQ ID NO: 457702 - DNA, 25 bp, Homo sapien
agtagtagaacatctggtatcagaa

SEQ ID NO: 457703 - DNA, 25 bp, Homo sapien
acttgagtgtttttattgccatgtt

SEQ ID NO: 457704 - DNA, 25 bp, Homo sapien
ttgccatgttagcatatgaatctta

SEQ ID NO: 457705 - DNA, 25 bp, Homo sapien
gagtttcttgataagagagacctta

SEQ ID NO: 457706 - DNA, 25 bp, Homo sapien
gagagaccttagatttcttacgtaa

SEQ ID NO: 457707 - DNA, 25 bp, Homo sapien
gatttcttacgtaaagccatgttca

SEQ ID NO: 457708 - DNA, 25 bp, Homo sapien
cttacgtaaagccatgttcacaagg

SEQ ID NO: 457709 - DNA, 25 bp, Homo sapien
acaaggaccactgtccttgtgattc

SEQ ID NO: 457710 - DNA, 25 bp, Homo sapien
tgtccttgtgattctaatttgccag

SEQ ID NO: 457711 - DNA, 25 bp, Homo sapien
gatttctaagcagtgagagacttca

SEQ ID NO: 457712 - DNA, 25 bp, Homo sapien
agagacttcagtattttagattaga

SEQ ID NO: 457713 - DNA, 25 bp, Homo sapien
ccagtaggacccactcagcaggtag

SEQ ID NO: 457714 - DNA, 25 bp, Homo sapien
gtaggacccactcagcaggtagcag

SEQ ID NO: 457715 - DNA, 25 bp, Homo sapien
aggacccactcagcaggtagcagtg

SEQ ID NO: 457716 - DNA, 25 bp, Homo sapien
actcagcaggtagcagtggagacag

SEQ ID NO: 457717 - DNA, 25 bp, Homo sapien
agcagtggagacagaggccgcctgg

SEQ ID NO: 457718 - DNA, 25 bp, Homo sapien
catgctggctggacaggagctgtcc

SEQ ID NO: 457719 - DNA, 25 bp, Homo sapien
ctggctggacaggagctgtccactc

SEQ ID NO: 457720 - DNA, 25 bp, Homo sapien
ggacaggagctgtccactccccaaa

SEQ ID NO: 457721 - DNA, 25 bp, Homo sapien
tgccaggccccttcagatggaggag

SEQ ID NO: 457722 - DNA, 25 bp, Homo sapien
ggctgtgacagccaggtggcccgcg

SEQ ID NO: 457723 - DNA, 25 bp, Homo sapien
tctccacaggtgaaccactcaccga

SEQ ID NO: 457724 - DNA, 25 bp, Homo sapien
aggcttcatgctgagtcccatcact

SEQ ID NO: 457725 - DNA, 25 bp, Homo sapien
tgagtcccatcacttcctaagaaac

SEQ ID NO: 457726 - DNA, 25 bp, Homo sapien
acttcctaagaaacctgctggcaga

SEQ ID NO: 457727 - DNA, 25 bp, Homo sapien
tgcatgtccctcaccttattggtgt

SEQ ID NO: 457728 - DNA, 25 bp, Homo sapien
ttattggtgtctcacagccactctg

SEQ ID NO: 457729 - DNA, 25 bp, Homo sapien
cagccactctggtcacagatgaaga

SEQ ID NO: 457730 - DNA, 25 bp, Homo sapien
agaagcaactcaagtggcagctgga

SEQ ID NO: 457731 - DNA, 25 bp, Homo sapien
aagtggcagctggaccgtgacagca

SEQ ID NO: 457732 - DNA, 25 bp, Homo sapien
ccgtgacagcaccatgaggagctga

SEQ ID NO: 457733 - DNA, 25 bp, Homo sapien
ggcaatttgcaaaacctttctgagc

SEQ ID NO: 457734 - DNA, 25 bp, Homo sapien
aatgatgcttcgtgggattgtcgta

SEQ ID NO: 457735 - DNA, 25 bp, Homo sapien
cagttcattgttttaagggattggg

SEQ ID NO: 457736 - DNA, 25 bp, Homo sapien
ggacacaaaccttttatacaataca

SEQ ID NO: 457737 - DNA, 25 bp, Homo sapien
ttatacaatacaaagctttgctttt

SEQ ID NO: 457738 - DNA, 25 bp, Homo sapien
tgaatggctgaagacccctctgccg

SEQ ID NO: 457739 - DNA, 25 bp, Homo sapien
gaatggctgaagacccctctgccga

SEQ ID NO: 457740 - DNA, 25 bp, Homo sapien
aatggctgaagacccctctgccgag

SEQ ID NO: 457741 - DNA, 25 bp, Homo sapien
gctgaagacccctctgccgagggag

SEQ ID NO: 457742 - DNA, 25 bp, Homo sapien
gaagacccctctgccgagggaggtt

SEQ ID NO: 457743 - DNA, 25 bp, Homo sapien
ggcagatgcagttttctgtgggctt

SEQ ID NO: 457744 - DNA, 25 bp, Homo sapien
gcagatgcagttttctgtgggcttg

SEQ ID NO: 457745 - DNA, 25 bp, Homo sapien
cagatgcagttttctgtgggcttgg

SEQ ID NO: 457746 - DNA, 25 bp, Homo sapien
gaactctagtgctttgcatagccct

SEQ ID NO: 457747 - DNA, 25 bp, Homo sapien
tttgcatagccctggtttagaaaca

SEQ ID NO: 457748 - DNA, 25 bp, Homo sapien
gaagaaccagcaatcattccactgt

SEQ ID NO: 457749 - DNA, 25 bp, Homo sapien
cccttcccaactgaagtggtatgag

SEQ ID NO: 457750 - DNA, 25 bp, Homo sapien
gtggtatgaggctagctctttccaa

SEQ ID NO: 457751 - DNA, 25 bp, Homo sapien
ggctagctctttccaaaagcattca

SEQ ID NO: 457752 - DNA, 25 bp, Homo sapien
caagtttggcttctgatgtgactca

SEQ ID NO: 457753 - DNA, 25 bp, Homo sapien
gtgactcagaatttaggaaccagat

SEQ ID NO: 457754 - DNA, 25 bp, Homo sapien
gatgctagatcaaataagctctgaa

SEQ ID NO: 457755 - DNA, 25 bp, Homo sapien
gttaagcatctcttaagtgccatga

SEQ ID NO: 457756 - DNA, 25 bp, Homo sapien
aagtgccatgatgagcataacagcc

SEQ ID NO: 457757 - DNA, 25 bp, Homo sapien
ttttctgctgataacaacaatctac

SEQ ID NO: 457758 - DNA, 25 bp, Homo sapien
aacaatctacatattcaatttcgaa

SEQ ID NO: 457759 - DNA, 25 bp, Homo sapien
aaatacacataattcaccacccgga

SEQ ID NO: 457760 - DNA, 25 bp, Homo sapien
cataattcaccacccggagacgact

SEQ ID NO: 457761 - DNA, 25 bp, Homo sapien
ggagacgactgctcaacctgatgtc

SEQ ID NO: 457762 - DNA, 25 bp, Homo sapien
gactgctcaacctgatgtcgttaca

SEQ ID NO: 457763 - DNA, 25 bp, Homo sapien
caacctgatgtcgttacagtttttt

SEQ ID NO: 457764 - DNA, 25 bp, Homo sapien
gaattttatctgtagagtcacatct

SEQ ID NO: 457765 - DNA, 25 bp, Homo sapien
gtcacatctaggcaaatgcgtgctt

SEQ ID NO: 457766 - DNA, 25 bp, Homo sapien
tgcgtgcttgacaaaggcgcccaat

SEQ ID NO: 457767 - DNA, 25 bp, Homo sapien
gacaaaggcgcccaataaattactt

SEQ ID NO: 457768 - DNA, 25 bp, Homo sapien
atctgagcaattttgaactcaaaag

SEQ ID NO: 457769 - DNA, 25 bp, Homo sapien
cattgttttaaggattgccacagga

SEQ ID NO: 457770 - DNA, 25 bp, Homo sapien
aaggattgccacaggactctttaat

SEQ ID NO: 457771 - DNA, 25 bp, Homo sapien
gccacaggactctttaatggttttt

SEQ ID NO: 457772 - DNA, 25 bp, Homo sapien
gtttttaatggacatacatgcctaa

SEQ ID NO: 457773 - DNA, 25 bp, Homo sapien
gacatacatgcctaatatttattgg

SEQ ID NO: 457774 - DNA, 25 bp, Homo sapien
gagtgttatgtcttaagcgcattag

SEQ ID NO: 457775 - DNA, 25 bp, Homo sapien
aagcgcattagaaaacaattgtttg

SEQ ID NO: 457776 - DNA, 25 bp, Homo sapien
tccctggacagtttgatgtgcttat

SEQ ID NO: 457777 - DNA, 25 bp, Homo sapien
gatgtgcttatggttgagatttata

SEQ ID NO: 457778 - DNA, 25 bp, Homo sapien
tgagatttataatctgcttgtactt

SEQ ID NO: 457779 - DNA, 25 bp, Homo sapien
aggcagccactgacttatggagagg

SEQ ID NO: 457780 - DNA, 25 bp, Homo sapien
cactgacttatggagagggcttcac

SEQ ID NO: 457781 - DNA, 25 bp, Homo sapien
gagagggcttcacagcacatactct

SEQ ID NO: 457782 - DNA, 25 bp, Homo sapien
atactctctcaactcaacctaaagc

SEQ ID NO: 457783 - DNA, 25 bp, Homo sapien
aactcaacctaaagccaggagtgat

SEQ ID NO: 457784 - DNA, 25 bp, Homo sapien
aggagtgatgagtacttttctcctc

SEQ ID NO: 457785 - DNA, 25 bp, Homo sapien
agtcactgccacctaccaatatagt

SEQ ID NO: 457786 - DNA, 25 bp, Homo sapien
caatatagtggaaccatctttctaa

SEQ ID NO: 457787 - DNA, 25 bp, Homo sapien
catctttctaaatcttgcatttctt

SEQ ID NO: 457788 - DNA, 25 bp, Homo sapien
ttttttctgaaatcctaggaccgca

SEQ ID NO: 457789 - DNA, 25 bp, Homo sapien
tgaaatcctaggaccgcaatcagcc

SEQ ID NO: 457790 - DNA, 25 bp, Homo sapien
agactcctcgagtggcgtccatcca

SEQ ID NO: 457791 - DNA, 25 bp, Homo sapien
aggacacaaagcctggcgtgaaaag

SEQ ID NO: 457792 - DNA, 25 bp, Homo sapien
gaaaaggactgtcacgcacaggaca

SEQ ID NO: 457793 - DNA, 25 bp, Homo sapien
gtcacgcacaggacaaacagtggtg

SEQ ID NO: 457794 - DNA, 25 bp, Homo sapien
acagtggtggtggagacgggcccca

SEQ ID NO: 457795 - DNA, 25 bp, Homo sapien
ccacatcagctccaaggtcagggtg

SEQ ID NO: 457796 - DNA, 25 bp, Homo sapien
gttgacaagttttatgagagcctct

SEQ ID NO: 457797 - DNA, 25 bp, Homo sapien
gagagcctctttgagtctgtgtatc

SEQ ID NO: 457798 - DNA, 25 bp, Homo sapien
gcctctttgagtctgtgtatcacat

SEQ ID NO: 457799 - DNA, 25 bp, Homo sapien
gtgtatcacatagaatgtcctcatt

SEQ ID NO: 457800 - DNA, 25 bp, Homo sapien
atgtcctcatttgcagagaatgttt

SEQ ID NO: 457801 - DNA, 25 bp, Homo sapien
ccagcatggtttgttctaatgcttc

SEQ ID NO: 457802 - DNA, 25 bp, Homo sapien
tctaatgcttcttgttggcagctgc

SEQ ID NO: 457803 - DNA, 25 bp, Homo sapien
agctgccacctgtccggcgattctg

SEQ ID NO: 457804 - DNA, 25 bp, Homo sapien
cacactcttggagcctcggctgaag

SEQ ID NO: 457805 - DNA, 25 bp, Homo sapien
actcttggagcctcggctgaagtgg

SEQ ID NO: 457806 - DNA, 25 bp, Homo sapien
gagcctcggctgaagtggctgggca

SEQ ID NO: 457807 - DNA, 25 bp, Homo sapien
gtggctgggcatgacgccgtttctc

SEQ ID NO: 457808 - DNA, 25 bp, Homo sapien
gggcatgacgccgtttctctgacgt

SEQ ID NO: 457809 - DNA, 25 bp, Homo sapien
gcatgacgccgtttctctgacgtcc

SEQ ID NO: 457810 - DNA, 25 bp, Homo sapien
tctgacgtcccccatagatcttggt

SEQ ID NO: 457811 - DNA, 25 bp, Homo sapien
gtcccccatagatcttggtcatgga

SEQ ID NO: 457812 - DNA, 25 bp, Homo sapien
actgctgaatgtttgtatgtgtaag

SEQ ID NO: 457813 - DNA, 25 bp, Homo sapien
atgtgtaagatatttccaaagattc

SEQ ID NO: 457814 - DNA, 25 bp, Homo sapien
aaaagtgtactttctggatctaatt

SEQ ID NO: 457815 - DNA, 25 bp, Homo sapien
gtactttctggatctaattgtgctt

SEQ ID NO: 457816 - DNA, 25 bp, Homo sapien
ttctggatctaattgtgctttttct

SEQ ID NO: 457817 - DNA, 25 bp, Homo sapien
ttttggtgtcctgttaaaatctgga

SEQ ID NO: 457818 - DNA, 25 bp, Homo sapien
ggtgtcctgttaaaatctggaatcc

SEQ ID NO: 457819 - DNA, 25 bp, Homo sapien
atgcccagccaacctctaatgtttc

SEQ ID NO: 457820 - DNA, 25 bp, Homo sapien
agccaacctctaatgtttctttcct

SEQ ID NO: 457821 - DNA, 25 bp, Homo sapien
aatgtttctttcctggccctttcat

SEQ ID NO: 457822 - DNA, 25 bp, Homo sapien
tgtttctttcctggccctttcatgc

SEQ ID NO: 457823 - DNA, 25 bp, Homo sapien
tcatcctaatttctaccaacttcac

SEQ ID NO: 457824 - DNA, 25 bp, Homo sapien
atttctaccaacttcactgggcaac

SEQ ID NO: 457825 - DNA, 25 bp, Homo sapien
tctaccaacttcactgggcaacaat

SEQ ID NO: 457826 - DNA, 25 bp, Homo sapien
gggcaacaatcaatcgttttatttc

SEQ ID NO: 457827 - DNA, 25 bp, Homo sapien
aatcaatcgttttatttccctcaat

SEQ ID NO: 457828 - DNA, 25 bp, Homo sapien
cgttttatttccctcaatgactctt

SEQ ID NO: 457829 - DNA, 25 bp, Homo sapien
atttccctcaatgactcttgttatc

SEQ ID NO: 457830 - DNA, 25 bp, Homo sapien
gactcttgttatcttcagacctgaa

SEQ ID NO: 457831 - DNA, 25 bp, Homo sapien
agacctgaaactgattcggagacca

SEQ ID NO: 457832 - DNA, 25 bp, Homo sapien
cctaatcagagtaacatgtgttcat

SEQ ID NO: 457833 - DNA, 25 bp, Homo sapien
catagttcatcctaatttctaccaa

SEQ ID NO: 457834 - DNA, 25 bp, Homo sapien
ttattcatacgtaaaattttggatt

SEQ ID NO: 457835 - DNA, 25 bp, Homo sapien
taacatagcattaaggtggacagcc

SEQ ID NO: 457836 - DNA, 25 bp, Homo sapien
catagcattaaggtggacagccaaa

SEQ ID NO: 457837 - DNA, 25 bp, Homo sapien
gcattaaggtggacagccaaacaga

SEQ ID NO: 457838 - DNA, 25 bp, Homo sapien
gtctttcatcacgttctcacacatt

SEQ ID NO: 457839 - DNA, 25 bp, Homo sapien
tttcatcacgttctcacacattgcg

SEQ ID NO: 457840 - DNA, 25 bp, Homo sapien
tcatcacgttctcacacattgcgaa

SEQ ID NO: 457841 - DNA, 25 bp, Homo sapien
cacgttctcacacattgcgaacaac

SEQ ID NO: 457842 - DNA, 25 bp, Homo sapien
ttctcacacattgcgaacaacatgt

SEQ ID NO: 457843 - DNA, 25 bp, Homo sapien
acacattgcgaacaacatgttggga

SEQ ID NO: 457844 - DNA, 25 bp, Homo sapien
attgcgaacaacatgttgggatggg

SEQ ID NO: 457845 - DNA, 25 bp, Homo sapien
ttctgttctttcagcgactatgaca

SEQ ID NO: 457846 - DNA, 25 bp, Homo sapien
gttctttcagcgactatgacatcgt

SEQ ID NO: 457847 - DNA, 25 bp, Homo sapien
tttcagcgactatgacatcgtcatt

SEQ ID NO: 457848 - DNA, 25 bp, Homo sapien
tatgacatcgtcattctggaggtct

SEQ ID NO: 457849 - DNA, 25 bp, Homo sapien
gacatcgtcattctggaggtctgcc

SEQ ID NO: 457850 - DNA, 25 bp, Homo sapien
atcgtcattctggaggtctgcccag

SEQ ID NO: 457851 - DNA, 25 bp, Homo sapien
gtcattctggaggtctgcccagaaa

SEQ ID NO: 457852 - DNA, 25 bp, Homo sapien
ttctggaggtctgcccagaaaccaa

SEQ ID NO: 457853 - DNA, 25 bp, Homo sapien
ggagggccagctccgaccaaagacc

SEQ ID NO: 457854 - DNA, 25 bp, Homo sapien
gggccagctccgaccaaagacctat

SEQ ID NO: 457855 - DNA, 25 bp, Homo sapien
aaagggcagaccagcggcagtgtct

SEQ ID NO: 457856 - DNA, 25 bp, Homo sapien
acagggtacactgagcgctacatgg

SEQ ID NO: 457857 - DNA, 25 bp, Homo sapien
agcgctacatggacgtccctgagaa

SEQ ID NO: 457858 - DNA, 25 bp, Homo sapien
tccctgagaacaaccagcacggcta

SEQ ID NO: 457859 - DNA, 25 bp, Homo sapien
ccagcacggctatgaggcgggttcc

SEQ ID NO: 457860 - DNA, 25 bp, Homo sapien
ttcctggacgaaaacgtgcactttt

SEQ ID NO: 457861 - DNA, 25 bp, Homo sapien
acgtgcactttttccacacaaactt

SEQ ID NO: 457862 - DNA, 25 bp, Homo sapien
ctcccaactgatccgagcagggaaa

SEQ ID NO: 457863 - DNA, 25 bp, Homo sapien
agcagggaaaccttaccagctccag

SEQ ID NO: 457864 - DNA, 25 bp, Homo sapien
agatctaccccaacgagagacacag

SEQ ID NO: 457865 - DNA, 25 bp, Homo sapien
agagacacagtattcgctgccccga

SEQ ID NO: 457866 - DNA, 25 bp, Homo sapien
agtcgggcgagcactatgaagtcac

SEQ ID NO: 457867 - DNA, 25 bp, Homo sapien
tccgcgggatgctgcattgttaccc

SEQ ID NO: 457868 - DNA, 25 bp, Homo sapien
ttaggcttcctgttttatctcgtgt

SEQ ID NO: 457869 - DNA, 25 bp, Homo sapien
ctgttttatctcgtgtgtgtggtgc

SEQ ID NO: 457870 - DNA, 25 bp, Homo sapien
ttatctcgtgtgtgtggtgcaccag

SEQ ID NO: 457871 - DNA, 25 bp, Homo sapien
tggtgcaccagctatgaggttgtct

SEQ ID NO: 457872 - DNA, 25 bp, Homo sapien
gaggttgtctgtaacccaagccatc

SEQ ID NO: 457873 - DNA, 25 bp, Homo sapien
acccaagccatcaaagggcctgtac

SEQ ID NO: 457874 - DNA, 25 bp, Homo sapien
gggcctgtacatacctaggagccat

SEQ ID NO: 457875 - DNA, 25 bp, Homo sapien
tacctaggagccatgagttgtcccg

SEQ ID NO: 457876 - DNA, 25 bp, Homo sapien
ctaggagccatgagttgtcccggcc

SEQ ID NO: 457877 - DNA, 25 bp, Homo sapien
ttgagtgtgcacatcttgagaaata

SEQ ID NO: 457878 - DNA, 25 bp, Homo sapien
atttacagttattttgtgaatggcc

SEQ ID NO: 457879 - DNA, 25 bp, Homo sapien
aactatgatttgatctatatacaac

SEQ ID NO: 457880 - DNA, 25 bp, Homo sapien
gatttgatctatatacaacttttca

SEQ ID NO: 457881 - DNA, 25 bp, Homo sapien
ttgatctatatacaacttttcagaa

SEQ ID NO: 457882 - DNA, 25 bp, Homo sapien
tcagaatacttttgattgtgtgttg

SEQ ID NO: 457883 - DNA, 25 bp, Homo sapien
gaatacttttgattgtgtgttggac

SEQ ID NO: 457884 - DNA, 25 bp, Homo sapien
tacttttgattgtgtgttggacata

SEQ ID NO: 457885 - DNA, 25 bp, Homo sapien
ttttgattgtgtgttggacatatct

SEQ ID NO: 457886 - DNA, 25 bp, Homo sapien
ttatctggcagaattaaacctaaat

SEQ ID NO: 457887 - DNA, 25 bp, Homo sapien
aaacaaatatgagcatttactaatt

SEQ ID NO: 457888 - DNA, 25 bp, Homo sapien
tatttacactctaaaattaaaggtg

SEQ ID NO: 457889 - DNA, 25 bp, Homo sapien
caaagtaacaagagattcctaagaa

SEQ ID NO: 457890 - DNA, 25 bp, Homo sapien
tcctaagaaacgcaaatccttgagt

SEQ ID NO: 457891 - DNA, 25 bp, Homo sapien
aatccttgagtttcacgcacttcat

SEQ ID NO: 457892 - DNA, 25 bp, Homo sapien
gagtttcacgcacttcatgttcaac

SEQ ID NO: 457893 - DNA, 25 bp, Homo sapien
acttcatgttcaaccatttgctgta

SEQ ID NO: 457894 - DNA, 25 bp, Homo sapien
aaccatttgctgtaatccagaggca

SEQ ID NO: 457895 - DNA, 25 bp, Homo sapien
tttgctgtaatccagaggcagcctg

SEQ ID NO: 457896 - DNA, 25 bp, Homo sapien
gtgaatcattctcatgccctgtttt

SEQ ID NO: 457897 - DNA, 25 bp, Homo sapien
gaatcattctcatgccctgtttttt

SEQ ID NO: 457898 - DNA, 25 bp, Homo sapien
taatgttctgggtttaaaagccatc

SEQ ID NO: 457899 - DNA, 25 bp, Homo sapien
aaatgtacttgctgaattcaatcat

SEQ ID NO: 457900 - DNA, 25 bp, Homo sapien
atgttcagggaaactcctcagtcct

SEQ ID NO: 457901 - DNA, 25 bp, Homo sapien
gtcctgggcaaaactaagactggtt

SEQ ID NO: 457902 - DNA, 25 bp, Homo sapien
aagactggttatcctacttcaggga

SEQ ID NO: 457903 - DNA, 25 bp, Homo sapien
ctacttcagggaagcaccatcctac

SEQ ID NO: 457904 - DNA, 25 bp, Homo sapien
agggaagcaccatcctacctcaggg

SEQ ID NO: 457905 - DNA, 25 bp, Homo sapien
gggtacagcccaggatgatcttcac

SEQ ID NO: 457906 - DNA, 25 bp, Homo sapien
aggatgatcttcacttctgctggcc

SEQ ID NO: 457907 - DNA, 25 bp, Homo sapien
ttcacttctgctggccttgtttctt

SEQ ID NO: 457908 - DNA, 25 bp, Homo sapien
ctctagtgtgaggagattcccgcaa

SEQ ID NO: 457909 - DNA, 25 bp, Homo sapien
gattcccgcaaggttgatggtttca

SEQ ID NO: 457910 - DNA, 25 bp, Homo sapien
aggttgatggtttcaactcctgatc

SEQ ID NO: 457911 - DNA, 25 bp, Homo sapien
aaagctacaggataatcttcgccaa

SEQ ID NO: 457912 - DNA, 25 bp, Homo sapien
gataatcttcgccaactttcagttc

SEQ ID NO: 457913 - DNA, 25 bp, Homo sapien
actttcagttctcttcaggaagctg

SEQ ID NO: 457914 - DNA, 25 bp, Homo sapien
aggaagctgagattggtatatgaca

SEQ ID NO: 457915 - DNA, 25 bp, Homo sapien
aatgcaatgaaaactgtggtgggat

SEQ ID NO: 457916 - DNA, 25 bp, Homo sapien
cattccagtcgagcaacttattcca

SEQ ID NO: 457917 - DNA, 25 bp, Homo sapien
gtcgagcaacttattccatatgtgg

SEQ ID NO: 457918 - DNA, 25 bp, Homo sapien
aaagaatgatgatcgggctggccca

SEQ ID NO: 457919 - DNA, 25 bp, Homo sapien
gcccacctcgttttgctagtgaaga

SEQ ID NO: 457920 - DNA, 25 bp, Homo sapien
caacagctgaaacaaattatggatc

SEQ ID NO: 457921 - DNA, 25 bp, Homo sapien
atcaattacgaaatctcatctggga

SEQ ID NO: 457922 - DNA, 25 bp, Homo sapien
agatttataagagcactgtgacctg

SEQ ID NO: 457923 - DNA, 25 bp, Homo sapien
gaccaaggacaaagtttcaccacct

SEQ ID NO: 457924 - DNA, 25 bp, Homo sapien
gacaaagtttcaccacctccttgga

SEQ ID NO: 457925 - DNA, 25 bp, Homo sapien
gtgatcactggccacttcttgacct

SEQ ID NO: 457926 - DNA, 25 bp, Homo sapien
cttcctctcatgtaaaaggagcctg

SEQ ID NO: 457927 - DNA, 25 bp, Homo sapien
ggagcctgaaatttgtattgactta

SEQ ID NO: 457928 - DNA, 25 bp, Homo sapien
gacttaaaaatggttcttcaggaca

SEQ ID NO: 457929 - DNA, 25 bp, Homo sapien
aatggttcttcaggacactactctt

SEQ ID NO: 457930 - DNA, 25 bp, Homo sapien
caggacactactcttccattttctt

SEQ ID NO: 457931 - DNA, 25 bp, Homo sapien
cattttcttgatttgctggctctct

SEQ ID NO: 457932 - DNA, 25 bp, Homo sapien
tgatttgctggctctctgaataaaa

SEQ ID NO: 457933 - DNA, 25 bp, Homo sapien
atttcaataccttaattcagtgcac

SEQ ID NO: 457934 - DNA, 25 bp, Homo sapien
taattcagtgcacataatactaatg

SEQ ID NO: 457935 - DNA, 25 bp, Homo sapien
aatactaatgtaacagcagatgaaa

SEQ ID NO: 457936 - DNA, 25 bp, Homo sapien
cctggccatggttggagagggaatg

SEQ ID NO: 457937 - DNA, 25 bp, Homo sapien
ggatcaaggagcctagattctctcc

SEQ ID NO: 457938 - DNA, 25 bp, Homo sapien
aggagcctagattctctccctggat

SEQ ID NO: 457939 - DNA, 25 bp, Homo sapien
tcactaacttgctgcgtgacctgaa

SEQ ID NO: 457940 - DNA, 25 bp, Homo sapien
aacttgctgcgtgacctgaacacgt

SEQ ID NO: 457941 - DNA, 25 bp, Homo sapien
tgcgtgacctgaacacgtcacttta

SEQ ID NO: 457942 - DNA, 25 bp, Homo sapien
gaacacgtcactttacctctctgtg

SEQ ID NO: 457943 - DNA, 25 bp, Homo sapien
ctcagttttcccatgcatgaaaaat

SEQ ID NO: 457944 - DNA, 25 bp, Homo sapien
gtctgctcaggatcatgttttgtag

SEQ ID NO: 457945 - DNA, 25 bp, Homo sapien
aggatcatgttttgtagcacctcct

SEQ ID NO: 457946 - DNA, 25 bp, Homo sapien
gtggagggatgttcccctgagccag

SEQ ID NO: 457947 - DNA, 25 bp, Homo sapien
gtggctgctacaggagcacagtagt

SEQ ID NO: 457948 - DNA, 25 bp, Homo sapien
cacagtagtgaaggcctgagctcca

SEQ ID NO: 457949 - DNA, 25 bp, Homo sapien
tgagctccaggtttgaaagacccaa

SEQ ID NO: 457950 - DNA, 25 bp, Homo sapien
tttgaaagacccaactggagcgtgg

SEQ ID NO: 457951 - DNA, 25 bp, Homo sapien
gttagtgaaaggacacttccagggt

SEQ ID NO: 457952 - DNA, 25 bp, Homo sapien
aggacacttccagggttaggacaga

SEQ ID NO: 457953 - DNA, 25 bp, Homo sapien
gttaggacagagcatttagccttct

SEQ ID NO: 457954 - DNA, 25 bp, Homo sapien
tttagccttctggaagaacccctgc

SEQ ID NO: 457955 - DNA, 25 bp, Homo sapien
cctcatcaacattggcctgctgctc

SEQ ID NO: 457956 - DNA, 25 bp, Homo sapien
aaagacctatcacaccagcctcaag

SEQ ID NO: 457957 - DNA, 25 bp, Homo sapien
tatcacaccagcctcaaggtggcat

SEQ ID NO: 457958 - DNA, 25 bp, Homo sapien
gcctcaaggtggcatgggacctcaa

SEQ ID NO: 457959 - DNA, 25 bp, Homo sapien
gggacctcaacacagggatcttcga

SEQ ID NO: 457960 - DNA, 25 bp, Homo sapien
cagggatcttcgagacagtcagtgt

SEQ ID NO: 457961 - DNA, 25 bp, Homo sapien
tcagtgtaggcgacctgactgaggt

SEQ ID NO: 457962 - DNA, 25 bp, Homo sapien
ctgactgaggtcaaagggcagacca

SEQ ID NO: 457963 - DNA, 25 bp, Homo sapien
cagcggcagtgtctggagctcctac

SEQ ID NO: 457964 - DNA, 25 bp, Homo sapien
gtgtctggagctcctaccgcaagag

SEQ ID NO: 457965 - DNA, 25 bp, Homo sapien
cctaccgcaagagctgcgtggacat

SEQ ID NO: 457966 - DNA, 25 bp, Homo sapien
gcaagggtgctgatgtaggactcaa

SEQ ID NO: 457967 - DNA, 25 bp, Homo sapien
gtgctgatgtaggactcaagtgact

SEQ ID NO: 457968 - DNA, 25 bp, Homo sapien
tcaagtgactaccagtccctgttac

SEQ ID NO: 457969 - DNA, 25 bp, Homo sapien
accagtccctgttaccagctgtgtg

SEQ ID NO: 457970 - DNA, 25 bp, Homo sapien
gggcaagtctgccagcgtcacttag

SEQ ID NO: 457971 - DNA, 25 bp, Homo sapien
gtctgccagcgtcacttagcctcag

SEQ ID NO: 457972 - DNA, 25 bp, Homo sapien
gaaatggtagcgttttgtccctgtc

SEQ ID NO: 457973 - DNA, 25 bp, Homo sapien
gtagcgttttgtccctgtcttcaca

SEQ ID NO: 457974 - DNA, 25 bp, Homo sapien
gtccctgtcttcacactatcatagg

SEQ ID NO: 457975 - DNA, 25 bp, Homo sapien
gtcttcacactatcatagggagaat

SEQ ID NO: 457976 - DNA, 25 bp, Homo sapien
gggagaatcaaaagagctaacaaat

SEQ ID NO: 457977 - DNA, 25 bp, Homo sapien
ggtggcacagcctgggcccgctcaa

SEQ ID NO: 457978 - DNA, 25 bp, Homo sapien
gggccgcaggccaaggggtgcttgc

SEQ ID NO: 457979 - DNA, 25 bp, Homo sapien
gggtgcttgcgccacccacgtccca

SEQ ID NO: 457980 - DNA, 25 bp, Homo sapien
gtgggaaccccaagccggggcagct

SEQ ID NO: 457981 - DNA, 25 bp, Homo sapien
cagatgcaaggcatcccggcgccct

SEQ ID NO: 457982 - DNA, 25 bp, Homo sapien
agatgcaaggcatcccggcgccctc

SEQ ID NO: 457983 - DNA, 25 bp, Homo sapien
gatgcaaggcatcccggcgccctcc

SEQ ID NO: 457984 - DNA, 25 bp, Homo sapien
cctcccaggcgctccaggagccggc

SEQ ID NO: 457985 - DNA, 25 bp, Homo sapien
gagccggcgccctggtctgcactcc

SEQ ID NO: 457986 - DNA, 25 bp, Homo sapien
ctggtctgcactcccctgcggcctg

SEQ ID NO: 457987 - DNA, 25 bp, Homo sapien
gtctgcactcccctgcggcctgctg

SEQ ID NO: 457988 - DNA, 25 bp, Homo sapien
ccatttttgtctccactctaactct

SEQ ID NO: 457989 - DNA, 25 bp, Homo sapien
atttttgtctccactctaactctcc

SEQ ID NO: 457990 - DNA, 25 bp, Homo sapien
taactctcccactagttgtcccagt

SEQ ID NO: 457991 - DNA, 25 bp, Homo sapien
ttcctccttcttggttctgtgtctc

SEQ ID NO: 457992 - DNA, 25 bp, Homo sapien
tggttctgtgtctcccacagacaca

SEQ ID NO: 457993 - DNA, 25 bp, Homo sapien
acaatttccctctctagctaagtct

SEQ ID NO: 457994 - DNA, 25 bp, Homo sapien
tgtcctctgttcctctgccgctgtt

SEQ ID NO: 457995 - DNA, 25 bp, Homo sapien
tagctaagtctctcacctctgcgtc

SEQ ID NO: 457996 - DNA, 25 bp, Homo sapien
atgacccccgatctcttctggtctg

SEQ ID NO: 457997 - DNA, 25 bp, Homo sapien
ttctggtctggctctgtagacctct

SEQ ID NO: 457998 - DNA, 25 bp, Homo sapien
gtctggctctgtagacctctgtctc

SEQ ID NO: 457999 - DNA, 25 bp, Homo sapien
caccagggaaccacgtcttggagtg

SEQ ID NO: 458000 - DNA, 25 bp, Homo sapien
cacgtcttggagtggtccactgtag

SEQ ID NO: 458001 - DNA, 25 bp, Homo sapien
tccactgtaggccatgcgcttcatc

SEQ ID NO: 458002 - DNA, 25 bp, Homo sapien
cttgcccgggagcttctagatagaa

SEQ ID NO: 458003 - DNA, 25 bp, Homo sapien
atcagaaagagattcaaggagccaa

SEQ ID NO: 458004 - DNA, 25 bp, Homo sapien
aggagccaaatgagcggtcagcccc

SEQ ID NO: 458005 - DNA, 25 bp, Homo sapien
ccactggctcctggttggaacgaaa

SEQ ID NO: 458006 - DNA, 25 bp, Homo sapien
gaacgaaagggtctctggttgcact

SEQ ID NO: 458007 - DNA, 25 bp, Homo sapien
aagggtctctggttgcactgaatgc

SEQ ID NO: 458008 - DNA, 25 bp, Homo sapien
gaatgcagctctcaaactggtcttg

SEQ ID NO: 458009 - DNA, 25 bp, Homo sapien
aaactggtcttgtacttgctgaata

SEQ ID NO: 458010 - DNA, 25 bp, Homo sapien
cggtgatctggccattataccctgc

SEQ ID NO: 458011 - DNA, 25 bp, Homo sapien
ggattatgctgtctatcgaaacatt

SEQ ID NO: 458012 - DNA, 25 bp, Homo sapien
gctgtctatcgaaacattgccaatg

SEQ ID NO: 458013 - DNA, 25 bp, Homo sapien
cgaaacattgccaatgagaccagta

SEQ ID NO: 458014 - DNA, 25 bp, Homo sapien
tgttatgttggagctcatcagcctg

SEQ ID NO: 458015 - DNA, 25 bp, Homo sapien
tatgttggagctcatcagcctgagt

SEQ ID NO: 458016 - DNA, 25 bp, Homo sapien
gtgtcattagaaaaggagactgttt

SEQ ID NO: 458017 - DNA, 25 bp, Homo sapien
gagactgtttgatgcccttcaacca

SEQ ID NO: 458018 - DNA, 25 bp, Homo sapien
ctgtttgatgcccttcaaccacagc

SEQ ID NO: 458019 - DNA, 25 bp, Homo sapien
tggggtcccgtctgtattgcacaga

SEQ ID NO: 458020 - DNA, 25 bp, Homo sapien
gaatcaaaccaaacggatccaccat

SEQ ID NO: 458021 - DNA, 25 bp, Homo sapien
cattttcttgttcgcggctaaatga

SEQ ID NO: 458022 - DNA, 25 bp, Homo sapien
ttcgcggctaaatgacagtttctgt

SEQ ID NO: 458023 - DNA, 25 bp, Homo sapien
gtttctgtcattacttagattccga

SEQ ID NO: 458024 - DNA, 25 bp, Homo sapien
tagattccgatctttcccaaaggtg

SEQ ID NO: 458025 - DNA, 25 bp, Homo sapien
ttacaaagaggccagctaatagcag

SEQ ID NO: 458026 - DNA, 25 bp, Homo sapien
agctaatagcagaaatcatgaccct

SEQ ID NO: 458027 - DNA, 25 bp, Homo sapien
aattcaagctgtgagccaggcagga

SEQ ID NO: 458028 - DNA, 25 bp, Homo sapien
cagtatggcaaaggttcttgagaat

SEQ ID NO: 458029 - DNA, 25 bp, Homo sapien
tcttgagaatcagccatttggtaca

SEQ ID NO: 458030 - DNA, 25 bp, Homo sapien
agcttttatgttataccatggagcc

SEQ ID NO: 458031 - DNA, 25 bp, Homo sapien
aaaggctatggattgtttaagaact

SEQ ID NO: 458032 - DNA, 25 bp, Homo sapien
acattttcctactctgtgctcatca

SEQ ID NO: 458033 - DNA, 25 bp, Homo sapien
attttcctactctgtgctcatcaaa

SEQ ID NO: 458034 - DNA, 25 bp, Homo sapien
tcctactctgtgctcatcaaacata

SEQ ID NO: 458035 - DNA, 25 bp, Homo sapien
gtgctcatcaaacatattacaggat

SEQ ID NO: 458036 - DNA, 25 bp, Homo sapien
aaaacacagactaataagacctgat

SEQ ID NO: 458037 - DNA, 25 bp, Homo sapien
taagacctgataagttggacaaaat

SEQ ID NO: 458038 - DNA, 25 bp, Homo sapien
gaatctatattcactgtcattaatg

SEQ ID NO: 458039 - DNA, 25 bp, Homo sapien
gtcattaatgtcaaacctttacctt

SEQ ID NO: 458040 - DNA, 25 bp, Homo sapien
atgtcaaacctttaccttatggtat

SEQ ID NO: 458041 - DNA, 25 bp, Homo sapien
accttatggtatattgtactttgag

SEQ ID NO: 458042 - DNA, 25 bp, Homo sapien
actttgagaaattatggccaggcat

SEQ ID NO: 458043 - DNA, 25 bp, Homo sapien
gagggtgacactgggccactcttct

SEQ ID NO: 458044 - DNA, 25 bp, Homo sapien
actcttctgctacttcttggagctg

SEQ ID NO: 458045 - DNA, 25 bp, Homo sapien
tgctacttcttggagctgagttgga

SEQ ID NO: 458046 - DNA, 25 bp, Homo sapien
gttggaggcaaaagaccagccccag

SEQ ID NO: 458047 - DNA, 25 bp, Homo sapien
ggtgatgacagttctagatgcctcc

SEQ ID NO: 458048 - DNA, 25 bp, Homo sapien
tgacagttctagatgcctccagcct

SEQ ID NO: 458049 - DNA, 25 bp, Homo sapien
tgggctgggctcacatgactcagga

SEQ ID NO: 458050 - DNA, 25 bp, Homo sapien
gctcacatgactcaggagcctggct

SEQ ID NO: 458051 - DNA, 25 bp, Homo sapien
gactcaggagcctggctccaccaag

SEQ ID NO: 458052 - DNA, 25 bp, Homo sapien
caaaagcctgacaatggcattgaat

SEQ ID NO: 458053 - DNA, 25 bp, Homo sapien
gcattgaataagaggctgttccacc

SEQ ID NO: 458054 - DNA, 25 bp, Homo sapien
ccccataactatttttcgtgtgaag

SEQ ID NO: 458055 - DNA, 25 bp, Homo sapien
gaaggaagtaactgacctcttgagt

SEQ ID NO: 458056 - DNA, 25 bp, Homo sapien
gtaactgacctcttgagtcagagat

SEQ ID NO: 458057 - DNA, 25 bp, Homo sapien
gacctcttgagtcagagatggcact

SEQ ID NO: 458058 - DNA, 25 bp, Homo sapien
cagagatggcactcgagtttttccc

SEQ ID NO: 458059 - DNA, 25 bp, Homo sapien
gagtttttccccatgggtcttgcct

SEQ ID NO: 458060 - DNA, 25 bp, Homo sapien
cctcaccgccacatacattgaaaaa

SEQ ID NO: 458061 - DNA, 25 bp, Homo sapien
atgggtcttgcctgctacactcctg

SEQ ID NO: 458062 - DNA, 25 bp, Homo sapien
tgaccaaatggaccacactggccag

SEQ ID NO: 458063 - DNA, 25 bp, Homo sapien
tggccagcctgacaaacccaccaga

SEQ ID NO: 458064 - DNA, 25 bp, Homo sapien
ccactaaaggcatattgtaaacttt

SEQ ID NO: 458065 - DNA, 25 bp, Homo sapien
tcaaggtccgtcatgatcatttcaa

SEQ ID NO: 458066 - DNA, 25 bp, Homo sapien
atgatcatttcaatctcgtcggcct

SEQ ID NO: 458067 - DNA, 25 bp, Homo sapien
atttcaatctcgtcggcctttgcag

SEQ ID NO: 458068 - DNA, 25 bp, Homo sapien
cttcatcgtatttggttttcaggtc

SEQ ID NO: 458069 - DNA, 25 bp, Homo sapien
ttcgagttttttccagggctgtttg

SEQ ID NO: 458070 - DNA, 25 bp, Homo sapien
agggctgtttgtaggctctgaacct

SEQ ID NO: 458071 - DNA, 25 bp, Homo sapien
aggctctgaaccttgtgctcatgtt

SEQ ID NO: 458072 - DNA, 25 bp, Homo sapien
aggaatgctcgtccccagagtttca

SEQ ID NO: 458073 - DNA, 25 bp, Homo sapien
gagtttcacatgactcgttctctcg

SEQ ID NO: 458074 - DNA, 25 bp, Homo sapien
ttggttttcctgcataaacttgccc

SEQ ID NO: 458075 - DNA, 25 bp, Homo sapien
ttgccccctgcatggaagtgtatta

SEQ ID NO: 458076 - DNA, 25 bp, Homo sapien
ttccctttctcggttctcttctctc

SEQ ID NO: 458077 - DNA, 25 bp, Homo sapien
ttgtgggacaaggtcccttggtgct

SEQ ID NO: 458078 - DNA, 25 bp, Homo sapien
acaaggtcccttggtgctgatggcc

SEQ ID NO: 458079 - DNA, 25 bp, Homo sapien
aaggtcccttggtgctgatggcctg

SEQ ID NO: 458080 - DNA, 25 bp, Homo sapien
gtcccttggtgctgatggcctgaag

SEQ ID NO: 458081 - DNA, 25 bp, Homo sapien
tcccttggtgctgatggcctgaagg

SEQ ID NO: 458082 - DNA, 25 bp, Homo sapien
gggaacctctcacgttgctgtgtcc

SEQ ID NO: 458083 - DNA, 25 bp, Homo sapien
aacctctcacgttgctgtgtcctgg

SEQ ID NO: 458084 - DNA, 25 bp, Homo sapien
cctctcacgttgctgtgtcctggtg

SEQ ID NO: 458085 - DNA, 25 bp, Homo sapien
gctgtgtcctggtgagcagcccgac

SEQ ID NO: 458086 - DNA, 25 bp, Homo sapien
cagcccgaccaataaacctgctttt

SEQ ID NO: 458087 - DNA, 25 bp, Homo sapien
acagcgcggcacctgtacctccggg

SEQ ID NO: 458088 - DNA, 25 bp, Homo sapien
gggttggctccatgaccaagatcta

SEQ ID NO: 458089 - DNA, 25 bp, Homo sapien
ggttggctccatgaccaagatctat

SEQ ID NO: 458090 - DNA, 25 bp, Homo sapien
gttggctccatgaccaagatctatg

SEQ ID NO: 458091 - DNA, 25 bp, Homo sapien
ttggctccatgaccaagatctatgg

SEQ ID NO: 458092 - DNA, 25 bp, Homo sapien
tggctccatgaccaagatctatggg

SEQ ID NO: 458093 - DNA, 25 bp, Homo sapien
aaaaggaccaagatggcggccgcaa

SEQ ID NO: 458094 - DNA, 25 bp, Homo sapien
agatggcggccgcaaactgacacct

SEQ ID NO: 458095 - DNA, 25 bp, Homo sapien
ggccgcaaactgacacctcagggac

SEQ ID NO: 458096 - DNA, 25 bp, Homo sapien
actgacacctcagggacaaagagat

SEQ ID NO: 458097 - DNA, 25 bp, Homo sapien
cagaatcgccggacaggtggcagct

SEQ ID NO: 458098 - DNA, 25 bp, Homo sapien
cccaccagggtccagggagatgttc

SEQ ID NO: 458099 - DNA, 25 bp, Homo sapien
cagggtccagggagatgttcgttct

SEQ ID NO: 458100 - DNA, 25 bp, Homo sapien
cagggagatgttcgttctcgcttta

SEQ ID NO: 458101 - DNA, 25 bp, Homo sapien
agatgttcgttctcgctttaagtca

SEQ ID NO: 458102 - DNA, 25 bp, Homo sapien
tgttcgttctcgctttaagtcagga

SEQ ID NO: 458103 - DNA, 25 bp, Homo sapien
ctcgctttaagtcaggagtcacaaa

SEQ ID NO: 458104 - DNA, 25 bp, Homo sapien
gtcaggagtcacaaatgactttttt

SEQ ID NO: 458105 - DNA, 25 bp, Homo sapien
agctccatctctacctttaacatca

SEQ ID NO: 458106 - DNA, 25 bp, Homo sapien
cacgctgctgctaacgacagtatga

SEQ ID NO: 458107 - DNA, 25 bp, Homo sapien
gacagtatgatgcttactctgctac

SEQ ID NO: 458108 - DNA, 25 bp, Homo sapien
gtaattaatgtatgctttcttgttt

SEQ ID NO: 458109 - DNA, 25 bp, Homo sapien
ggaactgagaatggcatgatacgca

SEQ ID NO: 458110 - DNA, 25 bp, Homo sapien
tcggtaataccctttgtcctgaaat

SEQ ID NO: 458111 - DNA, 25 bp, Homo sapien
ccctttgtcctgaaatctactttat

SEQ ID NO: 458112 - DNA, 25 bp, Homo sapien
atctgacatttctatagccagtcca

SEQ ID NO: 458113 - DNA, 25 bp, Homo sapien
tagccagtccagttttcatggtatt

SEQ ID NO: 458114 - DNA, 25 bp, Homo sapien
ggtattgtgtggtatgtacatcttt

SEQ ID NO: 458115 - DNA, 25 bp, Homo sapien
gtacatctttttccatctgtttact

SEQ ID NO: 458116 - DNA, 25 bp, Homo sapien
aagagtgactcttttatcattatga

SEQ ID NO: 458117 - DNA, 25 bp, Homo sapien
tgatacgcagattcaaaaggccatt

SEQ ID NO: 458118 - DNA, 25 bp, Homo sapien
ttactggcaaactgcaaatgcacgc

SEQ ID NO: 458119 - DNA, 25 bp, Homo sapien
attgcgtgactcttttatcattagg

SEQ ID NO: 458120 - DNA, 25 bp, Homo sapien
gcagctaatcctcaaactctgactt

SEQ ID NO: 458121 - DNA, 25 bp, Homo sapien
atttataacatctctttcaaagcct

SEQ ID NO: 458122 - DNA, 25 bp, Homo sapien
agcctccacctttgattaaacacca

SEQ ID NO: 458123 - DNA, 25 bp, Homo sapien
ggtttagtaggcaagataccagaac

SEQ ID NO: 458124 - DNA, 25 bp, Homo sapien
tcagattgcatctcactcagtaaca

SEQ ID NO: 458125 - DNA, 25 bp, Homo sapien
tcactcagtaacaaccttcagaaat

SEQ ID NO: 458126 - DNA, 25 bp, Homo sapien
tcagaaatgattgtaggagtcctac

SEQ ID NO: 458127 - DNA, 25 bp, Homo sapien
ttcttctacaaatacactccgcagt

SEQ ID NO: 458128 - DNA, 25 bp, Homo sapien
aatacactccgcagtatgcctgcat

SEQ ID NO: 458129 - DNA, 25 bp, Homo sapien
gtatgcctgcattacatagagcacc

SEQ ID NO: 458130 - DNA, 25 bp, Homo sapien
acatagagcaccagtatttcaccca

SEQ ID NO: 458131 - DNA, 25 bp, Homo sapien
ttatagggttttgggctgctgagaa

SEQ ID NO: 458132 - DNA, 25 bp, Homo sapien
aggtgcaaatcatgactaaagactt

SEQ ID NO: 458133 - DNA, 25 bp, Homo sapien
ttctttcttcttttgcatatagtag

SEQ ID NO: 458134 - DNA, 25 bp, Homo sapien
tgagggtcgtggctaaaaccccaca

SEQ ID NO: 458135 - DNA, 25 bp, Homo sapien
ttacattcctagctttacagtcttg

SEQ ID NO: 458136 - DNA, 25 bp, Homo sapien
acagtcttgctgtgaattctctggt

SEQ ID NO: 458137 - DNA, 25 bp, Homo sapien
gaattctctggtgttcattaaagtg

SEQ ID NO: 458138 - DNA, 25 bp, Homo sapien
gtgagctgtgttaaaaggcattctt

SEQ ID NO: 458139 - DNA, 25 bp, Homo sapien
ggcattcttagattcattttaacca

SEQ ID NO: 458140 - DNA, 25 bp, Homo sapien
aaactcacagttggttaacatgatg

SEQ ID NO: 458141 - DNA, 25 bp, Homo sapien
tgatggtttcagattgcttgcctct

SEQ ID NO: 458142 - DNA, 25 bp, Homo sapien
gggaaggccgtcttagaccatagag

SEQ ID NO: 458143 - DNA, 25 bp, Homo sapien
agcccagccccttgatgttacagag

SEQ ID NO: 458144 - DNA, 25 bp, Homo sapien
cagaagacagatgcccaaacaggag

SEQ ID NO: 458145 - DNA, 25 bp, Homo sapien
gagaaggcacttgcccacggtcata

SEQ ID NO: 458146 - DNA, 25 bp, Homo sapien
gtcatacggcaggttgccacaaaac

SEQ ID NO: 458147 - DNA, 25 bp, Homo sapien
acaaaaccaagatggcagcccttcc

SEQ ID NO: 458148 - DNA, 25 bp, Homo sapien
agggagccccataaaacccacatca

SEQ ID NO: 458149 - DNA, 25 bp, Homo sapien
acccacatcatgtcttaagagtata

SEQ ID NO: 458150 - DNA, 25 bp, Homo sapien
gtatatctggctccttgaccagcaa

SEQ ID NO: 458151 - DNA, 25 bp, Homo sapien
agcaatcggccctgggagccaccag

SEQ ID NO: 458152 - DNA, 25 bp, Homo sapien
gagccaccaggtgggaaaagcgcct

SEQ ID NO: 458153 - DNA, 25 bp, Homo sapien
ggcacctgtacctccggggtggcgc

SEQ ID NO: 458154 - DNA, 25 bp, Homo sapien
acctgtacctccggggtggcgctgg

SEQ ID NO: 458155 - DNA, 25 bp, Homo sapien
tccggggtggcgctggggttggctc

SEQ ID NO: 458156 - DNA, 25 bp, Homo sapien
gggttggctccatgaccaagatcta

SEQ ID NO: 458157 - DNA, 25 bp, Homo sapien
ggttggctccatgaccaagatctat

SEQ ID NO: 458158 - DNA, 25 bp, Homo sapien
gttggctccatgaccaagatctatg

SEQ ID NO: 458159 - DNA, 25 bp, Homo sapien
ttggctccatgaccaagatctatgg

SEQ ID NO: 458160 - DNA, 25 bp, Homo sapien
tggctccatgaccaagatctatggg

SEQ ID NO: 458161 - DNA, 25 bp, Homo sapien
ggctccatgaccaagatctatgggg

SEQ ID NO: 458162 - DNA, 25 bp, Homo sapien
gctccatgaccaagatctatggggg

SEQ ID NO: 458163 - DNA, 25 bp, Homo sapien
ctccatgaccaagatctatggggga

SEQ ID NO: 458164 - DNA, 25 bp, Homo sapien
gggaaggaaaagatgaatagccttt

SEQ ID NO: 458165 - DNA, 25 bp, Homo sapien
cgcccttggtttttgatagaattct

SEQ ID NO: 458166 - DNA, 25 bp, Homo sapien
gcccttggtttttgatagaattcta

SEQ ID NO: 458167 - DNA, 25 bp, Homo sapien
tggtttttgatagaattctagagaa

SEQ ID NO: 458168 - DNA, 25 bp, Homo sapien
gaattctagagaaggggtgagccct

SEQ ID NO: 458169 - DNA, 25 bp, Homo sapien
gggtgagcccttttgtctgcctgga

SEQ ID NO: 458170 - DNA, 25 bp, Homo sapien
gtgagcccttttgtctgcctggaca

SEQ ID NO: 458171 - DNA, 25 bp, Homo sapien
tgagcccttttgtctgcctggacac

SEQ ID NO: 458172 - DNA, 25 bp, Homo sapien
gagcccttttgtctgcctggacaca

SEQ ID NO: 458173 - DNA, 25 bp, Homo sapien
agcccttttgtctgcctggacacat

SEQ ID NO: 458174 - DNA, 25 bp, Homo sapien
ccttttgtctgcctggacacatcct

SEQ ID NO: 458175 - DNA, 25 bp, Homo sapien
tgagctcttctcagtggggtcccct

SEQ ID NO: 458176 - DNA, 25 bp, Homo sapien
ctttgatgttctcccccaagttggg

SEQ ID NO: 458177 - DNA, 25 bp, Homo sapien
ccaagttgggcagcctagaggtgtt

SEQ ID NO: 458178 - DNA, 25 bp, Homo sapien
gcagcctagaggtgttgggaaccct

SEQ ID NO: 458179 - DNA, 25 bp, Homo sapien
tgtttccttccgttgcccaggacac

SEQ ID NO: 458180 - DNA, 25 bp, Homo sapien
aggaaccctggcctcaccaaaacag

SEQ ID NO: 458181 - DNA, 25 bp, Homo sapien
caaaacagcagcagctcgttggctc

SEQ ID NO: 458182 - DNA, 25 bp, Homo sapien
aacagcagcagctcgttggctccaa

SEQ ID NO: 458183 - DNA, 25 bp, Homo sapien
agcagcagctcgttggctccaaaac

SEQ ID NO: 458184 - DNA, 25 bp, Homo sapien
agctcgttggctccaaaaccaggga

SEQ ID NO: 458185 - DNA, 25 bp, Homo sapien
aaaccagggagcagaccatgccctc

SEQ ID NO: 458186 - DNA, 25 bp, Homo sapien
gaactattattcttcagagggagaa

SEQ ID NO: 458187 - DNA, 25 bp, Homo sapien
gagtccaaaggtagtgtgtacatct

SEQ ID NO: 458188 - DNA, 25 bp, Homo sapien
taaacctcctatctatcttcagcat

SEQ ID NO: 458189 - DNA, 25 bp, Homo sapien
tcagcatcaaggtcacagtcgaact

SEQ ID NO: 458190 - DNA, 25 bp, Homo sapien
acagtcgaactgttattggaattga

SEQ ID NO: 458191 - DNA, 25 bp, Homo sapien
aaaaccgaacattatgcttactaat

SEQ ID NO: 458192 - DNA, 25 bp, Homo sapien
gcttactaatacttgatcctggatg

SEQ ID NO: 458193 - DNA, 25 bp, Homo sapien
gatcctggatgtccttctcgagaaa

SEQ ID NO: 458194 - DNA, 25 bp, Homo sapien
atgtccttctcgagaaatgcagaaa

SEQ ID NO: 458195 - DNA, 25 bp, Homo sapien
gctagcagtctcaagcaacttcgga

SEQ ID NO: 458196 - DNA, 25 bp, Homo sapien
gcaacttcggaaatctatgggaaat

SEQ ID NO: 458197 - DNA, 25 bp, Homo sapien
ttgggtccctcacacagagacacca

SEQ ID NO: 458198 - DNA, 25 bp, Homo sapien
tgggtccctcacacagagacaccat

SEQ ID NO: 458199 - DNA, 25 bp, Homo sapien
caccatcagccggagtggtataatc

SEQ ID NO: 458200 - DNA, 25 bp, Homo sapien
tcagccggagtggtataatcttacg

SEQ ID NO: 458201 - DNA, 25 bp, Homo sapien
tggtataatcttacggagtccccgg

SEQ ID NO: 458202 - DNA, 25 bp, Homo sapien
tataatcttacggagtccccggcca

SEQ ID NO: 458203 - DNA, 25 bp, Homo sapien
gccagactttcggcctagggaacct

SEQ ID NO: 458204 - DNA, 25 bp, Homo sapien
atttcacagtttaaagagacccagg

SEQ ID NO: 458205 - DNA, 25 bp, Homo sapien
ttcacagtttaaagagacccaggcc

SEQ ID NO: 458206 - DNA, 25 bp, Homo sapien
agagacccaggccaccttttgctag

SEQ ID NO: 458207 - DNA, 25 bp, Homo sapien
agacccaggccaccttttgctaggg

SEQ ID NO: 458208 - DNA, 25 bp, Homo sapien
gccaagagtggcatgaagacatttg

SEQ ID NO: 458209 - DNA, 25 bp, Homo sapien
gacatttgcaagttcttgtatcctg

SEQ ID NO: 458210 - DNA, 25 bp, Homo sapien
caagttcttgtatcctgaagagagt

SEQ ID NO: 458211 - DNA, 25 bp, Homo sapien
aaagttcagtttggatggcagcaag

SEQ ID NO: 458212 - DNA, 25 bp, Homo sapien
gtttggatggcagcaagatgaaatc

SEQ ID NO: 458213 - DNA, 25 bp, Homo sapien
aaatcagctattacacctgctgtac

SEQ ID NO: 458214 - DNA, 25 bp, Homo sapien
tattacacctgctgtacacacactt

SEQ ID NO: 458215 - DNA, 25 bp, Homo sapien
ttcctcatcactgcagccattgtga

SEQ ID NO: 458216 - DNA, 25 bp, Homo sapien
aaggtggattcctctagttggtttg

SEQ ID NO: 458217 - DNA, 25 bp, Homo sapien
gttggtttgtaattgttctttgaag

SEQ ID NO: 458218 - DNA, 25 bp, Homo sapien
gaaggctgtttatgactagattttt

SEQ ID NO: 458219 - DNA, 25 bp, Homo sapien
gacctttatcctcctgagccatgaa

SEQ ID NO: 458220 - DNA, 25 bp, Homo sapien
gagccatgaatgtccctcaggagtg

SEQ ID NO: 458221 - DNA, 25 bp, Homo sapien
gaatgtccctcaggagtgtctaaag

SEQ ID NO: 458222 - DNA, 25 bp, Homo sapien
agtggaaacgcacgtggcctctaaa

SEQ ID NO: 458223 - DNA, 25 bp, Homo sapien
gggacccctataggccttaggagct

SEQ ID NO: 458224 - DNA, 25 bp, Homo sapien
ggccaattagtggtcagtaaaacgc

SEQ ID NO: 458225 - DNA, 25 bp, Homo sapien
cagtaaaacgcagaggtgaacacca

SEQ ID NO: 458226 - DNA, 25 bp, Homo sapien
ggtgaacaccatagaaccacaggtc

SEQ ID NO: 458227 - DNA, 25 bp, Homo sapien
gtggcctctaaagagtgggtcccaa

SEQ ID NO: 458228 - DNA, 25 bp, Homo sapien
gtgggtcccaaggtcatgaaggcct

SEQ ID NO: 458229 - DNA, 25 bp, Homo sapien
tctccttccaggctggaatggcgga

SEQ ID NO: 458230 - DNA, 25 bp, Homo sapien
ctgtggttttaattactcatggtga

SEQ ID NO: 458231 - DNA, 25 bp, Homo sapien
attactcatggtgaactgtggtcta

SEQ ID NO: 458232 - DNA, 25 bp, Homo sapien
actcatggtgaactgtggtctaaaa

SEQ ID NO: 458233 - DNA, 25 bp, Homo sapien
ggtgaactgtggtctaaaaatacta

SEQ ID NO: 458234 - DNA, 25 bp, Homo sapien
ctgtggtctaaaaatactaaagtgg

SEQ ID NO: 458235 - DNA, 25 bp, Homo sapien
atttgaatacaatagtcccctctta

SEQ ID NO: 458236 - DNA, 25 bp, Homo sapien
tgaatacaatagtcccctcttatcc

SEQ ID NO: 458237 - DNA, 25 bp, Homo sapien
aatagtcccctcttatcctgtcttg

SEQ ID NO: 458238 - DNA, 25 bp, Homo sapien
ctcttatcctgtcttgctttctgtg

SEQ ID NO: 458239 - DNA, 25 bp, Homo sapien
ttatcctgtcttgctttctgtggtt

SEQ ID NO: 458240 - DNA, 25 bp, Homo sapien
tcctgtcttgctttctgtggtttta

SEQ ID NO: 458241 - DNA, 25 bp, Homo sapien
agctgccacctgtccggcgattctg

SEQ ID NO: 458242 - DNA, 25 bp, Homo sapien
ccacactcttggagcctcggctgaa

SEQ ID NO: 458243 - DNA, 25 bp, Homo sapien
cacactcttggagcctcggctgaag

SEQ ID NO: 458244 - DNA, 25 bp, Homo sapien
actcttggagcctcggctgaagtgg

SEQ ID NO: 458245 - DNA, 25 bp, Homo sapien
gagcctcggctgaagtggctgggca

SEQ ID NO: 458246 - DNA, 25 bp, Homo sapien
gtggctgggcatgacgccgtttctc

SEQ ID NO: 458247 - DNA, 25 bp, Homo sapien
tggctgggcatgacgccgtttctct

SEQ ID NO: 458248 - DNA, 25 bp, Homo sapien
gggcatgacgccgtttctctgacgt

SEQ ID NO: 458249 - DNA, 25 bp, Homo sapien
gcatgacgccgtttctctgacgtcc

SEQ ID NO: 458250 - DNA, 25 bp, Homo sapien
tctgacgtcccccatagatcttggt

SEQ ID NO: 458251 - DNA, 25 bp, Homo sapien
gtcccccatagatcttggtcatgga

SEQ ID NO: 458252 - DNA, 25 bp, Homo sapien
agatggctgcctgctgctcggcttt

SEQ ID NO: 458253 - DNA, 25 bp, Homo sapien
tttcccaccgtgttttcatctttgt

SEQ ID NO: 458254 - DNA, 25 bp, Homo sapien
atctttgttcacttgaggctttccc

SEQ ID NO: 458255 - DNA, 25 bp, Homo sapien
tccccagctggtgtgtgcaggacag

SEQ ID NO: 458256 - DNA, 25 bp, Homo sapien
gttcatggtaatgttgccctctgag

SEQ ID NO: 458257 - DNA, 25 bp, Homo sapien
ctgaggccccgtacaccagaaggga

SEQ ID NO: 458258 - DNA, 25 bp, Homo sapien
ggaggccctggaaaattttgtgctt

SEQ ID NO: 458259 - DNA, 25 bp, Homo sapien
aaattttgtgcttccaacgtggcct

SEQ ID NO: 458260 - DNA, 25 bp, Homo sapien
ccaacgtggccttcaattcttgctt

SEQ ID NO: 458261 - DNA, 25 bp, Homo sapien
ctgttgttgaattgtactctgcccc

SEQ ID NO: 458262 - DNA, 25 bp, Homo sapien
tgaattgtactctgcccctggaagc

SEQ ID NO: 458263 - DNA, 25 bp, Homo sapien
aagggttcagaagaagttagcatca

SEQ ID NO: 458264 - DNA, 25 bp, Homo sapien
gggttcagaagaagttagcatcaac

SEQ ID NO: 458265 - DNA, 25 bp, Homo sapien
gaagaagttagcatcaactgtatga

SEQ ID NO: 458266 - DNA, 25 bp, Homo sapien
agaagttagcatcaactgtatgaaa

SEQ ID NO: 458267 - DNA, 25 bp, Homo sapien
ctgtatgaaaattctaggtaaagct

SEQ ID NO: 458268 - DNA, 25 bp, Homo sapien
aattctaggtaaagctaagtactat

SEQ ID NO: 458269 - DNA, 25 bp, Homo sapien
aaagctaagtactattgagttggaa

SEQ ID NO: 458270 - DNA, 25 bp, Homo sapien
gctaagtactattgagttggaaaaa

SEQ ID NO: 458271 - DNA, 25 bp, Homo sapien
agtaattctatcatgtttgcttgtt

SEQ ID NO: 458272 - DNA, 25 bp, Homo sapien
gtaattctatcatgtttgcttgttt

SEQ ID NO: 458273 - DNA, 25 bp, Homo sapien
attctatcatgtttgcttgttttcc

SEQ ID NO: 458274 - DNA, 25 bp, Homo sapien
gattcacaccagaaacactaggtgt

SEQ ID NO: 458275 - DNA, 25 bp, Homo sapien
aacactaggtgttcatatccatagc

SEQ ID NO: 458276 - DNA, 25 bp, Homo sapien
taggtgttcatatccatagcatgga

SEQ ID NO: 458277 - DNA, 25 bp, Homo sapien
gagaagcttcttcctacctggtact

SEQ ID NO: 458278 - DNA, 25 bp, Homo sapien
ccccagacaggcgttagcattcagt

SEQ ID NO: 458279 - DNA, 25 bp, Homo sapien
agacaggcgttagcattcagtgtgg

SEQ ID NO: 458280 - DNA, 25 bp, Homo sapien
tgaagcctggctgggtcatcagatg

SEQ ID NO: 458281 - DNA, 25 bp, Homo sapien
gggcagcctgtgacgggcaccagcg

SEQ ID NO: 458282 - DNA, 25 bp, Homo sapien
gcaccagcggcctgattccagggaa

SEQ ID NO: 458283 - DNA, 25 bp, Homo sapien
cggcctgattccagggaagagttcc

SEQ ID NO: 458284 - DNA, 25 bp, Homo sapien
ggctgtttttgttagctcagttttt

SEQ ID NO: 458285 - DNA, 25 bp, Homo sapien
atctttgtgttcatgatccggacgc

SEQ ID NO: 458286 - DNA, 25 bp, Homo sapien
tctttgtgttcatgatccggacgct

SEQ ID NO: 458287 - DNA, 25 bp, Homo sapien
ctttgtgttcatgatccggacgctg

SEQ ID NO: 458288 - DNA, 25 bp, Homo sapien
tttgtgttcatgatccggacgctgc

SEQ ID NO: 458289 - DNA, 25 bp, Homo sapien
ttgtgttcatgatccggacgctgcg

SEQ ID NO: 458290 - DNA, 25 bp, Homo sapien
gttcatgatccggacgctgcggctg

SEQ ID NO: 458291 - DNA, 25 bp, Homo sapien
tcatgatccggacgctgcggctgaa

SEQ ID NO: 458292 - DNA, 25 bp, Homo sapien
tgatccggacgctgcggctgaagat

SEQ ID NO: 458293 - DNA, 25 bp, Homo sapien
gatccggacgctgcggctgaagatc

SEQ ID NO: 458294 - DNA, 25 bp, Homo sapien
gacgctgcggctgaagatcttggca

SEQ ID NO: 458295 - DNA, 25 bp, Homo sapien
cgctgcggctgaagatcttggcaga

SEQ ID NO: 458296 - DNA, 25 bp, Homo sapien
agtccgccgacgtgcgccgggcaca

SEQ ID NO: 458297 - DNA, 25 bp, Homo sapien
acgtgcgccgggcacaggagcagca

SEQ ID NO: 458298 - DNA, 25 bp, Homo sapien
gagggcccgggcttcagtgcgagcg

SEQ ID NO: 458299 - DNA, 25 bp, Homo sapien
gggcccgggcttcagtgcgagcgcg

SEQ ID NO: 458300 - DNA, 25 bp, Homo sapien
ccgggcttcagtgcgagcgcggcga

SEQ ID NO: 458301 - DNA, 25 bp, Homo sapien
gggcttcagtgcgagcgcggcgagc

SEQ ID NO: 458302 - DNA, 25 bp, Homo sapien
gcttcagtgcgagcgcggcgagcgc

SEQ ID NO: 458303 - DNA, 25 bp, Homo sapien
tgcgagcgcggcgagcgcaacggcg

SEQ ID NO: 458304 - DNA, 25 bp, Homo sapien
gggaggcgagggatccggcggcggc

SEQ ID NO: 458305 - DNA, 25 bp, Homo sapien
gaggcgagggatccggcggcggcgg

SEQ ID NO: 458306 - DNA, 25 bp, Homo sapien
catcccgggcgaggagggcgcggcg

SEQ ID NO: 458307 - DNA, 25 bp, Homo sapien
gtgtgtcaggtaagactcattcttc

SEQ ID NO: 458308 - DNA, 25 bp, Homo sapien
agactcattcttcacccttgagaaa

SEQ ID NO: 458309 - DNA, 25 bp, Homo sapien
acccttgagaaatctcctttctgag

SEQ ID NO: 458310 - DNA, 25 bp, Homo sapien
tgtctgccaaacttgaaccacagtc

SEQ ID NO: 458311 - DNA, 25 bp, Homo sapien
cagatgttgaacgttcagtgtgatt

SEQ ID NO: 458312 - DNA, 25 bp, Homo sapien
gtgtgattgatatgtttcccctcat

SEQ ID NO: 458313 - DNA, 25 bp, Homo sapien
ttaaccattggaacagcgtaccctg

SEQ ID NO: 458314 - DNA, 25 bp, Homo sapien
gaacagcgtaccctgtaagtaacat

SEQ ID NO: 458315 - DNA, 25 bp, Homo sapien
atctgtggaattattgtgggtggtc

SEQ ID NO: 458316 - DNA, 25 bp, Homo sapien
aaccacagtcatgtctaagcactag

SEQ ID NO: 458317 - DNA, 25 bp, Homo sapien
agacttgagcttgttcattatctaa

SEQ ID NO: 458318 - DNA, 25 bp, Homo sapien
gatagctcagtactttgcctcataa

SEQ ID NO: 458319 - DNA, 25 bp, Homo sapien
tgtggaaaacacactagaattcacc

SEQ ID NO: 458320 - DNA, 25 bp, Homo sapien
acagacagatcctgaggccccatgc

SEQ ID NO: 458321 - DNA, 25 bp, Homo sapien
gaaaaatgtcttaaggcaagtgcaa

SEQ ID NO: 458322 - DNA, 25 bp, Homo sapien
tagttgcatgcagggtgttaggaaa

SEQ ID NO: 458323 - DNA, 25 bp, Homo sapien
acaaaataggctggcactctagtga

SEQ ID NO: 458324 - DNA, 25 bp, Homo sapien
atgctcaggtggtgaggccaatatc

SEQ ID NO: 458325 - DNA, 25 bp, Homo sapien
gaggccaatatcaggcactgtcttt

SEQ ID NO: 458326 - DNA, 25 bp, Homo sapien
aggcactgtctttctccccttataa

SEQ ID NO: 458327 - DNA, 25 bp, Homo sapien
tataaccaccaaacacatgctgctt

SEQ ID NO: 458328 - DNA, 25 bp, Homo sapien
acatgctgcttcctgatagctcagt

SEQ ID NO: 458329 - DNA, 25 bp, Homo sapien
gcaggcgggcatcggcggcaccagt

SEQ ID NO: 458330 - DNA, 25 bp, Homo sapien
gcatcggcggcaccagtggctggag

SEQ ID NO: 458331 - DNA, 25 bp, Homo sapien
cccaggtggaggtagccagtgccaa

SEQ ID NO: 458332 - DNA, 25 bp, Homo sapien
gccaaggagttccagatcgtgtttg

SEQ ID NO: 458333 - DNA, 25 bp, Homo sapien
aaggagttccagatcgtgtttgaag

SEQ ID NO: 458334 - DNA, 25 bp, Homo sapien
atcgtgtttgaagccactctgggcg

SEQ ID NO: 458335 - DNA, 25 bp, Homo sapien
gtgtttgaagccactctgggcggcc

SEQ ID NO: 458336 - DNA, 25 bp, Homo sapien
cctggatgacgtggagtatctggct

SEQ ID NO: 458337 - DNA, 25 bp, Homo sapien
ggaacacagccgcacccgggtctgt

SEQ ID NO: 458338 - DNA, 25 bp, Homo sapien
tggcagtgccctcctattgctcatg

SEQ ID NO: 458339 - DNA, 25 bp, Homo sapien
tcctattgctcatgctcctggtgct

SEQ ID NO: 458340 - DNA, 25 bp, Homo sapien
gaaggaagtaactgacctcttgagt

SEQ ID NO: 458341 - DNA, 25 bp, Homo sapien
gtaactgacctcttgagtcagagat

SEQ ID NO: 458342 - DNA, 25 bp, Homo sapien
gacctcttgagtcagagatggcact

SEQ ID NO: 458343 - DNA, 25 bp, Homo sapien
cagagatggcactcgagtttttccc

SEQ ID NO: 458344 - DNA, 25 bp, Homo sapien
gagtttttccccatgggtcttgcct

SEQ ID NO: 458345 - DNA, 25 bp, Homo sapien
cctcaccgccacatacattgaaaaa

SEQ ID NO: 458346 - DNA, 25 bp, Homo sapien
caccctttctgtggggcttgaccaa

SEQ ID NO: 458347 - DNA, 25 bp, Homo sapien
tgaccaaatggaccacactggccag

SEQ ID NO: 458348 - DNA, 25 bp, Homo sapien
tggccagcctgacaaacccaccaga

SEQ ID NO: 458349 - DNA, 25 bp, Homo sapien
caaaagaaaagctggatgtgggaaa

SEQ ID NO: 458350 - DNA, 25 bp, Homo sapien
ccactaaaggcatattgtaaacttt

SEQ ID NO: 458351 - DNA, 25 bp, Homo sapien
gggcataaggagtagcaacttcctc

SEQ ID NO: 458352 - DNA, 25 bp, Homo sapien
cagtactttatatgggagtctgccc

SEQ ID NO: 458353 - DNA, 25 bp, Homo sapien
gagtagcaacttcctccttgtggct

SEQ ID NO: 458354 - DNA, 25 bp, Homo sapien
acttcctccttgtggcttcaacagt

SEQ ID NO: 458355 - DNA, 25 bp, Homo sapien
ttcaacagtccccagagcagtgaga

SEQ ID NO: 458356 - DNA, 25 bp, Homo sapien
gtccccagagcagtgagagggcaca

SEQ ID NO: 458357 - DNA, 25 bp, Homo sapien
ctgcaccctgtgtgccgatcagacg

SEQ ID NO: 458358 - DNA, 25 bp, Homo sapien
tgtgtgccgatcagacgctttctcc

SEQ ID NO: 458359 - DNA, 25 bp, Homo sapien
ggagtctgccccctgaggagaaact

SEQ ID NO: 458360 - DNA, 25 bp, Homo sapien
aggagaaactcccaagaaagctgcc

SEQ ID NO: 458361 - DNA, 25 bp, Homo sapien
gaaagctgccagatacacaagtgat

SEQ ID NO: 458362 - DNA, 25 bp, Homo sapien
cccaaactaatctaggaatcactgt

SEQ ID NO: 458363 - DNA, 25 bp, Homo sapien
ggaatcactgtctaaccactcactg

SEQ ID NO: 458364 - DNA, 25 bp, Homo sapien
gtctaaccactcactgtcatgaatg

SEQ ID NO: 458365 - DNA, 25 bp, Homo sapien
ggatgaggttgagtcataccaaata

SEQ ID NO: 458366 - DNA, 25 bp, Homo sapien
gagtcataccaaatagtgatttcga

SEQ ID NO: 458367 - DNA, 25 bp, Homo sapien
aacttctcaatctggaaagtgtagt

SEQ ID NO: 458368 - DNA, 25 bp, Homo sapien
gtgatttcgatagttcaaaatggtg

SEQ ID NO: 458369 - DNA, 25 bp, Homo sapien
ggtgaaattagcaattctacatgat

SEQ ID NO: 458370 - DNA, 25 bp, Homo sapien
gattcagtctaatcaatggataccg

SEQ ID NO: 458371 - DNA, 25 bp, Homo sapien
aatggataccgactgtttcccacac

SEQ ID NO: 458372 - DNA, 25 bp, Homo sapien
tgtttcccacacaagtctcctgttc

SEQ ID NO: 458373 - DNA, 25 bp, Homo sapien
caggctgcgcggattgttgctgggt

SEQ ID NO: 458374 - DNA, 25 bp, Homo sapien
gctgcgcggattgttgctgggtgaa

SEQ ID NO: 458375 - DNA, 25 bp, Homo sapien
agagaaaaagccaacgcccccattg

SEQ ID NO: 458376 - DNA, 25 bp, Homo sapien
aacgcccccattgtgcagaggtgga

SEQ ID NO: 458377 - DNA, 25 bp, Homo sapien
cccccattgtgcagaggtggagact

SEQ ID NO: 458378 - DNA, 25 bp, Homo sapien
ggtggagactgaggaaccccgcggc

SEQ ID NO: 458379 - DNA, 25 bp, Homo sapien
ggagactgaggaaccccgcggccgg

SEQ ID NO: 458380 - DNA, 25 bp, Homo sapien
ccgcggccggcacggtttggactgg

SEQ ID NO: 458381 - DNA, 25 bp, Homo sapien
gcacggtttggactggggcccatac

SEQ ID NO: 458382 - DNA, 25 bp, Homo sapien
tcacacaaatcccagacagaaagcc

SEQ ID NO: 458383 - DNA, 25 bp, Homo sapien
cacacaaatcccagacagaaagcct

SEQ ID NO: 458384 - DNA, 25 bp, Homo sapien
gaaataatatagaaatgttggccag

SEQ ID NO: 458385 - DNA, 25 bp, Homo sapien
aaataatatagaaatgttggccagg

SEQ ID NO: 458386 - DNA, 25 bp, Homo sapien
aataatatagaaatgttggccaggc

SEQ ID NO: 458387 - DNA, 25 bp, Homo sapien
ataatatagaaatgttggccaggca

SEQ ID NO: 458388 - DNA, 25 bp, Homo sapien
taatatagaaatgttggccaggcac

SEQ ID NO: 458389 - DNA, 25 bp, Homo sapien
aatatagaaatgttggccaggcacg

SEQ ID NO: 458390 - DNA, 25 bp, Homo sapien
ggaggctgagcggggaggacttctt

SEQ ID NO: 458391 - DNA, 25 bp, Homo sapien
gaggctgagcggggaggacttcttg

SEQ ID NO: 458392 - DNA, 25 bp, Homo sapien
aggctgagcggggaggacttcttga

SEQ ID NO: 458393 - DNA, 25 bp, Homo sapien
ggctgagcggggaggacttcttgag

SEQ ID NO: 458394 - DNA, 25 bp, Homo sapien
gctgagcggggaggacttcttgagc

SEQ ID NO: 458395 - DNA, 25 bp, Homo sapien
aagcctgagtcgtgttatttggaag

SEQ ID NO: 458396 - DNA, 25 bp, Homo sapien
gatccaccgggatcaggaacaaaga

SEQ ID NO: 458397 - DNA, 25 bp, Homo sapien
taatggtatcagaggcccctgtggt

SEQ ID NO: 458398 - DNA, 25 bp, Homo sapien
gtggtggtttccacacagaccaggg

SEQ ID NO: 458399 - DNA, 25 bp, Homo sapien
acagaccagggctgctgtggaagct

SEQ ID NO: 458400 - DNA, 25 bp, Homo sapien
gtgccccgacaggaactctagtgta

SEQ ID NO: 458401 - DNA, 25 bp, Homo sapien
tctagtgtactgtgtgatcgcggcc

SEQ ID NO: 458402 - DNA, 25 bp, Homo sapien
gtactgtgtgatcgcggccattaga

SEQ ID NO: 458403 - DNA, 25 bp, Homo sapien
aaaggtggcctcttcagatggaccc

SEQ ID NO: 458404 - DNA, 25 bp, Homo sapien
ctctgcacacagtagtaacttgatt

SEQ ID NO: 458405 - DNA, 25 bp, Homo sapien
acttgatttctgctgtgaagcctga

SEQ ID NO: 458406 - DNA, 25 bp, Homo sapien
gagcctcagaatattaacttgagca

SEQ ID NO: 458407 - DNA, 25 bp, Homo sapien
atttgagtagttgaatggccttata

SEQ ID NO: 458408 - DNA, 25 bp, Homo sapien
ggccttatataccatacatccacaa

SEQ ID NO: 458409 - DNA, 25 bp, Homo sapien
accatacatccacaatttctcaaag

SEQ ID NO: 458410 - DNA, 25 bp, Homo sapien
tttctcaaagaatgtgcactggcac

SEQ ID NO: 458411 - DNA, 25 bp, Homo sapien
gtgcactggcacactaatgtgcaac

SEQ ID NO: 458412 - DNA, 25 bp, Homo sapien
aatgtgcaacagtggtttatagatg

SEQ ID NO: 458413 - DNA, 25 bp, Homo sapien
gggtggaaatattgattgactcagc

SEQ ID NO: 458414 - DNA, 25 bp, Homo sapien
ttgactcagccctcaggaatgacag

SEQ ID NO: 458415 - DNA, 25 bp, Homo sapien
tcaggaatgacagagcctatagcca

SEQ ID NO: 458416 - DNA, 25 bp, Homo sapien
cctcatccatttacagtcctagaaa

SEQ ID NO: 458417 - DNA, 25 bp, Homo sapien
gaccaaattggctcctaaagtggaa

SEQ ID NO: 458418 - DNA, 25 bp, Homo sapien
tgctgtgccacaaacccagagccaa

SEQ ID NO: 458419 - DNA, 25 bp, Homo sapien
gagccaaatcactgtcttaaaatat

SEQ ID NO: 458420 - DNA, 25 bp, Homo sapien
gaagcaaggtaaaacctcgtggaga

SEQ ID NO: 458421 - DNA, 25 bp, Homo sapien
tcgtggagaggagacatttgtttca

SEQ ID NO: 458422 - DNA, 25 bp, Homo sapien
aggagacatttgtttcacagcaaac

SEQ ID NO: 458423 - DNA, 25 bp, Homo sapien
tcaggcaagaaacacatccaaatgg

SEQ ID NO: 458424 - DNA, 25 bp, Homo sapien
tccaaatgggaacagagagggaatt

SEQ ID NO: 458425 - DNA, 25 bp, Homo sapien
ccatcagatgttatttctcttccta

SEQ ID NO: 458426 - DNA, 25 bp, Homo sapien
gttatttctcttcctacttatgacc

SEQ ID NO: 458427 - DNA, 25 bp, Homo sapien
tctcttcctacttatgaccaaattg

SEQ ID NO: 458428 - DNA, 25 bp, Homo sapien
gttcacaagaacaacggcaagacag

SEQ ID NO: 458429 - DNA, 25 bp, Homo sapien
gcaagacagtgcctatactgcctct

SEQ ID NO: 458430 - DNA, 25 bp, Homo sapien
agtgcctatactgcctctacagtta

SEQ ID NO: 458431 - DNA, 25 bp, Homo sapien
gaagaagttacccttaagctaggat

SEQ ID NO: 458432 - DNA, 25 bp, Homo sapien
ccttaagctaggatgttgctcagaa

SEQ ID NO: 458433 - DNA, 25 bp, Homo sapien
tgctcagaagtgaccatcccaactt

SEQ ID NO: 458434 - DNA, 25 bp, Homo sapien
atcccaactttggtgcgggcacaat

SEQ ID NO: 458435 - DNA, 25 bp, Homo sapien
ggtgcgggcacaataaatcagccta

SEQ ID NO: 458436 - DNA, 25 bp, Homo sapien
taaatcagcctaaatgtccctaatt

SEQ ID NO: 458437 - DNA, 25 bp, Homo sapien
attgctgtgtaacactgtctgagag

SEQ ID NO: 458438 - DNA, 25 bp, Homo sapien
agttcagggacggataggcacatag

SEQ ID NO: 458439 - DNA, 25 bp, Homo sapien
cagatgtttgtatagctggtatgct

SEQ ID NO: 458440 - DNA, 25 bp, Homo sapien
gatgtttgtatagctggtatgctat

SEQ ID NO: 458441 - DNA, 25 bp, Homo sapien
ggtaaaaattcaactcccattatat

SEQ ID NO: 458442 - DNA, 25 bp, Homo sapien
aaaaattcaactcccattatatact

SEQ ID NO: 458443 - DNA, 25 bp, Homo sapien
ttttatttctctgggttcttgtagt

SEQ ID NO: 458444 - DNA, 25 bp, Homo sapien
ttatttctctgggttcttgtagtaa

SEQ ID NO: 458445 - DNA, 25 bp, Homo sapien
atttctctgggttcttgtagtaatt

SEQ ID NO: 458446 - DNA, 25 bp, Homo sapien
gaattggcaaaaagtagatcagact

SEQ ID NO: 458447 - DNA, 25 bp, Homo sapien
gatcagactaatctgaatcccagat

SEQ ID NO: 458448 - DNA, 25 bp, Homo sapien
gactaatctgaatcccagatgtttg

SEQ ID NO: 458449 - DNA, 25 bp, Homo sapien
taatctgaatcccagatgtttgtat

SEQ ID NO: 458450 - DNA, 25 bp, Homo sapien
cagctttgaagtagagcaggtctca

SEQ ID NO: 458451 - DNA, 25 bp, Homo sapien
gaagtagagcaggtctcatatacat

SEQ ID NO: 458452 - DNA, 25 bp, Homo sapien
gtagagcaggtctcatatacatgaa

SEQ ID NO: 458453 - DNA, 25 bp, Homo sapien
gagcaggtctcatatacatgaataa

SEQ ID NO: 458454 - DNA, 25 bp, Homo sapien
taacatggcacgatgaatgcttctt

SEQ ID NO: 458455 - DNA, 25 bp, Homo sapien
catggcacgatgaatgcttctttag

SEQ ID NO: 458456 - DNA, 25 bp, Homo sapien
ggcacgatgaatgcttctttagagt

SEQ ID NO: 458457 - DNA, 25 bp, Homo sapien
acgatgaatgcttctttagagtaaa

SEQ ID NO: 458458 - DNA, 25 bp, Homo sapien
taacttgttaagtcagagttgtcta

SEQ ID NO: 458459 - DNA, 25 bp, Homo sapien
aagtcagagttgtctaagtaattgt

SEQ ID NO: 458460 - DNA, 25 bp, Homo sapien
ctaagtaattgtaatgtcatgatca

SEQ ID NO: 458461 - DNA, 25 bp, Homo sapien
gacattcccagggctgtccagtgag

SEQ ID NO: 458462 - DNA, 25 bp, Homo sapien
agggctgtccagtgagtggtgttca

SEQ ID NO: 458463 - DNA, 25 bp, Homo sapien
gtccagtgagtggtgttcagtgggc

SEQ ID NO: 458464 - DNA, 25 bp, Homo sapien
ttgggagacgtgtggcagaaaaact

SEQ ID NO: 458465 - DNA, 25 bp, Homo sapien
tctctattgtgccttcagaaacccg

SEQ ID NO: 458466 - DNA, 25 bp, Homo sapien
tctattgtgccttcagaaacccgat

SEQ ID NO: 458467 - DNA, 25 bp, Homo sapien
tattgtgccttcagaaacccgatgg

SEQ ID NO: 458468 - DNA, 25 bp, Homo sapien
attgtgccttcagaaacccgatgga

SEQ ID NO: 458469 - DNA, 25 bp, Homo sapien
ttgtgccttcagaaacccgatggag

SEQ ID NO: 458470 - DNA, 25 bp, Homo sapien
tgtgccttcagaaacccgatggagg

SEQ ID NO: 458471 - DNA, 25 bp, Homo sapien
tgccttcagaaacccgatggaggca

SEQ ID NO: 458472 - DNA, 25 bp, Homo sapien
tcctgttttccgctcttctaagaaa

SEQ ID NO: 458473 - DNA, 25 bp, Homo sapien
aaaagaccgtgagttattgcccagc

SEQ ID NO: 458474 - DNA, 25 bp, Homo sapien
agaccgtgagttattgcccagcaat

SEQ ID NO: 458475 - DNA, 25 bp, Homo sapien
attgcccagcaataatcatgttgtt

SEQ ID NO: 458476 - DNA, 25 bp, Homo sapien
tcatgttgttactgtgagttagcaa

SEQ ID NO: 458477 - DNA, 25 bp, Homo sapien
gagttagcaacatgcctgacttcct

SEQ ID NO: 458478 - DNA, 25 bp, Homo sapien
tagcaacatgcctgacttcctgata

SEQ ID NO: 458479 - DNA, 25 bp, Homo sapien
gcctgacttcctgatagcattactg

SEQ ID NO: 458480 - DNA, 25 bp, Homo sapien
gactgtagaatgcaaaactcggaga

SEQ ID NO: 458481 - DNA, 25 bp, Homo sapien
aactcggagatgctaaactgtctta

SEQ ID NO: 458482 - DNA, 25 bp, Homo sapien
gatgctaaactgtcttattagagga

SEQ ID NO: 458483 - DNA, 25 bp, Homo sapien
cttccaaactctgggcgggccctgg

SEQ ID NO: 458484 - DNA, 25 bp, Homo sapien
aggcgtttgccatttggggagccca

SEQ ID NO: 458485 - DNA, 25 bp, Homo sapien
ggccctggcacctgtcaggccaatg

SEQ ID NO: 458486 - DNA, 25 bp, Homo sapien
ctggcacctgtcaggccaatgcggg

SEQ ID NO: 458487 - DNA, 25 bp, Homo sapien
tcccaagtgcgtctcagctgccaaa

SEQ ID NO: 458488 - DNA, 25 bp, Homo sapien
ccaagtgcgtctcagctgccaaaac

SEQ ID NO: 458489 - DNA, 25 bp, Homo sapien
ggtctgtggtgcaggcgctaaaaac

SEQ ID NO: 458490 - DNA, 25 bp, Homo sapien
gtctgtggtgcaggcgctaaaaact

SEQ ID NO: 458491 - DNA, 25 bp, Homo sapien
cacttccagagacaatcctgctcta

SEQ ID NO: 458492 - DNA, 25 bp, Homo sapien
acttccagagacaatcctgctctac

SEQ ID NO: 458493 - DNA, 25 bp, Homo sapien
taccctcagcccacagctccgaggg

SEQ ID NO: 458494 - DNA, 25 bp, Homo sapien
ataaccatttacctccagatctaag

SEQ ID NO: 458495 - DNA, 25 bp, Homo sapien
acctccagatctaagggttgtcttc

SEQ ID NO: 458496 - DNA, 25 bp, Homo sapien
atctaagggttgtcttctgggactc

SEQ ID NO: 458497 - DNA, 25 bp, Homo sapien
ttctgggactctactaaccttctaa

SEQ ID NO: 458498 - DNA, 25 bp, Homo sapien
actaaccttctaacacttgatgcaa

SEQ ID NO: 458499 - DNA, 25 bp, Homo sapien
gagggtgtacatgatcttatgctaa

SEQ ID NO: 458500 - DNA, 25 bp, Homo sapien
gggcaagggagttattggttttcat

SEQ ID NO: 458501 - DNA, 25 bp, Homo sapien
aaagagcagggtacccgaaggcagt

SEQ ID NO: 458502 - DNA, 25 bp, Homo sapien
tacccgaaggcagtaagtacgagtt

SEQ ID NO: 458503 - DNA, 25 bp, Homo sapien
acgagttatgtactagcgggtgaat

SEQ ID NO: 458504 - DNA, 25 bp, Homo sapien
gaaatgcttcttaacctgataacca

SEQ ID NO: 458505 - DNA, 25 bp, Homo sapien
tgaaagctatacatgttcaaaagaa

SEQ ID NO: 458506 - DNA, 25 bp, Homo sapien
gaaataatatagaaatgttggccag

SEQ ID NO: 458507 - DNA, 25 bp, Homo sapien
aaataatatagaaatgttggccagg

SEQ ID NO: 458508 - DNA, 25 bp, Homo sapien
aataatatagaaatgttggccaggc

SEQ ID NO: 458509 - DNA, 25 bp, Homo sapien
ataatatagaaatgttggccaggca

SEQ ID NO: 458510 - DNA, 25 bp, Homo sapien
taatatagaaatgttggccaggcac

SEQ ID NO: 458511 - DNA, 25 bp, Homo sapien
aatatagaaatgttggccaggcacg

SEQ ID NO: 458512 - DNA, 25 bp, Homo sapien
aggctgagcggggaggacttcttga

SEQ ID NO: 458513 - DNA, 25 bp, Homo sapien
ggctgagcggggaggacttcttgag

SEQ ID NO: 458514 - DNA, 25 bp, Homo sapien
gctgagcggggaggacttcttgagc

SEQ ID NO: 458515 - DNA, 25 bp, Homo sapien
agcggggaggacttcttgagcccag

SEQ ID NO: 458516 - DNA, 25 bp, Homo sapien
agtcacacacctcccagtcaggtga

SEQ ID NO: 458517 - DNA, 25 bp, Homo sapien
tgggcccttccgagagcaccttgac

SEQ ID NO: 458518 - DNA, 25 bp, Homo sapien
ttccgagagcaccttgacctatatt

SEQ ID NO: 458519 - DNA, 25 bp, Homo sapien
gagagcaccttgacctatattccgt

SEQ ID NO: 458520 - DNA, 25 bp, Homo sapien
agcaccttgacctatattccgttct

SEQ ID NO: 458521 - DNA, 25 bp, Homo sapien
ttgacctatattccgttctctccat

SEQ ID NO: 458522 - DNA, 25 bp, Homo sapien
ctatattccgttctctccatgacag

SEQ ID NO: 458523 - DNA, 25 bp, Homo sapien
attccgttctctccatgacagcaga

SEQ ID NO: 458524 - DNA, 25 bp, Homo sapien
tctctccatgacagcagactctaag

SEQ ID NO: 458525 - DNA, 25 bp, Homo sapien
agacagaggcaacctgacctcttcc

SEQ ID NO: 458526 - DNA, 25 bp, Homo sapien
cctccgggcgggagattcggctcca

SEQ ID NO: 458527 - DNA, 25 bp, Homo sapien
gggaatctgtgtacgcctgggagct

SEQ ID NO: 458528 - DNA, 25 bp, Homo sapien
gccacattccagcacatggatctga

SEQ ID NO: 458529 - DNA, 25 bp, Homo sapien
gaaacagaacgctgatctgcagaaa

SEQ ID NO: 458530 - DNA, 25 bp, Homo sapien
tgagaaccaaagagaggccacctgc

SEQ ID NO: 458531 - DNA, 25 bp, Homo sapien
agagaggccacctgcgtcctgggtc

SEQ ID NO: 458532 - DNA, 25 bp, Homo sapien
tgggtccattttcatcctccctgaa

SEQ ID NO: 458533 - DNA, 25 bp, Homo sapien
ggagaaacaccctgtgtccatggga

SEQ ID NO: 458534 - DNA, 25 bp, Homo sapien
aaacaccctgtgtccatgggataga

SEQ ID NO: 458535 - DNA, 25 bp, Homo sapien
atgggatagagtcctttccgcttgc

SEQ ID NO: 458536 - DNA, 25 bp, Homo sapien
atagagtcctttccgcttgcagttg

SEQ ID NO: 458537 - DNA, 25 bp, Homo sapien
tttccgcttgcagttgtgcccaaag

SEQ ID NO: 458538 - DNA, 25 bp, Homo sapien
cagaccatgtcatcgtcctggcgtc

SEQ ID NO: 458539 - DNA, 25 bp, Homo sapien
gactggaccggcacgtcttcattga

SEQ ID NO: 458540 - DNA, 25 bp, Homo sapien
tggaccggcacgtcttcattgatct

SEQ ID NO: 458541 - DNA, 25 bp, Homo sapien
gaccggcacgtcttcattgatctcc

SEQ ID NO: 458542 - DNA, 25 bp, Homo sapien
ggctgacatcgccaacatctgcaat

SEQ ID NO: 458543 - DNA, 25 bp, Homo sapien
gacatcgccaacatctgcaatgagg

SEQ ID NO: 458544 - DNA, 25 bp, Homo sapien
atcgccaacatctgcaatgaggctg

SEQ ID NO: 458545 - DNA, 25 bp, Homo sapien
aacatctgcaatgaggctgcgctgc

SEQ ID NO: 458546 - DNA, 25 bp, Homo sapien
cacgcggcgcgggagggacacactt

SEQ ID NO: 458547 - DNA, 25 bp, Homo sapien
gggagggacacacttccgtgcacac

SEQ ID NO: 458548 - DNA, 25 bp, Homo sapien
gagggacacacttccgtgcacactc

SEQ ID NO: 458549 - DNA, 25 bp, Homo sapien
attgtttcccatagcagaatgtcaa

SEQ ID NO: 458550 - DNA, 25 bp, Homo sapien
gcagaatgtcaatattcacagtaca

SEQ ID NO: 458551 - DNA, 25 bp, Homo sapien
agaattagacaactcttcatctacc

SEQ ID NO: 458552 - DNA, 25 bp, Homo sapien
actcttcatctaccttatttctagt

SEQ ID NO: 458553 - DNA, 25 bp, Homo sapien
taccttatttctagttcacacagtt

SEQ ID NO: 458554 - DNA, 25 bp, Homo sapien
gttcacacagttatctcaaattcca

SEQ ID NO: 458555 - DNA, 25 bp, Homo sapien
gttatctcaaattccactgaaacta

SEQ ID NO: 458556 - DNA, 25 bp, Homo sapien
gaaactaatgggatactgtcttgtg

SEQ ID NO: 458557 - DNA, 25 bp, Homo sapien
tactgtcttgtgtagatgccagttg

SEQ ID NO: 458558 - DNA, 25 bp, Homo sapien
gccagttgagtttataatgtgacct

SEQ ID NO: 458559 - DNA, 25 bp, Homo sapien
tgtgacctagtaaagctgtcttttt

SEQ ID NO: 458560 - DNA, 25 bp, Homo sapien
gtagagtggctcataagtggtttct

SEQ ID NO: 458561 - DNA, 25 bp, Homo sapien
gaaaagaccagacaacatcctagaa

SEQ ID NO: 458562 - DNA, 25 bp, Homo sapien
aatttgctgcagactacttcacgga

SEQ ID NO: 458563 - DNA, 25 bp, Homo sapien
gcagactacttcacggatccaagac

SEQ ID NO: 458564 - DNA, 25 bp, Homo sapien
ggatccaagacttcccaacaagatt

SEQ ID NO: 458565 - DNA, 25 bp, Homo sapien
aacaagattcacatgcagctaatta

SEQ ID NO: 458566 - DNA, 25 bp, Homo sapien
gggagagaccagacggaatccagcc

SEQ ID NO: 458567 - DNA, 25 bp, Homo sapien
gtcatctggaggcatgagagcccta

SEQ ID NO: 458568 - DNA, 25 bp, Homo sapien
tgagagccctactgccatcagtgtg

SEQ ID NO: 458569 - DNA, 25 bp, Homo sapien
atcagtgtgggtttccaagctgcct

SEQ ID NO: 458570 - DNA, 25 bp, Homo sapien
tgggctctgtctactgtcgcaaaag

SEQ ID NO: 458571 - DNA, 25 bp, Homo sapien
attatcatcttcatggaaagaatcc

SEQ ID NO: 458572 - DNA, 25 bp, Homo sapien
catggaaagaatccactgtggtttc

SEQ ID NO: 458573 - DNA, 25 bp, Homo sapien
gaaagaatccactgtggtttctgta

SEQ ID NO: 458574 - DNA, 25 bp, Homo sapien
ctgtggtttctgtagagtgattgga

SEQ ID NO: 458575 - DNA, 25 bp, Homo sapien
aaagtgttctttctgcgttgtcact

SEQ ID NO: 458576 - DNA, 25 bp, Homo sapien
tgttctttctgcgttgtcactttgt

SEQ ID NO: 458577 - DNA, 25 bp, Homo sapien
ttctttctgcgttgtcactttgttc

SEQ ID NO: 458578 - DNA, 25 bp, Homo sapien
tgtcactttgttcaacagtaaaact

SEQ ID NO: 458579 - DNA, 25 bp, Homo sapien
ttattctcagtgttcctactctgca

SEQ ID NO: 458580 - DNA, 25 bp, Homo sapien
tctcagtgttcctactctgcattgt

SEQ ID NO: 458581 - DNA, 25 bp, Homo sapien
tttaatcacctacaatctgtaaaga

SEQ ID NO: 458582 - DNA, 25 bp, Homo sapien
aactttcctgatcctatgtgcccag

SEQ ID NO: 458583 - DNA, 25 bp, Homo sapien
ttcctgatcctatgtgcccagaaaa

SEQ ID NO: 458584 - DNA, 25 bp, Homo sapien
ttcttttaaactggtattgcctaag

SEQ ID NO: 458585 - DNA, 25 bp, Homo sapien
gaggcagcatggaacctcatttttt

SEQ ID NO: 458586 - DNA, 25 bp, Homo sapien
atctgtgtgtacacgtgagtgcaca

SEQ ID NO: 458587 - DNA, 25 bp, Homo sapien
gtacacgtgagtgcacatgtgtata

SEQ ID NO: 458588 - DNA, 25 bp, Homo sapien
gggccacatgtgttttgtatacggt

SEQ ID NO: 458589 - DNA, 25 bp, Homo sapien
ggtattgcctaaggtgtattcttta

SEQ ID NO: 458590 - DNA, 25 bp, Homo sapien
atgcatgaaaatgtacctttgtacc

SEQ ID NO: 458591 - DNA, 25 bp, Homo sapien
atgtacctttgtaccttatacacaa

SEQ ID NO: 458592 - DNA, 25 bp, Homo sapien
tgtttttgcattgatggtttaaatc

SEQ ID NO: 458593 - DNA, 25 bp, Homo sapien
atcagtgcgtcatggaggtctcaga

SEQ ID NO: 458594 - DNA, 25 bp, Homo sapien
gaaactgtggctacccgggcatcag

SEQ ID NO: 458595 - DNA, 25 bp, Homo sapien
ggaatgcgcctctcggaagtgctgc

SEQ ID NO: 458596 - DNA, 25 bp, Homo sapien
ctgcttctccaacttcatctttgaa

SEQ ID NO: 458597 - DNA, 25 bp, Homo sapien
tcatctttgaagtgccctggtgctt

SEQ ID NO: 458598 - DNA, 25 bp, Homo sapien
gtgcttcttcccgaagtctgtggaa

SEQ ID NO: 458599 - DNA, 25 bp, Homo sapien
ggaagactgccattactaagagagg

SEQ ID NO: 458600 - DNA, 25 bp, Homo sapien
agaggatgcatctggctcaccgggt

SEQ ID NO: 458601 - DNA, 25 bp, Homo sapien
tggctcaccgggtgttccgaaacca

SEQ ID NO: 458602 - DNA, 25 bp, Homo sapien
aaacttcgccttatcagcttcatat

SEQ ID NO: 458603 - DNA, 25 bp, Homo sapien
tcatgaaatcctgggttttcttaac

SEQ ID NO: 458604 - DNA, 25 bp, Homo sapien
tctctctgggacagacctcagagat

SEQ ID NO: 458605 - DNA, 25 bp, Homo sapien
gggacagacctcagagattgtgaat

SEQ ID NO: 458606 - DNA, 25 bp, Homo sapien
ggccaggccagaaaagggtgggcct

SEQ ID NO: 458607 - DNA, 25 bp, Homo sapien
agagctgaagggatcccagccccta

SEQ ID NO: 458608 - DNA, 25 bp, Homo sapien
gagctccttaggaagaagacagact

SEQ ID NO: 458609 - DNA, 25 bp, Homo sapien
aagacagactggttcattgaatgcc

SEQ ID NO: 458610 - DNA, 25 bp, Homo sapien
ttgaatgccgccttatttatttctg

SEQ ID NO: 458611 - DNA, 25 bp, Homo sapien
gaatgccgccttatttatttctggt

SEQ ID NO: 458612 - DNA, 25 bp, Homo sapien
tgccgccttatttatttctggtgag

SEQ ID NO: 458613 - DNA, 25 bp, Homo sapien
cgccttatttatttctggtgaggat

SEQ ID NO: 458614 - DNA, 25 bp, Homo sapien
gggctacccaataaatcactgatac

SEQ ID NO: 458615 - DNA, 25 bp, Homo sapien
caccacccactgacgttatttttat

SEQ ID NO: 458616 - DNA, 25 bp, Homo sapien
ccactgacgttatttttatactaga

SEQ ID NO: 458617 - DNA, 25 bp, Homo sapien
gatgaagaggtcaacagcaggcatg

SEQ ID NO: 458618 - DNA, 25 bp, Homo sapien
ggagccgagtcttctgtgctcaggt

SEQ ID NO: 458619 - DNA, 25 bp, Homo sapien
gtgctcaggtcctcacgctgcagac

SEQ ID NO: 458620 - DNA, 25 bp, Homo sapien
tgcagacgccccctagaggaacttt

SEQ ID NO: 458621 - DNA, 25 bp, Homo sapien
gcagcccagcagagggctctatgca

SEQ ID NO: 458622 - DNA, 25 bp, Homo sapien
gagggctctatgcacgggtttcaaa

SEQ ID NO: 458623 - DNA, 25 bp, Homo sapien
ctctatgcacgggtttcaaacctgt

SEQ ID NO: 458624 - DNA, 25 bp, Homo sapien
gtttcaaacctgttttccacactct

SEQ ID NO: 458625 - DNA, 25 bp, Homo sapien
gttttccacactctgtctttgcagt

SEQ ID NO: 458626 - DNA, 25 bp, Homo sapien
gtaatagaggaatgtccacttccag

SEQ ID NO: 458627 - DNA, 25 bp, Homo sapien
aggaatgtccacttccagggccaaa

SEQ ID NO: 458628 - DNA, 25 bp, Homo sapien
acttccagggccaaaccggctgttg

SEQ ID NO: 458629 - DNA, 25 bp, Homo sapien
gccaaaccggctgttgcggttccgg

SEQ ID NO: 458630 - DNA, 25 bp, Homo sapien
gttccgggagatgccgaaagtcttg

SEQ ID NO: 458631 - DNA, 25 bp, Homo sapien
gagatgccgaaagtcttgaagccct

SEQ ID NO: 458632 - DNA, 25 bp, Homo sapien
tgccgaaagtcttgaagccctcgtg

SEQ ID NO: 458633 - DNA, 25 bp, Homo sapien
gaaagtcttgaagccctcgtgggcc

SEQ ID NO: 458634 - DNA, 25 bp, Homo sapien
ggcacatgcccagaaagacgtcgtc

SEQ ID NO: 458635 - DNA, 25 bp, Homo sapien
agacgtcgtcgatcgggtagagctc

SEQ ID NO: 458636 - DNA, 25 bp, Homo sapien
tagagctccagggtgtcgcaggcat

SEQ ID NO: 458637 - DNA, 25 bp, Homo sapien
atctttgagccttagcaatacagga

SEQ ID NO: 458638 - DNA, 25 bp, Homo sapien
gcagcgcacacttcatttgcatata

SEQ ID NO: 458639 - DNA, 25 bp, Homo sapien
aatcaacggatttcgttggctggca

SEQ ID NO: 458640 - DNA, 25 bp, Homo sapien
tggctggcagcggtttgatctgcac

SEQ ID NO: 458641 - DNA, 25 bp, Homo sapien
tgatctgcacgaaactgggtcgccc

SEQ ID NO: 458642 - DNA, 25 bp, Homo sapien
tctgaccggtctctatcagtcattg

SEQ ID NO: 458643 - DNA, 25 bp, Homo sapien
ggtctctatcagtcattggcccatg

SEQ ID NO: 458644 - DNA, 25 bp, Homo sapien
tcattggcccatgcgagtctcgtga

SEQ ID NO: 458645 - DNA, 25 bp, Homo sapien
tgacccaccagtcactaaagcgcat

SEQ ID NO: 458646 - DNA, 25 bp, Homo sapien
taaagcgcatccctattggcccgag

SEQ ID NO: 458647 - DNA, 25 bp, Homo sapien
aatacaggacgtgggtccaagagca

SEQ ID NO: 458648 - DNA, 25 bp, Homo sapien
gggaatggagcaaaacagtctttga

SEQ ID NO: 458649 - DNA, 25 bp, Homo sapien
acagtctttgaatatcgaacacgca

SEQ ID NO: 458650 - DNA, 25 bp, Homo sapien
ttgaatatcgaacacgcaaggctgt

SEQ ID NO: 458651 - DNA, 25 bp, Homo sapien
aacacgcaaggctgtgagactacct

SEQ ID NO: 458652 - DNA, 25 bp, Homo sapien
aaggctgtgagactacctattgtag

SEQ ID NO: 458653 - DNA, 25 bp, Homo sapien
ctacctattgtagatattgcaccct

SEQ ID NO: 458654 - DNA, 25 bp, Homo sapien
gtagatattgcaccctatgacattg

SEQ ID NO: 458655 - DNA, 25 bp, Homo sapien
accctatgacattggtggtcctgat

SEQ ID NO: 458656 - DNA, 25 bp, Homo sapien
gacattggtggtcctgatcaagaat

SEQ ID NO: 458657 - DNA, 25 bp, Homo sapien
gtggtcctgatcaagaatttggtgt

SEQ ID NO: 458658 - DNA, 25 bp, Homo sapien
agaatttggtgtggacgttggccct

SEQ ID NO: 458659 - DNA, 25 bp, Homo sapien
ccagtaggacccactcagcaggtag

SEQ ID NO: 458660 - DNA, 25 bp, Homo sapien
agtaggacccactcagcaggtagca

SEQ ID NO: 458661 - DNA, 25 bp, Homo sapien
taggacccactcagcaggtagcagt

SEQ ID NO: 458662 - DNA, 25 bp, Homo sapien
aggacccactcagcaggtagcagtg

SEQ ID NO: 458663 - DNA, 25 bp, Homo sapien
gacccactcagcaggtagcagtgga

SEQ ID NO: 458664 - DNA, 25 bp, Homo sapien
actcagcaggtagcagtggagacag

SEQ ID NO: 458665 - DNA, 25 bp, Homo sapien
catgctggctggacaggagctgtcc

SEQ ID NO: 458666 - DNA, 25 bp, Homo sapien
ctggctggacaggagctgtccactc

SEQ ID NO: 458667 - DNA, 25 bp, Homo sapien
ggctgtgacagccaggtggcccgcg

SEQ ID NO: 458668 - DNA, 25 bp, Homo sapien
tcctctctccacaggtgaaccactc

SEQ ID NO: 458669 - DNA, 25 bp, Homo sapien
aggtgaaccactcaccgaccccaag

SEQ ID NO: 458670 - DNA, 25 bp, Homo sapien
aaataatcatacaaggaccctaaga

SEQ ID NO: 458671 - DNA, 25 bp, Homo sapien
tatttttaagatgaagtctcgcaat

SEQ ID NO: 458672 - DNA, 25 bp, Homo sapien
aagtctcgcaatgtttcacaagctg

SEQ ID NO: 458673 - DNA, 25 bp, Homo sapien
gtctcgcaatgtttcacaagctggt

SEQ ID NO: 458674 - DNA, 25 bp, Homo sapien
ccgccagaatccaagcattctgact

SEQ ID NO: 458675 - DNA, 25 bp, Homo sapien
gactccagagcccaaagccataatg

SEQ ID NO: 458676 - DNA, 25 bp, Homo sapien
gagcccaaagccataatgtcactct

SEQ ID NO: 458677 - DNA, 25 bp, Homo sapien
caaagccataatgtcactctgcctt

SEQ ID NO: 458678 - DNA, 25 bp, Homo sapien
ataatgtcactctgcctttcagcac

SEQ ID NO: 458679 - DNA, 25 bp, Homo sapien
tgcctttcagcactacacatccaaa

SEQ ID NO: 458680 - DNA, 25 bp, Homo sapien
atccaaaatgactatcttctctctt

SEQ ID NO: 458681 - DNA, 25 bp, Homo sapien
gtccctggcatattatcatcttcat

SEQ ID NO: 458682 - DNA, 25 bp, Homo sapien
catggaaagaatccactgtggtttc

SEQ ID NO: 458683 - DNA, 25 bp, Homo sapien
gaatccactgtggtttctgtagagt

SEQ ID NO: 458684 - DNA, 25 bp, Homo sapien
ctgtggtttctgtagagtgattgga

SEQ ID NO: 458685 - DNA, 25 bp, Homo sapien
aaagtgttctttctgcgttgtcact

SEQ ID NO: 458686 - DNA, 25 bp, Homo sapien
ttctttctgcgttgtcactttgttc

SEQ ID NO: 458687 - DNA, 25 bp, Homo sapien
tgtcactttgttcaacagtaaaact

SEQ ID NO: 458688 - DNA, 25 bp, Homo sapien
ttattctcagtgttcctactctgca

SEQ ID NO: 458689 - DNA, 25 bp, Homo sapien
tctcagtgttcctactctgcattgt

SEQ ID NO: 458690 - DNA, 25 bp, Homo sapien
gcattgtttacatttttgacagttt

SEQ ID NO: 458691 - DNA, 25 bp, Homo sapien
tttaatcacctacaatctgtaaaga

SEQ ID NO: 458692 - DNA, 25 bp, Homo sapien
tatcacttctagaaacaggcgaggt

SEQ ID NO: 458693 - DNA, 25 bp, Homo sapien
aacaggcgaggtgtaagaccagaaa

SEQ ID NO: 458694 - DNA, 25 bp, Homo sapien
ggatggtaactggtcttttctcgtc

SEQ ID NO: 458695 - DNA, 25 bp, Homo sapien
taactggtcttttctcgtcctctct

SEQ ID NO: 458696 - DNA, 25 bp, Homo sapien
gctacaggaactatccctgttgtta

SEQ ID NO: 458697 - DNA, 25 bp, Homo sapien
gttgttaagcgatgaatgactgcat

SEQ ID NO: 458698 - DNA, 25 bp, Homo sapien
gactgcattgcacttcctagaaaaa

SEQ ID NO: 458699 - DNA, 25 bp, Homo sapien
tgcacttcctagaaaaaccttccaa

SEQ ID NO: 458700 - DNA, 25 bp, Homo sapien
accttccaactatatagcatcacag

SEQ ID NO: 458701 - DNA, 25 bp, Homo sapien
aacttgttgggcattgttttcctat

SEQ ID NO: 458702 - DNA, 25 bp, Homo sapien
ggcattgttttcctatcacttctag

SEQ ID NO: 458703 - DNA, 25 bp, Homo sapien
atgggtcaccccttgggtagcaggt

SEQ ID NO: 458704 - DNA, 25 bp, Homo sapien
gaaagggtcccagtctggtatgccc

SEQ ID NO: 458705 - DNA, 25 bp, Homo sapien
ttggtcagcaagtcttcctggcatc

SEQ ID NO: 458706 - DNA, 25 bp, Homo sapien
tcagttagagtatgtctctctcccc

SEQ ID NO: 458707 - DNA, 25 bp, Homo sapien
ctcggcctgttcactgtcattttcc

SEQ ID NO: 458708 - DNA, 25 bp, Homo sapien
tcttcattggtcaacatgtgtgtcc

SEQ ID NO: 458709 - DNA, 25 bp, Homo sapien
aacatgtgtgtcctgttgctgattt

SEQ ID NO: 458710 - DNA, 25 bp, Homo sapien
aacatctctagtttgtagtctgtat

SEQ ID NO: 458711 - DNA, 25 bp, Homo sapien
tctgttgcacagctccatggacatt

SEQ ID NO: 458712 - DNA, 25 bp, Homo sapien
agctccatggacattttgtggcaca

SEQ ID NO: 458713 - DNA, 25 bp, Homo sapien
attttgtggcacagggactccccta

SEQ ID NO: 458714 - DNA, 25 bp, Homo sapien
aatagcacacagaatagttctttct

SEQ ID NO: 458715 - DNA, 25 bp, Homo sapien
agaatagttctttctgctggtctgt

SEQ ID NO: 458716 - DNA, 25 bp, Homo sapien
aatagttctttctgctggtctgttt

SEQ ID NO: 458717 - DNA, 25 bp, Homo sapien
tctttctgctggtctgttttttctc

SEQ ID NO: 458718 - DNA, 25 bp, Homo sapien
ctgctggtctgttttttctcttcgt

SEQ ID NO: 458719 - DNA, 25 bp, Homo sapien
caatcaaactattgtagcagctaca

SEQ ID NO: 458720 - DNA, 25 bp, Homo sapien
gtagcagctacaaagtaattcacca

SEQ ID NO: 458721 - DNA, 25 bp, Homo sapien
tacaaagtaattcaccagcatgaca

SEQ ID NO: 458722 - DNA, 25 bp, Homo sapien
attcaccagcatgacaaaatggtca

SEQ ID NO: 458723 - DNA, 25 bp, Homo sapien
aagtcatcagcacttaagaaatgaa

SEQ ID NO: 458724 - DNA, 25 bp, Homo sapien
gattgtaatttattgttcatgactt

SEQ ID NO: 458725 - DNA, 25 bp, Homo sapien
acccagtgtgcgatggctgcacaca

SEQ ID NO: 458726 - DNA, 25 bp, Homo sapien
cacagcagcttccttggtagtgtac

SEQ ID NO: 458727 - DNA, 25 bp, Homo sapien
cttccttggtagtgtacgcagcctg

SEQ ID NO: 458728 - DNA, 25 bp, Homo sapien
tacgcagcctgttggttgtatgggt

SEQ ID NO: 458729 - DNA, 25 bp, Homo sapien
ctgttggttgtatgggttgctctaa

SEQ ID NO: 458730 - DNA, 25 bp, Homo sapien
atgggttgctctaagggaccttgga

SEQ ID NO: 458731 - DNA, 25 bp, Homo sapien
agggaccttggagacaggcctttca

SEQ ID NO: 458732 - DNA, 25 bp, Homo sapien
aggcctttcaggtggatgttcatgt

SEQ ID NO: 458733 - DNA, 25 bp, Homo sapien
gatgttcatgtttctgaccttgcac

SEQ ID NO: 458734 - DNA, 25 bp, Homo sapien
tgaccttgcactaccccaatgtagg

SEQ ID NO: 458735 - DNA, 25 bp, Homo sapien
ctaccccaatgtaggctccaaacag

SEQ ID NO: 458736 - DNA, 25 bp, Homo sapien
cctgagggtctggacgctttttatt

SEQ ID NO: 458737 - DNA, 25 bp, Homo sapien
gtctggacgctttttatttatgcct

SEQ ID NO: 458738 - DNA, 25 bp, Homo sapien
ggacgctttttatttatgcctattt

SEQ ID NO: 458739 - DNA, 25 bp, Homo sapien
atttatgcctatttaagttgggaag

SEQ ID NO: 458740 - DNA, 25 bp, Homo sapien
tggcccctcgtgcatttgccctttt

SEQ ID NO: 458741 - DNA, 25 bp, Homo sapien
gcatttgcccttttctcggctacag

SEQ ID NO: 458742 - DNA, 25 bp, Homo sapien
ttttctcggctacagctgtggacgt

SEQ ID NO: 458743 - DNA, 25 bp, Homo sapien
tctcggctacagctgtggacgttgc

SEQ ID NO: 458744 - DNA, 25 bp, Homo sapien
ctacagctgtggacgttgccctcgg

SEQ ID NO: 458745 - DNA, 25 bp, Homo sapien
ccattccgttcttcttcatgtaata

SEQ ID NO: 458746 - DNA, 25 bp, Homo sapien
ttccgttcttcttcatgtaataaat

SEQ ID NO: 458747 - DNA, 25 bp, Homo sapien
accactttctggtgcacacctagga

SEQ ID NO: 458748 - DNA, 25 bp, Homo sapien
ggtgcacacctaggacagatttcaa

SEQ ID NO: 458749 - DNA, 25 bp, Homo sapien
acagatttcaatccctgagatccca

SEQ ID NO: 458750 - DNA, 25 bp, Homo sapien
tttcaatccctgagatcccaggatg

SEQ ID NO: 458751 - DNA, 25 bp, Homo sapien
ctgagatcccaggatgaaacctatg

SEQ ID NO: 458752 - DNA, 25 bp, Homo sapien
gaaacctatgtttgccaaataccag

SEQ ID NO: 458753 - DNA, 25 bp, Homo sapien
ctatgtttgccaaataccagctact

SEQ ID NO: 458754 - DNA, 25 bp, Homo sapien
ctactgtgccagaagagatcatgga

SEQ ID NO: 458755 - DNA, 25 bp, Homo sapien
ccaggtgtggaaagctgcttgagaa

SEQ ID NO: 458756 - DNA, 25 bp, Homo sapien
aagctgcttgagaagaggagccaaa

SEQ ID NO: 458757 - DNA, 25 bp, Homo sapien
ggagccaaaacatcatagttgaacc

SEQ ID NO: 458758 - DNA, 25 bp, Homo sapien
gtatctatcaggtgtagttcagcca

SEQ ID NO: 458759 - DNA, 25 bp, Homo sapien
atcaggtgtagttcagccagaggga

SEQ ID NO: 458760 - DNA, 25 bp, Homo sapien
tagttcagccagagggagtaaaccc

SEQ ID NO: 458761 - DNA, 25 bp, Homo sapien
cagccagagggagtaaacccaccgg

SEQ ID NO: 458762 - DNA, 25 bp, Homo sapien
ctttcctagcaccaccatttaaagg

SEQ ID NO: 458763 - DNA, 25 bp, Homo sapien
agcaccaccatttaaagggatgttt

SEQ ID NO: 458764 - DNA, 25 bp, Homo sapien
gtagggcagcggagcattccagaca

SEQ ID NO: 458765 - DNA, 25 bp, Homo sapien
gcggagcattccagacacggagtta

SEQ ID NO: 458766 - DNA, 25 bp, Homo sapien
gcattccagacacggagttaaaccc

SEQ ID NO: 458767 - DNA, 25 bp, Homo sapien
cacgtccagcccgatcaagaattgg

SEQ ID NO: 458768 - DNA, 25 bp, Homo sapien
tccagcccgatcaagaattggagga

SEQ ID NO: 458769 - DNA, 25 bp, Homo sapien
atacgaatagcaaggtgcttccctc

SEQ ID NO: 458770 - DNA, 25 bp, Homo sapien
ctcccatctttctacctggtaagaa

SEQ ID NO: 458771 - DNA, 25 bp, Homo sapien
tttaactcccctaaatgacatttag

SEQ ID NO: 458772 - DNA, 25 bp, Homo sapien
tagagaactcgtgttatgcctaatt

SEQ ID NO: 458773 - DNA, 25 bp, Homo sapien
aactcgtgttatgcctaattcttct

SEQ ID NO: 458774 - DNA, 25 bp, Homo sapien
ttctgctgttggctctgctttgagc

SEQ ID NO: 458775 - DNA, 25 bp, Homo sapien
ggtgggcctaggtttgagagccctg

SEQ ID NO: 458776 - DNA, 25 bp, Homo sapien
cagggccctttccaatgaatctgcc

SEQ ID NO: 458777 - DNA, 25 bp, Homo sapien
gaatctgccggaaaggaaccaatct

SEQ ID NO: 458778 - DNA, 25 bp, Homo sapien
ggaaccaatctttcagtggcagctg

SEQ ID NO: 458779 - DNA, 25 bp, Homo sapien
ctttcagtggcagctgattttacaa

SEQ ID NO: 458780 - DNA, 25 bp, Homo sapien
gaaaaattctgtcccattgcaggag

SEQ ID NO: 458781 - DNA, 25 bp, Homo sapien
attgcaggaggactgcggttcccat

SEQ ID NO: 458782 - DNA, 25 bp, Homo sapien
attttccagcgcttcccagggaggt

SEQ ID NO: 458783 - DNA, 25 bp, Homo sapien
tcccagggaggttctttcagtgaca

SEQ ID NO: 458784 - DNA, 25 bp, Homo sapien
cagtgacagtccgagcctgaggatc

SEQ ID NO: 458785 - DNA, 25 bp, Homo sapien
tgaggatcccgccacttaaaacttt

SEQ ID NO: 458786 - DNA, 25 bp, Homo sapien
ataactaccatctggcctcattcca

SEQ ID NO: 458787 - DNA, 25 bp, Homo sapien
attccaagcccattcatcattttat

SEQ ID NO: 458788 - DNA, 25 bp, Homo sapien
gtgcctgaaagtattccccttggta

SEQ ID NO: 458789 - DNA, 25 bp, Homo sapien
ttttaactatagtgaccccagttgg

SEQ ID NO: 458790 - DNA, 25 bp, Homo sapien
tgaccccagttggaagcaccctttg

SEQ ID NO: 458791 - DNA, 25 bp, Homo sapien
atttacagttattttgtgaatggcc

SEQ ID NO: 458792 - DNA, 25 bp, Homo sapien
aactatgatttgatctatatacaac

SEQ ID NO: 458793 - DNA, 25 bp, Homo sapien
gatttgatctatatacaacttttca

SEQ ID NO: 458794 - DNA, 25 bp, Homo sapien
ttgatctatatacaacttttcagaa

SEQ ID NO: 458795 - DNA, 25 bp, Homo sapien
gaatacttttgattgtgtgttggac

SEQ ID NO: 458796 - DNA, 25 bp, Homo sapien
atacttttgattgtgtgttggacat

SEQ ID NO: 458797 - DNA, 25 bp, Homo sapien
cttttgattgtgtgttggacatatc

SEQ ID NO: 458798 - DNA, 25 bp, Homo sapien
gattgtgtgttggacatatctaaaa

SEQ ID NO: 458799 - DNA, 25 bp, Homo sapien
ttatctggcagaattaaacctaaat

SEQ ID NO: 458800 - DNA, 25 bp, Homo sapien
aaacaaatatgagcatttactaatt

SEQ ID NO: 458801 - DNA, 25 bp, Homo sapien
aagattattcttatttacactctaa

SEQ ID NO: 458802 - DNA, 25 bp, Homo sapien
ccccagctaatttgtgatttcgctt

SEQ ID NO: 458803 - DNA, 25 bp, Homo sapien
taatttgtgatttcgctttctgcag

SEQ ID NO: 458804 - DNA, 25 bp, Homo sapien
agttacccattgttggggctcagaa

SEQ ID NO: 458805 - DNA, 25 bp, Homo sapien
ccaataccccgaaatatagtggtgt

SEQ ID NO: 458806 - DNA, 25 bp, Homo sapien
ccccgaaatatagtggtgtgacatt

SEQ ID NO: 458807 - DNA, 25 bp, Homo sapien
tatagtggtgtgacattctgaactg

SEQ ID NO: 458808 - DNA, 25 bp, Homo sapien
gtggtgtgacattctgaactgaaga

SEQ ID NO: 458809 - DNA, 25 bp, Homo sapien
agaagccttaaggtctctccgacca

SEQ ID NO: 458810 - DNA, 25 bp, Homo sapien
gccttaaggtctctccgaccagact

SEQ ID NO: 458811 - DNA, 25 bp, Homo sapien
ttgtctcttccaaagcatacagtga

SEQ ID NO: 458812 - DNA, 25 bp, Homo sapien
tcatctgccttaagtctggacccac

SEQ ID NO: 458813 - DNA, 25 bp, Homo sapien
tgccaaatctcccacgtctctgtgc

SEQ ID NO: 458814 - DNA, 25 bp, Homo sapien
tgtcacccctgctttctggcctgag

SEQ ID NO: 458815 - DNA, 25 bp, Homo sapien
ccaggagctgagaagtacccaaaaa

SEQ ID NO: 458816 - DNA, 25 bp, Homo sapien
gagctgagaagtacccaaaaaccac

SEQ ID NO: 458817 - DNA, 25 bp, Homo sapien
aaccctcaggcgtgcctgtgagtgt

SEQ ID NO: 458818 - DNA, 25 bp, Homo sapien
ctcaggcgtgcctgtgagtgtgtct

SEQ ID NO: 458819 - DNA, 25 bp, Homo sapien
gtctgtgtgtctcactctgactcac

SEQ ID NO: 458820 - DNA, 25 bp, Homo sapien
tctgactcacccagacaactgactt

SEQ ID NO: 458821 - DNA, 25 bp, Homo sapien
gactcacccagacaactgacttcag

SEQ ID NO: 458822 - DNA, 25 bp, Homo sapien
actgacttcagcagccaaccttggt

SEQ ID NO: 458823 - DNA, 25 bp, Homo sapien
agccaaccttggtcattcccagaac

SEQ ID NO: 458824 - DNA, 25 bp, Homo sapien
catactgttttgactatagaggctt

SEQ ID NO: 458825 - DNA, 25 bp, Homo sapien
atagaggcttttcagtgtcatttaa

SEQ ID NO: 458826 - DNA, 25 bp, Homo sapien
tatctgtgatggcaatccctactca

SEQ ID NO: 458827 - DNA, 25 bp, Homo sapien
caatccctactcaaagctctttgtt

SEQ ID NO: 458828 - DNA, 25 bp, Homo sapien
gtattgctcttttgttaatccctta

SEQ ID NO: 458829 - DNA, 25 bp, Homo sapien
aacccagttggcatattattttgat

SEQ ID NO: 458830 - DNA, 25 bp, Homo sapien
tactgtgatttttgaagcttcctac

SEQ ID NO: 458831 - DNA, 25 bp, Homo sapien
ctgagtttgcttctagattttctgt

SEQ ID NO: 458832 - DNA, 25 bp, Homo sapien
tagattttctgttctgtcccagtgg

SEQ ID NO: 458833 - DNA, 25 bp, Homo sapien
gtcccagtggttggatatttcttca

SEQ ID NO: 458834 - DNA, 25 bp, Homo sapien
ttcttcatacacgtctatcatactg

SEQ ID NO: 458835 - DNA, 25 bp, Homo sapien
gcaggcaaggtctcccactgcaggg

SEQ ID NO: 458836 - DNA, 25 bp, Homo sapien
tctcccactgcagggcttgctggag

SEQ ID NO: 458837 - DNA, 25 bp, Homo sapien
aggcctcggctcttggacacgtggc

SEQ ID NO: 458838 - DNA, 25 bp, Homo sapien
gacacgtggctttgggcgtccacca

SEQ ID NO: 458839 - DNA, 25 bp, Homo sapien
tgtccaggacgctcctttctgctga

SEQ ID NO: 458840 - DNA, 25 bp, Homo sapien
gacagcccagccagtttggctgttt

SEQ ID NO: 458841 - DNA, 25 bp, Homo sapien
ttaaagacacatccacggacctgag

SEQ ID NO: 458842 - DNA, 25 bp, Homo sapien
catccacggacctgagtttactttt

SEQ ID NO: 458843 - DNA, 25 bp, Homo sapien
ggcaggtaaatccaagctccctgga

SEQ ID NO: 458844 - DNA, 25 bp, Homo sapien
gctccctggagcacaaagagtgttt

SEQ ID NO: 458845 - DNA, 25 bp, Homo sapien
ttcaggctacatgcaacagtggatt

SEQ ID NO: 458846 - DNA, 25 bp, Homo sapien
taaatgggacaaacagcagtacctc

SEQ ID NO: 458847 - DNA, 25 bp, Homo sapien
aaacagcagtacctccctcatcagg

SEQ ID NO: 458848 - DNA, 25 bp, Homo sapien
ccctcatcaggtactgtgggattaa

SEQ ID NO: 458849 - DNA, 25 bp, Homo sapien
acagagcctgatatatagcaagcat

SEQ ID NO: 458850 - DNA, 25 bp, Homo sapien
gcattcagtgaatcttaaccagcat

SEQ ID NO: 458851 - DNA, 25 bp, Homo sapien
taaccagcatcattgtgattccaca

SEQ ID NO: 458852 - DNA, 25 bp, Homo sapien
ttgtgattccacacaggagcccatc

SEQ ID NO: 458853 - DNA, 25 bp, Homo sapien
ggagcccatctgcttgaggaattta

SEQ ID NO: 458854 - DNA, 25 bp, Homo sapien
gtttgaacactactggatgggatga

SEQ ID NO: 458855 - DNA, 25 bp, Homo sapien
atgggatgatctagaacagggtgtc

SEQ ID NO: 458856 - DNA, 25 bp, Homo sapien
gcttccctgtggcaccttgggaaaa

SEQ ID NO: 458857 - DNA, 25 bp, Homo sapien
aagagccagtgagcctcattgagcc

SEQ ID NO: 458858 - DNA, 25 bp, Homo sapien
attgagcccctctggtcagccagat

SEQ ID NO: 458859 - DNA, 25 bp, Homo sapien
agccagatctgacattgagcccagc

SEQ ID NO: 458860 - DNA, 25 bp, Homo sapien
gacattgagcccagcattgaagatc

SEQ ID NO: 458861 - DNA, 25 bp, Homo sapien
cacagacctgtctccgcgtgagctg

SEQ ID NO: 458862 - DNA, 25 bp, Homo sapien
tgtctccgcgtgagctgcctgcagg

SEQ ID NO: 458863 - DNA, 25 bp, Homo sapien
tgcgtcattcctcagctgcgtgcga

SEQ ID NO: 458864 - DNA, 25 bp, Homo sapien
tcagctgcgtgcgaggcctctggct

SEQ ID NO: 458865 - DNA, 25 bp, Homo sapien
aataccatccccttgcaggtgagga

SEQ ID NO: 458866 - DNA, 25 bp, Homo sapien
tctggcttggagagcctccccgctg

SEQ ID NO: 458867 - DNA, 25 bp, Homo sapien
gccacagcagggtgcatgaagagcc

SEQ ID NO: 458868 - DNA, 25 bp, Homo sapien
ggtgtcagggctggtagttaccaaa

SEQ ID NO: 458869 - DNA, 25 bp, Homo sapien
gctggtagttaccaaatcagggtta

SEQ ID NO: 458870 - DNA, 25 bp, Homo sapien
tcagggccacatttcactaccttca

SEQ ID NO: 458871 - DNA, 25 bp, Homo sapien
acatttcactaccttcacagatcaa

SEQ ID NO: 458872 - DNA, 25 bp, Homo sapien
cactaccttcacagatcaaactcag

SEQ ID NO: 458873 - DNA, 25 bp, Homo sapien
caaactcagcagcagtcatgactgt

SEQ ID NO: 458874 - DNA, 25 bp, Homo sapien
cagcagtcatgactgtctgtcacta

SEQ ID NO: 458875 - DNA, 25 bp, Homo sapien
atcccaattccacataagcactttt

SEQ ID NO: 458876 - DNA, 25 bp, Homo sapien
aagttggcctaaaattggcgctgga

SEQ ID NO: 458877 - DNA, 25 bp, Homo sapien
aaaattggcgctggaatttgggctg

SEQ ID NO: 458878 - DNA, 25 bp, Homo sapien
ttgggctgggaaaaatcttgtggtt

SEQ ID NO: 458879 - DNA, 25 bp, Homo sapien
tgagtgggcactttccgggccaggg

SEQ ID NO: 458880 - DNA, 25 bp, Homo sapien
gctgcagggaagacccgcaggacac

SEQ ID NO: 458881 - DNA, 25 bp, Homo sapien
gaagacccgcaggacacagaagagc

SEQ ID NO: 458882 - DNA, 25 bp, Homo sapien
ttggaagggagtctcgtttcttacg

SEQ ID NO: 458883 - DNA, 25 bp, Homo sapien
gggagtctcgtttcttacggagaat

SEQ ID NO: 458884 - DNA, 25 bp, Homo sapien
cttacggagaattgggagctgaatc

SEQ ID NO: 458885 - DNA, 25 bp, Homo sapien
gaggatctctgcctggctttgcttc

SEQ ID NO: 458886 - DNA, 25 bp, Homo sapien
tgcctgccttctccgagttcttcat

SEQ ID NO: 458887 - DNA, 25 bp, Homo sapien
ttctccgagttcttcatttccttct

SEQ ID NO: 458888 - DNA, 25 bp, Homo sapien
gagttcttcatttccttctctgcaa

SEQ ID NO: 458889 - DNA, 25 bp, Homo sapien
atgcagcaggtgagtgggcactttc

SEQ ID NO: 458890 - DNA, 25 bp, Homo sapien
gtcccacccagcaccataaagaaag

SEQ ID NO: 458891 - DNA, 25 bp, Homo sapien
tcccacccagcaccataaagaaagg

SEQ ID NO: 458892 - DNA, 25 bp, Homo sapien
cccacccagcaccataaagaaaggc

SEQ ID NO: 458893 - DNA, 25 bp, Homo sapien
ccacccagcaccataaagaaaggca

SEQ ID NO: 458894 - DNA, 25 bp, Homo sapien
cacccagcaccataaagaaaggcaa

SEQ ID NO: 458895 - DNA, 25 bp, Homo sapien
acccagcaccataaagaaaggcaaa

SEQ ID NO: 458896 - DNA, 25 bp, Homo sapien
cccagcaccataaagaaaggcaaat

SEQ ID NO: 458897 - DNA, 25 bp, Homo sapien
aaaggcaaattgacggccgggtgca

SEQ ID NO: 458898 - DNA, 25 bp, Homo sapien
aaggcaaattgacggccgggtgcag

SEQ ID NO: 458899 - DNA, 25 bp, Homo sapien
aggcaaattgacggccgggtgcagt

SEQ ID NO: 458900 - DNA, 25 bp, Homo sapien
ggcaaattgacggccgggtgcagtg

SEQ ID NO: 458901 - DNA, 25 bp, Homo sapien
ggcctttaggccacagtagtgtctg

SEQ ID NO: 458902 - DNA, 25 bp, Homo sapien
acagtagtgtctgtgttaagttcac

SEQ ID NO: 458903 - DNA, 25 bp, Homo sapien
tctgtgttaagttcactaaatgtgt

SEQ ID NO: 458904 - DNA, 25 bp, Homo sapien
gtatttaatgagaaacattcctatg

SEQ ID NO: 458905 - DNA, 25 bp, Homo sapien
atgtgaacgtatgcatacattttta

SEQ ID NO: 458906 - DNA, 25 bp, Homo sapien
acatttttattgtgcacctgtacat

SEQ ID NO: 458907 - DNA, 25 bp, Homo sapien
ttgtgcacctgtacattgtgaagaa

SEQ ID NO: 458908 - DNA, 25 bp, Homo sapien
gtagtttggaaatttgtaaagcaca

SEQ ID NO: 458909 - DNA, 25 bp, Homo sapien
taatgtttagcttataaaaggtcct

SEQ ID NO: 458910 - DNA, 25 bp, Homo sapien
attttctatggcaaagactttgaca

SEQ ID NO: 458911 - DNA, 25 bp, Homo sapien
atggcaaagactttgacacttgaaa

SEQ ID NO: 458912 - DNA, 25 bp, Homo sapien
cattcatattcaggcatggtccttt

SEQ ID NO: 458913 - DNA, 25 bp, Homo sapien
caggcatggtcctttagcattcgag

SEQ ID NO: 458914 - DNA, 25 bp, Homo sapien
tggtcctttagcattcgagtgatag

SEQ ID NO: 458915 - DNA, 25 bp, Homo sapien
gcattcgagtgataggcacttttat

SEQ ID NO: 458916 - DNA, 25 bp, Homo sapien
aaaggatagcagtttttacttgata

SEQ ID NO: 458917 - DNA, 25 bp, Homo sapien
ttacttgataagttgggacccatgg

SEQ ID NO: 458918 - DNA, 25 bp, Homo sapien
aagttgggacccatggtaacagcaa

SEQ ID NO: 458919 - DNA, 25 bp, Homo sapien
atggtaacagcaagcatcccactta

SEQ ID NO: 458920 - DNA, 25 bp, Homo sapien
gcatcccacttataactggtgtcca

SEQ ID NO: 458921 - DNA, 25 bp, Homo sapien
actggtgtccattcagggaaaaaca

SEQ ID NO: 458922 - DNA, 25 bp, Homo sapien
gatgtaaccattatgtgactcaata

SEQ ID NO: 458923 - DNA, 25 bp, Homo sapien
caaaacctacctgaattaacataca

SEQ ID NO: 458924 - DNA, 25 bp, Homo sapien
gtattctcagatcctatatcttggt

SEQ ID NO: 458925 - DNA, 25 bp, Homo sapien
atatcttggttaatatgctcccaga

SEQ ID NO: 458926 - DNA, 25 bp, Homo sapien
ggttaatatgctcccagatacttta

SEQ ID NO: 458927 - DNA, 25 bp, Homo sapien
cagatactttaaacatggcaacctt

SEQ ID NO: 458928 - DNA, 25 bp, Homo sapien
atggcaaccttttggcctaagagaa

SEQ ID NO: 458929 - DNA, 25 bp, Homo sapien
ttttggcctaagagaatgtttgttc

SEQ ID NO: 458930 - DNA, 25 bp, Homo sapien
aaagcttttgagatgagagggtgtc

SEQ ID NO: 458931 - DNA, 25 bp, Homo sapien
tgagagggtgtcttactttcttgtg

SEQ ID NO: 458932 - DNA, 25 bp, Homo sapien
tcttgtggcaattgattttctgttt

SEQ ID NO: 458933 - DNA, 25 bp, Homo sapien
gggtaaaatcttgcaaagagctttt

SEQ ID NO: 458934 - DNA, 25 bp, Homo sapien
ttcggtctccccaaagcaatatggc

SEQ ID NO: 458935 - DNA, 25 bp, Homo sapien
tcggtctccccaaagcaatatggct

SEQ ID NO: 458936 - DNA, 25 bp, Homo sapien
cggtctccccaaagcaatatggctc

SEQ ID NO: 458937 - DNA, 25 bp, Homo sapien
ctccccaaagcaatatggctcctta

SEQ ID NO: 458938 - DNA, 25 bp, Homo sapien
tccccaaagcaatatggctccttat

SEQ ID NO: 458939 - DNA, 25 bp, Homo sapien
cccaaagcaatatggctccttataa

SEQ ID NO: 458940 - DNA, 25 bp, Homo sapien
aaagcaatatggctccttataaaga

SEQ ID NO: 458941 - DNA, 25 bp, Homo sapien
agcaatatggctccttataaagaag

SEQ ID NO: 458942 - DNA, 25 bp, Homo sapien
atatggctccttataaagaagtctt

SEQ ID NO: 458943 - DNA, 25 bp, Homo sapien
aagaagtcttttagggctgggctcg

SEQ ID NO: 458944 - DNA, 25 bp, Homo sapien
gtcttttagggctgggctcggtagc

SEQ ID NO: 458945 - DNA, 25 bp, Homo sapien
tctgccaaggtacctgggacagctg

SEQ ID NO: 458946 - DNA, 25 bp, Homo sapien
ctgttttccagcagcttccagacag

SEQ ID NO: 458947 - DNA, 25 bp, Homo sapien
ttccagacagccctatgcctgttgc

SEQ ID NO: 458948 - DNA, 25 bp, Homo sapien
gcctgttgcccctaataacttatag

SEQ ID NO: 458949 - DNA, 25 bp, Homo sapien
cttataggcaaggtgagactcagaa

SEQ ID NO: 458950 - DNA, 25 bp, Homo sapien
gggctagacttgctattcccaagag

SEQ ID NO: 458951 - DNA, 25 bp, Homo sapien
ttcccaagagccaacaaagattcat

SEQ ID NO: 458952 - DNA, 25 bp, Homo sapien
gggtcagcttggaagactctctgcc

SEQ ID NO: 458953 - DNA, 25 bp, Homo sapien
agactctctgcccatgaggtgtagc

SEQ ID NO: 458954 - DNA, 25 bp, Homo sapien
ctgcccatgaggtgtagctgagtga

SEQ ID NO: 458955 - DNA, 25 bp, Homo sapien
gcagggataccagagctccaagctc

SEQ ID NO: 458956 - DNA, 25 bp, Homo sapien
ggactactcaagttttctatttctt

SEQ ID NO: 458957 - DNA, 25 bp, Homo sapien
gttaaactaatgtgacgtctctgtc

SEQ ID NO: 458958 - DNA, 25 bp, Homo sapien
taatgtgacgtctctgtcaaagaaa

SEQ ID NO: 458959 - DNA, 25 bp, Homo sapien
gaaactctgggaattattctagtaa

SEQ ID NO: 458960 - DNA, 25 bp, Homo sapien
agtaatcactatgcataacatcaaa

SEQ ID NO: 458961 - DNA, 25 bp, Homo sapien
atttactcacacttcatatttccta

SEQ ID NO: 458962 - DNA, 25 bp, Homo sapien
cacacttcatatttcctagcacttg

SEQ ID NO: 458963 - DNA, 25 bp, Homo sapien
atttcctagcacttgttatcttaaa

SEQ ID NO: 458964 - DNA, 25 bp, Homo sapien
gtcaaatctattatttcattcacta

SEQ ID NO: 458965 - DNA, 25 bp, Homo sapien
caatcattaaaacttgtcccaagca

SEQ ID NO: 458966 - DNA, 25 bp, Homo sapien
ttgtcccaagcagtataaatctttc

SEQ ID NO: 458967 - DNA, 25 bp, Homo sapien
tgccaccatctgagggagaggaacg

SEQ ID NO: 458968 - DNA, 25 bp, Homo sapien
aggctctgatgctgagaggcttgcc

SEQ ID NO: 458969 - DNA, 25 bp, Homo sapien
tctgatgctgagaggcttgcctccg

SEQ ID NO: 458970 - DNA, 25 bp, Homo sapien
ctgaagaaggctcccctctgtatcc

SEQ ID NO: 458971 - DNA, 25 bp, Homo sapien
aggtctcctcaacactgggctgatc

SEQ ID NO: 458972 - DNA, 25 bp, Homo sapien
gctgatcctgaatggcacaggccaa

SEQ ID NO: 458973 - DNA, 25 bp, Homo sapien
ctccccacggtactgtgaacgtcgt

SEQ ID NO: 458974 - DNA, 25 bp, Homo sapien
ggtactgtgaacgtcgtgtgactca

SEQ ID NO: 458975 - DNA, 25 bp, Homo sapien
gtgaacgtcgtgtgactcagtgcag

SEQ ID NO: 458976 - DNA, 25 bp, Homo sapien
acgtcgtgtgactcagtgcagagac

SEQ ID NO: 458977 - DNA, 25 bp, Homo sapien
gtgactcagtgcagagacagataat

SEQ ID NO: 458978 - DNA, 25 bp, Homo sapien
cacgctgttcttgcttcatggaatg

SEQ ID NO: 458979 - DNA, 25 bp, Homo sapien
catggaatgctacatgctttctgtt

SEQ ID NO: 458980 - DNA, 25 bp, Homo sapien
tttttctcattttggatttctccaa

SEQ ID NO: 458981 - DNA, 25 bp, Homo sapien
ggatttctccaaaactaactgaatt

SEQ ID NO: 458982 - DNA, 25 bp, Homo sapien
tgaatttaagcttcaggtccctttg

SEQ ID NO: 458983 - DNA, 25 bp, Homo sapien
aatatatcctacttgaaatttactc

SEQ ID NO: 458984 - DNA, 25 bp, Homo sapien
gaaatttactctatggacttaccca

SEQ ID NO: 458985 - DNA, 25 bp, Homo sapien
atggacttacccactgctagaataa

SEQ ID NO: 458986 - DNA, 25 bp, Homo sapien
acccactgctagaataaatgtatca

SEQ ID NO: 458987 - DNA, 25 bp, Homo sapien
atacatatccacacttgtctgcaag

SEQ ID NO: 458988 - DNA, 25 bp, Homo sapien
tatccacacttgtctgcaagaatat

SEQ ID NO: 458989 - DNA, 25 bp, Homo sapien
acttttatcagttagatcttggttc

SEQ ID NO: 458990 - DNA, 25 bp, Homo sapien
agatcttggttcagatcccttaaga

SEQ ID NO: 458991 - DNA, 25 bp, Homo sapien
atcttggttcagatcccttaagaat

SEQ ID NO: 458992 - DNA, 25 bp, Homo sapien
cttggttcagatcccttaagaatac

SEQ ID NO: 458993 - DNA, 25 bp, Homo sapien
ggttcagatcccttaagaatacact

SEQ ID NO: 458994 - DNA, 25 bp, Homo sapien
tcagatcccttaagaatacacttgg

SEQ ID NO: 458995 - DNA, 25 bp, Homo sapien
taagaatacacttggggccgggcat

SEQ ID NO: 458996 - DNA, 25 bp, Homo sapien
agtgagctaggatcgaaccattaca

SEQ ID NO: 458997 - DNA, 25 bp, Homo sapien
tgagctaggatcgaaccattacact

SEQ ID NO: 458998 - DNA, 25 bp, Homo sapien
agctaggatcgaaccattacactcc

SEQ ID NO: 458999 - DNA, 25 bp, Homo sapien
ctaggatcgaaccattacactccag

SEQ ID NO: 459000 - DNA, 25 bp, Homo sapien
aggcatggccagtactgaaaatggt

SEQ ID NO: 459001 - DNA, 25 bp, Homo sapien
gtactgaaaatggtcccttccactt

SEQ ID NO: 459002 - DNA, 25 bp, Homo sapien
aaatggtcccttccactttgattgt

SEQ ID NO: 459003 - DNA, 25 bp, Homo sapien
ttgagcaggtgatccctccttctat

SEQ ID NO: 459004 - DNA, 25 bp, Homo sapien
aggtgatccctccttctatgtttta

SEQ ID NO: 459005 - DNA, 25 bp, Homo sapien
ggtgtagtgcctgatgggagcttca

SEQ ID NO: 459006 - DNA, 25 bp, Homo sapien
ctatgttttaacaggtaccttgtct

SEQ ID NO: 459007 - DNA, 25 bp, Homo sapien
aggtaccttgtctgttggcctgatt

SEQ ID NO: 459008 - DNA, 25 bp, Homo sapien
tctgttggcctgattttgggttggt

SEQ ID NO: 459009 - DNA, 25 bp, Homo sapien
agcttttgagttccaaactcttgta

SEQ ID NO: 459010 - DNA, 25 bp, Homo sapien
caaactcttgtaaagcctgctgaaa

SEQ ID NO: 459011 - DNA, 25 bp, Homo sapien
gatgacaatgacagcttttaactct

SEQ ID NO: 459012 - DNA, 25 bp, Homo sapien
agcttttaactcttcaagtcaccta

SEQ ID NO: 459013 - DNA, 25 bp, Homo sapien
caagtcacctaaagctattatgcag

SEQ ID NO: 459014 - DNA, 25 bp, Homo sapien
tatgcaggaggatttagaagtcaca

SEQ ID NO: 459015 - DNA, 25 bp, Homo sapien
agaagtcacattcataaaacccaag

SEQ ID NO: 459016 - DNA, 25 bp, Homo sapien
gtattattcatgatagctggcccac

SEQ ID NO: 459017 - DNA, 25 bp, Homo sapien
gatagctggcccacaggtcatgaat

SEQ ID NO: 459018 - DNA, 25 bp, Homo sapien
gctggcccacaggtcatgaattgag

SEQ ID NO: 459019 - DNA, 25 bp, Homo sapien
gaattgaggaggaatttgctttcaa

SEQ ID NO: 459020 - DNA, 25 bp, Homo sapien
aaagcaagaatgtccaacactgaaa

SEQ ID NO: 459021 - DNA, 25 bp, Homo sapien
gaatgtccaacactgaaagtttata

SEQ ID NO: 459022 - DNA, 25 bp, Homo sapien
gaaatactcttaccacactgttcaa

SEQ ID NO: 459023 - DNA, 25 bp, Homo sapien
accacactgttcaaaaaaccaagag

SEQ ID NO: 459024 - DNA, 25 bp, Homo sapien
aaaccaagagctctgttctctatct

SEQ ID NO: 459025 - DNA, 25 bp, Homo sapien
gttctctatcttcatttctttcctt

SEQ ID NO: 459026 - DNA, 25 bp, Homo sapien
gcttagtgtgtggtagtacaggctt

SEQ ID NO: 459027 - DNA, 25 bp, Homo sapien
agtacaggcttgaagttcttgctct

SEQ ID NO: 459028 - DNA, 25 bp, Homo sapien
ggcttgaagttcttgctctgagttc

SEQ ID NO: 459029 - DNA, 25 bp, Homo sapien
aagttcttgctctgagttcaccaca

SEQ ID NO: 459030 - DNA, 25 bp, Homo sapien
gctctgagttcaccacatgtttttg

SEQ ID NO: 459031 - DNA, 25 bp, Homo sapien
gagttcaccacatgtttttgtaatt

SEQ ID NO: 459032 - DNA, 25 bp, Homo sapien
tttttgtaattttgtggttggtgat

SEQ ID NO: 459033 - DNA, 25 bp, Homo sapien
tctttttgccagatagcaaatcttc

SEQ ID NO: 459034 - DNA, 25 bp, Homo sapien
tagcaaatcttctccaagtaaatca

SEQ ID NO: 459035 - DNA, 25 bp, Homo sapien
atcttctccaagtaaatcatcttca

SEQ ID NO: 459036 - DNA, 25 bp, Homo sapien
tctccaagtaaatcatcttcaagtt

SEQ ID NO: 459037 - DNA, 25 bp, Homo sapien
tcttcaagttcactgtcccagtcct

SEQ ID NO: 459038 - DNA, 25 bp, Homo sapien
ttccgcgccaggcttatcaaactgg

SEQ ID NO: 459039 - DNA, 25 bp, Homo sapien
gcgccaggcttatcaaactggtcaa

SEQ ID NO: 459040 - DNA, 25 bp, Homo sapien
aactggtcaaagtcatcatctccgg

SEQ ID NO: 459041 - DNA, 25 bp, Homo sapien
tggtcaaagtcatcatctccggcgc

SEQ ID NO: 459042 - DNA, 25 bp, Homo sapien
aaagtcatcatctccggcgcctgct

SEQ ID NO: 459043 - DNA, 25 bp, Homo sapien
agctggtgggccgacgtgcctggtc

SEQ ID NO: 459044 - DNA, 25 bp, Homo sapien
gaaatatgagatcaatgttctccga

SEQ ID NO: 459045 - DNA, 25 bp, Homo sapien
atgagatcaatgttctccgaaacag

SEQ ID NO: 459046 - DNA, 25 bp, Homo sapien
agatcaatgttctccgaaacaggat

SEQ ID NO: 459047 - DNA, 25 bp, Homo sapien
aatgttctccgaaacaggatcaacg

SEQ ID NO: 459048 - DNA, 25 bp, Homo sapien
gttctccgaaacaggatcaacgata

SEQ ID NO: 459049 - DNA, 25 bp, Homo sapien
gaaacaggatcaacgataaccagaa

SEQ ID NO: 459050 - DNA, 25 bp, Homo sapien
ggatcaacgataaccagaaagtctc

SEQ ID NO: 459051 - DNA, 25 bp, Homo sapien
aacgataaccagaaagtctccaaga

SEQ ID NO: 459052 - DNA, 25 bp, Homo sapien
ggaaggctaaagtcaccgggcgctg

SEQ ID NO: 459053 - DNA, 25 bp, Homo sapien
tcaccgggcgctggaaatagagcct

SEQ ID NO: 459054 - DNA, 25 bp, Homo sapien
aaagatctgctcctcgctcgcacct

SEQ ID NO: 459055 - DNA, 25 bp, Homo sapien
gcgccgctcggcgacttccggcaca

SEQ ID NO: 459056 - DNA, 25 bp, Homo sapien
ctgctgtccttccacctggatctgg

SEQ ID NO: 459057 - DNA, 25 bp, Homo sapien
gccgctcggcgacttccggcacacg

SEQ ID NO: 459058 - DNA, 25 bp, Homo sapien
ggccctccatgctggacgcggtgct

SEQ ID NO: 459059 - DNA, 25 bp, Homo sapien
cctccatgctggacgcggtgctggg

SEQ ID NO: 459060 - DNA, 25 bp, Homo sapien
ctccatgctggacgcggtgctgggc

SEQ ID NO: 459061 - DNA, 25 bp, Homo sapien
atgctggacgcggtgctgggcgtca

SEQ ID NO: 459062 - DNA, 25 bp, Homo sapien
tgctggacgcggtgctgggcgtcat

SEQ ID NO: 459063 - DNA, 25 bp, Homo sapien
tggacgcggtgctgggcgtcatgga

SEQ ID NO: 459064 - DNA, 25 bp, Homo sapien
tgctgggcgtcatggacgcggcgcg

SEQ ID NO: 459065 - DNA, 25 bp, Homo sapien
gggcgtcatggacgcggcgcgcccg

SEQ ID NO: 459066 - DNA, 25 bp, Homo sapien
gaaaggcgttcgatcgactacatcc

SEQ ID NO: 459067 - DNA, 25 bp, Homo sapien
gatcgactacatcccggaagcggaa

SEQ ID NO: 459068 - DNA, 25 bp, Homo sapien
ggaagcggaaagacacggccgtcta

SEQ ID NO: 459069 - DNA, 25 bp, Homo sapien
aagagcaatccgcatccagaacaat

SEQ ID NO: 459070 - DNA, 25 bp, Homo sapien
tattgagtcagttcaccctgtggtt

SEQ ID NO: 459071 - DNA, 25 bp, Homo sapien
gttgggtgccaacctgcaaatcacc

SEQ ID NO: 459072 - DNA, 25 bp, Homo sapien
gcaaatcaccgcgattgtcaccggg

SEQ ID NO: 459073 - DNA, 25 bp, Homo sapien
gatgtgttctggtcgttgatcggtc

SEQ ID NO: 459074 - DNA, 25 bp, Homo sapien
ttgatcggtctgttgatcggtcaac

SEQ ID NO: 459075 - DNA, 25 bp, Homo sapien
atggctgtaacagacgctcgtgcaa

SEQ ID NO: 459076 - DNA, 25 bp, Homo sapien
agcaccaccccgttgatcgaaaggc

SEQ ID NO: 459077 - DNA, 25 bp, Homo sapien
gcatttgttagaagtttaactccta

SEQ ID NO: 459078 - DNA, 25 bp, Homo sapien
agacctatttaacaattggtgcata

SEQ ID NO: 459079 - DNA, 25 bp, Homo sapien
ggtgcataaatgaaagtagtactgt

SEQ ID NO: 459080 - DNA, 25 bp, Homo sapien
gtactgtatacttgaaactgtttaa

SEQ ID NO: 459081 - DNA, 25 bp, Homo sapien
cttgaaactgtttaagtacaagttg

SEQ ID NO: 459082 - DNA, 25 bp, Homo sapien
aaggtatatttgcttctcgggaaag

SEQ ID NO: 459083 - DNA, 25 bp, Homo sapien
ggtatatttgcttctcgggaaagca

SEQ ID NO: 459084 - DNA, 25 bp, Homo sapien
ttctcgggaaagcaaagaagctgct

SEQ ID NO: 459085 - DNA, 25 bp, Homo sapien
tgcgcacgtaggactgaattcagtg

SEQ ID NO: 459086 - DNA, 25 bp, Homo sapien
gaattcagtgatatccctatacact

SEQ ID NO: 459087 - DNA, 25 bp, Homo sapien
cagtgatatccctatacactgccat

SEQ ID NO: 459088 - DNA, 25 bp, Homo sapien
tgcgtgcccgtctgctgcaagactg

SEQ ID NO: 459089 - DNA, 25 bp, Homo sapien
tctgctgcaagactgtctgctgcaa

SEQ ID NO: 459090 - DNA, 25 bp, Homo sapien
aagactgtctgctgcaagcctgtgt

SEQ ID NO: 459091 - DNA, 25 bp, Homo sapien
tgctgcaagcctgtgtgctgtatgc

SEQ ID NO: 459092 - DNA, 25 bp, Homo sapien
tgctgtatgcccgtctgctgtgggc

SEQ ID NO: 459093 - DNA, 25 bp, Homo sapien
tgctgtgggccttcttcttcatgct

SEQ ID NO: 459094 - DNA, 25 bp, Homo sapien
tcttcatgctgccagcagtctagct

SEQ ID NO: 459095 - DNA, 25 bp, Homo sapien
tgctgccgagtgacctgtgagccca

SEQ ID NO: 459096 - DNA, 25 bp, Homo sapien
ccgtgtcaacagtcctgctgtgtgc

SEQ ID NO: 459097 - DNA, 25 bp, Homo sapien
aacagtcctgctgtgtgcccgtctg

SEQ ID NO: 459098 - DNA, 25 bp, Homo sapien
cgtgctgccagcagtctagctgcca

SEQ ID NO: 459099 - DNA, 25 bp, Homo sapien
gtagttataccaaaatattgcctga

SEQ ID NO: 459100 - DNA, 25 bp, Homo sapien
gataaatcatgacaaggtcccctgt

SEQ ID NO: 459101 - DNA, 25 bp, Homo sapien
tcatgacaaggtcccctgtttattc

SEQ ID NO: 459102 - DNA, 25 bp, Homo sapien
cccctgtttattcctgtgttacaga

SEQ ID NO: 459103 - DNA, 25 bp, Homo sapien
gtttattcctgtgttacagacgcat

SEQ ID NO: 459104 - DNA, 25 bp, Homo sapien
cctgtgttacagacgcatggaattg

SEQ ID NO: 459105 - DNA, 25 bp, Homo sapien
gttacagacgcatggaattgctcct

SEQ ID NO: 459106 - DNA, 25 bp, Homo sapien
agacgcatggaattgctcctgtaga

SEQ ID NO: 459107 - DNA, 25 bp, Homo sapien
tgctcctgtagatttgaatttttgt

SEQ ID NO: 459108 - DNA, 25 bp, Homo sapien
gaacttgtcaaaaggcaagtagcat

SEQ ID NO: 459109 - DNA, 25 bp, Homo sapien
aaggcaagtagcatgaaagaagaca

SEQ ID NO: 459110 - DNA, 25 bp, Homo sapien
tggagccttctccctccaaattctt

SEQ ID NO: 459111 - DNA, 25 bp, Homo sapien
gtaatagaggaatgtccacttccag

SEQ ID NO: 459112 - DNA, 25 bp, Homo sapien
aggaatgtccacttccagggccaaa

SEQ ID NO: 459113 - DNA, 25 bp, Homo sapien
acttccagggccaaaccggctgttg

SEQ ID NO: 459114 - DNA, 25 bp, Homo sapien
gccaaaccggctgttgcggttccgg

SEQ ID NO: 459115 - DNA, 25 bp, Homo sapien
gttccgggagatgccgaaagtcttg

SEQ ID NO: 459116 - DNA, 25 bp, Homo sapien
gagatgccgaaagtcttgaagccct

SEQ ID NO: 459117 - DNA, 25 bp, Homo sapien
tgccgaaagtcttgaagccctcgtg

SEQ ID NO: 459118 - DNA, 25 bp, Homo sapien
gaaagtcttgaagccctcgtgggcc

SEQ ID NO: 459119 - DNA, 25 bp, Homo sapien
acgtcgtcgatcgggtagagctcca

SEQ ID NO: 459120 - DNA, 25 bp, Homo sapien
tagagctccagggtgtcgcaggcat

SEQ ID NO: 459121 - DNA, 25 bp, Homo sapien
tcctttttgtactgttgaaaccact

SEQ ID NO: 459122 - DNA, 25 bp, Homo sapien
gtactgttgaaaccacttcattgga

SEQ ID NO: 459123 - DNA, 25 bp, Homo sapien
aaccacttcattggacatgttgcaa

SEQ ID NO: 459124 - DNA, 25 bp, Homo sapien
ggacatgttgcaatagcaaaacccc

SEQ ID NO: 459125 - DNA, 25 bp, Homo sapien
ccccagttagattagtgtttacaca

SEQ ID NO: 459126 - DNA, 25 bp, Homo sapien
acacattttctcagttatttaatat

SEQ ID NO: 459127 - DNA, 25 bp, Homo sapien
atgtttgtctctagtgttctaatgt

SEQ ID NO: 459128 - DNA, 25 bp, Homo sapien
gttctaatgtagcacaaatcctatg

SEQ ID NO: 459129 - DNA, 25 bp, Homo sapien
tgaaatcaaatatatgcacaagtct

SEQ ID NO: 459130 - DNA, 25 bp, Homo sapien
gtgtaatgtgttaagtgctgttcat

SEQ ID NO: 459131 - DNA, 25 bp, Homo sapien
taagtgctgttcatttaagttattg

SEQ ID NO: 459132 - DNA, 25 bp, Homo sapien
aagttgatacttctttatgacccac

SEQ ID NO: 459133 - DNA, 25 bp, Homo sapien
gatacttctttatgacccacagttg

SEQ ID NO: 459134 - DNA, 25 bp, Homo sapien
ttctttatgacccacagttgacctt

SEQ ID NO: 459135 - DNA, 25 bp, Homo sapien
ctttatgacccacagttgaccttta

SEQ ID NO: 459136 - DNA, 25 bp, Homo sapien
ttatgacccacagttgacctttatt

SEQ ID NO: 459137 - DNA, 25 bp, Homo sapien
atgacccacagttgacctttatttt

SEQ ID NO: 459138 - DNA, 25 bp, Homo sapien
aataccagggcagttgtggctcatt

SEQ ID NO: 459139 - DNA, 25 bp, Homo sapien
taccagggcagttgtggctcattgt

SEQ ID NO: 459140 - DNA, 25 bp, Homo sapien
ccagggcagttgtggctcattgtgc

SEQ ID NO: 459141 - DNA, 25 bp, Homo sapien
tggcccattcatttcgtttttggaa

SEQ ID NO: 459142 - DNA, 25 bp, Homo sapien
gcccattcatttcgtttttggaaat

SEQ ID NO: 459143 - DNA, 25 bp, Homo sapien
aaacaccagagtcagcagggagctt

SEQ ID NO: 459144 - DNA, 25 bp, Homo sapien
agctttgtgcccctctcgaggcaga

SEQ ID NO: 459145 - DNA, 25 bp, Homo sapien
ttacaggcagagcttagaacctaga

SEQ ID NO: 459146 - DNA, 25 bp, Homo sapien
agcttagaacctagagctgctctgg

SEQ ID NO: 459147 - DNA, 25 bp, Homo sapien
attccagagccgcagctgacaacgg

SEQ ID NO: 459148 - DNA, 25 bp, Homo sapien
ggcactggagctgagaacctacttc

SEQ ID NO: 459149 - DNA, 25 bp, Homo sapien
gaacctacttcgatccttcttgggt

SEQ ID NO: 459150 - DNA, 25 bp, Homo sapien
cttcttgggttagcaaagtctactc

SEQ ID NO: 459151 - DNA, 25 bp, Homo sapien
gacaacggagagtccagaatctact

SEQ ID NO: 459152 - DNA, 25 bp, Homo sapien
tgagttcactttagagccagggccc

SEQ ID NO: 459153 - DNA, 25 bp, Homo sapien
agccagggccccagaaaacaccaga

SEQ ID NO: 459154 - DNA, 25 bp, Homo sapien
ttcccactcagctttgtgctcagat

SEQ ID NO: 459155 - DNA, 25 bp, Homo sapien
gtgctcagatcccaggtcccaagga

SEQ ID NO: 459156 - DNA, 25 bp, Homo sapien
cttctgtccttgtccagtcatgtaa

SEQ ID NO: 459157 - DNA, 25 bp, Homo sapien
gtccttgtccagtcatgtaaataat

SEQ ID NO: 459158 - DNA, 25 bp, Homo sapien
taccgtggttcctcagctaactgca

SEQ ID NO: 459159 - DNA, 25 bp, Homo sapien
gttcctcagctaactgcattcccta

SEQ ID NO: 459160 - DNA, 25 bp, Homo sapien
gcattccctacccaggcagagactg

SEQ ID NO: 459161 - DNA, 25 bp, Homo sapien
aggcagagactgtcctatgcctcga

SEQ ID NO: 459162 - DNA, 25 bp, Homo sapien
tatgcctcgagcttccaaacgagac

SEQ ID NO: 459163 - DNA, 25 bp, Homo sapien
aaacgagactcagaccgcgacacag

SEQ ID NO: 459164 - DNA, 25 bp, Homo sapien
agaccgcgacacagccaccgtattt

SEQ ID NO: 459165 - DNA, 25 bp, Homo sapien
tgccaggcccgtgcggtcagtggga

SEQ ID NO: 459166 - DNA, 25 bp, Homo sapien
tgggacccggacgtgggcaggcgag

SEQ ID NO: 459167 - DNA, 25 bp, Homo sapien
gtgggcaggcgagctcgggaccctc

SEQ ID NO: 459168 - DNA, 25 bp, Homo sapien
gctccccttggcacaggtgcgagtc

SEQ ID NO: 459169 - DNA, 25 bp, Homo sapien
tggcacaggtgcgagtccgtttctt

SEQ ID NO: 459170 - DNA, 25 bp, Homo sapien
acaggtgcgagtccgtttcttttca

SEQ ID NO: 459171 - DNA, 25 bp, Homo sapien
ggtgcgagtccgtttcttttcagca

SEQ ID NO: 459172 - DNA, 25 bp, Homo sapien
tgtccgctgtgtgggctgctgactc

SEQ ID NO: 459173 - DNA, 25 bp, Homo sapien
tgggctgctgactcctctgtgtgtg

SEQ ID NO: 459174 - DNA, 25 bp, Homo sapien
ctgctgactcctctgtgtgtgaggc

SEQ ID NO: 459175 - DNA, 25 bp, Homo sapien
tgtgtgaggcccttcatctaagtga

SEQ ID NO: 459176 - DNA, 25 bp, Homo sapien
ttataaaccaaggtccattgcagcc

SEQ ID NO: 459177 - DNA, 25 bp, Homo sapien
gattcaagtgttcatatgtgtcttt

SEQ ID NO: 459178 - DNA, 25 bp, Homo sapien
atgtgtctttatatagctatgcctg

SEQ ID NO: 459179 - DNA, 25 bp, Homo sapien
tatagctatgcctgatccactgatg

SEQ ID NO: 459180 - DNA, 25 bp, Homo sapien
tagctatgcctgatccactgatggg

SEQ ID NO: 459181 - DNA, 25 bp, Homo sapien
gatggggtgttacaatacctgctta

SEQ ID NO: 459182 - DNA, 25 bp, Homo sapien
tacctgcttatatatgccagctggg

SEQ ID NO: 459183 - DNA, 25 bp, Homo sapien
atttactgaatgtgtctgaagtttc

SEQ ID NO: 459184 - DNA, 25 bp, Homo sapien
aagttggaattttatgcctgtatct

SEQ ID NO: 459185 - DNA, 25 bp, Homo sapien
gcctgtatctatgtttatgcctttg

SEQ ID NO: 459186 - DNA, 25 bp, Homo sapien
atgcctttgtaaaacccactgattt

SEQ ID NO: 459187 - DNA, 25 bp, Homo sapien
tgaggacctgcagacagccatcctg

SEQ ID NO: 459188 - DNA, 25 bp, Homo sapien
ggaatgtggtcctggcgcagctcct

SEQ ID NO: 459189 - DNA, 25 bp, Homo sapien
tggcgcagctcctgatctggtacgg

SEQ ID NO: 459190 - DNA, 25 bp, Homo sapien
gtcatggcccgagatgcccacggga

SEQ ID NO: 459191 - DNA, 25 bp, Homo sapien
acgggaacacagcgctgacctacgc

SEQ ID NO: 459192 - DNA, 25 bp, Homo sapien
tccagccaggagtgcatcaacgtgc

SEQ ID NO: 459193 - DNA, 25 bp, Homo sapien
aggagtgcatcaacgtgcttctgca

SEQ ID NO: 459194 - DNA, 25 bp, Homo sapien
atcaacgtgcttctgcagtacggct

SEQ ID NO: 459195 - DNA, 25 bp, Homo sapien
tgcttctgcagtacggctgccccga

SEQ ID NO: 459196 - DNA, 25 bp, Homo sapien
gtagtatctgttttatttgactgca

SEQ ID NO: 459197 - DNA, 25 bp, Homo sapien
tagtatctgttttatttgactgcag

SEQ ID NO: 459198 - DNA, 25 bp, Homo sapien
atctcttggaagcatgcagtttgac

SEQ ID NO: 459199 - DNA, 25 bp, Homo sapien
gcagtttgactcatggaatcaagca

SEQ ID NO: 459200 - DNA, 25 bp, Homo sapien
caagcatgtgctgtactataataac

SEQ ID NO: 459201 - DNA, 25 bp, Homo sapien
tataataacttgtctctccatgccg

SEQ ID NO: 459202 - DNA, 25 bp, Homo sapien
atgccgtaatgccatcctgactgag

SEQ ID NO: 459203 - DNA, 25 bp, Homo sapien
tttacctggcccttcaatatagcat

SEQ ID NO: 459204 - DNA, 25 bp, Homo sapien
ggcccttcaatatagcattttgcat

SEQ ID NO: 459205 - DNA, 25 bp, Homo sapien
gcattttgcatatctacctatgaca

SEQ ID NO: 459206 - DNA, 25 bp, Homo sapien
gaaatcacagtgtcaacaagcacct

SEQ ID NO: 459207 - DNA, 25 bp, Homo sapien
gaaatagtcacaggagcgaacacaa

SEQ ID NO: 459208 - DNA, 25 bp, Homo sapien
ggagcgaacacaactatctcttgga

SEQ ID NO: 459209 - DNA, 25 bp, Homo sapien
agggaaggacatgtgactcaaggca

SEQ ID NO: 459210 - DNA, 25 bp, Homo sapien
aaggcaggccagtgaagtgcaattc

SEQ ID NO: 459211 - DNA, 25 bp, Homo sapien
caattctaggttagactggccggga

SEQ ID NO: 459212 - DNA, 25 bp, Homo sapien
aaggagcggccgtgttttctgttga

SEQ ID NO: 459213 - DNA, 25 bp, Homo sapien
tttctgttgatggatgctgctgccc

SEQ ID NO: 459214 - DNA, 25 bp, Homo sapien
tctgcactacagacaacctccttgg

SEQ ID NO: 459215 - DNA, 25 bp, Homo sapien
tgaggccagcacagcgcaaagcaca

SEQ ID NO: 459216 - DNA, 25 bp, Homo sapien
gcacagcgcaaagcacagcaagagg

SEQ ID NO: 459217 - DNA, 25 bp, Homo sapien
agctctttcacagaaccctggtcta

SEQ ID NO: 459218 - DNA, 25 bp, Homo sapien
agaaccctggtctacctagttgatg

SEQ ID NO: 459219 - DNA, 25 bp, Homo sapien
ggtctacctagttgatgtcttatat

SEQ ID NO: 459220 - DNA, 25 bp, Homo sapien
ttgggtccctcacacagagacacca

SEQ ID NO: 459221 - DNA, 25 bp, Homo sapien
caccatcagccggagtggtataatc

SEQ ID NO: 459222 - DNA, 25 bp, Homo sapien
tcagccggagtggtataatcttacg

SEQ ID NO: 459223 - DNA, 25 bp, Homo sapien
tggtataatcttacggagtccccgg

SEQ ID NO: 459224 - DNA, 25 bp, Homo sapien
tataatcttacggagtccccggcca

SEQ ID NO: 459225 - DNA, 25 bp, Homo sapien
gccagactttcggcctagggaacct

SEQ ID NO: 459226 - DNA, 25 bp, Homo sapien
tcggcctagggaaccttttctcagc

SEQ ID NO: 459227 - DNA, 25 bp, Homo sapien
cagagacccatttcacagtttaaag

SEQ ID NO: 459228 - DNA, 25 bp, Homo sapien
ttcacagtttaaagagacccaggcc

SEQ ID NO: 459229 - DNA, 25 bp, Homo sapien
agagacccaggccaccttttgctag

SEQ ID NO: 459230 - DNA, 25 bp, Homo sapien
agacccaggccaccttttgctaggg

SEQ ID NO: 459231 - DNA, 25 bp, Homo sapien
gttgtgttaagcagcaaactgatgt

SEQ ID NO: 459232 - DNA, 25 bp, Homo sapien
aactgatgttacatcctgggcacga

SEQ ID NO: 459233 - DNA, 25 bp, Homo sapien
atgttacatcctgggcacgaggaaa

SEQ ID NO: 459234 - DNA, 25 bp, Homo sapien
aaatctgtgtgttagactgtgccta

SEQ ID NO: 459235 - DNA, 25 bp, Homo sapien
gactgtgcctagcatttaggtgcca

SEQ ID NO: 459236 - DNA, 25 bp, Homo sapien
ttaggtgccatctgcaattgttcgg

SEQ ID NO: 459237 - DNA, 25 bp, Homo sapien
caattgttcggctgtttgcattttc

SEQ ID NO: 459238 - DNA, 25 bp, Homo sapien
ggctgtttgcattttcatggttcct

SEQ ID NO: 459239 - DNA, 25 bp, Homo sapien
catggttccttttgacagtagttcc

SEQ ID NO: 459240 - DNA, 25 bp, Homo sapien
gacagtagttccaaacagctcctaa

SEQ ID NO: 459241 - DNA, 25 bp, Homo sapien
acagctcctaatttttgttcacaga

SEQ ID NO: 459242 - DNA, 25 bp, Homo sapien
gagcccaggctcatgaagatctgaa

SEQ ID NO: 459243 - DNA, 25 bp, Homo sapien
gaagatctgaacatggtccatagca

SEQ ID NO: 459244 - DNA, 25 bp, Homo sapien
aaatggcagttaccttcctggagaa

SEQ ID NO: 459245 - DNA, 25 bp, Homo sapien
tttccattccttattaggctcatgt

SEQ ID NO: 459246 - DNA, 25 bp, Homo sapien
ccttattaggctcatgtctttggaa

SEQ ID NO: 459247 - DNA, 25 bp, Homo sapien
ggctcatgtctttggaactagcccc

SEQ ID NO: 459248 - DNA, 25 bp, Homo sapien
tggtctccttcctgttatatacctg

SEQ ID NO: 459249 - DNA, 25 bp, Homo sapien
tgttatatacctgcagttaccatgt

SEQ ID NO: 459250 - DNA, 25 bp, Homo sapien
aggaagttgatcatgtttggttgct

SEQ ID NO: 459251 - DNA, 25 bp, Homo sapien
gtttggttgcttttggtcatcacaa

SEQ ID NO: 459252 - DNA, 25 bp, Homo sapien
ggttgcttttggtcatcacaataaa

SEQ ID NO: 459253 - DNA, 25 bp, Homo sapien
gcagagctcgtgttgtctaacctgt

SEQ ID NO: 459254 - DNA, 25 bp, Homo sapien
ggtccagctggcgtggcctcagtgt

SEQ ID NO: 459255 - DNA, 25 bp, Homo sapien
ccggtgagcacctgctgctctaggg

SEQ ID NO: 459256 - DNA, 25 bp, Homo sapien
tcgtgttgtctaacctgttttctgg

SEQ ID NO: 459257 - DNA, 25 bp, Homo sapien
agcaccctgtatgtctgctgtgttc

SEQ ID NO: 459258 - DNA, 25 bp, Homo sapien
gaaacaaagttcgagaccaaaggct

SEQ ID NO: 459259 - DNA, 25 bp, Homo sapien
gttcgagaccaaaggctggcgagcc

SEQ ID NO: 459260 - DNA, 25 bp, Homo sapien
cctgttttctggttgggcagataaa

SEQ ID NO: 459261 - DNA, 25 bp, Homo sapien
aaacagcccatgaaatgagtgcaca

SEQ ID NO: 459262 - DNA, 25 bp, Homo sapien
tgagtgcacacagtgctcacgggac

SEQ ID NO: 459263 - DNA, 25 bp, Homo sapien
ctcacgggacccaagagctggctgg

SEQ ID NO: 459264 - DNA, 25 bp, Homo sapien
ccgcagtccgcagcgccctcgcctg

SEQ ID NO: 459265 - DNA, 25 bp, Homo sapien
gcgccgctcggcgacttccggcaca

SEQ ID NO: 459266 - DNA, 25 bp, Homo sapien
gccgctcggcgacttccggcacacg

SEQ ID NO: 459267 - DNA, 25 bp, Homo sapien
cctccatgctggacgcggtgctggg

SEQ ID NO: 459268 - DNA, 25 bp, Homo sapien
ctccatgctggacgcggtgctgggc

SEQ ID NO: 459269 - DNA, 25 bp, Homo sapien
atgctggacgcggtgctgggcgtca

SEQ ID NO: 459270 - DNA, 25 bp, Homo sapien
tgctggacgcggtgctgggcgtcat

SEQ ID NO: 459271 - DNA, 25 bp, Homo sapien
gctggacgcggtgctgggcgtcatg

SEQ ID NO: 459272 - DNA, 25 bp, Homo sapien
tgctgggcgtcatggacgcggcgcg

SEQ ID NO: 459273 - DNA, 25 bp, Homo sapien
gggcgtcatggacgcggcgcgcccg

SEQ ID NO: 459274 - DNA, 25 bp, Homo sapien
ggcgcgcccggaggcggctgccgcc

SEQ ID NO: 459275 - DNA, 25 bp, Homo sapien
ggcttacatcagtcaatatagggtt

SEQ ID NO: 459276 - DNA, 25 bp, Homo sapien
tagggttactgtctattgaacaaga

SEQ ID NO: 459277 - DNA, 25 bp, Homo sapien
gtatttattcctaaccatcacacaa

SEQ ID NO: 459278 - DNA, 25 bp, Homo sapien
gccttcattttaactgggaggactt

SEQ ID NO: 459279 - DNA, 25 bp, Homo sapien
actgggaggacttggttctgtctaa

SEQ ID NO: 459280 - DNA, 25 bp, Homo sapien
cttggttctgtctaagatgttgctt

SEQ ID NO: 459281 - DNA, 25 bp, Homo sapien
gttgcttttgttatgggttagtgcc

SEQ ID NO: 459282 - DNA, 25 bp, Homo sapien
tagtgcctattagataacattctgt

SEQ ID NO: 459283 - DNA, 25 bp, Homo sapien
aacattctgtttctgtgactgatta

SEQ ID NO: 459284 - DNA, 25 bp, Homo sapien
ctgtttctgtgactgattatttctt

SEQ ID NO: 459285 - DNA, 25 bp, Homo sapien
tctttttgaccttctgagttttagt

SEQ ID NO: 459286 - DNA, 25 bp, Homo sapien
tggtgtttaatcaaaggtggaggct

SEQ ID NO: 459287 - DNA, 25 bp, Homo sapien
gagtttgaggattagctgctgccgc

SEQ ID NO: 459288 - DNA, 25 bp, Homo sapien
ctgctgccgctgcaagggcattact

SEQ ID NO: 459289 - DNA, 25 bp, Homo sapien
tgcaagggcattactctgtttatca

SEQ ID NO: 459290 - DNA, 25 bp, Homo sapien
tatttgaaacttctttggatgggta

SEQ ID NO: 459291 - DNA, 25 bp, Homo sapien
aacttctttggatgggtatgatctt

SEQ ID NO: 459292 - DNA, 25 bp, Homo sapien
gtatgatcttggtggttcattgacc

SEQ ID NO: 459293 - DNA, 25 bp, Homo sapien
ggttcattgaccacactattagaca

SEQ ID NO: 459294 - DNA, 25 bp, Homo sapien
tactttggggtaaactctgaggcac

SEQ ID NO: 459295 - DNA, 25 bp, Homo sapien
ataaagatctgatactgagcgttct

SEQ ID NO: 459296 - DNA, 25 bp, Homo sapien
atcttgtttgatgatatggctttta

SEQ ID NO: 459297 - DNA, 25 bp, Homo sapien
tgccagctgcatttatgggaatgct

SEQ ID NO: 459298 - DNA, 25 bp, Homo sapien
agaggacacatggaatctggaggcc

SEQ ID NO: 459299 - DNA, 25 bp, Homo sapien
gaatctggaggccatttagatgatt

SEQ ID NO: 459300 - DNA, 25 bp, Homo sapien
gaggccatttagatgattagttaat

SEQ ID NO: 459301 - DNA, 25 bp, Homo sapien
tgattagttaatttgtttttcacca

SEQ ID NO: 459302 - DNA, 25 bp, Homo sapien
ttgtttttcaccatttagcaaaaat

SEQ ID NO: 459303 - DNA, 25 bp, Homo sapien
atgtatactaccttaaatgtcttaa

SEQ ID NO: 459304 - DNA, 25 bp, Homo sapien
atgtcttaagaaatagtactcataa

SEQ ID NO: 459305 - DNA, 25 bp, Homo sapien
tgtcgtctaccgctggcaaggagat

SEQ ID NO: 459306 - DNA, 25 bp, Homo sapien
cgctggcaaggagatgcccgccaaa

SEQ ID NO: 459307 - DNA, 25 bp, Homo sapien
gggtaaaatccagtacaaggaatat

SEQ ID NO: 459308 - DNA, 25 bp, Homo sapien
cacattttggcttcattcagacttt

SEQ ID NO: 459309 - DNA, 25 bp, Homo sapien
ttcattcagactttctatagcttca

SEQ ID NO: 459310 - DNA, 25 bp, Homo sapien
agcttcaagtttggcttcattcaga

SEQ ID NO: 459311 - DNA, 25 bp, Homo sapien
aagtttggcttcattcagattttct

SEQ ID NO: 459312 - DNA, 25 bp, Homo sapien
ttctatacctcagtgaaccaactag

SEQ ID NO: 459313 - DNA, 25 bp, Homo sapien
gcaaaatataaaggtgctcccacac

SEQ ID NO: 459314 - DNA, 25 bp, Homo sapien
aaatttccatgttcccatttgcact

SEQ ID NO: 459315 - DNA, 25 bp, Homo sapien
tccatgttcccatttgcactgatgc

SEQ ID NO: 459316 - DNA, 25 bp, Homo sapien
acatttcattaagcttatcactggc

SEQ ID NO: 459317 - DNA, 25 bp, Homo sapien
ttatcactggcatggattcttcctt

SEQ ID NO: 459318 - DNA, 25 bp, Homo sapien
gcatggattcttccttgtggagtaa

SEQ ID NO: 459319 - DNA, 25 bp, Homo sapien
gtcaaaattgagaagtgccctaatt

SEQ ID NO: 459320 - DNA, 25 bp, Homo sapien
aagtgccctaattgaatgtgtttga

SEQ ID NO: 459321 - DNA, 25 bp, Homo sapien
gtgtttgaatgttatccttgcacaa

SEQ ID NO: 459322 - DNA, 25 bp, Homo sapien
atccttgcacaattctttaaattga

SEQ ID NO: 459323 - DNA, 25 bp, Homo sapien
ataaaatgttttacctcactgttgg

SEQ ID NO: 459324 - DNA, 25 bp, Homo sapien
gttttacctcactgttggacataca

SEQ ID NO: 459325 - DNA, 25 bp, Homo sapien
gttggacatacattccaagcttttc

SEQ ID NO: 459326 - DNA, 25 bp, Homo sapien
tacattgtattaaaactgccatatc

SEQ ID NO: 459327 - DNA, 25 bp, Homo sapien
aaaactgccatatcaattttaatgt

SEQ ID NO: 459328 - DNA, 25 bp, Homo sapien
tatgctatatgtaatacctaactgt

SEQ ID NO: 459329 - DNA, 25 bp, Homo sapien
tacctaactgtatctgtagtgtata

SEQ ID NO: 459330 - DNA, 25 bp, Homo sapien
gccaagagtggcatgaagacatttg

SEQ ID NO: 459331 - DNA, 25 bp, Homo sapien
gacatttgcaagttcttgtatcctg

SEQ ID NO: 459332 - DNA, 25 bp, Homo sapien
tgcaagttcttgtatcctgaagaga

SEQ ID NO: 459333 - DNA, 25 bp, Homo sapien
gttcttgtatcctgaagagagtaaa

SEQ ID NO: 459334 - DNA, 25 bp, Homo sapien
aaagttcagtttggatggcagcaag

SEQ ID NO: 459335 - DNA, 25 bp, Homo sapien
gtttggatggcagcaagatgaaatc

SEQ ID NO: 459336 - DNA, 25 bp, Homo sapien
aaatcagctattacacctgctgtac

SEQ ID NO: 459337 - DNA, 25 bp, Homo sapien
agctattacacctgctgtacacaca

SEQ ID NO: 459338 - DNA, 25 bp, Homo sapien
tattacacctgctgtacacacactt

SEQ ID NO: 459339 - DNA, 25 bp, Homo sapien
ttgaaggctgtttatgactagattt

SEQ ID NO: 459340 - DNA, 25 bp, Homo sapien
ggctgtttatgactagatttttata

SEQ ID NO: 459341 - DNA, 25 bp, Homo sapien
agaggtgaagactgcggccgctgga

SEQ ID NO: 459342 - DNA, 25 bp, Homo sapien
gccgctggacttggcttgagctagc

SEQ ID NO: 459343 - DNA, 25 bp, Homo sapien
gctggacttggcttgagctagctga

SEQ ID NO: 459344 - DNA, 25 bp, Homo sapien
ggacttggcttgagctagctgagca

SEQ ID NO: 459345 - DNA, 25 bp, Homo sapien
ggcttgagctagctgagcagttcca

SEQ ID NO: 459346 - DNA, 25 bp, Homo sapien
tgagctagctgagcagttccaagta

SEQ ID NO: 459347 - DNA, 25 bp, Homo sapien
ctagctgagcagttccaagtaggtg

SEQ ID NO: 459348 - DNA, 25 bp, Homo sapien
gctgagcagttccaagtaggtgaca

SEQ ID NO: 459349 - DNA, 25 bp, Homo sapien
agcagttccaagtaggtgacaggga

SEQ ID NO: 459350 - DNA, 25 bp, Homo sapien
taggtgacagggaccttgcccttct

SEQ ID NO: 459351 - DNA, 25 bp, Homo sapien
ggtgacagggaccttgcccttctgt

SEQ ID NO: 459352 - DNA, 25 bp, Homo sapien
tgctgagtatgtcccacctcaaatt

SEQ ID NO: 459353 - DNA, 25 bp, Homo sapien
gtatgtcccacctcaaattattttt

SEQ ID NO: 459354 - DNA, 25 bp, Homo sapien
atatgtacaatgatatcagatcctt

SEQ ID NO: 459355 - DNA, 25 bp, Homo sapien
atcagatccttttactcataccttt

SEQ ID NO: 459356 - DNA, 25 bp, Homo sapien
gatccttttactcatacctttttga

SEQ ID NO: 459357 - DNA, 25 bp, Homo sapien
ttgggacttttttattctggagtct

SEQ ID NO: 459358 - DNA, 25 bp, Homo sapien
tacaggttttcagaggtacttgcct

SEQ ID NO: 459359 - DNA, 25 bp, Homo sapien
aggtacttgcctaccttcatccttt

SEQ ID NO: 459360 - DNA, 25 bp, Homo sapien
tgactatttcatttactttcctggg

SEQ ID NO: 459361 - DNA, 25 bp, Homo sapien
gtaatcaggttttccaagcacttgg

SEQ ID NO: 459362 - DNA, 25 bp, Homo sapien
ggttttccaagcacttggactgaat

SEQ ID NO: 459363 - DNA, 25 bp, Homo sapien
gacatgagtaggagttctgattaat

SEQ ID NO: 459364 - DNA, 25 bp, Homo sapien
ttgatgcatattcctagattctgag

SEQ ID NO: 459365 - DNA, 25 bp, Homo sapien
ttctagcaaagtggcaggaatgaca

SEQ ID NO: 459366 - DNA, 25 bp, Homo sapien
gttgctattttgcaactgctaacaa

SEQ ID NO: 459367 - DNA, 25 bp, Homo sapien
gcaactgctaacaaagtaactgatt

SEQ ID NO: 459368 - DNA, 25 bp, Homo sapien
tcaatggatgaaaccttttagctaa

SEQ ID NO: 459369 - DNA, 25 bp, Homo sapien
gttgatgggaaacttcacagtgagt

SEQ ID NO: 459370 - DNA, 25 bp, Homo sapien
gggaacacatggtcagtgcctgaac

SEQ ID NO: 459371 - DNA, 25 bp, Homo sapien
atggtcagtgcctgaacccactaag

SEQ ID NO: 459372 - DNA, 25 bp, Homo sapien
agtgcctgaacccactaagtgtgca

SEQ ID NO: 459373 - DNA, 25 bp, Homo sapien
gaacccactaagtgtgcactgaatg

SEQ ID NO: 459374 - DNA, 25 bp, Homo sapien
gtcatgttaactcttatccctataa

SEQ ID NO: 459375 - DNA, 25 bp, Homo sapien
aactcttatccctataaactgcgta

SEQ ID NO: 459376 - DNA, 25 bp, Homo sapien
ataaactgcgtatctacatgtagac

SEQ ID NO: 459377 - DNA, 25 bp, Homo sapien
gacatgtatctatattacacccata

SEQ ID NO: 459378 - DNA, 25 bp, Homo sapien
atattacacccatatatctgtctaa

SEQ ID NO: 459379 - DNA, 25 bp, Homo sapien
atctgtctaatctatacatctgtag

SEQ ID NO: 459380 - DNA, 25 bp, Homo sapien
atttcttttttcatgggaccacgtg

SEQ ID NO: 459381 - DNA, 25 bp, Homo sapien
gggaccacgtgaaagtaagctgtag

SEQ ID NO: 459382 - DNA, 25 bp, Homo sapien
agtaagctgtagacaccgtggccct

SEQ ID NO: 459383 - DNA, 25 bp, Homo sapien
gaatgtttttctgcacaatcctgat

SEQ ID NO: 459384 - DNA, 25 bp, Homo sapien
ttctgcacaatcctgataccattat

SEQ ID NO: 459385 - DNA, 25 bp, Homo sapien
gtcccacccagcaccataaagaaag

SEQ ID NO: 459386 - DNA, 25 bp, Homo sapien
tcccacccagcaccataaagaaagg

SEQ ID NO: 459387 - DNA, 25 bp, Homo sapien
ccacccagcaccataaagaaaggca

SEQ ID NO: 459388 - DNA, 25 bp, Homo sapien
cacccagcaccataaagaaaggcaa

SEQ ID NO: 459389 - DNA, 25 bp, Homo sapien
acccagcaccataaagaaaggcaaa

SEQ ID NO: 459390 - DNA, 25 bp, Homo sapien
cccagcaccataaagaaaggcaaat

SEQ ID NO: 459391 - DNA, 25 bp, Homo sapien
ccagcaccataaagaaaggcaaatt

SEQ ID NO: 459392 - DNA, 25 bp, Homo sapien
aaaggcaaattgacggccgggtgca

SEQ ID NO: 459393 - DNA, 25 bp, Homo sapien
aaggcaaattgacggccgggtgcag

SEQ ID NO: 459394 - DNA, 25 bp, Homo sapien
aggcaaattgacggccgggtgcagt

SEQ ID NO: 459395 - DNA, 25 bp, Homo sapien
ggcaaattgacggccgggtgcagtg

SEQ ID NO: 459396 - DNA, 25 bp, Homo sapien
tccttaatcagtccagtctacatca

SEQ ID NO: 459397 - DNA, 25 bp, Homo sapien
ttaatcagtccagtctacatcagga

SEQ ID NO: 459398 - DNA, 25 bp, Homo sapien
gtctacatcaggactatgacttggg

SEQ ID NO: 459399 - DNA, 25 bp, Homo sapien
actattgtcaactgctgttgtacat

SEQ ID NO: 459400 - DNA, 25 bp, Homo sapien
tcaactgctgttgtacatactgtta

SEQ ID NO: 459401 - DNA, 25 bp, Homo sapien
aactgctgttgtacatactgttatg

SEQ ID NO: 459402 - DNA, 25 bp, Homo sapien
atactgttatgtgtaatggcgtaaa

SEQ ID NO: 459403 - DNA, 25 bp, Homo sapien
tcttctgtgatatatgggatattat

SEQ ID NO: 459404 - DNA, 25 bp, Homo sapien
gggatattatgttttaaagaccatc

SEQ ID NO: 459405 - DNA, 25 bp, Homo sapien
aagaccatcttggaatacaattaga

SEQ ID NO: 459406 - DNA, 25 bp, Homo sapien
taatattctactttgcaaaaacttt

SEQ ID NO: 459407 - DNA, 25 bp, Homo sapien
ttgggaaaacctgcaggagtattgt

SEQ ID NO: 459408 - DNA, 25 bp, Homo sapien
gggaaaacctgcaggagtattgtat

SEQ ID NO: 459409 - DNA, 25 bp, Homo sapien
taaaaaggctttgaatactgtccta

SEQ ID NO: 459410 - DNA, 25 bp, Homo sapien
tactgtcctaaaaactcatccctac

SEQ ID NO: 459411 - DNA, 25 bp, Homo sapien
aactcatccctaccactcacaagaa

SEQ ID NO: 459412 - DNA, 25 bp, Homo sapien
aaggtctgagacctctacagtagct

SEQ ID NO: 459413 - DNA, 25 bp, Homo sapien
ggtctgagacctctacagtagctaa

SEQ ID NO: 459414 - DNA, 25 bp, Homo sapien
ctgagacctctacagtagctaaaac

SEQ ID NO: 459415 - DNA, 25 bp, Homo sapien
aactcagattcaagtaggaagtgat

SEQ ID NO: 459416 - DNA, 25 bp, Homo sapien
caagtaggaagtgatggcagagtaa

SEQ ID NO: 459417 - DNA, 25 bp, Homo sapien
tgatggcagagtaagtgaaagagct

SEQ ID NO: 459418 - DNA, 25 bp, Homo sapien
ccgagggcaacgtccacagctgtag

SEQ ID NO: 459419 - DNA, 25 bp, Homo sapien
tctgccccttcccaacttaaatagg

SEQ ID NO: 459420 - DNA, 25 bp, Homo sapien
gccccttcccaacttaaataggcat

SEQ ID NO: 459421 - DNA, 25 bp, Homo sapien
cttcccaacttaaataggcataaat

SEQ ID NO: 459422 - DNA, 25 bp, Homo sapien
cataaataaaaagcgtccagaccct

SEQ ID NO: 459423 - DNA, 25 bp, Homo sapien
aataaaaagcgtccagaccctcagg

SEQ ID NO: 459424 - DNA, 25 bp, Homo sapien
ataaaaagcgtccagaccctcaggc

SEQ ID NO: 459425 - DNA, 25 bp, Homo sapien
aaaagcgtccagaccctcaggccaa

SEQ ID NO: 459426 - DNA, 25 bp, Homo sapien
gtccagaccctcaggccaacagagg

SEQ ID NO: 459427 - DNA, 25 bp, Homo sapien
agaccctcaggccaacagaggctgc

SEQ ID NO: 459428 - DNA, 25 bp, Homo sapien
gaatggggtccattcgacctccccg

SEQ ID NO: 459429 - DNA, 25 bp, Homo sapien
atttgcttctgtcccgcccttctat

SEQ ID NO: 459430 - DNA, 25 bp, Homo sapien
gaagcacagatggtctggctgctcc

SEQ ID NO: 459431 - DNA, 25 bp, Homo sapien
tctttcctctggtccaaatttcact

SEQ ID NO: 459432 - DNA, 25 bp, Homo sapien
ctctggtccaaatttcactatctgt

SEQ ID NO: 459433 - DNA, 25 bp, Homo sapien
actatctgtgatgcttcttctgacc

SEQ ID NO: 459434 - DNA, 25 bp, Homo sapien
tcttctgacccgtcatctcacattt

SEQ ID NO: 459435 - DNA, 25 bp, Homo sapien
agtgaacattcagcctccattaaaa

SEQ ID NO: 459436 - DNA, 25 bp, Homo sapien
ctgctattccccatactctataata

SEQ ID NO: 459437 - DNA, 25 bp, Homo sapien
ataatagttacattgagtgccacat

SEQ ID NO: 459438 - DNA, 25 bp, Homo sapien
ttgagtgccacataatgctgatact

SEQ ID NO: 459439 - DNA, 25 bp, Homo sapien
atgctgatacttgtctaatgttgag

SEQ ID NO: 459440 - DNA, 25 bp, Homo sapien
gtattatataacaacgtgatccaga

SEQ ID NO: 459441 - DNA, 25 bp, Homo sapien
tataacaacgtgatccagacagtga

SEQ ID NO: 459442 - DNA, 25 bp, Homo sapien
acaacgtgatccagacagtgagttc

SEQ ID NO: 459443 - DNA, 25 bp, Homo sapien
cagacagtgagttctaagtgtatta

SEQ ID NO: 459444 - DNA, 25 bp, Homo sapien
cagtgagttctaagtgtattaatta

SEQ ID NO: 459445 - DNA, 25 bp, Homo sapien
gggttgccaacctgaagtcttaagt

SEQ ID NO: 459446 - DNA, 25 bp, Homo sapien
tccttctttgaacattgtctgaaat

SEQ ID NO: 459447 - DNA, 25 bp, Homo sapien
cttctttgaacattgtctgaaattt

SEQ ID NO: 459448 - DNA, 25 bp, Homo sapien
atcaagacttcttgtacaaagaatg

SEQ ID NO: 459449 - DNA, 25 bp, Homo sapien
tcttgtacaaagaatgatgggacat

SEQ ID NO: 459450 - DNA, 25 bp, Homo sapien
atgggacatatgtaataattcaggc

SEQ ID NO: 459451 - DNA, 25 bp, Homo sapien
gacttatagaagactgatgatgcct

SEQ ID NO: 459452 - DNA, 25 bp, Homo sapien
ccttgggaccaggcagggacaatcg

SEQ ID NO: 459453 - DNA, 25 bp, Homo sapien
aatgagtcaacctgggcgctcagac

SEQ ID NO: 459454 - DNA, 25 bp, Homo sapien
agggacaatcgtggcgggtccctca

SEQ ID NO: 459455 - DNA, 25 bp, Homo sapien
gtccctcagcggagggcgctgctta

SEQ ID NO: 459456 - DNA, 25 bp, Homo sapien
agggcgctgcttacggcctgtcgtc

SEQ ID NO: 459457 - DNA, 25 bp, Homo sapien
aacctgggcgctcagaccactcatt

SEQ ID NO: 459458 - DNA, 25 bp, Homo sapien
tcagaccactcattcatctgcaaag

SEQ ID NO: 459459 - DNA, 25 bp, Homo sapien
tgcctggcgcatgggagatgcttca

SEQ ID NO: 459460 - DNA, 25 bp, Homo sapien
ggcgcatgggagatgcttcacagtt

SEQ ID NO: 459461 - DNA, 25 bp, Homo sapien
gttagctacttcctgagacttatag

SEQ ID NO: 459462 - DNA, 25 bp, Homo sapien
agcagcttttttctaaccatcctgt

SEQ ID NO: 459463 - DNA, 25 bp, Homo sapien
tttggctttttcatatacctagtgg

SEQ ID NO: 459464 - DNA, 25 bp, Homo sapien
atacctagtggtgccttatcataat

SEQ ID NO: 459465 - DNA, 25 bp, Homo sapien
gccttatcataatagcactgttaca

SEQ ID NO: 459466 - DNA, 25 bp, Homo sapien
tgttacatgaaataagcccctacct

SEQ ID NO: 459467 - DNA, 25 bp, Homo sapien
tgaaataagcccctaccttcttact

SEQ ID NO: 459468 - DNA, 25 bp, Homo sapien
taccttcttactttctggtttgttg

SEQ ID NO: 459469 - DNA, 25 bp, Homo sapien
aatacactggtgctctttgaagtga

SEQ ID NO: 459470 - DNA, 25 bp, Homo sapien
gtaattaggaaatacttctcatctg

SEQ ID NO: 459471 - DNA, 25 bp, Homo sapien
ctcatctgacagctacaaataacta

SEQ ID NO: 459472 - DNA, 25 bp, Homo sapien
ggaggtattttcactctatatgaat

SEQ ID NO: 459473 - DNA, 25 bp, Homo sapien
agggagggcctgtacagtgtccttt

SEQ ID NO: 459474 - DNA, 25 bp, Homo sapien
gggcctgtacagtgtcctttaaacg

SEQ ID NO: 459475 - DNA, 25 bp, Homo sapien
tgtacagtgtcctttaaacgctccc

SEQ ID NO: 459476 - DNA, 25 bp, Homo sapien
gtgtcctttaaacgctccccgagcg

SEQ ID NO: 459477 - DNA, 25 bp, Homo sapien
gtgggtgggcgttcctctcaagccc

SEQ ID NO: 459478 - DNA, 25 bp, Homo sapien
tcaccatttccagagccctgggagt

SEQ ID NO: 459479 - DNA, 25 bp, Homo sapien
ttccagagccctgggagttgggctt

SEQ ID NO: 459480 - DNA, 25 bp, Homo sapien
tattgatactaacctcacccaccat

SEQ ID NO: 459481 - DNA, 25 bp, Homo sapien
gggagcccagtatccagaggccttt

SEQ ID NO: 459482 - DNA, 25 bp, Homo sapien
cccagtatccagaggcctttagact

SEQ ID NO: 459483 - DNA, 25 bp, Homo sapien
tatccagaggcctttagactggctt

SEQ ID NO: 459484 - DNA, 25 bp, Homo sapien
gacatttacccaactggcaagtcgt

SEQ ID NO: 459485 - DNA, 25 bp, Homo sapien
aactggcaagtcgtgctaacccgaa

SEQ ID NO: 459486 - DNA, 25 bp, Homo sapien
tcgtgctaacccgaagacccaaagt

SEQ ID NO: 459487 - DNA, 25 bp, Homo sapien
caaagtacccctttatgcaaaatag

SEQ ID NO: 459488 - DNA, 25 bp, Homo sapien
gcagagctggttcctaccactccat

SEQ ID NO: 459489 - DNA, 25 bp, Homo sapien
acagttcatcagttcattcccaagt

SEQ ID NO: 459490 - DNA, 25 bp, Homo sapien
catcagttcattcccaagtatttat

SEQ ID NO: 459491 - DNA, 25 bp, Homo sapien
acatctctggagtactactgctcaa

SEQ ID NO: 459492 - DNA, 25 bp, Homo sapien
gctcaatttttgtgtcgttatcagg

SEQ ID NO: 459493 - DNA, 25 bp, Homo sapien
tatcaggagtataccttggctcttc

SEQ ID NO: 459494 - DNA, 25 bp, Homo sapien
ggaaacattctcagacatttaccca

SEQ ID NO: 459495 - DNA, 25 bp, Homo sapien
ggataatcttttatagttatgcaag

SEQ ID NO: 459496 - DNA, 25 bp, Homo sapien
gcaaggaaatgatgtgattcactag

SEQ ID NO: 459497 - DNA, 25 bp, Homo sapien
aagttggcatgagatacagcaaaac

SEQ ID NO: 459498 - DNA, 25 bp, Homo sapien
gggttttatttctattctggagaat

SEQ ID NO: 459499 - DNA, 25 bp, Homo sapien
atttctattctggagaatgaaccag

SEQ ID NO: 459500 - DNA, 25 bp, Homo sapien
ataaatcatataccagatggcccag

SEQ ID NO: 459501 - DNA, 25 bp, Homo sapien
atggcccagggaagcagcccatgaa

SEQ ID NO: 459502 - DNA, 25 bp, Homo sapien
gaagcagcccatgaatgtgttaggt

SEQ ID NO: 459503 - DNA, 25 bp, Homo sapien
agcccatgaatgtgttaggtggcac

SEQ ID NO: 459504 - DNA, 25 bp, Homo sapien
gaatgtgttaggtggcacttataaa

SEQ ID NO: 459505 - DNA, 25 bp, Homo sapien
gtggcacttataaaaaggctttttg

SEQ ID NO: 459506 - DNA, 25 bp, Homo sapien
agacacctggttattgcagcagcct

SEQ ID NO: 459507 - DNA, 25 bp, Homo sapien
tgtatctcaccgtcccagaatgaat

SEQ ID NO: 459508 - DNA, 25 bp, Homo sapien
aacgatggcatgagcatttgttacc

SEQ ID NO: 459509 - DNA, 25 bp, Homo sapien
agcatttgttaccatcaggcttccg

SEQ ID NO: 459510 - DNA, 25 bp, Homo sapien
aggcttccgccctagattatgagct

SEQ ID NO: 459511 - DNA, 25 bp, Homo sapien
ctgaggacaagcagagggttcatct

SEQ ID NO: 459512 - DNA, 25 bp, Homo sapien
agggttcatctctctttatagctag

SEQ ID NO: 459513 - DNA, 25 bp, Homo sapien
ttatagctagaacccagcacagcgc

SEQ ID NO: 459514 - DNA, 25 bp, Homo sapien
actcaggaggcacccaattactttg

SEQ ID NO: 459515 - DNA, 25 bp, Homo sapien
aattactttggctgactggatagac

SEQ ID NO: 459516 - DNA, 25 bp, Homo sapien
tagacatacatacagacggacggat

SEQ ID NO: 459517 - DNA, 25 bp, Homo sapien
gtacaaggactacatgacatggcat

SEQ ID NO: 459518 - DNA, 25 bp, Homo sapien
gacatggcatgtgatgacacacaca

SEQ ID NO: 459519 - DNA, 25 bp, Homo sapien
atggcatgtgatgacacacacacag

SEQ ID NO: 459520 - DNA, 25 bp, Homo sapien
agaggagatcctttttccagcatgc

SEQ ID NO: 459521 - DNA, 25 bp, Homo sapien
ggagatcctttttccagcatgcagg

SEQ ID NO: 459522 - DNA, 25 bp, Homo sapien
gaggagatcccatacatgggcttgg

SEQ ID NO: 459523 - DNA, 25 bp, Homo sapien
tggcttccctcactgcagtgtccgg

SEQ ID NO: 459524 - DNA, 25 bp, Homo sapien
ggagcaggagtgactatctccgttt

SEQ ID NO: 459525 - DNA, 25 bp, Homo sapien
gagtgactatctccgttttgcagat

SEQ ID NO: 459526 - DNA, 25 bp, Homo sapien
agcagaaccataaaggtgacctttt

SEQ ID NO: 459527 - DNA, 25 bp, Homo sapien
tattttaattatcctcacatatact

SEQ ID NO: 459528 - DNA, 25 bp, Homo sapien
tattatcaggtgtcttggccggttc

SEQ ID NO: 459529 - DNA, 25 bp, Homo sapien
atcaggtgtcttggccggttcatgc

SEQ ID NO: 459530 - DNA, 25 bp, Homo sapien
ttggccggttcatgccccacgatga

SEQ ID NO: 459531 - DNA, 25 bp, Homo sapien
ccccacgatgaaagggccagaggtt

SEQ ID NO: 459532 - DNA, 25 bp, Homo sapien
cgatgaaagggccagaggttttcat

SEQ ID NO: 459533 - DNA, 25 bp, Homo sapien
agcagaaatgtgaaacctacaatta

SEQ ID NO: 459534 - DNA, 25 bp, Homo sapien
gtgaaacctacaattaggctaaaca

SEQ ID NO: 459535 - DNA, 25 bp, Homo sapien
gggagaagagttggctacatgttta

SEQ ID NO: 459536 - DNA, 25 bp, Homo sapien
gagttggctacatgtttatgttagg

SEQ ID NO: 459537 - DNA, 25 bp, Homo sapien
gagtacattttagctatgtattcaa

SEQ ID NO: 459538 - DNA, 25 bp, Homo sapien
tagtttaatgttgctgcttataaac

SEQ ID NO: 459539 - DNA, 25 bp, Homo sapien
cactgtactaccaacaaaggtgtca

SEQ ID NO: 459540 - DNA, 25 bp, Homo sapien
aaaggtgtcagttgcttgtgctgcc

SEQ ID NO: 459541 - DNA, 25 bp, Homo sapien
tgtgctgccctgtctatgttatgct

SEQ ID NO: 459542 - DNA, 25 bp, Homo sapien
gccctgtctatgttatgctctgaat

SEQ ID NO: 459543 - DNA, 25 bp, Homo sapien
atgttatgctctgaataggtctcgg

SEQ ID NO: 459544 - DNA, 25 bp, Homo sapien
atgctctgaataggtctcggtaaag

SEQ ID NO: 459545 - DNA, 25 bp, Homo sapien
taggtctcggtaaagattatatgga

SEQ ID NO: 459546 - DNA, 25 bp, Homo sapien
aagggttcagaagaagttagcatca

SEQ ID NO: 459547 - DNA, 25 bp, Homo sapien
gttagcatcaactgtatgaaaattc

SEQ ID NO: 459548 - DNA, 25 bp, Homo sapien
agtaattctatcatgtttgcttgtt

SEQ ID NO: 459549 - DNA, 25 bp, Homo sapien
atcatgtttgcttgttttcctctac

SEQ ID NO: 459550 - DNA, 25 bp, Homo sapien
atgcaacatttagatcaacgagtac

SEQ ID NO: 459551 - DNA, 25 bp, Homo sapien
gatcaacgagtacctgtgcacgaga

SEQ ID NO: 459552 - DNA, 25 bp, Homo sapien
caacgagtacctgtgcacgagaagc

SEQ ID NO: 459553 - DNA, 25 bp, Homo sapien
cacgagaagcacagggatggtttca

SEQ ID NO: 459554 - DNA, 25 bp, Homo sapien
taggatttcatagtttgatggtgac

SEQ ID NO: 459555 - DNA, 25 bp, Homo sapien
ttgatggtgacttttgccaagctgc

SEQ ID NO: 459556 - DNA, 25 bp, Homo sapien
caagctgctgctacttggattgtgt

SEQ ID NO: 459557 - DNA, 25 bp, Homo sapien
agctgctgctacttggattgtgtgg

SEQ ID NO: 459558 - DNA, 25 bp, Homo sapien
tgctgctacttggattgtgtggtgt

SEQ ID NO: 459559 - DNA, 25 bp, Homo sapien
gctacttggattgtgtggtgtgttt

SEQ ID NO: 459560 - DNA, 25 bp, Homo sapien
actgatgagacaaggcaagaaaaca

SEQ ID NO: 459561 - DNA, 25 bp, Homo sapien
cactgtactaccaacaaaggtgtca

SEQ ID NO: 459562 - DNA, 25 bp, Homo sapien
tgtactaccaacaaaggtgtcagtt

SEQ ID NO: 459563 - DNA, 25 bp, Homo sapien
tgtgctgccctgtctatgttatgct

SEQ ID NO: 459564 - DNA, 25 bp, Homo sapien
tgctgccctgtctatgttatgctct

SEQ ID NO: 459565 - DNA, 25 bp, Homo sapien
tgccctgtctatgttatgctctgaa

SEQ ID NO: 459566 - DNA, 25 bp, Homo sapien
gccctgtctatgttatgctctgaat

SEQ ID NO: 459567 - DNA, 25 bp, Homo sapien
ccctgtctatgttatgctctgaata

SEQ ID NO: 459568 - DNA, 25 bp, Homo sapien
atgttatgctctgaataggtctcgg

SEQ ID NO: 459569 - DNA, 25 bp, Homo sapien
atgctctgaataggtctcggtaaag

SEQ ID NO: 459570 - DNA, 25 bp, Homo sapien
gctctgaataggtctcggtaaagat

SEQ ID NO: 459571 - DNA, 25 bp, Homo sapien
taggtctcggtaaagattatatgga

SEQ ID NO: 459572 - DNA, 25 bp, Homo sapien
gggaaggaaaagatgaatagccttt

SEQ ID NO: 459573 - DNA, 25 bp, Homo sapien
tggtttttgatagaattctagagaa

SEQ ID NO: 459574 - DNA, 25 bp, Homo sapien
ggtttttgatagaattctagagaag

SEQ ID NO: 459575 - DNA, 25 bp, Homo sapien
gtttttgatagaattctagagaagg

SEQ ID NO: 459576 - DNA, 25 bp, Homo sapien
tttttgatagaattctagagaaggg

SEQ ID NO: 459577 - DNA, 25 bp, Homo sapien
agaattctagagaaggggtgagccc

SEQ ID NO: 459578 - DNA, 25 bp, Homo sapien
gaattctagagaaggggtgagccct

SEQ ID NO: 459579 - DNA, 25 bp, Homo sapien
aattctagagaaggggtgagccctt

SEQ ID NO: 459580 - DNA, 25 bp, Homo sapien
attctagagaaggggtgagcccttt

SEQ ID NO: 459581 - DNA, 25 bp, Homo sapien
ttctagagaaggggtgagccctttt

SEQ ID NO: 459582 - DNA, 25 bp, Homo sapien
atgcatttgttactgctgaaaagtt

SEQ ID NO: 459583 - DNA, 25 bp, Homo sapien
gttaggactagacatttgttctgca

SEQ ID NO: 459584 - DNA, 25 bp, Homo sapien
gacagaggcagtgaaagctcagttt

SEQ ID NO: 459585 - DNA, 25 bp, Homo sapien
catcctgatagtgaagaccttgcct

SEQ ID NO: 459586 - DNA, 25 bp, Homo sapien
gatagtgaagaccttgcctttttat

SEQ ID NO: 459587 - DNA, 25 bp, Homo sapien
accaccaacatttgtgtttttgcag

SEQ ID NO: 459588 - DNA, 25 bp, Homo sapien
gtttttgcagatgaacaggttgaca

SEQ ID NO: 459589 - DNA, 25 bp, Homo sapien
aggttgacagaagtcccactggctc

SEQ ID NO: 459590 - DNA, 25 bp, Homo sapien
tcaggagtgacagcccgaattgcct

SEQ ID NO: 459591 - DNA, 25 bp, Homo sapien
gcccgaattgccttacagtatcaca

SEQ ID NO: 459592 - DNA, 25 bp, Homo sapien
cagtatcacaaagggcttctggaac

SEQ ID NO: 459593 - DNA, 25 bp, Homo sapien
tggcacagctcctgatctggtacgg

SEQ ID NO: 459594 - DNA, 25 bp, Homo sapien
gtcatggcccgagatgcccacggga

SEQ ID NO: 459595 - DNA, 25 bp, Homo sapien
tccagccaggagtgcatcaacgtgc

SEQ ID NO: 459596 - DNA, 25 bp, Homo sapien
atcaacgtgcttctgcagtacggct

SEQ ID NO: 459597 - DNA, 25 bp, Homo sapien
gctgccccgacgagtgcgtgtagta

SEQ ID NO: 459598 - DNA, 25 bp, Homo sapien
gccccgacgagtgcgtgtagtatct

SEQ ID NO: 459599 - DNA, 25 bp, Homo sapien
cgacgagtgcgtgtagtatctgttt

SEQ ID NO: 459600 - DNA, 25 bp, Homo sapien
gtagtatctgttttatttgactgca

SEQ ID NO: 459601 - DNA, 25 bp, Homo sapien
atctgttttatttgactgcagtctc

SEQ ID NO: 459602 - DNA, 25 bp, Homo sapien
cacatggctcccgtgaggaggtgaa

SEQ ID NO: 459603 - DNA, 25 bp, Homo sapien
acatggctcccgtgaggaggtgaac

SEQ ID NO: 459604 - DNA, 25 bp, Homo sapien
ccccagctaatttgtgatttcgctt

SEQ ID NO: 459605 - DNA, 25 bp, Homo sapien
taatttgtgatttcgctttctgcag

SEQ ID NO: 459606 - DNA, 25 bp, Homo sapien
ctgcagtttcagttacccattgttg

SEQ ID NO: 459607 - DNA, 25 bp, Homo sapien
ccaataccccgaaatatagtggtgt

SEQ ID NO: 459608 - DNA, 25 bp, Homo sapien
tagtggtgtgacattctgaactgaa

SEQ ID NO: 459609 - DNA, 25 bp, Homo sapien
agaagccttaaggtctctccgacca

SEQ ID NO: 459610 - DNA, 25 bp, Homo sapien
ttgtctcttccaaagcatacagtga

SEQ ID NO: 459611 - DNA, 25 bp, Homo sapien
tctgaagttcctcatctgccttaag

SEQ ID NO: 459612 - DNA, 25 bp, Homo sapien
tcatctgccttaagtctggacccac

SEQ ID NO: 459613 - DNA, 25 bp, Homo sapien
cttaagtctggacccaccaaagaag

SEQ ID NO: 459614 - DNA, 25 bp, Homo sapien
gaagaaaacaatgaccactggtccc

SEQ ID NO: 459615 - DNA, 25 bp, Homo sapien
gctcgctgcgcacggtgctggagag

SEQ ID NO: 459616 - DNA, 25 bp, Homo sapien
agcgagctgggtggcgcgggaagca

SEQ ID NO: 459617 - DNA, 25 bp, Homo sapien
tgaaccgggcgctgagcagcacctc

SEQ ID NO: 459618 - DNA, 25 bp, Homo sapien
cgctgagcagcacctcgagttagaa

SEQ ID NO: 459619 - DNA, 25 bp, Homo sapien
agcagcacctcgagttagaacccgg

SEQ ID NO: 459620 - DNA, 25 bp, Homo sapien
tcgagttagaacccggcccacgtag

SEQ ID NO: 459621 - DNA, 25 bp, Homo sapien
acgtagggcggcactcacacgcgaa

SEQ ID NO: 459622 - DNA, 25 bp, Homo sapien
tagggcggcactcacacgcgaaagt

SEQ ID NO: 459623 - DNA, 25 bp, Homo sapien
gcggcactcacacgcgaaagtatca

SEQ ID NO: 459624 - DNA, 25 bp, Homo sapien
tcacacgcgaaagtatcaccagggt

SEQ ID NO: 459625 - DNA, 25 bp, Homo sapien
aaagtatcaccagggtgccgcggtt

SEQ ID NO: 459626 - DNA, 25 bp, Homo sapien
ggacagccaagcctatttccttgat

SEQ ID NO: 459627 - DNA, 25 bp, Homo sapien
agccaagcctatttccttgatttcc

SEQ ID NO: 459628 - DNA, 25 bp, Homo sapien
ttgtgcccctcctgtcggatatctg

SEQ ID NO: 459629 - DNA, 25 bp, Homo sapien
ctcctgtcggatatctgctttggga

SEQ ID NO: 459630 - DNA, 25 bp, Homo sapien
gtcggatatctgctttgggacccat

SEQ ID NO: 459631 - DNA, 25 bp, Homo sapien
ggatatctgctttgggacccatctc

SEQ ID NO: 459632 - DNA, 25 bp, Homo sapien
gacccatctcttttgggcttgcaga

SEQ ID NO: 459633 - DNA, 25 bp, Homo sapien
atcacccagatggtcaaacatgcaa

SEQ ID NO: 459634 - DNA, 25 bp, Homo sapien
ggcaggcaaagagactcctcgaccc

SEQ ID NO: 459635 - DNA, 25 bp, Homo sapien
atatttttggaatttcaggctccct

SEQ ID NO: 459636 - DNA, 25 bp, Homo sapien
tagacctttcctagtagcccaccag

SEQ ID NO: 459637 - DNA, 25 bp, Homo sapien
actgttgggctctttgtaagcggta

SEQ ID NO: 459638 - DNA, 25 bp, Homo sapien
taagcggtacagttactaaagcgag

SEQ ID NO: 459639 - DNA, 25 bp, Homo sapien
tatggttttcttttaggcaccctca

SEQ ID NO: 459640 - DNA, 25 bp, Homo sapien
gcatggtgagggtgcctacattcta

SEQ ID NO: 459641 - DNA, 25 bp, Homo sapien
gagggtgcctacattctagttaaag

SEQ ID NO: 459642 - DNA, 25 bp, Homo sapien
gtcagtaacacaaattaactcatgt

SEQ ID NO: 459643 - DNA, 25 bp, Homo sapien
gtgtttcttacagctgattattcag

SEQ ID NO: 459644 - DNA, 25 bp, Homo sapien
gattattcagctcattaactctgat

SEQ ID NO: 459645 - DNA, 25 bp, Homo sapien
gatcataaatctggactttggaaaa

SEQ ID NO: 459646 - DNA, 25 bp, Homo sapien
agaacaaaatggtggctgaggtaga

SEQ ID NO: 459647 - DNA, 25 bp, Homo sapien
agagaaatgacttgttctctgactg

SEQ ID NO: 459648 - DNA, 25 bp, Homo sapien
ggtggtattataaaagtgctgtggt

SEQ ID NO: 459649 - DNA, 25 bp, Homo sapien
tattataaaagtgctgtggtgtggg

SEQ ID NO: 459650 - DNA, 25 bp, Homo sapien
aagtgctgtggtgtgggcacgtggc

SEQ ID NO: 459651 - DNA, 25 bp, Homo sapien
ggtggcacgcacttacggtccaggc

SEQ ID NO: 459652 - DNA, 25 bp, Homo sapien
tggcacgcacttacggtccaggcta

SEQ ID NO: 459653 - DNA, 25 bp, Homo sapien
ggcacgcacttacggtccaggctat

SEQ ID NO: 459654 - DNA, 25 bp, Homo sapien
acgcacttacggtccaggctatttg

SEQ ID NO: 459655 - DNA, 25 bp, Homo sapien
gcacttacggtccaggctatttggg

SEQ ID NO: 459656 - DNA, 25 bp, Homo sapien
cacttacggtccaggctatttggga

SEQ ID NO: 459657 - DNA, 25 bp, Homo sapien
acttacggtccaggctatttgggag

SEQ ID NO: 459658 - DNA, 25 bp, Homo sapien
ttacggtccaggctatttgggaggc

SEQ ID NO: 459659 - DNA, 25 bp, Homo sapien
tctgagacccattgtacaggattat

SEQ ID NO: 459660 - DNA, 25 bp, Homo sapien
gagacccattgtacaggattattaa

SEQ ID NO: 459661 - DNA, 25 bp, Homo sapien
gacccattgtacaggattattaata

SEQ ID NO: 459662 - DNA, 25 bp, Homo sapien
tagccctcataataaggtattataa

SEQ ID NO: 459663 - DNA, 25 bp, Homo sapien
ggtattataaatgtcaagattgcta

SEQ ID NO: 459664 - DNA, 25 bp, Homo sapien
gtcaagattgctaaaagaatacgtt

SEQ ID NO: 459665 - DNA, 25 bp, Homo sapien
ggtgatggacatattaatcagctta

SEQ ID NO: 459666 - DNA, 25 bp, Homo sapien
atagtatatgtagctatatcaaaac

SEQ ID NO: 459667 - DNA, 25 bp, Homo sapien
aaacatcacattataacccataact

SEQ ID NO: 459668 - DNA, 25 bp, Homo sapien
taacccataactacatgcaattatt

SEQ ID NO: 459669 - DNA, 25 bp, Homo sapien
aatacaaatctaggccaaggtggga

SEQ ID NO: 459670 - DNA, 25 bp, Homo sapien
tacccttcggcaatatcatttcctc

SEQ ID NO: 459671 - DNA, 25 bp, Homo sapien
ttcggcaatatcatttcctccaagg

SEQ ID NO: 459672 - DNA, 25 bp, Homo sapien
ttcctccaaggtgtttatggatcga

SEQ ID NO: 459673 - DNA, 25 bp, Homo sapien
ccaaggtgtttatggatcgagctac

SEQ ID NO: 459674 - DNA, 25 bp, Homo sapien
ggtgtttatggatcgagctaccaac

SEQ ID NO: 459675 - DNA, 25 bp, Homo sapien
gtttatggatcgagctaccaaccag

SEQ ID NO: 459676 - DNA, 25 bp, Homo sapien
ccagagcaagtgtttcggcttcgtg

SEQ ID NO: 459677 - DNA, 25 bp, Homo sapien
agagcaagtgtttcggcttcgtgag

SEQ ID NO: 459678 - DNA, 25 bp, Homo sapien
gagctttgataacccggccagcgcc

SEQ ID NO: 459679 - DNA, 25 bp, Homo sapien
gataacccggccagcgcccaggcag

SEQ ID NO: 459680 - DNA, 25 bp, Homo sapien
atcccccgtttctgttcattcacag

SEQ ID NO: 459681 - DNA, 25 bp, Homo sapien
ctacgccagccaagtttcgtcatag

SEQ ID NO: 459682 - DNA, 25 bp, Homo sapien
agccaagtttcgtcatagccagttc

SEQ ID NO: 459683 - DNA, 25 bp, Homo sapien
agtttcgtcatagccagttccagct

SEQ ID NO: 459684 - DNA, 25 bp, Homo sapien
gagacagtgggcgtcgtccatcctc

SEQ ID NO: 459685 - DNA, 25 bp, Homo sapien
gggcgtcgtccatcctcagtgagaa

SEQ ID NO: 459686 - DNA, 25 bp, Homo sapien
gtcgtccatcctcagtgagaacacc

SEQ ID NO: 459687 - DNA, 25 bp, Homo sapien
agaaggtggttcttcaagccgagag

SEQ ID NO: 459688 - DNA, 25 bp, Homo sapien
ggtggttcttcaagccgagaggcac

SEQ ID NO: 459689 - DNA, 25 bp, Homo sapien
ggacagttctgcctctgtgactgct

SEQ ID NO: 459690 - DNA, 25 bp, Homo sapien
tctgtgactgctgctttgcatgaaa

SEQ ID NO: 459691 - DNA, 25 bp, Homo sapien
gaaaactcatttgatgtatattggg

SEQ ID NO: 459692 - DNA, 25 bp, Homo sapien
atcacctcagctaaccagaccgaag

SEQ ID NO: 459693 - DNA, 25 bp, Homo sapien
tcacctcagctaaccagaccgaaga

SEQ ID NO: 459694 - DNA, 25 bp, Homo sapien
cacctcagctaaccagaccgaagaa

SEQ ID NO: 459695 - DNA, 25 bp, Homo sapien
acctcagctaaccagaccgaagaag

SEQ ID NO: 459696 - DNA, 25 bp, Homo sapien
cctcagctaaccagaccgaagaaga

SEQ ID NO: 459697 - DNA, 25 bp, Homo sapien
tcagctaaccagaccgaagaagaga

SEQ ID NO: 459698 - DNA, 25 bp, Homo sapien
cagctaaccagaccgaagaagagaa

SEQ ID NO: 459699 - DNA, 25 bp, Homo sapien
gctaaccagaccgaagaagagaatt

SEQ ID NO: 459700 - DNA, 25 bp, Homo sapien
ctaaccagaccgaagaagagaattg

SEQ ID NO: 459701 - DNA, 25 bp, Homo sapien
cgaagaagagaattggacggccgat

SEQ ID NO: 459702 - DNA, 25 bp, Homo sapien
aagagaattggacggccgatggtgg

SEQ ID NO: 459703 - DNA, 25 bp, Homo sapien
tccagtcccagacggcaatgttcct

SEQ ID NO: 459704 - DNA, 25 bp, Homo sapien
gagccagaacactcacagagacacc

SEQ ID NO: 459705 - DNA, 25 bp, Homo sapien
actcacagagacacccctgagaggg

SEQ ID NO: 459706 - DNA, 25 bp, Homo sapien
gacgggcacctggaaccagtcacgg

SEQ ID NO: 459707 - DNA, 25 bp, Homo sapien
acctggaaccagtcacggcttggga

SEQ ID NO: 459708 - DNA, 25 bp, Homo sapien
aggtgccccgtgttaggcgcctttg

SEQ ID NO: 459709 - DNA, 25 bp, Homo sapien
tttgtcggggacttgcaaggcctca

SEQ ID NO: 459710 - DNA, 25 bp, Homo sapien
gcctcacctgtttggccatgattga

SEQ ID NO: 459711 - DNA, 25 bp, Homo sapien
cacctgtttggccatgattgatgac

SEQ ID NO: 459712 - DNA, 25 bp, Homo sapien
gattgatgacgtgactgcttccatt

SEQ ID NO: 459713 - DNA, 25 bp, Homo sapien
tgacgtgactgcttccattttgcag

SEQ ID NO: 459714 - DNA, 25 bp, Homo sapien
gtcctgttttggcttaaatctaagg

SEQ ID NO: 459715 - DNA, 25 bp, Homo sapien
gttttggcttaaatctaaggtcttg

SEQ ID NO: 459716 - DNA, 25 bp, Homo sapien
ttggcttaaatctaaggtcttgttg

SEQ ID NO: 459717 - DNA, 25 bp, Homo sapien
gcttaaatctaaggtcttgttggat

SEQ ID NO: 459718 - DNA, 25 bp, Homo sapien
aaatctaaggtcttgttggatgtga

SEQ ID NO: 459719 - DNA, 25 bp, Homo sapien
aaggtcttgttggatgtgatggctc

SEQ ID NO: 459720 - DNA, 25 bp, Homo sapien
ggtcttgttggatgtgatggctcac

SEQ ID NO: 459721 - DNA, 25 bp, Homo sapien
aatcccaacacagagactaagacag

SEQ ID NO: 459722 - DNA, 25 bp, Homo sapien
tcccaacacagagactaagacagat

SEQ ID NO: 459723 - DNA, 25 bp, Homo sapien
acacagagactaagacagatcactt

SEQ ID NO: 459724 - DNA, 25 bp, Homo sapien
cagcacatggggcacatgcctatat

SEQ ID NO: 459725 - DNA, 25 bp, Homo sapien
tgctctctcctgagattcacatttc

SEQ ID NO: 459726 - DNA, 25 bp, Homo sapien
tctctcctgagattcacatttcctg

SEQ ID NO: 459727 - DNA, 25 bp, Homo sapien
ctcctgagattcacatttcctgcaa

SEQ ID NO: 459728 - DNA, 25 bp, Homo sapien
ctgagattcacatttcctgcaaaac

SEQ ID NO: 459729 - DNA, 25 bp, Homo sapien
gattcacatttcctgcaaaaccacg

SEQ ID NO: 459730 - DNA, 25 bp, Homo sapien
ttcacatttcctgcaaaaccacggt

SEQ ID NO: 459731 - DNA, 25 bp, Homo sapien
atttcctgcaaaaccacggtccagt

SEQ ID NO: 459732 - DNA, 25 bp, Homo sapien
gcaaaaccacggtccagtgggtact

SEQ ID NO: 459733 - DNA, 25 bp, Homo sapien
tccagtgggtacttgaacaatgcca

SEQ ID NO: 459734 - DNA, 25 bp, Homo sapien
gggtacttgaacaatgccatagcaa

SEQ ID NO: 459735 - DNA, 25 bp, Homo sapien
tgaacaatgccatagcaagcttgat

SEQ ID NO: 459736 - DNA, 25 bp, Homo sapien
gggtgcatctccagagccactcaca

SEQ ID NO: 459737 - DNA, 25 bp, Homo sapien
tatttctgggtgcagcgccaagcga

SEQ ID NO: 459738 - DNA, 25 bp, Homo sapien
atttctgggtgcagcgccaagcgag

SEQ ID NO: 459739 - DNA, 25 bp, Homo sapien
gatgggagcgactgctggcttcatt

SEQ ID NO: 459740 - DNA, 25 bp, Homo sapien
gactgctggcttcattccatggaaa

SEQ ID NO: 459741 - DNA, 25 bp, Homo sapien
gctggcttcattccatggaaattat

SEQ ID NO: 459742 - DNA, 25 bp, Homo sapien
tctctgttgccccagctggaagaca

SEQ ID NO: 459743 - DNA, 25 bp, Homo sapien
cagctggaagacacttgagtcccaa

SEQ ID NO: 459744 - DNA, 25 bp, Homo sapien
gaagacacttgagtcccaatcagcc

SEQ ID NO: 459745 - DNA, 25 bp, Homo sapien
tgagtcccaatcagccccagagaaa

SEQ ID NO: 459746 - DNA, 25 bp, Homo sapien
gagaaacactggtttaatcaactgg

SEQ ID NO: 459747 - DNA, 25 bp, Homo sapien
gtgtgaagcctcagtttaggtcatc

SEQ ID NO: 459748 - DNA, 25 bp, Homo sapien
gtgaagcctcagtttaggtcatctg

SEQ ID NO: 459749 - DNA, 25 bp, Homo sapien
gaagcctcagtttaggtcatctggt

SEQ ID NO: 459750 - DNA, 25 bp, Homo sapien
aagcctcagtttaggtcatctggtg

SEQ ID NO: 459751 - DNA, 25 bp, Homo sapien
gcctcagtttaggtcatctggtggt

SEQ ID NO: 459752 - DNA, 25 bp, Homo sapien
ctcagtttaggtcatctggtggttc

SEQ ID NO: 459753 - DNA, 25 bp, Homo sapien
cagtttaggtcatctggtggttcag

SEQ ID NO: 459754 - DNA, 25 bp, Homo sapien
gtttaggtcatctggtggttcagaa

SEQ ID NO: 459755 - DNA, 25 bp, Homo sapien
taggtcatctggtggttcagaacac

SEQ ID NO: 459756 - DNA, 25 bp, Homo sapien
ggtcatctggtggttcagaacactc

SEQ ID NO: 459757 - DNA, 25 bp, Homo sapien
tcatctggtggttcagaacactcaa

SEQ ID NO: 459758 - DNA, 25 bp, Homo sapien
gagagaaagacagcatcacccttat

SEQ ID NO: 459759 - DNA, 25 bp, Homo sapien
gcatcacccttatctccatgaagaa

SEQ ID NO: 459760 - DNA, 25 bp, Homo sapien
tggcaaacaaagtctctcagcagag

SEQ ID NO: 459761 - DNA, 25 bp, Homo sapien
taaaagcaactttgggtccccatga

SEQ ID NO: 459762 - DNA, 25 bp, Homo sapien
ggtccccatgagtccaaggatgatg

SEQ ID NO: 459763 - DNA, 25 bp, Homo sapien
agtccaaggatgatgcagctgccct

SEQ ID NO: 459764 - DNA, 25 bp, Homo sapien
ggaattagtagaggcaatgaaccac

SEQ ID NO: 459765 - DNA, 25 bp, Homo sapien
gaggcaatgaaccacatgtaaatta

SEQ ID NO: 459766 - DNA, 25 bp, Homo sapien
gaaacctgggagttcagggctgtct

SEQ ID NO: 459767 - DNA, 25 bp, Homo sapien
agggctgtctgaaagctgctccaca

SEQ ID NO: 459768 - DNA, 25 bp, Homo sapien
ctgctccacagccaatggagagaaa

SEQ ID NO: 459769 - DNA, 25 bp, Homo sapien
tttccacaaccattaatctcacttg

SEQ ID NO: 459770 - DNA, 25 bp, Homo sapien
atctcacttgtatatggcacaccca

SEQ ID NO: 459771 - DNA, 25 bp, Homo sapien
tcacttgtatatggcacacccagca

SEQ ID NO: 459772 - DNA, 25 bp, Homo sapien
cagcacttgtgcctgtgggccatat

SEQ ID NO: 459773 - DNA, 25 bp, Homo sapien
acttgtgcctgtgggccatattaga

SEQ ID NO: 459774 - DNA, 25 bp, Homo sapien
gcctgtgggccatattagatgttca

SEQ ID NO: 459775 - DNA, 25 bp, Homo sapien
gggccatattagatgttcattgtca

SEQ ID NO: 459776 - DNA, 25 bp, Homo sapien
agatgttcattgtcagagctcaaga

SEQ ID NO: 459777 - DNA, 25 bp, Homo sapien
cattgtcagagctcaagatgatata

SEQ ID NO: 459778 - DNA, 25 bp, Homo sapien
tgtgccttgtattttggggaaactc

SEQ ID NO: 459779 - DNA, 25 bp, Homo sapien
ttgtatgatgaaaaccctaatgaga

SEQ ID NO: 459780 - DNA, 25 bp, Homo sapien
taaggtccctccagtatccttccag

SEQ ID NO: 459781 - DNA, 25 bp, Homo sapien
cctccagtatccttccaggagagaa

SEQ ID NO: 459782 - DNA, 25 bp, Homo sapien
agaggtccgggcatcggtgtctcca

SEQ ID NO: 459783 - DNA, 25 bp, Homo sapien
atctcatcagaattcagccttgcct

SEQ ID NO: 459784 - DNA, 25 bp, Homo sapien
gggcatcggtgtctccaccgtcact

SEQ ID NO: 459785 - DNA, 25 bp, Homo sapien
gtcactcacacaccctatgtgtttg

SEQ ID NO: 459786 - DNA, 25 bp, Homo sapien
tcatcagaattcagccttgcctggg

SEQ ID NO: 459787 - DNA, 25 bp, Homo sapien
cacacaccctatgtgtttgggaaag

SEQ ID NO: 459788 - DNA, 25 bp, Homo sapien
ggaaagtggggtccctatccacctg

SEQ ID NO: 459789 - DNA, 25 bp, Homo sapien
gggtcctgatgactctcccgctgtc

SEQ ID NO: 459790 - DNA, 25 bp, Homo sapien
agagcccatggccacatagagcccc

SEQ ID NO: 459791 - DNA, 25 bp, Homo sapien
gcagcaagctgaccttggtacccac

SEQ ID NO: 459792 - DNA, 25 bp, Homo sapien
gctgaccttggtacccaccgtggaa

SEQ ID NO: 459793 - DNA, 25 bp, Homo sapien
tggaagcgggcctcatgtctcaggc

SEQ ID NO: 459794 - DNA, 25 bp, Homo sapien
tgtctcaggcctcaaggccggaaca

SEQ ID NO: 459795 - DNA, 25 bp, Homo sapien
ggaacagtccgtgatgcaagctctc

SEQ ID NO: 459796 - DNA, 25 bp, Homo sapien
atgcaagctctcgagagtctcacgg

SEQ ID NO: 459797 - DNA, 25 bp, Homo sapien
agtctcacggagacgcaggtcagtg

SEQ ID NO: 459798 - DNA, 25 bp, Homo sapien
aggtcagtgacttcctgtcgggccg

SEQ ID NO: 459799 - DNA, 25 bp, Homo sapien
tgtcgggccgttcgccactgacact

SEQ ID NO: 459800 - DNA, 25 bp, Homo sapien
actggccttgcgtgtgggcgaccac

SEQ ID NO: 459801 - DNA, 25 bp, Homo sapien
gcgaccacatgatgttcgtgcagct

SEQ ID NO: 459802 - DNA, 25 bp, Homo sapien
catgaggaaagctgctgccaagaaa

SEQ ID NO: 459803 - DNA, 25 bp, Homo sapien
atgaggaaagctgctgccaagaaag

SEQ ID NO: 459804 - DNA, 25 bp, Homo sapien
tgaggaaagctgctgccaagaaaga

SEQ ID NO: 459805 - DNA, 25 bp, Homo sapien
gaggaaagctgctgccaagaaagac

SEQ ID NO: 459806 - DNA, 25 bp, Homo sapien
aggaaagctgctgccaagaaagact

SEQ ID NO: 459807 - DNA, 25 bp, Homo sapien
gaaagctgctgccaagaaagactga

SEQ ID NO: 459808 - DNA, 25 bp, Homo sapien
aaagctgctgccaagaaagactgag

SEQ ID NO: 459809 - DNA, 25 bp, Homo sapien
aagctgctgccaagaaagactgagc

SEQ ID NO: 459810 - DNA, 25 bp, Homo sapien
gctgccaagaaagactgagcccctc

SEQ ID NO: 459811 - DNA, 25 bp, Homo sapien
ctgccaagaaagactgagcccctcc

SEQ ID NO: 459812 - DNA, 25 bp, Homo sapien
ccaagaaagactgagcccctcccct

SEQ ID NO: 459813 - DNA, 25 bp, Homo sapien
gtatcattttacaagatagtgctga

SEQ ID NO: 459814 - DNA, 25 bp, Homo sapien
atcattttacaagatagtgctgaga

SEQ ID NO: 459815 - DNA, 25 bp, Homo sapien
tcattttacaagatagtgctgagag

SEQ ID NO: 459816 - DNA, 25 bp, Homo sapien
cattttacaagatagtgctgagaga

SEQ ID NO: 459817 - DNA, 25 bp, Homo sapien
attttacaagatagtgctgagagag

SEQ ID NO: 459818 - DNA, 25 bp, Homo sapien
ttttacaagatagtgctgagagagt

SEQ ID NO: 459819 - DNA, 25 bp, Homo sapien
tttacaagatagtgctgagagagta

SEQ ID NO: 459820 - DNA, 25 bp, Homo sapien
tacaagatagtgctgagagagtata

SEQ ID NO: 459821 - DNA, 25 bp, Homo sapien
acaagatagtgctgagagagtataa

SEQ ID NO: 459822 - DNA, 25 bp, Homo sapien
gtataaaaagcagatgtaggccggg

SEQ ID NO: 459823 - DNA, 25 bp, Homo sapien
gcagatgtaggccgggcactgtagc

SEQ ID NO: 459824 - DNA, 25 bp, Homo sapien
gagaaagacagcatcacccttatct

SEQ ID NO: 459825 - DNA, 25 bp, Homo sapien
gaaagacagcatcacccttatctcc

SEQ ID NO: 459826 - DNA, 25 bp, Homo sapien
gcatcacccttatctccatgaagaa

SEQ ID NO: 459827 - DNA, 25 bp, Homo sapien
atcacccttatctccatgaagaaca

SEQ ID NO: 459828 - DNA, 25 bp, Homo sapien
acccttatctccatgaagaacatca

SEQ ID NO: 459829 - DNA, 25 bp, Homo sapien
ttatctccatgaagaacatcaacat

SEQ ID NO: 459830 - DNA, 25 bp, Homo sapien
gaacatcaacatgaataatggcaaa

SEQ ID NO: 459831 - DNA, 25 bp, Homo sapien
gaaacctgggagttcagggctgtct

SEQ ID NO: 459832 - DNA, 25 bp, Homo sapien
acctgggagttcagggctgtctgaa

SEQ ID NO: 459833 - DNA, 25 bp, Homo sapien
agttcagggctgtctgaaagctgct

SEQ ID NO: 459834 - DNA, 25 bp, Homo sapien
ctgctccacagccaatggagagaaa

SEQ ID NO: 459835 - DNA, 25 bp, Homo sapien
ttcttaaagtcattctctgcctgca

SEQ ID NO: 459836 - DNA, 25 bp, Homo sapien
aaagtcattctctgcctgcatccag

SEQ ID NO: 459837 - DNA, 25 bp, Homo sapien
cctctcctcacacgtagatcatttt

SEQ ID NO: 459838 - DNA, 25 bp, Homo sapien
cagggtgctgcctatgggccctctg

SEQ ID NO: 459839 - DNA, 25 bp, Homo sapien
gggtgctgcctatgggccctctgct

SEQ ID NO: 459840 - DNA, 25 bp, Homo sapien
tctgctccccaatgccttagagaga

SEQ ID NO: 459841 - DNA, 25 bp, Homo sapien
gctccccaatgccttagagagagga

SEQ ID NO: 459842 - DNA, 25 bp, Homo sapien
gcacggccgctcaccggaaggctgt

SEQ ID NO: 459843 - DNA, 25 bp, Homo sapien
ctccctgggcagaatgtagcttttc

SEQ ID NO: 459844 - DNA, 25 bp, Homo sapien
gcagaatgtagcttttctgcttcac

SEQ ID NO: 459845 - DNA, 25 bp, Homo sapien
ccctggatccttagatcccagagga

SEQ ID NO: 459846 - DNA, 25 bp, Homo sapien
tacccagcaaaaatgagtgtctcag

SEQ ID NO: 459847 - DNA, 25 bp, Homo sapien
gagtgtctcagaagtgtgctcctct

SEQ ID NO: 459848 - DNA, 25 bp, Homo sapien
ctcagttctcctcttttggaacaac

SEQ ID NO: 459849 - DNA, 25 bp, Homo sapien
gggatatctgctcagccaatggaaa

SEQ ID NO: 459850 - DNA, 25 bp, Homo sapien
ccaatggaaaatctgggttcaacca

SEQ ID NO: 459851 - DNA, 25 bp, Homo sapien
gatcctgagctgcacttacctgtga

SEQ ID NO: 459852 - DNA, 25 bp, Homo sapien
agctgcacttacctgtgagagtctt

SEQ ID NO: 459853 - DNA, 25 bp, Homo sapien
acctgtgagagtcttcaaactttta

SEQ ID NO: 459854 - DNA, 25 bp, Homo sapien
aaaccttgccagtcaggacttttgc

SEQ ID NO: 459855 - DNA, 25 bp, Homo sapien
atagaaaacccaactcaacctgctt

SEQ ID NO: 459856 - DNA, 25 bp, Homo sapien
acccaactcaacctgcttaagcaga

SEQ ID NO: 459857 - DNA, 25 bp, Homo sapien
attctctgcctgcatccagcccctt

SEQ ID NO: 459858 - DNA, 25 bp, Homo sapien
ttctctgcctgcatccagccccttg

SEQ ID NO: 459859 - DNA, 25 bp, Homo sapien
tctctgcctgcatccagccccttgc

SEQ ID NO: 459860 - DNA, 25 bp, Homo sapien
cctctcctcacacgtagatcatttt

SEQ ID NO: 459861 - DNA, 25 bp, Homo sapien
cagggtgctgcctatgggccctctg

SEQ ID NO: 459862 - DNA, 25 bp, Homo sapien
gggtgctgcctatgggccctctgct

SEQ ID NO: 459863 - DNA, 25 bp, Homo sapien
ggtgctgcctatgggccctctgctc

SEQ ID NO: 459864 - DNA, 25 bp, Homo sapien
gtgctgcctatgggccctctgctcc

SEQ ID NO: 459865 - DNA, 25 bp, Homo sapien
tgctgcctatgggccctctgctccc

SEQ ID NO: 459866 - DNA, 25 bp, Homo sapien
gctgcctatgggccctctgctcccc

SEQ ID NO: 459867 - DNA, 25 bp, Homo sapien
ctgcctatgggccctctgctcccca

SEQ ID NO: 459868 - DNA, 25 bp, Homo sapien
aatttttgacttttggctcacgcct

SEQ ID NO: 459869 - DNA, 25 bp, Homo sapien
atttttgacttttggctcacgcctg

SEQ ID NO: 459870 - DNA, 25 bp, Homo sapien
aggtgggtagatcatttcagctcag

SEQ ID NO: 459871 - DNA, 25 bp, Homo sapien
gggtagatcatttcagctcaggaat

SEQ ID NO: 459872 - DNA, 25 bp, Homo sapien
tagatcatttcagctcaggaattcg

SEQ ID NO: 459873 - DNA, 25 bp, Homo sapien
tgagcctaggcggttgaagcagcac

SEQ ID NO: 459874 - DNA, 25 bp, Homo sapien
cctaggcggttgaagcagcactgag

SEQ ID NO: 459875 - DNA, 25 bp, Homo sapien
gttgaagcagcactgagccacgatc

SEQ ID NO: 459876 - DNA, 25 bp, Homo sapien
ttgaagcagcactgagccacgatca

SEQ ID NO: 459877 - DNA, 25 bp, Homo sapien
tgaagcagcactgagccacgatcac

SEQ ID NO: 459878 - DNA, 25 bp, Homo sapien
gaagcagcactgagccacgatcaca

SEQ ID NO: 459879 - DNA, 25 bp, Homo sapien
gagtagctgccatgttcacagttta

SEQ ID NO: 459880 - DNA, 25 bp, Homo sapien
attttactggatacaggcgtacctt

SEQ ID NO: 459881 - DNA, 25 bp, Homo sapien
ggcgtaccttgcttaattgtgcatt

SEQ ID NO: 459882 - DNA, 25 bp, Homo sapien
tactgcattttatacacactgaagg

SEQ ID NO: 459883 - DNA, 25 bp, Homo sapien
ggtttgcagcaaccttgcagtgaat

SEQ ID NO: 459884 - DNA, 25 bp, Homo sapien
gtgaataagtctatcagcaccattt

SEQ ID NO: 459885 - DNA, 25 bp, Homo sapien
gcaccattttccaaacagcatatgc

SEQ ID NO: 459886 - DNA, 25 bp, Homo sapien
acagcatatgcacatttcatgtctt

SEQ ID NO: 459887 - DNA, 25 bp, Homo sapien
tgtctttgtgtcacactttgctagt

SEQ ID NO: 459888 - DNA, 25 bp, Homo sapien
gtgtcacactttgctagttttcata

SEQ ID NO: 459889 - DNA, 25 bp, Homo sapien
tctgtgaccagtgttttttgattac

SEQ ID NO: 459890 - DNA, 25 bp, Homo sapien
cttatataactttctgtgagagcat

SEQ ID NO: 459891 - DNA, 25 bp, Homo sapien
ttctgcttcaagttacatggtgtct

SEQ ID NO: 459892 - DNA, 25 bp, Homo sapien
ttacatggtgtctagccttttcagc

SEQ ID NO: 459893 - DNA, 25 bp, Homo sapien
gtgtctagccttttcagctctagaa

SEQ ID NO: 459894 - DNA, 25 bp, Homo sapien
tagccttttcagctctagaaattct

SEQ ID NO: 459895 - DNA, 25 bp, Homo sapien
gtaatatcctgctttatgggtcttg

SEQ ID NO: 459896 - DNA, 25 bp, Homo sapien
cctgctttatgggtcttggtggtat

SEQ ID NO: 459897 - DNA, 25 bp, Homo sapien
ggtatatggtatagatcaactcaaa

SEQ ID NO: 459898 - DNA, 25 bp, Homo sapien
tagtatcatagttcagtctgttcca

SEQ ID NO: 459899 - DNA, 25 bp, Homo sapien
tagttcagtctgttccaagctgtaa

SEQ ID NO: 459900 - DNA, 25 bp, Homo sapien
gtctgttccaagctgtaaagtcagt

SEQ ID NO: 459901 - DNA, 25 bp, Homo sapien
aagagcgaactgtgcagggatatcc

SEQ ID NO: 459902 - DNA, 25 bp, Homo sapien
gcgaactgtgcagggatatcctaca

SEQ ID NO: 459903 - DNA, 25 bp, Homo sapien
aactgtgcagggatatcctacagaa

SEQ ID NO: 459904 - DNA, 25 bp, Homo sapien
tgtgcagggatatcctacagaaata

SEQ ID NO: 459905 - DNA, 25 bp, Homo sapien
agggatatcctacagaaatagtggg

SEQ ID NO: 459906 - DNA, 25 bp, Homo sapien
gggcgtcgattgcagctgttcatct

SEQ ID NO: 459907 - DNA, 25 bp, Homo sapien
gtcgattgcagctgttcatctggca

SEQ ID NO: 459908 - DNA, 25 bp, Homo sapien
gattgcagctgttcatctggcagga

SEQ ID NO: 459909 - DNA, 25 bp, Homo sapien
tgcagctgttcatctggcaggagat

SEQ ID NO: 459910 - DNA, 25 bp, Homo sapien
agctgttcatctggcaggagatgtt

SEQ ID NO: 459911 - DNA, 25 bp, Homo sapien
gttcatctggcaggagatgttgatc

SEQ ID NO: 459912 - DNA, 25 bp, Homo sapien
ttgtcacaccccattactgcagact

SEQ ID NO: 459913 - DNA, 25 bp, Homo sapien
accccattactgcagactctagtct

SEQ ID NO: 459914 - DNA, 25 bp, Homo sapien
cagactctagtctgctggtcttgcc

SEQ ID NO: 459915 - DNA, 25 bp, Homo sapien
tggtcttgccagagaatcctccgca

SEQ ID NO: 459916 - DNA, 25 bp, Homo sapien
gaatcctccgcaatagaggcatggg

SEQ ID NO: 459917 - DNA, 25 bp, Homo sapien
gcggaaagagagcaaacctctgccc

SEQ ID NO: 459918 - DNA, 25 bp, Homo sapien
gacagggaaccaaatgatctcagag

SEQ ID NO: 459919 - DNA, 25 bp, Homo sapien
gatctcagagtatctggttggtgtc

SEQ ID NO: 459920 - DNA, 25 bp, Homo sapien
gttggtgtcttgtctccctcagaaa

SEQ ID NO: 459921 - DNA, 25 bp, Homo sapien
gtctccctcagaaatgttgcattta

SEQ ID NO: 459922 - DNA, 25 bp, Homo sapien
tgttgcatttagagcagtgcacaca

SEQ ID NO: 459923 - DNA, 25 bp, Homo sapien
gcaggctgagagctcacctgttcag

SEQ ID NO: 459924 - DNA, 25 bp, Homo sapien
gagagctcacctgttcagcagagaa

SEQ ID NO: 459925 - DNA, 25 bp, Homo sapien
ctgtctaccacagtgttatcagctt

SEQ ID NO: 459926 - DNA, 25 bp, Homo sapien
gtgttatcagcttcattgtcatcct

SEQ ID NO: 459927 - DNA, 25 bp, Homo sapien
tcatcctggtggttgtggtgatcat

SEQ ID NO: 459928 - DNA, 25 bp, Homo sapien
ggtggttgtggtgatcatcctagtt

SEQ ID NO: 459929 - DNA, 25 bp, Homo sapien
gatcatcctagttggtgtggtcagc

SEQ ID NO: 459930 - DNA, 25 bp, Homo sapien
atcctagttggtgtggtcagcctga

SEQ ID NO: 459931 - DNA, 25 bp, Homo sapien
gtcagcctgaggttcaagtgtcgga

SEQ ID NO: 459932 - DNA, 25 bp, Homo sapien
tcaagtgtcggaagagcaaggagtc

SEQ ID NO: 459933 - DNA, 25 bp, Homo sapien
aaggagtctgaagatccccagaaac

SEQ ID NO: 459934 - DNA, 25 bp, Homo sapien
gtctggttttgaacttcgggattca

SEQ ID NO: 459935 - DNA, 25 bp, Homo sapien
gaacttcgggattcaagcaatccgc

SEQ ID NO: 459936 - DNA, 25 bp, Homo sapien
ttcgggattcaagcaatccgccagc

SEQ ID NO: 459937 - DNA, 25 bp, Homo sapien
gggattcaagcaatccgccagcctc

SEQ ID NO: 459938 - DNA, 25 bp, Homo sapien
agtgtgagctaccaccactggcagt

SEQ ID NO: 459939 - DNA, 25 bp, Homo sapien
gtgagctaccaccactggcagttaa

SEQ ID NO: 459940 - DNA, 25 bp, Homo sapien
gagctaccaccactggcagttaaga

SEQ ID NO: 459941 - DNA, 25 bp, Homo sapien
accaccactggcagttaagaatttt

SEQ ID NO: 459942 - DNA, 25 bp, Homo sapien
gaaacaagaatctcaattagagtct

SEQ ID NO: 459943 - DNA, 25 bp, Homo sapien
agagtctttatatacaatctgtact

SEQ ID NO: 459944 - DNA, 25 bp, Homo sapien
ctttatatacaatctgtactgttgg

SEQ ID NO: 459945 - DNA, 25 bp, Homo sapien
gcaagtcagtgtaagtccccaggga

SEQ ID NO: 459946 - DNA, 25 bp, Homo sapien
tctctctgcagaagccctggtaacc

SEQ ID NO: 459947 - DNA, 25 bp, Homo sapien
gatttctgaggagctgtcaggccat

SEQ ID NO: 459948 - DNA, 25 bp, Homo sapien
gaggagctgtcaggccatgtccttg

SEQ ID NO: 459949 - DNA, 25 bp, Homo sapien
catgtccttgtccaccctgtgtggg

SEQ ID NO: 459950 - DNA, 25 bp, Homo sapien
gggcacggcttcgacatggctctgc

SEQ ID NO: 459951 - DNA, 25 bp, Homo sapien
tctgctcccgtcgtgggctgagaag

SEQ ID NO: 459952 - DNA, 25 bp, Homo sapien
tgtgccttggaaaggaggccctccc

SEQ ID NO: 459953 - DNA, 25 bp, Homo sapien
aaaggaggccctcccgacatgcctt

SEQ ID NO: 459954 - DNA, 25 bp, Homo sapien
gacatgcctttgtgcgaggtccctg

SEQ ID NO: 459955 - DNA, 25 bp, Homo sapien
tttgtgcgaggtccctgtccatgct

SEQ ID NO: 459956 - DNA, 25 bp, Homo sapien
gttctggtcagaaggtaaactctca

SEQ ID NO: 459957 - DNA, 25 bp, Homo sapien
gaaggtaaactctcacaccagccat

SEQ ID NO: 459958 - DNA, 25 bp, Homo sapien
gccatacttccactggctggagcaa

SEQ ID NO: 459959 - DNA, 25 bp, Homo sapien
gaatctctggagatcggcgtgcttc

SEQ ID NO: 459960 - DNA, 25 bp, Homo sapien
gctgcacctccatggtttcaaagta

SEQ ID NO: 459961 - DNA, 25 bp, Homo sapien
cctccatggtttcaaagtagcctct

SEQ ID NO: 459962 - DNA, 25 bp, Homo sapien
tcacctcacattctaattcctctag

SEQ ID NO: 459963 - DNA, 25 bp, Homo sapien
acattctaattcctctagggcccaa

SEQ ID NO: 459964 - DNA, 25 bp, Homo sapien
tctagggcccaactgtcacttttgc

SEQ ID NO: 459965 - DNA, 25 bp, Homo sapien
aactgtcacttttgccgtggaccct

SEQ ID NO: 459966 - DNA, 25 bp, Homo sapien
gtcctgctgaaaattgcagcctcca

SEQ ID NO: 459967 - DNA, 25 bp, Homo sapien
aaagttcacatctctgtaagtccca

SEQ ID NO: 459968 - DNA, 25 bp, Homo sapien
agttcacatctctgtaagtcccagc

SEQ ID NO: 459969 - DNA, 25 bp, Homo sapien
gttcacatctctgtaagtcccagct

SEQ ID NO: 459970 - DNA, 25 bp, Homo sapien
cattggcaaattgtacctctggaat

SEQ ID NO: 459971 - DNA, 25 bp, Homo sapien
tctcctgagattcacatttcctgca

SEQ ID NO: 459972 - DNA, 25 bp, Homo sapien
gtacctctggaatatacagggcaca

SEQ ID NO: 459973 - DNA, 25 bp, Homo sapien
atttcctgcaaaaccacggtccagt

SEQ ID NO: 459974 - DNA, 25 bp, Homo sapien
acggtccagtgggtacttgaacaat

SEQ ID NO: 459975 - DNA, 25 bp, Homo sapien
atgccatagcaagcttgatgcaccg

SEQ ID NO: 459976 - DNA, 25 bp, Homo sapien
tatacagggcacaaaccacatgggc

SEQ ID NO: 459977 - DNA, 25 bp, Homo sapien
ctgttctttttaaagctccatcctt

SEQ ID NO: 459978 - DNA, 25 bp, Homo sapien
gatagaactgcttctggcacaccaa

SEQ ID NO: 459979 - DNA, 25 bp, Homo sapien
gcttctggcacaccaaagaacagca

SEQ ID NO: 459980 - DNA, 25 bp, Homo sapien
aagaacagcacagaggtccaaatac

SEQ ID NO: 459981 - DNA, 25 bp, Homo sapien
ggtccaaatacatcttccttaggtg

SEQ ID NO: 459982 - DNA, 25 bp, Homo sapien
atcttccttaggtgcccatgaattt

SEQ ID NO: 459983 - DNA, 25 bp, Homo sapien
tctaacgatttcaaatgccttgctg

SEQ ID NO: 459984 - DNA, 25 bp, Homo sapien
aacagccctctcaggatagttcatc

SEQ ID NO: 459985 - DNA, 25 bp, Homo sapien
agttcatcctagtaggtctgtcaaa

SEQ ID NO: 459986 - DNA, 25 bp, Homo sapien
ctgaaacaccaacatgtgagttcct

SEQ ID NO: 459987 - DNA, 25 bp, Homo sapien
tcctcctctgggttttaaatgttag

SEQ ID NO: 459988 - DNA, 25 bp, Homo sapien
agtactgtgactacttctttgtttg

SEQ ID NO: 459989 - DNA, 25 bp, Homo sapien
aaaatgcttttattggccaggcgtg

SEQ ID NO: 459990 - DNA, 25 bp, Homo sapien
aaatgcttttattggccaggcgtgg

SEQ ID NO: 459991 - DNA, 25 bp, Homo sapien
aatgcttttattggccaggcgtggt

SEQ ID NO: 459992 - DNA, 25 bp, Homo sapien
atgcttttattggccaggcgtggtg

SEQ ID NO: 459993 - DNA, 25 bp, Homo sapien
tgcttttattggccaggcgtggtgg

SEQ ID NO: 459994 - DNA, 25 bp, Homo sapien
gcttttattggccaggcgtggtggc

SEQ ID NO: 459995 - DNA, 25 bp, Homo sapien
ctcacaccttataatcccagtactt

SEQ ID NO: 459996 - DNA, 25 bp, Homo sapien
tcacaccttataatcccagtacttt

SEQ ID NO: 459997 - DNA, 25 bp, Homo sapien
gcagatcatgaggtcgagattgaga

SEQ ID NO: 459998 - DNA, 25 bp, Homo sapien
cagatcatgaggtcgagattgagac

SEQ ID NO: 459999 - DNA, 25 bp, Homo sapien
tcatgaggtcgagattgagaccatc

SEQ ID NO: 460000 - DNA, 25 bp, Homo sapien
actctccccacgaaggtatctctgt

SEQ ID NO: 460001 - DNA, 25 bp, Homo sapien
cccacgaaggtatctctgtgtctta

SEQ ID NO: 460002 - DNA, 25 bp, Homo sapien
aaggtatctctgtgtcttactctgt

SEQ ID NO: 460003 - DNA, 25 bp, Homo sapien
atctctgtgtcttactctgtgcaaa

SEQ ID NO: 460004 - DNA, 25 bp, Homo sapien
cttactctgtgcaaagacgcggcaa

SEQ ID NO: 460005 - DNA, 25 bp, Homo sapien
agacgcggcaaaacccagtgccctg

SEQ ID NO: 460006 - DNA, 25 bp, Homo sapien
ttttccccacccgagatgaaggata

SEQ ID NO: 460007 - DNA, 25 bp, Homo sapien
acccgagatgaaggatacgctgtat

SEQ ID NO: 460008 - DNA, 25 bp, Homo sapien
ggatacgctgtattttttgcctaat

SEQ ID NO: 460009 - DNA, 25 bp, Homo sapien
acgctgtattttttgcctaatgtcc

SEQ ID NO: 460010 - DNA, 25 bp, Homo sapien
gcctctaggttcataatgaattaaa

SEQ ID NO: 460011 - DNA, 25 bp, Homo sapien
catgtcgtaaggcagcagctgtgcc

SEQ ID NO: 460012 - DNA, 25 bp, Homo sapien
gtgccaggatagctgggtccattca

SEQ ID NO: 460013 - DNA, 25 bp, Homo sapien
gatagctgggtccattcagagcacc

SEQ ID NO: 460014 - DNA, 25 bp, Homo sapien
gctgggtccattcagagcaccttga

SEQ ID NO: 460015 - DNA, 25 bp, Homo sapien
agcaccttgagaagtgttgcaggga

SEQ ID NO: 460016 - DNA, 25 bp, Homo sapien
accagcctcctgtatctcatcaggt

SEQ ID NO: 460017 - DNA, 25 bp, Homo sapien
tatctcatcaggtcccttctcagta

SEQ ID NO: 460018 - DNA, 25 bp, Homo sapien
atcaggtcccttctcagtactgtat

SEQ ID NO: 460019 - DNA, 25 bp, Homo sapien
gtcccttctcagtactgtatttgct

SEQ ID NO: 460020 - DNA, 25 bp, Homo sapien
agtactgtatttgctcagtgcatca

SEQ ID NO: 460021 - DNA, 25 bp, Homo sapien
gtatttgctcagtgcatcaggaatg

SEQ ID NO: 460022 - DNA, 25 bp, Homo sapien
actataaaactcttacagcccaggg

SEQ ID NO: 460023 - DNA, 25 bp, Homo sapien
gggaaaagctcctggacactggcct

SEQ ID NO: 460024 - DNA, 25 bp, Homo sapien
gaatagagaccccagaaacaaatcc

SEQ ID NO: 460025 - DNA, 25 bp, Homo sapien
aatccaaacacatatgggtcaacta

SEQ ID NO: 460026 - DNA, 25 bp, Homo sapien
caactaatttttgatgagggtacca

SEQ ID NO: 460027 - DNA, 25 bp, Homo sapien
gatgagggtaccaagaagacacaat

SEQ ID NO: 460028 - DNA, 25 bp, Homo sapien
ggtgctaataaactagatttccaca

SEQ ID NO: 460029 - DNA, 25 bp, Homo sapien
taaactagatttccacatgcaaaag

SEQ ID NO: 460030 - DNA, 25 bp, Homo sapien
aatgaaactggacccatatcttcta

SEQ ID NO: 460031 - DNA, 25 bp, Homo sapien
actggacccatatcttctattacac

SEQ ID NO: 460032 - DNA, 25 bp, Homo sapien
ggacccatatcttctattacacaca

SEQ ID NO: 460033 - DNA, 25 bp, Homo sapien
gtcacaaagcttgctgggcacattg

SEQ ID NO: 460034 - DNA, 25 bp, Homo sapien
gcacattgtaaaagctagccctgga

SEQ ID NO: 460035 - DNA, 25 bp, Homo sapien
ggaagaaatagcatcctgagctttc

SEQ ID NO: 460036 - DNA, 25 bp, Homo sapien
tcctgagctttctggtagccaaaac

SEQ ID NO: 460037 - DNA, 25 bp, Homo sapien
aaacaagagaaggacaccatggctt

SEQ ID NO: 460038 - DNA, 25 bp, Homo sapien
taattgaaagcacaccaggctatta

SEQ ID NO: 460039 - DNA, 25 bp, Homo sapien
ttaatagctatcagttttccatgca

SEQ ID NO: 460040 - DNA, 25 bp, Homo sapien
gttttccatgcattttatgccaagg

SEQ ID NO: 460041 - DNA, 25 bp, Homo sapien
atgccaagggaaattgatcatctaa

SEQ ID NO: 460042 - DNA, 25 bp, Homo sapien
gagtattttcctcatgaccacttct

SEQ ID NO: 460043 - DNA, 25 bp, Homo sapien
cacttctcacactggtgcttagtga

SEQ ID NO: 460044 - DNA, 25 bp, Homo sapien
tttgactcaaagtggataggctagt

SEQ ID NO: 460045 - DNA, 25 bp, Homo sapien
taggctagtgttgatattggagtgc

SEQ ID NO: 460046 - DNA, 25 bp, Homo sapien
gcaaatgtatatactccaagagcta

SEQ ID NO: 460047 - DNA, 25 bp, Homo sapien
gctagttcttaattctgctgagttg

SEQ ID NO: 460048 - DNA, 25 bp, Homo sapien
tattgtctgtatccttactggtttt

SEQ ID NO: 460049 - DNA, 25 bp, Homo sapien
ctaaattttgatgtggacctctctc

SEQ ID NO: 460050 - DNA, 25 bp, Homo sapien
tgatgtggacctctctccatagaga

SEQ ID NO: 460051 - DNA, 25 bp, Homo sapien
atagagagccgctcctaagtgcaag

SEQ ID NO: 460052 - DNA, 25 bp, Homo sapien
gtgcaagaaattccaacaggtgtca

SEQ ID NO: 460053 - DNA, 25 bp, Homo sapien
acaggtgtcagtaggacttggccct

SEQ ID NO: 460054 - DNA, 25 bp, Homo sapien
tcataattacattcttacctttcaa

SEQ ID NO: 460055 - DNA, 25 bp, Homo sapien
ctcctctggtagagcactcttgcga

SEQ ID NO: 460056 - DNA, 25 bp, Homo sapien
tcgcagacgatatctctctcggcct

SEQ ID NO: 460057 - DNA, 25 bp, Homo sapien
acgatatctctctcggcctcttaat

SEQ ID NO: 460058 - DNA, 25 bp, Homo sapien
taatcccttacctgagaatgaaggg

SEQ ID NO: 460059 - DNA, 25 bp, Homo sapien
gaaaggccttattcaagtgcttgta

SEQ ID NO: 460060 - DNA, 25 bp, Homo sapien
attcaagtgcttgtaaatgctttca

SEQ ID NO: 460061 - DNA, 25 bp, Homo sapien
gtgcttgtaaatgctttcatttctg

SEQ ID NO: 460062 - DNA, 25 bp, Homo sapien
gaagatttttctaacttagggtctg

SEQ ID NO: 460063 - DNA, 25 bp, Homo sapien
tttttctaacttagggtctgtcttg

SEQ ID NO: 460064 - DNA, 25 bp, Homo sapien
tcttgcatgtattacaaccagaata

SEQ ID NO: 460065 - DNA, 25 bp, Homo sapien
tattacaaccagaatacagtgtttg

SEQ ID NO: 460066 - DNA, 25 bp, Homo sapien
tgaatcctattactagcctgcacca

SEQ ID NO: 460067 - DNA, 25 bp, Homo sapien
tagcctgcaccatgatcccaaaaac

SEQ ID NO: 460068 - DNA, 25 bp, Homo sapien
atacaggaagtaggagcatcacaac

SEQ ID NO: 460069 - DNA, 25 bp, Homo sapien
aggagcatcacaacaaccaaaatct

SEQ ID NO: 460070 - DNA, 25 bp, Homo sapien
gattagatatcttattttgttccca

SEQ ID NO: 460071 - DNA, 25 bp, Homo sapien
tttgttcccaagatccactgcatag

SEQ ID NO: 460072 - DNA, 25 bp, Homo sapien
agctaaagtgagagcctttattcct

SEQ ID NO: 460073 - DNA, 25 bp, Homo sapien
ctggttacattcacttccctatgaa

SEQ ID NO: 460074 - DNA, 25 bp, Homo sapien
gagggatgatttcagagcactttga

SEQ ID NO: 460075 - DNA, 25 bp, Homo sapien
ttagaatcccttacatggtcgatat

SEQ ID NO: 460076 - DNA, 25 bp, Homo sapien
aagggaagcaattctgaatcctatt

SEQ ID NO: 460077 - DNA, 25 bp, Homo sapien
gggtgccctactctatatggcctag

SEQ ID NO: 460078 - DNA, 25 bp, Homo sapien
cctactctatatggcctagggcttt

SEQ ID NO: 460079 - DNA, 25 bp, Homo sapien
ctctatatggcctagggctttggtt

SEQ ID NO: 460080 - DNA, 25 bp, Homo sapien
gggtcagtcttgttctttcagatac

SEQ ID NO: 460081 - DNA, 25 bp, Homo sapien
gttctttcagatacataacaccagc

SEQ ID NO: 460082 - DNA, 25 bp, Homo sapien
atacataacaccagcagtactttcg

SEQ ID NO: 460083 - DNA, 25 bp, Homo sapien
gtactttcgggctcacttcaagaac

SEQ ID NO: 460084 - DNA, 25 bp, Homo sapien
ttcgggctcacttcaagaaccagat

SEQ ID NO: 460085 - DNA, 25 bp, Homo sapien
caagaaccagataactctcccaaac

SEQ ID NO: 460086 - DNA, 25 bp, Homo sapien
agataactctcccaaaccatgatac

SEQ ID NO: 460087 - DNA, 25 bp, Homo sapien
taactctcccaaaccatgatacatg

SEQ ID NO: 460088 - DNA, 25 bp, Homo sapien
cagaggactgcctagtagcaaaggt

SEQ ID NO: 460089 - DNA, 25 bp, Homo sapien
agcaaaggttattcctggacacagg

SEQ ID NO: 460090 - DNA, 25 bp, Homo sapien
gaaagacgggcattacagggaccaa

SEQ ID NO: 460091 - DNA, 25 bp, Homo sapien
gcattacagggaccaaagctctgaa

SEQ ID NO: 460092 - DNA, 25 bp, Homo sapien
ggacaaaccacatcacgggtgagtg

SEQ ID NO: 460093 - DNA, 25 bp, Homo sapien
acgggtgagtgatacttctcagtct

SEQ ID NO: 460094 - DNA, 25 bp, Homo sapien
ttctcagtcttctctactcattcaa

SEQ ID NO: 460095 - DNA, 25 bp, Homo sapien
gtcttctctactcattcaacaaagg

SEQ ID NO: 460096 - DNA, 25 bp, Homo sapien
attcaacaaaggaaatgtgggctgg

SEQ ID NO: 460097 - DNA, 25 bp, Homo sapien
gggcagaggtcttttttcatttaat

SEQ ID NO: 460098 - DNA, 25 bp, Homo sapien
gaggtcttttttcatttaatactgg

SEQ ID NO: 460099 - DNA, 25 bp, Homo sapien
agggcactgggttttgccgcgtctt

SEQ ID NO: 460100 - DNA, 25 bp, Homo sapien
ttttgccgcgtctttgcacagagta

SEQ ID NO: 460101 - DNA, 25 bp, Homo sapien
tgccgcgtctttgcacagagtaaga

SEQ ID NO: 460102 - DNA, 25 bp, Homo sapien
tttcgcagcgttcatgaacctttaa

SEQ ID NO: 460103 - DNA, 25 bp, Homo sapien
tttgcacagagtaagacacagagat

SEQ ID NO: 460104 - DNA, 25 bp, Homo sapien
gggagagtgtgcagctccggcctgc

SEQ ID NO: 460105 - DNA, 25 bp, Homo sapien
tgaacctttaattcattatgaacct

SEQ ID NO: 460106 - DNA, 25 bp, Homo sapien
ttatgaacctagaggcagggacatt

SEQ ID NO: 460107 - DNA, 25 bp, Homo sapien
gaggcagggacattaggcaaaaaat

SEQ ID NO: 460108 - DNA, 25 bp, Homo sapien
aaatacagcgtatccttcatctcgg

SEQ ID NO: 460109 - DNA, 25 bp, Homo sapien
cagcgtatccttcatctcgggtggg

SEQ ID NO: 460110 - DNA, 25 bp, Homo sapien
gaagctcactccttcagcacttttg

SEQ ID NO: 460111 - DNA, 25 bp, Homo sapien
actccttcagcacttttggctggag

SEQ ID NO: 460112 - DNA, 25 bp, Homo sapien
cacttttggctggaggtcacttgtt

SEQ ID NO: 460113 - DNA, 25 bp, Homo sapien
ggaggtcacttgttggagccccact

SEQ ID NO: 460114 - DNA, 25 bp, Homo sapien
gtcacttgttggagccccactcaga

SEQ ID NO: 460115 - DNA, 25 bp, Homo sapien
ttaaatagtgtggttctggcctaat

SEQ ID NO: 460116 - DNA, 25 bp, Homo sapien
aaggactgggccgctggagacttca

SEQ ID NO: 460117 - DNA, 25 bp, Homo sapien
cgctggagacttcactcattcccta

SEQ ID NO: 460118 - DNA, 25 bp, Homo sapien
tcactcattccctagcaagaaacaa

SEQ ID NO: 460119 - DNA, 25 bp, Homo sapien
caaaagcagtaaaaggtggcccgag

SEQ ID NO: 460120 - DNA, 25 bp, Homo sapien
ggtggcccgaggacaacctgaagct

SEQ ID NO: 460121 - DNA, 25 bp, Homo sapien
agggctcctgagctgccatgtcttc

SEQ ID NO: 460122 - DNA, 25 bp, Homo sapien
tgagctgccatgtcttccgagtctg

SEQ ID NO: 460123 - DNA, 25 bp, Homo sapien
ctgccatgtcttccgagtctgcaga

SEQ ID NO: 460124 - DNA, 25 bp, Homo sapien
aaatggcgggcttcaagggctgcac

SEQ ID NO: 460125 - DNA, 25 bp, Homo sapien
atggcgggcttcaagggctgcacac

SEQ ID NO: 460126 - DNA, 25 bp, Homo sapien
ggcttcaagggctgcacactcttgg

SEQ ID NO: 460127 - DNA, 25 bp, Homo sapien
aagggctgcacactcttggctccag

SEQ ID NO: 460128 - DNA, 25 bp, Homo sapien
gctgcacactcttggctccaggaaa

SEQ ID NO: 460129 - DNA, 25 bp, Homo sapien
gcacactcttggctccaggaaacgg

SEQ ID NO: 460130 - DNA, 25 bp, Homo sapien
ttggctccaggaaacggccatcagg

SEQ ID NO: 460131 - DNA, 25 bp, Homo sapien
aggaaacggccatcagggctcctga

SEQ ID NO: 460132 - DNA, 25 bp, Homo sapien
cagcagatgccaccacttccagtga

SEQ ID NO: 460133 - DNA, 25 bp, Homo sapien
gaaggaggctccgtacacgcttgtg

SEQ ID NO: 460134 - DNA, 25 bp, Homo sapien
gtacacgcttgtgggatccatcagt

SEQ ID NO: 460135 - DNA, 25 bp, Homo sapien
gtgggatccatcagtgagccaggcc

SEQ ID NO: 460136 - DNA, 25 bp, Homo sapien
ttctctcctggtggaccagcaacta

SEQ ID NO: 460137 - DNA, 25 bp, Homo sapien
tggtggaccagcaactagccctggg

SEQ ID NO: 460138 - DNA, 25 bp, Homo sapien
gggctggacagtggaccctaccagc

SEQ ID NO: 460139 - DNA, 25 bp, Homo sapien
accctaccagcctgcgggaaggtgg

SEQ ID NO: 460140 - DNA, 25 bp, Homo sapien
ggtatggccggctgtgaagacaaca

SEQ ID NO: 460141 - DNA, 25 bp, Homo sapien
aaggagatagtgtctcgagctggac

SEQ ID NO: 460142 - DNA, 25 bp, Homo sapien
tgtctcgagctggacagtgaggcaa

SEQ ID NO: 460143 - DNA, 25 bp, Homo sapien
ttggttctttttcaaatacacctat

SEQ ID NO: 460144 - DNA, 25 bp, Homo sapien
gtgagggtgatgtggctgcaccatc

SEQ ID NO: 460145 - DNA, 25 bp, Homo sapien
atctgtcactccatcaatcaccagg

SEQ ID NO: 460146 - DNA, 25 bp, Homo sapien
tgtcactccatcaatcaccagggtt

SEQ ID NO: 460147 - DNA, 25 bp, Homo sapien
actccatcaatcaccagggttggtt

SEQ ID NO: 460148 - DNA, 25 bp, Homo sapien
caatcaccagggttggttagctgat

SEQ ID NO: 460149 - DNA, 25 bp, Homo sapien
tcaccagggttggttagctgatctg

SEQ ID NO: 460150 - DNA, 25 bp, Homo sapien
gttggttagctgatctggatggcta

SEQ ID NO: 460151 - DNA, 25 bp, Homo sapien
atctggatggctaggtggtgtcccc

SEQ ID NO: 460152 - DNA, 25 bp, Homo sapien
tggatggctaggtggtgtccccttc

SEQ ID NO: 460153 - DNA, 25 bp, Homo sapien
atggctaggtggtgtccccttcttc

SEQ ID NO: 460154 - DNA, 25 bp, Homo sapien
gagggtggccgatccgaagatccta

SEQ ID NO: 460155 - DNA, 25 bp, Homo sapien
gtggccgatccgaagatcctaagcc

SEQ ID NO: 460156 - DNA, 25 bp, Homo sapien
cgaactctgacttgatgtcagggtt

SEQ ID NO: 460157 - DNA, 25 bp, Homo sapien
tgacttgatgtcagggttgacttct

SEQ ID NO: 460158 - DNA, 25 bp, Homo sapien
ttccacacggagtcctcgaagtcga

SEQ ID NO: 460159 - DNA, 25 bp, Homo sapien
gagtcctcgaagtcgaggcccaagc

SEQ ID NO: 460160 - DNA, 25 bp, Homo sapien
aagtcgaggcccaagccggaggcct

SEQ ID NO: 460161 - DNA, 25 bp, Homo sapien
tactgctgtcgctgcggccggcctt

SEQ ID NO: 460162 - DNA, 25 bp, Homo sapien
gtgaccagtggtacggaccccgcgc

SEQ ID NO: 460163 - DNA, 25 bp, Homo sapien
ggcctttctacggagccgtttctgc

SEQ ID NO: 460164 - DNA, 25 bp, Homo sapien
tacggagccgtttctgctgcagaag

SEQ ID NO: 460165 - DNA, 25 bp, Homo sapien
ctagtcatctggttaaggattttaa

SEQ ID NO: 460166 - DNA, 25 bp, Homo sapien
aagcagatgcaactataaacccaag

SEQ ID NO: 460167 - DNA, 25 bp, Homo sapien
taaacccaagaaactgtattactat

SEQ ID NO: 460168 - DNA, 25 bp, Homo sapien
actgttggtcatactaaacctgtct

SEQ ID NO: 460169 - DNA, 25 bp, Homo sapien
taaacctgtctatttcctgaagtat

SEQ ID NO: 460170 - DNA, 25 bp, Homo sapien
tttcctgaagtatatgacccacaag

SEQ ID NO: 460171 - DNA, 25 bp, Homo sapien
tgtacactgtacatccttagtattt

SEQ ID NO: 460172 - DNA, 25 bp, Homo sapien
gtacatccttagtatttttacacgt

SEQ ID NO: 460173 - DNA, 25 bp, Homo sapien
ggatgaacatgattttccttcgtac

SEQ ID NO: 460174 - DNA, 25 bp, Homo sapien
attttccttcgtacagacagcttaa

SEQ ID NO: 460175 - DNA, 25 bp, Homo sapien
gcttaaataaagcactatgtcaatc

SEQ ID NO: 460176 - DNA, 25 bp, Homo sapien
gttgactaactggttttatttgact

SEQ ID NO: 460177 - DNA, 25 bp, Homo sapien
ggtaaattattcctagcaatctctg

SEQ ID NO: 460178 - DNA, 25 bp, Homo sapien
gcaatctctgaattttgggttccaa

SEQ ID NO: 460179 - DNA, 25 bp, Homo sapien
ttttgggttccaaagagccctggag

SEQ ID NO: 460180 - DNA, 25 bp, Homo sapien
ttccaaagagccctggagacgagtg

SEQ ID NO: 460181 - DNA, 25 bp, Homo sapien
cagttgtgtgctcagtattataggt

SEQ ID NO: 460182 - DNA, 25 bp, Homo sapien
gtgtgctcagtattataggttattt

SEQ ID NO: 460183 - DNA, 25 bp, Homo sapien
gtaaccgaaccaaaacttgcatatg

SEQ ID NO: 460184 - DNA, 25 bp, Homo sapien
gcatatgcacagcacataacagtgg

SEQ ID NO: 460185 - DNA, 25 bp, Homo sapien
cacataacagtggttggcacgtagt

SEQ ID NO: 460186 - DNA, 25 bp, Homo sapien
cacgtagtgggttgtgtgtgcgtct

SEQ ID NO: 460187 - DNA, 25 bp, Homo sapien
tttataaccttttggtgaacctgct

SEQ ID NO: 460188 - DNA, 25 bp, Homo sapien
ataaccttttggtgaacctgctatt

SEQ ID NO: 460189 - DNA, 25 bp, Homo sapien
accttttggtgaacctgctatttcg

SEQ ID NO: 460190 - DNA, 25 bp, Homo sapien
ttttggtgaacctgctatttcggat

SEQ ID NO: 460191 - DNA, 25 bp, Homo sapien
tggtgaacctgctatttcggatgac

SEQ ID NO: 460192 - DNA, 25 bp, Homo sapien
gtgaacctgctatttcggatgacat

SEQ ID NO: 460193 - DNA, 25 bp, Homo sapien
aacctgctatttcggatgacattgg

SEQ ID NO: 460194 - DNA, 25 bp, Homo sapien
gctatttcggatgacattgggcatt

SEQ ID NO: 460195 - DNA, 25 bp, Homo sapien
atttcggatgacattgggcatttta

SEQ ID NO: 460196 - DNA, 25 bp, Homo sapien
gacattgggcattttagttctatat

SEQ ID NO: 460197 - DNA, 25 bp, Homo sapien
cattgggcattttagttctatattt

SEQ ID NO: 460198 - DNA, 25 bp, Homo sapien
aacgtgtgttgactcttggaaagca

SEQ ID NO: 460199 - DNA, 25 bp, Homo sapien
gaaaagaaattcttggaaccagccg

SEQ ID NO: 460200 - DNA, 25 bp, Homo sapien
ttggaaccagccgtaacccagtaag

SEQ ID NO: 460201 - DNA, 25 bp, Homo sapien
gccgtaacccagtaaggaattgtga

SEQ ID NO: 460202 - DNA, 25 bp, Homo sapien
taagaacattattctggaacatcag

SEQ ID NO: 460203 - DNA, 25 bp, Homo sapien
gaacatcagaacgtttcccttagac

SEQ ID NO: 460204 - DNA, 25 bp, Homo sapien
atcagaacgtttcccttagaccgat

SEQ ID NO: 460205 - DNA, 25 bp, Homo sapien
ccttagaccgatcccagcaggtggc

SEQ ID NO: 460206 - DNA, 25 bp, Homo sapien
cccagcaggtggcagctcagattgc

SEQ ID NO: 460207 - DNA, 25 bp, Homo sapien
agctcagattgctgcagtgttgtaa

SEQ ID NO: 460208 - DNA, 25 bp, Homo sapien
gattgctgcagtgttgtaattataa

SEQ ID NO: 460209 - DNA, 25 bp, Homo sapien
cataagtcatatttggagtccaggc

SEQ ID NO: 460210 - DNA, 25 bp, Homo sapien
tggagtccaggctcttggcggaaaa

SEQ ID NO: 460211 - DNA, 25 bp, Homo sapien
gctcttggcggaaaagtcgatggca

SEQ ID NO: 460212 - DNA, 25 bp, Homo sapien
cggaaaagtcgatggcagatggcac

SEQ ID NO: 460213 - DNA, 25 bp, Homo sapien
aataacgttattcttccttttgcat

SEQ ID NO: 460214 - DNA, 25 bp, Homo sapien
gatatgcttaagaaattgtacagtt

SEQ ID NO: 460215 - DNA, 25 bp, Homo sapien
ttgtacagttccaagtagctcactt

SEQ ID NO: 460216 - DNA, 25 bp, Homo sapien
agtagctcacttagaacacccattt

SEQ ID NO: 460217 - DNA, 25 bp, Homo sapien
ctcacttagaacacccatttgcatg

SEQ ID NO: 460218 - DNA, 25 bp, Homo sapien
gaacacccatttgcatgtactaaca

SEQ ID NO: 460219 - DNA, 25 bp, Homo sapien
taggcagtacagcattgttatttga

SEQ ID NO: 460220 - DNA, 25 bp, Homo sapien
atgtgatcaagtgttcatcaatgga

SEQ ID NO: 460221 - DNA, 25 bp, Homo sapien
gtgatcaagtgttcatcaatggatg

SEQ ID NO: 460222 - DNA, 25 bp, Homo sapien
tgatcaagtgttcatcaatggatga

SEQ ID NO: 460223 - DNA, 25 bp, Homo sapien
ggatgaatagataaacagtgatacg

SEQ ID NO: 460224 - DNA, 25 bp, Homo sapien
taaacagtgatacgtacatacaatg

SEQ ID NO: 460225 - DNA, 25 bp, Homo sapien
aacagtgatacgtacatacaatggg

SEQ ID NO: 460226 - DNA, 25 bp, Homo sapien
cagtgatacgtacatacaatgggtc

SEQ ID NO: 460227 - DNA, 25 bp, Homo sapien
gtgatacgtacatacaatgggtcat

SEQ ID NO: 460228 - DNA, 25 bp, Homo sapien
tgatacgtacatacaatgggtcatt

SEQ ID NO: 460229 - DNA, 25 bp, Homo sapien
gatacgtacatacaatgggtcattt

SEQ ID NO: 460230 - DNA, 25 bp, Homo sapien
atacgtacatacaatgggtcattta

SEQ ID NO: 460231 - DNA, 25 bp, Homo sapien
aaacttttcttttctgatagtctgt

SEQ ID NO: 460232 - DNA, 25 bp, Homo sapien
aacttttcttttctgatagtctgtt

SEQ ID NO: 460233 - DNA, 25 bp, Homo sapien
acttttcttttctgatagtctgttt

SEQ ID NO: 460234 - DNA, 25 bp, Homo sapien
cttttcttttctgatagtctgtttt

SEQ ID NO: 460235 - DNA, 25 bp, Homo sapien
ttttcttttctgatagtctgtttta

SEQ ID NO: 460236 - DNA, 25 bp, Homo sapien
tttcttttctgatagtctgttttaa

SEQ ID NO: 460237 - DNA, 25 bp, Homo sapien
ttcttttctgatagtctgttttaaa

SEQ ID NO: 460238 - DNA, 25 bp, Homo sapien
tcttttctgatagtctgttttaaaa

SEQ ID NO: 460239 - DNA, 25 bp, Homo sapien
aaaatcaaaatggtcagggttggtg

SEQ ID NO: 460240 - DNA, 25 bp, Homo sapien
aaatcaaaatggtcagggttggtgg

SEQ ID NO: 460241 - DNA, 25 bp, Homo sapien
agccccaaatatcaactcattttag

SEQ ID NO: 460242 - DNA, 25 bp, Homo sapien
gtagtccaaagtgtgatttaaatgt

SEQ ID NO: 460243 - DNA, 25 bp, Homo sapien
gttatctgagtcaaacatgggtaag

SEQ ID NO: 460244 - DNA, 25 bp, Homo sapien
catgggtaagactcaaggtacaatt

SEQ ID NO: 460245 - DNA, 25 bp, Homo sapien
ggtacaatttatcctgagtccaact

SEQ ID NO: 460246 - DNA, 25 bp, Homo sapien
tgagtccaactgttcttgctgcgaa

SEQ ID NO: 460247 - DNA, 25 bp, Homo sapien
aactgttcttgctgcgaacctagga

SEQ ID NO: 460248 - DNA, 25 bp, Homo sapien
tcttgctgcgaacctaggaaatcaa

SEQ ID NO: 460249 - DNA, 25 bp, Homo sapien
aggataaacattcccattccagaaa

SEQ ID NO: 460250 - DNA, 25 bp, Homo sapien
gtaacaagtttcaagcaactccaaa

SEQ ID NO: 460251 - DNA, 25 bp, Homo sapien
aagcaactccaaaattgaatgtgac

SEQ ID NO: 460252 - DNA, 25 bp, Homo sapien
ttcttccctcctctgggatctaagg

SEQ ID NO: 460253 - DNA, 25 bp, Homo sapien
tcttccctcctctgggatctaagga

SEQ ID NO: 460254 - DNA, 25 bp, Homo sapien
cttccctcctctgggatctaaggat

SEQ ID NO: 460255 - DNA, 25 bp, Homo sapien
cctcctctgggatctaaggatccag

SEQ ID NO: 460256 - DNA, 25 bp, Homo sapien
cctctgggatctaaggatccaggga

SEQ ID NO: 460257 - DNA, 25 bp, Homo sapien
gatctaaggatccagggaggaggct

SEQ ID NO: 460258 - DNA, 25 bp, Homo sapien
agaaaagctacattctgcccaggga

SEQ ID NO: 460259 - DNA, 25 bp, Homo sapien
gaaaagctacattctgcccagggag

SEQ ID NO: 460260 - DNA, 25 bp, Homo sapien
aaaagctacattctgcccagggagg

SEQ ID NO: 460261 - DNA, 25 bp, Homo sapien
aaagctacattctgcccagggagga

SEQ ID NO: 460262 - DNA, 25 bp, Homo sapien
aagctacattctgcccagggaggaa

SEQ ID NO: 460263 - DNA, 25 bp, Homo sapien
aaaatgctctgagggaactggctaa

SEQ ID NO: 460264 - DNA, 25 bp, Homo sapien
gtgggcctggtgattgtctatcacg

SEQ ID NO: 460265 - DNA, 25 bp, Homo sapien
gtctatcacgcaaggctttgttttg

SEQ ID NO: 460266 - DNA, 25 bp, Homo sapien
gctttgttttgtactgttcagaaat

SEQ ID NO: 460267 - DNA, 25 bp, Homo sapien
aagtcctccctcactgaatgtagaa

SEQ ID NO: 460268 - DNA, 25 bp, Homo sapien
gaatcgttgccaagtttctgagaag

SEQ ID NO: 460269 - DNA, 25 bp, Homo sapien
gaagtgtcgattccctgttaacatg

SEQ ID NO: 460270 - DNA, 25 bp, Homo sapien
atggatatcagttctgcctcacatt

SEQ ID NO: 460271 - DNA, 25 bp, Homo sapien
atttcccacttgaggttgaggcgta

SEQ ID NO: 460272 - DNA, 25 bp, Homo sapien
ggcgtactggagacaacacctcaga

SEQ ID NO: 460273 - DNA, 25 bp, Homo sapien
agaccatctgaaccccatcagtgga

SEQ ID NO: 460274 - DNA, 25 bp, Homo sapien
atgtgatcaagtgttcatcaatgga

SEQ ID NO: 460275 - DNA, 25 bp, Homo sapien
gtgatcaagtgttcatcaatggatg

SEQ ID NO: 460276 - DNA, 25 bp, Homo sapien
tgatcaagtgttcatcaatggatga

SEQ ID NO: 460277 - DNA, 25 bp, Homo sapien
ggatgaatagataaacagtgatacg

SEQ ID NO: 460278 - DNA, 25 bp, Homo sapien
taaacagtgatacgtacatacaatg

SEQ ID NO: 460279 - DNA, 25 bp, Homo sapien
aacagtgatacgtacatacaatggg

SEQ ID NO: 460280 - DNA, 25 bp, Homo sapien
cagtgatacgtacatacaatgggtc

SEQ ID NO: 460281 - DNA, 25 bp, Homo sapien
gtgatacgtacatacaatgggtcat

SEQ ID NO: 460282 - DNA, 25 bp, Homo sapien
gatacgtacatacaatgggtcattt

SEQ ID NO: 460283 - DNA, 25 bp, Homo sapien
atacgtacatacaatgggtcattta

SEQ ID NO: 460284 - DNA, 25 bp, Homo sapien
cgtacatacaatgggtcatttagcc

SEQ ID NO: 460285 - DNA, 25 bp, Homo sapien
gagattttggatcagctggagtcac

SEQ ID NO: 460286 - DNA, 25 bp, Homo sapien
ggagtcactcaaattagaaaatcgt

SEQ ID NO: 460287 - DNA, 25 bp, Homo sapien
aaaatcgtcatctttctgaaatggt

SEQ ID NO: 460288 - DNA, 25 bp, Homo sapien
gtctggttttgaacttcgggattca

SEQ ID NO: 460289 - DNA, 25 bp, Homo sapien
ttcgggattcaagcaatccgccagc

SEQ ID NO: 460290 - DNA, 25 bp, Homo sapien
gggattcaagcaatccgccagcctc

SEQ ID NO: 460291 - DNA, 25 bp, Homo sapien
agtgtgagctaccaccactggcagt

SEQ ID NO: 460292 - DNA, 25 bp, Homo sapien
tgagctaccaccactggcagttaag

SEQ ID NO: 460293 - DNA, 25 bp, Homo sapien
taccaccactggcagttaagaattt

SEQ ID NO: 460294 - DNA, 25 bp, Homo sapien
gaaacaagaatctcaattagagtct

SEQ ID NO: 460295 - DNA, 25 bp, Homo sapien
gagtctttatatacaatctgtactg

SEQ ID NO: 460296 - DNA, 25 bp, Homo sapien
actcttttctccacatacagtgcag

SEQ ID NO: 460297 - DNA, 25 bp, Homo sapien
agagagctgtctggagtcacaatct

SEQ ID NO: 460298 - DNA, 25 bp, Homo sapien
gctgtctggagtcacaatctgaaca

SEQ ID NO: 460299 - DNA, 25 bp, Homo sapien
aatctgaacagattctcgggcgctc

SEQ ID NO: 460300 - DNA, 25 bp, Homo sapien
tctccttccatcactacagtaagta

SEQ ID NO: 460301 - DNA, 25 bp, Homo sapien
ggaatctgagaatcagctgtgctca

SEQ ID NO: 460302 - DNA, 25 bp, Homo sapien
atcagctgtgctcaatagccaacct

SEQ ID NO: 460303 - DNA, 25 bp, Homo sapien
aacctccctgtccagatgcagctat

SEQ ID NO: 460304 - DNA, 25 bp, Homo sapien
gatgcagctattttggtatctccta

SEQ ID NO: 460305 - DNA, 25 bp, Homo sapien
ttttggtatctcctatcacatgcac

SEQ ID NO: 460306 - DNA, 25 bp, Homo sapien
ctatcacatgcactctgaatcaggg

SEQ ID NO: 460307 - DNA, 25 bp, Homo sapien
aagacaaagcagtagagcataagga

SEQ ID NO: 460308 - DNA, 25 bp, Homo sapien
ctggagtcactcaaattagaaaatc

SEQ ID NO: 460309 - DNA, 25 bp, Homo sapien
ggagtcactcaaattagaaaatcgt

SEQ ID NO: 460310 - DNA, 25 bp, Homo sapien
gtcactcaaattagaaaatcgtcat

SEQ ID NO: 460311 - DNA, 25 bp, Homo sapien
gaaaatcgtcatctttctgaaatgg

SEQ ID NO: 460312 - DNA, 25 bp, Homo sapien
aaaatcgtcatctttctgaaatggt

SEQ ID NO: 460313 - DNA, 25 bp, Homo sapien
aatcgtcatctttctgaaatggtga

SEQ ID NO: 460314 - DNA, 25 bp, Homo sapien
atcgtcatctttctgaaatggtgat

SEQ ID NO: 460315 - DNA, 25 bp, Homo sapien
tcgtcatctttctgaaatggtgatg

SEQ ID NO: 460316 - DNA, 25 bp, Homo sapien
catctttctgaaatggtgatgaaat

SEQ ID NO: 460317 - DNA, 25 bp, Homo sapien
gaaattggaattgggtttacatgag

SEQ ID NO: 460318 - DNA, 25 bp, Homo sapien
tgggtaagttctcctccactgtttg

SEQ ID NO: 460319 - DNA, 25 bp, Homo sapien
aagttctcctccactgtttgaccaa

SEQ ID NO: 460320 - DNA, 25 bp, Homo sapien
gtttgaccaaattctcagtgataaa

SEQ ID NO: 460321 - DNA, 25 bp, Homo sapien
gtgtgcagatccctagaagagaaaa

SEQ ID NO: 460322 - DNA, 25 bp, Homo sapien
gtgcagatccctagaagagaaaacg

SEQ ID NO: 460323 - DNA, 25 bp, Homo sapien
aagtgtggcacataaggatctgcag

SEQ ID NO: 460324 - DNA, 25 bp, Homo sapien
ggatctgcagaattttccgtagaca

SEQ ID NO: 460325 - DNA, 25 bp, Homo sapien
gcagaattttccgtagacaaagaaa

SEQ ID NO: 460326 - DNA, 25 bp, Homo sapien
gacaaagaaaggatcttgtgtattt

SEQ ID NO: 460327 - DNA, 25 bp, Homo sapien
ttttgtccatatccaatgttatatg

SEQ ID NO: 460328 - DNA, 25 bp, Homo sapien
ttatgcaatgcaccatttgtttttt

SEQ ID NO: 460329 - DNA, 25 bp, Homo sapien
tttgtccgaccctacgaaaaggatg

SEQ ID NO: 460330 - DNA, 25 bp, Homo sapien
tgagcatttgtcctgtgctttcaca

SEQ ID NO: 460331 - DNA, 25 bp, Homo sapien
gctttcacattctttctgcatggag

SEQ ID NO: 460332 - DNA, 25 bp, Homo sapien
aagtgtggagattgcccagcaccag

SEQ ID NO: 460333 - DNA, 25 bp, Homo sapien
cccagcaccagccaatttatttgat

SEQ ID NO: 460334 - DNA, 25 bp, Homo sapien
atatacacatggctcagtcttcacc

SEQ ID NO: 460335 - DNA, 25 bp, Homo sapien
ttcacctgcaccatttcaagtactg

SEQ ID NO: 460336 - DNA, 25 bp, Homo sapien
agtactggtaagtccttatggctta

SEQ ID NO: 460337 - DNA, 25 bp, Homo sapien
aatgggacgctaacaggccaagcat

SEQ ID NO: 460338 - DNA, 25 bp, Homo sapien
aagcatacaagatgtcagacccagc

SEQ ID NO: 460339 - DNA, 25 bp, Homo sapien
tcagacccagccactcgtaagttga

SEQ ID NO: 460340 - DNA, 25 bp, Homo sapien
attacaaatgtctgtgcaataaatt

SEQ ID NO: 460341 - DNA, 25 bp, Homo sapien
tttctgttaaagagtaaatgagcca

SEQ ID NO: 460342 - DNA, 25 bp, Homo sapien
tgttaaagagtaaatgagccaggct

SEQ ID NO: 460343 - DNA, 25 bp, Homo sapien
gttaaagagtaaatgagccaggctt

SEQ ID NO: 460344 - DNA, 25 bp, Homo sapien
ttaaagagtaaatgagccaggcttg

SEQ ID NO: 460345 - DNA, 25 bp, Homo sapien
taaagagtaaatgagccaggcttgg

SEQ ID NO: 460346 - DNA, 25 bp, Homo sapien
aaagagtaaatgagccaggcttggt

SEQ ID NO: 460347 - DNA, 25 bp, Homo sapien
aagagtaaatgagccaggcttggtg

SEQ ID NO: 460348 - DNA, 25 bp, Homo sapien
agagtaaatgagccaggcttggtga

SEQ ID NO: 460349 - DNA, 25 bp, Homo sapien
aaatgagccaggcttggtgactcac

SEQ ID NO: 460350 - DNA, 25 bp, Homo sapien
attgtttgagcccagcagtccaaga

SEQ ID NO: 460351 - DNA, 25 bp, Homo sapien
gggcgcagcgttcattcagcaccag

SEQ ID NO: 460352 - DNA, 25 bp, Homo sapien
ggcgcagcgttcattcagcaccaga

SEQ ID NO: 460353 - DNA, 25 bp, Homo sapien
agtaccaatctcataatccaccaaa

SEQ ID NO: 460354 - DNA, 25 bp, Homo sapien
gaaattcttcagtgagagctcagcc

SEQ ID NO: 460355 - DNA, 25 bp, Homo sapien
cattcggcatcatataatccacacc

SEQ ID NO: 460356 - DNA, 25 bp, Homo sapien
agccctacagatgtgccgcgtgtgg

SEQ ID NO: 460357 - DNA, 25 bp, Homo sapien
ccctacagatgtgccgcgtgtggga

SEQ ID NO: 460358 - DNA, 25 bp, Homo sapien
agatgtgccgcgtgtgggaaggcct

SEQ ID NO: 460359 - DNA, 25 bp, Homo sapien
agccagagtgcaaaccatcagagga

SEQ ID NO: 460360 - DNA, 25 bp, Homo sapien
ccagagtgcaaaccatcagaggact

SEQ ID NO: 460361 - DNA, 25 bp, Homo sapien
agagtgcaaaccatcagaggactca

SEQ ID NO: 460362 - DNA, 25 bp, Homo sapien
gacctagaagatgaagtctatgccc

SEQ ID NO: 460363 - DNA, 25 bp, Homo sapien
aggtggccaggaagctggtgatcct

SEQ ID NO: 460364 - DNA, 25 bp, Homo sapien
agctggagcgctcggaggagagggc

SEQ ID NO: 460365 - DNA, 25 bp, Homo sapien
gaggagctgaaaattgttaccaaca

SEQ ID NO: 460366 - DNA, 25 bp, Homo sapien
tgaaaattgttaccaacaacttgaa

SEQ ID NO: 460367 - DNA, 25 bp, Homo sapien
acaacttgaaatccctggaggccca

SEQ ID NO: 460368 - DNA, 25 bp, Homo sapien
gaggcccaggcggacaagtattcca

SEQ ID NO: 460369 - DNA, 25 bp, Homo sapien
aggcccaggcggacaagtattccac

SEQ ID NO: 460370 - DNA, 25 bp, Homo sapien
gcccaggcggacaagtattccacca

SEQ ID NO: 460371 - DNA, 25 bp, Homo sapien
caggcggacaagtattccaccaaag

SEQ ID NO: 460372 - DNA, 25 bp, Homo sapien
gagacccgagcagagtttgccgaga

SEQ ID NO: 460373 - DNA, 25 bp, Homo sapien
ttgctaccctgcttaaagtctgtag

SEQ ID NO: 460374 - DNA, 25 bp, Homo sapien
tgctaccctgcttaaagtctgtaga

SEQ ID NO: 460375 - DNA, 25 bp, Homo sapien
gctaccctgcttaaagtctgtagat

SEQ ID NO: 460376 - DNA, 25 bp, Homo sapien
taccctgcttaaagtctgtagatgg

SEQ ID NO: 460377 - DNA, 25 bp, Homo sapien
cctgcttaaagtctgtagatgggag

SEQ ID NO: 460378 - DNA, 25 bp, Homo sapien
ctgcttaaagtctgtagatgggagg

SEQ ID NO: 460379 - DNA, 25 bp, Homo sapien
aaattagttggatgttgtggcactc

SEQ ID NO: 460380 - DNA, 25 bp, Homo sapien
aattagttggatgttgtggcactca

SEQ ID NO: 460381 - DNA, 25 bp, Homo sapien
attagttggatgttgtggcactcac

SEQ ID NO: 460382 - DNA, 25 bp, Homo sapien
ttagttggatgttgtggcactcacc

SEQ ID NO: 460383 - DNA, 25 bp, Homo sapien
tagttggatgttgtggcactcacct

SEQ ID NO: 460384 - DNA, 25 bp, Homo sapien
agagcatctctacctgggccagtct

SEQ ID NO: 460385 - DNA, 25 bp, Homo sapien
agcatctctacctgggccagtctca

SEQ ID NO: 460386 - DNA, 25 bp, Homo sapien
tctacctgggccagtctcagcctgt

SEQ ID NO: 460387 - DNA, 25 bp, Homo sapien
tacctgggccagtctcagcctgtct

SEQ ID NO: 460388 - DNA, 25 bp, Homo sapien
agtctcagcctgtctccaccggaga

SEQ ID NO: 460389 - DNA, 25 bp, Homo sapien
tctcagcctgtctccaccggagaga

SEQ ID NO: 460390 - DNA, 25 bp, Homo sapien
tcagcctgtctccaccggagagagg

SEQ ID NO: 460391 - DNA, 25 bp, Homo sapien
agcctgtctccaccggagagaggta

SEQ ID NO: 460392 - DNA, 25 bp, Homo sapien
gtctccaccggagagaggtagctct

SEQ ID NO: 460393 - DNA, 25 bp, Homo sapien
tctccaccggagagaggtagctctc

SEQ ID NO: 460394 - DNA, 25 bp, Homo sapien
tccaccggagagaggtagctctccc

SEQ ID NO: 460395 - DNA, 25 bp, Homo sapien
caaaggtatcgtgaagagcgcttcc

SEQ ID NO: 460396 - DNA, 25 bp, Homo sapien
aagagcgcttccgactgacgagcga

SEQ ID NO: 460397 - DNA, 25 bp, Homo sapien
gactgacgagcgagagcaccaacca

SEQ ID NO: 460398 - DNA, 25 bp, Homo sapien
gagagcaccaaccagagggtcctat

SEQ ID NO: 460399 - DNA, 25 bp, Homo sapien
accagagggtcctatggtggtccat

SEQ ID NO: 460400 - DNA, 25 bp, Homo sapien
atggtggtccattgctcagactgtc

SEQ ID NO: 460401 - DNA, 25 bp, Homo sapien
ggtccattgctcagactgtcatcct

SEQ ID NO: 460402 - DNA, 25 bp, Homo sapien
ggcatctggcagatgcgtcacctca

SEQ ID NO: 460403 - DNA, 25 bp, Homo sapien
agaagctggtgtagtgccctctttg

SEQ ID NO: 460404 - DNA, 25 bp, Homo sapien
gtagtgccctctttgtatgaccctt

SEQ ID NO: 460405 - DNA, 25 bp, Homo sapien
tttatttggtactttccccacacag

SEQ ID NO: 460406 - DNA, 25 bp, Homo sapien
taagcatccctggtctacgctatgt

SEQ ID NO: 460407 - DNA, 25 bp, Homo sapien
gctatgtcacgaccctctgctgaac

SEQ ID NO: 460408 - DNA, 25 bp, Homo sapien
ctctgctgaaccacgtcagggtgaa

SEQ ID NO: 460409 - DNA, 25 bp, Homo sapien
gggtgaaccccacaccgtgtctgtg

SEQ ID NO: 460410 - DNA, 25 bp, Homo sapien
acgcctactgccatgggtggcactg

SEQ ID NO: 460411 - DNA, 25 bp, Homo sapien
ggtggcactggaactaacccgtgga

SEQ ID NO: 460412 - DNA, 25 bp, Homo sapien
tggaactaacccgtggacgatccga

SEQ ID NO: 460413 - DNA, 25 bp, Homo sapien
gacgatccgacgtgcaccaggaata

SEQ ID NO: 460414 - DNA, 25 bp, Homo sapien
ggaatagaaaccaagctctcgcaaa

SEQ ID NO: 460415 - DNA, 25 bp, Homo sapien
gaaaccaagctctcgcaaagacaga

SEQ ID NO: 460416 - DNA, 25 bp, Homo sapien
tgtgcactgcacagggtgacacgcc

SEQ ID NO: 460417 - DNA, 25 bp, Homo sapien
tttggctcagattcttcagggaagc

SEQ ID NO: 460418 - DNA, 25 bp, Homo sapien
tcagggaagcccagttaagacaaac

SEQ ID NO: 460419 - DNA, 25 bp, Homo sapien
gacaaacagctctctatactcaatc

SEQ ID NO: 460420 - DNA, 25 bp, Homo sapien
agctctctatactcaatccttactt

SEQ ID NO: 460421 - DNA, 25 bp, Homo sapien
tcaatccttactttgctgagaagat

SEQ ID NO: 460422 - DNA, 25 bp, Homo sapien
ctgagaagatacaggcctgcccact

SEQ ID NO: 460423 - DNA, 25 bp, Homo sapien
tgttctttgggacctttaggagcta

SEQ ID NO: 460424 - DNA, 25 bp, Homo sapien
taggagctaacctccacagatgctg

SEQ ID NO: 460425 - DNA, 25 bp, Homo sapien
tagtctgtagagtcaggaataccat

SEQ ID NO: 460426 - DNA, 25 bp, Homo sapien
gttctttggcaatagcccagtctgg

SEQ ID NO: 460427 - DNA, 25 bp, Homo sapien
cccagtctggacttactatgtactt

SEQ ID NO: 460428 - DNA, 25 bp, Homo sapien
acagttgcagtagctctgccagcaa

SEQ ID NO: 460429 - DNA, 25 bp, Homo sapien
actcctacttccagtaacacacaag

SEQ ID NO: 460430 - DNA, 25 bp, Homo sapien
acagccatccagtgtgtctgattta

SEQ ID NO: 460431 - DNA, 25 bp, Homo sapien
gatttaagtcctatgtcaatgcctt

SEQ ID NO: 460432 - DNA, 25 bp, Homo sapien
atgccttttgcatctaactcagaac

SEQ ID NO: 460433 - DNA, 25 bp, Homo sapien
agaacctgctccattgactttgaca

SEQ ID NO: 460434 - DNA, 25 bp, Homo sapien
aggacaccagtaatttacctcagtt

SEQ ID NO: 460435 - DNA, 25 bp, Homo sapien
ttacctcagttagctgtaccagcac

SEQ ID NO: 460436 - DNA, 25 bp, Homo sapien
tgtaccagcacctcgagtttctcat

SEQ ID NO: 460437 - DNA, 25 bp, Homo sapien
agtttctcatcgaatgcagcccaga

SEQ ID NO: 460438 - DNA, 25 bp, Homo sapien
agcccagaggttctttttactccat

SEQ ID NO: 460439 - DNA, 25 bp, Homo sapien
atttttggtaactcccatggcagct

SEQ ID NO: 460440 - DNA, 25 bp, Homo sapien
atggcagctcctaggatttcagcgg

SEQ ID NO: 460441 - DNA, 25 bp, Homo sapien
atttcagcggtctgtgggccagaaa

SEQ ID NO: 460442 - DNA, 25 bp, Homo sapien
agaaagcaggcaccagggctgacct

SEQ ID NO: 460443 - DNA, 25 bp, Homo sapien
gggctgacctcaaggccgtatcaga

SEQ ID NO: 460444 - DNA, 25 bp, Homo sapien
gagggccaagcagagttcttttgga

SEQ ID NO: 460445 - DNA, 25 bp, Homo sapien
gttcttttggatacctgcttttcat

SEQ ID NO: 460446 - DNA, 25 bp, Homo sapien
atcccacagggccttagagtcagag

SEQ ID NO: 460447 - DNA, 25 bp, Homo sapien
tcagaggtaaggtagcaacagagct

SEQ ID NO: 460448 - DNA, 25 bp, Homo sapien
tcttaccctccttctcaacttttat

SEQ ID NO: 460449 - DNA, 25 bp, Homo sapien
ttttcttcaagggaaccagatttag

SEQ ID NO: 460450 - DNA, 25 bp, Homo sapien
caaaaagaaagagcggcctgctgtc

SEQ ID NO: 460451 - DNA, 25 bp, Homo sapien
accataagccttcacagacgccaga

SEQ ID NO: 460452 - DNA, 25 bp, Homo sapien
ccataagccttcacagacgccagag

SEQ ID NO: 460453 - DNA, 25 bp, Homo sapien
ataagccttcacagacgccagagca

SEQ ID NO: 460454 - DNA, 25 bp, Homo sapien
accctcgagcttcaccatggggtgt

SEQ ID NO: 460455 - DNA, 25 bp, Homo sapien
tgtggtgggctttagtttagtccca

SEQ ID NO: 460456 - DNA, 25 bp, Homo sapien
tggtgggctttagtttagtcccaga

SEQ ID NO: 460457 - DNA, 25 bp, Homo sapien
gggctttagtttagtcccagaaatg

SEQ ID NO: 460458 - DNA, 25 bp, Homo sapien
ggctttagtttagtcccagaaatgg

SEQ ID NO: 460459 - DNA, 25 bp, Homo sapien
gctttagtttagtcccagaaatgga

SEQ ID NO: 460460 - DNA, 25 bp, Homo sapien
ttagtttagtcccagaaatggagaa

SEQ ID NO: 460461 - DNA, 25 bp, Homo sapien
taaggagccagatgtttttagtcag

SEQ ID NO: 460462 - DNA, 25 bp, Homo sapien
gccagatgtttttagtcaggctatc

SEQ ID NO: 460463 - DNA, 25 bp, Homo sapien
agatgtttttagtcaggctatcctg

SEQ ID NO: 460464 - DNA, 25 bp, Homo sapien
tgtttttagtcaggctatcctgaca

SEQ ID NO: 460465 - DNA, 25 bp, Homo sapien
atattcttggccaattttgtccaac

SEQ ID NO: 460466 - DNA, 25 bp, Homo sapien
attcttggccaattttgtccaacgg

SEQ ID NO: 460467 - DNA, 25 bp, Homo sapien
cttggccaattttgtccaacggaca

SEQ ID NO: 460468 - DNA, 25 bp, Homo sapien
aaaagcaaagtcaacgacaccatta

SEQ ID NO: 460469 - DNA, 25 bp, Homo sapien
aaagtcaacgacaccattatcttgt

SEQ ID NO: 460470 - DNA, 25 bp, Homo sapien
gtcaacgacaccattatcttgtcaa

SEQ ID NO: 460471 - DNA, 25 bp, Homo sapien
cgacaccattatcttgtcaagatca

SEQ ID NO: 460472 - DNA, 25 bp, Homo sapien
tgggtcttttggtggattatgagat

SEQ ID NO: 460473 - DNA, 25 bp, Homo sapien
tgagattggtactctggctgaaggc

SEQ ID NO: 460474 - DNA, 25 bp, Homo sapien
cccagtgtgagtcctctgatggttt

SEQ ID NO: 460475 - DNA, 25 bp, Homo sapien
agtcctctgatggtttgcactctgg

SEQ ID NO: 460476 - DNA, 25 bp, Homo sapien
tctgatggtttgcactctggctgaa

SEQ ID NO: 460477 - DNA, 25 bp, Homo sapien
atggtttgcactctggctgaaggcc

SEQ ID NO: 460478 - DNA, 25 bp, Homo sapien
acgcggcacatctgtagggcttctc

SEQ ID NO: 460479 - DNA, 25 bp, Homo sapien
ggtttttctccggtgtggattatat

SEQ ID NO: 460480 - DNA, 25 bp, Homo sapien
tctccggtgtggattatatgatgcc

SEQ ID NO: 460481 - DNA, 25 bp, Homo sapien
gatgccgaatgagggctgagctctc

SEQ ID NO: 460482 - DNA, 25 bp, Homo sapien
gagggctgagctctcactgaagaat

SEQ ID NO: 460483 - DNA, 25 bp, Homo sapien
ctttcaagggtcatcggtagcataa

SEQ ID NO: 460484 - DNA, 25 bp, Homo sapien
ggtagcataactgcaccttggtgct

SEQ ID NO: 460485 - DNA, 25 bp, Homo sapien
ggagctcctggtaatggacctgcca

SEQ ID NO: 460486 - DNA, 25 bp, Homo sapien
taatggacctgccagcgtgtgaact

SEQ ID NO: 460487 - DNA, 25 bp, Homo sapien
agcgtgtgaactgacgtgcccagcg

SEQ ID NO: 460488 - DNA, 25 bp, Homo sapien
cacggtgggaagctgtttactctct

SEQ ID NO: 460489 - DNA, 25 bp, Homo sapien
tgtttactctctcccgggaggacac

SEQ ID NO: 460490 - DNA, 25 bp, Homo sapien
ggaggacacagggttagacatagtt

SEQ ID NO: 460491 - DNA, 25 bp, Homo sapien
agatcaacacgttctaactgacttg

SEQ ID NO: 460492 - DNA, 25 bp, Homo sapien
aactgacttgcttgtgtcgtttttt

SEQ ID NO: 460493 - DNA, 25 bp, Homo sapien
ttttttccccaacagtagttcaatg

SEQ ID NO: 460494 - DNA, 25 bp, Homo sapien
tgtgtgggttacactgaggagccaa

SEQ ID NO: 460495 - DNA, 25 bp, Homo sapien
ctgcattccagagaccaacatgata

SEQ ID NO: 460496 - DNA, 25 bp, Homo sapien
gagaccaacatgatagcttttaatt

SEQ ID NO: 460497 - DNA, 25 bp, Homo sapien
gcttttaattcagctgcatgacctg

SEQ ID NO: 460498 - DNA, 25 bp, Homo sapien
taattcagctgcatgacctgtgcct

SEQ ID NO: 460499 - DNA, 25 bp, Homo sapien
agctgcatgacctgtgccttttaag

SEQ ID NO: 460500 - DNA, 25 bp, Homo sapien
tgacctgtgccttttaagccataaa

SEQ ID NO: 460501 - DNA, 25 bp, Homo sapien
aagcctagcacctcttgaaatccag

SEQ ID NO: 460502 - DNA, 25 bp, Homo sapien
agcacctcttgaaatccagatgttc

SEQ ID NO: 460503 - DNA, 25 bp, Homo sapien
agatgttcatattagactcgaaaaa

SEQ ID NO: 460504 - DNA, 25 bp, Homo sapien
gaaaaaataggctccaggcctaggt

SEQ ID NO: 460505 - DNA, 25 bp, Homo sapien
gagcatacctagttctcagacccaa

SEQ ID NO: 460506 - DNA, 25 bp, Homo sapien
agcatacctagttctcagacccaat

SEQ ID NO: 460507 - DNA, 25 bp, Homo sapien
gcatacctagttctcagacccaatt

SEQ ID NO: 460508 - DNA, 25 bp, Homo sapien
catacctagttctcagacccaattc

SEQ ID NO: 460509 - DNA, 25 bp, Homo sapien
tacctagttctcagacccaattcca

SEQ ID NO: 460510 - DNA, 25 bp, Homo sapien
ctagttctcagacccaattccatag

SEQ ID NO: 460511 - DNA, 25 bp, Homo sapien
agttctcagacccaattccatagat

SEQ ID NO: 460512 - DNA, 25 bp, Homo sapien
gttctcagacccaattccatagatt

SEQ ID NO: 460513 - DNA, 25 bp, Homo sapien
ctcagacccaattccatagattaga

SEQ ID NO: 460514 - DNA, 25 bp, Homo sapien
gacccaattccatagattagaaaga

SEQ ID NO: 460515 - DNA, 25 bp, Homo sapien
tagattagaaagaagttttggccgg

SEQ ID NO: 460516 - DNA, 25 bp, Homo sapien
ccgactgctcccatcaggaatagga

SEQ ID NO: 460517 - DNA, 25 bp, Homo sapien
gagagtagacagagatcttccacat

SEQ ID NO: 460518 - DNA, 25 bp, Homo sapien
agacagagatcttccacatcccagg

SEQ ID NO: 460519 - DNA, 25 bp, Homo sapien
gctgctttaaaagctctgtccttgg

SEQ ID NO: 460520 - DNA, 25 bp, Homo sapien
acagcactggcctttcggaagcatc

SEQ ID NO: 460521 - DNA, 25 bp, Homo sapien
ctttcggaagcatcccagtagggtt

SEQ ID NO: 460522 - DNA, 25 bp, Homo sapien
ccagtagggttttctgaggctcgct

SEQ ID NO: 460523 - DNA, 25 bp, Homo sapien
tctgaggctcgctggtgactcatgc

SEQ ID NO: 460524 - DNA, 25 bp, Homo sapien
gactcatgccctaattgcaatcctc

SEQ ID NO: 460525 - DNA, 25 bp, Homo sapien
taattgcaatcctctgcttttatct

SEQ ID NO: 460526 - DNA, 25 bp, Homo sapien
aaggatctaacactgctctctcttc

SEQ ID NO: 460527 - DNA, 25 bp, Homo sapien
gtaataaatgaaccatgcacatggg

SEQ ID NO: 460528 - DNA, 25 bp, Homo sapien
ccatgcacatgggagtattcataga

SEQ ID NO: 460529 - DNA, 25 bp, Homo sapien
gcacatgggagtattcatagagaat

SEQ ID NO: 460530 - DNA, 25 bp, Homo sapien
tgataacttcaacctaaatcttgaa

SEQ ID NO: 460531 - DNA, 25 bp, Homo sapien
gtataaatttgccaggttcacctct

SEQ ID NO: 460532 - DNA, 25 bp, Homo sapien
aaatttgccaggttcacctcttgat

SEQ ID NO: 460533 - DNA, 25 bp, Homo sapien
gccaggttcacctcttgattattta

SEQ ID NO: 460534 - DNA, 25 bp, Homo sapien
caggttcacctcttgattatttaag

SEQ ID NO: 460535 - DNA, 25 bp, Homo sapien
aagaggatgcatagatcaccttcaa

SEQ ID NO: 460536 - DNA, 25 bp, Homo sapien
gatgcatagatcaccttcaagtagc

SEQ ID NO: 460537 - DNA, 25 bp, Homo sapien
gcatagatcaccttcaagtagctaa

SEQ ID NO: 460538 - DNA, 25 bp, Homo sapien
ggagccttccccaccttagctgtct

SEQ ID NO: 460539 - DNA, 25 bp, Homo sapien
gagccttccccaccttagctgtctc

SEQ ID NO: 460540 - DNA, 25 bp, Homo sapien
ttccccaccttagctgtctcctgcc

SEQ ID NO: 460541 - DNA, 25 bp, Homo sapien
caccttagctgtctcctgccccagg

SEQ ID NO: 460542 - DNA, 25 bp, Homo sapien
tctcctgccccagggagggatggag

SEQ ID NO: 460543 - DNA, 25 bp, Homo sapien
gggatggaggagataatttgcttat

SEQ ID NO: 460544 - DNA, 25 bp, Homo sapien
gatggaggagataatttgcttatat

SEQ ID NO: 460545 - DNA, 25 bp, Homo sapien
ggaggagataatttgcttatattaa

SEQ ID NO: 460546 - DNA, 25 bp, Homo sapien
aaaacaaaaaatggctgaggcagga

SEQ ID NO: 460547 - DNA, 25 bp, Homo sapien
aacaaaaaatggctgaggcaggagt

SEQ ID NO: 460548 - DNA, 25 bp, Homo sapien
tgaggctgcagtcagctcagattgc

SEQ ID NO: 460549 - DNA, 25 bp, Homo sapien
aacagctcttagtttgaggacctac

SEQ ID NO: 460550 - DNA, 25 bp, Homo sapien
ttgaggacctacaaaaacagactgt

SEQ ID NO: 460551 - DNA, 25 bp, Homo sapien
aaacagactgtggagtgggcccata

SEQ ID NO: 460552 - DNA, 25 bp, Homo sapien
gagtgggcccatagccctagtttgc

SEQ ID NO: 460553 - DNA, 25 bp, Homo sapien
tagtttgccagcctcttatatggac

SEQ ID NO: 460554 - DNA, 25 bp, Homo sapien
gccagcctcttatatggacactgat

SEQ ID NO: 460555 - DNA, 25 bp, Homo sapien
gacactgattctcagggaagagcta

SEQ ID NO: 460556 - DNA, 25 bp, Homo sapien
ttatttaactttctactccagccac

SEQ ID NO: 460557 - DNA, 25 bp, Homo sapien
ctgtaaaggccctgatagcatttta

SEQ ID NO: 460558 - DNA, 25 bp, Homo sapien
agcattttaggcctgtgggacccat

SEQ ID NO: 460559 - DNA, 25 bp, Homo sapien
gacccataggtctgttttatacatg

SEQ ID NO: 460560 - DNA, 25 bp, Homo sapien
tctctgaacagtttttacactgaaa

SEQ ID NO: 460561 - DNA, 25 bp, Homo sapien
gaaaatcttcatttctggattgcag

SEQ ID NO: 460562 - DNA, 25 bp, Homo sapien
aatcttcatttctggattgcagttt

SEQ ID NO: 460563 - DNA, 25 bp, Homo sapien
ggaatgaagacctgaattatttggg

SEQ ID NO: 460564 - DNA, 25 bp, Homo sapien
agtgcttataagaactgtaaactgt

SEQ ID NO: 460565 - DNA, 25 bp, Homo sapien
aactattttgtgtttgacgcatcaa

SEQ ID NO: 460566 - DNA, 25 bp, Homo sapien
gtgtttgacgcatcaaacttcaagt

SEQ ID NO: 460567 - DNA, 25 bp, Homo sapien
ttttgtaagtttctctcctgaaatt

SEQ ID NO: 460568 - DNA, 25 bp, Homo sapien
gtttctctcctgaaattttctttct

SEQ ID NO: 460569 - DNA, 25 bp, Homo sapien
ttctcttctatactttatgcactta

SEQ ID NO: 460570 - DNA, 25 bp, Homo sapien
tatgcacttactatactactgatgt

SEQ ID NO: 460571 - DNA, 25 bp, Homo sapien
gggtgcatctccagagccactcaca

SEQ ID NO: 460572 - DNA, 25 bp, Homo sapien
tatttctgggtgcagcgccaagcga

SEQ ID NO: 460573 - DNA, 25 bp, Homo sapien
atttctgggtgcagcgccaagcgag

SEQ ID NO: 460574 - DNA, 25 bp, Homo sapien
gggatgggagcgactgctggcttca

SEQ ID NO: 460575 - DNA, 25 bp, Homo sapien
tgctggcttcattccatggaaatta

SEQ ID NO: 460576 - DNA, 25 bp, Homo sapien
ctggcttcattccatggaaattatg

SEQ ID NO: 460577 - DNA, 25 bp, Homo sapien
tctctgttgccccagctggaagaca

SEQ ID NO: 460578 - DNA, 25 bp, Homo sapien
cagctggaagacacttgagtcccaa

SEQ ID NO: 460579 - DNA, 25 bp, Homo sapien
gaagacacttgagtcccaatcagcc

SEQ ID NO: 460580 - DNA, 25 bp, Homo sapien
agtcccaatcagccccagagaaaca

SEQ ID NO: 460581 - DNA, 25 bp, Homo sapien
gagaaacactggtttaatcaactgg

SEQ ID NO: 460582 - DNA, 25 bp, Homo sapien
ccactgcgcccggccccagtcactt

SEQ ID NO: 460583 - DNA, 25 bp, Homo sapien
cactgcgcccggccccagtcacttg

SEQ ID NO: 460584 - DNA, 25 bp, Homo sapien
actgcgcccggccccagtcacttgt

SEQ ID NO: 460585 - DNA, 25 bp, Homo sapien
ctgcgcccggccccagtcacttgtt

SEQ ID NO: 460586 - DNA, 25 bp, Homo sapien
tgcgcccggccccagtcacttgttc

SEQ ID NO: 460587 - DNA, 25 bp, Homo sapien
gcgcccggccccagtcacttgttct

SEQ ID NO: 460588 - DNA, 25 bp, Homo sapien
cgcccggccccagtcacttgttctt

SEQ ID NO: 460589 - DNA, 25 bp, Homo sapien
gcccggccccagtcacttgttctta

SEQ ID NO: 460590 - DNA, 25 bp, Homo sapien
cttgtctctctgcaggtcatttata

SEQ ID NO: 460591 - DNA, 25 bp, Homo sapien
agcagtcatggcgtacaggcctcat

SEQ ID NO: 460592 - DNA, 25 bp, Homo sapien
ggcgtacaggcctcattagtgatat

SEQ ID NO: 460593 - DNA, 25 bp, Homo sapien
agtgatatagccattccttcagtgc

SEQ ID NO: 460594 - DNA, 25 bp, Homo sapien
agccattccttcagtgcttcagaaa

SEQ ID NO: 460595 - DNA, 25 bp, Homo sapien
aaaaatgcacggtttccatcccttg

SEQ ID NO: 460596 - DNA, 25 bp, Homo sapien
ttccatcccttgagagcccatgagt

SEQ ID NO: 460597 - DNA, 25 bp, Homo sapien
agtttggctggcttggctgtcttgc

SEQ ID NO: 460598 - DNA, 25 bp, Homo sapien
gtcttgctcagccttatttccatat

SEQ ID NO: 460599 - DNA, 25 bp, Homo sapien
ctgcatatctgctccctaagttgat

SEQ ID NO: 460600 - DNA, 25 bp, Homo sapien
tgctccctaagttgattcctcttgg

SEQ ID NO: 460601 - DNA, 25 bp, Homo sapien
taaggtccctccagtatccttccag

SEQ ID NO: 460602 - DNA, 25 bp, Homo sapien
cctccagtatccttccaggagagaa

SEQ ID NO: 460603 - DNA, 25 bp, Homo sapien
agaggtccgggcatcggtgtctcca

SEQ ID NO: 460604 - DNA, 25 bp, Homo sapien
gggcatcggtgtctccaccgtcact

SEQ ID NO: 460605 - DNA, 25 bp, Homo sapien
gtcactcacacaccctatgtgtttg

SEQ ID NO: 460606 - DNA, 25 bp, Homo sapien
actcacacaccctatgtgtttggga

SEQ ID NO: 460607 - DNA, 25 bp, Homo sapien
cacacaccctatgtgtttgggaaag

SEQ ID NO: 460608 - DNA, 25 bp, Homo sapien
ggaaagtggggtccctatccacctg

SEQ ID NO: 460609 - DNA, 25 bp, Homo sapien
gggtcctgatgactctcccgctgtc

SEQ ID NO: 460610 - DNA, 25 bp, Homo sapien
cgctgtcccctttcagagcccatgg

SEQ ID NO: 460611 - DNA, 25 bp, Homo sapien
agagcccatggccacatagagcccc

SEQ ID NO: 460612 - DNA, 25 bp, Homo sapien
gcagtggcggccacttctacaaaag

SEQ ID NO: 460613 - DNA, 25 bp, Homo sapien
caagagcaaagtgcccagaagacta

SEQ ID NO: 460614 - DNA, 25 bp, Homo sapien
tcccctcagaatccaatgagccaaa

SEQ ID NO: 460615 - DNA, 25 bp, Homo sapien
aatgagccaaagaggaaacttccag

SEQ ID NO: 460616 - DNA, 25 bp, Homo sapien
aaacttccagttggtgcttgcgtgt

SEQ ID NO: 460617 - DNA, 25 bp, Homo sapien
aatcttttgaagttggcgccggaca

SEQ ID NO: 460618 - DNA, 25 bp, Homo sapien
agttggcgccggacaggtttctgtt

SEQ ID NO: 460619 - DNA, 25 bp, Homo sapien
ggtttctgttgcttacaactcatta

SEQ ID NO: 460620 - DNA, 25 bp, Homo sapien
gggtctccaattgctatgtttctca

SEQ ID NO: 460621 - DNA, 25 bp, Homo sapien
aattgctatgtttctcactattcga

SEQ ID NO: 460622 - DNA, 25 bp, Homo sapien
gtttctcactattcgaggagttgat

SEQ ID NO: 460623 - DNA, 25 bp, Homo sapien
actgcttccctgttaggtaatgcaa

SEQ ID NO: 460624 - DNA, 25 bp, Homo sapien
aaagactactccagtttatcctctc

SEQ ID NO: 460625 - DNA, 25 bp, Homo sapien
gacagcagacacatgttgcctgtat

SEQ ID NO: 460626 - DNA, 25 bp, Homo sapien
cctccttatcttctcaatgattgtt

SEQ ID NO: 460627 - DNA, 25 bp, Homo sapien
cattccttttcagtcgtaccatatg

SEQ ID NO: 460628 - DNA, 25 bp, Homo sapien
tttcagtcgtaccatatgtcctcat

SEQ ID NO: 460629 - DNA, 25 bp, Homo sapien
ttagcttttcagtctaatgtctgat

SEQ ID NO: 460630 - DNA, 25 bp, Homo sapien
gtctaatgtctgatgctgatgtcct

SEQ ID NO: 460631 - DNA, 25 bp, Homo sapien
aatgttttgtctacaagcaatcgta

SEQ ID NO: 460632 - DNA, 25 bp, Homo sapien
caagcaatcgtagtgcactgtggaa

SEQ ID NO: 460633 - DNA, 25 bp, Homo sapien
gtgcactgtggaaactcactgcttc

SEQ ID NO: 460634 - DNA, 25 bp, Homo sapien
ttaactttgatcttgtaatgacaaa

SEQ ID NO: 460635 - DNA, 25 bp, Homo sapien
ataagaatgttgaatcggctggctt

SEQ ID NO: 460636 - DNA, 25 bp, Homo sapien
agaatgttgaatcggctggcttttt

SEQ ID NO: 460637 - DNA, 25 bp, Homo sapien
atgttgaatcggctggcttttttct

SEQ ID NO: 460638 - DNA, 25 bp, Homo sapien
gttgaatcggctggcttttttctat

SEQ ID NO: 460639 - DNA, 25 bp, Homo sapien
tgaatcggctggcttttttctatcc

SEQ ID NO: 460640 - DNA, 25 bp, Homo sapien
aatcggctggcttttttctatccta

SEQ ID NO: 460641 - DNA, 25 bp, Homo sapien
tcggctggcttttttctatcctagg

SEQ ID NO: 460642 - DNA, 25 bp, Homo sapien
gctggcttttttctatcctaggtaa

SEQ ID NO: 460643 - DNA, 25 bp, Homo sapien
ggcttttttctatcctaggtaatgt

SEQ ID NO: 460644 - DNA, 25 bp, Homo sapien
tttctatcctaggtaatgtggactg

SEQ ID NO: 460645 - DNA, 25 bp, Homo sapien
tattttagccagtgggtcccttcct

SEQ ID NO: 460646 - DNA, 25 bp, Homo sapien
ttagccagtgggtcccttcctttct

SEQ ID NO: 460647 - DNA, 25 bp, Homo sapien
tttcctctctactgctcaagaacag

SEQ ID NO: 460648 - DNA, 25 bp, Homo sapien
tcaagaacagatttgaggccaggtg

SEQ ID NO: 460649 - DNA, 25 bp, Homo sapien
aataacagacttgaggaacccctct

SEQ ID NO: 460650 - DNA, 25 bp, Homo sapien
caggcactcactcaaacttgctctt

SEQ ID NO: 460651 - DNA, 25 bp, Homo sapien
actcactcaaacttgctcttcaact

SEQ ID NO: 460652 - DNA, 25 bp, Homo sapien
actcaaacttgctcttcaactctgt

SEQ ID NO: 460653 - DNA, 25 bp, Homo sapien
ctcaaacttgctcttcaactctgta

SEQ ID NO: 460654 - DNA, 25 bp, Homo sapien
aaacttgctcttcaactctgtatac

SEQ ID NO: 460655 - DNA, 25 bp, Homo sapien
ttgctcttcaactctgtatacaagc

SEQ ID NO: 460656 - DNA, 25 bp, Homo sapien
gccaaactcctgagtgacggcattg

SEQ ID NO: 460657 - DNA, 25 bp, Homo sapien
aaactcctgagtgacggcattgcgc

SEQ ID NO: 460658 - DNA, 25 bp, Homo sapien
actcctgagtgacggcattgcgcac

SEQ ID NO: 460659 - DNA, 25 bp, Homo sapien
agtgacggcattgcgcacggagttg

SEQ ID NO: 460660 - DNA, 25 bp, Homo sapien
agcaggttgttggagatgttatcca

SEQ ID NO: 460661 - DNA, 25 bp, Homo sapien
tatccaagtgcccacggaacttgag

SEQ ID NO: 460662 - DNA, 25 bp, Homo sapien
gcagctgagatgtggtcagtggtac

SEQ ID NO: 460663 - DNA, 25 bp, Homo sapien
tttgaccttgggtggtaagtagaga

SEQ ID NO: 460664 - DNA, 25 bp, Homo sapien
ggacagaggtcagggcatggccctg

SEQ ID NO: 460665 - DNA, 25 bp, Homo sapien
gatgacaagccctccagaggcaggc

SEQ ID NO: 460666 - DNA, 25 bp, Homo sapien
tgagaggcaggcaagtcttcagaca

SEQ ID NO: 460667 - DNA, 25 bp, Homo sapien
acagcctcattcacctgaagttcag

SEQ ID NO: 460668 - DNA, 25 bp, Homo sapien
ggttgataccattaagtgcctaatt

SEQ ID NO: 460669 - DNA, 25 bp, Homo sapien
aaggatcgcaaaagtggccgcacag

SEQ ID NO: 460670 - DNA, 25 bp, Homo sapien
acagccctgcatttggcagctgaag

SEQ ID NO: 460671 - DNA, 25 bp, Homo sapien
aatctggaactcattcgcctctttt

SEQ ID NO: 460672 - DNA, 25 bp, Homo sapien
gaactcattcgcctctttttggagc

SEQ ID NO: 460673 - DNA, 25 bp, Homo sapien
cccagttgcctgtcttttgtgaatg

SEQ ID NO: 460674 - DNA, 25 bp, Homo sapien
caaaggcttacaatggcaacactgc

SEQ ID NO: 460675 - DNA, 25 bp, Homo sapien
tgcagtatcggttgacacaattaga

SEQ ID NO: 460676 - DNA, 25 bp, Homo sapien
acacaattagatgctgtccgcctgt

SEQ ID NO: 460677 - DNA, 25 bp, Homo sapien
attagatgctgtccgcctgttgatg

SEQ ID NO: 460678 - DNA, 25 bp, Homo sapien
cattatctggatgagtgtattacat

SEQ ID NO: 460679 - DNA, 25 bp, Homo sapien
aaagcaagctagttgatttgtcaat

SEQ ID NO: 460680 - DNA, 25 bp, Homo sapien
gctagttgatttgtcaattttgagt

SEQ ID NO: 460681 - DNA, 25 bp, Homo sapien
aaatgttttgactgcttatcagcaa

SEQ ID NO: 460682 - DNA, 25 bp, Homo sapien
gcagagtatatttaattggcatgat

SEQ ID NO: 460683 - DNA, 25 bp, Homo sapien
ggcatgattttttcatggatgtgtg

SEQ ID NO: 460684 - DNA, 25 bp, Homo sapien
gatgtgtgcttcatttgatctattg

SEQ ID NO: 460685 - DNA, 25 bp, Homo sapien
tgatctattgtatgtagctcgtgat

SEQ ID NO: 460686 - DNA, 25 bp, Homo sapien
ttttctgttggttaacattgttcct

SEQ ID NO: 460687 - DNA, 25 bp, Homo sapien
ggttaacattgttcctagcttatat

SEQ ID NO: 460688 - DNA, 25 bp, Homo sapien
acattgttcctagcttatatgatgg

SEQ ID NO: 460689 - DNA, 25 bp, Homo sapien
aaactcctgagtgacggcattgcgc

SEQ ID NO: 460690 - DNA, 25 bp, Homo sapien
gcattgcgcacggagttggccttgc

SEQ ID NO: 460691 - DNA, 25 bp, Homo sapien
tggccttgccgttttcaatgttgat

SEQ ID NO: 460692 - DNA, 25 bp, Homo sapien
gttgatggcaccaatgagcaggttg

SEQ ID NO: 460693 - DNA, 25 bp, Homo sapien
agcaggttgttggagatgttatcca

SEQ ID NO: 460694 - DNA, 25 bp, Homo sapien
tatccaagtgcccacggaacttgag

SEQ ID NO: 460695 - DNA, 25 bp, Homo sapien
gatgtggtcagtggtacacttccct

SEQ ID NO: 460696 - DNA, 25 bp, Homo sapien
agtggtacacttccctttgaccttg

SEQ ID NO: 460697 - DNA, 25 bp, Homo sapien
tttgaccttgggtggtaagtagaga

SEQ ID NO: 460698 - DNA, 25 bp, Homo sapien
gatgacaagccctccagaggcaggc

SEQ ID NO: 460699 - DNA, 25 bp, Homo sapien
tgagaggcaggcaagtcttcagaca

SEQ ID NO: 460700 - DNA, 25 bp, Homo sapien
gtccagaaacaggagggatttaagg

SEQ ID NO: 460701 - DNA, 25 bp, Homo sapien
tccagaaacaggagggatttaaggg

SEQ ID NO: 460702 - DNA, 25 bp, Homo sapien
gacagacacaggcataagagacaaa

SEQ ID NO: 460703 - DNA, 25 bp, Homo sapien
acagacacaggcataagagacaaaa

SEQ ID NO: 460704 - DNA, 25 bp, Homo sapien
cagacacaggcataagagacaaaaa

SEQ ID NO: 460705 - DNA, 25 bp, Homo sapien
agacacaggcataagagacaaaaag

SEQ ID NO: 460706 - DNA, 25 bp, Homo sapien
aattcaagccaggtgtaggggtgca

SEQ ID NO: 460707 - DNA, 25 bp, Homo sapien
acacctgtagccctagttactaggg

SEQ ID NO: 460708 - DNA, 25 bp, Homo sapien
cacctgtagccctagttactaggga

SEQ ID NO: 460709 - DNA, 25 bp, Homo sapien
aacatagcgagcctgcctcaaaaca

SEQ ID NO: 460710 - DNA, 25 bp, Homo sapien
acatagcgagcctgcctcaaaacaa

SEQ ID NO: 460711 - DNA, 25 bp, Homo sapien
gtgtgtctgttcactaccttttcag

SEQ ID NO: 460712 - DNA, 25 bp, Homo sapien
gttcactaccttttcaggtttattg

SEQ ID NO: 460713 - DNA, 25 bp, Homo sapien
taatttctttgcagacaaggtctag

SEQ ID NO: 460714 - DNA, 25 bp, Homo sapien
caaggtctagatgcggagtcagaga

SEQ ID NO: 460715 - DNA, 25 bp, Homo sapien
gggagggatcctttgtgttctcatg

SEQ ID NO: 460716 - DNA, 25 bp, Homo sapien
gatcctttgtgttctcatggttggc

SEQ ID NO: 460717 - DNA, 25 bp, Homo sapien
tgttctcatggttggctctgacttt

SEQ ID NO: 460718 - DNA, 25 bp, Homo sapien
ctgactttcagctgtgttgggacca

SEQ ID NO: 460719 - DNA, 25 bp, Homo sapien
gttgggaccactggctgatcacatc

SEQ ID NO: 460720 - DNA, 25 bp, Homo sapien
gagaataatacttgcctacctacct

SEQ ID NO: 460721 - DNA, 25 bp, Homo sapien
gttgtgaggattcatttgtgatttt

SEQ ID NO: 460722 - DNA, 25 bp, Homo sapien
cagaaacctgggagttcagggctgt

SEQ ID NO: 460723 - DNA, 25 bp, Homo sapien
agaaacctgggagttcagggctgtc

SEQ ID NO: 460724 - DNA, 25 bp, Homo sapien
gaaacctgggagttcagggctgtct

SEQ ID NO: 460725 - DNA, 25 bp, Homo sapien
aaacctgggagttcagggctgtctg

SEQ ID NO: 460726 - DNA, 25 bp, Homo sapien
aacctgggagttcagggctgtctga

SEQ ID NO: 460727 - DNA, 25 bp, Homo sapien
acctgggagttcagggctgtctgaa

SEQ ID NO: 460728 - DNA, 25 bp, Homo sapien
cctgggagttcagggctgtctgaaa

SEQ ID NO: 460729 - DNA, 25 bp, Homo sapien
agttcagggctgtctgaaagctgct

SEQ ID NO: 460730 - DNA, 25 bp, Homo sapien
aactagtgatgattttagcattagc

SEQ ID NO: 460731 - DNA, 25 bp, Homo sapien
tttagcattagctttacttggaggg

SEQ ID NO: 460732 - DNA, 25 bp, Homo sapien
gatttgatgtattcttacttttcca

SEQ ID NO: 460733 - DNA, 25 bp, Homo sapien
agctggagaggcttatgggcaatat

SEQ ID NO: 460734 - DNA, 25 bp, Homo sapien
cttatgggcaatatgaagtgggcca

SEQ ID NO: 460735 - DNA, 25 bp, Homo sapien
gaagtgggccaaattcttgcaatac

SEQ ID NO: 460736 - DNA, 25 bp, Homo sapien
gccaaattcttgcaatacaccctat

SEQ ID NO: 460737 - DNA, 25 bp, Homo sapien
aattcttgcaatacaccctattcaa

SEQ ID NO: 460738 - DNA, 25 bp, Homo sapien
gcaatacaccctattcaattgaaag

SEQ ID NO: 460739 - DNA, 25 bp, Homo sapien
ttcaattgaaagtacagtgtctaag

SEQ ID NO: 460740 - DNA, 25 bp, Homo sapien
gtgtctaaggataagaatacttctt

SEQ ID NO: 460741 - DNA, 25 bp, Homo sapien
cagtgtatattttttgtactagtca

SEQ ID NO: 460742 - DNA, 25 bp, Homo sapien
gtactagtcagtttattgacactat

SEQ ID NO: 460743 - DNA, 25 bp, Homo sapien
attgacactatttgaaacttttgaa

SEQ ID NO: 460744 - DNA, 25 bp, Homo sapien
cttttgaaatataaacggagaggct

SEQ ID NO: 460745 - DNA, 25 bp, Homo sapien
cggagaggctttctgttgagacatt

SEQ ID NO: 460746 - DNA, 25 bp, Homo sapien
ggctttctgttgagacattgtcacc

SEQ ID NO: 460747 - DNA, 25 bp, Homo sapien
gagacattgtcaccaaaacaatttt

SEQ ID NO: 460748 - DNA, 25 bp, Homo sapien
agggttgttaccattcttatctgag

SEQ ID NO: 460749 - DNA, 25 bp, Homo sapien
gttaccattcttatctgagtagttg

SEQ ID NO: 460750 - DNA, 25 bp, Homo sapien
attcttatctgagtagttgggagga

SEQ ID NO: 460751 - DNA, 25 bp, Homo sapien
taccactttagttcatttggaaaat

SEQ ID NO: 460752 - DNA, 25 bp, Homo sapien
aaggagtctgccactcgcgcttgaa

SEQ ID NO: 460753 - DNA, 25 bp, Homo sapien
actcgcgcttgaaggacgtgtttga

SEQ ID NO: 460754 - DNA, 25 bp, Homo sapien
gacgtgtttgaagagctgctttccc

SEQ ID NO: 460755 - DNA, 25 bp, Homo sapien
tttcccagtgggatgctgccttaaa

SEQ ID NO: 460756 - DNA, 25 bp, Homo sapien
gctgccttaaagtcttgattccctg

SEQ ID NO: 460757 - DNA, 25 bp, Homo sapien
aaagtcttgattccctggcactctt

SEQ ID NO: 460758 - DNA, 25 bp, Homo sapien
tggcactctttcctattactacatt

SEQ ID NO: 460759 - DNA, 25 bp, Homo sapien
tactacattttatcggtgctgtttg

SEQ ID NO: 460760 - DNA, 25 bp, Homo sapien
gtgctgtttgtgttatgcaacggta

SEQ ID NO: 460761 - DNA, 25 bp, Homo sapien
ggtagcatcgtgtctccggaagata

SEQ ID NO: 460762 - DNA, 25 bp, Homo sapien
aagtagcaaagtgcactcagccctc

SEQ ID NO: 460763 - DNA, 25 bp, Homo sapien
ggtgaggttctcccgccttcccagg

SEQ ID NO: 460764 - DNA, 25 bp, Homo sapien
cgccttcccaggtggtttctttctg

SEQ ID NO: 460765 - DNA, 25 bp, Homo sapien
cttcccaggtggtttctttctgcca

SEQ ID NO: 460766 - DNA, 25 bp, Homo sapien
cccaggtggtttctttctgccactt

SEQ ID NO: 460767 - DNA, 25 bp, Homo sapien
aggtgaggctgccagtagcccacta

SEQ ID NO: 460768 - DNA, 25 bp, Homo sapien
ggtgaggctgccagtagcccactag

SEQ ID NO: 460769 - DNA, 25 bp, Homo sapien
tgaggctgccagtagcccactagca

SEQ ID NO: 460770 - DNA, 25 bp, Homo sapien
gaggctgccagtagcccactagcac

SEQ ID NO: 460771 - DNA, 25 bp, Homo sapien
agtagcccactagcaccagccagac

SEQ ID NO: 460772 - DNA, 25 bp, Homo sapien
ggctggctgttgagagattttacaa

SEQ ID NO: 460773 - DNA, 25 bp, Homo sapien
gctgttgagagattttacaattttc

SEQ ID NO: 460774 - DNA, 25 bp, Homo sapien
ccacaagaagcagcattgagagagc

SEQ ID NO: 460775 - DNA, 25 bp, Homo sapien
gagagagctgtggactcaggaccca

SEQ ID NO: 460776 - DNA, 25 bp, Homo sapien
gactcaggacccaggactctgttta

SEQ ID NO: 460777 - DNA, 25 bp, Homo sapien
aggactctgtttacgtgcccagtca

SEQ ID NO: 460778 - DNA, 25 bp, Homo sapien
tgtttacgtgcccagtcagccctac

SEQ ID NO: 460779 - DNA, 25 bp, Homo sapien
ggtgtctttagtcttggctatggta

SEQ ID NO: 460780 - DNA, 25 bp, Homo sapien
ctatggtagtttcagtccagtgggt

SEQ ID NO: 460781 - DNA, 25 bp, Homo sapien
ggatggagaccaacgaccaagtgtt

SEQ ID NO: 460782 - DNA, 25 bp, Homo sapien
gagaccaacgaccaagtgttcctgc

SEQ ID NO: 460783 - DNA, 25 bp, Homo sapien
aacgaccaagtgttcctgcaaggag

SEQ ID NO: 460784 - DNA, 25 bp, Homo sapien
ccaagtgttcctgcaaggagagcct

SEQ ID NO: 460785 - DNA, 25 bp, Homo sapien
gagtggcgagctcagccgcgggctt

SEQ ID NO: 460786 - DNA, 25 bp, Homo sapien
gctttaacacccctccataaataca

SEQ ID NO: 460787 - DNA, 25 bp, Homo sapien
ttaacacccctccataaatacaagg

SEQ ID NO: 460788 - DNA, 25 bp, Homo sapien
tcccttcgcactcaatacggagatg

SEQ ID NO: 460789 - DNA, 25 bp, Homo sapien
aatacggagatgcaactgcgccaga

SEQ ID NO: 460790 - DNA, 25 bp, Homo sapien
ggagatgcaactgcgccagagaccc

SEQ ID NO: 460791 - DNA, 25 bp, Homo sapien
ggagccaccccaccaagggtagcag

SEQ ID NO: 460792 - DNA, 25 bp, Homo sapien
agggtagcagctgttctggaaccgc

SEQ ID NO: 460793 - DNA, 25 bp, Homo sapien
gcagctgttctggaaccgcccagag

SEQ ID NO: 460794 - DNA, 25 bp, Homo sapien
tccaacactccttttgccagctttt

SEQ ID NO: 460795 - DNA, 25 bp, Homo sapien
tttcttctttctctcgccggctgga

SEQ ID NO: 460796 - DNA, 25 bp, Homo sapien
tggcaggtctcctgttctctggaat

SEQ ID NO: 460797 - DNA, 25 bp, Homo sapien
ggtctcctgttctctggaattcaga

SEQ ID NO: 460798 - DNA, 25 bp, Homo sapien
tggaattcagatcttccaccacctg

SEQ ID NO: 460799 - DNA, 25 bp, Homo sapien
atacactctctcttcgcaagtgagg

SEQ ID NO: 460800 - DNA, 25 bp, Homo sapien
tcttcgcaagtgaggatcagatcaa

SEQ ID NO: 460801 - DNA, 25 bp, Homo sapien
gggcttgattctcttatttctgtcc

SEQ ID NO: 460802 - DNA, 25 bp, Homo sapien
gattctcttatttctgtccagcata

SEQ ID NO: 460803 - DNA, 25 bp, Homo sapien
gtccagcatatgtaaaatcccattc

SEQ ID NO: 460804 - DNA, 25 bp, Homo sapien
tggcctcctcgtggttgtcctggat

SEQ ID NO: 460805 - DNA, 25 bp, Homo sapien
ggttgtcctggatgtccacattgac

SEQ ID NO: 460806 - DNA, 25 bp, Homo sapien
tggatgtccacattgaccacgtgca

SEQ ID NO: 460807 - DNA, 25 bp, Homo sapien
gcagtttggtttttagcctaagagc

SEQ ID NO: 460808 - DNA, 25 bp, Homo sapien
ggcatttatgactaagtgtgcaatt

SEQ ID NO: 460809 - DNA, 25 bp, Homo sapien
gtgcaatttacaaaaactcctgtgg

SEQ ID NO: 460810 - DNA, 25 bp, Homo sapien
gggttgttttcctgctaagccctgc

SEQ ID NO: 460811 - DNA, 25 bp, Homo sapien
ctcagagtgtgaatccacgagccat

SEQ ID NO: 460812 - DNA, 25 bp, Homo sapien
aatccacgagccatggaccgggagg

SEQ ID NO: 460813 - DNA, 25 bp, Homo sapien
agggcctcaggccagacaacaagtc

SEQ ID NO: 460814 - DNA, 25 bp, Homo sapien
atccaccttgcgttctgagatggct

SEQ ID NO: 460815 - DNA, 25 bp, Homo sapien
tgcgttctgagatggctgagctgta

SEQ ID NO: 460816 - DNA, 25 bp, Homo sapien
ctgagctgtatgtgtcgccgtggct

SEQ ID NO: 460817 - DNA, 25 bp, Homo sapien
ggccctggaccgtgttaagcagttt

SEQ ID NO: 460818 - DNA, 25 bp, Homo sapien
agaggtgaaacttgaagctcatatc

SEQ ID NO: 460819 - DNA, 25 bp, Homo sapien
gaagctcatatcagagtgccatcct

SEQ ID NO: 460820 - DNA, 25 bp, Homo sapien
atcagagtgccatcctttgctgctg

SEQ ID NO: 460821 - DNA, 25 bp, Homo sapien
ggaggcaaaacggtgaatgaacttc

SEQ ID NO: 460822 - DNA, 25 bp, Homo sapien
gtcaagtgcagaagttgttgtccct

SEQ ID NO: 460823 - DNA, 25 bp, Homo sapien
cctgatgagaatgaccaagtggttg

SEQ ID NO: 460824 - DNA, 25 bp, Homo sapien
ggttgtcaaaataactggtcacttc

SEQ ID NO: 460825 - DNA, 25 bp, Homo sapien
ataactggtcacttctatgcttgcc

SEQ ID NO: 460826 - DNA, 25 bp, Homo sapien
gtcacttctatgcttgccaggttgc

SEQ ID NO: 460827 - DNA, 25 bp, Homo sapien
gttgcccagagaaaaattcaggaaa

SEQ ID NO: 460828 - DNA, 25 bp, Homo sapien
gaaattctgactcaggtaaagcagc

SEQ ID NO: 460829 - DNA, 25 bp, Homo sapien
tccttcactgcagtgatggatccat

SEQ ID NO: 460830 - DNA, 25 bp, Homo sapien
gatggatccatctgtggctgtggct

SEQ ID NO: 460831 - DNA, 25 bp, Homo sapien
actgaccttgactgaaaagaccctt

SEQ ID NO: 460832 - DNA, 25 bp, Homo sapien
ctggaccctggacttgacaacaaac

SEQ ID NO: 460833 - DNA, 25 bp, Homo sapien
gacaacaaacggcacagacaccaat

SEQ ID NO: 460834 - DNA, 25 bp, Homo sapien
cagacaccaatcactcacagaacag

SEQ ID NO: 460835 - DNA, 25 bp, Homo sapien
atcactcacagaacagtcactggtt

SEQ ID NO: 460836 - DNA, 25 bp, Homo sapien
gtcactggttttggattcttgtttt

SEQ ID NO: 460837 - DNA, 25 bp, Homo sapien
tcttgttttccttgcaagaacaaaa

SEQ ID NO: 460838 - DNA, 25 bp, Homo sapien
aaaactttagatgggagtcttgtca

SEQ ID NO: 460839 - DNA, 25 bp, Homo sapien
atgggagtcttgtcatcaaaaataa

SEQ ID NO: 460840 - DNA, 25 bp, Homo sapien
ggtgcctgcagaactacattcctgc

SEQ ID NO: 460841 - DNA, 25 bp, Homo sapien
aactacattcctgcccacagtttaa

SEQ ID NO: 460842 - DNA, 25 bp, Homo sapien
agacctccatcctgcccgagaaagg

SEQ ID NO: 460843 - DNA, 25 bp, Homo sapien
tggccgcgctccagaacaatttctt

SEQ ID NO: 460844 - DNA, 25 bp, Homo sapien
tgatggacgtgctgcagcgaactcc

SEQ ID NO: 460845 - DNA, 25 bp, Homo sapien
gcgaactccaggcagcaacgctgag

SEQ ID NO: 460846 - DNA, 25 bp, Homo sapien
gcagcaacgctgaggagtcttccat

SEQ ID NO: 460847 - DNA, 25 bp, Homo sapien
gagtcttccatcctggagacagtca

SEQ ID NO: 460848 - DNA, 25 bp, Homo sapien
cactgctgtggctgcgggaaagcct

SEQ ID NO: 460849 - DNA, 25 bp, Homo sapien
ctgtctgcacactttctgcgagagg

SEQ ID NO: 460850 - DNA, 25 bp, Homo sapien
acactttctgcgagaggtgcctgca

SEQ ID NO: 460851 - DNA, 25 bp, Homo sapien
tagtcaccccattcaaactcaagca

SEQ ID NO: 460852 - DNA, 25 bp, Homo sapien
tcaaactcaagcacagtatgcctcc

SEQ ID NO: 460853 - DNA, 25 bp, Homo sapien
agtatgcctccccagtctttatgca

SEQ ID NO: 460854 - DNA, 25 bp, Homo sapien
cccagtctttatgcagcctgtatat

SEQ ID NO: 460855 - DNA, 25 bp, Homo sapien
tgcagcctgtatataatcctcacca

SEQ ID NO: 460856 - DNA, 25 bp, Homo sapien
ataatcctcaccaacagtactcggt

SEQ ID NO: 460857 - DNA, 25 bp, Homo sapien
gtactcggtctatagtattgtgcct

SEQ ID NO: 460858 - DNA, 25 bp, Homo sapien
agtattgtgcctcagtcttggtctc

SEQ ID NO: 460859 - DNA, 25 bp, Homo sapien
tcagtcttggtctccaaatcctaca

SEQ ID NO: 460860 - DNA, 25 bp, Homo sapien
tccaaatcctacaccttactttgaa

SEQ ID NO: 460861 - DNA, 25 bp, Homo sapien
tactttgaaacaccactggctccct

SEQ ID NO: 460862 - DNA, 25 bp, Homo sapien
tgggaaacgtcttaacattgttctg

SEQ ID NO: 460863 - DNA, 25 bp, Homo sapien
ataaacttgctaatgaggtcaggtc

SEQ ID NO: 460864 - DNA, 25 bp, Homo sapien
atgaggtcaggtcatggtacagact

SEQ ID NO: 460865 - DNA, 25 bp, Homo sapien
ggtcatggtacagactgatgcagtc

SEQ ID NO: 460866 - DNA, 25 bp, Homo sapien
gactgatgcagtcaacatgatttca

SEQ ID NO: 460867 - DNA, 25 bp, Homo sapien
gtcaacatgatttcattgcagagtt

SEQ ID NO: 460868 - DNA, 25 bp, Homo sapien
gcagagtttattagtatcagcaagt

SEQ ID NO: 460869 - DNA, 25 bp, Homo sapien
tagtatcagcaagtttttgctttgc

SEQ ID NO: 460870 - DNA, 25 bp, Homo sapien
aaactttttcatgccagatgctgtt

SEQ ID NO: 460871 - DNA, 25 bp, Homo sapien
tttcatgccagatgctgtttacaac

SEQ ID NO: 460872 - DNA, 25 bp, Homo sapien
gtttacaacaatgaacatgccaata

SEQ ID NO: 460873 - DNA, 25 bp, Homo sapien
tcggtttgagagcttaatcatagtg

SEQ ID NO: 460874 - DNA, 25 bp, Homo sapien
taatcatagtgggtagtgctggaga

SEQ ID NO: 460875 - DNA, 25 bp, Homo sapien
aagggtagcccacctgagtatcggc

SEQ ID NO: 460876 - DNA, 25 bp, Homo sapien
tgagggcagaccagccagggcaccc

SEQ ID NO: 460877 - DNA, 25 bp, Homo sapien
gcaccctcattctcctgggaggatg

SEQ ID NO: 460878 - DNA, 25 bp, Homo sapien
gggaggatgccttgctttcttggtc

SEQ ID NO: 460879 - DNA, 25 bp, Homo sapien
gctttcttggtctggtggtctctta

SEQ ID NO: 460880 - DNA, 25 bp, Homo sapien
tggtctggtggtctcttagttacat

SEQ ID NO: 460881 - DNA, 25 bp, Homo sapien
tcttagttacattacactccggtgt

SEQ ID NO: 460882 - DNA, 25 bp, Homo sapien
actccggtgtattcgtgtactgatt

SEQ ID NO: 460883 - DNA, 25 bp, Homo sapien
gtgtactgatttttcacaaaagctt

SEQ ID NO: 460884 - DNA, 25 bp, Homo sapien
aagagctcgcccatgttacgagcat

SEQ ID NO: 460885 - DNA, 25 bp, Homo sapien
ggactgacttcctagtaactgttgc

SEQ ID NO: 460886 - DNA, 25 bp, Homo sapien
ctgttgcagtttacaacctgccctc

SEQ ID NO: 460887 - DNA, 25 bp, Homo sapien
ccagggacacgtctccatggttttt

SEQ ID NO: 460888 - DNA, 25 bp, Homo sapien
gagatttagtcattaaccaacccgg

SEQ ID NO: 460889 - DNA, 25 bp, Homo sapien
aaccaacccggtctttgtgatgtgt

SEQ ID NO: 460890 - DNA, 25 bp, Homo sapien
tttgtgatgtgtgaagccttccctt

SEQ ID NO: 460891 - DNA, 25 bp, Homo sapien
ttcccttcagttatgtcccattttt

SEQ ID NO: 460892 - DNA, 25 bp, Homo sapien
gttatgtcccatttttatgatgcca

SEQ ID NO: 460893 - DNA, 25 bp, Homo sapien
ttatgatgccaaaagctgccactgt

SEQ ID NO: 460894 - DNA, 25 bp, Homo sapien
gccactgtgtggtattcgaggatta

SEQ ID NO: 460895 - DNA, 25 bp, Homo sapien
ctacaccccttattagagccgtgat

SEQ ID NO: 460896 - DNA, 25 bp, Homo sapien
agagccgtgatagcctacagagtga

SEQ ID NO: 460897 - DNA, 25 bp, Homo sapien
cgccttcccaggtggtttctttctg

SEQ ID NO: 460898 - DNA, 25 bp, Homo sapien
cttcccaggtggtttctttctgcca

SEQ ID NO: 460899 - DNA, 25 bp, Homo sapien
cccaggtggtttctttctgccactt

SEQ ID NO: 460900 - DNA, 25 bp, Homo sapien
aggtgaggctgccagtagcccacta

SEQ ID NO: 460901 - DNA, 25 bp, Homo sapien
gtgaggctgccagtagcccactagc

SEQ ID NO: 460902 - DNA, 25 bp, Homo sapien
gaggctgccagtagcccactagcac

SEQ ID NO: 460903 - DNA, 25 bp, Homo sapien
agtagcccactagcaccagccagac

SEQ ID NO: 460904 - DNA, 25 bp, Homo sapien
ggctggctgttgagagattttacaa

SEQ ID NO: 460905 - DNA, 25 bp, Homo sapien
gctgttgagagattttacaattttc

SEQ ID NO: 460906 - DNA, 25 bp, Homo sapien
tgaattcctgtcctcgtgtccccga

SEQ ID NO: 460907 - DNA, 25 bp, Homo sapien
accccactcaactactcagaatttt

SEQ ID NO: 460908 - DNA, 25 bp, Homo sapien
taaaccatgtaagctctcttcttct

SEQ ID NO: 460909 - DNA, 25 bp, Homo sapien
gctctcttcttctcgaaaaggtgct

SEQ ID NO: 460910 - DNA, 25 bp, Homo sapien
aaaaggtgctactgcaatgccctac

SEQ ID NO: 460911 - DNA, 25 bp, Homo sapien
aatgccctactgagcaacctttgag

SEQ ID NO: 460912 - DNA, 25 bp, Homo sapien
gccctactgagcaacctttgagatt

SEQ ID NO: 460913 - DNA, 25 bp, Homo sapien
ctttgagattgtcacttctgtacat

SEQ ID NO: 460914 - DNA, 25 bp, Homo sapien
gtcacttctgtacataaaccacctt

SEQ ID NO: 460915 - DNA, 25 bp, Homo sapien
taaaccacctttgtgaggctctttc

SEQ ID NO: 460916 - DNA, 25 bp, Homo sapien
ccacctttgtgaggctctttctata

SEQ ID NO: 460917 - DNA, 25 bp, Homo sapien
gcaaaatgctaagtttcccctgaag

SEQ ID NO: 460918 - DNA, 25 bp, Homo sapien
tcccctgaagggtgttgatccaata

SEQ ID NO: 460919 - DNA, 25 bp, Homo sapien
gcaggagtgcttctatagctctaaa

SEQ ID NO: 460920 - DNA, 25 bp, Homo sapien
gtatgtaacgagttgaccctctcca

SEQ ID NO: 460921 - DNA, 25 bp, Homo sapien
tgaccctctccagacaactgtgaag

SEQ ID NO: 460922 - DNA, 25 bp, Homo sapien
gacaactgtgaagggagttcccgga

SEQ ID NO: 460923 - DNA, 25 bp, Homo sapien
ccggaacagccattgctctaagttt

SEQ ID NO: 460924 - DNA, 25 bp, Homo sapien
gacactctggagttatcacagcttt

SEQ ID NO: 460925 - DNA, 25 bp, Homo sapien
gtgcagtttgcttctgtctacagaa

SEQ ID NO: 460926 - DNA, 25 bp, Homo sapien
gggtccaccaaagcatccaaggtct

SEQ ID NO: 460927 - DNA, 25 bp, Homo sapien
aggtctcaaggatcagtggctgcaa

SEQ ID NO: 460928 - DNA, 25 bp, Homo sapien
tgtcttccttaaaagtgtccccatg

SEQ ID NO: 460929 - DNA, 25 bp, Homo sapien
tcttccttaaaagtgtccccatgaa

SEQ ID NO: 460930 - DNA, 25 bp, Homo sapien
gaactcagtgtttattcccttttca

SEQ ID NO: 460931 - DNA, 25 bp, Homo sapien
aatggtagaattagaacagcaagat

SEQ ID NO: 460932 - DNA, 25 bp, Homo sapien
acaacatagatttcagccacctcat

SEQ ID NO: 460933 - DNA, 25 bp, Homo sapien
caacatagatttcagccacctcatt

SEQ ID NO: 460934 - DNA, 25 bp, Homo sapien
aatgcctttcccagactgggtagtg

SEQ ID NO: 460935 - DNA, 25 bp, Homo sapien
tcccagactgggtagtggcagatct

SEQ ID NO: 460936 - DNA, 25 bp, Homo sapien
cagatctgggatggaatatggtttt

SEQ ID NO: 460937 - DNA, 25 bp, Homo sapien
atatggttttcttgattccctttca

SEQ ID NO: 460938 - DNA, 25 bp, Homo sapien
atggttttcttgattccctttcagc

SEQ ID NO: 460939 - DNA, 25 bp, Homo sapien
tacccttcggcaatatcatttcctc

SEQ ID NO: 460940 - DNA, 25 bp, Homo sapien
ttcggcaatatcatttcctccaagg

SEQ ID NO: 460941 - DNA, 25 bp, Homo sapien
ttcctccaaggtgtttatggatcga

SEQ ID NO: 460942 - DNA, 25 bp, Homo sapien
ggtgtttatggatcgagctaccaac

SEQ ID NO: 460943 - DNA, 25 bp, Homo sapien
gtttatggatcgagctaccaaccag

SEQ ID NO: 460944 - DNA, 25 bp, Homo sapien
gatcgagctaccaaccagagcaagt

SEQ ID NO: 460945 - DNA, 25 bp, Homo sapien
cagagcaagtgtttcggcttcgtga

SEQ ID NO: 460946 - DNA, 25 bp, Homo sapien
agagcaagtgtttcggcttcgtgag

SEQ ID NO: 460947 - DNA, 25 bp, Homo sapien
gagctttgataacccggccagcgcc

SEQ ID NO: 460948 - DNA, 25 bp, Homo sapien
atcccccgtttctgttcattcacag

SEQ ID NO: 460949 - DNA, 25 bp, Homo sapien
gtttctgttcattcacagctgcgtc

SEQ ID NO: 460950 - DNA, 25 bp, Homo sapien
tattttgacttgttaaatcctgaag

SEQ ID NO: 460951 - DNA, 25 bp, Homo sapien
aatcctgaagaatgttgaaacctag

SEQ ID NO: 460952 - DNA, 25 bp, Homo sapien
ctagaattttcaatctggcaggagt

SEQ ID NO: 460953 - DNA, 25 bp, Homo sapien
ctggcaggagtagaaagatgctcat

SEQ ID NO: 460954 - DNA, 25 bp, Homo sapien
gatgctcatagcacacgcgatatgt

SEQ ID NO: 460955 - DNA, 25 bp, Homo sapien
agcacacgcgatatgtatgataaca

SEQ ID NO: 460956 - DNA, 25 bp, Homo sapien
tttctttccccttctaatagaggtg

SEQ ID NO: 460957 - DNA, 25 bp, Homo sapien
tagaggtggctttgccttgacccag

SEQ ID NO: 460958 - DNA, 25 bp, Homo sapien
cttgacccagcctttaacaatcttt

SEQ ID NO: 460959 - DNA, 25 bp, Homo sapien
actgaagtcttttacatctgtctag

SEQ ID NO: 460960 - DNA, 25 bp, Homo sapien
atctgtctagatttgaattctgctt

SEQ ID NO: 460961 - DNA, 25 bp, Homo sapien
gggagccgtgtcactcctgggccat

SEQ ID NO: 460962 - DNA, 25 bp, Homo sapien
acctcctgggcacttaggtgtttca

SEQ ID NO: 460963 - DNA, 25 bp, Homo sapien
ggtgtttcagcatagattccagttt

SEQ ID NO: 460964 - DNA, 25 bp, Homo sapien
atagattccagtttcgcaccctggg

SEQ ID NO: 460965 - DNA, 25 bp, Homo sapien
gggtgagcgctccatgttcacatga

SEQ ID NO: 460966 - DNA, 25 bp, Homo sapien
gctccatgttcacatgagcactgct

SEQ ID NO: 460967 - DNA, 25 bp, Homo sapien
acatgagcactgctgcctcttcact

SEQ ID NO: 460968 - DNA, 25 bp, Homo sapien
gcctcttcacttgtgggactttttg

SEQ ID NO: 460969 - DNA, 25 bp, Homo sapien
gggactttttgcaaacccaaggatg

SEQ ID NO: 460970 - DNA, 25 bp, Homo sapien
aacccaaggatgaactttgtgtgca

SEQ ID NO: 460971 - DNA, 25 bp, Homo sapien
gatgaactttgtgtgcattcaataa

SEQ ID NO: 460972 - DNA, 25 bp, Homo sapien
ttgtgacatttcttgaccttgctag

SEQ ID NO: 460973 - DNA, 25 bp, Homo sapien
tgtgacatttcttgaccttgctagt

SEQ ID NO: 460974 - DNA, 25 bp, Homo sapien
tgaccttgctagttctttcattaga

SEQ ID NO: 460975 - DNA, 25 bp, Homo sapien
gaccttgctagttctttcattagat

SEQ ID NO: 460976 - DNA, 25 bp, Homo sapien
accttgctagttctttcattagatc

SEQ ID NO: 460977 - DNA, 25 bp, Homo sapien
ccttgctagttctttcattagatct

SEQ ID NO: 460978 - DNA, 25 bp, Homo sapien
cttgctagttctttcattagatctg

SEQ ID NO: 460979 - DNA, 25 bp, Homo sapien
tgctagttctttcattagatctgcg

SEQ ID NO: 460980 - DNA, 25 bp, Homo sapien
gctagttctttcattagatctgcgc

SEQ ID NO: 460981 - DNA, 25 bp, Homo sapien
ctagttctttcattagatctgcgca

SEQ ID NO: 460982 - DNA, 25 bp, Homo sapien
gatctgcgcaagatctagtcatctg

SEQ ID NO: 460983 - DNA, 25 bp, Homo sapien
aacgtgtactgcctactggagtggc

SEQ ID NO: 460984 - DNA, 25 bp, Homo sapien
tcttcattgtggctagctttgaaaa

SEQ ID NO: 460985 - DNA, 25 bp, Homo sapien
ggctagctttgaaaagaccctctga

SEQ ID NO: 460986 - DNA, 25 bp, Homo sapien
ttagttggacaacttgtggagcact

SEQ ID NO: 460987 - DNA, 25 bp, Homo sapien
tgtggagcactagccatacttcttt

SEQ ID NO: 460988 - DNA, 25 bp, Homo sapien
actagccatacttctttcttatctt

SEQ ID NO: 460989 - DNA, 25 bp, Homo sapien
atacttctttcttatctttactatg

SEQ ID NO: 460990 - DNA, 25 bp, Homo sapien
atgtgtttaaggttgttcatctgca

SEQ ID NO: 460991 - DNA, 25 bp, Homo sapien
gttgttcatctgcaagccagcttaa

SEQ ID NO: 460992 - DNA, 25 bp, Homo sapien
taagaatagccagcctgtgaatccc

SEQ ID NO: 460993 - DNA, 25 bp, Homo sapien
atcccaaacactctagaagaagtga

SEQ ID NO: 460994 - DNA, 25 bp, Homo sapien
acataacttcaagccatttctgaaa

SEQ ID NO: 460995 - DNA, 25 bp, Homo sapien
gaaaacatacaccaggagctctgct

SEQ ID NO: 460996 - DNA, 25 bp, Homo sapien
aggagctctgctcagctagagtcag

SEQ ID NO: 460997 - DNA, 25 bp, Homo sapien
gctctgctcagctagagtcagactc

SEQ ID NO: 460998 - DNA, 25 bp, Homo sapien
acagcgcccgcgttgatgaggacca

SEQ ID NO: 460999 - DNA, 25 bp, Homo sapien
cagccccactgcaggctgaggcggt

SEQ ID NO: 461000 - DNA, 25 bp, Homo sapien
tgaggcggtgtcaccctgggaaggt

SEQ ID NO: 461001 - DNA, 25 bp, Homo sapien
gtcgtggtgcgttgtggcatattaa

SEQ ID NO: 461002 - DNA, 25 bp, Homo sapien
ggcatattaagtctaaaccagatga

SEQ ID NO: 461003 - DNA, 25 bp, Homo sapien
tttatttcactctgttccatccagg

SEQ ID NO: 461004 - DNA, 25 bp, Homo sapien
gttccatccaggtcagcaatcagat

SEQ ID NO: 461005 - DNA, 25 bp, Homo sapien
aggcacgtaccactataccctgcta

SEQ ID NO: 461006 - DNA, 25 bp, Homo sapien
taccactataccctgctaaaatttg

SEQ ID NO: 461007 - DNA, 25 bp, Homo sapien
ttggccaggctagtcgtaatgtctc

SEQ ID NO: 461008 - DNA, 25 bp, Homo sapien
gccaggctagtcgtaatgtctcttt

SEQ ID NO: 461009 - DNA, 25 bp, Homo sapien
ggctagtcgtaatgtctctttttaa

SEQ ID NO: 461010 - DNA, 25 bp, Homo sapien
gtcgtaatgtctctttttaacactg

SEQ ID NO: 461011 - DNA, 25 bp, Homo sapien
atgtctctttttaacactgaatatg

SEQ ID NO: 461012 - DNA, 25 bp, Homo sapien
aatatgttaggtggtttttcttgat

SEQ ID NO: 461013 - DNA, 25 bp, Homo sapien
ttcttgatggatttagggttaacct

SEQ ID NO: 461014 - DNA, 25 bp, Homo sapien
ttccaggtaattatcaagttttgtc

SEQ ID NO: 461015 - DNA, 25 bp, Homo sapien
gaagagttaatattgtcatcgatac

SEQ ID NO: 461016 - DNA, 25 bp, Homo sapien
agtaaaggaactctcaacccctgca

SEQ ID NO: 461017 - DNA, 25 bp, Homo sapien
taaaggaactctcaacccctgcatt

SEQ ID NO: 461018 - DNA, 25 bp, Homo sapien
aggaactctcaacccctgcattaca

SEQ ID NO: 461019 - DNA, 25 bp, Homo sapien
aactctcaacccctgcattacatga

SEQ ID NO: 461020 - DNA, 25 bp, Homo sapien
actctcaacccctgcattacatgat

SEQ ID NO: 461021 - DNA, 25 bp, Homo sapien
tctcaacccctgcattacatgatta

SEQ ID NO: 461022 - DNA, 25 bp, Homo sapien
ctcaacccctgcattacatgattag

SEQ ID NO: 461023 - DNA, 25 bp, Homo sapien
tcaacccctgcattacatgattagg

SEQ ID NO: 461024 - DNA, 25 bp, Homo sapien
caacccctgcattacatgattagga

SEQ ID NO: 461025 - DNA, 25 bp, Homo sapien
aacccctgcattacatgattaggac

SEQ ID NO: 461026 - DNA, 25 bp, Homo sapien
acccctgcattacatgattaggaca

SEQ ID NO: 461027 - DNA, 25 bp, Homo sapien
gataatatgttatctcttgggagta

SEQ ID NO: 461028 - DNA, 25 bp, Homo sapien
aatatgttatctcttgggagtagtt

SEQ ID NO: 461029 - DNA, 25 bp, Homo sapien
gtagttctgaatatgaagtgtgttg

SEQ ID NO: 461030 - DNA, 25 bp, Homo sapien
gccttttttatcaagagagcttaac

SEQ ID NO: 461031 - DNA, 25 bp, Homo sapien
tgaaattagtctattttctacttgc

SEQ ID NO: 461032 - DNA, 25 bp, Homo sapien
tacttgccagcagagtatctgtctt

SEQ ID NO: 461033 - DNA, 25 bp, Homo sapien
gccagcagagtatctgtcttatttt

SEQ ID NO: 461034 - DNA, 25 bp, Homo sapien
gcagagtatctgtcttattttagga

SEQ ID NO: 461035 - DNA, 25 bp, Homo sapien
ggatgcagtgtgaaacttaccattc

SEQ ID NO: 461036 - DNA, 25 bp, Homo sapien
tgcagtgtgaaacttaccattcaac

SEQ ID NO: 461037 - DNA, 25 bp, Homo sapien
ttaccattcaactgaacaactagtt

SEQ ID NO: 461038 - DNA, 25 bp, Homo sapien
attatagataatgcccagtttcagt

SEQ ID NO: 461039 - DNA, 25 bp, Homo sapien
gataatatgttatctcttgggagta

SEQ ID NO: 461040 - DNA, 25 bp, Homo sapien
gtagttctgaatatgaagtgtgttg

SEQ ID NO: 461041 - DNA, 25 bp, Homo sapien
gccttttttatcaagagagcttaac

SEQ ID NO: 461042 - DNA, 25 bp, Homo sapien
tgaaattagtctattttctacttgc

SEQ ID NO: 461043 - DNA, 25 bp, Homo sapien
gtctattttctacttgccagcagag

SEQ ID NO: 461044 - DNA, 25 bp, Homo sapien
acttgccagcagagtatctgtctta

SEQ ID NO: 461045 - DNA, 25 bp, Homo sapien
gcagagtatctgtcttattttagga

SEQ ID NO: 461046 - DNA, 25 bp, Homo sapien
ggatgcagtgtgaaacttaccattc

SEQ ID NO: 461047 - DNA, 25 bp, Homo sapien
tgcagtgtgaaacttaccattcaac

SEQ ID NO: 461048 - DNA, 25 bp, Homo sapien
ttaccattcaactgaacaactagtt

SEQ ID NO: 461049 - DNA, 25 bp, Homo sapien
tggctgccctcagctgttccaggag

SEQ ID NO: 461050 - DNA, 25 bp, Homo sapien
agctgttccaggagcggtcagtcat

SEQ ID NO: 461051 - DNA, 25 bp, Homo sapien
gttccaggagcggtcagtcatagtg

SEQ ID NO: 461052 - DNA, 25 bp, Homo sapien
ggtcagtcatagtggagaactcctc

SEQ ID NO: 461053 - DNA, 25 bp, Homo sapien
tggagaactcctcaggctctaccag

SEQ ID NO: 461054 - DNA, 25 bp, Homo sapien
tcaggctctaccagcgcttctgagc

SEQ ID NO: 461055 - DNA, 25 bp, Homo sapien
taccagcgcttctgagctcctcaaa

SEQ ID NO: 461056 - DNA, 25 bp, Homo sapien
tgagctcctcaaacccatgaagaag

SEQ ID NO: 461057 - DNA, 25 bp, Homo sapien
aagcgcagggaataccagagcccat

SEQ ID NO: 461058 - DNA, 25 bp, Homo sapien
agggaataccagagcccatcagagg

SEQ ID NO: 461059 - DNA, 25 bp, Homo sapien
cccatcagaggaggagtcggagcca

SEQ ID NO: 461060 - DNA, 25 bp, Homo sapien
gggcatctacatgatgctctgctgg

SEQ ID NO: 461061 - DNA, 25 bp, Homo sapien
tacatgatgctctgctgggaggtca

SEQ ID NO: 461062 - DNA, 25 bp, Homo sapien
atgatgctctgctgggaggtcacaa

SEQ ID NO: 461063 - DNA, 25 bp, Homo sapien
tctgctgggaggtcacaaggtacat

SEQ ID NO: 461064 - DNA, 25 bp, Homo sapien
gtcacaaggtacatgagctatgcta

SEQ ID NO: 461065 - DNA, 25 bp, Homo sapien
aggtacatgagctatgctagggcag

SEQ ID NO: 461066 - DNA, 25 bp, Homo sapien
tgtgagttctcttctgtcctccttg

SEQ ID NO: 461067 - DNA, 25 bp, Homo sapien
tcttctgtcctccttgggaaggaga

SEQ ID NO: 461068 - DNA, 25 bp, Homo sapien
aatatggactgttagctgataagac

SEQ ID NO: 461069 - DNA, 25 bp, Homo sapien
aaaactgcacaaaaatgccgctatt

SEQ ID NO: 461070 - DNA, 25 bp, Homo sapien
aaaaatgccgctattgtgtttcacc

SEQ ID NO: 461071 - DNA, 25 bp, Homo sapien
agataagtatcaggtctgaccccag

SEQ ID NO: 461072 - DNA, 25 bp, Homo sapien
ggtctgaccccagtggaaaacaaag

SEQ ID NO: 461073 - DNA, 25 bp, Homo sapien
tgaccccagtggaaaacaaagccaa

SEQ ID NO: 461074 - DNA, 25 bp, Homo sapien
caaaaccaaacttgttcatttagat

SEQ ID NO: 461075 - DNA, 25 bp, Homo sapien
agttccatagaaaaggcgtgcagta

SEQ ID NO: 461076 - DNA, 25 bp, Homo sapien
aaaggcgtgcagtactaagggaaca

SEQ ID NO: 461077 - DNA, 25 bp, Homo sapien
gtgcagtactaagggaacaatccat

SEQ ID NO: 461078 - DNA, 25 bp, Homo sapien
ggaacaatccatgtgattaatgttt

SEQ ID NO: 461079 - DNA, 25 bp, Homo sapien
attatgttcatgtaagaagcccctt

SEQ ID NO: 461080 - DNA, 25 bp, Homo sapien
gaagccccttatttttagccataat

SEQ ID NO: 461081 - DNA, 25 bp, Homo sapien
tttagccataattttgcatactgaa

SEQ ID NO: 461082 - DNA, 25 bp, Homo sapien
ctgaatctgaggttttataaatccc

SEQ ID NO: 461083 - DNA, 25 bp, Homo sapien
taaatccctcaaacgattgctgaga

SEQ ID NO: 461084 - DNA, 25 bp, Homo sapien
attgctgagagcctgattgtggaaa

SEQ ID NO: 461085 - DNA, 25 bp, Homo sapien
gtgagatgcaccttattttcaagaa

SEQ ID NO: 461086 - DNA, 25 bp, Homo sapien
aagaagtcctgggaagcgctctcct

SEQ ID NO: 461087 - DNA, 25 bp, Homo sapien
tgggaagcgctctcctagcacgtcc

SEQ ID NO: 461088 - DNA, 25 bp, Homo sapien
tagcacgtccatttccaggaggaga

SEQ ID NO: 461089 - DNA, 25 bp, Homo sapien
ttttccattttgtcatccaaggtag

SEQ ID NO: 461090 - DNA, 25 bp, Homo sapien
tccaaggtagctgtgcacttgcctt

SEQ ID NO: 461091 - DNA, 25 bp, Homo sapien
gtagctgtgcacttgccttgttgct

SEQ ID NO: 461092 - DNA, 25 bp, Homo sapien
tctattaatttcacttataccaaag

SEQ ID NO: 461093 - DNA, 25 bp, Homo sapien
agtgttgcaccagatctgattgtaa

SEQ ID NO: 461094 - DNA, 25 bp, Homo sapien
gtgttgcaccagatctgattgtaac

SEQ ID NO: 461095 - DNA, 25 bp, Homo sapien
accagatctgattgtaacccactga

SEQ ID NO: 461096 - DNA, 25 bp, Homo sapien
agagaaataagtgccctctcccact

SEQ ID NO: 461097 - DNA, 25 bp, Homo sapien
actctcttcctactggtctctctat

SEQ ID NO: 461098 - DNA, 25 bp, Homo sapien
tctctatgcctctctagagtctcgt

SEQ ID NO: 461099 - DNA, 25 bp, Homo sapien
tagagtctcgtctcttttaccctgg

SEQ ID NO: 461100 - DNA, 25 bp, Homo sapien
ttagctctgagaaccgtagatgatt

SEQ ID NO: 461101 - DNA, 25 bp, Homo sapien
gttccttccagtgtcatttctcaat

SEQ ID NO: 461102 - DNA, 25 bp, Homo sapien
tttctcaatccacataccctaacct

SEQ ID NO: 461103 - DNA, 25 bp, Homo sapien
tctcaatccacataccctaacctgg

SEQ ID NO: 461104 - DNA, 25 bp, Homo sapien
tctctgaacagtttttacactgaaa

SEQ ID NO: 461105 - DNA, 25 bp, Homo sapien
gaaaatcttcatttctggattgcag

SEQ ID NO: 461106 - DNA, 25 bp, Homo sapien
aatcttcatttctggattgcagttt

SEQ ID NO: 461107 - DNA, 25 bp, Homo sapien
tggaatgaagacctgaattatttgg

SEQ ID NO: 461108 - DNA, 25 bp, Homo sapien
atgaagacctgaattatttgggtag

SEQ ID NO: 461109 - DNA, 25 bp, Homo sapien
aactattttgtgtttgacgcatcaa

SEQ ID NO: 461110 - DNA, 25 bp, Homo sapien
gtgtttgacgcatcaaacttcaagt

SEQ ID NO: 461111 - DNA, 25 bp, Homo sapien
ttttgtaagtttctctcctgaaatt

SEQ ID NO: 461112 - DNA, 25 bp, Homo sapien
gtaagtttctctcctgaaattttct

SEQ ID NO: 461113 - DNA, 25 bp, Homo sapien
gtttctctcctgaaattttctttct

SEQ ID NO: 461114 - DNA, 25 bp, Homo sapien
tttctctcctgaaattttctttctc

SEQ ID NO: 461115 - DNA, 25 bp, Homo sapien
cgatgacctagaagatgaagtctat

SEQ ID NO: 461116 - DNA, 25 bp, Homo sapien
gacctagaagatgaagtctatgccc

SEQ ID NO: 461117 - DNA, 25 bp, Homo sapien
tgaggtggccgagagtaaatgtggg

SEQ ID NO: 461118 - DNA, 25 bp, Homo sapien
ctgaaaattgttaccaacaacttga

SEQ ID NO: 461119 - DNA, 25 bp, Homo sapien
gaggcccaggcggacaagtattcca

SEQ ID NO: 461120 - DNA, 25 bp, Homo sapien
aggcccaggcggacaagtattccac

SEQ ID NO: 461121 - DNA, 25 bp, Homo sapien
ggcccaggcggacaagtattccacc

SEQ ID NO: 461122 - DNA, 25 bp, Homo sapien
gcccaggcggacaagtattccacca

SEQ ID NO: 461123 - DNA, 25 bp, Homo sapien
cccaggcggacaagtattccaccaa

SEQ ID NO: 461124 - DNA, 25 bp, Homo sapien
ccaggcggacaagtattccaccaaa

SEQ ID NO: 461125 - DNA, 25 bp, Homo sapien
caggcggacaagtattccaccaaag

SEQ ID NO: 461126 - DNA, 25 bp, Homo sapien
atgtagagagagttccaaaccacca

SEQ ID NO: 461127 - DNA, 25 bp, Homo sapien
gagagagttccaaaccaccaatttt

SEQ ID NO: 461128 - DNA, 25 bp, Homo sapien
gagagttccaaaccaccaattttat

SEQ ID NO: 461129 - DNA, 25 bp, Homo sapien
ataatttcccttgttgaatatattc

SEQ ID NO: 461130 - DNA, 25 bp, Homo sapien
aatgtgttctataatatgcccaaag

SEQ ID NO: 461131 - DNA, 25 bp, Homo sapien
gttctataatatgcccaaagcagct

SEQ ID NO: 461132 - DNA, 25 bp, Homo sapien
caaagcagctttgtctatagttaac

SEQ ID NO: 461133 - DNA, 25 bp, Homo sapien
aagcagctttgtctatagttaacaa

SEQ ID NO: 461134 - DNA, 25 bp, Homo sapien
taaggatagacaagaatgtgttttc

SEQ ID NO: 461135 - DNA, 25 bp, Homo sapien
tatcatctttttagggatatagtac

SEQ ID NO: 461136 - DNA, 25 bp, Homo sapien
actgtcttttaatagtgatttcaaa

SEQ ID NO: 461137 - DNA, 25 bp, Homo sapien
agaggccacagacaaatgcgactgt

SEQ ID NO: 461138 - DNA, 25 bp, Homo sapien
gaggccacagacaaatgcgactgtg

SEQ ID NO: 461139 - DNA, 25 bp, Homo sapien
aggccacagacaaatgcgactgtgg

SEQ ID NO: 461140 - DNA, 25 bp, Homo sapien
ggccacagacaaatgcgactgtggc

SEQ ID NO: 461141 - DNA, 25 bp, Homo sapien
gccacagacaaatgcgactgtggcc

SEQ ID NO: 461142 - DNA, 25 bp, Homo sapien
ccacagacaaatgcgactgtggccc

SEQ ID NO: 461143 - DNA, 25 bp, Homo sapien
cacagacaaatgcgactgtggcccg

SEQ ID NO: 461144 - DNA, 25 bp, Homo sapien
acagacaaatgcgactgtggcccgg

SEQ ID NO: 461145 - DNA, 25 bp, Homo sapien
gaatagagaccccagaaacaaatcc

SEQ ID NO: 461146 - DNA, 25 bp, Homo sapien
aatccaaacacatatgggtcaacta

SEQ ID NO: 461147 - DNA, 25 bp, Homo sapien
caactaatttttgatgagggtacca

SEQ ID NO: 461148 - DNA, 25 bp, Homo sapien
gatgagggtaccaagaagacacaat

SEQ ID NO: 461149 - DNA, 25 bp, Homo sapien
ggtgctaataaactagatttccaca

SEQ ID NO: 461150 - DNA, 25 bp, Homo sapien
taaactagatttccacatgcaaaag

SEQ ID NO: 461151 - DNA, 25 bp, Homo sapien
aatgaaactggacccatatcttcta

SEQ ID NO: 461152 - DNA, 25 bp, Homo sapien
aaactggacccatatcttctattac

SEQ ID NO: 461153 - DNA, 25 bp, Homo sapien
actggacccatatcttctattacac

SEQ ID NO: 461154 - DNA, 25 bp, Homo sapien
ggacccatatcttctattacacaca

SEQ ID NO: 461155 - DNA, 25 bp, Homo sapien
catatcttctattacacacaaaaaa

SEQ ID NO: 461156 - DNA, 25 bp, Homo sapien
tagtgatctgttactcttaaaacaa

SEQ ID NO: 461157 - DNA, 25 bp, Homo sapien
aactcatctaagattttggttggga

SEQ ID NO: 461158 - DNA, 25 bp, Homo sapien
ttgggagatggcatttggcttctga

SEQ ID NO: 461159 - DNA, 25 bp, Homo sapien
gcttctgagaaaggtagctatgaaa

SEQ ID NO: 461160 - DNA, 25 bp, Homo sapien
atactgatgaagacacagctgttaa

SEQ ID NO: 461161 - DNA, 25 bp, Homo sapien
ctgttaacaattggctgatcagccc

SEQ ID NO: 461162 - DNA, 25 bp, Homo sapien
ccccagaatgcctcacgtgcttggg

SEQ ID NO: 461163 - DNA, 25 bp, Homo sapien
gagaaagcacccctcttgccaacaa

SEQ ID NO: 461164 - DNA, 25 bp, Homo sapien
ccctcttgccaacaagcctggaaag

SEQ ID NO: 461165 - DNA, 25 bp, Homo sapien
aaatctctacaagtaagacaggatg

SEQ ID NO: 461166 - DNA, 25 bp, Homo sapien
tagactgaagaaaagccagtttctc

SEQ ID NO: 461167 - DNA, 25 bp, Homo sapien
gatttgactaagatcaggcataaga

SEQ ID NO: 461168 - DNA, 25 bp, Homo sapien
caggcataagatagaatttttgtca

SEQ ID NO: 461169 - DNA, 25 bp, Homo sapien
tttccttgcagttttattgacttag

SEQ ID NO: 461170 - DNA, 25 bp, Homo sapien
attgacttagtttatgagcttggat

SEQ ID NO: 461171 - DNA, 25 bp, Homo sapien
aatgtaactacctcataagtctgat

SEQ ID NO: 461172 - DNA, 25 bp, Homo sapien
gaatttctgaaggtggttaaatcaa

SEQ ID NO: 461173 - DNA, 25 bp, Homo sapien
aatatcaactagttccacttttgtg

SEQ ID NO: 461174 - DNA, 25 bp, Homo sapien
aactagttccacttttgtgattgca

SEQ ID NO: 461175 - DNA, 25 bp, Homo sapien
ccacttttgtgattgcaggatgctt

SEQ ID NO: 461176 - DNA, 25 bp, Homo sapien
attgcaggatgcttcttatactaaa

SEQ ID NO: 461177 - DNA, 25 bp, Homo sapien
gatgcttcttatactaaagttctca

SEQ ID NO: 461178 - DNA, 25 bp, Homo sapien
gggcgcagcgttcattcagcaccag

SEQ ID NO: 461179 - DNA, 25 bp, Homo sapien
ggcgcagcgttcattcagcaccaga

SEQ ID NO: 461180 - DNA, 25 bp, Homo sapien
agccctacagatgtgccgcgtgtgg

SEQ ID NO: 461181 - DNA, 25 bp, Homo sapien
ccctacagatgtgccgcgtgtggga

SEQ ID NO: 461182 - DNA, 25 bp, Homo sapien
agatgtgccgcgtgtgggaaggcct

SEQ ID NO: 461183 - DNA, 25 bp, Homo sapien
gatgtgccgcgtgtgggaaggcctt

SEQ ID NO: 461184 - DNA, 25 bp, Homo sapien
agccagagtgcaaaccatcagagga

SEQ ID NO: 461185 - DNA, 25 bp, Homo sapien
gccagagtgcaaaccatcagaggac

SEQ ID NO: 461186 - DNA, 25 bp, Homo sapien
ccagagtgcaaaccatcagaggact

SEQ ID NO: 461187 - DNA, 25 bp, Homo sapien
cagagtgcaaaccatcagaggactc

SEQ ID NO: 461188 - DNA, 25 bp, Homo sapien
agagtgcaaaccatcagaggactca

SEQ ID NO: 461189 - DNA, 25 bp, Homo sapien
cagaaggcacagacggagtggaaca

SEQ ID NO: 461190 - DNA, 25 bp, Homo sapien
cagacggagtggaacacgggcactt

SEQ ID NO: 461191 - DNA, 25 bp, Homo sapien
tggaacacgggcacttggcggaacc

SEQ ID NO: 461192 - DNA, 25 bp, Homo sapien
gaacacgggcacttggcggaaccca

SEQ ID NO: 461193 - DNA, 25 bp, Homo sapien
cacttggcggaacccaccgtcgagg

SEQ ID NO: 461194 - DNA, 25 bp, Homo sapien
gagggaggcccagtacaacaacttc

SEQ ID NO: 461195 - DNA, 25 bp, Homo sapien
aggcccagtacaacaacttctcagg

SEQ ID NO: 461196 - DNA, 25 bp, Homo sapien
ccagtacaacaacttctcaggcaac

SEQ ID NO: 461197 - DNA, 25 bp, Homo sapien
actgtgcccagctacccgggcagtg

SEQ ID NO: 461198 - DNA, 25 bp, Homo sapien
gctacccctgtgtcccgagggctgg

SEQ ID NO: 461199 - DNA, 25 bp, Homo sapien
atccccccagctgtgatggtggaag

SEQ ID NO: 461200 - DNA, 25 bp, Homo sapien
cagatgggaacttggaactgggcat

SEQ ID NO: 461201 - DNA, 25 bp, Homo sapien
gaactgggcatgaatcctgaatggt

SEQ ID NO: 461202 - DNA, 25 bp, Homo sapien
gggaaacttgaagccatcacagcca

SEQ ID NO: 461203 - DNA, 25 bp, Homo sapien
gggttccatgacctgccctgaggtc

SEQ ID NO: 461204 - DNA, 25 bp, Homo sapien
tttgccctcactagggaagccccag

SEQ ID NO: 461205 - DNA, 25 bp, Homo sapien
tagggaagccccagtcaccggactt

SEQ ID NO: 461206 - DNA, 25 bp, Homo sapien
cggacttgtccccatggagtgaaga

SEQ ID NO: 461207 - DNA, 25 bp, Homo sapien
agagaggccccatttttgagtgttg

SEQ ID NO: 461208 - DNA, 25 bp, Homo sapien
cccatttttgagtgttgtgtgtcca

SEQ ID NO: 461209 - DNA, 25 bp, Homo sapien
ttgtgtgtccaaaacagtgttgtgt

SEQ ID NO: 461210 - DNA, 25 bp, Homo sapien
ggtggtcatgttgcttagttgaaga

SEQ ID NO: 461211 - DNA, 25 bp, Homo sapien
gtattttgttttgcatattgacctt

SEQ ID NO: 461212 - DNA, 25 bp, Homo sapien
gttttgcatattgaccttgtgttaa

SEQ ID NO: 461213 - DNA, 25 bp, Homo sapien
tgaccttgtgttaagggttctttag

SEQ ID NO: 461214 - DNA, 25 bp, Homo sapien
agaagaaaaggtttaggctgcgtgt

SEQ ID NO: 461215 - DNA, 25 bp, Homo sapien
gcgtgtggtgtctcatgtctacaac

SEQ ID NO: 461216 - DNA, 25 bp, Homo sapien
gtgtggtgtctcatgtctacaaccg

SEQ ID NO: 461217 - DNA, 25 bp, Homo sapien
tggtgtctcatgtctacaaccgcta

SEQ ID NO: 461218 - DNA, 25 bp, Homo sapien
gtgtctcatgtctacaaccgctaag

SEQ ID NO: 461219 - DNA, 25 bp, Homo sapien
tctcatgtctacaaccgctaaggtg

SEQ ID NO: 461220 - DNA, 25 bp, Homo sapien
tcatgtctacaaccgctaaggtggg

SEQ ID NO: 461221 - DNA, 25 bp, Homo sapien
gtctacaaccgctaaggtgggagga

SEQ ID NO: 461222 - DNA, 25 bp, Homo sapien
ttatcttaaacatgtcaggcatctt

SEQ ID NO: 461223 - DNA, 25 bp, Homo sapien
catgtcaggcatcttaagtcacctt

SEQ ID NO: 461224 - DNA, 25 bp, Homo sapien
cttaagtcacctttatactgttttg

SEQ ID NO: 461225 - DNA, 25 bp, Homo sapien
gagtttctttcagtatgttatacaa

SEQ ID NO: 461226 - DNA, 25 bp, Homo sapien
taacatgtagcagccatacttgcat

SEQ ID NO: 461227 - DNA, 25 bp, Homo sapien
atacttgcatggaaactgactacac

SEQ ID NO: 461228 - DNA, 25 bp, Homo sapien
gactacacatacataatactgcatt

SEQ ID NO: 461229 - DNA, 25 bp, Homo sapien
aaggttttcacattaatacagcaat

SEQ ID NO: 461230 - DNA, 25 bp, Homo sapien
atacagcaattaccctgactaaatt

SEQ ID NO: 461231 - DNA, 25 bp, Homo sapien
gagaatcttgcatacaatgttgaca

SEQ ID NO: 461232 - DNA, 25 bp, Homo sapien
atccaaaataaagcatctgtgtaca

SEQ ID NO: 461233 - DNA, 25 bp, Homo sapien
tttaacattccaaagctctgaccca

SEQ ID NO: 461234 - DNA, 25 bp, Homo sapien
attccaaagctctgacccagaacag

SEQ ID NO: 461235 - DNA, 25 bp, Homo sapien
acccagaacagatgcgacagagttt

SEQ ID NO: 461236 - DNA, 25 bp, Homo sapien
atgcgacagagtttgctgactgcaa

SEQ ID NO: 461237 - DNA, 25 bp, Homo sapien
tgctgactgcaatccgttcgggaga

SEQ ID NO: 461238 - DNA, 25 bp, Homo sapien
gggagaggctgctgccaaattgaaa

SEQ ID NO: 461239 - DNA, 25 bp, Homo sapien
aagggttaccattccatcaaataca

SEQ ID NO: 461240 - DNA, 25 bp, Homo sapien
gaaggtcaagactcagccattccat

SEQ ID NO: 461241 - DNA, 25 bp, Homo sapien
ctgatgcccaggacggccattaaat

SEQ ID NO: 461242 - DNA, 25 bp, Homo sapien
acggccattaaatgttaccctgcca

SEQ ID NO: 461243 - DNA, 25 bp, Homo sapien
tccacttcagaccaacttcatacta

SEQ ID NO: 461244 - DNA, 25 bp, Homo sapien
gtgaactttgactgggattctggac

SEQ ID NO: 461245 - DNA, 25 bp, Homo sapien
ctgggattctggactggtggacatt

SEQ ID NO: 461246 - DNA, 25 bp, Homo sapien
cacaggcaagggagccctcatgttt

SEQ ID NO: 461247 - DNA, 25 bp, Homo sapien
agggagccctcatgtttgccaagag

SEQ ID NO: 461248 - DNA, 25 bp, Homo sapien
ggatcagatcacagcccaaaaagaa

SEQ ID NO: 461249 - DNA, 25 bp, Homo sapien
aagatgctgcccagaccgatggcct

SEQ ID NO: 461250 - DNA, 25 bp, Homo sapien
agaccgatggcctgagaaccacgac

SEQ ID NO: 461251 - DNA, 25 bp, Homo sapien
gagaaccacgacttcttaccaaaga

SEQ ID NO: 461252 - DNA, 25 bp, Homo sapien
agtcggtaagaacgcagagctctgt

SEQ ID NO: 461253 - DNA, 25 bp, Homo sapien
gagctctgtgagcaaaagctacatc

SEQ ID NO: 461254 - DNA, 25 bp, Homo sapien
gagcaaaagctacatcgaggtgagt

SEQ ID NO: 461255 - DNA, 25 bp, Homo sapien
gtaagtggaagctgaccaggttgtc

SEQ ID NO: 461256 - DNA, 25 bp, Homo sapien
atgttactctgcatgactccccttt

SEQ ID NO: 461257 - DNA, 25 bp, Homo sapien
atgactcccctttaaacgtcagtct

SEQ ID NO: 461258 - DNA, 25 bp, Homo sapien
cctttaaacgtcagtctttgttctg

SEQ ID NO: 461259 - DNA, 25 bp, Homo sapien
ttgtcacagggtcatctactgctta

SEQ ID NO: 461260 - DNA, 25 bp, Homo sapien
ggtcatctactgcttatttgtggca

SEQ ID NO: 461261 - DNA, 25 bp, Homo sapien
atttgtggcactgttttgtcttctg

SEQ ID NO: 461262 - DNA, 25 bp, Homo sapien
tatttcacagcttgtcagagtctat

SEQ ID NO: 461263 - DNA, 25 bp, Homo sapien
gtcagagtctatacaactcagcaga

SEQ ID NO: 461264 - DNA, 25 bp, Homo sapien
tcagcagaaagaacacggcttgcct

SEQ ID NO: 461265 - DNA, 25 bp, Homo sapien
tgcgcctgcagaggtaacaataata

SEQ ID NO: 461266 - DNA, 25 bp, Homo sapien
aaatagattagattctgcaaaaatg

SEQ ID NO: 461267 - DNA, 25 bp, Homo sapien
gcattaaaaaacattttcagccagg

SEQ ID NO: 461268 - DNA, 25 bp, Homo sapien
attaaaaaacattttcagccaggtg

SEQ ID NO: 461269 - DNA, 25 bp, Homo sapien
tgggaggccacagcataaggcttgc

SEQ ID NO: 461270 - DNA, 25 bp, Homo sapien
ccctcagatttgacaatggattgtt

SEQ ID NO: 461271 - DNA, 25 bp, Homo sapien
atggattgttagatttgacacccaa

SEQ ID NO: 461272 - DNA, 25 bp, Homo sapien
ggattgttagatttgacacccaaaa

SEQ ID NO: 461273 - DNA, 25 bp, Homo sapien
gttagatttgacacccaaaagcact

SEQ ID NO: 461274 - DNA, 25 bp, Homo sapien
gatttgacacccaaaagcactagta

SEQ ID NO: 461275 - DNA, 25 bp, Homo sapien
tttgacacccaaaagcactagtaac

SEQ ID NO: 461276 - DNA, 25 bp, Homo sapien
gacacccaaaagcactagtaacaaa

SEQ ID NO: 461277 - DNA, 25 bp, Homo sapien
tgagatactaacatgtgcctagcac

SEQ ID NO: 461278 - DNA, 25 bp, Homo sapien
gtgcctagcacagcaatactacgta

SEQ ID NO: 461279 - DNA, 25 bp, Homo sapien
aaaaagacatatcccttgcttaatt

SEQ ID NO: 461280 - DNA, 25 bp, Homo sapien
aatttgtttattatcttaagcctag

SEQ ID NO: 461281 - DNA, 25 bp, Homo sapien
caagtggtcagaatagcagtgttaa

SEQ ID NO: 461282 - DNA, 25 bp, Homo sapien
aagattctgacctttcacttgctat

SEQ ID NO: 461283 - DNA, 25 bp, Homo sapien
gacctttcacttgctatgtgaccta

SEQ ID NO: 461284 - DNA, 25 bp, Homo sapien
gtgacctagggcaagatacataact

SEQ ID NO: 461285 - DNA, 25 bp, Homo sapien
gatacataactttttagtgcttggg

SEQ ID NO: 461286 - DNA, 25 bp, Homo sapien
tagtgcttgggttttttcatttgta

SEQ ID NO: 461287 - DNA, 25 bp, Homo sapien
gtagattattagtgtctttctcatt

SEQ ID NO: 461288 - DNA, 25 bp, Homo sapien
gcttgagtaggaaaggcccttatgc

SEQ ID NO: 461289 - DNA, 25 bp, Homo sapien
gaaaggcccttatgctgcctgaggg

SEQ ID NO: 461290 - DNA, 25 bp, Homo sapien
aggagccgccctgggtatgagacat

SEQ ID NO: 461291 - DNA, 25 bp, Homo sapien
tatgagacatccctggaacggccta

SEQ ID NO: 461292 - DNA, 25 bp, Homo sapien
gctggcagtcacagcaagtggccaa

SEQ ID NO: 461293 - DNA, 25 bp, Homo sapien
gtcacagcaagtggccaatcaggtc

SEQ ID NO: 461294 - DNA, 25 bp, Homo sapien
aatcaggtcccattgaggcccaggg

SEQ ID NO: 461295 - DNA, 25 bp, Homo sapien
tttattcaactaacatggcgtctcg

SEQ ID NO: 461296 - DNA, 25 bp, Homo sapien
taacatggcgtctcgatgggacctg

SEQ ID NO: 461297 - DNA, 25 bp, Homo sapien
cgtctcgatgggacctgaggccagc

SEQ ID NO: 461298 - DNA, 25 bp, Homo sapien
cctggtgggctcatagctgcgggta

SEQ ID NO: 461299 - DNA, 25 bp, Homo sapien
tattttagccagtgggtcccttcct

SEQ ID NO: 461300 - DNA, 25 bp, Homo sapien
ttagccagtgggtcccttcctttct

SEQ ID NO: 461301 - DNA, 25 bp, Homo sapien
tagccagtgggtcccttcctttctc

SEQ ID NO: 461302 - DNA, 25 bp, Homo sapien
ctactgctcaagaacagatttgagg

SEQ ID NO: 461303 - DNA, 25 bp, Homo sapien
tcaagaacagatttgaggccaggtg

SEQ ID NO: 461304 - DNA, 25 bp, Homo sapien
aataacagacttgaggaacccctct

SEQ ID NO: 461305 - DNA, 25 bp, Homo sapien
caggcactcactcaaacttgctctt

SEQ ID NO: 461306 - DNA, 25 bp, Homo sapien
gcactcactcaaacttgctcttcaa

SEQ ID NO: 461307 - DNA, 25 bp, Homo sapien
actcactcaaacttgctcttcaact

SEQ ID NO: 461308 - DNA, 25 bp, Homo sapien
actcaaacttgctcttcaactctgt

SEQ ID NO: 461309 - DNA, 25 bp, Homo sapien
ctcaaacttgctcttcaactctgta

SEQ ID NO: 461310 - DNA, 25 bp, Homo sapien
ggtaatgtggactgtggagctctgt

SEQ ID NO: 461311 - DNA, 25 bp, Homo sapien
ctgaacctgatgctacttattttgc

SEQ ID NO: 461312 - DNA, 25 bp, Homo sapien
gatgctacttattttgcagttctaa

SEQ ID NO: 461313 - DNA, 25 bp, Homo sapien
gttctaagtgcaaagtcggcctggt

SEQ ID NO: 461314 - DNA, 25 bp, Homo sapien
aaagtcggcctggtggatgcttccc

SEQ ID NO: 461315 - DNA, 25 bp, Homo sapien
cctggtggatgcttcccattataat

SEQ ID NO: 461316 - DNA, 25 bp, Homo sapien
aatttgcttcttcgtgaggtcacac

SEQ ID NO: 461317 - DNA, 25 bp, Homo sapien
tcacatccccagtgtcactttaata

SEQ ID NO: 461318 - DNA, 25 bp, Homo sapien
tttttacatggtgggccatgaccca

SEQ ID NO: 461319 - DNA, 25 bp, Homo sapien
catggtgggccatgacccattagtg

SEQ ID NO: 461320 - DNA, 25 bp, Homo sapien
acccattagtggactctgcatttaa

SEQ ID NO: 461321 - DNA, 25 bp, Homo sapien
gtacttaaaattaccgttatacatg

SEQ ID NO: 461322 - DNA, 25 bp, Homo sapien
accgttatacatgaactttgtggac

SEQ ID NO: 461323 - DNA, 25 bp, Homo sapien
gaactttgtggactgtaagatttgt

SEQ ID NO: 461324 - DNA, 25 bp, Homo sapien
caaatgccttttagctggcttttta

SEQ ID NO: 461325 - DNA, 25 bp, Homo sapien
aatatgcctgttttgagtgcttaat

SEQ ID NO: 461326 - DNA, 25 bp, Homo sapien
cttcctgtatatttgtactcagaga

SEQ ID NO: 461327 - DNA, 25 bp, Homo sapien
ttgtactcagagagccttattttat

SEQ ID NO: 461328 - DNA, 25 bp, Homo sapien
cttccagcagaattactacttgtga

SEQ ID NO: 461329 - DNA, 25 bp, Homo sapien
ctacttgtgatagttcatttacatt

SEQ ID NO: 461330 - DNA, 25 bp, Homo sapien
attccccagaatgtgcctctagtgt

SEQ ID NO: 461331 - DNA, 25 bp, Homo sapien
tgtgcctctagtgtgaattttgtat

SEQ ID NO: 461332 - DNA, 25 bp, Homo sapien
cacttcacagcccttgtatttgcag

SEQ ID NO: 461333 - DNA, 25 bp, Homo sapien
agcccttgtatttgcagccctttct

SEQ ID NO: 461334 - DNA, 25 bp, Homo sapien
cctgaccccaggtctcttcaaatat

SEQ ID NO: 461335 - DNA, 25 bp, Homo sapien
ttctccatagcatttagcaccagct

SEQ ID NO: 461336 - DNA, 25 bp, Homo sapien
tagcaccagctgatatattaccatg

SEQ ID NO: 461337 - DNA, 25 bp, Homo sapien
ccagctgatatattaccatgtttat

SEQ ID NO: 461338 - DNA, 25 bp, Homo sapien
atttgtttgctgtttgtcctactag

SEQ ID NO: 461339 - DNA, 25 bp, Homo sapien
gtttgctgtttgtcctactagaatg

SEQ ID NO: 461340 - DNA, 25 bp, Homo sapien
gctgtttgtcctactagaatgctag

SEQ ID NO: 461341 - DNA, 25 bp, Homo sapien
ctagaatgctagttttttgaaggca

SEQ ID NO: 461342 - DNA, 25 bp, Homo sapien
atgtcccaaggctcagttctcaggt

SEQ ID NO: 461343 - DNA, 25 bp, Homo sapien
tagtggcaactaggttcggaggttt

SEQ ID NO: 461344 - DNA, 25 bp, Homo sapien
ttcggaggtttcgtgtggtcataat

SEQ ID NO: 461345 - DNA, 25 bp, Homo sapien
ttgggtgaagtgtgagatctctgca

SEQ ID NO: 461346 - DNA, 25 bp, Homo sapien
gagatctctgcaaatgagccaggta

SEQ ID NO: 461347 - DNA, 25 bp, Homo sapien
gagccaggtaagatcagtattccat

SEQ ID NO: 461348 - DNA, 25 bp, Homo sapien
gatcagtattccatagtgcttgaaa

SEQ ID NO: 461349 - DNA, 25 bp, Homo sapien
tagagacttctgtcatcacaaagca

SEQ ID NO: 461350 - DNA, 25 bp, Homo sapien
cacaaagcagattaactcctagtta

SEQ ID NO: 461351 - DNA, 25 bp, Homo sapien
gatgaaagcagtaggcccaagataa

SEQ ID NO: 461352 - DNA, 25 bp, Homo sapien
actgttcacttcacagataacactg

SEQ ID NO: 461353 - DNA, 25 bp, Homo sapien
ttctgtgtccagtgttgtgcatatg

SEQ ID NO: 461354 - DNA, 25 bp, Homo sapien
ttgcaaaaggtctggaatggagctt

SEQ ID NO: 461355 - DNA, 25 bp, Homo sapien
cttggaaaaatgttggatatcagca

SEQ ID NO: 461356 - DNA, 25 bp, Homo sapien
tttcactgcagcagcaggtctgttt

SEQ ID NO: 461357 - DNA, 25 bp, Homo sapien
agcaggtctgttttctacctcaagt

SEQ ID NO: 461358 - DNA, 25 bp, Homo sapien
tggcgcagtctttgtcttaccttct

SEQ ID NO: 461359 - DNA, 25 bp, Homo sapien
tctttgtcttaccttctgtctccaa

SEQ ID NO: 461360 - DNA, 25 bp, Homo sapien
taccttctgtctccaacttccttaa

SEQ ID NO: 461361 - DNA, 25 bp, Homo sapien
aaagtagtttatgactcagccctcc

SEQ ID NO: 461362 - DNA, 25 bp, Homo sapien
tctatgaccccaaggccttgagtga

SEQ ID NO: 461363 - DNA, 25 bp, Homo sapien
aggccttgagtgaggcatccacgtc

SEQ ID NO: 461364 - DNA, 25 bp, Homo sapien
agtgaggcatccacgtccgtcctgt

SEQ ID NO: 461365 - DNA, 25 bp, Homo sapien
tttctgttaaagagtaaatgagcca

SEQ ID NO: 461366 - DNA, 25 bp, Homo sapien
ttctgttaaagagtaaatgagccag

SEQ ID NO: 461367 - DNA, 25 bp, Homo sapien
tctgttaaagagtaaatgagccagg

SEQ ID NO: 461368 - DNA, 25 bp, Homo sapien
ctgttaaagagtaaatgagccaggc

SEQ ID NO: 461369 - DNA, 25 bp, Homo sapien
tgttaaagagtaaatgagccaggct

SEQ ID NO: 461370 - DNA, 25 bp, Homo sapien
gttaaagagtaaatgagccaggctt

SEQ ID NO: 461371 - DNA, 25 bp, Homo sapien
ttaaagagtaaatgagccaggcttg

SEQ ID NO: 461372 - DNA, 25 bp, Homo sapien
taaagagtaaatgagccaggcttgg

SEQ ID NO: 461373 - DNA, 25 bp, Homo sapien
aaagagtaaatgagccaggcttggt

SEQ ID NO: 461374 - DNA, 25 bp, Homo sapien
aagagtaaatgagccaggcttggtg

SEQ ID NO: 461375 - DNA, 25 bp, Homo sapien
agagtaaatgagccaggcttggtga

SEQ ID NO: 461376 - DNA, 25 bp, Homo sapien
actgcccagagacctcgtggtaact

SEQ ID NO: 461377 - DNA, 25 bp, Homo sapien
agagacctcgtggtaactgcccttg

SEQ ID NO: 461378 - DNA, 25 bp, Homo sapien
gacctcgtggtaactgcccttggat

SEQ ID NO: 461379 - DNA, 25 bp, Homo sapien
ctcgtggtaactgcccttggatcag

SEQ ID NO: 461380 - DNA, 25 bp, Homo sapien
gtggtaactgcccttggatcagccc

SEQ ID NO: 461381 - DNA, 25 bp, Homo sapien
ggatcagcccagatacaagattgtt

SEQ ID NO: 461382 - DNA, 25 bp, Homo sapien
cagcccagatacaagattgttcggg

SEQ ID NO: 461383 - DNA, 25 bp, Homo sapien
aacagaggctcactcctgggagcgt

SEQ ID NO: 461384 - DNA, 25 bp, Homo sapien
ctgggagcgttcaagaggtggcaaa

SEQ ID NO: 461385 - DNA, 25 bp, Homo sapien
ggtggcaaagtgacaaccatttatt

SEQ ID NO: 461386 - DNA, 25 bp, Homo sapien
gagggcttgggccacctccattcac

SEQ ID NO: 461387 - DNA, 25 bp, Homo sapien
tttccatcctcctcattcgtctagg

SEQ ID NO: 461388 - DNA, 25 bp, Homo sapien
ttccatcctcctcattcgtctaggg

SEQ ID NO: 461389 - DNA, 25 bp, Homo sapien
tccatcctcctcattcgtctagggg

SEQ ID NO: 461390 - DNA, 25 bp, Homo sapien
catcctcctcattcgtctaggggca

SEQ ID NO: 461391 - DNA, 25 bp, Homo sapien
atcctcctcattcgtctaggggcac

SEQ ID NO: 461392 - DNA, 25 bp, Homo sapien
tcctcattcgtctaggggcacccga

SEQ ID NO: 461393 - DNA, 25 bp, Homo sapien
cctcattcgtctaggggcacccgaa

SEQ ID NO: 461394 - DNA, 25 bp, Homo sapien
ctcattcgtctaggggcacccgaat

SEQ ID NO: 461395 - DNA, 25 bp, Homo sapien
tcattcgtctaggggcacccgaatc

SEQ ID NO: 461396 - DNA, 25 bp, Homo sapien
ggcacccgaatcccctattccttat

SEQ ID NO: 461397 - DNA, 25 bp, Homo sapien
gcacccgaatcccctattccttatt

SEQ ID NO: 461398 - DNA, 25 bp, Homo sapien
gaactgtaactttgttcaccctgta

SEQ ID NO: 461399 - DNA, 25 bp, Homo sapien
tctttcaacttcttaatctctgctt

SEQ ID NO: 461400 - DNA, 25 bp, Homo sapien
aatctctgctttgtattcattgtta

SEQ ID NO: 461401 - DNA, 25 bp, Homo sapien
ttcattgttatgtgcttccatcctc

SEQ ID NO: 461402 - DNA, 25 bp, Homo sapien
tccatcctcttcagttcttcatatt

SEQ ID NO: 461403 - DNA, 25 bp, Homo sapien
ttccattagttcttggctcagctgt

SEQ ID NO: 461404 - DNA, 25 bp, Homo sapien
tcagctgttttacacgttgcactca

SEQ ID NO: 461405 - DNA, 25 bp, Homo sapien
gttgcactcacagattccaaacttc

SEQ ID NO: 461406 - DNA, 25 bp, Homo sapien
gaaggtcctcactagtatgggtaaa

SEQ ID NO: 461407 - DNA, 25 bp, Homo sapien
attcaactgggagagcacactgtct

SEQ ID NO: 461408 - DNA, 25 bp, Homo sapien
gcccttgagaggtgtacttcttttc

SEQ ID NO: 461409 - DNA, 25 bp, Homo sapien
ataaatatcttttattacctctgca

SEQ ID NO: 461410 - DNA, 25 bp, Homo sapien
gagagacacaatgatgacatacatc

SEQ ID NO: 461411 - DNA, 25 bp, Homo sapien
gatgacatacatctgccaagtagat

SEQ ID NO: 461412 - DNA, 25 bp, Homo sapien
tctgccaagtagatgctgattttag

SEQ ID NO: 461413 - DNA, 25 bp, Homo sapien
agatgctgattttagagaagacttt

SEQ ID NO: 461414 - DNA, 25 bp, Homo sapien
tctttgtaccgtcttttcccagaat

SEQ ID NO: 461415 - DNA, 25 bp, Homo sapien
gtaccgtcttttcccagaatatgga

SEQ ID NO: 461416 - DNA, 25 bp, Homo sapien
atggaatatgtctttctacttgaac

SEQ ID NO: 461417 - DNA, 25 bp, Homo sapien
atgtctttctacttgaacttctgag

SEQ ID NO: 461418 - DNA, 25 bp, Homo sapien
ttgaacttctgagattcctaaagca

SEQ ID NO: 461419 - DNA, 25 bp, Homo sapien
agattcctaaagcaatactgtttaa

SEQ ID NO: 461420 - DNA, 25 bp, Homo sapien
gagcaggaggccgatgttaaacaac

SEQ ID NO: 461421 - DNA, 25 bp, Homo sapien
gaggccgatgttaaacaacgcagga

SEQ ID NO: 461422 - DNA, 25 bp, Homo sapien
aacaacgcaggaagggacatcatca

SEQ ID NO: 461423 - DNA, 25 bp, Homo sapien
gcaggaagggacatcatcaaagcaa

SEQ ID NO: 461424 - DNA, 25 bp, Homo sapien
gggacatcatcaaagcaaagagcag

SEQ ID NO: 461425 - DNA, 25 bp, Homo sapien
aaagagcagcgtgcggatccccttt

SEQ ID NO: 461426 - DNA, 25 bp, Homo sapien
gagcagcgtgcggatcccctttgct

SEQ ID NO: 461427 - DNA, 25 bp, Homo sapien
agacgtaggattcggccaatcctgg

SEQ ID NO: 461428 - DNA, 25 bp, Homo sapien
gattcggccaatcctggcaagacgg

SEQ ID NO: 461429 - DNA, 25 bp, Homo sapien
gccaatcctggcaagacggatcact

SEQ ID NO: 461430 - DNA, 25 bp, Homo sapien
ctggcaagacggatcactcggaaca

SEQ ID NO: 461431 - DNA, 25 bp, Homo sapien
ctgagctgtgaatcccctgggcagg

SEQ ID NO: 461432 - DNA, 25 bp, Homo sapien
tgagctgtgaatcccctgggcaggg

SEQ ID NO: 461433 - DNA, 25 bp, Homo sapien
cagggggcgacaactccgtgtagca

SEQ ID NO: 461434 - DNA, 25 bp, Homo sapien
gggggcgacaactccgtgtagcatt

SEQ ID NO: 461435 - DNA, 25 bp, Homo sapien
gggcgacaactccgtgtagcattaa

SEQ ID NO: 461436 - DNA, 25 bp, Homo sapien
tgctggtctaatttggaccccctgc

SEQ ID NO: 461437 - DNA, 25 bp, Homo sapien
gctggtctaatttggaccccctgcc

SEQ ID NO: 461438 - DNA, 25 bp, Homo sapien
ggtctaatttggaccccctgcctct

SEQ ID NO: 461439 - DNA, 25 bp, Homo sapien
aatttggaccccctgcctctcagtg

SEQ ID NO: 461440 - DNA, 25 bp, Homo sapien
gccctaggggtgtctgtctccagag

SEQ ID NO: 461441 - DNA, 25 bp, Homo sapien
gaggggagggacaaatcccctactg

SEQ ID NO: 461442 - DNA, 25 bp, Homo sapien
aggcaccaggatcatctacgaccga

SEQ ID NO: 461443 - DNA, 25 bp, Homo sapien
atctacgaccgaaagttcctgctgg

SEQ ID NO: 461444 - DNA, 25 bp, Homo sapien
accgaaagttcctgctggagtgcaa

SEQ ID NO: 461445 - DNA, 25 bp, Homo sapien
gctggagtgcaagaactcacccatt

SEQ ID NO: 461446 - DNA, 25 bp, Homo sapien
tgcaagaactcacccattgcccgga

SEQ ID NO: 461447 - DNA, 25 bp, Homo sapien
gaggaagagatacccgatgacgcac

SEQ ID NO: 461448 - DNA, 25 bp, Homo sapien
gagatacccgatgacgcacaatttg

SEQ ID NO: 461449 - DNA, 25 bp, Homo sapien
acccgatgacgcacaatttgaaatg

SEQ ID NO: 461450 - DNA, 25 bp, Homo sapien
gaaatggacatctaatccagtgcag

SEQ ID NO: 461451 - DNA, 25 bp, Homo sapien
aatccagtgcagatgacctggcatg

SEQ ID NO: 461452 - DNA, 25 bp, Homo sapien
agatgacctggcatgtggagttaca

SEQ ID NO: 461453 - DNA, 25 bp, Homo sapien
aatactttcatattgggagctcctc

SEQ ID NO: 461454 - DNA, 25 bp, Homo sapien
tactttcatattgggagctcctctt

SEQ ID NO: 461455 - DNA, 25 bp, Homo sapien
ctttcatattgggagctcctcttag

SEQ ID NO: 461456 - DNA, 25 bp, Homo sapien
ttcatattgggagctcctcttaggt

SEQ ID NO: 461457 - DNA, 25 bp, Homo sapien
catattgggagctcctcttaggttt

SEQ ID NO: 461458 - DNA, 25 bp, Homo sapien
tattgggagctcctcttaggtttga

SEQ ID NO: 461459 - DNA, 25 bp, Homo sapien
attgggagctcctcttaggtttgaa

SEQ ID NO: 461460 - DNA, 25 bp, Homo sapien
tgggagctcctcttaggtttgaaaa

SEQ ID NO: 461461 - DNA, 25 bp, Homo sapien
ggagctcctcttaggtttgaaaaat

SEQ ID NO: 461462 - DNA, 25 bp, Homo sapien
gagctcctcttaggtttgaaaaata

SEQ ID NO: 461463 - DNA, 25 bp, Homo sapien
ataaaataattggccgtgcacggtg

SEQ ID NO: 461464 - DNA, 25 bp, Homo sapien
taaaataaagcaccacctccttgac

SEQ ID NO: 461465 - DNA, 25 bp, Homo sapien
ataaagcaccacctccttgacctga

SEQ ID NO: 461466 - DNA, 25 bp, Homo sapien
acctccttgacctgactcagggcgt

SEQ ID NO: 461467 - DNA, 25 bp, Homo sapien
aacaatggagtattttggtctgttc

SEQ ID NO: 461468 - DNA, 25 bp, Homo sapien
ctgagaatccgggtgaggaaatcat

SEQ ID NO: 461469 - DNA, 25 bp, Homo sapien
atccgggtgaggaaatcatcggcac

SEQ ID NO: 461470 - DNA, 25 bp, Homo sapien
tgaggaaatcatcggcacactgaac

SEQ ID NO: 461471 - DNA, 25 bp, Homo sapien
ggaaatcatcggcacactgaacccc

SEQ ID NO: 461472 - DNA, 25 bp, Homo sapien
cccctactcagaagtttacctatga

SEQ ID NO: 461473 - DNA, 25 bp, Homo sapien
tacctatgaaacaatcttgcacatg

SEQ ID NO: 461474 - DNA, 25 bp, Homo sapien
acaatcttgcacatgtatgcttcaa

SEQ ID NO: 461475 - DNA, 25 bp, Homo sapien
gcttctggaccgaaaagccaatgtt

SEQ ID NO: 461476 - DNA, 25 bp, Homo sapien
tgaacatagggcaaagacgggtctt

SEQ ID NO: 461477 - DNA, 25 bp, Homo sapien
ggtcttacccccttgatggaagcag

SEQ ID NO: 461478 - DNA, 25 bp, Homo sapien
aagcagcttctggagggtatgcaga

SEQ ID NO: 461479 - DNA, 25 bp, Homo sapien
gagttcttcttgataaaggagcaga

SEQ ID NO: 461480 - DNA, 25 bp, Homo sapien
gccttcctcaagagatactgcttta

SEQ ID NO: 461481 - DNA, 25 bp, Homo sapien
gcagacaaaggtcactacaaatttt

SEQ ID NO: 461482 - DNA, 25 bp, Homo sapien
ttttgtgaactcctgattcataggg

SEQ ID NO: 461483 - DNA, 25 bp, Homo sapien
cccacattgatgttcgtaacaaaaa

SEQ ID NO: 461484 - DNA, 25 bp, Homo sapien
gaaatacgccactttggctggcatc

SEQ ID NO: 461485 - DNA, 25 bp, Homo sapien
ggctggcatccaatggaggtcattt

SEQ ID NO: 461486 - DNA, 25 bp, Homo sapien
gtatcattttacaagatagtgctga

SEQ ID NO: 461487 - DNA, 25 bp, Homo sapien
atcattttacaagatagtgctgaga

SEQ ID NO: 461488 - DNA, 25 bp, Homo sapien
tcattttacaagatagtgctgagag

SEQ ID NO: 461489 - DNA, 25 bp, Homo sapien
cattttacaagatagtgctgagaga

SEQ ID NO: 461490 - DNA, 25 bp, Homo sapien
attttacaagatagtgctgagagag

SEQ ID NO: 461491 - DNA, 25 bp, Homo sapien
ttttacaagatagtgctgagagagt

SEQ ID NO: 461492 - DNA, 25 bp, Homo sapien
tacaagatagtgctgagagagtata

SEQ ID NO: 461493 - DNA, 25 bp, Homo sapien
acaagatagtgctgagagagtataa

SEQ ID NO: 461494 - DNA, 25 bp, Homo sapien
gtataaaaagcagatgtaggccggg

SEQ ID NO: 461495 - DNA, 25 bp, Homo sapien
aaaaagcagatgtaggccgggcact

SEQ ID NO: 461496 - DNA, 25 bp, Homo sapien
tgtaggccgggcactgtagctcaca

SEQ ID NO: 461497 - DNA, 25 bp, Homo sapien
agcttgctatggcattgttcaagta

SEQ ID NO: 461498 - DNA, 25 bp, Homo sapien
ttgctatggcattgttcaagtaccc

SEQ ID NO: 461499 - DNA, 25 bp, Homo sapien
gctatggcattgttcaagtacccac

SEQ ID NO: 461500 - DNA, 25 bp, Homo sapien
atggcattgttcaagtacccactgg

SEQ ID NO: 461501 - DNA, 25 bp, Homo sapien
ggcattgttcaagtacccactggac

SEQ ID NO: 461502 - DNA, 25 bp, Homo sapien
attgttcaagtacccactggaccgt

SEQ ID NO: 461503 - DNA, 25 bp, Homo sapien
gttcaagtacccactggaccgtggt

SEQ ID NO: 461504 - DNA, 25 bp, Homo sapien
tcaagtacccactggaccgtggttt

SEQ ID NO: 461505 - DNA, 25 bp, Homo sapien
gtacccactggaccgtggttttgca

SEQ ID NO: 461506 - DNA, 25 bp, Homo sapien
cccactggaccgtggttttgcagga

SEQ ID NO: 461507 - DNA, 25 bp, Homo sapien
cactggaccgtggttttgcaggaaa

SEQ ID NO: 461508 - DNA, 25 bp, Homo sapien
aagacaccccgggccaggcaaggtg

SEQ ID NO: 461509 - DNA, 25 bp, Homo sapien
cccgggccaggcaaggtgggtcaca

SEQ ID NO: 461510 - DNA, 25 bp, Homo sapien
gaatcacttgagtccggcagtttga

SEQ ID NO: 461511 - DNA, 25 bp, Homo sapien
aacataatgagaccgcatcttcaca

SEQ ID NO: 461512 - DNA, 25 bp, Homo sapien
ataatgagaccgcatcttcacaaaa

SEQ ID NO: 461513 - DNA, 25 bp, Homo sapien
taatgagaccgcatcttcacaaaaa

SEQ ID NO: 461514 - DNA, 25 bp, Homo sapien
aatgagaccgcatcttcacaaaaaa

SEQ ID NO: 461515 - DNA, 25 bp, Homo sapien
atgagaccgcatcttcacaaaaaat

SEQ ID NO: 461516 - DNA, 25 bp, Homo sapien
gagaccgcatcttcacaaaaaatat

SEQ ID NO: 461517 - DNA, 25 bp, Homo sapien
gaccgcatcttcacaaaaaatatgt

SEQ ID NO: 461518 - DNA, 25 bp, Homo sapien
ccgcatcttcacaaaaaatatgttt

SEQ ID NO: 461519 - DNA, 25 bp, Homo sapien
ggcccgcttgctcacgaataaagaa

SEQ ID NO: 461520 - DNA, 25 bp, Homo sapien
gcttgctcacgaataaagaactcag

SEQ ID NO: 461521 - DNA, 25 bp, Homo sapien
aactcagagttgtgtgtgcaatgca

SEQ ID NO: 461522 - DNA, 25 bp, Homo sapien
tgtgcaatgcacacccagacacacg

SEQ ID NO: 461523 - DNA, 25 bp, Homo sapien
gcgcacacacatgcttttttctgtt

SEQ ID NO: 461524 - DNA, 25 bp, Homo sapien
acacacatgcttttttctgttcccc

SEQ ID NO: 461525 - DNA, 25 bp, Homo sapien
ttttctgttcccctccgctttctga

SEQ ID NO: 461526 - DNA, 25 bp, Homo sapien
cagtgacagaggtgttttggtttta

SEQ ID NO: 461527 - DNA, 25 bp, Homo sapien
tgttatgtgggttttcttttgtatt

SEQ ID NO: 461528 - DNA, 25 bp, Homo sapien
aatgatcagacataggagaaaccct

SEQ ID NO: 461529 - DNA, 25 bp, Homo sapien
taggagaaaccctgaatagaaacaa

SEQ ID NO: 461530 - DNA, 25 bp, Homo sapien
aataccctggacctctctttgtact

SEQ ID NO: 461531 - DNA, 25 bp, Homo sapien
tgctccttccatcttttgcttaggt

SEQ ID NO: 461532 - DNA, 25 bp, Homo sapien
cccattccattaccatgatctgttt

SEQ ID NO: 461533 - DNA, 25 bp, Homo sapien
ggaatctgtttctcccatttatttg

SEQ ID NO: 461534 - DNA, 25 bp, Homo sapien
catttatttgtgagcccttggcaga

SEQ ID NO: 461535 - DNA, 25 bp, Homo sapien
cacatctgtgtgttgtgcacatctg

SEQ ID NO: 461536 - DNA, 25 bp, Homo sapien
gttgtgcacatctgtgtacatatct

SEQ ID NO: 461537 - DNA, 25 bp, Homo sapien
attcgttgtttggtatatgtgctgt

SEQ ID NO: 461538 - DNA, 25 bp, Homo sapien
tgtgctgtgactgttacatttaact

SEQ ID NO: 461539 - DNA, 25 bp, Homo sapien
ttgcttaggttttctcttcctgggc

SEQ ID NO: 461540 - DNA, 25 bp, Homo sapien
tcaacacatacatccacactgggca

SEQ ID NO: 461541 - DNA, 25 bp, Homo sapien
accggtgctgcgagttgtacatctg

SEQ ID NO: 461542 - DNA, 25 bp, Homo sapien
ttgtacatctgcaagcgctgcttca

SEQ ID NO: 461543 - DNA, 25 bp, Homo sapien
ctggattcattaccgcatcgtggag

SEQ ID NO: 461544 - DNA, 25 bp, Homo sapien
catcgtggagcagggtggccatact

SEQ ID NO: 461545 - DNA, 25 bp, Homo sapien
aaaattaccctctgcgatcgggtgt

SEQ ID NO: 461546 - DNA, 25 bp, Homo sapien
gatcgggtgttctcaggaagttcct

SEQ ID NO: 461547 - DNA, 25 bp, Homo sapien
gaacctaaaatcagacggaacccag

SEQ ID NO: 461548 - DNA, 25 bp, Homo sapien
ggaacccaggacttagctttctaag

SEQ ID NO: 461549 - DNA, 25 bp, Homo sapien
gcccaggtgagcactgactcttaaa

SEQ ID NO: 461550 - DNA, 25 bp, Homo sapien
gagcactgactcttaaaaccctgaa

SEQ ID NO: 461551 - DNA, 25 bp, Homo sapien
atgcagctgattgctgaccggtgct

SEQ ID NO: 461552 - DNA, 25 bp, Homo sapien
aggaactctcaacccctgcattaca

SEQ ID NO: 461553 - DNA, 25 bp, Homo sapien
ggaactctcaacccctgcattacat

SEQ ID NO: 461554 - DNA, 25 bp, Homo sapien
gaactctcaacccctgcattacatg

SEQ ID NO: 461555 - DNA, 25 bp, Homo sapien
aactctcaacccctgcattacatga

SEQ ID NO: 461556 - DNA, 25 bp, Homo sapien
actctcaacccctgcattacatgat

SEQ ID NO: 461557 - DNA, 25 bp, Homo sapien
tctcaacccctgcattacatgatta

SEQ ID NO: 461558 - DNA, 25 bp, Homo sapien
ctcaacccctgcattacatgattag

SEQ ID NO: 461559 - DNA, 25 bp, Homo sapien
tcaacccctgcattacatgattagg

SEQ ID NO: 461560 - DNA, 25 bp, Homo sapien
caacccctgcattacatgattagga

SEQ ID NO: 461561 - DNA, 25 bp, Homo sapien
aacccctgcattacatgattaggac

SEQ ID NO: 461562 - DNA, 25 bp, Homo sapien
acccctgcattacatgattaggaca

SEQ ID NO: 461563 - DNA, 25 bp, Homo sapien
aaaagaacctgcttgcacatgcaca

SEQ ID NO: 461564 - DNA, 25 bp, Homo sapien
aagaacctgcttgcacatgcacaaa

SEQ ID NO: 461565 - DNA, 25 bp, Homo sapien
gcacatgcacaaaagctgaaggcag

SEQ ID NO: 461566 - DNA, 25 bp, Homo sapien
gaggagtttattagcttctcacagt

SEQ ID NO: 461567 - DNA, 25 bp, Homo sapien
gtttattagcttctcacagttgata

SEQ ID NO: 461568 - DNA, 25 bp, Homo sapien
agcttctcacagttgatagaattgg

SEQ ID NO: 461569 - DNA, 25 bp, Homo sapien
gggagctggaaatgaagtttacttc

SEQ ID NO: 461570 - DNA, 25 bp, Homo sapien
gatgcagtaaggtccctgctggcat

SEQ ID NO: 461571 - DNA, 25 bp, Homo sapien
atttcagttacttatctttgtgagc

SEQ ID NO: 461572 - DNA, 25 bp, Homo sapien
cagttacttatctttgtgagcaatg

SEQ ID NO: 461573 - DNA, 25 bp, Homo sapien
tctttgtgagcaatgttcatttatt

SEQ ID NO: 461574 - DNA, 25 bp, Homo sapien
tcagcccaaacagagggctccttgt

SEQ ID NO: 461575 - DNA, 25 bp, Homo sapien
aaacagagggctccttgttccgctc

SEQ ID NO: 461576 - DNA, 25 bp, Homo sapien
ccttgttccgctcacacaaagagag

SEQ ID NO: 461577 - DNA, 25 bp, Homo sapien
aagagagcccgccatcaaaggaatc

SEQ ID NO: 461578 - DNA, 25 bp, Homo sapien
aaaggaatccctcaggtccggctgg

SEQ ID NO: 461579 - DNA, 25 bp, Homo sapien
aggaccccggtgcttgtggactctt

SEQ ID NO: 461580 - DNA, 25 bp, Homo sapien
gtgcttgtggactcttctttgtctt

SEQ ID NO: 461581 - DNA, 25 bp, Homo sapien
ctttgtcttttctagaggagatcat

SEQ ID NO: 461582 - DNA, 25 bp, Homo sapien
aggagatcatttcctgtgatcccct

SEQ ID NO: 461583 - DNA, 25 bp, Homo sapien
agatcatttcctgtgatccccttgg

SEQ ID NO: 461584 - DNA, 25 bp, Homo sapien
cctgtgatccccttggctgggttca

SEQ ID NO: 461585 - DNA, 25 bp, Homo sapien
ttcggcccgcttgctcacgaataaa

SEQ ID NO: 461586 - DNA, 25 bp, Homo sapien
ggcccgcttgctcacgaataaagaa

SEQ ID NO: 461587 - DNA, 25 bp, Homo sapien
gcttgctcacgaataaagaactcag

SEQ ID NO: 461588 - DNA, 25 bp, Homo sapien
aagaactcagagttgtgtgtgcaat

SEQ ID NO: 461589 - DNA, 25 bp, Homo sapien
aactcagagttgtgtgtgcaatgca

SEQ ID NO: 461590 - DNA, 25 bp, Homo sapien
tgtgcaatgcacacccagacacacg

SEQ ID NO: 461591 - DNA, 25 bp, Homo sapien
ttttctgttcccctccgctttctga

SEQ ID NO: 461592 - DNA, 25 bp, Homo sapien
atcagtgacagaggtgttttggttt

SEQ ID NO: 461593 - DNA, 25 bp, Homo sapien
gtgacagaggtgttttggttttatt

SEQ ID NO: 461594 - DNA, 25 bp, Homo sapien
aatgatcagacataggagaaaccct

SEQ ID NO: 461595 - DNA, 25 bp, Homo sapien
taggagaaaccctgaatagaaacaa

SEQ ID NO: 461596 - DNA, 25 bp, Homo sapien
gttcatctaacaattctcctctttt

SEQ ID NO: 461597 - DNA, 25 bp, Homo sapien
acaattctcctcttttgcttgtatt

SEQ ID NO: 461598 - DNA, 25 bp, Homo sapien
atgaacacttctttacacttacgta

SEQ ID NO: 461599 - DNA, 25 bp, Homo sapien
tacacttacgtacttcacattctag

SEQ ID NO: 461600 - DNA, 25 bp, Homo sapien
gtacttcacattctagtccttgcaa

SEQ ID NO: 461601 - DNA, 25 bp, Homo sapien
ggaggctttgccaattatccctata

SEQ ID NO: 461602 - DNA, 25 bp, Homo sapien
gccaattatccctataacttgtttt

SEQ ID NO: 461603 - DNA, 25 bp, Homo sapien
taacttgttttccatctagattgac

SEQ ID NO: 461604 - DNA, 25 bp, Homo sapien
catctagattgactttcttgtgctc

SEQ ID NO: 461605 - DNA, 25 bp, Homo sapien
actttcttgtgctcccatctgctgg

SEQ ID NO: 461606 - DNA, 25 bp, Homo sapien
ggccacactgtgtaaagcagccatg

SEQ ID NO: 461607 - DNA, 25 bp, Homo sapien
actattagagctgggcattctcctc

SEQ ID NO: 461608 - DNA, 25 bp, Homo sapien
ccggcagacagctctcaagcaggag

SEQ ID NO: 461609 - DNA, 25 bp, Homo sapien
tcaagcaggagcacaccgaggccag

SEQ ID NO: 461610 - DNA, 25 bp, Homo sapien
gtcagctcaggaggcatcaattaca

SEQ ID NO: 461611 - DNA, 25 bp, Homo sapien
gagctatgggataagagcattgcat

SEQ ID NO: 461612 - DNA, 25 bp, Homo sapien
gagcattgcattgaagttttaagtt

SEQ ID NO: 461613 - DNA, 25 bp, Homo sapien
agtttacttgtttgcatgtattctc

SEQ ID NO: 461614 - DNA, 25 bp, Homo sapien
ttgtttgcatgtattctctaagaga

SEQ ID NO: 461615 - DNA, 25 bp, Homo sapien
tttagatctttgaaaacccaggact

SEQ ID NO: 461616 - DNA, 25 bp, Homo sapien
aagtcatagtagcaggttgaggcaa

SEQ ID NO: 461617 - DNA, 25 bp, Homo sapien
gtagaagttacatctctatttccca

SEQ ID NO: 461618 - DNA, 25 bp, Homo sapien
aaagcacttactagcacactgccta

SEQ ID NO: 461619 - DNA, 25 bp, Homo sapien
tagcacactgcctaacacaataagt

SEQ ID NO: 461620 - DNA, 25 bp, Homo sapien
aatataatttgtgtagaactctgac

SEQ ID NO: 461621 - DNA, 25 bp, Homo sapien
gtagaactctgacaacatacattta

SEQ ID NO: 461622 - DNA, 25 bp, Homo sapien
attctggtataaggtttgtcataac

SEQ ID NO: 461623 - DNA, 25 bp, Homo sapien
aaagatagaaaattcacctccattt

SEQ ID NO: 461624 - DNA, 25 bp, Homo sapien
tcacctccattttctttgtacttga

SEQ ID NO: 461625 - DNA, 25 bp, Homo sapien
agtttccctatctgtcagttaagtc

SEQ ID NO: 461626 - DNA, 25 bp, Homo sapien
atctgtcagttaagtcggtattacc

SEQ ID NO: 461627 - DNA, 25 bp, Homo sapien
gtcggtattacctgcttcatagggt

SEQ ID NO: 461628 - DNA, 25 bp, Homo sapien
attacctgcttcatagggttatggg

SEQ ID NO: 461629 - DNA, 25 bp, Homo sapien
agatctgactcaagactgactctga

SEQ ID NO: 461630 - DNA, 25 bp, Homo sapien
aagactgactctgatagtgtagcat

SEQ ID NO: 461631 - DNA, 25 bp, Homo sapien
tagatggttcactaccactgggtag

SEQ ID NO: 461632 - DNA, 25 bp, Homo sapien
tagtgccattttggccggacatggt

SEQ ID NO: 461633 - DNA, 25 bp, Homo sapien
gggtaacccagtgacaccagcactg

SEQ ID NO: 461634 - DNA, 25 bp, Homo sapien
accagcactgattggactgccctac

SEQ ID NO: 461635 - DNA, 25 bp, Homo sapien
tgccctacaccaatcagaagctcag

SEQ ID NO: 461636 - DNA, 25 bp, Homo sapien
tcagaagctcagtgcccaatgggcc

SEQ ID NO: 461637 - DNA, 25 bp, Homo sapien
aatgggccactgttttgactcggaa

SEQ ID NO: 461638 - DNA, 25 bp, Homo sapien
gactcggaatcatgttgtgcactat

SEQ ID NO: 461639 - DNA, 25 bp, Homo sapien
tgtgcactatagtcaaatgtactgt

SEQ ID NO: 461640 - DNA, 25 bp, Homo sapien
gaaaaaagctatcagctgtatgtta

SEQ ID NO: 461641 - DNA, 25 bp, Homo sapien
cagctgtatgttaagagagactctt

SEQ ID NO: 461642 - DNA, 25 bp, Homo sapien
agagagactcttactaacatgttgt

SEQ ID NO: 461643 - DNA, 25 bp, Homo sapien
gagactcttactaacatgttgtaaa

SEQ ID NO: 461644 - DNA, 25 bp, Homo sapien
aatgttattgtaagtctgtaactta

SEQ ID NO: 461645 - DNA, 25 bp, Homo sapien
ttatacaggttggtttggaaatttg

SEQ ID NO: 461646 - DNA, 25 bp, Homo sapien
attttatggtttccatgcttttgta

SEQ ID NO: 461647 - DNA, 25 bp, Homo sapien
aaaatattaatgtctagttgttcta

SEQ ID NO: 461648 - DNA, 25 bp, Homo sapien
ttctatattataaccacatttgcgc

SEQ ID NO: 461649 - DNA, 25 bp, Homo sapien
atattataaccacatttgcgctcta

SEQ ID NO: 461650 - DNA, 25 bp, Homo sapien
ttataaccacatttgcgctctatgc

SEQ ID NO: 461651 - DNA, 25 bp, Homo sapien
tagccctccacaagaagcagcattg

SEQ ID NO: 461652 - DNA, 25 bp, Homo sapien
ctccacaagaagcagcattgagaga

SEQ ID NO: 461653 - DNA, 25 bp, Homo sapien
gagagagctgtggactcaggaccca

SEQ ID NO: 461654 - DNA, 25 bp, Homo sapien
agctgtggactcaggacccaggact

SEQ ID NO: 461655 - DNA, 25 bp, Homo sapien
tgtggactcaggacccaggactctg

SEQ ID NO: 461656 - DNA, 25 bp, Homo sapien
gactcaggacccaggactctgttta

SEQ ID NO: 461657 - DNA, 25 bp, Homo sapien
aggacccaggactctgtttacgtgc

SEQ ID NO: 461658 - DNA, 25 bp, Homo sapien
aggactctgtttacgtgcccagtca

SEQ ID NO: 461659 - DNA, 25 bp, Homo sapien
actctgtttacgtgcccagtcagcc

SEQ ID NO: 461660 - DNA, 25 bp, Homo sapien
gtctttagtcttggctatggtagtt

SEQ ID NO: 461661 - DNA, 25 bp, Homo sapien
atccccccatggatcctttcagtaa

SEQ ID NO: 461662 - DNA, 25 bp, Homo sapien
gaagacagcagcagtggaaaatgat

SEQ ID NO: 461663 - DNA, 25 bp, Homo sapien
atgggtagagatatgtagggccaat

SEQ ID NO: 461664 - DNA, 25 bp, Homo sapien
gggccaatgagttggagacatttta

SEQ ID NO: 461665 - DNA, 25 bp, Homo sapien
tagagtatgccataactgagaaact

SEQ ID NO: 461666 - DNA, 25 bp, Homo sapien
gaaactttggatatagagggaaact

SEQ ID NO: 461667 - DNA, 25 bp, Homo sapien
gatatagagggaaactaaccaattt

SEQ ID NO: 461668 - DNA, 25 bp, Homo sapien
tccaattaaaatcagtgtgaacccc

SEQ ID NO: 461669 - DNA, 25 bp, Homo sapien
gtctaaataaacttcactggtttct

SEQ ID NO: 461670 - DNA, 25 bp, Homo sapien
gccaaattatgcaaagactagacta

SEQ ID NO: 461671 - DNA, 25 bp, Homo sapien
aaagactagactacataggctccta

SEQ ID NO: 461672 - DNA, 25 bp, Homo sapien
gactacataggctcctagtatttat

SEQ ID NO: 461673 - DNA, 25 bp, Homo sapien
gttaaagtattgcacaatcagctgg

SEQ ID NO: 461674 - DNA, 25 bp, Homo sapien
cacaatgccattgccgcttactttg

SEQ ID NO: 461675 - DNA, 25 bp, Homo sapien
gccgcttactttgctgggaatcaga

SEQ ID NO: 461676 - DNA, 25 bp, Homo sapien
tcagaagcagcttgaacagacactt

SEQ ID NO: 461677 - DNA, 25 bp, Homo sapien
agacacttaaacagttccatatcaa

SEQ ID NO: 461678 - DNA, 25 bp, Homo sapien
tgaaaacccctggagtggatgcccc

SEQ ID NO: 461679 - DNA, 25 bp, Homo sapien
acagtcaaaatccaccagcggcaca

SEQ ID NO: 461680 - DNA, 25 bp, Homo sapien
gtcaaaatccaccagcggcacaaca

SEQ ID NO: 461681 - DNA, 25 bp, Homo sapien
aagtccgccgtagcttcatcatttc

SEQ ID NO: 461682 - DNA, 25 bp, Homo sapien
acccaacctcaaccaagcaattaag

SEQ ID NO: 461683 - DNA, 25 bp, Homo sapien
accaagcaattaagccagcagtctg

SEQ ID NO: 461684 - DNA, 25 bp, Homo sapien
aagtcacctcaagcacttagacagg

SEQ ID NO: 461685 - DNA, 25 bp, Homo sapien
gtcacctcaagcacttagacaggag

SEQ ID NO: 461686 - DNA, 25 bp, Homo sapien
tcaagcacttagacaggagagatgg

SEQ ID NO: 461687 - DNA, 25 bp, Homo sapien
gagatgggagagctacctctctccg

SEQ ID NO: 461688 - DNA, 25 bp, Homo sapien
gagagctacctctctccggtggaga

SEQ ID NO: 461689 - DNA, 25 bp, Homo sapien
agctacctctctccggtggagacag

SEQ ID NO: 461690 - DNA, 25 bp, Homo sapien
tctccggtggagacaggctgagact

SEQ ID NO: 461691 - DNA, 25 bp, Homo sapien
agacaggctgagactggcccaggta

SEQ ID NO: 461692 - DNA, 25 bp, Homo sapien
acaggctgagactggcccaggtaga

SEQ ID NO: 461693 - DNA, 25 bp, Homo sapien
agactggcccaggtagagatgctct

SEQ ID NO: 461694 - DNA, 25 bp, Homo sapien
actggcccaggtagagatgctctgg

SEQ ID NO: 461695 - DNA, 25 bp, Homo sapien
aaacttttcttttctgatagtctgt

SEQ ID NO: 461696 - DNA, 25 bp, Homo sapien
aacttttcttttctgatagtctgtt

SEQ ID NO: 461697 - DNA, 25 bp, Homo sapien
acttttcttttctgatagtctgttt

SEQ ID NO: 461698 - DNA, 25 bp, Homo sapien
cttttcttttctgatagtctgtttt

SEQ ID NO: 461699 - DNA, 25 bp, Homo sapien
ttttcttttctgatagtctgtttta

SEQ ID NO: 461700 - DNA, 25 bp, Homo sapien
tttcttttctgatagtctgttttaa

SEQ ID NO: 461701 - DNA, 25 bp, Homo sapien
ttcttttctgatagtctgttttaaa

SEQ ID NO: 461702 - DNA, 25 bp, Homo sapien
tcttttctgatagtctgttttaaaa

SEQ ID NO: 461703 - DNA, 25 bp, Homo sapien
aaaatcaaaatggtcagggttggtg

SEQ ID NO: 461704 - DNA, 25 bp, Homo sapien
tcaaaatggtcagggttggtggttc

SEQ ID NO: 461705 - DNA, 25 bp, Homo sapien
atggtcagggttggtggttcacgcc

SEQ ID NO: 461706 - DNA, 25 bp, Homo sapien
gttaaagtattgcacaatcagctgg

SEQ ID NO: 461707 - DNA, 25 bp, Homo sapien
tttccacaatgccattgccgcttac

SEQ ID NO: 461708 - DNA, 25 bp, Homo sapien
cacaatgccattgccgcttactttg

SEQ ID NO: 461709 - DNA, 25 bp, Homo sapien
atgccattgccgcttactttgctgg

SEQ ID NO: 461710 - DNA, 25 bp, Homo sapien
cattgccgcttactttgctgggaat

SEQ ID NO: 461711 - DNA, 25 bp, Homo sapien
ttgccgcttactttgctgggaatca

SEQ ID NO: 461712 - DNA, 25 bp, Homo sapien
gccgcttactttgctgggaatcaga

SEQ ID NO: 461713 - DNA, 25 bp, Homo sapien
ctttgctgggaatcagaagcagctt

SEQ ID NO: 461714 - DNA, 25 bp, Homo sapien
tcagaagcagcttgaacagacactt

SEQ ID NO: 461715 - DNA, 25 bp, Homo sapien
aacagacacttaaacagttccatat

SEQ ID NO: 461716 - DNA, 25 bp, Homo sapien
agacacttaaacagttccatatcaa

SEQ ID NO: 461717 - DNA, 25 bp, Homo sapien
acaaaccaaaccttagtgtcttcag

SEQ ID NO: 461718 - DNA, 25 bp, Homo sapien
gcaagctgtaaagggcatgggaaca

SEQ ID NO: 461719 - DNA, 25 bp, Homo sapien
gggtcctaacaatatctgctaggct

SEQ ID NO: 461720 - DNA, 25 bp, Homo sapien
acaatatctgctaggctggtctacc

SEQ ID NO: 461721 - DNA, 25 bp, Homo sapien
ctggtctacctcctaaatatactct

SEQ ID NO: 461722 - DNA, 25 bp, Homo sapien
actctgaatctatcacctctattgc

SEQ ID NO: 461723 - DNA, 25 bp, Homo sapien
tatcacctctattgccttcttgcac

SEQ ID NO: 461724 - DNA, 25 bp, Homo sapien
gatttctgcaatccaagctactcaa

SEQ ID NO: 461725 - DNA, 25 bp, Homo sapien
gggagatgctgctctgagctgctct

SEQ ID NO: 461726 - DNA, 25 bp, Homo sapien
tgagctgctctcagtactctcctca

SEQ ID NO: 461727 - DNA, 25 bp, Homo sapien
gtactctcctcatcatggcagttaa

SEQ ID NO: 461728 - DNA, 25 bp, Homo sapien
tgaacccttgtgaggttggcacgga

SEQ ID NO: 461729 - DNA, 25 bp, Homo sapien
tgtgaggttggcacggactgactcc

SEQ ID NO: 461730 - DNA, 25 bp, Homo sapien
gcacggactgactccgtgggccgct

SEQ ID NO: 461731 - DNA, 25 bp, Homo sapien
ttcctctcctgatgagtcacaggct

SEQ ID NO: 461732 - DNA, 25 bp, Homo sapien
tcctgatgagtcacaggctgcggtg

SEQ ID NO: 461733 - DNA, 25 bp, Homo sapien
ctgaccctggtaccgaagctgtgga

SEQ ID NO: 461734 - DNA, 25 bp, Homo sapien
gtaccgaagctgtggacgttctcgc

SEQ ID NO: 461735 - DNA, 25 bp, Homo sapien
tgtggacgttctcgccacactcaac

SEQ ID NO: 461736 - DNA, 25 bp, Homo sapien
caaggatgccctggccgattggaaa

SEQ ID NO: 461737 - DNA, 25 bp, Homo sapien
gccctggccgattggaaatgctgta

SEQ ID NO: 461738 - DNA, 25 bp, Homo sapien
atgctgtaaaatgcaaactaagtta

SEQ ID NO: 461739 - DNA, 25 bp, Homo sapien
atagccatatagaacacttagggac

SEQ ID NO: 461740 - DNA, 25 bp, Homo sapien
acttagggacgaaccctgatctctt

SEQ ID NO: 461741 - DNA, 25 bp, Homo sapien
accctgatctcttgatatcgtagat

SEQ ID NO: 461742 - DNA, 25 bp, Homo sapien
atcgtagatatccttaatcgagttt

SEQ ID NO: 461743 - DNA, 25 bp, Homo sapien
aatcgagttttatattgccatcaga

SEQ ID NO: 461744 - DNA, 25 bp, Homo sapien
tattgccatcagatctaacctctct

SEQ ID NO: 461745 - DNA, 25 bp, Homo sapien
tacgctctacctcatttatcaccta

SEQ ID NO: 461746 - DNA, 25 bp, Homo sapien
atttatcacctaaccatccaactat

SEQ ID NO: 461747 - DNA, 25 bp, Homo sapien
tagacctatggcctatccccttatg

SEQ ID NO: 461748 - DNA, 25 bp, Homo sapien
tatccccttatgagctgggctgcag

SEQ ID NO: 461749 - DNA, 25 bp, Homo sapien
tgggctgcagtgattataaggcttt

SEQ ID NO: 461750 - DNA, 25 bp, Homo sapien
acataggcaaagttggacatcccaa

SEQ ID NO: 461751 - DNA, 25 bp, Homo sapien
taggcaaagttggacatcccaaaga

SEQ ID NO: 461752 - DNA, 25 bp, Homo sapien
tcccaaagatggcatagataaacat

SEQ ID NO: 461753 - DNA, 25 bp, Homo sapien
atcatctcagccagaaacataccta

SEQ ID NO: 461754 - DNA, 25 bp, Homo sapien
tctcagccagaaacatacctacaat

SEQ ID NO: 461755 - DNA, 25 bp, Homo sapien
gccagaaacatacctacaatggaga

SEQ ID NO: 461756 - DNA, 25 bp, Homo sapien
acaatggagagaatcaccaccacaa

SEQ ID NO: 461757 - DNA, 25 bp, Homo sapien
aatcaccaccacaaagtcaaagatg

SEQ ID NO: 461758 - DNA, 25 bp, Homo sapien
accacaaagtcaaagatgttccagc

SEQ ID NO: 461759 - DNA, 25 bp, Homo sapien
gatgttccagcctatagtgaagtag

SEQ ID NO: 461760 - DNA, 25 bp, Homo sapien
ttccagcctatagtgaagtagtagt

SEQ ID NO: 461761 - DNA, 25 bp, Homo sapien
aataacctacacctagaacactaag

SEQ ID NO: 461762 - DNA, 25 bp, Homo sapien
gaacactaagatactggtaacgtag

SEQ ID NO: 461763 - DNA, 25 bp, Homo sapien
aaaaatgtgtagttaatgccttgat

SEQ ID NO: 461764 - DNA, 25 bp, Homo sapien
gtagttaatgccttgatggattctt

SEQ ID NO: 461765 - DNA, 25 bp, Homo sapien
tctagcaatatttatgtctatccac

SEQ ID NO: 461766 - DNA, 25 bp, Homo sapien
ttatgtctatccacagaaagcgtac

SEQ ID NO: 461767 - DNA, 25 bp, Homo sapien
tatccacagaaagcgtacactcatg

SEQ ID NO: 461768 - DNA, 25 bp, Homo sapien
gaaagcgtacactcatgtatttgca

SEQ ID NO: 461769 - DNA, 25 bp, Homo sapien
gtacactcatgtatttgcatggcta

SEQ ID NO: 461770 - DNA, 25 bp, Homo sapien
gtatttgcatggctaatatatttta

SEQ ID NO: 461771 - DNA, 25 bp, Homo sapien
tatatttctcaacatttcacttaat

SEQ ID NO: 461772 - DNA, 25 bp, Homo sapien
tatgattcctgccatttgctgctaa

SEQ ID NO: 461773 - DNA, 25 bp, Homo sapien
tttgctgctaaatctgggctggtca

SEQ ID NO: 461774 - DNA, 25 bp, Homo sapien
ctggtcagaatgctgcagcgatact

SEQ ID NO: 461775 - DNA, 25 bp, Homo sapien
atgctgcagcgatacttgatctata

SEQ ID NO: 461776 - DNA, 25 bp, Homo sapien
tgatctatataaaaacctggcagta

SEQ ID NO: 461777 - DNA, 25 bp, Homo sapien
agtgaaagttaaatcctcttgctgt

SEQ ID NO: 461778 - DNA, 25 bp, Homo sapien
gatgacataggcaagctgtgcagct

SEQ ID NO: 461779 - DNA, 25 bp, Homo sapien
tgtggcatttaaaaccgtctagaaa

SEQ ID NO: 461780 - DNA, 25 bp, Homo sapien
tggttgtactttaatgccagtaata

SEQ ID NO: 461781 - DNA, 25 bp, Homo sapien
atgccagtaataatctgcttcctct

SEQ ID NO: 461782 - DNA, 25 bp, Homo sapien
aatctgcttcctctattgtcattaa

SEQ ID NO: 461783 - DNA, 25 bp, Homo sapien
ggtagcattacccaaataaactgtg

SEQ ID NO: 461784 - DNA, 25 bp, Homo sapien
gagaggagatgccaaaacgccagat

SEQ ID NO: 461785 - DNA, 25 bp, Homo sapien
gcaatcaagtttcttcttttccact

SEQ ID NO: 461786 - DNA, 25 bp, Homo sapien
ttcttttccacttttacttatgagc

SEQ ID NO: 461787 - DNA, 25 bp, Homo sapien
agacaacggtttgtgtgcacttccc

SEQ ID NO: 461788 - DNA, 25 bp, Homo sapien
tgtgcacttcccgacatacctgtgt

SEQ ID NO: 461789 - DNA, 25 bp, Homo sapien
acatacctgtgtcttcgtgtgcctg

SEQ ID NO: 461790 - DNA, 25 bp, Homo sapien
accgggccggactgtacagagccct

SEQ ID NO: 461791 - DNA, 25 bp, Homo sapien
tacagagccctgctgcggcgtgtta

SEQ ID NO: 461792 - DNA, 25 bp, Homo sapien
tgctgcggcgtgttaggaatgacct

SEQ ID NO: 461793 - DNA, 25 bp, Homo sapien
gctggtgacgggtagcattacccaa

SEQ ID NO: 461794 - DNA, 25 bp, Homo sapien
ttgagttgaggaccaaagtgccata

SEQ ID NO: 461795 - DNA, 25 bp, Homo sapien
gaggaccaaagtgccatagcgacat

SEQ ID NO: 461796 - DNA, 25 bp, Homo sapien
aagtgccatagcgacatccagaaca

SEQ ID NO: 461797 - DNA, 25 bp, Homo sapien
atagcgacatccagaacacaagccc

SEQ ID NO: 461798 - DNA, 25 bp, Homo sapien
ctagggtctcccaggctcagaaggg

SEQ ID NO: 461799 - DNA, 25 bp, Homo sapien
cccctgtggtcaagcctctggtggg

SEQ ID NO: 461800 - DNA, 25 bp, Homo sapien
ctctggtgggcgtcttgcccagttc

SEQ ID NO: 461801 - DNA, 25 bp, Homo sapien
tcttgcccagttcctgatggttcaa

SEQ ID NO: 461802 - DNA, 25 bp, Homo sapien
tgcccagttcctgatggttcaaggg

SEQ ID NO: 461803 - DNA, 25 bp, Homo sapien
ccctgacacaggtgtggctactgga

SEQ ID NO: 461804 - DNA, 25 bp, Homo sapien
actggaggggccttcatacctgcgg

SEQ ID NO: 461805 - DNA, 25 bp, Homo sapien
ggtgtggctgagtgaccagggtgtc

SEQ ID NO: 461806 - DNA, 25 bp, Homo sapien
agggtgtcacccactgcatctggag

SEQ ID NO: 461807 - DNA, 25 bp, Homo sapien
gtcacccactgcatctggagtacag

SEQ ID NO: 461808 - DNA, 25 bp, Homo sapien
acccactgcatctggagtacagctt

SEQ ID NO: 461809 - DNA, 25 bp, Homo sapien
gagtacagcttctcctaggacaggc

SEQ ID NO: 461810 - DNA, 25 bp, Homo sapien
gtacagcttctcctaggacaggcgg

SEQ ID NO: 461811 - DNA, 25 bp, Homo sapien
gcttctcctaggacaggcggctcta

SEQ ID NO: 461812 - DNA, 25 bp, Homo sapien
aggacaggcggctctacccgaggga

SEQ ID NO: 461813 - DNA, 25 bp, Homo sapien
ggctctacccgagggagggcgtctg

SEQ ID NO: 461814 - DNA, 25 bp, Homo sapien
tgatgccaactcaaacacgtgcctt

SEQ ID NO: 461815 - DNA, 25 bp, Homo sapien
aagccccggaccatgcaccaggctg

SEQ ID NO: 461816 - DNA, 25 bp, Homo sapien
atctgcttcatctgcccggcgctga

SEQ ID NO: 461817 - DNA, 25 bp, Homo sapien
tgcccggcgctgatctacaagaaaa

SEQ ID NO: 461818 - DNA, 25 bp, Homo sapien
aaatccacaagaacgcactttcctc

SEQ ID NO: 461819 - DNA, 25 bp, Homo sapien
caagaacgcactttcctcccaggtg

SEQ ID NO: 461820 - DNA, 25 bp, Homo sapien
gtggtgctgtgggtcggcctgggcg

SEQ ID NO: 461821 - DNA, 25 bp, Homo sapien
tgtgggtcggcctgggcgtcctggt

SEQ ID NO: 461822 - DNA, 25 bp, Homo sapien
tggtggtgagcactgtcaccacact

SEQ ID NO: 461823 - DNA, 25 bp, Homo sapien
gtgagcactgtcaccacactgtctg

SEQ ID NO: 461824 - DNA, 25 bp, Homo sapien
gcactgtcaccacactgtctgtgag

SEQ ID NO: 461825 - DNA, 25 bp, Homo sapien
cactgtctgtgagcgaggaggtccc

SEQ ID NO: 461826 - DNA, 25 bp, Homo sapien
tgaaggtggaggcagcgcggctctc

SEQ ID NO: 461827 - DNA, 25 bp, Homo sapien
tgtgccttccgtttcagaaggagac

SEQ ID NO: 461828 - DNA, 25 bp, Homo sapien
aggagacattttgctgttacattct

SEQ ID NO: 461829 - DNA, 25 bp, Homo sapien
caaaagatactaggcccaggagtca

SEQ ID NO: 461830 - DNA, 25 bp, Homo sapien
gaaagtgatagtttcacctgacttt

SEQ ID NO: 461831 - DNA, 25 bp, Homo sapien
ttcacctgactttgattccttaacc

SEQ ID NO: 461832 - DNA, 25 bp, Homo sapien
ggaacaagccatgtttgccctagtc

SEQ ID NO: 461833 - DNA, 25 bp, Homo sapien
atgtttgccctagtccaggattgcc

SEQ ID NO: 461834 - DNA, 25 bp, Homo sapien
tagtccaggattgcctcacttgaga

SEQ ID NO: 461835 - DNA, 25 bp, Homo sapien
ggattgcctcacttgagacttgcta

SEQ ID NO: 461836 - DNA, 25 bp, Homo sapien
tgagacttgctaggcctctgctgtg

SEQ ID NO: 461837 - DNA, 25 bp, Homo sapien
agagagcaagctaaggagtcaccaa

SEQ ID NO: 461838 - DNA, 25 bp, Homo sapien
ccacatttctggcagcgtttcccag

SEQ ID NO: 461839 - DNA, 25 bp, Homo sapien
cacatttctggcagcgtttcccaga

SEQ ID NO: 461840 - DNA, 25 bp, Homo sapien
aatatctgcggaataaacccaatgg

SEQ ID NO: 461841 - DNA, 25 bp, Homo sapien
atatctgcggaataaacccaatggt

SEQ ID NO: 461842 - DNA, 25 bp, Homo sapien
tatctgcggaataaacccaatggtt

SEQ ID NO: 461843 - DNA, 25 bp, Homo sapien
atctgcggaataaacccaatggtta

SEQ ID NO: 461844 - DNA, 25 bp, Homo sapien
tctgcggaataaacccaatggttaa

SEQ ID NO: 461845 - DNA, 25 bp, Homo sapien
ctgcggaataaacccaatggttaat

SEQ ID NO: 461846 - DNA, 25 bp, Homo sapien
tgcggaataaacccaatggttaatt

SEQ ID NO: 461847 - DNA, 25 bp, Homo sapien
tagagaactcaggtattctttcctg

SEQ ID NO: 461848 - DNA, 25 bp, Homo sapien
gaactcaggtattctttcctgacat

SEQ ID NO: 461849 - DNA, 25 bp, Homo sapien
caggtattctttcctgacattgttt

SEQ ID NO: 461850 - DNA, 25 bp, Homo sapien
gaattttgttcagcattgactttta

SEQ ID NO: 461851 - DNA, 25 bp, Homo sapien
gttcagcattgacttttataattcc

SEQ ID NO: 461852 - DNA, 25 bp, Homo sapien
tcagcattgacttttataattccca

SEQ ID NO: 461853 - DNA, 25 bp, Homo sapien
gttgtattttatcagtaacattttc

SEQ ID NO: 461854 - DNA, 25 bp, Homo sapien
agtaacattttctaagtgaagatta

SEQ ID NO: 461855 - DNA, 25 bp, Homo sapien
tttactgaggatgatacattatagt

SEQ ID NO: 461856 - DNA, 25 bp, Homo sapien
attgtattattctctgtagtaagat

SEQ ID NO: 461857 - DNA, 25 bp, Homo sapien
attattctctgtagtaagattagta

SEQ ID NO: 461858 - DNA, 25 bp, Homo sapien
ttgtactaatagaatgctttcaaga

SEQ ID NO: 461859 - DNA, 25 bp, Homo sapien
aatgctttcaagaataccgagtatt

SEQ ID NO: 461860 - DNA, 25 bp, Homo sapien
atgctttcaagaataccgagtattt

SEQ ID NO: 461861 - DNA, 25 bp, Homo sapien
tgctttcaagaataccgagtatttg

SEQ ID NO: 461862 - DNA, 25 bp, Homo sapien
gctttcaagaataccgagtatttgg

SEQ ID NO: 461863 - DNA, 25 bp, Homo sapien
ctttcaagaataccgagtatttggc

SEQ ID NO: 461864 - DNA, 25 bp, Homo sapien
ttcaagaataccgagtatttggcca

SEQ ID NO: 461865 - DNA, 25 bp, Homo sapien
tcaagaataccgagtatttggccag

SEQ ID NO: 461866 - DNA, 25 bp, Homo sapien
caagaataccgagtatttggccagg

SEQ ID NO: 461867 - DNA, 25 bp, Homo sapien
aagaataccgagtatttggccaggt

SEQ ID NO: 461868 - DNA, 25 bp, Homo sapien
aataccgagtatttggccaggtgca

SEQ ID NO: 461869 - DNA, 25 bp, Homo sapien
ttcccaatggtgatggccttcttca

SEQ ID NO: 461870 - DNA, 25 bp, Homo sapien
cccaatggtgatggccttcttcaat

SEQ ID NO: 461871 - DNA, 25 bp, Homo sapien
aatggtgatggccttcttcaatatt

SEQ ID NO: 461872 - DNA, 25 bp, Homo sapien
atggtgatggccttcttcaatattt

SEQ ID NO: 461873 - DNA, 25 bp, Homo sapien
ggtgatggccttcttcaatatttaa

SEQ ID NO: 461874 - DNA, 25 bp, Homo sapien
gatggccttcttcaatatttaataa

SEQ ID NO: 461875 - DNA, 25 bp, Homo sapien
ggccttcttcaatatttaataaggt

SEQ ID NO: 461876 - DNA, 25 bp, Homo sapien
tagtattacaataacaattgcgaat

SEQ ID NO: 461877 - DNA, 25 bp, Homo sapien
ttgcgaataatcaaatatgccctaa

SEQ ID NO: 461878 - DNA, 25 bp, Homo sapien
gaataatcaaatatgccctaagcag

SEQ ID NO: 461879 - DNA, 25 bp, Homo sapien
tcaaatatgccctaagcagtgtttt

SEQ ID NO: 461880 - DNA, 25 bp, Homo sapien
atagtcaccttctccagtggtacaa

SEQ ID NO: 461881 - DNA, 25 bp, Homo sapien
gtacaattctgttttgatcctgtgg

SEQ ID NO: 461882 - DNA, 25 bp, Homo sapien
gatcctgtggtagctgtcacaactg

SEQ ID NO: 461883 - DNA, 25 bp, Homo sapien
ggacaattcatcgacaatctgcatt

SEQ ID NO: 461884 - DNA, 25 bp, Homo sapien
gacaatctgcattgcgctgctatga

SEQ ID NO: 461885 - DNA, 25 bp, Homo sapien
gctgctatgattatccaactcctca

SEQ ID NO: 461886 - DNA, 25 bp, Homo sapien
ggaaatgcaatctgtttcgccacgc

SEQ ID NO: 461887 - DNA, 25 bp, Homo sapien
aatctgaggtgcctgcacgtgagct

SEQ ID NO: 461888 - DNA, 25 bp, Homo sapien
acgtgagcttgctgtgcctgagctg

SEQ ID NO: 461889 - DNA, 25 bp, Homo sapien
gcctgagctgctatgacctttgtag

SEQ ID NO: 461890 - DNA, 25 bp, Homo sapien
tatgacctttgtagcacctgcagtg

SEQ ID NO: 461891 - DNA, 25 bp, Homo sapien
cttcgtcatcatgccgactgatcag

SEQ ID NO: 461892 - DNA, 25 bp, Homo sapien
cagactactcaggtggatgctacta

SEQ ID NO: 461893 - DNA, 25 bp, Homo sapien
ttctcacaagctcggcagtgcttct

SEQ ID NO: 461894 - DNA, 25 bp, Homo sapien
cagtgcttctcagtaacaaccctaa

SEQ ID NO: 461895 - DNA, 25 bp, Homo sapien
ttctaccaggatcacccagacagac

SEQ ID NO: 461896 - DNA, 25 bp, Homo sapien
agacagactcttccaaaaagtgtct

SEQ ID NO: 461897 - DNA, 25 bp, Homo sapien
gcccacactcctttattcagatata

SEQ ID NO: 461898 - DNA, 25 bp, Homo sapien
gggaccctgaaagcagtaacttata

SEQ ID NO: 461899 - DNA, 25 bp, Homo sapien
gtaacttatatgacccactgtcctt

SEQ ID NO: 461900 - DNA, 25 bp, Homo sapien
tatgacccactgtcctttatttgat

SEQ ID NO: 461901 - DNA, 25 bp, Homo sapien
gatgaagatactactaagctactct

SEQ ID NO: 461902 - DNA, 25 bp, Homo sapien
gatccttgaggaaagcccagggcat

SEQ ID NO: 461903 - DNA, 25 bp, Homo sapien
aaagcccagggcatgaatttcagtt

SEQ ID NO: 461904 - DNA, 25 bp, Homo sapien
tgaatttcagttccggagtccccga

SEQ ID NO: 461905 - DNA, 25 bp, Homo sapien
ctcagggatccgtcagtccttcgtg

SEQ ID NO: 461906 - DNA, 25 bp, Homo sapien
gtcagtccttcgtgccaaggtcagg

SEQ ID NO: 461907 - DNA, 25 bp, Homo sapien
gtgccaaggtcaggctcaactccag

SEQ ID NO: 461908 - DNA, 25 bp, Homo sapien
agccgcactcctcgaagatgtctgg

SEQ ID NO: 461909 - DNA, 25 bp, Homo sapien
tcctcgaagatgtctgggtagtgcc

SEQ ID NO: 461910 - DNA, 25 bp, Homo sapien
gggtggcaagtctaatctattcgaa

SEQ ID NO: 461911 - DNA, 25 bp, Homo sapien
tctattcgaatctttacaggcactt

SEQ ID NO: 461912 - DNA, 25 bp, Homo sapien
cgaatctttacaggcacttttcttt

SEQ ID NO: 461913 - DNA, 25 bp, Homo sapien
ggaccctttaaaggtcagctgcttg

SEQ ID NO: 461914 - DNA, 25 bp, Homo sapien
cagctgcttggagacattgggtttc

SEQ ID NO: 461915 - DNA, 25 bp, Homo sapien
gagacattgggtttcagtgctgcag

SEQ ID NO: 461916 - DNA, 25 bp, Homo sapien
cattgggtttcagtgctgcaggtgt

SEQ ID NO: 461917 - DNA, 25 bp, Homo sapien
ctggaccagagaataggacatgcct

SEQ ID NO: 461918 - DNA, 25 bp, Homo sapien
gagaataggacatgcctcggacaaa

SEQ ID NO: 461919 - DNA, 25 bp, Homo sapien
atgcctcggacaaaaagcactctgg

SEQ ID NO: 461920 - DNA, 25 bp, Homo sapien
ggacaaaaagcactctggcccgcct

SEQ ID NO: 461921 - DNA, 25 bp, Homo sapien
tggcccgcctgcttacatgggtcct

SEQ ID NO: 461922 - DNA, 25 bp, Homo sapien
acatgggtcctcaaccttggctgtg

SEQ ID NO: 461923 - DNA, 25 bp, Homo sapien
gctgtgtgtcagactcacctgaaga

SEQ ID NO: 461924 - DNA, 25 bp, Homo sapien
actgctagttacaagacgtcacgat

SEQ ID NO: 461925 - DNA, 25 bp, Homo sapien
gacgtcacgatcttcaaaacatctg

SEQ ID NO: 461926 - DNA, 25 bp, Homo sapien
gcaaatgaggcttccacaagctgcc

SEQ ID NO: 461927 - DNA, 25 bp, Homo sapien
gacgcccctcgaaacgattatcaag

SEQ ID NO: 461928 - DNA, 25 bp, Homo sapien
gattatcaagttgtttcactggaca

SEQ ID NO: 461929 - DNA, 25 bp, Homo sapien
gacaggtgctgggtaaaagcttgtt

SEQ ID NO: 461930 - DNA, 25 bp, Homo sapien
aaacttcagttctttgcatcgctgg

SEQ ID NO: 461931 - DNA, 25 bp, Homo sapien
agttctttgcatcgctgggccaaga

SEQ ID NO: 461932 - DNA, 25 bp, Homo sapien
atcgctgggccaagacgttccttga

SEQ ID NO: 461933 - DNA, 25 bp, Homo sapien
gggccaagacgttccttgagtagga

SEQ ID NO: 461934 - DNA, 25 bp, Homo sapien
tctgtgcacacactgctagttacaa

SEQ ID NO: 461935 - DNA, 25 bp, Homo sapien
tttctacctgccacgcgtcggtgaa

SEQ ID NO: 461936 - DNA, 25 bp, Homo sapien
ttctacctgccacgcgtcggtgaag

SEQ ID NO: 461937 - DNA, 25 bp, Homo sapien
tctacctgccacgcgtcggtgaagg

SEQ ID NO: 461938 - DNA, 25 bp, Homo sapien
ctacctgccacgcgtcggtgaaggt

SEQ ID NO: 461939 - DNA, 25 bp, Homo sapien
acctgccacgcgtcggtgaaggttg

SEQ ID NO: 461940 - DNA, 25 bp, Homo sapien
cctgccacgcgtcggtgaaggttgg

SEQ ID NO: 461941 - DNA, 25 bp, Homo sapien
tgccacgcgtcggtgaaggttggga

SEQ ID NO: 461942 - DNA, 25 bp, Homo sapien
gccacgcgtcggtgaaggttgggac

SEQ ID NO: 461943 - DNA, 25 bp, Homo sapien
ccacgcgtcggtgaaggttgggact

SEQ ID NO: 461944 - DNA, 25 bp, Homo sapien
cacgcgtcggtgaaggttgggactc

SEQ ID NO: 461945 - DNA, 25 bp, Homo sapien
acgcgtcggtgaaggttgggactcg

SEQ ID NO: 461946 - DNA, 25 bp, Homo sapien
gactttgtagctacaatgagcttga

SEQ ID NO: 461947 - DNA, 25 bp, Homo sapien
atgagcttgaaaaagcgcttactta

SEQ ID NO: 461948 - DNA, 25 bp, Homo sapien
gagtacatactcctcagacgatgca

SEQ ID NO: 461949 - DNA, 25 bp, Homo sapien
gacgatgcacactttaattagctaa

SEQ ID NO: 461950 - DNA, 25 bp, Homo sapien
tctctgatcctttcatggcactgta

SEQ ID NO: 461951 - DNA, 25 bp, Homo sapien
tcctttcatggcactgtagctcaaa

SEQ ID NO: 461952 - DNA, 25 bp, Homo sapien
gtagctcaaagactggaatctctgc

SEQ ID NO: 461953 - DNA, 25 bp, Homo sapien
gaatctctgcttgttaaccattgtt

SEQ ID NO: 461954 - DNA, 25 bp, Homo sapien
ttttagtcctggttgcttttagcct

SEQ ID NO: 461955 - DNA, 25 bp, Homo sapien
gttgcttttagcctctgtatagttc

SEQ ID NO: 461956 - DNA, 25 bp, Homo sapien
tagcctctgtatagttcctttttta

SEQ ID NO: 461957 - DNA, 25 bp, Homo sapien
ataagtcagctttctgtagcataag

SEQ ID NO: 461958 - DNA, 25 bp, Homo sapien
gtagcataagatttgattttcccat

SEQ ID NO: 461959 - DNA, 25 bp, Homo sapien
attttcccatacttacttcacttgt

SEQ ID NO: 461960 - DNA, 25 bp, Homo sapien
tacttcacttgttatacatcactga

SEQ ID NO: 461961 - DNA, 25 bp, Homo sapien
acatcactgattatttgggttaaac

SEQ ID NO: 461962 - DNA, 25 bp, Homo sapien
gggttaaactggactcatttcaagc

SEQ ID NO: 461963 - DNA, 25 bp, Homo sapien
gcttttgttcaaatcgtgatgagaa

SEQ ID NO: 461964 - DNA, 25 bp, Homo sapien
gatgagaaacctaatactgtaattt

SEQ ID NO: 461965 - DNA, 25 bp, Homo sapien
actgtaatttgatttgagccataaa

SEQ ID NO: 461966 - DNA, 25 bp, Homo sapien
ggtaactctagattaggccagttca

SEQ ID NO: 461967 - DNA, 25 bp, Homo sapien
ggccagttcaggtgtattttgtatc

SEQ ID NO: 461968 - DNA, 25 bp, Homo sapien
aggtgtactggatgtgccgggacca

SEQ ID NO: 461969 - DNA, 25 bp, Homo sapien
atgtgccgggaccaggctcggctgg

SEQ ID NO: 461970 - DNA, 25 bp, Homo sapien
ataacccagggccaccgcatcatgg

SEQ ID NO: 461971 - DNA, 25 bp, Homo sapien
agggccaccgcatcatggtcatgcg

SEQ ID NO: 461972 - DNA, 25 bp, Homo sapien
gcatcatggtcatgcgcagccactg

SEQ ID NO: 461973 - DNA, 25 bp, Homo sapien
atggtcatgcgcagccactgccatc

SEQ ID NO: 461974 - DNA, 25 bp, Homo sapien
agcaggaggacccagaaaagattca

SEQ ID NO: 461975 - DNA, 25 bp, Homo sapien
gaaaagattcaagttcagctgtgct

SEQ ID NO: 461976 - DNA, 25 bp, Homo sapien
gcttcaagacgtgttctcctgaaag

SEQ ID NO: 461977 - DNA, 25 bp, Homo sapien
tcaagacgtgttctcctgaaagcca

SEQ ID NO: 461978 - DNA, 25 bp, Homo sapien
aagacgtgttctcctgaaagccagc

SEQ ID NO: 461979 - DNA, 25 bp, Homo sapien
gagaaacctgcctggcaccgctggc

SEQ ID NO: 461980 - DNA, 25 bp, Homo sapien
tctggactgacaccgctctggaggc

SEQ ID NO: 461981 - DNA, 25 bp, Homo sapien
ggactgacaccgctctggaggcctc

SEQ ID NO: 461982 - DNA, 25 bp, Homo sapien
tctggaggcctcccacaagcagcaa

SEQ ID NO: 461983 - DNA, 25 bp, Homo sapien
ccacaagcagcaaccaagccagaaa

SEQ ID NO: 461984 - DNA, 25 bp, Homo sapien
agcagcaaccaagccagaaaaagtt

SEQ ID NO: 461985 - DNA, 25 bp, Homo sapien
gaaaaagttgagaccagacccgctg

SEQ ID NO: 461986 - DNA, 25 bp, Homo sapien
aaagttgagaccagacccgctgtcc

SEQ ID NO: 461987 - DNA, 25 bp, Homo sapien
cagacccgctgtccctaaagatggg

SEQ ID NO: 461988 - DNA, 25 bp, Homo sapien
ggtgcatgggtatgttgcagacccc

SEQ ID NO: 461989 - DNA, 25 bp, Homo sapien
gtggctgtggaagaatggcaaataa

SEQ ID NO: 461990 - DNA, 25 bp, Homo sapien
tttgttcccgttcctcaactgaaat

SEQ ID NO: 461991 - DNA, 25 bp, Homo sapien
gttcctcaactgaaatctttccaga

SEQ ID NO: 461992 - DNA, 25 bp, Homo sapien
ctttccagaaaatccaagtccggct

SEQ ID NO: 461993 - DNA, 25 bp, Homo sapien
atccaagtccggctagtacgcgaat

SEQ ID NO: 461994 - DNA, 25 bp, Homo sapien
gttcagtgggaagcatgtcgtcttt

SEQ ID NO: 461995 - DNA, 25 bp, Homo sapien
gtgggaagcatgtcgtctttatcgc

SEQ ID NO: 461996 - DNA, 25 bp, Homo sapien
atgtcgtctttatcgctcagaggag

SEQ ID NO: 461997 - DNA, 25 bp, Homo sapien
cgtactctgacagctgtgcacgatg

SEQ ID NO: 461998 - DNA, 25 bp, Homo sapien
tgtgcacgatgccatccttgaggac

SEQ ID NO: 461999 - DNA, 25 bp, Homo sapien
gggcaagagaatccgcgtcaaacta

SEQ ID NO: 462000 - DNA, 25 bp, Homo sapien
gcgtcaaactagatggcagccggct

SEQ ID NO: 462001 - DNA, 25 bp, Homo sapien
gacccctggacatttgcactgactt

SEQ ID NO: 462002 - DNA, 25 bp, Homo sapien
gacatttgcactgactttatccaga

SEQ ID NO: 462003 - DNA, 25 bp, Homo sapien
gactttatccagaccaaagagctgc

SEQ ID NO: 462004 - DNA, 25 bp, Homo sapien
caaagagctgcctcttggtggcagt

SEQ ID NO: 462005 - DNA, 25 bp, Homo sapien
ctcttggtggcagtattcccacaga

SEQ ID NO: 462006 - DNA, 25 bp, Homo sapien
gggtagctgggatcatgctagtcac

SEQ ID NO: 462007 - DNA, 25 bp, Homo sapien
tgggatcatgctagtcacttcctgc

SEQ ID NO: 462008 - DNA, 25 bp, Homo sapien
aggcaccgtgccaaagactggatgc

SEQ ID NO: 462009 - DNA, 25 bp, Homo sapien
ggagagtgtctctgttcttttgctc

SEQ ID NO: 462010 - DNA, 25 bp, Homo sapien
gggccctttgtgtttgaggatgctt

SEQ ID NO: 462011 - DNA, 25 bp, Homo sapien
ggatgcttaatgattccagcctctc

SEQ ID NO: 462012 - DNA, 25 bp, Homo sapien
tctggtatcccagagtcgctggaga

SEQ ID NO: 462013 - DNA, 25 bp, Homo sapien
agagtcgctggagatgagctcgcct

SEQ ID NO: 462014 - DNA, 25 bp, Homo sapien
ctggagatgagctcgcctgcaggca

SEQ ID NO: 462015 - DNA, 25 bp, Homo sapien
gatgagctcgcctgcaggcagctgc

SEQ ID NO: 462016 - DNA, 25 bp, Homo sapien
agctgctgtgagctggcctacctgc

SEQ ID NO: 462017 - DNA, 25 bp, Homo sapien
tgggctttgggcctcagcttatgca

SEQ ID NO: 462018 - DNA, 25 bp, Homo sapien
gcctcagcttatgcatctggtggga

SEQ ID NO: 462019 - DNA, 25 bp, Homo sapien
gagtatcctagggtgtgtatccatc

SEQ ID NO: 462020 - DNA, 25 bp, Homo sapien
gtgtatccatctggctgtctgtcca

SEQ ID NO: 462021 - DNA, 25 bp, Homo sapien
tgcccaagctacttcctgtacttaa

SEQ ID NO: 462022 - DNA, 25 bp, Homo sapien
agctacttcctgtacttaaaagtgt

SEQ ID NO: 462023 - DNA, 25 bp, Homo sapien
acaccccatatataaaacacaacag

SEQ ID NO: 462024 - DNA, 25 bp, Homo sapien
gatacacatttacataaatctcagt

SEQ ID NO: 462025 - DNA, 25 bp, Homo sapien
taaaccaataaacagacttgcaggg

SEQ ID NO: 462026 - DNA, 25 bp, Homo sapien
gaaaccagcaagtagggctaattat

SEQ ID NO: 462027 - DNA, 25 bp, Homo sapien
gtagggctaattatcagtaacaaat

SEQ ID NO: 462028 - DNA, 25 bp, Homo sapien
ttgtgtgaagtgaagtgttgctgct

SEQ ID NO: 462029 - DNA, 25 bp, Homo sapien
gtgttgctgctgtaagtagtgtcca

SEQ ID NO: 462030 - DNA, 25 bp, Homo sapien
tgctgctgtaagtagtgtccataag

SEQ ID NO: 462031 - DNA, 25 bp, Homo sapien
tgtccataagcccatttgactgtat

SEQ ID NO: 462032 - DNA, 25 bp, Homo sapien
cataagcccatttgactgtattaca

SEQ ID NO: 462033 - DNA, 25 bp, Homo sapien
agcccatttgactgtattacaagtt

SEQ ID NO: 462034 - DNA, 25 bp, Homo sapien
aaagtttaatgatggaggatgggcg

SEQ ID NO: 462035 - DNA, 25 bp, Homo sapien
aagtttaatgatggaggatgggcgt

SEQ ID NO: 462036 - DNA, 25 bp, Homo sapien
agtttaatgatggaggatgggcgta

SEQ ID NO: 462037 - DNA, 25 bp, Homo sapien
gtttaatgatggaggatgggcgtag

SEQ ID NO: 462038 - DNA, 25 bp, Homo sapien
tttaatgatggaggatgggcgtagt

SEQ ID NO: 462039 - DNA, 25 bp, Homo sapien
ttaatgatggaggatgggcgtagtg

SEQ ID NO: 462040 - DNA, 25 bp, Homo sapien
taatgatggaggatgggcgtagtgg

SEQ ID NO: 462041 - DNA, 25 bp, Homo sapien
aatgatggaggatgggcgtagtggc

SEQ ID NO: 462042 - DNA, 25 bp, Homo sapien
atgatggaggatgggcgtagtggct

SEQ ID NO: 462043 - DNA, 25 bp, Homo sapien
tgatggaggatgggcgtagtggctt

SEQ ID NO: 462044 - DNA, 25 bp, Homo sapien
gtataaagggcatctttgcttttga

SEQ ID NO: 462045 - DNA, 25 bp, Homo sapien
tataaagggcatctttgcttttgag

SEQ ID NO: 462046 - DNA, 25 bp, Homo sapien
ataaagggcatctttgcttttgagc

SEQ ID NO: 462047 - DNA, 25 bp, Homo sapien
ttttgagcaataaagatgaaggccg

SEQ ID NO: 462048 - DNA, 25 bp, Homo sapien
tttgagcaataaagatgaaggccgg

SEQ ID NO: 462049 - DNA, 25 bp, Homo sapien
ttgagcaataaagatgaaggccggg

SEQ ID NO: 462050 - DNA, 25 bp, Homo sapien
tgagcaataaagatgaaggccgggc

SEQ ID NO: 462051 - DNA, 25 bp, Homo sapien
gagcaataaagatgaaggccgggca

SEQ ID NO: 462052 - DNA, 25 bp, Homo sapien
agcaataaagatgaaggccgggcac

SEQ ID NO: 462053 - DNA, 25 bp, Homo sapien
gcaataaagatgaaggccgggcaca

SEQ ID NO: 462054 - DNA, 25 bp, Homo sapien
caataaagatgaaggccgggcacag

SEQ ID NO: 462055 - DNA, 25 bp, Homo sapien
tggtggtggtaagccgccaacgcac

SEQ ID NO: 462056 - DNA, 25 bp, Homo sapien
gggctgcaaccccaccggacgggtg

SEQ ID NO: 462057 - DNA, 25 bp, Homo sapien
ggctgtgagtcctcagaggccctgg

SEQ ID NO: 462058 - DNA, 25 bp, Homo sapien
acatttctggcagcgtttcccagac

SEQ ID NO: 462059 - DNA, 25 bp, Homo sapien
taggccatccctggatagcaagtga

SEQ ID NO: 462060 - DNA, 25 bp, Homo sapien
gccatccctggatagcaagtgaatt

SEQ ID NO: 462061 - DNA, 25 bp, Homo sapien
ccatccctggatagcaagtgaatta

SEQ ID NO: 462062 - DNA, 25 bp, Homo sapien
agcaagtgaattaacttaagggcac

SEQ ID NO: 462063 - DNA, 25 bp, Homo sapien
gaattaacttaagggcactgtgatg

SEQ ID NO: 462064 - DNA, 25 bp, Homo sapien
ttaagggcactgtgatgggaagcct

SEQ ID NO: 462065 - DNA, 25 bp, Homo sapien
tgatgggaagccttgcccccctctt

SEQ ID NO: 462066 - DNA, 25 bp, Homo sapien
tgttctcctttttcatagtttccag

SEQ ID NO: 462067 - DNA, 25 bp, Homo sapien
ctcctttttcatagtttccagtggg

SEQ ID NO: 462068 - DNA, 25 bp, Homo sapien
catagtttccagtgggagcatctcc

SEQ ID NO: 462069 - DNA, 25 bp, Homo sapien
acaaacttctcacttgtatctctcc

SEQ ID NO: 462070 - DNA, 25 bp, Homo sapien
ggtacagtagccatgccataaaaca

SEQ ID NO: 462071 - DNA, 25 bp, Homo sapien
tgatcagttactcaggctagaaact

SEQ ID NO: 462072 - DNA, 25 bp, Homo sapien
gttactcaggctagaaacttcaaag

SEQ ID NO: 462073 - DNA, 25 bp, Homo sapien
caggttcaagaagagagtactacaa

SEQ ID NO: 462074 - DNA, 25 bp, Homo sapien
gaaaagtcagtcttttacctgagca

SEQ ID NO: 462075 - DNA, 25 bp, Homo sapien
cagtcttttacctgagcagtattat

SEQ ID NO: 462076 - DNA, 25 bp, Homo sapien
gcagtattatatagtacaatgcttg

SEQ ID NO: 462077 - DNA, 25 bp, Homo sapien
aaaaacgtatcatgcaccaactgtg

SEQ ID NO: 462078 - DNA, 25 bp, Homo sapien
caccaactgtgaatagctgccgctt

SEQ ID NO: 462079 - DNA, 25 bp, Homo sapien
aactgtgaatagctgccgcttgcgc

SEQ ID NO: 462080 - DNA, 25 bp, Homo sapien
aatagctgccgcttgcgcagaggac

SEQ ID NO: 462081 - DNA, 25 bp, Homo sapien
gagaggctccccatgcaacactgga

SEQ ID NO: 462082 - DNA, 25 bp, Homo sapien
aggctccccatgcaacactggaaat

SEQ ID NO: 462083 - DNA, 25 bp, Homo sapien
aaatgactgttccagagagcgggca

SEQ ID NO: 462084 - DNA, 25 bp, Homo sapien
ctgttccagagagcgggcagacctg

SEQ ID NO: 462085 - DNA, 25 bp, Homo sapien
gttcctgccagaaacgaccctctgt

SEQ ID NO: 462086 - DNA, 25 bp, Homo sapien
gaaacgaccctctgtggccgatggg

SEQ ID NO: 462087 - DNA, 25 bp, Homo sapien
agccaactcagccagtgttgggact

SEQ ID NO: 462088 - DNA, 25 bp, Homo sapien
ctgactggtgacgtgttcagaggaa

SEQ ID NO: 462089 - DNA, 25 bp, Homo sapien
gactggtgacgtgttcagaggaatc

SEQ ID NO: 462090 - DNA, 25 bp, Homo sapien
actggtgacgtgttcagaggaatcc

SEQ ID NO: 462091 - DNA, 25 bp, Homo sapien
tggtgacgtgttcagaggaatcccc

SEQ ID NO: 462092 - DNA, 25 bp, Homo sapien
tgacgtgttcagaggaatcccccta

SEQ ID NO: 462093 - DNA, 25 bp, Homo sapien
tgttcagaggaatccccctaaaatc

SEQ ID NO: 462094 - DNA, 25 bp, Homo sapien
gaggaatccccctaaaatcagatgt

SEQ ID NO: 462095 - DNA, 25 bp, Homo sapien
cctaaaatcagatgtggctgggcct

SEQ ID NO: 462096 - DNA, 25 bp, Homo sapien
taaaatcagatgtggctgggcctgg

SEQ ID NO: 462097 - DNA, 25 bp, Homo sapien
aaaatcagatgtggctgggcctggt

SEQ ID NO: 462098 - DNA, 25 bp, Homo sapien
ttgccaaagtccaggaggcaaaagt

SEQ ID NO: 462099 - DNA, 25 bp, Homo sapien
gctgcagttgcagagcatcgaagaa

SEQ ID NO: 462100 - DNA, 25 bp, Homo sapien
ggagatgttttagctgccgagcaga

SEQ ID NO: 462101 - DNA, 25 bp, Homo sapien
gggaggagttcccatcaccgcctgt

SEQ ID NO: 462102 - DNA, 25 bp, Homo sapien
ggccttgggagcatgtcactgtgta

SEQ ID NO: 462103 - DNA, 25 bp, Homo sapien
atgtcactgtgtacagctggccaca

SEQ ID NO: 462104 - DNA, 25 bp, Homo sapien
gagcagcatctggtatgcagccacc

SEQ ID NO: 462105 - DNA, 25 bp, Homo sapien
taatgtctacagtccacagcttcag

SEQ ID NO: 462106 - DNA, 25 bp, Homo sapien
tctacagtccacagcttcagcattt

SEQ ID NO: 462107 - DNA, 25 bp, Homo sapien
gcatttccagagaccacatgtgagc

SEQ ID NO: 462108 - DNA, 25 bp, Homo sapien
acatgtgagcttcttttaggtccca

SEQ ID NO: 462109 - DNA, 25 bp, Homo sapien
gcttcttttaggtcccagtgatggg

SEQ ID NO: 462110 - DNA, 25 bp, Homo sapien
aaacttgactgcagggaacattctt

SEQ ID NO: 462111 - DNA, 25 bp, Homo sapien
gaacattcttgtacctgtgttttgt

SEQ ID NO: 462112 - DNA, 25 bp, Homo sapien
gaatcaactcctagacatggaattg

SEQ ID NO: 462113 - DNA, 25 bp, Homo sapien
tggaattgctgggtcgaaggctatt

SEQ ID NO: 462114 - DNA, 25 bp, Homo sapien
ctgggtcgaaggctattgaatgtaa

SEQ ID NO: 462115 - DNA, 25 bp, Homo sapien
aaaatttccatagatactgccaagt

SEQ ID NO: 462116 - DNA, 25 bp, Homo sapien
tactgccaagttgtccttggaggct

SEQ ID NO: 462117 - DNA, 25 bp, Homo sapien
atcactcagagcgtttcccagggct

SEQ ID NO: 462118 - DNA, 25 bp, Homo sapien
gtttccctgtgcctcttgtttggcc

SEQ ID NO: 462119 - DNA, 25 bp, Homo sapien
ctcttgtttggcctgcacatttaaa

SEQ ID NO: 462120 - DNA, 25 bp, Homo sapien
gtttggcctgcacatttaaattttt

SEQ ID NO: 462121 - DNA, 25 bp, Homo sapien
cttccttatttatgccttatgaata

SEQ ID NO: 462122 - DNA, 25 bp, Homo sapien
aggtgaaattttatgtgcaagatcc

SEQ ID NO: 462123 - DNA, 25 bp, Homo sapien
gatcctgaaggaatgggtattcttg

SEQ ID NO: 462124 - DNA, 25 bp, Homo sapien
tattcttgaaggcagggactgtctt

SEQ ID NO: 462125 - DNA, 25 bp, Homo sapien
gtcttttctatgtttgttctgtaca

SEQ ID NO: 462126 - DNA, 25 bp, Homo sapien
ttgttctgtacagctctcagcacac

SEQ ID NO: 462127 - DNA, 25 bp, Homo sapien
ctcagcacactcttggtgcttgata

SEQ ID NO: 462128 - DNA, 25 bp, Homo sapien
agcacatttttagatcttttttcaa

SEQ ID NO: 462129 - DNA, 25 bp, Homo sapien
acaatggttggtttgaagctatcat

SEQ ID NO: 462130 - DNA, 25 bp, Homo sapien
agctatcatgtaaaattggcctctc

SEQ ID NO: 462131 - DNA, 25 bp, Homo sapien
aaaattggcctctccaaatataatc

SEQ ID NO: 462132 - DNA, 25 bp, Homo sapien
gttcatctattaaatcttgatcagg

SEQ ID NO: 462133 - DNA, 25 bp, Homo sapien
gatcagggtttcaagaatgactgca

SEQ ID NO: 462134 - DNA, 25 bp, Homo sapien
actgcagtgggttttggaaacagac

SEQ ID NO: 462135 - DNA, 25 bp, Homo sapien
tggaaacagacttatcattattgat

SEQ ID NO: 462136 - DNA, 25 bp, Homo sapien
atcattattgatttgaggtttccca

SEQ ID NO: 462137 - DNA, 25 bp, Homo sapien
gaggtttcccagagatatagttcac

SEQ ID NO: 462138 - DNA, 25 bp, Homo sapien
tttcccagagatatagttcacagtt

SEQ ID NO: 462139 - DNA, 25 bp, Homo sapien
gttcacagttaattgttgcgctcta

SEQ ID NO: 462140 - DNA, 25 bp, Homo sapien
tgcgctctaatacaactgaccattt

SEQ ID NO: 462141 - DNA, 25 bp, Homo sapien
gtcagttgttaaaccttgacatttc

SEQ ID NO: 462142 - DNA, 25 bp, Homo sapien
gtagttataactcaatgcaaattca

SEQ ID NO: 462143 - DNA, 25 bp, Homo sapien
aaaaattatagacccgtgctcactt

SEQ ID NO: 462144 - DNA, 25 bp, Homo sapien
aattatagacccgtgctcacttcag

SEQ ID NO: 462145 - DNA, 25 bp, Homo sapien
attatagacccgtgctcacttcagc

SEQ ID NO: 462146 - DNA, 25 bp, Homo sapien
ttatagacccgtgctcacttcagca

SEQ ID NO: 462147 - DNA, 25 bp, Homo sapien
acactaaaattggaaccttatagag

SEQ ID NO: 462148 - DNA, 25 bp, Homo sapien
aattggaaccttatagagaagatta

SEQ ID NO: 462149 - DNA, 25 bp, Homo sapien
gacccctgtgcgaggatgacacaca

SEQ ID NO: 462150 - DNA, 25 bp, Homo sapien
tatttttctgaaattgaggcagtaa

SEQ ID NO: 462151 - DNA, 25 bp, Homo sapien
ggcagtaattaatagcctaccaacc

SEQ ID NO: 462152 - DNA, 25 bp, Homo sapien
cagtaattaatagcctaccaaccaa

SEQ ID NO: 462153 - DNA, 25 bp, Homo sapien
gccacaggtacaaagaggagctggt

SEQ ID NO: 462154 - DNA, 25 bp, Homo sapien
ggttggaaagaaatgatctgaccta

SEQ ID NO: 462155 - DNA, 25 bp, Homo sapien
acctaccgtgtttgactgtcgtaag

SEQ ID NO: 462156 - DNA, 25 bp, Homo sapien
ctgtcgtaagatacccattccagag

SEQ ID NO: 462157 - DNA, 25 bp, Homo sapien
tgtcgtaagatacccattccagaga

SEQ ID NO: 462158 - DNA, 25 bp, Homo sapien
gtcgtaagatacccattccagagag

SEQ ID NO: 462159 - DNA, 25 bp, Homo sapien
caccccgtgcccagaaggaaggaat

SEQ ID NO: 462160 - DNA, 25 bp, Homo sapien
agaaggaaggaatcctgcacagaga

SEQ ID NO: 462161 - DNA, 25 bp, Homo sapien
atcatatttctacacagtccataat

SEQ ID NO: 462162 - DNA, 25 bp, Homo sapien
agtccataatctgttgaacctaaac

SEQ ID NO: 462163 - DNA, 25 bp, Homo sapien
ttggggtcttcattctgagggctca

SEQ ID NO: 462164 - DNA, 25 bp, Homo sapien
tctgagggctcacatacaattatga

SEQ ID NO: 462165 - DNA, 25 bp, Homo sapien
gagttcaaacccaactgagaaaaca

SEQ ID NO: 462166 - DNA, 25 bp, Homo sapien
agttcaaacccaactgagaaaacat

SEQ ID NO: 462167 - DNA, 25 bp, Homo sapien
gttcaaacccaactgagaaaacatc

SEQ ID NO: 462168 - DNA, 25 bp, Homo sapien
ttcaaacccaactgagaaaacatca

SEQ ID NO: 462169 - DNA, 25 bp, Homo sapien
caaacccaactgagaaaacatcagg

SEQ ID NO: 462170 - DNA, 25 bp, Homo sapien
acccaactgagaaaacatcagggct

SEQ ID NO: 462171 - DNA, 25 bp, Homo sapien
cccaactgagaaaacatcagggctt

SEQ ID NO: 462172 - DNA, 25 bp, Homo sapien
ccaactgagaaaacatcagggctta

SEQ ID NO: 462173 - DNA, 25 bp, Homo sapien
caactgagaaaacatcagggcttaa

SEQ ID NO: 462174 - DNA, 25 bp, Homo sapien
aactgagaaaacatcagggcttaaa

SEQ ID NO: 462175 - DNA, 25 bp, Homo sapien
ctgagaaaacatcagggcttaaaaa

SEQ ID NO: 462176 - DNA, 25 bp, Homo sapien
cctcctggaagagatcctgtaactt

SEQ ID NO: 462177 - DNA, 25 bp, Homo sapien
aacttttcagcatcaacaccagcga

SEQ ID NO: 462178 - DNA, 25 bp, Homo sapien
atcaacaccagcgactcctagagaa

SEQ ID NO: 462179 - DNA, 25 bp, Homo sapien
accagcgactcctagagaacaaaat

SEQ ID NO: 462180 - DNA, 25 bp, Homo sapien
aagagaatgtgagggctttgaccaa

SEQ ID NO: 462181 - DNA, 25 bp, Homo sapien
ggctttgaccaaaggagtccaggct

SEQ ID NO: 462182 - DNA, 25 bp, Homo sapien
gagtccaggctgtgatgggttacaa

SEQ ID NO: 462183 - DNA, 25 bp, Homo sapien
acaagcccgggagtggtgtagtgac

SEQ ID NO: 462184 - DNA, 25 bp, Homo sapien
gtgtagtgactgcatccactgcgag

SEQ ID NO: 462185 - DNA, 25 bp, Homo sapien
atccactgcgagctctgagaacggg

SEQ ID NO: 462186 - DNA, 25 bp, Homo sapien
gaagccctggaaaaaacatggcaac

SEQ ID NO: 462187 - DNA, 25 bp, Homo sapien
gaacttttctgtgatgttttagggt

SEQ ID NO: 462188 - DNA, 25 bp, Homo sapien
tagggttccttataacctggtggct

SEQ ID NO: 462189 - DNA, 25 bp, Homo sapien
gggttccttataacctggtggctat

SEQ ID NO: 462190 - DNA, 25 bp, Homo sapien
gttccttataacctggtggctatta

SEQ ID NO: 462191 - DNA, 25 bp, Homo sapien
cccctcataatccagttctttgtag

SEQ ID NO: 462192 - DNA, 25 bp, Homo sapien
tattttgaactttgtaattggagtc

SEQ ID NO: 462193 - DNA, 25 bp, Homo sapien
ccccaaattatgagctattaataag

SEQ ID NO: 462194 - DNA, 25 bp, Homo sapien
gctattaataaggagctttctgaat

SEQ ID NO: 462195 - DNA, 25 bp, Homo sapien
gagctttctgaatcctaattactgt

SEQ ID NO: 462196 - DNA, 25 bp, Homo sapien
gaatcctaattactgtctcaaaaac

SEQ ID NO: 462197 - DNA, 25 bp, Homo sapien
gagtggacacttgagaagtttttca

SEQ ID NO: 462198 - DNA, 25 bp, Homo sapien
gggatatctaacagcaatacctgat

SEQ ID NO: 462199 - DNA, 25 bp, Homo sapien
gatatctaacagcaatacctgatca

SEQ ID NO: 462200 - DNA, 25 bp, Homo sapien
agcaatacctgatcactacttcgca

SEQ ID NO: 462201 - DNA, 25 bp, Homo sapien
gcaatacctgatcactacttcgcac

SEQ ID NO: 462202 - DNA, 25 bp, Homo sapien
aatacctgatcactacttcgcacta

SEQ ID NO: 462203 - DNA, 25 bp, Homo sapien
atacctgatcactacttcgcactag

SEQ ID NO: 462204 - DNA, 25 bp, Homo sapien
tacctgatcactacttcgcactagt

SEQ ID NO: 462205 - DNA, 25 bp, Homo sapien
acctgatcactacttcgcactagtt

SEQ ID NO: 462206 - DNA, 25 bp, Homo sapien
cctgatcactacttcgcactagttt

SEQ ID NO: 462207 - DNA, 25 bp, Homo sapien
tgatcactacttcgcactagtttct

SEQ ID NO: 462208 - DNA, 25 bp, Homo sapien
atcactacttcgcactagtttctcg

SEQ ID NO: 462209 - DNA, 25 bp, Homo sapien
aagcctataggaattgagttcaccc

SEQ ID NO: 462210 - DNA, 25 bp, Homo sapien
ataggaattgagttcaccctgaatt

SEQ ID NO: 462211 - DNA, 25 bp, Homo sapien
aggaattgagttcaccctgaattct

SEQ ID NO: 462212 - DNA, 25 bp, Homo sapien
tggaactggccccttgctgcatctg

SEQ ID NO: 462213 - DNA, 25 bp, Homo sapien
gaattcagactcaaactgatggtga

SEQ ID NO: 462214 - DNA, 25 bp, Homo sapien
cagactcaaactgatggtgaatgga

SEQ ID NO: 462215 - DNA, 25 bp, Homo sapien
aaaaatgaggagtcgagcctaatgg

SEQ ID NO: 462216 - DNA, 25 bp, Homo sapien
gggcccttcccaggtatgcaaaagg

SEQ ID NO: 462217 - DNA, 25 bp, Homo sapien
aggtatgcaaaaggcacacctacac

SEQ ID NO: 462218 - DNA, 25 bp, Homo sapien
cacctacacctttgaaccaattgga

SEQ ID NO: 462219 - DNA, 25 bp, Homo sapien
agccattcatcccaagcctatagga

SEQ ID NO: 462220 - DNA, 25 bp, Homo sapien
tcgtctcctgtgagaattccccgtc

SEQ ID NO: 462221 - DNA, 25 bp, Homo sapien
gtctcctgtgagaattccccgtcgg

SEQ ID NO: 462222 - DNA, 25 bp, Homo sapien
tctcctgtgagaattccccgtcgga

SEQ ID NO: 462223 - DNA, 25 bp, Homo sapien
ctcctgtgagaattccccgtcggat

SEQ ID NO: 462224 - DNA, 25 bp, Homo sapien
tcctgtgagaattccccgtcggata

SEQ ID NO: 462225 - DNA, 25 bp, Homo sapien
cctgtgagaattccccgtcggatac

SEQ ID NO: 462226 - DNA, 25 bp, Homo sapien
ctgtgagaattccccgtcggatacg

SEQ ID NO: 462227 - DNA, 25 bp, Homo sapien
tgtgagaattccccgtcggatacga

SEQ ID NO: 462228 - DNA, 25 bp, Homo sapien
ctcgcacaggacttccttcccgact

SEQ ID NO: 462229 - DNA, 25 bp, Homo sapien
gcacaggacttccttcccgactcca

SEQ ID NO: 462230 - DNA, 25 bp, Homo sapien
caggacttccttcccgactccatca

SEQ ID NO: 462231 - DNA, 25 bp, Homo sapien
ttcctaaagcaatctgaattttttc

SEQ ID NO: 462232 - DNA, 25 bp, Homo sapien
cctaaagcaatctgaattttttcca

SEQ ID NO: 462233 - DNA, 25 bp, Homo sapien
aagcaatctgaattttttccaaggc

SEQ ID NO: 462234 - DNA, 25 bp, Homo sapien
agcaatctgaattttttccaaggca

SEQ ID NO: 462235 - DNA, 25 bp, Homo sapien
gcaatctgaattttttccaaggcag

SEQ ID NO: 462236 - DNA, 25 bp, Homo sapien
atctgaattttttccaaggcagtag

SEQ ID NO: 462237 - DNA, 25 bp, Homo sapien
tctgaattttttccaaggcagtaga

SEQ ID NO: 462238 - DNA, 25 bp, Homo sapien
ctgaattttttccaaggcagtagaa

SEQ ID NO: 462239 - DNA, 25 bp, Homo sapien
tgaattttttccaaggcagtagaaa

SEQ ID NO: 462240 - DNA, 25 bp, Homo sapien
gaattttttccaaggcagtagaaag

SEQ ID NO: 462241 - DNA, 25 bp, Homo sapien
gcagtagaaagaccttcttaaaaag

SEQ ID NO: 462242 - DNA, 25 bp, Homo sapien
aataaatgtttgtggccaggcatgg

SEQ ID NO: 462243 - DNA, 25 bp, Homo sapien
ataaatgtttgtggccaggcatggt

SEQ ID NO: 462244 - DNA, 25 bp, Homo sapien
taaatgtttgtggccaggcatggtg

SEQ ID NO: 462245 - DNA, 25 bp, Homo sapien
aaatgtttgtggccaggcatggtgg

SEQ ID NO: 462246 - DNA, 25 bp, Homo sapien
ggctgagacaggcagatcacttgaa

SEQ ID NO: 462247 - DNA, 25 bp, Homo sapien
gctgagacaggcagatcacttgaag

SEQ ID NO: 462248 - DNA, 25 bp, Homo sapien
ctgagacaggcagatcacttgaagt

SEQ ID NO: 462249 - DNA, 25 bp, Homo sapien
ataataatgcagaaaaatctgggca

SEQ ID NO: 462250 - DNA, 25 bp, Homo sapien
taataatgcagaaaaatctgggcat

SEQ ID NO: 462251 - DNA, 25 bp, Homo sapien
ataatgcagaaaaatctgggcatgg

SEQ ID NO: 462252 - DNA, 25 bp, Homo sapien
taatgcagaaaaatctgggcatggt

SEQ ID NO: 462253 - DNA, 25 bp, Homo sapien
gcactacccagacatcttcgaggag

SEQ ID NO: 462254 - DNA, 25 bp, Homo sapien
acatcttcgaggagtgcggctgagc

SEQ ID NO: 462255 - DNA, 25 bp, Homo sapien
gagcggcaccgcaggctggagttga

SEQ ID NO: 462256 - DNA, 25 bp, Homo sapien
ctggagttgagcctgaccttggcac

SEQ ID NO: 462257 - DNA, 25 bp, Homo sapien
ttgagcctgaccttggcacgaagga

SEQ ID NO: 462258 - DNA, 25 bp, Homo sapien
tggcacgaaggactgacggatccct

SEQ ID NO: 462259 - DNA, 25 bp, Homo sapien
acggatccctgaggtgggccactga

SEQ ID NO: 462260 - DNA, 25 bp, Homo sapien
gggactccggaactgaaattcatgc

SEQ ID NO: 462261 - DNA, 25 bp, Homo sapien
gaactgaaattcatgccctgggctt

SEQ ID NO: 462262 - DNA, 25 bp, Homo sapien
tcaaggatccctcaagtttccaact

SEQ ID NO: 462263 - DNA, 25 bp, Homo sapien
ggatccctcaagtttccaacttgta

SEQ ID NO: 462264 - DNA, 25 bp, Homo sapien
gggctgcaaccccaccggacgggtg

SEQ ID NO: 462265 - DNA, 25 bp, Homo sapien
gctgcaaccccaccggacgggtggt

SEQ ID NO: 462266 - DNA, 25 bp, Homo sapien
aggagggggctgtgagtcctcagag

SEQ ID NO: 462267 - DNA, 25 bp, Homo sapien
taggccatccctggatagcaagtga

SEQ ID NO: 462268 - DNA, 25 bp, Homo sapien
aggccatccctggatagcaagtgaa

SEQ ID NO: 462269 - DNA, 25 bp, Homo sapien
ggccatccctggatagcaagtgaat

SEQ ID NO: 462270 - DNA, 25 bp, Homo sapien
gccatccctggatagcaagtgaatt

SEQ ID NO: 462271 - DNA, 25 bp, Homo sapien
ccatccctggatagcaagtgaatta

SEQ ID NO: 462272 - DNA, 25 bp, Homo sapien
agcaagtgaattaacttaagggcac

SEQ ID NO: 462273 - DNA, 25 bp, Homo sapien
caagtgaattaacttaagggcactg

SEQ ID NO: 462274 - DNA, 25 bp, Homo sapien
tgatgggaagccttgcccccctctt

SEQ ID NO: 462275 - DNA, 25 bp, Homo sapien
tagggtacaaaatctaaggaagctg

SEQ ID NO: 462276 - DNA, 25 bp, Homo sapien
aaggaagctgtcattctgaggatca

SEQ ID NO: 462277 - DNA, 25 bp, Homo sapien
aggaagctgtcattctgaggatcat

SEQ ID NO: 462278 - DNA, 25 bp, Homo sapien
ggaagctgtcattctgaggatcata

SEQ ID NO: 462279 - DNA, 25 bp, Homo sapien
gatcatatgatagatgctgggttaa

SEQ ID NO: 462280 - DNA, 25 bp, Homo sapien
atatgatagatgctgggttaagaca

SEQ ID NO: 462281 - DNA, 25 bp, Homo sapien
tagatgctgggttaagacatatggc

SEQ ID NO: 462282 - DNA, 25 bp, Homo sapien
gatgctgggttaagacatatggctg

SEQ ID NO: 462283 - DNA, 25 bp, Homo sapien
atgctgggttaagacatatggctgg

SEQ ID NO: 462284 - DNA, 25 bp, Homo sapien
ggtggcatggacctctaatcccagt

SEQ ID NO: 462285 - DNA, 25 bp, Homo sapien
gtggcatggacctctaatcccagtt

SEQ ID NO: 462286 - DNA, 25 bp, Homo sapien
gataccagccagtaaggagcttctc

SEQ ID NO: 462287 - DNA, 25 bp, Homo sapien
ggagcttctcaattcctttgatttg

SEQ ID NO: 462288 - DNA, 25 bp, Homo sapien
aattcctttgatttgtcaattcctg

SEQ ID NO: 462289 - DNA, 25 bp, Homo sapien
tccaacctgtgaaagaaacgtgaat

SEQ ID NO: 462290 - DNA, 25 bp, Homo sapien
gaaacgtgaatgtaaaagagaccta

SEQ ID NO: 462291 - DNA, 25 bp, Homo sapien
atatttattctctagttgatcagct

SEQ ID NO: 462292 - DNA, 25 bp, Homo sapien
acataggcatgtttgtactaatgaa

SEQ ID NO: 462293 - DNA, 25 bp, Homo sapien
aatgaaacgtactgtcaacctctat

SEQ ID NO: 462294 - DNA, 25 bp, Homo sapien
gtactgtcaacctctatcacattgt

SEQ ID NO: 462295 - DNA, 25 bp, Homo sapien
tgtcaacctctatcacattgttaaa

SEQ ID NO: 462296 - DNA, 25 bp, Homo sapien
ttaacacttttggtggtaactcaat

SEQ ID NO: 462297 - DNA, 25 bp, Homo sapien
ttaagtgtcaaagtcagcatgcagc

SEQ ID NO: 462298 - DNA, 25 bp, Homo sapien
gtcagcatgcagcacatgtagcttt

SEQ ID NO: 462299 - DNA, 25 bp, Homo sapien
gcagcacatgtagcttttctgtaaa

SEQ ID NO: 462300 - DNA, 25 bp, Homo sapien
gtagcttttctgtaaacaagggtgt

SEQ ID NO: 462301 - DNA, 25 bp, Homo sapien
acaagggtgtgatatgaaagctgct

SEQ ID NO: 462302 - DNA, 25 bp, Homo sapien
aaaagcacattccatatacgtaagt

SEQ ID NO: 462303 - DNA, 25 bp, Homo sapien
gttagtttgctcatctatgatctga

SEQ ID NO: 462304 - DNA, 25 bp, Homo sapien
tgatctgagatcatgccgaagtgag

SEQ ID NO: 462305 - DNA, 25 bp, Homo sapien
aatctccccaaaatacaatttaatg

SEQ ID NO: 462306 - DNA, 25 bp, Homo sapien
aactttaacagtaattccagccaca

SEQ ID NO: 462307 - DNA, 25 bp, Homo sapien
taacagtaattccagccacaatctt

SEQ ID NO: 462308 - DNA, 25 bp, Homo sapien
agagtgaaagagcatctaacctgat

SEQ ID NO: 462309 - DNA, 25 bp, Homo sapien
atctaacctgatgctcttggagaga

SEQ ID NO: 462310 - DNA, 25 bp, Homo sapien
tgatgctcttggagagagataacct

SEQ ID NO: 462311 - DNA, 25 bp, Homo sapien
gagataacctgtctgtcataactta

SEQ ID NO: 462312 - DNA, 25 bp, Homo sapien
aacctgtctgtcataacttaaagga

SEQ ID NO: 462313 - DNA, 25 bp, Homo sapien
gtgtagctattaaagattcatgcag

SEQ ID NO: 462314 - DNA, 25 bp, Homo sapien
gattcatgcagtcccaaaaggcact

SEQ ID NO: 462315 - DNA, 25 bp, Homo sapien
ccaaaaggcactgtcctgggatgat

SEQ ID NO: 462316 - DNA, 25 bp, Homo sapien
actgtcctgggatgatgagagatta

SEQ ID NO: 462317 - DNA, 25 bp, Homo sapien
cataaaaggaatccaaccctgtgcc

SEQ ID NO: 462318 - DNA, 25 bp, Homo sapien
ggccattgatgtgttgtcattgaat

SEQ ID NO: 462319 - DNA, 25 bp, Homo sapien
ctaggctgtgggtgctaggagccaa

SEQ ID NO: 462320 - DNA, 25 bp, Homo sapien
taggctgtgggtgctaggagccaag

SEQ ID NO: 462321 - DNA, 25 bp, Homo sapien
aggctgtgggtgctaggagccaagt

SEQ ID NO: 462322 - DNA, 25 bp, Homo sapien
gctgtgggtgctaggagccaagtgc

SEQ ID NO: 462323 - DNA, 25 bp, Homo sapien
ctgtgggtgctaggagccaagtgct

SEQ ID NO: 462324 - DNA, 25 bp, Homo sapien
tgtgggtgctaggagccaagtgcta

SEQ ID NO: 462325 - DNA, 25 bp, Homo sapien
gtgggtgctaggagccaagtgctag

SEQ ID NO: 462326 - DNA, 25 bp, Homo sapien
tgctaggagccaagtgctagggact

SEQ ID NO: 462327 - DNA, 25 bp, Homo sapien
gctaggagccaagtgctagggactc

SEQ ID NO: 462328 - DNA, 25 bp, Homo sapien
ctaggagccaagtgctagggactcg

SEQ ID NO: 462329 - DNA, 25 bp, Homo sapien
cttacgaatgtaattccttaggaag

SEQ ID NO: 462330 - DNA, 25 bp, Homo sapien
cctattcttggaaaatacacaataa

SEQ ID NO: 462331 - DNA, 25 bp, Homo sapien
gggccataatgtatgcaatctactc

SEQ ID NO: 462332 - DNA, 25 bp, Homo sapien
taatgtatgcaatctactctcaaaa

SEQ ID NO: 462333 - DNA, 25 bp, Homo sapien
gtatgcaatctactctcaaaaaatt

SEQ ID NO: 462334 - DNA, 25 bp, Homo sapien
gtgcatttgcatgtgcaacagtaca

SEQ ID NO: 462335 - DNA, 25 bp, Homo sapien
ttgcatgtgcaacagtacacacaaa

SEQ ID NO: 462336 - DNA, 25 bp, Homo sapien
aacagtacacacaaacatacataaa

SEQ ID NO: 462337 - DNA, 25 bp, Homo sapien
acatacataaagagagcaattgata

SEQ ID NO: 462338 - DNA, 25 bp, Homo sapien
ttgataaggcaaataaggtaacatt

SEQ ID NO: 462339 - DNA, 25 bp, Homo sapien
ggtaacatttaacaataatctgata

SEQ ID NO: 462340 - DNA, 25 bp, Homo sapien
ttaacaataatctgagcaaaaggta

SEQ ID NO: 462341 - DNA, 25 bp, Homo sapien
tgccacatttgttttcaacgtcttt

SEQ ID NO: 462342 - DNA, 25 bp, Homo sapien
acaaggacgggcgaattgagttctc

SEQ ID NO: 462343 - DNA, 25 bp, Homo sapien
attgagttctccgagttcatccagg

SEQ ID NO: 462344 - DNA, 25 bp, Homo sapien
ggaaccctggatgagaagctacggt

SEQ ID NO: 462345 - DNA, 25 bp, Homo sapien
gagaagctacggtgggccttcaagc

SEQ ID NO: 462346 - DNA, 25 bp, Homo sapien
gggccttcaagctctacgacttgga

SEQ ID NO: 462347 - DNA, 25 bp, Homo sapien
aagctctacgacttggacaatgatg

SEQ ID NO: 462348 - DNA, 25 bp, Homo sapien
atgctggacattgtggatgccattt

SEQ ID NO: 462349 - DNA, 25 bp, Homo sapien
gtggatgccatttaccagatggtgg

SEQ ID NO: 462350 - DNA, 25 bp, Homo sapien
agggtggaccggatctttgccatga

SEQ ID NO: 462351 - DNA, 25 bp, Homo sapien
tggaccggatctttgccatgatgga

SEQ ID NO: 462352 - DNA, 25 bp, Homo sapien
ctagtttctcggtactatgcatatg

SEQ ID NO: 462353 - DNA, 25 bp, Homo sapien
gtttctcggtactatgcatatggtc

SEQ ID NO: 462354 - DNA, 25 bp, Homo sapien
ttctcggtactatgcatatggtcca

SEQ ID NO: 462355 - DNA, 25 bp, Homo sapien
ctcggtactatgcatatggtccaat

SEQ ID NO: 462356 - DNA, 25 bp, Homo sapien
tcggtactatgcatatggtccaata

SEQ ID NO: 462357 - DNA, 25 bp, Homo sapien
ggtactatgcatatggtccaatatc

SEQ ID NO: 462358 - DNA, 25 bp, Homo sapien
actatgcatatggtccaatatcaaa

SEQ ID NO: 462359 - DNA, 25 bp, Homo sapien
gcatatggtccaatatcaaagggaa

SEQ ID NO: 462360 - DNA, 25 bp, Homo sapien
atatggtccaatatcaaagggaatg

SEQ ID NO: 462361 - DNA, 25 bp, Homo sapien
agcaatacctgatcactacttcgca

SEQ ID NO: 462362 - DNA, 25 bp, Homo sapien
tgatcactacttcgcactagtttct

SEQ ID NO: 462363 - DNA, 25 bp, Homo sapien
gaatgcaaggttggcttaacatcag

SEQ ID NO: 462364 - DNA, 25 bp, Homo sapien
atcaatcaatataatctactctatg

SEQ ID NO: 462365 - DNA, 25 bp, Homo sapien
aaatcaacactctttcatcactaaa

SEQ ID NO: 462366 - DNA, 25 bp, Homo sapien
atcaacactctttcatcactaaatc

SEQ ID NO: 462367 - DNA, 25 bp, Homo sapien
ggaatagaagtcttcctcatccaat

SEQ ID NO: 462368 - DNA, 25 bp, Homo sapien
ttcctcatccaattaaggttataaa

SEQ ID NO: 462369 - DNA, 25 bp, Homo sapien
aaatctacagctaacatcaaactca

SEQ ID NO: 462370 - DNA, 25 bp, Homo sapien
gctaacatcaaactcaatggtgaag

SEQ ID NO: 462371 - DNA, 25 bp, Homo sapien
aaatcacaaacaaagcaaagcaggc

SEQ ID NO: 462372 - DNA, 25 bp, Homo sapien
aaagcaggcatatccactctcacta

SEQ ID NO: 462373 - DNA, 25 bp, Homo sapien
aggcatatccactctcactatttgc

SEQ ID NO: 462374 - DNA, 25 bp, Homo sapien
gatgattaccaaagcatcagggttg

SEQ ID NO: 462375 - DNA, 25 bp, Homo sapien
gcatcagggttggaacaattcatct

SEQ ID NO: 462376 - DNA, 25 bp, Homo sapien
ggaacaattcatctttaggtaggat

SEQ ID NO: 462377 - DNA, 25 bp, Homo sapien
tcatctttaggtaggataatgtgat

SEQ ID NO: 462378 - DNA, 25 bp, Homo sapien
gataatgtgatattacagtaggatc

SEQ ID NO: 462379 - DNA, 25 bp, Homo sapien
atattacagtaggatcaaaaagaga

SEQ ID NO: 462380 - DNA, 25 bp, Homo sapien
agagatatgagtgttgtggataata

SEQ ID NO: 462381 - DNA, 25 bp, Homo sapien
aaatcaaattaaggccaggtgcggt

SEQ ID NO: 462382 - DNA, 25 bp, Homo sapien
gcaccccagcctgtttcaaatatga

SEQ ID NO: 462383 - DNA, 25 bp, Homo sapien
caccccagcctgtttcaaatatgaa

SEQ ID NO: 462384 - DNA, 25 bp, Homo sapien
accccagcctgtttcaaatatgaat

SEQ ID NO: 462385 - DNA, 25 bp, Homo sapien
aacgtgattttgatgcgactcctcc

SEQ ID NO: 462386 - DNA, 25 bp, Homo sapien
tgagcagatccctggcggaactcag

SEQ ID NO: 462387 - DNA, 25 bp, Homo sapien
aactcagggtcttctcatatttgcc

SEQ ID NO: 462388 - DNA, 25 bp, Homo sapien
atatttgccctgtgattccctcttg

SEQ ID NO: 462389 - DNA, 25 bp, Homo sapien
ctcttgggctgtaattcctctttaa

SEQ ID NO: 462390 - DNA, 25 bp, Homo sapien
agctctctgtgtagtccctttctcc

SEQ ID NO: 462391 - DNA, 25 bp, Homo sapien
gtccctttctcctgaatagtaatgt

SEQ ID NO: 462392 - DNA, 25 bp, Homo sapien
tagtaatgtgctcacttttgctccc

SEQ ID NO: 462393 - DNA, 25 bp, Homo sapien
tgctcccttatctatctcattttaa

SEQ ID NO: 462394 - DNA, 25 bp, Homo sapien
taaaatctcctttcaggcctggcat

SEQ ID NO: 462395 - DNA, 25 bp, Homo sapien
gtcgtttgagcccagtttgattcta

SEQ ID NO: 462396 - DNA, 25 bp, Homo sapien
cttctaataattttgcctctgggaa

SEQ ID NO: 462397 - DNA, 25 bp, Homo sapien
ttctaataattttgcctctgggaat

SEQ ID NO: 462398 - DNA, 25 bp, Homo sapien
tctaataattttgcctctgggaatt

SEQ ID NO: 462399 - DNA, 25 bp, Homo sapien
ttgcctctgggaattttgtcaagat

SEQ ID NO: 462400 - DNA, 25 bp, Homo sapien
tgcctctgggaattttgtcaagatt

SEQ ID NO: 462401 - DNA, 25 bp, Homo sapien
gcctctgggaattttgtcaagattt

SEQ ID NO: 462402 - DNA, 25 bp, Homo sapien
cctctgggaattttgtcaagattta

SEQ ID NO: 462403 - DNA, 25 bp, Homo sapien
tttgtcaagatttacaggctgggcg

SEQ ID NO: 462404 - DNA, 25 bp, Homo sapien
ttgtcaagatttacaggctgggcgt

SEQ ID NO: 462405 - DNA, 25 bp, Homo sapien
ttcttaacctgtacagttttattgt

SEQ ID NO: 462406 - DNA, 25 bp, Homo sapien
tttattgtaccaagagactcgcccc

SEQ ID NO: 462407 - DNA, 25 bp, Homo sapien
tattgtaccaagagactcgccccgc

SEQ ID NO: 462408 - DNA, 25 bp, Homo sapien
cgcccctgtatcataagcctttaaa

SEQ ID NO: 462409 - DNA, 25 bp, Homo sapien
tgtatcataagcctttaaatggagt

SEQ ID NO: 462410 - DNA, 25 bp, Homo sapien
taaatggagtcaactttttaattat

SEQ ID NO: 462411 - DNA, 25 bp, Homo sapien
tctgacgtgcagaatattatttttt

SEQ ID NO: 462412 - DNA, 25 bp, Homo sapien
ttatttcctgttagattatagtgtc

SEQ ID NO: 462413 - DNA, 25 bp, Homo sapien
gattatagtgtctagcaccggcttc

SEQ ID NO: 462414 - DNA, 25 bp, Homo sapien
ttatagtgtctagcaccggcttcac

SEQ ID NO: 462415 - DNA, 25 bp, Homo sapien
tagtgtctagcaccggcttcaccgg

SEQ ID NO: 462416 - DNA, 25 bp, Homo sapien
gactctttagaacttggcgatgatg

SEQ ID NO: 462417 - DNA, 25 bp, Homo sapien
actctttagaacttggcgatgatgt

SEQ ID NO: 462418 - DNA, 25 bp, Homo sapien
ctctttagaacttggcgatgatgtg

SEQ ID NO: 462419 - DNA, 25 bp, Homo sapien
tctttagaacttggcgatgatgtga

SEQ ID NO: 462420 - DNA, 25 bp, Homo sapien
ttagaacttggcgatgatgtgaaaa

SEQ ID NO: 462421 - DNA, 25 bp, Homo sapien
tagaacttggcgatgatgtgaaaat

SEQ ID NO: 462422 - DNA, 25 bp, Homo sapien
gaacttggcgatgatgtgaaaatgt

SEQ ID NO: 462423 - DNA, 25 bp, Homo sapien
aacttggcgatgatgtgaaaatgtg

SEQ ID NO: 462424 - DNA, 25 bp, Homo sapien
cttggcgatgatgtgaaaatgtgta

SEQ ID NO: 462425 - DNA, 25 bp, Homo sapien
ttggcgatgatgtgaaaatgtgtaa

SEQ ID NO: 462426 - DNA, 25 bp, Homo sapien
taagaaagagtttaggaggccaggc

SEQ ID NO: 462427 - DNA, 25 bp, Homo sapien
ggagtcaattgattacccagcagca

SEQ ID NO: 462428 - DNA, 25 bp, Homo sapien
gtcaattgattacccagcagcacag

SEQ ID NO: 462429 - DNA, 25 bp, Homo sapien
caattgattacccagcagcacagta

SEQ ID NO: 462430 - DNA, 25 bp, Homo sapien
cagagtttagattgtgagtccatgt

SEQ ID NO: 462431 - DNA, 25 bp, Homo sapien
gattgtgagtccatgttttgtctgt

SEQ ID NO: 462432 - DNA, 25 bp, Homo sapien
gttttgtctgttgtgcctataaagg

SEQ ID NO: 462433 - DNA, 25 bp, Homo sapien
tttgtctgttgtgcctataaaggaa

SEQ ID NO: 462434 - DNA, 25 bp, Homo sapien
atttgaaatctgtatcattctacta

SEQ ID NO: 462435 - DNA, 25 bp, Homo sapien
tgaaatctgtatcattctactataa

SEQ ID NO: 462436 - DNA, 25 bp, Homo sapien
aatacccacaaatgatagaccggat

SEQ ID NO: 462437 - DNA, 25 bp, Homo sapien
cccacaaatgatagaccggataaag

SEQ ID NO: 462438 - DNA, 25 bp, Homo sapien
gccagtagtgtgagccaagcgcagc

SEQ ID NO: 462439 - DNA, 25 bp, Homo sapien
aacgagccctgtgggcgcgagcaat

SEQ ID NO: 462440 - DNA, 25 bp, Homo sapien
gggcgcgagcaatactcaggcagaa

SEQ ID NO: 462441 - DNA, 25 bp, Homo sapien
aggtttctggctggcaaatcgacat

SEQ ID NO: 462442 - DNA, 25 bp, Homo sapien
aaatcgacatcccaagggtcccgtg

SEQ ID NO: 462443 - DNA, 25 bp, Homo sapien
ggtcccgtgacaattatagcccctg

SEQ ID NO: 462444 - DNA, 25 bp, Homo sapien
atagcccctgcttctggatagagta

SEQ ID NO: 462445 - DNA, 25 bp, Homo sapien
aatcgaataacccaacctccagaca

SEQ ID NO: 462446 - DNA, 25 bp, Homo sapien
caacctccagacattgctggtgtta

SEQ ID NO: 462447 - DNA, 25 bp, Homo sapien
gctggtgttaacttattgccaaatt

SEQ ID NO: 462448 - DNA, 25 bp, Homo sapien
tgccaaattctttctgatgtatgtg

SEQ ID NO: 462449 - DNA, 25 bp, Homo sapien
aattccaaggtggattatggacttc

SEQ ID NO: 462450 - DNA, 25 bp, Homo sapien
tctaactcccattgatagtgcttct

SEQ ID NO: 462451 - DNA, 25 bp, Homo sapien
attgatagtgcttcttaccaggtga

SEQ ID NO: 462452 - DNA, 25 bp, Homo sapien
agtgcttcttaccaggtgaagggaa

SEQ ID NO: 462453 - DNA, 25 bp, Homo sapien
tttcagacaaagctcgtaccaaccc

SEQ ID NO: 462454 - DNA, 25 bp, Homo sapien
caacccctgaactgcaaatttgctc

SEQ ID NO: 462455 - DNA, 25 bp, Homo sapien
aaatttgctcaagtgaccgtgcata

SEQ ID NO: 462456 - DNA, 25 bp, Homo sapien
gaccgtgcatacttatattcctaat

SEQ ID NO: 462457 - DNA, 25 bp, Homo sapien
gattatttatgtcaaacgctcattg

SEQ ID NO: 462458 - DNA, 25 bp, Homo sapien
caaacgctcattgtgaaacttgaaa

SEQ ID NO: 462459 - DNA, 25 bp, Homo sapien
agtttacttgtagcagacagaaaga

SEQ ID NO: 462460 - DNA, 25 bp, Homo sapien
attcctaaagcaatctgaatttttt

SEQ ID NO: 462461 - DNA, 25 bp, Homo sapien
ttcctaaagcaatctgaattttttc

SEQ ID NO: 462462 - DNA, 25 bp, Homo sapien
atctgaattttttccaaggcagtag

SEQ ID NO: 462463 - DNA, 25 bp, Homo sapien
tctgaattttttccaaggcagtaga

SEQ ID NO: 462464 - DNA, 25 bp, Homo sapien
ctgaattttttccaaggcagtagaa

SEQ ID NO: 462465 - DNA, 25 bp, Homo sapien
tgaattttttccaaggcagtagaaa

SEQ ID NO: 462466 - DNA, 25 bp, Homo sapien
gaattttttccaaggcagtagaaag

SEQ ID NO: 462467 - DNA, 25 bp, Homo sapien
gcagtagaaagaccttcttaaaaag

SEQ ID NO: 462468 - DNA, 25 bp, Homo sapien
gagctcggagaggagatgtcccaaa

SEQ ID NO: 462469 - DNA, 25 bp, Homo sapien
aggagatgtcccaaacaggaaggaa

SEQ ID NO: 462470 - DNA, 25 bp, Homo sapien
ccaaagggcctagaaaggctcctgt

SEQ ID NO: 462471 - DNA, 25 bp, Homo sapien
ggctcctgtgaaggagagtcctgaa

SEQ ID NO: 462472 - DNA, 25 bp, Homo sapien
gtcctgaagtgctggtggaacgcaa

SEQ ID NO: 462473 - DNA, 25 bp, Homo sapien
agtgctggtggaacgcaaccctgac

SEQ ID NO: 462474 - DNA, 25 bp, Homo sapien
aaccctgacccagctattagcgtgg

SEQ ID NO: 462475 - DNA, 25 bp, Homo sapien
agctattagcgtggccccggcacgg

SEQ ID NO: 462476 - DNA, 25 bp, Homo sapien
gccacccaaaaatgctgcctgggac

SEQ ID NO: 462477 - DNA, 25 bp, Homo sapien
tgctgcctgggacccgaccacagga

SEQ ID NO: 462478 - DNA, 25 bp, Homo sapien
ggcacccatacccagcatggatgct

SEQ ID NO: 462479 - DNA, 25 bp, Homo sapien
gtataaatacccttatttgctgcaa

SEQ ID NO: 462480 - DNA, 25 bp, Homo sapien
ttatttgctgcaaagaccagtgtgt

SEQ ID NO: 462481 - DNA, 25 bp, Homo sapien
agaccagtgtgtaggcatttgcttt

SEQ ID NO: 462482 - DNA, 25 bp, Homo sapien
tgctccattttaatgccgaggaata

SEQ ID NO: 462483 - DNA, 25 bp, Homo sapien
ccgaggaataagtcttttggcaaca

SEQ ID NO: 462484 - DNA, 25 bp, Homo sapien
gtcttttggcaacacaaactggtca

SEQ ID NO: 462485 - DNA, 25 bp, Homo sapien
atgcaggtatgttcaggttaagcca

SEQ ID NO: 462486 - DNA, 25 bp, Homo sapien
tcaggttaagccaacaatgttttgc

SEQ ID NO: 462487 - DNA, 25 bp, Homo sapien
ttatgcttattttctgtcaacacta

SEQ ID NO: 462488 - DNA, 25 bp, Homo sapien
actaatgaagtcaacattgcctgaa

SEQ ID NO: 462489 - DNA, 25 bp, Homo sapien
gtctgaataatgaaacacatccctg

SEQ ID NO: 462490 - DNA, 25 bp, Homo sapien
tggaggcttactcaaatcagcccct

SEQ ID NO: 462491 - DNA, 25 bp, Homo sapien
aaatcagcccctttgcctggcttag

SEQ ID NO: 462492 - DNA, 25 bp, Homo sapien
gcctggcttaggaactgtgtgaact

SEQ ID NO: 462493 - DNA, 25 bp, Homo sapien
gaatgtgacggttcaccagagccca

SEQ ID NO: 462494 - DNA, 25 bp, Homo sapien
cttctctcctacgaaatcttgtgac

SEQ ID NO: 462495 - DNA, 25 bp, Homo sapien
attcctgaggttcttctttctttga

SEQ ID NO: 462496 - DNA, 25 bp, Homo sapien
cactctctaaactctctttgatgtc

SEQ ID NO: 462497 - DNA, 25 bp, Homo sapien
atcaatgcaaagtcacccgcaacag

SEQ ID NO: 462498 - DNA, 25 bp, Homo sapien
ccgcaacagcatcatccattgtgga

SEQ ID NO: 462499 - DNA, 25 bp, Homo sapien
attgtggaatccatgggctcatcct

SEQ ID NO: 462500 - DNA, 25 bp, Homo sapien
tcatcctcacaacttcctttgggaa

SEQ ID NO: 462501 - DNA, 25 bp, Homo sapien
ttaccagctatggacccttggaaga

SEQ ID NO: 462502 - DNA, 25 bp, Homo sapien
tatggacccttggaagatgaatcta

SEQ ID NO: 462503 - DNA, 25 bp, Homo sapien
tctcactggtttttctttgcaaatt

SEQ ID NO: 462504 - DNA, 25 bp, Homo sapien
actggtttttctttgcaaattcatt

SEQ ID NO: 462505 - DNA, 25 bp, Homo sapien
ataaactctattttccatgttctca

SEQ ID NO: 462506 - DNA, 25 bp, Homo sapien
tttccatgttctcagggcccctggg

SEQ ID NO: 462507 - DNA, 25 bp, Homo sapien
gtagacagacacagcttgatttcag

SEQ ID NO: 462508 - DNA, 25 bp, Homo sapien
ttgatttcagagcagacataggcga

SEQ ID NO: 462509 - DNA, 25 bp, Homo sapien
gacataggcgaagaaaacatggcat

SEQ ID NO: 462510 - DNA, 25 bp, Homo sapien
gtgtgctgagtccagacaaatgtta

SEQ ID NO: 462511 - DNA, 25 bp, Homo sapien
ttctttaggtttcaaacactgtaat

SEQ ID NO: 462512 - DNA, 25 bp, Homo sapien
taatttctatctgggcattaatgga

SEQ ID NO: 462513 - DNA, 25 bp, Homo sapien
ataagtagccttgtgtgctgcttca

SEQ ID NO: 462514 - DNA, 25 bp, Homo sapien
gccttgtgtgctgcttcagattgaa

SEQ ID NO: 462515 - DNA, 25 bp, Homo sapien
caaagtgagcacattgttctataaa

SEQ ID NO: 462516 - DNA, 25 bp, Homo sapien
ataaaaacatgctggtacaccctta

SEQ ID NO: 462517 - DNA, 25 bp, Homo sapien
gctggtacacccttaaacttttgat

SEQ ID NO: 462518 - DNA, 25 bp, Homo sapien
cacccttaaacttttgatcaatctg

SEQ ID NO: 462519 - DNA, 25 bp, Homo sapien
gatcaatctgagtgaggtgtgcttt

SEQ ID NO: 462520 - DNA, 25 bp, Homo sapien
tcttgggacctactcacgtttgaag

SEQ ID NO: 462521 - DNA, 25 bp, Homo sapien
gacctactcacgtttgaagattgga

SEQ ID NO: 462522 - DNA, 25 bp, Homo sapien
tatctcttgaacatcttctaaaggg

SEQ ID NO: 462523 - DNA, 25 bp, Homo sapien
agatctctccacgtcttagatttga

SEQ ID NO: 462524 - DNA, 25 bp, Homo sapien
ttgacatttgaaagccactggacct

SEQ ID NO: 462525 - DNA, 25 bp, Homo sapien
atggcatcatctatttctttctctt

SEQ ID NO: 462526 - DNA, 25 bp, Homo sapien
ttctttctcttgtctcataaatcta

SEQ ID NO: 462527 - DNA, 25 bp, Homo sapien
aaccatcaacctgcttatttttgta

SEQ ID NO: 462528 - DNA, 25 bp, Homo sapien
tatttttgtatactgtcacactgtg

SEQ ID NO: 462529 - DNA, 25 bp, Homo sapien
cacactgtgtattccctgcattgaa

SEQ ID NO: 462530 - DNA, 25 bp, Homo sapien
tgcattgaatgcctgtctgttgaca

SEQ ID NO: 462531 - DNA, 25 bp, Homo sapien
gcctgtctgttgacattatctgtaa

SEQ ID NO: 462532 - DNA, 25 bp, Homo sapien
ggaagttttctgcaccctgaaattt

SEQ ID NO: 462533 - DNA, 25 bp, Homo sapien
ccctgaaatttctgttatgcggatt

SEQ ID NO: 462534 - DNA, 25 bp, Homo sapien
atcctggcccagctgtaccacgaga

SEQ ID NO: 462535 - DNA, 25 bp, Homo sapien
agctgtaccacgagaagccactggt

SEQ ID NO: 462536 - DNA, 25 bp, Homo sapien
gagaagccactggtgttcctggagc

SEQ ID NO: 462537 - DNA, 25 bp, Homo sapien
aagccactggtgttcctggagcgct

SEQ ID NO: 462538 - DNA, 25 bp, Homo sapien
ggtgttcctggagcgcttccgcaca

SEQ ID NO: 462539 - DNA, 25 bp, Homo sapien
gcctccgtgaggagcatctggcctg

SEQ ID NO: 462540 - DNA, 25 bp, Homo sapien
tgaggagcatctggcctgctttggc

SEQ ID NO: 462541 - DNA, 25 bp, Homo sapien
gagcatctggcctgctttggccacg

SEQ ID NO: 462542 - DNA, 25 bp, Homo sapien
acgtgcgtggcgaccaccgtgcaga

SEQ ID NO: 462543 - DNA, 25 bp, Homo sapien
gtggcgaccaccgtgcagacttcta

SEQ ID NO: 462544 - DNA, 25 bp, Homo sapien
caccgtgcagacttctactgtgctg

SEQ ID NO: 462545 - DNA, 25 bp, Homo sapien
atgtttcccataggccacgctggtc

SEQ ID NO: 462546 - DNA, 25 bp, Homo sapien
ataggccacgctggtcactgaaaga

SEQ ID NO: 462547 - DNA, 25 bp, Homo sapien
ggccacgctggtcactgaaagagat

SEQ ID NO: 462548 - DNA, 25 bp, Homo sapien
acgctggtcactgaaagagatgggc

SEQ ID NO: 462549 - DNA, 25 bp, Homo sapien
gatgggctatgagccatcttgaaaa

SEQ ID NO: 462550 - DNA, 25 bp, Homo sapien
caccctgcagctgagtgccatataa

SEQ ID NO: 462551 - DNA, 25 bp, Homo sapien
gcagctgagtgccatataatgttga

SEQ ID NO: 462552 - DNA, 25 bp, Homo sapien
gccatataatgttgaagctgttgag

SEQ ID NO: 462553 - DNA, 25 bp, Homo sapien
aggagaggttggaagctgccagctt

SEQ ID NO: 462554 - DNA, 25 bp, Homo sapien
aacagtgactgggtaaggcaggatc

SEQ ID NO: 462555 - DNA, 25 bp, Homo sapien
gactgggtaaggcaggatctttttt

SEQ ID NO: 462556 - DNA, 25 bp, Homo sapien
tgctacatctgcaagaagcacttca

SEQ ID NO: 462557 - DNA, 25 bp, Homo sapien
ctacatctgcaagaagcacttcacg

SEQ ID NO: 462558 - DNA, 25 bp, Homo sapien
agaagcacttcacggggcgctcgtc

SEQ ID NO: 462559 - DNA, 25 bp, Homo sapien
cgtgcaccagatcgtgcacaccggg

SEQ ID NO: 462560 - DNA, 25 bp, Homo sapien
agccagagcgcctacctcatcgagc

SEQ ID NO: 462561 - DNA, 25 bp, Homo sapien
gcgagaagccgtacaggtgcggcca

SEQ ID NO: 462562 - DNA, 25 bp, Homo sapien
tacaggtgcggccagtgcgggaagt

SEQ ID NO: 462563 - DNA, 25 bp, Homo sapien
ggtgcggccagtgcgggaagtcctt

SEQ ID NO: 462564 - DNA, 25 bp, Homo sapien
aagtccttcatcaagaactcctccc

SEQ ID NO: 462565 - DNA, 25 bp, Homo sapien
tcaagaactcctccctcactgtgca

SEQ ID NO: 462566 - DNA, 25 bp, Homo sapien
ggaagaccttcagccgcaacacgaa

SEQ ID NO: 462567 - DNA, 25 bp, Homo sapien
atgcccttctgcttatagacctaaa

SEQ ID NO: 462568 - DNA, 25 bp, Homo sapien
gttcaggtacttattattggccatt

SEQ ID NO: 462569 - DNA, 25 bp, Homo sapien
gccattgatcttgaatttgccctct

SEQ ID NO: 462570 - DNA, 25 bp, Homo sapien
tgcagtcccacttcaaagccatttt

SEQ ID NO: 462571 - DNA, 25 bp, Homo sapien
gtttaggtctggcaattgtccttga

SEQ ID NO: 462572 - DNA, 25 bp, Homo sapien
tgaaaaatcccacccatgttgtacc

SEQ ID NO: 462573 - DNA, 25 bp, Homo sapien
atgttgtaccaccttggtgagtcat

SEQ ID NO: 462574 - DNA, 25 bp, Homo sapien
atatgccactcatcagcttgggaat

SEQ ID NO: 462575 - DNA, 25 bp, Homo sapien
ggaatgatggctgccaactcccaat

SEQ ID NO: 462576 - DNA, 25 bp, Homo sapien
aactcccaatctcccaggaaggcag

SEQ ID NO: 462577 - DNA, 25 bp, Homo sapien
ttggcctgctacctccattaaaaaa

SEQ ID NO: 462578 - DNA, 25 bp, Homo sapien
tacattagagcccacccggagagag

SEQ ID NO: 462579 - DNA, 25 bp, Homo sapien
tgctgttcgtgtccagtgtctgcat

SEQ ID NO: 462580 - DNA, 25 bp, Homo sapien
gtgtccagtgtctgcatcggcctgg

SEQ ID NO: 462581 - DNA, 25 bp, Homo sapien
tgtgcgccctggtcatcagagagtc

SEQ ID NO: 462582 - DNA, 25 bp, Homo sapien
gtcatcagagagtcctgtgccaagg

SEQ ID NO: 462583 - DNA, 25 bp, Homo sapien
aaggacttccgcgacttgcagctgg

SEQ ID NO: 462584 - DNA, 25 bp, Homo sapien
cccctctgagtctgatttcccaggg

SEQ ID NO: 462585 - DNA, 25 bp, Homo sapien
ggttctgtaggacttcatatcctat

SEQ ID NO: 462586 - DNA, 25 bp, Homo sapien
ggacttcatatcctatatacagttc

SEQ ID NO: 462587 - DNA, 25 bp, Homo sapien
tatacagttccatagaagctgcaga

SEQ ID NO: 462588 - DNA, 25 bp, Homo sapien
atagaagctgcagagctcgcagaaa

SEQ ID NO: 462589 - DNA, 25 bp, Homo sapien
ggcttattgcaacatccgccacctg

SEQ ID NO: 462590 - DNA, 25 bp, Homo sapien
ttattgcaacatccgccacctgggt

SEQ ID NO: 462591 - DNA, 25 bp, Homo sapien
cctccctatctctgtatcttatgaa

SEQ ID NO: 462592 - DNA, 25 bp, Homo sapien
tccctatctctgtatcttatgaaga

SEQ ID NO: 462593 - DNA, 25 bp, Homo sapien
tctctgtatcttatgaagacttcct

SEQ ID NO: 462594 - DNA, 25 bp, Homo sapien
tctgtatcttatgaagacttccttt

SEQ ID NO: 462595 - DNA, 25 bp, Homo sapien
ctgaagagctgccataagtcttaaa

SEQ ID NO: 462596 - DNA, 25 bp, Homo sapien
gaagagctgccataagtcttaaaca

SEQ ID NO: 462597 - DNA, 25 bp, Homo sapien
gagctgccataagtcttaaacattt

SEQ ID NO: 462598 - DNA, 25 bp, Homo sapien
gctgccataagtcttaaacatttaa

SEQ ID NO: 462599 - DNA, 25 bp, Homo sapien
aacatttaaatcatcagaacctttt

SEQ ID NO: 462600 - DNA, 25 bp, Homo sapien
gggctttgtgaccagaaagcttcat

SEQ ID NO: 462601 - DNA, 25 bp, Homo sapien
agaaagcttcatccacagccttgca

SEQ ID NO: 462602 - DNA, 25 bp, Homo sapien
aaagcttcatccacagccttgcagc

SEQ ID NO: 462603 - DNA, 25 bp, Homo sapien
ccttgcagcggctcctgcaaaagga

SEQ ID NO: 462604 - DNA, 25 bp, Homo sapien
ctcaggccaagggaccaggtttgca

SEQ ID NO: 462605 - DNA, 25 bp, Homo sapien
gctgagccctcctgagggccggttc

SEQ ID NO: 462606 - DNA, 25 bp, Homo sapien
gagggccggttctaaggctcagact

SEQ ID NO: 462607 - DNA, 25 bp, Homo sapien
agggccggttctaaggctcagactg

SEQ ID NO: 462608 - DNA, 25 bp, Homo sapien
tctaaggctcagactgggcactggg

SEQ ID NO: 462609 - DNA, 25 bp, Homo sapien
ctgactcagtgaccagtgcctgtga

SEQ ID NO: 462610 - DNA, 25 bp, Homo sapien
ctggtaataaatgtgactcagcatc

SEQ ID NO: 462611 - DNA, 25 bp, Homo sapien
aaacaggtggaaaagaggctgcttc

SEQ ID NO: 462612 - DNA, 25 bp, Homo sapien
gaaaagaggctgcttcaggcaccac

SEQ ID NO: 462613 - DNA, 25 bp, Homo sapien
aaaagaggctgcttcaggcaccaca

SEQ ID NO: 462614 - DNA, 25 bp, Homo sapien
aaagaggctgcttcaggcaccacac

SEQ ID NO: 462615 - DNA, 25 bp, Homo sapien
agaggctgcttcaggcaccacacct

SEQ ID NO: 462616 - DNA, 25 bp, Homo sapien
tgcttcaggcaccacacctcagaag

SEQ ID NO: 462617 - DNA, 25 bp, Homo sapien
accacacctcagaagtcccggaagc

SEQ ID NO: 462618 - DNA, 25 bp, Homo sapien
tgcaaagcaacatcacccagtgcct

SEQ ID NO: 462619 - DNA, 25 bp, Homo sapien
aggcctcagtggtgaaggtcctgac

SEQ ID NO: 462620 - DNA, 25 bp, Homo sapien
gcctcagtggtgaaggtcctgactg

SEQ ID NO: 462621 - DNA, 25 bp, Homo sapien
cagtggtgaaggtcctgactgagct

SEQ ID NO: 462622 - DNA, 25 bp, Homo sapien
gtacctattagcatcttcctgcagg

SEQ ID NO: 462623 - DNA, 25 bp, Homo sapien
ctgcagggacttgggcccatggcct

SEQ ID NO: 462624 - DNA, 25 bp, Homo sapien
cttctcatgcccaagacagttgttt

SEQ ID NO: 462625 - DNA, 25 bp, Homo sapien
gcccaagacagttgtttcacaggag

SEQ ID NO: 462626 - DNA, 25 bp, Homo sapien
ggtgatgcaagtagaaccctctaga

SEQ ID NO: 462627 - DNA, 25 bp, Homo sapien
gaaccctctagatgtaccctgtgtg

SEQ ID NO: 462628 - DNA, 25 bp, Homo sapien
tgtggtctgcaggactggactgttt

SEQ ID NO: 462629 - DNA, 25 bp, Homo sapien
ctgtttgctgtgtttgtggatgttg

SEQ ID NO: 462630 - DNA, 25 bp, Homo sapien
tttgtggatgttggcgatagactgt

SEQ ID NO: 462631 - DNA, 25 bp, Homo sapien
aggttgtttgtgatccaacaagaac

SEQ ID NO: 462632 - DNA, 25 bp, Homo sapien
gaacatttccaaaagtatctaggtg

SEQ ID NO: 462633 - DNA, 25 bp, Homo sapien
atatagattgttatgttggtgagaa

SEQ ID NO: 462634 - DNA, 25 bp, Homo sapien
tgttggtgagaaagggctgaactca

SEQ ID NO: 462635 - DNA, 25 bp, Homo sapien
gtgagaaagggctgaactcaggact

SEQ ID NO: 462636 - DNA, 25 bp, Homo sapien
tgagaaagggctgaactcaggactg

SEQ ID NO: 462637 - DNA, 25 bp, Homo sapien
aaagggctgaactcaggactgggaa

SEQ ID NO: 462638 - DNA, 25 bp, Homo sapien
agggctgaactcaggactgggaaaa

SEQ ID NO: 462639 - DNA, 25 bp, Homo sapien
ggctgaactcaggactgggaaaaat

SEQ ID NO: 462640 - DNA, 25 bp, Homo sapien
gctgaactcaggactgggaaaaatg

SEQ ID NO: 462641 - DNA, 25 bp, Homo sapien
tgggaaaaatgttgcaatctggaaa

SEQ ID NO: 462642 - DNA, 25 bp, Homo sapien
gggaaaaatgttgcaatctggaaag

SEQ ID NO: 462643 - DNA, 25 bp, Homo sapien
ggaaaaatgttgcaatctggaaagg

SEQ ID NO: 462644 - DNA, 25 bp, Homo sapien
gcatctgtgggcctgtcccatcact

SEQ ID NO: 462645 - DNA, 25 bp, Homo sapien
tgccatcagtatcagtcgagccagt

SEQ ID NO: 462646 - DNA, 25 bp, Homo sapien
atcagtatcagtcgagccagtgccc

SEQ ID NO: 462647 - DNA, 25 bp, Homo sapien
atcagtcgagccagtgcccctctgg

SEQ ID NO: 462648 - DNA, 25 bp, Homo sapien
aagcatcaccagtgcttctctggag

SEQ ID NO: 462649 - DNA, 25 bp, Homo sapien
gcccagtggccggatagtgaccgtt

SEQ ID NO: 462650 - DNA, 25 bp, Homo sapien
ggatagtgaccgttctccctggact

SEQ ID NO: 462651 - DNA, 25 bp, Homo sapien
acatctcctgacagtgcttcatcag

SEQ ID NO: 462652 - DNA, 25 bp, Homo sapien
cagtgcttcatcagcttgtgggaac

SEQ ID NO: 462653 - DNA, 25 bp, Homo sapien
gcttcatcagcttgtgggaacagtt

SEQ ID NO: 462654 - DNA, 25 bp, Homo sapien
gcttgtgggaacagttcagcaacca

SEQ ID NO: 462655 - DNA, 25 bp, Homo sapien
agttgccattataggtttttggatt

SEQ ID NO: 462656 - DNA, 25 bp, Homo sapien
acatcatgttgttgctagtttgagc

SEQ ID NO: 462657 - DNA, 25 bp, Homo sapien
gttgctagtttgagcagatgcacat

SEQ ID NO: 462658 - DNA, 25 bp, Homo sapien
gatgcacatagcatatgtttccatt

SEQ ID NO: 462659 - DNA, 25 bp, Homo sapien
gcatatgtttccattaccaatttgg

SEQ ID NO: 462660 - DNA, 25 bp, Homo sapien
ggaaatttttcccagtggcatcagc

SEQ ID NO: 462661 - DNA, 25 bp, Homo sapien
ccagtggcatcagcatttgagagat

SEQ ID NO: 462662 - DNA, 25 bp, Homo sapien
gtggcatcagcatttgagagatact

SEQ ID NO: 462663 - DNA, 25 bp, Homo sapien
gcatttgagagatactgattttgaa

SEQ ID NO: 462664 - DNA, 25 bp, Homo sapien
acctttggggatctgtacttgacta

SEQ ID NO: 462665 - DNA, 25 bp, Homo sapien
gggatctgtacttgactaaaaagta

SEQ ID NO: 462666 - DNA, 25 bp, Homo sapien
cctgcaggtccaggcagctgtagag

SEQ ID NO: 462667 - DNA, 25 bp, Homo sapien
tccccgctttctcatagacacagag

SEQ ID NO: 462668 - DNA, 25 bp, Homo sapien
catagacacagaggtactgtctgcc

SEQ ID NO: 462669 - DNA, 25 bp, Homo sapien
gtactgtctgcctgttgtcacacag

SEQ ID NO: 462670 - DNA, 25 bp, Homo sapien
ttgtcacacagttcatatgctcgct

SEQ ID NO: 462671 - DNA, 25 bp, Homo sapien
catatgctcgcttgagatggaatct

SEQ ID NO: 462672 - DNA, 25 bp, Homo sapien
gatggaatctgaaccttggtcccag

SEQ ID NO: 462673 - DNA, 25 bp, Homo sapien
tctgaaccttggtcccaggatctgt

SEQ ID NO: 462674 - DNA, 25 bp, Homo sapien
ccactttgccacactgtctaaggtg

SEQ ID NO: 462675 - DNA, 25 bp, Homo sapien
ggtggctttgaactggaacccaagt

SEQ ID NO: 462676 - DNA, 25 bp, Homo sapien
actggaacccaagtgcaaataaagg

SEQ ID NO: 462677 - DNA, 25 bp, Homo sapien
tctccatattttaagctatgtgatt

SEQ ID NO: 462678 - DNA, 25 bp, Homo sapien
aagtacctctgttcatagtttcctg

SEQ ID NO: 462679 - DNA, 25 bp, Homo sapien
cctctgttcatagtttcctggtata

SEQ ID NO: 462680 - DNA, 25 bp, Homo sapien
tcatagtttcctggtataaagttgg

SEQ ID NO: 462681 - DNA, 25 bp, Homo sapien
ggttaaaatttcatctgttaataga

SEQ ID NO: 462682 - DNA, 25 bp, Homo sapien
taatgtatgggttttctattggttt

SEQ ID NO: 462683 - DNA, 25 bp, Homo sapien
tttgcagacagtagagggagatttt

SEQ ID NO: 462684 - DNA, 25 bp, Homo sapien
cagtagagggagattttgtaacaag

SEQ ID NO: 462685 - DNA, 25 bp, Homo sapien
aattgcaatttatcactccttttca

SEQ ID NO: 462686 - DNA, 25 bp, Homo sapien
gcaatttatcactccttttcatgtt

SEQ ID NO: 462687 - DNA, 25 bp, Homo sapien
aatttatcactccttttcatgttaa

SEQ ID NO: 462688 - DNA, 25 bp, Homo sapien
taggatatacatagctgtagctttg

SEQ ID NO: 462689 - DNA, 25 bp, Homo sapien
acaatatatgaatgtgccgtcttat

SEQ ID NO: 462690 - DNA, 25 bp, Homo sapien
atatatgaatgtgccgtcttattta

SEQ ID NO: 462691 - DNA, 25 bp, Homo sapien
ttatacctgtgggaattaactggag

SEQ ID NO: 462692 - DNA, 25 bp, Homo sapien
acctgtgggaattaactggagtatt

SEQ ID NO: 462693 - DNA, 25 bp, Homo sapien
gtatttgttatttgactgttttcta

SEQ ID NO: 462694 - DNA, 25 bp, Homo sapien
gttatttgactgttttctattaagg

SEQ ID NO: 462695 - DNA, 25 bp, Homo sapien
taaggaatattaggcttggtgctat

SEQ ID NO: 462696 - DNA, 25 bp, Homo sapien
aggcttggtgctatgatgaatgatc

SEQ ID NO: 462697 - DNA, 25 bp, Homo sapien
ggtgctatgatgaatgatcttgtaa

SEQ ID NO: 462698 - DNA, 25 bp, Homo sapien
aaaatcatgtgtattcttaagaaaa

SEQ ID NO: 462699 - DNA, 25 bp, Homo sapien
taaagtcagagcatcttttcctgaa

SEQ ID NO: 462700 - DNA, 25 bp, Homo sapien
agtcagagcatcttttcctgaagac

SEQ ID NO: 462701 - DNA, 25 bp, Homo sapien
gggtctaaggttatacaatcaacta

SEQ ID NO: 462702 - DNA, 25 bp, Homo sapien
aaggttatacaatcaactagctgaa

SEQ ID NO: 462703 - DNA, 25 bp, Homo sapien
atcaactagctgaagtgaaacaaca

SEQ ID NO: 462704 - DNA, 25 bp, Homo sapien
acaaaacaagaagcttatgcccaaa

SEQ ID NO: 462705 - DNA, 25 bp, Homo sapien
gcaagggcaaaagaattccataaga

SEQ ID NO: 462706 - DNA, 25 bp, Homo sapien
gaattccataagaaaacactagaga

SEQ ID NO: 462707 - DNA, 25 bp, Homo sapien
gagaaacttcgagccaaaaatacat

SEQ ID NO: 462708 - DNA, 25 bp, Homo sapien
gagccaaaaatacatgctgactttc

SEQ ID NO: 462709 - DNA, 25 bp, Homo sapien
atacatgctgactttctagaaatag

SEQ ID NO: 462710 - DNA, 25 bp, Homo sapien
gggctttgtgaccagaaagcttcat

SEQ ID NO: 462711 - DNA, 25 bp, Homo sapien
ggctttgtgaccagaaagcttcatc

SEQ ID NO: 462712 - DNA, 25 bp, Homo sapien
cagaaagcttcatccacagccttgc

SEQ ID NO: 462713 - DNA, 25 bp, Homo sapien
agaaagcttcatccacagccttgca

SEQ ID NO: 462714 - DNA, 25 bp, Homo sapien
gaaagcttcatccacagccttgcag

SEQ ID NO: 462715 - DNA, 25 bp, Homo sapien
aaagcttcatccacagccttgcagc

SEQ ID NO: 462716 - DNA, 25 bp, Homo sapien
gctgagccctcctgagggccggttc

SEQ ID NO: 462717 - DNA, 25 bp, Homo sapien
gagggccggttctaaggctcagact

SEQ ID NO: 462718 - DNA, 25 bp, Homo sapien
agggccggttctaaggctcagactg

SEQ ID NO: 462719 - DNA, 25 bp, Homo sapien
ggccggttctaaggctcagactggg

SEQ ID NO: 462720 - DNA, 25 bp, Homo sapien
ctggtaataaatgtgactcagcatc

SEQ ID NO: 462721 - DNA, 25 bp, Homo sapien
tagacctctcactatgaccgcggcc

SEQ ID NO: 462722 - DNA, 25 bp, Homo sapien
tgctcttggtcttctgctcatggat

SEQ ID NO: 462723 - DNA, 25 bp, Homo sapien
tcttggtcttctgctcatggatgac

SEQ ID NO: 462724 - DNA, 25 bp, Homo sapien
tgctcatggatgacgcaccagtcgt

SEQ ID NO: 462725 - DNA, 25 bp, Homo sapien
tggatgacgcaccagtcgtgcatgt

SEQ ID NO: 462726 - DNA, 25 bp, Homo sapien
accagtcgtgcatgttcttggtgaa

SEQ ID NO: 462727 - DNA, 25 bp, Homo sapien
atgttcttggtgaagtcggccagcc

SEQ ID NO: 462728 - DNA, 25 bp, Homo sapien
ttcttggtgaagtcggccagcctga

SEQ ID NO: 462729 - DNA, 25 bp, Homo sapien
gtgaagtcggccagcctgagcaagc

SEQ ID NO: 462730 - DNA, 25 bp, Homo sapien
cagcctgagcaagcggaggacctac

SEQ ID NO: 462731 - DNA, 25 bp, Homo sapien
agcaagcggaggacctacgccggcc

SEQ ID NO: 462732 - DNA, 25 bp, Homo sapien
aagatcaacaatgaacgccgtacat

SEQ ID NO: 462733 - DNA, 25 bp, Homo sapien
aatgaacgccgtacatacctagctg

SEQ ID NO: 462734 - DNA, 25 bp, Homo sapien
aacgccgtacatacctagctgaaat

SEQ ID NO: 462735 - DNA, 25 bp, Homo sapien
atacctagctgaaatgtctcagggt

SEQ ID NO: 462736 - DNA, 25 bp, Homo sapien
aaatgtctcagggttctggtttaca

SEQ ID NO: 462737 - DNA, 25 bp, Homo sapien
ctcagggttctggtttacatcaagt

SEQ ID NO: 462738 - DNA, 25 bp, Homo sapien
ggttctggtttacatcaagtttcta

SEQ ID NO: 462739 - DNA, 25 bp, Homo sapien
acatcaagtttctaaaaggcaacag

SEQ ID NO: 462740 - DNA, 25 bp, Homo sapien
aacaggtggatcaactgcctaggat

SEQ ID NO: 462741 - DNA, 25 bp, Homo sapien
ggtggatcaactgcctaggatgcaa

SEQ ID NO: 462742 - DNA, 25 bp, Homo sapien
gatcaactgcctaggatgcaagaga

SEQ ID NO: 462743 - DNA, 25 bp, Homo sapien
gtagtgcgtgtgcaccaccaacgtt

SEQ ID NO: 462744 - DNA, 25 bp, Homo sapien
gtgtgcaccaccaacgtttggtgaa

SEQ ID NO: 462745 - DNA, 25 bp, Homo sapien
atataaaagctaggtgcactaccac

SEQ ID NO: 462746 - DNA, 25 bp, Homo sapien
acacccctggtttccacgaggctga

SEQ ID NO: 462747 - DNA, 25 bp, Homo sapien
ctggtttccacgaggctgacaacat

SEQ ID NO: 462748 - DNA, 25 bp, Homo sapien
ttccacgaggctgacaacatactgt

SEQ ID NO: 462749 - DNA, 25 bp, Homo sapien
gaggctgacaacatactgtaatgaa

SEQ ID NO: 462750 - DNA, 25 bp, Homo sapien
atggtaaaagacacagacctcttga

SEQ ID NO: 462751 - DNA, 25 bp, Homo sapien
acagacctcttgacaacattgtgat

SEQ ID NO: 462752 - DNA, 25 bp, Homo sapien
agttgagtgcacacagtttgctgtt

SEQ ID NO: 462753 - DNA, 25 bp, Homo sapien
gtttgctgtttgaatccaatgcaca

SEQ ID NO: 462754 - DNA, 25 bp, Homo sapien
agggaggagacatctccctctttgt

SEQ ID NO: 462755 - DNA, 25 bp, Homo sapien
acatctccctctttgtcagatacat

SEQ ID NO: 462756 - DNA, 25 bp, Homo sapien
tgtcagatacatcctggagtccaga

SEQ ID NO: 462757 - DNA, 25 bp, Homo sapien
ggagtccagatgcagcttgtcacca

SEQ ID NO: 462758 - DNA, 25 bp, Homo sapien
gcagcttgtcaccatctgcattttc

SEQ ID NO: 462759 - DNA, 25 bp, Homo sapien
ttgggagcgtgagggccttcctatc

SEQ ID NO: 462760 - DNA, 25 bp, Homo sapien
gtttccctgcagtgcacgctggcag

SEQ ID NO: 462761 - DNA, 25 bp, Homo sapien
tgcagtgcacgctggcagccaccaa

SEQ ID NO: 462762 - DNA, 25 bp, Homo sapien
gcagccaccaagctaggaagtggca

SEQ ID NO: 462763 - DNA, 25 bp, Homo sapien
aagtttcttagagtggtctgttacg

SEQ ID NO: 462764 - DNA, 25 bp, Homo sapien
tcttagagtggtctgttacgttttt

SEQ ID NO: 462765 - DNA, 25 bp, Homo sapien
cgagaaactagtgcgaagtagtgat

SEQ ID NO: 462766 - DNA, 25 bp, Homo sapien
gaaactagtgcgaagtagtgatcag

SEQ ID NO: 462767 - DNA, 25 bp, Homo sapien
aactagtgcgaagtagtgatcaggt

SEQ ID NO: 462768 - DNA, 25 bp, Homo sapien
tagtgcgaagtagtgatcaggtatt

SEQ ID NO: 462769 - DNA, 25 bp, Homo sapien
gtgcgaagtagtgatcaggtattgc

SEQ ID NO: 462770 - DNA, 25 bp, Homo sapien
tgcgaagtagtgatcaggtattgct

SEQ ID NO: 462771 - DNA, 25 bp, Homo sapien
gcgaagtagtgatcaggtattgctg

SEQ ID NO: 462772 - DNA, 25 bp, Homo sapien
aagtagtgatcaggtattgctgtta

SEQ ID NO: 462773 - DNA, 25 bp, Homo sapien
gtagtgatcaggtattgctgttaga

SEQ ID NO: 462774 - DNA, 25 bp, Homo sapien
agtgatcaggtattgctgttagata

SEQ ID NO: 462775 - DNA, 25 bp, Homo sapien
gatcaggtattgctgttagatatcc

SEQ ID NO: 462776 - DNA, 25 bp, Homo sapien
agattcccctgtgtggtcgaaccta

SEQ ID NO: 462777 - DNA, 25 bp, Homo sapien
tgatgctccatgtgacgacgacttt

SEQ ID NO: 462778 - DNA, 25 bp, Homo sapien
gctttctttcctcttagtgaggagg

SEQ ID NO: 462779 - DNA, 25 bp, Homo sapien
gaggaggtgattcgtagatcccaac

SEQ ID NO: 462780 - DNA, 25 bp, Homo sapien
aggtgattcgtagatcccaactgcc

SEQ ID NO: 462781 - DNA, 25 bp, Homo sapien
tgattcgtagatcccaactgcctat

SEQ ID NO: 462782 - DNA, 25 bp, Homo sapien
tcgtagatcccaactgcctatgtaa

SEQ ID NO: 462783 - DNA, 25 bp, Homo sapien
gatcccaactgcctatgtaatgtaa

SEQ ID NO: 462784 - DNA, 25 bp, Homo sapien
tgctatggtagcacattgtatttgt

SEQ ID NO: 462785 - DNA, 25 bp, Homo sapien
atggtagcacattgtatttgttaat

SEQ ID NO: 462786 - DNA, 25 bp, Homo sapien
caaattctaaaaggttgacaaatgt

SEQ ID NO: 462787 - DNA, 25 bp, Homo sapien
aaaaattatagacccgtgctcactt

SEQ ID NO: 462788 - DNA, 25 bp, Homo sapien
aaaattatagacccgtgctcacttc

SEQ ID NO: 462789 - DNA, 25 bp, Homo sapien
aaattatagacccgtgctcacttca

SEQ ID NO: 462790 - DNA, 25 bp, Homo sapien
aattatagacccgtgctcacttcag

SEQ ID NO: 462791 - DNA, 25 bp, Homo sapien
attatagacccgtgctcacttcagc

SEQ ID NO: 462792 - DNA, 25 bp, Homo sapien
ttatagacccgtgctcacttcagca

SEQ ID NO: 462793 - DNA, 25 bp, Homo sapien
acactaaaattggaaccttatagag

SEQ ID NO: 462794 - DNA, 25 bp, Homo sapien
cactaaaattggaaccttatagaga

SEQ ID NO: 462795 - DNA, 25 bp, Homo sapien
ctaaaattggaaccttatagagaag

SEQ ID NO: 462796 - DNA, 25 bp, Homo sapien
aaattggaaccttatagagaagatt

SEQ ID NO: 462797 - DNA, 25 bp, Homo sapien
aattggaaccttatagagaagatta

SEQ ID NO: 462798 - DNA, 25 bp, Homo sapien
aaggtggtggacaccaccaaggaga

SEQ ID NO: 462799 - DNA, 25 bp, Homo sapien
gtggacaccaccaaggagagcagca

SEQ ID NO: 462800 - DNA, 25 bp, Homo sapien
tggacaccaccaaggagagcagcag

SEQ ID NO: 462801 - DNA, 25 bp, Homo sapien
ggacaccaccaaggagagcagcagg

SEQ ID NO: 462802 - DNA, 25 bp, Homo sapien
gacaccaccaaggagagcagcagga

SEQ ID NO: 462803 - DNA, 25 bp, Homo sapien
acaccaccaaggagagcagcaggaa

SEQ ID NO: 462804 - DNA, 25 bp, Homo sapien
ccgcaagcggaagctatcgggagac

SEQ ID NO: 462805 - DNA, 25 bp, Homo sapien
gcaagcggaagctatcgggagacca

SEQ ID NO: 462806 - DNA, 25 bp, Homo sapien
caagcggaagctatcgggagaccag

SEQ ID NO: 462807 - DNA, 25 bp, Homo sapien
aagcggaagctatcgggagaccagc

SEQ ID NO: 462808 - DNA, 25 bp, Homo sapien
gcggaagctatcgggagaccagcca

SEQ ID NO: 462809 - DNA, 25 bp, Homo sapien
ggcaggtttggagcccatgggaccc

SEQ ID NO: 462810 - DNA, 25 bp, Homo sapien
cgtgggtctctgtccaggagcagca

SEQ ID NO: 462811 - DNA, 25 bp, Homo sapien
accctcccaatgcttatatgctgaa

SEQ ID NO: 462812 - DNA, 25 bp, Homo sapien
tatgctgaagctcacagaatgggct

SEQ ID NO: 462813 - DNA, 25 bp, Homo sapien
acagaatgggcttcttgcctgacag

SEQ ID NO: 462814 - DNA, 25 bp, Homo sapien
gaatgggcttcttgcctgacagcaa

SEQ ID NO: 462815 - DNA, 25 bp, Homo sapien
ggcttcttgcctgacagcaagtcaa

SEQ ID NO: 462816 - DNA, 25 bp, Homo sapien
ttgcctgacagcaagtcaaagaatg

SEQ ID NO: 462817 - DNA, 25 bp, Homo sapien
agtgtaagcttactttccatcccca

SEQ ID NO: 462818 - DNA, 25 bp, Homo sapien
gtaagcttactttccatccccaagc

SEQ ID NO: 462819 - DNA, 25 bp, Homo sapien
ccatttcccatgagcacacttctgg

SEQ ID NO: 462820 - DNA, 25 bp, Homo sapien
gatgcggtggtggttactcttctgc

SEQ ID NO: 462821 - DNA, 25 bp, Homo sapien
gtggtggttactcttctgccgatcc

SEQ ID NO: 462822 - DNA, 25 bp, Homo sapien
tgccgatcccacagccttgaaagag

SEQ ID NO: 462823 - DNA, 25 bp, Homo sapien
acagccttgaaagagccccgtggtg

SEQ ID NO: 462824 - DNA, 25 bp, Homo sapien
gggattgttcccacagtaaccatct

SEQ ID NO: 462825 - DNA, 25 bp, Homo sapien
acagtaaccatctgcgtggccttgg

SEQ ID NO: 462826 - DNA, 25 bp, Homo sapien
cagggacagagcagcaggcatcttg

SEQ ID NO: 462827 - DNA, 25 bp, Homo sapien
cagagcagcaggcatcttggatgtc

SEQ ID NO: 462828 - DNA, 25 bp, Homo sapien
ggcatcttggatgtcagagccatgt

SEQ ID NO: 462829 - DNA, 25 bp, Homo sapien
agagccatgtttttcaggccgggac

SEQ ID NO: 462830 - DNA, 25 bp, Homo sapien
aggccgggacctgagcaaaccaaag

SEQ ID NO: 462831 - DNA, 25 bp, Homo sapien
atcgtgctgttcctactcagtaaac

SEQ ID NO: 462832 - DNA, 25 bp, Homo sapien
ttcctactcagtaaacaggtgtgat

SEQ ID NO: 462833 - DNA, 25 bp, Homo sapien
aacactgtttgagaactagctttga

SEQ ID NO: 462834 - DNA, 25 bp, Homo sapien
aatttttccctttgtacatgacctg

SEQ ID NO: 462835 - DNA, 25 bp, Homo sapien
acatgacctgctgaatttcggtaca

SEQ ID NO: 462836 - DNA, 25 bp, Homo sapien
gtagctaacttattttgtcatgcac

SEQ ID NO: 462837 - DNA, 25 bp, Homo sapien
tcttgtttttccaacagtgaacatt

SEQ ID NO: 462838 - DNA, 25 bp, Homo sapien
acatttttaggcacacttttcactg

SEQ ID NO: 462839 - DNA, 25 bp, Homo sapien
cacttttcactgacgggatatctct

SEQ ID NO: 462840 - DNA, 25 bp, Homo sapien
ggatatctctttatgcaatacctca

SEQ ID NO: 462841 - DNA, 25 bp, Homo sapien
tgcaaagagtagctttttgtacttt

SEQ ID NO: 462842 - DNA, 25 bp, Homo sapien
ctttcttatgaataggggtctgcaa

SEQ ID NO: 462843 - DNA, 25 bp, Homo sapien
gggtctgcaatctattcttaaaatt

SEQ ID NO: 462844 - DNA, 25 bp, Homo sapien
aaattacatcttttgctgggcacgg

SEQ ID NO: 462845 - DNA, 25 bp, Homo sapien
attacatcttttgctgggcacggtg

SEQ ID NO: 462846 - DNA, 25 bp, Homo sapien
gactagccagagcaatattgagacc

SEQ ID NO: 462847 - DNA, 25 bp, Homo sapien
gccagagcaatattgagacccctgt

SEQ ID NO: 462848 - DNA, 25 bp, Homo sapien
agagcaatattgagacccctgtctc

SEQ ID NO: 462849 - DNA, 25 bp, Homo sapien
ctgtagtcccaactaatgtggaagg

SEQ ID NO: 462850 - DNA, 25 bp, Homo sapien
gtagtcccaactaatgtggaaggat

SEQ ID NO: 462851 - DNA, 25 bp, Homo sapien
tagtcccaactaatgtggaaggatc

SEQ ID NO: 462852 - DNA, 25 bp, Homo sapien
gtcccaactaatgtggaaggatcac

SEQ ID NO: 462853 - DNA, 25 bp, Homo sapien
aagctactgtgattgatagcattgt

SEQ ID NO: 462854 - DNA, 25 bp, Homo sapien
gatagcattgtaagaatcgggacaa

SEQ ID NO: 462855 - DNA, 25 bp, Homo sapien
gggacaatattgtattcaactgttt

SEQ ID NO: 462856 - DNA, 25 bp, Homo sapien
aaacttttagcaagtgggtgtctag

SEQ ID NO: 462857 - DNA, 25 bp, Homo sapien
tagcaagtgggtgtctagtttttac

SEQ ID NO: 462858 - DNA, 25 bp, Homo sapien
tgtctagtttttactaatccctaat

SEQ ID NO: 462859 - DNA, 25 bp, Homo sapien
tttttccagtgtattgctcatatta

SEQ ID NO: 462860 - DNA, 25 bp, Homo sapien
gtattgctcatattatcagaaggaa

SEQ ID NO: 462861 - DNA, 25 bp, Homo sapien
gtcagttaattgtactacttggctg

SEQ ID NO: 462862 - DNA, 25 bp, Homo sapien
gtactacttggctgaatttccatat

SEQ ID NO: 462863 - DNA, 25 bp, Homo sapien
ggctgaatttccatatagtttttac

SEQ ID NO: 462864 - DNA, 25 bp, Homo sapien
gaggaaccattaggagtcgctttta

SEQ ID NO: 462865 - DNA, 25 bp, Homo sapien
gagtcgcttttagggtattcagctt

SEQ ID NO: 462866 - DNA, 25 bp, Homo sapien
gggtattcagctttgttcatgaaat

SEQ ID NO: 462867 - DNA, 25 bp, Homo sapien
gaagcattaactgagctccaagggt

SEQ ID NO: 462868 - DNA, 25 bp, Homo sapien
tgggcagagagcttgctatgtgaac

SEQ ID NO: 462869 - DNA, 25 bp, Homo sapien
gcttgctatgtgaactcactcctta

SEQ ID NO: 462870 - DNA, 25 bp, Homo sapien
tgtgaactcactccttaagaaaatg

SEQ ID NO: 462871 - DNA, 25 bp, Homo sapien
gtgctagttaaaaaatcgggatgtt

SEQ ID NO: 462872 - DNA, 25 bp, Homo sapien
tcgggatgttttagtttggatttag

SEQ ID NO: 462873 - DNA, 25 bp, Homo sapien
ttagggttttgatacttatgttgaa

SEQ ID NO: 462874 - DNA, 25 bp, Homo sapien
gttgaaatactaatgtttctgatca

SEQ ID NO: 462875 - DNA, 25 bp, Homo sapien
gtgctggccacggattttgacgacg

SEQ ID NO: 462876 - DNA, 25 bp, Homo sapien
ggccacggattttgacgacgagttt

SEQ ID NO: 462877 - DNA, 25 bp, Homo sapien
tttgacgacgagtttgatgatgagg

SEQ ID NO: 462878 - DNA, 25 bp, Homo sapien
tgaggagcccctccctgccataggg

SEQ ID NO: 462879 - DNA, 25 bp, Homo sapien
gccatagggacgtgcaaagctctct

SEQ ID NO: 462880 - DNA, 25 bp, Homo sapien
gacgtgcaaagctctctacacattt

SEQ ID NO: 462881 - DNA, 25 bp, Homo sapien
agctctctacacatttgaaggtcag

SEQ ID NO: 462882 - DNA, 25 bp, Homo sapien
aaaggcgatggctggacccgcattc

SEQ ID NO: 462883 - DNA, 25 bp, Homo sapien
gatgaagagggttatgtccccactt

SEQ ID NO: 462884 - DNA, 25 bp, Homo sapien
ttatgtccccacttcatatgtcgaa

SEQ ID NO: 462885 - DNA, 25 bp, Homo sapien
catatgtcgaagtctgtttggacaa

SEQ ID NO: 462886 - DNA, 25 bp, Homo sapien
caataacagagctgtacttctaaga

SEQ ID NO: 462887 - DNA, 25 bp, Homo sapien
tgtacttctaagaggtcaagtggtt

SEQ ID NO: 462888 - DNA, 25 bp, Homo sapien
gtggtttggagttctataaagctat

SEQ ID NO: 462889 - DNA, 25 bp, Homo sapien
taaagctataaggatgggcagaacc

SEQ ID NO: 462890 - DNA, 25 bp, Homo sapien
gggcagaacctaggaaatgctgtta

SEQ ID NO: 462891 - DNA, 25 bp, Homo sapien
aaatctaatggctagtaggaacaag

SEQ ID NO: 462892 - DNA, 25 bp, Homo sapien
gatgagcttcccagttatattgaga

SEQ ID NO: 462893 - DNA, 25 bp, Homo sapien
ttgagaggtccctttccacagtaag

SEQ ID NO: 462894 - DNA, 25 bp, Homo sapien
gaggtccctttccacagtaagtagt

SEQ ID NO: 462895 - DNA, 25 bp, Homo sapien
gtccctttccacagtaagtagtagt

SEQ ID NO: 462896 - DNA, 25 bp, Homo sapien
atagagcgattacatggctgggcat

SEQ ID NO: 462897 - DNA, 25 bp, Homo sapien
atgcagaagatcgtaactggacccc

SEQ ID NO: 462898 - DNA, 25 bp, Homo sapien
cagaagatcgtaactggaccccttt

SEQ ID NO: 462899 - DNA, 25 bp, Homo sapien
tcgtaactggaccccttttactatg

SEQ ID NO: 462900 - DNA, 25 bp, Homo sapien
aaatcctgaagataacttaggcaat

SEQ ID NO: 462901 - DNA, 25 bp, Homo sapien
tgaagataacttaggcaataccatt

SEQ ID NO: 462902 - DNA, 25 bp, Homo sapien
ttctggacataggaactggcaaaga

SEQ ID NO: 462903 - DNA, 25 bp, Homo sapien
caaattggatttaagagctttttca

SEQ ID NO: 462904 - DNA, 25 bp, Homo sapien
gagctttttcatagcaaaataaaca

SEQ ID NO: 462905 - DNA, 25 bp, Homo sapien
aaaataaacaacagggcagacaatc

SEQ ID NO: 462906 - DNA, 25 bp, Homo sapien
acaacagggcagacaatctaccaaa

SEQ ID NO: 462907 - DNA, 25 bp, Homo sapien
cagggcagacaatctaccaaatgac

SEQ ID NO: 462908 - DNA, 25 bp, Homo sapien
tcaggtattgctgttagatatcccc

SEQ ID NO: 462909 - DNA, 25 bp, Homo sapien
agtccttcaatgctatcattccctt

SEQ ID NO: 462910 - DNA, 25 bp, Homo sapien
cattccctttgatattggaccatat

SEQ ID NO: 462911 - DNA, 25 bp, Homo sapien
ttccctttgatattggaccatatgc

SEQ ID NO: 462912 - DNA, 25 bp, Homo sapien
ccctttgatattggaccatatgcat

SEQ ID NO: 462913 - DNA, 25 bp, Homo sapien
tattggaccatatgcatagtaccga

SEQ ID NO: 462914 - DNA, 25 bp, Homo sapien
attggaccatatgcatagtaccgag

SEQ ID NO: 462915 - DNA, 25 bp, Homo sapien
tggaccatatgcatagtaccgagaa

SEQ ID NO: 462916 - DNA, 25 bp, Homo sapien
gaccatatgcatagtaccgagaaac

SEQ ID NO: 462917 - DNA, 25 bp, Homo sapien
catatgcatagtaccgagaaactag

SEQ ID NO: 462918 - DNA, 25 bp, Homo sapien
atcaggtattgctgttagatatccc

SEQ ID NO: 462919 - DNA, 25 bp, Homo sapien
tccttttctgtctgagcaattaaaa

SEQ ID NO: 462920 - DNA, 25 bp, Homo sapien
aaagcattaagtaaattccacaaat

SEQ ID NO: 462921 - DNA, 25 bp, Homo sapien
ccacaaattctttggaatacctaga

SEQ ID NO: 462922 - DNA, 25 bp, Homo sapien
ttctttggaatacctagagataaac

SEQ ID NO: 462923 - DNA, 25 bp, Homo sapien
agttagaatacttgcaacaaaatgc

SEQ ID NO: 462924 - DNA, 25 bp, Homo sapien
cttgcaacaaaatgcagagttttct

SEQ ID NO: 462925 - DNA, 25 bp, Homo sapien
atgaatagttcctcagttctccccc

SEQ ID NO: 462926 - DNA, 25 bp, Homo sapien
cccctttgtggaatttgtgcagtaa

SEQ ID NO: 462927 - DNA, 25 bp, Homo sapien
atttgtgcagtaaatgctgctccaa

SEQ ID NO: 462928 - DNA, 25 bp, Homo sapien
gtgcagtaaatgctgctccaaagct

SEQ ID NO: 462929 - DNA, 25 bp, Homo sapien
gctgctccaaagctctgtggaaaac

SEQ ID NO: 462930 - DNA, 25 bp, Homo sapien
gactctttagaacttggcgatgatg

SEQ ID NO: 462931 - DNA, 25 bp, Homo sapien
actctttagaacttggcgatgatgt

SEQ ID NO: 462932 - DNA, 25 bp, Homo sapien
ctctttagaacttggcgatgatgtg

SEQ ID NO: 462933 - DNA, 25 bp, Homo sapien
tctttagaacttggcgatgatgtga

SEQ ID NO: 462934 - DNA, 25 bp, Homo sapien
ttagaacttggcgatgatgtgaaaa

SEQ ID NO: 462935 - DNA, 25 bp, Homo sapien
tagaacttggcgatgatgtgaaaat

SEQ ID NO: 462936 - DNA, 25 bp, Homo sapien
agaacttggcgatgatgtgaaaatg

SEQ ID NO: 462937 - DNA, 25 bp, Homo sapien
gaacttggcgatgatgtgaaaatgt

SEQ ID NO: 462938 - DNA, 25 bp, Homo sapien
aacttggcgatgatgtgaaaatgtg

SEQ ID NO: 462939 - DNA, 25 bp, Homo sapien
cttggcgatgatgtgaaaatgtgta

SEQ ID NO: 462940 - DNA, 25 bp, Homo sapien
ttggcgatgatgtgaaaatgtgtaa

SEQ ID NO: 462941 - DNA, 25 bp, Homo sapien
acatggcaaaaatctcatcttgact

SEQ ID NO: 462942 - DNA, 25 bp, Homo sapien
cgtggtggcaggtgctgaaatccca

SEQ ID NO: 462943 - DNA, 25 bp, Homo sapien
gtggcaggtgctgaaatcccagcta

SEQ ID NO: 462944 - DNA, 25 bp, Homo sapien
caggtgctgaaatcccagctacttg

SEQ ID NO: 462945 - DNA, 25 bp, Homo sapien
tgtgccactgaacttcagtctgggt

SEQ ID NO: 462946 - DNA, 25 bp, Homo sapien
ctgaacttcagtctgggtgacagag

SEQ ID NO: 462947 - DNA, 25 bp, Homo sapien
tgaacttcagtctgggtgacagagc

SEQ ID NO: 462948 - DNA, 25 bp, Homo sapien
gaacttcagtctgggtgacagagca

SEQ ID NO: 462949 - DNA, 25 bp, Homo sapien
cagagcaaggctccagctccaaaaa

SEQ ID NO: 462950 - DNA, 25 bp, Homo sapien
agagcaaggctccagctccaaaaaa

SEQ ID NO: 462951 - DNA, 25 bp, Homo sapien
gcaaggctccagctccaaaaaaaaa

SEQ ID NO: 462952 - DNA, 25 bp, Homo sapien
acttttgaaaattcatgtgtcatta

SEQ ID NO: 462953 - DNA, 25 bp, Homo sapien
gaaaattcatgtgtcattaaagtat

SEQ ID NO: 462954 - DNA, 25 bp, Homo sapien
tcatgtgtcattaaagtataacttg

SEQ ID NO: 462955 - DNA, 25 bp, Homo sapien
gtgtcattaaagtataacttgctga

SEQ ID NO: 462956 - DNA, 25 bp, Homo sapien
aaagtataacttgctgacaaagatg

SEQ ID NO: 462957 - DNA, 25 bp, Homo sapien
agtataacttgctgacaaagatgtg

SEQ ID NO: 462958 - DNA, 25 bp, Homo sapien
taacttgctgacaaagatgtgtggc

SEQ ID NO: 462959 - DNA, 25 bp, Homo sapien
acttgctgacaaagatgtgtggcat

SEQ ID NO: 462960 - DNA, 25 bp, Homo sapien
ttgctgacaaagatgtgtggcatat

SEQ ID NO: 462961 - DNA, 25 bp, Homo sapien
gctgacaaagatgtgtggcatattt

SEQ ID NO: 462962 - DNA, 25 bp, Homo sapien
acaaagatgtgtggcatattttggc

SEQ ID NO: 462963 - DNA, 25 bp, Homo sapien
tgctcgccttgatgacttgctcttt

SEQ ID NO: 462964 - DNA, 25 bp, Homo sapien
ccttgatgacttgctcttttttggc

SEQ ID NO: 462965 - DNA, 25 bp, Homo sapien
cttttttggcagatgtgtggagttg

SEQ ID NO: 462966 - DNA, 25 bp, Homo sapien
tggagttggctgttacgacatccct

SEQ ID NO: 462967 - DNA, 25 bp, Homo sapien
gacatccctgtgtgatcccagagga

SEQ ID NO: 462968 - DNA, 25 bp, Homo sapien
gaaactgcaggcacacatttgggtg

SEQ ID NO: 462969 - DNA, 25 bp, Homo sapien
aggcacacatttgggtggatcacct

SEQ ID NO: 462970 - DNA, 25 bp, Homo sapien
tatcatagaggaccacggcgcttat

SEQ ID NO: 462971 - DNA, 25 bp, Homo sapien
acggcgcttatcagcattgtttctt

SEQ ID NO: 462972 - DNA, 25 bp, Homo sapien
gcattgtttctttggagtctgtgta

SEQ ID NO: 462973 - DNA, 25 bp, Homo sapien
gcattttctgtaacaattccttata

SEQ ID NO: 462974 - DNA, 25 bp, Homo sapien
gtagcagtctgtaacttaactatag

SEQ ID NO: 462975 - DNA, 25 bp, Homo sapien
gttttgtagattcttgtgtcactgc

SEQ ID NO: 462976 - DNA, 25 bp, Homo sapien
gtagattcttgtgtcactgcaaaca

SEQ ID NO: 462977 - DNA, 25 bp, Homo sapien
cactgcaaacaatatgaactccttt

SEQ ID NO: 462978 - DNA, 25 bp, Homo sapien
tgaactcctttttcgtattgccatc

SEQ ID NO: 462979 - DNA, 25 bp, Homo sapien
ttttcgtattgccatcgggttgcat

SEQ ID NO: 462980 - DNA, 25 bp, Homo sapien
attgccatcgggttgcatggaagtt

SEQ ID NO: 462981 - DNA, 25 bp, Homo sapien
ggttgcatggaagttttattctctt

SEQ ID NO: 462982 - DNA, 25 bp, Homo sapien
gaaaccaagaggatccaaacttcct

SEQ ID NO: 462983 - DNA, 25 bp, Homo sapien
ggatccaaacttcctgcaacatttt

SEQ ID NO: 462984 - DNA, 25 bp, Homo sapien
aacttcctgcaacattttcttagag

SEQ ID NO: 462985 - DNA, 25 bp, Homo sapien
gaacctagaaacttagaggtcaact

SEQ ID NO: 462986 - DNA, 25 bp, Homo sapien
ttagaggtcaactaaggagacaggc

SEQ ID NO: 462987 - DNA, 25 bp, Homo sapien
agaggtcaactaaggagacaggcat

SEQ ID NO: 462988 - DNA, 25 bp, Homo sapien
gaggtcaactaaggagacaggcatt

SEQ ID NO: 462989 - DNA, 25 bp, Homo sapien
aggtcaactaaggagacaggcattt

SEQ ID NO: 462990 - DNA, 25 bp, Homo sapien
ggtcaactaaggagacaggcatttt

SEQ ID NO: 462991 - DNA, 25 bp, Homo sapien
gtcaactaaggagacaggcattttt

SEQ ID NO: 462992 - DNA, 25 bp, Homo sapien
tcaactaaggagacaggcattttta

SEQ ID NO: 462993 - DNA, 25 bp, Homo sapien
caactaaggagacaggcatttttat

SEQ ID NO: 462994 - DNA, 25 bp, Homo sapien
aactaaggagacaggcatttttata

SEQ ID NO: 462995 - DNA, 25 bp, Homo sapien
actaaggagacaggcatttttataa

SEQ ID NO: 462996 - DNA, 25 bp, Homo sapien
gatgtaatcatggttggatggactc

SEQ ID NO: 462997 - DNA, 25 bp, Homo sapien
gagtttatctgggtagagtgtccaa

SEQ ID NO: 462998 - DNA, 25 bp, Homo sapien
gagtgtccaaagcattcactggagt

SEQ ID NO: 462999 - DNA, 25 bp, Homo sapien
tcactggagtctcaagggaatccat

SEQ ID NO: 463000 - DNA, 25 bp, Homo sapien
tcaagggaatccatggtccccaaga

SEQ ID NO: 463001 - DNA, 25 bp, Homo sapien
gacactattgtacgttcaggttcct

SEQ ID NO: 463002 - DNA, 25 bp, Homo sapien
tacgttcaggttcctttctagtaat

SEQ ID NO: 463003 - DNA, 25 bp, Homo sapien
aagtgtctgtaggtcagttcttcta

SEQ ID NO: 463004 - DNA, 25 bp, Homo sapien
ggtcagttcttctaaggacttctag

SEQ ID NO: 463005 - DNA, 25 bp, Homo sapien
tagtgatagtggtacaacaaagtga

SEQ ID NO: 463006 - DNA, 25 bp, Homo sapien
gtgaaggtacttaactgtacactta

SEQ ID NO: 463007 - DNA, 25 bp, Homo sapien
gtttatggttctaacccttgcttgt

SEQ ID NO: 463008 - DNA, 25 bp, Homo sapien
gaaatcattatgcaaagaacaactg

SEQ ID NO: 463009 - DNA, 25 bp, Homo sapien
gcattctttttaatgtctgcatgga

SEQ ID NO: 463010 - DNA, 25 bp, Homo sapien
gtacaataatcagttccctctggtt

SEQ ID NO: 463011 - DNA, 25 bp, Homo sapien
taatcagttccctctggttggacat

SEQ ID NO: 463012 - DNA, 25 bp, Homo sapien
ctggttggacatttttgttatttct

SEQ ID NO: 463013 - DNA, 25 bp, Homo sapien
aacgatatagccttaaacacacttg

SEQ ID NO: 463014 - DNA, 25 bp, Homo sapien
ttaaacacacttgttctcagatatt

SEQ ID NO: 463015 - DNA, 25 bp, Homo sapien
atggacaagtgtttctgagggtagt

SEQ ID NO: 463016 - DNA, 25 bp, Homo sapien
gtgtttctgagggtagtcaccagga

SEQ ID NO: 463017 - DNA, 25 bp, Homo sapien
gtagtcaccaggaagggaaatgatt

SEQ ID NO: 463018 - DNA, 25 bp, Homo sapien
aggaaaagatttcccctgctcgagt

SEQ ID NO: 463019 - DNA, 25 bp, Homo sapien
cagaactgttgagtagctgatgcaa

SEQ ID NO: 463020 - DNA, 25 bp, Homo sapien
gtagctgatgcaatttcatccataa

SEQ ID NO: 463021 - DNA, 25 bp, Homo sapien
ggattcaccattgattcagcatctg

SEQ ID NO: 463022 - DNA, 25 bp, Homo sapien
agcatctgatcctcagcactgtata

SEQ ID NO: 463023 - DNA, 25 bp, Homo sapien
tcagcactgtatatctaagaactca

SEQ ID NO: 463024 - DNA, 25 bp, Homo sapien
attctccttggttcatcaggcatga

SEQ ID NO: 463025 - DNA, 25 bp, Homo sapien
aaggattcatacacactgacctaac

SEQ ID NO: 463026 - DNA, 25 bp, Homo sapien
acactgacctaactcacaggagaga

SEQ ID NO: 463027 - DNA, 25 bp, Homo sapien
caccaatttattgccttgttcatgg

SEQ ID NO: 463028 - DNA, 25 bp, Homo sapien
gaaacactacatgtgtcagcttact

SEQ ID NO: 463029 - DNA, 25 bp, Homo sapien
aatgctttcaagaataccgagtatt

SEQ ID NO: 463030 - DNA, 25 bp, Homo sapien
atgctttcaagaataccgagtattt

SEQ ID NO: 463031 - DNA, 25 bp, Homo sapien
tgctttcaagaataccgagtatttg

SEQ ID NO: 463032 - DNA, 25 bp, Homo sapien
gctttcaagaataccgagtatttgg

SEQ ID NO: 463033 - DNA, 25 bp, Homo sapien
ctttcaagaataccgagtatttggc

SEQ ID NO: 463034 - DNA, 25 bp, Homo sapien
tttcaagaataccgagtatttggcc

SEQ ID NO: 463035 - DNA, 25 bp, Homo sapien
ttcaagaataccgagtatttggcca

SEQ ID NO: 463036 - DNA, 25 bp, Homo sapien
tcaagaataccgagtatttggccag

SEQ ID NO: 463037 - DNA, 25 bp, Homo sapien
caagaataccgagtatttggccagg

SEQ ID NO: 463038 - DNA, 25 bp, Homo sapien
aagaataccgagtatttggccaggt

SEQ ID NO: 463039 - DNA, 25 bp, Homo sapien
caagttataaaggaggacatggatt

SEQ ID NO: 463040 - DNA, 25 bp, Homo sapien
ggattaatggtatacttctaggcta

SEQ ID NO: 463041 - DNA, 25 bp, Homo sapien
aatggtatacttctaggctataggg

SEQ ID NO: 463042 - DNA, 25 bp, Homo sapien
gtacaagtggaaggacaccatctta

SEQ ID NO: 463043 - DNA, 25 bp, Homo sapien
cttagcatcagatcactttctgagc

SEQ ID NO: 463044 - DNA, 25 bp, Homo sapien
gatcactttctgagcaactttggca

SEQ ID NO: 463045 - DNA, 25 bp, Homo sapien
tcactttctgagcaactttggcaaa

SEQ ID NO: 463046 - DNA, 25 bp, Homo sapien
gcaactttggcaaatcttttaaatt

SEQ ID NO: 463047 - DNA, 25 bp, Homo sapien
gtgaatgtatgtgaaagccaatgct

SEQ ID NO: 463048 - DNA, 25 bp, Homo sapien
aaagccaatgctgactgggcacggg

SEQ ID NO: 463049 - DNA, 25 bp, Homo sapien
gagccggggatatcacttgagccca

SEQ ID NO: 463050 - DNA, 25 bp, Homo sapien
acccaccaaggctccggatgtgttc

SEQ ID NO: 463051 - DNA, 25 bp, Homo sapien
ggatgtgttccccatcatatcaggg

SEQ ID NO: 463052 - DNA, 25 bp, Homo sapien
gttccccatcatatcagggtgcaga

SEQ ID NO: 463053 - DNA, 25 bp, Homo sapien
tcatatcagggtgcagacacccaaa

SEQ ID NO: 463054 - DNA, 25 bp, Homo sapien
gacacccaaaggataacagccctgt

SEQ ID NO: 463055 - DNA, 25 bp, Homo sapien
ctgtggtcctggcatgcttgataac

SEQ ID NO: 463056 - DNA, 25 bp, Homo sapien
tcctggcatgcttgataactgggta

SEQ ID NO: 463057 - DNA, 25 bp, Homo sapien
tgataactgggtaccacccaacgtc

SEQ ID NO: 463058 - DNA, 25 bp, Homo sapien
ggtaccacccaacgtccgtgactgt

SEQ ID NO: 463059 - DNA, 25 bp, Homo sapien
ccgtgactgtcacctggtacatggg

SEQ ID NO: 463060 - DNA, 25 bp, Homo sapien
cttccctgagatacaaagacgggac

SEQ ID NO: 463061 - DNA, 25 bp, Homo sapien
taattacttacttattacctagatt

SEQ ID NO: 463062 - DNA, 25 bp, Homo sapien
gacaatccaaagtctccccttcgtg

SEQ ID NO: 463063 - DNA, 25 bp, Homo sapien
aatccaaagtctccccttcgtgttg

SEQ ID NO: 463064 - DNA, 25 bp, Homo sapien
cttcgtgttgccatcatcttgttga

SEQ ID NO: 463065 - DNA, 25 bp, Homo sapien
tcgtgttgccatcatcttgttgaat

SEQ ID NO: 463066 - DNA, 25 bp, Homo sapien
gttgccatcatcttgttgaatcagc

SEQ ID NO: 463067 - DNA, 25 bp, Homo sapien
gccatcatcttgttgaatcagccat

SEQ ID NO: 463068 - DNA, 25 bp, Homo sapien
atcatcttgttgaatcagccatttt

SEQ ID NO: 463069 - DNA, 25 bp, Homo sapien
gaatcagccattttatcgaggcacg

SEQ ID NO: 463070 - DNA, 25 bp, Homo sapien
agccattttatcgaggcacgtgatc

SEQ ID NO: 463071 - DNA, 25 bp, Homo sapien
ttatcgaggcacgtgatcagtgttg

SEQ ID NO: 463072 - DNA, 25 bp, Homo sapien
tttgaaaaggtgctcaagctctgac

SEQ ID NO: 463073 - DNA, 25 bp, Homo sapien
aggtgctcaagctctgacatttttg

SEQ ID NO: 463074 - DNA, 25 bp, Homo sapien
caagctctgacatttttggttttca

SEQ ID NO: 463075 - DNA, 25 bp, Homo sapien
acatttttggttttcatagtcgtga

SEQ ID NO: 463076 - DNA, 25 bp, Homo sapien
agtcgtgaagtatttatcatttgca

SEQ ID NO: 463077 - DNA, 25 bp, Homo sapien
atcatttgcatgactaatggcacag

SEQ ID NO: 463078 - DNA, 25 bp, Homo sapien
tttgcatgactaatggcacaggaaa

SEQ ID NO: 463079 - DNA, 25 bp, Homo sapien
ggcacaggaaaaacctattcataag

SEQ ID NO: 463080 - DNA, 25 bp, Homo sapien
gggtcttcagctaacttagttatac

SEQ ID NO: 463081 - DNA, 25 bp, Homo sapien
aaagattatcttgagctgggccttg

SEQ ID NO: 463082 - DNA, 25 bp, Homo sapien
ttatcttgagctgggccttgggaga

SEQ ID NO: 463083 - DNA, 25 bp, Homo sapien
agcacaagctgtttctacctctcag

SEQ ID NO: 463084 - DNA, 25 bp, Homo sapien
aagctgtttctacctctcagaggca

SEQ ID NO: 463085 - DNA, 25 bp, Homo sapien
gtttctacctctcagaggcattgaa

SEQ ID NO: 463086 - DNA, 25 bp, Homo sapien
attgcatgctataaactgctttgtg

SEQ ID NO: 463087 - DNA, 25 bp, Homo sapien
aactgctttgtgtatctgttaccac

SEQ ID NO: 463088 - DNA, 25 bp, Homo sapien
tttgtgtatctgttaccacctctca

SEQ ID NO: 463089 - DNA, 25 bp, Homo sapien
atctgttaccacctctcacttgaga

SEQ ID NO: 463090 - DNA, 25 bp, Homo sapien
tgttaccacctctcacttgagacat

SEQ ID NO: 463091 - DNA, 25 bp, Homo sapien
tcacttgagacatcactcactggta

SEQ ID NO: 463092 - DNA, 25 bp, Homo sapien
gagacatcactcactggtaaaatgt

SEQ ID NO: 463093 - DNA, 25 bp, Homo sapien
atcactcactggtaaaatgttttat

SEQ ID NO: 463094 - DNA, 25 bp, Homo sapien
aaactgagcaaggatttgttggaca

SEQ ID NO: 463095 - DNA, 25 bp, Homo sapien
gcaaggatttgttggacaggacaca

SEQ ID NO: 463096 - DNA, 25 bp, Homo sapien
gatttgttggacaggacacagcact

SEQ ID NO: 463097 - DNA, 25 bp, Homo sapien
gttggacaggacacagcactaatct

SEQ ID NO: 463098 - DNA, 25 bp, Homo sapien
gacaggacacagcactaatctcaaa

SEQ ID NO: 463099 - DNA, 25 bp, Homo sapien
ggacacagcactaatctcaaaagaa

SEQ ID NO: 463100 - DNA, 25 bp, Homo sapien
ataggtcttattcatagtttttgct

SEQ ID NO: 463101 - DNA, 25 bp, Homo sapien
gaaattcccagcatttacaagggat

SEQ ID NO: 463102 - DNA, 25 bp, Homo sapien
cccagcatttacaagggattaaaga

SEQ ID NO: 463103 - DNA, 25 bp, Homo sapien
caagggattaaagatgtgtatcaga

SEQ ID NO: 463104 - DNA, 25 bp, Homo sapien
aggatcatttaaagctaggagttca

SEQ ID NO: 463105 - DNA, 25 bp, Homo sapien
tttttgtgtggacagggtctcgctt

SEQ ID NO: 463106 - DNA, 25 bp, Homo sapien
aattattctttgttaggatacagaa

SEQ ID NO: 463107 - DNA, 25 bp, Homo sapien
aatgctttgtgtcctgcaatactgt

SEQ ID NO: 463108 - DNA, 25 bp, Homo sapien
atgctttgtgtcctgcaatactgtt

SEQ ID NO: 463109 - DNA, 25 bp, Homo sapien
gctttgtgtcctgcaatactgttaa

SEQ ID NO: 463110 - DNA, 25 bp, Homo sapien
gtgtcctgcaatactgttaaatctc

SEQ ID NO: 463111 - DNA, 25 bp, Homo sapien
gtcctgcaatactgttaaatctcct

SEQ ID NO: 463112 - DNA, 25 bp, Homo sapien
ctgcaatactgttaaatctccttat

SEQ ID NO: 463113 - DNA, 25 bp, Homo sapien
aaatctccttattagttttagcagc

SEQ ID NO: 463114 - DNA, 25 bp, Homo sapien
atctccttattagttttagcagctt

SEQ ID NO: 463115 - DNA, 25 bp, Homo sapien
tccttattagttttagcagcttttt

SEQ ID NO: 463116 - DNA, 25 bp, Homo sapien
agtgacgttcatgctaagtgttttt

SEQ ID NO: 463117 - DNA, 25 bp, Homo sapien
tggtttcatgtttcttattggctct

SEQ ID NO: 463118 - DNA, 25 bp, Homo sapien
tttcttattggctctgcctcctgtg

SEQ ID NO: 463119 - DNA, 25 bp, Homo sapien
cctcctgtgcttatatcatccaaaa

SEQ ID NO: 463120 - DNA, 25 bp, Homo sapien
gagcacctttaaaacgttcgtatgt

SEQ ID NO: 463121 - DNA, 25 bp, Homo sapien
gcactaattctaaactttggaggca

SEQ ID NO: 463122 - DNA, 25 bp, Homo sapien
gcattttgctgtgtgaggccgatcg

SEQ ID NO: 463123 - DNA, 25 bp, Homo sapien
ctgtgtgaggccgatcgccactgta

SEQ ID NO: 463124 - DNA, 25 bp, Homo sapien
tcgccactgtaaaggtcctagagtt

SEQ ID NO: 463125 - DNA, 25 bp, Homo sapien
aaggtcctagagttgcctgtttgtc

SEQ ID NO: 463126 - DNA, 25 bp, Homo sapien
agttgcctgtttgtctctggagatg

SEQ ID NO: 463127 - DNA, 25 bp, Homo sapien
ggaggcccaaaagcgacatggcaaa

SEQ ID NO: 463128 - DNA, 25 bp, Homo sapien
agcgacatggcaaaccaccgggcag

SEQ ID NO: 463129 - DNA, 25 bp, Homo sapien
ggactcgctctttgttgcttcccaa

SEQ ID NO: 463130 - DNA, 25 bp, Homo sapien
tctttgttgcttcccaaacacttag

SEQ ID NO: 463131 - DNA, 25 bp, Homo sapien
caaacacttagacgccagcagcatg

SEQ ID NO: 463132 - DNA, 25 bp, Homo sapien
gtgtgctgggctggttaaggccgat

SEQ ID NO: 463133 - DNA, 25 bp, Homo sapien
gtggagcagagccaacctgcaaaat

SEQ ID NO: 463134 - DNA, 25 bp, Homo sapien
aaatccacttcctcagcatcagatc

SEQ ID NO: 463135 - DNA, 25 bp, Homo sapien
gcatcagatctcttgataaaagcat

SEQ ID NO: 463136 - DNA, 25 bp, Homo sapien
aaagcatgaacctgcatgtaaggaa

SEQ ID NO: 463137 - DNA, 25 bp, Homo sapien
atccaagagtttcaggtctagagct

SEQ ID NO: 463138 - DNA, 25 bp, Homo sapien
cttccttacactatattttggctgc

SEQ ID NO: 463139 - DNA, 25 bp, Homo sapien
ttttggctgcacacatgtctttaac

SEQ ID NO: 463140 - DNA, 25 bp, Homo sapien
tgcacacatgtctttaacccaggag

SEQ ID NO: 463141 - DNA, 25 bp, Homo sapien
ggaggactaaggtaatcaatttgca

SEQ ID NO: 463142 - DNA, 25 bp, Homo sapien
ttttttcttcagtggtgacttcctt

SEQ ID NO: 463143 - DNA, 25 bp, Homo sapien
ttttttcattcttcccggtcctctg

SEQ ID NO: 463144 - DNA, 25 bp, Homo sapien
tctgccctgatctgtgtaactctta

SEQ ID NO: 463145 - DNA, 25 bp, Homo sapien
atctgtgtaactcttatcttgggta

SEQ ID NO: 463146 - DNA, 25 bp, Homo sapien
tcttatcttgggtacttgagcagac

SEQ ID NO: 463147 - DNA, 25 bp, Homo sapien
gtacttgagcagacggtatattcca

SEQ ID NO: 463148 - DNA, 25 bp, Homo sapien
cagacggtatattccagaggtggga

SEQ ID NO: 463149 - DNA, 25 bp, Homo sapien
agctatgtaacagaggagagatttt

SEQ ID NO: 463150 - DNA, 25 bp, Homo sapien
gaggagagattttagctgacagtaa

SEQ ID NO: 463151 - DNA, 25 bp, Homo sapien
tagctgacagtaagcatggaatgat

SEQ ID NO: 463152 - DNA, 25 bp, Homo sapien
agctgacagtaagcatggaatgatt

SEQ ID NO: 463153 - DNA, 25 bp, Homo sapien
gacagtaagcatggaatgatttgga

SEQ ID NO: 463154 - DNA, 25 bp, Homo sapien
agcatggaatgatttggaagaaaaa

SEQ ID NO: 463155 - DNA, 25 bp, Homo sapien
aaagaaaagccttggccaggcactg

SEQ ID NO: 463156 - DNA, 25 bp, Homo sapien
aagaaaagccttggccaggcactgg

SEQ ID NO: 463157 - DNA, 25 bp, Homo sapien
agaaaagccttggccaggcactggg

SEQ ID NO: 463158 - DNA, 25 bp, Homo sapien
tggtggtgtgcacctcttttcccag

SEQ ID NO: 463159 - DNA, 25 bp, Homo sapien
tgcacctcttttcccagctgcttgg

SEQ ID NO: 463160 - DNA, 25 bp, Homo sapien
aacaacaatgtccttattatgatga

SEQ ID NO: 463161 - DNA, 25 bp, Homo sapien
tatgatgaccatctcgtagtggtac

SEQ ID NO: 463162 - DNA, 25 bp, Homo sapien
ctcgtagtggtacattccattccta

SEQ ID NO: 463163 - DNA, 25 bp, Homo sapien
tcgactgtccgagaaaagttgtgta

SEQ ID NO: 463164 - DNA, 25 bp, Homo sapien
aaagttgtgtaagcgcctgcgttct

SEQ ID NO: 463165 - DNA, 25 bp, Homo sapien
ctgcgttcttctgggtttggctaga

SEQ ID NO: 463166 - DNA, 25 bp, Homo sapien
gtttggctagatagggttgtgtccc

SEQ ID NO: 463167 - DNA, 25 bp, Homo sapien
gatagggttgtgtccctctatggaa

SEQ ID NO: 463168 - DNA, 25 bp, Homo sapien
tttctcgcacaatacaactcactga

SEQ ID NO: 463169 - DNA, 25 bp, Homo sapien
aactcactgaggatgcttctgtaga

SEQ ID NO: 463170 - DNA, 25 bp, Homo sapien
gagaaacacgatgagtacattcaga

SEQ ID NO: 463171 - DNA, 25 bp, Homo sapien
tgcttcatatattggatgcatacaa

SEQ ID NO: 463172 - DNA, 25 bp, Homo sapien
gatgcatacaaatttcgactgttgt

SEQ ID NO: 463173 - DNA, 25 bp, Homo sapien
ttcgactgttgtgttgtccttgaca

SEQ ID NO: 463174 - DNA, 25 bp, Homo sapien
gttgtccttgacaataagactttta

SEQ ID NO: 463175 - DNA, 25 bp, Homo sapien
atatgcagtgtacattttggcttaa

SEQ ID NO: 463176 - DNA, 25 bp, Homo sapien
tggcttaagtatattttgtctgata

SEQ ID NO: 463177 - DNA, 25 bp, Homo sapien
ccagtctagccttttgatgtctact

SEQ ID NO: 463178 - DNA, 25 bp, Homo sapien
gatgtctactgtttgcatggtgtat

SEQ ID NO: 463179 - DNA, 25 bp, Homo sapien
ttttccacccattttctttcaacat

SEQ ID NO: 463180 - DNA, 25 bp, Homo sapien
tccacccattttctttcaacatatt

SEQ ID NO: 463181 - DNA, 25 bp, Homo sapien
atttgtcaatatatttgctggttct

SEQ ID NO: 463182 - DNA, 25 bp, Homo sapien
ttcaaccttggagaaaatgaccaga

SEQ ID NO: 463183 - DNA, 25 bp, Homo sapien
aaatgaccagatcactttactgctt

SEQ ID NO: 463184 - DNA, 25 bp, Homo sapien
gaccagatcactttactgcttatat

SEQ ID NO: 463185 - DNA, 25 bp, Homo sapien
gatcactttactgcttatatcttca

SEQ ID NO: 463186 - DNA, 25 bp, Homo sapien
gtattagaaaaactgcatgtatgat

SEQ ID NO: 463187 - DNA, 25 bp, Homo sapien
ctttttataaagctaacattcagaa

SEQ ID NO: 463188 - DNA, 25 bp, Homo sapien
taaaatgcaataacatctttccttt

SEQ ID NO: 463189 - DNA, 25 bp, Homo sapien
gtgcattaaattcccttctaattct

SEQ ID NO: 463190 - DNA, 25 bp, Homo sapien
ttcccttctaattctaaaattgaca

SEQ ID NO: 463191 - DNA, 25 bp, Homo sapien
atttgtatcttgcttaggatttaac

SEQ ID NO: 463192 - DNA, 25 bp, Homo sapien
cttgcttaggatttaacattgttaa

SEQ ID NO: 463193 - DNA, 25 bp, Homo sapien
ttgagggtgtcccattctcaactct

SEQ ID NO: 463194 - DNA, 25 bp, Homo sapien
agggtgtcccattctcaactctaat

SEQ ID NO: 463195 - DNA, 25 bp, Homo sapien
tgtcccattctcaactctaatccat

SEQ ID NO: 463196 - DNA, 25 bp, Homo sapien
tgcccctctcggcagggaacaggaa

SEQ ID NO: 463197 - DNA, 25 bp, Homo sapien
cccctctcggcagggaacaggaagt

SEQ ID NO: 463198 - DNA, 25 bp, Homo sapien
gggaaccctaaccctgagctcagtc

SEQ ID NO: 463199 - DNA, 25 bp, Homo sapien
tgagctcagtccagttcacccctca

SEQ ID NO: 463200 - DNA, 25 bp, Homo sapien
cctcaggacggctggagcctggagg

SEQ ID NO: 463201 - DNA, 25 bp, Homo sapien
cccggcaggcttggtggactctgct

SEQ ID NO: 463202 - DNA, 25 bp, Homo sapien
cttggtggactctgctggcagcaaa

SEQ ID NO: 463203 - DNA, 25 bp, Homo sapien
ggtggactctgctggcagcaaataa

SEQ ID NO: 463204 - DNA, 25 bp, Homo sapien
gtggggtatgattatcaccaagcca

SEQ ID NO: 463205 - DNA, 25 bp, Homo sapien
ggggtatgattatcaccaagccaaa

SEQ ID NO: 463206 - DNA, 25 bp, Homo sapien
tcaccaagccaaacatcatcatgga

SEQ ID NO: 463207 - DNA, 25 bp, Homo sapien
accaagccaaacatcatcatggagt

SEQ ID NO: 463208 - DNA, 25 bp, Homo sapien
ccaagccaaacatcatcatggagtg

SEQ ID NO: 463209 - DNA, 25 bp, Homo sapien
caagccaaacatcatcatggagtgg

SEQ ID NO: 463210 - DNA, 25 bp, Homo sapien
aagccaaacatcatcatggagtgga

SEQ ID NO: 463211 - DNA, 25 bp, Homo sapien
agccaaacatcatcatggagtggag

SEQ ID NO: 463212 - DNA, 25 bp, Homo sapien
gccaaacatcatcatggagtggagg

SEQ ID NO: 463213 - DNA, 25 bp, Homo sapien
caaacatcatcatggagtggaggtg

SEQ ID NO: 463214 - DNA, 25 bp, Homo sapien
aaacatcatcatggagtggaggtga

SEQ ID NO: 463215 - DNA, 25 bp, Homo sapien
tactttcttatgaataggggtctgc

SEQ ID NO: 463216 - DNA, 25 bp, Homo sapien
actttcttatgaataggggtctgca

SEQ ID NO: 463217 - DNA, 25 bp, Homo sapien
ctttcttatgaataggggtctgcaa

SEQ ID NO: 463218 - DNA, 25 bp, Homo sapien
ttcttatgaataggggtctgcaatc

SEQ ID NO: 463219 - DNA, 25 bp, Homo sapien
aataggggtctgcaatctattctta

SEQ ID NO: 463220 - DNA, 25 bp, Homo sapien
ataggggtctgcaatctattcttaa

SEQ ID NO: 463221 - DNA, 25 bp, Homo sapien
taggggtctgcaatctattcttaaa

SEQ ID NO: 463222 - DNA, 25 bp, Homo sapien
aggggtctgcaatctattcttaaaa

SEQ ID NO: 463223 - DNA, 25 bp, Homo sapien
ggggtctgcaatctattcttaaaat

SEQ ID NO: 463224 - DNA, 25 bp, Homo sapien
gggtctgcaatctattcttaaaatt

SEQ ID NO: 463225 - DNA, 25 bp, Homo sapien
gactagccagagcaatattgagacc

SEQ ID NO: 463226 - DNA, 25 bp, Homo sapien
ccgtactctgacagctgtgcacgat

SEQ ID NO: 463227 - DNA, 25 bp, Homo sapien
cgtactctgacagctgtgcacgatg

SEQ ID NO: 463228 - DNA, 25 bp, Homo sapien
gggcaagagaatccgcgtcaaacta

SEQ ID NO: 463229 - DNA, 25 bp, Homo sapien
agagaatccgcgtcaaactagatgg

SEQ ID NO: 463230 - DNA, 25 bp, Homo sapien
gagaatccgcgtcaaactagatggc

SEQ ID NO: 463231 - DNA, 25 bp, Homo sapien
agaatccgcgtcaaactagatggca

SEQ ID NO: 463232 - DNA, 25 bp, Homo sapien
gaatccgcgtcaaactagatggcag

SEQ ID NO: 463233 - DNA, 25 bp, Homo sapien
aatccgcgtcaaactagatggcagc

SEQ ID NO: 463234 - DNA, 25 bp, Homo sapien
tccgcgtcaaactagatggcagccg

SEQ ID NO: 463235 - DNA, 25 bp, Homo sapien
gcgtcaaactagatggcagccggct

SEQ ID NO: 463236 - DNA, 25 bp, Homo sapien
cgtcaaactagatggcagccggctc

SEQ ID NO: 463237 - DNA, 25 bp, Homo sapien
gaaaaacaagtctccatcaaaggta

SEQ ID NO: 463238 - DNA, 25 bp, Homo sapien
agtctccatcaaaggtaataaccac

SEQ ID NO: 463239 - DNA, 25 bp, Homo sapien
gagaactatacatagctatgtgctt

SEQ ID NO: 463240 - DNA, 25 bp, Homo sapien
gctatgtgcttataggtcttagttc

SEQ ID NO: 463241 - DNA, 25 bp, Homo sapien
tcttagttcacattcccctcattaa

SEQ ID NO: 463242 - DNA, 25 bp, Homo sapien
agggctgtttaatgacttgggtata

SEQ ID NO: 463243 - DNA, 25 bp, Homo sapien
tgctaaaatctatccaaattggtat

SEQ ID NO: 463244 - DNA, 25 bp, Homo sapien
aattggtattacctcaaaccataat

SEQ ID NO: 463245 - DNA, 25 bp, Homo sapien
tttattgccatgtatttttcccact

SEQ ID NO: 463246 - DNA, 25 bp, Homo sapien
tttcccactgatgttcacaaattca

SEQ ID NO: 463247 - DNA, 25 bp, Homo sapien
actgatgttcacaaattcacaggaa

SEQ ID NO: 463248 - DNA, 25 bp, Homo sapien
agtatatgctttgattttataggct

SEQ ID NO: 463249 - DNA, 25 bp, Homo sapien
actaaaatgtatctgtcgttgctaa

SEQ ID NO: 463250 - DNA, 25 bp, Homo sapien
aaatgtatctgtcgttgctaacttg

SEQ ID NO: 463251 - DNA, 25 bp, Homo sapien
tgtatctgtcgttgctaacttgaaa

SEQ ID NO: 463252 - DNA, 25 bp, Homo sapien
agaagttattcaagtgcacactctt

SEQ ID NO: 463253 - DNA, 25 bp, Homo sapien
tcaagtgcacactcttttctaaaag

SEQ ID NO: 463254 - DNA, 25 bp, Homo sapien
gaaagccaatgactataaggcaaaa

SEQ ID NO: 463255 - DNA, 25 bp, Homo sapien
gaagtttgactgcatgtggtatttt

SEQ ID NO: 463256 - DNA, 25 bp, Homo sapien
catgtggtattttttgctcttgtat

SEQ ID NO: 463257 - DNA, 25 bp, Homo sapien
ttttgctcttgtatatgctttttga

SEQ ID NO: 463258 - DNA, 25 bp, Homo sapien
gaacaagctatttgataaagcctga

SEQ ID NO: 463259 - DNA, 25 bp, Homo sapien
tcagctattagtgggagtgcaggta

SEQ ID NO: 463260 - DNA, 25 bp, Homo sapien
agctattagtgggagtgcaggtacc

SEQ ID NO: 463261 - DNA, 25 bp, Homo sapien
gctattagtgggagtgcaggtacca

SEQ ID NO: 463262 - DNA, 25 bp, Homo sapien
attagtgggagtgcaggtaccacat

SEQ ID NO: 463263 - DNA, 25 bp, Homo sapien
tagtgggagtgcaggtaccacatac

SEQ ID NO: 463264 - DNA, 25 bp, Homo sapien
tgggagtgcaggtaccacatactac

SEQ ID NO: 463265 - DNA, 25 bp, Homo sapien
gggagtgcaggtaccacatactacg

SEQ ID NO: 463266 - DNA, 25 bp, Homo sapien
ggagtgcaggtaccacatactacgc

SEQ ID NO: 463267 - DNA, 25 bp, Homo sapien
gagtgcaggtaccacatactacgca

SEQ ID NO: 463268 - DNA, 25 bp, Homo sapien
agtgcaggtaccacatactacgcag

SEQ ID NO: 463269 - DNA, 25 bp, Homo sapien
gtgcaggtaccacatactacgcaga

SEQ ID NO: 463270 - DNA, 25 bp, Homo sapien
atagttttgtacttttctaccatgt

SEQ ID NO: 463271 - DNA, 25 bp, Homo sapien
gtacttttctaccatgtaaatgtgc

SEQ ID NO: 463272 - DNA, 25 bp, Homo sapien
ttctaccatgtaaatgtgcaatgta

SEQ ID NO: 463273 - DNA, 25 bp, Homo sapien
cacattcaaccttttgttaggtgtt

SEQ ID NO: 463274 - DNA, 25 bp, Homo sapien
aggtgtttcctttaagctactcagc

SEQ ID NO: 463275 - DNA, 25 bp, Homo sapien
ttcctttaagctactcagctgtacc

SEQ ID NO: 463276 - DNA, 25 bp, Homo sapien
gttctttttcaaccagtatatcact

SEQ ID NO: 463277 - DNA, 25 bp, Homo sapien
gttatatcaaagctttatcagttca

SEQ ID NO: 463278 - DNA, 25 bp, Homo sapien
gctttatcagttcaagtttcttgct

SEQ ID NO: 463279 - DNA, 25 bp, Homo sapien
tcaagtttcttgcttttcataatac

SEQ ID NO: 463280 - DNA, 25 bp, Homo sapien
cataatacttttttctgatgcaatt

SEQ ID NO: 463281 - DNA, 25 bp, Homo sapien
taaacagtcacccttcccttttgca

SEQ ID NO: 463282 - DNA, 25 bp, Homo sapien
taagtgtatacataaaaccctgggt

SEQ ID NO: 463283 - DNA, 25 bp, Homo sapien
aaaccctgggtacatattgttgtgg

SEQ ID NO: 463284 - DNA, 25 bp, Homo sapien
acagtacacttgtttatggaacttt

SEQ ID NO: 463285 - DNA, 25 bp, Homo sapien
tatggaactttctgtggccacctac

SEQ ID NO: 463286 - DNA, 25 bp, Homo sapien
gtggccacctacgaaagacaagtta

SEQ ID NO: 463287 - DNA, 25 bp, Homo sapien
ctgtcatggaggctgttgttgccca

SEQ ID NO: 463288 - DNA, 25 bp, Homo sapien
gccgctgcattttgacaacatttcc

SEQ ID NO: 463289 - DNA, 25 bp, Homo sapien
attttgacaacatttccaccctggc

SEQ ID NO: 463290 - DNA, 25 bp, Homo sapien
tggccactcagcacatttcatggag

SEQ ID NO: 463291 - DNA, 25 bp, Homo sapien
ggaggtcatgtcttttcactgatac

SEQ ID NO: 463292 - DNA, 25 bp, Homo sapien
gacagccactaagtgagcttcagag

SEQ ID NO: 463293 - DNA, 25 bp, Homo sapien
actaagtgagcttcagagccttccc

SEQ ID NO: 463294 - DNA, 25 bp, Homo sapien
agagccttccccttgcaaagttcca

SEQ ID NO: 463295 - DNA, 25 bp, Homo sapien
tgcaaagttccagggccaccagatg

SEQ ID NO: 463296 - DNA, 25 bp, Homo sapien
tgcccagtcactgtcacagagttaa

SEQ ID NO: 463297 - DNA, 25 bp, Homo sapien
cacagagttaaagcgtgcgggtgaa

SEQ ID NO: 463298 - DNA, 25 bp, Homo sapien
cctgctgtatgacatttgcaccaca

SEQ ID NO: 463299 - DNA, 25 bp, Homo sapien
tgtatgacatttgcaccacatggtg

SEQ ID NO: 463300 - DNA, 25 bp, Homo sapien
tgcaccacatggtgtgtgtccgtgc

SEQ ID NO: 463301 - DNA, 25 bp, Homo sapien
catggtgtgtgtccgtgccctttga

SEQ ID NO: 463302 - DNA, 25 bp, Homo sapien
tgtccgtgccctttgacatgacagt

SEQ ID NO: 463303 - DNA, 25 bp, Homo sapien
aatgctttgtgtcctgcaatactgt

SEQ ID NO: 463304 - DNA, 25 bp, Homo sapien
atgctttgtgtcctgcaatactgtt

SEQ ID NO: 463305 - DNA, 25 bp, Homo sapien
gctttgtgtcctgcaatactgttaa

SEQ ID NO: 463306 - DNA, 25 bp, Homo sapien
ctttgtgtcctgcaatactgttaaa

SEQ ID NO: 463307 - DNA, 25 bp, Homo sapien
gtgtcctgcaatactgttaaatctc

SEQ ID NO: 463308 - DNA, 25 bp, Homo sapien
gtcctgcaatactgttaaatctcct

SEQ ID NO: 463309 - DNA, 25 bp, Homo sapien
ctgcaatactgttaaatctccttat

SEQ ID NO: 463310 - DNA, 25 bp, Homo sapien
tactgttaaatctccttattagttt

SEQ ID NO: 463311 - DNA, 25 bp, Homo sapien
aaatctccttattagttttagcagc

SEQ ID NO: 463312 - DNA, 25 bp, Homo sapien
atctccttattagttttagcagctt

SEQ ID NO: 463313 - DNA, 25 bp, Homo sapien
tccttattagttttagcagcttttt

SEQ ID NO: 463314 - DNA, 25 bp, Homo sapien
tgttctccattgctgaaatgacaat

SEQ ID NO: 463315 - DNA, 25 bp, Homo sapien
agaagctgagagtagtccctgccaa

SEQ ID NO: 463316 - DNA, 25 bp, Homo sapien
gagagtagtccctgccaacagccaa

SEQ ID NO: 463317 - DNA, 25 bp, Homo sapien
gggaccatagtcctacaacagcaag

SEQ ID NO: 463318 - DNA, 25 bp, Homo sapien
actgaattctgcaaacaatctgatt

SEQ ID NO: 463319 - DNA, 25 bp, Homo sapien
aaacaatctgattgcgcctggaagc

SEQ ID NO: 463320 - DNA, 25 bp, Homo sapien
atctgattgcgcctggaagcaaatt

SEQ ID NO: 463321 - DNA, 25 bp, Homo sapien
agataagagcccagcttctgaccaa

SEQ ID NO: 463322 - DNA, 25 bp, Homo sapien
taagagcccagcttctgaccaacat

SEQ ID NO: 463323 - DNA, 25 bp, Homo sapien
aacatcttgatttctaccttgtgag

SEQ ID NO: 463324 - DNA, 25 bp, Homo sapien
agaggacccagttgagcccacctgg

SEQ ID NO: 463325 - DNA, 25 bp, Homo sapien
acgtctccagtgagggtgtcaaggg

SEQ ID NO: 463326 - DNA, 25 bp, Homo sapien
aggccatcaacgtgtccagccgctt

SEQ ID NO: 463327 - DNA, 25 bp, Homo sapien
tgtccagccgcttcgaggaggagat

SEQ ID NO: 463328 - DNA, 25 bp, Homo sapien
ccagccgcttcgaggaggagatcaa

SEQ ID NO: 463329 - DNA, 25 bp, Homo sapien
aagcagcggaaagcggccttcaagg

SEQ ID NO: 463330 - DNA, 25 bp, Homo sapien
ttcaaggagctgcagtccaccttta

SEQ ID NO: 463331 - DNA, 25 bp, Homo sapien
ggagctgcagtccacctttaagtag

SEQ ID NO: 463332 - DNA, 25 bp, Homo sapien
ctgcagtccacctttaagtagcggg

SEQ ID NO: 463333 - DNA, 25 bp, Homo sapien
atgggaggccgagcctgaatccttg

SEQ ID NO: 463334 - DNA, 25 bp, Homo sapien
cgagcctgaatccttgcctgtgtct

SEQ ID NO: 463335 - DNA, 25 bp, Homo sapien
gtgtctgacgggaccactactaaaa

SEQ ID NO: 463336 - DNA, 25 bp, Homo sapien
gaagcaagtgcaataccacctctct

SEQ ID NO: 463337 - DNA, 25 bp, Homo sapien
ctctctcctagggtttcctttgtag

SEQ ID NO: 463338 - DNA, 25 bp, Homo sapien
tcctagggtttcctttgtagcctat

SEQ ID NO: 463339 - DNA, 25 bp, Homo sapien
ttgtagcctatgtttggtgtctctt

SEQ ID NO: 463340 - DNA, 25 bp, Homo sapien
agcctatgtttggtgtctcttttga

SEQ ID NO: 463341 - DNA, 25 bp, Homo sapien
gggagttaaactagcttttgagact

SEQ ID NO: 463342 - DNA, 25 bp, Homo sapien
aactagcttttgagacttattgcaa

SEQ ID NO: 463343 - DNA, 25 bp, Homo sapien
gtaacggagatatactactgtaagt

SEQ ID NO: 463344 - DNA, 25 bp, Homo sapien
aagttttgtactgtactggctgaaa

SEQ ID NO: 463345 - DNA, 25 bp, Homo sapien
gtactgtactggctgaaagtctgtt

SEQ ID NO: 463346 - DNA, 25 bp, Homo sapien
gtactggctgaaagtctgttataaa

SEQ ID NO: 463347 - DNA, 25 bp, Homo sapien
gaaaccagtggtaaactttagatca

SEQ ID NO: 463348 - DNA, 25 bp, Homo sapien
aaaccagtggtaaactttagatcag

SEQ ID NO: 463349 - DNA, 25 bp, Homo sapien
aaccagtggtaaactttagatcaga

SEQ ID NO: 463350 - DNA, 25 bp, Homo sapien
accagtggtaaactttagatcagaa

SEQ ID NO: 463351 - DNA, 25 bp, Homo sapien
ccagtggtaaactttagatcagaaa

SEQ ID NO: 463352 - DNA, 25 bp, Homo sapien
cagtggtaaactttagatcagaaac

SEQ ID NO: 463353 - DNA, 25 bp, Homo sapien
gtggtaaactttagatcagaaacag

SEQ ID NO: 463354 - DNA, 25 bp, Homo sapien
ggtaaactttagatcagaaacagaa

SEQ ID NO: 463355 - DNA, 25 bp, Homo sapien
aatgaaagaactggccatgagcagt

SEQ ID NO: 463356 - DNA, 25 bp, Homo sapien
aaagaactggccatgagcagtggct

SEQ ID NO: 463357 - DNA, 25 bp, Homo sapien
aagaactggccatgagcagtggctc

SEQ ID NO: 463358 - DNA, 25 bp, Homo sapien
agaaggaataaatgaggccgggcac

SEQ ID NO: 463359 - DNA, 25 bp, Homo sapien
gaaggaataaatgaggccgggcaca

SEQ ID NO: 463360 - DNA, 25 bp, Homo sapien
aaggaataaatgaggccgggcacag

SEQ ID NO: 463361 - DNA, 25 bp, Homo sapien
aggaataaatgaggccgggcacagt

SEQ ID NO: 463362 - DNA, 25 bp, Homo sapien
taattaggcaggcatggtgttgcac

SEQ ID NO: 463363 - DNA, 25 bp, Homo sapien
taggcaggcatggtgttgcacacct

SEQ ID NO: 463364 - DNA, 25 bp, Homo sapien
ggcaggcatggtgttgcacacctgt

SEQ ID NO: 463365 - DNA, 25 bp, Homo sapien
gtgagcagagattgcaccaccacat

SEQ ID NO: 463366 - DNA, 25 bp, Homo sapien
tgagcagagattgcaccaccacatt

SEQ ID NO: 463367 - DNA, 25 bp, Homo sapien
gagcagagattgcaccaccacattc

SEQ ID NO: 463368 - DNA, 25 bp, Homo sapien
gcagagattgcaccaccacattcca

SEQ ID NO: 463369 - DNA, 25 bp, Homo sapien
ctaggctgtgggtgctaggagccaa

SEQ ID NO: 463370 - DNA, 25 bp, Homo sapien
gctaggagccaagtgctagggactc

SEQ ID NO: 463371 - DNA, 25 bp, Homo sapien
ctaggagccaagtgctagggactcg

SEQ ID NO: 463372 - DNA, 25 bp, Homo sapien
gactcgtcatgagtgggaatcccca

SEQ ID NO: 463373 - DNA, 25 bp, Homo sapien
agtgggaatccccacgttcctgtca

SEQ ID NO: 463374 - DNA, 25 bp, Homo sapien
cttacgaatgtaattccttaggaag

SEQ ID NO: 463375 - DNA, 25 bp, Homo sapien
taattccttaggaagacttgtacaa

SEQ ID NO: 463376 - DNA, 25 bp, Homo sapien
tgaactttggcctactttgtgataa

SEQ ID NO: 463377 - DNA, 25 bp, Homo sapien
atttctcacttctgtatttctcaaa

SEQ ID NO: 463378 - DNA, 25 bp, Homo sapien
gagttcaatatactgtgtactactg

SEQ ID NO: 463379 - DNA, 25 bp, Homo sapien
gtgtactactgatcttctattgtga

SEQ ID NO: 463380 - DNA, 25 bp, Homo sapien
gtgtctcttgctcatagcaagcctg

SEQ ID NO: 463381 - DNA, 25 bp, Homo sapien
tcatagcaagcctgtgggtagagga

SEQ ID NO: 463382 - DNA, 25 bp, Homo sapien
tctggtgtcgaataggaggacccat

SEQ ID NO: 463383 - DNA, 25 bp, Homo sapien
ggaggacccatgtagattcgcagat

SEQ ID NO: 463384 - DNA, 25 bp, Homo sapien
ggacccatgtagattcgcagatggc

SEQ ID NO: 463385 - DNA, 25 bp, Homo sapien
aagggcagacggtacatgtcccagc

SEQ ID NO: 463386 - DNA, 25 bp, Homo sapien
gtacatgtcccagcccacatagatg

SEQ ID NO: 463387 - DNA, 25 bp, Homo sapien
cttgctgagggtagcaggaccttct

SEQ ID NO: 463388 - DNA, 25 bp, Homo sapien
gggctcctgggtgtctgtatacacg

SEQ ID NO: 463389 - DNA, 25 bp, Homo sapien
gggtgtctgtatacacgccaaaggc

SEQ ID NO: 463390 - DNA, 25 bp, Homo sapien
gtatacacgccaaaggcagatacaa

SEQ ID NO: 463391 - DNA, 25 bp, Homo sapien
gtgcatgccagggacccaatcaagc

SEQ ID NO: 463392 - DNA, 25 bp, Homo sapien
gccagggacccaatcaagcattttt

SEQ ID NO: 463393 - DNA, 25 bp, Homo sapien
gggacccaatcaagcatttttatct

SEQ ID NO: 463394 - DNA, 25 bp, Homo sapien
gaaatctttgaattcctgcctttct

SEQ ID NO: 463395 - DNA, 25 bp, Homo sapien
ttcctgcctttcttggatgtttggt

SEQ ID NO: 463396 - DNA, 25 bp, Homo sapien
tcttggatgtttggtcttttgatat

SEQ ID NO: 463397 - DNA, 25 bp, Homo sapien
gatataatttagcatgggccaacat

SEQ ID NO: 463398 - DNA, 25 bp, Homo sapien
catttggtccagatttgtattagcc

SEQ ID NO: 463399 - DNA, 25 bp, Homo sapien
atttgtattagccaagccctcctaa

SEQ ID NO: 463400 - DNA, 25 bp, Homo sapien
agtatctggcgatttgagcttttac

SEQ ID NO: 463401 - DNA, 25 bp, Homo sapien
ggcgatttgagcttttacgtagaat

SEQ ID NO: 463402 - DNA, 25 bp, Homo sapien
ggttaatggtacatgatagaatttc

SEQ ID NO: 463403 - DNA, 25 bp, Homo sapien
ttaatggtacatgatagaatttcac

SEQ ID NO: 463404 - DNA, 25 bp, Homo sapien
tgatagaatttcacattaaaaagtt

SEQ ID NO: 463405 - DNA, 25 bp, Homo sapien
agtttaatgatggaggatgggcgta

SEQ ID NO: 463406 - DNA, 25 bp, Homo sapien
gtttaatgatggaggatgggcgtag

SEQ ID NO: 463407 - DNA, 25 bp, Homo sapien
tttaatgatggaggatgggcgtagt

SEQ ID NO: 463408 - DNA, 25 bp, Homo sapien
ttaatgatggaggatgggcgtagtg

SEQ ID NO: 463409 - DNA, 25 bp, Homo sapien
aatgatggaggatgggcgtagtggc

SEQ ID NO: 463410 - DNA, 25 bp, Homo sapien
atgatggaggatgggcgtagtggct

SEQ ID NO: 463411 - DNA, 25 bp, Homo sapien
tgatggaggatgggcgtagtggctt

SEQ ID NO: 463412 - DNA, 25 bp, Homo sapien
tgcactcccagccactctggaggcc

SEQ ID NO: 463413 - DNA, 25 bp, Homo sapien
tcttgttaccagtataatatccagg

SEQ ID NO: 463414 - DNA, 25 bp, Homo sapien
aatatccagggtcagccagtgttga

SEQ ID NO: 463415 - DNA, 25 bp, Homo sapien
agacattttgtctacctggcactgc

SEQ ID NO: 463416 - DNA, 25 bp, Homo sapien
gcactgctttctctttttagcttta

SEQ ID NO: 463417 - DNA, 25 bp, Homo sapien
tttagctttactactcttttgtgag

SEQ ID NO: 463418 - DNA, 25 bp, Homo sapien
gtgaggagtacatgttatgcatatt

SEQ ID NO: 463419 - DNA, 25 bp, Homo sapien
gcatattaacattcctcatgtcata

SEQ ID NO: 463420 - DNA, 25 bp, Homo sapien
caaccaaaattctgatgccccaaat

SEQ ID NO: 463421 - DNA, 25 bp, Homo sapien
tctgatgccccaaataaccactttt

SEQ ID NO: 463422 - DNA, 25 bp, Homo sapien
accacttttaatgccttggtgtaag

SEQ ID NO: 463423 - DNA, 25 bp, Homo sapien
ggtgtaagtatacctctgaactttt

SEQ ID NO: 463424 - DNA, 25 bp, Homo sapien
ttcgctggacgatacttctctctca

SEQ ID NO: 463425 - DNA, 25 bp, Homo sapien
tcatctgcctcacaatttctgcaaa

SEQ ID NO: 463426 - DNA, 25 bp, Homo sapien
gtccactttgttcccaaccaagatg

SEQ ID NO: 463427 - DNA, 25 bp, Homo sapien
aagatgactggcactttctcatacc

SEQ ID NO: 463428 - DNA, 25 bp, Homo sapien
cggatgatctggtcccgcatgggct

SEQ ID NO: 463429 - DNA, 25 bp, Homo sapien
cccgcatgggcttgatgtcctggaa

SEQ ID NO: 463430 - DNA, 25 bp, Homo sapien
agctctgctggttgacgaggctgta

SEQ ID NO: 463431 - DNA, 25 bp, Homo sapien
agacgaggatgaagccctggccgtt

SEQ ID NO: 463432 - DNA, 25 bp, Homo sapien
tggccgttcttgatgtacaggtccc

SEQ ID NO: 463433 - DNA, 25 bp, Homo sapien
tttctgcaaagagttcgtccaccat

SEQ ID NO: 463434 - DNA, 25 bp, Homo sapien
agttcgtccaccattgttttactct

SEQ ID NO: 463435 - DNA, 25 bp, Homo sapien
gtcactcgggtataaagggcatctt

SEQ ID NO: 463436 - DNA, 25 bp, Homo sapien
tcactcgggtataaagggcatcttt

SEQ ID NO: 463437 - DNA, 25 bp, Homo sapien
actcgggtataaagggcatctttgc

SEQ ID NO: 463438 - DNA, 25 bp, Homo sapien
gtataaagggcatctttgcttttga

SEQ ID NO: 463439 - DNA, 25 bp, Homo sapien
tataaagggcatctttgcttttgag

SEQ ID NO: 463440 - DNA, 25 bp, Homo sapien
ataaagggcatctttgcttttgagc

SEQ ID NO: 463441 - DNA, 25 bp, Homo sapien
aagggcatctttgcttttgagcaat

SEQ ID NO: 463442 - DNA, 25 bp, Homo sapien
ttttgagcaataaagatgaaggccg

SEQ ID NO: 463443 - DNA, 25 bp, Homo sapien
agcaataaagatgaaggccgggcac

SEQ ID NO: 463444 - DNA, 25 bp, Homo sapien
gcaataaagatgaaggccgggcaca

SEQ ID NO: 463445 - DNA, 25 bp, Homo sapien
caataaagatgaaggccgggcacag

SEQ ID NO: 463446 - DNA, 25 bp, Homo sapien
aaagatggcccttacttctgacctt

SEQ ID NO: 463447 - DNA, 25 bp, Homo sapien
agcagtgggccaccccttgcagaga

SEQ ID NO: 463448 - DNA, 25 bp, Homo sapien
gatgagttcagtttgagccatatgg

SEQ ID NO: 463449 - DNA, 25 bp, Homo sapien
atggagtttgaaatgcctctggcat

SEQ ID NO: 463450 - DNA, 25 bp, Homo sapien
atgcctctggcattccattcaaagt

SEQ ID NO: 463451 - DNA, 25 bp, Homo sapien
ggcattccattcaaagtaatcccct

SEQ ID NO: 463452 - DNA, 25 bp, Homo sapien
gtaatccccttaaatggtcattgag

SEQ ID NO: 463453 - DNA, 25 bp, Homo sapien
aatagtgctactgttcttggaactt

SEQ ID NO: 463454 - DNA, 25 bp, Homo sapien
tggaacttttcagagacttctcgaa

SEQ ID NO: 463455 - DNA, 25 bp, Homo sapien
gagacttctcgaaaaaccattacca

SEQ ID NO: 463456 - DNA, 25 bp, Homo sapien
ccaaagacattttatcagctacata

SEQ ID NO: 463457 - DNA, 25 bp, Homo sapien
tgacagagactctgcctcgaaagat

SEQ ID NO: 463458 - DNA, 25 bp, Homo sapien
gacagagactctgcctcgaaagata

SEQ ID NO: 463459 - DNA, 25 bp, Homo sapien
agagactctgcctcgaaagataaaa

SEQ ID NO: 463460 - DNA, 25 bp, Homo sapien
agactctgcctcgaaagataaaaat

SEQ ID NO: 463461 - DNA, 25 bp, Homo sapien
aatattgggattatactgtacattc

SEQ ID NO: 463462 - DNA, 25 bp, Homo sapien
tattgggattatactgtacattctt

SEQ ID NO: 463463 - DNA, 25 bp, Homo sapien
ttgggattatactgtacattctttc

SEQ ID NO: 463464 - DNA, 25 bp, Homo sapien
ggattatactgtacattctttctta

SEQ ID NO: 463465 - DNA, 25 bp, Homo sapien
ttctttcttacatgtatggtgaata

SEQ ID NO: 463466 - DNA, 25 bp, Homo sapien
ctttcttacatgtatggtgaatata

SEQ ID NO: 463467 - DNA, 25 bp, Homo sapien
caataaaccaggaattctaaacttg

SEQ ID NO: 463468 - DNA, 25 bp, Homo sapien
gtatcagagccttagggtgccccca

SEQ ID NO: 463469 - DNA, 25 bp, Homo sapien
aactgtggcacctgtaacctcccgg

SEQ ID NO: 463470 - DNA, 25 bp, Homo sapien
tgtaacctcccggaacatgaaggac

SEQ ID NO: 463471 - DNA, 25 bp, Homo sapien
catgaaggactatgctctgaggcta

SEQ ID NO: 463472 - DNA, 25 bp, Homo sapien
atgctctgaggctatactctgtgcc

SEQ ID NO: 463473 - DNA, 25 bp, Homo sapien
ctgtgcccatgagagcagagactgg

SEQ ID NO: 463474 - DNA, 25 bp, Homo sapien
agaccatcactgcactttaaccagg

SEQ ID NO: 463475 - DNA, 25 bp, Homo sapien
tgcactttaaccagggtcttaggta

SEQ ID NO: 463476 - DNA, 25 bp, Homo sapien
caaaatcctacttttcagagccttc

SEQ ID NO: 463477 - DNA, 25 bp, Homo sapien
agagccttccagctctggaacctca

SEQ ID NO: 463478 - DNA, 25 bp, Homo sapien
tggaacctcaaacatcctcatgctc

SEQ ID NO: 463479 - DNA, 25 bp, Homo sapien
ttttgcattgactgctgagagctcc

SEQ ID NO: 463480 - DNA, 25 bp, Homo sapien
tgagagctcctgtttactaagcaag

SEQ ID NO: 463481 - DNA, 25 bp, Homo sapien
gctcctgtttactaagcaagctttt

SEQ ID NO: 463482 - DNA, 25 bp, Homo sapien
ctaagcaagcttttgtgtttattat

SEQ ID NO: 463483 - DNA, 25 bp, Homo sapien
attatcctcatttttactgaacatt

SEQ ID NO: 463484 - DNA, 25 bp, Homo sapien
tttactgaacattgttagttttggg

SEQ ID NO: 463485 - DNA, 25 bp, Homo sapien
acccactttttcattgtaatgactt

SEQ ID NO: 463486 - DNA, 25 bp, Homo sapien
ttgcagacggaggtcaggtcttcct

SEQ ID NO: 463487 - DNA, 25 bp, Homo sapien
agacggaggtcaggtcttcctcttt

SEQ ID NO: 463488 - DNA, 25 bp, Homo sapien
gtcttcctctttcctgagactggat

SEQ ID NO: 463489 - DNA, 25 bp, Homo sapien
gagactggatctgttcaaacagcaa

SEQ ID NO: 463490 - DNA, 25 bp, Homo sapien
agtaatattgggattatactgtaca

SEQ ID NO: 463491 - DNA, 25 bp, Homo sapien
gtaatattgggattatactgtacat

SEQ ID NO: 463492 - DNA, 25 bp, Homo sapien
taatattgggattatactgtacatt

SEQ ID NO: 463493 - DNA, 25 bp, Homo sapien
aatattgggattatactgtacattc

SEQ ID NO: 463494 - DNA, 25 bp, Homo sapien
atattgggattatactgtacattct

SEQ ID NO: 463495 - DNA, 25 bp, Homo sapien
tattgggattatactgtacattctt

SEQ ID NO: 463496 - DNA, 25 bp, Homo sapien
attgggattatactgtacattcttt

SEQ ID NO: 463497 - DNA, 25 bp, Homo sapien
ttgggattatactgtacattctttc

SEQ ID NO: 463498 - DNA, 25 bp, Homo sapien
ttctttcttacatgtatggtgaata

SEQ ID NO: 463499 - DNA, 25 bp, Homo sapien
tctttcttacatgtatggtgaatat

SEQ ID NO: 463500 - DNA, 25 bp, Homo sapien
ctttcttacatgtatggtgaatata

SEQ ID NO: 463501 - DNA, 25 bp, Homo sapien
ccccatgtccccatttgagttaaat

SEQ ID NO: 463502 - DNA, 25 bp, Homo sapien
gtccccatttgagttaaattcagat

SEQ ID NO: 463503 - DNA, 25 bp, Homo sapien
aattcagatccacagcttgcaggag

SEQ ID NO: 463504 - DNA, 25 bp, Homo sapien
ttgcaggagaaagtcagtggcccca

SEQ ID NO: 463505 - DNA, 25 bp, Homo sapien
gagaaagtcagtggccccagacaca

SEQ ID NO: 463506 - DNA, 25 bp, Homo sapien
gtggccccagacacacgtaacaggg

SEQ ID NO: 463507 - DNA, 25 bp, Homo sapien
acacacgtaacagggtgagcactga

SEQ ID NO: 463508 - DNA, 25 bp, Homo sapien
tgagcactgaaataagagcacgctg

SEQ ID NO: 463509 - DNA, 25 bp, Homo sapien
cacctatcttttctccatcattaac

SEQ ID NO: 463510 - DNA, 25 bp, Homo sapien
tttctccctggacttccaagtacca

SEQ ID NO: 463511 - DNA, 25 bp, Homo sapien
ggacttccaagtaccaatgaccttg

SEQ ID NO: 463512 - DNA, 25 bp, Homo sapien
tttctgaatacaggagaggagctga

SEQ ID NO: 463513 - DNA, 25 bp, Homo sapien
ggcaaaacctgaatggtatgtttgt

SEQ ID NO: 463514 - DNA, 25 bp, Homo sapien
ccctgtgacctgtgcatctggccaa

SEQ ID NO: 463515 - DNA, 25 bp, Homo sapien
catccttaggaatccccgtggattc

SEQ ID NO: 463516 - DNA, 25 bp, Homo sapien
aatccccgtggattccagagaagag

SEQ ID NO: 463517 - DNA, 25 bp, Homo sapien
gtagatgggagcaagtgtccagtac

SEQ ID NO: 463518 - DNA, 25 bp, Homo sapien
gagcaagtgtccagtacagcaacag

SEQ ID NO: 463519 - DNA, 25 bp, Homo sapien
gtgtccagtacagcaacagcgtatt

SEQ ID NO: 463520 - DNA, 25 bp, Homo sapien
acagcaacagcgtattaggaggaga

SEQ ID NO: 463521 - DNA, 25 bp, Homo sapien
acagcgtattaggaggagacagcaa

SEQ ID NO: 463522 - DNA, 25 bp, Homo sapien
ggagacagcaaaatgcctaggcaga

SEQ ID NO: 463523 - DNA, 25 bp, Homo sapien
ggctcccaggttgtgttcatgtgac

SEQ ID NO: 463524 - DNA, 25 bp, Homo sapien
ttcatgtgacgtttccttgtggtag

SEQ ID NO: 463525 - DNA, 25 bp, Homo sapien
ttccttgtggtaggttctgggtctg

SEQ ID NO: 463526 - DNA, 25 bp, Homo sapien
gagtgtcacaggatggacactgcct

SEQ ID NO: 463527 - DNA, 25 bp, Homo sapien
ccaatgcagttagcctcctgctggt

SEQ ID NO: 463528 - DNA, 25 bp, Homo sapien
ctggtgttctctcttgttgcttggt

SEQ ID NO: 463529 - DNA, 25 bp, Homo sapien
tgcccagtgaacgacccctttgtaa

SEQ ID NO: 463530 - DNA, 25 bp, Homo sapien
gtgaacgacccctttgtaatgaatg

SEQ ID NO: 463531 - DNA, 25 bp, Homo sapien
gtgtgaagcgatgccaatatcccat

SEQ ID NO: 463532 - DNA, 25 bp, Homo sapien
atgccaatatcccatccctgtcaaa

SEQ ID NO: 463533 - DNA, 25 bp, Homo sapien
catccctgtcaaactgcctttactt

SEQ ID NO: 463534 - DNA, 25 bp, Homo sapien
tgagggtctcgcagctgtccggttc

SEQ ID NO: 463535 - DNA, 25 bp, Homo sapien
tgtccggttcgccaagctggtccag

SEQ ID NO: 463536 - DNA, 25 bp, Homo sapien
gccaagctggtccagccgacctgtg

SEQ ID NO: 463537 - DNA, 25 bp, Homo sapien
agctggaggacaagggactcgcccc

SEQ ID NO: 463538 - DNA, 25 bp, Homo sapien
cgaggcctcggtttggatgggcagt

SEQ ID NO: 463539 - DNA, 25 bp, Homo sapien
tggatgggcagtcgcgggctggaga

SEQ ID NO: 463540 - DNA, 25 bp, Homo sapien
tttgacctttattcccaggaccgat

SEQ ID NO: 463541 - DNA, 25 bp, Homo sapien
gacctttattcccaggaccgattct

SEQ ID NO: 463542 - DNA, 25 bp, Homo sapien
ctttattcccaggaccgattctggg

SEQ ID NO: 463543 - DNA, 25 bp, Homo sapien
tggtgggacgcgagccaatgagagg

SEQ ID NO: 463544 - DNA, 25 bp, Homo sapien
gagccaatgagaggcgggcccggag

SEQ ID NO: 463545 - DNA, 25 bp, Homo sapien
aagggtagctgaagttgcggccaca

SEQ ID NO: 463546 - DNA, 25 bp, Homo sapien
gtagctgaagttgcggccacagtct

SEQ ID NO: 463547 - DNA, 25 bp, Homo sapien
ggcagtcttcgggtcagagtgtcct

SEQ ID NO: 463548 - DNA, 25 bp, Homo sapien
agtcttcgggtcagagtgtccttga

SEQ ID NO: 463549 - DNA, 25 bp, Homo sapien
ttcgggtcagagtgtccttgagcca

SEQ ID NO: 463550 - DNA, 25 bp, Homo sapien
gggctctgcctagggttgcagaact

SEQ ID NO: 463551 - DNA, 25 bp, Homo sapien
ttgcagaactctgggcaggcgacgc

SEQ ID NO: 463552 - DNA, 25 bp, Homo sapien
tccttgacagccacttcatgcgcca

SEQ ID NO: 463553 - DNA, 25 bp, Homo sapien
tgaaagctgcagagctctcaccgtc

SEQ ID NO: 463554 - DNA, 25 bp, Homo sapien
agctgcagagctctcaccgtcggga

SEQ ID NO: 463555 - DNA, 25 bp, Homo sapien
gagctctcaccgtcgggatcctggg

SEQ ID NO: 463556 - DNA, 25 bp, Homo sapien
agttgcacgatttcggcttattgca

SEQ ID NO: 463557 - DNA, 25 bp, Homo sapien
ggcttattgcaacatccgccacctg

SEQ ID NO: 463558 - DNA, 25 bp, Homo sapien
ttattgcaacatccgccacctgggt

SEQ ID NO: 463559 - DNA, 25 bp, Homo sapien
cctccctatctctgtatcttatgaa

SEQ ID NO: 463560 - DNA, 25 bp, Homo sapien
tccctatctctgtatcttatgaaga

SEQ ID NO: 463561 - DNA, 25 bp, Homo sapien
tctgtatcttatgaagacttccttt

SEQ ID NO: 463562 - DNA, 25 bp, Homo sapien
ctgaagagctgccataagtcttaaa

SEQ ID NO: 463563 - DNA, 25 bp, Homo sapien
gagctgccataagtcttaaacattt

SEQ ID NO: 463564 - DNA, 25 bp, Homo sapien
gctgccataagtcttaaacatttaa

SEQ ID NO: 463565 - DNA, 25 bp, Homo sapien
aacatttaaatcatcagaacctttt

SEQ ID NO: 463566 - DNA, 25 bp, Homo sapien
agaaccttttcttgtagcagaaatg

SEQ ID NO: 463567 - DNA, 25 bp, Homo sapien
actgctcctctcttagatctaacag

SEQ ID NO: 463568 - DNA, 25 bp, Homo sapien
tgaggagtgttcacctgctgcagcc

SEQ ID NO: 463569 - DNA, 25 bp, Homo sapien
gcaccttccaccctgaggaacattt

SEQ ID NO: 463570 - DNA, 25 bp, Homo sapien
tccaccctgaggaacatttctgcag

SEQ ID NO: 463571 - DNA, 25 bp, Homo sapien
atttctgcagagacaacaccttgga

SEQ ID NO: 463572 - DNA, 25 bp, Homo sapien
tgcagagacaacaccttggaagaga

SEQ ID NO: 463573 - DNA, 25 bp, Homo sapien
ttggaagagaatccgggcctttctt

SEQ ID NO: 463574 - DNA, 25 bp, Homo sapien
accttccttattagaaaagccagag

SEQ ID NO: 463575 - DNA, 25 bp, Homo sapien
aaaagccagagtcctctcgtggcag

SEQ ID NO: 463576 - DNA, 25 bp, Homo sapien
tctcgtggcaggaggagctactcct

SEQ ID NO: 463577 - DNA, 25 bp, Homo sapien
gctactcctggaggtccaagggtgt

SEQ ID NO: 463578 - DNA, 25 bp, Homo sapien
tgaacgccgtacatacctagctgaa

SEQ ID NO: 463579 - DNA, 25 bp, Homo sapien
aaatgtctcagggttctggtttaca

SEQ ID NO: 463580 - DNA, 25 bp, Homo sapien
ggttctggtttacatcaagtttcta

SEQ ID NO: 463581 - DNA, 25 bp, Homo sapien
aacaggtggatcaactgcctaggat

SEQ ID NO: 463582 - DNA, 25 bp, Homo sapien
taatccagctaagcagaagacagtg

SEQ ID NO: 463583 - DNA, 25 bp, Homo sapien
gtgagtgccaagagaggaccagtaa

SEQ ID NO: 463584 - DNA, 25 bp, Homo sapien
gattacaagaccaaaccatcttcca

SEQ ID NO: 463585 - DNA, 25 bp, Homo sapien
cagaactccatccatgattccagaa

SEQ ID NO: 463586 - DNA, 25 bp, Homo sapien
aactccatccatgattccagaactg

SEQ ID NO: 463587 - DNA, 25 bp, Homo sapien
ctggatggatttctatttcttcctt

SEQ ID NO: 463588 - DNA, 25 bp, Homo sapien
gttataaagttaatggtcagcacat

SEQ ID NO: 463589 - DNA, 25 bp, Homo sapien
cagtatgtcatgtttgctgtagtgc

SEQ ID NO: 463590 - DNA, 25 bp, Homo sapien
agtatgtcatgtttgctgtagtgct

SEQ ID NO: 463591 - DNA, 25 bp, Homo sapien
gtatgtcatgtttgctgtagtgctc

SEQ ID NO: 463592 - DNA, 25 bp, Homo sapien
tatgtcatgtttgctgtagtgctca

SEQ ID NO: 463593 - DNA, 25 bp, Homo sapien
atgtcatgtttgctgtagtgctcat

SEQ ID NO: 463594 - DNA, 25 bp, Homo sapien
tgtcatgtttgctgtagtgctcata

SEQ ID NO: 463595 - DNA, 25 bp, Homo sapien
tcatgtttgctgtagtgctcatatt

SEQ ID NO: 463596 - DNA, 25 bp, Homo sapien
catgtttgctgtagtgctcatattt

SEQ ID NO: 463597 - DNA, 25 bp, Homo sapien
atgtttgctgtagtgctcatattta

SEQ ID NO: 463598 - DNA, 25 bp, Homo sapien
tgtttgctgtagtgctcatatttat

SEQ ID NO: 463599 - DNA, 25 bp, Homo sapien
tgtagtgctcatatttattgttgtt

SEQ ID NO: 463600 - DNA, 25 bp, Homo sapien
cgggtattataccagatatctattt

SEQ ID NO: 463601 - DNA, 25 bp, Homo sapien
accagatatctatttagggcacagt

SEQ ID NO: 463602 - DNA, 25 bp, Homo sapien
gcaagtggtcaagaaaggcttcgtg

SEQ ID NO: 463603 - DNA, 25 bp, Homo sapien
tatcgctcctgctgagtcttgaaag

SEQ ID NO: 463604 - DNA, 25 bp, Homo sapien
gagtcttgaaagcatccataggtgt

SEQ ID NO: 463605 - DNA, 25 bp, Homo sapien
gaaagcatccataggtgtgtgtgcc

SEQ ID NO: 463606 - DNA, 25 bp, Homo sapien
aaagagcctgactaagctgagatgt

SEQ ID NO: 463607 - DNA, 25 bp, Homo sapien
gaaggcccattggagaccggctatt

SEQ ID NO: 463608 - DNA, 25 bp, Homo sapien
ggagaccggctattaagacttgatc

SEQ ID NO: 463609 - DNA, 25 bp, Homo sapien
aagacttgatcctaaaggcattgag

SEQ ID NO: 463610 - DNA, 25 bp, Homo sapien
aggcattgaggaaaccttggtggct

SEQ ID NO: 463611 - DNA, 25 bp, Homo sapien
tctgtgacaagtgccaaaaatggat

SEQ ID NO: 463612 - DNA, 25 bp, Homo sapien
ctgtgacaagtgccaaaaatggata

SEQ ID NO: 463613 - DNA, 25 bp, Homo sapien
tgtgacaagtgccaaaaatggatac

SEQ ID NO: 463614 - DNA, 25 bp, Homo sapien
gtgacaagtgccaaaaatggatacc

SEQ ID NO: 463615 - DNA, 25 bp, Homo sapien
tgacaagtgccaaaaatggatacca

SEQ ID NO: 463616 - DNA, 25 bp, Homo sapien
acaagtgccaaaaatggataccagc

SEQ ID NO: 463617 - DNA, 25 bp, Homo sapien
caagtgccaaaaatggataccagcc

SEQ ID NO: 463618 - DNA, 25 bp, Homo sapien
aagtgccaaaaatggataccagcca

SEQ ID NO: 463619 - DNA, 25 bp, Homo sapien
agtgccaaaaatggataccagccag

SEQ ID NO: 463620 - DNA, 25 bp, Homo sapien
gtgccaaaaatggataccagccagt

SEQ ID NO: 463621 - DNA, 25 bp, Homo sapien
cacaatctgtgttattaggcctgca

SEQ ID NO: 463622 - DNA, 25 bp, Homo sapien
attaggcctgcatttttcctttctt

SEQ ID NO: 463623 - DNA, 25 bp, Homo sapien
gtctcttcagacatgttaaaatttc

SEQ ID NO: 463624 - DNA, 25 bp, Homo sapien
aatttctacttatcattttgtcaac

SEQ ID NO: 463625 - DNA, 25 bp, Homo sapien
gtcaactctgtgtgtttgcattcgt

SEQ ID NO: 463626 - DNA, 25 bp, Homo sapien
gtgtgtttgcattcgttcttggaaa

SEQ ID NO: 463627 - DNA, 25 bp, Homo sapien
gcattcgttcttggaaatttgtctc

SEQ ID NO: 463628 - DNA, 25 bp, Homo sapien
attagcaggcttgctggtgcatgcc

SEQ ID NO: 463629 - DNA, 25 bp, Homo sapien
aaggcaagagtatcacttgtgtcca

SEQ ID NO: 463630 - DNA, 25 bp, Homo sapien
ggagctcaagactacagcgaggtat

SEQ ID NO: 463631 - DNA, 25 bp, Homo sapien
actacagcgaggtatgattgtgcca

SEQ ID NO: 463632 - DNA, 25 bp, Homo sapien
ggacttcaataaagcaagcagatga

SEQ ID NO: 463633 - DNA, 25 bp, Homo sapien
agaggctttaattaaatcgaatcaa

SEQ ID NO: 463634 - DNA, 25 bp, Homo sapien
aatggatatttaacagcacccttca

SEQ ID NO: 463635 - DNA, 25 bp, Homo sapien
taacagcacccttcaaataaataat

SEQ ID NO: 463636 - DNA, 25 bp, Homo sapien
taacttaggccacaaagaaaacctg

SEQ ID NO: 463637 - DNA, 25 bp, Homo sapien
aatttttagagtccacatataccac

SEQ ID NO: 463638 - DNA, 25 bp, Homo sapien
tttagagtccacatataccaccaaa

SEQ ID NO: 463639 - DNA, 25 bp, Homo sapien
gagtccacatataccaccaaaaata

SEQ ID NO: 463640 - DNA, 25 bp, Homo sapien
atctacaatttagcaataagggatt

SEQ ID NO: 463641 - DNA, 25 bp, Homo sapien
taagggattaaactcttgcttcaaa

SEQ ID NO: 463642 - DNA, 25 bp, Homo sapien
aaaagcacttagacaccactgcact

SEQ ID NO: 463643 - DNA, 25 bp, Homo sapien
cgttccctccttgttgctgtgtaat

SEQ ID NO: 463644 - DNA, 25 bp, Homo sapien
ctgtgtaattagtcagtgttgccac

SEQ ID NO: 463645 - DNA, 25 bp, Homo sapien
tgttgccacagtgtgtggcgctgat

SEQ ID NO: 463646 - DNA, 25 bp, Homo sapien
ggagatgtcagaaccgagaacactt

SEQ ID NO: 463647 - DNA, 25 bp, Homo sapien
gagaacacttaaccttctttgattg

SEQ ID NO: 463648 - DNA, 25 bp, Homo sapien
ttttaagacttcgatccacccctat

SEQ ID NO: 463649 - DNA, 25 bp, Homo sapien
gatccacccctatgagagcaagtaa

SEQ ID NO: 463650 - DNA, 25 bp, Homo sapien
gagattcgtgttactttggcttttc

SEQ ID NO: 463651 - DNA, 25 bp, Homo sapien
ttggcttttctgtctctgttgacac

SEQ ID NO: 463652 - DNA, 25 bp, Homo sapien
gttgacacggttgcacatttccaag

SEQ ID NO: 463653 - DNA, 25 bp, Homo sapien
acatttccaagttactacagcgtga

SEQ ID NO: 463654 - DNA, 25 bp, Homo sapien
atgcccttctgcttcaaacagtgcg

SEQ ID NO: 463655 - DNA, 25 bp, Homo sapien
gcttcaaacagtgcggcatcgtcct

SEQ ID NO: 463656 - DNA, 25 bp, Homo sapien
tgctcttggtcttctgctcatggat

SEQ ID NO: 463657 - DNA, 25 bp, Homo sapien
tcttggtcttctgctcatggatgac

SEQ ID NO: 463658 - DNA, 25 bp, Homo sapien
tgctcatggatgacgcaccagtcgt

SEQ ID NO: 463659 - DNA, 25 bp, Homo sapien
tggatgacgcaccagtcgtgcatgt

SEQ ID NO: 463660 - DNA, 25 bp, Homo sapien
accagtcgtgcatgttcttggtgaa

SEQ ID NO: 463661 - DNA, 25 bp, Homo sapien
atgttcttggtgaagtcggccagcc

SEQ ID NO: 463662 - DNA, 25 bp, Homo sapien
gtgaagtcggccagcctgagcaagc

SEQ ID NO: 463663 - DNA, 25 bp, Homo sapien
cagcctgagcaagcggaggacctac

SEQ ID NO: 463664 - DNA, 25 bp, Homo sapien
agcaagcggaggacctacgccggcc

SEQ ID NO: 463665 - DNA, 25 bp, Homo sapien
ttccatgtcccaaaggtccaggctg

SEQ ID NO: 463666 - DNA, 25 bp, Homo sapien
atgtcccaaaggtccaggctggtcc

SEQ ID NO: 463667 - DNA, 25 bp, Homo sapien
cccaaaggtccaggctggtccagga

SEQ ID NO: 463668 - DNA, 25 bp, Homo sapien
taaggtcatgctgtccagggaaggc

SEQ ID NO: 463669 - DNA, 25 bp, Homo sapien
cagggaaggccgagggatccagggt

SEQ ID NO: 463670 - DNA, 25 bp, Homo sapien
accacccgtactcttggatcaagaa

SEQ ID NO: 463671 - DNA, 25 bp, Homo sapien
tagtctctgagaccacctgtaggat

SEQ ID NO: 463672 - DNA, 25 bp, Homo sapien
gtctctgagaccacctgtaggattg

SEQ ID NO: 463673 - DNA, 25 bp, Homo sapien
gagaccacctgtaggattgaggcga

SEQ ID NO: 463674 - DNA, 25 bp, Homo sapien
ccacctgtaggattgaggcgagaca

SEQ ID NO: 463675 - DNA, 25 bp, Homo sapien
gtactcttggatcaagaacccagaa

SEQ ID NO: 463676 - DNA, 25 bp, Homo sapien
ctggtgaagcttgggcctgctctcc

SEQ ID NO: 463677 - DNA, 25 bp, Homo sapien
tttccatcctctaaggagccaactt

SEQ ID NO: 463678 - DNA, 25 bp, Homo sapien
atcctctaaggagccaacttggctt

SEQ ID NO: 463679 - DNA, 25 bp, Homo sapien
aacttggcttttacctgtcaaatag

SEQ ID NO: 463680 - DNA, 25 bp, Homo sapien
ggcttttacctgtcaaatagtcata

SEQ ID NO: 463681 - DNA, 25 bp, Homo sapien
atagtcataaagtcccctatccttt

SEQ ID NO: 463682 - DNA, 25 bp, Homo sapien
tttaccccaccttatacacacgagg

SEQ ID NO: 463683 - DNA, 25 bp, Homo sapien
ccttatacacacgaggctttctcag

SEQ ID NO: 463684 - DNA, 25 bp, Homo sapien
tacacacgaggctttctcaggaagt

SEQ ID NO: 463685 - DNA, 25 bp, Homo sapien
cgaggctttctcaggaagtggctct

SEQ ID NO: 463686 - DNA, 25 bp, Homo sapien
ctctgccaggcaggactatgtggga

SEQ ID NO: 463687 - DNA, 25 bp, Homo sapien
acttcttcccaatggtgatggcctt

SEQ ID NO: 463688 - DNA, 25 bp, Homo sapien
ttcccaatggtgatggccttcttca

SEQ ID NO: 463689 - DNA, 25 bp, Homo sapien
cccaatggtgatggccttcttcaat

SEQ ID NO: 463690 - DNA, 25 bp, Homo sapien
aatggtgatggccttcttcaatatt

SEQ ID NO: 463691 - DNA, 25 bp, Homo sapien
ggtgatggccttcttcaatatttaa

SEQ ID NO: 463692 - DNA, 25 bp, Homo sapien
gatggccttcttcaatatttaataa

SEQ ID NO: 463693 - DNA, 25 bp, Homo sapien
tagtattacaataacaattgcgaat

SEQ ID NO: 463694 - DNA, 25 bp, Homo sapien
ttgcgaataatcaaatatgccctaa

SEQ ID NO: 463695 - DNA, 25 bp, Homo sapien
gaataatcaaatatgccctaagcag

SEQ ID NO: 463696 - DNA, 25 bp, Homo sapien
tcaaatatgccctaagcagtgtttt

SEQ ID NO: 463697 - DNA, 25 bp, Homo sapien
aatatcagggctttgtctctcttct

SEQ ID NO: 463698 - DNA, 25 bp, Homo sapien
cttctaataattttgcctctgggaa

SEQ ID NO: 463699 - DNA, 25 bp, Homo sapien
ttctaataattttgcctctgggaat

SEQ ID NO: 463700 - DNA, 25 bp, Homo sapien
tctaataattttgcctctgggaatt

SEQ ID NO: 463701 - DNA, 25 bp, Homo sapien
taattttgcctctgggaattttgtc

SEQ ID NO: 463702 - DNA, 25 bp, Homo sapien
aattttgcctctgggaattttgtca

SEQ ID NO: 463703 - DNA, 25 bp, Homo sapien
ttgcctctgggaattttgtcaagat

SEQ ID NO: 463704 - DNA, 25 bp, Homo sapien
tgcctctgggaattttgtcaagatt

SEQ ID NO: 463705 - DNA, 25 bp, Homo sapien
gcctctgggaattttgtcaagattt

SEQ ID NO: 463706 - DNA, 25 bp, Homo sapien
cctctgggaattttgtcaagattta

SEQ ID NO: 463707 - DNA, 25 bp, Homo sapien
tttgtcaagatttacaggctgggcg

SEQ ID NO: 463708 - DNA, 25 bp, Homo sapien
ttgtcaagatttacaggctgggcgt

SEQ ID NO: 463709 - DNA, 25 bp, Homo sapien
gtcaagaaggtcaaagggagcgtct

SEQ ID NO: 463710 - DNA, 25 bp, Homo sapien
aaagggagcgtctgtctccctgacc

SEQ ID NO: 463711 - DNA, 25 bp, Homo sapien
tctccctgacctgaatgacaactaa

SEQ ID NO: 463712 - DNA, 25 bp, Homo sapien
gacaactaacatagcccttgtttcc

SEQ ID NO: 463713 - DNA, 25 bp, Homo sapien
gcagctgtgtgggatcaaggcattt

SEQ ID NO: 463714 - DNA, 25 bp, Homo sapien
aggcattttgtgagattgcagctgt

SEQ ID NO: 463715 - DNA, 25 bp, Homo sapien
ttggaagaacatccctagctccagg

SEQ ID NO: 463716 - DNA, 25 bp, Homo sapien
atatggtgggaattggttagctaaa

SEQ ID NO: 463717 - DNA, 25 bp, Homo sapien
atatcaattccctgggtaaaagagg

SEQ ID NO: 463718 - DNA, 25 bp, Homo sapien
ggaaaaccatgagaccctctaatct

SEQ ID NO: 463719 - DNA, 25 bp, Homo sapien
ctctaatcttaacttttctccttca

SEQ ID NO: 463720 - DNA, 25 bp, Homo sapien
caactgggggctgatcacgaacatc

SEQ ID NO: 463721 - DNA, 25 bp, Homo sapien
atgcccttctgcttcaaacagtgcg

SEQ ID NO: 463722 - DNA, 25 bp, Homo sapien
tgcccttctgcttcaaacagtgcgg

SEQ ID NO: 463723 - DNA, 25 bp, Homo sapien
ccttctgcttcaaacagtgcggcat

SEQ ID NO: 463724 - DNA, 25 bp, Homo sapien
cttctgcttcaaacagtgcggcatc

SEQ ID NO: 463725 - DNA, 25 bp, Homo sapien
ttctgcttcaaacagtgcggcatcg

SEQ ID NO: 463726 - DNA, 25 bp, Homo sapien
tctgcttcaaacagtgcggcatcgt

SEQ ID NO: 463727 - DNA, 25 bp, Homo sapien
ctgcttcaaacagtgcggcatcgtc

SEQ ID NO: 463728 - DNA, 25 bp, Homo sapien
tgcttcaaacagtgcggcatcgtcc

SEQ ID NO: 463729 - DNA, 25 bp, Homo sapien
gcttcaaacagtgcggcatcgtcct

SEQ ID NO: 463730 - DNA, 25 bp, Homo sapien
tcaaacagtgcggcatcgtcctggg

SEQ ID NO: 463731 - DNA, 25 bp, Homo sapien
cagacctcctgacctgggtggttga

SEQ ID NO: 463732 - DNA, 25 bp, Homo sapien
ggttgaggctcaagacagctcaccc

SEQ ID NO: 463733 - DNA, 25 bp, Homo sapien
caagacagctcacccggtccagaag

SEQ ID NO: 463734 - DNA, 25 bp, Homo sapien
agaagctccatgctggtcactaggg

SEQ ID NO: 463735 - DNA, 25 bp, Homo sapien
tcactagggtgctgtgctctctggc

SEQ ID NO: 463736 - DNA, 25 bp, Homo sapien
agggaccccagttgcagggcccaag

SEQ ID NO: 463737 - DNA, 25 bp, Homo sapien
ggagtggacaccaggcttcccagtg

SEQ ID NO: 463738 - DNA, 25 bp, Homo sapien
gcttcccagtggacgtccctgagca

SEQ ID NO: 463739 - DNA, 25 bp, Homo sapien
gcatgcttggttctcccggagcttc

SEQ ID NO: 463740 - DNA, 25 bp, Homo sapien
tcctgctcaggcctcttgagaaatg

SEQ ID NO: 463741 - DNA, 25 bp, Homo sapien
aaatggatgctgtctcagaaggagt

SEQ ID NO: 463742 - DNA, 25 bp, Homo sapien
ctgttcttacttttagcagatggcc

SEQ ID NO: 463743 - DNA, 25 bp, Homo sapien
gttcttacttttagcagatggcctt

SEQ ID NO: 463744 - DNA, 25 bp, Homo sapien
tcttacttttagcagatggccttga

SEQ ID NO: 463745 - DNA, 25 bp, Homo sapien
ttacttttagcagatggccttgact

SEQ ID NO: 463746 - DNA, 25 bp, Homo sapien
acttttagcagatggccttgactgc

SEQ ID NO: 463747 - DNA, 25 bp, Homo sapien
agcagatggccttgactgctacttc

SEQ ID NO: 463748 - DNA, 25 bp, Homo sapien
agatggccttgactgctacttccaa

SEQ ID NO: 463749 - DNA, 25 bp, Homo sapien
atggccttgactgctacttccaaga

SEQ ID NO: 463750 - DNA, 25 bp, Homo sapien
tggccttgactgctacttccaagac

SEQ ID NO: 463751 - DNA, 25 bp, Homo sapien
gccttgactgctacttccaagacaa

SEQ ID NO: 463752 - DNA, 25 bp, Homo sapien
ttgactgctacttccaagacaaaaa

SEQ ID NO: 463753 - DNA, 25 bp, Homo sapien
aaaccaacatcaagtcggcttccat

SEQ ID NO: 463754 - DNA, 25 bp, Homo sapien
tcaagtcggcttccatgcatcccta

SEQ ID NO: 463755 - DNA, 25 bp, Homo sapien
atgcatccctaccagcggtgagtgt

SEQ ID NO: 463756 - DNA, 25 bp, Homo sapien
gactccctggtgctctttgcagagt

SEQ ID NO: 463757 - DNA, 25 bp, Homo sapien
ctggtgctctttgcagagttgggca

SEQ ID NO: 463758 - DNA, 25 bp, Homo sapien
gagttgggcagtgaaattacctttt

SEQ ID NO: 463759 - DNA, 25 bp, Homo sapien
taccttttgctcaaggctcacctag

SEQ ID NO: 463760 - DNA, 25 bp, Homo sapien
ttgctcaaggctcacctagatgggt

SEQ ID NO: 463761 - DNA, 25 bp, Homo sapien
aaggctcacctagatgggtacaata

SEQ ID NO: 463762 - DNA, 25 bp, Homo sapien
gaacatgggctttcagcagcagaca

SEQ ID NO: 463763 - DNA, 25 bp, Homo sapien
tttcagcagcagacaaatcccactt

SEQ ID NO: 463764 - DNA, 25 bp, Homo sapien
agagatgccctgctcatccgactgg

SEQ ID NO: 463765 - DNA, 25 bp, Homo sapien
ggctttgactcccacactgtgtacc

SEQ ID NO: 463766 - DNA, 25 bp, Homo sapien
actgtgtacccctcttgtgtggacg

SEQ ID NO: 463767 - DNA, 25 bp, Homo sapien
tgtgtggacgccctgctgccaaaac

SEQ ID NO: 463768 - DNA, 25 bp, Homo sapien
tcagcaaacagctttccaaatggaa

SEQ ID NO: 463769 - DNA, 25 bp, Homo sapien
atggaagttgtcactgtcagggcct

SEQ ID NO: 463770 - DNA, 25 bp, Homo sapien
gttgtcactgtcagggcctttacaa

SEQ ID NO: 463771 - DNA, 25 bp, Homo sapien
gggcctttacaatcagcaacagcaa

SEQ ID NO: 463772 - DNA, 25 bp, Homo sapien
cagcaaaatctacatgctgctgagg

SEQ ID NO: 463773 - DNA, 25 bp, Homo sapien
tgctgagggtcctgcctcattaaga

SEQ ID NO: 463774 - DNA, 25 bp, Homo sapien
gggtcctgcctcattaagatgcaat

SEQ ID NO: 463775 - DNA, 25 bp, Homo sapien
atctgcttcatctgcccggcgctga

SEQ ID NO: 463776 - DNA, 25 bp, Homo sapien
atctgcccggcgctgatctacaaga

SEQ ID NO: 463777 - DNA, 25 bp, Homo sapien
tgcccggcgctgatctacaagaaaa

SEQ ID NO: 463778 - DNA, 25 bp, Homo sapien
aaatccacaagaacgcactttcctc

SEQ ID NO: 463779 - DNA, 25 bp, Homo sapien
acaagaacgcactttcctcccaggt

SEQ ID NO: 463780 - DNA, 25 bp, Homo sapien
caagaacgcactttcctcccaggtg

SEQ ID NO: 463781 - DNA, 25 bp, Homo sapien
gtggtgctgtgggtcggcctgggcg

SEQ ID NO: 463782 - DNA, 25 bp, Homo sapien
tgtgggtcggcctgggcgtcctggt

SEQ ID NO: 463783 - DNA, 25 bp, Homo sapien
tggtggtgagcactgtcaccacact

SEQ ID NO: 463784 - DNA, 25 bp, Homo sapien
gtggtgagcactgtcaccacactgt

SEQ ID NO: 463785 - DNA, 25 bp, Homo sapien
gtgagcactgtcaccacactgtctg

SEQ ID NO: 463786 - DNA, 25 bp, Homo sapien
gctttctttcctcttagtgaggagg

SEQ ID NO: 463787 - DNA, 25 bp, Homo sapien
ttctttcctcttagtgaggaggtga

SEQ ID NO: 463788 - DNA, 25 bp, Homo sapien
gaggaggtgattcgtagatcccaac

SEQ ID NO: 463789 - DNA, 25 bp, Homo sapien
aggtgattcgtagatcccaactgcc

SEQ ID NO: 463790 - DNA, 25 bp, Homo sapien
tgattcgtagatcccaactgcctat

SEQ ID NO: 463791 - DNA, 25 bp, Homo sapien
ttcgtagatcccaactgcctatgta

SEQ ID NO: 463792 - DNA, 25 bp, Homo sapien
cgtagatcccaactgcctatgtaat

SEQ ID NO: 463793 - DNA, 25 bp, Homo sapien
gatcccaactgcctatgtaatgtaa

SEQ ID NO: 463794 - DNA, 25 bp, Homo sapien
tgctatggtagcacattgtatttgt

SEQ ID NO: 463795 - DNA, 25 bp, Homo sapien
atggtagcacattgtatttgttaat

SEQ ID NO: 463796 - DNA, 25 bp, Homo sapien
caaattctaaaaggttgacaaatgt

SEQ ID NO: 463797 - DNA, 25 bp, Homo sapien
tgcattatgacctagcccccataat

SEQ ID NO: 463798 - DNA, 25 bp, Homo sapien
ccccataattgggatttatcatttt

SEQ ID NO: 463799 - DNA, 25 bp, Homo sapien
gattctttctagagcaagatatgct

SEQ ID NO: 463800 - DNA, 25 bp, Homo sapien
aagatatgctcaaattctcctgttt

SEQ ID NO: 463801 - DNA, 25 bp, Homo sapien
gctcaaattctcctgtttgtatttt

SEQ ID NO: 463802 - DNA, 25 bp, Homo sapien
aagtaacttaatcacagttgtgcat

SEQ ID NO: 463803 - DNA, 25 bp, Homo sapien
taaaacagactgtttcctcaggccc

SEQ ID NO: 463804 - DNA, 25 bp, Homo sapien
gactgtttcctcaggcccattttaa

SEQ ID NO: 463805 - DNA, 25 bp, Homo sapien
ttcctcaggcccattttaaactgaa

SEQ ID NO: 463806 - DNA, 25 bp, Homo sapien
actgaacttatgctaggaaacctta

SEQ ID NO: 463807 - DNA, 25 bp, Homo sapien
gaaagttcatttcatcacttagaaa

SEQ ID NO: 463808 - DNA, 25 bp, Homo sapien
aagcagacatttcttgtttgttgaa

SEQ ID NO: 463809 - DNA, 25 bp, Homo sapien
acagtatagatctcagcccaccaat

SEQ ID NO: 463810 - DNA, 25 bp, Homo sapien
tcagcccaccaatgccaagacaaaa

SEQ ID NO: 463811 - DNA, 25 bp, Homo sapien
aaactaacactccagtattttgtca

SEQ ID NO: 463812 - DNA, 25 bp, Homo sapien
acactccagtattttgtcattgttt

SEQ ID NO: 463813 - DNA, 25 bp, Homo sapien
gtcattgtttttcgcaattgagcta

SEQ ID NO: 463814 - DNA, 25 bp, Homo sapien
gtttttcgcaattgagctatctgaa

SEQ ID NO: 463815 - DNA, 25 bp, Homo sapien
gctatctgaaaactgttattcctaa

SEQ ID NO: 463816 - DNA, 25 bp, Homo sapien
actgttattcctaagtaatgttcaa

SEQ ID NO: 463817 - DNA, 25 bp, Homo sapien
aaatgataagtaatctggatacctt

SEQ ID NO: 463818 - DNA, 25 bp, Homo sapien
tcttatactttctcctaggaaaact

SEQ ID NO: 463819 - DNA, 25 bp, Homo sapien
gtattccccaccatctggtaaatgg

SEQ ID NO: 463820 - DNA, 25 bp, Homo sapien
aaatggcatccacaatgtccagcat

SEQ ID NO: 463821 - DNA, 25 bp, Homo sapien
ctcattcctggtgatgtagccatca

SEQ ID NO: 463822 - DNA, 25 bp, Homo sapien
gtagccatcattgtccaagtcgtag

SEQ ID NO: 463823 - DNA, 25 bp, Homo sapien
agtcgtagagcttgaaggcccaccg

SEQ ID NO: 463824 - DNA, 25 bp, Homo sapien
tcatccagggttccccgtgaggtca

SEQ ID NO: 463825 - DNA, 25 bp, Homo sapien
aggtcaccgacagcgcctggatgaa

SEQ ID NO: 463826 - DNA, 25 bp, Homo sapien
aactcggagaactcaattcgcccgt

SEQ ID NO: 463827 - DNA, 25 bp, Homo sapien
gcccgtccttgttttcatcaaagac

SEQ ID NO: 463828 - DNA, 25 bp, Homo sapien
tcggcattcttatccatcatggcaa

SEQ ID NO: 463829 - DNA, 25 bp, Homo sapien
atcatggcaaagatccggtccaccc

SEQ ID NO: 463830 - DNA, 25 bp, Homo sapien
gaagtttgtatataaggtaagacct

SEQ ID NO: 463831 - DNA, 25 bp, Homo sapien
aaatagcagtctaagctgagtatag

SEQ ID NO: 463832 - DNA, 25 bp, Homo sapien
cagtctaagctgagtatagtggcac

SEQ ID NO: 463833 - DNA, 25 bp, Homo sapien
ctaagctgagtatagtggcacatgc

SEQ ID NO: 463834 - DNA, 25 bp, Homo sapien
cttgagctaagagtttaaggctaca

SEQ ID NO: 463835 - DNA, 25 bp, Homo sapien
gctgtgattgtaactgagaatagcc

SEQ ID NO: 463836 - DNA, 25 bp, Homo sapien
gattgtaactgagaatagccactgt

SEQ ID NO: 463837 - DNA, 25 bp, Homo sapien
ttgtaactgagaatagccactgtac

SEQ ID NO: 463838 - DNA, 25 bp, Homo sapien
tgggtaacacagagagaccatgcct

SEQ ID NO: 463839 - DNA, 25 bp, Homo sapien
ggtaacacagagagaccatgcctca

SEQ ID NO: 463840 - DNA, 25 bp, Homo sapien
taacacagagagaccatgcctcagt

SEQ ID NO: 463841 - DNA, 25 bp, Homo sapien
ccccacatcttacagaatctcgatt

SEQ ID NO: 463842 - DNA, 25 bp, Homo sapien
acagaatctcgattgaatccccggg

SEQ ID NO: 463843 - DNA, 25 bp, Homo sapien
ggcacatccctcagcaggacagcaa

SEQ ID NO: 463844 - DNA, 25 bp, Homo sapien
atgagcgccgagtggccgtggacta

SEQ ID NO: 463845 - DNA, 25 bp, Homo sapien
tggccgtggactaagtgaaggaaat

SEQ ID NO: 463846 - DNA, 25 bp, Homo sapien
gtgaaggaaatgaccatgctcttct

SEQ ID NO: 463847 - DNA, 25 bp, Homo sapien
tgctcttctcccagctggatggcga

SEQ ID NO: 463848 - DNA, 25 bp, Homo sapien
ttctcccagctggatggcgaggccg

SEQ ID NO: 463849 - DNA, 25 bp, Homo sapien
aggaaccgcggaattcctgctcttc

SEQ ID NO: 463850 - DNA, 25 bp, Homo sapien
cgcggaattcctgctcttcgttttc

SEQ ID NO: 463851 - DNA, 25 bp, Homo sapien
aacactttgctgtcaagctatttga

SEQ ID NO: 463852 - DNA, 25 bp, Homo sapien
tgacaataagccagtgttctgccat

SEQ ID NO: 463853 - DNA, 25 bp, Homo sapien
ctgcttatcaagacaaaacctgctc

SEQ ID NO: 463854 - DNA, 25 bp, Homo sapien
caagtttggtggtaagacctgacct

SEQ ID NO: 463855 - DNA, 25 bp, Homo sapien
tggtaagacctgacctgaggcttct

SEQ ID NO: 463856 - DNA, 25 bp, Homo sapien
gacctgaggcttcttataaccttta

SEQ ID NO: 463857 - DNA, 25 bp, Homo sapien
ggcttcttataacctttactcagtg

SEQ ID NO: 463858 - DNA, 25 bp, Homo sapien
taacctttactcagtgggaatatgc

SEQ ID NO: 463859 - DNA, 25 bp, Homo sapien
gggaatatgcatacagttcactaca

SEQ ID NO: 463860 - DNA, 25 bp, Homo sapien
tatgcatacagttcactacagaaat

SEQ ID NO: 463861 - DNA, 25 bp, Homo sapien
ttacttagaggaagtgccctggatc

SEQ ID NO: 463862 - DNA, 25 bp, Homo sapien
agcagttcatgccattattcttaat

SEQ ID NO: 463863 - DNA, 25 bp, Homo sapien
ttcagccaagcacatgggatagaaa

SEQ ID NO: 463864 - DNA, 25 bp, Homo sapien
ggatagaaagtagcaggcggcctct

SEQ ID NO: 463865 - DNA, 25 bp, Homo sapien
agtcctctccagttaacatctagac

SEQ ID NO: 463866 - DNA, 25 bp, Homo sapien
tagaccgaacacaaagcatccttct

SEQ ID NO: 463867 - DNA, 25 bp, Homo sapien
catccttctctcatccagaagacat

SEQ ID NO: 463868 - DNA, 25 bp, Homo sapien
gaagacataggaaccctaccttcag

SEQ ID NO: 463869 - DNA, 25 bp, Homo sapien
ggaaccctaccttcagggatgattt

SEQ ID NO: 463870 - DNA, 25 bp, Homo sapien
ggaacccagggtgttgatactagaa

SEQ ID NO: 463871 - DNA, 25 bp, Homo sapien
gtaactgtttcactaaagcctccag

SEQ ID NO: 463872 - DNA, 25 bp, Homo sapien
ggatacagtaagatgctgccacagt

SEQ ID NO: 463873 - DNA, 25 bp, Homo sapien
gccacagtgagatgcctcacccagg

SEQ ID NO: 463874 - DNA, 25 bp, Homo sapien
gatactagagggaactactcgagta

SEQ ID NO: 463875 - DNA, 25 bp, Homo sapien
ggaactactcgagtaggcgaggtca

SEQ ID NO: 463876 - DNA, 25 bp, Homo sapien
ggcgaggtcagactacataccgaat

SEQ ID NO: 463877 - DNA, 25 bp, Homo sapien
cataccgaataggagtccttccaaa

SEQ ID NO: 463878 - DNA, 25 bp, Homo sapien
atgtaagtcatttcattaacagctg

SEQ ID NO: 463879 - DNA, 25 bp, Homo sapien
cattaacagctgaccgtaaaacttt

SEQ ID NO: 463880 - DNA, 25 bp, Homo sapien
aaattttcaagttatatgagccact

SEQ ID NO: 463881 - DNA, 25 bp, Homo sapien
tatgagccacttttaacctttggtt

SEQ ID NO: 463882 - DNA, 25 bp, Homo sapien
acctctttccaaatcctgatttcac

SEQ ID NO: 463883 - DNA, 25 bp, Homo sapien
tcctgatttcactctgtagcattct

SEQ ID NO: 463884 - DNA, 25 bp, Homo sapien
actctgtagcattctttgcatcatg

SEQ ID NO: 463885 - DNA, 25 bp, Homo sapien
gcaatgtaacttttagccaaattta

SEQ ID NO: 463886 - DNA, 25 bp, Homo sapien
acttttgaaaattcatgtgtcatta

SEQ ID NO: 463887 - DNA, 25 bp, Homo sapien
gaaaattcatgtgtcattaaagtat

SEQ ID NO: 463888 - DNA, 25 bp, Homo sapien
gtgtcattaaagtataacttgctga

SEQ ID NO: 463889 - DNA, 25 bp, Homo sapien
taacttgctgacaaagatgtgtggc

SEQ ID NO: 463890 - DNA, 25 bp, Homo sapien
acttgctgacaaagatgtgtggcat

SEQ ID NO: 463891 - DNA, 25 bp, Homo sapien
ttgctgacaaagatgtgtggcatat

SEQ ID NO: 463892 - DNA, 25 bp, Homo sapien
gctgacaaagatgtgtggcatattt

SEQ ID NO: 463893 - DNA, 25 bp, Homo sapien
acaaagatgtgtggcatattttggc

SEQ ID NO: 463894 - DNA, 25 bp, Homo sapien
atgtgtggcatattttggctaaaaa

SEQ ID NO: 463895 - DNA, 25 bp, Homo sapien
caagtaatcctctcatttcggcttc

SEQ ID NO: 463896 - DNA, 25 bp, Homo sapien
gaacagctccaagtcataggtctag

SEQ ID NO: 463897 - DNA, 25 bp, Homo sapien
aggtctagacttctttgctatgctc

SEQ ID NO: 463898 - DNA, 25 bp, Homo sapien
ttctttgctatgctcctccttaatg

SEQ ID NO: 463899 - DNA, 25 bp, Homo sapien
taatgcccttccaaaattttcctct

SEQ ID NO: 463900 - DNA, 25 bp, Homo sapien
tttcctctagccttttcaaaggtgc

SEQ ID NO: 463901 - DNA, 25 bp, Homo sapien
tttcaaaggtgcctgcccattctac

SEQ ID NO: 463902 - DNA, 25 bp, Homo sapien
ctgcccattctacactggttttttc

SEQ ID NO: 463903 - DNA, 25 bp, Homo sapien
ctctcacagcatctgactaatccga

SEQ ID NO: 463904 - DNA, 25 bp, Homo sapien
actaatccgatcttcactcctgggt

SEQ ID NO: 463905 - DNA, 25 bp, Homo sapien
actcctgggttccttgacattccta

SEQ ID NO: 463906 - DNA, 25 bp, Homo sapien
gacattcctaccattgttcgtatag

SEQ ID NO: 463907 - DNA, 25 bp, Homo sapien
tgtcttccattcctctttgctggaa

SEQ ID NO: 463908 - DNA, 25 bp, Homo sapien
aactgtgacaattcctaaggtttct

SEQ ID NO: 463909 - DNA, 25 bp, Homo sapien
caccacaatggtgctgtaaattcct

SEQ ID NO: 463910 - DNA, 25 bp, Homo sapien
gtgctgtaaattcctgtcttggcca

SEQ ID NO: 463911 - DNA, 25 bp, Homo sapien
gtcttggccaggagatggacaccac

SEQ ID NO: 463912 - DNA, 25 bp, Homo sapien
ggacaccacattttgatggtttctc

SEQ ID NO: 463913 - DNA, 25 bp, Homo sapien
tttctcaaaccgtgtgtgacctttt

SEQ ID NO: 463914 - DNA, 25 bp, Homo sapien
ttctctgttctgtcagtcatggcat

SEQ ID NO: 463915 - DNA, 25 bp, Homo sapien
gtcatggcatggctggacagaattc

SEQ ID NO: 463916 - DNA, 25 bp, Homo sapien
gaattcagggacatctatcaggcct

SEQ ID NO: 463917 - DNA, 25 bp, Homo sapien
ctatcaggcctctcaggagcaatta

SEQ ID NO: 463918 - DNA, 25 bp, Homo sapien
aagtcagtgaacttttctgtgatgt

SEQ ID NO: 463919 - DNA, 25 bp, Homo sapien
ttttctgtgatgttttagggttcct

SEQ ID NO: 463920 - DNA, 25 bp, Homo sapien
tagggttccttataacctggtggct

SEQ ID NO: 463921 - DNA, 25 bp, Homo sapien
gttccttataacctggtggctatta

SEQ ID NO: 463922 - DNA, 25 bp, Homo sapien
cccctcataatccagttctttgtag

SEQ ID NO: 463923 - DNA, 25 bp, Homo sapien
gcagtgatttattttgaactttgta

SEQ ID NO: 463924 - DNA, 25 bp, Homo sapien
gaactttgtaattggagtccctgaa

SEQ ID NO: 463925 - DNA, 25 bp, Homo sapien
gctattaataaggagctttctgaat

SEQ ID NO: 463926 - DNA, 25 bp, Homo sapien
gagctttctgaatcctaattactgt

SEQ ID NO: 463927 - DNA, 25 bp, Homo sapien
gaatcctaattactgtctcaaaaac

SEQ ID NO: 463928 - DNA, 25 bp, Homo sapien
gagtggacacttgagaagtttttca

SEQ ID NO: 463929 - DNA, 25 bp, Homo sapien
ttgcctgtggctgtctgaactctga

SEQ ID NO: 463930 - DNA, 25 bp, Homo sapien
tggctgtctgaactctgactccctt

SEQ ID NO: 463931 - DNA, 25 bp, Homo sapien
actcccttctctaagctgagtcaat

SEQ ID NO: 463932 - DNA, 25 bp, Homo sapien
tctctaagctgagtcaatgctctaa

SEQ ID NO: 463933 - DNA, 25 bp, Homo sapien
tgcagctctcactgatggctgatcc

SEQ ID NO: 463934 - DNA, 25 bp, Homo sapien
ctgatggctgatcctccacctggat

SEQ ID NO: 463935 - DNA, 25 bp, Homo sapien
cacctggatgttctatttcagactc

SEQ ID NO: 463936 - DNA, 25 bp, Homo sapien
atttcagactcagtatgttcctccc

SEQ ID NO: 463937 - DNA, 25 bp, Homo sapien
taagcctatttcaccctctgttcaa

SEQ ID NO: 463938 - DNA, 25 bp, Homo sapien
cctatttcaccctctgttcaaaaca

SEQ ID NO: 463939 - DNA, 25 bp, Homo sapien
aaacaatttacagcagggcatggtg

SEQ ID NO: 463940 - DNA, 25 bp, Homo sapien
tttccagtcaggagcagtgcactgc

SEQ ID NO: 463941 - DNA, 25 bp, Homo sapien
gtgcactgcgcccaaactgatggag

SEQ ID NO: 463942 - DNA, 25 bp, Homo sapien
gaggcagccataacatcattgacat

SEQ ID NO: 463943 - DNA, 25 bp, Homo sapien
gaataagctctgattatagccttga

SEQ ID NO: 463944 - DNA, 25 bp, Homo sapien
ggaagaactgagtgaagtgcctaaa

SEQ ID NO: 463945 - DNA, 25 bp, Homo sapien
gaagtgcctaaagttgaagctgaaa

SEQ ID NO: 463946 - DNA, 25 bp, Homo sapien
gaaaatatttctccgaagtcacaag

SEQ ID NO: 463947 - DNA, 25 bp, Homo sapien
tccgaagtcacaagatattcctttt

SEQ ID NO: 463948 - DNA, 25 bp, Homo sapien
aagatattccttttgtatctactga

SEQ ID NO: 463949 - DNA, 25 bp, Homo sapien
aaaaatgatcctgactcagcccttg

SEQ ID NO: 463950 - DNA, 25 bp, Homo sapien
ctgactcagcccttggcaatggtag

SEQ ID NO: 463951 - DNA, 25 bp, Homo sapien
aactgtgaaagtcaagccggctact

SEQ ID NO: 463952 - DNA, 25 bp, Homo sapien
tcaagccggctactggcatgccaag

SEQ ID NO: 463953 - DNA, 25 bp, Homo sapien
gcatgccaagactatagacggattt

SEQ ID NO: 463954 - DNA, 25 bp, Homo sapien
agattctttgattcagggctgtgag

SEQ ID NO: 463955 - DNA, 25 bp, Homo sapien
agccagtttgcaacaagctcactaa

SEQ ID NO: 463956 - DNA, 25 bp, Homo sapien
gggactctcagacctgcgaataaga

SEQ ID NO: 463957 - DNA, 25 bp, Homo sapien
caggcggtgggctcgttgttttcat

SEQ ID NO: 463958 - DNA, 25 bp, Homo sapien
gttgttttcatcaatggctctgtgc

SEQ ID NO: 463959 - DNA, 25 bp, Homo sapien
atggctctgtgcaggagcgtctgaa

SEQ ID NO: 463960 - DNA, 25 bp, Homo sapien
aggagcgtctgaaggcacccaccag

SEQ ID NO: 463961 - DNA, 25 bp, Homo sapien
gtgactctctgataaccttaactgt

SEQ ID NO: 463962 - DNA, 25 bp, Homo sapien
gggtaagttctgctccggaatcctg

SEQ ID NO: 463963 - DNA, 25 bp, Homo sapien
gtaagttctgctccggaatcctgtc

SEQ ID NO: 463964 - DNA, 25 bp, Homo sapien
agttctgctccggaatcctgtctct

SEQ ID NO: 463965 - DNA, 25 bp, Homo sapien
tccggaatcctgtctctctggcgtg

SEQ ID NO: 463966 - DNA, 25 bp, Homo sapien
ggaatcctgtctctctggcgtgctt

SEQ ID NO: 463967 - DNA, 25 bp, Homo sapien
aatcctgtctctctggcgtgctttg

SEQ ID NO: 463968 - DNA, 25 bp, Homo sapien
gtctctctggcgtgctttggttgca

SEQ ID NO: 463969 - DNA, 25 bp, Homo sapien
ctctggcgtgctttggttgcatgtt

SEQ ID NO: 463970 - DNA, 25 bp, Homo sapien
cgtgctttggttgcatgtttggttc

SEQ ID NO: 463971 - DNA, 25 bp, Homo sapien
ttgtttgtgaatgaatccattgtgt

SEQ ID NO: 463972 - DNA, 25 bp, Homo sapien
tgtgaatgaatccattgtgttttcc

SEQ ID NO: 463973 - DNA, 25 bp, Homo sapien
atgcagctttcaaatcattgggggg

SEQ ID NO: 463974 - DNA, 25 bp, Homo sapien
aaggatgtctttcaggattatttta

SEQ ID NO: 463975 - DNA, 25 bp, Homo sapien
tatatccttttgctacaagctatag

SEQ ID NO: 463976 - DNA, 25 bp, Homo sapien
acaagctatagctaatgtgctgagc

SEQ ID NO: 463977 - DNA, 25 bp, Homo sapien
tagctaatgtgctgagcttgtgcct

SEQ ID NO: 463978 - DNA, 25 bp, Homo sapien
ctgagcttgtgccttggtgattgat

SEQ ID NO: 463979 - DNA, 25 bp, Homo sapien
agcttgtgccttggtgattgattga

SEQ ID NO: 463980 - DNA, 25 bp, Homo sapien
ttgtgccttggtgattgattgattg

SEQ ID NO: 463981 - DNA, 25 bp, Homo sapien
gattgttttaactgattactgtaga

SEQ ID NO: 463982 - DNA, 25 bp, Homo sapien
gattactgtagatcaacctgatgat

SEQ ID NO: 463983 - DNA, 25 bp, Homo sapien
actgtagatcaacctgatgatttgt

SEQ ID NO: 463984 - DNA, 25 bp, Homo sapien
aaggcaaaccaacacattcatccat

SEQ ID NO: 463985 - DNA, 25 bp, Homo sapien
aaaccaacacattcatccatgagga

SEQ ID NO: 463986 - DNA, 25 bp, Homo sapien
tccatgaggattttggtccattcca

SEQ ID NO: 463987 - DNA, 25 bp, Homo sapien
ggattttggtccattccatttattt

SEQ ID NO: 463988 - DNA, 25 bp, Homo sapien
agtttaacactgtttgtttgagctt

SEQ ID NO: 463989 - DNA, 25 bp, Homo sapien
ttgagcttagggaagacaactacca

SEQ ID NO: 463990 - DNA, 25 bp, Homo sapien
gacaactaccaagaaaggccaggaa

SEQ ID NO: 463991 - DNA, 25 bp, Homo sapien
gaagattccatgcaaaatgttcaat

SEQ ID NO: 463992 - DNA, 25 bp, Homo sapien
atatttgttaactctgtgtacacct

SEQ ID NO: 463993 - DNA, 25 bp, Homo sapien
ctctgtgtacacctaataaaattca

SEQ ID NO: 463994 - DNA, 25 bp, Homo sapien
attcaatgttttcttctcagaagag

SEQ ID NO: 463995 - DNA, 25 bp, Homo sapien
ttctccttctctaacccagaggaca

SEQ ID NO: 463996 - DNA, 25 bp, Homo sapien
tgatttgggtgtggagacctctcag

SEQ ID NO: 463997 - DNA, 25 bp, Homo sapien
tgtggagacctctcaggttgggact

SEQ ID NO: 463998 - DNA, 25 bp, Homo sapien
acttcttgtcagcttggacccctga

SEQ ID NO: 463999 - DNA, 25 bp, Homo sapien
tgaccagtgggctttggcttctcca

SEQ ID NO: 464000 - DNA, 25 bp, Homo sapien
ctccagtgctgcgtgatttgattct

SEQ ID NO: 464001 - DNA, 25 bp, Homo sapien
gcgtgatttgattctgttgtacctt

SEQ ID NO: 464002 - DNA, 25 bp, Homo sapien
ctgttgtaccttcaattcttctgac

SEQ ID NO: 464003 - DNA, 25 bp, Homo sapien
caattcttctgacccgcattataaa

SEQ ID NO: 464004 - DNA, 25 bp, Homo sapien
ttctgacccgcattataaacattat

SEQ ID NO: 464005 - DNA, 25 bp, Homo sapien
tttttgcattttggaagtgactgct

SEQ ID NO: 464006 - DNA, 25 bp, Homo sapien
gaaaactgggcttgattcatgctgc

SEQ ID NO: 464007 - DNA, 25 bp, Homo sapien
atgctgcctcagatgactgtgctag

SEQ ID NO: 464008 - DNA, 25 bp, Homo sapien
actgtgctagagttggtaggcaaaa

SEQ ID NO: 464009 - DNA, 25 bp, Homo sapien
agcaggaacactctcacctgttttg

SEQ ID NO: 464010 - DNA, 25 bp, Homo sapien
ctcacctgttttgcatgctgcagag

SEQ ID NO: 464011 - DNA, 25 bp, Homo sapien
atgctgcagaggaaattttcatccc

SEQ ID NO: 464012 - DNA, 25 bp, Homo sapien
aggcaaaggcaatctccaagaccct

SEQ ID NO: 464013 - DNA, 25 bp, Homo sapien
tccaagaccctcctgtatgtaattc

SEQ ID NO: 464014 - DNA, 25 bp, Homo sapien
aaataaatgccctgtcacgtagatg

SEQ ID NO: 464015 - DNA, 25 bp, Homo sapien
tgccctgtcacgtagatgaagctta

SEQ ID NO: 464016 - DNA, 25 bp, Homo sapien
aaatgctgggctctttttcgttcct

SEQ ID NO: 464017 - DNA, 25 bp, Homo sapien
gtaactctgacttaggaatagagac

SEQ ID NO: 464018 - DNA, 25 bp, Homo sapien
gacttaggaatagagacagccagag

SEQ ID NO: 464019 - DNA, 25 bp, Homo sapien
gagacatctggagtgtgcgtgcttc

SEQ ID NO: 464020 - DNA, 25 bp, Homo sapien
acatctggagtgtgcgtgcttcttc

SEQ ID NO: 464021 - DNA, 25 bp, Homo sapien
ctggagtgtgcgtgcttcttcagag

SEQ ID NO: 464022 - DNA, 25 bp, Homo sapien
gcagattggaaaaagcaccgcagat

SEQ ID NO: 464023 - DNA, 25 bp, Homo sapien
agcaccgcagatgggaaccttaatc

SEQ ID NO: 464024 - DNA, 25 bp, Homo sapien
cagatgggaaccttaatctttcttt

SEQ ID NO: 464025 - DNA, 25 bp, Homo sapien
attgatgctatgaaaatttgcgttt

SEQ ID NO: 464026 - DNA, 25 bp, Homo sapien
gaaaatttgcgttttctgtaacttg

SEQ ID NO: 464027 - DNA, 25 bp, Homo sapien
aaaactaaaagttgcttgtctactg

SEQ ID NO: 464028 - DNA, 25 bp, Homo sapien
gttgagctatttgtgcttgtaaatc

SEQ ID NO: 464029 - DNA, 25 bp, Homo sapien
gagctatttgtgcttgtaaatcact

SEQ ID NO: 464030 - DNA, 25 bp, Homo sapien
gtgcttgtaaatcacttacttcagt

SEQ ID NO: 464031 - DNA, 25 bp, Homo sapien
acttacttcagtgtttattgctaaa

SEQ ID NO: 464032 - DNA, 25 bp, Homo sapien
cttcagtgtttattgctaaaagtaa

SEQ ID NO: 464033 - DNA, 25 bp, Homo sapien
gtaaaacatctacaatggatttgaa

SEQ ID NO: 464034 - DNA, 25 bp, Homo sapien
gaagtaatactcaatcttgagggaa

SEQ ID NO: 464035 - DNA, 25 bp, Homo sapien
agattcgatttgttcttgagtaaca

SEQ ID NO: 464036 - DNA, 25 bp, Homo sapien
taatttgtcttgagcagctttgttt

SEQ ID NO: 464037 - DNA, 25 bp, Homo sapien
tgtttgtattttgatcttttgatgc

SEQ ID NO: 464038 - DNA, 25 bp, Homo sapien
taattgttcattttgttgagctatt

SEQ ID NO: 464039 - DNA, 25 bp, Homo sapien
aggactgttttatagactctatgct

SEQ ID NO: 464040 - DNA, 25 bp, Homo sapien
gactctatgctctttttgttttact

SEQ ID NO: 464041 - DNA, 25 bp, Homo sapien
ttaagttttggtgtatccatctctt

SEQ ID NO: 464042 - DNA, 25 bp, Homo sapien
atctcttcgacactgatgatctgca

SEQ ID NO: 464043 - DNA, 25 bp, Homo sapien
caggagttggtcagcttcacagtct

SEQ ID NO: 464044 - DNA, 25 bp, Homo sapien
gtcagcttcacagtctggcagatca

SEQ ID NO: 464045 - DNA, 25 bp, Homo sapien
gtctggcagatcacccttgacaaca

SEQ ID NO: 464046 - DNA, 25 bp, Homo sapien
atgcttgttgttgtaatcgagccaa

SEQ ID NO: 464047 - DNA, 25 bp, Homo sapien
ttgcaaggcatgtatctgatattaa

SEQ ID NO: 464048 - DNA, 25 bp, Homo sapien
ctgatattaattctggacccgccaa

SEQ ID NO: 464049 - DNA, 25 bp, Homo sapien
ggacccgccaagagagaattcaagt

SEQ ID NO: 464050 - DNA, 25 bp, Homo sapien
agtaggatctacaaatgtccgaata

SEQ ID NO: 464051 - DNA, 25 bp, Homo sapien
tgtccgaataggaagcacgattttt

SEQ ID NO: 464052 - DNA, 25 bp, Homo sapien
cacgatttttggagagcgggattac

SEQ ID NO: 464053 - DNA, 25 bp, Homo sapien
tggagagcgggattactcaaagaaa

SEQ ID NO: 464054 - DNA, 25 bp, Homo sapien
gaaggccccgctggaggtggcacag

SEQ ID NO: 464055 - DNA, 25 bp, Homo sapien
gaatactgagagcactaactatgca

SEQ ID NO: 464056 - DNA, 25 bp, Homo sapien
gagcactaactatgcactaacctag

SEQ ID NO: 464057 - DNA, 25 bp, Homo sapien
ctatgcactaacctagattttcatt

SEQ ID NO: 464058 - DNA, 25 bp, Homo sapien
gtggagagcactaatgatcacgtgt

SEQ ID NO: 464059 - DNA, 25 bp, Homo sapien
gatcacgtgtgttgatggaaaccat

SEQ ID NO: 464060 - DNA, 25 bp, Homo sapien
gttgatggaaaccatctgtgcttag

SEQ ID NO: 464061 - DNA, 25 bp, Homo sapien
gcagatgttcctctaagacatcgat

SEQ ID NO: 464062 - DNA, 25 bp, Homo sapien
agacatcgattacagaagccttata

SEQ ID NO: 464063 - DNA, 25 bp, Homo sapien
gaagccttatatacatggatttgat

SEQ ID NO: 464064 - DNA, 25 bp, Homo sapien
gtagctgaaagtcactgttgtctaa

SEQ ID NO: 464065 - DNA, 25 bp, Homo sapien
gtcactgttgtctaaaactaacttt

SEQ ID NO: 464066 - DNA, 25 bp, Homo sapien
aatggcatgaaggattgtgtgacac

SEQ ID NO: 464067 - DNA, 25 bp, Homo sapien
actctcttcctttggccattagagg

SEQ ID NO: 464068 - DNA, 25 bp, Homo sapien
tcctttggccattagagggaggtgt

SEQ ID NO: 464069 - DNA, 25 bp, Homo sapien
ggaggtgttgcctttcattgacgct

SEQ ID NO: 464070 - DNA, 25 bp, Homo sapien
gttgcctttcattgacgcttagaag

SEQ ID NO: 464071 - DNA, 25 bp, Homo sapien
gcttagaagcaaattgttcacttgt

SEQ ID NO: 464072 - DNA, 25 bp, Homo sapien
acagacttaagtatgtcctcactgg

SEQ ID NO: 464073 - DNA, 25 bp, Homo sapien
cagacttaagtatgtcctcactgga

SEQ ID NO: 464074 - DNA, 25 bp, Homo sapien
agacttaagtatgtcctcactggaa

SEQ ID NO: 464075 - DNA, 25 bp, Homo sapien
ttaagatcaatggcaaggtccgtac

SEQ ID NO: 464076 - DNA, 25 bp, Homo sapien
taagatcaatggcaaggtccgtact

SEQ ID NO: 464077 - DNA, 25 bp, Homo sapien
aagatcaatggcaaggtccgtactg

SEQ ID NO: 464078 - DNA, 25 bp, Homo sapien
agatcaatggcaaggtccgtactga

SEQ ID NO: 464079 - DNA, 25 bp, Homo sapien
gatcaatggcaaggtccgtactgat

SEQ ID NO: 464080 - DNA, 25 bp, Homo sapien
gatttcccaaagatacttattctca

SEQ ID NO: 464081 - DNA, 25 bp, Homo sapien
gaaatgtcagctgtccacttaacgg

SEQ ID NO: 464082 - DNA, 25 bp, Homo sapien
ttcgataggcggcaggcacaactaa

SEQ ID NO: 464083 - DNA, 25 bp, Homo sapien
taaaagccaaactcgacctaagtct

SEQ ID NO: 464084 - DNA, 25 bp, Homo sapien
gacctaagtcttatgaaatcctact

SEQ ID NO: 464085 - DNA, 25 bp, Homo sapien
gaaatcctacttaatgagctttctt

SEQ ID NO: 464086 - DNA, 25 bp, Homo sapien
ttgactactgctagcctcacttatc

SEQ ID NO: 464087 - DNA, 25 bp, Homo sapien
tcacttatctggcaggagtcgaagg

SEQ ID NO: 464088 - DNA, 25 bp, Homo sapien
gagaggaagccccaagctcctctgt

SEQ ID NO: 464089 - DNA, 25 bp, Homo sapien
agtcctgaaccccttctcaagtgta

SEQ ID NO: 464090 - DNA, 25 bp, Homo sapien
caagtgtaccacttcatccctgctt

SEQ ID NO: 464091 - DNA, 25 bp, Homo sapien
ctcaagaaactcaaagaatcatact

SEQ ID NO: 464092 - DNA, 25 bp, Homo sapien
tcaagaaactcaaagaatcatactg

SEQ ID NO: 464093 - DNA, 25 bp, Homo sapien
caagaaactcaaagaatcatactgt

SEQ ID NO: 464094 - DNA, 25 bp, Homo sapien
aagaaactcaaagaatcatactgtc

SEQ ID NO: 464095 - DNA, 25 bp, Homo sapien
agaaactcaaagaatcatactgtca

SEQ ID NO: 464096 - DNA, 25 bp, Homo sapien
gaaactcaaagaatcatactgtcaa

SEQ ID NO: 464097 - DNA, 25 bp, Homo sapien
aaactcaaagaatcatactgtcaaa

SEQ ID NO: 464098 - DNA, 25 bp, Homo sapien
aactcaaagaatcatactgtcaaag

SEQ ID NO: 464099 - DNA, 25 bp, Homo sapien
tgcacccagccctacgaataatttt

SEQ ID NO: 464100 - DNA, 25 bp, Homo sapien
gcacccagccctacgaataattttt

SEQ ID NO: 464101 - DNA, 25 bp, Homo sapien
tggttctagctactctgtgaggctg

SEQ ID NO: 464102 - DNA, 25 bp, Homo sapien
gcttgggtccaggagatctagactg

SEQ ID NO: 464103 - DNA, 25 bp, Homo sapien
ttgggtccaggagatctagactgca

SEQ ID NO: 464104 - DNA, 25 bp, Homo sapien
gggtccaggagatctagactgcagt

SEQ ID NO: 464105 - DNA, 25 bp, Homo sapien
tgtgatcatgctacagcactcgaag

SEQ ID NO: 464106 - DNA, 25 bp, Homo sapien
gtgatcatgctacagcactcgaagc

SEQ ID NO: 464107 - DNA, 25 bp, Homo sapien
gatcatgctacagcactcgaagcct

SEQ ID NO: 464108 - DNA, 25 bp, Homo sapien
tcatgctacagcactcgaagcctgg

SEQ ID NO: 464109 - DNA, 25 bp, Homo sapien
tacagcactcgaagcctggggaaca

SEQ ID NO: 464110 - DNA, 25 bp, Homo sapien
gggttatgcttgatctatacttcta

SEQ ID NO: 464111 - DNA, 25 bp, Homo sapien
caggctgctgctgaaaaagctgtaa

SEQ ID NO: 464112 - DNA, 25 bp, Homo sapien
agctgtaaccaagtaggaattttag

SEQ ID NO: 464113 - DNA, 25 bp, Homo sapien
tagattgaatagactgcttcagctc

SEQ ID NO: 464114 - DNA, 25 bp, Homo sapien
agactgcttcagctcctgagtttac

SEQ ID NO: 464115 - DNA, 25 bp, Homo sapien
gagtttactgctactcagtctgaga

SEQ ID NO: 464116 - DNA, 25 bp, Homo sapien
tctgagattgcagactggtgtgaag

SEQ ID NO: 464117 - DNA, 25 bp, Homo sapien
aaggtgtgcagcgtgggtgccctct

SEQ ID NO: 464118 - DNA, 25 bp, Homo sapien
cctctgtgcctatttagtagttccc

SEQ ID NO: 464119 - DNA, 25 bp, Homo sapien
ttagtagttccctgctgaagactgg

SEQ ID NO: 464120 - DNA, 25 bp, Homo sapien
tggaagactggtcagcagctcacac

SEQ ID NO: 464121 - DNA, 25 bp, Homo sapien
gacgtgctcaccgtggagtgctaca

SEQ ID NO: 464122 - DNA, 25 bp, Homo sapien
gcggcgccgctgcaggtgggagtga

SEQ ID NO: 464123 - DNA, 25 bp, Homo sapien
tgggagtgagcactgcgggcgtctc

SEQ ID NO: 464124 - DNA, 25 bp, Homo sapien
agaagaagtacaagaagtgcatcca

SEQ ID NO: 464125 - DNA, 25 bp, Homo sapien
ttcagccccgagctcaacgagtgga

SEQ ID NO: 464126 - DNA, 25 bp, Homo sapien
gccccgagctcaacgagtggacgga

SEQ ID NO: 464127 - DNA, 25 bp, Homo sapien
aggacgacgagctacccgaggccac

SEQ ID NO: 464128 - DNA, 25 bp, Homo sapien
tacccgaggccactgtcggcgtgtc

SEQ ID NO: 464129 - DNA, 25 bp, Homo sapien
gatgcccaacaacgtgactcgggaa

SEQ ID NO: 464130 - DNA, 25 bp, Homo sapien
caacaacgtgactcgggaatcccgg

SEQ ID NO: 464131 - DNA, 25 bp, Homo sapien
acgtgactcgggaatcccgggccag

SEQ ID NO: 464132 - DNA, 25 bp, Homo sapien
ctcagccaggtgaccttcgggcgct

SEQ ID NO: 464133 - DNA, 25 bp, Homo sapien
agccaggtgaccttcgggcgctcct

SEQ ID NO: 464134 - DNA, 25 bp, Homo sapien
gcgctcctccgatggcctctgtgtg

SEQ ID NO: 464135 - DNA, 25 bp, Homo sapien
gtgtggaccccgaggagctgaacct

SEQ ID NO: 464136 - DNA, 25 bp, Homo sapien
tggaccccgaggagctgaacctcac

SEQ ID NO: 464137 - DNA, 25 bp, Homo sapien
tgaacctcaccacgtccagtccagg

SEQ ID NO: 464138 - DNA, 25 bp, Homo sapien
cagcggccaccaccgtgagcaggtt

SEQ ID NO: 464139 - DNA, 25 bp, Homo sapien
accaccgtgagcaggttcagcagcc

SEQ ID NO: 464140 - DNA, 25 bp, Homo sapien
gtgagcaggttcagcagcctcctct

SEQ ID NO: 464141 - DNA, 25 bp, Homo sapien
tgctggccccgagggtcccggtgga

SEQ ID NO: 464142 - DNA, 25 bp, Homo sapien
ggaggaggcggccaacaccactggg

SEQ ID NO: 464143 - DNA, 25 bp, Homo sapien
acttttgggctggattcgttgctga

SEQ ID NO: 464144 - DNA, 25 bp, Homo sapien
gattcgttgctgattgtgatctcct

SEQ ID NO: 464145 - DNA, 25 bp, Homo sapien
attgtgatctcctatgggctcatac

SEQ ID NO: 464146 - DNA, 25 bp, Homo sapien
gggctcatactccacactgtattgg

SEQ ID NO: 464147 - DNA, 25 bp, Homo sapien
cactgtattgggtattgccactgga

SEQ ID NO: 464148 - DNA, 25 bp, Homo sapien
acatgtggctcacacgtctgtgctg

SEQ ID NO: 464149 - DNA, 25 bp, Homo sapien
gcttgcttactatgtgcctatgatt

SEQ ID NO: 464150 - DNA, 25 bp, Homo sapien
gattggcttgtctatagtgcaccgc

SEQ ID NO: 464151 - DNA, 25 bp, Homo sapien
gtgcaccgccttggacatcgtgtgt

SEQ ID NO: 464152 - DNA, 25 bp, Homo sapien
tcccacctgttgtcaatcctattgt

SEQ ID NO: 464153 - DNA, 25 bp, Homo sapien
ggagatccatggtgccattgtccga

SEQ ID NO: 464154 - DNA, 25 bp, Homo sapien
ttgtcccaaagctcccaaattagag

SEQ ID NO: 464155 - DNA, 25 bp, Homo sapien
gctcccaaattagaggaaaggctca

SEQ ID NO: 464156 - DNA, 25 bp, Homo sapien
aggaaaggctcaaagtgctgacaaa

SEQ ID NO: 464157 - DNA, 25 bp, Homo sapien
gaagcaaaatgtggattcagcaaac

SEQ ID NO: 464158 - DNA, 25 bp, Homo sapien
gtggattcagcaaacaaattctgga

SEQ ID NO: 464159 - DNA, 25 bp, Homo sapien
atgaaacattcgatatattggagga

SEQ ID NO: 464160 - DNA, 25 bp, Homo sapien
tcggcaaggattaaaagcttactca

SEQ ID NO: 464161 - DNA, 25 bp, Homo sapien
aaagcttactcaaattggccaacat

SEQ ID NO: 464162 - DNA, 25 bp, Homo sapien
aaattggccaacataccctcagctg

SEQ ID NO: 464163 - DNA, 25 bp, Homo sapien
ttggccaacataccctcagctgtat

SEQ ID NO: 464164 - DNA, 25 bp, Homo sapien
cataccctcagctgtatgtgaaagg

SEQ ID NO: 464165 - DNA, 25 bp, Homo sapien
tgaattcctcgttctgcagccaaca

SEQ ID NO: 464166 - DNA, 25 bp, Homo sapien
ctgcagccaacaagtcacctctgag

SEQ ID NO: 464167 - DNA, 25 bp, Homo sapien
acctctgagggccatgtgtctaaac

SEQ ID NO: 464168 - DNA, 25 bp, Homo sapien
tctaaacatagacaggagggacacc

SEQ ID NO: 464169 - DNA, 25 bp, Homo sapien
gagggacacctgttgcttcagccaa

SEQ ID NO: 464170 - DNA, 25 bp, Homo sapien
tgttgcttcagccaacacctgctgg

SEQ ID NO: 464171 - DNA, 25 bp, Homo sapien
aacacctgctggcatgtgctgagga

SEQ ID NO: 464172 - DNA, 25 bp, Homo sapien
gctgctttgggtgtgtgcctcttga

SEQ ID NO: 464173 - DNA, 25 bp, Homo sapien
gtgtgcctcttgactttagtgagaa

SEQ ID NO: 464174 - DNA, 25 bp, Homo sapien
gtactttttcatccctaccatgggt

SEQ ID NO: 464175 - DNA, 25 bp, Homo sapien
ttcatccctaccatgggtgaaaagt

SEQ ID NO: 464176 - DNA, 25 bp, Homo sapien
gtgaatacaattgtgaaaccatatc

SEQ ID NO: 464177 - DNA, 25 bp, Homo sapien
gaaaattcttggcaatgccaccctt

SEQ ID NO: 464178 - DNA, 25 bp, Homo sapien
ggcaatgccaccctttttaagaagt

SEQ ID NO: 464179 - DNA, 25 bp, Homo sapien
gagattaaagtttcaatgctgttat

SEQ ID NO: 464180 - DNA, 25 bp, Homo sapien
atcatatctcttaagtgaacccttt

SEQ ID NO: 464181 - DNA, 25 bp, Homo sapien
ttttttcaaatgctcgttctctcca

SEQ ID NO: 464182 - DNA, 25 bp, Homo sapien
gctcgttctctccagggttcagtga

SEQ ID NO: 464183 - DNA, 25 bp, Homo sapien
agatagatagttctgcacttgaaaa

SEQ ID NO: 464184 - DNA, 25 bp, Homo sapien
ctgcacttgaaaattagcttaactt

SEQ ID NO: 464185 - DNA, 25 bp, Homo sapien
aacttttttagttgacttgcatttg

SEQ ID NO: 464186 - DNA, 25 bp, Homo sapien
gacttgcatttgttcaagttgcata

SEQ ID NO: 464187 - DNA, 25 bp, Homo sapien
ctcagccaggtgaccttcgggcgct

SEQ ID NO: 464188 - DNA, 25 bp, Homo sapien
agccaggtgaccttcgggcgctcct

SEQ ID NO: 464189 - DNA, 25 bp, Homo sapien
ggcgctcctccgatggcctctgtgt

SEQ ID NO: 464190 - DNA, 25 bp, Homo sapien
ctcctccgatggcctctgtgtggac

SEQ ID NO: 464191 - DNA, 25 bp, Homo sapien
tgaacctcaccacgtccagtccagg

SEQ ID NO: 464192 - DNA, 25 bp, Homo sapien
agtccaggcccgtccccagaaccag

SEQ ID NO: 464193 - DNA, 25 bp, Homo sapien
agaaccagcggccaccaccgtgagc

SEQ ID NO: 464194 - DNA, 25 bp, Homo sapien
agcaggttcagcagcctcctctcca

SEQ ID NO: 464195 - DNA, 25 bp, Homo sapien
ctccaagctgctggccccgagggtc

SEQ ID NO: 464196 - DNA, 25 bp, Homo sapien
tgctggccccgagggtcccggtgga

SEQ ID NO: 464197 - DNA, 25 bp, Homo sapien
ggaggaggcggccaacaccactggg

SEQ ID NO: 464198 - DNA, 25 bp, Homo sapien
cctttgacaaaggacaagcttatat

SEQ ID NO: 464199 - DNA, 25 bp, Homo sapien
gacaaaggacaagcttatattcgca

SEQ ID NO: 464200 - DNA, 25 bp, Homo sapien
acaaaggacaagcttatattcgcat

SEQ ID NO: 464201 - DNA, 25 bp, Homo sapien
caaaggacaagcttatattcgcatc

SEQ ID NO: 464202 - DNA, 25 bp, Homo sapien
aaaggacaagcttatattcgcatca

SEQ ID NO: 464203 - DNA, 25 bp, Homo sapien
aaggacaagcttatattcgcatcac

SEQ ID NO: 464204 - DNA, 25 bp, Homo sapien
aggacaagcttatattcgcatcaca

SEQ ID NO: 464205 - DNA, 25 bp, Homo sapien
gacaaaatggccatacaagaagggt

SEQ ID NO: 464206 - DNA, 25 bp, Homo sapien
caaaatggccatacaagaagggtga

SEQ ID NO: 464207 - DNA, 25 bp, Homo sapien
aaatggccatacaagaagggtgaga

SEQ ID NO: 464208 - DNA, 25 bp, Homo sapien
atggccatacaagaagggtgagaag

SEQ ID NO: 464209 - DNA, 25 bp, Homo sapien
aatccttagatttaggaaagcaatc

SEQ ID NO: 464210 - DNA, 25 bp, Homo sapien
aagcaatcagttaatgtctttagca

SEQ ID NO: 464211 - DNA, 25 bp, Homo sapien
cagttaatgtctttagcacactaaa

SEQ ID NO: 464212 - DNA, 25 bp, Homo sapien
actaaagcagtattaaacacaggta

SEQ ID NO: 464213 - DNA, 25 bp, Homo sapien
taaacacaggtacaagttggaaatt

SEQ ID NO: 464214 - DNA, 25 bp, Homo sapien
gacaaaatgtctatggtagggaata

SEQ ID NO: 464215 - DNA, 25 bp, Homo sapien
gtttgtgaaaagtgtgctcaacttt

SEQ ID NO: 464216 - DNA, 25 bp, Homo sapien
tgctcaacttttttacaagagtgat

SEQ ID NO: 464217 - DNA, 25 bp, Homo sapien
gagtgatattaacttggatttattt

SEQ ID NO: 464218 - DNA, 25 bp, Homo sapien
tataatttggagaccctttgttatc

SEQ ID NO: 464219 - DNA, 25 bp, Homo sapien
tggagaccctttgttatccaaataa

SEQ ID NO: 464220 - DNA, 25 bp, Homo sapien
tacagccactctgggaaagagttta

SEQ ID NO: 464221 - DNA, 25 bp, Homo sapien
agagtttatgaatttcttatcaagt

SEQ ID NO: 464222 - DNA, 25 bp, Homo sapien
aaacataagacccagcagttgtgct

SEQ ID NO: 464223 - DNA, 25 bp, Homo sapien
ataagacccagcagttgtgctcctg

SEQ ID NO: 464224 - DNA, 25 bp, Homo sapien
tgtgctcctggacattcattccaga

SEQ ID NO: 464225 - DNA, 25 bp, Homo sapien
gaaaacctatattgtacttgtactc

SEQ ID NO: 464226 - DNA, 25 bp, Homo sapien
gtacttgtactcaaatattcatagg

SEQ ID NO: 464227 - DNA, 25 bp, Homo sapien
gtactcaaatattcataggagcttt

SEQ ID NO: 464228 - DNA, 25 bp, Homo sapien
ctcaaatattcataggagctttatt

SEQ ID NO: 464229 - DNA, 25 bp, Homo sapien
ggtacatggttaaacaaaccatcca

SEQ ID NO: 464230 - DNA, 25 bp, Homo sapien
acaaaccatccataacttggaatac

SEQ ID NO: 464231 - DNA, 25 bp, Homo sapien
ctggttcgtcaccatgaactttggt

SEQ ID NO: 464232 - DNA, 25 bp, Homo sapien
tgaactttggtgttcatgccatcat

SEQ ID NO: 464233 - DNA, 25 bp, Homo sapien
atgtacacctactacactctgaagg

SEQ ID NO: 464234 - DNA, 25 bp, Homo sapien
acactctgaaggctgccaacgtgaa

SEQ ID NO: 464235 - DNA, 25 bp, Homo sapien
atcaccagcctgcagatcttgcaga

SEQ ID NO: 464236 - DNA, 25 bp, Homo sapien
atcttgcagatgtttgtaggagcca

SEQ ID NO: 464237 - DNA, 25 bp, Homo sapien
tcagcatcctcacgtacatctggag

SEQ ID NO: 464238 - DNA, 25 bp, Homo sapien
aggatcagggatgccacaccacgat

SEQ ID NO: 464239 - DNA, 25 bp, Homo sapien
gatgccacaccacgatggaacactt

SEQ ID NO: 464240 - DNA, 25 bp, Homo sapien
ggaacacttattctggtccttcatc

SEQ ID NO: 464241 - DNA, 25 bp, Homo sapien
attctggtccttcatcttgtatatg

SEQ ID NO: 464242 - DNA, 25 bp, Homo sapien
gtaacagtggtctgaggcccttggc

SEQ ID NO: 464243 - DNA, 25 bp, Homo sapien
tcactatcctgcctgcctttatctg

SEQ ID NO: 464244 - DNA, 25 bp, Homo sapien
ctttatctgccttgccctgcgatta

SEQ ID NO: 464245 - DNA, 25 bp, Homo sapien
ccctgcgattatttggctttgtaag

SEQ ID NO: 464246 - DNA, 25 bp, Homo sapien
ttggctttgtaagcataagctacgt

SEQ ID NO: 464247 - DNA, 25 bp, Homo sapien
aagctacgtaagacataccacacct

SEQ ID NO: 464248 - DNA, 25 bp, Homo sapien
aagacataccacacctaagaaacta

SEQ ID NO: 464249 - DNA, 25 bp, Homo sapien
acagcaatgaaaacccatacttctg

SEQ ID NO: 464250 - DNA, 25 bp, Homo sapien
ccatacttctgaaaagggtgtcttt

SEQ ID NO: 464251 - DNA, 25 bp, Homo sapien
gatttaccaagatctatgctctttc

SEQ ID NO: 464252 - DNA, 25 bp, Homo sapien
atgctctttcaaatggagactggga

SEQ ID NO: 464253 - DNA, 25 bp, Homo sapien
aagcaatcagttaatgtctttagca

SEQ ID NO: 464254 - DNA, 25 bp, Homo sapien
actaaagcagtattaaacacaggta

SEQ ID NO: 464255 - DNA, 25 bp, Homo sapien
taaagcagtattaaacacaggtaca

SEQ ID NO: 464256 - DNA, 25 bp, Homo sapien
taaacacaggtacaagttggaaatt

SEQ ID NO: 464257 - DNA, 25 bp, Homo sapien
aaacacaggtacaagttggaaattg

SEQ ID NO: 464258 - DNA, 25 bp, Homo sapien
aacacaggtacaagttggaaattgt

SEQ ID NO: 464259 - DNA, 25 bp, Homo sapien
cacaggtacaagttggaaattgtag

SEQ ID NO: 464260 - DNA, 25 bp, Homo sapien
agacaaaatgtctatggtagggaat

SEQ ID NO: 464261 - DNA, 25 bp, Homo sapien
gacaaaatgtctatggtagggaata

SEQ ID NO: 464262 - DNA, 25 bp, Homo sapien
caaaatgtctatggtagggaataaa

SEQ ID NO: 464263 - DNA, 25 bp, Homo sapien
aaatgtctatggtagggaataaaag

SEQ ID NO: 464264 - DNA, 25 bp, Homo sapien
agctacttcggaggttgagtcacga

SEQ ID NO: 464265 - DNA, 25 bp, Homo sapien
tacttcggaggttgagtcacgagaa

SEQ ID NO: 464266 - DNA, 25 bp, Homo sapien
tcggaggttgagtcacgagaattgc

SEQ ID NO: 464267 - DNA, 25 bp, Homo sapien
actcttggaccacagtgccataaaa

SEQ ID NO: 464268 - DNA, 25 bp, Homo sapien
ttggaccacagtgccataaaaataa

SEQ ID NO: 464269 - DNA, 25 bp, Homo sapien
aataaataccaagaagatctctcaa

SEQ ID NO: 464270 - DNA, 25 bp, Homo sapien
ttaagtggaaattaatctactcctg

SEQ ID NO: 464271 - DNA, 25 bp, Homo sapien
attaatctactcctgaatgacttgg

SEQ ID NO: 464272 - DNA, 25 bp, Homo sapien
taatctactcctgaatgacttgggt

SEQ ID NO: 464273 - DNA, 25 bp, Homo sapien
atctactcctgaatgacttgggtaa

SEQ ID NO: 464274 - DNA, 25 bp, Homo sapien
gaatgacttgggtaaacaaagagaa

SEQ ID NO: 464275 - DNA, 25 bp, Homo sapien
ccaaggccatgagtgcacgtgcaaa

SEQ ID NO: 464276 - DNA, 25 bp, Homo sapien
gagtgcacgtgcaaaggctatcaag

SEQ ID NO: 464277 - DNA, 25 bp, Homo sapien
aaaggctatcaaggccctggtaaag

SEQ ID NO: 464278 - DNA, 25 bp, Homo sapien
acaagctccatcgacttgcccacat

SEQ ID NO: 464279 - DNA, 25 bp, Homo sapien
ccactccaagcttgggaagcatgat

SEQ ID NO: 464280 - DNA, 25 bp, Homo sapien
tccaagcttgggaagcatgatcatg

SEQ ID NO: 464281 - DNA, 25 bp, Homo sapien
aagcttgggaagcatgatcatgccc

SEQ ID NO: 464282 - DNA, 25 bp, Homo sapien
ttgggaagcatgatcatgcccacat

SEQ ID NO: 464283 - DNA, 25 bp, Homo sapien
ggaagcatgatcatgcccacattgc

SEQ ID NO: 464284 - DNA, 25 bp, Homo sapien
aagcatgatcatgcccacattgcca

SEQ ID NO: 464285 - DNA, 25 bp, Homo sapien
gcatgatcatgcccacattgccaaa

SEQ ID NO: 464286 - DNA, 25 bp, Homo sapien
tcatttgcagggacaaatactgtgc

SEQ ID NO: 464287 - DNA, 25 bp, Homo sapien
ggacaaatactgtgcgtggatcgat

SEQ ID NO: 464288 - DNA, 25 bp, Homo sapien
atactgtgcgtggatcgatgatgac

SEQ ID NO: 464289 - DNA, 25 bp, Homo sapien
gatcgatgatgacttccacatatac

SEQ ID NO: 464290 - DNA, 25 bp, Homo sapien
tgacttccacatatacattccttgg

SEQ ID NO: 464291 - DNA, 25 bp, Homo sapien
acattccttggaaagctgaacaaaa

SEQ ID NO: 464292 - DNA, 25 bp, Homo sapien
gtgaaaactctataccgtcatcctc

SEQ ID NO: 464293 - DNA, 25 bp, Homo sapien
tataccgtcatcctcgtcgaactga

SEQ ID NO: 464294 - DNA, 25 bp, Homo sapien
cgtcatcctcgtcgaactgaggtcc

SEQ ID NO: 464295 - DNA, 25 bp, Homo sapien
acaggagagtggtggctcccacgta

SEQ ID NO: 464296 - DNA, 25 bp, Homo sapien
ggtggctcccacgtataggaaattt

SEQ ID NO: 464297 - DNA, 25 bp, Homo sapien
gaattcactcagatttgtctttgaa

SEQ ID NO: 464298 - DNA, 25 bp, Homo sapien
agatttgtctttgaagatcagagaa

SEQ ID NO: 464299 - DNA, 25 bp, Homo sapien
gaagatcagagaattgctgctactc

SEQ ID NO: 464300 - DNA, 25 bp, Homo sapien
gatcagagaattgctgctactcata

SEQ ID NO: 464301 - DNA, 25 bp, Homo sapien
cagagaattgctgctactcatacta

SEQ ID NO: 464302 - DNA, 25 bp, Homo sapien
gagaattgctgctactcatactata

SEQ ID NO: 464303 - DNA, 25 bp, Homo sapien
agaattgctgctactcatactataa

SEQ ID NO: 464304 - DNA, 25 bp, Homo sapien
gaattgctgctactcatactataaa

SEQ ID NO: 464305 - DNA, 25 bp, Homo sapien
attgctgctactcatactataaaag

SEQ ID NO: 464306 - DNA, 25 bp, Homo sapien
gctgctactcatactataaaagaac

SEQ ID NO: 464307 - DNA, 25 bp, Homo sapien
gctactcatactataaaagaactgg

SEQ ID NO: 464308 - DNA, 25 bp, Homo sapien
ggtgtgagcctctgcgtctggacac

SEQ ID NO: 464309 - DNA, 25 bp, Homo sapien
gtgagcctctgcgtctggacacaca

SEQ ID NO: 464310 - DNA, 25 bp, Homo sapien
tgagcctctgcgtctggacacacac

SEQ ID NO: 464311 - DNA, 25 bp, Homo sapien
atgatgacaaagttgaaatacctag

SEQ ID NO: 464312 - DNA, 25 bp, Homo sapien
gatgacaaagttgaaatacctagag

SEQ ID NO: 464313 - DNA, 25 bp, Homo sapien
tgaaatacctagagtttgcaaagca

SEQ ID NO: 464314 - DNA, 25 bp, Homo sapien
gagtttgcaaagcatgtatcaggca

SEQ ID NO: 464315 - DNA, 25 bp, Homo sapien
agtttgcaaagcatgtatcaggcag

SEQ ID NO: 464316 - DNA, 25 bp, Homo sapien
gtttgcaaagcatgtatcaggcaga

SEQ ID NO: 464317 - DNA, 25 bp, Homo sapien
tttgcaaagcatgtatcaggcagac

SEQ ID NO: 464318 - DNA, 25 bp, Homo sapien
ttgcaaagcatgtatcaggcagacc

SEQ ID NO: 464319 - DNA, 25 bp, Homo sapien
cccagctccgaggacggcggcgtct

SEQ ID NO: 464320 - DNA, 25 bp, Homo sapien
tgccctcagccatgggggaatctgt

SEQ ID NO: 464321 - DNA, 25 bp, Homo sapien
gcccctcctgggagcttacctggga

SEQ ID NO: 464322 - DNA, 25 bp, Homo sapien
tgggagcttacctgggacccacctc

SEQ ID NO: 464323 - DNA, 25 bp, Homo sapien
ctgggacccacctcggcgacggaga

SEQ ID NO: 464324 - DNA, 25 bp, Homo sapien
cgacggagaccgcagcagctggaga

SEQ ID NO: 464325 - DNA, 25 bp, Homo sapien
gtgaggcgtgggatcgccaggagta

SEQ ID NO: 464326 - DNA, 25 bp, Homo sapien
gatcgccaggagtagggaggacatc

SEQ ID NO: 464327 - DNA, 25 bp, Homo sapien
gacatcgacgatgtgcccgtagcag

SEQ ID NO: 464328 - DNA, 25 bp, Homo sapien
catcgacgatgtgcccgtagcagtc

SEQ ID NO: 464329 - DNA, 25 bp, Homo sapien
gaaggtttgaaggttacggctcagg

SEQ ID NO: 464330 - DNA, 25 bp, Homo sapien
caaaaccaagttaattactgcctag

SEQ ID NO: 464331 - DNA, 25 bp, Homo sapien
tactgcctagatacaacgggggtag

SEQ ID NO: 464332 - DNA, 25 bp, Homo sapien
gtttgaaatccaatagggcaattat

SEQ ID NO: 464333 - DNA, 25 bp, Homo sapien
tccaatagggcaattattaaacctt

SEQ ID NO: 464334 - DNA, 25 bp, Homo sapien
ttcgactccatatctcacatcctag

SEQ ID NO: 464335 - DNA, 25 bp, Homo sapien
gactccatatctcacatcctagtac

SEQ ID NO: 464336 - DNA, 25 bp, Homo sapien
tccatatctcacatcctagtacact

SEQ ID NO: 464337 - DNA, 25 bp, Homo sapien
atatctcacatcctagtacactgat

SEQ ID NO: 464338 - DNA, 25 bp, Homo sapien
tctcacatcctagtacactgatgca

SEQ ID NO: 464339 - DNA, 25 bp, Homo sapien
acatcctagtacactgatgcaagag

SEQ ID NO: 464340 - DNA, 25 bp, Homo sapien
tgatgcaagagtgggctcccaaggc

SEQ ID NO: 464341 - DNA, 25 bp, Homo sapien
aaattgtcccctctattctaaggat

SEQ ID NO: 464342 - DNA, 25 bp, Homo sapien
attgtcccctctattctaaggattt

SEQ ID NO: 464343 - DNA, 25 bp, Homo sapien
gtcccctctattctaaggatttcat

SEQ ID NO: 464344 - DNA, 25 bp, Homo sapien
tctattctaaggatttcatcgtcag

SEQ ID NO: 464345 - DNA, 25 bp, Homo sapien
attctaaggatttcatcgtcagatg

SEQ ID NO: 464346 - DNA, 25 bp, Homo sapien
ctaaggatttcatcgtcagatggga

SEQ ID NO: 464347 - DNA, 25 bp, Homo sapien
tcaccaccccccaggagtggtgtgg

SEQ ID NO: 464348 - DNA, 25 bp, Homo sapien
aaacagagacattcaaagcgccctc

SEQ ID NO: 464349 - DNA, 25 bp, Homo sapien
agagacattcaaagcgccctctgga

SEQ ID NO: 464350 - DNA, 25 bp, Homo sapien
gagacattcaaagcgccctctggag

SEQ ID NO: 464351 - DNA, 25 bp, Homo sapien
acattcaaagcgccctctggaggct

SEQ ID NO: 464352 - DNA, 25 bp, Homo sapien
atgcaccgaacccaatacgttcatt

SEQ ID NO: 464353 - DNA, 25 bp, Homo sapien
aatacgttcattccccgtatgatcg

SEQ ID NO: 464354 - DNA, 25 bp, Homo sapien
attccccgtatgatcgtcctggttg

SEQ ID NO: 464355 - DNA, 25 bp, Homo sapien
gtatgatcgtcctggttggaaccct

SEQ ID NO: 464356 - DNA, 25 bp, Homo sapien
gatcgtcctggttggaaccctcggt

SEQ ID NO: 464357 - DNA, 25 bp, Homo sapien
ggcctgatgagcaggtctcgagcct

SEQ ID NO: 464358 - DNA, 25 bp, Homo sapien
ggttggaaccctcggttctgcatca

SEQ ID NO: 464359 - DNA, 25 bp, Homo sapien
aaccctcggttctgcatcatctcgg

SEQ ID NO: 464360 - DNA, 25 bp, Homo sapien
tgatgagcaggtctcgagcctccat

SEQ ID NO: 464361 - DNA, 25 bp, Homo sapien
aggtctcgagcctccatccatcggg

SEQ ID NO: 464362 - DNA, 25 bp, Homo sapien
ggagcatccccgcgatgtcctatgc

SEQ ID NO: 464363 - DNA, 25 bp, Homo sapien
acacaacgtgcatcccactgagctg

SEQ ID NO: 464364 - DNA, 25 bp, Homo sapien
cacaacgtgcatcccactgagctgg

SEQ ID NO: 464365 - DNA, 25 bp, Homo sapien
caacgtgcatcccactgagctggtg

SEQ ID NO: 464366 - DNA, 25 bp, Homo sapien
cactgagctggtgggcttcttgcct

SEQ ID NO: 464367 - DNA, 25 bp, Homo sapien
actgagctggtgggcttcttgcctg

SEQ ID NO: 464368 - DNA, 25 bp, Homo sapien
ctgggtcacaagtctgtggctcatg

SEQ ID NO: 464369 - DNA, 25 bp, Homo sapien
tgggtcacaagtctgtggctcatgt

SEQ ID NO: 464370 - DNA, 25 bp, Homo sapien
gggtcacaagtctgtggctcatgtc

SEQ ID NO: 464371 - DNA, 25 bp, Homo sapien
ggtcacaagtctgtggctcatgtca

SEQ ID NO: 464372 - DNA, 25 bp, Homo sapien
gtcacaagtctgtggctcatgtcac

SEQ ID NO: 464373 - DNA, 25 bp, Homo sapien
tcacaagtctgtggctcatgtcacc

SEQ ID NO: 464374 - DNA, 25 bp, Homo sapien
ggctggggcaataccctgagctcag

SEQ ID NO: 464375 - DNA, 25 bp, Homo sapien
gctggggcaataccctgagctcagg

SEQ ID NO: 464376 - DNA, 25 bp, Homo sapien
agctcaggggccgactacccagatg

SEQ ID NO: 464377 - DNA, 25 bp, Homo sapien
gctcaggggccgactacccagatga

SEQ ID NO: 464378 - DNA, 25 bp, Homo sapien
tcaggggccgactacccagatgagc

SEQ ID NO: 464379 - DNA, 25 bp, Homo sapien
caggggccgactacccagatgagct

SEQ ID NO: 464380 - DNA, 25 bp, Homo sapien
aggggccgactacccagatgagctg

SEQ ID NO: 464381 - DNA, 25 bp, Homo sapien
ctgtgctgacccaggctaagtgtaa

SEQ ID NO: 464382 - DNA, 25 bp, Homo sapien
gtctgcaatggacagcttcaaggaa

SEQ ID NO: 464383 - DNA, 25 bp, Homo sapien
gcaatggacagcttcaaggaattgt

SEQ ID NO: 464384 - DNA, 25 bp, Homo sapien
ctgtgcccagaagagaaggcctgga

SEQ ID NO: 464385 - DNA, 25 bp, Homo sapien
aataaaggtagattcgatgggcccg

SEQ ID NO: 464386 - DNA, 25 bp, Homo sapien
ataaaggtagattcgatgggcccga

SEQ ID NO: 464387 - DNA, 25 bp, Homo sapien
aaggtagattcgatgggcccgaggc

SEQ ID NO: 464388 - DNA, 25 bp, Homo sapien
aggtagattcgatgggcccgaggct

SEQ ID NO: 464389 - DNA, 25 bp, Homo sapien
gtagattcgatgggcccgaggctca

SEQ ID NO: 464390 - DNA, 25 bp, Homo sapien
tagattcgatgggcccgaggctcag

SEQ ID NO: 464391 - DNA, 25 bp, Homo sapien
agaaagccatgaagcagaagcagct

SEQ ID NO: 464392 - DNA, 25 bp, Homo sapien
gaaagccatgaagcagaagcagctt

SEQ ID NO: 464393 - DNA, 25 bp, Homo sapien
aagccatgaagcagaagcagcttcg

SEQ ID NO: 464394 - DNA, 25 bp, Homo sapien
gccatgaagcagaagcagcttcggc

SEQ ID NO: 464395 - DNA, 25 bp, Homo sapien
ccatgaagcagaagcagcttcggcg

SEQ ID NO: 464396 - DNA, 25 bp, Homo sapien
caggcccagtacctcgaggagaagc

SEQ ID NO: 464397 - DNA, 25 bp, Homo sapien
gcccagtacctcgaggagaagcgca

SEQ ID NO: 464398 - DNA, 25 bp, Homo sapien
aagcgcaggcgcgagcgtgagtggg

SEQ ID NO: 464399 - DNA, 25 bp, Homo sapien
agtatgacctggagcgactgcgtgc

SEQ ID NO: 464400 - DNA, 25 bp, Homo sapien
atgacctggagcgactgcgtgctgc

SEQ ID NO: 464401 - DNA, 25 bp, Homo sapien
ggagcgactgcgtgctgcccagaaa

SEQ ID NO: 464402 - DNA, 25 bp, Homo sapien
gcgactgcgtgctgcccagaaacag

SEQ ID NO: 464403 - DNA, 25 bp, Homo sapien
aacagcttgagagggaacaggagca

SEQ ID NO: 464404 - DNA, 25 bp, Homo sapien
gaggcagagcggctcagccagcggc

SEQ ID NO: 464405 - DNA, 25 bp, Homo sapien
tcagccagcggcagacagaacggga

SEQ ID NO: 464406 - DNA, 25 bp, Homo sapien
ccagcggcagacagaacgggacctg

SEQ ID NO: 464407 - DNA, 25 bp, Homo sapien
ttagatagtgttatatttggttttc

SEQ ID NO: 464408 - DNA, 25 bp, Homo sapien
atggaacaggacttggagcctacct

SEQ ID NO: 464409 - DNA, 25 bp, Homo sapien
ggaacaggacttggagcctacctca

SEQ ID NO: 464410 - DNA, 25 bp, Homo sapien
acaggacttggagcctacctcagtt

SEQ ID NO: 464411 - DNA, 25 bp, Homo sapien
ggacttggagcctacctcagttcag

SEQ ID NO: 464412 - DNA, 25 bp, Homo sapien
ttggagcctacctcagttcagctgc

SEQ ID NO: 464413 - DNA, 25 bp, Homo sapien
ggagcctacctcagttcagctgcgt

SEQ ID NO: 464414 - DNA, 25 bp, Homo sapien
acctcagttcagctgcgtcctcttt

SEQ ID NO: 464415 - DNA, 25 bp, Homo sapien
gtcctctttccccaggaagggtgcg

SEQ ID NO: 464416 - DNA, 25 bp, Homo sapien
tctttccccaggaagggtgcggtca

SEQ ID NO: 464417 - DNA, 25 bp, Homo sapien
ggtgcggtcacctcagtgatgtaca

SEQ ID NO: 464418 - DNA, 25 bp, Homo sapien
ctgcctcaggtagtggagatgacag

SEQ ID NO: 464419 - DNA, 25 bp, Homo sapien
gatgacagtgctggacacagcctct

SEQ ID NO: 464420 - DNA, 25 bp, Homo sapien
cctagccttgacacatcagcaaagt

SEQ ID NO: 464421 - DNA, 25 bp, Homo sapien
tcactagcatcacatgacctcttaa

SEQ ID NO: 464422 - DNA, 25 bp, Homo sapien
gacctcttaagtgtcatgggagaca

SEQ ID NO: 464423 - DNA, 25 bp, Homo sapien
gggagacagtccacattattccaca

SEQ ID NO: 464424 - DNA, 25 bp, Homo sapien
tccacattattccacactgtacctt

SEQ ID NO: 464425 - DNA, 25 bp, Homo sapien
ctctctctttggatttctatctgga

SEQ ID NO: 464426 - DNA, 25 bp, Homo sapien
tggatttctatctggagctcccgac

SEQ ID NO: 464427 - DNA, 25 bp, Homo sapien
gctcccgacttcaccatgtggaaaa

SEQ ID NO: 464428 - DNA, 25 bp, Homo sapien
tcaaaacgtatcttgtgctcattat

SEQ ID NO: 464429 - DNA, 25 bp, Homo sapien
gggactggattccattctcattgcc

SEQ ID NO: 464430 - DNA, 25 bp, Homo sapien
atttcctatggctttatcctccatg

SEQ ID NO: 464431 - DNA, 25 bp, Homo sapien
tggctttatcctccatgcagtcttt

SEQ ID NO: 464432 - DNA, 25 bp, Homo sapien
ttccatctcatgatgcccagcacaa

SEQ ID NO: 464433 - DNA, 25 bp, Homo sapien
acaaagctctgagtacctgtggctc

SEQ ID NO: 464434 - DNA, 25 bp, Homo sapien
atcatcctggttttctacatccctg

SEQ ID NO: 464435 - DNA, 25 bp, Homo sapien
gtcaccacgaagtccccaagcatgt

SEQ ID NO: 464436 - DNA, 25 bp, Homo sapien
ttctggctaatctctatgtgctggt

SEQ ID NO: 464437 - DNA, 25 bp, Homo sapien
atgtgctggtgcctcctgtactcaa

SEQ ID NO: 464438 - DNA, 25 bp, Homo sapien
ctgtactcaatcctattctctatgg

SEQ ID NO: 464439 - DNA, 25 bp, Homo sapien
ggagattcggagtcgacttctaaaa

SEQ ID NO: 464440 - DNA, 25 bp, Homo sapien
ccaacttggcaactgtacatttccc

SEQ ID NO: 464441 - DNA, 25 bp, Homo sapien
aacttggcaactgtacatttcccca

SEQ ID NO: 464442 - DNA, 25 bp, Homo sapien
ttggcaactgtacatttccccatct

SEQ ID NO: 464443 - DNA, 25 bp, Homo sapien
atctccgacctgaaatggatgcccc

SEQ ID NO: 464444 - DNA, 25 bp, Homo sapien
tccgacctgaaatggatgccccttt

SEQ ID NO: 464445 - DNA, 25 bp, Homo sapien
gacctgaaatggatgcccctttctg

SEQ ID NO: 464446 - DNA, 25 bp, Homo sapien
tggatgcccctttctggtgtaatca

SEQ ID NO: 464447 - DNA, 25 bp, Homo sapien
gatgcccctttctggtgtaatcaag

SEQ ID NO: 464448 - DNA, 25 bp, Homo sapien
ttctggtgtaatcaaggcgctgcct

SEQ ID NO: 464449 - DNA, 25 bp, Homo sapien
aatgggacattagttcaagtagcaa

SEQ ID NO: 464450 - DNA, 25 bp, Homo sapien
tagttcaagtagcaactatatcagg

SEQ ID NO: 464451 - DNA, 25 bp, Homo sapien
tctcttttccctcagatgtatattt

SEQ ID NO: 464452 - DNA, 25 bp, Homo sapien
ccaaacactgacattacctacactt

SEQ ID NO: 464453 - DNA, 25 bp, Homo sapien
actgacattacctacacttccacta

SEQ ID NO: 464454 - DNA, 25 bp, Homo sapien
cttccactacccaaagacaaaatgt

SEQ ID NO: 464455 - DNA, 25 bp, Homo sapien
caaaatgtgcccactgtgtgctttt

SEQ ID NO: 464456 - DNA, 25 bp, Homo sapien
gtgtgcttttgagtgtattttcttt

SEQ ID NO: 464457 - DNA, 25 bp, Homo sapien
gttttttgttgggtgcatatttatg

SEQ ID NO: 464458 - DNA, 25 bp, Homo sapien
gatggacttcaattgtactcactgt

SEQ ID NO: 464459 - DNA, 25 bp, Homo sapien
attgttggttttaattagcagcaag

SEQ ID NO: 464460 - DNA, 25 bp, Homo sapien
gcagcaagttgtgatcactttccca

SEQ ID NO: 464461 - DNA, 25 bp, Homo sapien
gttgtgatcactttcccaggtgaat

SEQ ID NO: 464462 - DNA, 25 bp, Homo sapien
tctacgtctgagactaggagtcctg

SEQ ID NO: 464463 - DNA, 25 bp, Homo sapien
ggagtcctgaactgctgacgcgaaa

SEQ ID NO: 464464 - DNA, 25 bp, Homo sapien
tgacgcgaaagaggcgcagttccca

SEQ ID NO: 464465 - DNA, 25 bp, Homo sapien
gaaagaggcgcagttcccaattaat

SEQ ID NO: 464466 - DNA, 25 bp, Homo sapien
attaatacggaaatcgctgtgggag

SEQ ID NO: 464467 - DNA, 25 bp, Homo sapien
gcattctgatgcttgtgatgaacac

SEQ ID NO: 464468 - DNA, 25 bp, Homo sapien
atgtacttgtgtagagacatttcct

SEQ ID NO: 464469 - DNA, 25 bp, Homo sapien
gagaaagcctaggagaagccgattt

SEQ ID NO: 464470 - DNA, 25 bp, Homo sapien
agccgatttggaggttaatgctgta

SEQ ID NO: 464471 - DNA, 25 bp, Homo sapien
ggactgtataccaaatgtaatcttt

SEQ ID NO: 464472 - DNA, 25 bp, Homo sapien
tgtaatctttccaatgctccaatga

SEQ ID NO: 464473 - DNA, 25 bp, Homo sapien
tctgatctcgacttctcgcaaccta

SEQ ID NO: 464474 - DNA, 25 bp, Homo sapien
tcgacttctcgcaacctatccaggt

SEQ ID NO: 464475 - DNA, 25 bp, Homo sapien
ctatttccttccagtgtaacgacaa

SEQ ID NO: 464476 - DNA, 25 bp, Homo sapien
cagtgtaacgacaaccacaagctgt

SEQ ID NO: 464477 - DNA, 25 bp, Homo sapien
acgacaaccacaagctgtcagcact

SEQ ID NO: 464478 - DNA, 25 bp, Homo sapien
gctgtcagcacttcactatttgctg

SEQ ID NO: 464479 - DNA, 25 bp, Homo sapien
agcacttcactatttgctgtcccct

SEQ ID NO: 464480 - DNA, 25 bp, Homo sapien
atcgggatgcagctacgcagcgggc

SEQ ID NO: 464481 - DNA, 25 bp, Homo sapien
cgagccgcggtgtcagggccctttt

SEQ ID NO: 464482 - DNA, 25 bp, Homo sapien
tgggaagcgaattcagtggcgtcaa

SEQ ID NO: 464483 - DNA, 25 bp, Homo sapien
agagccagacctgagtttgtctctc

SEQ ID NO: 464484 - DNA, 25 bp, Homo sapien
gtgcatacaaatcaggagaggaagt

SEQ ID NO: 464485 - DNA, 25 bp, Homo sapien
gaattgaaacgttctaaggtccttg

SEQ ID NO: 464486 - DNA, 25 bp, Homo sapien
tgaaacgttctaaggtccttgtact

SEQ ID NO: 464487 - DNA, 25 bp, Homo sapien
ttctaaggtccttgtactattatgg

SEQ ID NO: 464488 - DNA, 25 bp, Homo sapien
aggtccttgtactattatggaagaa

SEQ ID NO: 464489 - DNA, 25 bp, Homo sapien
tagcctttgctaactcagagaccca

SEQ ID NO: 464490 - DNA, 25 bp, Homo sapien
actcagagacccatactgtgatcta

SEQ ID NO: 464491 - DNA, 25 bp, Homo sapien
agacccatactgtgatctataggat

SEQ ID NO: 464492 - DNA, 25 bp, Homo sapien
actgtgatctataggataaactcta

SEQ ID NO: 464493 - DNA, 25 bp, Homo sapien
taggataaactctaaaagactacta

SEQ ID NO: 464494 - DNA, 25 bp, Homo sapien
tttccaaaagcaggcaaaaagtgag

SEQ ID NO: 464495 - DNA, 25 bp, Homo sapien
agggacacagagatgcatcccatcc

SEQ ID NO: 464496 - DNA, 25 bp, Homo sapien
ggtgtcactgtcctatgggaccatc

SEQ ID NO: 464497 - DNA, 25 bp, Homo sapien
ggaccatctttgctgtgtacttaca

SEQ ID NO: 464498 - DNA, 25 bp, Homo sapien
ttgctgtgtacttacagcccacatc

SEQ ID NO: 464499 - DNA, 25 bp, Homo sapien
ccctttatctacagcatacggaaca

SEQ ID NO: 464500 - DNA, 25 bp, Homo sapien
tacggaacaaggatatgaaggcagc

SEQ ID NO: 464501 - DNA, 25 bp, Homo sapien
aagctcatcggcaaagtggccgtcc

SEQ ID NO: 464502 - DNA, 25 bp, Homo sapien
cctgtcctaggccagaacagttatt

SEQ ID NO: 464503 - DNA, 25 bp, Homo sapien
ggatgtttatcatgttccaggatca

SEQ ID NO: 464504 - DNA, 25 bp, Homo sapien
gttccaggatcactgttggctgcta

SEQ ID NO: 464505 - DNA, 25 bp, Homo sapien
atcactgttggctgctagggacaca

SEQ ID NO: 464506 - DNA, 25 bp, Homo sapien
tactttgttgagtgaatccccaact

SEQ ID NO: 464507 - DNA, 25 bp, Homo sapien
gaatccccaactatgtgaaaacagc

SEQ ID NO: 464508 - DNA, 25 bp, Homo sapien
tgtctgccaccttcaacatcaacag

SEQ ID NO: 464509 - DNA, 25 bp, Homo sapien
gctgttcaagcacatctctgagtgg

SEQ ID NO: 464510 - DNA, 25 bp, Homo sapien
ctctgagtggtcatgtttcggtgca

SEQ ID NO: 464511 - DNA, 25 bp, Homo sapien
catgtttcggtgcaaagcctttctg

SEQ ID NO: 464512 - DNA, 25 bp, Homo sapien
agcctttctgcactggcacatgggc

SEQ ID NO: 464513 - DNA, 25 bp, Homo sapien
gcacatgggcaagagcatggactag

SEQ ID NO: 464514 - DNA, 25 bp, Homo sapien
aacatgaacaacctggtgtcccggt

SEQ ID NO: 464515 - DNA, 25 bp, Homo sapien
ggtgtcccggtaccagtaataccag

SEQ ID NO: 464516 - DNA, 25 bp, Homo sapien
gtaataccaggacacctcagccaag

SEQ ID NO: 464517 - DNA, 25 bp, Homo sapien
tattgagcttcaggccaggtgtgtt

SEQ ID NO: 464518 - DNA, 25 bp, Homo sapien
attgagcttcaggccaggtgtgttg

SEQ ID NO: 464519 - DNA, 25 bp, Homo sapien
agcttcaggccaggtgtgttggctc

SEQ ID NO: 464520 - DNA, 25 bp, Homo sapien
gcttcaggccaggtgtgttggctca

SEQ ID NO: 464521 - DNA, 25 bp, Homo sapien
atgcctgtaattcccaaagtgggga

SEQ ID NO: 464522 - DNA, 25 bp, Homo sapien
gcctgtaattcccaaagtggggatt

SEQ ID NO: 464523 - DNA, 25 bp, Homo sapien
ggattttgagagaccaaagcgggca

SEQ ID NO: 464524 - DNA, 25 bp, Homo sapien
attttgagagaccaaagcgggcaga

SEQ ID NO: 464525 - DNA, 25 bp, Homo sapien
ttttgagagaccaaagcgggcagat

SEQ ID NO: 464526 - DNA, 25 bp, Homo sapien
agcctcagtggcagagtgagcccct

SEQ ID NO: 464527 - DNA, 25 bp, Homo sapien
gcctcagtggcagagtgagcccctg

SEQ ID NO: 464528 - DNA, 25 bp, Homo sapien
gcagctctccgaagagctccgacaa

SEQ ID NO: 464529 - DNA, 25 bp, Homo sapien
ccgaagagctccgacaagtccaaga

SEQ ID NO: 464530 - DNA, 25 bp, Homo sapien
gacaagtccaagagcttcagcatag

SEQ ID NO: 464531 - DNA, 25 bp, Homo sapien
gagcttcagcatagacagcatcctg

SEQ ID NO: 464532 - DNA, 25 bp, Homo sapien
atagacagcatcctggcgggaaagc

SEQ ID NO: 464533 - DNA, 25 bp, Homo sapien
agcagggccagaagccgccttcagg

SEQ ID NO: 464534 - DNA, 25 bp, Homo sapien
gacgaactcctagggggtgccaagc

SEQ ID NO: 464535 - DNA, 25 bp, Homo sapien
atgctcgacccgcatgtccagggcg

SEQ ID NO: 464536 - DNA, 25 bp, Homo sapien
tcgacccgcatgtccagggcggctt

SEQ ID NO: 464537 - DNA, 25 bp, Homo sapien
agggcggcttttaccagctcgggat

SEQ ID NO: 464538 - DNA, 25 bp, Homo sapien
gcttttaccagctcgggatcccctt

SEQ ID NO: 464539 - DNA, 25 bp, Homo sapien
gggagcctggcaactcctgcaagga

SEQ ID NO: 464540 - DNA, 25 bp, Homo sapien
gcccttctgaagaatgcactgcctt

SEQ ID NO: 464541 - DNA, 25 bp, Homo sapien
agaatgcactgccttcactttttac

SEQ ID NO: 464542 - DNA, 25 bp, Homo sapien
cactttttactgtgttagagtccat

SEQ ID NO: 464543 - DNA, 25 bp, Homo sapien
gtccatccagactgttctatccaaa

SEQ ID NO: 464544 - DNA, 25 bp, Homo sapien
gaaatgattcctttcccgactgctt

SEQ ID NO: 464545 - DNA, 25 bp, Homo sapien
actgcttctgtctagtgcctgggaa

SEQ ID NO: 464546 - DNA, 25 bp, Homo sapien
agtgcctgggaatcttgagtcaatc

SEQ ID NO: 464547 - DNA, 25 bp, Homo sapien
gagtcaatccctcagtaagtcagtg

SEQ ID NO: 464548 - DNA, 25 bp, Homo sapien
gtgactagggaaatccctctctgag

SEQ ID NO: 464549 - DNA, 25 bp, Homo sapien
ccagttcatgttgcttagggaacct

SEQ ID NO: 464550 - DNA, 25 bp, Homo sapien
tgcaccccaagaggcgtgagggcaa

SEQ ID NO: 464551 - DNA, 25 bp, Homo sapien
gctcactggcattttcatgataaca

SEQ ID NO: 464552 - DNA, 25 bp, Homo sapien
tggcggtggcgcttttctttggctc

SEQ ID NO: 464553 - DNA, 25 bp, Homo sapien
tggcgcttttctttggctctgtcct

SEQ ID NO: 464554 - DNA, 25 bp, Homo sapien
ggctctgtcctctccgtgtatttcc

SEQ ID NO: 464555 - DNA, 25 bp, Homo sapien
tggccagcgtggtctacgctgtcat

SEQ ID NO: 464556 - DNA, 25 bp, Homo sapien
acgctgtcatcacgccgaccttgaa

SEQ ID NO: 464557 - DNA, 25 bp, Homo sapien
cgaccttgaaccctttcatcaacag

SEQ ID NO: 464558 - DNA, 25 bp, Homo sapien
ttcatcaacagccttcgcaacaaag

SEQ ID NO: 464559 - DNA, 25 bp, Homo sapien
aacagccttcgcaacaaagaggtca

SEQ ID NO: 464560 - DNA, 25 bp, Homo sapien
acaaagaggtcaagggcgccctgaa

SEQ ID NO: 464561 - DNA, 25 bp, Homo sapien
gtcacccctaactacgtggacaacg

SEQ ID NO: 464562 - DNA, 25 bp, Homo sapien
actacgtggacaacgtgagcgcgcg

SEQ ID NO: 464563 - DNA, 25 bp, Homo sapien
ggtgcgactgcggagccagcgggaa

SEQ ID NO: 464564 - DNA, 25 bp, Homo sapien
accggcgtgaggactgcgaagcctt

SEQ ID NO: 464565 - DNA, 25 bp, Homo sapien
gggctctttaccaggaaccgctgct

SEQ ID NO: 464566 - DNA, 25 bp, Homo sapien
taccaggaaccgctgcttggatggt

SEQ ID NO: 464567 - DNA, 25 bp, Homo sapien
gaaccgctgcttggatggtgccatt

SEQ ID NO: 464568 - DNA, 25 bp, Homo sapien
gatggtgccattcaggcctttgcca

SEQ ID NO: 464569 - DNA, 25 bp, Homo sapien
attcaggcctttgccagcgggtggc

SEQ ID NO: 464570 - DNA, 25 bp, Homo sapien
agggagacccggagcacagcctcct

SEQ ID NO: 464571 - DNA, 25 bp, Homo sapien
tggagagacgctccctgctctccat

SEQ ID NO: 464572 - DNA, 25 bp, Homo sapien
tatgtgctcattctgcgttctgtca

SEQ ID NO: 464573 - DNA, 25 bp, Homo sapien
attctgcgttctgtcatggccactg

SEQ ID NO: 464574 - DNA, 25 bp, Homo sapien
atggccactgcttcccgtgaggaac

SEQ ID NO: 464575 - DNA, 25 bp, Homo sapien
gcctcaaagctctcaacacatgtgt

SEQ ID NO: 464576 - DNA, 25 bp, Homo sapien
tgtgtgtcacatatcctggctgtac

SEQ ID NO: 464577 - DNA, 25 bp, Homo sapien
gctgtacttgcattttatgtgccaa

SEQ ID NO: 464578 - DNA, 25 bp, Homo sapien
tctccacagtgcaccgctttgggaa

SEQ ID NO: 464579 - DNA, 25 bp, Homo sapien
atgtcccatgctacatacatgtcct

SEQ ID NO: 464580 - DNA, 25 bp, Homo sapien
aatgtgtacctatttgtgcctcctg

SEQ ID NO: 464581 - DNA, 25 bp, Homo sapien
aaccctctcatttatagcgccaaga

SEQ ID NO: 464582 - DNA, 25 bp, Homo sapien
gacaaaggaaatccgccgagccatt

SEQ ID NO: 464583 - DNA, 25 bp, Homo sapien
cacctctgagcatttggaaaatact

SEQ ID NO: 464584 - DNA, 25 bp, Homo sapien
ggcattggactggattcccaggtaa

SEQ ID NO: 464585 - DNA, 25 bp, Homo sapien
cattggactggattcccaggtaagg

SEQ ID NO: 464586 - DNA, 25 bp, Homo sapien
gtctggagtttcaaaaggacttagt

SEQ ID NO: 464587 - DNA, 25 bp, Homo sapien
gacttagtagtcctttcctcagaga

SEQ ID NO: 464588 - DNA, 25 bp, Homo sapien
cttagtagtcctttcctcagagaac

SEQ ID NO: 464589 - DNA, 25 bp, Homo sapien
tagtagtcctttcctcagagaactg

SEQ ID NO: 464590 - DNA, 25 bp, Homo sapien
gtagtcctttcctcagagaactggt

SEQ ID NO: 464591 - DNA, 25 bp, Homo sapien
gtcctttcctcagagaactggttct

SEQ ID NO: 464592 - DNA, 25 bp, Homo sapien
gaactggttctctaagatgggggct

SEQ ID NO: 464593 - DNA, 25 bp, Homo sapien
agatgggggctttctcataggtaag

SEQ ID NO: 464594 - DNA, 25 bp, Homo sapien
ttcacatatgtcttaaaactttcaa

SEQ ID NO: 464595 - DNA, 25 bp, Homo sapien
tttcctgtttatcccttgtttaatg

SEQ ID NO: 464596 - DNA, 25 bp, Homo sapien
tgttccgttttagttctaagtctat

SEQ ID NO: 464597 - DNA, 25 bp, Homo sapien
gttctaagtctatcctacaactaat

SEQ ID NO: 464598 - DNA, 25 bp, Homo sapien
ggaatgattgtctctgtgttctttg

SEQ ID NO: 464599 - DNA, 25 bp, Homo sapien
taaagtggccagaagcaagcaagtg

SEQ ID NO: 464600 - DNA, 25 bp, Homo sapien
acaggacaattgcagagtttatgga

SEQ ID NO: 464601 - DNA, 25 bp, Homo sapien
ggattaggccaattgcaggcttcca

SEQ ID NO: 464602 - DNA, 25 bp, Homo sapien
aattgcaggcttccacacttaggga

SEQ ID NO: 464603 - DNA, 25 bp, Homo sapien
aggcttccacacttagggaggagaa

SEQ ID NO: 464604 - DNA, 25 bp, Homo sapien
gggaggagaaaacatcctcatgaat

SEQ ID NO: 464605 - DNA, 25 bp, Homo sapien
gattatcttcatctcctatgtgttg

SEQ ID NO: 464606 - DNA, 25 bp, Homo sapien
gtgttgatactcaagactgtcctga

SEQ ID NO: 464607 - DNA, 25 bp, Homo sapien
tgtcctgagcattgcctccagagag

SEQ ID NO: 464608 - DNA, 25 bp, Homo sapien
gagggccaaggctctcattacctgt

SEQ ID NO: 464609 - DNA, 25 bp, Homo sapien
ttacctgtgtctcccatatctgctg

SEQ ID NO: 464610 - DNA, 25 bp, Homo sapien
atctgctgtgtcctggttttttatg

SEQ ID NO: 464611 - DNA, 25 bp, Homo sapien
atgtcacagtgattggattgtctct

SEQ ID NO: 464612 - DNA, 25 bp, Homo sapien
gattgtctctgattcatcgttttgg

SEQ ID NO: 464613 - DNA, 25 bp, Homo sapien
ggttccacatattgttcacctcatt

SEQ ID NO: 464614 - DNA, 25 bp, Homo sapien
atgagctatgcctattttctgttcc

SEQ ID NO: 464615 - DNA, 25 bp, Homo sapien
gttccctccactaatgaatcctata

SEQ ID NO: 464616 - DNA, 25 bp, Homo sapien
gtaaaagacatacatctgccctatc

SEQ ID NO: 464617 - DNA, 25 bp, Homo sapien
aaaagacatacatctgccctatccc

SEQ ID NO: 464618 - DNA, 25 bp, Homo sapien
ccagcgtcctgggtttgagattaca

SEQ ID NO: 464619 - DNA, 25 bp, Homo sapien
cgtcctgggtttgagattacaggca

SEQ ID NO: 464620 - DNA, 25 bp, Homo sapien
gaaggctttttgtccaaacttcaag

SEQ ID NO: 464621 - DNA, 25 bp, Homo sapien
ggctttttgtccaaacttcaagata

SEQ ID NO: 464622 - DNA, 25 bp, Homo sapien
caggttcttaatctcagtaggtgtt

SEQ ID NO: 464623 - DNA, 25 bp, Homo sapien
tctcagtaggtgttggcctccactt

SEQ ID NO: 464624 - DNA, 25 bp, Homo sapien
tcagtaggtgttggcctccactttg

SEQ ID NO: 464625 - DNA, 25 bp, Homo sapien
gcctccactttgtggaataaacaag

SEQ ID NO: 464626 - DNA, 25 bp, Homo sapien
gcttgggaccgtcttaccctcgtca

SEQ ID NO: 464627 - DNA, 25 bp, Homo sapien
aaatgtctatatcctactttttgtt

SEQ ID NO: 464628 - DNA, 25 bp, Homo sapien
tttgtttgcttgttctgtcaattgg

SEQ ID NO: 464629 - DNA, 25 bp, Homo sapien
gtttgcttgttctgtcaattggtaa

SEQ ID NO: 464630 - DNA, 25 bp, Homo sapien
tgcttgttctgtcaattggtaaaaa

SEQ ID NO: 464631 - DNA, 25 bp, Homo sapien
ttctccttgtagttctgtcaatgtt

SEQ ID NO: 464632 - DNA, 25 bp, Homo sapien
ccttgtagttctgtcaatgtttgct

SEQ ID NO: 464633 - DNA, 25 bp, Homo sapien
aaggttatgtcattaggtacatcaa

SEQ ID NO: 464634 - DNA, 25 bp, Homo sapien
aagacaaattaagagcttccagatg

SEQ ID NO: 464635 - DNA, 25 bp, Homo sapien
taagagcttccagatgaattgattc

SEQ ID NO: 464636 - DNA, 25 bp, Homo sapien
agtaatgctttttgtctgaaaattt

SEQ ID NO: 464637 - DNA, 25 bp, Homo sapien
tattactgtaactatatttttcttt

SEQ ID NO: 464638 - DNA, 25 bp, Homo sapien
tcttccatctaatacccctgacact

SEQ ID NO: 464639 - DNA, 25 bp, Homo sapien
gacactcatccttatatcatatgct

SEQ ID NO: 464640 - DNA, 25 bp, Homo sapien
ttttattgtccgagcagtattgagg

SEQ ID NO: 464641 - DNA, 25 bp, Homo sapien
attgtccgagcagtattgaggatac

SEQ ID NO: 464642 - DNA, 25 bp, Homo sapien
cagtattgaggatacagtctgctga

SEQ ID NO: 464643 - DNA, 25 bp, Homo sapien
attgaggatacagtctgctgaaggt

SEQ ID NO: 464644 - DNA, 25 bp, Homo sapien
agtctgctgaaggtcgacaaaaagc

SEQ ID NO: 464645 - DNA, 25 bp, Homo sapien
gctgaaggtcgacaaaaagcatttg

SEQ ID NO: 464646 - DNA, 25 bp, Homo sapien
ggacatgtggttcccatctaattgt

SEQ ID NO: 464647 - DNA, 25 bp, Homo sapien
gtctcttttttatagtacagccgtc

SEQ ID NO: 464648 - DNA, 25 bp, Homo sapien
tcttttttatagtacagccgtctct

SEQ ID NO: 464649 - DNA, 25 bp, Homo sapien
aaaattagagatatgggtcaggcgc

SEQ ID NO: 464650 - DNA, 25 bp, Homo sapien
aaattagagatatgggtcaggcgca

SEQ ID NO: 464651 - DNA, 25 bp, Homo sapien
aattagagatatgggtcaggcgcag

SEQ ID NO: 464652 - DNA, 25 bp, Homo sapien
attagagatatgggtcaggcgcagt

SEQ ID NO: 464653 - DNA, 25 bp, Homo sapien
ttagagatatgggtcaggcgcagtg

SEQ ID NO: 464654 - DNA, 25 bp, Homo sapien
tagagatatgggtcaggcgcagtgg

SEQ ID NO: 464655 - DNA, 25 bp, Homo sapien
gagaccttgttgctactaaaaattt

SEQ ID NO: 464656 - DNA, 25 bp, Homo sapien
gcatggtagtgtgcgcctgtagccc

SEQ ID NO: 464657 - DNA, 25 bp, Homo sapien
catggtagtgtgcgcctgtagcccc

SEQ ID NO: 464658 - DNA, 25 bp, Homo sapien
atggtagtgtgcgcctgtagcccca

SEQ ID NO: 464659 - DNA, 25 bp, Homo sapien
gtgacagagtgaaaccctatcaaaa

SEQ ID NO: 464660 - DNA, 25 bp, Homo sapien
ttctcccgcagttgttcagggtatg

SEQ ID NO: 464661 - DNA, 25 bp, Homo sapien
tcagggtatggcatatgcagcagcc

SEQ ID NO: 464662 - DNA, 25 bp, Homo sapien
tatgcagcagccatgggaaggcaaa

SEQ ID NO: 464663 - DNA, 25 bp, Homo sapien
gaaggcaaaagtattctacctttgt

SEQ ID NO: 464664 - DNA, 25 bp, Homo sapien
caaggatcagaagggccagtttgtt

SEQ ID NO: 464665 - DNA, 25 bp, Homo sapien
cagtttgtttctcctgtggcaagac

SEQ ID NO: 464666 - DNA, 25 bp, Homo sapien
agggctctaaaagggctccttctgg

SEQ ID NO: 464667 - DNA, 25 bp, Homo sapien
taaaagggctccttctgggctttgt

SEQ ID NO: 464668 - DNA, 25 bp, Homo sapien
gggctttgtcccagatgtaagaaag

SEQ ID NO: 464669 - DNA, 25 bp, Homo sapien
gtaagaaaggctaccactggaacag

SEQ ID NO: 464670 - DNA, 25 bp, Homo sapien
aaagatgggaatccacttcctcctt

SEQ ID NO: 464671 - DNA, 25 bp, Homo sapien
agccttgaagacaacagcctgcatt

SEQ ID NO: 464672 - DNA, 25 bp, Homo sapien
gcctgcattcttgatataggttctt

SEQ ID NO: 464673 - DNA, 25 bp, Homo sapien
ataggttcttagtgttcgagggagc

SEQ ID NO: 464674 - DNA, 25 bp, Homo sapien
tggaacttactctcaaaggattgtg

SEQ ID NO: 464675 - DNA, 25 bp, Homo sapien
aggattgtggttgcctgttttgacc

SEQ ID NO: 464676 - DNA, 25 bp, Homo sapien
tggttgcctgttttgacctgtctgt

SEQ ID NO: 464677 - DNA, 25 bp, Homo sapien
ttgacctgtctgttggttccctgaa

SEQ ID NO: 464678 - DNA, 25 bp, Homo sapien
ctgttggttccctgaaggatgagca

SEQ ID NO: 464679 - DNA, 25 bp, Homo sapien
ttcacctaacttagaattctcccag

SEQ ID NO: 464680 - DNA, 25 bp, Homo sapien
agaattctcccagggctgaagcagc

SEQ ID NO: 464681 - DNA, 25 bp, Homo sapien
aaatgcattcactaatggtaacagt

SEQ ID NO: 464682 - DNA, 25 bp, Homo sapien
ttgctttcgttttgaaccgcccttg

SEQ ID NO: 464683 - DNA, 25 bp, Homo sapien
aaccgcccttgtaatcgcctgaaat

SEQ ID NO: 464684 - DNA, 25 bp, Homo sapien
aatcgcctgaaatcgctagttcttt

SEQ ID NO: 464685 - DNA, 25 bp, Homo sapien
gctagttctttatgcggtggctgcc

SEQ ID NO: 464686 - DNA, 25 bp, Homo sapien
ggtggctgccgctgtgttccgttat

SEQ ID NO: 464687 - DNA, 25 bp, Homo sapien
gttccgttattttcagtaggtgtca

SEQ ID NO: 464688 - DNA, 25 bp, Homo sapien
tctgttcgccgctggttttaaacca

SEQ ID NO: 464689 - DNA, 25 bp, Homo sapien
agcttgctgtgtgcatctcagacgt

SEQ ID NO: 464690 - DNA, 25 bp, Homo sapien
gtgcatctcagacgtcggttggtac

SEQ ID NO: 464691 - DNA, 25 bp, Homo sapien
gaaagcgatagcctcacctatttga

SEQ ID NO: 464692 - DNA, 25 bp, Homo sapien
aacaagccctgagaggaaacgcaga

SEQ ID NO: 464693 - DNA, 25 bp, Homo sapien
tctgtgctttcggattctggatgtt

SEQ ID NO: 464694 - DNA, 25 bp, Homo sapien
atgttttctattcacttaccatcga

SEQ ID NO: 464695 - DNA, 25 bp, Homo sapien
tgaaagtctggcaggatgacagcat

SEQ ID NO: 464696 - DNA, 25 bp, Homo sapien
gacagcataaatggtccactgcaga

SEQ ID NO: 464697 - DNA, 25 bp, Homo sapien
cactgcagagcttgaggttgtacca

SEQ ID NO: 464698 - DNA, 25 bp, Homo sapien
gtaccaggagaaggtgcgacatcac

SEQ ID NO: 464699 - DNA, 25 bp, Homo sapien
gggaaatccaggacctccgaggtag

SEQ ID NO: 464700 - DNA, 25 bp, Homo sapien
ggacctccgaggtagcatgaaccag

SEQ ID NO: 464701 - DNA, 25 bp, Homo sapien
gctcattgccaagctccaggagatg

SEQ ID NO: 464702 - DNA, 25 bp, Homo sapien
gatggaagccatgtccgatgagcaa

SEQ ID NO: 464703 - DNA, 25 bp, Homo sapien
gtccgatgagcaaaaaatggcccag

SEQ ID NO: 464704 - DNA, 25 bp, Homo sapien
aaccaaagattcatgattgtttcct

SEQ ID NO: 464705 - DNA, 25 bp, Homo sapien
acagtcttgactctccattagcaat

SEQ ID NO: 464706 - DNA, 25 bp, Homo sapien
tgactctccattagcaataacccac

SEQ ID NO: 464707 - DNA, 25 bp, Homo sapien
aataacccacatctgccatttgtct

SEQ ID NO: 464708 - DNA, 25 bp, Homo sapien
atttgtctccatcaatctggtgacc

SEQ ID NO: 464709 - DNA, 25 bp, Homo sapien
atgtcacagccaatatggtattttt

SEQ ID NO: 464710 - DNA, 25 bp, Homo sapien
taaatggtcaagtagacgtctcaaa

SEQ ID NO: 464711 - DNA, 25 bp, Homo sapien
aagtagacgtctcaaatactccagc

SEQ ID NO: 464712 - DNA, 25 bp, Homo sapien
ctcccactgggagcgtaattaatcc

SEQ ID NO: 464713 - DNA, 25 bp, Homo sapien
tcagtaaatggttccagcatcccct

SEQ ID NO: 464714 - DNA, 25 bp, Homo sapien
ttccagcatcccctaattatttaaa

SEQ ID NO: 464715 - DNA, 25 bp, Homo sapien
gacactatggcttgggaggaaccct

SEQ ID NO: 464716 - DNA, 25 bp, Homo sapien
gaggaaccctaaatatccttggaag

SEQ ID NO: 464717 - DNA, 25 bp, Homo sapien
gcttgaccactatgccattaccaag

SEQ ID NO: 464718 - DNA, 25 bp, Homo sapien
tgaccactatgccattaccaagtcc

SEQ ID NO: 464719 - DNA, 25 bp, Homo sapien
cccctgaccactgaattagctatga

SEQ ID NO: 464720 - DNA, 25 bp, Homo sapien
agaagaaagaagacaacacacttgt

SEQ ID NO: 464721 - DNA, 25 bp, Homo sapien
gaagttctatgacattaatgtagcc

SEQ ID NO: 464722 - DNA, 25 bp, Homo sapien
ttaatgtagccaaggtcaacatgct

SEQ ID NO: 464723 - DNA, 25 bp, Homo sapien
gtcaacatgctaatcagcctgaggg

SEQ ID NO: 464724 - DNA, 25 bp, Homo sapien
aaggcttctgttcaactggttcctt

SEQ ID NO: 464725 - DNA, 25 bp, Homo sapien
gttcaactggttccttacaatgctt

SEQ ID NO: 464726 - DNA, 25 bp, Homo sapien
gcccctccagtgtgtgaaaatggta

SEQ ID NO: 464727 - DNA, 25 bp, Homo sapien
aaaatggtatgaagcctggaggcct

SEQ ID NO: 464728 - DNA, 25 bp, Homo sapien
gtatgaagcctggaggcctggcaaa

SEQ ID NO: 464729 - DNA, 25 bp, Homo sapien
aaagggacagaccatttttgctcag

SEQ ID NO: 464730 - DNA, 25 bp, Homo sapien
agggacagaccatttttgctcagct

SEQ ID NO: 464731 - DNA, 25 bp, Homo sapien
ttttgctcagctctagacttttttt

SEQ ID NO: 464732 - DNA, 25 bp, Homo sapien
tttttaaatcagctgtcatatgtga

SEQ ID NO: 464733 - DNA, 25 bp, Homo sapien
aaatcagctgtcatatgtgaaataa

SEQ ID NO: 464734 - DNA, 25 bp, Homo sapien
attaagaacatgatcctcggccggg

SEQ ID NO: 464735 - DNA, 25 bp, Homo sapien
taagaacatgatcctcggccgggcg

SEQ ID NO: 464736 - DNA, 25 bp, Homo sapien
agaacatgatcctcggccgggcgcg

SEQ ID NO: 464737 - DNA, 25 bp, Homo sapien
tccgccccaaggaaccacttacaca

SEQ ID NO: 464738 - DNA, 25 bp, Homo sapien
gcccctcggaactttgcccagtggg

SEQ ID NO: 464739 - DNA, 25 bp, Homo sapien
agatctcgcccctcgtgatgtcagg

SEQ ID NO: 464740 - DNA, 25 bp, Homo sapien
agctcgggcggtgtagagctcagcc

SEQ ID NO: 464741 - DNA, 25 bp, Homo sapien
tgtagagctcagccccttgtggccc

SEQ ID NO: 464742 - DNA, 25 bp, Homo sapien
ttgtggccccgtcctgggcgtgtgc

SEQ ID NO: 464743 - DNA, 25 bp, Homo sapien
aattgagggagggtctggatacctt

SEQ ID NO: 464744 - DNA, 25 bp, Homo sapien
ggagggtctggatacctttagagcc

SEQ ID NO: 464745 - DNA, 25 bp, Homo sapien
gggtctggatacctttagagccaat

SEQ ID NO: 464746 - DNA, 25 bp, Homo sapien
gtctggatacctttagagccaatgc

SEQ ID NO: 464747 - DNA, 25 bp, Homo sapien
gatacctttagagccaatgcaacgg

SEQ ID NO: 464748 - DNA, 25 bp, Homo sapien
tatttatttaggatttgttctttga

SEQ ID NO: 464749 - DNA, 25 bp, Homo sapien
taggatttgttctttgaaatagaat

SEQ ID NO: 464750 - DNA, 25 bp, Homo sapien
taaggcttttagtacatataatgaa

SEQ ID NO: 464751 - DNA, 25 bp, Homo sapien
ataatgaaattgctgatggcacagt

SEQ ID NO: 464752 - DNA, 25 bp, Homo sapien
acctgttttaccatggtcttaccag

SEQ ID NO: 464753 - DNA, 25 bp, Homo sapien
cctgttttaccatggtcttaccagc

SEQ ID NO: 464754 - DNA, 25 bp, Homo sapien
tgttttaccatggtcttaccagcat

SEQ ID NO: 464755 - DNA, 25 bp, Homo sapien
gttttaccatggtcttaccagcatt

SEQ ID NO: 464756 - DNA, 25 bp, Homo sapien
tttaccatggtcttaccagcattat

SEQ ID NO: 464757 - DNA, 25 bp, Homo sapien
taccatggtcttaccagcattatta

SEQ ID NO: 464758 - DNA, 25 bp, Homo sapien
catggtcttaccagcattattataa

SEQ ID NO: 464759 - DNA, 25 bp, Homo sapien
cccacctgtgcgaagggccgatctt

SEQ ID NO: 464760 - DNA, 25 bp, Homo sapien
gtgcgaagggccgatcttcctttcc

SEQ ID NO: 464761 - DNA, 25 bp, Homo sapien
atgccactgctgatggatgttgctg

SEQ ID NO: 464762 - DNA, 25 bp, Homo sapien
ctgatggatgttgctggcagtgaca

SEQ ID NO: 464763 - DNA, 25 bp, Homo sapien
agctctgcagctgagatcctacctg

SEQ ID NO: 464764 - DNA, 25 bp, Homo sapien
tgcagctgagatcctacctgctgtg

SEQ ID NO: 464765 - DNA, 25 bp, Homo sapien
gagatcctacctgctgtgcccatgg

SEQ ID NO: 464766 - DNA, 25 bp, Homo sapien
ccatggagccaaagcctgacccttt

SEQ ID NO: 464767 - DNA, 25 bp, Homo sapien
tcaggagtcccctctggataccttt

SEQ ID NO: 464768 - DNA, 25 bp, Homo sapien
agtcccctctggatacctttccaga

SEQ ID NO: 464769 - DNA, 25 bp, Homo sapien
tgctgacttctgaccagactttggc

SEQ ID NO: 464770 - DNA, 25 bp, Homo sapien
gttctgaagtctggttatacgtggt

SEQ ID NO: 464771 - DNA, 25 bp, Homo sapien
tctgaagtctggttatacgtggtat

SEQ ID NO: 464772 - DNA, 25 bp, Homo sapien
tgaagtctggttatacgtggtattc

SEQ ID NO: 464773 - DNA, 25 bp, Homo sapien
aagtctggttatacgtggtattctg

SEQ ID NO: 464774 - DNA, 25 bp, Homo sapien
tggttatacgtggtattctgggttc

SEQ ID NO: 464775 - DNA, 25 bp, Homo sapien
tctgggttcaacaagtatgactcga

SEQ ID NO: 464776 - DNA, 25 bp, Homo sapien
tgggttcaacaagtatgactcgaga

SEQ ID NO: 464777 - DNA, 25 bp, Homo sapien
ggttcaacaagtatgactcgagagt

SEQ ID NO: 464778 - DNA, 25 bp, Homo sapien
caagtatgactcgagagtgtgctct

SEQ ID NO: 464779 - DNA, 25 bp, Homo sapien
gtatgactcgagagtgtgctctggt

SEQ ID NO: 464780 - DNA, 25 bp, Homo sapien
tgactcgagagtgtgctctggtatt

SEQ ID NO: 464781 - DNA, 25 bp, Homo sapien
atgtgactgaatatggaggaagtgt

SEQ ID NO: 464782 - DNA, 25 bp, Homo sapien
atggaggaagtgtctttcaagaggt

SEQ ID NO: 464783 - DNA, 25 bp, Homo sapien
gaggaagtgtctttcaagaggtaat

SEQ ID NO: 464784 - DNA, 25 bp, Homo sapien
tgtctttcaagaggtaattaccgcc

SEQ ID NO: 464785 - DNA, 25 bp, Homo sapien
gtctttcaagaggtaattaccgcct

SEQ ID NO: 464786 - DNA, 25 bp, Homo sapien
ctttcaagaggtaattaccgcctgt

SEQ ID NO: 464787 - DNA, 25 bp, Homo sapien
tttcaagaggtaattaccgcctgta

SEQ ID NO: 464788 - DNA, 25 bp, Homo sapien
ttcaagaggtaattaccgcctgtaa

SEQ ID NO: 464789 - DNA, 25 bp, Homo sapien
tcaagaggtaattaccgcctgtaat

SEQ ID NO: 464790 - DNA, 25 bp, Homo sapien
caagaggtaattaccgcctgtaatc

SEQ ID NO: 464791 - DNA, 25 bp, Homo sapien
gaggtaattaccgcctgtaatccca

SEQ ID NO: 464792 - DNA, 25 bp, Homo sapien
gtgcgaggcaagtcgtctcaccagc

SEQ ID NO: 464793 - DNA, 25 bp, Homo sapien
gtctcaccagcgttccaaatgaaaa

SEQ ID NO: 464794 - DNA, 25 bp, Homo sapien
tgctccaaatccaaatatttcctga

SEQ ID NO: 464795 - DNA, 25 bp, Homo sapien
tcctgagtattcacgcccatgtgca

SEQ ID NO: 464796 - DNA, 25 bp, Homo sapien
acgcccatgtgcacggtttctgtaa

SEQ ID NO: 464797 - DNA, 25 bp, Homo sapien
tctgtaagtgaaccccagacttgga

SEQ ID NO: 464798 - DNA, 25 bp, Homo sapien
ttttttctccagttggtagcttttg

SEQ ID NO: 464799 - DNA, 25 bp, Homo sapien
gctgtgagctgcctctgacttaaaa

SEQ ID NO: 464800 - DNA, 25 bp, Homo sapien
ctgacttaaaaccaaccccgagctg

SEQ ID NO: 464801 - DNA, 25 bp, Homo sapien
tgagctgtcgcgatggcactaatac

SEQ ID NO: 464802 - DNA, 25 bp, Homo sapien
gatggcactaataccagctcctgtt

SEQ ID NO: 464803 - DNA, 25 bp, Homo sapien
tcgaaataggaactattgctgtttc

SEQ ID NO: 464804 - DNA, 25 bp, Homo sapien
attgctgtttcttgagatttgaacc

SEQ ID NO: 464805 - DNA, 25 bp, Homo sapien
cttgagatttgaacctttatagtgt

SEQ ID NO: 464806 - DNA, 25 bp, Homo sapien
ctttatagtgttattaggtgccata

SEQ ID NO: 464807 - DNA, 25 bp, Homo sapien
ttaggtgccatatcacatccatctt

SEQ ID NO: 464808 - DNA, 25 bp, Homo sapien
gtgccatatcacatccatcttaaaa

SEQ ID NO: 464809 - DNA, 25 bp, Homo sapien
gccatatcacatccatcttaaaacc

SEQ ID NO: 464810 - DNA, 25 bp, Homo sapien
aatttcacttatatgaagcgcctag

SEQ ID NO: 464811 - DNA, 25 bp, Homo sapien
aagcgcctagaatgggcaaattcac

SEQ ID NO: 464812 - DNA, 25 bp, Homo sapien
atgggcaaattcacacagatggaga

SEQ ID NO: 464813 - DNA, 25 bp, Homo sapien
gcaaattcacacagatggagagtag

SEQ ID NO: 464814 - DNA, 25 bp, Homo sapien
aagcaggatttgaaaatgttactca

SEQ ID NO: 464815 - DNA, 25 bp, Homo sapien
gttactcaagaacaaatcgaatctt

SEQ ID NO: 464816 - DNA, 25 bp, Homo sapien
tataaaactttaccttctggaacag

SEQ ID NO: 464817 - DNA, 25 bp, Homo sapien
ccctcaagattgagtattacttcaa

SEQ ID NO: 464818 - DNA, 25 bp, Homo sapien
gagtattacttcaattcaaatccat

SEQ ID NO: 464819 - DNA, 25 bp, Homo sapien
caaatccattgtagatgttttactt

SEQ ID NO: 464820 - DNA, 25 bp, Homo sapien
gtagatgttttacttttagcaataa

SEQ ID NO: 464821 - DNA, 25 bp, Homo sapien
tttagcaataaacactgaagtaagt

SEQ ID NO: 464822 - DNA, 25 bp, Homo sapien
gtgatttacaagcacaaatagctca

SEQ ID NO: 464823 - DNA, 25 bp, Homo sapien
gcacaaatagctcaacaaaatgaac

SEQ ID NO: 464824 - DNA, 25 bp, Homo sapien
aaaatacaaacaaagctgctcaaga

SEQ ID NO: 464825 - DNA, 25 bp, Homo sapien
ctaaactttcaaaacctgtcagtga

SEQ ID NO: 464826 - DNA, 25 bp, Homo sapien
aaacctgtcagtgattgggttccga

SEQ ID NO: 464827 - DNA, 25 bp, Homo sapien
acctgtcagtgattgggttccgaat

SEQ ID NO: 464828 - DNA, 25 bp, Homo sapien
ctgtcagtgattgggttccgaatcc

SEQ ID NO: 464829 - DNA, 25 bp, Homo sapien
tcagtgattgggttccgaatcctcc

SEQ ID NO: 464830 - DNA, 25 bp, Homo sapien
agtgattgggttccgaatcctcctc

SEQ ID NO: 464831 - DNA, 25 bp, Homo sapien
tgattgggttccgaatcctcctcct

SEQ ID NO: 464832 - DNA, 25 bp, Homo sapien
tcctgaaagtggccgggtttaatct

SEQ ID NO: 464833 - DNA, 25 bp, Homo sapien
agctggtcgagaaaagctttgaaac

SEQ ID NO: 464834 - DNA, 25 bp, Homo sapien
aagctttgaaacagatacgaaccta

SEQ ID NO: 464835 - DNA, 25 bp, Homo sapien
tgaaacagatacgaacctaaacttt

SEQ ID NO: 464836 - DNA, 25 bp, Homo sapien
ctcctcaagtctacggtagggtttg

SEQ ID NO: 464837 - DNA, 25 bp, Homo sapien
ctacggtagggtttgatgtcatcag

SEQ ID NO: 464838 - DNA, 25 bp, Homo sapien
tagtgtgctatatgaaaggccaaat

SEQ ID NO: 464839 - DNA, 25 bp, Homo sapien
aggccaaattggcagcctctctttt

SEQ ID NO: 464840 - DNA, 25 bp, Homo sapien
tcttttctcaaggtcagtatcaaca

SEQ ID NO: 464841 - DNA, 25 bp, Homo sapien
ggtcagtatcaacatgcataaatca

SEQ ID NO: 464842 - DNA, 25 bp, Homo sapien
tgacagtatgtctatgtgcccttga

SEQ ID NO: 464843 - DNA, 25 bp, Homo sapien
ctatgtgcccttgacatgatgtgat

SEQ ID NO: 464844 - DNA, 25 bp, Homo sapien
aacctattacctcaatctaatcatg

SEQ ID NO: 464845 - DNA, 25 bp, Homo sapien
gagatacattctgtgaaatacctga

SEQ ID NO: 464846 - DNA, 25 bp, Homo sapien
aatacctgatcagtactcatccaaa

SEQ ID NO: 464847 - DNA, 25 bp, Homo sapien
ccatttctgtcagtacgatgtcaac

SEQ ID NO: 464848 - DNA, 25 bp, Homo sapien
catttctgtcagtacgatgtcaact

SEQ ID NO: 464849 - DNA, 25 bp, Homo sapien
atttctgtcagtacgatgtcaactc

SEQ ID NO: 464850 - DNA, 25 bp, Homo sapien
tttctgtcagtacgatgtcaactca

SEQ ID NO: 464851 - DNA, 25 bp, Homo sapien
ttctgtcagtacgatgtcaactcat

SEQ ID NO: 464852 - DNA, 25 bp, Homo sapien
tctgtcagtacgatgtcaactcatg

SEQ ID NO: 464853 - DNA, 25 bp, Homo sapien
ctgtcagtacgatgtcaactcatgc

SEQ ID NO: 464854 - DNA, 25 bp, Homo sapien
actcatgcttttaattcagcatcag

SEQ ID NO: 464855 - DNA, 25 bp, Homo sapien
catgcttttaattcagcatcagcag

SEQ ID NO: 464856 - DNA, 25 bp, Homo sapien
gcttttaattcagcatcagcagaaa

SEQ ID NO: 464857 - DNA, 25 bp, Homo sapien
cttttaattcagcatcagcagaaaa

SEQ ID NO: 464858 - DNA, 25 bp, Homo sapien
gaaagctaggagtctaatgaagtta

SEQ ID NO: 464859 - DNA, 25 bp, Homo sapien
tatgagaaaacagaacaacccctct

SEQ ID NO: 464860 - DNA, 25 bp, Homo sapien
gaacaacccctctccaaaggaatat

SEQ ID NO: 464861 - DNA, 25 bp, Homo sapien
tctgaaaaactacttgaaacccact

SEQ ID NO: 464862 - DNA, 25 bp, Homo sapien
acttgaaacccactccagcaaaagg

SEQ ID NO: 464863 - DNA, 25 bp, Homo sapien
ggataaatcgcctcttaagaatcaa

SEQ ID NO: 464864 - DNA, 25 bp, Homo sapien
gctagttaaacataggccttagaaa

SEQ ID NO: 464865 - DNA, 25 bp, Homo sapien
tagaaaacaatttccaacagtctta

SEQ ID NO: 464866 - DNA, 25 bp, Homo sapien
gatggccctatattttttacctcaa

SEQ ID NO: 464867 - DNA, 25 bp, Homo sapien
tggccctatattttttacctcaact

SEQ ID NO: 464868 - DNA, 25 bp, Homo sapien
ctcaactccttacaacctcaaaaga

SEQ ID NO: 464869 - DNA, 25 bp, Homo sapien
caaccatcctcttggaagcaggaca

SEQ ID NO: 464870 - DNA, 25 bp, Homo sapien
gaagcaggacaatttccaagtctat

SEQ ID NO: 464871 - DNA, 25 bp, Homo sapien
gacaatttccaagtctattctcttt

SEQ ID NO: 464872 - DNA, 25 bp, Homo sapien
tattctctttcttagccgataacaa

SEQ ID NO: 464873 - DNA, 25 bp, Homo sapien
tatcctcttaacattagctcaacga

SEQ ID NO: 464874 - DNA, 25 bp, Homo sapien
ttgtgctctaagaatctaaatgatt

SEQ ID NO: 464875 - DNA, 25 bp, Homo sapien
ccacacccctagataacagctattt

SEQ ID NO: 464876 - DNA, 25 bp, Homo sapien
aacagctattttttacctggctcca

SEQ ID NO: 464877 - DNA, 25 bp, Homo sapien
tttacctggctccaaggccagatgg

SEQ ID NO: 464878 - DNA, 25 bp, Homo sapien
ggctccaaggccagatggaactgaa

SEQ ID NO: 464879 - DNA, 25 bp, Homo sapien
attctttgatttcttcaaccatcct

SEQ ID NO: 464880 - DNA, 25 bp, Homo sapien
ggcgcggctggagcgacggcttcga

SEQ ID NO: 464881 - DNA, 25 bp, Homo sapien
gacggcttcgaggacctcaggcaca

SEQ ID NO: 464882 - DNA, 25 bp, Homo sapien
caggcacaggttcttcggaaacggc

SEQ ID NO: 464883 - DNA, 25 bp, Homo sapien
ggcacaggttcttcggaaacggcct

SEQ ID NO: 464884 - DNA, 25 bp, Homo sapien
gcacaggttcttcggaaacggcctg

SEQ ID NO: 464885 - DNA, 25 bp, Homo sapien
caggttcttcggaaacggcctggag

SEQ ID NO: 464886 - DNA, 25 bp, Homo sapien
gccggcccccgaagaacaggcgaag

SEQ ID NO: 464887 - DNA, 25 bp, Homo sapien
ggaaagaacaggagcggaccgaaga

SEQ ID NO: 464888 - DNA, 25 bp, Homo sapien
agaacaggagcggaccgaagaggcc

SEQ ID NO: 464889 - DNA, 25 bp, Homo sapien
cgaagaggccgctccggttcagaag

SEQ ID NO: 464890 - DNA, 25 bp, Homo sapien
cggatctcagactctccgggttccg

SEQ ID NO: 464891 - DNA, 25 bp, Homo sapien
tttttctgtgtttttgtgcatcaaa

SEQ ID NO: 464892 - DNA, 25 bp, Homo sapien
aatcttagagattgcttatcgaaat

SEQ ID NO: 464893 - DNA, 25 bp, Homo sapien
ggaagttaaaaatcgattggcaaat

SEQ ID NO: 464894 - DNA, 25 bp, Homo sapien
ggcaaatttgtagcatttattcact

SEQ ID NO: 464895 - DNA, 25 bp, Homo sapien
tttgtagcatttattcactgattaa

SEQ ID NO: 464896 - DNA, 25 bp, Homo sapien
tccacttttgtgaaaaccataccag

SEQ ID NO: 464897 - DNA, 25 bp, Homo sapien
gtgaaaaccataccagtggtttaca

SEQ ID NO: 464898 - DNA, 25 bp, Homo sapien
taaacctagctaaaagttactgcaa

SEQ ID NO: 464899 - DNA, 25 bp, Homo sapien
gaaatctttggctgccacaagtaga

SEQ ID NO: 464900 - DNA, 25 bp, Homo sapien
ggctgccacaagtagatgctctcta

SEQ ID NO: 464901 - DNA, 25 bp, Homo sapien
gatgctctctactaccagagctgga

SEQ ID NO: 464902 - DNA, 25 bp, Homo sapien
tgtcctacgcgatgctgaaggtcat

SEQ ID NO: 464903 - DNA, 25 bp, Homo sapien
tgaaggtcatcatcactcacactgc

SEQ ID NO: 464904 - DNA, 25 bp, Homo sapien
tcatcactcacactgccaagcagag

SEQ ID NO: 464905 - DNA, 25 bp, Homo sapien
gctctgtgcagagaaataacctgga

SEQ ID NO: 464906 - DNA, 25 bp, Homo sapien
aaataacctggatgcaagaatcacc

SEQ ID NO: 464907 - DNA, 25 bp, Homo sapien
gcaagaatcaccaaactaacctact

SEQ ID NO: 464908 - DNA, 25 bp, Homo sapien
gacataaaatctaagccagctactg

SEQ ID NO: 464909 - DNA, 25 bp, Homo sapien
gccagctactgggttaacatcacca

SEQ ID NO: 464910 - DNA, 25 bp, Homo sapien
agttctctctcttcagacactaaaa

SEQ ID NO: 464911 - DNA, 25 bp, Homo sapien
aaaatgtcagcgtttccctaattct

SEQ ID NO: 464912 - DNA, 25 bp, Homo sapien
taattctgtcctacgcgatgctgaa

SEQ ID NO: 464913 - DNA, 25 bp, Homo sapien
caaaaccaagttaattactgcctag

SEQ ID NO: 464914 - DNA, 25 bp, Homo sapien
ttaattactgcctagatacaacggg

SEQ ID NO: 464915 - DNA, 25 bp, Homo sapien
gtttgaaatccaatagggcaattat

SEQ ID NO: 464916 - DNA, 25 bp, Homo sapien
tccaatagggcaattattaaacctt

SEQ ID NO: 464917 - DNA, 25 bp, Homo sapien
ttcgactccatatctcacatcctag

SEQ ID NO: 464918 - DNA, 25 bp, Homo sapien
tccatatctcacatcctagtacact

SEQ ID NO: 464919 - DNA, 25 bp, Homo sapien
atatctcacatcctagtacactgat

SEQ ID NO: 464920 - DNA, 25 bp, Homo sapien
acatcctagtacactgatgcaagag

SEQ ID NO: 464921 - DNA, 25 bp, Homo sapien
tgatgcaagagtgggctcccaaggc

SEQ ID NO: 464922 - DNA, 25 bp, Homo sapien
agctccagtcctgttgttttgcagg

SEQ ID NO: 464923 - DNA, 25 bp, Homo sapien
gtcctgttgttttgcagggtacagc

SEQ ID NO: 464924 - DNA, 25 bp, Homo sapien
gcagagtcccgctgccaagagacag

SEQ ID NO: 464925 - DNA, 25 bp, Homo sapien
gagtcccgctgccaagagacagatg

SEQ ID NO: 464926 - DNA, 25 bp, Homo sapien
gtcccgctgccaagagacagatgag

SEQ ID NO: 464927 - DNA, 25 bp, Homo sapien
gccaagagacagatgagcagatcag

SEQ ID NO: 464928 - DNA, 25 bp, Homo sapien
aagagacagatgagcagatcagact

SEQ ID NO: 464929 - DNA, 25 bp, Homo sapien
agacagatgagcagatcagactgat

SEQ ID NO: 464930 - DNA, 25 bp, Homo sapien
cagatgagcagatcagactgatgga

SEQ ID NO: 464931 - DNA, 25 bp, Homo sapien
gatcaagattctcactgacaaactc

SEQ ID NO: 464932 - DNA, 25 bp, Homo sapien
aactgatgacttggaatataaactg

SEQ ID NO: 464933 - DNA, 25 bp, Homo sapien
cttggaatataaactgaaatgcaac

SEQ ID NO: 464934 - DNA, 25 bp, Homo sapien
gaggagaacctctgtacacaaagga

SEQ ID NO: 464935 - DNA, 25 bp, Homo sapien
taaaggaggatgtgatagaaaaggc

SEQ ID NO: 464936 - DNA, 25 bp, Homo sapien
aaaggaggatgtgatagaaaaggct

SEQ ID NO: 464937 - DNA, 25 bp, Homo sapien
aaggaggatgtgatagaaaaggctg

SEQ ID NO: 464938 - DNA, 25 bp, Homo sapien
aggaggatgtgatagaaaaggctga

SEQ ID NO: 464939 - DNA, 25 bp, Homo sapien
ggaggatgtgatagaaaaggctgag

SEQ ID NO: 464940 - DNA, 25 bp, Homo sapien
gaggatgtgatagaaaaggctgagt

SEQ ID NO: 464941 - DNA, 25 bp, Homo sapien
aggatgtgatagaaaaggctgagtt

SEQ ID NO: 464942 - DNA, 25 bp, Homo sapien
ggatgtgatagaaaaggctgagtta

SEQ ID NO: 464943 - DNA, 25 bp, Homo sapien
gaacaaggcagcaaggacagaggcc

SEQ ID NO: 464944 - DNA, 25 bp, Homo sapien
atgcagcttttgatggtggctttac

SEQ ID NO: 464945 - DNA, 25 bp, Homo sapien
ggtggctttactgtcaagaccagac

SEQ ID NO: 464946 - DNA, 25 bp, Homo sapien
gacctggtctgttaaatagcaaact

SEQ ID NO: 464947 - DNA, 25 bp, Homo sapien
gcaaactgtaggtccaaatctcaat

SEQ ID NO: 464948 - DNA, 25 bp, Homo sapien
aagtgctcaaaggtactgacacagt

SEQ ID NO: 464949 - DNA, 25 bp, Homo sapien
gacacagttgattttattcacacca

SEQ ID NO: 464950 - DNA, 25 bp, Homo sapien
aataaacctcaagtagtggctagtg

SEQ ID NO: 464951 - DNA, 25 bp, Homo sapien
ttaagttttgtcacagcaagctgcc

SEQ ID NO: 464952 - DNA, 25 bp, Homo sapien
ttttgtcacagcaagctgcctggat

SEQ ID NO: 464953 - DNA, 25 bp, Homo sapien
gctgcctggatgaggttcttaatgc

SEQ ID NO: 464954 - DNA, 25 bp, Homo sapien
gatgaggttcttaatgcagcttttg

SEQ ID NO: 464955 - DNA, 25 bp, Homo sapien
ggtgctcatcgcactgtcctatgga

SEQ ID NO: 464956 - DNA, 25 bp, Homo sapien
tatggactcatcctgcacacagtag

SEQ ID NO: 464957 - DNA, 25 bp, Homo sapien
tgcacacagtagcaggcctggcctc

SEQ ID NO: 464958 - DNA, 25 bp, Homo sapien
aggagcagcgccgtgcctttcagac

SEQ ID NO: 464959 - DNA, 25 bp, Homo sapien
gctcatcgctgtgctgtgctagtat

SEQ ID NO: 464960 - DNA, 25 bp, Homo sapien
gtgctagtattctttgtgcccatga

SEQ ID NO: 464961 - DNA, 25 bp, Homo sapien
ccctggtgcaccgttttgggaagca

SEQ ID NO: 464962 - DNA, 25 bp, Homo sapien
acctgctattcatcttcttatggcc

SEQ ID NO: 464963 - DNA, 25 bp, Homo sapien
cttatggccaatgtctacctttttg

SEQ ID NO: 464964 - DNA, 25 bp, Homo sapien
ctcccatgcttaacccaatcatata

SEQ ID NO: 464965 - DNA, 25 bp, Homo sapien
ggagatccaccgtgccattatcaaa

SEQ ID NO: 464966 - DNA, 25 bp, Homo sapien
tatactgtaggatccattttggtca

SEQ ID NO: 464967 - DNA, 25 bp, Homo sapien
ggatccattttggtcatctgtcaaa

SEQ ID NO: 464968 - DNA, 25 bp, Homo sapien
cattttggtcatctgtcaaagagat

SEQ ID NO: 464969 - DNA, 25 bp, Homo sapien
gaaataaggcttttagacagtttgc

SEQ ID NO: 464970 - DNA, 25 bp, Homo sapien
aatgacgagagagatgtgggactaa

SEQ ID NO: 464971 - DNA, 25 bp, Homo sapien
tgatcgttcaactactagccaagga

SEQ ID NO: 464972 - DNA, 25 bp, Homo sapien
tgagagtgatctcagtgatgacatc

SEQ ID NO: 464973 - DNA, 25 bp, Homo sapien
cagtgaagacacagtacaggccgct

SEQ ID NO: 464974 - DNA, 25 bp, Homo sapien
aagacacagtacaggccgctgtcga

SEQ ID NO: 464975 - DNA, 25 bp, Homo sapien
gccgctgtcgacaccattttagaaa

SEQ ID NO: 464976 - DNA, 25 bp, Homo sapien
gctgtcgacaccattttagaaatta

SEQ ID NO: 464977 - DNA, 25 bp, Homo sapien
tgcacccagccctacgaataatttt

SEQ ID NO: 464978 - DNA, 25 bp, Homo sapien
gcttgggtccaggagatctagactg

SEQ ID NO: 464979 - DNA, 25 bp, Homo sapien
cttgggtccaggagatctagactgc

SEQ ID NO: 464980 - DNA, 25 bp, Homo sapien
ttgggtccaggagatctagactgca

SEQ ID NO: 464981 - DNA, 25 bp, Homo sapien
gggtccaggagatctagactgcagt

SEQ ID NO: 464982 - DNA, 25 bp, Homo sapien
tgtgatcatgctacagcactcgaag

SEQ ID NO: 464983 - DNA, 25 bp, Homo sapien
gtgatcatgctacagcactcgaagc

SEQ ID NO: 464984 - DNA, 25 bp, Homo sapien
gatcatgctacagcactcgaagcct

SEQ ID NO: 464985 - DNA, 25 bp, Homo sapien
atcatgctacagcactcgaagcctg

SEQ ID NO: 464986 - DNA, 25 bp, Homo sapien
tcatgctacagcactcgaagcctgg

SEQ ID NO: 464987 - DNA, 25 bp, Homo sapien
tacagcactcgaagcctggggaaca

SEQ ID NO: 464988 - DNA, 25 bp, Homo sapien
aagattagacttggctcacagccca

SEQ ID NO: 464989 - DNA, 25 bp, Homo sapien
gacttggctcacagcccacaaaata

SEQ ID NO: 464990 - DNA, 25 bp, Homo sapien
ttagaactacctttacttctcctct

SEQ ID NO: 464991 - DNA, 25 bp, Homo sapien
aacccaatggaagccagctactgca

SEQ ID NO: 464992 - DNA, 25 bp, Homo sapien
aggcagacctttccttaatgtccat

SEQ ID NO: 464993 - DNA, 25 bp, Homo sapien
aatgtccatgttgaacaggacccta

SEQ ID NO: 464994 - DNA, 25 bp, Homo sapien
acaggaccctaggtgctgttacttt

SEQ ID NO: 464995 - DNA, 25 bp, Homo sapien
ctgttactttcccatggcatctcct

SEQ ID NO: 464996 - DNA, 25 bp, Homo sapien
atctcctcttccacagtagaacaga

SEQ ID NO: 464997 - DNA, 25 bp, Homo sapien
gaacagaggcatgcccagggagccc

SEQ ID NO: 464998 - DNA, 25 bp, Homo sapien
ggacccaaacactaagtcaggtact

SEQ ID NO: 464999 - DNA, 25 bp, Homo sapien
taaaggcttaaatgatagatccgaa

SEQ ID NO: 465000 - DNA, 25 bp, Homo sapien
ggcttaaatgatagatccgaaacta

SEQ ID NO: 465001 - DNA, 25 bp, Homo sapien
gaaatgctcaagaacattggtctag

SEQ ID NO: 465002 - DNA, 25 bp, Homo sapien
atgctcaagaacattggtctaggca

SEQ ID NO: 465003 - DNA, 25 bp, Homo sapien
gcaaagattttatggttaagacatc

SEQ ID NO: 465004 - DNA, 25 bp, Homo sapien
aggcaggtgggactatattaaacta

SEQ ID NO: 465005 - DNA, 25 bp, Homo sapien
tattaaactaaaaatctgcacagca

SEQ ID NO: 465006 - DNA, 25 bp, Homo sapien
agagtgaagagaccaactgtagatg

SEQ ID NO: 465007 - DNA, 25 bp, Homo sapien
gagaccaactgtagatgggaacaat

SEQ ID NO: 465008 - DNA, 25 bp, Homo sapien
ctgtagatgggaacaatattttcaa

SEQ ID NO: 465009 - DNA, 25 bp, Homo sapien
ggggactaatatccagagtgtacaa

SEQ ID NO: 465010 - DNA, 25 bp, Homo sapien
taattgagattatccattgcttgct

SEQ ID NO: 465011 - DNA, 25 bp, Homo sapien
aaatcaaatcttcccagtgtaaact

SEQ ID NO: 465012 - DNA, 25 bp, Homo sapien
agtgtaaactctgggcttaacatgc

SEQ ID NO: 465013 - DNA, 25 bp, Homo sapien
ttaacatgcctcctgttgtgttttg

SEQ ID NO: 465014 - DNA, 25 bp, Homo sapien
gttgtgttttgatatttttggtgtc

SEQ ID NO: 465015 - DNA, 25 bp, Homo sapien
ggatattttatttccagggccttat

SEQ ID NO: 465016 - DNA, 25 bp, Homo sapien
ttccagggccttataaagccagatg

SEQ ID NO: 465017 - DNA, 25 bp, Homo sapien
tatctattctttggataattctggt

SEQ ID NO: 465018 - DNA, 25 bp, Homo sapien
taattctggtatcctccattggctt

SEQ ID NO: 465019 - DNA, 25 bp, Homo sapien
ggtatcctccattggcttaagccag

SEQ ID NO: 465020 - DNA, 25 bp, Homo sapien
gcttaagccagatttagactcacct

SEQ ID NO: 465021 - DNA, 25 bp, Homo sapien
ctcttccagggaccttggctttata

SEQ ID NO: 465022 - DNA, 25 bp, Homo sapien
cttggctttatagagggtcttacgt

SEQ ID NO: 465023 - DNA, 25 bp, Homo sapien
gagggtcttacgtacctcaggagta

SEQ ID NO: 465024 - DNA, 25 bp, Homo sapien
gagtaaagggctttaggtctggctt

SEQ ID NO: 465025 - DNA, 25 bp, Homo sapien
taggtctggcttggaaatcttcttg

SEQ ID NO: 465026 - DNA, 25 bp, Homo sapien
ggaaatcttcttgagctcaggtttg

SEQ ID NO: 465027 - DNA, 25 bp, Homo sapien
gagctcaggtttggtatctttcctc

SEQ ID NO: 465028 - DNA, 25 bp, Homo sapien
caggtttggtatctttcctcttctc

SEQ ID NO: 465029 - DNA, 25 bp, Homo sapien
tccttcatccttcttgagctctttc

SEQ ID NO: 465030 - DNA, 25 bp, Homo sapien
ttttttcttccagctttgatatctt

SEQ ID NO: 465031 - DNA, 25 bp, Homo sapien
tcttccagctttgatatcttttctt

SEQ ID NO: 465032 - DNA, 25 bp, Homo sapien
accgacgtcttcgagcgcttcgtgg

SEQ ID NO: 465033 - DNA, 25 bp, Homo sapien
tcgagcgcttcgtggccgccgagca

SEQ ID NO: 465034 - DNA, 25 bp, Homo sapien
ccgagcagtcggtggccctgggcga

SEQ ID NO: 465035 - DNA, 25 bp, Homo sapien
gaggtgcggcgcagctactgcccgg

SEQ ID NO: 465036 - DNA, 25 bp, Homo sapien
agcggcgcgtactcatcaacctgta

SEQ ID NO: 465037 - DNA, 25 bp, Homo sapien
gtactcatcaacctgtactgctgcg

SEQ ID NO: 465038 - DNA, 25 bp, Homo sapien
aacctgtactgctgcgcggcagagg

SEQ ID NO: 465039 - DNA, 25 bp, Homo sapien
gcggcagaggatgcgcgcttcatca

SEQ ID NO: 465040 - DNA, 25 bp, Homo sapien
agaggatgcgcgcttcatcaccgac

SEQ ID NO: 465041 - DNA, 25 bp, Homo sapien
ttgagcccgccgactgcggccagga

SEQ ID NO: 465042 - DNA, 25 bp, Homo sapien
agatccgcgccgccatgcagtttgg

SEQ ID NO: 465043 - DNA, 25 bp, Homo sapien
cttggcctcaaagcaatcttcttgt

SEQ ID NO: 465044 - DNA, 25 bp, Homo sapien
tcaaagcaatcttcttgtctcagcc

SEQ ID NO: 465045 - DNA, 25 bp, Homo sapien
attataggcacttgtcactggccca

SEQ ID NO: 465046 - DNA, 25 bp, Homo sapien
cagcttccacacctattttttgatc

SEQ ID NO: 465047 - DNA, 25 bp, Homo sapien
cacctattttttgatccattgactg

SEQ ID NO: 465048 - DNA, 25 bp, Homo sapien
gatccattgactgtatctctagaca

SEQ ID NO: 465049 - DNA, 25 bp, Homo sapien
ttgactgtatctctagacatctagc

SEQ ID NO: 465050 - DNA, 25 bp, Homo sapien
tgtatctctagacatctagcctaga

SEQ ID NO: 465051 - DNA, 25 bp, Homo sapien
atctagcctagagacattcttgagc

SEQ ID NO: 465052 - DNA, 25 bp, Homo sapien
gagacattcttgagcagtacacaaa

SEQ ID NO: 465053 - DNA, 25 bp, Homo sapien
gagcagtacacaaaggcatatgcaa

SEQ ID NO: 465054 - DNA, 25 bp, Homo sapien
attgactggtgtgtttgctcctcat

SEQ ID NO: 465055 - DNA, 25 bp, Homo sapien
gtccccacaatttgagagagtgtct

SEQ ID NO: 465056 - DNA, 25 bp, Homo sapien
acagacttaagtatgtcctcactgg

SEQ ID NO: 465057 - DNA, 25 bp, Homo sapien
agacttaagtatgtcctcactggaa

SEQ ID NO: 465058 - DNA, 25 bp, Homo sapien
taagatcaatggcaaggtccgtact

SEQ ID NO: 465059 - DNA, 25 bp, Homo sapien
agatcaatggcaaggtccgtactga

SEQ ID NO: 465060 - DNA, 25 bp, Homo sapien
gatcaatggcaaggtccgtactgat

SEQ ID NO: 465061 - DNA, 25 bp, Homo sapien
ggtccgtactgatataacctactct

SEQ ID NO: 465062 - DNA, 25 bp, Homo sapien
ataacctactctgctggattcatgg

SEQ ID NO: 465063 - DNA, 25 bp, Homo sapien
tcgggagagaatttccgtctgatct

SEQ ID NO: 465064 - DNA, 25 bp, Homo sapien
gcaggtagcagctccaaagcattgg

SEQ ID NO: 465065 - DNA, 25 bp, Homo sapien
acgcactgcctgtaaagtcccctgt

SEQ ID NO: 465066 - DNA, 25 bp, Homo sapien
ccctgtcctgccctgtaggtggaat

SEQ ID NO: 465067 - DNA, 25 bp, Homo sapien
tgtcctgccctgtaggtggaatcta

SEQ ID NO: 465068 - DNA, 25 bp, Homo sapien
gtggaatctataccttggggtctgt

SEQ ID NO: 465069 - DNA, 25 bp, Homo sapien
gggtctgttctgacgttcacctaac

SEQ ID NO: 465070 - DNA, 25 bp, Homo sapien
gtctgttctgacgttcacctaacag

SEQ ID NO: 465071 - DNA, 25 bp, Homo sapien
ttctgacgttcacctaacagccttt

SEQ ID NO: 465072 - DNA, 25 bp, Homo sapien
acgttcacctaacagcctttccagg

SEQ ID NO: 465073 - DNA, 25 bp, Homo sapien
taacagcctttccaggctcagctgt

SEQ ID NO: 465074 - DNA, 25 bp, Homo sapien
tcagctgtgctattgtatggaccag

SEQ ID NO: 465075 - DNA, 25 bp, Homo sapien
agctgtgctattgtatggaccaggg

SEQ ID NO: 465076 - DNA, 25 bp, Homo sapien
atctttgtactagatagcaaccctt

SEQ ID NO: 465077 - DNA, 25 bp, Homo sapien
gtactagatagcaaccctttataag

SEQ ID NO: 465078 - DNA, 25 bp, Homo sapien
gatagcaaccctttataaggttgta

SEQ ID NO: 465079 - DNA, 25 bp, Homo sapien
ggttgtaaggtataataaactgctt

SEQ ID NO: 465080 - DNA, 25 bp, Homo sapien
atacttcatatcaagcattttgcag

SEQ ID NO: 465081 - DNA, 25 bp, Homo sapien
gcattttgcagtccaattatatagt

SEQ ID NO: 465082 - DNA, 25 bp, Homo sapien
gcagtccaattatatagttgaggat

SEQ ID NO: 465083 - DNA, 25 bp, Homo sapien
agttgaggatggtgtattttgatat

SEQ ID NO: 465084 - DNA, 25 bp, Homo sapien
attttcaagtaagcaatcagtctac

SEQ ID NO: 465085 - DNA, 25 bp, Homo sapien
atcagtctactaccatcagattata

SEQ ID NO: 465086 - DNA, 25 bp, Homo sapien
tactaccatcagattataagctttt

SEQ ID NO: 465087 - DNA, 25 bp, Homo sapien
gtggctgaggttgataaagtcacga

SEQ ID NO: 465088 - DNA, 25 bp, Homo sapien
aaagtcacgagcaggtttaatggcc

SEQ ID NO: 465089 - DNA, 25 bp, Homo sapien
aatgctagtgagtttgtggacgtat

SEQ ID NO: 465090 - DNA, 25 bp, Homo sapien
gctagtgagtttgtggacgtatatg

SEQ ID NO: 465091 - DNA, 25 bp, Homo sapien
gacgtatatgaaatgctccaccagc

SEQ ID NO: 465092 - DNA, 25 bp, Homo sapien
gtatatgaaatgctccaccagcaac

SEQ ID NO: 465093 - DNA, 25 bp, Homo sapien
tccaccagcaactgcatcatcagca

SEQ ID NO: 465094 - DNA, 25 bp, Homo sapien
atcaaagactacacctccatccgga

SEQ ID NO: 465095 - DNA, 25 bp, Homo sapien
actacacctccatccggataaatgt

SEQ ID NO: 465096 - DNA, 25 bp, Homo sapien
acctccatccggataaatgtggctg

SEQ ID NO: 465097 - DNA, 25 bp, Homo sapien
ctccatccggataaatgtggctgag

SEQ ID NO: 465098 - DNA, 25 bp, Homo sapien
gaagcagagaggctcccagacagaa

SEQ ID NO: 465099 - DNA, 25 bp, Homo sapien
cagacagaacagaagccagagagga

SEQ ID NO: 465100 - DNA, 25 bp, Homo sapien
aagccagagaggaaagtgaacctga

SEQ ID NO: 465101 - DNA, 25 bp, Homo sapien
gatgtgatagaaaaggctgagttat

SEQ ID NO: 465102 - DNA, 25 bp, Homo sapien
tttttaccaaaaaacatatgcaagg

SEQ ID NO: 465103 - DNA, 25 bp, Homo sapien
ttttaccaaaaaacatatgcaagga

SEQ ID NO: 465104 - DNA, 25 bp, Homo sapien
tttaccaaaaaacatatgcaaggaa

SEQ ID NO: 465105 - DNA, 25 bp, Homo sapien
taccaaaaaacatatgcaaggaacc

SEQ ID NO: 465106 - DNA, 25 bp, Homo sapien
gaggtccctgaggaacaaggcagca

SEQ ID NO: 465107 - DNA, 25 bp, Homo sapien
gaacaaggcagcaaggacagaggcc

SEQ ID NO: 465108 - DNA, 25 bp, Homo sapien
acaaggcagcaaggacagaggccta

SEQ ID NO: 465109 - DNA, 25 bp, Homo sapien
ctccactcagtttttgccaaaacac

SEQ ID NO: 465110 - DNA, 25 bp, Homo sapien
tccactcagtttttgccaaaacacc

SEQ ID NO: 465111 - DNA, 25 bp, Homo sapien
ccactcagtttttgccaaaacacca

SEQ ID NO: 465112 - DNA, 25 bp, Homo sapien
ttttgccaaaacaccacctgtaagc

SEQ ID NO: 465113 - DNA, 25 bp, Homo sapien
tttgccaaaacaccacctgtaagca

SEQ ID NO: 465114 - DNA, 25 bp, Homo sapien
gccaaaacaccacctgtaagcactg

SEQ ID NO: 465115 - DNA, 25 bp, Homo sapien
ccaaaacaccacctgtaagcactga

SEQ ID NO: 465116 - DNA, 25 bp, Homo sapien
caaaacaccacctgtaagcactgag

SEQ ID NO: 465117 - DNA, 25 bp, Homo sapien
aaaacaccacctgtaagcactgaga

SEQ ID NO: 465118 - DNA, 25 bp, Homo sapien
aaacaccacctgtaagcactgagaa

SEQ ID NO: 465119 - DNA, 25 bp, Homo sapien
aacaccacctgtaagcactgagaag

SEQ ID NO: 465120 - DNA, 25 bp, Homo sapien
cggctggggcaataccctgagctca

SEQ ID NO: 465121 - DNA, 25 bp, Homo sapien
ggctggggcaataccctgagctcag

SEQ ID NO: 465122 - DNA, 25 bp, Homo sapien
gctggggcaataccctgagctcagg

SEQ ID NO: 465123 - DNA, 25 bp, Homo sapien
aataccctgagctcaggggccgact

SEQ ID NO: 465124 - DNA, 25 bp, Homo sapien
ataccctgagctcaggggccgacta

SEQ ID NO: 465125 - DNA, 25 bp, Homo sapien
agctcaggggccgactacccagatg

SEQ ID NO: 465126 - DNA, 25 bp, Homo sapien
gctcaggggccgactacccagatga

SEQ ID NO: 465127 - DNA, 25 bp, Homo sapien
ctcaggggccgactacccagatgag

SEQ ID NO: 465128 - DNA, 25 bp, Homo sapien
tcaggggccgactacccagatgagc

SEQ ID NO: 465129 - DNA, 25 bp, Homo sapien
caggggccgactacccagatgagct

SEQ ID NO: 465130 - DNA, 25 bp, Homo sapien
aggggccgactacccagatgagctg

SEQ ID NO: 465131 - DNA, 25 bp, Homo sapien
aaatggaatcatgggctgcgggtgg

SEQ ID NO: 465132 - DNA, 25 bp, Homo sapien
ggaatcatgggctgcgggtggtggc

SEQ ID NO: 465133 - DNA, 25 bp, Homo sapien
gaatcatgggctgcgggtggtggct

SEQ ID NO: 465134 - DNA, 25 bp, Homo sapien
atcatgggctgcgggtggtggctca

SEQ ID NO: 465135 - DNA, 25 bp, Homo sapien
catgggctgcgggtggtggctcatg

SEQ ID NO: 465136 - DNA, 25 bp, Homo sapien
gctcatgcctgtcatatgaacactt

SEQ ID NO: 465137 - DNA, 25 bp, Homo sapien
atgcctgtcatatgaacactttggg

SEQ ID NO: 465138 - DNA, 25 bp, Homo sapien
agcctaagcagcataggaagaccct

SEQ ID NO: 465139 - DNA, 25 bp, Homo sapien
gcctaagcagcataggaagaccctg

SEQ ID NO: 465140 - DNA, 25 bp, Homo sapien
actgcagcccagaggacaaagtaag

SEQ ID NO: 465141 - DNA, 25 bp, Homo sapien
ctgcagcccagaggacaaagtaaga

SEQ ID NO: 465142 - DNA, 25 bp, Homo sapien
tcttccatctaatacccctgacact

SEQ ID NO: 465143 - DNA, 25 bp, Homo sapien
ttttattgtccgagcagtattgagg

SEQ ID NO: 465144 - DNA, 25 bp, Homo sapien
attgtccgagcagtattgaggatac

SEQ ID NO: 465145 - DNA, 25 bp, Homo sapien
gtccgagcagtattgaggatacagt

SEQ ID NO: 465146 - DNA, 25 bp, Homo sapien
cagtattgaggatacagtctgctga

SEQ ID NO: 465147 - DNA, 25 bp, Homo sapien
attgaggatacagtctgctgaaggt

SEQ ID NO: 465148 - DNA, 25 bp, Homo sapien
agtctgctgaaggtcgacaaaaagc

SEQ ID NO: 465149 - DNA, 25 bp, Homo sapien
gctgaaggtcgacaaaaagcatttg

SEQ ID NO: 465150 - DNA, 25 bp, Homo sapien
gtctcttttttatagtacagccgtc

SEQ ID NO: 465151 - DNA, 25 bp, Homo sapien
ctcttttttatagtacagccgtctc

SEQ ID NO: 465152 - DNA, 25 bp, Homo sapien
tcttttttatagtacagccgtctct

SEQ ID NO: 465153 - DNA, 25 bp, Homo sapien
actaaaatacatagggtctggtgca

SEQ ID NO: 465154 - DNA, 25 bp, Homo sapien
acatagggtctggtgcaatgactca

SEQ ID NO: 465155 - DNA, 25 bp, Homo sapien
gggtctggtgcaatgactcatacct

SEQ ID NO: 465156 - DNA, 25 bp, Homo sapien
gtctggtgcaatgactcatacctat

SEQ ID NO: 465157 - DNA, 25 bp, Homo sapien
ggtgcaatgactcatacctataatt

SEQ ID NO: 465158 - DNA, 25 bp, Homo sapien
gactcatacctataattccagtgct

SEQ ID NO: 465159 - DNA, 25 bp, Homo sapien
tacctataattccagtgcttttggg

SEQ ID NO: 465160 - DNA, 25 bp, Homo sapien
tgctcctatagtccctattacttgg

SEQ ID NO: 465161 - DNA, 25 bp, Homo sapien
ttgaggctacagtgataccgattgc

SEQ ID NO: 465162 - DNA, 25 bp, Homo sapien
ggctacagtgataccgattgcatca

SEQ ID NO: 465163 - DNA, 25 bp, Homo sapien
cagtgataccgattgcatcactgca

SEQ ID NO: 465164 - DNA, 25 bp, Homo sapien
acaaaactgactctccacttggaca

SEQ ID NO: 465165 - DNA, 25 bp, Homo sapien
aaaactgactctccacttggacatc

SEQ ID NO: 465166 - DNA, 25 bp, Homo sapien
aactgactctccacttggacatcta

SEQ ID NO: 465167 - DNA, 25 bp, Homo sapien
tgactctccacttggacatctaaca

SEQ ID NO: 465168 - DNA, 25 bp, Homo sapien
gactctccacttggacatctaacag

SEQ ID NO: 465169 - DNA, 25 bp, Homo sapien
tctccacttggacatctaacaggca

SEQ ID NO: 465170 - DNA, 25 bp, Homo sapien
tccacttggacatctaacaggcatc

SEQ ID NO: 465171 - DNA, 25 bp, Homo sapien
cacttggacatctaacaggcatctt

SEQ ID NO: 465172 - DNA, 25 bp, Homo sapien
cttggacatctaacaggcatcttaa

SEQ ID NO: 465173 - DNA, 25 bp, Homo sapien
ggacatctaacaggcatcttaaatt

SEQ ID NO: 465174 - DNA, 25 bp, Homo sapien
catctaacaggcatcttaaatttaa

SEQ ID NO: 465175 - DNA, 25 bp, Homo sapien
agtccagtgattgggtttgtggctc

SEQ ID NO: 465176 - DNA, 25 bp, Homo sapien
aggcctcgcccacagacggacagac

SEQ ID NO: 465177 - DNA, 25 bp, Homo sapien
tcttccggcaaaaggaccgagccct

SEQ ID NO: 465178 - DNA, 25 bp, Homo sapien
tccggcaaaaggaccgagccctggg

SEQ ID NO: 465179 - DNA, 25 bp, Homo sapien
tagtaaggcccccacactcctgttt

SEQ ID NO: 465180 - DNA, 25 bp, Homo sapien
gtatctgcctattttcttgctaatc

SEQ ID NO: 465181 - DNA, 25 bp, Homo sapien
tgcctattttcttgctaatcccaga

SEQ ID NO: 465182 - DNA, 25 bp, Homo sapien
tttcttgctaatcccagaacctttc

SEQ ID NO: 465183 - DNA, 25 bp, Homo sapien
tgctaatcccagaacctttcctttt

SEQ ID NO: 465184 - DNA, 25 bp, Homo sapien
aggtcggcaggctccgcttcttttc

SEQ ID NO: 465185 - DNA, 25 bp, Homo sapien
tccgcggggtgattcagtccagtga

SEQ ID NO: 465186 - DNA, 25 bp, Homo sapien
tcctaccttgagtattcagccaata

SEQ ID NO: 465187 - DNA, 25 bp, Homo sapien
cctaccttgagtattcagccaatat

SEQ ID NO: 465188 - DNA, 25 bp, Homo sapien
ctaccttgagtattcagccaatatt

SEQ ID NO: 465189 - DNA, 25 bp, Homo sapien
accttgagtattcagccaatattaa

SEQ ID NO: 465190 - DNA, 25 bp, Homo sapien
cttgagtattcagccaatattaaga

SEQ ID NO: 465191 - DNA, 25 bp, Homo sapien
aatattaagagttatgcctggtggg

SEQ ID NO: 465192 - DNA, 25 bp, Homo sapien
gggaccaagtcaggcagatcacttt

SEQ ID NO: 465193 - DNA, 25 bp, Homo sapien
tggcggtcacctgtaacccaagcta

SEQ ID NO: 465194 - DNA, 25 bp, Homo sapien
cggtcacctgtaacccaagctactt

SEQ ID NO: 465195 - DNA, 25 bp, Homo sapien
gagtctgaagcagtagaatcgctta

SEQ ID NO: 465196 - DNA, 25 bp, Homo sapien
tctgaagcagtagaatcgcttaaac

SEQ ID NO: 465197 - DNA, 25 bp, Homo sapien
tgtgccccttcgatgtttgcaacag

SEQ ID NO: 465198 - DNA, 25 bp, Homo sapien
gtttgcaacaggaagttcgctcagt

SEQ ID NO: 465199 - DNA, 25 bp, Homo sapien
ttcgctcagtcaaccaacctgaaaa

SEQ ID NO: 465200 - DNA, 25 bp, Homo sapien
atgttccgggattacgccgccatga

SEQ ID NO: 465201 - DNA, 25 bp, Homo sapien
ggattacgccgccatgagaaaacat

SEQ ID NO: 465202 - DNA, 25 bp, Homo sapien
gagaaaacatctccacatccacggg

SEQ ID NO: 465203 - DNA, 25 bp, Homo sapien
gcttttcttgagagctcaaagctga

SEQ ID NO: 465204 - DNA, 25 bp, Homo sapien
aagctgagacgacaccagctggtcc

SEQ ID NO: 465205 - DNA, 25 bp, Homo sapien
tgcgggaaacgcttttcccttgatt

SEQ ID NO: 465206 - DNA, 25 bp, Homo sapien
tttcccttgatttcaatttgcgcac

SEQ ID NO: 465207 - DNA, 25 bp, Homo sapien
atttgcgcacacacttgcgcatcca

SEQ ID NO: 465208 - DNA, 25 bp, Homo sapien
gagtatattggtgacatgtacagcc

SEQ ID NO: 465209 - DNA, 25 bp, Homo sapien
gacatgtacagccatgatgggaata

SEQ ID NO: 465210 - DNA, 25 bp, Homo sapien
gatgggaatactgatgagccagaat

SEQ ID NO: 465211 - DNA, 25 bp, Homo sapien
gagcagtttgttgagtttcgggata

SEQ ID NO: 465212 - DNA, 25 bp, Homo sapien
tgagtttcgggataagaaccgtgat

SEQ ID NO: 465213 - DNA, 25 bp, Homo sapien
aagaaccgtgatgggaagatggaca

SEQ ID NO: 465214 - DNA, 25 bp, Homo sapien
gagaccaaagactggatccttccct

SEQ ID NO: 465215 - DNA, 25 bp, Homo sapien
tggatccttccctcagactatgatc

SEQ ID NO: 465216 - DNA, 25 bp, Homo sapien
cttccctcagactatgatcatgcag

SEQ ID NO: 465217 - DNA, 25 bp, Homo sapien
aggatggcaagcttaccaaggagga

SEQ ID NO: 465218 - DNA, 25 bp, Homo sapien
gagatcgttgacaagtatgacttat

SEQ ID NO: 465219 - DNA, 25 bp, Homo sapien
gcagctctccgaagagctccgacaa

SEQ ID NO: 465220 - DNA, 25 bp, Homo sapien
ccgaagagctccgacaagtccaaga

SEQ ID NO: 465221 - DNA, 25 bp, Homo sapien
gacaagtccaagagcttcagcatag

SEQ ID NO: 465222 - DNA, 25 bp, Homo sapien
gagcttcagcatagacagcatcctg

SEQ ID NO: 465223 - DNA, 25 bp, Homo sapien
gcatcctggcgggaaagcagggcca

SEQ ID NO: 465224 - DNA, 25 bp, Homo sapien
agaagccgccttcaggggacgaact

SEQ ID NO: 465225 - DNA, 25 bp, Homo sapien
gacgaactcctagggggtgccaagc

SEQ ID NO: 465226 - DNA, 25 bp, Homo sapien
atgctcgacccgcatgtccagggcg

SEQ ID NO: 465227 - DNA, 25 bp, Homo sapien
tcgacccgcatgtccagggcggctt

SEQ ID NO: 465228 - DNA, 25 bp, Homo sapien
agggcggcttttaccagctcgggat

SEQ ID NO: 465229 - DNA, 25 bp, Homo sapien
gcttttaccagctcgggatcccctt

SEQ ID NO: 465230 - DNA, 25 bp, Homo sapien
ctcttatcagctcccaactagaggt

SEQ ID NO: 465231 - DNA, 25 bp, Homo sapien
ttatcagctcccaactagaggtcca

SEQ ID NO: 465232 - DNA, 25 bp, Homo sapien
tagaggtccacccaggacccagaga

SEQ ID NO: 465233 - DNA, 25 bp, Homo sapien
ctggatttgaggctgctgggcggca

SEQ ID NO: 465234 - DNA, 25 bp, Homo sapien
ggcagatggagcgatcagaagacca

SEQ ID NO: 465235 - DNA, 25 bp, Homo sapien
tggagcgatcagaagaccagggtaa

SEQ ID NO: 465236 - DNA, 25 bp, Homo sapien
aagggtgtggcagatactgccacta

SEQ ID NO: 465237 - DNA, 25 bp, Homo sapien
gtggcagatactgccactaacactt

SEQ ID NO: 465238 - DNA, 25 bp, Homo sapien
cactaacacttctcagcctttcctt

SEQ ID NO: 465239 - DNA, 25 bp, Homo sapien
tgtgtttgtctactcccagccaggt

SEQ ID NO: 465240 - DNA, 25 bp, Homo sapien
tgtttgtctactcccagccaggtgt

SEQ ID NO: 465241 - DNA, 25 bp, Homo sapien
tagatgctgctcacagaaccaaatt

SEQ ID NO: 465242 - DNA, 25 bp, Homo sapien
gaaccaaatttcctgtgctgaattg

SEQ ID NO: 465243 - DNA, 25 bp, Homo sapien
ctgtgctgaattgtcactcatgggc

SEQ ID NO: 465244 - DNA, 25 bp, Homo sapien
gctagaatccagttgggcctgatgt

SEQ ID NO: 465245 - DNA, 25 bp, Homo sapien
ggcctgatgtctccctgttgaaagg

SEQ ID NO: 465246 - DNA, 25 bp, Homo sapien
gaaagggctccttgtggaatgaata

SEQ ID NO: 465247 - DNA, 25 bp, Homo sapien
gtggaatgaatagcacatggctcct

SEQ ID NO: 465248 - DNA, 25 bp, Homo sapien
catggctcctgtggtggatctgata

SEQ ID NO: 465249 - DNA, 25 bp, Homo sapien
ggatctgatagtggcatagcaccaa

SEQ ID NO: 465250 - DNA, 25 bp, Homo sapien
agcaccaagtgatgcaggcctgcca

SEQ ID NO: 465251 - DNA, 25 bp, Homo sapien
tctcccagcaggttgccagtcatgg

SEQ ID NO: 465252 - DNA, 25 bp, Homo sapien
atttctgccccctgcagtgggtcat

SEQ ID NO: 465253 - DNA, 25 bp, Homo sapien
tgccccctgcagtgggtcatacctg

SEQ ID NO: 465254 - DNA, 25 bp, Homo sapien
caggagttcgagactcaactgtgta

SEQ ID NO: 465255 - DNA, 25 bp, Homo sapien
aggagttcgagactcaactgtgtag

SEQ ID NO: 465256 - DNA, 25 bp, Homo sapien
gagttcgagactcaactgtgtaggc

SEQ ID NO: 465257 - DNA, 25 bp, Homo sapien
gttcgagactcaactgtgtaggctg

SEQ ID NO: 465258 - DNA, 25 bp, Homo sapien
ttcgagactcaactgtgtaggctgg

SEQ ID NO: 465259 - DNA, 25 bp, Homo sapien
tcgagactcaactgtgtaggctggg

SEQ ID NO: 465260 - DNA, 25 bp, Homo sapien
cgagactcaactgtgtaggctgggc

SEQ ID NO: 465261 - DNA, 25 bp, Homo sapien
ctcaactgtgtaggctgggcaacat

SEQ ID NO: 465262 - DNA, 25 bp, Homo sapien
tgggctctgatcgtgccactgggct

SEQ ID NO: 465263 - DNA, 25 bp, Homo sapien
tgttttctttccaaggcccacacca

SEQ ID NO: 465264 - DNA, 25 bp, Homo sapien
caccaacgatgcctagcactttttg

SEQ ID NO: 465265 - DNA, 25 bp, Homo sapien
aacgatgcctagcactttttgttca

SEQ ID NO: 465266 - DNA, 25 bp, Homo sapien
ctttttgttcactcaaggattcaaa

SEQ ID NO: 465267 - DNA, 25 bp, Homo sapien
tgttcactcaaggattcaaaaatat

SEQ ID NO: 465268 - DNA, 25 bp, Homo sapien
gtttcaggaactgtaataggtatac

SEQ ID NO: 465269 - DNA, 25 bp, Homo sapien
tttccttttctgtacccatttgtag

SEQ ID NO: 465270 - DNA, 25 bp, Homo sapien
ttctgtacccatttgtagaaacaat

SEQ ID NO: 465271 - DNA, 25 bp, Homo sapien
gaaacaatatactctactcggagtg

SEQ ID NO: 465272 - DNA, 25 bp, Homo sapien
aatatactctactcggagtgaggta

SEQ ID NO: 465273 - DNA, 25 bp, Homo sapien
actcggagtgaggtaatattttgtt

SEQ ID NO: 465274 - DNA, 25 bp, Homo sapien
gggagacactaccatcaacagcatg

SEQ ID NO: 465275 - DNA, 25 bp, Homo sapien
tgttcattgtcatctctgcctttgg

SEQ ID NO: 465276 - DNA, 25 bp, Homo sapien
gcctttggtgtagattcactgctca

SEQ ID NO: 465277 - DNA, 25 bp, Homo sapien
gagaggcttaagacactcaacacat

SEQ ID NO: 465278 - DNA, 25 bp, Homo sapien
gtgtgtcacatatctatgcagtgct

SEQ ID NO: 465279 - DNA, 25 bp, Homo sapien
ctatgcagtgctgatcttctatgtg

SEQ ID NO: 465280 - DNA, 25 bp, Homo sapien
gttagtgtgtccatggttcatcgat

SEQ ID NO: 465281 - DNA, 25 bp, Homo sapien
gttcatcgatttgggaggcatgctc

SEQ ID NO: 465282 - DNA, 25 bp, Homo sapien
ggcatgctcctgaatatgtgcacaa

SEQ ID NO: 465283 - DNA, 25 bp, Homo sapien
tgtgcacaagttcatgtctctttgt

SEQ ID NO: 465284 - DNA, 25 bp, Homo sapien
catgtctctttgtacctccaatgct

SEQ ID NO: 465285 - DNA, 25 bp, Homo sapien
caccccattcaagtgtgcaattcaa

SEQ ID NO: 465286 - DNA, 25 bp, Homo sapien
gtgtgcaattcaatggattctagta

SEQ ID NO: 465287 - DNA, 25 bp, Homo sapien
ggattctagtatcttcacagtgctg

SEQ ID NO: 465288 - DNA, 25 bp, Homo sapien
agtgctgtgcaactatcactcctat

SEQ ID NO: 465289 - DNA, 25 bp, Homo sapien
actatcactcctatctacttacaaa

SEQ ID NO: 465290 - DNA, 25 bp, Homo sapien
tacttacaaagcatttccatcatct

SEQ ID NO: 465291 - DNA, 25 bp, Homo sapien
aagcatttccatcatcttaaaaaga

SEQ ID NO: 465292 - DNA, 25 bp, Homo sapien
aaaaagaatccccatgtccaatagc

SEQ ID NO: 465293 - DNA, 25 bp, Homo sapien
gaatccccatgtccaatagcagttc

SEQ ID NO: 465294 - DNA, 25 bp, Homo sapien
tcatcctcgggcaaccgctaatctt

SEQ ID NO: 465295 - DNA, 25 bp, Homo sapien
aaccgctaatcttcctgtgtgtctg

SEQ ID NO: 465296 - DNA, 25 bp, Homo sapien
ttttaaagttttcagttctctgcca

SEQ ID NO: 465297 - DNA, 25 bp, Homo sapien
cagttctctgccaaatttgttgata

SEQ ID NO: 465298 - DNA, 25 bp, Homo sapien
gttgatactgtcttttatctccgta

SEQ ID NO: 465299 - DNA, 25 bp, Homo sapien
actgtcttttatctccgtatgtgta

SEQ ID NO: 465300 - DNA, 25 bp, Homo sapien
tttatctccgtatgtgtagtaaaca

SEQ ID NO: 465301 - DNA, 25 bp, Homo sapien
attaatttaaagtccgtatctgata

SEQ ID NO: 465302 - DNA, 25 bp, Homo sapien
agtccgtatctgataaatccattaa

SEQ ID NO: 465303 - DNA, 25 bp, Homo sapien
tccattaactggagttctgtggtat

SEQ ID NO: 465304 - DNA, 25 bp, Homo sapien
cttatttctttatgggcctggttat

SEQ ID NO: 465305 - DNA, 25 bp, Homo sapien
gcctggttattctcttgtgtgctaa

SEQ ID NO: 465306 - DNA, 25 bp, Homo sapien
ttctcttgtgtgctaaaattgtata

SEQ ID NO: 465307 - DNA, 25 bp, Homo sapien
acatacgtgtgtacatctgtgctta

SEQ ID NO: 465308 - DNA, 25 bp, Homo sapien
gtacatctgtgcttataacatggag

SEQ ID NO: 465309 - DNA, 25 bp, Homo sapien
gaaatgtactttcgtgtaaactgaa

SEQ ID NO: 465310 - DNA, 25 bp, Homo sapien
gtaaactgaacaactggcactgttt

SEQ ID NO: 465311 - DNA, 25 bp, Homo sapien
aatgagctggtaatcatgcttctgc

SEQ ID NO: 465312 - DNA, 25 bp, Homo sapien
ttcagtatcaggaaatttcacccat

SEQ ID NO: 465313 - DNA, 25 bp, Homo sapien
acccatgcacggagtgaagaggctc

SEQ ID NO: 465314 - DNA, 25 bp, Homo sapien
gaaagccgggaaataacctacatgt

SEQ ID NO: 465315 - DNA, 25 bp, Homo sapien
aacctacatgtctatgatgagccaa

SEQ ID NO: 465316 - DNA, 25 bp, Homo sapien
gtcaattacggtatactgctccaag

SEQ ID NO: 465317 - DNA, 25 bp, Homo sapien
tacggtatactgctccaagggattt

SEQ ID NO: 465318 - DNA, 25 bp, Homo sapien
gagcctggaagatatgttgctggta

SEQ ID NO: 465319 - DNA, 25 bp, Homo sapien
gtaggttgggcatgtgtccagtaaa

SEQ ID NO: 465320 - DNA, 25 bp, Homo sapien
taaaaaactcagttgattccttaat

SEQ ID NO: 465321 - DNA, 25 bp, Homo sapien
gggaacattatatctagtttttatc

SEQ ID NO: 465322 - DNA, 25 bp, Homo sapien
gaagttctaaaaaggtacacaggat

SEQ ID NO: 465323 - DNA, 25 bp, Homo sapien
ggtacacaggatttcattaacctta

SEQ ID NO: 465324 - DNA, 25 bp, Homo sapien
attaaccttatatgcctctgggaaa

SEQ ID NO: 465325 - DNA, 25 bp, Homo sapien
atgcctctgggaaacaggactggga

SEQ ID NO: 465326 - DNA, 25 bp, Homo sapien
gatggtgactgactttgcattatgt

SEQ ID NO: 465327 - DNA, 25 bp, Homo sapien
gactttgcattatgtctgtctgtta

SEQ ID NO: 465328 - DNA, 25 bp, Homo sapien
ttatgtctgtctgttatgtttgatt

SEQ ID NO: 465329 - DNA, 25 bp, Homo sapien
attactcttaaggataggaagccag

SEQ ID NO: 465330 - DNA, 25 bp, Homo sapien
aggataggaagccagtcacataaac

SEQ ID NO: 465331 - DNA, 25 bp, Homo sapien
ggaagccagtcacataaaccactat

SEQ ID NO: 465332 - DNA, 25 bp, Homo sapien
ataaaccactatgttcccacagtgc

SEQ ID NO: 465333 - DNA, 25 bp, Homo sapien
taaaccactatgttcccacagtgcc

SEQ ID NO: 465334 - DNA, 25 bp, Homo sapien
acagtgcctattcctcccatggtct

SEQ ID NO: 465335 - DNA, 25 bp, Homo sapien
tattcctcccatggtctacatatgg

SEQ ID NO: 465336 - DNA, 25 bp, Homo sapien
atggtctacatatggggaactctac

SEQ ID NO: 465337 - DNA, 25 bp, Homo sapien
ctctacagaagaaaagtttgctaaa

SEQ ID NO: 465338 - DNA, 25 bp, Homo sapien
atgaatgaaattgattctgggttta

SEQ ID NO: 465339 - DNA, 25 bp, Homo sapien
ttaaaatgacattttgctcaagaaa

SEQ ID NO: 465340 - DNA, 25 bp, Homo sapien
gagagagcttcacttctttatcctc

SEQ ID NO: 465341 - DNA, 25 bp, Homo sapien
gagagcttcacttctttatcctctc

SEQ ID NO: 465342 - DNA, 25 bp, Homo sapien
ggataatacatttctgggttttgat

SEQ ID NO: 465343 - DNA, 25 bp, Homo sapien
acatttctgggttttgatatctaat

SEQ ID NO: 465344 - DNA, 25 bp, Homo sapien
gggttttgatatctaatgtgacatt

SEQ ID NO: 465345 - DNA, 25 bp, Homo sapien
aaatgcccacccagttgcccaagtt

SEQ ID NO: 465346 - DNA, 25 bp, Homo sapien
tgcccaagttttgtcagttcaacct

SEQ ID NO: 465347 - DNA, 25 bp, Homo sapien
agttttgtcagttcaacctgctgag

SEQ ID NO: 465348 - DNA, 25 bp, Homo sapien
gtcagttcaacctgctgagtgtcag

SEQ ID NO: 465349 - DNA, 25 bp, Homo sapien
gttcaacctgctgagtgtcaggaga

SEQ ID NO: 465350 - DNA, 25 bp, Homo sapien
tgtcaggagagagcttcacttcttt

SEQ ID NO: 465351 - DNA, 25 bp, Homo sapien
agatttgtctttgaagatcagagaa

SEQ ID NO: 465352 - DNA, 25 bp, Homo sapien
gaagatcagagaattgctgctactc

SEQ ID NO: 465353 - DNA, 25 bp, Homo sapien
gatcagagaattgctgctactcata

SEQ ID NO: 465354 - DNA, 25 bp, Homo sapien
cagagaattgctgctactcatacta

SEQ ID NO: 465355 - DNA, 25 bp, Homo sapien
gagaattgctgctactcatactata

SEQ ID NO: 465356 - DNA, 25 bp, Homo sapien
agaattgctgctactcatactataa

SEQ ID NO: 465357 - DNA, 25 bp, Homo sapien
gaattgctgctactcatactataaa

SEQ ID NO: 465358 - DNA, 25 bp, Homo sapien
attgctgctactcatactataaaag

SEQ ID NO: 465359 - DNA, 25 bp, Homo sapien
gctgctactcatactataaaagaac

SEQ ID NO: 465360 - DNA, 25 bp, Homo sapien
gctactcatactataaaagaactgg

SEQ ID NO: 465361 - DNA, 25 bp, Homo sapien
actcatactataaaagaactgggaa

SEQ ID NO: 465362 - DNA, 25 bp, Homo sapien
gggaagacaatgtgatgacacaagc

SEQ ID NO: 465363 - DNA, 25 bp, Homo sapien
accccccagtctctgtaaatgtgta

SEQ ID NO: 465364 - DNA, 25 bp, Homo sapien
gatgacacaagcagcagccatttac

SEQ ID NO: 465365 - DNA, 25 bp, Homo sapien
gacacaagcagcagccatttacaag

SEQ ID NO: 465366 - DNA, 25 bp, Homo sapien
caagcagcagccatttacaagctaa

SEQ ID NO: 465367 - DNA, 25 bp, Homo sapien
atcacagtccagaatcgacccggaa

SEQ ID NO: 465368 - DNA, 25 bp, Homo sapien
agtccagaatcgacccggaagcctt

SEQ ID NO: 465369 - DNA, 25 bp, Homo sapien
agaatcgacccggaagccttcagat

SEQ ID NO: 465370 - DNA, 25 bp, Homo sapien
aagccttcagatctgtaagacgtta

SEQ ID NO: 465371 - DNA, 25 bp, Homo sapien
agatctgtaagacgttacatttttg

SEQ ID NO: 465372 - DNA, 25 bp, Homo sapien
aatagggtccttgtagttaatcaag

SEQ ID NO: 465373 - DNA, 25 bp, Homo sapien
aggagcgtcaggatcattttcaact

SEQ ID NO: 465374 - DNA, 25 bp, Homo sapien
ggatcattttcaactctggttaggc

SEQ ID NO: 465375 - DNA, 25 bp, Homo sapien
ttttcaactctggttaggcctccta

SEQ ID NO: 465376 - DNA, 25 bp, Homo sapien
actgcactgggaggtcctggctgct

SEQ ID NO: 465377 - DNA, 25 bp, Homo sapien
gactgcgtgggctgagatgccaccc

SEQ ID NO: 465378 - DNA, 25 bp, Homo sapien
ggctgagatgccaccctttgaaggg

SEQ ID NO: 465379 - DNA, 25 bp, Homo sapien
acagcatggcggcatctgggcccca

SEQ ID NO: 465380 - DNA, 25 bp, Homo sapien
tgggccccacagtaacacctagtgg

SEQ ID NO: 465381 - DNA, 25 bp, Homo sapien
agtaacacctagtggcaaccttgcc

SEQ ID NO: 465382 - DNA, 25 bp, Homo sapien
tagtggcaaccttgccttcctgacc

SEQ ID NO: 465383 - DNA, 25 bp, Homo sapien
cagcagccctcaggagcgtcaggat

SEQ ID NO: 465384 - DNA, 25 bp, Homo sapien
agcagctccaagatcccggtcaagt

SEQ ID NO: 465385 - DNA, 25 bp, Homo sapien
tcccggtcaagtggacagcgcctga

SEQ ID NO: 465386 - DNA, 25 bp, Homo sapien
tgaggcggccaattatcgtgtcttc

SEQ ID NO: 465387 - DNA, 25 bp, Homo sapien
gccaattatcgtgtcttctcccaga

SEQ ID NO: 465388 - DNA, 25 bp, Homo sapien
ggcgtcctgctgcacgaggttttca

SEQ ID NO: 465389 - DNA, 25 bp, Homo sapien
gaggttttcacctatggccagtgtc

SEQ ID NO: 465390 - DNA, 25 bp, Homo sapien
ctatggccagtgtccctatgaaggg

SEQ ID NO: 465391 - DNA, 25 bp, Homo sapien
aagggatgaccaaccacgagacgct

SEQ ID NO: 465392 - DNA, 25 bp, Homo sapien
acgctgcagcagatcatgcgagggt

SEQ ID NO: 465393 - DNA, 25 bp, Homo sapien
cagatcatgcgagggtaccggctgc

SEQ ID NO: 465394 - DNA, 25 bp, Homo sapien
cggaggtctacgtgctcatgctgga

SEQ ID NO: 465395 - DNA, 25 bp, Homo sapien
ttctgctcccgactgtgaggacacc

SEQ ID NO: 465396 - DNA, 25 bp, Homo sapien
gaggacacccagttctagtagagca

SEQ ID NO: 465397 - DNA, 25 bp, Homo sapien
aaagctcccattttgtaaccactag

SEQ ID NO: 465398 - DNA, 25 bp, Homo sapien
aaccactagtttgcggttgacttga

SEQ ID NO: 465399 - DNA, 25 bp, Homo sapien
gacttgagtactctggtgacttcct

SEQ ID NO: 465400 - DNA, 25 bp, Homo sapien
tgcgtcaagcgttctcaagctgtga

SEQ ID NO: 465401 - DNA, 25 bp, Homo sapien
agaatgtgcgcagctccaggcaggt

SEQ ID NO: 465402 - DNA, 25 bp, Homo sapien
ccaggcaggttttctctcggagagt

SEQ ID NO: 465403 - DNA, 25 bp, Homo sapien
cggagagttaagtcttcccttgaag

SEQ ID NO: 465404 - DNA, 25 bp, Homo sapien
aaaacaccaggtgcgggagcagccc

SEQ ID NO: 465405 - DNA, 25 bp, Homo sapien
ctaaactggaggctgaataccgtgg

SEQ ID NO: 465406 - DNA, 25 bp, Homo sapien
atcagtcccttaactgccagtgttc

SEQ ID NO: 465407 - DNA, 25 bp, Homo sapien
tgccagtgttcgtggaccatgcaaa

SEQ ID NO: 465408 - DNA, 25 bp, Homo sapien
ggaccatgcaaaacaaccaagagga

SEQ ID NO: 465409 - DNA, 25 bp, Homo sapien
agggaccatctcaggtatgacttca

SEQ ID NO: 465410 - DNA, 25 bp, Homo sapien
tcaggtatgacttcaaatcaagcca

SEQ ID NO: 465411 - DNA, 25 bp, Homo sapien
caagccactgggttgtctgagaagt

SEQ ID NO: 465412 - DNA, 25 bp, Homo sapien
ggttgtctgagaagtaccccaagca

SEQ ID NO: 465413 - DNA, 25 bp, Homo sapien
gtaccccaagcaactagtctggact

SEQ ID NO: 465414 - DNA, 25 bp, Homo sapien
ctagtctggactgggaggttgaatt

SEQ ID NO: 465415 - DNA, 25 bp, Homo sapien
ggttgaattgagtccttgctgttgc

SEQ ID NO: 465416 - DNA, 25 bp, Homo sapien
ccttgctgttgctgaagctgtgaga

SEQ ID NO: 465417 - DNA, 25 bp, Homo sapien
aaccctggagagaacgagcatttga

SEQ ID NO: 465418 - DNA, 25 bp, Homo sapien
aaagggttcacttaagagatatgat

SEQ ID NO: 465419 - DNA, 25 bp, Homo sapien
atgattttatcataacagcattgaa

SEQ ID NO: 465420 - DNA, 25 bp, Homo sapien
cagcattgaaactttaatctcttat

SEQ ID NO: 465421 - DNA, 25 bp, Homo sapien
gacttcttaaaaagggtggcattgc

SEQ ID NO: 465422 - DNA, 25 bp, Homo sapien
gggtggcattgccaagaattttctt

SEQ ID NO: 465423 - DNA, 25 bp, Homo sapien
ctttgatatggtttcacaattgtat

SEQ ID NO: 465424 - DNA, 25 bp, Homo sapien
ggtttcacaattgtattcaccttct

SEQ ID NO: 465425 - DNA, 25 bp, Homo sapien
ccttctctccattctgagacttatc

SEQ ID NO: 465426 - DNA, 25 bp, Homo sapien
ctccattctgagacttatccataag

SEQ ID NO: 465427 - DNA, 25 bp, Homo sapien
gaatactcactttaatccgacttct

SEQ ID NO: 465428 - DNA, 25 bp, Homo sapien
gaaggacgcttggatgatgatgcat

SEQ ID NO: 465429 - DNA, 25 bp, Homo sapien
gatgatgcatactctcttgatctca

SEQ ID NO: 465430 - DNA, 25 bp, Homo sapien
gatctcaacacgagttcttctaggc

SEQ ID NO: 465431 - DNA, 25 bp, Homo sapien
agttcttctaggcaacccattctag

SEQ ID NO: 465432 - DNA, 25 bp, Homo sapien
taggcaacccattctagttaaaaga

SEQ ID NO: 465433 - DNA, 25 bp, Homo sapien
tggatgagaggccaaggtcccatat

SEQ ID NO: 465434 - DNA, 25 bp, Homo sapien
ggccaaggtcccatatcatgtggaa

SEQ ID NO: 465435 - DNA, 25 bp, Homo sapien
aattatggaggtcctacacgtagac

SEQ ID NO: 465436 - DNA, 25 bp, Homo sapien
gaggtcctacacgtagacggccaat

SEQ ID NO: 465437 - DNA, 25 bp, Homo sapien
acgtagacggccaatctcttcctgg

SEQ ID NO: 465438 - DNA, 25 bp, Homo sapien
ggagaaatgaccacatgtctctaag

SEQ ID NO: 465439 - DNA, 25 bp, Homo sapien
tatggactcaactttcatcctgctt

SEQ ID NO: 465440 - DNA, 25 bp, Homo sapien
ctttcctacgcattgatcctgagag

SEQ ID NO: 465441 - DNA, 25 bp, Homo sapien
aggaacagcggctcaaggcactcaa

SEQ ID NO: 465442 - DNA, 25 bp, Homo sapien
aacacctgcatgtcacacatctgtg

SEQ ID NO: 465443 - DNA, 25 bp, Homo sapien
agtgctggccttttatgtgcccata

SEQ ID NO: 465444 - DNA, 25 bp, Homo sapien
tatgtgcccataattgctgtctcca

SEQ ID NO: 465445 - DNA, 25 bp, Homo sapien
ataattgctgtctccatgattcacc

SEQ ID NO: 465446 - DNA, 25 bp, Homo sapien
gcttctggaaaagtgctccacctgt

SEQ ID NO: 465447 - DNA, 25 bp, Homo sapien
ctccacctgttgttcatgtcatgat

SEQ ID NO: 465448 - DNA, 25 bp, Homo sapien
catgtcatgatgtccaatgtctacc

SEQ ID NO: 465449 - DNA, 25 bp, Homo sapien
aatgtctacctgtttgtaccaccca

SEQ ID NO: 465450 - DNA, 25 bp, Homo sapien
aaatccaatccaatctaatctaatc

SEQ ID NO: 465451 - DNA, 25 bp, Homo sapien
acaataaaatcaatatcccaaggaa

SEQ ID NO: 465452 - DNA, 25 bp, Homo sapien
ttttcactgtgcatcttcctggttt

SEQ ID NO: 465453 - DNA, 25 bp, Homo sapien
tcactgtgcatcttcctggttttag

SEQ ID NO: 465454 - DNA, 25 bp, Homo sapien
atcttcctggttttagagtaggcac

SEQ ID NO: 465455 - DNA, 25 bp, Homo sapien
ctggttttagagtaggcacttattt

SEQ ID NO: 465456 - DNA, 25 bp, Homo sapien
atttttattttcactattgctctat

SEQ ID NO: 465457 - DNA, 25 bp, Homo sapien
gctctatttttagccataaccacca

SEQ ID NO: 465458 - DNA, 25 bp, Homo sapien
ttagccataaccaccagtactgcag

SEQ ID NO: 465459 - DNA, 25 bp, Homo sapien
aaccaccagtactgcagcaaatact

SEQ ID NO: 465460 - DNA, 25 bp, Homo sapien
aatacttcttgagaattatcctatg

SEQ ID NO: 465461 - DNA, 25 bp, Homo sapien
tcttgctatttttcccaggttggct

SEQ ID NO: 465462 - DNA, 25 bp, Homo sapien
ttttcccaggttggctggcctcaaa

SEQ ID NO: 465463 - DNA, 25 bp, Homo sapien
acacctagccatttcaggctcttga

SEQ ID NO: 465464 - DNA, 25 bp, Homo sapien
gccatttcaggctcttgaagtagga

SEQ ID NO: 465465 - DNA, 25 bp, Homo sapien
tgaagtaggaggacatgctaccaat

SEQ ID NO: 465466 - DNA, 25 bp, Homo sapien
tgctaccaatgaggacaaccgaaga

SEQ ID NO: 465467 - DNA, 25 bp, Homo sapien
gaagaacacaccacaggctctgaag

SEQ ID NO: 465468 - DNA, 25 bp, Homo sapien
tctgaaggccattcccaaatgaggt

SEQ ID NO: 465469 - DNA, 25 bp, Homo sapien
ggccattcccaaatgaggttccaaa

SEQ ID NO: 465470 - DNA, 25 bp, Homo sapien
tgaggttccaaacaggttttcaaca

SEQ ID NO: 465471 - DNA, 25 bp, Homo sapien
aaagtgacagtcctgcatagcctcc

SEQ ID NO: 465472 - DNA, 25 bp, Homo sapien
tcaccatcgcggtctcaggagataa

SEQ ID NO: 465473 - DNA, 25 bp, Homo sapien
gagctggactcgtaccctctctacg

SEQ ID NO: 465474 - DNA, 25 bp, Homo sapien
tacgccatctacctcatcgtcattg

SEQ ID NO: 465475 - DNA, 25 bp, Homo sapien
atcgtcattggcctcagcggtggct

SEQ ID NO: 465476 - DNA, 25 bp, Homo sapien
agcggtggcttcatggtcctgtact

SEQ ID NO: 465477 - DNA, 25 bp, Homo sapien
atggtcctgtactacgtgtccttaa

SEQ ID NO: 465478 - DNA, 25 bp, Homo sapien
gtgtccttaaggttcatcaaacaga

SEQ ID NO: 465479 - DNA, 25 bp, Homo sapien
aagtcaagactggtgattcacgcca

SEQ ID NO: 465480 - DNA, 25 bp, Homo sapien
actggtgattcacgccagacgtctg

SEQ ID NO: 465481 - DNA, 25 bp, Homo sapien
gggacctgaggcagacccttcaact

SEQ ID NO: 465482 - DNA, 25 bp, Homo sapien
tgaggcagacccttcaactgcactt

SEQ ID NO: 465483 - DNA, 25 bp, Homo sapien
catcttctcaatgtccttttcttta

SEQ ID NO: 465484 - DNA, 25 bp, Homo sapien
ttttctttaatttgagatcgcttct

SEQ ID NO: 465485 - DNA, 25 bp, Homo sapien
gatcgcttctcaggtttttctttac

SEQ ID NO: 465486 - DNA, 25 bp, Homo sapien
tctttactttcctttatatgctttt

SEQ ID NO: 465487 - DNA, 25 bp, Homo sapien
aatgaagccctatagattcctcaat

SEQ ID NO: 465488 - DNA, 25 bp, Homo sapien
tagattcctcaatggcactcatacc

SEQ ID NO: 465489 - DNA, 25 bp, Homo sapien
attctcgctttcctttttaatcttg

SEQ ID NO: 465490 - DNA, 25 bp, Homo sapien
taatcttgtctcgttcctctttaaa

SEQ ID NO: 465491 - DNA, 25 bp, Homo sapien
tcgttcctctttaaagttcctctct

SEQ ID NO: 465492 - DNA, 25 bp, Homo sapien
tcacccttcttgtatggccattttg

SEQ ID NO: 465493 - DNA, 25 bp, Homo sapien
attttgtctgtgtgatgcgaatata

SEQ ID NO: 465494 - DNA, 25 bp, Homo sapien
gagaattgcttcaattccctgcttg

SEQ ID NO: 465495 - DNA, 25 bp, Homo sapien
agaattgcttcaattccctgcttga

SEQ ID NO: 465496 - DNA, 25 bp, Homo sapien
gaattgcttcaattccctgcttgaa

SEQ ID NO: 465497 - DNA, 25 bp, Homo sapien
aattgcttcaattccctgcttgaac

SEQ ID NO: 465498 - DNA, 25 bp, Homo sapien
attgcttcaattccctgcttgaacc

SEQ ID NO: 465499 - DNA, 25 bp, Homo sapien
ttgcttcaattccctgcttgaaccc

SEQ ID NO: 465500 - DNA, 25 bp, Homo sapien
tgcttcaattccctgcttgaaccca

SEQ ID NO: 465501 - DNA, 25 bp, Homo sapien
gcttcaattccctgcttgaacccag

SEQ ID NO: 465502 - DNA, 25 bp, Homo sapien
cttcaattccctgcttgaacccagg

SEQ ID NO: 465503 - DNA, 25 bp, Homo sapien
tggagatttcagtgagctgacatcg

SEQ ID NO: 465504 - DNA, 25 bp, Homo sapien
ggcgtggtggcgcacaagtgtaatc

SEQ ID NO: 465505 - DNA, 25 bp, Homo sapien
tcatttgcagggacaaatactgtgc

SEQ ID NO: 465506 - DNA, 25 bp, Homo sapien
cagggacaaatactgtgcgtggatc

SEQ ID NO: 465507 - DNA, 25 bp, Homo sapien
ggacaaatactgtgcgtggatcgat

SEQ ID NO: 465508 - DNA, 25 bp, Homo sapien
caaatactgtgcgtggatcgatgat

SEQ ID NO: 465509 - DNA, 25 bp, Homo sapien
atactgtgcgtggatcgatgatgac

SEQ ID NO: 465510 - DNA, 25 bp, Homo sapien
acttccacatatacattccttggaa

SEQ ID NO: 465511 - DNA, 25 bp, Homo sapien
catatacattccttggaaagctgaa

SEQ ID NO: 465512 - DNA, 25 bp, Homo sapien
tataccgtcatcctcgtcgaactga

SEQ ID NO: 465513 - DNA, 25 bp, Homo sapien
ataccgtcatcctcgtcgaactgag

SEQ ID NO: 465514 - DNA, 25 bp, Homo sapien
accgtcatcctcgtcgaactgaggt

SEQ ID NO: 465515 - DNA, 25 bp, Homo sapien
cgtcatcctcgtcgaactgaggtcc

SEQ ID NO: 465516 - DNA, 25 bp, Homo sapien
ctcttatcagctcccaactagaggt

SEQ ID NO: 465517 - DNA, 25 bp, Homo sapien
ttatcagctcccaactagaggtcca

SEQ ID NO: 465518 - DNA, 25 bp, Homo sapien
tagaggtccacccaggacccagaga

SEQ ID NO: 465519 - DNA, 25 bp, Homo sapien
ccagagacctggatttgaggctgct

SEQ ID NO: 465520 - DNA, 25 bp, Homo sapien
gatttgaggctgctgggcggcagat

SEQ ID NO: 465521 - DNA, 25 bp, Homo sapien
ggcagatggagcgatcagaagacca

SEQ ID NO: 465522 - DNA, 25 bp, Homo sapien
tggagcgatcagaagaccagggtaa

SEQ ID NO: 465523 - DNA, 25 bp, Homo sapien
aagggtgtggcagatactgccacta

SEQ ID NO: 465524 - DNA, 25 bp, Homo sapien
agatactgccactaacacttctcag

SEQ ID NO: 465525 - DNA, 25 bp, Homo sapien
tgtgtttgtctactcccagccaggt

SEQ ID NO: 465526 - DNA, 25 bp, Homo sapien
tgtttgtctactcccagccaggtgt

SEQ ID NO: 465527 - DNA, 25 bp, Homo sapien
ttctctcagcttcttgaagttgttc

SEQ ID NO: 465528 - DNA, 25 bp, Homo sapien
aagttgttcaactatccttgccact

SEQ ID NO: 465529 - DNA, 25 bp, Homo sapien
tcaactatccttgccactggaagac

SEQ ID NO: 465530 - DNA, 25 bp, Homo sapien
gaccaaacaaggttttcactgcttt

SEQ ID NO: 465531 - DNA, 25 bp, Homo sapien
actgctttttcttttacataatatg

SEQ ID NO: 465532 - DNA, 25 bp, Homo sapien
acaaacaaaattactcacctggatt

SEQ ID NO: 465533 - DNA, 25 bp, Homo sapien
ttaatctccatgaaatcgtgaaata

SEQ ID NO: 465534 - DNA, 25 bp, Homo sapien
gacaagaatagtgtttcagctgtag

SEQ ID NO: 465535 - DNA, 25 bp, Homo sapien
ttacagctaattgcccataaattgt

SEQ ID NO: 465536 - DNA, 25 bp, Homo sapien
gtagcatttattgacctgaagtact

SEQ ID NO: 465537 - DNA, 25 bp, Homo sapien
gtactaagctaattgtcttgactac

SEQ ID NO: 465538 - DNA, 25 bp, Homo sapien
acctggagactaccatctgcctcat

SEQ ID NO: 465539 - DNA, 25 bp, Homo sapien
atctgcctcattgacgtggacacag

SEQ ID NO: 465540 - DNA, 25 bp, Homo sapien
gtggacacagaattcttggcctcat

SEQ ID NO: 465541 - DNA, 25 bp, Homo sapien
ttggcctcattttccacagaaggag

SEQ ID NO: 465542 - DNA, 25 bp, Homo sapien
aacctcagaacctcaaacgtgggca

SEQ ID NO: 465543 - DNA, 25 bp, Homo sapien
gggcaactttgatattggcctcatg

SEQ ID NO: 465544 - DNA, 25 bp, Homo sapien
ttttgacctggcattcatgcccgca

SEQ ID NO: 465545 - DNA, 25 bp, Homo sapien
attcatgcccgcaatgaacgctgtg

SEQ ID NO: 465546 - DNA, 25 bp, Homo sapien
aatgaacgctgtgctgggttctggc

SEQ ID NO: 465547 - DNA, 25 bp, Homo sapien
cccaaaatcctcaacatcgacttta

SEQ ID NO: 465548 - DNA, 25 bp, Homo sapien
aacatcgactttagcaatgcagaca

SEQ ID NO: 465549 - DNA, 25 bp, Homo sapien
gagccgaaaatttaggcctctggaa

SEQ ID NO: 465550 - DNA, 25 bp, Homo sapien
ttaggcctctggaagctacaggtct

SEQ ID NO: 465551 - DNA, 25 bp, Homo sapien
tctggaagctacaggtctgtttcag

SEQ ID NO: 465552 - DNA, 25 bp, Homo sapien
tctgtttcagatggatctattcttt

SEQ ID NO: 465553 - DNA, 25 bp, Homo sapien
gatctattctttttcctgggttcag

SEQ ID NO: 465554 - DNA, 25 bp, Homo sapien
ttatttggccataaagccctaagcc

SEQ ID NO: 465555 - DNA, 25 bp, Homo sapien
aaagccctaagccatgtatgatcat

SEQ ID NO: 465556 - DNA, 25 bp, Homo sapien
tattagaaggttccgttttctctat

SEQ ID NO: 465557 - DNA, 25 bp, Homo sapien
ataccccaactttaggagcattaag

SEQ ID NO: 465558 - DNA, 25 bp, Homo sapien
gggtttcaggacaatttacctcttg

SEQ ID NO: 465559 - DNA, 25 bp, Homo sapien
tcaggacaatttacctcttgaacat

SEQ ID NO: 465560 - DNA, 25 bp, Homo sapien
cgtgctgtttgcctgtattggctat

SEQ ID NO: 465561 - DNA, 25 bp, Homo sapien
tgcctgtattggctatgccttctaa

SEQ ID NO: 465562 - DNA, 25 bp, Homo sapien
attggctatgccttctaactccaac

SEQ ID NO: 465563 - DNA, 25 bp, Homo sapien
actccaaccagtcacttgagaatat

SEQ ID NO: 465564 - DNA, 25 bp, Homo sapien
tattctttcaagattctgggccccg

SEQ ID NO: 465565 - DNA, 25 bp, Homo sapien
tctttcaagattctgggccccgatt

SEQ ID NO: 465566 - DNA, 25 bp, Homo sapien
agcaaagatctaattctcaagcaat

SEQ ID NO: 465567 - DNA, 25 bp, Homo sapien
tattcatgctaggaatttgtgtctg

SEQ ID NO: 465568 - DNA, 25 bp, Homo sapien
gaatttgtgtctgttgttgtactca

SEQ ID NO: 465569 - DNA, 25 bp, Homo sapien
gtctgttgttgtactcacagcagca

SEQ ID NO: 465570 - DNA, 25 bp, Homo sapien
tcacagcagcaacatgagtgtaaac

SEQ ID NO: 465571 - DNA, 25 bp, Homo sapien
gaagagtctatcattgctggtcaaa

SEQ ID NO: 465572 - DNA, 25 bp, Homo sapien
attgctggtcaaaatcggcctgagg

SEQ ID NO: 465573 - DNA, 25 bp, Homo sapien
aaaatcggcctgaggatggccgcca

SEQ ID NO: 465574 - DNA, 25 bp, Homo sapien
aggcctgaaggcatcatctgggcag

SEQ ID NO: 465575 - DNA, 25 bp, Homo sapien
ttgcataaaacagacccattccctt

SEQ ID NO: 465576 - DNA, 25 bp, Homo sapien
gccctccagggaagctgcatgtgga

SEQ ID NO: 465577 - DNA, 25 bp, Homo sapien
gctgcatgtggacctccacggtatt

SEQ ID NO: 465578 - DNA, 25 bp, Homo sapien
taaaacagacccattccctttgtgg

SEQ ID NO: 465579 - DNA, 25 bp, Homo sapien
tccctttgtgggtcagatgttacca

SEQ ID NO: 465580 - DNA, 25 bp, Homo sapien
tgggtcagatgttaccacctttaaa

SEQ ID NO: 465581 - DNA, 25 bp, Homo sapien
tctcctttctgtcccactgaaaaat

SEQ ID NO: 465582 - DNA, 25 bp, Homo sapien
acacaacgtgcatcccactgagctg

SEQ ID NO: 465583 - DNA, 25 bp, Homo sapien
caacgtgcatcccactgagctggtg

SEQ ID NO: 465584 - DNA, 25 bp, Homo sapien
cactgagctggtgggcttcttgcct

SEQ ID NO: 465585 - DNA, 25 bp, Homo sapien
ctgggtcacaagtctgtggctcatg

SEQ ID NO: 465586 - DNA, 25 bp, Homo sapien
gggtcacaagtctgtggctcatgtc

SEQ ID NO: 465587 - DNA, 25 bp, Homo sapien
ggtcacaagtctgtggctcatgtca

SEQ ID NO: 465588 - DNA, 25 bp, Homo sapien
gtcacaagtctgtggctcatgtcac

SEQ ID NO: 465589 - DNA, 25 bp, Homo sapien
tcacaagtctgtggctcatgtcacc

SEQ ID NO: 465590 - DNA, 25 bp, Homo sapien
acaagtctgtggctcatgtcaccaa

SEQ ID NO: 465591 - DNA, 25 bp, Homo sapien
gtggctcatgtcaccaagctcgaaa

SEQ ID NO: 465592 - DNA, 25 bp, Homo sapien
gctcatgtcaccaagctcgaaaagg

SEQ ID NO: 465593 - DNA, 25 bp, Homo sapien
agctatgggccggtcagactgtata

SEQ ID NO: 465594 - DNA, 25 bp, Homo sapien
ggtcagactgtataatcctcctgct

SEQ ID NO: 465595 - DNA, 25 bp, Homo sapien
agactgtataatcctcctgctccag

SEQ ID NO: 465596 - DNA, 25 bp, Homo sapien
gggcctccatccacgacagagatgc

SEQ ID NO: 465597 - DNA, 25 bp, Homo sapien
tccatccacgacagagatgccaagg

SEQ ID NO: 465598 - DNA, 25 bp, Homo sapien
gcctgaaccacacactgagcgagag

SEQ ID NO: 465599 - DNA, 25 bp, Homo sapien
gagcgagaggcagatggtcctcctc

SEQ ID NO: 465600 - DNA, 25 bp, Homo sapien
tggtcctcctccaccggatagcaaa

SEQ ID NO: 465601 - DNA, 25 bp, Homo sapien
tcctccaccggatagcaaagtcggg

SEQ ID NO: 465602 - DNA, 25 bp, Homo sapien
ggataagggatctgaatgacttggt

SEQ ID NO: 465603 - DNA, 25 bp, Homo sapien
atgacttggtcatgaagaatgcttt

SEQ ID NO: 465604 - DNA, 25 bp, Homo sapien
ttgcctgttcttcccaccttgactt

SEQ ID NO: 465605 - DNA, 25 bp, Homo sapien
cttgacttccagagcagccatcgct

SEQ ID NO: 465606 - DNA, 25 bp, Homo sapien
agccatcgctggtgagctttagttc

SEQ ID NO: 465607 - DNA, 25 bp, Homo sapien
gtgagctttagttctccttagggtt

SEQ ID NO: 465608 - DNA, 25 bp, Homo sapien
gttctccttagggttccaaggcatt

SEQ ID NO: 465609 - DNA, 25 bp, Homo sapien
gtaagagtgtagcttggaaaccaac

SEQ ID NO: 465610 - DNA, 25 bp, Homo sapien
gcttggaaaccaacttctgtgattt

SEQ ID NO: 465611 - DNA, 25 bp, Homo sapien
ttctgtgatttaggaaagctgtctc

SEQ ID NO: 465612 - DNA, 25 bp, Homo sapien
ttatttcatttaggccccagttggt

SEQ ID NO: 465613 - DNA, 25 bp, Homo sapien
tcatttaggccccagttggtaggtt

SEQ ID NO: 465614 - DNA, 25 bp, Homo sapien
gctaaaccaagcctctaaaaactca

SEQ ID NO: 465615 - DNA, 25 bp, Homo sapien
ttggccggttcttgacctggtggat

SEQ ID NO: 465616 - DNA, 25 bp, Homo sapien
gtggcagagcagaccactctccctt

SEQ ID NO: 465617 - DNA, 25 bp, Homo sapien
tttttgcctcctcggaagctcgctg

SEQ ID NO: 465618 - DNA, 25 bp, Homo sapien
tcggaagctcgctgcccagagccat

SEQ ID NO: 465619 - DNA, 25 bp, Homo sapien
agagccatgtccagaacccagccgg

SEQ ID NO: 465620 - DNA, 25 bp, Homo sapien
ccatctccatggtgccaattaccag

SEQ ID NO: 465621 - DNA, 25 bp, Homo sapien
agcaagtgtctttcctgcggcaccg

SEQ ID NO: 465622 - DNA, 25 bp, Homo sapien
ctgcggcaccgggttcaggcagcta

SEQ ID NO: 465623 - DNA, 25 bp, Homo sapien
tctcccaacgggattggctacactt

SEQ ID NO: 465624 - DNA, 25 bp, Homo sapien
acgggattggctacacttttgactt

SEQ ID NO: 465625 - DNA, 25 bp, Homo sapien
tacacttttgacttggccggttctt

SEQ ID NO: 465626 - DNA, 25 bp, Homo sapien
ggcagagtcccgctgccaagagaca

SEQ ID NO: 465627 - DNA, 25 bp, Homo sapien
gcagagtcccgctgccaagagacag

SEQ ID NO: 465628 - DNA, 25 bp, Homo sapien
tgccaagagacagatgagcagatca

SEQ ID NO: 465629 - DNA, 25 bp, Homo sapien
gccaagagacagatgagcagatcag

SEQ ID NO: 465630 - DNA, 25 bp, Homo sapien
aagagacagatgagcagatcagact

SEQ ID NO: 465631 - DNA, 25 bp, Homo sapien
gagacagatgagcagatcagactga

SEQ ID NO: 465632 - DNA, 25 bp, Homo sapien
agacagatgagcagatcagactgat

SEQ ID NO: 465633 - DNA, 25 bp, Homo sapien
gacagatgagcagatcagactgatg

SEQ ID NO: 465634 - DNA, 25 bp, Homo sapien
cagatgagcagatcagactgatgga

SEQ ID NO: 465635 - DNA, 25 bp, Homo sapien
aactgatgacttggaatataaactg

SEQ ID NO: 465636 - DNA, 25 bp, Homo sapien
cttggaatataaactgaaatgcaac

SEQ ID NO: 465637 - DNA, 25 bp, Homo sapien
tgctcaggtggtgggtgctcagggc

SEQ ID NO: 465638 - DNA, 25 bp, Homo sapien
ggccactgggccgttttgatgacct

SEQ ID NO: 465639 - DNA, 25 bp, Homo sapien
tgggccgttttgatgacctcgaagg

SEQ ID NO: 465640 - DNA, 25 bp, Homo sapien
gcttacacggccatttgtctctttt

SEQ ID NO: 465641 - DNA, 25 bp, Homo sapien
aaataggagcaggatttcccctggg

SEQ ID NO: 465642 - DNA, 25 bp, Homo sapien
gggaaaagttctcctgggacatctt

SEQ ID NO: 465643 - DNA, 25 bp, Homo sapien
tccttcaccaggcagtgagtggcgt

SEQ ID NO: 465644 - DNA, 25 bp, Homo sapien
agtgagtggcgtaggctctggagcc

SEQ ID NO: 465645 - DNA, 25 bp, Homo sapien
tgtctcttttcccaatgcggcggtg

SEQ ID NO: 465646 - DNA, 25 bp, Homo sapien
aatgcggcggtgcactttcgctctt

SEQ ID NO: 465647 - DNA, 25 bp, Homo sapien
gggctgcaccccagacatagctggc

SEQ ID NO: 465648 - DNA, 25 bp, Homo sapien
gatcctgtggattagaaacaagttg

SEQ ID NO: 465649 - DNA, 25 bp, Homo sapien
gattagaaacaagttgctcctcaga

SEQ ID NO: 465650 - DNA, 25 bp, Homo sapien
ttagaaacaagttgctcctcagagc

SEQ ID NO: 465651 - DNA, 25 bp, Homo sapien
acaagttgctcctcagagctctcaa

SEQ ID NO: 465652 - DNA, 25 bp, Homo sapien
cagagctctcaagcagggactgctc

SEQ ID NO: 465653 - DNA, 25 bp, Homo sapien
gagctctcaagcagggactgctctt

SEQ ID NO: 465654 - DNA, 25 bp, Homo sapien
ctctcaagcagggactgctctttag

SEQ ID NO: 465655 - DNA, 25 bp, Homo sapien
tcaagcagggactgctctttaggaa

SEQ ID NO: 465656 - DNA, 25 bp, Homo sapien
gcagcggctgggagtgagcagggca

SEQ ID NO: 465657 - DNA, 25 bp, Homo sapien
gggaccgcaggtagcccagggtgtt

SEQ ID NO: 465658 - DNA, 25 bp, Homo sapien
ggcagcacttgtttactggctgctt

SEQ ID NO: 465659 - DNA, 25 bp, Homo sapien
gatcatattctgagtttgcttgtga

SEQ ID NO: 465660 - DNA, 25 bp, Homo sapien
agtttgcttgtgatagtccaattta

SEQ ID NO: 465661 - DNA, 25 bp, Homo sapien
gatagtccaatttataccgtggaaa

SEQ ID NO: 465662 - DNA, 25 bp, Homo sapien
gaaagtacgaccttccttgaattgg

SEQ ID NO: 465663 - DNA, 25 bp, Homo sapien
tccttgaattgggtgtttattggcc

SEQ ID NO: 465664 - DNA, 25 bp, Homo sapien
ttattggccagaagggctagtcaat

SEQ ID NO: 465665 - DNA, 25 bp, Homo sapien
tagtcaatactagacctgcttgcat

SEQ ID NO: 465666 - DNA, 25 bp, Homo sapien
gacctgcttgcatttaatgactgtg

SEQ ID NO: 465667 - DNA, 25 bp, Homo sapien
gactgtgttaatgacccaatagtga

SEQ ID NO: 465668 - DNA, 25 bp, Homo sapien
aaagtatcaagaagccccagaaatt

SEQ ID NO: 465669 - DNA, 25 bp, Homo sapien
gggtttatctgtggccatgaagaaa

SEQ ID NO: 465670 - DNA, 25 bp, Homo sapien
atgcctgtaattcccaaagtgggga

SEQ ID NO: 465671 - DNA, 25 bp, Homo sapien
tgcctgtaattcccaaagtggggat

SEQ ID NO: 465672 - DNA, 25 bp, Homo sapien
gcctgtaattcccaaagtggggatt

SEQ ID NO: 465673 - DNA, 25 bp, Homo sapien
attcccaaagtggggattttgagag

SEQ ID NO: 465674 - DNA, 25 bp, Homo sapien
ccaaagtggggattttgagagacca

SEQ ID NO: 465675 - DNA, 25 bp, Homo sapien
ggattttgagagaccaaagcgggca

SEQ ID NO: 465676 - DNA, 25 bp, Homo sapien
gattttgagagaccaaagcgggcag

SEQ ID NO: 465677 - DNA, 25 bp, Homo sapien
attttgagagaccaaagcgggcaga

SEQ ID NO: 465678 - DNA, 25 bp, Homo sapien
agacgagtgagctctcgggctcaat

SEQ ID NO: 465679 - DNA, 25 bp, Homo sapien
tcgggctcaattgctcctaagaaat

SEQ ID NO: 465680 - DNA, 25 bp, Homo sapien
cactccaggtctggtcacgttcaga

SEQ ID NO: 465681 - DNA, 25 bp, Homo sapien
ataaggtcaccttttttcgcctctg

SEQ ID NO: 465682 - DNA, 25 bp, Homo sapien
gcctctgtggacacccttttgaaat

SEQ ID NO: 465683 - DNA, 25 bp, Homo sapien
ttttcttccaattgacttggatctc

SEQ ID NO: 465684 - DNA, 25 bp, Homo sapien
tgacttggatctcctctggattttt

SEQ ID NO: 465685 - DNA, 25 bp, Homo sapien
gttcagacccgtgtctgtattcgaa

SEQ ID NO: 465686 - DNA, 25 bp, Homo sapien
gtgtctgtattcgaacccaaaattg

SEQ ID NO: 465687 - DNA, 25 bp, Homo sapien
attggagccgaattgatgagactaa

SEQ ID NO: 465688 - DNA, 25 bp, Homo sapien
gatgagactaatttctagagaggga

SEQ ID NO: 465689 - DNA, 25 bp, Homo sapien
atgagtcttttgctttgccctactg

SEQ ID NO: 465690 - DNA, 25 bp, Homo sapien
tttgctttgccctactggaactttg

SEQ ID NO: 465691 - DNA, 25 bp, Homo sapien
ctactggaactttgccactgggagg

SEQ ID NO: 465692 - DNA, 25 bp, Homo sapien
tgtgatgtgtgtacagaccagctgt

SEQ ID NO: 465693 - DNA, 25 bp, Homo sapien
atgtgtgtacagaccagctgtttgg

SEQ ID NO: 465694 - DNA, 25 bp, Homo sapien
ggcagcgagaccagacgatccgact

SEQ ID NO: 465695 - DNA, 25 bp, Homo sapien
agaccagacgatccgactctgatta

SEQ ID NO: 465696 - DNA, 25 bp, Homo sapien
gactctgattagtcggaactcaaga

SEQ ID NO: 465697 - DNA, 25 bp, Homo sapien
tagtcggaactcaagattctccagc

SEQ ID NO: 465698 - DNA, 25 bp, Homo sapien
aagattctccagctgggaaactgtc

SEQ ID NO: 465699 - DNA, 25 bp, Homo sapien
ccagctgggaaactgtctgtgatag

SEQ ID NO: 465700 - DNA, 25 bp, Homo sapien
agaggttcagaaatttgtcaacaaa

SEQ ID NO: 465701 - DNA, 25 bp, Homo sapien
gaggttcagaaatttgtcaacaaag

SEQ ID NO: 465702 - DNA, 25 bp, Homo sapien
gaaaaagggatcatggttttggcag

SEQ ID NO: 465703 - DNA, 25 bp, Homo sapien
agacacactgcccattgaggtatac

SEQ ID NO: 465704 - DNA, 25 bp, Homo sapien
gacacactgcccattgaggtatact

SEQ ID NO: 465705 - DNA, 25 bp, Homo sapien
acacactgcccattgaggtatactg

SEQ ID NO: 465706 - DNA, 25 bp, Homo sapien
acactgcccattgaggtatactgcc

SEQ ID NO: 465707 - DNA, 25 bp, Homo sapien
cactgcccattgaggtatactgcca

SEQ ID NO: 465708 - DNA, 25 bp, Homo sapien
actgcccattgaggtatactgccat

SEQ ID NO: 465709 - DNA, 25 bp, Homo sapien
ctgcccattgaggtatactgccatc

SEQ ID NO: 465710 - DNA, 25 bp, Homo sapien
tgcccattgaggtatactgccatct

SEQ ID NO: 465711 - DNA, 25 bp, Homo sapien
tacttttgtgaattccttagccttt

SEQ ID NO: 465712 - DNA, 25 bp, Homo sapien
tagcctttcttccttggtgcataaa

SEQ ID NO: 465713 - DNA, 25 bp, Homo sapien
gaattgctgcatattaacatctcag

SEQ ID NO: 465714 - DNA, 25 bp, Homo sapien
gaaattcgtactatattggccaaag

SEQ ID NO: 465715 - DNA, 25 bp, Homo sapien
attggccaaagtgagcgagttaggt

SEQ ID NO: 465716 - DNA, 25 bp, Homo sapien
gagcgagttaggtgatcttggtttc

SEQ ID NO: 465717 - DNA, 25 bp, Homo sapien
gatcttggtttcaatttccgagcct

SEQ ID NO: 465718 - DNA, 25 bp, Homo sapien
ttcaatttccgagcctttgttaata

SEQ ID NO: 465719 - DNA, 25 bp, Homo sapien
tatgtaggacctttggacccagggt

SEQ ID NO: 465720 - DNA, 25 bp, Homo sapien
ggacccagggtcctacagatagata

SEQ ID NO: 465721 - DNA, 25 bp, Homo sapien
gatagatatggtgtgcccagatttt

SEQ ID NO: 465722 - DNA, 25 bp, Homo sapien
aagatcatgcccaaagcttcctatg

SEQ ID NO: 465723 - DNA, 25 bp, Homo sapien
actccaggttaggacacttggcgtt

SEQ ID NO: 465724 - DNA, 25 bp, Homo sapien
acttggcgtttatgtgctccacgat

SEQ ID NO: 465725 - DNA, 25 bp, Homo sapien
cacgatggctatggtctctgaaggt

SEQ ID NO: 465726 - DNA, 25 bp, Homo sapien
ttctccgctggtgttaatctggacc

SEQ ID NO: 465727 - DNA, 25 bp, Homo sapien
tggaccataacctttaacctttcag

SEQ ID NO: 465728 - DNA, 25 bp, Homo sapien
aggaactgttcactttgtctgccaa

SEQ ID NO: 465729 - DNA, 25 bp, Homo sapien
gcagggatgttcagctttttacaca

SEQ ID NO: 465730 - DNA, 25 bp, Homo sapien
ctcccggagggacaataacagctgg

SEQ ID NO: 465731 - DNA, 25 bp, Homo sapien
agctggaagtctggatttggtcctt

SEQ ID NO: 465732 - DNA, 25 bp, Homo sapien
ttggtccttgactaagatcatgccc

SEQ ID NO: 465733 - DNA, 25 bp, Homo sapien
ggtatgagtgccattgaggaatcta

SEQ ID NO: 465734 - DNA, 25 bp, Homo sapien
atgagtgccattgaggaatctatag

SEQ ID NO: 465735 - DNA, 25 bp, Homo sapien
gagtgccattgaggaatctataggg

SEQ ID NO: 465736 - DNA, 25 bp, Homo sapien
ccattgaggaatctatagggcttca

SEQ ID NO: 465737 - DNA, 25 bp, Homo sapien
ttgaggaatctatagggcttcattt

SEQ ID NO: 465738 - DNA, 25 bp, Homo sapien
gaggaatctatagggcttcatttag

SEQ ID NO: 465739 - DNA, 25 bp, Homo sapien
aatctatagggcttcatttagtgga

SEQ ID NO: 465740 - DNA, 25 bp, Homo sapien
ctatagggcttcatttagtggaaaa

SEQ ID NO: 465741 - DNA, 25 bp, Homo sapien
tagggcttcatttagtggaaaagga

SEQ ID NO: 465742 - DNA, 25 bp, Homo sapien
aaaacctgagaagcgatctcaaatt

SEQ ID NO: 465743 - DNA, 25 bp, Homo sapien
gagaagcgatctcaaattaaagaaa

SEQ ID NO: 465744 - DNA, 25 bp, Homo sapien
agtctgagtgggtgtgaaaaaaaca

SEQ ID NO: 465745 - DNA, 25 bp, Homo sapien
tgtgaaaaaaacagcacctggcggt

SEQ ID NO: 465746 - DNA, 25 bp, Homo sapien
aaaaacagcacctggcggtgccccg

SEQ ID NO: 465747 - DNA, 25 bp, Homo sapien
ggaggatcgtttgagaatatatctc

SEQ ID NO: 465748 - DNA, 25 bp, Homo sapien
ggatcgtttgagaatatatctcctt

SEQ ID NO: 465749 - DNA, 25 bp, Homo sapien
gatcgtttgagaatatatctccttg

SEQ ID NO: 465750 - DNA, 25 bp, Homo sapien
atcgtttgagaatatatctccttgc

SEQ ID NO: 465751 - DNA, 25 bp, Homo sapien
tcgtttgagaatatatctccttgcc

SEQ ID NO: 465752 - DNA, 25 bp, Homo sapien
cgtttgagaatatatctccttgccc

SEQ ID NO: 465753 - DNA, 25 bp, Homo sapien
gtttgagaatatatctccttgccca

SEQ ID NO: 465754 - DNA, 25 bp, Homo sapien
tttgagaatatatctccttgcccaa

SEQ ID NO: 465755 - DNA, 25 bp, Homo sapien
acaagctccatcgacttgcccacat

SEQ ID NO: 465756 - DNA, 25 bp, Homo sapien
catcgacttgcccacattgcccact

SEQ ID NO: 465757 - DNA, 25 bp, Homo sapien
tccaagcttgggaagcatgatcatg

SEQ ID NO: 465758 - DNA, 25 bp, Homo sapien
aagcttgggaagcatgatcatgccc

SEQ ID NO: 465759 - DNA, 25 bp, Homo sapien
gcttgggaagcatgatcatgcccac

SEQ ID NO: 465760 - DNA, 25 bp, Homo sapien
ttgggaagcatgatcatgcccacat

SEQ ID NO: 465761 - DNA, 25 bp, Homo sapien
tgggaagcatgatcatgcccacatt

SEQ ID NO: 465762 - DNA, 25 bp, Homo sapien
gggaagcatgatcatgcccacattg

SEQ ID NO: 465763 - DNA, 25 bp, Homo sapien
ggaagcatgatcatgcccacattgc

SEQ ID NO: 465764 - DNA, 25 bp, Homo sapien
aagcatgatcatgcccacattgcca

SEQ ID NO: 465765 - DNA, 25 bp, Homo sapien
gcatgatcatgcccacattgccaaa

SEQ ID NO: 465766 - DNA, 25 bp, Homo sapien
gggatacagccagagttttaacaac

SEQ ID NO: 465767 - DNA, 25 bp, Homo sapien
gatacagccagagttttaacaactt

SEQ ID NO: 465768 - DNA, 25 bp, Homo sapien
tacagccagagttttaacaactttt

SEQ ID NO: 465769 - DNA, 25 bp, Homo sapien
cagccagagttttaacaacttttat

SEQ ID NO: 465770 - DNA, 25 bp, Homo sapien
gccagagttttaacaacttttatca

SEQ ID NO: 465771 - DNA, 25 bp, Homo sapien
agagttttaacaacttttatcatca

SEQ ID NO: 465772 - DNA, 25 bp, Homo sapien
tgtttgttatttctcaagggacaaa

SEQ ID NO: 465773 - DNA, 25 bp, Homo sapien
tgttatttctcaagggacaaaaagt

SEQ ID NO: 465774 - DNA, 25 bp, Homo sapien
gcttaagatgttatatatacggccg

SEQ ID NO: 465775 - DNA, 25 bp, Homo sapien
ttaagatgttatatatacggccggg

SEQ ID NO: 465776 - DNA, 25 bp, Homo sapien
gatgttatatatacggccgggggcc

SEQ ID NO: 465777 - DNA, 25 bp, Homo sapien
atttctgccccctgcagtgggtcat

SEQ ID NO: 465778 - DNA, 25 bp, Homo sapien
tgccccctgcagtgggtcatacctg

SEQ ID NO: 465779 - DNA, 25 bp, Homo sapien
caggagttcgagactcaactgtgta

SEQ ID NO: 465780 - DNA, 25 bp, Homo sapien
aggagttcgagactcaactgtgtag

SEQ ID NO: 465781 - DNA, 25 bp, Homo sapien
ggagttcgagactcaactgtgtagg

SEQ ID NO: 465782 - DNA, 25 bp, Homo sapien
gagttcgagactcaactgtgtaggc

SEQ ID NO: 465783 - DNA, 25 bp, Homo sapien
agttcgagactcaactgtgtaggct

SEQ ID NO: 465784 - DNA, 25 bp, Homo sapien
gttcgagactcaactgtgtaggctg

SEQ ID NO: 465785 - DNA, 25 bp, Homo sapien
ttcgagactcaactgtgtaggctgg

SEQ ID NO: 465786 - DNA, 25 bp, Homo sapien
tcgagactcaactgtgtaggctggg

SEQ ID NO: 465787 - DNA, 25 bp, Homo sapien
cgagactcaactgtgtaggctgggc

SEQ ID NO: 465788 - DNA, 25 bp, Homo sapien
ggtgtgagcctctgcgtctggacac

SEQ ID NO: 465789 - DNA, 25 bp, Homo sapien
gtgagcctctgcgtctggacacaca

SEQ ID NO: 465790 - DNA, 25 bp, Homo sapien
atgatgacaaagttgaaatacctag

SEQ ID NO: 465791 - DNA, 25 bp, Homo sapien
tgatgacaaagttgaaatacctaga

SEQ ID NO: 465792 - DNA, 25 bp, Homo sapien
gatgacaaagttgaaatacctagag

SEQ ID NO: 465793 - DNA, 25 bp, Homo sapien
gagtttgcaaagcatgtatcaggca

SEQ ID NO: 465794 - DNA, 25 bp, Homo sapien
agtttgcaaagcatgtatcaggcag

SEQ ID NO: 465795 - DNA, 25 bp, Homo sapien
gtttgcaaagcatgtatcaggcaga

SEQ ID NO: 465796 - DNA, 25 bp, Homo sapien
tttgcaaagcatgtatcaggcagac

SEQ ID NO: 465797 - DNA, 25 bp, Homo sapien
ttgcaaagcatgtatcaggcagacc

SEQ ID NO: 465798 - DNA, 25 bp, Homo sapien
aggtcaccatctcgcagcagctcgg

SEQ ID NO: 465799 - DNA, 25 bp, Homo sapien
gcagcagctcggcttggagctcaac

SEQ ID NO: 465800 - DNA, 25 bp, Homo sapien
agcagctcggcttggagctcaacac

SEQ ID NO: 465801 - DNA, 25 bp, Homo sapien
agctcggcttggagctcaacaccgt

SEQ ID NO: 465802 - DNA, 25 bp, Homo sapien
tcggcttggagctcaacaccgtcag

SEQ ID NO: 465803 - DNA, 25 bp, Homo sapien
gcttggagctcaacaccgtcagcaa

SEQ ID NO: 465804 - DNA, 25 bp, Homo sapien
tgaacgcgcggcgccgctgcatgaa

SEQ ID NO: 465805 - DNA, 25 bp, Homo sapien
cgccgctgcatgaaccgctgggctg

SEQ ID NO: 465806 - DNA, 25 bp, Homo sapien
aaccgctgggctgaggagcccagca

SEQ ID NO: 465807 - DNA, 25 bp, Homo sapien
ccaacatcctgccaggcccggagac

SEQ ID NO: 465808 - DNA, 25 bp, Homo sapien
aggcccggagaccacgaccaccagg

SEQ ID NO: 465809 - DNA, 25 bp, Homo sapien
agaatgtgactgaatatggaggaag

SEQ ID NO: 465810 - DNA, 25 bp, Homo sapien
atggaggaagtgtctttcaagaggt

SEQ ID NO: 465811 - DNA, 25 bp, Homo sapien
gaggaagtgtctttcaagaggtaat

SEQ ID NO: 465812 - DNA, 25 bp, Homo sapien
tgtctttcaagaggtaattaccgcc

SEQ ID NO: 465813 - DNA, 25 bp, Homo sapien
gtctttcaagaggtaattaccgcct

SEQ ID NO: 465814 - DNA, 25 bp, Homo sapien
ctttcaagaggtaattaccgcctgt

SEQ ID NO: 465815 - DNA, 25 bp, Homo sapien
tttcaagaggtaattaccgcctgta

SEQ ID NO: 465816 - DNA, 25 bp, Homo sapien
tcaagaggtaattaccgcctgtaat

SEQ ID NO: 465817 - DNA, 25 bp, Homo sapien
caagaggtaattaccgcctgtaatc

SEQ ID NO: 465818 - DNA, 25 bp, Homo sapien
gaggtaattaccgcctgtaatccca

SEQ ID NO: 465819 - DNA, 25 bp, Homo sapien
agtggagatggctccgctgcgctcc

SEQ ID NO: 465820 - DNA, 25 bp, Homo sapien
gggaattgtccaaaacatatatcat

SEQ ID NO: 465821 - DNA, 25 bp, Homo sapien
cattgaggagttccatccagatgat

SEQ ID NO: 465822 - DNA, 25 bp, Homo sapien
gctttcagaaacttttatcgctact

SEQ ID NO: 465823 - DNA, 25 bp, Homo sapien
atcgctactgttgtttctagttcca

SEQ ID NO: 465824 - DNA, 25 bp, Homo sapien
tgttgtttctagttccagctggtgg

SEQ ID NO: 465825 - DNA, 25 bp, Homo sapien
catctcaacagtggccgttgccttg

SEQ ID NO: 465826 - DNA, 25 bp, Homo sapien
cgttgccttgatgtattgcctgtac

SEQ ID NO: 465827 - DNA, 25 bp, Homo sapien
gatgtattgcctgtacatggcagaa

SEQ ID NO: 465828 - DNA, 25 bp, Homo sapien
atggcagaagactaaacaactcctc

SEQ ID NO: 465829 - DNA, 25 bp, Homo sapien
aacaactcctcagaagccagtgcag

SEQ ID NO: 465830 - DNA, 25 bp, Homo sapien
agccagtgcaggaaaagcctgcttt

SEQ ID NO: 465831 - DNA, 25 bp, Homo sapien
ccagctttaatttaatggccctact

SEQ ID NO: 465832 - DNA, 25 bp, Homo sapien
ttaatggccctactgatattcacat

SEQ ID NO: 465833 - DNA, 25 bp, Homo sapien
taatggccctactgatattcacatc

SEQ ID NO: 465834 - DNA, 25 bp, Homo sapien
ggtgactaacaatgacaaaggcctt

SEQ ID NO: 465835 - DNA, 25 bp, Homo sapien
gactaacaatgacaaaggccttatg

SEQ ID NO: 465836 - DNA, 25 bp, Homo sapien
atgacaaaggccttatgaactgtac

SEQ ID NO: 465837 - DNA, 25 bp, Homo sapien
tattcttatcctcattgcatttcta

SEQ ID NO: 465838 - DNA, 25 bp, Homo sapien
attcttatcctcattgcatttctat

SEQ ID NO: 465839 - DNA, 25 bp, Homo sapien
tcttatcctcattgcatttctatgc

SEQ ID NO: 465840 - DNA, 25 bp, Homo sapien
aagccaagaaaatatctgtcaaacc

SEQ ID NO: 465841 - DNA, 25 bp, Homo sapien
aaaatatctgtcaaaccatttctgt

SEQ ID NO: 465842 - DNA, 25 bp, Homo sapien
actgcaaaaatctccggctgcacag

SEQ ID NO: 465843 - DNA, 25 bp, Homo sapien
aacactgtactggttgccttcacaa

SEQ ID NO: 465844 - DNA, 25 bp, Homo sapien
tctggtgcccttgactgcatgatga

SEQ ID NO: 465845 - DNA, 25 bp, Homo sapien
aactggacttcaactgtgatgggca

SEQ ID NO: 465846 - DNA, 25 bp, Homo sapien
gggcaggctagattttcaggacttt

SEQ ID NO: 465847 - DNA, 25 bp, Homo sapien
tcaggactttctcagtcttactgat

SEQ ID NO: 465848 - DNA, 25 bp, Homo sapien
tccggctgcacagagattgcatggt

SEQ ID NO: 465849 - DNA, 25 bp, Homo sapien
atggtgtagctgtggcttgccctga

SEQ ID NO: 465850 - DNA, 25 bp, Homo sapien
atggtggtgcatcacgaccctgtgc

SEQ ID NO: 465851 - DNA, 25 bp, Homo sapien
gtgctgttttccagagaggtatgct

SEQ ID NO: 465852 - DNA, 25 bp, Homo sapien
gaggtatgctggacgggaccataac

SEQ ID NO: 465853 - DNA, 25 bp, Homo sapien
tgtgcccaaccatgttgtctggtcc

SEQ ID NO: 465854 - DNA, 25 bp, Homo sapien
gcttcatagcagtcacctactccat

SEQ ID NO: 465855 - DNA, 25 bp, Homo sapien
cttcatagcagtcacctactccatg

SEQ ID NO: 465856 - DNA, 25 bp, Homo sapien
ttcatagcagtcacctactccatga

SEQ ID NO: 465857 - DNA, 25 bp, Homo sapien
tcatagcagtcacctactccatgaa

SEQ ID NO: 465858 - DNA, 25 bp, Homo sapien
catagcagtcacctactccatgaag

SEQ ID NO: 465859 - DNA, 25 bp, Homo sapien
atagcagtcacctactccatgaagt

SEQ ID NO: 465860 - DNA, 25 bp, Homo sapien
gcagtcacctactccatgaagtcta

SEQ ID NO: 465861 - DNA, 25 bp, Homo sapien
cagtcacctactccatgaagtctag

SEQ ID NO: 465862 - DNA, 25 bp, Homo sapien
agtcacctactccatgaagtctagg

SEQ ID NO: 465863 - DNA, 25 bp, Homo sapien
taaccgggggccaggcctgtgcctc

SEQ ID NO: 465864 - DNA, 25 bp, Homo sapien
gaagccctatgtatgcgatgtagag

SEQ ID NO: 465865 - DNA, 25 bp, Homo sapien
gtacgtggaaatttgcccgctcaga

SEQ ID NO: 465866 - DNA, 25 bp, Homo sapien
gccctatgtctgcacttacgaggac

SEQ ID NO: 465867 - DNA, 25 bp, Homo sapien
gctcagatgagctcaacagacacaa

SEQ ID NO: 465868 - DNA, 25 bp, Homo sapien
atgtctgcacttacgaggactgcaa

SEQ ID NO: 465869 - DNA, 25 bp, Homo sapien
gggaaaggccctacctgtgttcaat

SEQ ID NO: 465870 - DNA, 25 bp, Homo sapien
ggccctacctgtgttcaatatgcag

SEQ ID NO: 465871 - DNA, 25 bp, Homo sapien
agaattttgcaagatctgatcacct

SEQ ID NO: 465872 - DNA, 25 bp, Homo sapien
gaggactgcaagatgtcttattcaa

SEQ ID NO: 465873 - DNA, 25 bp, Homo sapien
gatgtcttattcaaaggcttgccac

SEQ ID NO: 465874 - DNA, 25 bp, Homo sapien
tattcaaaggcttgccacctccgaa

SEQ ID NO: 465875 - DNA, 25 bp, Homo sapien
aatattaagagttatgcctggtggg

SEQ ID NO: 465876 - DNA, 25 bp, Homo sapien
atattaagagttatgcctggtgggg

SEQ ID NO: 465877 - DNA, 25 bp, Homo sapien
tattaagagttatgcctggtggggt

SEQ ID NO: 465878 - DNA, 25 bp, Homo sapien
attaagagttatgcctggtggggtg

SEQ ID NO: 465879 - DNA, 25 bp, Homo sapien
ttaagagttatgcctggtggggtgt

SEQ ID NO: 465880 - DNA, 25 bp, Homo sapien
taagagttatgcctggtggggtgtg

SEQ ID NO: 465881 - DNA, 25 bp, Homo sapien
aagagttatgcctggtggggtgtgg

SEQ ID NO: 465882 - DNA, 25 bp, Homo sapien
agagttatgcctggtggggtgtggt

SEQ ID NO: 465883 - DNA, 25 bp, Homo sapien
gagttatgcctggtggggtgtggtg

SEQ ID NO: 465884 - DNA, 25 bp, Homo sapien
agttatgcctggtggggtgtggtgg

SEQ ID NO: 465885 - DNA, 25 bp, Homo sapien
ctagcactttgggggaccaagtcag

SEQ ID NO: 465886 - DNA, 25 bp, Homo sapien
ttttgattctcaagactgtcatggg

SEQ ID NO: 465887 - DNA, 25 bp, Homo sapien
caagactgtcatgggcattggttct

SEQ ID NO: 465888 - DNA, 25 bp, Homo sapien
aggccctcaacacatgtgtctctca

SEQ ID NO: 465889 - DNA, 25 bp, Homo sapien
atcctggtcttctatgtcactgtag

SEQ ID NO: 465890 - DNA, 25 bp, Homo sapien
gtcactgtagtttgtctgacattta

SEQ ID NO: 465891 - DNA, 25 bp, Homo sapien
ctgacatttattcataggtttggaa

SEQ ID NO: 465892 - DNA, 25 bp, Homo sapien
aaagcatgttcctcatgtcgttcac

SEQ ID NO: 465893 - DNA, 25 bp, Homo sapien
atgtcgttcacatcacaatgagata

SEQ ID NO: 465894 - DNA, 25 bp, Homo sapien
acaatgagatacatccacttccttt

SEQ ID NO: 465895 - DNA, 25 bp, Homo sapien
tgaacccatttatctatagcattaa

SEQ ID NO: 465896 - DNA, 25 bp, Homo sapien
gcagattcagagtggcatacttcgc

SEQ ID NO: 465897 - DNA, 25 bp, Homo sapien
atgtatcctggcatgaaagccagaa

SEQ ID NO: 465898 - DNA, 25 bp, Homo sapien
gaaggaactgttggagatgagaccc

SEQ ID NO: 465899 - DNA, 25 bp, Homo sapien
ggttcaacttgcctcgaaccctgtg

SEQ ID NO: 465900 - DNA, 25 bp, Homo sapien
ttgcctcgaaccctgtgctggatgc

SEQ ID NO: 465901 - DNA, 25 bp, Homo sapien
atgcctggtacggtgctcgtgactg

SEQ ID NO: 465902 - DNA, 25 bp, Homo sapien
acggtgctcgtgactgggccttgaa

SEQ ID NO: 465903 - DNA, 25 bp, Homo sapien
gtgactgggccttgaaccacctaga

SEQ ID NO: 465904 - DNA, 25 bp, Homo sapien
gggccttgaaccacctagatgataa

SEQ ID NO: 465905 - DNA, 25 bp, Homo sapien
tgaaccacctagatgataatgaagt

SEQ ID NO: 465906 - DNA, 25 bp, Homo sapien
cagatgcccaggcatccagcaaggg

SEQ ID NO: 465907 - DNA, 25 bp, Homo sapien
aggcatccagcaagggctccgctgc

SEQ ID NO: 465908 - DNA, 25 bp, Homo sapien
aacggctgcgcctttggcgagcgct

SEQ ID NO: 465909 - DNA, 25 bp, Homo sapien
tttggcgagcgctcttcgacggctc

SEQ ID NO: 465910 - DNA, 25 bp, Homo sapien
tcgacggctcccttagtccgaagga

SEQ ID NO: 465911 - DNA, 25 bp, Homo sapien
aactgcacttctccagcgcgcggga

SEQ ID NO: 465912 - DNA, 25 bp, Homo sapien
ctgagccctgattggagcgcactct

SEQ ID NO: 465913 - DNA, 25 bp, Homo sapien
attggagcgcactctcgttttctgg

SEQ ID NO: 465914 - DNA, 25 bp, Homo sapien
ttttctggcttgatggagccgatcc

SEQ ID NO: 465915 - DNA, 25 bp, Homo sapien
gagccgatccagtgacgtcaggaat

SEQ ID NO: 465916 - DNA, 25 bp, Homo sapien
ttggaagcgggtaggacccttcact

SEQ ID NO: 465917 - DNA, 25 bp, Homo sapien
ggacccttcactgcagttcgaggga

SEQ ID NO: 465918 - DNA, 25 bp, Homo sapien
cttcactgcagttcgagggagtctt

SEQ ID NO: 465919 - DNA, 25 bp, Homo sapien
gagaattgcttcaattccctgcttg

SEQ ID NO: 465920 - DNA, 25 bp, Homo sapien
agaattgcttcaattccctgcttga

SEQ ID NO: 465921 - DNA, 25 bp, Homo sapien
gaattgcttcaattccctgcttgaa

SEQ ID NO: 465922 - DNA, 25 bp, Homo sapien
aattgcttcaattccctgcttgaac

SEQ ID NO: 465923 - DNA, 25 bp, Homo sapien
attgcttcaattccctgcttgaacc

SEQ ID NO: 465924 - DNA, 25 bp, Homo sapien
ttgcttcaattccctgcttgaaccc

SEQ ID NO: 465925 - DNA, 25 bp, Homo sapien
tgcttcaattccctgcttgaaccca

SEQ ID NO: 465926 - DNA, 25 bp, Homo sapien
gcttcaattccctgcttgaacccag

SEQ ID NO: 465927 - DNA, 25 bp, Homo sapien
cttcaattccctgcttgaacccagg

SEQ ID NO: 465928 - DNA, 25 bp, Homo sapien
acggtccttcatcataggcagccta

SEQ ID NO: 465929 - DNA, 25 bp, Homo sapien
ggcagcctatgcgagatgcatctta

SEQ ID NO: 465930 - DNA, 25 bp, Homo sapien
gcatcttaggaagggagctttcgct

SEQ ID NO: 465931 - DNA, 25 bp, Homo sapien
ggagctttcgctgctcagaaatcaa

SEQ ID NO: 465932 - DNA, 25 bp, Homo sapien
tcagaaatcaaagctccatcggagg

SEQ ID NO: 465933 - DNA, 25 bp, Homo sapien
tcggaggtgtcctactggaggcatc

SEQ ID NO: 465934 - DNA, 25 bp, Homo sapien
ggaggcatcagacaacaagctaaat

SEQ ID NO: 465935 - DNA, 25 bp, Homo sapien
gctaaatgacgttagggctacacaa

SEQ ID NO: 465936 - DNA, 25 bp, Homo sapien
caattagcttagtacttcaggtcaa

SEQ ID NO: 465937 - DNA, 25 bp, Homo sapien
aacacaggtcaacttttaaactcag

SEQ ID NO: 465938 - DNA, 25 bp, Homo sapien
tttaaactcagcactctgttggagt

SEQ ID NO: 465939 - DNA, 25 bp, Homo sapien
tcatggaggaaggagaacttacacc

SEQ ID NO: 465940 - DNA, 25 bp, Homo sapien
ggaaggagaacttacacctctgagc

SEQ ID NO: 465941 - DNA, 25 bp, Homo sapien
aaggagaacttacacctctgagcat

SEQ ID NO: 465942 - DNA, 25 bp, Homo sapien
ggagaacttacacctctgagcattt

SEQ ID NO: 465943 - DNA, 25 bp, Homo sapien
gattcccaggtaaggctgagcagat

SEQ ID NO: 465944 - DNA, 25 bp, Homo sapien
aggctgagcagatatctatgcccag

SEQ ID NO: 465945 - DNA, 25 bp, Homo sapien
acaggaaattcctctgaaatagctg

SEQ ID NO: 465946 - DNA, 25 bp, Homo sapien
ttctcataggtaagtttccctttca

SEQ ID NO: 465947 - DNA, 25 bp, Homo sapien
ataggtaagtttccctttcatagat

SEQ ID NO: 465948 - DNA, 25 bp, Homo sapien
ggtaagtttccctttcatagatgtt

SEQ ID NO: 465949 - DNA, 25 bp, Homo sapien
taagtttccctttcatagatgtttt

SEQ ID NO: 465950 - DNA, 25 bp, Homo sapien
aagatcaccaagaaagtccggagaa

SEQ ID NO: 465951 - DNA, 25 bp, Homo sapien
gaaagtccggagaatgaccctagac

SEQ ID NO: 465952 - DNA, 25 bp, Homo sapien
gaccctagaccccatcaaggagaag

SEQ ID NO: 465953 - DNA, 25 bp, Homo sapien
agaagacggcttggcaacagctgca

SEQ ID NO: 465954 - DNA, 25 bp, Homo sapien
agacggcttggcaacagctgcaggc

SEQ ID NO: 465955 - DNA, 25 bp, Homo sapien
gattcatccgacctttcactgagcg

SEQ ID NO: 465956 - DNA, 25 bp, Homo sapien
atccgacctttcactgagcggaaag

SEQ ID NO: 465957 - DNA, 25 bp, Homo sapien
gagcggaaaggatcgacgcccacgc

SEQ ID NO: 465958 - DNA, 25 bp, Homo sapien
gcccacgcctagcactgcggagaaa

SEQ ID NO: 465959 - DNA, 25 bp, Homo sapien
actgcggagaaaacgccgccgcgag

SEQ ID NO: 465960 - DNA, 25 bp, Homo sapien
aacgccgccgcgagatgagaaagat

SEQ ID NO: 465961 - DNA, 25 bp, Homo sapien
agtccagtgattgggtttgtggctc

SEQ ID NO: 465962 - DNA, 25 bp, Homo sapien
aggcctcgcccacagacggacagac

SEQ ID NO: 465963 - DNA, 25 bp, Homo sapien
tccggcaaaaggaccgagccctggg

SEQ ID NO: 465964 - DNA, 25 bp, Homo sapien
cacactcctgttttttgcaagtaca

SEQ ID NO: 465965 - DNA, 25 bp, Homo sapien
tttgcaagtacatttttgtccctcc

SEQ ID NO: 465966 - DNA, 25 bp, Homo sapien
gtatctgcctattttcttgctaatc

SEQ ID NO: 465967 - DNA, 25 bp, Homo sapien
tgcctattttcttgctaatcccaga

SEQ ID NO: 465968 - DNA, 25 bp, Homo sapien
tttcttgctaatcccagaacctttc

SEQ ID NO: 465969 - DNA, 25 bp, Homo sapien
tgctaatcccagaacctttcctttt

SEQ ID NO: 465970 - DNA, 25 bp, Homo sapien
aggtcggcaggctccgcttcttttc

SEQ ID NO: 465971 - DNA, 25 bp, Homo sapien
tccgcggggtgattcagtccagtga

SEQ ID NO: 465972 - DNA, 25 bp, Homo sapien
gacttgggcctttctgacatcatcc

SEQ ID NO: 465973 - DNA, 25 bp, Homo sapien
agacaggactttgcgtttttcctct

SEQ ID NO: 465974 - DNA, 25 bp, Homo sapien
tttcctctgggacctacagtgatga

SEQ ID NO: 465975 - DNA, 25 bp, Homo sapien
gaatttaatgattatctcctccact

SEQ ID NO: 465976 - DNA, 25 bp, Homo sapien
cctccactataatcctctttagggt

SEQ ID NO: 465977 - DNA, 25 bp, Homo sapien
aacccagtgaatctcattactccta

SEQ ID NO: 465978 - DNA, 25 bp, Homo sapien
gccttttcaggcacatggtttcaac

SEQ ID NO: 465979 - DNA, 25 bp, Homo sapien
aaagcctggctttgacattccttgt

SEQ ID NO: 465980 - DNA, 25 bp, Homo sapien
gacattccttgtcctgaggagcact

SEQ ID NO: 465981 - DNA, 25 bp, Homo sapien
tttccaggcatagttacagcttccc

SEQ ID NO: 465982 - DNA, 25 bp, Homo sapien
cttccccactgtatttacaagccag

SEQ ID NO: 465983 - DNA, 25 bp, Homo sapien
tttccaaagctttcagcaccaggat

SEQ ID NO: 465984 - DNA, 25 bp, Homo sapien
tttcagcaccaggatcagagccaga

SEQ ID NO: 465985 - DNA, 25 bp, Homo sapien
gagccagaatatttaactccatcta

SEQ ID NO: 465986 - DNA, 25 bp, Homo sapien
actccatctataatcattttttcag

SEQ ID NO: 465987 - DNA, 25 bp, Homo sapien
aaatctgtaggtcttcgggatgcac

SEQ ID NO: 465988 - DNA, 25 bp, Homo sapien
ggtcttcgggatgcacagtggaact

SEQ ID NO: 465989 - DNA, 25 bp, Homo sapien
gtggaacttatatccagactgcagt

SEQ ID NO: 465990 - DNA, 25 bp, Homo sapien
tatatccagactgcagtcagctttt

SEQ ID NO: 465991 - DNA, 25 bp, Homo sapien
actggaatccagatgtttaggcaca

SEQ ID NO: 465992 - DNA, 25 bp, Homo sapien
ttaggcacagctggaatgaggtctg

SEQ ID NO: 465993 - DNA, 25 bp, Homo sapien
aaattaggcctcttctagggtggat

SEQ ID NO: 465994 - DNA, 25 bp, Homo sapien
tgctccagggattacaatatacgtc

SEQ ID NO: 465995 - DNA, 25 bp, Homo sapien
aatatacgtctttacctttccatgg

SEQ ID NO: 465996 - DNA, 25 bp, Homo sapien
ttacctttccatggtctacttagaa

SEQ ID NO: 465997 - DNA, 25 bp, Homo sapien
ggtctacttagaatcaatattttac

SEQ ID NO: 465998 - DNA, 25 bp, Homo sapien
tggagttctctattccatttttgct

SEQ ID NO: 465999 - DNA, 25 bp, Homo sapien
attccatttttgctgataccattct

SEQ ID NO: 466000 - DNA, 25 bp, Homo sapien
tgctgataccattcttagatcattt

SEQ ID NO: 466001 - DNA, 25 bp, Homo sapien
ggttggatttgtgtctaccatttta

SEQ ID NO: 466002 - DNA, 25 bp, Homo sapien
gtgtctaccattttaaggacattta

SEQ ID NO: 466003 - DNA, 25 bp, Homo sapien
tgtttttaactttatctgcttgtat

SEQ ID NO: 466004 - DNA, 25 bp, Homo sapien
atctgcttgtatagttctgtttgtt

SEQ ID NO: 466005 - DNA, 25 bp, Homo sapien
gatcctgtggattagaaacaagttg

SEQ ID NO: 466006 - DNA, 25 bp, Homo sapien
gtggattagaaacaagttgctcctc

SEQ ID NO: 466007 - DNA, 25 bp, Homo sapien
gattagaaacaagttgctcctcaga

SEQ ID NO: 466008 - DNA, 25 bp, Homo sapien
ttagaaacaagttgctcctcagagc

SEQ ID NO: 466009 - DNA, 25 bp, Homo sapien
cagagctctcaagcagggactgctc

SEQ ID NO: 466010 - DNA, 25 bp, Homo sapien
gagctctcaagcagggactgctctt

SEQ ID NO: 466011 - DNA, 25 bp, Homo sapien
ctctcaagcagggactgctctttag

SEQ ID NO: 466012 - DNA, 25 bp, Homo sapien
tcaagcagggactgctctttaggaa

SEQ ID NO: 466013 - DNA, 25 bp, Homo sapien
agcagggactgctctttaggaaggg

SEQ ID NO: 466014 - DNA, 25 bp, Homo sapien
gcagcggctgggagtgagcagggca

SEQ ID NO: 466015 - DNA, 25 bp, Homo sapien
gggaccgcaggtagcccagggtgtt

SEQ ID NO: 466016 - DNA, 25 bp, Homo sapien
taggccctacgggttccagtcttgg

SEQ ID NO: 466017 - DNA, 25 bp, Homo sapien
tacgggttccagtcttggctaagtg

SEQ ID NO: 466018 - DNA, 25 bp, Homo sapien
cagtcttggctaagtgctgccttgg

SEQ ID NO: 466019 - DNA, 25 bp, Homo sapien
tgccttgggatgtgcggcctacata

SEQ ID NO: 466020 - DNA, 25 bp, Homo sapien
tgcggcctacataagcttcctcatg

SEQ ID NO: 466021 - DNA, 25 bp, Homo sapien
ctcatgcctcctacgggtggcggat

SEQ ID NO: 466022 - DNA, 25 bp, Homo sapien
atgtgtgggcgctctgttgtctgct

SEQ ID NO: 466023 - DNA, 25 bp, Homo sapien
tgctgtctgctgtctgcttgtctgg

SEQ ID NO: 466024 - DNA, 25 bp, Homo sapien
tgtctgcttgtctggtgtctgtatc

SEQ ID NO: 466025 - DNA, 25 bp, Homo sapien
tggtgtctgtatcttgtgcactccc

SEQ ID NO: 466026 - DNA, 25 bp, Homo sapien
tctgcgtggtcggtggactcagctc

SEQ ID NO: 466027 - DNA, 25 bp, Homo sapien
ggaggaactcctagaagcagtccat

SEQ ID NO: 466028 - DNA, 25 bp, Homo sapien
gaagcagtccatgccaaatccattg

SEQ ID NO: 466029 - DNA, 25 bp, Homo sapien
tggactgcttcctatccatgacggt

SEQ ID NO: 466030 - DNA, 25 bp, Homo sapien
cctggtaccagagcctgatcaaagt

SEQ ID NO: 466031 - DNA, 25 bp, Homo sapien
tgatcaaagttctcctaagccgctt

SEQ ID NO: 466032 - DNA, 25 bp, Homo sapien
agagctgtcgccatttccaaagccc

SEQ ID NO: 466033 - DNA, 25 bp, Homo sapien
tccaaagcccagacttgggaactca

SEQ ID NO: 466034 - DNA, 25 bp, Homo sapien
tgggaactcagtacctggttgtgct

SEQ ID NO: 466035 - DNA, 25 bp, Homo sapien
agtacctggttgtgctgaatcagaa

SEQ ID NO: 466036 - DNA, 25 bp, Homo sapien
tgactgctttgtgctagtgtttctg

SEQ ID NO: 466037 - DNA, 25 bp, Homo sapien
ttgtgctagtgtttctggactccca

SEQ ID NO: 466038 - DNA, 25 bp, Homo sapien
tatttatttaggatttgttctttga

SEQ ID NO: 466039 - DNA, 25 bp, Homo sapien
gaatgtggacatttaaggcttttag

SEQ ID NO: 466040 - DNA, 25 bp, Homo sapien
taaggcttttagtacatataatgaa

SEQ ID NO: 466041 - DNA, 25 bp, Homo sapien
ataatgaaattgctgatggcacagt

SEQ ID NO: 466042 - DNA, 25 bp, Homo sapien
ttgctgatggcacagttgttttgga

SEQ ID NO: 466043 - DNA, 25 bp, Homo sapien
gcaatagatgagagtacctgtttta

SEQ ID NO: 466044 - DNA, 25 bp, Homo sapien
acctgttttaccatggtcttaccag

SEQ ID NO: 466045 - DNA, 25 bp, Homo sapien
gttttaccatggtcttaccagcatt

SEQ ID NO: 466046 - DNA, 25 bp, Homo sapien
tttaccatggtcttaccagcattat

SEQ ID NO: 466047 - DNA, 25 bp, Homo sapien
taccatggtcttaccagcattatta

SEQ ID NO: 466048 - DNA, 25 bp, Homo sapien
catggtcttaccagcattattataa

SEQ ID NO: 466049 - DNA, 25 bp, Homo sapien
gtataggcaaaaaactcaaggacta

SEQ ID NO: 466050 - DNA, 25 bp, Homo sapien
tataggcaaaaaactcaaggactat

SEQ ID NO: 466051 - DNA, 25 bp, Homo sapien
taggcaaaaaactcaaggactatat

SEQ ID NO: 466052 - DNA, 25 bp, Homo sapien
aggcaaaaaactcaaggactatatt

SEQ ID NO: 466053 - DNA, 25 bp, Homo sapien
aataacatgttattttagtttcagt

SEQ ID NO: 466054 - DNA, 25 bp, Homo sapien
ttgctaaatgtcatagtctgataat

SEQ ID NO: 466055 - DNA, 25 bp, Homo sapien
tgctaaatgtcatagtctgataatg

SEQ ID NO: 466056 - DNA, 25 bp, Homo sapien
gctaaatgtcatagtctgataatga

SEQ ID NO: 466057 - DNA, 25 bp, Homo sapien
ctaaatgtcatagtctgataatgat

SEQ ID NO: 466058 - DNA, 25 bp, Homo sapien
taaatgtcatagtctgataatgatg

SEQ ID NO: 466059 - DNA, 25 bp, Homo sapien
aaatgtcatagtctgataatgatgc

SEQ ID NO: 466060 - DNA, 25 bp, Homo sapien
ctcgcggaggacagcattctctgct

SEQ ID NO: 466061 - DNA, 25 bp, Homo sapien
agggagagcaccagtggctgcacct

SEQ ID NO: 466062 - DNA, 25 bp, Homo sapien
cagtggctgcaccttcacctcataa

SEQ ID NO: 466063 - DNA, 25 bp, Homo sapien
acctcataaggagatgtggcagttc

SEQ ID NO: 466064 - DNA, 25 bp, Homo sapien
atgtggcagttctgccagtagccgt

SEQ ID NO: 466065 - DNA, 25 bp, Homo sapien
cagtagccgtggtgggctacaccta

SEQ ID NO: 466066 - DNA, 25 bp, Homo sapien
ggtgggctacacctactgcatggtc

SEQ ID NO: 466067 - DNA, 25 bp, Homo sapien
agccagactggcttcatgctgtgcg

SEQ ID NO: 466068 - DNA, 25 bp, Homo sapien
ggcttcatgctgtgcggcagaacat

SEQ ID NO: 466069 - DNA, 25 bp, Homo sapien
agaacatgatcacccgtgaccggga

SEQ ID NO: 466070 - DNA, 25 bp, Homo sapien
agacacacaccgcacagcctttgtg

SEQ ID NO: 466071 - DNA, 25 bp, Homo sapien
tggctcctgcatcagctaccctgaa

SEQ ID NO: 466072 - DNA, 25 bp, Homo sapien
ctgcatcagctaccctgaacagtaa

SEQ ID NO: 466073 - DNA, 25 bp, Homo sapien
gcatcagctaccctgaacagtaaaa

SEQ ID NO: 466074 - DNA, 25 bp, Homo sapien
tcagctaccctgaacagtaaaacca

SEQ ID NO: 466075 - DNA, 25 bp, Homo sapien
gctaccctgaacagtaaaaccacaa

SEQ ID NO: 466076 - DNA, 25 bp, Homo sapien
gaacagtaaaaccacaagcatcgag

SEQ ID NO: 466077 - DNA, 25 bp, Homo sapien
taaaaccacaagcatcgagaacctg

SEQ ID NO: 466078 - DNA, 25 bp, Homo sapien
aaccacaagcatcgagaacctgcgg

SEQ ID NO: 466079 - DNA, 25 bp, Homo sapien
acaagcatcgagaacctgcggctcc

SEQ ID NO: 466080 - DNA, 25 bp, Homo sapien
aagcatcgagaacctgcggctccgg

SEQ ID NO: 466081 - DNA, 25 bp, Homo sapien
gcatcgagaacctgcggctccgggc

SEQ ID NO: 466082 - DNA, 25 bp, Homo sapien
agtaccaccgtcaccttgttcaagg

SEQ ID NO: 466083 - DNA, 25 bp, Homo sapien
caaggtgaaatgatcccaacagaag

SEQ ID NO: 466084 - DNA, 25 bp, Homo sapien
aacagaagaacatcggagaccagag

SEQ ID NO: 466085 - DNA, 25 bp, Homo sapien
tggcctgttggcacgtgtttctctt

SEQ ID NO: 466086 - DNA, 25 bp, Homo sapien
tgttggcacgtgtttctcttccccg

SEQ ID NO: 466087 - DNA, 25 bp, Homo sapien
agttgtgtgctctcacacaggcttc

SEQ ID NO: 466088 - DNA, 25 bp, Homo sapien
acaggcttccttctcgaccggcagg

SEQ ID NO: 466089 - DNA, 25 bp, Homo sapien
acgaggtgggctctaccccacactg

SEQ ID NO: 466090 - DNA, 25 bp, Homo sapien
gctttgctgtgtatacgcttgttgc

SEQ ID NO: 466091 - DNA, 25 bp, Homo sapien
tgtatacgcttgttgccctgaaata

SEQ ID NO: 466092 - DNA, 25 bp, Homo sapien
acgcttgttgccctgaaataaatat

SEQ ID NO: 466093 - DNA, 25 bp, Homo sapien
tatttacctaaaatgtgctagtagc

SEQ ID NO: 466094 - DNA, 25 bp, Homo sapien
atgtgctagtagcatcttgcccagc

SEQ ID NO: 466095 - DNA, 25 bp, Homo sapien
tagtagcatcttgcccagccataaa

SEQ ID NO: 466096 - DNA, 25 bp, Homo sapien
gccataaagcaataaacttctcaat

SEQ ID NO: 466097 - DNA, 25 bp, Homo sapien
ggaaactttctgtattaagggcatg

SEQ ID NO: 466098 - DNA, 25 bp, Homo sapien
aagggcatgtatcccatcaattgga

SEQ ID NO: 466099 - DNA, 25 bp, Homo sapien
aattggaatcagtaccttaacagaa

SEQ ID NO: 466100 - DNA, 25 bp, Homo sapien
aacagaaaaaggcagctcttcaatg

SEQ ID NO: 466101 - DNA, 25 bp, Homo sapien
cagctcttcaatggaattaacgtga

SEQ ID NO: 466102 - DNA, 25 bp, Homo sapien
atgtttgatataggcagtactttta

SEQ ID NO: 466103 - DNA, 25 bp, Homo sapien
aagctggaaattgctccgtgtaatt

SEQ ID NO: 466104 - DNA, 25 bp, Homo sapien
taatggttgccagggatagggactg

SEQ ID NO: 466105 - DNA, 25 bp, Homo sapien
gtatgactataaagggatgacgcaa

SEQ ID NO: 466106 - DNA, 25 bp, Homo sapien
aagggatgacgcaaggagttccttt

SEQ ID NO: 466107 - DNA, 25 bp, Homo sapien
gggatgacgcaaggagttcctttgt

SEQ ID NO: 466108 - DNA, 25 bp, Homo sapien
gatgacgcaaggagttcctttgtgc

SEQ ID NO: 466109 - DNA, 25 bp, Homo sapien
tgacgcaaggagttcctttgtgctg

SEQ ID NO: 466110 - DNA, 25 bp, Homo sapien
gacgcaaggagttcctttgtgctga

SEQ ID NO: 466111 - DNA, 25 bp, Homo sapien
acgcaaggagttcctttgtgctgat

SEQ ID NO: 466112 - DNA, 25 bp, Homo sapien
aaaaccagtctcaaatggtcacata

SEQ ID NO: 466113 - DNA, 25 bp, Homo sapien
aaccagtctcaaatggtcacatact

SEQ ID NO: 466114 - DNA, 25 bp, Homo sapien
accagtctcaaatggtcacatactg

SEQ ID NO: 466115 - DNA, 25 bp, Homo sapien
aaatggaatcatgggctgcgggtgg

SEQ ID NO: 466116 - DNA, 25 bp, Homo sapien
aatggaatcatgggctgcgggtggt

SEQ ID NO: 466117 - DNA, 25 bp, Homo sapien
atggaatcatgggctgcgggtggtg

SEQ ID NO: 466118 - DNA, 25 bp, Homo sapien
tggaatcatgggctgcgggtggtgg

SEQ ID NO: 466119 - DNA, 25 bp, Homo sapien
ggaatcatgggctgcgggtggtggc

SEQ ID NO: 466120 - DNA, 25 bp, Homo sapien
gaatcatgggctgcgggtggtggct

SEQ ID NO: 466121 - DNA, 25 bp, Homo sapien
aatcatgggctgcgggtggtggctc

SEQ ID NO: 466122 - DNA, 25 bp, Homo sapien
atcatgggctgcgggtggtggctca

SEQ ID NO: 466123 - DNA, 25 bp, Homo sapien
tcatgggctgcgggtggtggctcat

SEQ ID NO: 466124 - DNA, 25 bp, Homo sapien
gctcatgcctgtcatatgaacactt

SEQ ID NO: 466125 - DNA, 25 bp, Homo sapien
gacttgagagtgttgctctggtatt

SEQ ID NO: 466126 - DNA, 25 bp, Homo sapien
gctctggtattctgggttctgaagt

SEQ ID NO: 466127 - DNA, 25 bp, Homo sapien
gttctgaagtctggttatacgtggt

SEQ ID NO: 466128 - DNA, 25 bp, Homo sapien
ctgaagtctggttatacgtggtatt

SEQ ID NO: 466129 - DNA, 25 bp, Homo sapien
aagtctggttatacgtggtattctg

SEQ ID NO: 466130 - DNA, 25 bp, Homo sapien
tggttatacgtggtattctgggttc

SEQ ID NO: 466131 - DNA, 25 bp, Homo sapien
tctgggttcaacaagtatgactcga

SEQ ID NO: 466132 - DNA, 25 bp, Homo sapien
ggttcaacaagtatgactcgagagt

SEQ ID NO: 466133 - DNA, 25 bp, Homo sapien
caagtatgactcgagagtgtgctct

SEQ ID NO: 466134 - DNA, 25 bp, Homo sapien
gtatgactcgagagtgtgctctggt

SEQ ID NO: 466135 - DNA, 25 bp, Homo sapien
tgactcgagagtgtgctctggtatt

SEQ ID NO: 466136 - DNA, 25 bp, Homo sapien
ggaggcaactgatgactggctaaac

SEQ ID NO: 466137 - DNA, 25 bp, Homo sapien
ctgatgactggctaaacaaggttat

SEQ ID NO: 466138 - DNA, 25 bp, Homo sapien
atggtgtatctcacttcctacctat

SEQ ID NO: 466139 - DNA, 25 bp, Homo sapien
gaagatatcattgcccaaggtattg

SEQ ID NO: 466140 - DNA, 25 bp, Homo sapien
tatctcacttcctacctattacctt

SEQ ID NO: 466141 - DNA, 25 bp, Homo sapien
tattaccttccctcatgagcaacac

SEQ ID NO: 466142 - DNA, 25 bp, Homo sapien
tcatgagcaacacctcccttagtgc

SEQ ID NO: 466143 - DNA, 25 bp, Homo sapien
acctcccttagtgccaaggacatta

SEQ ID NO: 466144 - DNA, 25 bp, Homo sapien
tagtgccaaggacattaagaagatc

SEQ ID NO: 466145 - DNA, 25 bp, Homo sapien
agatcctggacagagtaggcatgga

SEQ ID NO: 466146 - DNA, 25 bp, Homo sapien
cagagtaggcatggaggcaactgat

SEQ ID NO: 466147 - DNA, 25 bp, Homo sapien
tgtctgcctccgtggtgtcaggttt

SEQ ID NO: 466148 - DNA, 25 bp, Homo sapien
gcctccgtggtgtcaggttttgtgc

SEQ ID NO: 466149 - DNA, 25 bp, Homo sapien
tttgtgccctctactcactagattg

SEQ ID NO: 466150 - DNA, 25 bp, Homo sapien
tgccctctactcactagattgtgga

SEQ ID NO: 466151 - DNA, 25 bp, Homo sapien
tctactcactagattgtggacacag

SEQ ID NO: 466152 - DNA, 25 bp, Homo sapien
tgtggacacagaaagcgctggtgct

SEQ ID NO: 466153 - DNA, 25 bp, Homo sapien
agaaagcgctggtgctgtcaaaacc

SEQ ID NO: 466154 - DNA, 25 bp, Homo sapien
agcgctggtgctgtcaaaaccactt

SEQ ID NO: 466155 - DNA, 25 bp, Homo sapien
ggtgctgtcaaaaccacttctgggt

SEQ ID NO: 466156 - DNA, 25 bp, Homo sapien
tcaaaaccacttctgggttgccggg

SEQ ID NO: 466157 - DNA, 25 bp, Homo sapien
aaccacttctgggttgccgggcgcg

SEQ ID NO: 466158 - DNA, 25 bp, Homo sapien
gatcatattctgagtttgcttgtga

SEQ ID NO: 466159 - DNA, 25 bp, Homo sapien
agtttgcttgtgatagtccaattta

SEQ ID NO: 466160 - DNA, 25 bp, Homo sapien
ttgtgatagtccaatttataccgtg

SEQ ID NO: 466161 - DNA, 25 bp, Homo sapien
tagtccaatttataccgtggaaagt

SEQ ID NO: 466162 - DNA, 25 bp, Homo sapien
gtggaaagtacgaccttccttgaat

SEQ ID NO: 466163 - DNA, 25 bp, Homo sapien
gaaagtacgaccttccttgaattgg

SEQ ID NO: 466164 - DNA, 25 bp, Homo sapien
gtacgaccttccttgaattgggtgt

SEQ ID NO: 466165 - DNA, 25 bp, Homo sapien
gaccttccttgaattgggtgtttat

SEQ ID NO: 466166 - DNA, 25 bp, Homo sapien
tccttgaattgggtgtttattggcc

SEQ ID NO: 466167 - DNA, 25 bp, Homo sapien
ttattggccagaagggctagtcaat

SEQ ID NO: 466168 - DNA, 25 bp, Homo sapien
gggttatgggaataatgctgaattt

SEQ ID NO: 466169 - DNA, 25 bp, Homo sapien
tccatcccaaaaaagcatccagttc

SEQ ID NO: 466170 - DNA, 25 bp, Homo sapien
agcatccagttcagaattgcccact

SEQ ID NO: 466171 - DNA, 25 bp, Homo sapien
cagttcagaattgcccactgttggc

SEQ ID NO: 466172 - DNA, 25 bp, Homo sapien
agaattgcccactgttggcaaagaa

SEQ ID NO: 466173 - DNA, 25 bp, Homo sapien
ggtcagaggctgagaaacctaccct

SEQ ID NO: 466174 - DNA, 25 bp, Homo sapien
gaggctgagaaacctaccctggtga

SEQ ID NO: 466175 - DNA, 25 bp, Homo sapien
gagaaacctaccctggtgaccaaat

SEQ ID NO: 466176 - DNA, 25 bp, Homo sapien
accctggtgaccaaataacagaatt

SEQ ID NO: 466177 - DNA, 25 bp, Homo sapien
aacagaattggcaggttttgcttca

SEQ ID NO: 466178 - DNA, 25 bp, Homo sapien
gaattggcaggttttgcttcaaaat

SEQ ID NO: 466179 - DNA, 25 bp, Homo sapien
attggcaggttttgcttcaaaatca

SEQ ID NO: 466180 - DNA, 25 bp, Homo sapien
tacagctgcactttatcgcccgcca

SEQ ID NO: 466181 - DNA, 25 bp, Homo sapien
cccggccgggtcagacatggactat

SEQ ID NO: 466182 - DNA, 25 bp, Homo sapien
cggccgggtcagacatggactattg

SEQ ID NO: 466183 - DNA, 25 bp, Homo sapien
ccgggtcagacatggactattggca

SEQ ID NO: 466184 - DNA, 25 bp, Homo sapien
gggtcagacatggactattggcagc

SEQ ID NO: 466185 - DNA, 25 bp, Homo sapien
tcagacatggactattggcagcccc

SEQ ID NO: 466186 - DNA, 25 bp, Homo sapien
gacatggactattggcagcccccac

SEQ ID NO: 466187 - DNA, 25 bp, Homo sapien
tcccgacaagcaccgctatgcacct

SEQ ID NO: 466188 - DNA, 25 bp, Homo sapien
gcgctcttctccgaggcagtgttgc

SEQ ID NO: 466189 - DNA, 25 bp, Homo sapien
gctcttctccgaggcagtgttgctg

SEQ ID NO: 466190 - DNA, 25 bp, Homo sapien
tggagttgcaccaacagccccgcgc

SEQ ID NO: 466191 - DNA, 25 bp, Homo sapien
gctctatgctggtgaatattaacat

SEQ ID NO: 466192 - DNA, 25 bp, Homo sapien
tctatgctggtgaatattaacatgg

SEQ ID NO: 466193 - DNA, 25 bp, Homo sapien
agggcattgcatgaggtctgccaga

SEQ ID NO: 466194 - DNA, 25 bp, Homo sapien
aggtctgccagaaggccctgcgttg

SEQ ID NO: 466195 - DNA, 25 bp, Homo sapien
gatggtgacacataggatggctcta

SEQ ID NO: 466196 - DNA, 25 bp, Homo sapien
cataggatggctctatgctggtgac

SEQ ID NO: 466197 - DNA, 25 bp, Homo sapien
cctaattatccgatctctgatgaat

SEQ ID NO: 466198 - DNA, 25 bp, Homo sapien
ctaattatccgatctctgatgaata

SEQ ID NO: 466199 - DNA, 25 bp, Homo sapien
attatccgatctctgatgaatatta

SEQ ID NO: 466200 - DNA, 25 bp, Homo sapien
ttatccgatctctgatgaatattaa

SEQ ID NO: 466201 - DNA, 25 bp, Homo sapien
aggtctgccagaaggccctgcgtgt

SEQ ID NO: 466202 - DNA, 25 bp, Homo sapien
tctgggtcctccactggttagaaaa

SEQ ID NO: 466203 - DNA, 25 bp, Homo sapien
gagtagctggttttaaccctgcatt

SEQ ID NO: 466204 - DNA, 25 bp, Homo sapien
aaccctgcattacagttaatcttga

SEQ ID NO: 466205 - DNA, 25 bp, Homo sapien
cttagaccgtattaacagagctgat

SEQ ID NO: 466206 - DNA, 25 bp, Homo sapien
attattgtcctgagtgttatcctga

SEQ ID NO: 466207 - DNA, 25 bp, Homo sapien
gttatcctgataatcctgctaatag

SEQ ID NO: 466208 - DNA, 25 bp, Homo sapien
atagaagccttgttcttccttggtc

SEQ ID NO: 466209 - DNA, 25 bp, Homo sapien
tccttggtctttcccacttgagtgg

SEQ ID NO: 466210 - DNA, 25 bp, Homo sapien
agaatctcaccagatggacctttga

SEQ ID NO: 466211 - DNA, 25 bp, Homo sapien
ggacctttgagaaagcttgccatcc

SEQ ID NO: 466212 - DNA, 25 bp, Homo sapien
aaagcttgccatccatttcttctgg

SEQ ID NO: 466213 - DNA, 25 bp, Homo sapien
atgttgggaaattttcagatgccat

SEQ ID NO: 466214 - DNA, 25 bp, Homo sapien
aacaaggactttaggataagcctct

SEQ ID NO: 466215 - DNA, 25 bp, Homo sapien
attgaaagcatgtctgtcaaattgc

SEQ ID NO: 466216 - DNA, 25 bp, Homo sapien
tgtcaaattgcaagtctcccttcag

SEQ ID NO: 466217 - DNA, 25 bp, Homo sapien
agtctcccttcagtttctatatatc

SEQ ID NO: 466218 - DNA, 25 bp, Homo sapien
agggtctctgagttggtgttgtacc

SEQ ID NO: 466219 - DNA, 25 bp, Homo sapien
ctgagttggtgttgtacctgtacca

SEQ ID NO: 466220 - DNA, 25 bp, Homo sapien
gctgaggcaaaacattgggttcttt

SEQ ID NO: 466221 - DNA, 25 bp, Homo sapien
tgggttcttttgtgttctacgttca

SEQ ID NO: 466222 - DNA, 25 bp, Homo sapien
tctacgttcagaacaatctgtttgc

SEQ ID NO: 466223 - DNA, 25 bp, Homo sapien
gaacaatctgtttgcatttgaaata

SEQ ID NO: 466224 - DNA, 25 bp, Homo sapien
attccttgtgaagatgatatactat

SEQ ID NO: 466225 - DNA, 25 bp, Homo sapien
atatactatttttgttaagcgtgtc

SEQ ID NO: 466226 - DNA, 25 bp, Homo sapien
tttgttaagcgtgtctgtatttatg

SEQ ID NO: 466227 - DNA, 25 bp, Homo sapien
tctgtatttatgtgtgaggagctgc

SEQ ID NO: 466228 - DNA, 25 bp, Homo sapien
ctgctggcttgcagtgcgcgtgcac

SEQ ID NO: 466229 - DNA, 25 bp, Homo sapien
gcagtgcgcgtgcacgtggagagct

SEQ ID NO: 466230 - DNA, 25 bp, Homo sapien
cccggagattggacggcctgatgct

SEQ ID NO: 466231 - DNA, 25 bp, Homo sapien
agattggacggcctgatgctccctc

SEQ ID NO: 466232 - DNA, 25 bp, Homo sapien
ggaagctggccgagggtcctggctc

SEQ ID NO: 466233 - DNA, 25 bp, Homo sapien
agctctttgaaatagtctgtgtgaa

SEQ ID NO: 466234 - DNA, 25 bp, Homo sapien
gtgaaagtgcagttcagtaataaac

SEQ ID NO: 466235 - DNA, 25 bp, Homo sapien
gaaaagttgcaagaccactacaaag

SEQ ID NO: 466236 - DNA, 25 bp, Homo sapien
ctacaaagatcatatttctcctgaa

SEQ ID NO: 466237 - DNA, 25 bp, Homo sapien
ttctcctgaaacatttgttgtaatc

SEQ ID NO: 466238 - DNA, 25 bp, Homo sapien
gtaatcatgcattatcatccccaaa

SEQ ID NO: 466239 - DNA, 25 bp, Homo sapien
aatattctactttgtattcgctatg

SEQ ID NO: 466240 - DNA, 25 bp, Homo sapien
tacaatggaaccctcggatcccctt

SEQ ID NO: 466241 - DNA, 25 bp, Homo sapien
ggatccccttcaaatatcactaact

SEQ ID NO: 466242 - DNA, 25 bp, Homo sapien
aaatatcactaactggcccattaat

SEQ ID NO: 466243 - DNA, 25 bp, Homo sapien
ggcccattaatgtccttagagcaaa

SEQ ID NO: 466244 - DNA, 25 bp, Homo sapien
tgcatttagttttaagtctcttcca

SEQ ID NO: 466245 - DNA, 25 bp, Homo sapien
gttttaagtctcttccaactggagc

SEQ ID NO: 466246 - DNA, 25 bp, Homo sapien
agctggtggcagctttactcctgct

SEQ ID NO: 466247 - DNA, 25 bp, Homo sapien
gtctccattgtactgttgtctttga

SEQ ID NO: 466248 - DNA, 25 bp, Homo sapien
aggactatttactaatcgactgttg

SEQ ID NO: 466249 - DNA, 25 bp, Homo sapien
aatcgactgttgttactatggcaat

SEQ ID NO: 466250 - DNA, 25 bp, Homo sapien
ctacatttcaacaccaagctctggg

SEQ ID NO: 466251 - DNA, 25 bp, Homo sapien
aggaaatgcacataccaactgaagt

SEQ ID NO: 466252 - DNA, 25 bp, Homo sapien
aagtgcatggttgcttccgatttgc

SEQ ID NO: 466253 - DNA, 25 bp, Homo sapien
gcagcagcctgctttatcttacaga

SEQ ID NO: 466254 - DNA, 25 bp, Homo sapien
agatcacctctttagcatgcatgcc

SEQ ID NO: 466255 - DNA, 25 bp, Homo sapien
catgcatgcccttctgtatcttctt

SEQ ID NO: 466256 - DNA, 25 bp, Homo sapien
ttcttcgcttgcttcaataaactaa

SEQ ID NO: 466257 - DNA, 25 bp, Homo sapien
tcatcggcctgccatgacctgcagc

SEQ ID NO: 466258 - DNA, 25 bp, Homo sapien
aacagaagagggtagtgggtgggct

SEQ ID NO: 466259 - DNA, 25 bp, Homo sapien
gctaggggggctgccttatttaaag

SEQ ID NO: 466260 - DNA, 25 bp, Homo sapien
gtggttgtttatgattcttatacta

SEQ ID NO: 466261 - DNA, 25 bp, Homo sapien
ggttgtttatgattcttatactaat

SEQ ID NO: 466262 - DNA, 25 bp, Homo sapien
tacaaagatattaaggccctgttca

SEQ ID NO: 466263 - DNA, 25 bp, Homo sapien
gatattaaggccctgttcattaaga

SEQ ID NO: 466264 - DNA, 25 bp, Homo sapien
attaaggccctgttcattaagaaat

SEQ ID NO: 466265 - DNA, 25 bp, Homo sapien
aaggccctgttcattaagaaattgt

SEQ ID NO: 466266 - DNA, 25 bp, Homo sapien
ggccctgttcattaagaaattgttc

SEQ ID NO: 466267 - DNA, 25 bp, Homo sapien
taagaaattgttcccttcccctgtg

SEQ ID NO: 466268 - DNA, 25 bp, Homo sapien
aattgattgctgtgcctcattacaa

SEQ ID NO: 466269 - DNA, 25 bp, Homo sapien
tgattgctgtgcctcattacaaatg

SEQ ID NO: 466270 - DNA, 25 bp, Homo sapien
gattgctgtgcctcattacaaatgc

SEQ ID NO: 466271 - DNA, 25 bp, Homo sapien
ttgctgtgcctcattacaaatgcat

SEQ ID NO: 466272 - DNA, 25 bp, Homo sapien
gctgtgcctcattacaaatgcatat

SEQ ID NO: 466273 - DNA, 25 bp, Homo sapien
gtgcctcattacaaatgcatatgat

SEQ ID NO: 466274 - DNA, 25 bp, Homo sapien
catatgatgtttgagtgctgttgtt

SEQ ID NO: 466275 - DNA, 25 bp, Homo sapien
gatgtttgagtgctgttgtttgaaa

SEQ ID NO: 466276 - DNA, 25 bp, Homo sapien
ttgagtgctgttgtttgaaattatt

SEQ ID NO: 466277 - DNA, 25 bp, Homo sapien
agttgatgattgacttgaagattac

SEQ ID NO: 466278 - DNA, 25 bp, Homo sapien
ttaaggttttttggcatgtgtgttt

SEQ ID NO: 466279 - DNA, 25 bp, Homo sapien
taagaagtgcgggagcttctctggt

SEQ ID NO: 466280 - DNA, 25 bp, Homo sapien
cagggttctctgaacacttatggag

SEQ ID NO: 466281 - DNA, 25 bp, Homo sapien
ggcaggtctttaagatggcgagact

SEQ ID NO: 466282 - DNA, 25 bp, Homo sapien
ttaagatggcgagactgcccttctc

SEQ ID NO: 466283 - DNA, 25 bp, Homo sapien
gcccttctcagctgataaacacaag

SEQ ID NO: 466284 - DNA, 25 bp, Homo sapien
taaacacaagaacggcgatcctgtc

SEQ ID NO: 466285 - DNA, 25 bp, Homo sapien
agaacggcgatcctgtcttcagtaa

SEQ ID NO: 466286 - DNA, 25 bp, Homo sapien
ctgtcttcagtaaggctccacgaga

SEQ ID NO: 466287 - DNA, 25 bp, Homo sapien
gtaaggctccacgagaagagaggaa

SEQ ID NO: 466288 - DNA, 25 bp, Homo sapien
ggaagtatatctacacctcaaccct

SEQ ID NO: 466289 - DNA, 25 bp, Homo sapien
tcagcacaatcggagttcatataag

SEQ ID NO: 466290 - DNA, 25 bp, Homo sapien
ggcaaggtacaatctaaggtgaact

SEQ ID NO: 466291 - DNA, 25 bp, Homo sapien
aggttcttagcaaatttgggcagat

SEQ ID NO: 466292 - DNA, 25 bp, Homo sapien
cggaattccattcccagatctcaaa

SEQ ID NO: 466293 - DNA, 25 bp, Homo sapien
agatctcaaagtcccgccaagagtt

SEQ ID NO: 466294 - DNA, 25 bp, Homo sapien
aagtcccgccaagagttggagcagc

SEQ ID NO: 466295 - DNA, 25 bp, Homo sapien
gcacctccgatgcagtgaccttcat

SEQ ID NO: 466296 - DNA, 25 bp, Homo sapien
agtgaccttcatcacctatgtgcag

SEQ ID NO: 466297 - DNA, 25 bp, Homo sapien
acctatgtgcagtctttgaaacgga

SEQ ID NO: 466298 - DNA, 25 bp, Homo sapien
gaagcaagttgagctctaccgcaat

SEQ ID NO: 466299 - DNA, 25 bp, Homo sapien
agttgagctctaccgcaatggccag

SEQ ID NO: 466300 - DNA, 25 bp, Homo sapien
aatggccagcgcttactggaaaagc

SEQ ID NO: 466301 - DNA, 25 bp, Homo sapien
gtgagggccttggaaatggcttcct

SEQ ID NO: 466302 - DNA, 25 bp, Homo sapien
gagatggcaattatccaggtagaca

SEQ ID NO: 466303 - DNA, 25 bp, Homo sapien
ccaggtagacaagatgtgtgtgtgt

SEQ ID NO: 466304 - DNA, 25 bp, Homo sapien
tgtgcaaagccctggtcataaataa

SEQ ID NO: 466305 - DNA, 25 bp, Homo sapien
ggtcataaataacttttcctctgca

SEQ ID NO: 466306 - DNA, 25 bp, Homo sapien
acttttcctctgcaaactgtggatg

SEQ ID NO: 466307 - DNA, 25 bp, Homo sapien
actgtggatggcagttcaccatgtt

SEQ ID NO: 466308 - DNA, 25 bp, Homo sapien
ggatggcagttcaccatgtttctca

SEQ ID NO: 466309 - DNA, 25 bp, Homo sapien
agttcaccatgtttctcaccactgg

SEQ ID NO: 466310 - DNA, 25 bp, Homo sapien
cctggtcactgcttatccaatatgc

SEQ ID NO: 466311 - DNA, 25 bp, Homo sapien
cactgcttatccaatatgcatgtaa

SEQ ID NO: 466312 - DNA, 25 bp, Homo sapien
cacaccttcctgtcgtgacagataa

SEQ ID NO: 466313 - DNA, 25 bp, Homo sapien
aaggacaacccttgaaatcatgtaa

SEQ ID NO: 466314 - DNA, 25 bp, Homo sapien
aatcatgtaacgttggtcatttcaa

SEQ ID NO: 466315 - DNA, 25 bp, Homo sapien
tttgagggtacctttgtattttgct

SEQ ID NO: 466316 - DNA, 25 bp, Homo sapien
tgaccttggttctgtgatttggatg

SEQ ID NO: 466317 - DNA, 25 bp, Homo sapien
gatttggatgtcaacaacttcccta

SEQ ID NO: 466318 - DNA, 25 bp, Homo sapien
aaagcaccagtgtgttaggttctaa

SEQ ID NO: 466319 - DNA, 25 bp, Homo sapien
taggttctaatgtcatgacccaatt

SEQ ID NO: 466320 - DNA, 25 bp, Homo sapien
tgacccaatttgtgttattcatctt

SEQ ID NO: 466321 - DNA, 25 bp, Homo sapien
attcatctttaatcctgttttcagt

SEQ ID NO: 466322 - DNA, 25 bp, Homo sapien
gttttcagtctctatgtgtacagca

SEQ ID NO: 466323 - DNA, 25 bp, Homo sapien
atggccttcatcctcctcgttctta

SEQ ID NO: 466324 - DNA, 25 bp, Homo sapien
tcatcctcctcgttcttactggcgt

SEQ ID NO: 466325 - DNA, 25 bp, Homo sapien
atcctcctcgttcttactggcgtca

SEQ ID NO: 466326 - DNA, 25 bp, Homo sapien
tcctcctcgttcttactggcgtcaa

SEQ ID NO: 466327 - DNA, 25 bp, Homo sapien
cctcctcgttcttactggcgtcaat

SEQ ID NO: 466328 - DNA, 25 bp, Homo sapien
tcctcgttcttactggcgtcaatct

SEQ ID NO: 466329 - DNA, 25 bp, Homo sapien
cctcgttcttactggcgtcaatctt

SEQ ID NO: 466330 - DNA, 25 bp, Homo sapien
ctcgttcttactggcgtcaatcttc

SEQ ID NO: 466331 - DNA, 25 bp, Homo sapien
gttcttactggcgtcaatcttcgcc

SEQ ID NO: 466332 - DNA, 25 bp, Homo sapien
ttcttactggcgtcaatcttcgccc

SEQ ID NO: 466333 - DNA, 25 bp, Homo sapien
ttcggtgcctccagacgcggttccg

SEQ ID NO: 466334 - DNA, 25 bp, Homo sapien
tacattaccatgtcagtattcactg

SEQ ID NO: 466335 - DNA, 25 bp, Homo sapien
gactacatgtatttgactctacaga

SEQ ID NO: 466336 - DNA, 25 bp, Homo sapien
gacatgtttattcacttggtacttt

SEQ ID NO: 466337 - DNA, 25 bp, Homo sapien
gaacagactgagagtgacacgcata

SEQ ID NO: 466338 - DNA, 25 bp, Homo sapien
gacacgcatatttgattgtgaggac

SEQ ID NO: 466339 - DNA, 25 bp, Homo sapien
gattgtgaggacagtttttgtcata

SEQ ID NO: 466340 - DNA, 25 bp, Homo sapien
gtcataatatctggttatcgtgtga

SEQ ID NO: 466341 - DNA, 25 bp, Homo sapien
ggacatttatgacctatgcattctc

SEQ ID NO: 466342 - DNA, 25 bp, Homo sapien
atcgtgtgatattaaactactgaag

SEQ ID NO: 466343 - DNA, 25 bp, Homo sapien
ctatgcattctctttatgtagatta

SEQ ID NO: 466344 - DNA, 25 bp, Homo sapien
gatactacacttatacattaccatg

SEQ ID NO: 466345 - DNA, 25 bp, Homo sapien
ggagaataaatgacttgcttttcta

SEQ ID NO: 466346 - DNA, 25 bp, Homo sapien
gaataaatgacttgcttttctaaat

SEQ ID NO: 466347 - DNA, 25 bp, Homo sapien
aataaatgacttgcttttctaaatc

SEQ ID NO: 466348 - DNA, 25 bp, Homo sapien
tttctaaatctcaggtttatctggg

SEQ ID NO: 466349 - DNA, 25 bp, Homo sapien
ttctaaatctcaggtttatctgggc

SEQ ID NO: 466350 - DNA, 25 bp, Homo sapien
tatatatgatgcatcggataggtca

SEQ ID NO: 466351 - DNA, 25 bp, Homo sapien
tatatgatgcatcggataggtcatt

SEQ ID NO: 466352 - DNA, 25 bp, Homo sapien
tatgatgcatcggataggtcattat

SEQ ID NO: 466353 - DNA, 25 bp, Homo sapien
atgatgcatcggataggtcattatg

SEQ ID NO: 466354 - DNA, 25 bp, Homo sapien
attatgattttttaccatttcgact

SEQ ID NO: 466355 - DNA, 25 bp, Homo sapien
tgattttttaccatttcgacttaca

SEQ ID NO: 466356 - DNA, 25 bp, Homo sapien
ggtcagacacacaaaaccttcgtca

SEQ ID NO: 466357 - DNA, 25 bp, Homo sapien
aaaaccttcgtcaattgcacaccgg

SEQ ID NO: 466358 - DNA, 25 bp, Homo sapien
acaccggtgctgttgggagtgacca

SEQ ID NO: 466359 - DNA, 25 bp, Homo sapien
gctgttgggagtgaccaaaccacat

SEQ ID NO: 466360 - DNA, 25 bp, Homo sapien
aaccacatgaaccagacttttcccg

SEQ ID NO: 466361 - DNA, 25 bp, Homo sapien
tgaaccagacttttcccgtccagga

SEQ ID NO: 466362 - DNA, 25 bp, Homo sapien
ttcccgtccaggaaatagcatttca

SEQ ID NO: 466363 - DNA, 25 bp, Homo sapien
gatttggtttttaatttcatgccct

SEQ ID NO: 466364 - DNA, 25 bp, Homo sapien
tttttaatttcatgcccttcggcca

SEQ ID NO: 466365 - DNA, 25 bp, Homo sapien
tcggccacaggctcaacgggacatg

SEQ ID NO: 466366 - DNA, 25 bp, Homo sapien
caggctcaacgggacatgcaacata

SEQ ID NO: 466367 - DNA, 25 bp, Homo sapien
ctcatgcacgctctctattcagaaa

SEQ ID NO: 466368 - DNA, 25 bp, Homo sapien
aattttcacaattcaatccttcaaa

SEQ ID NO: 466369 - DNA, 25 bp, Homo sapien
aaaactcaactatgtcttgctatag

SEQ ID NO: 466370 - DNA, 25 bp, Homo sapien
aataaacagtagcagtccaccaaag

SEQ ID NO: 466371 - DNA, 25 bp, Homo sapien
gcagtccaccaaagagcttagtttc

SEQ ID NO: 466372 - DNA, 25 bp, Homo sapien
gagcttagtttcaaactctatcgag

SEQ ID NO: 466373 - DNA, 25 bp, Homo sapien
ctctatcgagataacttgatggttt

SEQ ID NO: 466374 - DNA, 25 bp, Homo sapien
aatgcttaacacaattctcgccttt

SEQ ID NO: 466375 - DNA, 25 bp, Homo sapien
cacaattctcgcctttaaatgtaaa

SEQ ID NO: 466376 - DNA, 25 bp, Homo sapien
atgtaaacttgttcacctgatactc

SEQ ID NO: 466377 - DNA, 25 bp, Homo sapien
taaatataatcttgcacctaggaca

SEQ ID NO: 466378 - DNA, 25 bp, Homo sapien
gaaacatattgcagacttaagccat

SEQ ID NO: 466379 - DNA, 25 bp, Homo sapien
gacttaagccatttttgatacagat

SEQ ID NO: 466380 - DNA, 25 bp, Homo sapien
tggataaggccctgagtcatcttcc

SEQ ID NO: 466381 - DNA, 25 bp, Homo sapien
ccctgagtcatcttcctgagctgaa

SEQ ID NO: 466382 - DNA, 25 bp, Homo sapien
tagttaagctgaatgtacgtataaa

SEQ ID NO: 466383 - DNA, 25 bp, Homo sapien
atgattttctaaccacttgctcgcc

SEQ ID NO: 466384 - DNA, 25 bp, Homo sapien
taaccacttgctcgccaacaaggaa

SEQ ID NO: 466385 - DNA, 25 bp, Homo sapien
aacttttaagtagagcagaacctga

SEQ ID NO: 466386 - DNA, 25 bp, Homo sapien
gcagaacctgaatagacaagacatt

SEQ ID NO: 466387 - DNA, 25 bp, Homo sapien
aaatgatttaccatcactgtgtagt

SEQ ID NO: 466388 - DNA, 25 bp, Homo sapien
accatcactgtgtagttaattgtag

SEQ ID NO: 466389 - DNA, 25 bp, Homo sapien
atgcaggaggcttggaagtataacc

SEQ ID NO: 466390 - DNA, 25 bp, Homo sapien
gtataaccgggaatgcaaactccta

SEQ ID NO: 466391 - DNA, 25 bp, Homo sapien
gggaatgcaaactcctaagagatac

SEQ ID NO: 466392 - DNA, 25 bp, Homo sapien
taagagatactctgcagagcttcag

SEQ ID NO: 466393 - DNA, 25 bp, Homo sapien
cagagcttcagctggaatggtcgtg

SEQ ID NO: 466394 - DNA, 25 bp, Homo sapien
gaatggtcgtggattcacagataaa

SEQ ID NO: 466395 - DNA, 25 bp, Homo sapien
gtagatcgactaaaactggcagaaa

SEQ ID NO: 466396 - DNA, 25 bp, Homo sapien
ggcagaaattgtgaagcaggtgata

SEQ ID NO: 466397 - DNA, 25 bp, Homo sapien
aagagcaaaccacgtcccacgaatc

SEQ ID NO: 466398 - DNA, 25 bp, Homo sapien
acgtcccacgaatcccaataatgac

SEQ ID NO: 466399 - DNA, 25 bp, Homo sapien
taatgacagcttcagactttgtttt

SEQ ID NO: 466400 - DNA, 25 bp, Homo sapien
tttccagttgcccataagcacatca

SEQ ID NO: 466401 - DNA, 25 bp, Homo sapien
tgcccataagcacatcagtactttt

SEQ ID NO: 466402 - DNA, 25 bp, Homo sapien
acttttctctggctggaatagtaaa

SEQ ID NO: 466403 - DNA, 25 bp, Homo sapien
gtatggtacatctacctaaaggact

SEQ ID NO: 466404 - DNA, 25 bp, Homo sapien
taaagactaccataaaacccaacat

SEQ ID NO: 466405 - DNA, 25 bp, Homo sapien
aaacccaacatgcttattacattaa

SEQ ID NO: 466406 - DNA, 25 bp, Homo sapien
gatacatgattgaaaccaagttgaa

SEQ ID NO: 466407 - DNA, 25 bp, Homo sapien
aaaaatagcatatgccttggaggaa

SEQ ID NO: 466408 - DNA, 25 bp, Homo sapien
atgtgctcaaaattactaatgattt

SEQ ID NO: 466409 - DNA, 25 bp, Homo sapien
aatgatttagtgttgtccctacttt

SEQ ID NO: 466410 - DNA, 25 bp, Homo sapien
atttagtgttgtccctactttctct

SEQ ID NO: 466411 - DNA, 25 bp, Homo sapien
gcttgaggtatgtatgttctatatg

SEQ ID NO: 466412 - DNA, 25 bp, Homo sapien
gatttgccttactataactcttaga

SEQ ID NO: 466413 - DNA, 25 bp, Homo sapien
gagatccttcatctttctcagaatc

SEQ ID NO: 466414 - DNA, 25 bp, Homo sapien
tctcagaatctaggaggatgcatct

SEQ ID NO: 466415 - DNA, 25 bp, Homo sapien
gtacctagaggaggacacaaaggca

SEQ ID NO: 466416 - DNA, 25 bp, Homo sapien
aggcatcatatgttacattctcgtg

SEQ ID NO: 466417 - DNA, 25 bp, Homo sapien
atcatatgttacattctcgtgacat

SEQ ID NO: 466418 - DNA, 25 bp, Homo sapien
gtttagcatgatgtcagatgtccat

SEQ ID NO: 466419 - DNA, 25 bp, Homo sapien
cagatgtccatttgtcatatatggc

SEQ ID NO: 466420 - DNA, 25 bp, Homo sapien
tatatggcctttattggcttgaggt

SEQ ID NO: 466421 - DNA, 25 bp, Homo sapien
ggcctttattggcttgaggtatgta

SEQ ID NO: 466422 - DNA, 25 bp, Homo sapien
aaaaacgtttggctctattggcaga

SEQ ID NO: 466423 - DNA, 25 bp, Homo sapien
aaaacgtttggctctattggcagag

SEQ ID NO: 466424 - DNA, 25 bp, Homo sapien
aaacgtttggctctattggcagaga

SEQ ID NO: 466425 - DNA, 25 bp, Homo sapien
acgtttggctctattggcagagatc

SEQ ID NO: 466426 - DNA, 25 bp, Homo sapien
gtttggctctattggcagagatcaa

SEQ ID NO: 466427 - DNA, 25 bp, Homo sapien
tttggctctattggcagagatcaag

SEQ ID NO: 466428 - DNA, 25 bp, Homo sapien
agagatcaagatttaggctgaggcg

SEQ ID NO: 466429 - DNA, 25 bp, Homo sapien
gtggtacatgtctgtttttccagct

SEQ ID NO: 466430 - DNA, 25 bp, Homo sapien
tggtacatgtctgtttttccagcta

SEQ ID NO: 466431 - DNA, 25 bp, Homo sapien
tacatgtctgtttttccagctactc

SEQ ID NO: 466432 - DNA, 25 bp, Homo sapien
acatgtctgtttttccagctactca

SEQ ID NO: 466433 - DNA, 25 bp, Homo sapien
aaaacatccatgctcggaaatacca

SEQ ID NO: 466434 - DNA, 25 bp, Homo sapien
tccatgctcggaaataccaatattg

SEQ ID NO: 466435 - DNA, 25 bp, Homo sapien
tgctcggaaataccaatattgggct

SEQ ID NO: 466436 - DNA, 25 bp, Homo sapien
tggttatctggtggtatatggatga

SEQ ID NO: 466437 - DNA, 25 bp, Homo sapien
ctggcttcttcactgattgggtatg

SEQ ID NO: 466438 - DNA, 25 bp, Homo sapien
ggcttcttcactgattgggtatgtt

SEQ ID NO: 466439 - DNA, 25 bp, Homo sapien
tcttcactgattgggtatgttttgt

SEQ ID NO: 466440 - DNA, 25 bp, Homo sapien
attgggtatgttttgtttgatctca

SEQ ID NO: 466441 - DNA, 25 bp, Homo sapien
ggctgacctgaagagtgccctagtc

SEQ ID NO: 466442 - DNA, 25 bp, Homo sapien
aagagtgccctagtcttcattactt

SEQ ID NO: 466443 - DNA, 25 bp, Homo sapien
gtgccctagtcttcattactttcac

SEQ ID NO: 466444 - DNA, 25 bp, Homo sapien
gctctatgctggtgaatattaacat

SEQ ID NO: 466445 - DNA, 25 bp, Homo sapien
ctctatgctggtgaatattaacatg

SEQ ID NO: 466446 - DNA, 25 bp, Homo sapien
tctatgctggtgaatattaacatgg

SEQ ID NO: 466447 - DNA, 25 bp, Homo sapien
cccccctaattatccgatctctgat

SEQ ID NO: 466448 - DNA, 25 bp, Homo sapien
ccccctaattatccgatctctgatg

SEQ ID NO: 466449 - DNA, 25 bp, Homo sapien
cctaattatccgatctctgatgaat

SEQ ID NO: 466450 - DNA, 25 bp, Homo sapien
ctaattatccgatctctgatgaata

SEQ ID NO: 466451 - DNA, 25 bp, Homo sapien
attatccgatctctgatgaatatta

SEQ ID NO: 466452 - DNA, 25 bp, Homo sapien
ttatccgatctctgatgaatattaa

SEQ ID NO: 466453 - DNA, 25 bp, Homo sapien
actaactgaagaaatggtgatgctc

SEQ ID NO: 466454 - DNA, 25 bp, Homo sapien
tgccttccctatcagcagaaaggct

SEQ ID NO: 466455 - DNA, 25 bp, Homo sapien
cagcctcccagtctggtgaagcttc

SEQ ID NO: 466456 - DNA, 25 bp, Homo sapien
tcccagtctggtgaagcttcctgta

SEQ ID NO: 466457 - DNA, 25 bp, Homo sapien
gtctggtgaagcttcctgtatggtc

SEQ ID NO: 466458 - DNA, 25 bp, Homo sapien
tgaagcttcctgtatggtccatgac

SEQ ID NO: 466459 - DNA, 25 bp, Homo sapien
cttcctgtatggtccatgaccgtat

SEQ ID NO: 466460 - DNA, 25 bp, Homo sapien
gtatggtccatgaccgtattccacc

SEQ ID NO: 466461 - DNA, 25 bp, Homo sapien
atgtgctgtccactaagcactgcac

SEQ ID NO: 466462 - DNA, 25 bp, Homo sapien
tgctgtccactaagcactgcacaaa

SEQ ID NO: 466463 - DNA, 25 bp, Homo sapien
agcactgcacaaacaagcaatcaaa

SEQ ID NO: 466464 - DNA, 25 bp, Homo sapien
tgcaggtattggtgagtcggatcgc

SEQ ID NO: 466465 - DNA, 25 bp, Homo sapien
agtcggatcgcagcttggatggcca

SEQ ID NO: 466466 - DNA, 25 bp, Homo sapien
ggatcgcagcttggatggccactta

SEQ ID NO: 466467 - DNA, 25 bp, Homo sapien
cgcagcttggatggccacttacctg

SEQ ID NO: 466468 - DNA, 25 bp, Homo sapien
cacttacctgaatgaccacctagag

SEQ ID NO: 466469 - DNA, 25 bp, Homo sapien
tgaatgaccacctagagccttggat

SEQ ID NO: 466470 - DNA, 25 bp, Homo sapien
tgaccacctagagccttggatccag

SEQ ID NO: 466471 - DNA, 25 bp, Homo sapien
agagctttgaacaggtagtgaatga

SEQ ID NO: 466472 - DNA, 25 bp, Homo sapien
tagtgaatgaactcttccgggatgg

SEQ ID NO: 466473 - DNA, 25 bp, Homo sapien
gcactgtgcgtggaaagcgtagaca

SEQ ID NO: 466474 - DNA, 25 bp, Homo sapien
gcgtagacaaggagatgcaggtatt

SEQ ID NO: 466475 - DNA, 25 bp, Homo sapien
ttccctcaaacgattgtaaagagct

SEQ ID NO: 466476 - DNA, 25 bp, Homo sapien
tccctcaaacgattgtaaagagctt

SEQ ID NO: 466477 - DNA, 25 bp, Homo sapien
ccctcaaacgattgtaaagagctta

SEQ ID NO: 466478 - DNA, 25 bp, Homo sapien
cctcaaacgattgtaaagagcttaa

SEQ ID NO: 466479 - DNA, 25 bp, Homo sapien
tcaaacgattgtaaagagcttaaag

SEQ ID NO: 466480 - DNA, 25 bp, Homo sapien
caaacgattgtaaagagcttaaagg

SEQ ID NO: 466481 - DNA, 25 bp, Homo sapien
gattgtaaagagcttaaaggcatta

SEQ ID NO: 466482 - DNA, 25 bp, Homo sapien
aaaggcattaagatgagagacgggc

SEQ ID NO: 466483 - DNA, 25 bp, Homo sapien
aggcattaagatgagagacgggcca

SEQ ID NO: 466484 - DNA, 25 bp, Homo sapien
cattaagatgagagacgggccaggc

SEQ ID NO: 466485 - DNA, 25 bp, Homo sapien
attaagatgagagacgggccaggcg

SEQ ID NO: 466486 - DNA, 25 bp, Homo sapien
aataatacttccttatgtagccatt

SEQ ID NO: 466487 - DNA, 25 bp, Homo sapien
tacttccttatgtagccattaagat

SEQ ID NO: 466488 - DNA, 25 bp, Homo sapien
tgtgctttttagaacaaatctggat

SEQ ID NO: 466489 - DNA, 25 bp, Homo sapien
gataaatgtgcaaaagtaccccttt

SEQ ID NO: 466490 - DNA, 25 bp, Homo sapien
gcaaaagtacccctttgcacagata

SEQ ID NO: 466491 - DNA, 25 bp, Homo sapien
agatagttaatgttttatgcttcca

SEQ ID NO: 466492 - DNA, 25 bp, Homo sapien
gaaatgcggctagttcagagagatt

SEQ ID NO: 466493 - DNA, 25 bp, Homo sapien
gatttttagagctgtggtggacttc

SEQ ID NO: 466494 - DNA, 25 bp, Homo sapien
tagagctgtggtggacttcatagat

SEQ ID NO: 466495 - DNA, 25 bp, Homo sapien
gctgtggtggacttcatagatgaat

SEQ ID NO: 466496 - DNA, 25 bp, Homo sapien
ttcaagtgttgagggaggattaaag

SEQ ID NO: 466497 - DNA, 25 bp, Homo sapien
tgcccagccacttagttttttctta

SEQ ID NO: 466498 - DNA, 25 bp, Homo sapien
tctatcccatagaacactctttttt

SEQ ID NO: 466499 - DNA, 25 bp, Homo sapien
agaacactcttttttatcttccctg

SEQ ID NO: 466500 - DNA, 25 bp, Homo sapien
actcaacagagtatttcccttggcc

SEQ ID NO: 466501 - DNA, 25 bp, Homo sapien
agagtatttcccttggccgagatgg

SEQ ID NO: 466502 - DNA, 25 bp, Homo sapien
gccgagatggaagttttgtcccaat

SEQ ID NO: 466503 - DNA, 25 bp, Homo sapien
ttgtcccaatagatgagctgctgag

SEQ ID NO: 466504 - DNA, 25 bp, Homo sapien
acaaggtgacatttttctgctgccc

SEQ ID NO: 466505 - DNA, 25 bp, Homo sapien
acatttttctgctgcccatttgtgt

SEQ ID NO: 466506 - DNA, 25 bp, Homo sapien
tgctgcccatttgtgtcctggagac

SEQ ID NO: 466507 - DNA, 25 bp, Homo sapien
ttgtgtcctggagacggtggtaccc

SEQ ID NO: 466508 - DNA, 25 bp, Homo sapien
ctgatggtaataggtgaaagtggta

SEQ ID NO: 466509 - DNA, 25 bp, Homo sapien
gatggtaataggtgaaagtggtaac

SEQ ID NO: 466510 - DNA, 25 bp, Homo sapien
tggtaataggtgaaagtggtaacct

SEQ ID NO: 466511 - DNA, 25 bp, Homo sapien
taataggtgaaagtggtaacctgtt

SEQ ID NO: 466512 - DNA, 25 bp, Homo sapien
ctgttttaactttgaattcttgccg

SEQ ID NO: 466513 - DNA, 25 bp, Homo sapien
tgttttaactttgaattcttgccgg

SEQ ID NO: 466514 - DNA, 25 bp, Homo sapien
tttaactttgaattcttgccgggcg

SEQ ID NO: 466515 - DNA, 25 bp, Homo sapien
ttaactttgaattcttgccgggcgc

SEQ ID NO: 466516 - DNA, 25 bp, Homo sapien
taactttgaattcttgccgggcgcg

SEQ ID NO: 466517 - DNA, 25 bp, Homo sapien
aactttgaattcttgccgggcgcgg

SEQ ID NO: 466518 - DNA, 25 bp, Homo sapien
actttgaattcttgccgggcgcggt

SEQ ID NO: 466519 - DNA, 25 bp, Homo sapien
gggtcagctatgcagcccatcacgt

SEQ ID NO: 466520 - DNA, 25 bp, Homo sapien
tatgcagcccatcacgtgtgttttt

SEQ ID NO: 466521 - DNA, 25 bp, Homo sapien
tcacgtgtgtttttcatctgggatg

SEQ ID NO: 466522 - DNA, 25 bp, Homo sapien
tgggatgaaaaagcctggttctctt

SEQ ID NO: 466523 - DNA, 25 bp, Homo sapien
gaaatgcttgattgtacttattgag

SEQ ID NO: 466524 - DNA, 25 bp, Homo sapien
cttattgagctaaacaagtcttggt

SEQ ID NO: 466525 - DNA, 25 bp, Homo sapien
acaagtcttggtgactgttgttgat

SEQ ID NO: 466526 - DNA, 25 bp, Homo sapien
ttttgcctccaaagttggatctagt

SEQ ID NO: 466527 - DNA, 25 bp, Homo sapien
gttggatctagtgatgatcagcacc

SEQ ID NO: 466528 - DNA, 25 bp, Homo sapien
attgactccactggatttgtgctct

SEQ ID NO: 466529 - DNA, 25 bp, Homo sapien
tgctctgttgagtcagaggctcccg

SEQ ID NO: 466530 - DNA, 25 bp, Homo sapien
gatagagactttgacgtcgacgcgg

SEQ ID NO: 466531 - DNA, 25 bp, Homo sapien
tagagactttgacgtcgacgcggcc

SEQ ID NO: 466532 - DNA, 25 bp, Homo sapien
caaagcatcctggtttatggccaga

SEQ ID NO: 466533 - DNA, 25 bp, Homo sapien
catcctggtttatggccagagacca

SEQ ID NO: 466534 - DNA, 25 bp, Homo sapien
tggtttatggccagagaccagtgag

SEQ ID NO: 466535 - DNA, 25 bp, Homo sapien
accagtgagctagagtaactctaat

SEQ ID NO: 466536 - DNA, 25 bp, Homo sapien
gagtaactctaataacacctgcacg

SEQ ID NO: 466537 - DNA, 25 bp, Homo sapien
gtaactctaataacacctgcacgta

SEQ ID NO: 466538 - DNA, 25 bp, Homo sapien
aataacacctgcacgtaatggctaa

SEQ ID NO: 466539 - DNA, 25 bp, Homo sapien
acacctgcacgtaatggctaaaatt

SEQ ID NO: 466540 - DNA, 25 bp, Homo sapien
gcacgtaatggctaaaattgcttta

SEQ ID NO: 466541 - DNA, 25 bp, Homo sapien
tacttgtaaaagcatatcacatctt

SEQ ID NO: 466542 - DNA, 25 bp, Homo sapien
atcacatcttaaaccagtggtgcac

SEQ ID NO: 466543 - DNA, 25 bp, Homo sapien
ggtgcacatgtggatttacagctca

SEQ ID NO: 466544 - DNA, 25 bp, Homo sapien
ggatttacagctcatggactctact

SEQ ID NO: 466545 - DNA, 25 bp, Homo sapien
ctcatggactctactgttcagcttt

SEQ ID NO: 466546 - DNA, 25 bp, Homo sapien
ggactctactgttcagctttaattt

SEQ ID NO: 466547 - DNA, 25 bp, Homo sapien
ggaacatagggataactcagtttta

SEQ ID NO: 466548 - DNA, 25 bp, Homo sapien
tgttaagtgttgtagcctgcccaga

SEQ ID NO: 466549 - DNA, 25 bp, Homo sapien
gcctgcccagagtgacttctatttt

SEQ ID NO: 466550 - DNA, 25 bp, Homo sapien
tttcttctttgtctccaggtggtga

SEQ ID NO: 466551 - DNA, 25 bp, Homo sapien
tctttgtctccaggtggtgaagcag

SEQ ID NO: 466552 - DNA, 25 bp, Homo sapien
tagaataatggcctaccactctgaa

SEQ ID NO: 466553 - DNA, 25 bp, Homo sapien
gaataatggcctaccactctgaaac

SEQ ID NO: 466554 - DNA, 25 bp, Homo sapien
taccactctgaaacatatgaatatg

SEQ ID NO: 466555 - DNA, 25 bp, Homo sapien
ttaagttgctaatcagatgactgta

SEQ ID NO: 466556 - DNA, 25 bp, Homo sapien
aataaattatcctggatcatctgga

SEQ ID NO: 466557 - DNA, 25 bp, Homo sapien
tccagcaagggtgggttgagctctc

SEQ ID NO: 466558 - DNA, 25 bp, Homo sapien
gcaagggtgggttgagctctcacat

SEQ ID NO: 466559 - DNA, 25 bp, Homo sapien
ggtgggttgagctctcacatggcac

SEQ ID NO: 466560 - DNA, 25 bp, Homo sapien
ggttgagctctcacatggcaccact

SEQ ID NO: 466561 - DNA, 25 bp, Homo sapien
tgcttccctcttctacactgaaaga

SEQ ID NO: 466562 - DNA, 25 bp, Homo sapien
ttctacactgaaagacttatgggcc

SEQ ID NO: 466563 - DNA, 25 bp, Homo sapien
gtgtaaggcattttaatcattgtga

SEQ ID NO: 466564 - DNA, 25 bp, Homo sapien
taaaaatcagaaacttcccttggag

SEQ ID NO: 466565 - DNA, 25 bp, Homo sapien
gaaacttcccttggagtagagacat

SEQ ID NO: 466566 - DNA, 25 bp, Homo sapien
gtagagacatttcagttgcaagcat

SEQ ID NO: 466567 - DNA, 25 bp, Homo sapien
gagacatttcagttgcaagcataaa

SEQ ID NO: 466568 - DNA, 25 bp, Homo sapien
ttttctaccattgtatgaacgtaat

SEQ ID NO: 466569 - DNA, 25 bp, Homo sapien
tttttaataaccacactcatagatg

SEQ ID NO: 466570 - DNA, 25 bp, Homo sapien
actcatagatggttttgattgttcc

SEQ ID NO: 466571 - DNA, 25 bp, Homo sapien
gattgttccagttgagtgattgtgt

SEQ ID NO: 466572 - DNA, 25 bp, Homo sapien
gttgagtgattgtgtatgtacgcat

SEQ ID NO: 466573 - DNA, 25 bp, Homo sapien
atgtacgcataggaatgttttgttc

SEQ ID NO: 466574 - DNA, 25 bp, Homo sapien
gtcgcctgcctgagtgacatccagc

SEQ ID NO: 466575 - DNA, 25 bp, Homo sapien
agcagctgtttctgccccacggaca

SEQ ID NO: 466576 - DNA, 25 bp, Homo sapien
ggaataggcccaatgatgtctttgc

SEQ ID NO: 466577 - DNA, 25 bp, Homo sapien
aatgatgtctttgcctaccggcagg

SEQ ID NO: 466578 - DNA, 25 bp, Homo sapien
ggtgggcctgcctgagtcacgcatc

SEQ ID NO: 466579 - DNA, 25 bp, Homo sapien
tgagtcacgcatcttcacagtcaac

SEQ ID NO: 466580 - DNA, 25 bp, Homo sapien
gggagagctcatccaggagctcata

SEQ ID NO: 466581 - DNA, 25 bp, Homo sapien
atccaggagctcataaagaaccaca

SEQ ID NO: 466582 - DNA, 25 bp, Homo sapien
agaaccacaaatccacgtatgagcg

SEQ ID NO: 466583 - DNA, 25 bp, Homo sapien
atccacgtatgagcggcttggtgaa

SEQ ID NO: 466584 - DNA, 25 bp, Homo sapien
ttggtgaagtggtcgagctcctctt

SEQ ID NO: 466585 - DNA, 25 bp, Homo sapien
taaccatcataaagacactgcctgt

SEQ ID NO: 466586 - DNA, 25 bp, Homo sapien
taaagacactgcctgtcttctagga

SEQ ID NO: 466587 - DNA, 25 bp, Homo sapien
ttctaggaatgaccaggcacccagc

SEQ ID NO: 466588 - DNA, 25 bp, Homo sapien
agctcccactggactccaatttttt

SEQ ID NO: 466589 - DNA, 25 bp, Homo sapien
ttcctgccttatttagaattctttg

SEQ ID NO: 466590 - DNA, 25 bp, Homo sapien
cagagacaagaagcccaaccttctg

SEQ ID NO: 466591 - DNA, 25 bp, Homo sapien
cctgggctgtgctgatagtgctgag

SEQ ID NO: 466592 - DNA, 25 bp, Homo sapien
gagggagataggaatttgctgctaa

SEQ ID NO: 466593 - DNA, 25 bp, Homo sapien
ggcttgcagctatccttcctgtgta

SEQ ID NO: 466594 - DNA, 25 bp, Homo sapien
cagctatccttcctgtgtatacaaa

SEQ ID NO: 466595 - DNA, 25 bp, Homo sapien
gctatccttcctgtgtatacaaata

SEQ ID NO: 466596 - DNA, 25 bp, Homo sapien
tttcgtttttatactaagaacaatg

SEQ ID NO: 466597 - DNA, 25 bp, Homo sapien
ttcgtttttatactaagaacaatgg

SEQ ID NO: 466598 - DNA, 25 bp, Homo sapien
tcgtttttatactaagaacaatgga

SEQ ID NO: 466599 - DNA, 25 bp, Homo sapien
tttatactaagaacaatggaaacat

SEQ ID NO: 466600 - DNA, 25 bp, Homo sapien
aatgaaaggatcaaaatcgctgaac

SEQ ID NO: 466601 - DNA, 25 bp, Homo sapien
atgaaaggatcaaaatcgctgaaca

SEQ ID NO: 466602 - DNA, 25 bp, Homo sapien
tgaaaggatcaaaatcgctgaacac

SEQ ID NO: 466603 - DNA, 25 bp, Homo sapien
gaaaggatcaaaatcgctgaacact

SEQ ID NO: 466604 - DNA, 25 bp, Homo sapien
aaaggatcaaaatcgctgaacacta

SEQ ID NO: 466605 - DNA, 25 bp, Homo sapien
aaggatcaaaatcgctgaacactaa

SEQ ID NO: 466606 - DNA, 25 bp, Homo sapien
aggatcaaaatcgctgaacactaaa

SEQ ID NO: 466607 - DNA, 25 bp, Homo sapien
cagtgtttactgtgatgggcagaac

SEQ ID NO: 466608 - DNA, 25 bp, Homo sapien
actgtgatgggcagaacagcctttt

SEQ ID NO: 466609 - DNA, 25 bp, Homo sapien
cagccttttgtatctaggagtccat

SEQ ID NO: 466610 - DNA, 25 bp, Homo sapien
tctaggagtccatttgagttctttc

SEQ ID NO: 466611 - DNA, 25 bp, Homo sapien
gagtccatttgagttctttccaata

SEQ ID NO: 466612 - DNA, 25 bp, Homo sapien
tatttccatatcgttcataaatgtg

SEQ ID NO: 466613 - DNA, 25 bp, Homo sapien
catatcgttcataaatgtgtctggg

SEQ ID NO: 466614 - DNA, 25 bp, Homo sapien
atatggatatcgctttgttttcctt

SEQ ID NO: 466615 - DNA, 25 bp, Homo sapien
tatatcttaagaacatagtatcatg

SEQ ID NO: 466616 - DNA, 25 bp, Homo sapien
gtatcatgaatggagtagacaggga

SEQ ID NO: 466617 - DNA, 25 bp, Homo sapien
aaagcattatctatgattgttgtat

SEQ ID NO: 466618 - DNA, 25 bp, Homo sapien
taatcccaacaaagttgcctatagt

SEQ ID NO: 466619 - DNA, 25 bp, Homo sapien
tttgcatgggtgtttaaatagttct

SEQ ID NO: 466620 - DNA, 25 bp, Homo sapien
gttctgttacgaatattgtccctgc

SEQ ID NO: 466621 - DNA, 25 bp, Homo sapien
tgaagcaagttgacagttccatcag

SEQ ID NO: 466622 - DNA, 25 bp, Homo sapien
gaatattgtccctgcacagttctaa

SEQ ID NO: 466623 - DNA, 25 bp, Homo sapien
gcacagttctaaattgtccttttat

SEQ ID NO: 466624 - DNA, 25 bp, Homo sapien
gatattctagtttcttcacaatgta

SEQ ID NO: 466625 - DNA, 25 bp, Homo sapien
cacaatgtagtgattatcagcctta

SEQ ID NO: 466626 - DNA, 25 bp, Homo sapien
ttatcagccttactaattaccttgt

SEQ ID NO: 466627 - DNA, 25 bp, Homo sapien
taattaccttgtagcctttcttaat

SEQ ID NO: 466628 - DNA, 25 bp, Homo sapien
gagttcaaccatcgtcattttaaac

SEQ ID NO: 466629 - DNA, 25 bp, Homo sapien
gagtgccgagaaagcatccgtggaa

SEQ ID NO: 466630 - DNA, 25 bp, Homo sapien
gaaacgctgacagagatgctgcaga

SEQ ID NO: 466631 - DNA, 25 bp, Homo sapien
gatgctgcagagctacatttcagaa

SEQ ID NO: 466632 - DNA, 25 bp, Homo sapien
tgccaagtcttactgtgagcacaca

SEQ ID NO: 466633 - DNA, 25 bp, Homo sapien
actgtccgatatcgtggtcacactt

SEQ ID NO: 466634 - DNA, 25 bp, Homo sapien
gtcacacttgttgagatgggtttca

SEQ ID NO: 466635 - DNA, 25 bp, Homo sapien
ggtttcaatgtggacactctccctg

SEQ ID NO: 466636 - DNA, 25 bp, Homo sapien
actctccctgcttatgcaaaacggt

SEQ ID NO: 466637 - DNA, 25 bp, Homo sapien
ttatgcaaaacggtctcagaggatg

SEQ ID NO: 466638 - DNA, 25 bp, Homo sapien
tcagaggatggtcatcactgctcct

SEQ ID NO: 466639 - DNA, 25 bp, Homo sapien
ctccggtgaccaatcagccagtgac

SEQ ID NO: 466640 - DNA, 25 bp, Homo sapien
tcttccccttgagcttcagagagga

SEQ ID NO: 466641 - DNA, 25 bp, Homo sapien
aggagagttggcatggttaaatctg

SEQ ID NO: 466642 - DNA, 25 bp, Homo sapien
gagagttggcatggttaaatctgaa

SEQ ID NO: 466643 - DNA, 25 bp, Homo sapien
gttggcatggttaaatctgaatggt

SEQ ID NO: 466644 - DNA, 25 bp, Homo sapien
ggttaaatctgaatggttacctcac

SEQ ID NO: 466645 - DNA, 25 bp, Homo sapien
gttaaatctgaatggttacctcact

SEQ ID NO: 466646 - DNA, 25 bp, Homo sapien
aaatctgaatggttacctcactgct

SEQ ID NO: 466647 - DNA, 25 bp, Homo sapien
aatctgaatggttacctcactgctg

SEQ ID NO: 466648 - DNA, 25 bp, Homo sapien
atctgaatggttacctcactgctga

SEQ ID NO: 466649 - DNA, 25 bp, Homo sapien
tctgaatggttacctcactgctgaa

SEQ ID NO: 466650 - DNA, 25 bp, Homo sapien
gggcgtggcacactcgcttgtgtgg

SEQ ID NO: 466651 - DNA, 25 bp, Homo sapien
gggactccagacctagagcgtaagt

SEQ ID NO: 466652 - DNA, 25 bp, Homo sapien
gactccagacctagagcgtaagtat

SEQ ID NO: 466653 - DNA, 25 bp, Homo sapien
gacctagagcgtaagtatggatgtt

SEQ ID NO: 466654 - DNA, 25 bp, Homo sapien
agtatggatgttgtggccctgtgtc

SEQ ID NO: 466655 - DNA, 25 bp, Homo sapien
tatggatgttgtggccctgtgtctt

SEQ ID NO: 466656 - DNA, 25 bp, Homo sapien
atgttgtggccctgtgtcttcctag

SEQ ID NO: 466657 - DNA, 25 bp, Homo sapien
gtggccctgtgtcttcctagtgtga

SEQ ID NO: 466658 - DNA, 25 bp, Homo sapien
cctgtgtcttcctagtgtgacccag

SEQ ID NO: 466659 - DNA, 25 bp, Homo sapien
gtgtcttcctagtgtgacccagcca

SEQ ID NO: 466660 - DNA, 25 bp, Homo sapien
tagtgtgacccagccaggagcggaa

SEQ ID NO: 466661 - DNA, 25 bp, Homo sapien
tcgctcatgtcgcccaggcttggag

SEQ ID NO: 466662 - DNA, 25 bp, Homo sapien
ggaacacttcacagtgcttgtctta

SEQ ID NO: 466663 - DNA, 25 bp, Homo sapien
tgcttgtcttacacagtccagccta

SEQ ID NO: 466664 - DNA, 25 bp, Homo sapien
ggcaagctcaagacaggatcctcca

SEQ ID NO: 466665 - DNA, 25 bp, Homo sapien
ggatcctccagacaccacagcaaaa

SEQ ID NO: 466666 - DNA, 25 bp, Homo sapien
gcaaaactccatgtgttccgttgtg

SEQ ID NO: 466667 - DNA, 25 bp, Homo sapien
catgtgttccgttgtgttgggaccg

SEQ ID NO: 466668 - DNA, 25 bp, Homo sapien
tccagccatactcgcaagaaacgtg

SEQ ID NO: 466669 - DNA, 25 bp, Homo sapien
aagaaacgtgtcctctccacagcta

SEQ ID NO: 466670 - DNA, 25 bp, Homo sapien
aaggaaagcttcctctacctcacag

SEQ ID NO: 466671 - DNA, 25 bp, Homo sapien
acagctcctaggcagattctaggca

SEQ ID NO: 466672 - DNA, 25 bp, Homo sapien
agatggcacaacacctaagcaccag

SEQ ID NO: 466673 - DNA, 25 bp, Homo sapien
gagttaggagcttctaacccgtcat

SEQ ID NO: 466674 - DNA, 25 bp, Homo sapien
acccgtcatggtttcaatacacatt

SEQ ID NO: 466675 - DNA, 25 bp, Homo sapien
ggtttcaatacacattcttcttttg

SEQ ID NO: 466676 - DNA, 25 bp, Homo sapien
cttttgccagcgcttctgaagagct

SEQ ID NO: 466677 - DNA, 25 bp, Homo sapien
tgaagagctgctctcacctctctgc

SEQ ID NO: 466678 - DNA, 25 bp, Homo sapien
acctctctgcatcccaatagatatc

SEQ ID NO: 466679 - DNA, 25 bp, Homo sapien
atagatatccccctatgtgcatgca

SEQ ID NO: 466680 - DNA, 25 bp, Homo sapien
acacctgcacactcacggctgaaat

SEQ ID NO: 466681 - DNA, 25 bp, Homo sapien
acggctgaaatctccctaacccagg

SEQ ID NO: 466682 - DNA, 25 bp, Homo sapien
gggaccttagcatgcctaagtgact

SEQ ID NO: 466683 - DNA, 25 bp, Homo sapien
gcatgcctaagtgactaaaccaata

SEQ ID NO: 466684 - DNA, 25 bp, Homo sapien
gagttaggagcttctaacccgtcat

SEQ ID NO: 466685 - DNA, 25 bp, Homo sapien
ttaggagcttctaacccgtcatggt

SEQ ID NO: 466686 - DNA, 25 bp, Homo sapien
taggagcttctaacccgtcatggtt

SEQ ID NO: 466687 - DNA, 25 bp, Homo sapien
acccgtcatggtttcaatacacatt

SEQ ID NO: 466688 - DNA, 25 bp, Homo sapien
gtcatggtttcaatacacattcttc

SEQ ID NO: 466689 - DNA, 25 bp, Homo sapien
ggtttcaatacacattcttcttttg

SEQ ID NO: 466690 - DNA, 25 bp, Homo sapien
ttcttcttttgccagcgcttctgaa

SEQ ID NO: 466691 - DNA, 25 bp, Homo sapien
cttcttttgccagcgcttctgaaga

SEQ ID NO: 466692 - DNA, 25 bp, Homo sapien
cttttgccagcgcttctgaagagct

SEQ ID NO: 466693 - DNA, 25 bp, Homo sapien
ttttgccagcgcttctgaagagctg

SEQ ID NO: 466694 - DNA, 25 bp, Homo sapien
ccctggaagtggagttaggagcttc

SEQ ID NO: 466695 - DNA, 25 bp, Homo sapien
cactgcttggcttgctgtcactata

SEQ ID NO: 466696 - DNA, 25 bp, Homo sapien
gcttggcttgctgtcactatagatt

SEQ ID NO: 466697 - DNA, 25 bp, Homo sapien
ttcccattttctagaattccataga

SEQ ID NO: 466698 - DNA, 25 bp, Homo sapien
ccatagaaatggactcatacagtgt

SEQ ID NO: 466699 - DNA, 25 bp, Homo sapien
atacagtgtatgtctggcctctttc

SEQ ID NO: 466700 - DNA, 25 bp, Homo sapien
ttcatcaggtgtttttgtgcatatc

SEQ ID NO: 466701 - DNA, 25 bp, Homo sapien
ttgtgcatatcagtactccattttt

SEQ ID NO: 466702 - DNA, 25 bp, Homo sapien
gatcccattgtatgggtggaccaca

SEQ ID NO: 466703 - DNA, 25 bp, Homo sapien
gggtggaccacaatacctgttgaat

SEQ ID NO: 466704 - DNA, 25 bp, Homo sapien
gaccacaatacctgttgaatacctg

SEQ ID NO: 466705 - DNA, 25 bp, Homo sapien
gttgttaccaggttttggccatgac

SEQ ID NO: 466706 - DNA, 25 bp, Homo sapien
ctgttcccgggctgcgttctgacac

SEQ ID NO: 466707 - DNA, 25 bp, Homo sapien
gggctgcgttctgacacctgtcgga

SEQ ID NO: 466708 - DNA, 25 bp, Homo sapien
ggctgcgttctgacacctgtcggat

SEQ ID NO: 466709 - DNA, 25 bp, Homo sapien
gcgttctgacacctgtcggatagta

SEQ ID NO: 466710 - DNA, 25 bp, Homo sapien
gttctgacacctgtcggatagtaaa

SEQ ID NO: 466711 - DNA, 25 bp, Homo sapien
ccacagtcctccagtgttttagacg

SEQ ID NO: 466712 - DNA, 25 bp, Homo sapien
tcctccagtgttttagacgcccagc

SEQ ID NO: 466713 - DNA, 25 bp, Homo sapien
acagtcctccaggtacctccgtcgg

SEQ ID NO: 466714 - DNA, 25 bp, Homo sapien
agtcctccaggtacctccgtcggca

SEQ ID NO: 466715 - DNA, 25 bp, Homo sapien
gtcctccaggtacctccgtcggcag

SEQ ID NO: 466716 - DNA, 25 bp, Homo sapien
tcctccaggtacctccgtcggcaga

SEQ ID NO: 466717 - DNA, 25 bp, Homo sapien
aaaagaatggttataggcagggcgt

SEQ ID NO: 466718 - DNA, 25 bp, Homo sapien
aaagaatggttataggcagggcgtg

SEQ ID NO: 466719 - DNA, 25 bp, Homo sapien
aagaatggttataggcagggcgtgg

SEQ ID NO: 466720 - DNA, 25 bp, Homo sapien
agaatggttataggcagggcgtggc

SEQ ID NO: 466721 - DNA, 25 bp, Homo sapien
aatggttataggcagggcgtggcgg

SEQ ID NO: 466722 - DNA, 25 bp, Homo sapien
atggttataggcagggcgtggcggc

SEQ ID NO: 466723 - DNA, 25 bp, Homo sapien
tggttataggcagggcgtggcggct

SEQ ID NO: 466724 - DNA, 25 bp, Homo sapien
ggttataggcagggcgtggcggctt

SEQ ID NO: 466725 - DNA, 25 bp, Homo sapien
tataggcagggcgtggcggcttaca

SEQ ID NO: 466726 - DNA, 25 bp, Homo sapien
ataggcagggcgtggcggcttacac

SEQ ID NO: 466727 - DNA, 25 bp, Homo sapien
taggcagggcgtggcggcttacacc

SEQ ID NO: 466728 - DNA, 25 bp, Homo sapien
aaagaagccaatcacgagtttatgt

SEQ ID NO: 466729 - DNA, 25 bp, Homo sapien
aagaagccaatcacgagtttatgtg

SEQ ID NO: 466730 - DNA, 25 bp, Homo sapien
gaagccaatcacgagtttatgtgaa

SEQ ID NO: 466731 - DNA, 25 bp, Homo sapien
aagccaatcacgagtttatgtgaaa

SEQ ID NO: 466732 - DNA, 25 bp, Homo sapien
gccaatcacgagtttatgtgaaatg

SEQ ID NO: 466733 - DNA, 25 bp, Homo sapien
caatcacgagtttatgtgaaatgtc

SEQ ID NO: 466734 - DNA, 25 bp, Homo sapien
ataggcaaatctgtgtatcagagac

SEQ ID NO: 466735 - DNA, 25 bp, Homo sapien
taggcaaatctgtgtatcagagaca

SEQ ID NO: 466736 - DNA, 25 bp, Homo sapien
ggcaaatctgtgtatcagagacaaa

SEQ ID NO: 466737 - DNA, 25 bp, Homo sapien
aatctgtgtatcagagacaaagcac

SEQ ID NO: 466738 - DNA, 25 bp, Homo sapien
ctgtgtatcagagacaaagcacatt

SEQ ID NO: 466739 - DNA, 25 bp, Homo sapien
ggtcgtagtaggtcacccttctaca

SEQ ID NO: 466740 - DNA, 25 bp, Homo sapien
taggtcacccttctacagcagctaa

SEQ ID NO: 466741 - DNA, 25 bp, Homo sapien
acagcagctaactagagtcctaact

SEQ ID NO: 466742 - DNA, 25 bp, Homo sapien
gagtcctaactaatgggatccagca

SEQ ID NO: 466743 - DNA, 25 bp, Homo sapien
atccagcagggccatttctccagag

SEQ ID NO: 466744 - DNA, 25 bp, Homo sapien
tctccagagggccagtatcctatta

SEQ ID NO: 466745 - DNA, 25 bp, Homo sapien
gactcttggaattcttaggttctac

SEQ ID NO: 466746 - DNA, 25 bp, Homo sapien
gtggaaggaccaatcacctctgata

SEQ ID NO: 466747 - DNA, 25 bp, Homo sapien
atcacctctgatattctgtggaagg

SEQ ID NO: 466748 - DNA, 25 bp, Homo sapien
gggtcaaattctgccctctgcattc

SEQ ID NO: 466749 - DNA, 25 bp, Homo sapien
ctctgcattctgtgcaacttgtata

SEQ ID NO: 466750 - DNA, 25 bp, Homo sapien
gtcttttctccctggttgattacac

SEQ ID NO: 466751 - DNA, 25 bp, Homo sapien
ccctggttgattacacattcggtga

SEQ ID NO: 466752 - DNA, 25 bp, Homo sapien
attcggtgagaatgcaattttgctt

SEQ ID NO: 466753 - DNA, 25 bp, Homo sapien
tttgcttacgatttccttggatcct

SEQ ID NO: 466754 - DNA, 25 bp, Homo sapien
cttggatcctcccatatagctaata

SEQ ID NO: 466755 - DNA, 25 bp, Homo sapien
attattaaagactccactgactcag

SEQ ID NO: 466756 - DNA, 25 bp, Homo sapien
gactcagtcatttcagatggttcaa

SEQ ID NO: 466757 - DNA, 25 bp, Homo sapien
cagatggttcaagatgccttcccct

SEQ ID NO: 466758 - DNA, 25 bp, Homo sapien
gccttcccctctccagattttttag

SEQ ID NO: 466759 - DNA, 25 bp, Homo sapien
atgcagtcgactgagatccactagt

SEQ ID NO: 466760 - DNA, 25 bp, Homo sapien
agtcgactgagatccactagttcta

SEQ ID NO: 466761 - DNA, 25 bp, Homo sapien
gatactgtaaagtccacacacacat

SEQ ID NO: 466762 - DNA, 25 bp, Homo sapien
tgttttcctgaaagtatggcatcaa

SEQ ID NO: 466763 - DNA, 25 bp, Homo sapien
aaccttgtcacaactgatttgaatg

SEQ ID NO: 466764 - DNA, 25 bp, Homo sapien
ggcttgtaatgtctcttttcatcat

SEQ ID NO: 466765 - DNA, 25 bp, Homo sapien
atatcagtggaacaggcagcgctac

SEQ ID NO: 466766 - DNA, 25 bp, Homo sapien
gcagcgctactcaagtcctaaggat

SEQ ID NO: 466767 - DNA, 25 bp, Homo sapien
caagtcctaaggattcctcagtgat

SEQ ID NO: 466768 - DNA, 25 bp, Homo sapien
gtgatcagtgatccagggccgttca

SEQ ID NO: 466769 - DNA, 25 bp, Homo sapien
agggccgttcatgaaccactgggct

SEQ ID NO: 466770 - DNA, 25 bp, Homo sapien
ccactgggctggatttgactgttga

SEQ ID NO: 466771 - DNA, 25 bp, Homo sapien
gagtgtggcagttaatgcccctcaa

SEQ ID NO: 466772 - DNA, 25 bp, Homo sapien
gaatcccagggtagtgcctattcac

SEQ ID NO: 466773 - DNA, 25 bp, Homo sapien
gtagtgcctattcactgggtggtct

SEQ ID NO: 466774 - DNA, 25 bp, Homo sapien
tgcctattcactgggtggtctcaga

SEQ ID NO: 466775 - DNA, 25 bp, Homo sapien
ctgggtggtctcagaagacttcccc

SEQ ID NO: 466776 - DNA, 25 bp, Homo sapien
caaagcgcggctgacaagggtgaca

SEQ ID NO: 466777 - DNA, 25 bp, Homo sapien
acaagggtgacagcgcctggaccgc

SEQ ID NO: 466778 - DNA, 25 bp, Homo sapien
tgtccgcggagctggtgctgaatag

SEQ ID NO: 466779 - DNA, 25 bp, Homo sapien
ttcaaggaaactggaagcgggaccg

SEQ ID NO: 466780 - DNA, 25 bp, Homo sapien
gggcgtgtgccagttacaaaagact

SEQ ID NO: 466781 - DNA, 25 bp, Homo sapien
aaaagactgtcttgaatcccagggt

SEQ ID NO: 466782 - DNA, 25 bp, Homo sapien
gactgtcttgaatcccagggtagtg

SEQ ID NO: 466783 - DNA, 25 bp, Homo sapien
aagcagcatatgctaatttactttt

SEQ ID NO: 466784 - DNA, 25 bp, Homo sapien
ttactttttcatatgatgatggtct

SEQ ID NO: 466785 - DNA, 25 bp, Homo sapien
atgatgatggtctaatggaagttac

SEQ ID NO: 466786 - DNA, 25 bp, Homo sapien
taatggaagttacatatgctttctt

SEQ ID NO: 466787 - DNA, 25 bp, Homo sapien
gctttcttttgtcctaactctgaaa

SEQ ID NO: 466788 - DNA, 25 bp, Homo sapien
gaaaagtatatgtcagagttctgga

SEQ ID NO: 466789 - DNA, 25 bp, Homo sapien
agagttctggaatatgtctttagcc

SEQ ID NO: 466790 - DNA, 25 bp, Homo sapien
atgtctttagccaagaattttattc

SEQ ID NO: 466791 - DNA, 25 bp, Homo sapien
atgtgtgtaactatagtgaacgcat

SEQ ID NO: 466792 - DNA, 25 bp, Homo sapien
gaacgcatagttttgcttatattat

SEQ ID NO: 466793 - DNA, 25 bp, Homo sapien
gcttatattatgtgatgtttgccaa

SEQ ID NO: 466794 - DNA, 25 bp, Homo sapien
actcaaccttccttaagtagtagat

SEQ ID NO: 466795 - DNA, 25 bp, Homo sapien
gtcaaagtggatgccaactgccctc

SEQ ID NO: 466796 - DNA, 25 bp, Homo sapien
caactgccctcacagaagacaactt

SEQ ID NO: 466797 - DNA, 25 bp, Homo sapien
acttttgggacttgataattcaggc

SEQ ID NO: 466798 - DNA, 25 bp, Homo sapien
ggacttgataattcaggcaggcatt

SEQ ID NO: 466799 - DNA, 25 bp, Homo sapien
ggcaggcattgtgattgtcataatt

SEQ ID NO: 466800 - DNA, 25 bp, Homo sapien
gattgtcataattaaggaagctgta

SEQ ID NO: 466801 - DNA, 25 bp, Homo sapien
gtaaggttagtagggctggcaactt

SEQ ID NO: 466802 - DNA, 25 bp, Homo sapien
tggcaactttggctctaccttacat

SEQ ID NO: 466803 - DNA, 25 bp, Homo sapien
cattttgtctggcactagtttctgt

SEQ ID NO: 466804 - DNA, 25 bp, Homo sapien
tgtctggcactagtttctgttgtat

SEQ ID NO: 466805 - DNA, 25 bp, Homo sapien
atcacctcgggcgtgtgggtctggt

SEQ ID NO: 466806 - DNA, 25 bp, Homo sapien
ggcgtgtgggtctggtccggcaaga

SEQ ID NO: 466807 - DNA, 25 bp, Homo sapien
aagacgctggagtcctggcgctccc

SEQ ID NO: 466808 - DNA, 25 bp, Homo sapien
acgctggagtcctggcgctccctgt

SEQ ID NO: 466809 - DNA, 25 bp, Homo sapien
gctgggccagcaagggcgccgcggt

SEQ ID NO: 466810 - DNA, 25 bp, Homo sapien
tctacagcgacgtcagcactggcct

SEQ ID NO: 466811 - DNA, 25 bp, Homo sapien
tacagcgacgtcagcactggcctga

SEQ ID NO: 466812 - DNA, 25 bp, Homo sapien
agcgacgtcagcactggcctgacgt

SEQ ID NO: 466813 - DNA, 25 bp, Homo sapien
tcagcactggcctgacgtggcggtc

SEQ ID NO: 466814 - DNA, 25 bp, Homo sapien
actggcctgacgtggcggtcgggca

SEQ ID NO: 466815 - DNA, 25 bp, Homo sapien
cgggcacggcgagctccgtgtctta

SEQ ID NO: 466816 - DNA, 25 bp, Homo sapien
ggctaccatgaataatgctactatg

SEQ ID NO: 466817 - DNA, 25 bp, Homo sapien
gctactatgaacttttgtgtacaaa

SEQ ID NO: 466818 - DNA, 25 bp, Homo sapien
gtgtacaaatcttatgtggacttgt

SEQ ID NO: 466819 - DNA, 25 bp, Homo sapien
tctcttggatgtatattcctaggag

SEQ ID NO: 466820 - DNA, 25 bp, Homo sapien
gaatggctggattatacagtaactc

SEQ ID NO: 466821 - DNA, 25 bp, Homo sapien
tacagtaactctttcctcataactt

SEQ ID NO: 466822 - DNA, 25 bp, Homo sapien
attatatccatctttcagaacccaa

SEQ ID NO: 466823 - DNA, 25 bp, Homo sapien
aaagtgttccaacatctcccactca

SEQ ID NO: 466824 - DNA, 25 bp, Homo sapien
ccaacatctcccactcaaaatgaat

SEQ ID NO: 466825 - DNA, 25 bp, Homo sapien
aaatgaatcttctccctagtactcc

SEQ ID NO: 466826 - DNA, 25 bp, Homo sapien
ctccctagtactcccattgtttagt

SEQ ID NO: 466827 - DNA, 25 bp, Homo sapien
gtgactaaatcagctaaaatggttg

SEQ ID NO: 466828 - DNA, 25 bp, Homo sapien
gctaaaatggttgcttgactaaatg

SEQ ID NO: 466829 - DNA, 25 bp, Homo sapien
gcttgactaaatgaacgagttactt

SEQ ID NO: 466830 - DNA, 25 bp, Homo sapien
gagttacttgatacatcgtgaacac

SEQ ID NO: 466831 - DNA, 25 bp, Homo sapien
catcgtgaacacattgaaggaaatt

SEQ ID NO: 466832 - DNA, 25 bp, Homo sapien
aaatggaattctggctcctgggtcc

SEQ ID NO: 466833 - DNA, 25 bp, Homo sapien
tcctgggtccctaaaaattgctgag

SEQ ID NO: 466834 - DNA, 25 bp, Homo sapien
cctaaaaattgctgagtgtgtttcc

SEQ ID NO: 466835 - DNA, 25 bp, Homo sapien
atattttgcctagatgtgttacagt

SEQ ID NO: 466836 - DNA, 25 bp, Homo sapien
gagaataaatggttgctgtaactta

SEQ ID NO: 466837 - DNA, 25 bp, Homo sapien
ggttgctgtaacttattatgattat

SEQ ID NO: 466838 - DNA, 25 bp, Homo sapien
attttcctaccatgagtggtagatt

SEQ ID NO: 466839 - DNA, 25 bp, Homo sapien
ggtagattaagtagcattgagtcat

SEQ ID NO: 466840 - DNA, 25 bp, Homo sapien
gtcatgtagtgaaagtaatgtccct

SEQ ID NO: 466841 - DNA, 25 bp, Homo sapien
ccttcttcataccatttcaatgcct

SEQ ID NO: 466842 - DNA, 25 bp, Homo sapien
tttcaatgcctctggtaagtcaaga

SEQ ID NO: 466843 - DNA, 25 bp, Homo sapien
gagaaagtctttgataatagcctat

SEQ ID NO: 466844 - DNA, 25 bp, Homo sapien
atagcctatttttaacacctctcac

SEQ ID NO: 466845 - DNA, 25 bp, Homo sapien
acctctcacccttgtttgtcagaaa

SEQ ID NO: 466846 - DNA, 25 bp, Homo sapien
ttgtcagaaagagcagacctcagat

SEQ ID NO: 466847 - DNA, 25 bp, Homo sapien
gcagacctcagattcagagacttta

SEQ ID NO: 466848 - DNA, 25 bp, Homo sapien
gactttagcaagcaaagatatccag

SEQ ID NO: 466849 - DNA, 25 bp, Homo sapien
gggcagtcataagctctgtttcccc

SEQ ID NO: 466850 - DNA, 25 bp, Homo sapien
tccccaaagccttcagcgaacgtga

SEQ ID NO: 466851 - DNA, 25 bp, Homo sapien
gcgaacgtgaaatgtgcgctaaacg

SEQ ID NO: 466852 - DNA, 25 bp, Homo sapien
gaaacctgtttaattctagatatag

SEQ ID NO: 466853 - DNA, 25 bp, Homo sapien
gaacgaggaccttgaatgagctata

SEQ ID NO: 466854 - DNA, 25 bp, Homo sapien
gagctatattcagggtatccggtat

SEQ ID NO: 466855 - DNA, 25 bp, Homo sapien
cagggtatccggtattttgtaatag

SEQ ID NO: 466856 - DNA, 25 bp, Homo sapien
gaataggaaaccttgttggctgtgg

SEQ ID NO: 466857 - DNA, 25 bp, Homo sapien
gttggctgtggaatatccgatgctt

SEQ ID NO: 466858 - DNA, 25 bp, Homo sapien
gaatatccgatgctttgaatcatgc

SEQ ID NO: 466859 - DNA, 25 bp, Homo sapien
ctgtgttgaataaacgtatctgcta

SEQ ID NO: 466860 - DNA, 25 bp, Homo sapien
tgggaactgtactggaagatttatg

SEQ ID NO: 466861 - DNA, 25 bp, Homo sapien
gaaagcatgtgaaattgcacctaaa

SEQ ID NO: 466862 - DNA, 25 bp, Homo sapien
gcatgtgaaattgcacctaaaattg

SEQ ID NO: 466863 - DNA, 25 bp, Homo sapien
gtgaaattgcacctaaaattgtgtt

SEQ ID NO: 466864 - DNA, 25 bp, Homo sapien
attgcacctaaaattgtgttattag

SEQ ID NO: 466865 - DNA, 25 bp, Homo sapien
gtgttattagtgactataagcagca

SEQ ID NO: 466866 - DNA, 25 bp, Homo sapien
gcagcaatgctaaatttattgtact

SEQ ID NO: 466867 - DNA, 25 bp, Homo sapien
gctaaatttattgtacttgatgaat

SEQ ID NO: 466868 - DNA, 25 bp, Homo sapien
gaatgtatttagtcacagttacttt

SEQ ID NO: 466869 - DNA, 25 bp, Homo sapien
tatttagtcacagttactttggttt

SEQ ID NO: 466870 - DNA, 25 bp, Homo sapien
gtgtttgtaatttgtactattgtgg

SEQ ID NO: 466871 - DNA, 25 bp, Homo sapien
gaagccagatttagccttctgttgt

SEQ ID NO: 466872 - DNA, 25 bp, Homo sapien
agccttctgttgtttggcaaaacct

SEQ ID NO: 466873 - DNA, 25 bp, Homo sapien
aaaacctcactcagagctttactcc

SEQ ID NO: 466874 - DNA, 25 bp, Homo sapien
actccctcagacctttctgagttta

SEQ ID NO: 466875 - DNA, 25 bp, Homo sapien
tgagtttaaccacagacatgatctt

SEQ ID NO: 466876 - DNA, 25 bp, Homo sapien
acagacatgatctttgctgtgctga

SEQ ID NO: 466877 - DNA, 25 bp, Homo sapien
tttgctgtgctgagaaacttgtgtc

SEQ ID NO: 466878 - DNA, 25 bp, Homo sapien
gagaaacttgtgtctacctggcctg

SEQ ID NO: 466879 - DNA, 25 bp, Homo sapien
gtctacctggcctgtagggagtgta

SEQ ID NO: 466880 - DNA, 25 bp, Homo sapien
atatcaactcctaagaggtcagcag

SEQ ID NO: 466881 - DNA, 25 bp, Homo sapien
gtccttataagaatagctggtgctc

SEQ ID NO: 466882 - DNA, 25 bp, Homo sapien
tctgctggagcagggtgtaggaagt

SEQ ID NO: 466883 - DNA, 25 bp, Homo sapien
gggtgtaggaagtgtgcccagaata

SEQ ID NO: 466884 - DNA, 25 bp, Homo sapien
aatgtataccaaggaggttcaccag

SEQ ID NO: 466885 - DNA, 25 bp, Homo sapien
gtataccaaggaggttcaccagtgt

SEQ ID NO: 466886 - DNA, 25 bp, Homo sapien
ataccaaggaggttcaccagtgttg

SEQ ID NO: 466887 - DNA, 25 bp, Homo sapien
accaaggaggttcaccagtgttgtt

SEQ ID NO: 466888 - DNA, 25 bp, Homo sapien
aaggaggttcaccagtgttgttgat

SEQ ID NO: 466889 - DNA, 25 bp, Homo sapien
ggaggttcaccagtgttgttgataa

SEQ ID NO: 466890 - DNA, 25 bp, Homo sapien
ggttcaccagtgttgttgataatca

SEQ ID NO: 466891 - DNA, 25 bp, Homo sapien
ttcaccagtgttgttgataatcaga

SEQ ID NO: 466892 - DNA, 25 bp, Homo sapien
caccagtgttgttgataatcagaaa

SEQ ID NO: 466893 - DNA, 25 bp, Homo sapien
agtatgactactggtccccaccttt

SEQ ID NO: 466894 - DNA, 25 bp, Homo sapien
cacccattcattcatgaccattttt

SEQ ID NO: 466895 - DNA, 25 bp, Homo sapien
tgaccatttttcactaccaagctcc

SEQ ID NO: 466896 - DNA, 25 bp, Homo sapien
gaggctgaggtttttgtgactctct

SEQ ID NO: 466897 - DNA, 25 bp, Homo sapien
ggtttttgtgactctctagactcta

SEQ ID NO: 466898 - DNA, 25 bp, Homo sapien
gtgactctctagactctattgtggg

SEQ ID NO: 466899 - DNA, 25 bp, Homo sapien
ctctagactctattgtgggatggaa

SEQ ID NO: 466900 - DNA, 25 bp, Homo sapien
ggaatgaacattgctaaagaatctt

SEQ ID NO: 466901 - DNA, 25 bp, Homo sapien
aaagaatcttgtgttcgctttactt

SEQ ID NO: 466902 - DNA, 25 bp, Homo sapien
ctgatgtgtcagttacggaaaaatt

SEQ ID NO: 466903 - DNA, 25 bp, Homo sapien
gaaatgcagcacaaatacatgaata

SEQ ID NO: 466904 - DNA, 25 bp, Homo sapien
agctccagcctgatatggaggcaca

SEQ ID NO: 466905 - DNA, 25 bp, Homo sapien
tggaggcacattatcctggagccca

SEQ ID NO: 466906 - DNA, 25 bp, Homo sapien
acattatcctggagcccacgaagag

SEQ ID NO: 466907 - DNA, 25 bp, Homo sapien
gaaacattaatgtactcacgtccaa

SEQ ID NO: 466908 - DNA, 25 bp, Homo sapien
taatgtactcacgtccaaggaaggt

SEQ ID NO: 466909 - DNA, 25 bp, Homo sapien
aaagctaatttacatgctgaacctg

SEQ ID NO: 466910 - DNA, 25 bp, Homo sapien
catgctgaacctgactatttagaag

SEQ ID NO: 466911 - DNA, 25 bp, Homo sapien
aatgctgtgattctgttttaagtcc

SEQ ID NO: 466912 - DNA, 25 bp, Homo sapien
tctgttttaagtccataccttgtaa

SEQ ID NO: 466913 - DNA, 25 bp, Homo sapien
ataagtgccttacgtgagtgtgtca

SEQ ID NO: 466914 - DNA, 25 bp, Homo sapien
gagtgtgtcatcaatcagaacctaa

SEQ ID NO: 466915 - DNA, 25 bp, Homo sapien
gccaacatgattttctcatttcggg

SEQ ID NO: 466916 - DNA, 25 bp, Homo sapien
atttcgggaggaactctgttgcttc

SEQ ID NO: 466917 - DNA, 25 bp, Homo sapien
actctgttgcttcgcctggacaaga

SEQ ID NO: 466918 - DNA, 25 bp, Homo sapien
aaaatgctgatttcctccttgggta

SEQ ID NO: 466919 - DNA, 25 bp, Homo sapien
aggcgagaacaagcactctaattcc

SEQ ID NO: 466920 - DNA, 25 bp, Homo sapien
acaagcactctaattccagtgggct

SEQ ID NO: 466921 - DNA, 25 bp, Homo sapien
tcagctttacaacaatccctagagg

SEQ ID NO: 466922 - DNA, 25 bp, Homo sapien
tagaggctcgaccacagaataatgc

SEQ ID NO: 466923 - DNA, 25 bp, Homo sapien
agaataatgccagtcaccaccctga

SEQ ID NO: 466924 - DNA, 25 bp, Homo sapien
gaacgcacaatctccagtgcaggat

SEQ ID NO: 466925 - DNA, 25 bp, Homo sapien
gtgcaggatctaatgactgtacata

SEQ ID NO: 466926 - DNA, 25 bp, Homo sapien
tccgtggttaccaaatcggccaaga

SEQ ID NO: 466927 - DNA, 25 bp, Homo sapien
taccaaatcggccaagaagctcaga

SEQ ID NO: 466928 - DNA, 25 bp, Homo sapien
agcagtaatgcagcagtaagccgaa

SEQ ID NO: 466929 - DNA, 25 bp, Homo sapien
aagccgaaaggatgaagagttagac

SEQ ID NO: 466930 - DNA, 25 bp, Homo sapien
tgaagagttagaccccatggaccct

SEQ ID NO: 466931 - DNA, 25 bp, Homo sapien
atggaccctagctcatactcagacg

SEQ ID NO: 466932 - DNA, 25 bp, Homo sapien
gtggtcaacaggactccccaagcgg

SEQ ID NO: 466933 - DNA, 25 bp, Homo sapien
ccccaagcggaatgaggccaagact

SEQ ID NO: 466934 - DNA, 25 bp, Homo sapien
atgaggccaagactggcgctgacac

SEQ ID NO: 466935 - DNA, 25 bp, Homo sapien
gcagcaggattgaagcttcggcctc

SEQ ID NO: 466936 - DNA, 25 bp, Homo sapien
aggattgaagcttcggcctccctgg

SEQ ID NO: 466937 - DNA, 25 bp, Homo sapien
gagccaaaccctagggctcaatgaa

SEQ ID NO: 466938 - DNA, 25 bp, Homo sapien
agccaaaccctagggctcaatgaaa

SEQ ID NO: 466939 - DNA, 25 bp, Homo sapien
gccaaaccctagggctcaatgaaaa

SEQ ID NO: 466940 - DNA, 25 bp, Homo sapien
tgaaaaccagacgtaaggctgggtg

SEQ ID NO: 466941 - DNA, 25 bp, Homo sapien
gaaaaccagacgtaaggctgggtgc

SEQ ID NO: 466942 - DNA, 25 bp, Homo sapien
aaaaccagacgtaaggctgggtgca

SEQ ID NO: 466943 - DNA, 25 bp, Homo sapien
aaaccagacgtaaggctgggtgcat

SEQ ID NO: 466944 - DNA, 25 bp, Homo sapien
aaccagacgtaaggctgggtgcatt

SEQ ID NO: 466945 - DNA, 25 bp, Homo sapien
accagacgtaaggctgggtgcattg

SEQ ID NO: 466946 - DNA, 25 bp, Homo sapien
accacctgtgctgcagtccggaggg

SEQ ID NO: 466947 - DNA, 25 bp, Homo sapien
tttcgtcaccacctgagggcatgag

SEQ ID NO: 466948 - DNA, 25 bp, Homo sapien
gtcaccacctgagggcatgagcaca

SEQ ID NO: 466949 - DNA, 25 bp, Homo sapien
gcctggtgagtctgcctgtggttca

SEQ ID NO: 466950 - DNA, 25 bp, Homo sapien
tgtggttcaggcttagcctgtggtc

SEQ ID NO: 466951 - DNA, 25 bp, Homo sapien
ctgtgtgctgctgcccgcatgggat

SEQ ID NO: 466952 - DNA, 25 bp, Homo sapien
gtggttgggatacaccggatacctc

SEQ ID NO: 466953 - DNA, 25 bp, Homo sapien
ggttgggatacaccggatacctctg

SEQ ID NO: 466954 - DNA, 25 bp, Homo sapien
gggatacaccggatacctctgctct

SEQ ID NO: 466955 - DNA, 25 bp, Homo sapien
atacctctgctctcattgcttgttt

SEQ ID NO: 466956 - DNA, 25 bp, Homo sapien
tatggacatttgtgtgctaaatcct

SEQ ID NO: 466957 - DNA, 25 bp, Homo sapien
gctctgcctgatcggtgagggcggg

SEQ ID NO: 466958 - DNA, 25 bp, Homo sapien
ctctgcctgatcggtgagggcgggg

SEQ ID NO: 466959 - DNA, 25 bp, Homo sapien
ggctgggctcttccagggtgggaac

SEQ ID NO: 466960 - DNA, 25 bp, Homo sapien
gctgggctcttccagggtgggaaca

SEQ ID NO: 466961 - DNA, 25 bp, Homo sapien
ctgggctcttccagggtgggaacac

SEQ ID NO: 466962 - DNA, 25 bp, Homo sapien
tgggctcttccagggtgggaacaca

SEQ ID NO: 466963 - DNA, 25 bp, Homo sapien
gggctcttccagggtgggaacacag

SEQ ID NO: 466964 - DNA, 25 bp, Homo sapien
ggctcttccagggtgggaacacagg

SEQ ID NO: 466965 - DNA, 25 bp, Homo sapien
gctcttccagggtgggaacacagga

SEQ ID NO: 466966 - DNA, 25 bp, Homo sapien
tgggaacacaggagaccacctcctt

SEQ ID NO: 466967 - DNA, 25 bp, Homo sapien
tgctggagagggaaaattttcgttt

SEQ ID NO: 466968 - DNA, 25 bp, Homo sapien
tttcgtttttatactaagaacaatg

SEQ ID NO: 466969 - DNA, 25 bp, Homo sapien
tcgtttttatactaagaacaatgga

SEQ ID NO: 466970 - DNA, 25 bp, Homo sapien
tttatactaagaacaatggaaacat

SEQ ID NO: 466971 - DNA, 25 bp, Homo sapien
aatgaaaggatcaaaatcgctgaac

SEQ ID NO: 466972 - DNA, 25 bp, Homo sapien
atgaaaggatcaaaatcgctgaaca

SEQ ID NO: 466973 - DNA, 25 bp, Homo sapien
tgaaaggatcaaaatcgctgaacac

SEQ ID NO: 466974 - DNA, 25 bp, Homo sapien
gaaaggatcaaaatcgctgaacact

SEQ ID NO: 466975 - DNA, 25 bp, Homo sapien
aaaggatcaaaatcgctgaacacta

SEQ ID NO: 466976 - DNA, 25 bp, Homo sapien
aaggatcaaaatcgctgaacactaa

SEQ ID NO: 466977 - DNA, 25 bp, Homo sapien
aggatcaaaatcgctgaacactaaa

SEQ ID NO: 466978 - DNA, 25 bp, Homo sapien
tccgtggttaccaaatcggccaaga

SEQ ID NO: 466979 - DNA, 25 bp, Homo sapien
cgtggttaccaaatcggccaagaag

SEQ ID NO: 466980 - DNA, 25 bp, Homo sapien
tggttaccaaatcggccaagaagct

SEQ ID NO: 466981 - DNA, 25 bp, Homo sapien
taccaaatcggccaagaagctcaga

SEQ ID NO: 466982 - DNA, 25 bp, Homo sapien
ggaccctagctcatactcagacgcc

SEQ ID NO: 466983 - DNA, 25 bp, Homo sapien
ccccaagcggaatgaggccaagact

SEQ ID NO: 466984 - DNA, 25 bp, Homo sapien
caagcggaatgaggccaagactggc

SEQ ID NO: 466985 - DNA, 25 bp, Homo sapien
aatgaggccaagactggcgctgaca

SEQ ID NO: 466986 - DNA, 25 bp, Homo sapien
tgaggccaagactggcgctgacacc

SEQ ID NO: 466987 - DNA, 25 bp, Homo sapien
agcagcggccgtatccatccccagg

SEQ ID NO: 466988 - DNA, 25 bp, Homo sapien
ggctgtgctccgggccaatgcagag

SEQ ID NO: 466989 - DNA, 25 bp, Homo sapien
tatagaacctatcagcaactagaaa

SEQ ID NO: 466990 - DNA, 25 bp, Homo sapien
agagtattcagtgcttccaaagtgg

SEQ ID NO: 466991 - DNA, 25 bp, Homo sapien
acaacaataggtacacagagagcag

SEQ ID NO: 466992 - DNA, 25 bp, Homo sapien
catttatgtgtcagtgttttccaac

SEQ ID NO: 466993 - DNA, 25 bp, Homo sapien
gtgtcagtgttttccaactacttag

SEQ ID NO: 466994 - DNA, 25 bp, Homo sapien
aactacttagagtttatgtacctcg

SEQ ID NO: 466995 - DNA, 25 bp, Homo sapien
agtttatgtacctcgtgatttcttg

SEQ ID NO: 466996 - DNA, 25 bp, Homo sapien
attgaattccattgtggcgtagatg

SEQ ID NO: 466997 - DNA, 25 bp, Homo sapien
attgtggcgtagatggatatgttga

SEQ ID NO: 466998 - DNA, 25 bp, Homo sapien
gttgataacatagaagacctgagga

SEQ ID NO: 466999 - DNA, 25 bp, Homo sapien
gaagacctgaggattatagaaccta

SEQ ID NO: 467000 - DNA, 25 bp, Homo sapien
ttcagacctgacaagattctttgaa

SEQ ID NO: 467001 - DNA, 25 bp, Homo sapien
tcagacctgacaagattctttgaat

SEQ ID NO: 467002 - DNA, 25 bp, Homo sapien
cagacctgacaagattctttgaata

SEQ ID NO: 467003 - DNA, 25 bp, Homo sapien
agacctgacaagattctttgaatac

SEQ ID NO: 467004 - DNA, 25 bp, Homo sapien
gacctgacaagattctttgaataca

SEQ ID NO: 467005 - DNA, 25 bp, Homo sapien
ttctttgaatacagataatgaatgt

SEQ ID NO: 467006 - DNA, 25 bp, Homo sapien
aacaattaactgtttataataactg

SEQ ID NO: 467007 - DNA, 25 bp, Homo sapien
acaattaactgtttataataactgt

SEQ ID NO: 467008 - DNA, 25 bp, Homo sapien
caattaactgtttataataactgta

SEQ ID NO: 467009 - DNA, 25 bp, Homo sapien
aattaactgtttataataactgtat

SEQ ID NO: 467010 - DNA, 25 bp, Homo sapien
attaactgtttataataactgtata

SEQ ID NO: 467011 - DNA, 25 bp, Homo sapien
gattctttgtcttcatgttaactga

SEQ ID NO: 467012 - DNA, 25 bp, Homo sapien
ggatctaaaactttattcttctctc

SEQ ID NO: 467013 - DNA, 25 bp, Homo sapien
attcttctctctcatattactcaaa

SEQ ID NO: 467014 - DNA, 25 bp, Homo sapien
acattttgtaacgttcagccatcag

SEQ ID NO: 467015 - DNA, 25 bp, Homo sapien
gtaacgttcagccatcagatttagt

SEQ ID NO: 467016 - DNA, 25 bp, Homo sapien
tgcagttaagtgtcaagcaacctct

SEQ ID NO: 467017 - DNA, 25 bp, Homo sapien
aagcaacctctattttaccaagcaa

SEQ ID NO: 467018 - DNA, 25 bp, Homo sapien
agcaacgtgagttatccgcttttca

SEQ ID NO: 467019 - DNA, 25 bp, Homo sapien
ttatccgcttttcagaggtgctgat

SEQ ID NO: 467020 - DNA, 25 bp, Homo sapien
aggtgctgattttgcctctaaattt

SEQ ID NO: 467021 - DNA, 25 bp, Homo sapien
gcctctaaattttgtcctaaggatt

SEQ ID NO: 467022 - DNA, 25 bp, Homo sapien
taatagaggttcttgttttgtaagg

SEQ ID NO: 467023 - DNA, 25 bp, Homo sapien
aggttttagtgtcttgactgaatgt

SEQ ID NO: 467024 - DNA, 25 bp, Homo sapien
gtgtcttgactgaatgttaaatgca

SEQ ID NO: 467025 - DNA, 25 bp, Homo sapien
gaatgttaaatgcaaagctgcttac

SEQ ID NO: 467026 - DNA, 25 bp, Homo sapien
atgtttcctgacaatacttgatttg

SEQ ID NO: 467027 - DNA, 25 bp, Homo sapien
gggcctttccaccttatgttatata

SEQ ID NO: 467028 - DNA, 25 bp, Homo sapien
aatgtaagtctcataagctggttgc

SEQ ID NO: 467029 - DNA, 25 bp, Homo sapien
ataagctggttgctcccttggcagt

SEQ ID NO: 467030 - DNA, 25 bp, Homo sapien
ggttgctcccttggcagttttcttt

SEQ ID NO: 467031 - DNA, 25 bp, Homo sapien
cccttggcagttttctttgctctgt

SEQ ID NO: 467032 - DNA, 25 bp, Homo sapien
tttttggttgtcattctcctatccc

SEQ ID NO: 467033 - DNA, 25 bp, Homo sapien
agttagccagactgtttttaaagca

SEQ ID NO: 467034 - DNA, 25 bp, Homo sapien
tttaaagcacctggcgggaagcaga

SEQ ID NO: 467035 - DNA, 25 bp, Homo sapien
aaggttggatccaagcccttgttca

SEQ ID NO: 467036 - DNA, 25 bp, Homo sapien
ggatccaagcccttgttcagatttg

SEQ ID NO: 467037 - DNA, 25 bp, Homo sapien
aagcccttgttcagatttggtgcct

SEQ ID NO: 467038 - DNA, 25 bp, Homo sapien
ccttgttcagatttggtgcctgata

SEQ ID NO: 467039 - DNA, 25 bp, Homo sapien
ttcagatttggtgcctgataagaca

SEQ ID NO: 467040 - DNA, 25 bp, Homo sapien
tttctctttttgtgacctttattat

SEQ ID NO: 467041 - DNA, 25 bp, Homo sapien
ctgttgtaaccagttagctgttgtg

SEQ ID NO: 467042 - DNA, 25 bp, Homo sapien
accagttagctgttgtgttttaaga

SEQ ID NO: 467043 - DNA, 25 bp, Homo sapien
aagggcattgatagcataccaaaca

SEQ ID NO: 467044 - DNA, 25 bp, Homo sapien
aggaaccggtggagaccgaccgcat

SEQ ID NO: 467045 - DNA, 25 bp, Homo sapien
ggtggagaccgaccgcatcatcagc

SEQ ID NO: 467046 - DNA, 25 bp, Homo sapien
agaccgaccgcatcatcagccagtg

SEQ ID NO: 467047 - DNA, 25 bp, Homo sapien
atcatcagccagtgcggccgtctca

SEQ ID NO: 467048 - DNA, 25 bp, Homo sapien
atgagcacgccgtgcagctcggtgc

SEQ ID NO: 467049 - DNA, 25 bp, Homo sapien
ggagaatggcatcagaactggcaat

SEQ ID NO: 467050 - DNA, 25 bp, Homo sapien
tcagaactggcaatgagcaactccg

SEQ ID NO: 467051 - DNA, 25 bp, Homo sapien
aactggcaatgagcaactccgacct

SEQ ID NO: 467052 - DNA, 25 bp, Homo sapien
tggcaatgagcaactccgacctgcc

SEQ ID NO: 467053 - DNA, 25 bp, Homo sapien
gaatatgttaatgacttcgatctga

SEQ ID NO: 467054 - DNA, 25 bp, Homo sapien
tcgatctgatgaagtttgaagtgaa

SEQ ID NO: 467055 - DNA, 25 bp, Homo sapien
atcctgtgtgccataataaaatagt

SEQ ID NO: 467056 - DNA, 25 bp, Homo sapien
atgtacatggtaagtctcaaacaga

SEQ ID NO: 467057 - DNA, 25 bp, Homo sapien
ggtaagtctcaaacagatgcaagct

SEQ ID NO: 467058 - DNA, 25 bp, Homo sapien
gtctcaaacagatgcaagctatgtg

SEQ ID NO: 467059 - DNA, 25 bp, Homo sapien
gcaagctatgtgcaaaaagtaactt

SEQ ID NO: 467060 - DNA, 25 bp, Homo sapien
gccaaatggaaatagctggatgctt

SEQ ID NO: 467061 - DNA, 25 bp, Homo sapien
tagctggatgctttgagaattactt

SEQ ID NO: 467062 - DNA, 25 bp, Homo sapien
atgctttgagaattacttggttgaa

SEQ ID NO: 467063 - DNA, 25 bp, Homo sapien
aagaaaactgtaccatcctctatcc

SEQ ID NO: 467064 - DNA, 25 bp, Homo sapien
aactgtaccatcctctatcctgtgt

SEQ ID NO: 467065 - DNA, 25 bp, Homo sapien
taccatcctctatcctgtgtgccat

SEQ ID NO: 467066 - DNA, 25 bp, Homo sapien
tggaacctcggttcaaacctgagtt

SEQ ID NO: 467067 - DNA, 25 bp, Homo sapien
agttgtaatactcactcttcctgtt

SEQ ID NO: 467068 - DNA, 25 bp, Homo sapien
gtaatactcactcttcctgttgctg

SEQ ID NO: 467069 - DNA, 25 bp, Homo sapien
cttcctgttgctgcctatgtaattt

SEQ ID NO: 467070 - DNA, 25 bp, Homo sapien
ctgttgctgcctatgtaattttgta

SEQ ID NO: 467071 - DNA, 25 bp, Homo sapien
gctgcctatgtaattttgtagaagt

SEQ ID NO: 467072 - DNA, 25 bp, Homo sapien
agaagttacctaattgcttccaagc

SEQ ID NO: 467073 - DNA, 25 bp, Homo sapien
tgcttccaagcttctgttggatttt

SEQ ID NO: 467074 - DNA, 25 bp, Homo sapien
ccaagcttctgttggattttttgag

SEQ ID NO: 467075 - DNA, 25 bp, Homo sapien
ggattttttgagaactgaatgacat

SEQ ID NO: 467076 - DNA, 25 bp, Homo sapien
gcttaatgtattgctttgtgcatgg

SEQ ID NO: 467077 - DNA, 25 bp, Homo sapien
gcgcggccgagggagcaaagggctc

SEQ ID NO: 467078 - DNA, 25 bp, Homo sapien
aaagggctcggcactcgggcccctg

SEQ ID NO: 467079 - DNA, 25 bp, Homo sapien
gggcctcgtggcgacgggcagcagc

SEQ ID NO: 467080 - DNA, 25 bp, Homo sapien
gcgccggctctgcttcggcgggcgg

SEQ ID NO: 467081 - DNA, 25 bp, Homo sapien
ggcgggcggctctaggctggcggca

SEQ ID NO: 467082 - DNA, 25 bp, Homo sapien
ggcggctctaggctggcggcagcag

SEQ ID NO: 467083 - DNA, 25 bp, Homo sapien
ggacaggtctttgtgctgggcccca

SEQ ID NO: 467084 - DNA, 25 bp, Homo sapien
gacaggtctttgtgctgggccccac

SEQ ID NO: 467085 - DNA, 25 bp, Homo sapien
acaggtctttgtgctgggccccacg

SEQ ID NO: 467086 - DNA, 25 bp, Homo sapien
caggtctttgtgctgggccccacgc

SEQ ID NO: 467087 - DNA, 25 bp, Homo sapien
aggtctttgtgctgggccccacgcg

SEQ ID NO: 467088 - DNA, 25 bp, Homo sapien
attcacttcaaggtcttgtgcctat

SEQ ID NO: 467089 - DNA, 25 bp, Homo sapien
tcaaggtcttgtgcctatttttctg

SEQ ID NO: 467090 - DNA, 25 bp, Homo sapien
gcctatttttctgcatatcttctgt

SEQ ID NO: 467091 - DNA, 25 bp, Homo sapien
atcttctgtgatgacaaatctctgt

SEQ ID NO: 467092 - DNA, 25 bp, Homo sapien
tctctgtcccctgagtgttaatttg

SEQ ID NO: 467093 - DNA, 25 bp, Homo sapien
gtcccctgagtgttaatttgatttt

SEQ ID NO: 467094 - DNA, 25 bp, Homo sapien
tatggagactgagctgcatggtagt

SEQ ID NO: 467095 - DNA, 25 bp, Homo sapien
gggatcaaaaatatgtgaccttaat

SEQ ID NO: 467096 - DNA, 25 bp, Homo sapien
aatatgtgaccttaatgagattttt

SEQ ID NO: 467097 - DNA, 25 bp, Homo sapien
aagcagtttttagagttgagttcca

SEQ ID NO: 467098 - DNA, 25 bp, Homo sapien
gtttttagagttgagttccagagag

SEQ ID NO: 467099 - DNA, 25 bp, Homo sapien
gaacgcttcacacgttataaaaaag

SEQ ID NO: 467100 - DNA, 25 bp, Homo sapien
acaacagctgtgtagggtagctagc

SEQ ID NO: 467101 - DNA, 25 bp, Homo sapien
ggctgagaatctaacaggtgtgacc

SEQ ID NO: 467102 - DNA, 25 bp, Homo sapien
gacagatatttgtgcatttctgcat

SEQ ID NO: 467103 - DNA, 25 bp, Homo sapien
gcattttctaagtttgctgcaatga

SEQ ID NO: 467104 - DNA, 25 bp, Homo sapien
atgagcatgtattactttcatagtt

SEQ ID NO: 467105 - DNA, 25 bp, Homo sapien
aacacatgcaaaatgcccttttaaa

SEQ ID NO: 467106 - DNA, 25 bp, Homo sapien
aggtgtgaccaattctgctactgaa

SEQ ID NO: 467107 - DNA, 25 bp, Homo sapien
gaatgagagcagaagcctgtgaact

SEQ ID NO: 467108 - DNA, 25 bp, Homo sapien
gaagcctgtgaacttccagttaata

SEQ ID NO: 467109 - DNA, 25 bp, Homo sapien
gaacttccagttaatagaccactta

SEQ ID NO: 467110 - DNA, 25 bp, Homo sapien
cgtcccaaaagaggcggtgtagagc

SEQ ID NO: 467111 - DNA, 25 bp, Homo sapien
gagactaatggataaacctacaagt

SEQ ID NO: 467112 - DNA, 25 bp, Homo sapien
ggccaatgacttttgaatagggttt

SEQ ID NO: 467113 - DNA, 25 bp, Homo sapien
gcctttcttcctgtttggttcattg

SEQ ID NO: 467114 - DNA, 25 bp, Homo sapien
cttcctgtttggttcattgtattgt

SEQ ID NO: 467115 - DNA, 25 bp, Homo sapien
gtattaggttaagctctactagggt

SEQ ID NO: 467116 - DNA, 25 bp, Homo sapien
gctctactagggtaatgaaggctct

SEQ ID NO: 467117 - DNA, 25 bp, Homo sapien
tgaaggctctacttttcacttttta

SEQ ID NO: 467118 - DNA, 25 bp, Homo sapien
aaattcctgagtatcaagacgtgca

SEQ ID NO: 467119 - DNA, 25 bp, Homo sapien
gtatcaagacgtgcaggtcatgctt

SEQ ID NO: 467120 - DNA, 25 bp, Homo sapien
gtgcaggtcatgctttggagcctat

SEQ ID NO: 467121 - DNA, 25 bp, Homo sapien
aatctaagttccattttcccgtcat

SEQ ID NO: 467122 - DNA, 25 bp, Homo sapien
ttcccgtcatgtttattaatttgtc

SEQ ID NO: 467123 - DNA, 25 bp, Homo sapien
ccgtcatgtttattaatttgtccca

SEQ ID NO: 467124 - DNA, 25 bp, Homo sapien
gtttattaatttgtcccattgcaag

SEQ ID NO: 467125 - DNA, 25 bp, Homo sapien
taatttgtcccattgcaagatatgt

SEQ ID NO: 467126 - DNA, 25 bp, Homo sapien
tttgtcccattgcaagatatgtttc

SEQ ID NO: 467127 - DNA, 25 bp, Homo sapien
gtcccattgcaagatatgtttctgt

SEQ ID NO: 467128 - DNA, 25 bp, Homo sapien
gcaagatatgtttctgttgtctgca

SEQ ID NO: 467129 - DNA, 25 bp, Homo sapien
agatatgtttctgttgtctgcatgg

SEQ ID NO: 467130 - DNA, 25 bp, Homo sapien
atatgtttctgttgtctgcatgggt

SEQ ID NO: 467131 - DNA, 25 bp, Homo sapien
gtctgcatgggtagagataatttta

SEQ ID NO: 467132 - DNA, 25 bp, Homo sapien
ggcatattctgtcaccctcccgtgg

SEQ ID NO: 467133 - DNA, 25 bp, Homo sapien
cccattccccagttaaagtgtgtct

SEQ ID NO: 467134 - DNA, 25 bp, Homo sapien
aaagtgtgtctctgtaccttacaac

SEQ ID NO: 467135 - DNA, 25 bp, Homo sapien
gtgtctctgtaccttacaacagcga

SEQ ID NO: 467136 - DNA, 25 bp, Homo sapien
tacaacagcgattcaggacccaagt

SEQ ID NO: 467137 - DNA, 25 bp, Homo sapien
ttcaggacccaagtgtgaacaacac

SEQ ID NO: 467138 - DNA, 25 bp, Homo sapien
ccctctggagcgtgtgctgtcttta

SEQ ID NO: 467139 - DNA, 25 bp, Homo sapien
agtgtgtcattaacctttctgtctc

SEQ ID NO: 467140 - DNA, 25 bp, Homo sapien
tttctgtctctttgcgccataaaaa

SEQ ID NO: 467141 - DNA, 25 bp, Homo sapien
ttagatgtagccactgtatgttgta

SEQ ID NO: 467142 - DNA, 25 bp, Homo sapien
gtatgttgtacaaacgttggcgaca

SEQ ID NO: 467143 - DNA, 25 bp, Homo sapien
ttatctttcatggtactagtgtttt

SEQ ID NO: 467144 - DNA, 25 bp, Homo sapien
tatctttcatggtactagtgttttt

SEQ ID NO: 467145 - DNA, 25 bp, Homo sapien
atctttcatggtactagtgtttttt

SEQ ID NO: 467146 - DNA, 25 bp, Homo sapien
tctttcatggtactagtgtttttta

SEQ ID NO: 467147 - DNA, 25 bp, Homo sapien
ctttcatggtactagtgttttttag

SEQ ID NO: 467148 - DNA, 25 bp, Homo sapien
tttcatggtactagtgttttttaga

SEQ ID NO: 467149 - DNA, 25 bp, Homo sapien
ccctgggatgttttgagggtctttg

SEQ ID NO: 467150 - DNA, 25 bp, Homo sapien
cctgggatgttttgagggtctttgc

SEQ ID NO: 467151 - DNA, 25 bp, Homo sapien
ttcagtgaattttcggagttactct

SEQ ID NO: 467152 - DNA, 25 bp, Homo sapien
agtgaattttcggagttactctcat

SEQ ID NO: 467153 - DNA, 25 bp, Homo sapien
gaattttcggagttactctcattag

SEQ ID NO: 467154 - DNA, 25 bp, Homo sapien
ttcggagttactctcattagccttg

SEQ ID NO: 467155 - DNA, 25 bp, Homo sapien
ggagttactctcattagccttgttc

SEQ ID NO: 467156 - DNA, 25 bp, Homo sapien
gagttactctcattagccttgttca

SEQ ID NO: 467157 - DNA, 25 bp, Homo sapien
agttactctcattagccttgttcag

SEQ ID NO: 467158 - DNA, 25 bp, Homo sapien
gttactctcattagccttgttcaga

SEQ ID NO: 467159 - DNA, 25 bp, Homo sapien
tctcattagccttgttcagagtctt

SEQ ID NO: 467160 - DNA, 25 bp, Homo sapien
tcattagccttgttcagagtctttg

SEQ ID NO: 467161 - DNA, 25 bp, Homo sapien
attagccttgttcagagtctttggg

SEQ ID NO: 467162 - DNA, 25 bp, Homo sapien
gcaaacatttatggcaacttctgca

SEQ ID NO: 467163 - DNA, 25 bp, Homo sapien
aagttccctaatgagacgatgtcct

SEQ ID NO: 467164 - DNA, 25 bp, Homo sapien
gagacgatgtcctccataactgaga

SEQ ID NO: 467165 - DNA, 25 bp, Homo sapien
tgagaaggacactgcagccattgct

SEQ ID NO: 467166 - DNA, 25 bp, Homo sapien
tacagatgatttgattacgctcttg

SEQ ID NO: 467167 - DNA, 25 bp, Homo sapien
attcctgcatttgaatggttgccga

SEQ ID NO: 467168 - DNA, 25 bp, Homo sapien
gttgccgagcgcatggtgtgccctt

SEQ ID NO: 467169 - DNA, 25 bp, Homo sapien
ggtgtgccctttctcaaagagcaga

SEQ ID NO: 467170 - DNA, 25 bp, Homo sapien
tacgctcttgtgtatttggtcctgt

SEQ ID NO: 467171 - DNA, 25 bp, Homo sapien
atttggtcctgttataatgtgagca

SEQ ID NO: 467172 - DNA, 25 bp, Homo sapien
agtgcttaaagctatgtcattatgc

SEQ ID NO: 467173 - DNA, 25 bp, Homo sapien
ggagaaaggcagcattctggctaaa

SEQ ID NO: 467174 - DNA, 25 bp, Homo sapien
gcagcattctggctaaaatgtgtag

SEQ ID NO: 467175 - DNA, 25 bp, Homo sapien
tagctttcatatgaagtgccttaag

SEQ ID NO: 467176 - DNA, 25 bp, Homo sapien
gtgccttaagtagactcttcattta

SEQ ID NO: 467177 - DNA, 25 bp, Homo sapien
gttatgcatttttaagatacagttc

SEQ ID NO: 467178 - DNA, 25 bp, Homo sapien
gatacagttcagaatgacacattgt

SEQ ID NO: 467179 - DNA, 25 bp, Homo sapien
tcagaatgacacattgtagtggcaa

SEQ ID NO: 467180 - DNA, 25 bp, Homo sapien
ggcaaagataaccaaatgtctggct

SEQ ID NO: 467181 - DNA, 25 bp, Homo sapien
aaatgtctggctgtttgctttttga

SEQ ID NO: 467182 - DNA, 25 bp, Homo sapien
ttgctttttgaccatatcaataaac

SEQ ID NO: 467183 - DNA, 25 bp, Homo sapien
gagcacattcttctgtaaggagaaa

SEQ ID NO: 467184 - DNA, 25 bp, Homo sapien
ttaccatcttcatcatgcacatctt

SEQ ID NO: 467185 - DNA, 25 bp, Homo sapien
atgcacatcttcaagcatgctcagc

SEQ ID NO: 467186 - DNA, 25 bp, Homo sapien
acatcttcaagcatgctcagcctgc

SEQ ID NO: 467187 - DNA, 25 bp, Homo sapien
tgaggagtcaaatcctaaggatcca

SEQ ID NO: 467188 - DNA, 25 bp, Homo sapien
aaatcctaaggatccagcggcagtg

SEQ ID NO: 467189 - DNA, 25 bp, Homo sapien
atcctaaggatccagcggcagtgac

SEQ ID NO: 467190 - DNA, 25 bp, Homo sapien
cctaaggatccagcggcagtgacag

SEQ ID NO: 467191 - DNA, 25 bp, Homo sapien
aggatccagcggcagtgacagaatc

SEQ ID NO: 467192 - DNA, 25 bp, Homo sapien
gatccagcggcagtgacagaatcca

SEQ ID NO: 467193 - DNA, 25 bp, Homo sapien
atccagcggcagtgacagaatccaa

SEQ ID NO: 467194 - DNA, 25 bp, Homo sapien
gacagaatccaaagagggaacagag

SEQ ID NO: 467195 - DNA, 25 bp, Homo sapien
cttcacactaggactgggtaccatc

SEQ ID NO: 467196 - DNA, 25 bp, Homo sapien
gggtaccatcacactgcagtataat

SEQ ID NO: 467197 - DNA, 25 bp, Homo sapien
aatgcatttccaagctaagtttccc

SEQ ID NO: 467198 - DNA, 25 bp, Homo sapien
agctaagtttcccagcgtctgattg

SEQ ID NO: 467199 - DNA, 25 bp, Homo sapien
cagcgtctgattgtgctttcctttt

SEQ ID NO: 467200 - DNA, 25 bp, Homo sapien
ttccttttggcctttactttcattg

SEQ ID NO: 467201 - DNA, 25 bp, Homo sapien
gtagtctgattttttagctaagtct

SEQ ID NO: 467202 - DNA, 25 bp, Homo sapien
aggctattatttgtctaccagctag

SEQ ID NO: 467203 - DNA, 25 bp, Homo sapien
taccagctagggttcaggctgcatt

SEQ ID NO: 467204 - DNA, 25 bp, Homo sapien
ctgcattccctgtgagtccttagat

SEQ ID NO: 467205 - DNA, 25 bp, Homo sapien
gaaagactgaaagcatctcctattt

SEQ ID NO: 467206 - DNA, 25 bp, Homo sapien
ggctgcaccattttagaaatatcta

SEQ ID NO: 467207 - DNA, 25 bp, Homo sapien
gctgcaccattttagaaatatctaa

SEQ ID NO: 467208 - DNA, 25 bp, Homo sapien
gaaatatctaaaggcggctgggtgc

SEQ ID NO: 467209 - DNA, 25 bp, Homo sapien
aaatatctaaaggcggctgggtgca

SEQ ID NO: 467210 - DNA, 25 bp, Homo sapien
atatctaaaggcggctgggtgcagt

SEQ ID NO: 467211 - DNA, 25 bp, Homo sapien
tatctaaaggcggctgggtgcagtg

SEQ ID NO: 467212 - DNA, 25 bp, Homo sapien
atctaaaggcggctgggtgcagtgg

SEQ ID NO: 467213 - DNA, 25 bp, Homo sapien
tagccgggtgcggttgcgggtgcct

SEQ ID NO: 467214 - DNA, 25 bp, Homo sapien
agccgggtgcggttgcgggtgcctg

SEQ ID NO: 467215 - DNA, 25 bp, Homo sapien
cgggtgcggttgcgggtgcctgtaa

SEQ ID NO: 467216 - DNA, 25 bp, Homo sapien
gggtgcggttgcgggtgcctgtaat

SEQ ID NO: 467217 - DNA, 25 bp, Homo sapien
tgaaacaggctataattggctcttt

SEQ ID NO: 467218 - DNA, 25 bp, Homo sapien
caggctataattggctcttttggat

SEQ ID NO: 467219 - DNA, 25 bp, Homo sapien
gaaaggcaactttcttgcttttgaa

SEQ ID NO: 467220 - DNA, 25 bp, Homo sapien
ggtaaggaatccagctacaatttta

SEQ ID NO: 467221 - DNA, 25 bp, Homo sapien
attagtgcttgaaacgggcttcctt

SEQ ID NO: 467222 - DNA, 25 bp, Homo sapien
cttgaaacgggcttccttgaattct

SEQ ID NO: 467223 - DNA, 25 bp, Homo sapien
ttgaattctccaggccctatcattt

SEQ ID NO: 467224 - DNA, 25 bp, Homo sapien
gtagaagccccatgtttgtattcca

SEQ ID NO: 467225 - DNA, 25 bp, Homo sapien
ttgtattccatgaaacacgtcgggt

SEQ ID NO: 467226 - DNA, 25 bp, Homo sapien
ccatgaaacacgtcgggttggagta

SEQ ID NO: 467227 - DNA, 25 bp, Homo sapien
aaaaacagctagacacaccaggtgt

SEQ ID NO: 467228 - DNA, 25 bp, Homo sapien
tactccctggtaattcaagaattgg

SEQ ID NO: 467229 - DNA, 25 bp, Homo sapien
aattggagactcctgagatgctgct

SEQ ID NO: 467230 - DNA, 25 bp, Homo sapien
ctgagatgctgctcatattagctga

SEQ ID NO: 467231 - DNA, 25 bp, Homo sapien
tattagctgagcacttatcaatact

SEQ ID NO: 467232 - DNA, 25 bp, Homo sapien
gagcacttatcaatacttcactttt

SEQ ID NO: 467233 - DNA, 25 bp, Homo sapien
aaagtgtttcactccactgtgctag

SEQ ID NO: 467234 - DNA, 25 bp, Homo sapien
actgtgctaggtgcaagactataaa

SEQ ID NO: 467235 - DNA, 25 bp, Homo sapien
gaggtgtgaggatcaacacttttat

SEQ ID NO: 467236 - DNA, 25 bp, Homo sapien
acttttatgaaaaccagtgtcattc

SEQ ID NO: 467237 - DNA, 25 bp, Homo sapien
agtgtcattctggatatagtttcag

SEQ ID NO: 467238 - DNA, 25 bp, Homo sapien
cattttggagggtaagtctctcaaa

SEQ ID NO: 467239 - DNA, 25 bp, Homo sapien
aattggaaccatgccactcttgagc

SEQ ID NO: 467240 - DNA, 25 bp, Homo sapien
actcttgagccacaatacctgtcac

SEQ ID NO: 467241 - DNA, 25 bp, Homo sapien
ttgggccccttaacaccttgggctg

SEQ ID NO: 467242 - DNA, 25 bp, Homo sapien
cccttaacaccttgggctgctcaga

SEQ ID NO: 467243 - DNA, 25 bp, Homo sapien
tccagatgaggtccagcccagatct

SEQ ID NO: 467244 - DNA, 25 bp, Homo sapien
ggaaatgtgaagtctctgttggtgt

SEQ ID NO: 467245 - DNA, 25 bp, Homo sapien
aaggcaggtagcagtcagcatgaca

SEQ ID NO: 467246 - DNA, 25 bp, Homo sapien
gcatgacagctgcaagaatgacctc

SEQ ID NO: 467247 - DNA, 25 bp, Homo sapien
gaatgacctctgtctgttgaagcct

SEQ ID NO: 467248 - DNA, 25 bp, Homo sapien
ctctgtctgttgaagccttggtatc

SEQ ID NO: 467249 - DNA, 25 bp, Homo sapien
gaagccttggtatctgagaggtcag

SEQ ID NO: 467250 - DNA, 25 bp, Homo sapien
gtctgtgtgatttttccccttggta

SEQ ID NO: 467251 - DNA, 25 bp, Homo sapien
tcttctgaagtcgtagtttttaatc

SEQ ID NO: 467252 - DNA, 25 bp, Homo sapien
gatattgctatgaggttgtgcacta

SEQ ID NO: 467253 - DNA, 25 bp, Homo sapien
gctatgaggttgtgcactattaaag

SEQ ID NO: 467254 - DNA, 25 bp, Homo sapien
gtgcactattaaagtttgctccatc

SEQ ID NO: 467255 - DNA, 25 bp, Homo sapien
ttgctccatcacttaaaggtaaagc

SEQ ID NO: 467256 - DNA, 25 bp, Homo sapien
agcagttcaaaaatactactttaca

SEQ ID NO: 467257 - DNA, 25 bp, Homo sapien
actactttacatcacaactttgcat

SEQ ID NO: 467258 - DNA, 25 bp, Homo sapien
acatcacaactttgcatggctgaga

SEQ ID NO: 467259 - DNA, 25 bp, Homo sapien
actttgcatggctgagattttgaac

SEQ ID NO: 467260 - DNA, 25 bp, Homo sapien
gcatggctgagattttgaacaacta

SEQ ID NO: 467261 - DNA, 25 bp, Homo sapien
tccagtgcctgaacccttaccggaa

SEQ ID NO: 467262 - DNA, 25 bp, Homo sapien
cttaccggaaacctgactgcaaagt

SEQ ID NO: 467263 - DNA, 25 bp, Homo sapien
ggaaacctgactgcaaagtgggaag

SEQ ID NO: 467264 - DNA, 25 bp, Homo sapien
ggaagaattaccacaactgaagact

SEQ ID NO: 467265 - DNA, 25 bp, Homo sapien
agctgactcacggtgttatgaataa

SEQ ID NO: 467266 - DNA, 25 bp, Homo sapien
gagctgaagtactgtaagaatcctg

SEQ ID NO: 467267 - DNA, 25 bp, Homo sapien
aggacctggagtgcaatgagaatgt

SEQ ID NO: 467268 - DNA, 25 bp, Homo sapien
tgtgaaacacaaaaccaaggagtac

SEQ ID NO: 467269 - DNA, 25 bp, Homo sapien
gctgtttacaaacccaaagaggaca

SEQ ID NO: 467270 - DNA, 25 bp, Homo sapien
aggacactgaattagagtgactgtt

SEQ ID NO: 467271 - DNA, 25 bp, Homo sapien
tgggtggtcaggtaagacagactct

SEQ ID NO: 467272 - DNA, 25 bp, Homo sapien
ttccctcaaacgattgtaaagagct

SEQ ID NO: 467273 - DNA, 25 bp, Homo sapien
tccctcaaacgattgtaaagagctt

SEQ ID NO: 467274 - DNA, 25 bp, Homo sapien
ccctcaaacgattgtaaagagctta

SEQ ID NO: 467275 - DNA, 25 bp, Homo sapien
cctcaaacgattgtaaagagcttaa

SEQ ID NO: 467276 - DNA, 25 bp, Homo sapien
tcaaacgattgtaaagagcttaaag

SEQ ID NO: 467277 - DNA, 25 bp, Homo sapien
caaacgattgtaaagagcttaaagg

SEQ ID NO: 467278 - DNA, 25 bp, Homo sapien
aaaggcattaagatgagagacgggc

SEQ ID NO: 467279 - DNA, 25 bp, Homo sapien
aaggcattaagatgagagacgggcc

SEQ ID NO: 467280 - DNA, 25 bp, Homo sapien
aggcattaagatgagagacgggcca

SEQ ID NO: 467281 - DNA, 25 bp, Homo sapien
cattaagatgagagacgggccaggc

SEQ ID NO: 467282 - DNA, 25 bp, Homo sapien
attaagatgagagacgggccaggcg

SEQ ID NO: 467283 - DNA, 25 bp, Homo sapien
taaccatcataaagacactgcctgt

SEQ ID NO: 467284 - DNA, 25 bp, Homo sapien
taaagacactgcctgtcttctagga

SEQ ID NO: 467285 - DNA, 25 bp, Homo sapien
ggaatgaccaggcacccagctccca

SEQ ID NO: 467286 - DNA, 25 bp, Homo sapien
gctcccactggactccaattttttt

SEQ ID NO: 467287 - DNA, 25 bp, Homo sapien
ttcctgccttatttagaattctttg

SEQ ID NO: 467288 - DNA, 25 bp, Homo sapien
cagagacaagaagcccaaccttctg

SEQ ID NO: 467289 - DNA, 25 bp, Homo sapien
cctgggctgtgctgatagtgctgag

SEQ ID NO: 467290 - DNA, 25 bp, Homo sapien
gagggagataggaatttgctgctaa

SEQ ID NO: 467291 - DNA, 25 bp, Homo sapien
ggcttgcagctatccttcctgtgta

SEQ ID NO: 467292 - DNA, 25 bp, Homo sapien
cagctatccttcctgtgtatacaaa

SEQ ID NO: 467293 - DNA, 25 bp, Homo sapien
gctatccttcctgtgtatacaaata

SEQ ID NO: 467294 - DNA, 25 bp, Homo sapien
tattggagccactgtacctactggc

SEQ ID NO: 467295 - DNA, 25 bp, Homo sapien
cactgtacctactggctttgagcaa

SEQ ID NO: 467296 - DNA, 25 bp, Homo sapien
ggctttgagcaaacagctgcagatg

SEQ ID NO: 467297 - DNA, 25 bp, Homo sapien
gagaaacttgggtcatcatgcaaaa

SEQ ID NO: 467298 - DNA, 25 bp, Homo sapien
aaatcagcagagaccgtggcaagat

SEQ ID NO: 467299 - DNA, 25 bp, Homo sapien
gtcatttcagtggaaagtctggcac

SEQ ID NO: 467300 - DNA, 25 bp, Homo sapien
agtctggcacaggttcattgtctga

SEQ ID NO: 467301 - DNA, 25 bp, Homo sapien
acaggttcattgtctgagatcagtt

SEQ ID NO: 467302 - DNA, 25 bp, Homo sapien
tatttgtggtggttcaggagtttca

SEQ ID NO: 467303 - DNA, 25 bp, Homo sapien
aggagtttcaagattaccagttcaa

SEQ ID NO: 467304 - DNA, 25 bp, Homo sapien
ttttgaagacttggctggaaaactc

SEQ ID NO: 467305 - DNA, 25 bp, Homo sapien
atacaccaatggataaactaacgga

SEQ ID NO: 467306 - DNA, 25 bp, Homo sapien
ctaacggaaactgctttttgacatt

SEQ ID NO: 467307 - DNA, 25 bp, Homo sapien
gttaagtcagaattacttgggtgat

SEQ ID NO: 467308 - DNA, 25 bp, Homo sapien
aattacttgggtgatgtgattcaat

SEQ ID NO: 467309 - DNA, 25 bp, Homo sapien
atttagcattatttcttcagctata

SEQ ID NO: 467310 - DNA, 25 bp, Homo sapien
taatgaattgctatagaaatcaggc

SEQ ID NO: 467311 - DNA, 25 bp, Homo sapien
aatcaggcagatctttctaatgtgt

SEQ ID NO: 467312 - DNA, 25 bp, Homo sapien
tgattggtcttttcagctactctga

SEQ ID NO: 467313 - DNA, 25 bp, Homo sapien
actctgaacagattactaaggccat

SEQ ID NO: 467314 - DNA, 25 bp, Homo sapien
acagattactaaggccatctcctca

SEQ ID NO: 467315 - DNA, 25 bp, Homo sapien
taaggccatctcctcatctctaagg

SEQ ID NO: 467316 - DNA, 25 bp, Homo sapien
tccccattgaattgcattggtgctt

SEQ ID NO: 467317 - DNA, 25 bp, Homo sapien
gaatgttttgtcacatatatgacag

SEQ ID NO: 467318 - DNA, 25 bp, Homo sapien
atgtggatccattctgtgattttgt

SEQ ID NO: 467319 - DNA, 25 bp, Homo sapien
agaattcagctatagtatgcttact

SEQ ID NO: 467320 - DNA, 25 bp, Homo sapien
gtatgcttactttaaaaatcatcaa

SEQ ID NO: 467321 - DNA, 25 bp, Homo sapien
aataaaatattacagcaagccattg

SEQ ID NO: 467322 - DNA, 25 bp, Homo sapien
cagcaagccattgttagatcttaaa

SEQ ID NO: 467323 - DNA, 25 bp, Homo sapien
agatcttaaagttgggcgatattat

SEQ ID NO: 467324 - DNA, 25 bp, Homo sapien
gggcgatattattctaactgatgtg

SEQ ID NO: 467325 - DNA, 25 bp, Homo sapien
ctgatgtgtgaagtgtcataccaac

SEQ ID NO: 467326 - DNA, 25 bp, Homo sapien
gtgtcataccaacaatagttacatc

SEQ ID NO: 467327 - DNA, 25 bp, Homo sapien
gcaacatcagcagttggtatctgga

SEQ ID NO: 467328 - DNA, 25 bp, Homo sapien
aactgtcttctaagtggagtgtctg

SEQ ID NO: 467329 - DNA, 25 bp, Homo sapien
ttctaagtggagtgtctgagcagga

SEQ ID NO: 467330 - DNA, 25 bp, Homo sapien
tcaccagcagtgagggtgccgctga

SEQ ID NO: 467331 - DNA, 25 bp, Homo sapien
aggacagagagtgattgtgcatatc

SEQ ID NO: 467332 - DNA, 25 bp, Homo sapien
gattgtgcatatcagtaagaatgga

SEQ ID NO: 467333 - DNA, 25 bp, Homo sapien
ctgaggtgggatagcttacacggaa

SEQ ID NO: 467334 - DNA, 25 bp, Homo sapien
ggatagcttacacggaaagaacagt

SEQ ID NO: 467335 - DNA, 25 bp, Homo sapien
aaagaacagtcatgtttggtggttt

SEQ ID NO: 467336 - DNA, 25 bp, Homo sapien
catgtttggtggtttttctagagca

SEQ ID NO: 467337 - DNA, 25 bp, Homo sapien
gtggtttttctagagcaacatcagc

SEQ ID NO: 467338 - DNA, 25 bp, Homo sapien
ccacaacccaagaatctgcagctaa

SEQ ID NO: 467339 - DNA, 25 bp, Homo sapien
aacccaagaatctgcagctaactta

SEQ ID NO: 467340 - DNA, 25 bp, Homo sapien
aatctgcagctaacttattttcccc

SEQ ID NO: 467341 - DNA, 25 bp, Homo sapien
tttccccagacatcctgttttattt

SEQ ID NO: 467342 - DNA, 25 bp, Homo sapien
aatgaattttgtttgttgatgtgaa

SEQ ID NO: 467343 - DNA, 25 bp, Homo sapien
gatgtgaaacattatgccttaagta

SEQ ID NO: 467344 - DNA, 25 bp, Homo sapien
gtttatctttcatggtactagtgtt

SEQ ID NO: 467345 - DNA, 25 bp, Homo sapien
ttgcttttcctcttgaaccacagtt

SEQ ID NO: 467346 - DNA, 25 bp, Homo sapien
cagttctacccctgggatgttttga

SEQ ID NO: 467347 - DNA, 25 bp, Homo sapien
ctgggatgttttgagggtctttgca

SEQ ID NO: 467348 - DNA, 25 bp, Homo sapien
agggtctttgcaagaatcatttttt

SEQ ID NO: 467349 - DNA, 25 bp, Homo sapien
ctctgaacgggagccgtagctcagg

SEQ ID NO: 467350 - DNA, 25 bp, Homo sapien
gctcaggaggcagaattcagtgtgt

SEQ ID NO: 467351 - DNA, 25 bp, Homo sapien
gaggcagaattcagtgtgttatcat

SEQ ID NO: 467352 - DNA, 25 bp, Homo sapien
cagaattcagtgtgttatcattggg

SEQ ID NO: 467353 - DNA, 25 bp, Homo sapien
gatgctaagcacctacactacttta

SEQ ID NO: 467354 - DNA, 25 bp, Homo sapien
agcacctacactactttaagaattt

SEQ ID NO: 467355 - DNA, 25 bp, Homo sapien
cactactttaagaatttggaactga

SEQ ID NO: 467356 - DNA, 25 bp, Homo sapien
tttggaactgaaacatgaagaggaa

SEQ ID NO: 467357 - DNA, 25 bp, Homo sapien
gaaataagaatttgggaacctgaat

SEQ ID NO: 467358 - DNA, 25 bp, Homo sapien
tgggaacctgaatagctctgcaaaa

SEQ ID NO: 467359 - DNA, 25 bp, Homo sapien
agaaggtgtgcgctcgtgcctcccc

SEQ ID NO: 467360 - DNA, 25 bp, Homo sapien
ctatttgatccatggataaccggta

SEQ ID NO: 467361 - DNA, 25 bp, Homo sapien
atgggaaaatgctccgaccctcaat

SEQ ID NO: 467362 - DNA, 25 bp, Homo sapien
gctccgaccctcaatgcagtaaata

SEQ ID NO: 467363 - DNA, 25 bp, Homo sapien
tacttgcaggcaactgggttctcat

SEQ ID NO: 467364 - DNA, 25 bp, Homo sapien
gttctcatctcttgatttgcttttg

SEQ ID NO: 467365 - DNA, 25 bp, Homo sapien
gatggatgacagttgctcattctga

SEQ ID NO: 467366 - DNA, 25 bp, Homo sapien
gctcattctgagaaacttcactctt

SEQ ID NO: 467367 - DNA, 25 bp, Homo sapien
ttcactcttttcacttatgcatcac

SEQ ID NO: 467368 - DNA, 25 bp, Homo sapien
ttcacttatgcatcacgaggaaata

SEQ ID NO: 467369 - DNA, 25 bp, Homo sapien
gaaaaataccttgccatcggatcat

SEQ ID NO: 467370 - DNA, 25 bp, Homo sapien
tgccatcggatcatcaacaagtctt

SEQ ID NO: 467371 - DNA, 25 bp, Homo sapien
cactcgcttgtgtggaaaagcctct

SEQ ID NO: 467372 - DNA, 25 bp, Homo sapien
ggaaaagcctctaaatgcatccctt

SEQ ID NO: 467373 - DNA, 25 bp, Homo sapien
tgcttcctttgccttacaattgaag

SEQ ID NO: 467374 - DNA, 25 bp, Homo sapien
acaattgaagcagcccgtggtacca

SEQ ID NO: 467375 - DNA, 25 bp, Homo sapien
aagcagcccgtggtaccatcacagt

SEQ ID NO: 467376 - DNA, 25 bp, Homo sapien
agtatgcagagacttcctcaccttt

SEQ ID NO: 467377 - DNA, 25 bp, Homo sapien
tcacctttcatatctagggaccacc

SEQ ID NO: 467378 - DNA, 25 bp, Homo sapien
ggtgggcacttataaatgcctgcta

SEQ ID NO: 467379 - DNA, 25 bp, Homo sapien
gcctgctattgttaagccattccag

SEQ ID NO: 467380 - DNA, 25 bp, Homo sapien
tattgttaagccattccagcctctt

SEQ ID NO: 467381 - DNA, 25 bp, Homo sapien
attccagcctcttcctctgaataga

SEQ ID NO: 467382 - DNA, 25 bp, Homo sapien
ccacaacccaagaatctgcagctaa

SEQ ID NO: 467383 - DNA, 25 bp, Homo sapien
acaacccaagaatctgcagctaact

SEQ ID NO: 467384 - DNA, 25 bp, Homo sapien
caacccaagaatctgcagctaactt

SEQ ID NO: 467385 - DNA, 25 bp, Homo sapien
aacccaagaatctgcagctaactta

SEQ ID NO: 467386 - DNA, 25 bp, Homo sapien
cccaagaatctgcagctaacttatt

SEQ ID NO: 467387 - DNA, 25 bp, Homo sapien
ccaagaatctgcagctaacttattt

SEQ ID NO: 467388 - DNA, 25 bp, Homo sapien
caagaatctgcagctaacttatttt

SEQ ID NO: 467389 - DNA, 25 bp, Homo sapien
aatgaattttgtttgttgatgtgaa

SEQ ID NO: 467390 - DNA, 25 bp, Homo sapien
gttgatgtgaaacattatgccttaa

SEQ ID NO: 467391 - DNA, 25 bp, Homo sapien
gatgtgaaacattatgccttaagta

SEQ ID NO: 467392 - DNA, 25 bp, Homo sapien
tgtgaaacattatgccttaagtaat

SEQ ID NO: 467393 - DNA, 25 bp, Homo sapien
aatggattggaatttcacaggctgt

SEQ ID NO: 467394 - DNA, 25 bp, Homo sapien
cacaggctgtgaataattccttagg

SEQ ID NO: 467395 - DNA, 25 bp, Homo sapien
attccttaggatctggcaaaccgtg

SEQ ID NO: 467396 - DNA, 25 bp, Homo sapien
tctggcaaaccgtgaagtcttattt

SEQ ID NO: 467397 - DNA, 25 bp, Homo sapien
tcttatttgaagaccttatctcctg

SEQ ID NO: 467398 - DNA, 25 bp, Homo sapien
gaagaccttatctcctgagagttct

SEQ ID NO: 467399 - DNA, 25 bp, Homo sapien
ctgagagttcttttggagtaggaaa

SEQ ID NO: 467400 - DNA, 25 bp, Homo sapien
tgaaatagaccgtttttctcttgtt

SEQ ID NO: 467401 - DNA, 25 bp, Homo sapien
tagtaggaagatgtttagggcagca

SEQ ID NO: 467402 - DNA, 25 bp, Homo sapien
gcagaactctgggtctaaataagta

SEQ ID NO: 467403 - DNA, 25 bp, Homo sapien
agtacatgttcccacttgttgccga

SEQ ID NO: 467404 - DNA, 25 bp, Homo sapien
atgcaggacacagctattcacccag

SEQ ID NO: 467405 - DNA, 25 bp, Homo sapien
gggacgagacaagcctgacatcctt

SEQ ID NO: 467406 - DNA, 25 bp, Homo sapien
ggcaccaaatcccactgattccagt

SEQ ID NO: 467407 - DNA, 25 bp, Homo sapien
actgattccagtccctaaatgccac

SEQ ID NO: 467408 - DNA, 25 bp, Homo sapien
taaatgccacctgaatctgctcttc

SEQ ID NO: 467409 - DNA, 25 bp, Homo sapien
gaatctgctcttcctctccttacaa

SEQ ID NO: 467410 - DNA, 25 bp, Homo sapien
ttacaacaacctaactacctcctgg

SEQ ID NO: 467411 - DNA, 25 bp, Homo sapien
atctgccctccgctacagggatgga

SEQ ID NO: 467412 - DNA, 25 bp, Homo sapien
ccgctacagggatggagtgatttat

SEQ ID NO: 467413 - DNA, 25 bp, Homo sapien
gtgatttatctgtctatgcaactga

SEQ ID NO: 467414 - DNA, 25 bp, Homo sapien
tgtctatgcaactgaccatgtcatt

SEQ ID NO: 467415 - DNA, 25 bp, Homo sapien
taaggtttgtgttctcttagcccag

SEQ ID NO: 467416 - DNA, 25 bp, Homo sapien
ttgtgttctcttagcccagagacac

SEQ ID NO: 467417 - DNA, 25 bp, Homo sapien
ggtacataggcgcagaagagttcaa

SEQ ID NO: 467418 - DNA, 25 bp, Homo sapien
agagttcaaacttcattacagcttt

SEQ ID NO: 467419 - DNA, 25 bp, Homo sapien
aacttcattacagctttgtcttagt

SEQ ID NO: 467420 - DNA, 25 bp, Homo sapien
tttgtcttagtgatgcttcctccct

SEQ ID NO: 467421 - DNA, 25 bp, Homo sapien
ttggtcacaatataagacagtgttt

SEQ ID NO: 467422 - DNA, 25 bp, Homo sapien
gatgcctgctaggtttcatactcat

SEQ ID NO: 467423 - DNA, 25 bp, Homo sapien
gctaggtttcatactcattatcttc

SEQ ID NO: 467424 - DNA, 25 bp, Homo sapien
ttatcttctgaaactttatagcaaa

SEQ ID NO: 467425 - DNA, 25 bp, Homo sapien
agggagcaaataatctgtcatttat

SEQ ID NO: 467426 - DNA, 25 bp, Homo sapien
aaaccctgtcaggatgtgcctctgt

SEQ ID NO: 467427 - DNA, 25 bp, Homo sapien
aggatgtgcctctgtgtagttaaca

SEQ ID NO: 467428 - DNA, 25 bp, Homo sapien
gtgtagttaacactgccccagacag

SEQ ID NO: 467429 - DNA, 25 bp, Homo sapien
acagcagctctgatttcagtcacag

SEQ ID NO: 467430 - DNA, 25 bp, Homo sapien
gatttcagtcacagttctgctgaga

SEQ ID NO: 467431 - DNA, 25 bp, Homo sapien
cagttctgctgagaagcctgtctgc

SEQ ID NO: 467432 - DNA, 25 bp, Homo sapien
tcagaggcagaggagaccaatggca

SEQ ID NO: 467433 - DNA, 25 bp, Homo sapien
gacattgtacccatgggatgtttcc

SEQ ID NO: 467434 - DNA, 25 bp, Homo sapien
ggatgtttccaagcttcttgatctt

SEQ ID NO: 467435 - DNA, 25 bp, Homo sapien
agcttcttgatctttaatcttttag

SEQ ID NO: 467436 - DNA, 25 bp, Homo sapien
tttaccttcctaggtgtggtgccct

SEQ ID NO: 467437 - DNA, 25 bp, Homo sapien
catcatcatcatggatttgctggtg

SEQ ID NO: 467438 - DNA, 25 bp, Homo sapien
atcatcatcatggatttgctggtgc

SEQ ID NO: 467439 - DNA, 25 bp, Homo sapien
tcatcatcatggatttgctggtgca

SEQ ID NO: 467440 - DNA, 25 bp, Homo sapien
cttaatagggactcgaattcaagct

SEQ ID NO: 467441 - DNA, 25 bp, Homo sapien
ttaatagggactcgaattcaagctt

SEQ ID NO: 467442 - DNA, 25 bp, Homo sapien
taatagggactcgaattcaagcttc

SEQ ID NO: 467443 - DNA, 25 bp, Homo sapien
ttcaagcttctaacgttagaagctt

SEQ ID NO: 467444 - DNA, 25 bp, Homo sapien
aagcttctaacgttagaagcttgaa

SEQ ID NO: 467445 - DNA, 25 bp, Homo sapien
ttctaacgttagaagcttgaattcg

SEQ ID NO: 467446 - DNA, 25 bp, Homo sapien
tctaacgttagaagcttgaattcga

SEQ ID NO: 467447 - DNA, 25 bp, Homo sapien
taacgttagaagcttgaattcgagc

SEQ ID NO: 467448 - DNA, 25 bp, Homo sapien
tccggcagcggccacaattgtcttg

SEQ ID NO: 467449 - DNA, 25 bp, Homo sapien
ggcagcggccacaattgtcttgtcc

SEQ ID NO: 467450 - DNA, 25 bp, Homo sapien
agcggccacaattgtcttgtcccct

SEQ ID NO: 467451 - DNA, 25 bp, Homo sapien
cattcacaacggttgggccaaaaag

SEQ ID NO: 467452 - DNA, 25 bp, Homo sapien
tgcactcgctgaccacaactttgga

SEQ ID NO: 467453 - DNA, 25 bp, Homo sapien
tgaccacaactttggacaccccagg

SEQ ID NO: 467454 - DNA, 25 bp, Homo sapien
gatgctgttgctgtaggacgcctgc

SEQ ID NO: 467455 - DNA, 25 bp, Homo sapien
ctgttgctgtaggacgcctgctgcc

SEQ ID NO: 467456 - DNA, 25 bp, Homo sapien
aggatgtgagccagtcccctcgctg

SEQ ID NO: 467457 - DNA, 25 bp, Homo sapien
cagtcccctcgctggtacggaatgc

SEQ ID NO: 467458 - DNA, 25 bp, Homo sapien
ccctcgctggtacggaatgccgctg

SEQ ID NO: 467459 - DNA, 25 bp, Homo sapien
ggctccagacagaccatgttctaca

SEQ ID NO: 467460 - DNA, 25 bp, Homo sapien
agaccatgttctacacagaggtgac

SEQ ID NO: 467461 - DNA, 25 bp, Homo sapien
cacagaggtgacagatgcccagcgt

SEQ ID NO: 467462 - DNA, 25 bp, Homo sapien
agaggtgacagatgcccagcgtagc

SEQ ID NO: 467463 - DNA, 25 bp, Homo sapien
agatgcccagcgtagcggtccaggt

SEQ ID NO: 467464 - DNA, 25 bp, Homo sapien
gtgagctcattgaggtggtgcacct

SEQ ID NO: 467465 - DNA, 25 bp, Homo sapien
aagaccctcggcgtcatctttggtg

SEQ ID NO: 467466 - DNA, 25 bp, Homo sapien
ctcggcgtcatctttggtgtctcat

SEQ ID NO: 467467 - DNA, 25 bp, Homo sapien
gcgtcatctttggtgtctcatggtt

SEQ ID NO: 467468 - DNA, 25 bp, Homo sapien
atctttggtgtctcatggttcctca

SEQ ID NO: 467469 - DNA, 25 bp, Homo sapien
tcatggttcctcagccaggtggccc

SEQ ID NO: 467470 - DNA, 25 bp, Homo sapien
aatataatgtctcttttccataaag

SEQ ID NO: 467471 - DNA, 25 bp, Homo sapien
tgtctcttttccataaagtctttga

SEQ ID NO: 467472 - DNA, 25 bp, Homo sapien
atagttcattgttgctaagacaaag

SEQ ID NO: 467473 - DNA, 25 bp, Homo sapien
ttttaatggcagactaaactctcag

SEQ ID NO: 467474 - DNA, 25 bp, Homo sapien
atggcagactaaactctcagatttg

SEQ ID NO: 467475 - DNA, 25 bp, Homo sapien
gactaaactctcagatttggcatca

SEQ ID NO: 467476 - DNA, 25 bp, Homo sapien
aactctcagatttggcatcacaagg

SEQ ID NO: 467477 - DNA, 25 bp, Homo sapien
ctcagatttggcatcacaaggccaa

SEQ ID NO: 467478 - DNA, 25 bp, Homo sapien
acaaggccaaaactcacaagtcaca

SEQ ID NO: 467479 - DNA, 25 bp, Homo sapien
aaactcacaagtcacacccagaagg

SEQ ID NO: 467480 - DNA, 25 bp, Homo sapien
actcacaagtcacacccagaaggtt

SEQ ID NO: 467481 - DNA, 25 bp, Homo sapien
ctcctctgagctgtcaagtaggaag

SEQ ID NO: 467482 - DNA, 25 bp, Homo sapien
tgtcaagtaggaagtccgggctgct

SEQ ID NO: 467483 - DNA, 25 bp, Homo sapien
tccgggctgctctgctagaaagaga

SEQ ID NO: 467484 - DNA, 25 bp, Homo sapien
atgtgcaggagcactgaggcatccc

SEQ ID NO: 467485 - DNA, 25 bp, Homo sapien
aggtgtgacactcttccacctagag

SEQ ID NO: 467486 - DNA, 25 bp, Homo sapien
tagagcattccgtctctcatcctct

SEQ ID NO: 467487 - DNA, 25 bp, Homo sapien
catcctctgccatgtgacgctgggc

SEQ ID NO: 467488 - DNA, 25 bp, Homo sapien
aattaatcccaagtgcaagacattt

SEQ ID NO: 467489 - DNA, 25 bp, Homo sapien
tatttcttctgtacctaatgacctg

SEQ ID NO: 467490 - DNA, 25 bp, Homo sapien
taatgacctgagcaatccttctctg

SEQ ID NO: 467491 - DNA, 25 bp, Homo sapien
cctggtagtgtcatctttagaagtg

SEQ ID NO: 467492 - DNA, 25 bp, Homo sapien
gagaccacagtccagtcatcatggc

SEQ ID NO: 467493 - DNA, 25 bp, Homo sapien
tcatcatggcacacatcgtcttcaa

SEQ ID NO: 467494 - DNA, 25 bp, Homo sapien
gtattgctcaaaggcctttctcaga

SEQ ID NO: 467495 - DNA, 25 bp, Homo sapien
gaggtctgcgattctataactgcac

SEQ ID NO: 467496 - DNA, 25 bp, Homo sapien
ggaacatcacccctgcttgtgttga

SEQ ID NO: 467497 - DNA, 25 bp, Homo sapien
aagatgctgctccttttcaggcatt

SEQ ID NO: 467498 - DNA, 25 bp, Homo sapien
ggaagaaattgctctcctgcagtat

SEQ ID NO: 467499 - DNA, 25 bp, Homo sapien
tgctctcctgcagtattcatgtaac

SEQ ID NO: 467500 - DNA, 25 bp, Homo sapien
ttcatgtaaccactaaacccacagc

SEQ ID NO: 467501 - DNA, 25 bp, Homo sapien
ttttctgttcagtgtttgatgccct

SEQ ID NO: 467502 - DNA, 25 bp, Homo sapien
ggtttttctctcacagagaccacag

SEQ ID NO: 467503 - DNA, 25 bp, Homo sapien
ttcatggatcaccagctcacgtcat

SEQ ID NO: 467504 - DNA, 25 bp, Homo sapien
agctcacgtcatgttgccttctctt

SEQ ID NO: 467505 - DNA, 25 bp, Homo sapien
ctcacgtcatgttgccttctctttt

SEQ ID NO: 467506 - DNA, 25 bp, Homo sapien
tcacgtcatgttgccttctcttttc

SEQ ID NO: 467507 - DNA, 25 bp, Homo sapien
actggaggatgtgctatgagtttgc

SEQ ID NO: 467508 - DNA, 25 bp, Homo sapien
acagctggactgtcaggctgctttt

SEQ ID NO: 467509 - DNA, 25 bp, Homo sapien
ttttccagatgttcctcctctgcct

SEQ ID NO: 467510 - DNA, 25 bp, Homo sapien
tttccttggagcactgagcaccatt

SEQ ID NO: 467511 - DNA, 25 bp, Homo sapien
ggagcactgagcaccatttggaagc

SEQ ID NO: 467512 - DNA, 25 bp, Homo sapien
agcactgagcaccatttggaagctt

SEQ ID NO: 467513 - DNA, 25 bp, Homo sapien
ctgagcaccatttggaagcttgaga

SEQ ID NO: 467514 - DNA, 25 bp, Homo sapien
ggtggcacgggataaaactcaccgt

SEQ ID NO: 467515 - DNA, 25 bp, Homo sapien
aactcaccgtaaacttctgtatctg

SEQ ID NO: 467516 - DNA, 25 bp, Homo sapien
gttgtaggtacttccacagtaatac

SEQ ID NO: 467517 - DNA, 25 bp, Homo sapien
gagtcagtttcaagtgctggtgctg

SEQ ID NO: 467518 - DNA, 25 bp, Homo sapien
gtgctgaagacgcagcctgcacaat

SEQ ID NO: 467519 - DNA, 25 bp, Homo sapien
cacaatctgcggtgctgggtttgaa

SEQ ID NO: 467520 - DNA, 25 bp, Homo sapien
aggtggctgctctatagccgatgat

SEQ ID NO: 467521 - DNA, 25 bp, Homo sapien
agccgatgattctgagttatcctct

SEQ ID NO: 467522 - DNA, 25 bp, Homo sapien
attgcagcagctttagccttctcag

SEQ ID NO: 467523 - DNA, 25 bp, Homo sapien
ctttagccttctcagcttcatcgta

SEQ ID NO: 467524 - DNA, 25 bp, Homo sapien
tagcaacgctatagggaggtggcac

SEQ ID NO: 467525 - DNA, 25 bp, Homo sapien
gtgtgggtttccttgagggaggcaa

SEQ ID NO: 467526 - DNA, 25 bp, Homo sapien
tgtgggtttccttgagggaggcaag

SEQ ID NO: 467527 - DNA, 25 bp, Homo sapien
ttgagggaggcaaggattcctgcca

SEQ ID NO: 467528 - DNA, 25 bp, Homo sapien
aacaggcctggagtctacaccaagg

SEQ ID NO: 467529 - DNA, 25 bp, Homo sapien
acaggcctggagtctacaccaaggt

SEQ ID NO: 467530 - DNA, 25 bp, Homo sapien
caggcctggagtctacaccaaggtc

SEQ ID NO: 467531 - DNA, 25 bp, Homo sapien
aggcctggagtctacaccaaggtct

SEQ ID NO: 467532 - DNA, 25 bp, Homo sapien
ggcctggagtctacaccaaggtcta

SEQ ID NO: 467533 - DNA, 25 bp, Homo sapien
ctggagtctacaccaaggtctacaa

SEQ ID NO: 467534 - DNA, 25 bp, Homo sapien
agtctacaccaaggtctacaactat

SEQ ID NO: 467535 - DNA, 25 bp, Homo sapien
caaggtctacaactatgtggactgg

SEQ ID NO: 467536 - DNA, 25 bp, Homo sapien
gactttttaatgatcagatagcctc

SEQ ID NO: 467537 - DNA, 25 bp, Homo sapien
tttttaatgatcagatagcctccta

SEQ ID NO: 467538 - DNA, 25 bp, Homo sapien
aactatgagttggaatttgctgctt

SEQ ID NO: 467539 - DNA, 25 bp, Homo sapien
ctatgagttggaatttgctgctttt

SEQ ID NO: 467540 - DNA, 25 bp, Homo sapien
atttgctgcttttgatatgataaga

SEQ ID NO: 467541 - DNA, 25 bp, Homo sapien
gaaagttcaaagtttctcttccttg

SEQ ID NO: 467542 - DNA, 25 bp, Homo sapien
ttccttgctttgttgtgtgttctaa

SEQ ID NO: 467543 - DNA, 25 bp, Homo sapien
tgtgttctaattcttttctgcccat

SEQ ID NO: 467544 - DNA, 25 bp, Homo sapien
catcccccagtaaagaaaaggctca

SEQ ID NO: 467545 - DNA, 25 bp, Homo sapien
aaaaggctcagtatgatttcttgaa

SEQ ID NO: 467546 - DNA, 25 bp, Homo sapien
ggctcagtatgatttcttgaataga

SEQ ID NO: 467547 - DNA, 25 bp, Homo sapien
gggttaggaccaccacagattgact

SEQ ID NO: 467548 - DNA, 25 bp, Homo sapien
taggaccaccacagattgactagat

SEQ ID NO: 467549 - DNA, 25 bp, Homo sapien
gaccaccacagattgactagatcct

SEQ ID NO: 467550 - DNA, 25 bp, Homo sapien
accacagattgactagatcctaagg

SEQ ID NO: 467551 - DNA, 25 bp, Homo sapien
agatcctaaggattctctacctggg

SEQ ID NO: 467552 - DNA, 25 bp, Homo sapien
taaggattctctacctggggctgga

SEQ ID NO: 467553 - DNA, 25 bp, Homo sapien
gttcgggtcaggtgcccgggaagca

SEQ ID NO: 467554 - DNA, 25 bp, Homo sapien
agcactgtgcggtgtgggaggatga

SEQ ID NO: 467555 - DNA, 25 bp, Homo sapien
gggaggatgaatatgtgccaatttg

SEQ ID NO: 467556 - DNA, 25 bp, Homo sapien
ggatgaatatgtgccaatttggaaa

SEQ ID NO: 467557 - DNA, 25 bp, Homo sapien
gtgccaatttggaaagatgagtatt

SEQ ID NO: 467558 - DNA, 25 bp, Homo sapien
cagggtgtaggaagtgtgcccagaa

SEQ ID NO: 467559 - DNA, 25 bp, Homo sapien
aatgtataccaaggaggttcaccag

SEQ ID NO: 467560 - DNA, 25 bp, Homo sapien
gtataccaaggaggttcaccagtgt

SEQ ID NO: 467561 - DNA, 25 bp, Homo sapien
taccaaggaggttcaccagtgttgt

SEQ ID NO: 467562 - DNA, 25 bp, Homo sapien
caaggaggttcaccagtgttgttga

SEQ ID NO: 467563 - DNA, 25 bp, Homo sapien
ggaggttcaccagtgttgttgataa

SEQ ID NO: 467564 - DNA, 25 bp, Homo sapien
ggttcaccagtgttgttgataatca

SEQ ID NO: 467565 - DNA, 25 bp, Homo sapien
caccagtgttgttgataatcagaaa

SEQ ID NO: 467566 - DNA, 25 bp, Homo sapien
aaacgggactcaactgcaatgatgc

SEQ ID NO: 467567 - DNA, 25 bp, Homo sapien
gaaggtgcatatcaaagagtctcac

SEQ ID NO: 467568 - DNA, 25 bp, Homo sapien
aagagtctcacatgctctgctggag

SEQ ID NO: 467569 - DNA, 25 bp, Homo sapien
gggaaaggttttcatgtgaattctt

SEQ ID NO: 467570 - DNA, 25 bp, Homo sapien
gtgaattctttgtatcactttgaag

SEQ ID NO: 467571 - DNA, 25 bp, Homo sapien
aattctttgtatcactttgaagtac

SEQ ID NO: 467572 - DNA, 25 bp, Homo sapien
agggaagatggatacaatttgtttt

SEQ ID NO: 467573 - DNA, 25 bp, Homo sapien
ttttgtcaacaaaaatacagtgtag

SEQ ID NO: 467574 - DNA, 25 bp, Homo sapien
agtgtagtgaattttatatttgtca

SEQ ID NO: 467575 - DNA, 25 bp, Homo sapien
atatttgtcacttgattaggtaaac

SEQ ID NO: 467576 - DNA, 25 bp, Homo sapien
cacttgattaggtaaactgaaaact

SEQ ID NO: 467577 - DNA, 25 bp, Homo sapien
attttactgcattgaaataccatga

SEQ ID NO: 467578 - DNA, 25 bp, Homo sapien
actgcattgaaataccatgaacttt

SEQ ID NO: 467579 - DNA, 25 bp, Homo sapien
aactttcagacttgttagttctaca

SEQ ID NO: 467580 - DNA, 25 bp, Homo sapien
tatatggccaatgggcttttgtcat

SEQ ID NO: 467581 - DNA, 25 bp, Homo sapien
gggcttttgtcatgtgaatgcagaa

SEQ ID NO: 467582 - DNA, 25 bp, Homo sapien
gtcatgtgaatgcagaaaacctagg

SEQ ID NO: 467583 - DNA, 25 bp, Homo sapien
gtgaatgcagaaaacctaggtatac

SEQ ID NO: 467584 - DNA, 25 bp, Homo sapien
ctaggtatacaggttttgagttgac

SEQ ID NO: 467585 - DNA, 25 bp, Homo sapien
acctttcatattatgactcttcatt

SEQ ID NO: 467586 - DNA, 25 bp, Homo sapien
atgactcttcattcttaatgctgtt

SEQ ID NO: 467587 - DNA, 25 bp, Homo sapien
cttaatgctgttaatagcgatgcta

SEQ ID NO: 467588 - DNA, 25 bp, Homo sapien
atagcgatgctattatgtgcttata

SEQ ID NO: 467589 - DNA, 25 bp, Homo sapien
gctattatgtgcttatatggccaat

SEQ ID NO: 467590 - DNA, 25 bp, Homo sapien
tatgtgcttatatggccaatgggct

SEQ ID NO: 467591 - DNA, 25 bp, Homo sapien
ggttgatcaaaccagctcttgtgac

SEQ ID NO: 467592 - DNA, 25 bp, Homo sapien
cagctcttgtgacccaaaccagtgc

SEQ ID NO: 467593 - DNA, 25 bp, Homo sapien
aaaccagtgccgctgcattaaaggg

SEQ ID NO: 467594 - DNA, 25 bp, Homo sapien
taaagggaggcccagctactccttc

SEQ ID NO: 467595 - DNA, 25 bp, Homo sapien
ccagctgagatgtgggtacaggtca

SEQ ID NO: 467596 - DNA, 25 bp, Homo sapien
atgtgggtacaggtcagatttgtca

SEQ ID NO: 467597 - DNA, 25 bp, Homo sapien
agatttgtcagggagatggcactaa

SEQ ID NO: 467598 - DNA, 25 bp, Homo sapien
atggcactaacacgacacaagctca

SEQ ID NO: 467599 - DNA, 25 bp, Homo sapien
tcccagaaccgcagctgatgtttat

SEQ ID NO: 467600 - DNA, 25 bp, Homo sapien
aatcgtatgtactgtgcaatttagg

SEQ ID NO: 467601 - DNA, 25 bp, Homo sapien
ggctgtacaagctttaactctaaaa

SEQ ID NO: 467602 - DNA, 25 bp, Homo sapien
aaaagaatggttataggcagggcgt

SEQ ID NO: 467603 - DNA, 25 bp, Homo sapien
aaagaatggttataggcagggcgtg

SEQ ID NO: 467604 - DNA, 25 bp, Homo sapien
aagaatggttataggcagggcgtgg

SEQ ID NO: 467605 - DNA, 25 bp, Homo sapien
agaatggttataggcagggcgtggc

SEQ ID NO: 467606 - DNA, 25 bp, Homo sapien
aatggttataggcagggcgtggcgg

SEQ ID NO: 467607 - DNA, 25 bp, Homo sapien
atggttataggcagggcgtggcggc

SEQ ID NO: 467608 - DNA, 25 bp, Homo sapien
tggttataggcagggcgtggcggct

SEQ ID NO: 467609 - DNA, 25 bp, Homo sapien
tataggcagggcgtggcggcttaca

SEQ ID NO: 467610 - DNA, 25 bp, Homo sapien
ataggcagggcgtggcggcttacac

SEQ ID NO: 467611 - DNA, 25 bp, Homo sapien
taggcagggcgtggcggcttacacc

SEQ ID NO: 467612 - DNA, 25 bp, Homo sapien
gcaccccagcttggatgtcagagtg

SEQ ID NO: 467613 - DNA, 25 bp, Homo sapien
caggtctgtccgatggaaacacagt

SEQ ID NO: 467614 - DNA, 25 bp, Homo sapien
aggtctgtccgatggaaacacagtt

SEQ ID NO: 467615 - DNA, 25 bp, Homo sapien
ggtctgtccgatggaaacacagtta

SEQ ID NO: 467616 - DNA, 25 bp, Homo sapien
gtctgtccgatggaaacacagttag

SEQ ID NO: 467617 - DNA, 25 bp, Homo sapien
tctgtccgatggaaacacagttaga

SEQ ID NO: 467618 - DNA, 25 bp, Homo sapien
ctgtccgatggaaacacagttagag

SEQ ID NO: 467619 - DNA, 25 bp, Homo sapien
tgtccgatggaaacacagttagagc

SEQ ID NO: 467620 - DNA, 25 bp, Homo sapien
gtccgatggaaacacagttagagcc

SEQ ID NO: 467621 - DNA, 25 bp, Homo sapien
tccgatggaaacacagttagagcca

SEQ ID NO: 467622 - DNA, 25 bp, Homo sapien
ccgatggaaacacagttagagccac

SEQ ID NO: 467623 - DNA, 25 bp, Homo sapien
cccgcgcggccgagggagcaaaggg

SEQ ID NO: 467624 - DNA, 25 bp, Homo sapien
gcgcggccgagggagcaaagggctc

SEQ ID NO: 467625 - DNA, 25 bp, Homo sapien
cgagggagcaaagggctcggcactc

SEQ ID NO: 467626 - DNA, 25 bp, Homo sapien
aaagggctcggcactcgggcccctg

SEQ ID NO: 467627 - DNA, 25 bp, Homo sapien
gcgccggctctgcttcggcgggcgg

SEQ ID NO: 467628 - DNA, 25 bp, Homo sapien
ggacaggtctttgtgctgggcccca

SEQ ID NO: 467629 - DNA, 25 bp, Homo sapien
gacaggtctttgtgctgggccccac

SEQ ID NO: 467630 - DNA, 25 bp, Homo sapien
acaggtctttgtgctgggccccacg

SEQ ID NO: 467631 - DNA, 25 bp, Homo sapien
caggtctttgtgctgggccccacgc

SEQ ID NO: 467632 - DNA, 25 bp, Homo sapien
aggtctttgtgctgggccccacgcg

SEQ ID NO: 467633 - DNA, 25 bp, Homo sapien
ggtctttgtgctgggccccacgcgg

SEQ ID NO: 467634 - DNA, 25 bp, Homo sapien
ggcctaaacctgctgatccgcaaaa

SEQ ID NO: 467635 - DNA, 25 bp, Homo sapien
tgctgatccgcaaaaacggccggac

SEQ ID NO: 467636 - DNA, 25 bp, Homo sapien
caaaaacggccggacggtgaatctg

SEQ ID NO: 467637 - DNA, 25 bp, Homo sapien
ggacggtgaatctgggcggcaagac

SEQ ID NO: 467638 - DNA, 25 bp, Homo sapien
ggcaagacgtcggtgaccgtgtacc

SEQ ID NO: 467639 - DNA, 25 bp, Homo sapien
gggatgtgttctgtctccacacgcc

SEQ ID NO: 467640 - DNA, 25 bp, Homo sapien
tggcctttcccgagcacggcagcgt

SEQ ID NO: 467641 - DNA, 25 bp, Homo sapien
cacggcagcgtctatgagtatcgcc

SEQ ID NO: 467642 - DNA, 25 bp, Homo sapien
cgtctatgagtatcgccgggcccag

SEQ ID NO: 467643 - DNA, 25 bp, Homo sapien
gaggccgtgtgaggatcccgcaata

SEQ ID NO: 467644 - DNA, 25 bp, Homo sapien
gaggatcccgcaataaagatgcctt

SEQ ID NO: 467645 - DNA, 25 bp, Homo sapien
ggcatgggagatagggagacagtgt

SEQ ID NO: 467646 - DNA, 25 bp, Homo sapien
gcatgggagatagggagacagtgtg

SEQ ID NO: 467647 - DNA, 25 bp, Homo sapien
gggagacagtgtgggtgagcaggtg

SEQ ID NO: 467648 - DNA, 25 bp, Homo sapien
gagacagtgtgggtgagcaggtggg

SEQ ID NO: 467649 - DNA, 25 bp, Homo sapien
tgggtgagcaggtgggcaggagcta

SEQ ID NO: 467650 - DNA, 25 bp, Homo sapien
gggtgagcaggtgggcaggagctac

SEQ ID NO: 467651 - DNA, 25 bp, Homo sapien
ggtgagcaggtgggcaggagctaca

SEQ ID NO: 467652 - DNA, 25 bp, Homo sapien
caggagctacaggagcctggggcct

SEQ ID NO: 467653 - DNA, 25 bp, Homo sapien
tggatcacagacaccgccaggcaag

SEQ ID NO: 467654 - DNA, 25 bp, Homo sapien
ggatcacagacaccgccaggcaagt

SEQ ID NO: 467655 - DNA, 25 bp, Homo sapien
gatcacagacaccgccaggcaagtg

SEQ ID NO: 467656 - DNA, 25 bp, Homo sapien
cactcctgaagatccatctcttggg

SEQ ID NO: 467657 - DNA, 25 bp, Homo sapien
tgaagatccatctcttggggctccc

SEQ ID NO: 467658 - DNA, 25 bp, Homo sapien
gggctcccctgacagagaagacagc

SEQ ID NO: 467659 - DNA, 25 bp, Homo sapien
tcccctgacagagaagacagccgaa

SEQ ID NO: 467660 - DNA, 25 bp, Homo sapien
aagacagccgaagtcaaagccacat

SEQ ID NO: 467661 - DNA, 25 bp, Homo sapien
acagccgaagtcaaagccacatcct

SEQ ID NO: 467662 - DNA, 25 bp, Homo sapien
agccgaagtcaaagccacatcctct

SEQ ID NO: 467663 - DNA, 25 bp, Homo sapien
gaagtcaaagccacatcctcttgct

SEQ ID NO: 467664 - DNA, 25 bp, Homo sapien
gtcaaagccacatcctcttgctgat

SEQ ID NO: 467665 - DNA, 25 bp, Homo sapien
aaagccacatcctcttgctgatgtt

SEQ ID NO: 467666 - DNA, 25 bp, Homo sapien
agccacatcctcttgctgatgttgg

SEQ ID NO: 467667 - DNA, 25 bp, Homo sapien
tcatctagaggaaggtcctcatcat

SEQ ID NO: 467668 - DNA, 25 bp, Homo sapien
gtagaattgaacctgaacctgcttg

SEQ ID NO: 467669 - DNA, 25 bp, Homo sapien
gaattgaacctgaacctgcttgaca

SEQ ID NO: 467670 - DNA, 25 bp, Homo sapien
attgaacctgaacctgcttgacaga

SEQ ID NO: 467671 - DNA, 25 bp, Homo sapien
acctgcttgacagacaagagcccaa

SEQ ID NO: 467672 - DNA, 25 bp, Homo sapien
tgacagacaagagcccaagcctaac

SEQ ID NO: 467673 - DNA, 25 bp, Homo sapien
caagcctaaccaaggtggctgccat

SEQ ID NO: 467674 - DNA, 25 bp, Homo sapien
gcctaaccaaggtggctgccatggt

SEQ ID NO: 467675 - DNA, 25 bp, Homo sapien
aaggtggctgccatggtgacccttg

SEQ ID NO: 467676 - DNA, 25 bp, Homo sapien
atggtgacccttgccctgaaagcca

SEQ ID NO: 467677 - DNA, 25 bp, Homo sapien
taggaactataataacaggcttaaa

SEQ ID NO: 467678 - DNA, 25 bp, Homo sapien
aataactctgtcaggtaaacatgat

SEQ ID NO: 467679 - DNA, 25 bp, Homo sapien
ggtaaacatgattaagtcaccctta

SEQ ID NO: 467680 - DNA, 25 bp, Homo sapien
gattaagtcacccttatagatgtgg

SEQ ID NO: 467681 - DNA, 25 bp, Homo sapien
aagtcacccttatagatgtggatac

SEQ ID NO: 467682 - DNA, 25 bp, Homo sapien
aatttaagtaactcacttgtgacta

SEQ ID NO: 467683 - DNA, 25 bp, Homo sapien
gtaactcacttgtgactaccaaact

SEQ ID NO: 467684 - DNA, 25 bp, Homo sapien
gactaccaaactcatgaatggtgga

SEQ ID NO: 467685 - DNA, 25 bp, Homo sapien
aggtaagtgtggctcccagccagca

SEQ ID NO: 467686 - DNA, 25 bp, Homo sapien
tcgtaactgctcttactgaataaat

SEQ ID NO: 467687 - DNA, 25 bp, Homo sapien
gctcttactgaataaatcactgatg

SEQ ID NO: 467688 - DNA, 25 bp, Homo sapien
atcactgatgtggttaatttcaaaa

SEQ ID NO: 467689 - DNA, 25 bp, Homo sapien
ctttcagctgataaggtgtcctcct

SEQ ID NO: 467690 - DNA, 25 bp, Homo sapien
ggtgtcctcctgaagccaagtaggt

SEQ ID NO: 467691 - DNA, 25 bp, Homo sapien
ccaagtaggtggttctggtctccaa

SEQ ID NO: 467692 - DNA, 25 bp, Homo sapien
ggttctggtctccaagtatcgttaa

SEQ ID NO: 467693 - DNA, 25 bp, Homo sapien
ccaagtatcgttaagcacaggtgct

SEQ ID NO: 467694 - DNA, 25 bp, Homo sapien
gaggagttctgatcttaggcatctt

SEQ ID NO: 467695 - DNA, 25 bp, Homo sapien
taggcatcttaacagtcacaaggtg

SEQ ID NO: 467696 - DNA, 25 bp, Homo sapien
gaaacagtacaattcttgatgagtg

SEQ ID NO: 467697 - DNA, 25 bp, Homo sapien
aaagtagatagcttcccactggaaa

SEQ ID NO: 467698 - DNA, 25 bp, Homo sapien
aaagctaggccacactctatttcaa

SEQ ID NO: 467699 - DNA, 25 bp, Homo sapien
ggccacactctatttcaaggcattt

SEQ ID NO: 467700 - DNA, 25 bp, Homo sapien
gtgtgaaccaccacgtcctgctaaa

SEQ ID NO: 467701 - DNA, 25 bp, Homo sapien
gaaccaccacgtcctgctaaaaagt

SEQ ID NO: 467702 - DNA, 25 bp, Homo sapien
aatctaagttccattttcccgtcat

SEQ ID NO: 467703 - DNA, 25 bp, Homo sapien
ttcccgtcatgtttattaatttgtc

SEQ ID NO: 467704 - DNA, 25 bp, Homo sapien
ccgtcatgtttattaatttgtccca

SEQ ID NO: 467705 - DNA, 25 bp, Homo sapien
gtttattaatttgtcccattgcaag

SEQ ID NO: 467706 - DNA, 25 bp, Homo sapien
taatttgtcccattgcaagatatgt

SEQ ID NO: 467707 - DNA, 25 bp, Homo sapien
gtcccattgcaagatatgtttctgt

SEQ ID NO: 467708 - DNA, 25 bp, Homo sapien
gcaagatatgtttctgttgtctgca

SEQ ID NO: 467709 - DNA, 25 bp, Homo sapien
atatgtttctgttgtctgcatgggt

SEQ ID NO: 467710 - DNA, 25 bp, Homo sapien
gtctgcatgggtagagataatttta

SEQ ID NO: 467711 - DNA, 25 bp, Homo sapien
ggaagctgtgccaattgtaccagga

SEQ ID NO: 467712 - DNA, 25 bp, Homo sapien
agctgtgccaattgtaccaggagca

SEQ ID NO: 467713 - DNA, 25 bp, Homo sapien
tgccaattgtaccaggagcacatgg

SEQ ID NO: 467714 - DNA, 25 bp, Homo sapien
gggagccaagactggcatcaaggaa

SEQ ID NO: 467715 - DNA, 25 bp, Homo sapien
ctggcatcaaggaatgccagcacca

SEQ ID NO: 467716 - DNA, 25 bp, Homo sapien
tgcagcacagcggacaacgcatctg

SEQ ID NO: 467717 - DNA, 25 bp, Homo sapien
agcggacaacgcatctgtctttggg

SEQ ID NO: 467718 - DNA, 25 bp, Homo sapien
ggacaacgcatctgtctttgggaga

SEQ ID NO: 467719 - DNA, 25 bp, Homo sapien
tgggagagtcatgcagataggcagc

SEQ ID NO: 467720 - DNA, 25 bp, Homo sapien
aggcagccgagagaccgccttcacc

SEQ ID NO: 467721 - DNA, 25 bp, Homo sapien
tggtcaacgccatcagccgggcctg

SEQ ID NO: 467722 - DNA, 25 bp, Homo sapien
ttaactagaaaggagaacttcctgg

SEQ ID NO: 467723 - DNA, 25 bp, Homo sapien
gagaacttcctggagtgaaagaaga

SEQ ID NO: 467724 - DNA, 25 bp, Homo sapien
agaacttcctggagtgaaagaagat

SEQ ID NO: 467725 - DNA, 25 bp, Homo sapien
gaacttcctggagtgaaagaagata

SEQ ID NO: 467726 - DNA, 25 bp, Homo sapien
aacttcctggagtgaaagaagatac

SEQ ID NO: 467727 - DNA, 25 bp, Homo sapien
ttcctggagtgaaagaagatacgtt

SEQ ID NO: 467728 - DNA, 25 bp, Homo sapien
tcctggagtgaaagaagatacgttt

SEQ ID NO: 467729 - DNA, 25 bp, Homo sapien
cctggagtgaaagaagatacgtttt

SEQ ID NO: 467730 - DNA, 25 bp, Homo sapien
ctggagtgaaagaagatacgttttg

SEQ ID NO: 467731 - DNA, 25 bp, Homo sapien
ggagtgaaagaagatacgttttgat

SEQ ID NO: 467732 - DNA, 25 bp, Homo sapien
aagaagatacgttttgatggccagg

SEQ ID NO: 467733 - DNA, 25 bp, Homo sapien
ttcaccattgctcttagggtacaat

SEQ ID NO: 467734 - DNA, 25 bp, Homo sapien
tttatcttcatctttaaggtctcag

SEQ ID NO: 467735 - DNA, 25 bp, Homo sapien
taaggtctcagtatgccacttcatc

SEQ ID NO: 467736 - DNA, 25 bp, Homo sapien
gtctcagtatgccacttcatctagg

SEQ ID NO: 467737 - DNA, 25 bp, Homo sapien
aggaaaccttcattgatgccctcta

SEQ ID NO: 467738 - DNA, 25 bp, Homo sapien
atgccctctagattaggtgccctta

SEQ ID NO: 467739 - DNA, 25 bp, Homo sapien
gattaggtgcccttactatccattc

SEQ ID NO: 467740 - DNA, 25 bp, Homo sapien
tttcccagacatacacttggcacac

SEQ ID NO: 467741 - DNA, 25 bp, Homo sapien
gttactgcttattgatcactgctag

SEQ ID NO: 467742 - DNA, 25 bp, Homo sapien
gcttattgatcactgctagactgta

SEQ ID NO: 467743 - DNA, 25 bp, Homo sapien
ctgttatatctctagtgcttagcac

SEQ ID NO: 467744 - DNA, 25 bp, Homo sapien
gactttttaatgatcagatagcctc

SEQ ID NO: 467745 - DNA, 25 bp, Homo sapien
tttttaatgatcagatagcctccta

SEQ ID NO: 467746 - DNA, 25 bp, Homo sapien
aactatgagttggaatttgctgctt

SEQ ID NO: 467747 - DNA, 25 bp, Homo sapien
ctatgagttggaatttgctgctttt

SEQ ID NO: 467748 - DNA, 25 bp, Homo sapien
atttgctgcttttgatatgataaga

SEQ ID NO: 467749 - DNA, 25 bp, Homo sapien
gataagaaagttcaaagtttctctt

SEQ ID NO: 467750 - DNA, 25 bp, Homo sapien
catcccccagtaaagaaaaggctca

SEQ ID NO: 467751 - DNA, 25 bp, Homo sapien
aaaaggctcagtatgatttcttgaa

SEQ ID NO: 467752 - DNA, 25 bp, Homo sapien
aaggctcagtatgatttcttgaata

SEQ ID NO: 467753 - DNA, 25 bp, Homo sapien
ggctcagtatgatttcttgaataga

SEQ ID NO: 467754 - DNA, 25 bp, Homo sapien
gatttcttgaatagattgtttaagc

SEQ ID NO: 467755 - DNA, 25 bp, Homo sapien
ggcgggaactgcaaacagactcttt

SEQ ID NO: 467756 - DNA, 25 bp, Homo sapien
tgagactatttatccaatccactgg

SEQ ID NO: 467757 - DNA, 25 bp, Homo sapien
aatccactggtctgtgagtttttga

SEQ ID NO: 467758 - DNA, 25 bp, Homo sapien
gcttgcacagcatggtctcagttgt

SEQ ID NO: 467759 - DNA, 25 bp, Homo sapien
gaaattgcagagcttaactcgccta

SEQ ID NO: 467760 - DNA, 25 bp, Homo sapien
taactcgcctagtagatttgcacca

SEQ ID NO: 467761 - DNA, 25 bp, Homo sapien
ttgcaccaatggaaccgaagaactt

SEQ ID NO: 467762 - DNA, 25 bp, Homo sapien
gaagaacttcatagacactcacaag

SEQ ID NO: 467763 - DNA, 25 bp, Homo sapien
gacactcacaaggttatatccattt

SEQ ID NO: 467764 - DNA, 25 bp, Homo sapien
atcaacgtatacttttccgagactg

SEQ ID NO: 467765 - DNA, 25 bp, Homo sapien
tttccgagactgtatacgtccatat

SEQ ID NO: 467766 - DNA, 25 bp, Homo sapien
taacatgaaatccacaaaagcggaa

SEQ ID NO: 467767 - DNA, 25 bp, Homo sapien
tgcactttacagaatcattgtcctt

SEQ ID NO: 467768 - DNA, 25 bp, Homo sapien
agaatcattgtccttagctttagag

SEQ ID NO: 467769 - DNA, 25 bp, Homo sapien
gtccttagctttagaggttgttaat

SEQ ID NO: 467770 - DNA, 25 bp, Homo sapien
taacatgaacagaatgtgtggttct

SEQ ID NO: 467771 - DNA, 25 bp, Homo sapien
ttggagacacctgagggctggtcca

SEQ ID NO: 467772 - DNA, 25 bp, Homo sapien
tgagggctggtccacgtctcacctt

SEQ ID NO: 467773 - DNA, 25 bp, Homo sapien
tctcacctttgccatacgggtcatt

SEQ ID NO: 467774 - DNA, 25 bp, Homo sapien
tttgccatacgggtcatttcttgat

SEQ ID NO: 467775 - DNA, 25 bp, Homo sapien
gccatacgggtcatttcttgatcaa

SEQ ID NO: 467776 - DNA, 25 bp, Homo sapien
acgggtcatttcttgatcaaatata

SEQ ID NO: 467777 - DNA, 25 bp, Homo sapien
ggctccttgcggtcacattctggtt

SEQ ID NO: 467778 - DNA, 25 bp, Homo sapien
ttctggttctctgtgttttgtggac

SEQ ID NO: 467779 - DNA, 25 bp, Homo sapien
tgttcacccagcactagcagtacca

SEQ ID NO: 467780 - DNA, 25 bp, Homo sapien
gtaccagatggttctgtggagtcct

SEQ ID NO: 467781 - DNA, 25 bp, Homo sapien
gaatggagagagcacagtctgactc

SEQ ID NO: 467782 - DNA, 25 bp, Homo sapien
agtagccaggagttgacttgcccat

SEQ ID NO: 467783 - DNA, 25 bp, Homo sapien
agttgacttgcccatggtccgctgg

SEQ ID NO: 467784 - DNA, 25 bp, Homo sapien
accacttcctacaggatgggatcta

SEQ ID NO: 467785 - DNA, 25 bp, Homo sapien
gagactcaagagctgggtttctttc

SEQ ID NO: 467786 - DNA, 25 bp, Homo sapien
cactctgtactgtcccaaatagcaa

SEQ ID NO: 467787 - DNA, 25 bp, Homo sapien
acaaatcactttgtagccagatttc

SEQ ID NO: 467788 - DNA, 25 bp, Homo sapien
ttgtgtgtgcataaattcattctgt

SEQ ID NO: 467789 - DNA, 25 bp, Homo sapien
aagagtcccagaatgttgcttctat

SEQ ID NO: 467790 - DNA, 25 bp, Homo sapien
gcttctattattgtgcacaaccatt

SEQ ID NO: 467791 - DNA, 25 bp, Homo sapien
gtgcacaaccattgagaggtgttac

SEQ ID NO: 467792 - DNA, 25 bp, Homo sapien
tttaacatgtgtgatgtgccatggt

SEQ ID NO: 467793 - DNA, 25 bp, Homo sapien
gtgccatggtggaaaagtactatcg

SEQ ID NO: 467794 - DNA, 25 bp, Homo sapien
gtactatcggaataactctgcagtg

SEQ ID NO: 467795 - DNA, 25 bp, Homo sapien
gaagtttggctagcatccatacttt

SEQ ID NO: 467796 - DNA, 25 bp, Homo sapien
gctagcatccatacttttctactgt

SEQ ID NO: 467797 - DNA, 25 bp, Homo sapien
taaatatttcactctcctctagcta

SEQ ID NO: 467798 - DNA, 25 bp, Homo sapien
tctcctctagctatccttgatgagc

SEQ ID NO: 467799 - DNA, 25 bp, Homo sapien
agaagtgattcagggattcctatga

SEQ ID NO: 467800 - DNA, 25 bp, Homo sapien
gaacgcattttattgcagaagctaa

SEQ ID NO: 467801 - DNA, 25 bp, Homo sapien
aaaaagctaaagtaccagtcatcta

SEQ ID NO: 467802 - DNA, 25 bp, Homo sapien
gtaccagtcatctagagagaaggaa

SEQ ID NO: 467803 - DNA, 25 bp, Homo sapien
catgtatatgttgtctgttgtaaaa

SEQ ID NO: 467804 - DNA, 25 bp, Homo sapien
ttaacgaatactttgttcagggctc

SEQ ID NO: 467805 - DNA, 25 bp, Homo sapien
ttgttcagggctcactctctctttg

SEQ ID NO: 467806 - DNA, 25 bp, Homo sapien
gctcactctctctttgtcatgaaag

SEQ ID NO: 467807 - DNA, 25 bp, Homo sapien
ctctctttgtcatgaaagccagctc

SEQ ID NO: 467808 - DNA, 25 bp, Homo sapien
aagccagctccttgtggcgaggtaa

SEQ ID NO: 467809 - DNA, 25 bp, Homo sapien
ggcgaggtaaagtggaattccaata

SEQ ID NO: 467810 - DNA, 25 bp, Homo sapien
gcattcattctgctaggattgggct

SEQ ID NO: 467811 - DNA, 25 bp, Homo sapien
gtactttttctgctcctagtcatct

SEQ ID NO: 467812 - DNA, 25 bp, Homo sapien
tagtcatctccctttctcagcgtga

SEQ ID NO: 467813 - DNA, 25 bp, Homo sapien
cctgcagcaagcctagtatcactag

SEQ ID NO: 467814 - DNA, 25 bp, Homo sapien
gtatcactagcagtagttcctgcga

SEQ ID NO: 467815 - DNA, 25 bp, Homo sapien
gttcctgcgactcttagcaacacaa

SEQ ID NO: 467816 - DNA, 25 bp, Homo sapien
aacacaacccgaatatttgctccct

SEQ ID NO: 467817 - DNA, 25 bp, Homo sapien
accaggatgggcctgcgcatctgca

SEQ ID NO: 467818 - DNA, 25 bp, Homo sapien
gcgcatctgcattgctgtacagaca

SEQ ID NO: 467819 - DNA, 25 bp, Homo sapien
gtacagacaaacaggccttttaatt

SEQ ID NO: 467820 - DNA, 25 bp, Homo sapien
tttacatcctcctttaattctcatt

SEQ ID NO: 467821 - DNA, 25 bp, Homo sapien
cctgttactaggtggacttcactgc

SEQ ID NO: 467822 - DNA, 25 bp, Homo sapien
gttactaggtggacttcactgcctg

SEQ ID NO: 467823 - DNA, 25 bp, Homo sapien
actaggtggacttcactgcctgtga

SEQ ID NO: 467824 - DNA, 25 bp, Homo sapien
taggtggacttcactgcctgtgaat

SEQ ID NO: 467825 - DNA, 25 bp, Homo sapien
gtttgtatttggacaggccaggctt

SEQ ID NO: 467826 - DNA, 25 bp, Homo sapien
agggagagaactgggctactcttca

SEQ ID NO: 467827 - DNA, 25 bp, Homo sapien
tcttcagcagtgatctttaaaatgc

SEQ ID NO: 467828 - DNA, 25 bp, Homo sapien
gtgatctttaaaatgccagtcttgg

SEQ ID NO: 467829 - DNA, 25 bp, Homo sapien
ttaaaatgccagtcttgggccaggc

SEQ ID NO: 467830 - DNA, 25 bp, Homo sapien
aaatgccagtcttgggccaggcgtg

SEQ ID NO: 467831 - DNA, 25 bp, Homo sapien
tagccaggtggttggcatgctccta

SEQ ID NO: 467832 - DNA, 25 bp, Homo sapien
tgcctgttttttctttaattattca

SEQ ID NO: 467833 - DNA, 25 bp, Homo sapien
tattcaaggttgatgacttttagga

SEQ ID NO: 467834 - DNA, 25 bp, Homo sapien
gcaagtgccttgatgtaattccatg

SEQ ID NO: 467835 - DNA, 25 bp, Homo sapien
gtaaatcattgcttaaccctcttat

SEQ ID NO: 467836 - DNA, 25 bp, Homo sapien
ttgcttaaccctcttatgggatgag

SEQ ID NO: 467837 - DNA, 25 bp, Homo sapien
gttattaatgtattgcagcctactg

SEQ ID NO: 467838 - DNA, 25 bp, Homo sapien
gttggttaatagcagatacttttct

SEQ ID NO: 467839 - DNA, 25 bp, Homo sapien
tagcagatacttttcttctagaagc

SEQ ID NO: 467840 - DNA, 25 bp, Homo sapien
atgctgtttattatgtaagatcctg

SEQ ID NO: 467841 - DNA, 25 bp, Homo sapien
gtaagatcctgtatgtgtgttgaga

SEQ ID NO: 467842 - DNA, 25 bp, Homo sapien
ggtttcatttgttttgtctgctaat

SEQ ID NO: 467843 - DNA, 25 bp, Homo sapien
tttctgtgtcaaaacagtcacgcag

SEQ ID NO: 467844 - DNA, 25 bp, Homo sapien
gtgtcaaaacagtcacgcagaaata

SEQ ID NO: 467845 - DNA, 25 bp, Homo sapien
aaacagtcacgcagaaataaacagt

SEQ ID NO: 467846 - DNA, 25 bp, Homo sapien
gacagcactgtgatgagaaaagcga

SEQ ID NO: 467847 - DNA, 25 bp, Homo sapien
gcactgtgatgagaaaagcgaagaa

SEQ ID NO: 467848 - DNA, 25 bp, Homo sapien
ttaacattgaaaacagtgaggcagt

SEQ ID NO: 467849 - DNA, 25 bp, Homo sapien
cattgaaaacagtgaggcagtgtaa

SEQ ID NO: 467850 - DNA, 25 bp, Homo sapien
atgtgatttttcatttggtaagtgc

SEQ ID NO: 467851 - DNA, 25 bp, Homo sapien
atagaatttagtcgaccttaagaat

SEQ ID NO: 467852 - DNA, 25 bp, Homo sapien
gaatttagtcgaccttaagaattgt

SEQ ID NO: 467853 - DNA, 25 bp, Homo sapien
ttagtcgaccttaagaattgttaat

SEQ ID NO: 467854 - DNA, 25 bp, Homo sapien
acagtgcactctgaaatgcctcatg

SEQ ID NO: 467855 - DNA, 25 bp, Homo sapien
aaatgcctcatgatctcttttccct

SEQ ID NO: 467856 - DNA, 25 bp, Homo sapien
ttgccactttttgctgccctaggag

SEQ ID NO: 467857 - DNA, 25 bp, Homo sapien
tgctgccctaggagtaggcctgtgt

SEQ ID NO: 467858 - DNA, 25 bp, Homo sapien
atgaaatgcttttacagagacagag

SEQ ID NO: 467859 - DNA, 25 bp, Homo sapien
gaagactaatagatttcacactttc

SEQ ID NO: 467860 - DNA, 25 bp, Homo sapien
tcacactttctagtccttttccaaa

SEQ ID NO: 467861 - DNA, 25 bp, Homo sapien
tagtccttttccaaagggtccgctg

SEQ ID NO: 467862 - DNA, 25 bp, Homo sapien
aaagggtccgctgtccctggagact

SEQ ID NO: 467863 - DNA, 25 bp, Homo sapien
tgatgatgtcatagtcctcttccag

SEQ ID NO: 467864 - DNA, 25 bp, Homo sapien
caggagctgtttttagttccacttt

SEQ ID NO: 467865 - DNA, 25 bp, Homo sapien
taaactttggtggatcagaggtgaa

SEQ ID NO: 467866 - DNA, 25 bp, Homo sapien
tcagaggtgaatttaagtccaaaac

SEQ ID NO: 467867 - DNA, 25 bp, Homo sapien
ggcctttgctgatgaagttacgtgc

SEQ ID NO: 467868 - DNA, 25 bp, Homo sapien
tgatgaagttacgtgcttttgctgt

SEQ ID NO: 467869 - DNA, 25 bp, Homo sapien
tgctgttttgtctgtggagaatcag

SEQ ID NO: 467870 - DNA, 25 bp, Homo sapien
attcttggaactatgtgagaagact

SEQ ID NO: 467871 - DNA, 25 bp, Homo sapien
ctatgtgagaagactagatcatttc

SEQ ID NO: 467872 - DNA, 25 bp, Homo sapien
agtggttgcatatttaacctgctgt

SEQ ID NO: 467873 - DNA, 25 bp, Homo sapien
atttaacctgctgtgcagagcccag

SEQ ID NO: 467874 - DNA, 25 bp, Homo sapien
taatgtgaagtctgattctctcttg

SEQ ID NO: 467875 - DNA, 25 bp, Homo sapien
gaagtctgattctctcttgtggtac

SEQ ID NO: 467876 - DNA, 25 bp, Homo sapien
atttccaagtccctacatcctgaga

SEQ ID NO: 467877 - DNA, 25 bp, Homo sapien
agtccctacatcctgagagtcctca

SEQ ID NO: 467878 - DNA, 25 bp, Homo sapien
gagagaaccagcaaagtccactcct

SEQ ID NO: 467879 - DNA, 25 bp, Homo sapien
atctccagcgtctcttaaataagct

SEQ ID NO: 467880 - DNA, 25 bp, Homo sapien
tcttaaataagctcttcctttccat

SEQ ID NO: 467881 - DNA, 25 bp, Homo sapien
cattttcatctttccattgtatagc

SEQ ID NO: 467882 - DNA, 25 bp, Homo sapien
atctttccattgtatagcacccacc

SEQ ID NO: 467883 - DNA, 25 bp, Homo sapien
agcacccacccatttacttatacaa

SEQ ID NO: 467884 - DNA, 25 bp, Homo sapien
atagacctttgtgaggcagagtgca

SEQ ID NO: 467885 - DNA, 25 bp, Homo sapien
gccctccgggctatttacagatgta

SEQ ID NO: 467886 - DNA, 25 bp, Homo sapien
tatttacagatgtactggtccacga

SEQ ID NO: 467887 - DNA, 25 bp, Homo sapien
cctggccaacaaggcgaaatgctgt

SEQ ID NO: 467888 - DNA, 25 bp, Homo sapien
acaaaaattagccagaaatcacttg

SEQ ID NO: 467889 - DNA, 25 bp, Homo sapien
caaaaattagccagaaatcacttga

SEQ ID NO: 467890 - DNA, 25 bp, Homo sapien
aaaaattagccagaaatcacttgaa

SEQ ID NO: 467891 - DNA, 25 bp, Homo sapien
aaaattagccagaaatcacttgaat

SEQ ID NO: 467892 - DNA, 25 bp, Homo sapien
acgtatcctaggagttaggtattct

SEQ ID NO: 467893 - DNA, 25 bp, Homo sapien
cgtatcctaggagttaggtattctc

SEQ ID NO: 467894 - DNA, 25 bp, Homo sapien
gtatcctaggagttaggtattctca

SEQ ID NO: 467895 - DNA, 25 bp, Homo sapien
atctgggatgcccattctgggattc

SEQ ID NO: 467896 - DNA, 25 bp, Homo sapien
attctgggattcacccatgacagtt

SEQ ID NO: 467897 - DNA, 25 bp, Homo sapien
cccatgacagttcccactgcttttt

SEQ ID NO: 467898 - DNA, 25 bp, Homo sapien
ttcttgttctctcccttttgacagg

SEQ ID NO: 467899 - DNA, 25 bp, Homo sapien
tttgacaggccttcatatttttggg

SEQ ID NO: 467900 - DNA, 25 bp, Homo sapien
tatttttgggagcacttcctcactt

SEQ ID NO: 467901 - DNA, 25 bp, Homo sapien
tcctcactttcaggcactgaagata

SEQ ID NO: 467902 - DNA, 25 bp, Homo sapien
attccaagctcataacttttcctgc

SEQ ID NO: 467903 - DNA, 25 bp, Homo sapien
gatggacacttaatgtagctggaca

SEQ ID NO: 467904 - DNA, 25 bp, Homo sapien
atgtagcatgccaatatccagagaa

SEQ ID NO: 467905 - DNA, 25 bp, Homo sapien
cagagaattggattctgaacagcct

SEQ ID NO: 467906 - DNA, 25 bp, Homo sapien
ttagcagtcttacaaaagttgcact

SEQ ID NO: 467907 - DNA, 25 bp, Homo sapien
aagttgcactttgggaacatgctct

SEQ ID NO: 467908 - DNA, 25 bp, Homo sapien
gggaacatgctctcacatcgagcca

SEQ ID NO: 467909 - DNA, 25 bp, Homo sapien
ctcacatcgagccattttctgcttt

SEQ ID NO: 467910 - DNA, 25 bp, Homo sapien
gctttcccatactctgttcatagta

SEQ ID NO: 467911 - DNA, 25 bp, Homo sapien
ttcatagtagtaacaagctcttgct

SEQ ID NO: 467912 - DNA, 25 bp, Homo sapien
aagctcttgctggataactaagtct

SEQ ID NO: 467913 - DNA, 25 bp, Homo sapien
aactaagtctatatggagcctttat

SEQ ID NO: 467914 - DNA, 25 bp, Homo sapien
gagcctttattcattggatggtcaa

SEQ ID NO: 467915 - DNA, 25 bp, Homo sapien
atggtcaaatatatgctaggcatga

SEQ ID NO: 467916 - DNA, 25 bp, Homo sapien
ctaggcatgatgctaagtgcttatg

SEQ ID NO: 467917 - DNA, 25 bp, Homo sapien
ctgctgccaagagtgacagtgcctt

SEQ ID NO: 467918 - DNA, 25 bp, Homo sapien
aagagtgacagtgccttcctgatga

SEQ ID NO: 467919 - DNA, 25 bp, Homo sapien
gatgagggttcctttgttcaggtat

SEQ ID NO: 467920 - DNA, 25 bp, Homo sapien
gttcctttgttcaggtatttacctg

SEQ ID NO: 467921 - DNA, 25 bp, Homo sapien
ttacctggttatagtaaagcctatt

SEQ ID NO: 467922 - DNA, 25 bp, Homo sapien
gtaaagcctatttctgataccactc

SEQ ID NO: 467923 - DNA, 25 bp, Homo sapien
agcctatttctgataccactcaggt

SEQ ID NO: 467924 - DNA, 25 bp, Homo sapien
actcaggtcaaaaaactgtcgtgtt

SEQ ID NO: 467925 - DNA, 25 bp, Homo sapien
atgtccatggttgccgtttgaaatt

SEQ ID NO: 467926 - DNA, 25 bp, Homo sapien
catggttgccgtttgaaatttctgt

SEQ ID NO: 467927 - DNA, 25 bp, Homo sapien
ttgaaatttctgtaggtcaggcggg

SEQ ID NO: 467928 - DNA, 25 bp, Homo sapien
tgcacccagccagaaacagtaatct

SEQ ID NO: 467929 - DNA, 25 bp, Homo sapien
gaaacagtaatctctaccagtattg

SEQ ID NO: 467930 - DNA, 25 bp, Homo sapien
aacagtaatctctaccagtattgta

SEQ ID NO: 467931 - DNA, 25 bp, Homo sapien
aatctctaccagtattgtaggaggc

SEQ ID NO: 467932 - DNA, 25 bp, Homo sapien
taccagtattgtaggaggcagaaca

SEQ ID NO: 467933 - DNA, 25 bp, Homo sapien
cagtattgtaggaggcagaacagat

SEQ ID NO: 467934 - DNA, 25 bp, Homo sapien
ggcagaacagatatggaaagaaaac

SEQ ID NO: 467935 - DNA, 25 bp, Homo sapien
aaacagaggtctttttcactatggt

SEQ ID NO: 467936 - DNA, 25 bp, Homo sapien
acagaggtctttttcactatggtaa

SEQ ID NO: 467937 - DNA, 25 bp, Homo sapien
gaggtctttttcactatggtaagtt

SEQ ID NO: 467938 - DNA, 25 bp, Homo sapien
ggtctttttcactatggtaagtttg

SEQ ID NO: 467939 - DNA, 25 bp, Homo sapien
aatccagttgctcaagttctttacc

SEQ ID NO: 467940 - DNA, 25 bp, Homo sapien
ttgctcaagttctttacctcaacct

SEQ ID NO: 467941 - DNA, 25 bp, Homo sapien
gttctttacctcaacctgaaggaat

SEQ ID NO: 467942 - DNA, 25 bp, Homo sapien
tcaacctgaaggaatgaagcattat

SEQ ID NO: 467943 - DNA, 25 bp, Homo sapien
gaatggtgttcagcctataagacga

SEQ ID NO: 467944 - DNA, 25 bp, Homo sapien
gttcagcctataagacgaagtctca

SEQ ID NO: 467945 - DNA, 25 bp, Homo sapien
gacgaagtctcacaagacctatagg

SEQ ID NO: 467946 - DNA, 25 bp, Homo sapien
ataggaaagtttaccatctgcctta

SEQ ID NO: 467947 - DNA, 25 bp, Homo sapien
ttaaaatatccatctgttattcaca

SEQ ID NO: 467948 - DNA, 25 bp, Homo sapien
gtctaggaattatcaaaggtactgc

SEQ ID NO: 467949 - DNA, 25 bp, Homo sapien
aatagcacatacattgatagatggg

SEQ ID NO: 467950 - DNA, 25 bp, Homo sapien
cctcaaagagggtgcaatccagttg

SEQ ID NO: 467951 - DNA, 25 bp, Homo sapien
ggtgcaatccagttgatttttacat

SEQ ID NO: 467952 - DNA, 25 bp, Homo sapien
ttacattgaaaggtcacagttcccc

SEQ ID NO: 467953 - DNA, 25 bp, Homo sapien
gtagcttttctcatggacttaagtc

SEQ ID NO: 467954 - DNA, 25 bp, Homo sapien
cccatgaagcagtctcaggctaaga

SEQ ID NO: 467955 - DNA, 25 bp, Homo sapien
tattatggaccgtagcccaatctgt

SEQ ID NO: 467956 - DNA, 25 bp, Homo sapien
accgtagcccaatctgttcatttta

SEQ ID NO: 467957 - DNA, 25 bp, Homo sapien
atgaggcaactgagtccacaggaga

SEQ ID NO: 467958 - DNA, 25 bp, Homo sapien
ttaagtccccatcggtgacacggag

SEQ ID NO: 467959 - DNA, 25 bp, Homo sapien
cttcagaaccaactgttggccctga

SEQ ID NO: 467960 - DNA, 25 bp, Homo sapien
gttggccctgaaaagacctcaaaga

SEQ ID NO: 467961 - DNA, 25 bp, Homo sapien
ctttgctacattgtaactcacctaa

SEQ ID NO: 467962 - DNA, 25 bp, Homo sapien
tacattgtaactcacctaaaacctt

SEQ ID NO: 467963 - DNA, 25 bp, Homo sapien
gtgacaaaatcctaatatgtggaaa

SEQ ID NO: 467964 - DNA, 25 bp, Homo sapien
ggaaacttttagagtattacttcat

SEQ ID NO: 467965 - DNA, 25 bp, Homo sapien
tagagtattacttcatagggcagat

SEQ ID NO: 467966 - DNA, 25 bp, Homo sapien
gtattacttcatagggcagattttg

SEQ ID NO: 467967 - DNA, 25 bp, Homo sapien
acttcatagggcagattttgtaaac

SEQ ID NO: 467968 - DNA, 25 bp, Homo sapien
gggcagattttgtaaactgtcgtat

SEQ ID NO: 467969 - DNA, 25 bp, Homo sapien
gattttgtaaactgtcgtatactgt

SEQ ID NO: 467970 - DNA, 25 bp, Homo sapien
taaactgtcgtatactgtaaagggt

SEQ ID NO: 467971 - DNA, 25 bp, Homo sapien
taaagggttaaatcagcgttttgtg

SEQ ID NO: 467972 - DNA, 25 bp, Homo sapien
tgcctctgggcataactgtgtgtcc

SEQ ID NO: 467973 - DNA, 25 bp, Homo sapien
aactgtgtgtcctggtacctacgaa

SEQ ID NO: 467974 - DNA, 25 bp, Homo sapien
tggtacctacgaactccaagtcagc

SEQ ID NO: 467975 - DNA, 25 bp, Homo sapien
aagtcagcccctctagttattgtta

SEQ ID NO: 467976 - DNA, 25 bp, Homo sapien
agcccctctagttattgttacaata

SEQ ID NO: 467977 - DNA, 25 bp, Homo sapien
taattgattctcagctcaccacgtc

SEQ ID NO: 467978 - DNA, 25 bp, Homo sapien
caccacgtccataactattactgag

SEQ ID NO: 467979 - DNA, 25 bp, Homo sapien
attactgagtcaaacacggagctag

SEQ ID NO: 467980 - DNA, 25 bp, Homo sapien
ctggacgctgctttgtttcctggga

SEQ ID NO: 467981 - DNA, 25 bp, Homo sapien
agtggaggctggaatcacccaagct

SEQ ID NO: 467982 - DNA, 25 bp, Homo sapien
caagctccaagacacctgatcaaaa

SEQ ID NO: 467983 - DNA, 25 bp, Homo sapien
ccagcgccatttatgaggagtcaaa

SEQ ID NO: 467984 - DNA, 25 bp, Homo sapien
tgaggagtcaaatcctaaggatcca

SEQ ID NO: 467985 - DNA, 25 bp, Homo sapien
aatcctaaggatccagcggcagtga

SEQ ID NO: 467986 - DNA, 25 bp, Homo sapien
atccagcggcagtgacagaatccaa

SEQ ID NO: 467987 - DNA, 25 bp, Homo sapien
agggaacagaggcatcagcatcgaa

SEQ ID NO: 467988 - DNA, 25 bp, Homo sapien
ggccgactccatgcagcagaagcta

SEQ ID NO: 467989 - DNA, 25 bp, Homo sapien
cgactccatgcagcagaagctagct

SEQ ID NO: 467990 - DNA, 25 bp, Homo sapien
ccatgcagcagaagctagctggccc

SEQ ID NO: 467991 - DNA, 25 bp, Homo sapien
cgcagaatcccagcgccatttatga

SEQ ID NO: 467992 - DNA, 25 bp, Homo sapien
gaatcccagcgccatttatgaggag

SEQ ID NO: 467993 - DNA, 25 bp, Homo sapien
atcccagcgccatttatgaggagtc

SEQ ID NO: 467994 - DNA, 25 bp, Homo sapien
cactctgcccggcttatttttcttt

SEQ ID NO: 467995 - DNA, 25 bp, Homo sapien
tatgtttttgcttcgtaagaggttc

SEQ ID NO: 467996 - DNA, 25 bp, Homo sapien
ttcgtaagaggttctgttgagcagt

SEQ ID NO: 467997 - DNA, 25 bp, Homo sapien
ttgagcagtgatttgcaactcttgc

SEQ ID NO: 467998 - DNA, 25 bp, Homo sapien
gtgatttgcaactcttgctgacgtt

SEQ ID NO: 467999 - DNA, 25 bp, Homo sapien
ttgcaactcttgctgacgttgctgg

SEQ ID NO: 468000 - DNA, 25 bp, Homo sapien
aaaagatgccccacagagattctga

SEQ ID NO: 468001 - DNA, 25 bp, Homo sapien
gattctgattttaattgttctgatt

SEQ ID NO: 468002 - DNA, 25 bp, Homo sapien
attgttctgatttaattggcttgga

SEQ ID NO: 468003 - DNA, 25 bp, Homo sapien
attggcttggagtagaattcaggca

SEQ ID NO: 468004 - DNA, 25 bp, Homo sapien
gtagaattcaggcattgatatcttt

SEQ ID NO: 468005 - DNA, 25 bp, Homo sapien
actagcatctgaaactatatccaga

SEQ ID NO: 468006 - DNA, 25 bp, Homo sapien
ccagaatgacactggttttcataaa

SEQ ID NO: 468007 - DNA, 25 bp, Homo sapien
aaaagtgttgatcctcacacctctt

SEQ ID NO: 468008 - DNA, 25 bp, Homo sapien
atcctcacacctctttatagtcttg

SEQ ID NO: 468009 - DNA, 25 bp, Homo sapien
tttatagtcttgcacctagcacagt

SEQ ID NO: 468010 - DNA, 25 bp, Homo sapien
gcacctagcacagtggagtgaaaca

SEQ ID NO: 468011 - DNA, 25 bp, Homo sapien
ctttaaatagcacttgttccttgag

SEQ ID NO: 468012 - DNA, 25 bp, Homo sapien
atgagcagcatctcaggagtctcca

SEQ ID NO: 468013 - DNA, 25 bp, Homo sapien
caggagtctccaattcttgaattac

SEQ ID NO: 468014 - DNA, 25 bp, Homo sapien
tattttgagagacttaccctccaaa

SEQ ID NO: 468015 - DNA, 25 bp, Homo sapien
gacttaccctccaaaatgaatgtat

SEQ ID NO: 468016 - DNA, 25 bp, Homo sapien
tgattttgttgaccatgttcgtgaa

SEQ ID NO: 468017 - DNA, 25 bp, Homo sapien
tttgttgaccatgttcgtgaattac

SEQ ID NO: 468018 - DNA, 25 bp, Homo sapien
gaccatgttcgtgaattacagatgc

SEQ ID NO: 468019 - DNA, 25 bp, Homo sapien
tcgtgaattacagatgcaacatgca

SEQ ID NO: 468020 - DNA, 25 bp, Homo sapien
gcaacatgcattggtagaatcgtgt

SEQ ID NO: 468021 - DNA, 25 bp, Homo sapien
tagaatcgtgtgatggtcttttgtg

SEQ ID NO: 468022 - DNA, 25 bp, Homo sapien
aatttttacatatcccagtctctgt

SEQ ID NO: 468023 - DNA, 25 bp, Homo sapien
atatcccagtctctgtatgtatctg

SEQ ID NO: 468024 - DNA, 25 bp, Homo sapien
cccagtctctgtatgtatctgcata

SEQ ID NO: 468025 - DNA, 25 bp, Homo sapien
ctctgtatgtatctgcatagacaaa

SEQ ID NO: 468026 - DNA, 25 bp, Homo sapien
aaacaaactcctgctttgcttttat

SEQ ID NO: 468027 - DNA, 25 bp, Homo sapien
gaaccatttggcctgtagaagagga

SEQ ID NO: 468028 - DNA, 25 bp, Homo sapien
atttgaatgattccagcttatcgta

SEQ ID NO: 468029 - DNA, 25 bp, Homo sapien
gattccagcttatcgtaaatactaa

SEQ ID NO: 468030 - DNA, 25 bp, Homo sapien
tcgtaaatactaaactgaatggctt

SEQ ID NO: 468031 - DNA, 25 bp, Homo sapien
gtcaattgttagatgataatgtgcc

SEQ ID NO: 468032 - DNA, 25 bp, Homo sapien
gtgccattcattatcataggaatgt

SEQ ID NO: 468033 - DNA, 25 bp, Homo sapien
ataggaatgtccttgcccatatata

SEQ ID NO: 468034 - DNA, 25 bp, Homo sapien
aggaatgtccttgcccatatataaa

SEQ ID NO: 468035 - DNA, 25 bp, Homo sapien
ttgcccatatataaaacatgctggc

SEQ ID NO: 468036 - DNA, 25 bp, Homo sapien
catgctggcatgtattttacttgtt

SEQ ID NO: 468037 - DNA, 25 bp, Homo sapien
gctggcatgtattttacttgttaat

SEQ ID NO: 468038 - DNA, 25 bp, Homo sapien
gtgagggccttggaaatggcttcct

SEQ ID NO: 468039 - DNA, 25 bp, Homo sapien
ggaggagatggcaattatccaggta

SEQ ID NO: 468040 - DNA, 25 bp, Homo sapien
gatggcaattatccaggtagacaag

SEQ ID NO: 468041 - DNA, 25 bp, Homo sapien
tgtgcaaagccctggtcataaataa

SEQ ID NO: 468042 - DNA, 25 bp, Homo sapien
gccctggtcataaataacttttcct

SEQ ID NO: 468043 - DNA, 25 bp, Homo sapien
ggtcataaataacttttcctctgca

SEQ ID NO: 468044 - DNA, 25 bp, Homo sapien
aactgtggatggcagttcaccatgt

SEQ ID NO: 468045 - DNA, 25 bp, Homo sapien
ggatggcagttcaccatgtttctca

SEQ ID NO: 468046 - DNA, 25 bp, Homo sapien
tggcagttcaccatgtttctcacca

SEQ ID NO: 468047 - DNA, 25 bp, Homo sapien
agttcaccatgtttctcaccactgg

SEQ ID NO: 468048 - DNA, 25 bp, Homo sapien
cactgcttatccaatatgcatgtaa

SEQ ID NO: 468049 - DNA, 25 bp, Homo sapien
gagcatgttgaagctttgagatctg

SEQ ID NO: 468050 - DNA, 25 bp, Homo sapien
cagtgatgtccctggtctattcagg

SEQ ID NO: 468051 - DNA, 25 bp, Homo sapien
aatggtaaacatccaattgacagga

SEQ ID NO: 468052 - DNA, 25 bp, Homo sapien
gacaggatttagattttgcttagtt

SEQ ID NO: 468053 - DNA, 25 bp, Homo sapien
tctgctttttaatgtttctatcccc

SEQ ID NO: 468054 - DNA, 25 bp, Homo sapien
gtgttttctttatccatcccagtga

SEQ ID NO: 468055 - DNA, 25 bp, Homo sapien
tcccagtgatgccttatttgaaact

SEQ ID NO: 468056 - DNA, 25 bp, Homo sapien
ttgaaactgggcttaaactgcaaaa

SEQ ID NO: 468057 - DNA, 25 bp, Homo sapien
atgaagttggatttaggaagctgtt

SEQ ID NO: 468058 - DNA, 25 bp, Homo sapien
aagctgttagatcattgagtggtgt

SEQ ID NO: 468059 - DNA, 25 bp, Homo sapien
gagtgaagtttcactagcagggaag

SEQ ID NO: 468060 - DNA, 25 bp, Homo sapien
aatgtgccatgctgcgtgggatgcc

SEQ ID NO: 468061 - DNA, 25 bp, Homo sapien
cccgaggagagttctgtggcattta

SEQ ID NO: 468062 - DNA, 25 bp, Homo sapien
tttatttagccacactggttcctct

SEQ ID NO: 468063 - DNA, 25 bp, Homo sapien
cccctggtttcttttcatcatcaaa

SEQ ID NO: 468064 - DNA, 25 bp, Homo sapien
gatggaaagctcctttgcggtcttt

SEQ ID NO: 468065 - DNA, 25 bp, Homo sapien
agaggaggcggcacctatattccag

SEQ ID NO: 468066 - DNA, 25 bp, Homo sapien
cacctatattccagatgcagccatt

SEQ ID NO: 468067 - DNA, 25 bp, Homo sapien
gatgcagccatttcacagatccaag

SEQ ID NO: 468068 - DNA, 25 bp, Homo sapien
agatccaaggcgctagcttcctggt

SEQ ID NO: 468069 - DNA, 25 bp, Homo sapien
cttagcctcaatctccttgtagata

SEQ ID NO: 468070 - DNA, 25 bp, Homo sapien
aaactggaaccctaacgcttcactg

SEQ ID NO: 468071 - DNA, 25 bp, Homo sapien
gcgtagaggacccacagctgcgctc

SEQ ID NO: 468072 - DNA, 25 bp, Homo sapien
tggcggccgagctcgcccacgtcgt

SEQ ID NO: 468073 - DNA, 25 bp, Homo sapien
ccacgtcgtcatcacgcaactgctg

SEQ ID NO: 468074 - DNA, 25 bp, Homo sapien
aactgctgctgtggtacggcgcgga

SEQ ID NO: 468075 - DNA, 25 bp, Homo sapien
gctgctgtggtacggcgcggacgtg

SEQ ID NO: 468076 - DNA, 25 bp, Homo sapien
cccagggccgcacggcgctgttcta

SEQ ID NO: 468077 - DNA, 25 bp, Homo sapien
ctgttctacgcccgccaggctggaa

SEQ ID NO: 468078 - DNA, 25 bp, Homo sapien
tggaagccagctgtgcgccgacatc

SEQ ID NO: 468079 - DNA, 25 bp, Homo sapien
ggaagccagctgtgcgccgacatcc

SEQ ID NO: 468080 - DNA, 25 bp, Homo sapien
gccgacatccttctccagcacggct

SEQ ID NO: 468081 - DNA, 25 bp, Homo sapien
tccagcacggctgcccgggtgaggg

SEQ ID NO: 468082 - DNA, 25 bp, Homo sapien
attaacatccttggaactgtatgta

SEQ ID NO: 468083 - DNA, 25 bp, Homo sapien
ccttttcccatgtatctctttgatc

SEQ ID NO: 468084 - DNA, 25 bp, Homo sapien
ttgatcacatccctacctcatagat

SEQ ID NO: 468085 - DNA, 25 bp, Homo sapien
tacctcatagatcacccatgtgctg

SEQ ID NO: 468086 - DNA, 25 bp, Homo sapien
acccatgtgctgaagactttcagtt

SEQ ID NO: 468087 - DNA, 25 bp, Homo sapien
gtatgttcattctagatctcctgaa

SEQ ID NO: 468088 - DNA, 25 bp, Homo sapien
aatatctttctgacttctgactgtg

SEQ ID NO: 468089 - DNA, 25 bp, Homo sapien
ctgacttctgactgtgtatttctgg

SEQ ID NO: 468090 - DNA, 25 bp, Homo sapien
gatgttatacaagaacctcagctca

SEQ ID NO: 468091 - DNA, 25 bp, Homo sapien
ctcagctcaaactcagtattcccta

SEQ ID NO: 468092 - DNA, 25 bp, Homo sapien
ctcagtattccctaaaccattgttt

SEQ ID NO: 468093 - DNA, 25 bp, Homo sapien
gctgattacctgcagtcagaggtgt

SEQ ID NO: 468094 - DNA, 25 bp, Homo sapien
aggccacagccgcatcttgatcagg

SEQ ID NO: 468095 - DNA, 25 bp, Homo sapien
tcttgatcaggctttctcaagccct

SEQ ID NO: 468096 - DNA, 25 bp, Homo sapien
agatctccattctttgccatgaggg

SEQ ID NO: 468097 - DNA, 25 bp, Homo sapien
attctttgccatgagggccaacaca

SEQ ID NO: 468098 - DNA, 25 bp, Homo sapien
atgagggccaacacatgagacccca

SEQ ID NO: 468099 - DNA, 25 bp, Homo sapien
tgccagccctagacttgttggagca

SEQ ID NO: 468100 - DNA, 25 bp, Homo sapien
ttgttggagcatagagcccttcctc

SEQ ID NO: 468101 - DNA, 25 bp, Homo sapien
tcctccccaggcctaagtatgtgga

SEQ ID NO: 468102 - DNA, 25 bp, Homo sapien
agaggccacgcctatttattctgtt

SEQ ID NO: 468103 - DNA, 25 bp, Homo sapien
ccacgcctatttattctgtttctgt

SEQ ID NO: 468104 - DNA, 25 bp, Homo sapien
gctcagtgagccaggacgaatgtga

SEQ ID NO: 468105 - DNA, 25 bp, Homo sapien
ggacgaatgtgacagacaccccttg

SEQ ID NO: 468106 - DNA, 25 bp, Homo sapien
gaatgtgacagacaccccttgctgc

SEQ ID NO: 468107 - DNA, 25 bp, Homo sapien
ttgctgccacagtcagccctttgac

SEQ ID NO: 468108 - DNA, 25 bp, Homo sapien
acagtcagccctttgacgaaggtgg

SEQ ID NO: 468109 - DNA, 25 bp, Homo sapien
ggcccagtcaactcttccttgtgga

SEQ ID NO: 468110 - DNA, 25 bp, Homo sapien
cttccttgtggacttacgacagcag

SEQ ID NO: 468111 - DNA, 25 bp, Homo sapien
gacttacgacagcagattttctcta

SEQ ID NO: 468112 - DNA, 25 bp, Homo sapien
gattttctctaggataagcttgtgt

SEQ ID NO: 468113 - DNA, 25 bp, Homo sapien
taggataagcttgtgtggttctgcc

SEQ ID NO: 468114 - DNA, 25 bp, Homo sapien
gaagcagagaaccacctgtgctgtt

SEQ ID NO: 468115 - DNA, 25 bp, Homo sapien
ttttgctggcgtcgttggagttaaa

SEQ ID NO: 468116 - DNA, 25 bp, Homo sapien
ttggagttaaaatgccccgttactg

SEQ ID NO: 468117 - DNA, 25 bp, Homo sapien
aaacaatgtcactctggctaacaaa

SEQ ID NO: 468118 - DNA, 25 bp, Homo sapien
ggctaacaaatttgagtcctgcagt

SEQ ID NO: 468119 - DNA, 25 bp, Homo sapien
actcaaagactgtcctggtttcgtg

SEQ ID NO: 468120 - DNA, 25 bp, Homo sapien
tcgtgtttacccctcgatcaaggga

SEQ ID NO: 468121 - DNA, 25 bp, Homo sapien
gatcaagggaggaacttccaccaaa

SEQ ID NO: 468122 - DNA, 25 bp, Homo sapien
ttccaccaaacttccctagtgaaat

SEQ ID NO: 468123 - DNA, 25 bp, Homo sapien
tgaaatccccggaatctgccatttt

SEQ ID NO: 468124 - DNA, 25 bp, Homo sapien
gatgaagttatgtctccccatggag

SEQ ID NO: 468125 - DNA, 25 bp, Homo sapien
ctccccatggagaacctatcaagat

SEQ ID NO: 468126 - DNA, 25 bp, Homo sapien
ggcaagtgccagttcacacaggtac

SEQ ID NO: 468127 - DNA, 25 bp, Homo sapien
gcaagtgccagttcacacaggtaca

SEQ ID NO: 468128 - DNA, 25 bp, Homo sapien
aagtgccagttcacacaggtacagg

SEQ ID NO: 468129 - DNA, 25 bp, Homo sapien
gtgccagttcacacaggtacaggtg

SEQ ID NO: 468130 - DNA, 25 bp, Homo sapien
tgccagttcacacaggtacaggtgg

SEQ ID NO: 468131 - DNA, 25 bp, Homo sapien
ccagttcacacaggtacaggtggct

SEQ ID NO: 468132 - DNA, 25 bp, Homo sapien
agttcacacaggtacaggtggctgc

SEQ ID NO: 468133 - DNA, 25 bp, Homo sapien
gttcacacaggtacaggtggctgca

SEQ ID NO: 468134 - DNA, 25 bp, Homo sapien
tcacacaggtacaggtggctgcaga

SEQ ID NO: 468135 - DNA, 25 bp, Homo sapien
acacaggtacaggtggctgcagagt

SEQ ID NO: 468136 - DNA, 25 bp, Homo sapien
tggctgcagagtgcccaaaggccaa

SEQ ID NO: 468137 - DNA, 25 bp, Homo sapien
ttaactagaaaggagaacttcctgg

SEQ ID NO: 468138 - DNA, 25 bp, Homo sapien
gagaacttcctggagtgaaagaaga

SEQ ID NO: 468139 - DNA, 25 bp, Homo sapien
agaacttcctggagtgaaagaagat

SEQ ID NO: 468140 - DNA, 25 bp, Homo sapien
gaacttcctggagtgaaagaagata

SEQ ID NO: 468141 - DNA, 25 bp, Homo sapien
aacttcctggagtgaaagaagatac

SEQ ID NO: 468142 - DNA, 25 bp, Homo sapien
acttcctggagtgaaagaagatacg

SEQ ID NO: 468143 - DNA, 25 bp, Homo sapien
ttcctggagtgaaagaagatacgtt

SEQ ID NO: 468144 - DNA, 25 bp, Homo sapien
tcctggagtgaaagaagatacgttt

SEQ ID NO: 468145 - DNA, 25 bp, Homo sapien
cctggagtgaaagaagatacgtttt

SEQ ID NO: 468146 - DNA, 25 bp, Homo sapien
ctggagtgaaagaagatacgttttg

SEQ ID NO: 468147 - DNA, 25 bp, Homo sapien
ggagtgaaagaagatacgttttgat

SEQ ID NO: 468148 - DNA, 25 bp, Homo sapien
agcgagtggcgctatgtgctggtga

SEQ ID NO: 468149 - DNA, 25 bp, Homo sapien
tatgtgctggtgagcaccgtccgca

SEQ ID NO: 468150 - DNA, 25 bp, Homo sapien
tggtgagcaccgtccgcacctgtgc

SEQ ID NO: 468151 - DNA, 25 bp, Homo sapien
gcacctgtgccaagagcgacctgga

SEQ ID NO: 468152 - DNA, 25 bp, Homo sapien
agcggcccaccaagagctggctcaa

SEQ ID NO: 468153 - DNA, 25 bp, Homo sapien
aagagctggctcaagaagtttctgg

SEQ ID NO: 468154 - DNA, 25 bp, Homo sapien
gctcaagaagtttctgggcttcgtt

SEQ ID NO: 468155 - DNA, 25 bp, Homo sapien
ttctgggcttcgttgtggaccccaa

SEQ ID NO: 468156 - DNA, 25 bp, Homo sapien
cttcgttgtggaccccaaccaagtg

SEQ ID NO: 468157 - DNA, 25 bp, Homo sapien
tctggcgtagcctcctggacttctg

SEQ ID NO: 468158 - DNA, 25 bp, Homo sapien
tggacttctgcgaggctcagcagac

SEQ ID NO: 468159 - DNA, 25 bp, Homo sapien
ggagaataaatgacttgcttttcta

SEQ ID NO: 468160 - DNA, 25 bp, Homo sapien
aataaatgacttgcttttctaaatc

SEQ ID NO: 468161 - DNA, 25 bp, Homo sapien
ttctaaatctcaggtttatctgggc

SEQ ID NO: 468162 - DNA, 25 bp, Homo sapien
gtttatctgggctctatcatataga

SEQ ID NO: 468163 - DNA, 25 bp, Homo sapien
tagttaaaatcctggtctttcttgg

SEQ ID NO: 468164 - DNA, 25 bp, Homo sapien
tggtctttcttggtaaacagatttt

SEQ ID NO: 468165 - DNA, 25 bp, Homo sapien
aaaacatgccacaggagaattcggg

SEQ ID NO: 468166 - DNA, 25 bp, Homo sapien
tatatatgatgcatcggataggtca

SEQ ID NO: 468167 - DNA, 25 bp, Homo sapien
atgatgcatcggataggtcattatg

SEQ ID NO: 468168 - DNA, 25 bp, Homo sapien
attatgattttttaccatttcgact

SEQ ID NO: 468169 - DNA, 25 bp, Homo sapien
tgattttttaccatttcgacttaca

SEQ ID NO: 468170 - DNA, 25 bp, Homo sapien
gagccaaaccctagggctcaatgaa

SEQ ID NO: 468171 - DNA, 25 bp, Homo sapien
agccaaaccctagggctcaatgaaa

SEQ ID NO: 468172 - DNA, 25 bp, Homo sapien
aaccctagggctcaatgaaaaccag

SEQ ID NO: 468173 - DNA, 25 bp, Homo sapien
accctagggctcaatgaaaaccaga

SEQ ID NO: 468174 - DNA, 25 bp, Homo sapien
ctagggctcaatgaaaaccagacgt

SEQ ID NO: 468175 - DNA, 25 bp, Homo sapien
aaaaccagacgtaaggctgggtgca

SEQ ID NO: 468176 - DNA, 25 bp, Homo sapien
aaaccagacgtaaggctgggtgcat

SEQ ID NO: 468177 - DNA, 25 bp, Homo sapien
aaccagacgtaaggctgggtgcatt

SEQ ID NO: 468178 - DNA, 25 bp, Homo sapien
accagacgtaaggctgggtgcattg

SEQ ID NO: 468179 - DNA, 25 bp, Homo sapien
atggagaaaccttctctccacgaaa

SEQ ID NO: 468180 - DNA, 25 bp, Homo sapien
gagaaaccttctctccacgaaaaat

SEQ ID NO: 468181 - DNA, 25 bp, Homo sapien
acatggagggcattgcatgaggtct

SEQ ID NO: 468182 - DNA, 25 bp, Homo sapien
agggcattgcatgaggtctgccaga

SEQ ID NO: 468183 - DNA, 25 bp, Homo sapien
gggcattgcatgaggtctgccagaa

SEQ ID NO: 468184 - DNA, 25 bp, Homo sapien
gcattgcatgaggtctgccagaagg

SEQ ID NO: 468185 - DNA, 25 bp, Homo sapien
cattgcatgaggtctgccagaaggc

SEQ ID NO: 468186 - DNA, 25 bp, Homo sapien
attgcatgaggtctgccagaaggcc

SEQ ID NO: 468187 - DNA, 25 bp, Homo sapien
ttgcatgaggtctgccagaaggccc

SEQ ID NO: 468188 - DNA, 25 bp, Homo sapien
tgcatgaggtctgccagaaggccct

SEQ ID NO: 468189 - DNA, 25 bp, Homo sapien
atgaggtctgccagaaggccctgcg

SEQ ID NO: 468190 - DNA, 25 bp, Homo sapien
tgaggtctgccagaaggccctgcgt

SEQ ID NO: 468191 - DNA, 25 bp, Homo sapien
aggtctgccagaaggccctgcgtgt

SEQ ID NO: 468192 - DNA, 25 bp, Homo sapien
tcgaaattgaatggcagggtggttt

SEQ ID NO: 468193 - DNA, 25 bp, Homo sapien
agggtggtttttgcttacaagccat

SEQ ID NO: 468194 - DNA, 25 bp, Homo sapien
tcatttgttttgcacatatgcatat

SEQ ID NO: 468195 - DNA, 25 bp, Homo sapien
acatatgcatatgtgcccatttaag

SEQ ID NO: 468196 - DNA, 25 bp, Homo sapien
gtgcccatttaagatatttgcatat

SEQ ID NO: 468197 - DNA, 25 bp, Homo sapien
tttgcatatacttgatagaaaccat

SEQ ID NO: 468198 - DNA, 25 bp, Homo sapien
agttgtagcagttaagtccagtcac

SEQ ID NO: 468199 - DNA, 25 bp, Homo sapien
ggataaacagtcttccagcttgtaa

SEQ ID NO: 468200 - DNA, 25 bp, Homo sapien
gtcttccagcttgtaaatgccattg

SEQ ID NO: 468201 - DNA, 25 bp, Homo sapien
aaatgccattgacttctgacctgac

SEQ ID NO: 468202 - DNA, 25 bp, Homo sapien
gacttctgacctgacatttagtata

SEQ ID NO: 468203 - DNA, 25 bp, Homo sapien
tgaaatgaaactttgccacaaccag

SEQ ID NO: 468204 - DNA, 25 bp, Homo sapien
gctgtagcacacacatatatcactg

SEQ ID NO: 468205 - DNA, 25 bp, Homo sapien
acatatatcactgaacctgtttgaa

SEQ ID NO: 468206 - DNA, 25 bp, Homo sapien
atgattcgtctttgagtacctccag

SEQ ID NO: 468207 - DNA, 25 bp, Homo sapien
gtctttgagtacctccaggctgaaa

SEQ ID NO: 468208 - DNA, 25 bp, Homo sapien
ccaggctgaaagactgttgtaccag

SEQ ID NO: 468209 - DNA, 25 bp, Homo sapien
ggcacaaattctccttgaagacctt

SEQ ID NO: 468210 - DNA, 25 bp, Homo sapien
atgtggccccatattttatgttgct

SEQ ID NO: 468211 - DNA, 25 bp, Homo sapien
gattcgaatgaaattgtcctttaga

SEQ ID NO: 468212 - DNA, 25 bp, Homo sapien
ttgtcctttagagcatgattacttg

SEQ ID NO: 468213 - DNA, 25 bp, Homo sapien
atgattacttgttcccatggacaaa

SEQ ID NO: 468214 - DNA, 25 bp, Homo sapien
tctctggctgggacaacaccctgag

SEQ ID NO: 468215 - DNA, 25 bp, Homo sapien
ggctgggacaacaccctgagcagtg

SEQ ID NO: 468216 - DNA, 25 bp, Homo sapien
tgcagtgtctgaaggctcccattct

SEQ ID NO: 468217 - DNA, 25 bp, Homo sapien
tgaaggctcccattctctctaacac

SEQ ID NO: 468218 - DNA, 25 bp, Homo sapien
attctctctaacactgcttgccgca

SEQ ID NO: 468219 - DNA, 25 bp, Homo sapien
aggcaagattactacaaacatgata

SEQ ID NO: 468220 - DNA, 25 bp, Homo sapien
atatgtctgggattcctggagggtt

SEQ ID NO: 468221 - DNA, 25 bp, Homo sapien
tggagggttgaaaggactcttgcca

SEQ ID NO: 468222 - DNA, 25 bp, Homo sapien
gggctatggttgtcctcagaagaac

SEQ ID NO: 468223 - DNA, 25 bp, Homo sapien
gaacaaacctggagtctacactaaa

SEQ ID NO: 468224 - DNA, 25 bp, Homo sapien
gagtctacactaaagtttgcaacta

SEQ ID NO: 468225 - DNA, 25 bp, Homo sapien
gccatgccaatggagtgactgaact

SEQ ID NO: 468226 - DNA, 25 bp, Homo sapien
atggagtgactgaactggtgacatc

SEQ ID NO: 468227 - DNA, 25 bp, Homo sapien
ttgagcatgctttgtgtggctggta

SEQ ID NO: 468228 - DNA, 25 bp, Homo sapien
ggctggtagaatgccaccgttgtgc

SEQ ID NO: 468229 - DNA, 25 bp, Homo sapien
gccaccgttgtgcatacactttgta

SEQ ID NO: 468230 - DNA, 25 bp, Homo sapien
tgtgcatacactttgtacatcaggg

SEQ ID NO: 468231 - DNA, 25 bp, Homo sapien
tgaagggagggttttctagattatt

SEQ ID NO: 468232 - DNA, 25 bp, Homo sapien
gggtatagtactcagcttatgccct

SEQ ID NO: 468233 - DNA, 25 bp, Homo sapien
gcttatgccctaaaataacatgtat

SEQ ID NO: 468234 - DNA, 25 bp, Homo sapien
ataaaaacccctgaagtattgtgtg

SEQ ID NO: 468235 - DNA, 25 bp, Homo sapien
agtgtgtgtttgtatacgtctggca

SEQ ID NO: 468236 - DNA, 25 bp, Homo sapien
gcataactcagtagatagaattctc

SEQ ID NO: 468237 - DNA, 25 bp, Homo sapien
agaattctctagtagtaagctaaag

SEQ ID NO: 468238 - DNA, 25 bp, Homo sapien
gctaaagtgcttcaagtattagttg

SEQ ID NO: 468239 - DNA, 25 bp, Homo sapien
gaaaattagatctgagactacctcg

SEQ ID NO: 468240 - DNA, 25 bp, Homo sapien
gatctgagactacctcgaggagtaa

SEQ ID NO: 468241 - DNA, 25 bp, Homo sapien
tcgaggagtaaacgaacaacttctt

SEQ ID NO: 468242 - DNA, 25 bp, Homo sapien
tactagtcaaaatgcagtccacgga

SEQ ID NO: 468243 - DNA, 25 bp, Homo sapien
tgcagtccacggaccaatgctggtt

SEQ ID NO: 468244 - DNA, 25 bp, Homo sapien
aatgctggttcatgccctatttgat

SEQ ID NO: 468245 - DNA, 25 bp, Homo sapien
atgccctatttgatccaagtccaca

SEQ ID NO: 468246 - DNA, 25 bp, Homo sapien
gatccaagtccacattaagtacaga

SEQ ID NO: 468247 - DNA, 25 bp, Homo sapien
gtgtgtagccactattataactgga

SEQ ID NO: 468248 - DNA, 25 bp, Homo sapien
ttcataaactactatatttcccatc

SEQ ID NO: 468249 - DNA, 25 bp, Homo sapien
atttcccatcttgcaaatcatttta

SEQ ID NO: 468250 - DNA, 25 bp, Homo sapien
cattttatgtctcatctgtttttcc

SEQ ID NO: 468251 - DNA, 25 bp, Homo sapien
tctgtttttcctttcggttatatct

SEQ ID NO: 468252 - DNA, 25 bp, Homo sapien
atatctttggttttgaataccaaca

SEQ ID NO: 468253 - DNA, 25 bp, Homo sapien
atttaatacagctatatggacctta

SEQ ID NO: 468254 - DNA, 25 bp, Homo sapien
tacagctatatggaccttataaaat

SEQ ID NO: 468255 - DNA, 25 bp, Homo sapien
gacattactactaaaaggtacatct

SEQ ID NO: 468256 - DNA, 25 bp, Homo sapien
ctaaaaggtacatctaactattcag

SEQ ID NO: 468257 - DNA, 25 bp, Homo sapien
atctaactattcagggacatttttc

SEQ ID NO: 468258 - DNA, 25 bp, Homo sapien
tgagcattcattctctccaccaggc

SEQ ID NO: 468259 - DNA, 25 bp, Homo sapien
aggtcctgagcccttcctctgtaaa

SEQ ID NO: 468260 - DNA, 25 bp, Homo sapien
gagcccttcctctgtaaaagtgtca

SEQ ID NO: 468261 - DNA, 25 bp, Homo sapien
gcccttcctctgtaaaagtgtcaca

SEQ ID NO: 468262 - DNA, 25 bp, Homo sapien
ttcctctgtaaaagtgtcacaccac

SEQ ID NO: 468263 - DNA, 25 bp, Homo sapien
tgtaaaagtgtcacaccacctccct

SEQ ID NO: 468264 - DNA, 25 bp, Homo sapien
tcacaacaacctatgtcactgactc

SEQ ID NO: 468265 - DNA, 25 bp, Homo sapien
aacctatgtcactgactcagatgca

SEQ ID NO: 468266 - DNA, 25 bp, Homo sapien
tgtcactgactcagatgcagggtct

SEQ ID NO: 468267 - DNA, 25 bp, Homo sapien
tgactcagatgcagggtctgctcac

SEQ ID NO: 468268 - DNA, 25 bp, Homo sapien
agatgcagggtctgctcaccccaac

SEQ ID NO: 468269 - DNA, 25 bp, Homo sapien
gggccaagtggtagccacactcctc

SEQ ID NO: 468270 - DNA, 25 bp, Homo sapien
agcgagagcccaggctggtccacga

SEQ ID NO: 468271 - DNA, 25 bp, Homo sapien
ggctggtccacgaggccggcacaca

SEQ ID NO: 468272 - DNA, 25 bp, Homo sapien
aggccggcacacagctcaactgtca

SEQ ID NO: 468273 - DNA, 25 bp, Homo sapien
cccgtcctggtctacagctgctagg

SEQ ID NO: 468274 - DNA, 25 bp, Homo sapien
gcatacacagctggccggaactgct

SEQ ID NO: 468275 - DNA, 25 bp, Homo sapien
ggaactgcttcaccaacaccaggct

SEQ ID NO: 468276 - DNA, 25 bp, Homo sapien
caggctcctccgagaagagttgaat

SEQ ID NO: 468277 - DNA, 25 bp, Homo sapien
aagagaacggtcacgctgtcatgcg

SEQ ID NO: 468278 - DNA, 25 bp, Homo sapien
tcacgctgtcatgcgtcttcatgaa

SEQ ID NO: 468279 - DNA, 25 bp, Homo sapien
tcatgcgtcttcatgaagtcccagg

SEQ ID NO: 468280 - DNA, 25 bp, Homo sapien
gggactccagacctagagcgtaagt

SEQ ID NO: 468281 - DNA, 25 bp, Homo sapien
gactccagacctagagcgtaagtat

SEQ ID NO: 468282 - DNA, 25 bp, Homo sapien
gacctagagcgtaagtatggatgtt

SEQ ID NO: 468283 - DNA, 25 bp, Homo sapien
agtatggatgttgtggccctgtgtc

SEQ ID NO: 468284 - DNA, 25 bp, Homo sapien
atgttgtggccctgtgtcttcctag

SEQ ID NO: 468285 - DNA, 25 bp, Homo sapien
gtggccctgtgtcttcctagtgtga

SEQ ID NO: 468286 - DNA, 25 bp, Homo sapien
gtgtcttcctagtgtgacccagcca

SEQ ID NO: 468287 - DNA, 25 bp, Homo sapien
tagtgtgacccagccaggagcggaa

SEQ ID NO: 468288 - DNA, 25 bp, Homo sapien
gtaaagtgaggtctggctctgcctc

SEQ ID NO: 468289 - DNA, 25 bp, Homo sapien
tcgctcatgtcgcccaggcttggag

SEQ ID NO: 468290 - DNA, 25 bp, Homo sapien
gcccctcccaggtacaagagattct

SEQ ID NO: 468291 - DNA, 25 bp, Homo sapien
tttctgtgtcaaaacagtcacgcag

SEQ ID NO: 468292 - DNA, 25 bp, Homo sapien
gtgtcaaaacagtcacgcagaaata

SEQ ID NO: 468293 - DNA, 25 bp, Homo sapien
aaacagtcacgcagaaataaacagt

SEQ ID NO: 468294 - DNA, 25 bp, Homo sapien
gacagcactgtgatgagaaaagcga

SEQ ID NO: 468295 - DNA, 25 bp, Homo sapien
aacaacttatttcaactttctgact

SEQ ID NO: 468296 - DNA, 25 bp, Homo sapien
actttctgacttttgttgtggcctc

SEQ ID NO: 468297 - DNA, 25 bp, Homo sapien
tgttgtggcctcagcacttttgttt

SEQ ID NO: 468298 - DNA, 25 bp, Homo sapien
ttaacattgaaaacagtgaggcagt

SEQ ID NO: 468299 - DNA, 25 bp, Homo sapien
atgtgatttttcatttggtaagtgc

SEQ ID NO: 468300 - DNA, 25 bp, Homo sapien
atagaatttagtcgaccttaagaat

SEQ ID NO: 468301 - DNA, 25 bp, Homo sapien
ttagtcgaccttaagaattgttaat

SEQ ID NO: 468302 - DNA, 25 bp, Homo sapien
caggtctgtccgatggaaacacagt

SEQ ID NO: 468303 - DNA, 25 bp, Homo sapien
aggtctgtccgatggaaacacagtt

SEQ ID NO: 468304 - DNA, 25 bp, Homo sapien
ggtctgtccgatggaaacacagtta

SEQ ID NO: 468305 - DNA, 25 bp, Homo sapien
gtctgtccgatggaaacacagttag

SEQ ID NO: 468306 - DNA, 25 bp, Homo sapien
tgtccgatggaaacacagttagagc

SEQ ID NO: 468307 - DNA, 25 bp, Homo sapien
gtccgatggaaacacagttagagcc

SEQ ID NO: 468308 - DNA, 25 bp, Homo sapien
ccgatggaaacacagttagagccac

SEQ ID NO: 468309 - DNA, 25 bp, Homo sapien
ggaaacacagttagagccacattta

SEQ ID NO: 468310 - DNA, 25 bp, Homo sapien
agttagagccacatttaaaaagcca

SEQ ID NO: 468311 - DNA, 25 bp, Homo sapien
aaagccaaaagaggccaggcacggc

SEQ ID NO: 468312 - DNA, 25 bp, Homo sapien
gcagcgagccgtgattgagcttctc

SEQ ID NO: 468313 - DNA, 25 bp, Homo sapien
agacctgtgcatgaagtgctagcca

SEQ ID NO: 468314 - DNA, 25 bp, Homo sapien
gtgcatgaagtgctagccacaccct

SEQ ID NO: 468315 - DNA, 25 bp, Homo sapien
ctccttcaggataccgtgtgggcat

SEQ ID NO: 468316 - DNA, 25 bp, Homo sapien
ttcaggataccgtgtgggcatcacc

SEQ ID NO: 468317 - DNA, 25 bp, Homo sapien
caggataccgtgtgggcatcacccc

SEQ ID NO: 468318 - DNA, 25 bp, Homo sapien
atcccatcaacaccatctagacagg

SEQ ID NO: 468319 - DNA, 25 bp, Homo sapien
tctagacaggggtgggtgcttctcc

SEQ ID NO: 468320 - DNA, 25 bp, Homo sapien
agcccctagcacagagctaatgctc

SEQ ID NO: 468321 - DNA, 25 bp, Homo sapien
gagctaatgctcaatcgctattttt

SEQ ID NO: 468322 - DNA, 25 bp, Homo sapien
aatgctcaatcgctatttttggaat

SEQ ID NO: 468323 - DNA, 25 bp, Homo sapien
gctcaatcgctatttttggaatgta

SEQ ID NO: 468324 - DNA, 25 bp, Homo sapien
atcatctggataatcatttaaccct

SEQ ID NO: 468325 - DNA, 25 bp, Homo sapien
aatcatttaacccttttccatactg

SEQ ID NO: 468326 - DNA, 25 bp, Homo sapien
tttaacccttttccatactgcccag

SEQ ID NO: 468327 - DNA, 25 bp, Homo sapien
ggctgactctagagtatcccggtgt

SEQ ID NO: 468328 - DNA, 25 bp, Homo sapien
atactgcccagctttattccaggaa

SEQ ID NO: 468329 - DNA, 25 bp, Homo sapien
aaggtttcagaaattcagagttatt

SEQ ID NO: 468330 - DNA, 25 bp, Homo sapien
gagttatttttattcaggcaaagaa

SEQ ID NO: 468331 - DNA, 25 bp, Homo sapien
gaagtaccaagtattgtgactagtt

SEQ ID NO: 468332 - DNA, 25 bp, Homo sapien
gtagatggtggatcattaggcatat

SEQ ID NO: 468333 - DNA, 25 bp, Homo sapien
aaacatgctttgtaataccttaaat

SEQ ID NO: 468334 - DNA, 25 bp, Homo sapien
ttaaattatccacatgtatcatctg

SEQ ID NO: 468335 - DNA, 25 bp, Homo sapien
caggcgttgtagaccgcaggccagc

SEQ ID NO: 468336 - DNA, 25 bp, Homo sapien
ttgtagaccgcaggccagcataggg

SEQ ID NO: 468337 - DNA, 25 bp, Homo sapien
ggctgggtttatagtgccctctgga

SEQ ID NO: 468338 - DNA, 25 bp, Homo sapien
gtttatagtgccctctggatttaag

SEQ ID NO: 468339 - DNA, 25 bp, Homo sapien
tagtgccctctggatttaagctcac

SEQ ID NO: 468340 - DNA, 25 bp, Homo sapien
tctggatttaagctcacccgaggat

SEQ ID NO: 468341 - DNA, 25 bp, Homo sapien
gatttaagctcacccgaggatggat

SEQ ID NO: 468342 - DNA, 25 bp, Homo sapien
tcacccgaggatggatgagcacatg

SEQ ID NO: 468343 - DNA, 25 bp, Homo sapien
cccgaggatggatgagcacatggcc

SEQ ID NO: 468344 - DNA, 25 bp, Homo sapien
tgactttcccattcagtgcgtacca

SEQ ID NO: 468345 - DNA, 25 bp, Homo sapien
actttcccattcagtgcgtaccatc

SEQ ID NO: 468346 - DNA, 25 bp, Homo sapien
gaactgtcggatacttgaactctca

SEQ ID NO: 468347 - DNA, 25 bp, Homo sapien
gatacttgaactctcaagagctggg

SEQ ID NO: 468348 - DNA, 25 bp, Homo sapien
ggctctgagcgtcctcgtccagctg

SEQ ID NO: 468349 - DNA, 25 bp, Homo sapien
gtccagctgccaacttggccaaagg

SEQ ID NO: 468350 - DNA, 25 bp, Homo sapien
aggctaagccagcagattgttctgt

SEQ ID NO: 468351 - DNA, 25 bp, Homo sapien
aagccagcagattgttctgttgccg

SEQ ID NO: 468352 - DNA, 25 bp, Homo sapien
cagcagattgttctgttgccgggca

SEQ ID NO: 468353 - DNA, 25 bp, Homo sapien
gggcaacgcgacttctaaacctgag

SEQ ID NO: 468354 - DNA, 25 bp, Homo sapien
aacgcgacttctaaacctgagggag

SEQ ID NO: 468355 - DNA, 25 bp, Homo sapien
cttctaaacctgagggagtgggcat

SEQ ID NO: 468356 - DNA, 25 bp, Homo sapien
agggagtgggcatgtgagcacataa

SEQ ID NO: 468357 - DNA, 25 bp, Homo sapien
ggcatgggagatagggagacagtgt

SEQ ID NO: 468358 - DNA, 25 bp, Homo sapien
gggtgagcaggtgggcaggagctac

SEQ ID NO: 468359 - DNA, 25 bp, Homo sapien
aggtgggcaggagctacaggagcct

SEQ ID NO: 468360 - DNA, 25 bp, Homo sapien
tggatcacagacaccgccaggcaag

SEQ ID NO: 468361 - DNA, 25 bp, Homo sapien
ggatcacagacaccgccaggcaagt

SEQ ID NO: 468362 - DNA, 25 bp, Homo sapien
gatcacagacaccgccaggcaagtg

SEQ ID NO: 468363 - DNA, 25 bp, Homo sapien
ggcaagtgccagttcacacaggtac

SEQ ID NO: 468364 - DNA, 25 bp, Homo sapien
gttcacacaggtacaggtggctgca

SEQ ID NO: 468365 - DNA, 25 bp, Homo sapien
tacaggtggctgcagagtgcccaaa

SEQ ID NO: 468366 - DNA, 25 bp, Homo sapien
ctgcagagtgcccaaaggccaagca

SEQ ID NO: 468367 - DNA, 25 bp, Homo sapien
ggccaagcagcagagtgcctggtgt

SEQ ID NO: 468368 - DNA, 25 bp, Homo sapien
tccctggacctgttgtggcggactc

SEQ ID NO: 468369 - DNA, 25 bp, Homo sapien
cctgttgtggcggactccttgaagc

SEQ ID NO: 468370 - DNA, 25 bp, Homo sapien
tttaagaccattatccaactgcagt

SEQ ID NO: 468371 - DNA, 25 bp, Homo sapien
aagaccattatccaactgcagtttg

SEQ ID NO: 468372 - DNA, 25 bp, Homo sapien
ttttgtgcagctttcaccacttcca

SEQ ID NO: 468373 - DNA, 25 bp, Homo sapien
ggcagagttagcattaatgcaccct

SEQ ID NO: 468374 - DNA, 25 bp, Homo sapien
agcattaatgcaccctttgatctag

SEQ ID NO: 468375 - DNA, 25 bp, Homo sapien
taatgcaccctttgatctaggcacc

SEQ ID NO: 468376 - DNA, 25 bp, Homo sapien
accctttgatctaggcacctggagg

SEQ ID NO: 468377 - DNA, 25 bp, Homo sapien
tttgatctaggcacctggaggcagg

SEQ ID NO: 468378 - DNA, 25 bp, Homo sapien
cctggaggcaggtaagacaggctct

SEQ ID NO: 468379 - DNA, 25 bp, Homo sapien
agccaaataatgtaacgtgcggtca

SEQ ID NO: 468380 - DNA, 25 bp, Homo sapien
tgtaacgtgcggtcattgagagaga

SEQ ID NO: 468381 - DNA, 25 bp, Homo sapien
agagagaagcccgtcagaacaaatg

SEQ ID NO: 468382 - DNA, 25 bp, Homo sapien
ggaaccaagtccagaaacatgtttg

SEQ ID NO: 468383 - DNA, 25 bp, Homo sapien
gaaacatgtttgtctaggcgcaaga

SEQ ID NO: 468384 - DNA, 25 bp, Homo sapien
ttgtctaggcgcaagatgccagcat

SEQ ID NO: 468385 - DNA, 25 bp, Homo sapien
atgccagcatgtgtgtcagccaggg

SEQ ID NO: 468386 - DNA, 25 bp, Homo sapien
tgtcagccagggaagcagaccagga

SEQ ID NO: 468387 - DNA, 25 bp, Homo sapien
gaccaggaggagatattaagattta

SEQ ID NO: 468388 - DNA, 25 bp, Homo sapien
ttaaaacccagctctgtagctcagg

SEQ ID NO: 468389 - DNA, 25 bp, Homo sapien
caggcctataatttgagcgctttgg

SEQ ID NO: 468390 - DNA, 25 bp, Homo sapien
atgttttctattcatgtccagggca

SEQ ID NO: 468391 - DNA, 25 bp, Homo sapien
tgtccagggcatgagaatcttaata

SEQ ID NO: 468392 - DNA, 25 bp, Homo sapien
acttccctttttgcatgcagtatgt

SEQ ID NO: 468393 - DNA, 25 bp, Homo sapien
atgaacttaaaagctgccctgcaaa

SEQ ID NO: 468394 - DNA, 25 bp, Homo sapien
tgcaaaaccaatcctttcctatcat

SEQ ID NO: 468395 - DNA, 25 bp, Homo sapien
aatcctttcctatcatgaagagtac

SEQ ID NO: 468396 - DNA, 25 bp, Homo sapien
gaagagtaccttcatattttctaga

SEQ ID NO: 468397 - DNA, 25 bp, Homo sapien
gagattgtctctgaaccgttgctac

SEQ ID NO: 468398 - DNA, 25 bp, Homo sapien
gaaccgttgctacatagccataaat

SEQ ID NO: 468399 - DNA, 25 bp, Homo sapien
gtaaatcatgttggctatcagttct

SEQ ID NO: 468400 - DNA, 25 bp, Homo sapien
ggctatcagttcttgctattctcag

SEQ ID NO: 468401 - DNA, 25 bp, Homo sapien
aaaattcagttcctgaggtgcacta

SEQ ID NO: 468402 - DNA, 25 bp, Homo sapien
gaggtgcactaataacatttcaatg

SEQ ID NO: 468403 - DNA, 25 bp, Homo sapien
agagtaacatatggctggtggctac

SEQ ID NO: 468404 - DNA, 25 bp, Homo sapien
ttctgctggacagtgctgagttgga

SEQ ID NO: 468405 - DNA, 25 bp, Homo sapien
ggaaccaggtgttctttacacacag

SEQ ID NO: 468406 - DNA, 25 bp, Homo sapien
gaccacttaaagactgaggttttat

SEQ ID NO: 468407 - DNA, 25 bp, Homo sapien
acacctgagttttccaagcactttt

SEQ ID NO: 468408 - DNA, 25 bp, Homo sapien
acttttatctttgactgtggccaac

SEQ ID NO: 468409 - DNA, 25 bp, Homo sapien
gtggccaacattctatagggctaaa

SEQ ID NO: 468410 - DNA, 25 bp, Homo sapien
taaatcccaactttagcagccggaa

SEQ ID NO: 468411 - DNA, 25 bp, Homo sapien
agcagccggaagtcgcaactgaaga

SEQ ID NO: 468412 - DNA, 25 bp, Homo sapien
gtcaaaatgaattactatcacgtta

SEQ ID NO: 468413 - DNA, 25 bp, Homo sapien
atgaattactatcacgttaggttgg

SEQ ID NO: 468414 - DNA, 25 bp, Homo sapien
gaattactatcacgttaggttgggc

SEQ ID NO: 468415 - DNA, 25 bp, Homo sapien
aattactatcacgttaggttgggca

SEQ ID NO: 468416 - DNA, 25 bp, Homo sapien
attactatcacgttaggttgggcac

SEQ ID NO: 468417 - DNA, 25 bp, Homo sapien
ttactatcacgttaggttgggcaca

SEQ ID NO: 468418 - DNA, 25 bp, Homo sapien
tactatcacgttaggttgggcacag

SEQ ID NO: 468419 - DNA, 25 bp, Homo sapien
actatcacgttaggttgggcacagt

SEQ ID NO: 468420 - DNA, 25 bp, Homo sapien
tatcacgttaggttgggcacagtgc

SEQ ID NO: 468421 - DNA, 25 bp, Homo sapien
atcacgttaggttgggcacagtgca

SEQ ID NO: 468422 - DNA, 25 bp, Homo sapien
tcacgttaggttgggcacagtgcat

SEQ ID NO: 468423 - DNA, 25 bp, Homo sapien
atcatttgctgtcctggaatactgg

SEQ ID NO: 468424 - DNA, 25 bp, Homo sapien
tcatttgctgtcctggaatactggg

SEQ ID NO: 468425 - DNA, 25 bp, Homo sapien
gggaagggccctcattatccagtga

SEQ ID NO: 468426 - DNA, 25 bp, Homo sapien
ggaagggccctcattatccagtgag

SEQ ID NO: 468427 - DNA, 25 bp, Homo sapien
aagggccctcattatccagtgaggc

SEQ ID NO: 468428 - DNA, 25 bp, Homo sapien
tcattatccagtgaggcctgtgggt

SEQ ID NO: 468429 - DNA, 25 bp, Homo sapien
attatccagtgaggcctgtgggttc

SEQ ID NO: 468430 - DNA, 25 bp, Homo sapien
gcctgtgggttctgggaggcccttg

SEQ ID NO: 468431 - DNA, 25 bp, Homo sapien
ggcagacccgggacttctccaggag

SEQ ID NO: 468432 - DNA, 25 bp, Homo sapien
gacccgggacttctccaggagaaat

SEQ ID NO: 468433 - DNA, 25 bp, Homo sapien
cgggacttctccaggagaaattgct

SEQ ID NO: 468434 - DNA, 25 bp, Homo sapien
aaagtcagctggccgggcgcagtgg

SEQ ID NO: 468435 - DNA, 25 bp, Homo sapien
acactttgggtggccgaggtaggca

SEQ ID NO: 468436 - DNA, 25 bp, Homo sapien
cactttgggtggccgaggtaggcag

SEQ ID NO: 468437 - DNA, 25 bp, Homo sapien
actttgggtggccgaggtaggcaga

SEQ ID NO: 468438 - DNA, 25 bp, Homo sapien
agcctggccaaagagaccagcctga

SEQ ID NO: 468439 - DNA, 25 bp, Homo sapien
gcctggccaaagagaccagcctgac

SEQ ID NO: 468440 - DNA, 25 bp, Homo sapien
cctggccaaagagaccagcctgacc

SEQ ID NO: 468441 - DNA, 25 bp, Homo sapien
caaagattagccgggtgtggcggcg

SEQ ID NO: 468442 - DNA, 25 bp, Homo sapien
aaagattagccgggtgtggcggcgg

SEQ ID NO: 468443 - DNA, 25 bp, Homo sapien
agattagccgggtgtggcggcgggc

SEQ ID NO: 468444 - DNA, 25 bp, Homo sapien
accttgaagcagaggcgcttggtaa

SEQ ID NO: 468445 - DNA, 25 bp, Homo sapien
gcttggtaaggcagagcacctgaat

SEQ ID NO: 468446 - DNA, 25 bp, Homo sapien
gaatgctctgtattgcagggaggat

SEQ ID NO: 468447 - DNA, 25 bp, Homo sapien
ttgttctttcctgtagtggcagtta

SEQ ID NO: 468448 - DNA, 25 bp, Homo sapien
gtggcagttaacttaatggtctcta

SEQ ID NO: 468449 - DNA, 25 bp, Homo sapien
taatggtctctaaaacgttctgtgc

SEQ ID NO: 468450 - DNA, 25 bp, Homo sapien
aaacgttctgtgcaatcttaagatg

SEQ ID NO: 468451 - DNA, 25 bp, Homo sapien
aatacatttgggaaagccagcacat

SEQ ID NO: 468452 - DNA, 25 bp, Homo sapien
taggcccctcctaaagatttgctgg

SEQ ID NO: 468453 - DNA, 25 bp, Homo sapien
tgggcacaaagtattctgaaggctc

SEQ ID NO: 468454 - DNA, 25 bp, Homo sapien
gaaggctctacaaagtcctgtggaa

SEQ ID NO: 468455 - DNA, 25 bp, Homo sapien
agctccagtcagttgccttttaaaa

SEQ ID NO: 468456 - DNA, 25 bp, Homo sapien
gctccagtcagttgccttttaaaag

SEQ ID NO: 468457 - DNA, 25 bp, Homo sapien
ctccagtcagttgccttttaaaagt

SEQ ID NO: 468458 - DNA, 25 bp, Homo sapien
ttgccttttaaaagtaagcgtagat

SEQ ID NO: 468459 - DNA, 25 bp, Homo sapien
tgccttttaaaagtaagcgtagatg

SEQ ID NO: 468460 - DNA, 25 bp, Homo sapien
gccttttaaaagtaagcgtagatgt

SEQ ID NO: 468461 - DNA, 25 bp, Homo sapien
ttaaaagtaagcgtagatgtggctg

SEQ ID NO: 468462 - DNA, 25 bp, Homo sapien
taaaagtaagcgtagatgtggctgg

SEQ ID NO: 468463 - DNA, 25 bp, Homo sapien
aaagtaagcgtagatgtggctgggc

SEQ ID NO: 468464 - DNA, 25 bp, Homo sapien
agtaagcgtagatgtggctgggcgc

SEQ ID NO: 468465 - DNA, 25 bp, Homo sapien
gtaagcgtagatgtggctgggcgcg

SEQ ID NO: 468466 - DNA, 25 bp, Homo sapien
ctgggagccgcttccagactgtgga

SEQ ID NO: 468467 - DNA, 25 bp, Homo sapien
gactgtggactcgagcaacattgat

SEQ ID NO: 468468 - DNA, 25 bp, Homo sapien
tgggcaacctggactttctgatcac

SEQ ID NO: 468469 - DNA, 25 bp, Homo sapien
caccggcctcaatgggttagagatc

SEQ ID NO: 468470 - DNA, 25 bp, Homo sapien
ctcaatgggttagagatcctgcctt

SEQ ID NO: 468471 - DNA, 25 bp, Homo sapien
cacccctcacagttcatttcattgg

SEQ ID NO: 468472 - DNA, 25 bp, Homo sapien
ccctcacagttcatttcattggcca

SEQ ID NO: 468473 - DNA, 25 bp, Homo sapien
attggccaaaactttcctatgtgga

SEQ ID NO: 468474 - DNA, 25 bp, Homo sapien
aactttcctatgtggagctgactag

SEQ ID NO: 468475 - DNA, 25 bp, Homo sapien
gagctgactaggaatcaaagtcata

SEQ ID NO: 468476 - DNA, 25 bp, Homo sapien
caaagtcataaaattctagcctgtt

SEQ ID NO: 468477 - DNA, 25 bp, Homo sapien
accccttcttgctcagggacaggca

SEQ ID NO: 468478 - DNA, 25 bp, Homo sapien
gggacaggcaacatctatccatcca

SEQ ID NO: 468479 - DNA, 25 bp, Homo sapien
tatccatccatttgttattgagcac

SEQ ID NO: 468480 - DNA, 25 bp, Homo sapien
ccatttgttattgagcacctgttgt

SEQ ID NO: 468481 - DNA, 25 bp, Homo sapien
agcacctgttgtgtagtagaccctg

SEQ ID NO: 468482 - DNA, 25 bp, Homo sapien
ggcagagaacaaaacagacaggtcc

SEQ ID NO: 468483 - DNA, 25 bp, Homo sapien
aaaacagacaggtccctgcctgtgg

SEQ ID NO: 468484 - DNA, 25 bp, Homo sapien
ctgcctgtgggaagcttccattatg

SEQ ID NO: 468485 - DNA, 25 bp, Homo sapien
ggaagcttccattatggtgagaaga

SEQ ID NO: 468486 - DNA, 25 bp, Homo sapien
gacagacaatcaacaaatccacaaa

SEQ ID NO: 468487 - DNA, 25 bp, Homo sapien
aaatccacaaacaggtgtggtgact

SEQ ID NO: 468488 - DNA, 25 bp, Homo sapien
aggtaaatgtggcagcagacccaat

SEQ ID NO: 468489 - DNA, 25 bp, Homo sapien
gcagacccaatggaaagctcctgga

SEQ ID NO: 468490 - DNA, 25 bp, Homo sapien
ggttttcctctgtgacttagggaca

SEQ ID NO: 468491 - DNA, 25 bp, Homo sapien
gggacaggaaatcttatagccaaaa

SEQ ID NO: 468492 - DNA, 25 bp, Homo sapien
aggattttgctattgtgctgttttc

SEQ ID NO: 468493 - DNA, 25 bp, Homo sapien
gatggagataatgatcagcactaca

SEQ ID NO: 468494 - DNA, 25 bp, Homo sapien
agcactacaaaagcctctaccattg

SEQ ID NO: 468495 - DNA, 25 bp, Homo sapien
accattgctctcacccggagtggga

SEQ ID NO: 468496 - DNA, 25 bp, Homo sapien
gaagccgacagagtacccaaatgga

SEQ ID NO: 468497 - DNA, 25 bp, Homo sapien
taattatgccacgatctcggctcct

SEQ ID NO: 468498 - DNA, 25 bp, Homo sapien
gctccttccatgtgagaatgtccca

SEQ ID NO: 468499 - DNA, 25 bp, Homo sapien
gggctttccccctccttcgctctgc

SEQ ID NO: 468500 - DNA, 25 bp, Homo sapien
ggctttccccctccttcgctctgca

SEQ ID NO: 468501 - DNA, 25 bp, Homo sapien
gctttccccctccttcgctctgcac

SEQ ID NO: 468502 - DNA, 25 bp, Homo sapien
ctttccccctccttcgctctgcact

SEQ ID NO: 468503 - DNA, 25 bp, Homo sapien
tttccccctccttcgctctgcactt

SEQ ID NO: 468504 - DNA, 25 bp, Homo sapien
tccccctccttcgctctgcacttct

SEQ ID NO: 468505 - DNA, 25 bp, Homo sapien
ccccctccttcgctctgcacttctc

SEQ ID NO: 468506 - DNA, 25 bp, Homo sapien
cccctccttcgctctgcacttctcc

SEQ ID NO: 468507 - DNA, 25 bp, Homo sapien
ttctccttgctgccatgcgaagaag

SEQ ID NO: 468508 - DNA, 25 bp, Homo sapien
ccttgctgccatgcgaagaaggatg

SEQ ID NO: 468509 - DNA, 25 bp, Homo sapien
aaaattattatataggccaggtgcg

SEQ ID NO: 468510 - DNA, 25 bp, Homo sapien
aaattattatataggccaggtgcgg

SEQ ID NO: 468511 - DNA, 25 bp, Homo sapien
atacaagaattaaccagatgtggta

SEQ ID NO: 468512 - DNA, 25 bp, Homo sapien
acaagaattaaccagatgtggtagc

SEQ ID NO: 468513 - DNA, 25 bp, Homo sapien
agaattaaccagatgtggtagcggc

SEQ ID NO: 468514 - DNA, 25 bp, Homo sapien
gaattaaccagatgtggtagcggcg

SEQ ID NO: 468515 - DNA, 25 bp, Homo sapien
aattaaccagatgtggtagcggcgg

SEQ ID NO: 468516 - DNA, 25 bp, Homo sapien
aaccagatgtggtagcggcgggcac

SEQ ID NO: 468517 - DNA, 25 bp, Homo sapien
accagatgtggtagcggcgggcacc

SEQ ID NO: 468518 - DNA, 25 bp, Homo sapien
ccagatgtggtagcggcgggcacct

SEQ ID NO: 468519 - DNA, 25 bp, Homo sapien
ctacttgggaggcttgaacctggga

SEQ ID NO: 468520 - DNA, 25 bp, Homo sapien
aatgtaccagaactaaacagtataa

SEQ ID NO: 468521 - DNA, 25 bp, Homo sapien
gtcaagatcacagcaagttaataac

SEQ ID NO: 468522 - DNA, 25 bp, Homo sapien
taacttcaccagtaatgatgtagac

SEQ ID NO: 468523 - DNA, 25 bp, Homo sapien
agatcactactccaatggagttgga

SEQ ID NO: 468524 - DNA, 25 bp, Homo sapien
atccaatggtttcctaaatggtagc

SEQ ID NO: 468525 - DNA, 25 bp, Homo sapien
cctaaatggtagctctaaacatgac

SEQ ID NO: 468526 - DNA, 25 bp, Homo sapien
gtgacaccgaaatggaagttgattc

SEQ ID NO: 468527 - DNA, 25 bp, Homo sapien
aagttgattcaagtcagttgagacg

SEQ ID NO: 468528 - DNA, 25 bp, Homo sapien
gtcaggccgccatagaaagaatgat

SEQ ID NO: 468529 - DNA, 25 bp, Homo sapien
gatccactttggacgagagctgcaa

SEQ ID NO: 468530 - DNA, 25 bp, Homo sapien
gagagctgcaagcaatgagtgaaca

SEQ ID NO: 468531 - DNA, 25 bp, Homo sapien
tcataccctccttgggcaaagacct

SEQ ID NO: 468532 - DNA, 25 bp, Homo sapien
ttgggcaaagacctcactctcacgc

SEQ ID NO: 468533 - DNA, 25 bp, Homo sapien
ggcccagccctgactatgtggactg

SEQ ID NO: 468534 - DNA, 25 bp, Homo sapien
gggtctctgtgtcagatgcagactc

SEQ ID NO: 468535 - DNA, 25 bp, Homo sapien
tctgtgtcagatgcagactcttctg

SEQ ID NO: 468536 - DNA, 25 bp, Homo sapien
cagactcttctgaccctgtgagaaa

SEQ ID NO: 468537 - DNA, 25 bp, Homo sapien
gaccctgtgagaaaggctcatgaca

SEQ ID NO: 468538 - DNA, 25 bp, Homo sapien
cagcatgagggtgtggaagctaacc

SEQ ID NO: 468539 - DNA, 25 bp, Homo sapien
tgtggaagctaacccatgagctctg

SEQ ID NO: 468540 - DNA, 25 bp, Homo sapien
gtccccacctgccagtgtgggaagt

SEQ ID NO: 468541 - DNA, 25 bp, Homo sapien
agaggctcacccatcgggcaggagg

SEQ ID NO: 468542 - DNA, 25 bp, Homo sapien
aataattggtccataggtactattt

SEQ ID NO: 468543 - DNA, 25 bp, Homo sapien
ggtactattttatttggtccataag

SEQ ID NO: 468544 - DNA, 25 bp, Homo sapien
ttattatgtcatttcccacgtaggt

SEQ ID NO: 468545 - DNA, 25 bp, Homo sapien
gtcatttcccacgtaggttactgat

SEQ ID NO: 468546 - DNA, 25 bp, Homo sapien
cccacgtaggttactgatacctgaa

SEQ ID NO: 468547 - DNA, 25 bp, Homo sapien
gatacctgaagactttttccacctt

SEQ ID NO: 468548 - DNA, 25 bp, Homo sapien
ctttaaccttactcgttgaggagct

SEQ ID NO: 468549 - DNA, 25 bp, Homo sapien
aaccttactcgttgaggagctttgt

SEQ ID NO: 468550 - DNA, 25 bp, Homo sapien
ctcgttgaggagctttgtagtctaa

SEQ ID NO: 468551 - DNA, 25 bp, Homo sapien
ttgaggagctttgtagtctaataaa

SEQ ID NO: 468552 - DNA, 25 bp, Homo sapien
ggtggataatggtaactatgtgctt

SEQ ID NO: 468553 - DNA, 25 bp, Homo sapien
ggtgtatgaacatgggctctccact

SEQ ID NO: 468554 - DNA, 25 bp, Homo sapien
gtgtatgaacatgggctctccacta

SEQ ID NO: 468555 - DNA, 25 bp, Homo sapien
atgaacatgggctctccactatgaa

SEQ ID NO: 468556 - DNA, 25 bp, Homo sapien
tgaacatgggctctccactatgaaa

SEQ ID NO: 468557 - DNA, 25 bp, Homo sapien
gaacatgggctctccactatgaaat

SEQ ID NO: 468558 - DNA, 25 bp, Homo sapien
aacatgggctctccactatgaaatt

SEQ ID NO: 468559 - DNA, 25 bp, Homo sapien
acatgggctctccactatgaaatta

SEQ ID NO: 468560 - DNA, 25 bp, Homo sapien
tgggctctccactatgaaattatgg

SEQ ID NO: 468561 - DNA, 25 bp, Homo sapien
gggctctccactatgaaattatggt

SEQ ID NO: 468562 - DNA, 25 bp, Homo sapien
ggctctccactatgaaattatggta

SEQ ID NO: 468563 - DNA, 25 bp, Homo sapien
tgaaattatggtattggccgggcgc

SEQ ID NO: 468564 - DNA, 25 bp, Homo sapien
ttgcccttcattcggaaatgaaacg

SEQ ID NO: 468565 - DNA, 25 bp, Homo sapien
ttcggaaatgaaacgcctttgatct

SEQ ID NO: 468566 - DNA, 25 bp, Homo sapien
aatgaaacgcctttgatcttttctc

SEQ ID NO: 468567 - DNA, 25 bp, Homo sapien
ctgcttggtctcccagcatttttct

SEQ ID NO: 468568 - DNA, 25 bp, Homo sapien
ttctctctctttttaccactgaatt

SEQ ID NO: 468569 - DNA, 25 bp, Homo sapien
ctctctctttttaccactgaatttt

SEQ ID NO: 468570 - DNA, 25 bp, Homo sapien
tcccttcgctgagaggcgctttgga

SEQ ID NO: 468571 - DNA, 25 bp, Homo sapien
cgctgagaggcgctttggaaaatat

SEQ ID NO: 468572 - DNA, 25 bp, Homo sapien
gaggcgctttggaaaatatctagat

SEQ ID NO: 468573 - DNA, 25 bp, Homo sapien
atatctagatattcgtttgatcaca

SEQ ID NO: 468574 - DNA, 25 bp, Homo sapien
attcgtttgatcacaaactaaaggc

SEQ ID NO: 468575 - DNA, 25 bp, Homo sapien
gtttcttcacacttgttgcctacta

SEQ ID NO: 468576 - DNA, 25 bp, Homo sapien
acttgttgcctactatcatacctga

SEQ ID NO: 468577 - DNA, 25 bp, Homo sapien
gcctactatcatacctgacatgcag

SEQ ID NO: 468578 - DNA, 25 bp, Homo sapien
tacctgacatgcagtaaattaccat

SEQ ID NO: 468579 - DNA, 25 bp, Homo sapien
aatctcttaaacgtgtactctttat

SEQ ID NO: 468580 - DNA, 25 bp, Homo sapien
taaacgtgtactctttattactctg

SEQ ID NO: 468581 - DNA, 25 bp, Homo sapien
tttattactctgttggaccatgatg

SEQ ID NO: 468582 - DNA, 25 bp, Homo sapien
tggaccatgatgagagcaacttatt

SEQ ID NO: 468583 - DNA, 25 bp, Homo sapien
gcaacttattgtatggctatttaaa

SEQ ID NO: 468584 - DNA, 25 bp, Homo sapien
aactaagacttattgttcacatttg

SEQ ID NO: 468585 - DNA, 25 bp, Homo sapien
gaaatagacaatttactctgtaagt

SEQ ID NO: 468586 - DNA, 25 bp, Homo sapien
ctttttcactcccttatgaagcatg

SEQ ID NO: 468587 - DNA, 25 bp, Homo sapien
ttttcactcccttatgaagcatgtt

SEQ ID NO: 468588 - DNA, 25 bp, Homo sapien
tttcactcccttatgaagcatgtta

SEQ ID NO: 468589 - DNA, 25 bp, Homo sapien
tcactcccttatgaagcatgttagt

SEQ ID NO: 468590 - DNA, 25 bp, Homo sapien
actcccttatgaagcatgttagtgg

SEQ ID NO: 468591 - DNA, 25 bp, Homo sapien
gggatgcttaccttccttaatgaaa

SEQ ID NO: 468592 - DNA, 25 bp, Homo sapien
ggatgcttaccttccttaatgaaac

SEQ ID NO: 468593 - DNA, 25 bp, Homo sapien
gatgcttaccttccttaatgaaact

SEQ ID NO: 468594 - DNA, 25 bp, Homo sapien
tgcttaccttccttaatgaaacttg

SEQ ID NO: 468595 - DNA, 25 bp, Homo sapien
gcttaccttccttaatgaaacttga

SEQ ID NO: 468596 - DNA, 25 bp, Homo sapien
taccttccttaatgaaacttgagac

SEQ ID NO: 468597 - DNA, 25 bp, Homo sapien
tgaaagagatacctttgggagatgt

SEQ ID NO: 468598 - DNA, 25 bp, Homo sapien
tttgccaataattcacatgctgcct

SEQ ID NO: 468599 - DNA, 25 bp, Homo sapien
gatcccaggctgcacataaggtcca

SEQ ID NO: 468600 - DNA, 25 bp, Homo sapien
cataaggtccatttgcctgagtatt

SEQ ID NO: 468601 - DNA, 25 bp, Homo sapien
ggtccatttgcctgagtattattac

SEQ ID NO: 468602 - DNA, 25 bp, Homo sapien
aactttcaagttcacagccttgcgt

SEQ ID NO: 468603 - DNA, 25 bp, Homo sapien
aagttcacagccttgcgttgtccat

SEQ ID NO: 468604 - DNA, 25 bp, Homo sapien
agccttgcgttgtccatctttaata

SEQ ID NO: 468605 - DNA, 25 bp, Homo sapien
gtccatctttaatacacttagttgt

SEQ ID NO: 468606 - DNA, 25 bp, Homo sapien
ggaaacaggacctacctatacctgt

SEQ ID NO: 468607 - DNA, 25 bp, Homo sapien
gacctacctatacctgtgccaacag

SEQ ID NO: 468608 - DNA, 25 bp, Homo sapien
gagatagagcccgaggtgaccctat

SEQ ID NO: 468609 - DNA, 25 bp, Homo sapien
gatagagcccgaggtgaccctattc

SEQ ID NO: 468610 - DNA, 25 bp, Homo sapien
agagcccgaggtgaccctattcctg

SEQ ID NO: 468611 - DNA, 25 bp, Homo sapien
cgaggtgaccctattcctgttggga

SEQ ID NO: 468612 - DNA, 25 bp, Homo sapien
aggtgaccctattcctgttgggagc

SEQ ID NO: 468613 - DNA, 25 bp, Homo sapien
gtgaccctattcctgttgggagctc

SEQ ID NO: 468614 - DNA, 25 bp, Homo sapien
accctattcctgttgggagctctga

SEQ ID NO: 468615 - DNA, 25 bp, Homo sapien
tattcctgttgggagctctgatggg

SEQ ID NO: 468616 - DNA, 25 bp, Homo sapien
ccctgtgccggctccactgaggtgg

SEQ ID NO: 468617 - DNA, 25 bp, Homo sapien
gttaggaaagaaccaaagtctcatg

SEQ ID NO: 468618 - DNA, 25 bp, Homo sapien
aagtctcatgaacaggcatttttcc

SEQ ID NO: 468619 - DNA, 25 bp, Homo sapien
agcacacggcctttgacatgcacca

SEQ ID NO: 468620 - DNA, 25 bp, Homo sapien
cggcctttgacatgcaccaggctca

SEQ ID NO: 468621 - DNA, 25 bp, Homo sapien
cttcagcttgatggagtgcaggcac

SEQ ID NO: 468622 - DNA, 25 bp, Homo sapien
tgatggagtgcaggcacttcttcca

SEQ ID NO: 468623 - DNA, 25 bp, Homo sapien
aggcacttcttccagttggccacag

SEQ ID NO: 468624 - DNA, 25 bp, Homo sapien
ttccagttggccacagccgagtgca

SEQ ID NO: 468625 - DNA, 25 bp, Homo sapien
ttggccacagccgagtgcacataga

SEQ ID NO: 468626 - DNA, 25 bp, Homo sapien
agccgagtgcacatagagccagccg

SEQ ID NO: 468627 - DNA, 25 bp, Homo sapien
agtgcacatagagccagccgttctg

SEQ ID NO: 468628 - DNA, 25 bp, Homo sapien
agagccagccgttctgggctcccag

SEQ ID NO: 468629 - DNA, 25 bp, Homo sapien
ctcccagccacatggtgggtgcagc

SEQ ID NO: 468630 - DNA, 25 bp, Homo sapien
gtgtccacggtgacttaggagtgct

SEQ ID NO: 468631 - DNA, 25 bp, Homo sapien
ttcattttgtctagaaaggcagcat

SEQ ID NO: 468632 - DNA, 25 bp, Homo sapien
ggcagcatggtagatctgtagtcat

SEQ ID NO: 468633 - DNA, 25 bp, Homo sapien
gtcatacagacattccatttactag

SEQ ID NO: 468634 - DNA, 25 bp, Homo sapien
tccatttactagctgcatgatttag

SEQ ID NO: 468635 - DNA, 25 bp, Homo sapien
tgactttgaaagctggtctctgccc

SEQ ID NO: 468636 - DNA, 25 bp, Homo sapien
aaagctggtctctgcccttagtagg

SEQ ID NO: 468637 - DNA, 25 bp, Homo sapien
cccttagtagggttagcatctgtgt

SEQ ID NO: 468638 - DNA, 25 bp, Homo sapien
gggttagcatctgtgtagagaccct

SEQ ID NO: 468639 - DNA, 25 bp, Homo sapien
ccccacatccaattcttttaggaat

SEQ ID NO: 468640 - DNA, 25 bp, Homo sapien
agaaatttgtactgtgtccacggtg

SEQ ID NO: 468641 - DNA, 25 bp, Homo sapien
gaacacttgatttggaatttcggta

SEQ ID NO: 468642 - DNA, 25 bp, Homo sapien
gaatttcggtaatagccagtgagct

SEQ ID NO: 468643 - DNA, 25 bp, Homo sapien
cttcaacaaggtcccttccctgaga

SEQ ID NO: 468644 - DNA, 25 bp, Homo sapien
gagagactcagtttgtgacgcttgt

SEQ ID NO: 468645 - DNA, 25 bp, Homo sapien
cagtttgtgacgcttgtgattgtga

SEQ ID NO: 468646 - DNA, 25 bp, Homo sapien
tgactccacataactctgcaaactg

SEQ ID NO: 468647 - DNA, 25 bp, Homo sapien
tgcaaactgtggtgcgccctattat

SEQ ID NO: 468648 - DNA, 25 bp, Homo sapien
gtgcgccctattattgccgtttaac

SEQ ID NO: 468649 - DNA, 25 bp, Homo sapien
attattgccgtttaacttgtcagtg

SEQ ID NO: 468650 - DNA, 25 bp, Homo sapien
aacttgtcagtgtcggttctgcacc

SEQ ID NO: 468651 - DNA, 25 bp, Homo sapien
gggctggagaagaacacttgatttg

SEQ ID NO: 468652 - DNA, 25 bp, Homo sapien
actgttaaggccgtttgctggaaag

SEQ ID NO: 468653 - DNA, 25 bp, Homo sapien
ggagaatttcatcctcaaacattgc

SEQ ID NO: 468654 - DNA, 25 bp, Homo sapien
atttcatcctcaaacattgccgtgg

SEQ ID NO: 468655 - DNA, 25 bp, Homo sapien
tcatcctcaaacattgccgtggctg

SEQ ID NO: 468656 - DNA, 25 bp, Homo sapien
ggctggaggaagtgcctagatcact

SEQ ID NO: 468657 - DNA, 25 bp, Homo sapien
aagtgcctagatcactgcagttggc

SEQ ID NO: 468658 - DNA, 25 bp, Homo sapien
taggtatacttagtgtgtgaatcac

SEQ ID NO: 468659 - DNA, 25 bp, Homo sapien
gtgtgtgaatcactatgatatgtaa

SEQ ID NO: 468660 - DNA, 25 bp, Homo sapien
attataccttaatatactagccgaa

SEQ ID NO: 468661 - DNA, 25 bp, Homo sapien
aaaaattgtaaaagcattgccgtag

SEQ ID NO: 468662 - DNA, 25 bp, Homo sapien
aaagcattgccgtagcatttgaaac

SEQ ID NO: 468663 - DNA, 25 bp, Homo sapien
tgccgagaacaagcgagggctctga

SEQ ID NO: 468664 - DNA, 25 bp, Homo sapien
tcacctctcaaaatcctggctgtgg

SEQ ID NO: 468665 - DNA, 25 bp, Homo sapien
tctcaaaatcctggctgtggtaagc

SEQ ID NO: 468666 - DNA, 25 bp, Homo sapien
taagcagagggtgctgagtgcccac

SEQ ID NO: 468667 - DNA, 25 bp, Homo sapien
agcttccgcacctgcatagcgatgt

SEQ ID NO: 468668 - DNA, 25 bp, Homo sapien
catagcgatgttgctgagctcgtcg

SEQ ID NO: 468669 - DNA, 25 bp, Homo sapien
agctcgtcgctcagcaggcagcgaa

SEQ ID NO: 468670 - DNA, 25 bp, Homo sapien
tcagcaggcagcgaaggctcatgaa

SEQ ID NO: 468671 - DNA, 25 bp, Homo sapien
tgacactacctgattccagtgggcc

SEQ ID NO: 468672 - DNA, 25 bp, Homo sapien
gggacttggaggaccgaccacgcca

SEQ ID NO: 468673 - DNA, 25 bp, Homo sapien
acgccaagagcccaccgaggagatg

SEQ ID NO: 468674 - DNA, 25 bp, Homo sapien
ttgcccttcattcggaaatgaaacg

SEQ ID NO: 468675 - DNA, 25 bp, Homo sapien
ttcggaaatgaaacgcctttgatct

SEQ ID NO: 468676 - DNA, 25 bp, Homo sapien
aatgaaacgcctttgatcttttctc

SEQ ID NO: 468677 - DNA, 25 bp, Homo sapien
tggtctcccagcatttttctttaca

SEQ ID NO: 468678 - DNA, 25 bp, Homo sapien
tttctttacagctgtttctctctct

SEQ ID NO: 468679 - DNA, 25 bp, Homo sapien
ttctctctctttttaccactgaatt

SEQ ID NO: 468680 - DNA, 25 bp, Homo sapien
ctctctctttttaccactgaatttt

SEQ ID NO: 468681 - DNA, 25 bp, Homo sapien
tcccttcgctgagaggcgctttgga

SEQ ID NO: 468682 - DNA, 25 bp, Homo sapien
gaggcgctttggaaaatatctagat

SEQ ID NO: 468683 - DNA, 25 bp, Homo sapien
atatctagatattcgtttgatcaca

SEQ ID NO: 468684 - DNA, 25 bp, Homo sapien
tttgatcacaaactaaaggcttgga

SEQ ID NO: 468685 - DNA, 25 bp, Homo sapien
ttagacctaccaaacattaccgaga

SEQ ID NO: 468686 - DNA, 25 bp, Homo sapien
cattaccgagaatgggacattgcta

SEQ ID NO: 468687 - DNA, 25 bp, Homo sapien
gggacattgctagacccactatgag

SEQ ID NO: 468688 - DNA, 25 bp, Homo sapien
tagacccactatgagcagcatggag

SEQ ID NO: 468689 - DNA, 25 bp, Homo sapien
gaagatagcaaaggctggatccaat

SEQ ID NO: 468690 - DNA, 25 bp, Homo sapien
ggctggatccaatagatgttttcat

SEQ ID NO: 468691 - DNA, 25 bp, Homo sapien
gtagcttgctgatactggatctcca

SEQ ID NO: 468692 - DNA, 25 bp, Homo sapien
aaaactaacgttatgctccatgcat

SEQ ID NO: 468693 - DNA, 25 bp, Homo sapien
atcttcccattgttattagttgctc

SEQ ID NO: 468694 - DNA, 25 bp, Homo sapien
cattgttattagttgctcagctgga

SEQ ID NO: 468695 - DNA, 25 bp, Homo sapien
cgtgaggatgttttagacctaccaa

SEQ ID NO: 468696 - DNA, 25 bp, Homo sapien
atgggactggggactattatctaag

SEQ ID NO: 468697 - DNA, 25 bp, Homo sapien
ggactggggactattatctaagtga

SEQ ID NO: 468698 - DNA, 25 bp, Homo sapien
gaagcaaaggcttaagaataataca

SEQ ID NO: 468699 - DNA, 25 bp, Homo sapien
tacaatggactttggcgagtcaggg

SEQ ID NO: 468700 - DNA, 25 bp, Homo sapien
tgcacgaaaatctcataaatcactg

SEQ ID NO: 468701 - DNA, 25 bp, Homo sapien
gcacgaaaatctcataaatcactgt

SEQ ID NO: 468702 - DNA, 25 bp, Homo sapien
cacgaaaatctcataaatcactgtt

SEQ ID NO: 468703 - DNA, 25 bp, Homo sapien
acttactcatataaccaaacaccat

SEQ ID NO: 468704 - DNA, 25 bp, Homo sapien
tactcatataaccaaacaccatgtg

SEQ ID NO: 468705 - DNA, 25 bp, Homo sapien
actcatataaccaaacaccatgtgt

SEQ ID NO: 468706 - DNA, 25 bp, Homo sapien
ctcatataaccaaacaccatgtgtt

SEQ ID NO: 468707 - DNA, 25 bp, Homo sapien
gaagactcaaggatgatctctgggt

SEQ ID NO: 468708 - DNA, 25 bp, Homo sapien
caaggatgatctctgggtttctcca

SEQ ID NO: 468709 - DNA, 25 bp, Homo sapien
gatggtgtcaatagtgagttgcaaa

SEQ ID NO: 468710 - DNA, 25 bp, Homo sapien
gtattcagctcagtataaccccata

SEQ ID NO: 468711 - DNA, 25 bp, Homo sapien
agtataaccccatagtccagagcaa

SEQ ID NO: 468712 - DNA, 25 bp, Homo sapien
agtccagagcaatggttaaagtcag

SEQ ID NO: 468713 - DNA, 25 bp, Homo sapien
ggttaaagtcagatagcacaagcaa

SEQ ID NO: 468714 - DNA, 25 bp, Homo sapien
gatagcacaagcaaattacacactt

SEQ ID NO: 468715 - DNA, 25 bp, Homo sapien
acacactttgctaaaagacgcccca

SEQ ID NO: 468716 - DNA, 25 bp, Homo sapien
agacgccccaataattaaatgttgt

SEQ ID NO: 468717 - DNA, 25 bp, Homo sapien
tgagactgtattcatgcttaaagta

SEQ ID NO: 468718 - DNA, 25 bp, Homo sapien
tgtaaaagcattttaagtcattaaa

SEQ ID NO: 468719 - DNA, 25 bp, Homo sapien
agtcattaaacaaatgggccgggca

SEQ ID NO: 468720 - DNA, 25 bp, Homo sapien
gtcattaaacaaatgggccgggcat

SEQ ID NO: 468721 - DNA, 25 bp, Homo sapien
tcattaaacaaatgggccgggcatg

SEQ ID NO: 468722 - DNA, 25 bp, Homo sapien
cattaaacaaatgggccgggcatgg

SEQ ID NO: 468723 - DNA, 25 bp, Homo sapien
attaaacaaatgggccgggcatggt

SEQ ID NO: 468724 - DNA, 25 bp, Homo sapien
ttaaacaaatgggccgggcatggtg

SEQ ID NO: 468725 - DNA, 25 bp, Homo sapien
taaacaaatgggccgggcatggtgg

SEQ ID NO: 468726 - DNA, 25 bp, Homo sapien
ggagaatcacctgaatgggaggcag

SEQ ID NO: 468727 - DNA, 25 bp, Homo sapien
aatcacctgaatgggaggcagaggt

SEQ ID NO: 468728 - DNA, 25 bp, Homo sapien
atcacctgaatgggaggcagaggtt

SEQ ID NO: 468729 - DNA, 25 bp, Homo sapien
aacaatgagaacatacgggcacagt

SEQ ID NO: 468730 - DNA, 25 bp, Homo sapien
acaatgagaacatacgggcacagtg

SEQ ID NO: 468731 - DNA, 25 bp, Homo sapien
aatgagaacatacgggcacagtggg

SEQ ID NO: 468732 - DNA, 25 bp, Homo sapien
atgagaacatacgggcacagtgggg

SEQ ID NO: 468733 - DNA, 25 bp, Homo sapien
ggcacagtggggggaacatcacaca

SEQ ID NO: 468734 - DNA, 25 bp, Homo sapien
agaggcaagggaagtgatagcatta

SEQ ID NO: 468735 - DNA, 25 bp, Homo sapien
gaggcaagggaagtgatagcattaa

SEQ ID NO: 468736 - DNA, 25 bp, Homo sapien
aggcaagggaagtgatagcattaag

SEQ ID NO: 468737 - DNA, 25 bp, Homo sapien
ggcaagggaagtgatagcattaaga

SEQ ID NO: 468738 - DNA, 25 bp, Homo sapien
gcaagggaagtgatagcattaagag

SEQ ID NO: 468739 - DNA, 25 bp, Homo sapien
caagggaagtgatagcattaagaga

SEQ ID NO: 468740 - DNA, 25 bp, Homo sapien
tttaaaaaattagctagacgtggtg

SEQ ID NO: 468741 - DNA, 25 bp, Homo sapien
aattgcttgaaactggaaggcaggg

SEQ ID NO: 468742 - DNA, 25 bp, Homo sapien
ttgcttgaaactggaaggcaggggt

SEQ ID NO: 468743 - DNA, 25 bp, Homo sapien
tgcttgaaactggaaggcaggggtt

SEQ ID NO: 468744 - DNA, 25 bp, Homo sapien
cttgaaactggaaggcaggggttgc

SEQ ID NO: 468745 - DNA, 25 bp, Homo sapien
ttgaaactggaaggcaggggttgca

SEQ ID NO: 468746 - DNA, 25 bp, Homo sapien
ctggacaacaaaagtaaaactccat

SEQ ID NO: 468747 - DNA, 25 bp, Homo sapien
tggacaacaaaagtaaaactccatc

SEQ ID NO: 468748 - DNA, 25 bp, Homo sapien
ggacaacaaaagtaaaactccatct

SEQ ID NO: 468749 - DNA, 25 bp, Homo sapien
gacaacaaaagtaaaactccatctc

SEQ ID NO: 468750 - DNA, 25 bp, Homo sapien
acaacaaaagtaaaactccatctca

SEQ ID NO: 468751 - DNA, 25 bp, Homo sapien
ggaaaatgtaagctttgccctgttt

SEQ ID NO: 468752 - DNA, 25 bp, Homo sapien
gtaagctttgccctgtttataatat

SEQ ID NO: 468753 - DNA, 25 bp, Homo sapien
tgtttataatatagccaggcagtcc

SEQ ID NO: 468754 - DNA, 25 bp, Homo sapien
aataattactagctttcctgatatt

SEQ ID NO: 468755 - DNA, 25 bp, Homo sapien
agtcctgccttaataatagtgttca

SEQ ID NO: 468756 - DNA, 25 bp, Homo sapien
tctctgtatttgtccctgtccaaat

SEQ ID NO: 468757 - DNA, 25 bp, Homo sapien
gtccctgtccaaatctgcatgtatt

SEQ ID NO: 468758 - DNA, 25 bp, Homo sapien
aatctgcatgtatttctgacaataa

SEQ ID NO: 468759 - DNA, 25 bp, Homo sapien
aatactgatgcattccattttcttc

SEQ ID NO: 468760 - DNA, 25 bp, Homo sapien
attccattttcttcatcatgcatga

SEQ ID NO: 468761 - DNA, 25 bp, Homo sapien
atcatgcatgatggctctgtgaaaa

SEQ ID NO: 468762 - DNA, 25 bp, Homo sapien
cttaagagtgtggcttcttggccgg

SEQ ID NO: 468763 - DNA, 25 bp, Homo sapien
taagagtgtggcttcttggccgggc

SEQ ID NO: 468764 - DNA, 25 bp, Homo sapien
gagtgtggcttcttggccgggcaca

SEQ ID NO: 468765 - DNA, 25 bp, Homo sapien
agtgtggcttcttggccgggcacag

SEQ ID NO: 468766 - DNA, 25 bp, Homo sapien
gcccaggagggctcaagtggagatt

SEQ ID NO: 468767 - DNA, 25 bp, Homo sapien
cccaggagggctcaagtggagattg

SEQ ID NO: 468768 - DNA, 25 bp, Homo sapien
ccaggagggctcaagtggagattgc

SEQ ID NO: 468769 - DNA, 25 bp, Homo sapien
caggagggctcaagtggagattgca

SEQ ID NO: 468770 - DNA, 25 bp, Homo sapien
ggagggctcaagtggagattgcagt

SEQ ID NO: 468771 - DNA, 25 bp, Homo sapien
gagggctcaagtggagattgcagtg

SEQ ID NO: 468772 - DNA, 25 bp, Homo sapien
caagatagctctactgcactctagc

SEQ ID NO: 468773 - DNA, 25 bp, Homo sapien
gagtatttcacactcctcctgatat

SEQ ID NO: 468774 - DNA, 25 bp, Homo sapien
tttcacactcctcctgatatttctg

SEQ ID NO: 468775 - DNA, 25 bp, Homo sapien
tatttctgcattatcaactgtcttg

SEQ ID NO: 468776 - DNA, 25 bp, Homo sapien
cattatcaactgtcttgctgctgtt

SEQ ID NO: 468777 - DNA, 25 bp, Homo sapien
aactgtcttgctgctgttgtatgca

SEQ ID NO: 468778 - DNA, 25 bp, Homo sapien
tcttgctgctgttgtatgcacacca

SEQ ID NO: 468779 - DNA, 25 bp, Homo sapien
tgctgttgtatgcacaccacctaga

SEQ ID NO: 468780 - DNA, 25 bp, Homo sapien
gttgtatgcacaccacctagattca

SEQ ID NO: 468781 - DNA, 25 bp, Homo sapien
gtatgcacaccacctagattcaaga

SEQ ID NO: 468782 - DNA, 25 bp, Homo sapien
tgcacaccacctagattcaagatct

SEQ ID NO: 468783 - DNA, 25 bp, Homo sapien
accacctagattcaagatctttttt

SEQ ID NO: 468784 - DNA, 25 bp, Homo sapien
tctaaaaatccttgtttcattggaa

SEQ ID NO: 468785 - DNA, 25 bp, Homo sapien
gagtttgctatgatgcttaagacca

SEQ ID NO: 468786 - DNA, 25 bp, Homo sapien
gcttaagaccaagcatgtcaccatt

SEQ ID NO: 468787 - DNA, 25 bp, Homo sapien
atgtcaccatttgttattactgcac

SEQ ID NO: 468788 - DNA, 25 bp, Homo sapien
tttgttattactgcacttttccctg

SEQ ID NO: 468789 - DNA, 25 bp, Homo sapien
ttactgcacttttccctgccgtttt

SEQ ID NO: 468790 - DNA, 25 bp, Homo sapien
atggatgatgttaggttgcaatgac

SEQ ID NO: 468791 - DNA, 25 bp, Homo sapien
tgcttctagaacaatgtgtatccta

SEQ ID NO: 468792 - DNA, 25 bp, Homo sapien
gtgtatcctactattgtatttttgc

SEQ ID NO: 468793 - DNA, 25 bp, Homo sapien
gctacagtatatgaacgtggaggtg

SEQ ID NO: 468794 - DNA, 25 bp, Homo sapien
aacgtggaggtgtgcataagacagt

SEQ ID NO: 468795 - DNA, 25 bp, Homo sapien
gtactaagctctttcatatgaattg

SEQ ID NO: 468796 - DNA, 25 bp, Homo sapien
ctcagagaagtataccatattcccc

SEQ ID NO: 468797 - DNA, 25 bp, Homo sapien
gtataccatattcccccaattctaa

SEQ ID NO: 468798 - DNA, 25 bp, Homo sapien
ttagttgtaagtgccaccttccatt

SEQ ID NO: 468799 - DNA, 25 bp, Homo sapien
gccaccttccatttaacaaaagcat

SEQ ID NO: 468800 - DNA, 25 bp, Homo sapien
aaagcatactttttattcacctaca

SEQ ID NO: 468801 - DNA, 25 bp, Homo sapien
ttttattcacctacaattgcataca

SEQ ID NO: 468802 - DNA, 25 bp, Homo sapien
catcattttcccctagtatcataaa

SEQ ID NO: 468803 - DNA, 25 bp, Homo sapien
gattcttctgaattgctttcggcaa

SEQ ID NO: 468804 - DNA, 25 bp, Homo sapien
attgctttcggcaattatgcccaga

SEQ ID NO: 468805 - DNA, 25 bp, Homo sapien
ttatcgtactaagctctttcatatg

SEQ ID NO: 468806 - DNA, 25 bp, Homo sapien
atcccagctcctataatttttcttc

SEQ ID NO: 468807 - DNA, 25 bp, Homo sapien
ataatttttcttcgctccaatcaga

SEQ ID NO: 468808 - DNA, 25 bp, Homo sapien
agaaaggcaactggccatgaaatct

SEQ ID NO: 468809 - DNA, 25 bp, Homo sapien
ggaaattcagatatggcttgctcgt

SEQ ID NO: 468810 - DNA, 25 bp, Homo sapien
atatggcttgctcgtttgttaactt

SEQ ID NO: 468811 - DNA, 25 bp, Homo sapien
tgctcgtttgttaacttattaccaa

SEQ ID NO: 468812 - DNA, 25 bp, Homo sapien
ttaggccaaatctgacagggtcata

SEQ ID NO: 468813 - DNA, 25 bp, Homo sapien
gaaaagccaacaggttcctattagg

SEQ ID NO: 468814 - DNA, 25 bp, Homo sapien
tcctattaggctactcgaactcatc

SEQ ID NO: 468815 - DNA, 25 bp, Homo sapien
actcgaactcatcctactactacta

SEQ ID NO: 468816 - DNA, 25 bp, Homo sapien
gtgtccatcagtcacaagaggaggt

SEQ ID NO: 468817 - DNA, 25 bp, Homo sapien
atgggccaggttggacagggctgcc

SEQ ID NO: 468818 - DNA, 25 bp, Homo sapien
ctcccatctctttgagcttggcaga

SEQ ID NO: 468819 - DNA, 25 bp, Homo sapien
ctttgagcttggcagagctcagtga

SEQ ID NO: 468820 - DNA, 25 bp, Homo sapien
agctcagtgagtggaaccatctggg

SEQ ID NO: 468821 - DNA, 25 bp, Homo sapien
gccctgtgcggcaggatcctgagtc

SEQ ID NO: 468822 - DNA, 25 bp, Homo sapien
aggatcctgagtctttccttggccc

SEQ ID NO: 468823 - DNA, 25 bp, Homo sapien
cttggccccagtgggcttccattga

SEQ ID NO: 468824 - DNA, 25 bp, Homo sapien
agtgggcttccattgaacactgcct

SEQ ID NO: 468825 - DNA, 25 bp, Homo sapien
attgaacactgccttggtcacacac

SEQ ID NO: 468826 - DNA, 25 bp, Homo sapien
ggtcacacacgttctgtaggtccag

SEQ ID NO: 468827 - DNA, 25 bp, Homo sapien
tgtaggtccagatctgtgccagctc

SEQ ID NO: 468828 - DNA, 25 bp, Homo sapien
ggaaatgagataccggcagcctccg

SEQ ID NO: 468829 - DNA, 25 bp, Homo sapien
atgagataccggcagcctccgagac

SEQ ID NO: 468830 - DNA, 25 bp, Homo sapien
cgagacttctgacgcggctgtcctg

SEQ ID NO: 468831 - DNA, 25 bp, Homo sapien
ctggccaggctgaaaggataggatt

SEQ ID NO: 468832 - DNA, 25 bp, Homo sapien
aaggataggattccgcgtgggttca

SEQ ID NO: 468833 - DNA, 25 bp, Homo sapien
ccacgagagccatgcgggaggacta

SEQ ID NO: 468834 - DNA, 25 bp, Homo sapien
aggactagctagtgggacacgtgac

SEQ ID NO: 468835 - DNA, 25 bp, Homo sapien
actagctagtgggacacgtgacggc

SEQ ID NO: 468836 - DNA, 25 bp, Homo sapien
gagatctgaggttcgggagcccctc

SEQ ID NO: 468837 - DNA, 25 bp, Homo sapien
ggagtgggtcaaatcagccctggac

SEQ ID NO: 468838 - DNA, 25 bp, Homo sapien
ttgggaaagcttcagatttacagaa

SEQ ID NO: 468839 - DNA, 25 bp, Homo sapien
agatatgaggaccccctgttcttcc

SEQ ID NO: 468840 - DNA, 25 bp, Homo sapien
tgttcttcctcccaacgaaagcatg

SEQ ID NO: 468841 - DNA, 25 bp, Homo sapien
ttcttcctcccaacgaaagcatgga

SEQ ID NO: 468842 - DNA, 25 bp, Homo sapien
cttcctcccaacgaaagcatggaag

SEQ ID NO: 468843 - DNA, 25 bp, Homo sapien
ctcccaacgaaagcatggaagccct

SEQ ID NO: 468844 - DNA, 25 bp, Homo sapien
tgcttttcctcgtgcgtagtgtcca

SEQ ID NO: 468845 - DNA, 25 bp, Homo sapien
gcttttcctcgtgcgtagtgtccag

SEQ ID NO: 468846 - DNA, 25 bp, Homo sapien
ttttcctcgtgcgtagtgtccagcc

SEQ ID NO: 468847 - DNA, 25 bp, Homo sapien
tttcctcgtgcgtagtgtccagccc

SEQ ID NO: 468848 - DNA, 25 bp, Homo sapien
tcgtgcgtagtgtccagccccgaat

SEQ ID NO: 468849 - DNA, 25 bp, Homo sapien
gtgcgtagtgtccagccccgaatgt

SEQ ID NO: 468850 - DNA, 25 bp, Homo sapien
aacactggtcactgtttttatgaaa

SEQ ID NO: 468851 - DNA, 25 bp, Homo sapien
atgtgctgtgtatcctgtatgctgt

SEQ ID NO: 468852 - DNA, 25 bp, Homo sapien
gctgtatctcattaagtctgcttgc

SEQ ID NO: 468853 - DNA, 25 bp, Homo sapien
gtctgcttgcctataagttaaacat

SEQ ID NO: 468854 - DNA, 25 bp, Homo sapien
aaacatgaagtgctgttgcctctgg

SEQ ID NO: 468855 - DNA, 25 bp, Homo sapien
ggactccaagaatatccggactcct

SEQ ID NO: 468856 - DNA, 25 bp, Homo sapien
gttttctttagggttgtgtcatgtc

SEQ ID NO: 468857 - DNA, 25 bp, Homo sapien
gtgtcatgtcaagtgtccactggac

SEQ ID NO: 468858 - DNA, 25 bp, Homo sapien
gtccactggacatatcttaatttat

SEQ ID NO: 468859 - DNA, 25 bp, Homo sapien
tattctgcaattactcatactcacc

SEQ ID NO: 468860 - DNA, 25 bp, Homo sapien
catactcaccagtacttattggaaa

SEQ ID NO: 468861 - DNA, 25 bp, Homo sapien
ggcccaggatggagtataatggcgg

SEQ ID NO: 468862 - DNA, 25 bp, Homo sapien
gtataatggcgggatcatgactcac

SEQ ID NO: 468863 - DNA, 25 bp, Homo sapien
tataatggcgggatcatgactcact

SEQ ID NO: 468864 - DNA, 25 bp, Homo sapien
ataatggcgggatcatgactcactg

SEQ ID NO: 468865 - DNA, 25 bp, Homo sapien
gtgatcctcctacctaagactccaa

SEQ ID NO: 468866 - DNA, 25 bp, Homo sapien
tgatcctcctacctaagactccaaa

SEQ ID NO: 468867 - DNA, 25 bp, Homo sapien
gatcctcctacctaagactccaaag

SEQ ID NO: 468868 - DNA, 25 bp, Homo sapien
tcctcctacctaagactccaaagta

SEQ ID NO: 468869 - DNA, 25 bp, Homo sapien
ctcctacctaagactccaaagtagc

SEQ ID NO: 468870 - DNA, 25 bp, Homo sapien
tcctacctaagactccaaagtagct

SEQ ID NO: 468871 - DNA, 25 bp, Homo sapien
ctacctaagactccaaagtagctgg

SEQ ID NO: 468872 - DNA, 25 bp, Homo sapien
gaaaagggatcaaactttcacagga

SEQ ID NO: 468873 - DNA, 25 bp, Homo sapien
aagggatcaaactttcacaggaagt

SEQ ID NO: 468874 - DNA, 25 bp, Homo sapien
ctttcacaggaagttgtttgcataa

SEQ ID NO: 468875 - DNA, 25 bp, Homo sapien
aaacatatactattgtctcttggta

SEQ ID NO: 468876 - DNA, 25 bp, Homo sapien
aacatatactattgtctcttggtat

SEQ ID NO: 468877 - DNA, 25 bp, Homo sapien
gggaattggttccagaatactctat

SEQ ID NO: 468878 - DNA, 25 bp, Homo sapien
gaattggttccagaatactctataa

SEQ ID NO: 468879 - DNA, 25 bp, Homo sapien
tggttccagaatactctataaatta

SEQ ID NO: 468880 - DNA, 25 bp, Homo sapien
acttgtacatatacccccatatatt

SEQ ID NO: 468881 - DNA, 25 bp, Homo sapien
attacttataacaccagctgggcac

SEQ ID NO: 468882 - DNA, 25 bp, Homo sapien
tacttataacaccagctgggcacgg

SEQ ID NO: 468883 - DNA, 25 bp, Homo sapien
agccttatcatgctaggttttgtga

SEQ ID NO: 468884 - DNA, 25 bp, Homo sapien
gccttatcatgctaggttttgtgaa

SEQ ID NO: 468885 - DNA, 25 bp, Homo sapien
ccttatcatgctaggttttgtgaat

SEQ ID NO: 468886 - DNA, 25 bp, Homo sapien
cttatcatgctaggttttgtgaata

SEQ ID NO: 468887 - DNA, 25 bp, Homo sapien
ttatcatgctaggttttgtgaatat

SEQ ID NO: 468888 - DNA, 25 bp, Homo sapien
tatcatgctaggttttgtgaatatt

SEQ ID NO: 468889 - DNA, 25 bp, Homo sapien
atcatgctaggttttgtgaatatta

SEQ ID NO: 468890 - DNA, 25 bp, Homo sapien
catgctaggttttgtgaatattaag

SEQ ID NO: 468891 - DNA, 25 bp, Homo sapien
atgctaggttttgtgaatattaaga

SEQ ID NO: 468892 - DNA, 25 bp, Homo sapien
gctaggttttgtgaatattaagaaa

SEQ ID NO: 468893 - DNA, 25 bp, Homo sapien
aaattagtcagcgtggtggcgtgtg

SEQ ID NO: 468894 - DNA, 25 bp, Homo sapien
catctttgttgaaaatcgattggca

SEQ ID NO: 468895 - DNA, 25 bp, Homo sapien
atctttgttgaaaatcgattggcag

SEQ ID NO: 468896 - DNA, 25 bp, Homo sapien
tctttgttgaaaatcgattggcagc

SEQ ID NO: 468897 - DNA, 25 bp, Homo sapien
ctttgttgaaaatcgattggcagcc

SEQ ID NO: 468898 - DNA, 25 bp, Homo sapien
tttgttgaaaatcgattggcagcca

SEQ ID NO: 468899 - DNA, 25 bp, Homo sapien
ttgttgaaaatcgattggcagccag

SEQ ID NO: 468900 - DNA, 25 bp, Homo sapien
tgttgaaaatcgattggcagccagg

SEQ ID NO: 468901 - DNA, 25 bp, Homo sapien
gttgaaaatcgattggcagccaggt

SEQ ID NO: 468902 - DNA, 25 bp, Homo sapien
ttgaaaatcgattggcagccaggtg

SEQ ID NO: 468903 - DNA, 25 bp, Homo sapien
tgaaaatcgattggcagccaggtgc

SEQ ID NO: 468904 - DNA, 25 bp, Homo sapien
gaaaatcgattggcagccaggtgca

SEQ ID NO: 468905 - DNA, 25 bp, Homo sapien
aaatacttaatgctgttgaggaaaa

SEQ ID NO: 468906 - DNA, 25 bp, Homo sapien
tagtggattatctcacatatttatc

SEQ ID NO: 468907 - DNA, 25 bp, Homo sapien
atttatccctcattcaggcaactac

SEQ ID NO: 468908 - DNA, 25 bp, Homo sapien
cctcattcaggcaactacacatctg

SEQ ID NO: 468909 - DNA, 25 bp, Homo sapien
actacacatctgagttctctgcttg

SEQ ID NO: 468910 - DNA, 25 bp, Homo sapien
tctgcttgttactagagctcatggt

SEQ ID NO: 468911 - DNA, 25 bp, Homo sapien
agctcatggttgctggctccgaatg

SEQ ID NO: 468912 - DNA, 25 bp, Homo sapien
gttgctggctccgaatgagaactga

SEQ ID NO: 468913 - DNA, 25 bp, Homo sapien
gtttgtgaaaaacatctggagcttt

SEQ ID NO: 468914 - DNA, 25 bp, Homo sapien
catctggagcttttagttgactaca

SEQ ID NO: 468915 - DNA, 25 bp, Homo sapien
aatatgagccaactgtatgttgcaa

SEQ ID NO: 468916 - DNA, 25 bp, Homo sapien
ctttttgtaaaatggtcatcatggc

SEQ ID NO: 468917 - DNA, 25 bp, Homo sapien
tttttgtaaaatggtcatcatggct

SEQ ID NO: 468918 - DNA, 25 bp, Homo sapien
ttttgtaaaatggtcatcatggctg

SEQ ID NO: 468919 - DNA, 25 bp, Homo sapien
tttgtaaaatggtcatcatggctgg

SEQ ID NO: 468920 - DNA, 25 bp, Homo sapien
ttgtaaaatggtcatcatggctggg

SEQ ID NO: 468921 - DNA, 25 bp, Homo sapien
tgtaaaatggtcatcatggctgggc

SEQ ID NO: 468922 - DNA, 25 bp, Homo sapien
gtaaaatggtcatcatggctgggcg

SEQ ID NO: 468923 - DNA, 25 bp, Homo sapien
taaaatggtcatcatggctgggcgc

SEQ ID NO: 468924 - DNA, 25 bp, Homo sapien
aaaatggtcatcatggctgggcgcg

SEQ ID NO: 468925 - DNA, 25 bp, Homo sapien
aaatggtcatcatggctgggcgcgg

SEQ ID NO: 468926 - DNA, 25 bp, Homo sapien
aatggtcatcatggctgggcgcggt

SEQ ID NO: 468927 - DNA, 25 bp, Homo sapien
tatggcccatgaaaccaaaacgatt

SEQ ID NO: 468928 - DNA, 25 bp, Homo sapien
atttctttttacagtgctgactttt

SEQ ID NO: 468929 - DNA, 25 bp, Homo sapien
tgctgacttttgcaccgatcataaa

SEQ ID NO: 468930 - DNA, 25 bp, Homo sapien
aaagctatagtgaaacttttgcact

SEQ ID NO: 468931 - DNA, 25 bp, Homo sapien
tttgcactgatgatagaaaagctat

SEQ ID NO: 468932 - DNA, 25 bp, Homo sapien
tggtggtaaaactaccggctcttgg

SEQ ID NO: 468933 - DNA, 25 bp, Homo sapien
ttggaactaatcaaggcagcagtag

SEQ ID NO: 468934 - DNA, 25 bp, Homo sapien
gtagtgctgtactgtggaattagtg

SEQ ID NO: 468935 - DNA, 25 bp, Homo sapien
ggaattagtgattcctcactctgtg

SEQ ID NO: 468936 - DNA, 25 bp, Homo sapien
gtgattcctcactctgtgttttaaa

SEQ ID NO: 468937 - DNA, 25 bp, Homo sapien
gtttaacttaagaatgccctcgatg

SEQ ID NO: 468938 - DNA, 25 bp, Homo sapien
gtttgtaatggagtggaggcccctc

SEQ ID NO: 468939 - DNA, 25 bp, Homo sapien
tagtcttctagttactcttctcaat

SEQ ID NO: 468940 - DNA, 25 bp, Homo sapien
tcaatttattctttaccttagccgg

SEQ ID NO: 468941 - DNA, 25 bp, Homo sapien
tattctttaccttagccgggcacag

SEQ ID NO: 468942 - DNA, 25 bp, Homo sapien
ggcatgtgccaattgtctcagctac

SEQ ID NO: 468943 - DNA, 25 bp, Homo sapien
ttagagaaagtacaggcccttagat

SEQ ID NO: 468944 - DNA, 25 bp, Homo sapien
gggaaagcagtttgttccaaagctg

SEQ ID NO: 468945 - DNA, 25 bp, Homo sapien
gttccaaagctgcttgaacttgcaa

SEQ ID NO: 468946 - DNA, 25 bp, Homo sapien
ttgaacttgcaagactaccaggagt

SEQ ID NO: 468947 - DNA, 25 bp, Homo sapien
tgcaagactaccaggagtccattcc

SEQ ID NO: 468948 - DNA, 25 bp, Homo sapien
tccattccctctaacctctaatgta

SEQ ID NO: 468949 - DNA, 25 bp, Homo sapien
gaaaagggatcaaactttcacagga

SEQ ID NO: 468950 - DNA, 25 bp, Homo sapien
aagggatcaaactttcacaggaagt

SEQ ID NO: 468951 - DNA, 25 bp, Homo sapien
ctttcacaggaagttgtttgcataa

SEQ ID NO: 468952 - DNA, 25 bp, Homo sapien
aaacatatactattgtctcttggta

SEQ ID NO: 468953 - DNA, 25 bp, Homo sapien
tatactattgtctcttggtatccat

SEQ ID NO: 468954 - DNA, 25 bp, Homo sapien
gggaattggttccagaatactctat

SEQ ID NO: 468955 - DNA, 25 bp, Homo sapien
tggttccagaatactctataaatta

SEQ ID NO: 468956 - DNA, 25 bp, Homo sapien
taacagatgctgaagtccctcatat

SEQ ID NO: 468957 - DNA, 25 bp, Homo sapien
acttgtacatatacccccatatatt

SEQ ID NO: 468958 - DNA, 25 bp, Homo sapien
attacttataacaccagctgggcac

SEQ ID NO: 468959 - DNA, 25 bp, Homo sapien
tacttataacaccagctgggcacgg

SEQ ID NO: 468960 - DNA, 25 bp, Homo sapien
agcagttttcagtgaccatctcagt

SEQ ID NO: 468961 - DNA, 25 bp, Homo sapien
tttcagtgaccatctcagtttggaa

SEQ ID NO: 468962 - DNA, 25 bp, Homo sapien
tcagccacagagtcatcccgaaggg

SEQ ID NO: 468963 - DNA, 25 bp, Homo sapien
atcccgaaggggctctaaggtcaat

SEQ ID NO: 468964 - DNA, 25 bp, Homo sapien
taaggtcaataattttagggtctga

SEQ ID NO: 468965 - DNA, 25 bp, Homo sapien
agggtctgacagttgattatcacag

SEQ ID NO: 468966 - DNA, 25 bp, Homo sapien
tgacagttgattatcacagacagac

SEQ ID NO: 468967 - DNA, 25 bp, Homo sapien
tcatgatagcagatcatctctgtct

SEQ ID NO: 468968 - DNA, 25 bp, Homo sapien
gatagcagatcatctctgtctatat

SEQ ID NO: 468969 - DNA, 25 bp, Homo sapien
tgacagccaggcacttgaatctacc

SEQ ID NO: 468970 - DNA, 25 bp, Homo sapien
ccaggcacttgaatctacctggcaa

SEQ ID NO: 468971 - DNA, 25 bp, Homo sapien
gggagattgataactaattgcattt

SEQ ID NO: 468972 - DNA, 25 bp, Homo sapien
ggttaagcagtatgtactttgcgtt

SEQ ID NO: 468973 - DNA, 25 bp, Homo sapien
ctttgcgttaaagtgtatcctgcat

SEQ ID NO: 468974 - DNA, 25 bp, Homo sapien
taaagtgtatcctgcatgtgttcta

SEQ ID NO: 468975 - DNA, 25 bp, Homo sapien
tatcctgcatgtgttctatggaaca

SEQ ID NO: 468976 - DNA, 25 bp, Homo sapien
gaacaatatgtggactgttagtatt

SEQ ID NO: 468977 - DNA, 25 bp, Homo sapien
gaaaagagttccgtggtctggtaag

SEQ ID NO: 468978 - DNA, 25 bp, Homo sapien
gaatatccctaatcagaaaatgaga

SEQ ID NO: 468979 - DNA, 25 bp, Homo sapien
tgctcaaaggaagtgctcaatggag

SEQ ID NO: 468980 - DNA, 25 bp, Homo sapien
caatggagcatttcagagtttggat

SEQ ID NO: 468981 - DNA, 25 bp, Homo sapien
tagggatgctgaactggtaaatata

SEQ ID NO: 468982 - DNA, 25 bp, Homo sapien
gagcgtgtgtgtgcaaggtccctct

SEQ ID NO: 468983 - DNA, 25 bp, Homo sapien
tgtgcaaggtccctctcttattttc

SEQ ID NO: 468984 - DNA, 25 bp, Homo sapien
ctcttattttccctgtcttttctct

SEQ ID NO: 468985 - DNA, 25 bp, Homo sapien
gagcagggcccaagtcgtgtgaaat

SEQ ID NO: 468986 - DNA, 25 bp, Homo sapien
tgacagcacaaggaactaagactct

SEQ ID NO: 468987 - DNA, 25 bp, Homo sapien
accctggctttctaaatggactcct

SEQ ID NO: 468988 - DNA, 25 bp, Homo sapien
aatggactcctcctaggagcctgag

SEQ ID NO: 468989 - DNA, 25 bp, Homo sapien
ggagcctgagtgtatgggaacccca

SEQ ID NO: 468990 - DNA, 25 bp, Homo sapien
aaccccacagagcagcgacctggag

SEQ ID NO: 468991 - DNA, 25 bp, Homo sapien
tccacgctgagcatgaaacaacaca

SEQ ID NO: 468992 - DNA, 25 bp, Homo sapien
aacacaagctcggtgcttgcctgag

SEQ ID NO: 468993 - DNA, 25 bp, Homo sapien
gctgagtacttaacaaaaatgctag

SEQ ID NO: 468994 - DNA, 25 bp, Homo sapien
aaaatgctagttactcacatattat

SEQ ID NO: 468995 - DNA, 25 bp, Homo sapien
aatgctagttactcacatattattt

SEQ ID NO: 468996 - DNA, 25 bp, Homo sapien
atgctagttactcacatattattta

SEQ ID NO: 468997 - DNA, 25 bp, Homo sapien
tgctagttactcacatattatttat

SEQ ID NO: 468998 - DNA, 25 bp, Homo sapien
gctagttactcacatattatttatt

SEQ ID NO: 468999 - DNA, 25 bp, Homo sapien
ctgtgtggcccaggatggagtataa

SEQ ID NO: 469000 - DNA, 25 bp, Homo sapien
ataatggcgggatcatgactcactg

SEQ ID NO: 469001 - DNA, 25 bp, Homo sapien
gtgatcctcctacctaagactccaa

SEQ ID NO: 469002 - DNA, 25 bp, Homo sapien
tcctcctacctaagactccaaagta

SEQ ID NO: 469003 - DNA, 25 bp, Homo sapien
ctacctaagactccaaagtagctgg

SEQ ID NO: 469004 - DNA, 25 bp, Homo sapien
accactgtataagtgtatactcccc

SEQ ID NO: 469005 - DNA, 25 bp, Homo sapien
tataagtgtatactcccccaagacc

SEQ ID NO: 469006 - DNA, 25 bp, Homo sapien
ccccactgtcgtgttctagaaaaca

SEQ ID NO: 469007 - DNA, 25 bp, Homo sapien
agaaaacacctatgtcagcccaggc

SEQ ID NO: 469008 - DNA, 25 bp, Homo sapien
cctatgtcagcccaggcacaatggt

SEQ ID NO: 469009 - DNA, 25 bp, Homo sapien
aggcacaatggttctcgcctgtggt

SEQ ID NO: 469010 - DNA, 25 bp, Homo sapien
gcacaatggttctcgcctgtggtcc

SEQ ID NO: 469011 - DNA, 25 bp, Homo sapien
acttgaatagaggaggtcgagacca

SEQ ID NO: 469012 - DNA, 25 bp, Homo sapien
atagtgggaccctggctgtacaata

SEQ ID NO: 469013 - DNA, 25 bp, Homo sapien
tgggaccctggctgtacaatagata

SEQ ID NO: 469014 - DNA, 25 bp, Homo sapien
aatagatacatatgagccaggcacg

SEQ ID NO: 469015 - DNA, 25 bp, Homo sapien
atgtcttcatcttaacagaattgtc

SEQ ID NO: 469016 - DNA, 25 bp, Homo sapien
cagaattgtctttgtgattgttttt

SEQ ID NO: 469017 - DNA, 25 bp, Homo sapien
attgtgggaacaatccagcattaat

SEQ ID NO: 469018 - DNA, 25 bp, Homo sapien
ggaacaatccagcattaattgtatg

SEQ ID NO: 469019 - DNA, 25 bp, Homo sapien
ggagtcttaagcttggtgccttgaa

SEQ ID NO: 469020 - DNA, 25 bp, Homo sapien
gcttggtgccttgaagtcttttgta

SEQ ID NO: 469021 - DNA, 25 bp, Homo sapien
ggtgccttgaagtcttttgtactta

SEQ ID NO: 469022 - DNA, 25 bp, Homo sapien
gaagtcttttgtacttagtcccatg

SEQ ID NO: 469023 - DNA, 25 bp, Homo sapien
gtcttttgtacttagtcccatgttt

SEQ ID NO: 469024 - DNA, 25 bp, Homo sapien
tgtacttagtcccatgtttaaaatt

SEQ ID NO: 469025 - DNA, 25 bp, Homo sapien
aatttacatgatgctaattatggca

SEQ ID NO: 469026 - DNA, 25 bp, Homo sapien
ggtgagctaccatactgctgacagt

SEQ ID NO: 469027 - DNA, 25 bp, Homo sapien
gagctaccatactgctgacagtaat

SEQ ID NO: 469028 - DNA, 25 bp, Homo sapien
gacagtaatacactgcaaaatcttc

SEQ ID NO: 469029 - DNA, 25 bp, Homo sapien
gctccagtctgctgatggtgagagt

SEQ ID NO: 469030 - DNA, 25 bp, Homo sapien
atggtgagagtgaagtctgtcccag

SEQ ID NO: 469031 - DNA, 25 bp, Homo sapien
actgccactgaacctgtctgggatg

SEQ ID NO: 469032 - DNA, 25 bp, Homo sapien
cactgaacctgtctgggatgccagt

SEQ ID NO: 469033 - DNA, 25 bp, Homo sapien
aacctgtctgggatgccagtggccc

SEQ ID NO: 469034 - DNA, 25 bp, Homo sapien
ctgctggtaccaggctaagtagctg

SEQ ID NO: 469035 - DNA, 25 bp, Homo sapien
gtaccaggctaagtagctgctgcta

SEQ ID NO: 469036 - DNA, 25 bp, Homo sapien
aagtagctgctgctaacactctgac

SEQ ID NO: 469037 - DNA, 25 bp, Homo sapien
aactgaagttggttgagctttggaa

SEQ ID NO: 469038 - DNA, 25 bp, Homo sapien
gttggttgagctttggaagactaca

SEQ ID NO: 469039 - DNA, 25 bp, Homo sapien
ggaagactacaagccactgtaatat

SEQ ID NO: 469040 - DNA, 25 bp, Homo sapien
atatttaagatttcttgacctccag

SEQ ID NO: 469041 - DNA, 25 bp, Homo sapien
aagatttcttgacctccagaactaa

SEQ ID NO: 469042 - DNA, 25 bp, Homo sapien
cttgacctccagaactaacatttgt

SEQ ID NO: 469043 - DNA, 25 bp, Homo sapien
gaactaacatttgtcctgtcagaga

SEQ ID NO: 469044 - DNA, 25 bp, Homo sapien
agaaaataattactcctgttgagaa

SEQ ID NO: 469045 - DNA, 25 bp, Homo sapien
tactcctgttgagaatacatgcatt

SEQ ID NO: 469046 - DNA, 25 bp, Homo sapien
tgcattaaagtaagatgttcactac

SEQ ID NO: 469047 - DNA, 25 bp, Homo sapien
gttcactactctatatgatcaccaa

SEQ ID NO: 469048 - DNA, 25 bp, Homo sapien
tttaatcggttataccacgagatac

SEQ ID NO: 469049 - DNA, 25 bp, Homo sapien
atcggttataccacgagatacttat

SEQ ID NO: 469050 - DNA, 25 bp, Homo sapien
tcggttataccacgagatacttatg

SEQ ID NO: 469051 - DNA, 25 bp, Homo sapien
ggttataccacgagatacttatgga

SEQ ID NO: 469052 - DNA, 25 bp, Homo sapien
ataccacgagatacttatggagggt

SEQ ID NO: 469053 - DNA, 25 bp, Homo sapien
ccacgagatacttatggagggtatt

SEQ ID NO: 469054 - DNA, 25 bp, Homo sapien
ggagggtattagaacaattaatgat

SEQ ID NO: 469055 - DNA, 25 bp, Homo sapien
ttcattaaaaggtaagcaaacaact

SEQ ID NO: 469056 - DNA, 25 bp, Homo sapien
cacttagctatttaatcggttatac

SEQ ID NO: 469057 - DNA, 25 bp, Homo sapien
tagctatttaatcggttataccacg

SEQ ID NO: 469058 - DNA, 25 bp, Homo sapien
gctatttaatcggttataccacgag

SEQ ID NO: 469059 - DNA, 25 bp, Homo sapien
aggtttgtgagtgcagcaatgacac

SEQ ID NO: 469060 - DNA, 25 bp, Homo sapien
ggtttgtgagtgcagcaatgacact

SEQ ID NO: 469061 - DNA, 25 bp, Homo sapien
ttgtgagtgcagcaatgacactctg

SEQ ID NO: 469062 - DNA, 25 bp, Homo sapien
tgtgagtgcagcaatgacactctgt

SEQ ID NO: 469063 - DNA, 25 bp, Homo sapien
gagtgcagcaatgacactctgtatc

SEQ ID NO: 469064 - DNA, 25 bp, Homo sapien
agtgcagcaatgacactctgtatct

SEQ ID NO: 469065 - DNA, 25 bp, Homo sapien
gtgcagcaatgacactctgtatcta

SEQ ID NO: 469066 - DNA, 25 bp, Homo sapien
ttatgtccatactctgtatctaact

SEQ ID NO: 469067 - DNA, 25 bp, Homo sapien
atcagtgctctgtcaaaacacaccc

SEQ ID NO: 469068 - DNA, 25 bp, Homo sapien
tgctctgtcaaaacacacccctcgg

SEQ ID NO: 469069 - DNA, 25 bp, Homo sapien
aaacacacccctcggctctaccaat

SEQ ID NO: 469070 - DNA, 25 bp, Homo sapien
gaggaaacaggctacctgggcatct

SEQ ID NO: 469071 - DNA, 25 bp, Homo sapien
cctgggcatctggaggtgagctttc

SEQ ID NO: 469072 - DNA, 25 bp, Homo sapien
catctggaggtgagctttcgaggca

SEQ ID NO: 469073 - DNA, 25 bp, Homo sapien
agcaagcgcaaaatctgtgagctga

SEQ ID NO: 469074 - DNA, 25 bp, Homo sapien
atctgtgagctgaggttatgaagga

SEQ ID NO: 469075 - DNA, 25 bp, Homo sapien
gaggccaggcatgacaagagcaagc

SEQ ID NO: 469076 - DNA, 25 bp, Homo sapien
tgacaagagcaagccagagggagat

SEQ ID NO: 469077 - DNA, 25 bp, Homo sapien
gggcgccagagcacttggacttttg

SEQ ID NO: 469078 - DNA, 25 bp, Homo sapien
gagcacttggacttttgcttttact

SEQ ID NO: 469079 - DNA, 25 bp, Homo sapien
ttttgagcagaatagtgacgtgatc

SEQ ID NO: 469080 - DNA, 25 bp, Homo sapien
gtgacgtgatctgacaaatgtgttt

SEQ ID NO: 469081 - DNA, 25 bp, Homo sapien
tttgttccttttactctaccatgcc

SEQ ID NO: 469082 - DNA, 25 bp, Homo sapien
tctaccatgcctactgtaaagaata

SEQ ID NO: 469083 - DNA, 25 bp, Homo sapien
gattggatctactctcaagatgcag

SEQ ID NO: 469084 - DNA, 25 bp, Homo sapien
ttaaatggcatctacaccgcaggct

SEQ ID NO: 469085 - DNA, 25 bp, Homo sapien
tacaccgcaggctttgtaccaggca

SEQ ID NO: 469086 - DNA, 25 bp, Homo sapien
gcaggctttgtaccaggcacacact

SEQ ID NO: 469087 - DNA, 25 bp, Homo sapien
tgttcccagttatcccttactgcac

SEQ ID NO: 469088 - DNA, 25 bp, Homo sapien
cttactgcacccctagaggtatatg

SEQ ID NO: 469089 - DNA, 25 bp, Homo sapien
tagaggtatatgttttcccagaaaa

SEQ ID NO: 469090 - DNA, 25 bp, Homo sapien
gcccaaagtcacatatcacatagct

SEQ ID NO: 469091 - DNA, 25 bp, Homo sapien
cacatagctagcaagcggacatggg

SEQ ID NO: 469092 - DNA, 25 bp, Homo sapien
aaaacaaatagagggcatgatggcc

SEQ ID NO: 469093 - DNA, 25 bp, Homo sapien
acaaatagagggcatgatggcctac

SEQ ID NO: 469094 - DNA, 25 bp, Homo sapien
attgtggtgagggtcagctgataca

SEQ ID NO: 469095 - DNA, 25 bp, Homo sapien
gtggtgagggtcagctgatacaaaa

SEQ ID NO: 469096 - DNA, 25 bp, Homo sapien
ggtgagggtcagctgatacaaaata

SEQ ID NO: 469097 - DNA, 25 bp, Homo sapien
gtgagggtcagctgatacaaaataa

SEQ ID NO: 469098 - DNA, 25 bp, Homo sapien
agggtcagctgatacaaaataaagt

SEQ ID NO: 469099 - DNA, 25 bp, Homo sapien
gtcagctgatacaaaataaagtgtt

SEQ ID NO: 469100 - DNA, 25 bp, Homo sapien
taaagtgttaagtgtaattaccctg

SEQ ID NO: 469101 - DNA, 25 bp, Homo sapien
aatggagaaatgaagtgtagacact

SEQ ID NO: 469102 - DNA, 25 bp, Homo sapien
gtgtagacactttgttagtagaaac

SEQ ID NO: 469103 - DNA, 25 bp, Homo sapien
aggcctggagcctgtagggctggac

SEQ ID NO: 469104 - DNA, 25 bp, Homo sapien
cctggagcctgtagggctggactga

SEQ ID NO: 469105 - DNA, 25 bp, Homo sapien
agcctgtagggctggactgaggttc

SEQ ID NO: 469106 - DNA, 25 bp, Homo sapien
ggctggactgaggttcaggtctccc

SEQ ID NO: 469107 - DNA, 25 bp, Homo sapien
gctggactgaggttcaggtctcccc

SEQ ID NO: 469108 - DNA, 25 bp, Homo sapien
ggactgaggttcaggtctcccccca

SEQ ID NO: 469109 - DNA, 25 bp, Homo sapien
cactttgtccccactctagagcagg

SEQ ID NO: 469110 - DNA, 25 bp, Homo sapien
actttgtccccactctagagcaggg

SEQ ID NO: 469111 - DNA, 25 bp, Homo sapien
ctttgtccccactctagagcaggga

SEQ ID NO: 469112 - DNA, 25 bp, Homo sapien
tttgtccccactctagagcagggag

SEQ ID NO: 469113 - DNA, 25 bp, Homo sapien
ttgtccccactctagagcagggagg

SEQ ID NO: 469114 - DNA, 25 bp, Homo sapien
aggcatctcaccatctccgtgtata

SEQ ID NO: 469115 - DNA, 25 bp, Homo sapien
cagcagcaccacagtcacagagaag

SEQ ID NO: 469116 - DNA, 25 bp, Homo sapien
agtcacagagaagggctccgtggtc

SEQ ID NO: 469117 - DNA, 25 bp, Homo sapien
gagaagggctccgtggtcctgacct

SEQ ID NO: 469118 - DNA, 25 bp, Homo sapien
tggtcctgacctgccacacaaataa

SEQ ID NO: 469119 - DNA, 25 bp, Homo sapien
acacaaataacactggaacctcttt

SEQ ID NO: 469120 - DNA, 25 bp, Homo sapien
aacactggaacctctttccagtgga

SEQ ID NO: 469121 - DNA, 25 bp, Homo sapien
aacaaccagcgtctgcaggtcacga

SEQ ID NO: 469122 - DNA, 25 bp, Homo sapien
agcgtctgcaggtcacgaagaggat

SEQ ID NO: 469123 - DNA, 25 bp, Homo sapien
agtgtgaggtctccaacccagtcag

SEQ ID NO: 469124 - DNA, 25 bp, Homo sapien
acccagtcagctccaacaggagcga

SEQ ID NO: 469125 - DNA, 25 bp, Homo sapien
aataccacatattcttactcagaag

SEQ ID NO: 469126 - DNA, 25 bp, Homo sapien
tattcttactcagaagtgacagctt

SEQ ID NO: 469127 - DNA, 25 bp, Homo sapien
tcttactcagaagtgacagcttaac

SEQ ID NO: 469128 - DNA, 25 bp, Homo sapien
gaagtgacagcttaacaacgagaac

SEQ ID NO: 469129 - DNA, 25 bp, Homo sapien
gtgacagcttaacaacgagaacaca

SEQ ID NO: 469130 - DNA, 25 bp, Homo sapien
agcagacaccaaggcctgcttgagg

SEQ ID NO: 469131 - DNA, 25 bp, Homo sapien
acaccaaggcctgcttgagggtgga

SEQ ID NO: 469132 - DNA, 25 bp, Homo sapien
tgcttattacccaggtgacaaaatt

SEQ ID NO: 469133 - DNA, 25 bp, Homo sapien
acaccaaacccctgtgacaggcaaa

SEQ ID NO: 469134 - DNA, 25 bp, Homo sapien
ccctgtgacaggcaaatatataact

SEQ ID NO: 469135 - DNA, 25 bp, Homo sapien
gtgacaggcaaatatataactaatg

SEQ ID NO: 469136 - DNA, 25 bp, Homo sapien
agcctcctgagtagacatgagagtc

SEQ ID NO: 469137 - DNA, 25 bp, Homo sapien
gcctcctgagtagacatgagagtct

SEQ ID NO: 469138 - DNA, 25 bp, Homo sapien
tcctgagtagacatgagagtctccc

SEQ ID NO: 469139 - DNA, 25 bp, Homo sapien
tgagtagacatgagagtctccctgt

SEQ ID NO: 469140 - DNA, 25 bp, Homo sapien
gagtagacatgagagtctccctgtg

SEQ ID NO: 469141 - DNA, 25 bp, Homo sapien
agtagacatgagagtctccctgtgt

SEQ ID NO: 469142 - DNA, 25 bp, Homo sapien
gtagacatgagagtctccctgtgtg

SEQ ID NO: 469143 - DNA, 25 bp, Homo sapien
tagacatgagagtctccctgtgtgg

SEQ ID NO: 469144 - DNA, 25 bp, Homo sapien
agacatgagagtctccctgtgtggc

SEQ ID NO: 469145 - DNA, 25 bp, Homo sapien
gacatgagagtctccctgtgtggcc

SEQ ID NO: 469146 - DNA, 25 bp, Homo sapien
acatgagagtctccctgtgtggccc

SEQ ID NO: 469147 - DNA, 25 bp, Homo sapien
aacatgactcaaagcctagaaggac

SEQ ID NO: 469148 - DNA, 25 bp, Homo sapien
gccagatctcactgagtgaccattt

SEQ ID NO: 469149 - DNA, 25 bp, Homo sapien
gtgaccatttagtccaacctgagga

SEQ ID NO: 469150 - DNA, 25 bp, Homo sapien
tccaacctgaggactgatgttagga

SEQ ID NO: 469151 - DNA, 25 bp, Homo sapien
aaattctttctccaggtcaaattag

SEQ ID NO: 469152 - DNA, 25 bp, Homo sapien
gtcaaattagacttctgcagatcaa

SEQ ID NO: 469153 - DNA, 25 bp, Homo sapien
attagacttctgcagatcaaataga

SEQ ID NO: 469154 - DNA, 25 bp, Homo sapien
atgtgtaacacaggcttgtaggagc

SEQ ID NO: 469155 - DNA, 25 bp, Homo sapien
gcttgtaggagcacaggcttccagt

SEQ ID NO: 469156 - DNA, 25 bp, Homo sapien
ggaaatctccaattgggtgtgtagt

SEQ ID NO: 469157 - DNA, 25 bp, Homo sapien
atctccaattgggtgtgtagtaaag

SEQ ID NO: 469158 - DNA, 25 bp, Homo sapien
ttattgtccatcttagtattgccag

SEQ ID NO: 469159 - DNA, 25 bp, Homo sapien
gtattgccagactcttagcattgaa

SEQ ID NO: 469160 - DNA, 25 bp, Homo sapien
aatattagattgtctctcacccttg

SEQ ID NO: 469161 - DNA, 25 bp, Homo sapien
tcacccttgggccatggagttttat

SEQ ID NO: 469162 - DNA, 25 bp, Homo sapien
tgggccatggagttttattgcagca

SEQ ID NO: 469163 - DNA, 25 bp, Homo sapien
ataagtgttttctcaataggtatat

SEQ ID NO: 469164 - DNA, 25 bp, Homo sapien
ttgacagtggacttactatgatgtg

SEQ ID NO: 469165 - DNA, 25 bp, Homo sapien
actatgatgtggagctttgacattt

SEQ ID NO: 469166 - DNA, 25 bp, Homo sapien
ttgacatttgtggacctgctgcggt

SEQ ID NO: 469167 - DNA, 25 bp, Homo sapien
tgcggtgtccttacactcattgaga

SEQ ID NO: 469168 - DNA, 25 bp, Homo sapien
gtccttacactcattgagaaccatt

SEQ ID NO: 469169 - DNA, 25 bp, Homo sapien
tctctgggccagtgccagatgtgac

SEQ ID NO: 469170 - DNA, 25 bp, Homo sapien
agatatgaggaccccctgttcttcc

SEQ ID NO: 469171 - DNA, 25 bp, Homo sapien
tgttcttcctcccaacgaaagcatg

SEQ ID NO: 469172 - DNA, 25 bp, Homo sapien
ttcttcctcccaacgaaagcatgga

SEQ ID NO: 469173 - DNA, 25 bp, Homo sapien
cttcctcccaacgaaagcatggaag

SEQ ID NO: 469174 - DNA, 25 bp, Homo sapien
cgaaagcatggaagccctaagctta

SEQ ID NO: 469175 - DNA, 25 bp, Homo sapien
tgcttttcctcgtgcgtagtgtcca

SEQ ID NO: 469176 - DNA, 25 bp, Homo sapien
gcttttcctcgtgcgtagtgtccag

SEQ ID NO: 469177 - DNA, 25 bp, Homo sapien
ttttcctcgtgcgtagtgtccagcc

SEQ ID NO: 469178 - DNA, 25 bp, Homo sapien
tcgtgcgtagtgtccagccccgaat

SEQ ID NO: 469179 - DNA, 25 bp, Homo sapien
gtgcgtagtgtccagccccgaatgt

SEQ ID NO: 469180 - DNA, 25 bp, Homo sapien
cagaactgagtgcaagtcttggctt

SEQ ID NO: 469181 - DNA, 25 bp, Homo sapien
aactgagtgcaagtcttggctttac

SEQ ID NO: 469182 - DNA, 25 bp, Homo sapien
agtgcaagtcttggctttactaact

SEQ ID NO: 469183 - DNA, 25 bp, Homo sapien
gtcttggctttactaacttggctaa

SEQ ID NO: 469184 - DNA, 25 bp, Homo sapien
ggctttactaacttggctaatgcca

SEQ ID NO: 469185 - DNA, 25 bp, Homo sapien
ttggctaatgccactgtaccagcac

SEQ ID NO: 469186 - DNA, 25 bp, Homo sapien
ctaatgccactgtaccagcactttg

SEQ ID NO: 469187 - DNA, 25 bp, Homo sapien
cagtgagtagaggttgcaacaagct

SEQ ID NO: 469188 - DNA, 25 bp, Homo sapien
gttgcaacaagctcagatcgtacca

SEQ ID NO: 469189 - DNA, 25 bp, Homo sapien
tgcaacaagctcagatcgtaccact

SEQ ID NO: 469190 - DNA, 25 bp, Homo sapien
caacaagctcagatcgtaccactgc

SEQ ID NO: 469191 - DNA, 25 bp, Homo sapien
cctggctcataaaaagtactcagtg

SEQ ID NO: 469192 - DNA, 25 bp, Homo sapien
ctggctcataaaaagtactcagtga

SEQ ID NO: 469193 - DNA, 25 bp, Homo sapien
ggctcataaaaagtactcagtgagg

SEQ ID NO: 469194 - DNA, 25 bp, Homo sapien
tcataaaaagtactcagtgagggcc

SEQ ID NO: 469195 - DNA, 25 bp, Homo sapien
cataaaaagtactcagtgagggccg

SEQ ID NO: 469196 - DNA, 25 bp, Homo sapien
ataaaaagtactcagtgagggccgg

SEQ ID NO: 469197 - DNA, 25 bp, Homo sapien
taaaaagtactcagtgagggccggg

SEQ ID NO: 469198 - DNA, 25 bp, Homo sapien
aaaagtactcagtgagggccgggcg

SEQ ID NO: 469199 - DNA, 25 bp, Homo sapien
aaagtactcagtgagggccgggcgc

SEQ ID NO: 469200 - DNA, 25 bp, Homo sapien
aagtactcagtgagggccgggcgcg

SEQ ID NO: 469201 - DNA, 25 bp, Homo sapien
agtactcagtgagggccgggcgcgg

SEQ ID NO: 469202 - DNA, 25 bp, Homo sapien
tcaggagactcttattccagtgccc

SEQ ID NO: 469203 - DNA, 25 bp, Homo sapien
tttcatttccctcacttcatgttga

SEQ ID NO: 469204 - DNA, 25 bp, Homo sapien
ttcatgttgactcactctgtgaaag

SEQ ID NO: 469205 - DNA, 25 bp, Homo sapien
gaaagagctcaggtcagttacaagt

SEQ ID NO: 469206 - DNA, 25 bp, Homo sapien
agagtctcaccacaactgataaagg

SEQ ID NO: 469207 - DNA, 25 bp, Homo sapien
gagtatcttttcaacaattagcctt

SEQ ID NO: 469208 - DNA, 25 bp, Homo sapien
acaattagccttcagcagagggaat

SEQ ID NO: 469209 - DNA, 25 bp, Homo sapien
aaaagctgttttctatgcaccgact

SEQ ID NO: 469210 - DNA, 25 bp, Homo sapien
caccgacttcagacaagtgcagttt

SEQ ID NO: 469211 - DNA, 25 bp, Homo sapien
ttttggtgggatgtacttctattgt

SEQ ID NO: 469212 - DNA, 25 bp, Homo sapien
cctggtatctaatcatcaggatatt

SEQ ID NO: 469213 - DNA, 25 bp, Homo sapien
aacaatgagaacatacgggcacagt

SEQ ID NO: 469214 - DNA, 25 bp, Homo sapien
acaatgagaacatacgggcacagtg

SEQ ID NO: 469215 - DNA, 25 bp, Homo sapien
aatgagaacatacgggcacagtggg

SEQ ID NO: 469216 - DNA, 25 bp, Homo sapien
ggcacagtggggggaacatcacaca

SEQ ID NO: 469217 - DNA, 25 bp, Homo sapien
agaggcaagggaagtgatagcatta

SEQ ID NO: 469218 - DNA, 25 bp, Homo sapien
gaggcaagggaagtgatagcattaa

SEQ ID NO: 469219 - DNA, 25 bp, Homo sapien
aggcaagggaagtgatagcattaag

SEQ ID NO: 469220 - DNA, 25 bp, Homo sapien
ggcaagggaagtgatagcattaaga

SEQ ID NO: 469221 - DNA, 25 bp, Homo sapien
gcaagggaagtgatagcattaagag

SEQ ID NO: 469222 - DNA, 25 bp, Homo sapien
caagggaagtgatagcattaagaga

SEQ ID NO: 469223 - DNA, 25 bp, Homo sapien
aagtgatagcattaagagaaatacc

SEQ ID NO: 469224 - DNA, 25 bp, Homo sapien
aagcacattcatactcttaatgact

SEQ ID NO: 469225 - DNA, 25 bp, Homo sapien
gaatttgctgtatagttataagcta

SEQ ID NO: 469226 - DNA, 25 bp, Homo sapien
gaatttacaacaacaggcattgagc

SEQ ID NO: 469227 - DNA, 25 bp, Homo sapien
ggcattgagctaaatatatggacaa

SEQ ID NO: 469228 - DNA, 25 bp, Homo sapien
atatatggacaagcattttcttatt

SEQ ID NO: 469229 - DNA, 25 bp, Homo sapien
tttaatctgcataacatctctgagg

SEQ ID NO: 469230 - DNA, 25 bp, Homo sapien
gcataacatctctgaggttacttat

SEQ ID NO: 469231 - DNA, 25 bp, Homo sapien
gttacttatggttgttttcctccag

SEQ ID NO: 469232 - DNA, 25 bp, Homo sapien
acttgtctgaggtcatatagctgca

SEQ ID NO: 469233 - DNA, 25 bp, Homo sapien
gaggtcatatagctgcaaagtaata

SEQ ID NO: 469234 - DNA, 25 bp, Homo sapien
agaactggaattcaaacccagtctg

SEQ ID NO: 469235 - DNA, 25 bp, Homo sapien
attcgctgcaaactggatgggactg

SEQ ID NO: 469236 - DNA, 25 bp, Homo sapien
ttcgctgcaaactggatgggactgg

SEQ ID NO: 469237 - DNA, 25 bp, Homo sapien
atgggactggggactattatctaag

SEQ ID NO: 469238 - DNA, 25 bp, Homo sapien
gaagcaaaggcttaagaataataca

SEQ ID NO: 469239 - DNA, 25 bp, Homo sapien
tacaatggactttggcgagtcaggg

SEQ ID NO: 469240 - DNA, 25 bp, Homo sapien
agactacaagttgggttcagtgtat

SEQ ID NO: 469241 - DNA, 25 bp, Homo sapien
tgcacgaaaatctcataaatcactg

SEQ ID NO: 469242 - DNA, 25 bp, Homo sapien
cacgaaaatctcataaatcactgtt

SEQ ID NO: 469243 - DNA, 25 bp, Homo sapien
tactcatataaccaaacaccatgtg

SEQ ID NO: 469244 - DNA, 25 bp, Homo sapien
ctcatataaccaaacaccatgtgtt

SEQ ID NO: 469245 - DNA, 25 bp, Homo sapien
atataaccaaacaccatgtgttccc

SEQ ID NO: 469246 - DNA, 25 bp, Homo sapien
aaatggtcttggcatctttgttgaa

SEQ ID NO: 469247 - DNA, 25 bp, Homo sapien
tctttgttgaaaatcgattggcagc

SEQ ID NO: 469248 - DNA, 25 bp, Homo sapien
ctttgttgaaaatcgattggcagcc

SEQ ID NO: 469249 - DNA, 25 bp, Homo sapien
tttgttgaaaatcgattggcagcca

SEQ ID NO: 469250 - DNA, 25 bp, Homo sapien
ttgttgaaaatcgattggcagccag

SEQ ID NO: 469251 - DNA, 25 bp, Homo sapien
tgttgaaaatcgattggcagccagg

SEQ ID NO: 469252 - DNA, 25 bp, Homo sapien
gttgaaaatcgattggcagccaggt

SEQ ID NO: 469253 - DNA, 25 bp, Homo sapien
ttgaaaatcgattggcagccaggtg

SEQ ID NO: 469254 - DNA, 25 bp, Homo sapien
tgaaaatcgattggcagccaggtgc

SEQ ID NO: 469255 - DNA, 25 bp, Homo sapien
aatcgattggcagccaggtgcagta

SEQ ID NO: 469256 - DNA, 25 bp, Homo sapien
gcgctgggcagatcgcttaagctca

SEQ ID NO: 469257 - DNA, 25 bp, Homo sapien
aaaccaggattatacacagagaagt

SEQ ID NO: 469258 - DNA, 25 bp, Homo sapien
aaaattcaggtttgatacctaccag

SEQ ID NO: 469259 - DNA, 25 bp, Homo sapien
gtttgatacctaccagatactgctg

SEQ ID NO: 469260 - DNA, 25 bp, Homo sapien
agatactgctgtgggctctctaaaa

SEQ ID NO: 469261 - DNA, 25 bp, Homo sapien
gtgggctctctaaaagttgaccctg

SEQ ID NO: 469262 - DNA, 25 bp, Homo sapien
ataaatttagctctgcctgcgttgt

SEQ ID NO: 469263 - DNA, 25 bp, Homo sapien
cctgcgttgtttgactcagcgaatt

SEQ ID NO: 469264 - DNA, 25 bp, Homo sapien
gtttgactcagcgaattatgaagtt

SEQ ID NO: 469265 - DNA, 25 bp, Homo sapien
atggatgaacaaacatgccagtttc

SEQ ID NO: 469266 - DNA, 25 bp, Homo sapien
caaacatgccagtttctttacaata

SEQ ID NO: 469267 - DNA, 25 bp, Homo sapien
gaactagtggccaataaacttttct

SEQ ID NO: 469268 - DNA, 25 bp, Homo sapien
agaaaaagtttgctgccgggcacgg

SEQ ID NO: 469269 - DNA, 25 bp, Homo sapien
gaaaaagtttgctgccgggcacggt

SEQ ID NO: 469270 - DNA, 25 bp, Homo sapien
aaaaagtttgctgccgggcacggtg

SEQ ID NO: 469271 - DNA, 25 bp, Homo sapien
aaaagtttgctgccgggcacggtgg

SEQ ID NO: 469272 - DNA, 25 bp, Homo sapien
aaagtttgctgccgggcacggtggc

SEQ ID NO: 469273 - DNA, 25 bp, Homo sapien
aattagttgtgcatggtggcgggcg

SEQ ID NO: 469274 - DNA, 25 bp, Homo sapien
attagttgtgcatggtggcgggcgc

SEQ ID NO: 469275 - DNA, 25 bp, Homo sapien
ttagttgtgcatggtggcgggcgct

SEQ ID NO: 469276 - DNA, 25 bp, Homo sapien
tagttgtgcatggtggcgggcgctt

SEQ ID NO: 469277 - DNA, 25 bp, Homo sapien
agttgtgcatggtggcgggcgcttg

SEQ ID NO: 469278 - DNA, 25 bp, Homo sapien
gttgtgcatggtggcgggcgcttgt

SEQ ID NO: 469279 - DNA, 25 bp, Homo sapien
aaagaatttgataattatctggctg

SEQ ID NO: 469280 - DNA, 25 bp, Homo sapien
aagaatttgataattatctggctgg

SEQ ID NO: 469281 - DNA, 25 bp, Homo sapien
agaatttgataattatctggctggg

SEQ ID NO: 469282 - DNA, 25 bp, Homo sapien
gaatttgataattatctggctgggc

SEQ ID NO: 469283 - DNA, 25 bp, Homo sapien
aatttgataattatctggctgggca

SEQ ID NO: 469284 - DNA, 25 bp, Homo sapien
atttgataattatctggctgggcat

SEQ ID NO: 469285 - DNA, 25 bp, Homo sapien
tttgataattatctggctgggcatg

SEQ ID NO: 469286 - DNA, 25 bp, Homo sapien
ttgataattatctggctgggcatga

SEQ ID NO: 469287 - DNA, 25 bp, Homo sapien
ggtgagttgaggtcgtgccaccgca

SEQ ID NO: 469288 - DNA, 25 bp, Homo sapien
aaaatactttctgtctggcactatg

SEQ ID NO: 469289 - DNA, 25 bp, Homo sapien
ttctgtctggcactatgtgcttagt

SEQ ID NO: 469290 - DNA, 25 bp, Homo sapien
atgtgcttagtattttacccgacag

SEQ ID NO: 469291 - DNA, 25 bp, Homo sapien
ttacccgacagacagtattagatgt

SEQ ID NO: 469292 - DNA, 25 bp, Homo sapien
catatttaactgttagggatcctca

SEQ ID NO: 469293 - DNA, 25 bp, Homo sapien
gggatcctcattaatagtttacctt

SEQ ID NO: 469294 - DNA, 25 bp, Homo sapien
agtttaccttctttgtttgctcaca

SEQ ID NO: 469295 - DNA, 25 bp, Homo sapien
accttctttgtttgctcacatatta

SEQ ID NO: 469296 - DNA, 25 bp, Homo sapien
tacaatattcaatttcccgcatctc

SEQ ID NO: 469297 - DNA, 25 bp, Homo sapien
atttcccgcatctcataatttattt

SEQ ID NO: 469298 - DNA, 25 bp, Homo sapien
ttctgcttgatgagtacaacacctt

SEQ ID NO: 469299 - DNA, 25 bp, Homo sapien
aaccaaactgtctcaattcagtgaa

SEQ ID NO: 469300 - DNA, 25 bp, Homo sapien
cactcaaagtgaggaaaagcctttt

SEQ ID NO: 469301 - DNA, 25 bp, Homo sapien
gaaattctcagtctacttgtcaatt

SEQ ID NO: 469302 - DNA, 25 bp, Homo sapien
tcagtctacttgtcaattcaagagt

SEQ ID NO: 469303 - DNA, 25 bp, Homo sapien
aagagaactgtttaccactatgtct

SEQ ID NO: 469304 - DNA, 25 bp, Homo sapien
ttaccactatgtctaccctactttc

SEQ ID NO: 469305 - DNA, 25 bp, Homo sapien
tatgtctaccctactttctctaaat

SEQ ID NO: 469306 - DNA, 25 bp, Homo sapien
gtctaccctactttctctaaattga

SEQ ID NO: 469307 - DNA, 25 bp, Homo sapien
gtgagttgaagccaccttactggtc

SEQ ID NO: 469308 - DNA, 25 bp, Homo sapien
gagttgaagccaccttactggtccc

SEQ ID NO: 469309 - DNA, 25 bp, Homo sapien
tcattattttaaagacgtgccataa

SEQ ID NO: 469310 - DNA, 25 bp, Homo sapien
aaggtgagtattcacacttctgtgc

SEQ ID NO: 469311 - DNA, 25 bp, Homo sapien
acacttctgtgcctgatgaactctc

SEQ ID NO: 469312 - DNA, 25 bp, Homo sapien
tgatgaactctcattctccatgtac

SEQ ID NO: 469313 - DNA, 25 bp, Homo sapien
gaactctcattctccatgtacttta

SEQ ID NO: 469314 - DNA, 25 bp, Homo sapien
atgtactttatggaggtgacctacc

SEQ ID NO: 469315 - DNA, 25 bp, Homo sapien
tggaggtgacctacccagttccaaa

SEQ ID NO: 469316 - DNA, 25 bp, Homo sapien
ccagttccaaaaatgggctggatgt

SEQ ID NO: 469317 - DNA, 25 bp, Homo sapien
gggctggatgtgtaacatcacctcc

SEQ ID NO: 469318 - DNA, 25 bp, Homo sapien
ggatgtgtaacatcacctcccataa

SEQ ID NO: 469319 - DNA, 25 bp, Homo sapien
gtaacatcacctcccataagtgtgg

SEQ ID NO: 469320 - DNA, 25 bp, Homo sapien
cccataagtgtggtgaattcagtta

SEQ ID NO: 469321 - DNA, 25 bp, Homo sapien
gcctgtttgggataaagagtcaact

SEQ ID NO: 469322 - DNA, 25 bp, Homo sapien
cctgtttgggataaagagtcaactt

SEQ ID NO: 469323 - DNA, 25 bp, Homo sapien
ctgtttgggataaagagtcaacttg

SEQ ID NO: 469324 - DNA, 25 bp, Homo sapien
gtttgggataaagagtcaacttgag

SEQ ID NO: 469325 - DNA, 25 bp, Homo sapien
tgggataaagagtcaacttgaggcc

SEQ ID NO: 469326 - DNA, 25 bp, Homo sapien
ggataaagagtcaacttgaggccga

SEQ ID NO: 469327 - DNA, 25 bp, Homo sapien
gataaagagtcaacttgaggccgag

SEQ ID NO: 469328 - DNA, 25 bp, Homo sapien
ataaagagtcaacttgaggccgagc

SEQ ID NO: 469329 - DNA, 25 bp, Homo sapien
taaagagtcaacttgaggccgagca

SEQ ID NO: 469330 - DNA, 25 bp, Homo sapien
aaagagtcaacttgaggccgagcac

SEQ ID NO: 469331 - DNA, 25 bp, Homo sapien
aagagtcaacttgaggccgagcacg

SEQ ID NO: 469332 - DNA, 25 bp, Homo sapien
tggcgtgttaatcagttgaaataat

SEQ ID NO: 469333 - DNA, 25 bp, Homo sapien
ggcgtgttaatcagttgaaataatt

SEQ ID NO: 469334 - DNA, 25 bp, Homo sapien
gcgtgttaatcagttgaaataattt

SEQ ID NO: 469335 - DNA, 25 bp, Homo sapien
ataatttttacggcttggcgtggtg

SEQ ID NO: 469336 - DNA, 25 bp, Homo sapien
taatttttacggcttggcgtggtgg

SEQ ID NO: 469337 - DNA, 25 bp, Homo sapien
ttacggcttggcgtggtggcccata

SEQ ID NO: 469338 - DNA, 25 bp, Homo sapien
tacggcttggcgtggtggcccatac

SEQ ID NO: 469339 - DNA, 25 bp, Homo sapien
cggcttggcgtggtggcccatacct

SEQ ID NO: 469340 - DNA, 25 bp, Homo sapien
aacctcatctctgctgggaatacag

SEQ ID NO: 469341 - DNA, 25 bp, Homo sapien
tcccaactgctctggagcctgaagc

SEQ ID NO: 469342 - DNA, 25 bp, Homo sapien
caactgctctggagcctgaagcagg

SEQ ID NO: 469343 - DNA, 25 bp, Homo sapien
ttctaagtaccccttgtgggccagg

SEQ ID NO: 469344 - DNA, 25 bp, Homo sapien
tctaagtaccccttgtgggccaggc

SEQ ID NO: 469345 - DNA, 25 bp, Homo sapien
ctaagtaccccttgtgggccaggct

SEQ ID NO: 469346 - DNA, 25 bp, Homo sapien
taagtaccccttgtgggccaggctt

SEQ ID NO: 469347 - DNA, 25 bp, Homo sapien
agtaccccttgtgggccaggcttat

SEQ ID NO: 469348 - DNA, 25 bp, Homo sapien
ccccttgtgggccaggcttatatct

SEQ ID NO: 469349 - DNA, 25 bp, Homo sapien
cccttgtgggccaggcttatatctg

SEQ ID NO: 469350 - DNA, 25 bp, Homo sapien
caaagagtaagatgattagtggaac

SEQ ID NO: 469351 - DNA, 25 bp, Homo sapien
gattagtggaacatgctggtgtgca

SEQ ID NO: 469352 - DNA, 25 bp, Homo sapien
attagtggaacatgctggtgtgcac

SEQ ID NO: 469353 - DNA, 25 bp, Homo sapien
ttagtggaacatgctggtgtgcacc

SEQ ID NO: 469354 - DNA, 25 bp, Homo sapien
gggattacagcccaactgagactcc

SEQ ID NO: 469355 - DNA, 25 bp, Homo sapien
attacagcccaactgagactcccat

SEQ ID NO: 469356 - DNA, 25 bp, Homo sapien
ccaactgagactcccatcttttaac

SEQ ID NO: 469357 - DNA, 25 bp, Homo sapien
tcccatcttttaacactactgcata

SEQ ID NO: 469358 - DNA, 25 bp, Homo sapien
atcttttaacactactgcatatgct

SEQ ID NO: 469359 - DNA, 25 bp, Homo sapien
acactactgcatatgcttcagattg

SEQ ID NO: 469360 - DNA, 25 bp, Homo sapien
tgcatatgcttcagattgtttgatt

SEQ ID NO: 469361 - DNA, 25 bp, Homo sapien
ttgtttgatttgtatgagaatgcat

SEQ ID NO: 469362 - DNA, 25 bp, Homo sapien
gaatgcatttatgaatagtgtttta

SEQ ID NO: 469363 - DNA, 25 bp, Homo sapien
gcctgtgatcttagctacttggtag

SEQ ID NO: 469364 - DNA, 25 bp, Homo sapien
ggacttcgaggctacagtgggctga

SEQ ID NO: 469365 - DNA, 25 bp, Homo sapien
atgctcgaaacccatgatttcctgt

SEQ ID NO: 469366 - DNA, 25 bp, Homo sapien
gatttcctgtatactgttaccttga

SEQ ID NO: 469367 - DNA, 25 bp, Homo sapien
tgaacaaggctaaggctggcattta

SEQ ID NO: 469368 - DNA, 25 bp, Homo sapien
aggtggcccatagacaaggcacgct

SEQ ID NO: 469369 - DNA, 25 bp, Homo sapien
aaggcacgctcagatgctggtctag

SEQ ID NO: 469370 - DNA, 25 bp, Homo sapien
gactggctgtggaaaatactggctg

SEQ ID NO: 469371 - DNA, 25 bp, Homo sapien
tgagcagaccacatgtagacactat

SEQ ID NO: 469372 - DNA, 25 bp, Homo sapien
atgtagacactatcactcttctctc

SEQ ID NO: 469373 - DNA, 25 bp, Homo sapien
tctctctcttaatttgttcccctgg

SEQ ID NO: 469374 - DNA, 25 bp, Homo sapien
ttgttcccctggcaaaaagagagca

SEQ ID NO: 469375 - DNA, 25 bp, Homo sapien
aactacaaaggttgccaaggtggca

SEQ ID NO: 469376 - DNA, 25 bp, Homo sapien
aatagagagagtaggcctgtaaatc

SEQ ID NO: 469377 - DNA, 25 bp, Homo sapien
gtaggcctgtaaatcatggaactta

SEQ ID NO: 469378 - DNA, 25 bp, Homo sapien
aaatcatggaacttattcaacaggg

SEQ ID NO: 469379 - DNA, 25 bp, Homo sapien
gggatgcctgaagagggtctaaaaa

SEQ ID NO: 469380 - DNA, 25 bp, Homo sapien
tttgccgattggtgctgcaagtata

SEQ ID NO: 469381 - DNA, 25 bp, Homo sapien
aattgattcaacattttgcagggac

SEQ ID NO: 469382 - DNA, 25 bp, Homo sapien
caacattttgcagggacgttagtca

SEQ ID NO: 469383 - DNA, 25 bp, Homo sapien
gggacgttagtcaatatgtgtgaaa

SEQ ID NO: 469384 - DNA, 25 bp, Homo sapien
gtacactaatatctctttacacagt

SEQ ID NO: 469385 - DNA, 25 bp, Homo sapien
gaaaacatgtctcaatgtgcccata

SEQ ID NO: 469386 - DNA, 25 bp, Homo sapien
caatgtgcccatatttgtttctgtg

SEQ ID NO: 469387 - DNA, 25 bp, Homo sapien
aggctgagtcggcaggaatgacaga

SEQ ID NO: 469388 - DNA, 25 bp, Homo sapien
taaaaggatacaggagcagacagat

SEQ ID NO: 469389 - DNA, 25 bp, Homo sapien
ggatacaggagcagacagatgaaat

SEQ ID NO: 469390 - DNA, 25 bp, Homo sapien
ggagcagacagatgaaatagacagt

SEQ ID NO: 469391 - DNA, 25 bp, Homo sapien
aagaacctaactgacctggtagaga

SEQ ID NO: 469392 - DNA, 25 bp, Homo sapien
gaacctaactgacctggtagagata

SEQ ID NO: 469393 - DNA, 25 bp, Homo sapien
acctaactgacctggtagagataaa

SEQ ID NO: 469394 - DNA, 25 bp, Homo sapien
ctaactgacctggtagagataaaaa

SEQ ID NO: 469395 - DNA, 25 bp, Homo sapien
tctcagaacttaaagactgactgtc

SEQ ID NO: 469396 - DNA, 25 bp, Homo sapien
gaacttaaagactgactgtctgaaa

SEQ ID NO: 469397 - DNA, 25 bp, Homo sapien
aaagactgactgtctgaaataagac

SEQ ID NO: 469398 - DNA, 25 bp, Homo sapien
aaggagttaactctcaaggtgagac

SEQ ID NO: 469399 - DNA, 25 bp, Homo sapien
gtgagactgatgtaccaagggagca

SEQ ID NO: 469400 - DNA, 25 bp, Homo sapien
gatgtaccaagggagcaatgcctta

SEQ ID NO: 469401 - DNA, 25 bp, Homo sapien
agcaatgccttagaatggagttatt

SEQ ID NO: 469402 - DNA, 25 bp, Homo sapien
tggagttattctgcctaaggagaga

SEQ ID NO: 469403 - DNA, 25 bp, Homo sapien
gagaaagagttgtccctacagagta

SEQ ID NO: 469404 - DNA, 25 bp, Homo sapien
gagttgtccctacagagtagagttt

SEQ ID NO: 469405 - DNA, 25 bp, Homo sapien
cagagtagagtttattaccgtcctt

SEQ ID NO: 469406 - DNA, 25 bp, Homo sapien
aaaagggcacatttcatcgcgtctt

SEQ ID NO: 469407 - DNA, 25 bp, Homo sapien
gggcacatttcatcgcgtcttgaaa

SEQ ID NO: 469408 - DNA, 25 bp, Homo sapien
ttcatcgcgtcttgaaatatatcaa

SEQ ID NO: 469409 - DNA, 25 bp, Homo sapien
gaaaattcatactgccgtcaaacgc

SEQ ID NO: 469410 - DNA, 25 bp, Homo sapien
aaaattcatactgccgtcaaacgct

SEQ ID NO: 469411 - DNA, 25 bp, Homo sapien
attcatactgccgtcaaacgctata

SEQ ID NO: 469412 - DNA, 25 bp, Homo sapien
ttcatactgccgtcaaacgctataa

SEQ ID NO: 469413 - DNA, 25 bp, Homo sapien
tcatactgccgtcaaacgctataaa

SEQ ID NO: 469414 - DNA, 25 bp, Homo sapien
catactgccgtcaaacgctataaat

SEQ ID NO: 469415 - DNA, 25 bp, Homo sapien
tactgccgtcaaacgctataaatgt

SEQ ID NO: 469416 - DNA, 25 bp, Homo sapien
cttttaaacggtgctcacatcttaa

SEQ ID NO: 469417 - DNA, 25 bp, Homo sapien
tttaaacggtgctcacatcttaatg

SEQ ID NO: 469418 - DNA, 25 bp, Homo sapien
ttaaacggtgctcacatcttaatga

SEQ ID NO: 469419 - DNA, 25 bp, Homo sapien
acataagagagttcaaagaggagag

SEQ ID NO: 469420 - DNA, 25 bp, Homo sapien
agctgcctttgtctttagtatataa

SEQ ID NO: 469421 - DNA, 25 bp, Homo sapien
gcctttgtctttagtatataacagt

SEQ ID NO: 469422 - DNA, 25 bp, Homo sapien
gtatataacagtgaagattctgcag

SEQ ID NO: 469423 - DNA, 25 bp, Homo sapien
gatgaacagtgtagtgctattccca

SEQ ID NO: 469424 - DNA, 25 bp, Homo sapien
agtgtagtgctattcccacccgtac

SEQ ID NO: 469425 - DNA, 25 bp, Homo sapien
atgaaagcacagtatgttgctggga

SEQ ID NO: 469426 - DNA, 25 bp, Homo sapien
gtatgttgctgggaatggttttcga

SEQ ID NO: 469427 - DNA, 25 bp, Homo sapien
aatggttttcgaaaagtgtcctgtg

SEQ ID NO: 469428 - DNA, 25 bp, Homo sapien
gttaagctcaaatcttcgtcatgtg

SEQ ID NO: 469429 - DNA, 25 bp, Homo sapien
atcttcgtcatgtgagagtatttga

SEQ ID NO: 469430 - DNA, 25 bp, Homo sapien
aatgggagctcgatgagtcttcaga

SEQ ID NO: 469431 - DNA, 25 bp, Homo sapien
ccctcctgttaaccgagagaatcgt

SEQ ID NO: 469432 - DNA, 25 bp, Homo sapien
tcctgttaaccgagagaatcgtgac

SEQ ID NO: 469433 - DNA, 25 bp, Homo sapien
gttaaccgagagaatcgtgactcag

SEQ ID NO: 469434 - DNA, 25 bp, Homo sapien
taaccgagagaatcgtgactcaggt

SEQ ID NO: 469435 - DNA, 25 bp, Homo sapien
accgagagaatcgtgactcaggttg

SEQ ID NO: 469436 - DNA, 25 bp, Homo sapien
gagaatcgtgactcaggttgggctc

SEQ ID NO: 469437 - DNA, 25 bp, Homo sapien
aatcgtgactcaggttgggctcggt

SEQ ID NO: 469438 - DNA, 25 bp, Homo sapien
gtgactcaggttgggctcggtggct

SEQ ID NO: 469439 - DNA, 25 bp, Homo sapien
atggtgttggatgcttatagtgcca

SEQ ID NO: 469440 - DNA, 25 bp, Homo sapien
tggatgcttatagtgccaactactc

SEQ ID NO: 469441 - DNA, 25 bp, Homo sapien
ggatgcttatagtgccaactactca

SEQ ID NO: 469442 - DNA, 25 bp, Homo sapien
caggtcagatccaggtggacgtgaa

SEQ ID NO: 469443 - DNA, 25 bp, Homo sapien
atccaggtggacgtgaacgcagtct

SEQ ID NO: 469444 - DNA, 25 bp, Homo sapien
acgtgaacgcagtctttagcagaga

SEQ ID NO: 469445 - DNA, 25 bp, Homo sapien
gcagtctttagcagagacccagaga

SEQ ID NO: 469446 - DNA, 25 bp, Homo sapien
ggatgatgacaaacacagcctggat

SEQ ID NO: 469447 - DNA, 25 bp, Homo sapien
ggatcttgatggctgactggcactc

SEQ ID NO: 469448 - DNA, 25 bp, Homo sapien
tgactggcactcaaagaaactggag

SEQ ID NO: 469449 - DNA, 25 bp, Homo sapien
aactggagtagtagccggtcttgaa

SEQ ID NO: 469450 - DNA, 25 bp, Homo sapien
agccggtcttgaagacatccatgat

SEQ ID NO: 469451 - DNA, 25 bp, Homo sapien
catccatgatgagggtgcagattcc

SEQ ID NO: 469452 - DNA, 25 bp, Homo sapien
atgagggtgcagattccaaacagca

SEQ ID NO: 469453 - DNA, 25 bp, Homo sapien
gcagagggccatagccaagaagcca

SEQ ID NO: 469454 - DNA, 25 bp, Homo sapien
ggtgaaagctcttctatttgaatca

SEQ ID NO: 469455 - DNA, 25 bp, Homo sapien
tcagaattggaggaaagctacgact

SEQ ID NO: 469456 - DNA, 25 bp, Homo sapien
gctacgactcagtaaggaacccagt

SEQ ID NO: 469457 - DNA, 25 bp, Homo sapien
gtatactgggcctaccttagacaca

SEQ ID NO: 469458 - DNA, 25 bp, Homo sapien
gggcctaccttagacacactgaaaa

SEQ ID NO: 469459 - DNA, 25 bp, Homo sapien
tcaccaaatggaggtttccccaaca

SEQ ID NO: 469460 - DNA, 25 bp, Homo sapien
ggtttccccaacagcaacattgcat

SEQ ID NO: 469461 - DNA, 25 bp, Homo sapien
gtcagaaaagcatcttgggccccat

SEQ ID NO: 469462 - DNA, 25 bp, Homo sapien
aaacctactgaataagagtctgcat

SEQ ID NO: 469463 - DNA, 25 bp, Homo sapien
gcattgtaaagacatcccaggtgat

SEQ ID NO: 469464 - DNA, 25 bp, Homo sapien
atatgatggatgtgaccaagatcac

SEQ ID NO: 469465 - DNA, 25 bp, Homo sapien
gaccaagatcactttagtcctaggg

SEQ ID NO: 469466 - DNA, 25 bp, Homo sapien
gagggtcccttcctcagggagcaca

SEQ ID NO: 469467 - DNA, 25 bp, Homo sapien
gagaaggaaaatgacatcaggcagt

SEQ ID NO: 469468 - DNA, 25 bp, Homo sapien
tctgtgtgttctcccagtgaccacg

SEQ ID NO: 469469 - DNA, 25 bp, Homo sapien
cagtgaccacgctttctttagtgac

SEQ ID NO: 469470 - DNA, 25 bp, Homo sapien
cacaggaactctgagactcagcaag

SEQ ID NO: 469471 - DNA, 25 bp, Homo sapien
tctgagactcagcaagggtgtcctg

SEQ ID NO: 469472 - DNA, 25 bp, Homo sapien
cagcaagggtgtcctgggagggctc

SEQ ID NO: 469473 - DNA, 25 bp, Homo sapien
gtacacagattcacaactcattcag

SEQ ID NO: 469474 - DNA, 25 bp, Homo sapien
agattcacaactcattcagaactgt

SEQ ID NO: 469475 - DNA, 25 bp, Homo sapien
tcataatttgaagtcccaaccccta

SEQ ID NO: 469476 - DNA, 25 bp, Homo sapien
cataatttgaagtcccaacccctag

SEQ ID NO: 469477 - DNA, 25 bp, Homo sapien
tttgaagtcccaacccctagtatct

SEQ ID NO: 469478 - DNA, 25 bp, Homo sapien
aagtcccaacccctagtatctcagg

SEQ ID NO: 469479 - DNA, 25 bp, Homo sapien
gtcccaacccctagtatctcaggat

SEQ ID NO: 469480 - DNA, 25 bp, Homo sapien
ccaacccctagtatctcaggatgta

SEQ ID NO: 469481 - DNA, 25 bp, Homo sapien
caacccctagtatctcaggatgtaa

SEQ ID NO: 469482 - DNA, 25 bp, Homo sapien
acccctagtatctcaggatgtaact

SEQ ID NO: 469483 - DNA, 25 bp, Homo sapien
ccctagtatctcaggatgtaactgt

SEQ ID NO: 469484 - DNA, 25 bp, Homo sapien
gtatctcaggatgtaactgtattta

SEQ ID NO: 469485 - DNA, 25 bp, Homo sapien
atcccgtatgaatagtgtccttata

SEQ ID NO: 469486 - DNA, 25 bp, Homo sapien
cagggacaacagtcacgttgaccat

SEQ ID NO: 469487 - DNA, 25 bp, Homo sapien
aacagtcacgttgaccatcagtgga

SEQ ID NO: 469488 - DNA, 25 bp, Homo sapien
gtcacgttgaccatcagtggagtcc

SEQ ID NO: 469489 - DNA, 25 bp, Homo sapien
gttgaccatcagtggagtccaggca

SEQ ID NO: 469490 - DNA, 25 bp, Homo sapien
gaccatcagtggagtccaggcagaa

SEQ ID NO: 469491 - DNA, 25 bp, Homo sapien
gtccaggcagaagacgaggctgact

SEQ ID NO: 469492 - DNA, 25 bp, Homo sapien
ccaggcagaagacgaggctgactat

SEQ ID NO: 469493 - DNA, 25 bp, Homo sapien
gactattactgtcaatcagcagaca

SEQ ID NO: 469494 - DNA, 25 bp, Homo sapien
caatcagcagacagcagtggtactt

SEQ ID NO: 469495 - DNA, 25 bp, Homo sapien
actagtgtgtctgatcagtgacttc

SEQ ID NO: 469496 - DNA, 25 bp, Homo sapien
tagtgtgtctgatcagtgacttcta

SEQ ID NO: 469497 - DNA, 25 bp, Homo sapien
gaattgaaaagtatttaggcggcca

SEQ ID NO: 469498 - DNA, 25 bp, Homo sapien
ttgaaaagtatttaggcggccaggc

SEQ ID NO: 469499 - DNA, 25 bp, Homo sapien
gaaaagtatttaggcggccaggcgt

SEQ ID NO: 469500 - DNA, 25 bp, Homo sapien
attagccaggcgttatgttgcgtac

SEQ ID NO: 469501 - DNA, 25 bp, Homo sapien
ttagccaggcgttatgttgcgtacc

SEQ ID NO: 469502 - DNA, 25 bp, Homo sapien
tagccaggcgttatgttgcgtacct

SEQ ID NO: 469503 - DNA, 25 bp, Homo sapien
agccaggcgttatgttgcgtaccta

SEQ ID NO: 469504 - DNA, 25 bp, Homo sapien
gccaggcgttatgttgcgtacctat

SEQ ID NO: 469505 - DNA, 25 bp, Homo sapien
caggcgttatgttgcgtacctataa

SEQ ID NO: 469506 - DNA, 25 bp, Homo sapien
aggcgttatgttgcgtacctataat

SEQ ID NO: 469507 - DNA, 25 bp, Homo sapien
cgttatgttgcgtacctataatccc

SEQ ID NO: 469508 - DNA, 25 bp, Homo sapien
aagctgggccgagaatggctttgac

SEQ ID NO: 469509 - DNA, 25 bp, Homo sapien
ctgggccgagaatggctttgacgag

SEQ ID NO: 469510 - DNA, 25 bp, Homo sapien
tgggccgagaatggctttgacgagt

SEQ ID NO: 469511 - DNA, 25 bp, Homo sapien
gccgagaatggctttgacgagttga

SEQ ID NO: 469512 - DNA, 25 bp, Homo sapien
agacaatcaaacttctccgagctaa

SEQ ID NO: 469513 - DNA, 25 bp, Homo sapien
gaagttcgaacccatggtaaggaag

SEQ ID NO: 469514 - DNA, 25 bp, Homo sapien
aatgcacaagcctcagtagccaatt

SEQ ID NO: 469515 - DNA, 25 bp, Homo sapien
cctcagtagccaattcgatcaaccg

SEQ ID NO: 469516 - DNA, 25 bp, Homo sapien
tcagtagccaattcgatcaaccgga

SEQ ID NO: 469517 - DNA, 25 bp, Homo sapien
ccaattcgatcaaccggaagaaagg

SEQ ID NO: 469518 - DNA, 25 bp, Homo sapien
caattcgatcaaccggaagaaaggg

SEQ ID NO: 469519 - DNA, 25 bp, Homo sapien
cccatgaggtgtaaaccctttggag

SEQ ID NO: 469520 - DNA, 25 bp, Homo sapien
gaggtgtaaaccctttggagatata

SEQ ID NO: 469521 - DNA, 25 bp, Homo sapien
tggagatataccagctttttgggag

SEQ ID NO: 469522 - DNA, 25 bp, Homo sapien
tgggaggaacccgtgtatatctttc

SEQ ID NO: 469523 - DNA, 25 bp, Homo sapien
gaggaacccgtgtatatctttctct

SEQ ID NO: 469524 - DNA, 25 bp, Homo sapien
gaacccgtgtatatctttctcttat

SEQ ID NO: 469525 - DNA, 25 bp, Homo sapien
aggctagcgtgcagtgcagccaaca

SEQ ID NO: 469526 - DNA, 25 bp, Homo sapien
agcgtgcagtgcagccaacatagct

SEQ ID NO: 469527 - DNA, 25 bp, Homo sapien
gtgcagccaacatagctggttacag

SEQ ID NO: 469528 - DNA, 25 bp, Homo sapien
tggactcaactgactgggcctccca

SEQ ID NO: 469529 - DNA, 25 bp, Homo sapien
gaggccacaggcatgggacaccacg

SEQ ID NO: 469530 - DNA, 25 bp, Homo sapien
aaagtactcttacatcgaaattaat

SEQ ID NO: 469531 - DNA, 25 bp, Homo sapien
gtactcttacatcgaaattaattgg

SEQ ID NO: 469532 - DNA, 25 bp, Homo sapien
acatcgaaattaattgggttggctg

SEQ ID NO: 469533 - DNA, 25 bp, Homo sapien
gttcaagaccatcccaagtaacatg

SEQ ID NO: 469534 - DNA, 25 bp, Homo sapien
attatctgggcgtgatggtatctgc

SEQ ID NO: 469535 - DNA, 25 bp, Homo sapien
atctgggcgtgatggtatctgccta

SEQ ID NO: 469536 - DNA, 25 bp, Homo sapien
ctgggcgtgatggtatctgcctata

SEQ ID NO: 469537 - DNA, 25 bp, Homo sapien
gggcgtgatggtatctgcctatagt

SEQ ID NO: 469538 - DNA, 25 bp, Homo sapien
gcgtgatggtatctgcctatagttc

SEQ ID NO: 469539 - DNA, 25 bp, Homo sapien
cgtgatggtatctgcctatagttcc

SEQ ID NO: 469540 - DNA, 25 bp, Homo sapien
gtgatggtatctgcctatagttcca

SEQ ID NO: 469541 - DNA, 25 bp, Homo sapien
gcgttacatgtgcatacatatgttt

SEQ ID NO: 469542 - DNA, 25 bp, Homo sapien
atgtttctgaaaccttgactctcca

SEQ ID NO: 469543 - DNA, 25 bp, Homo sapien
tgaaaccttgactctccaacaagac

SEQ ID NO: 469544 - DNA, 25 bp, Homo sapien
gactctcatcaacaagactctcatt

SEQ ID NO: 469545 - DNA, 25 bp, Homo sapien
aagactctcattatcctaaatccag

SEQ ID NO: 469546 - DNA, 25 bp, Homo sapien
atccatttcttttcttagacttcaa

SEQ ID NO: 469547 - DNA, 25 bp, Homo sapien
gtaatcagccatcattctatcgttc

SEQ ID NO: 469548 - DNA, 25 bp, Homo sapien
atcattctatcgttcacctctgata

SEQ ID NO: 469549 - DNA, 25 bp, Homo sapien
tatcgttcacctctgataaaactgg

SEQ ID NO: 469550 - DNA, 25 bp, Homo sapien
aaaactggtggtgttggctgcctga

SEQ ID NO: 469551 - DNA, 25 bp, Homo sapien
ggtgttggctgcctgattcttcctc

SEQ ID NO: 469552 - DNA, 25 bp, Homo sapien
attatttcccctaacctgtgcttca

SEQ ID NO: 469553 - DNA, 25 bp, Homo sapien
taacctgtgcttcataccagaagga

SEQ ID NO: 469554 - DNA, 25 bp, Homo sapien
gcttcataccagaaggatcatccta

SEQ ID NO: 469555 - DNA, 25 bp, Homo sapien
ggatcatcctagacagaaattgaac

SEQ ID NO: 469556 - DNA, 25 bp, Homo sapien
gaacatgggatatttctgcccaaaa

SEQ ID NO: 469557 - DNA, 25 bp, Homo sapien
ttctgcccaaaatgctgtgtctctg

SEQ ID NO: 469558 - DNA, 25 bp, Homo sapien
gtgtctctgtcatcattagaatgaa

SEQ ID NO: 469559 - DNA, 25 bp, Homo sapien
agaatgaacttcctagtcaggcccc

SEQ ID NO: 469560 - DNA, 25 bp, Homo sapien
agtgacacaggctgtctcgtattcc

SEQ ID NO: 469561 - DNA, 25 bp, Homo sapien
tctttcctccgagctttggagtctg

SEQ ID NO: 469562 - DNA, 25 bp, Homo sapien
tttggagtctgctgtcctctcaact

SEQ ID NO: 469563 - DNA, 25 bp, Homo sapien
taaaagcacagggtgggccgggcac

SEQ ID NO: 469564 - DNA, 25 bp, Homo sapien
aaaagcacagggtgggccgggcaca

SEQ ID NO: 469565 - DNA, 25 bp, Homo sapien
aaagcacagggtgggccgggcacag

SEQ ID NO: 469566 - DNA, 25 bp, Homo sapien
aagcacagggtgggccgggcacagt

SEQ ID NO: 469567 - DNA, 25 bp, Homo sapien
agcacagggtgggccgggcacagtg

SEQ ID NO: 469568 - DNA, 25 bp, Homo sapien
gcacagggtgggccgggcacagtgg

SEQ ID NO: 469569 - DNA, 25 bp, Homo sapien
cacagggtgggccgggcacagtggc

SEQ ID NO: 469570 - DNA, 25 bp, Homo sapien
catggtggcacttgcctgtaagctc

SEQ ID NO: 469571 - DNA, 25 bp, Homo sapien
cacttgcctgtaagctcagctactc

SEQ ID NO: 469572 - DNA, 25 bp, Homo sapien
acttgcctgtaagctcagctactca

SEQ ID NO: 469573 - DNA, 25 bp, Homo sapien
cttgcctgtaagctcagctactcag

SEQ ID NO: 469574 - DNA, 25 bp, Homo sapien
accaattccgaacacaatttatcct

SEQ ID NO: 469575 - DNA, 25 bp, Homo sapien
caattccgaacacaatttatccttc

SEQ ID NO: 469576 - DNA, 25 bp, Homo sapien
ccttcaacagtttgtccctgatgtg

SEQ ID NO: 469577 - DNA, 25 bp, Homo sapien
tcaacagtttgtccctgatgtgtct

SEQ ID NO: 469578 - DNA, 25 bp, Homo sapien
aacagtttgtccctgatgtgtctat

SEQ ID NO: 469579 - DNA, 25 bp, Homo sapien
agtttgtccctgatgtgtctatgtg

SEQ ID NO: 469580 - DNA, 25 bp, Homo sapien
tctctgtatttgtcctgtattgagt

SEQ ID NO: 469581 - DNA, 25 bp, Homo sapien
ctgtatttgtcctgtattgagttag

SEQ ID NO: 469582 - DNA, 25 bp, Homo sapien
atttgtcctgtattgagttagttga

SEQ ID NO: 469583 - DNA, 25 bp, Homo sapien
tcctgtattgagttagttgaatggc

SEQ ID NO: 469584 - DNA, 25 bp, Homo sapien
agttgaatggctttgttctgtaaat

SEQ ID NO: 469585 - DNA, 25 bp, Homo sapien
ttctccttgctgccatgcgaagaag

SEQ ID NO: 469586 - DNA, 25 bp, Homo sapien
tccttgctgccatgcgaagaaggat

SEQ ID NO: 469587 - DNA, 25 bp, Homo sapien
ccttgctgccatgcgaagaaggatg

SEQ ID NO: 469588 - DNA, 25 bp, Homo sapien
ccccagccatgttaaactttgagtt

SEQ ID NO: 469589 - DNA, 25 bp, Homo sapien
cccagccatgttaaactttgagtta

SEQ ID NO: 469590 - DNA, 25 bp, Homo sapien
ccagccatgttaaactttgagttaa

SEQ ID NO: 469591 - DNA, 25 bp, Homo sapien
cagccatgttaaactttgagttaat

SEQ ID NO: 469592 - DNA, 25 bp, Homo sapien
gccatgttaaactttgagttaatta

SEQ ID NO: 469593 - DNA, 25 bp, Homo sapien
aatcttatcttgaactgcagctccc

SEQ ID NO: 469594 - DNA, 25 bp, Homo sapien
ttatcttgaactgcagctcccataa

SEQ ID NO: 469595 - DNA, 25 bp, Homo sapien
gcagctcccataatccccaggtgtt

SEQ ID NO: 469596 - DNA, 25 bp, Homo sapien
aaattcctgccatgagaccaaagtg

SEQ ID NO: 469597 - DNA, 25 bp, Homo sapien
gaccaaagtgatccttgactactct

SEQ ID NO: 469598 - DNA, 25 bp, Homo sapien
gtgatccttgactactctattagta

SEQ ID NO: 469599 - DNA, 25 bp, Homo sapien
tattagtaagcgactctgagccaag

SEQ ID NO: 469600 - DNA, 25 bp, Homo sapien
gagccaagagtacgaacctgtaagt

SEQ ID NO: 469601 - DNA, 25 bp, Homo sapien
gtggttggcccattagaaatctctg

SEQ ID NO: 469602 - DNA, 25 bp, Homo sapien
atgacagttaccttcctactggact

SEQ ID NO: 469603 - DNA, 25 bp, Homo sapien
ctactggactcatacttctcaattc

SEQ ID NO: 469604 - DNA, 25 bp, Homo sapien
cttctcaattccctctcctaaaaga

SEQ ID NO: 469605 - DNA, 25 bp, Homo sapien
agtttgagaccagctcggtggaaac

SEQ ID NO: 469606 - DNA, 25 bp, Homo sapien
ctcggtggaaacatagcaccatcca

SEQ ID NO: 469607 - DNA, 25 bp, Homo sapien
ttccaatgggcagtttgtcttccac

SEQ ID NO: 469608 - DNA, 25 bp, Homo sapien
tgtcttccacattctgcgcaaattt

SEQ ID NO: 469609 - DNA, 25 bp, Homo sapien
ttctgcgcaaatttctctacttggg

SEQ ID NO: 469610 - DNA, 25 bp, Homo sapien
gaaatctggatctcttataaagtga

SEQ ID NO: 469611 - DNA, 25 bp, Homo sapien
tttgtgcatgccagtttctctgcaa

SEQ ID NO: 469612 - DNA, 25 bp, Homo sapien
gtttctctgcaaggatctcagtcta

SEQ ID NO: 469613 - DNA, 25 bp, Homo sapien
ataaaatgcctatcccagagagtaa

SEQ ID NO: 469614 - DNA, 25 bp, Homo sapien
aaatattaacccaatgctaactgtc

SEQ ID NO: 469615 - DNA, 25 bp, Homo sapien
tgtctcccttttccattgcagtaag

SEQ ID NO: 469616 - DNA, 25 bp, Homo sapien
gcagcaatcttcacttgggctggtg

SEQ ID NO: 469617 - DNA, 25 bp, Homo sapien
acttgggctggtgctctgagaatcc

SEQ ID NO: 469618 - DNA, 25 bp, Homo sapien
gtcaaaatgaattactatcacgtta

SEQ ID NO: 469619 - DNA, 25 bp, Homo sapien
atgaattactatcacgttaggttgg

SEQ ID NO: 469620 - DNA, 25 bp, Homo sapien
gaattactatcacgttaggttgggc

SEQ ID NO: 469621 - DNA, 25 bp, Homo sapien
attactatcacgttaggttgggcac

SEQ ID NO: 469622 - DNA, 25 bp, Homo sapien
ttactatcacgttaggttgggcaca

SEQ ID NO: 469623 - DNA, 25 bp, Homo sapien
tactatcacgttaggttgggcacag

SEQ ID NO: 469624 - DNA, 25 bp, Homo sapien
actatcacgttaggttgggcacagt

SEQ ID NO: 469625 - DNA, 25 bp, Homo sapien
tatcacgttaggttgggcacagtgc

SEQ ID NO: 469626 - DNA, 25 bp, Homo sapien
atcacgttaggttgggcacagtgca

SEQ ID NO: 469627 - DNA, 25 bp, Homo sapien
tcacgttaggttgggcacagtgcat

SEQ ID NO: 469628 - DNA, 25 bp, Homo sapien
ttgggcacagtgcatcacgactgta

SEQ ID NO: 469629 - DNA, 25 bp, Homo sapien
gcagcacatggcaactctggtaatg

SEQ ID NO: 469630 - DNA, 25 bp, Homo sapien
gaagtagtaatgtctcagctcttta

SEQ ID NO: 469631 - DNA, 25 bp, Homo sapien
gtctcagctctttaaattgtgtgtt

SEQ ID NO: 469632 - DNA, 25 bp, Homo sapien
aatgttagaactgaaggatcttcct

SEQ ID NO: 469633 - DNA, 25 bp, Homo sapien
actgaaggatcttccttatccctgc

SEQ ID NO: 469634 - DNA, 25 bp, Homo sapien
ttatccctgcctctccttttacaga

SEQ ID NO: 469635 - DNA, 25 bp, Homo sapien
ggaccctcaaaagggactgtacctg

SEQ ID NO: 469636 - DNA, 25 bp, Homo sapien
aagggactgtacctggcttcaaagt

SEQ ID NO: 469637 - DNA, 25 bp, Homo sapien
gactgtacctggcttcaaagtgaca

SEQ ID NO: 469638 - DNA, 25 bp, Homo sapien
gtacctggcttcaaagtgacagaag

SEQ ID NO: 469639 - DNA, 25 bp, Homo sapien
ctaacttgatctcttgtataatgtc

SEQ ID NO: 469640 - DNA, 25 bp, Homo sapien
aaggaagggctcatgtcaacgttac

SEQ ID NO: 469641 - DNA, 25 bp, Homo sapien
caacgttacattgaagtgcctgaaa

SEQ ID NO: 469642 - DNA, 25 bp, Homo sapien
gtgcctgaaacctaggacagcgatc

SEQ ID NO: 469643 - DNA, 25 bp, Homo sapien
acagcgatcgctgaaatgacgaagt

SEQ ID NO: 469644 - DNA, 25 bp, Homo sapien
gacgaagtgaactggtttccggcct

SEQ ID NO: 469645 - DNA, 25 bp, Homo sapien
tccggcctttcctatgaactgagaa

SEQ ID NO: 469646 - DNA, 25 bp, Homo sapien
acaccccaaatctccatcatgtggt

SEQ ID NO: 469647 - DNA, 25 bp, Homo sapien
aaagcacatcctttgcctggatctc

SEQ ID NO: 469648 - DNA, 25 bp, Homo sapien
ctggatctccgctgtggaacgtggc

SEQ ID NO: 469649 - DNA, 25 bp, Homo sapien
gattttgacttagagttccatagaa

SEQ ID NO: 469650 - DNA, 25 bp, Homo sapien
taacaacagccagtttttcagtaaa

SEQ ID NO: 469651 - DNA, 25 bp, Homo sapien
ggaagaagccaatgaccactaggtc

SEQ ID NO: 469652 - DNA, 25 bp, Homo sapien
ggcaatgccctcagcgtcccgtggt

SEQ ID NO: 469653 - DNA, 25 bp, Homo sapien
tcagcgtcccgtggtcctgtgtact

SEQ ID NO: 469654 - DNA, 25 bp, Homo sapien
gtggtcctgtgtactcctccgggtg

SEQ ID NO: 469655 - DNA, 25 bp, Homo sapien
gtactcctccgggtgcgtgcggttc

SEQ ID NO: 469656 - DNA, 25 bp, Homo sapien
cgtgcggttcccattgcggaagaac

SEQ ID NO: 469657 - DNA, 25 bp, Homo sapien
tcccattgcggaagaacttgagcgt

SEQ ID NO: 469658 - DNA, 25 bp, Homo sapien
aacttgagcgtagggtactccgtca

SEQ ID NO: 469659 - DNA, 25 bp, Homo sapien
gtagggtactccgtcacaccaaact

SEQ ID NO: 469660 - DNA, 25 bp, Homo sapien
ttggccagcgtgaccaccattgact

SEQ ID NO: 469661 - DNA, 25 bp, Homo sapien
agcgtgaccaccattgactcggccg

SEQ ID NO: 469662 - DNA, 25 bp, Homo sapien
ggtctttatccgagtgcccaaaaag

SEQ ID NO: 469663 - DNA, 25 bp, Homo sapien
cccctgtggcctgtcagaggtaaga

SEQ ID NO: 469664 - DNA, 25 bp, Homo sapien
agaggtaagagcctgcccgtcaaaa

SEQ ID NO: 469665 - DNA, 25 bp, Homo sapien
gcccgtcaaaatgcacaatcctggt

SEQ ID NO: 469666 - DNA, 25 bp, Homo sapien
atgcacaatcctggttcttgcaggg

SEQ ID NO: 469667 - DNA, 25 bp, Homo sapien
aggcctcagtcaccactaacgaggt

SEQ ID NO: 469668 - DNA, 25 bp, Homo sapien
ctaacgaggtgctgcatgggaacaa

SEQ ID NO: 469669 - DNA, 25 bp, Homo sapien
aaagcgtaggcccacaacctggagt

SEQ ID NO: 469670 - DNA, 25 bp, Homo sapien
acaacctggagttcaggtcactcct

SEQ ID NO: 469671 - DNA, 25 bp, Homo sapien
tcccaggtgattccagcctcatttc

SEQ ID NO: 469672 - DNA, 25 bp, Homo sapien
ttctccatgggccaaatatcctaaa

SEQ ID NO: 469673 - DNA, 25 bp, Homo sapien
gcctgtttgggataaagagtcaact

SEQ ID NO: 469674 - DNA, 25 bp, Homo sapien
cctgtttgggataaagagtcaactt

SEQ ID NO: 469675 - DNA, 25 bp, Homo sapien
tgggataaagagtcaacttgaggcc

SEQ ID NO: 469676 - DNA, 25 bp, Homo sapien
ggataaagagtcaacttgaggccga

SEQ ID NO: 469677 - DNA, 25 bp, Homo sapien
ataaagagtcaacttgaggccgagc

SEQ ID NO: 469678 - DNA, 25 bp, Homo sapien
taaagagtcaacttgaggccgagca

SEQ ID NO: 469679 - DNA, 25 bp, Homo sapien
aaagagtcaacttgaggccgagcac

SEQ ID NO: 469680 - DNA, 25 bp, Homo sapien
aagagtcaacttgaggccgagcacg

SEQ ID NO: 469681 - DNA, 25 bp, Homo sapien
gagtcaacttgaggccgagcacggt

SEQ ID NO: 469682 - DNA, 25 bp, Homo sapien
caggcggatcacgaaatcaacagat

SEQ ID NO: 469683 - DNA, 25 bp, Homo sapien
gcggatcacgaaatcaacagattga

SEQ ID NO: 469684 - DNA, 25 bp, Homo sapien
aatctggtccccagtcgcacaactt

SEQ ID NO: 469685 - DNA, 25 bp, Homo sapien
aacttcccacatacccagaggagag

SEQ ID NO: 469686 - DNA, 25 bp, Homo sapien
acccagaggagagcatatgcctgtg

SEQ ID NO: 469687 - DNA, 25 bp, Homo sapien
gaaggaaatcaccaggtgccaccgt

SEQ ID NO: 469688 - DNA, 25 bp, Homo sapien
caggtgccaccgtcaatatttatca

SEQ ID NO: 469689 - DNA, 25 bp, Homo sapien
gccaccgtcaatatttatcagcttt

SEQ ID NO: 469690 - DNA, 25 bp, Homo sapien
gcactggttttgttagacagtcagg

SEQ ID NO: 469691 - DNA, 25 bp, Homo sapien
gtcagggtgtattatttcaagagct

SEQ ID NO: 469692 - DNA, 25 bp, Homo sapien
tcaggttttctcagtcaaccagcta

SEQ ID NO: 469693 - DNA, 25 bp, Homo sapien
gtcaaccagctagatgcatgtgatg

SEQ ID NO: 469694 - DNA, 25 bp, Homo sapien
gcatgtgatgcatgtctatccttca

SEQ ID NO: 469695 - DNA, 25 bp, Homo sapien
agctgcctaaaactaaagatccaaa

SEQ ID NO: 469696 - DNA, 25 bp, Homo sapien
agatccaaactcctataccttatta

SEQ ID NO: 469697 - DNA, 25 bp, Homo sapien
gtctaggcctgagtgctttctactc

SEQ ID NO: 469698 - DNA, 25 bp, Homo sapien
agtgctttctactctgtgtgaaaca

SEQ ID NO: 469699 - DNA, 25 bp, Homo sapien
gtgaaacacacaattgcaatgcttt

SEQ ID NO: 469700 - DNA, 25 bp, Homo sapien
tgcaatgctttgcatccactatcac

SEQ ID NO: 469701 - DNA, 25 bp, Homo sapien
ttgcatccactatcaccagtatatg

SEQ ID NO: 469702 - DNA, 25 bp, Homo sapien
gaactgctataagtgcaagcactct

SEQ ID NO: 469703 - DNA, 25 bp, Homo sapien
gtgcaagcactctgaaaacttaaac

SEQ ID NO: 469704 - DNA, 25 bp, Homo sapien
aacataagcctcgttttgaaatatt

SEQ ID NO: 469705 - DNA, 25 bp, Homo sapien
aaatgagtgatatacctgccccagg

SEQ ID NO: 469706 - DNA, 25 bp, Homo sapien
gatcatgatgcaacaagtttgaaaa

SEQ ID NO: 469707 - DNA, 25 bp, Homo sapien
tcatgatgcaacaagtttgaaaaat

SEQ ID NO: 469708 - DNA, 25 bp, Homo sapien
ggactagatactgttttcttctatg

SEQ ID NO: 469709 - DNA, 25 bp, Homo sapien
gactagatactgttttcttctatgt

SEQ ID NO: 469710 - DNA, 25 bp, Homo sapien
ttgtctatttcatttgggtctaatt

SEQ ID NO: 469711 - DNA, 25 bp, Homo sapien
tgtctatttcatttgggtctaatta

SEQ ID NO: 469712 - DNA, 25 bp, Homo sapien
gtctatttcatttgggtctaattat

SEQ ID NO: 469713 - DNA, 25 bp, Homo sapien
catttgggtctaattattgtaatca

SEQ ID NO: 469714 - DNA, 25 bp, Homo sapien
gggtctaattattgtaatcatttga

SEQ ID NO: 469715 - DNA, 25 bp, Homo sapien
tattgtaatcatttgatcatgatgc

SEQ ID NO: 469716 - DNA, 25 bp, Homo sapien
tttgatcatgatgcaacaagtttga

SEQ ID NO: 469717 - DNA, 25 bp, Homo sapien
ggaataatgtttgatcacatatctg

SEQ ID NO: 469718 - DNA, 25 bp, Homo sapien
ctgggcactgtgatctagctgagta

SEQ ID NO: 469719 - DNA, 25 bp, Homo sapien
cactgtgatctagctgagtagacac

SEQ ID NO: 469720 - DNA, 25 bp, Homo sapien
gagtagacacattaaccatccctta

SEQ ID NO: 469721 - DNA, 25 bp, Homo sapien
tagacacattaaccatcccttagcc

SEQ ID NO: 469722 - DNA, 25 bp, Homo sapien
tcccttagcccagtagggtgactac

SEQ ID NO: 469723 - DNA, 25 bp, Homo sapien
gggtgactactgtgtagttaacaac

SEQ ID NO: 469724 - DNA, 25 bp, Homo sapien
gaggtgatggatattctaaacttga

SEQ ID NO: 469725 - DNA, 25 bp, Homo sapien
ggatattctaaacttgattgttaca

SEQ ID NO: 469726 - DNA, 25 bp, Homo sapien
atatcacacgtaccataagtatgca

SEQ ID NO: 469727 - DNA, 25 bp, Homo sapien
acacgtaccataagtatgcacaaat

SEQ ID NO: 469728 - DNA, 25 bp, Homo sapien
tatagcatacggtcccttctcaagt

SEQ ID NO: 469729 - DNA, 25 bp, Homo sapien
acggtcccttctcaagtttcactgt

SEQ ID NO: 469730 - DNA, 25 bp, Homo sapien
aacaccctgggcttgaacacaagaa

SEQ ID NO: 469731 - DNA, 25 bp, Homo sapien
gaaactctgtgatgaacagacattc

SEQ ID NO: 469732 - DNA, 25 bp, Homo sapien
atttttgtaaaatagcgactctgga

SEQ ID NO: 469733 - DNA, 25 bp, Homo sapien
gactctggaaactaattggcagccg

SEQ ID NO: 469734 - DNA, 25 bp, Homo sapien
ttggcagccgcaaaacttgtgagca

SEQ ID NO: 469735 - DNA, 25 bp, Homo sapien
gcaaaacttgtgagcaaaggccaaa

SEQ ID NO: 469736 - DNA, 25 bp, Homo sapien
tttactacagtaacacgactcaaag

SEQ ID NO: 469737 - DNA, 25 bp, Homo sapien
gcatctttgtttcccagtcaaatta

SEQ ID NO: 469738 - DNA, 25 bp, Homo sapien
tttgtttcccagtcaaattagctga

SEQ ID NO: 469739 - DNA, 25 bp, Homo sapien
aaaacaaatagagggcatgatggcc

SEQ ID NO: 469740 - DNA, 25 bp, Homo sapien
gcatgatggcctacctccctgcatt

SEQ ID NO: 469741 - DNA, 25 bp, Homo sapien
acctccctgcattgtggtgagggtc

SEQ ID NO: 469742 - DNA, 25 bp, Homo sapien
attgtggtgagggtcagctgataca

SEQ ID NO: 469743 - DNA, 25 bp, Homo sapien
ggtgagggtcagctgatacaaaata

SEQ ID NO: 469744 - DNA, 25 bp, Homo sapien
gggtcagctgatacaaaataaagtg

SEQ ID NO: 469745 - DNA, 25 bp, Homo sapien
taaagtgttaagtgtaattaccctg

SEQ ID NO: 469746 - DNA, 25 bp, Homo sapien
gtgttaagtgtaattaccctgaaat

SEQ ID NO: 469747 - DNA, 25 bp, Homo sapien
aatggagaaatgaagtgtagacact

SEQ ID NO: 469748 - DNA, 25 bp, Homo sapien
gtgtagacactttgttagtagaaac

SEQ ID NO: 469749 - DNA, 25 bp, Homo sapien
agactggataaataaggttgtggtt

SEQ ID NO: 469750 - DNA, 25 bp, Homo sapien
tgtccctataacgtgccctcagggt

SEQ ID NO: 469751 - DNA, 25 bp, Homo sapien
tcagggtgcccgcaattaagctgcc

SEQ ID NO: 469752 - DNA, 25 bp, Homo sapien
taagctgcccttctatctgcatgaa

SEQ ID NO: 469753 - DNA, 25 bp, Homo sapien
tctgcatgaatctgtccttggttcc

SEQ ID NO: 469754 - DNA, 25 bp, Homo sapien
catgtcctgaatcctggctgagccc

SEQ ID NO: 469755 - DNA, 25 bp, Homo sapien
agccatcccgaattggcagctgcaa

SEQ ID NO: 469756 - DNA, 25 bp, Homo sapien
gctgcaaggatatggctctgaccca

SEQ ID NO: 469757 - DNA, 25 bp, Homo sapien
atatggctctgacccagaagccgtg

SEQ ID NO: 469758 - DNA, 25 bp, Homo sapien
agaagccgtggatgccctgcggcct

SEQ ID NO: 469759 - DNA, 25 bp, Homo sapien
tgggacattcactggagcccagctc

SEQ ID NO: 469760 - DNA, 25 bp, Homo sapien
gagcccagctccaagtgaaggacgt

SEQ ID NO: 469761 - DNA, 25 bp, Homo sapien
attgcttggtatgtaccatagatta

SEQ ID NO: 469762 - DNA, 25 bp, Homo sapien
gattaatgtctgcagctgctattct

SEQ ID NO: 469763 - DNA, 25 bp, Homo sapien
agctgctattctgccatttcaagaa

SEQ ID NO: 469764 - DNA, 25 bp, Homo sapien
ttgtctctgtagtaaattgcctacc

SEQ ID NO: 469765 - DNA, 25 bp, Homo sapien
gtaaattgcctaccacagtaaaagg

SEQ ID NO: 469766 - DNA, 25 bp, Homo sapien
taaaaggtaatctcttgtggttctc

SEQ ID NO: 469767 - DNA, 25 bp, Homo sapien
gtggttctcatgtatttttcatcgt

SEQ ID NO: 469768 - DNA, 25 bp, Homo sapien
tttgaataataccataagactcgta

SEQ ID NO: 469769 - DNA, 25 bp, Homo sapien
ccataagactcgtataaagtgatgc

SEQ ID NO: 469770 - DNA, 25 bp, Homo sapien
taaagtgatgccactagcactagtg

SEQ ID NO: 469771 - DNA, 25 bp, Homo sapien
cactagcactagtgatactggaagt

SEQ ID NO: 469772 - DNA, 25 bp, Homo sapien
aggcaaactctgtcttcccccaggg

SEQ ID NO: 469773 - DNA, 25 bp, Homo sapien
gggagtcaatgaatagtacctaaaa

SEQ ID NO: 469774 - DNA, 25 bp, Homo sapien
ttcaggaagtaacaagggcttgctt

SEQ ID NO: 469775 - DNA, 25 bp, Homo sapien
gggcttgcttagagacatgacggta

SEQ ID NO: 469776 - DNA, 25 bp, Homo sapien
ttagagacatgacggtaaaccctga

SEQ ID NO: 469777 - DNA, 25 bp, Homo sapien
tgacggtaaaccctgaaccatcagc

SEQ ID NO: 469778 - DNA, 25 bp, Homo sapien
cctgaaccatcagctaaaagaggta

SEQ ID NO: 469779 - DNA, 25 bp, Homo sapien
gaggtagatagcagtggttgcccct

SEQ ID NO: 469780 - DNA, 25 bp, Homo sapien
tgatggagagggaacaactgtgtac

SEQ ID NO: 469781 - DNA, 25 bp, Homo sapien
caactgtgtacaaacatgtgacttt

SEQ ID NO: 469782 - DNA, 25 bp, Homo sapien
acatgtgactttacgttttgatcaa

SEQ ID NO: 469783 - DNA, 25 bp, Homo sapien
tccagatcacgccaccctggctgtg

SEQ ID NO: 469784 - DNA, 25 bp, Homo sapien
tcctccctgccacgcagagggagag

SEQ ID NO: 469785 - DNA, 25 bp, Homo sapien
gagaggagcacctcaggaggctccc

SEQ ID NO: 469786 - DNA, 25 bp, Homo sapien
agccccgactcacaggacatgacag

SEQ ID NO: 469787 - DNA, 25 bp, Homo sapien
cgactcacaggacatgacagccgga

SEQ ID NO: 469788 - DNA, 25 bp, Homo sapien
actcacaggacatgacagccggaca

SEQ ID NO: 469789 - DNA, 25 bp, Homo sapien
tcacaggacatgacagccggacacc

SEQ ID NO: 469790 - DNA, 25 bp, Homo sapien
caggacatgacagccggacacctga

SEQ ID NO: 469791 - DNA, 25 bp, Homo sapien
tgacagccggacacctgagtccaca

SEQ ID NO: 469792 - DNA, 25 bp, Homo sapien
agcccagccaagagggtgggtcact

SEQ ID NO: 469793 - DNA, 25 bp, Homo sapien
agggtgggtcactggctggcgccag

SEQ ID NO: 469794 - DNA, 25 bp, Homo sapien
gggttgtagaccttgtcccagtaat

SEQ ID NO: 469795 - DNA, 25 bp, Homo sapien
tagaccttgtcccagtaatatctcc

SEQ ID NO: 469796 - DNA, 25 bp, Homo sapien
cttgtcccagtaatatctccagcag

SEQ ID NO: 469797 - DNA, 25 bp, Homo sapien
gtcccagtaatatctccagcagctc

SEQ ID NO: 469798 - DNA, 25 bp, Homo sapien
gcagctccaacacattttgtcaact

SEQ ID NO: 469799 - DNA, 25 bp, Homo sapien
gctccaacacattttgtcaacttcg

SEQ ID NO: 469800 - DNA, 25 bp, Homo sapien
ccaacacattttgtcaacttcgtat

SEQ ID NO: 469801 - DNA, 25 bp, Homo sapien
cattttgtcaacttcgtattcgttt

SEQ ID NO: 469802 - DNA, 25 bp, Homo sapien
ttttccttgctgttggccaccttta

SEQ ID NO: 469803 - DNA, 25 bp, Homo sapien
gtggggtcatatcggctaactgcaa

SEQ ID NO: 469804 - DNA, 25 bp, Homo sapien
aggttcaagcgatgctcctgtaatc

SEQ ID NO: 469805 - DNA, 25 bp, Homo sapien
aaaaaatcggcagtttcacagtaat

SEQ ID NO: 469806 - DNA, 25 bp, Homo sapien
taaaaagaccttagcgatgccaccc

SEQ ID NO: 469807 - DNA, 25 bp, Homo sapien
ttagcgatgccacccagtaaacaag

SEQ ID NO: 469808 - DNA, 25 bp, Homo sapien
agaaatgacctgtgacttgtcaata

SEQ ID NO: 469809 - DNA, 25 bp, Homo sapien
tgtcaatagggtagttactccctct

SEQ ID NO: 469810 - DNA, 25 bp, Homo sapien
ctcttctttgtcctccaattgtagg

SEQ ID NO: 469811 - DNA, 25 bp, Homo sapien
ggcaattttatgcttgaatcctgct

SEQ ID NO: 469812 - DNA, 25 bp, Homo sapien
aatcctgctgggtcagattggtcgt

SEQ ID NO: 469813 - DNA, 25 bp, Homo sapien
tgggtcagattggtcgtgaagctta

SEQ ID NO: 469814 - DNA, 25 bp, Homo sapien
actatagctgctgggtgttcaactg

SEQ ID NO: 469815 - DNA, 25 bp, Homo sapien
ctgctgggtgttcaactggttgttt

SEQ ID NO: 469816 - DNA, 25 bp, Homo sapien
gagagcctgtgtggtaagaatcata

SEQ ID NO: 469817 - DNA, 25 bp, Homo sapien
ggtaagaatcatatgcgactgtggt

SEQ ID NO: 469818 - DNA, 25 bp, Homo sapien
gaatcatatgcgactgtggtatttg

SEQ ID NO: 469819 - DNA, 25 bp, Homo sapien
tatgcgactgtggtatttgatttaa

SEQ ID NO: 469820 - DNA, 25 bp, Homo sapien
aggaacaggatattatagctaacat

SEQ ID NO: 469821 - DNA, 25 bp, Homo sapien
attatagctaacatccagacctcag

SEQ ID NO: 469822 - DNA, 25 bp, Homo sapien
tagctaacatccagacctcagaaat

SEQ ID NO: 469823 - DNA, 25 bp, Homo sapien
acatccagacctcagaaatacgatt

SEQ ID NO: 469824 - DNA, 25 bp, Homo sapien
gacctcagaaatacgattctctgta

SEQ ID NO: 469825 - DNA, 25 bp, Homo sapien
agaaatacgattctctgtaaaatgg

SEQ ID NO: 469826 - DNA, 25 bp, Homo sapien
tagaatttttactgaaactggctgg

SEQ ID NO: 469827 - DNA, 25 bp, Homo sapien
aagtgatttgctccaagttaccctg

SEQ ID NO: 469828 - DNA, 25 bp, Homo sapien
caagttaccctggaagcctctggaa

SEQ ID NO: 469829 - DNA, 25 bp, Homo sapien
gacagatgccctcctacaagatggg

SEQ ID NO: 469830 - DNA, 25 bp, Homo sapien
ggttgccttgctgtgagtgcccatg

SEQ ID NO: 469831 - DNA, 25 bp, Homo sapien
tgtgagtgcccatgaatagttccta

SEQ ID NO: 469832 - DNA, 25 bp, Homo sapien
tgaatagttcctaacgacttccctt

SEQ ID NO: 469833 - DNA, 25 bp, Homo sapien
ataaaaggcttttggctgtccccat

SEQ ID NO: 469834 - DNA, 25 bp, Homo sapien
gtccccatagtcctgtgcagtaggt

SEQ ID NO: 469835 - DNA, 25 bp, Homo sapien
agtaggtattatttctccctggcta

SEQ ID NO: 469836 - DNA, 25 bp, Homo sapien
attatttctccctggctacagacca

SEQ ID NO: 469837 - DNA, 25 bp, Homo sapien
tacagaccaggagaccgagactcag

SEQ ID NO: 469838 - DNA, 25 bp, Homo sapien
taaaagccccttgggcctgggcatg

SEQ ID NO: 469839 - DNA, 25 bp, Homo sapien
aaaagccccttgggcctgggcatgg

SEQ ID NO: 469840 - DNA, 25 bp, Homo sapien
aaagccccttgggcctgggcatggt

SEQ ID NO: 469841 - DNA, 25 bp, Homo sapien
aagccccttgggcctgggcatggtg

SEQ ID NO: 469842 - DNA, 25 bp, Homo sapien
agccccttgggcctgggcatggtgg

SEQ ID NO: 469843 - DNA, 25 bp, Homo sapien
gcctgtacaaagtggtgaaacccca

SEQ ID NO: 469844 - DNA, 25 bp, Homo sapien
cctgtacaaagtggtgaaaccccat

SEQ ID NO: 469845 - DNA, 25 bp, Homo sapien
gcagtgaagtgagaccacaccattg

SEQ ID NO: 469846 - DNA, 25 bp, Homo sapien
agtgaagtgagaccacaccattgca

SEQ ID NO: 469847 - DNA, 25 bp, Homo sapien
gtgaagtgagaccacaccattgcac

SEQ ID NO: 469848 - DNA, 25 bp, Homo sapien
gaagtgagaccacaccattgcactc

SEQ ID NO: 469849 - DNA, 25 bp, Homo sapien
gctatttggctccagtgtccttgga

SEQ ID NO: 469850 - DNA, 25 bp, Homo sapien
tccagtgtccttggagtctgaggag

SEQ ID NO: 469851 - DNA, 25 bp, Homo sapien
aaatcaaactgccaccggaactgct

SEQ ID NO: 469852 - DNA, 25 bp, Homo sapien
ctgccaccggaactgctttaaaaat

SEQ ID NO: 469853 - DNA, 25 bp, Homo sapien
ggagcaaacaaagtgtaaccatgta

SEQ ID NO: 469854 - DNA, 25 bp, Homo sapien
gtaaccatgtaaaacctgtgagctt

SEQ ID NO: 469855 - DNA, 25 bp, Homo sapien
aacctgtgagcttgtattgatatct

SEQ ID NO: 469856 - DNA, 25 bp, Homo sapien
ttggatcttcgtttgtgtgtgtgta

SEQ ID NO: 469857 - DNA, 25 bp, Homo sapien
cttattgttatatgttgtgtcaacc

SEQ ID NO: 469858 - DNA, 25 bp, Homo sapien
tgttgtgtcaaccaaatcagcttat

SEQ ID NO: 469859 - DNA, 25 bp, Homo sapien
gtgtcaaccaaatcagcttataaat

SEQ ID NO: 469860 - DNA, 25 bp, Homo sapien
ggagaaggcaatgtctgatcatcaa

SEQ ID NO: 469861 - DNA, 25 bp, Homo sapien
aaattgtcagataggcacttttgcc

SEQ ID NO: 469862 - DNA, 25 bp, Homo sapien
ggcacttttgccctttaagtcaaat

SEQ ID NO: 469863 - DNA, 25 bp, Homo sapien
gaaggctgaatggtcttagttaaat

SEQ ID NO: 469864 - DNA, 25 bp, Homo sapien
ggaaagtcactccaagaatacgagt

SEQ ID NO: 469865 - DNA, 25 bp, Homo sapien
tattcatcaaatacctatccaaaga

SEQ ID NO: 469866 - DNA, 25 bp, Homo sapien
cattcagctctcattgacatgggaa

SEQ ID NO: 469867 - DNA, 25 bp, Homo sapien
attctttttcctgacgaatgagtcc

SEQ ID NO: 469868 - DNA, 25 bp, Homo sapien
gaatgagtcctttgaacactgcctt

SEQ ID NO: 469869 - DNA, 25 bp, Homo sapien
agtcctttgaacactgcctttttca

SEQ ID NO: 469870 - DNA, 25 bp, Homo sapien
tgcctttttcagtggaaagccctat

SEQ ID NO: 469871 - DNA, 25 bp, Homo sapien
aactgcagtttcactgatagcgcta

SEQ ID NO: 469872 - DNA, 25 bp, Homo sapien
tgatagcgctatttacaacctccag

SEQ ID NO: 469873 - DNA, 25 bp, Homo sapien
ctccagtggtttaggcaggaccctg

SEQ ID NO: 469874 - DNA, 25 bp, Homo sapien
ggaccctgggaaaggtctcacatct

SEQ ID NO: 469875 - DNA, 25 bp, Homo sapien
gtctcacatctctgttgcttattca

SEQ ID NO: 469876 - DNA, 25 bp, Homo sapien
gttgcttattcagtcaagtcagaga

SEQ ID NO: 469877 - DNA, 25 bp, Homo sapien
gtggaagacttaatgcctcgctgga

SEQ ID NO: 469878 - DNA, 25 bp, Homo sapien
taatgcctcgctggataaatcatca

SEQ ID NO: 469879 - DNA, 25 bp, Homo sapien
gataaatcatcaggacgtagtactt

SEQ ID NO: 469880 - DNA, 25 bp, Homo sapien
gacgtagtactttatacattgcagc

SEQ ID NO: 469881 - DNA, 25 bp, Homo sapien
gctgtgagggacaatgacatgcgct

SEQ ID NO: 469882 - DNA, 25 bp, Homo sapien
gggtgagctgaagtctccatgccta

SEQ ID NO: 469883 - DNA, 25 bp, Homo sapien
gtgagctgaagtctccatgcctagc

SEQ ID NO: 469884 - DNA, 25 bp, Homo sapien
gagctgaagtctccatgcctagctt

SEQ ID NO: 469885 - DNA, 25 bp, Homo sapien
tgaagtctccatgcctagctttaaa

SEQ ID NO: 469886 - DNA, 25 bp, Homo sapien
aagtctccatgcctagctttaaaag

SEQ ID NO: 469887 - DNA, 25 bp, Homo sapien
gtctccatgcctagctttaaaagtt

SEQ ID NO: 469888 - DNA, 25 bp, Homo sapien
ctccatgcctagctttaaaagtttt

SEQ ID NO: 469889 - DNA, 25 bp, Homo sapien
tgcctagctttaaaagttttcgttg

SEQ ID NO: 469890 - DNA, 25 bp, Homo sapien
aaagttttcgttgggctgggagcag

SEQ ID NO: 469891 - DNA, 25 bp, Homo sapien
ctgggcatgggtatgctgtaatcct

SEQ ID NO: 469892 - DNA, 25 bp, Homo sapien
tgggcatgggtatgctgtaatccta

SEQ ID NO: 469893 - DNA, 25 bp, Homo sapien
tacaggagtcaaaatcttacacacc

SEQ ID NO: 469894 - DNA, 25 bp, Homo sapien
ggagtcaaaatcttacacaccaaaa

SEQ ID NO: 469895 - DNA, 25 bp, Homo sapien
tgtaaagcaaggtattcatgaaata

SEQ ID NO: 469896 - DNA, 25 bp, Homo sapien
attcatgaaatacccacagctaaca

SEQ ID NO: 469897 - DNA, 25 bp, Homo sapien
agctaacatcatacccaatgaacaa

SEQ ID NO: 469898 - DNA, 25 bp, Homo sapien
catacccaatgaacaatccaaaaag

SEQ ID NO: 469899 - DNA, 25 bp, Homo sapien
attgagaaaattccctttaagagca

SEQ ID NO: 469900 - DNA, 25 bp, Homo sapien
acccaggaagaaatttgtatataga

SEQ ID NO: 469901 - DNA, 25 bp, Homo sapien
acaaatgaacaaaaacactgctgaa

SEQ ID NO: 469902 - DNA, 25 bp, Homo sapien
aacactgctgaaacacattttaaaa

SEQ ID NO: 469903 - DNA, 25 bp, Homo sapien
aatatatccttgttcatggattgga

SEQ ID NO: 469904 - DNA, 25 bp, Homo sapien
tatatgttttcttagttcactttaa

SEQ ID NO: 469905 - DNA, 25 bp, Homo sapien
gtatgggcatatttcttaaaacgtt

SEQ ID NO: 469906 - DNA, 25 bp, Homo sapien
gcatatttcttaaaacgttaggtct

SEQ ID NO: 469907 - DNA, 25 bp, Homo sapien
tcttaaaacgttaggtctatagtat

SEQ ID NO: 469908 - DNA, 25 bp, Homo sapien
aaacaccaaagatttctattgattt

SEQ ID NO: 469909 - DNA, 25 bp, Homo sapien
gatttatattctttggttattcttt

SEQ ID NO: 469910 - DNA, 25 bp, Homo sapien
ttatatttcttgactggtattctgt

SEQ ID NO: 469911 - DNA, 25 bp, Homo sapien
gactggtattctgtatggttcccaa

SEQ ID NO: 469912 - DNA, 25 bp, Homo sapien
tggtattctgtatggttcccaaaac

SEQ ID NO: 469913 - DNA, 25 bp, Homo sapien
ttctgtatggttcccaaaaccagtc

SEQ ID NO: 469914 - DNA, 25 bp, Homo sapien
accagtcaagaactgtaaaactctt

SEQ ID NO: 469915 - DNA, 25 bp, Homo sapien
aaccatggaaaaaccgcaggtcctg

SEQ ID NO: 469916 - DNA, 25 bp, Homo sapien
atggaaaaaccgcaggtcctggagc

SEQ ID NO: 469917 - DNA, 25 bp, Homo sapien
gaaaaaccgcaggtcctggagcctc

SEQ ID NO: 469918 - DNA, 25 bp, Homo sapien
aaaccgcaggtcctggagcctccgt

SEQ ID NO: 469919 - DNA, 25 bp, Homo sapien
ctggagcctccgtgtggttgtcgtg

SEQ ID NO: 469920 - DNA, 25 bp, Homo sapien
tgtggttgtcgtgggcagctttcca

SEQ ID NO: 469921 - DNA, 25 bp, Homo sapien
ttgtcgtgggcagctttccacgcga

SEQ ID NO: 469922 - DNA, 25 bp, Homo sapien
tgggcagctttccacgcgacgtgcc

SEQ ID NO: 469923 - DNA, 25 bp, Homo sapien
acgtgccctccctgggcgtgaggct

SEQ ID NO: 469924 - DNA, 25 bp, Homo sapien
ggctgcacaagtaaccgtggaacct

SEQ ID NO: 469925 - DNA, 25 bp, Homo sapien
ctgcacaagtaaccgtggaacctaa

SEQ ID NO: 469926 - DNA, 25 bp, Homo sapien
agataagaagtgaaaccctgaccat

SEQ ID NO: 469927 - DNA, 25 bp, Homo sapien
tgaccatctctgagacctgcagaag

SEQ ID NO: 469928 - DNA, 25 bp, Homo sapien
gagacctgcagaagtgactgccttt

SEQ ID NO: 469929 - DNA, 25 bp, Homo sapien
tgcagaagtgactgcctttctgagc

SEQ ID NO: 469930 - DNA, 25 bp, Homo sapien
ttcctcacctgtaaacatgatgatg

SEQ ID NO: 469931 - DNA, 25 bp, Homo sapien
acatgatgatggttcctaccactta

SEQ ID NO: 469932 - DNA, 25 bp, Homo sapien
atggttcctaccacttaggttctga

SEQ ID NO: 469933 - DNA, 25 bp, Homo sapien
ctaccacttaggttctgaaaaggat

SEQ ID NO: 469934 - DNA, 25 bp, Homo sapien
ggattcctatatttactggcatgta

SEQ ID NO: 469935 - DNA, 25 bp, Homo sapien
actggcatgtaggtgtacaggtatt

SEQ ID NO: 469936 - DNA, 25 bp, Homo sapien
gaaaatctgcaaactggctaggcat

SEQ ID NO: 469937 - DNA, 25 bp, Homo sapien
ccccagctttcattgtggctgttag

SEQ ID NO: 469938 - DNA, 25 bp, Homo sapien
agctttcattgtggctgttagcaac

SEQ ID NO: 469939 - DNA, 25 bp, Homo sapien
tcattgtggctgttagcaacatcct

SEQ ID NO: 469940 - DNA, 25 bp, Homo sapien
ttgtggctgttagcaacatcctggg

SEQ ID NO: 469941 - DNA, 25 bp, Homo sapien
ctgttagcaacatcctggggtttaa

SEQ ID NO: 469942 - DNA, 25 bp, Homo sapien
cacgcccgatctggctgtctagagg

SEQ ID NO: 469943 - DNA, 25 bp, Homo sapien
aaggaaagctttgtcctgagctctt

SEQ ID NO: 469944 - DNA, 25 bp, Homo sapien
gaaagctttgtcctgagctcttcat

SEQ ID NO: 469945 - DNA, 25 bp, Homo sapien
aagctttgtcctgagctcttcattc

SEQ ID NO: 469946 - DNA, 25 bp, Homo sapien
tcttcattcattggctaacccctag

SEQ ID NO: 469947 - DNA, 25 bp, Homo sapien
tcattcattggctaacccctagctc

SEQ ID NO: 469948 - DNA, 25 bp, Homo sapien
aacactgagttcttgatctgaccaa

SEQ ID NO: 469949 - DNA, 25 bp, Homo sapien
taaccatttctattattatcactat

SEQ ID NO: 469950 - DNA, 25 bp, Homo sapien
aatatactctacaatgatacttctg

SEQ ID NO: 469951 - DNA, 25 bp, Homo sapien
atgatacttctgtagtggaatgtac

SEQ ID NO: 469952 - DNA, 25 bp, Homo sapien
aaaatgcttgcattcctgctaaatg

SEQ ID NO: 469953 - DNA, 25 bp, Homo sapien
aacagatcaaacaactattcctgag

SEQ ID NO: 469954 - DNA, 25 bp, Homo sapien
tattcctgagtgtttcgggtagctt

SEQ ID NO: 469955 - DNA, 25 bp, Homo sapien
gagtgtttcgggtagcttaagctct

SEQ ID NO: 469956 - DNA, 25 bp, Homo sapien
gtagcttaagctctattattctgaa

SEQ ID NO: 469957 - DNA, 25 bp, Homo sapien
agctctattattctgaacttcacta

SEQ ID NO: 469958 - DNA, 25 bp, Homo sapien
aacttcactactctcaatactcttt

SEQ ID NO: 469959 - DNA, 25 bp, Homo sapien
tgatgggaccaagtggattctgtta

SEQ ID NO: 469960 - DNA, 25 bp, Homo sapien
ttcacaaagctcctcatgctctaga

SEQ ID NO: 469961 - DNA, 25 bp, Homo sapien
atgctctagacctggtgagggccac

SEQ ID NO: 469962 - DNA, 25 bp, Homo sapien
ccacagctgcctttttgaacgtgta

SEQ ID NO: 469963 - DNA, 25 bp, Homo sapien
gaacgtgtagttttgcagtcctccc

SEQ ID NO: 469964 - DNA, 25 bp, Homo sapien
cttgcatacacagaagtgtgcgcat

SEQ ID NO: 469965 - DNA, 25 bp, Homo sapien
gcataagtcgcattgttttgtggtt

SEQ ID NO: 469966 - DNA, 25 bp, Homo sapien
ttgtggtttgcttttcctctactaa

SEQ ID NO: 469967 - DNA, 25 bp, Homo sapien
ttcctctactaaatgatgtgcctgc

SEQ ID NO: 469968 - DNA, 25 bp, Homo sapien
ctgctgttctccagcttgttttctt

SEQ ID NO: 469969 - DNA, 25 bp, Homo sapien
ggaggaccacacaactgccgaagtg

SEQ ID NO: 469970 - DNA, 25 bp, Homo sapien
aagaatttgataattatctggctgg

SEQ ID NO: 469971 - DNA, 25 bp, Homo sapien
agaatttgataattatctggctggg

SEQ ID NO: 469972 - DNA, 25 bp, Homo sapien
gaatttgataattatctggctgggc

SEQ ID NO: 469973 - DNA, 25 bp, Homo sapien
aatttgataattatctggctgggca

SEQ ID NO: 469974 - DNA, 25 bp, Homo sapien
atttgataattatctggctgggcat

SEQ ID NO: 469975 - DNA, 25 bp, Homo sapien
tttgataattatctggctgggcatg

SEQ ID NO: 469976 - DNA, 25 bp, Homo sapien
ttgataattatctggctgggcatga

SEQ ID NO: 469977 - DNA, 25 bp, Homo sapien
tgataattatctggctgggcatgat

SEQ ID NO: 469978 - DNA, 25 bp, Homo sapien
atgcctgtaattcaggcgctttggg

SEQ ID NO: 469979 - DNA, 25 bp, Homo sapien
ggtgagttgaggtcgtgccaccgca

SEQ ID NO: 469980 - DNA, 25 bp, Homo sapien
tgagttgaggtcgtgccaccgcact

SEQ ID NO: 469981 - DNA, 25 bp, Homo sapien
tagttttctaagacagttccatgta

SEQ ID NO: 469982 - DNA, 25 bp, Homo sapien
aaaatgatttatgcctttctccaag

SEQ ID NO: 469983 - DNA, 25 bp, Homo sapien
tccaaggcggtacatatccaaagac

SEQ ID NO: 469984 - DNA, 25 bp, Homo sapien
catatccaaagacatgacaccaggg

SEQ ID NO: 469985 - DNA, 25 bp, Homo sapien
aaagtgcttgtttttctgatggaag

SEQ ID NO: 469986 - DNA, 25 bp, Homo sapien
ggaagcagtggtcttttcttttctt

SEQ ID NO: 469987 - DNA, 25 bp, Homo sapien
gcatgtgtatgtgtagctaagccta

SEQ ID NO: 469988 - DNA, 25 bp, Homo sapien
gtagctaagcctaaataaccctgta

SEQ ID NO: 469989 - DNA, 25 bp, Homo sapien
taaccctgtaaaatttctgctgcaa

SEQ ID NO: 469990 - DNA, 25 bp, Homo sapien
tttctgctgcaaattgtctcttctg

SEQ ID NO: 469991 - DNA, 25 bp, Homo sapien
aattgtctcttctgaatttagaatg

SEQ ID NO: 469992 - DNA, 25 bp, Homo sapien
aaaacttctgaccatcagggcaagg

SEQ ID NO: 469993 - DNA, 25 bp, Homo sapien
gaccatcagggcaaggacacaagac

SEQ ID NO: 469994 - DNA, 25 bp, Homo sapien
gacatcacaaacacgtgtaagcaca

SEQ ID NO: 469995 - DNA, 25 bp, Homo sapien
tgtaagcacacctcctaactgagta

SEQ ID NO: 469996 - DNA, 25 bp, Homo sapien
agtgacagagaagtaattttccctt

SEQ ID NO: 469997 - DNA, 25 bp, Homo sapien
ttttcccttccacatagcaaattca

SEQ ID NO: 469998 - DNA, 25 bp, Homo sapien
ttcaaataaccttggcagaatatgt

SEQ ID NO: 469999 - DNA, 25 bp, Homo sapien
tatgtgatctcgtttcttatctgaa

SEQ ID NO: 470000 - DNA, 25 bp, Homo sapien
gaaaatgttatgttgtaacgctgca

SEQ ID NO: 470001 - DNA, 25 bp, Homo sapien
gtaacgctgcaatacaactttttga

SEQ ID NO: 470002 - DNA, 25 bp, Homo sapien
gactccaaatcctttatcatcatca

SEQ ID NO: 470003 - DNA, 25 bp, Homo sapien
tagcatatagaacagtacctaacta

SEQ ID NO: 470004 - DNA, 25 bp, Homo sapien
agaacagtacctaactatagcggat

SEQ ID NO: 470005 - DNA, 25 bp, Homo sapien
cagtacctaactatagcggatggtt

SEQ ID NO: 470006 - DNA, 25 bp, Homo sapien
ctatagcggatggttagtacgtgtt

SEQ ID NO: 470007 - DNA, 25 bp, Homo sapien
cggatggttagtacgtgttagctga

SEQ ID NO: 470008 - DNA, 25 bp, Homo sapien
gatggttagtacgtgttagctgagt

SEQ ID NO: 470009 - DNA, 25 bp, Homo sapien
agtacgtgttagctgagtaagtgaa

SEQ ID NO: 470010 - DNA, 25 bp, Homo sapien
gaatcaaataatcacgtgttgcagg

SEQ ID NO: 470011 - DNA, 25 bp, Homo sapien
aactgtaattatttctggctgattg

SEQ ID NO: 470012 - DNA, 25 bp, Homo sapien
tatttctggctgattgaattctaaa

SEQ ID NO: 470013 - DNA, 25 bp, Homo sapien
ttctcctttgtattttccaaatcct

SEQ ID NO: 470014 - DNA, 25 bp, Homo sapien
gttaggatctgaacccatctgacga

SEQ ID NO: 470015 - DNA, 25 bp, Homo sapien
catctgacgaaaggctatgctctta

SEQ ID NO: 470016 - DNA, 25 bp, Homo sapien
aattagtaacatttccctgccttgc

SEQ ID NO: 470017 - DNA, 25 bp, Homo sapien
ctgccttgcaaggacacatgtaggt

SEQ ID NO: 470018 - DNA, 25 bp, Homo sapien
acatgtaggtcacagggtacccagg

SEQ ID NO: 470019 - DNA, 25 bp, Homo sapien
ggtaaatgctctgtccttttctcac

SEQ ID NO: 470020 - DNA, 25 bp, Homo sapien
gtaacagcctctggcccaaaatgag

SEQ ID NO: 470021 - DNA, 25 bp, Homo sapien
gagactggacattgactttaatgca

SEQ ID NO: 470022 - DNA, 25 bp, Homo sapien
ggattcattcagaagcacccagatt

SEQ ID NO: 470023 - DNA, 25 bp, Homo sapien
agaagcacccagatttcacaagagg

SEQ ID NO: 470024 - DNA, 25 bp, Homo sapien
atgaggcgtttttctgaggtgttga

SEQ ID NO: 470025 - DNA, 25 bp, Homo sapien
ttctaagtaccccttgtgggccagg

SEQ ID NO: 470026 - DNA, 25 bp, Homo sapien
tctaagtaccccttgtgggccaggc

SEQ ID NO: 470027 - DNA, 25 bp, Homo sapien
taagtaccccttgtgggccaggctt

SEQ ID NO: 470028 - DNA, 25 bp, Homo sapien
agtaccccttgtgggccaggcttat

SEQ ID NO: 470029 - DNA, 25 bp, Homo sapien
ccccttgtgggccaggcttatatct

SEQ ID NO: 470030 - DNA, 25 bp, Homo sapien
cccttgtgggccaggcttatatctg

SEQ ID NO: 470031 - DNA, 25 bp, Homo sapien
ggccaggcttatatctgtaatccca

SEQ ID NO: 470032 - DNA, 25 bp, Homo sapien
agacccagtgtctacaaagagtaag

SEQ ID NO: 470033 - DNA, 25 bp, Homo sapien
gatgattagtggaacatgctggtgt

SEQ ID NO: 470034 - DNA, 25 bp, Homo sapien
gattagtggaacatgctggtgtgca

SEQ ID NO: 470035 - DNA, 25 bp, Homo sapien
ttagtggaacatgctggtgtgcacc

SEQ ID NO: 470036 - DNA, 25 bp, Homo sapien
gtataattttgaagcactctccgat

SEQ ID NO: 470037 - DNA, 25 bp, Homo sapien
gaagcactctccgataactataatg

SEQ ID NO: 470038 - DNA, 25 bp, Homo sapien
tcatttgatgatatatgtggcccaa

SEQ ID NO: 470039 - DNA, 25 bp, Homo sapien
atgtggcccaatttggtgtgaaaca

SEQ ID NO: 470040 - DNA, 25 bp, Homo sapien
gaaccttctaaaagaattactgctt

SEQ ID NO: 470041 - DNA, 25 bp, Homo sapien
attactgctttcaattcacacctag

SEQ ID NO: 470042 - DNA, 25 bp, Homo sapien
ttcacacctagttttaaattgcatt

SEQ ID NO: 470043 - DNA, 25 bp, Homo sapien
tttcttgtctttcaaggagaagtat

SEQ ID NO: 470044 - DNA, 25 bp, Homo sapien
tatgttttctctccacagattcctt

SEQ ID NO: 470045 - DNA, 25 bp, Homo sapien
ctctccacagattccttacttatat

SEQ ID NO: 470046 - DNA, 25 bp, Homo sapien
aatatagccctggtagggaatattt

SEQ ID NO: 470047 - DNA, 25 bp, Homo sapien
tctgaggcaggaacgctgctaggct

SEQ ID NO: 470048 - DNA, 25 bp, Homo sapien
aggtgcaaagcaaagacccctttct

SEQ ID NO: 470049 - DNA, 25 bp, Homo sapien
aggaaccctgcctgtctcggcagtt

SEQ ID NO: 470050 - DNA, 25 bp, Homo sapien
agttctccaactgtcctggcaaagt

SEQ ID NO: 470051 - DNA, 25 bp, Homo sapien
gagcccctttctggaagagcttaga

SEQ ID NO: 470052 - DNA, 25 bp, Homo sapien
gagcttagagcagcctgagttggaa

SEQ ID NO: 470053 - DNA, 25 bp, Homo sapien
aagggagcaaagcagcacctcaatt

SEQ ID NO: 470054 - DNA, 25 bp, Homo sapien
gcagcacctcaattcggaaactcga

SEQ ID NO: 470055 - DNA, 25 bp, Homo sapien
attcggaaactcgacctcagcagca

SEQ ID NO: 470056 - DNA, 25 bp, Homo sapien
agggatgtctagacctgccttcgct

SEQ ID NO: 470057 - DNA, 25 bp, Homo sapien
tgcgccgctgcttgggagccgctca

SEQ ID NO: 470058 - DNA, 25 bp, Homo sapien
tctgtgaggacagcccatgcccagt

SEQ ID NO: 470059 - DNA, 25 bp, Homo sapien
atgcccagttccatattcctcatat

SEQ ID NO: 470060 - DNA, 25 bp, Homo sapien
tattcctcatatctagaccttctac

SEQ ID NO: 470061 - DNA, 25 bp, Homo sapien
accttctaccctgcaacagttttga

SEQ ID NO: 470062 - DNA, 25 bp, Homo sapien
tgtatgtgtgcgtgtccacctgctt

SEQ ID NO: 470063 - DNA, 25 bp, Homo sapien
catgtttcctggtggcaagctttag

SEQ ID NO: 470064 - DNA, 25 bp, Homo sapien
ggcaagctttaggaaccagttcaaa

SEQ ID NO: 470065 - DNA, 25 bp, Homo sapien
tgagaggtgcccatactatgcatcc

SEQ ID NO: 470066 - DNA, 25 bp, Homo sapien
cggtctccattacctgaaactcaca

SEQ ID NO: 470067 - DNA, 25 bp, Homo sapien
tgaaactcacaccttgatcttgacc

SEQ ID NO: 470068 - DNA, 25 bp, Homo sapien
gatcttgaccattgagctctgacct

SEQ ID NO: 470069 - DNA, 25 bp, Homo sapien
cagagccaggaacccctgtagggaa

SEQ ID NO: 470070 - DNA, 25 bp, Homo sapien
aagcctgagcgcctctcctgggctt

SEQ ID NO: 470071 - DNA, 25 bp, Homo sapien
tctcctgggcttgccaaggactcaa

SEQ ID NO: 470072 - DNA, 25 bp, Homo sapien
gggcttgccaaggactcaaacccag

SEQ ID NO: 470073 - DNA, 25 bp, Homo sapien
cagaagcccagagcagggccttagg

SEQ ID NO: 470074 - DNA, 25 bp, Homo sapien
accctgctctgggcggaggaatatg

SEQ ID NO: 470075 - DNA, 25 bp, Homo sapien
ggaggaatatgtcccagatagcact

SEQ ID NO: 470076 - DNA, 25 bp, Homo sapien
agaggcggccacgacctggtgaaca

SEQ ID NO: 470077 - DNA, 25 bp, Homo sapien
gcggccacgacctggtgaacaccta

SEQ ID NO: 470078 - DNA, 25 bp, Homo sapien
gtgaacacctaggacgcaccattct

SEQ ID NO: 470079 - DNA, 25 bp, Homo sapien
cctaggacgcaccattctcacaaag

SEQ ID NO: 470080 - DNA, 25 bp, Homo sapien
tctgcccaggatgttaagggctgct

SEQ ID NO: 470081 - DNA, 25 bp, Homo sapien
gatgttaagggctgctggaaaatgc

SEQ ID NO: 470082 - DNA, 25 bp, Homo sapien
atattccaggatggatccagcctcc

SEQ ID NO: 470083 - DNA, 25 bp, Homo sapien
atggatccagcctccactggacttg

SEQ ID NO: 470084 - DNA, 25 bp, Homo sapien
ttggcccctttattttgattcctgc

SEQ ID NO: 470085 - DNA, 25 bp, Homo sapien
agccctgagcggcataacatctaca

SEQ ID NO: 470086 - DNA, 25 bp, Homo sapien
ctgagcggcataacatctacacggg

SEQ ID NO: 470087 - DNA, 25 bp, Homo sapien
gggttagctgcaggtagaactcaga

SEQ ID NO: 470088 - DNA, 25 bp, Homo sapien
ggtagaactcagaactcagctccta

SEQ ID NO: 470089 - DNA, 25 bp, Homo sapien
agaactcagctcctagccaagtaga

SEQ ID NO: 470090 - DNA, 25 bp, Homo sapien
cctagccaagtagagtgaggcctat

SEQ ID NO: 470091 - DNA, 25 bp, Homo sapien
ggctggtaatgtctttaaatctttc

SEQ ID NO: 470092 - DNA, 25 bp, Homo sapien
tcctggcattttcatcactggtata

SEQ ID NO: 470093 - DNA, 25 bp, Homo sapien
atcactggtataatctcccttggct

SEQ ID NO: 470094 - DNA, 25 bp, Homo sapien
atctcccttggcttcctgtaaaata

SEQ ID NO: 470095 - DNA, 25 bp, Homo sapien
aagatggtttcgctctctacttcga

SEQ ID NO: 470096 - DNA, 25 bp, Homo sapien
tctacttcgatttgccccttgtgca

SEQ ID NO: 470097 - DNA, 25 bp, Homo sapien
gcacacaggcctttgcattcaggaa

SEQ ID NO: 470098 - DNA, 25 bp, Homo sapien
aacagctccacggtggttttatcct

SEQ ID NO: 470099 - DNA, 25 bp, Homo sapien
gatatgctctcaatgtaaaacctca

SEQ ID NO: 470100 - DNA, 25 bp, Homo sapien
tgcaaaatggttgggcctggtttct

SEQ ID NO: 470101 - DNA, 25 bp, Homo sapien
ggtttcttgggcaaatcgtggtcaa

SEQ ID NO: 470102 - DNA, 25 bp, Homo sapien
agccctataataatggaagcctaaa

SEQ ID NO: 470103 - DNA, 25 bp, Homo sapien
ggaagcctaaagagagtgtggatct

SEQ ID NO: 470104 - DNA, 25 bp, Homo sapien
agggatatccgggaccgacagtctt

SEQ ID NO: 470105 - DNA, 25 bp, Homo sapien
ggaccgacagtctttcccgattata

SEQ ID NO: 470106 - DNA, 25 bp, Homo sapien
gtctttcccgattataccaatccag

SEQ ID NO: 470107 - DNA, 25 bp, Homo sapien
gattataccaatccagtatgcactg

SEQ ID NO: 470108 - DNA, 25 bp, Homo sapien
tccagtatgcactgagtggtggaca

SEQ ID NO: 470109 - DNA, 25 bp, Homo sapien
gtggtggacagatcaggtcgctaaa

SEQ ID NO: 470110 - DNA, 25 bp, Homo sapien
ggtcgctaaatttcatgatcatctg

SEQ ID NO: 470111 - DNA, 25 bp, Homo sapien
gtaagttattattcctgactcaaat

SEQ ID NO: 470112 - DNA, 25 bp, Homo sapien
gataacgccaaattttcagatgagt

SEQ ID NO: 470113 - DNA, 25 bp, Homo sapien
tacaggagtcaaaatcttacacacc

SEQ ID NO: 470114 - DNA, 25 bp, Homo sapien
aggagtcaaaatcttacacaccaaa

SEQ ID NO: 470115 - DNA, 25 bp, Homo sapien
gagtcaaaatcttacacaccaaaaa

SEQ ID NO: 470116 - DNA, 25 bp, Homo sapien
tcaaaatcttacacaccaaaaaaca

SEQ ID NO: 470117 - DNA, 25 bp, Homo sapien
tgtaaagcaaggtattcatgaaata

SEQ ID NO: 470118 - DNA, 25 bp, Homo sapien
tattcatgaaatacccacagctaac

SEQ ID NO: 470119 - DNA, 25 bp, Homo sapien
attcatgaaatacccacagctaaca

SEQ ID NO: 470120 - DNA, 25 bp, Homo sapien
cagctaacatcatacccaatgaaca

SEQ ID NO: 470121 - DNA, 25 bp, Homo sapien
gctaacatcatacccaatgaacaat

SEQ ID NO: 470122 - DNA, 25 bp, Homo sapien
catacccaatgaacaatccaaaaag

SEQ ID NO: 470123 - DNA, 25 bp, Homo sapien
acccaggaagaaatttgtatataga

SEQ ID NO: 470124 - DNA, 25 bp, Homo sapien
ctttttgtaaaatggtcatcatggc

SEQ ID NO: 470125 - DNA, 25 bp, Homo sapien
tttttgtaaaatggtcatcatggct

SEQ ID NO: 470126 - DNA, 25 bp, Homo sapien
ttttgtaaaatggtcatcatggctg

SEQ ID NO: 470127 - DNA, 25 bp, Homo sapien
tttgtaaaatggtcatcatggctgg

SEQ ID NO: 470128 - DNA, 25 bp, Homo sapien
ttgtaaaatggtcatcatggctggg

SEQ ID NO: 470129 - DNA, 25 bp, Homo sapien
tgtaaaatggtcatcatggctgggc

SEQ ID NO: 470130 - DNA, 25 bp, Homo sapien
gtaaaatggtcatcatggctgggcg

SEQ ID NO: 470131 - DNA, 25 bp, Homo sapien
taaaatggtcatcatggctgggcgc

SEQ ID NO: 470132 - DNA, 25 bp, Homo sapien
aaaatggtcatcatggctgggcgcg

SEQ ID NO: 470133 - DNA, 25 bp, Homo sapien
aaatggtcatcatggctgggcgcgg

SEQ ID NO: 470134 - DNA, 25 bp, Homo sapien
gaaacttgggatggaatgcactgta

SEQ ID NO: 470135 - DNA, 25 bp, Homo sapien
tgcactgtattggaagagggttaaa

SEQ ID NO: 470136 - DNA, 25 bp, Homo sapien
gggtgggatgtctatcactcattta

SEQ ID NO: 470137 - DNA, 25 bp, Homo sapien
tttagatggtcctcaagtcctgttt

SEQ ID NO: 470138 - DNA, 25 bp, Homo sapien
agtcctgtttctgctatgagtctga

SEQ ID NO: 470139 - DNA, 25 bp, Homo sapien
tgagagcacaaggtgtcaggagctt

SEQ ID NO: 470140 - DNA, 25 bp, Homo sapien
gcttggcatggaacttagggcttta

SEQ ID NO: 470141 - DNA, 25 bp, Homo sapien
ttagggctttacaatctgggcacag

SEQ ID NO: 470142 - DNA, 25 bp, Homo sapien
cagaaatgtgagagtgagggcctta

SEQ ID NO: 470143 - DNA, 25 bp, Homo sapien
gcagccatggtggtacctttacagg

SEQ ID NO: 470144 - DNA, 25 bp, Homo sapien
acctttacaggcattaatcagcaca

SEQ ID NO: 470145 - DNA, 25 bp, Homo sapien
actaccactattctcaataatacct

SEQ ID NO: 470146 - DNA, 25 bp, Homo sapien
tcagagaaccaaaaagcactcttgg

SEQ ID NO: 470147 - DNA, 25 bp, Homo sapien
aaaagcactcttggaaatcaaaaag

SEQ ID NO: 470148 - DNA, 25 bp, Homo sapien
agtatttcaatagatcacttggaag

SEQ ID NO: 470149 - DNA, 25 bp, Homo sapien
tcaatagatcacttggaagagtaaa

SEQ ID NO: 470150 - DNA, 25 bp, Homo sapien
gaagagtaaatttgtactaccacta

SEQ ID NO: 470151 - DNA, 25 bp, Homo sapien
aaaactatacgaatactaggctatc

SEQ ID NO: 470152 - DNA, 25 bp, Homo sapien
atacgaatactaggctatcagtcaa

SEQ ID NO: 470153 - DNA, 25 bp, Homo sapien
gaatactaggctatcagtcaaggat

SEQ ID NO: 470154 - DNA, 25 bp, Homo sapien
tactaggctatcagtcaaggatttc

SEQ ID NO: 470155 - DNA, 25 bp, Homo sapien
tttcctgcaacttaataatacaaat

SEQ ID NO: 470156 - DNA, 25 bp, Homo sapien
gcaaaatgctgtaccatatagccta

SEQ ID NO: 470157 - DNA, 25 bp, Homo sapien
cctaggtggtagtgggcttgaccat

SEQ ID NO: 470158 - DNA, 25 bp, Homo sapien
gtgggcttgaccatctaggtttgta

SEQ ID NO: 470159 - DNA, 25 bp, Homo sapien
ggtttgtataagtacaccgtatgat

SEQ ID NO: 470160 - DNA, 25 bp, Homo sapien
accgtatgatgttcacccaatggca

SEQ ID NO: 470161 - DNA, 25 bp, Homo sapien
ccaatggcagaatcccctaatgcat

SEQ ID NO: 470162 - DNA, 25 bp, Homo sapien
gaatcccctaatgcatttctgagaa

SEQ ID NO: 470163 - DNA, 25 bp, Homo sapien
atttctgagaacgtagccccatcaa

SEQ ID NO: 470164 - DNA, 25 bp, Homo sapien
atcaagtcactcatgactctatgtt

SEQ ID NO: 470165 - DNA, 25 bp, Homo sapien
gactctatgttgactatgctttttc

SEQ ID NO: 470166 - DNA, 25 bp, Homo sapien
actatgctttttcacgcttccagaa

SEQ ID NO: 470167 - DNA, 25 bp, Homo sapien
gatcttagactgtcagtattagttc

SEQ ID NO: 470168 - DNA, 25 bp, Homo sapien
agactgtcagtattagttcttggcc

SEQ ID NO: 470169 - DNA, 25 bp, Homo sapien
gactgtcagtattagttcttggcca

SEQ ID NO: 470170 - DNA, 25 bp, Homo sapien
ctgtcagtattagttcttggccaga

SEQ ID NO: 470171 - DNA, 25 bp, Homo sapien
gtcagtattagttcttggccagaca

SEQ ID NO: 470172 - DNA, 25 bp, Homo sapien
cagtattagttcttggccagacacg

SEQ ID NO: 470173 - DNA, 25 bp, Homo sapien
gtattagttcttggccagacacggt

SEQ ID NO: 470174 - DNA, 25 bp, Homo sapien
tatcaaaatacaaagatgagccggg

SEQ ID NO: 470175 - DNA, 25 bp, Homo sapien
atacaaagatgagccgggcatgata

SEQ ID NO: 470176 - DNA, 25 bp, Homo sapien
catgatagcaagtgcctgtaattgt

SEQ ID NO: 470177 - DNA, 25 bp, Homo sapien
atgatagcaagtgcctgtaattgta

SEQ ID NO: 470178 - DNA, 25 bp, Homo sapien
gcctacctgagggtaaagagtggga

SEQ ID NO: 470179 - DNA, 25 bp, Homo sapien
accttggtgatgagataatcaatac

SEQ ID NO: 470180 - DNA, 25 bp, Homo sapien
tgagataatcaatacaacgaacccc

SEQ ID NO: 470181 - DNA, 25 bp, Homo sapien
atgacacgagtttacttatgtagca

SEQ ID NO: 470182 - DNA, 25 bp, Homo sapien
gacacgagtttacttatgtagcaaa

SEQ ID NO: 470183 - DNA, 25 bp, Homo sapien
tgcacaaacctgcacctgaacttaa

SEQ ID NO: 470184 - DNA, 25 bp, Homo sapien
gcacaaacctgcacctgaacttaaa

SEQ ID NO: 470185 - DNA, 25 bp, Homo sapien
cacaaacctgcacctgaacttaaaa

SEQ ID NO: 470186 - DNA, 25 bp, Homo sapien
caaacctgcacctgaacttaaaata

SEQ ID NO: 470187 - DNA, 25 bp, Homo sapien
aaacctgcacctgaacttaaaatat

SEQ ID NO: 470188 - DNA, 25 bp, Homo sapien
acctgcacctgaacttaaaatataa

SEQ ID NO: 470189 - DNA, 25 bp, Homo sapien
agtccacttgcttcccagcagaaac

SEQ ID NO: 470190 - DNA, 25 bp, Homo sapien
aaacatcccaggtccaaaggcaggc

SEQ ID NO: 470191 - DNA, 25 bp, Homo sapien
aacatcccaggtccaaaggcaggca

SEQ ID NO: 470192 - DNA, 25 bp, Homo sapien
ggcaggcagagagccggcctgggaa

SEQ ID NO: 470193 - DNA, 25 bp, Homo sapien
ctctgtaccccaaagtctccaggaa

SEQ ID NO: 470194 - DNA, 25 bp, Homo sapien
tgagcctgcaacacccaattatcca

SEQ ID NO: 470195 - DNA, 25 bp, Homo sapien
cctgcaacacccaattatccaaatg

SEQ ID NO: 470196 - DNA, 25 bp, Homo sapien
acccaattatccaaatggtcttcaa

SEQ ID NO: 470197 - DNA, 25 bp, Homo sapien
ggtcttcaaagcctcagatgcttta

SEQ ID NO: 470198 - DNA, 25 bp, Homo sapien
caaagcctcagatgctttacaaccc

SEQ ID NO: 470199 - DNA, 25 bp, Homo sapien
tacaacccagtccagcagcctctga

SEQ ID NO: 470200 - DNA, 25 bp, Homo sapien
agagataaagcaggccgggcgcagt

SEQ ID NO: 470201 - DNA, 25 bp, Homo sapien
gagataaagcaggccgggcgcagtg

SEQ ID NO: 470202 - DNA, 25 bp, Homo sapien
agataaagcaggccgggcgcagtgg

SEQ ID NO: 470203 - DNA, 25 bp, Homo sapien
atggagaatatcctggccaacttgg

SEQ ID NO: 470204 - DNA, 25 bp, Homo sapien
tggagaatatcctggccaacttggt

SEQ ID NO: 470205 - DNA, 25 bp, Homo sapien
ggagaatatcctggccaacttggtg

SEQ ID NO: 470206 - DNA, 25 bp, Homo sapien
gagaatatcctggccaacttggtga

SEQ ID NO: 470207 - DNA, 25 bp, Homo sapien
agaatatcctggccaacttggtgaa

SEQ ID NO: 470208 - DNA, 25 bp, Homo sapien
aaaaactgggcgtggtggtgtgcgc

SEQ ID NO: 470209 - DNA, 25 bp, Homo sapien
aaaactgggcgtggtggtgtgcgcc

SEQ ID NO: 470210 - DNA, 25 bp, Homo sapien
acctgggaggctgagatagcagaat

SEQ ID NO: 470211 - DNA, 25 bp, Homo sapien
gtcaaataatccatgaagctaagag

SEQ ID NO: 470212 - DNA, 25 bp, Homo sapien
gttgcaaataggaatatgctccagc

SEQ ID NO: 470213 - DNA, 25 bp, Homo sapien
gcaatggcttgtttatcagcaaacc

SEQ ID NO: 470214 - DNA, 25 bp, Homo sapien
gcaaaccaaacactagtctctgaat

SEQ ID NO: 470215 - DNA, 25 bp, Homo sapien
tttcccctgggattgaagaatgcat

SEQ ID NO: 470216 - DNA, 25 bp, Homo sapien
gaagaatgcatctttttcacaatag

SEQ ID NO: 470217 - DNA, 25 bp, Homo sapien
gcatctttttcacaatagttacaca

SEQ ID NO: 470218 - DNA, 25 bp, Homo sapien
gcaatttgctataagttttgtccct

SEQ ID NO: 470219 - DNA, 25 bp, Homo sapien
gttttgtccctactgaactatagaa

SEQ ID NO: 470220 - DNA, 25 bp, Homo sapien
tagaaaaatattactccccaggtag

SEQ ID NO: 470221 - DNA, 25 bp, Homo sapien
tactccccaggtagaggtacttcct

SEQ ID NO: 470222 - DNA, 25 bp, Homo sapien
atgggcaccgcgatgccgtgaagtt

SEQ ID NO: 470223 - DNA, 25 bp, Homo sapien
accgcgatgccgtgaagttctttgt

SEQ ID NO: 470224 - DNA, 25 bp, Homo sapien
aagttctttgtctcggtgccaggga

SEQ ID NO: 470225 - DNA, 25 bp, Homo sapien
ctttgtctcggtgccagggaacgtg

SEQ ID NO: 470226 - DNA, 25 bp, Homo sapien
agggaacgtgctggccaccctgaat

SEQ ID NO: 470227 - DNA, 25 bp, Homo sapien
caccctgaatggcagtgtgctggac

SEQ ID NO: 470228 - DNA, 25 bp, Homo sapien
gaatggcagtgtgctggacagccca

SEQ ID NO: 470229 - DNA, 25 bp, Homo sapien
aagctgcggaacgtgctggtgctga

SEQ ID NO: 470230 - DNA, 25 bp, Homo sapien
gacatgagccaggtgaagcccgtgc

SEQ ID NO: 470231 - DNA, 25 bp, Homo sapien
gaagcccgtgctgtccaaggcagag

SEQ ID NO: 470232 - DNA, 25 bp, Homo sapien
caaggcagagcgcagtcacatcatc

SEQ ID NO: 470233 - DNA, 25 bp, Homo sapien
ataacctaggatatttaagctgtca

SEQ ID NO: 470234 - DNA, 25 bp, Homo sapien
ttaagctgtcagtaatagtgtttta

SEQ ID NO: 470235 - DNA, 25 bp, Homo sapien
tgttttaaaactccaggcctataat

SEQ ID NO: 470236 - DNA, 25 bp, Homo sapien
agtgtgtctgataaaatgggttttt

SEQ ID NO: 470237 - DNA, 25 bp, Homo sapien
gtaaatgtcttctgtttctcgctaa

SEQ ID NO: 470238 - DNA, 25 bp, Homo sapien
ttctcgctaaacattgtcacttgcc

SEQ ID NO: 470239 - DNA, 25 bp, Homo sapien
gtcacttgccaaaccatgttttctg

SEQ ID NO: 470240 - DNA, 25 bp, Homo sapien
atactaattttctactggcagtgag

SEQ ID NO: 470241 - DNA, 25 bp, Homo sapien
ggcagtgagaccagcggaatctaag

SEQ ID NO: 470242 - DNA, 25 bp, Homo sapien
ggaagtcaaccattagcaaccctag

SEQ ID NO: 470243 - DNA, 25 bp, Homo sapien
ccctagctcctctttaatctcaaga

SEQ ID NO: 470244 - DNA, 25 bp, Homo sapien
aaaattattatataggccaggtgcg

SEQ ID NO: 470245 - DNA, 25 bp, Homo sapien
aaattattatataggccaggtgcgg

SEQ ID NO: 470246 - DNA, 25 bp, Homo sapien
atacaagaattaaccagatgtggta

SEQ ID NO: 470247 - DNA, 25 bp, Homo sapien
acaagaattaaccagatgtggtagc

SEQ ID NO: 470248 - DNA, 25 bp, Homo sapien
agaattaaccagatgtggtagcggc

SEQ ID NO: 470249 - DNA, 25 bp, Homo sapien
gaattaaccagatgtggtagcggcg

SEQ ID NO: 470250 - DNA, 25 bp, Homo sapien
aattaaccagatgtggtagcggcgg

SEQ ID NO: 470251 - DNA, 25 bp, Homo sapien
ttaaccagatgtggtagcggcgggc

SEQ ID NO: 470252 - DNA, 25 bp, Homo sapien
aaccagatgtggtagcggcgggcac

SEQ ID NO: 470253 - DNA, 25 bp, Homo sapien
accagatgtggtagcggcgggcacc

SEQ ID NO: 470254 - DNA, 25 bp, Homo sapien
ccagatgtggtagcggcgggcacct

SEQ ID NO: 470255 - DNA, 25 bp, Homo sapien
gtctgttgaaggatcctgcttaatt

SEQ ID NO: 470256 - DNA, 25 bp, Homo sapien
gcttaatttatcttaggttcccagg

SEQ ID NO: 470257 - DNA, 25 bp, Homo sapien
taggttcccaggaccggtcacatgg

SEQ ID NO: 470258 - DNA, 25 bp, Homo sapien
ccggtcacatggtcaggcacataat

SEQ ID NO: 470259 - DNA, 25 bp, Homo sapien
ggtcaggcacataatacatgctcat

SEQ ID NO: 470260 - DNA, 25 bp, Homo sapien
atacatgctcattaagtgcttgttg

SEQ ID NO: 470261 - DNA, 25 bp, Homo sapien
taggtgaataaacccatgcaggcat

SEQ ID NO: 470262 - DNA, 25 bp, Homo sapien
aaagatgacaccttcaacctcttgt

SEQ ID NO: 470263 - DNA, 25 bp, Homo sapien
aagctggagggaggaagcccattca

SEQ ID NO: 470264 - DNA, 25 bp, Homo sapien
gaagcccattcaagtttctggccag

SEQ ID NO: 470265 - DNA, 25 bp, Homo sapien
gtgtctcctcacttggtttcaggaa

SEQ ID NO: 470266 - DNA, 25 bp, Homo sapien
aagtagcaaattcaactaaagagcc

SEQ ID NO: 470267 - DNA, 25 bp, Homo sapien
agtagcaaattcaactaaagagcct

SEQ ID NO: 470268 - DNA, 25 bp, Homo sapien
gtagcaaattcaactaaagagcctg

SEQ ID NO: 470269 - DNA, 25 bp, Homo sapien
tagcaaattcaactaaagagcctgg

SEQ ID NO: 470270 - DNA, 25 bp, Homo sapien
gcaaattcaactaaagagcctgggc

SEQ ID NO: 470271 - DNA, 25 bp, Homo sapien
caaattcaactaaagagcctgggca

SEQ ID NO: 470272 - DNA, 25 bp, Homo sapien
aaattcaactaaagagcctgggcac

SEQ ID NO: 470273 - DNA, 25 bp, Homo sapien
aattcaactaaagagcctgggcaca

SEQ ID NO: 470274 - DNA, 25 bp, Homo sapien
attcaactaaagagcctgggcacag

SEQ ID NO: 470275 - DNA, 25 bp, Homo sapien
ttcaactaaagagcctgggcacagt

SEQ ID NO: 470276 - DNA, 25 bp, Homo sapien
cataccactgcactcggttctgggt

SEQ ID NO: 470277 - DNA, 25 bp, Homo sapien
tatttgcctaagatgaagtgctaca

SEQ ID NO: 470278 - DNA, 25 bp, Homo sapien
gaagtgctacatactgtaacagtaa

SEQ ID NO: 470279 - DNA, 25 bp, Homo sapien
gagcatctcattactagaatttcct

SEQ ID NO: 470280 - DNA, 25 bp, Homo sapien
tagaatttcctgagtatgccaagtc

SEQ ID NO: 470281 - DNA, 25 bp, Homo sapien
caagtcctcatttggctttgaagtg

SEQ ID NO: 470282 - DNA, 25 bp, Homo sapien
aagtgagtttgttgtgctgtgcaca

SEQ ID NO: 470283 - DNA, 25 bp, Homo sapien
cacagtgtgggtgttacaatgaacg

SEQ ID NO: 470284 - DNA, 25 bp, Homo sapien
gagggaatcctatagtcattgcttc

SEQ ID NO: 470285 - DNA, 25 bp, Homo sapien
attgcttcatgatccactgtcttga

SEQ ID NO: 470286 - DNA, 25 bp, Homo sapien
cactgtcttgatatggttgttctac

SEQ ID NO: 470287 - DNA, 25 bp, Homo sapien
ggttgttctactgttgatattgttc

SEQ ID NO: 470288 - DNA, 25 bp, Homo sapien
ggaaaaagacaatgccatggcccaa

SEQ ID NO: 470289 - DNA, 25 bp, Homo sapien
tgccatggcccaaaggacatgcttt

SEQ ID NO: 470290 - DNA, 25 bp, Homo sapien
aaggacatgctttggatgcctcttt

SEQ ID NO: 470291 - DNA, 25 bp, Homo sapien
ttcctgctggcagacatagccaaga

SEQ ID NO: 470292 - DNA, 25 bp, Homo sapien
agaaggtacttcctcttctgtggca

SEQ ID NO: 470293 - DNA, 25 bp, Homo sapien
gaaaactgaaatcccagcgtcccat

SEQ ID NO: 470294 - DNA, 25 bp, Homo sapien
cattcctcgcttcgtggtgttgaga

SEQ ID NO: 470295 - DNA, 25 bp, Homo sapien
agccatgtgatatcatgactcgcaa

SEQ ID NO: 470296 - DNA, 25 bp, Homo sapien
tggacatccaggacccagcagacat

SEQ ID NO: 470297 - DNA, 25 bp, Homo sapien
atgagagtagatcctgcttcctcgt

SEQ ID NO: 470298 - DNA, 25 bp, Homo sapien
tggcaggccagttccatggtatgat

SEQ ID NO: 470299 - DNA, 25 bp, Homo sapien
caccggcctcaatgggttagagatc

SEQ ID NO: 470300 - DNA, 25 bp, Homo sapien
ggcctcaatgggttagagatcctgc

SEQ ID NO: 470301 - DNA, 25 bp, Homo sapien
ctcaatgggttagagatcctgcctt

SEQ ID NO: 470302 - DNA, 25 bp, Homo sapien
cacccctcacagttcatttcattgg

SEQ ID NO: 470303 - DNA, 25 bp, Homo sapien
ccctcacagttcatttcattggcca

SEQ ID NO: 470304 - DNA, 25 bp, Homo sapien
cattggccaaaactttcctatgtgg

SEQ ID NO: 470305 - DNA, 25 bp, Homo sapien
ggccaaaactttcctatgtggagct

SEQ ID NO: 470306 - DNA, 25 bp, Homo sapien
aaaactttcctatgtggagctgact

SEQ ID NO: 470307 - DNA, 25 bp, Homo sapien
aactttcctatgtggagctgactag

SEQ ID NO: 470308 - DNA, 25 bp, Homo sapien
gagctgactaggaatcaaagtcata

SEQ ID NO: 470309 - DNA, 25 bp, Homo sapien
caaagtcataaaattctagcctgtt

SEQ ID NO: 470310 - DNA, 25 bp, Homo sapien
ccaaagcactggaatcataggcata

SEQ ID NO: 470311 - DNA, 25 bp, Homo sapien
aatcataggcataaaccacagtggc

SEQ ID NO: 470312 - DNA, 25 bp, Homo sapien
ccacagtggccagccggaactggga

SEQ ID NO: 470313 - DNA, 25 bp, Homo sapien
gccagccggaactgggatttgaatc

SEQ ID NO: 470314 - DNA, 25 bp, Homo sapien
tttgaatccaggtcggtgtgactcc

SEQ ID NO: 470315 - DNA, 25 bp, Homo sapien
atccaggtcggtgtgactcctgagc

SEQ ID NO: 470316 - DNA, 25 bp, Homo sapien
tgtcctccaagcaccaagctacact

SEQ ID NO: 470317 - DNA, 25 bp, Homo sapien
tggcaccgactcacctacaaagctg

SEQ ID NO: 470318 - DNA, 25 bp, Homo sapien
agatctggggcaatttgctatgcag

SEQ ID NO: 470319 - DNA, 25 bp, Homo sapien
actaatacaggtgtcatcagtacat

SEQ ID NO: 470320 - DNA, 25 bp, Homo sapien
tacaggtgtcatcagtacataaatg

SEQ ID NO: 470321 - DNA, 25 bp, Homo sapien
caggccaggacagtggtgcatgcca

SEQ ID NO: 470322 - DNA, 25 bp, Homo sapien
gccaggacagtggtgcatgccagtc

SEQ ID NO: 470323 - DNA, 25 bp, Homo sapien
ccaggacagtggtgcatgccagtca

SEQ ID NO: 470324 - DNA, 25 bp, Homo sapien
caggacagtggtgcatgccagtcat

SEQ ID NO: 470325 - DNA, 25 bp, Homo sapien
aggacagtggtgcatgccagtcatc

SEQ ID NO: 470326 - DNA, 25 bp, Homo sapien
ggacagtggtgcatgccagtcatcc

SEQ ID NO: 470327 - DNA, 25 bp, Homo sapien
gacagtggtgcatgccagtcatccc

SEQ ID NO: 470328 - DNA, 25 bp, Homo sapien
acagtggtgcatgccagtcatccca

SEQ ID NO: 470329 - DNA, 25 bp, Homo sapien
gtgcatgccagtcatcccagcaatt

SEQ ID NO: 470330 - DNA, 25 bp, Homo sapien
agcctggagatgtagaggctgcaat

SEQ ID NO: 470331 - DNA, 25 bp, Homo sapien
gcctggagatgtagaggctgcaatg

SEQ ID NO: 470332 - DNA, 25 bp, Homo sapien
ggtgagcagccactgacttctgctc

SEQ ID NO: 470333 - DNA, 25 bp, Homo sapien
gccactgacttctgctctgtaagag

SEQ ID NO: 470334 - DNA, 25 bp, Homo sapien
acttctgctctgtaagagcacgctt

SEQ ID NO: 470335 - DNA, 25 bp, Homo sapien
gagcacgctttaatgcattctgagt

SEQ ID NO: 470336 - DNA, 25 bp, Homo sapien
acgctttaatgcattctgagtatca

SEQ ID NO: 470337 - DNA, 25 bp, Homo sapien
tctgagtatcacacattctcctttt

SEQ ID NO: 470338 - DNA, 25 bp, Homo sapien
gtataaagttgccagatcctcaccc

SEQ ID NO: 470339 - DNA, 25 bp, Homo sapien
tcacccccaaagtgtggcacaatat

SEQ ID NO: 470340 - DNA, 25 bp, Homo sapien
gtgtggcacaatattaacgcctcta

SEQ ID NO: 470341 - DNA, 25 bp, Homo sapien
caatattaacgcctctaggcaggca

SEQ ID NO: 470342 - DNA, 25 bp, Homo sapien
tctaggcaggcacgactgcgtgcct

SEQ ID NO: 470343 - DNA, 25 bp, Homo sapien
cttaagagtgtggcttcttggccgg

SEQ ID NO: 470344 - DNA, 25 bp, Homo sapien
gcccaggagggctcaagtggagatt

SEQ ID NO: 470345 - DNA, 25 bp, Homo sapien
cccaggagggctcaagtggagattg

SEQ ID NO: 470346 - DNA, 25 bp, Homo sapien
ccaggagggctcaagtggagattgc

SEQ ID NO: 470347 - DNA, 25 bp, Homo sapien
caggagggctcaagtggagattgca

SEQ ID NO: 470348 - DNA, 25 bp, Homo sapien
aggagggctcaagtggagattgcag

SEQ ID NO: 470349 - DNA, 25 bp, Homo sapien
ggagggctcaagtggagattgcagt

SEQ ID NO: 470350 - DNA, 25 bp, Homo sapien
gagggctcaagtggagattgcagtg

SEQ ID NO: 470351 - DNA, 25 bp, Homo sapien
aagcatatagacttcaaaatcagac

SEQ ID NO: 470352 - DNA, 25 bp, Homo sapien
aaatcagacctaacactgtacattg

SEQ ID NO: 470353 - DNA, 25 bp, Homo sapien
gacctaacactgtacattgtcaaaa

SEQ ID NO: 470354 - DNA, 25 bp, Homo sapien
gaatatacagcaagagtgggcctta

SEQ ID NO: 470355 - DNA, 25 bp, Homo sapien
tatacagcaagagtgggccttaata

SEQ ID NO: 470356 - DNA, 25 bp, Homo sapien
taatctatggaattcaggtgacaat

SEQ ID NO: 470357 - DNA, 25 bp, Homo sapien
gatgtattaatttatgttcgtcaac

SEQ ID NO: 470358 - DNA, 25 bp, Homo sapien
taatttatgttcgtcaactgtaaaa

SEQ ID NO: 470359 - DNA, 25 bp, Homo sapien
gtcaactgtaaaaaatgtaccactc

SEQ ID NO: 470360 - DNA, 25 bp, Homo sapien
aaatgggaaatatctgtatctttca

SEQ ID NO: 470361 - DNA, 25 bp, Homo sapien
gtatctttcattcaattttgctgtg

SEQ ID NO: 470362 - DNA, 25 bp, Homo sapien
aggccacatttcaaaacctgctgca

SEQ ID NO: 470363 - DNA, 25 bp, Homo sapien
agatctggctgtcccctgcatgagc

SEQ ID NO: 470364 - DNA, 25 bp, Homo sapien
gcaaggccttgcagccagtgccaag

SEQ ID NO: 470365 - DNA, 25 bp, Homo sapien
gggagccacagtattcactggctca

SEQ ID NO: 470366 - DNA, 25 bp, Homo sapien
cactggctcagtgctatgttcaaat

SEQ ID NO: 470367 - DNA, 25 bp, Homo sapien
gctatgttcaaattcctccatgtgc

SEQ ID NO: 470368 - DNA, 25 bp, Homo sapien
aaattcctccatgtgcctacagtgg

SEQ ID NO: 470369 - DNA, 25 bp, Homo sapien
gtgcctacagtggaatttcaatcaa

SEQ ID NO: 470370 - DNA, 25 bp, Homo sapien
ggaatttcaatcaaaatcagcttat

SEQ ID NO: 470371 - DNA, 25 bp, Homo sapien
tctttcctttgcaatctgagtgtgg

SEQ ID NO: 470372 - DNA, 25 bp, Homo sapien
aatctgagtgtggtgccagccatct

SEQ ID NO: 470373 - DNA, 25 bp, Homo sapien
atttaattctgagtgttctgctcct

SEQ ID NO: 470374 - DNA, 25 bp, Homo sapien
acaacaaacctctggaaagatattc

SEQ ID NO: 470375 - DNA, 25 bp, Homo sapien
aagatattcctttgtggccagttct

SEQ ID NO: 470376 - DNA, 25 bp, Homo sapien
ttcctttgtggccagttctccatca

SEQ ID NO: 470377 - DNA, 25 bp, Homo sapien
ggtgatctgatagcgcccaaggaca

SEQ ID NO: 470378 - DNA, 25 bp, Homo sapien
tctgatagcgcccaaggacaggctg

SEQ ID NO: 470379 - DNA, 25 bp, Homo sapien
tcaccaactctgtggcttctaggtc

SEQ ID NO: 470380 - DNA, 25 bp, Homo sapien
gtggcttctaggtcccgatgtagac

SEQ ID NO: 470381 - DNA, 25 bp, Homo sapien
gatgtagaccaacaaatgacctgag

SEQ ID NO: 470382 - DNA, 25 bp, Homo sapien
aaatgacctgagcagagctatagct

SEQ ID NO: 470383 - DNA, 25 bp, Homo sapien
gagctatagctcgatccaactgtgg

SEQ ID NO: 470384 - DNA, 25 bp, Homo sapien
aggaaaagttctctagtcttgctag

SEQ ID NO: 470385 - DNA, 25 bp, Homo sapien
gtcttgctagaaaggttgacattca

SEQ ID NO: 470386 - DNA, 25 bp, Homo sapien
gaaattcagagaacacctgtgggat

SEQ ID NO: 470387 - DNA, 25 bp, Homo sapien
agtaaacaagatgcccattcctaag

SEQ ID NO: 470388 - DNA, 25 bp, Homo sapien
ttcctaaggcatccacagtcattag

SEQ ID NO: 470389 - DNA, 25 bp, Homo sapien
ggcatccacagtcattagaatagct

SEQ ID NO: 470390 - DNA, 25 bp, Homo sapien
atagctgtggtcaatgcaaaagaaa

SEQ ID NO: 470391 - DNA, 25 bp, Homo sapien
gcagctcaaacaaagggccaaatta

SEQ ID NO: 470392 - DNA, 25 bp, Homo sapien
gattaacaacagacttagcagcaga

SEQ ID NO: 470393 - DNA, 25 bp, Homo sapien
aacagacttagcagcagataccctg

SEQ ID NO: 470394 - DNA, 25 bp, Homo sapien
gataccctgcaacctagaaaagatt

SEQ ID NO: 470395 - DNA, 25 bp, Homo sapien
ttgttatcgatttgttccttctctc

SEQ ID NO: 470396 - DNA, 25 bp, Homo sapien
tctcgcttcctttgtaggcatgttg

SEQ ID NO: 470397 - DNA, 25 bp, Homo sapien
gtgaatccagtgtcttatcatctga

SEQ ID NO: 470398 - DNA, 25 bp, Homo sapien
atctgagacctattcatgttttctg

SEQ ID NO: 470399 - DNA, 25 bp, Homo sapien
agttctttcctattgcctgtatcat

SEQ ID NO: 470400 - DNA, 25 bp, Homo sapien
gtatcatctatttcttccgagttct

SEQ ID NO: 470401 - DNA, 25 bp, Homo sapien
gagttcttttattcagttcattcct

SEQ ID NO: 470402 - DNA, 25 bp, Homo sapien
atgaacacaggccatccaaacgagg

SEQ ID NO: 470403 - DNA, 25 bp, Homo sapien
caaacgaggcttagtgtgcacgggt

SEQ ID NO: 470404 - DNA, 25 bp, Homo sapien
gtgcacgggtcatgttcaactgtaa

SEQ ID NO: 470405 - DNA, 25 bp, Homo sapien
atggtgagctcactttttgcttggg

SEQ ID NO: 470406 - DNA, 25 bp, Homo sapien
tgcccttaacaaaggtcacaagcta

SEQ ID NO: 470407 - DNA, 25 bp, Homo sapien
gcccttaacaaaggtcacaagctag

SEQ ID NO: 470408 - DNA, 25 bp, Homo sapien
cccttaacaaaggtcacaagctagg

SEQ ID NO: 470409 - DNA, 25 bp, Homo sapien
ccttaacaaaggtcacaagctaggc

SEQ ID NO: 470410 - DNA, 25 bp, Homo sapien
cttaacaaaggtcacaagctaggct

SEQ ID NO: 470411 - DNA, 25 bp, Homo sapien
ttaacaaaggtcacaagctaggctg

SEQ ID NO: 470412 - DNA, 25 bp, Homo sapien
taacaaaggtcacaagctaggctgg

SEQ ID NO: 470413 - DNA, 25 bp, Homo sapien
caaaggtcacaagctaggctgggcg

SEQ ID NO: 470414 - DNA, 25 bp, Homo sapien
aaaggtcacaagctaggctgggcgt

SEQ ID NO: 470415 - DNA, 25 bp, Homo sapien
aaggtcacaagctaggctgggcgtg

SEQ ID NO: 470416 - DNA, 25 bp, Homo sapien
aggtcacaagctaggctgggcgtgg

SEQ ID NO: 470417 - DNA, 25 bp, Homo sapien
ttgccttttaaaagtaagcgtagat

SEQ ID NO: 470418 - DNA, 25 bp, Homo sapien
tgccttttaaaagtaagcgtagatg

SEQ ID NO: 470419 - DNA, 25 bp, Homo sapien
gccttttaaaagtaagcgtagatgt

SEQ ID NO: 470420 - DNA, 25 bp, Homo sapien
ccttttaaaagtaagcgtagatgtg

SEQ ID NO: 470421 - DNA, 25 bp, Homo sapien
ttttaaaagtaagcgtagatgtggc

SEQ ID NO: 470422 - DNA, 25 bp, Homo sapien
ttaaaagtaagcgtagatgtggctg

SEQ ID NO: 470423 - DNA, 25 bp, Homo sapien
taaaagtaagcgtagatgtggctgg

SEQ ID NO: 470424 - DNA, 25 bp, Homo sapien
aaagtaagcgtagatgtggctgggc

SEQ ID NO: 470425 - DNA, 25 bp, Homo sapien
aagtaagcgtagatgtggctgggcg

SEQ ID NO: 470426 - DNA, 25 bp, Homo sapien
agtaagcgtagatgtggctgggcgc

SEQ ID NO: 470427 - DNA, 25 bp, Homo sapien
gtaagcgtagatgtggctgggcgcg

SEQ ID NO: 470428 - DNA, 25 bp, Homo sapien
ccaccaagctgagccttgctgaaga

SEQ ID NO: 470429 - DNA, 25 bp, Homo sapien
gccttgctgaagaccaggactccat

SEQ ID NO: 470430 - DNA, 25 bp, Homo sapien
ggccaagaagactattttttaagca

SEQ ID NO: 470431 - DNA, 25 bp, Homo sapien
ctattttttaagcaaggtctgtggg

SEQ ID NO: 470432 - DNA, 25 bp, Homo sapien
ttcagtgattttgtatgggatggat

SEQ ID NO: 470433 - DNA, 25 bp, Homo sapien
tgggtggcccctcttaggcccatgt

SEQ ID NO: 470434 - DNA, 25 bp, Homo sapien
ccctcttaggcccatgtgttcacag

SEQ ID NO: 470435 - DNA, 25 bp, Homo sapien
gttcacagtctgtggatgtatcccc

SEQ ID NO: 470436 - DNA, 25 bp, Homo sapien
tctcctgggagatgtaagcgactcc

SEQ ID NO: 470437 - DNA, 25 bp, Homo sapien
gaccatgtgtggttcacgcttgttc

SEQ ID NO: 470438 - DNA, 25 bp, Homo sapien
ggttcacgcttgttcccagaaagct

SEQ ID NO: 470439 - DNA, 25 bp, Homo sapien
aaacctgcatatttcaacacttgac

SEQ ID NO: 470440 - DNA, 25 bp, Homo sapien
aaagcctaccaataaatcactgaaa

SEQ ID NO: 470441 - DNA, 25 bp, Homo sapien
gctgaacacaaaagtagctggcttt

SEQ ID NO: 470442 - DNA, 25 bp, Homo sapien
gctggctttggaaataatactgctt

SEQ ID NO: 470443 - DNA, 25 bp, Homo sapien
aatactgctttacatttgagtctag

SEQ ID NO: 470444 - DNA, 25 bp, Homo sapien
atttgagtctagattccaccattta

SEQ ID NO: 470445 - DNA, 25 bp, Homo sapien
gattccaccatttatcattctgtaa

SEQ ID NO: 470446 - DNA, 25 bp, Homo sapien
tgtaatcctgaacacactacctctt

SEQ ID NO: 470447 - DNA, 25 bp, Homo sapien
cacactacctcttcaatctcagatt

SEQ ID NO: 470448 - DNA, 25 bp, Homo sapien
gggcataaaagctacattttcgtta

SEQ ID NO: 470449 - DNA, 25 bp, Homo sapien
ctacattttcgttagctgttctaag

SEQ ID NO: 470450 - DNA, 25 bp, Homo sapien
caactattttgcttatgtgatagat

SEQ ID NO: 470451 - DNA, 25 bp, Homo sapien
ttatatggttactaggattcagaag

SEQ ID NO: 470452 - DNA, 25 bp, Homo sapien
gaagtaaatctatttagtgatctgt

SEQ ID NO: 470453 - DNA, 25 bp, Homo sapien
taatatgtcagttattgccctttta

SEQ ID NO: 470454 - DNA, 25 bp, Homo sapien
attgcccttttatattgtgaatgta

SEQ ID NO: 470455 - DNA, 25 bp, Homo sapien
tgtgaatgtaatgtgcataagctat

SEQ ID NO: 470456 - DNA, 25 bp, Homo sapien
gtgcataagctatatccgtagatgt

SEQ ID NO: 470457 - DNA, 25 bp, Homo sapien
tatccgtagatgttattgttttatc

SEQ ID NO: 470458 - DNA, 25 bp, Homo sapien
tatctcatgtgtaattgtgggcctt

SEQ ID NO: 470459 - DNA, 25 bp, Homo sapien
gtgggcctttataaaattgtgttgt

SEQ ID NO: 470460 - DNA, 25 bp, Homo sapien
aattgtgttgtaagatatcaagcaa

SEQ ID NO: 470461 - DNA, 25 bp, Homo sapien
tgctcactgctgtgagtctccactg

SEQ ID NO: 470462 - DNA, 25 bp, Homo sapien
ctgctgtgagtctccactggctcca

SEQ ID NO: 470463 - DNA, 25 bp, Homo sapien
acagatccacgcagccacggcatgg

SEQ ID NO: 470464 - DNA, 25 bp, Homo sapien
acggcatggcaaggcctctgtttca

SEQ ID NO: 470465 - DNA, 25 bp, Homo sapien
catggcaaggcctctgtttcatgca

SEQ ID NO: 470466 - DNA, 25 bp, Homo sapien
ctctgtttcatgcagtgtttaaaag

SEQ ID NO: 470467 - DNA, 25 bp, Homo sapien
ttcatgcagtgtttaaaagtcagac

SEQ ID NO: 470468 - DNA, 25 bp, Homo sapien
aagtcagacagcaacacagacgtgc

SEQ ID NO: 470469 - DNA, 25 bp, Homo sapien
gacagcaacacagacgtgcgggaag

SEQ ID NO: 470470 - DNA, 25 bp, Homo sapien
gtgcgggaaggtttcaccccacgca

SEQ ID NO: 470471 - DNA, 25 bp, Homo sapien
cgggaaggtttcaccccacgcagag

SEQ ID NO: 470472 - DNA, 25 bp, Homo sapien
aggtttgtgagtgcagcaatgacac

SEQ ID NO: 470473 - DNA, 25 bp, Homo sapien
ggtttgtgagtgcagcaatgacact

SEQ ID NO: 470474 - DNA, 25 bp, Homo sapien
ttgtgagtgcagcaatgacactctg

SEQ ID NO: 470475 - DNA, 25 bp, Homo sapien
tgtgagtgcagcaatgacactctgt

SEQ ID NO: 470476 - DNA, 25 bp, Homo sapien
gagtgcagcaatgacactctgtatc

SEQ ID NO: 470477 - DNA, 25 bp, Homo sapien
agtgcagcaatgacactctgtatct

SEQ ID NO: 470478 - DNA, 25 bp, Homo sapien
ttatgtccatactctgtatctaact

SEQ ID NO: 470479 - DNA, 25 bp, Homo sapien
cagtgctctgtcaaaacacacccct

SEQ ID NO: 470480 - DNA, 25 bp, Homo sapien
tgctctgtcaaaacacacccctcgg

SEQ ID NO: 470481 - DNA, 25 bp, Homo sapien
tctgtcaaaacacacccctcggctc

SEQ ID NO: 470482 - DNA, 25 bp, Homo sapien
aaacacacccctcggctctaccaat

SEQ ID NO: 470483 - DNA, 25 bp, Homo sapien
gaatgttggcatgcatttgacttca

SEQ ID NO: 470484 - DNA, 25 bp, Homo sapien
gcatttgacttcacactctgaagca

SEQ ID NO: 470485 - DNA, 25 bp, Homo sapien
ttcacactctgaagcaacatcatga

SEQ ID NO: 470486 - DNA, 25 bp, Homo sapien
ttgatcattttgcaaggcccacacc

SEQ ID NO: 470487 - DNA, 25 bp, Homo sapien
gactaattcattaatggtggcttca

SEQ ID NO: 470488 - DNA, 25 bp, Homo sapien
caaggcccacaccacgtggctgaga

SEQ ID NO: 470489 - DNA, 25 bp, Homo sapien
gtggctgagaagtcaactactacaa

SEQ ID NO: 470490 - DNA, 25 bp, Homo sapien
ctacaagtttatcacctgcagcgtc

SEQ ID NO: 470491 - DNA, 25 bp, Homo sapien
aaggcttcctgaaaagcagtcttgc

SEQ ID NO: 470492 - DNA, 25 bp, Homo sapien
aaagcagtcttgctctcgatctgct

SEQ ID NO: 470493 - DNA, 25 bp, Homo sapien
ggtggcttcaagcttttccttattg

SEQ ID NO: 470494 - DNA, 25 bp, Homo sapien
ggaataccccagttgtgaaagtact

SEQ ID NO: 470495 - DNA, 25 bp, Homo sapien
ccagttgtgaaagtacttcctgtaa

SEQ ID NO: 470496 - DNA, 25 bp, Homo sapien
ggcaacatctgacaccaggaacctt

SEQ ID NO: 470497 - DNA, 25 bp, Homo sapien
ccaggaacctttctcttcagtattt

SEQ ID NO: 470498 - DNA, 25 bp, Homo sapien
acttaatttcagtcctttacttgtg

SEQ ID NO: 470499 - DNA, 25 bp, Homo sapien
ttcagtcctttacttgtggaatcag

SEQ ID NO: 470500 - DNA, 25 bp, Homo sapien
acttgtggaatcagagccttactta

SEQ ID NO: 470501 - DNA, 25 bp, Homo sapien
ggaatcagagccttacttatgtaat

SEQ ID NO: 470502 - DNA, 25 bp, Homo sapien
cttatgtaatacaacccactggaaa

SEQ ID NO: 470503 - DNA, 25 bp, Homo sapien
aaagctttttattgtattgtactat

SEQ ID NO: 470504 - DNA, 25 bp, Homo sapien
gtgattgagtacctgcagagctttc

SEQ ID NO: 470505 - DNA, 25 bp, Homo sapien
gacattcttgatcatggacaaaaca

SEQ ID NO: 470506 - DNA, 25 bp, Homo sapien
ttttccagataaactctcgctcttg

SEQ ID NO: 470507 - DNA, 25 bp, Homo sapien
ataaactctcgctcttggatcctct

SEQ ID NO: 470508 - DNA, 25 bp, Homo sapien
ctcttggatcctctaagctcttaaa

SEQ ID NO: 470509 - DNA, 25 bp, Homo sapien
aagctcttaaacttcctgagataac

SEQ ID NO: 470510 - DNA, 25 bp, Homo sapien
acttcctgagataacactttgcctg

SEQ ID NO: 470511 - DNA, 25 bp, Homo sapien
gagataacactttgcctggtcttac

SEQ ID NO: 470512 - DNA, 25 bp, Homo sapien
tgcctggtcttacccaaagcagcaa

SEQ ID NO: 470513 - DNA, 25 bp, Homo sapien
aagcagcaaacatgggacgttttga

SEQ ID NO: 470514 - DNA, 25 bp, Homo sapien
gaaaatccatcacttcattgtctaa

SEQ ID NO: 470515 - DNA, 25 bp, Homo sapien
gattaaaatttaacgtgcacctgaa

SEQ ID NO: 470516 - DNA, 25 bp, Homo sapien
tgggtgatacagcacaactctaagc

SEQ ID NO: 470517 - DNA, 25 bp, Homo sapien
gacccgagggtctaaggaggcctct

SEQ ID NO: 470518 - DNA, 25 bp, Homo sapien
agtggatttccaggcctccagaggt

SEQ ID NO: 470519 - DNA, 25 bp, Homo sapien
ggcctccagaggtcagattccttaa

SEQ ID NO: 470520 - DNA, 25 bp, Homo sapien
cagattccttaaccagtgagtagta

SEQ ID NO: 470521 - DNA, 25 bp, Homo sapien
gagtagtatctggacatttatgggt

SEQ ID NO: 470522 - DNA, 25 bp, Homo sapien
aactctccagggaaagtttcatctt

SEQ ID NO: 470523 - DNA, 25 bp, Homo sapien
tttcatctttagttacactccaggt

SEQ ID NO: 470524 - DNA, 25 bp, Homo sapien
ttacactccaggttgtgccttctat

SEQ ID NO: 470525 - DNA, 25 bp, Homo sapien
gtgccttctattctggccaagatgc

SEQ ID NO: 470526 - DNA, 25 bp, Homo sapien
ttctggccaagatgcgtttcttata

SEQ ID NO: 470527 - DNA, 25 bp, Homo sapien
ccttgtgatttgaagcatgaaagtt

SEQ ID NO: 470528 - DNA, 25 bp, Homo sapien
gaagcatgaaagttctggcaggtta

SEQ ID NO: 470529 - DNA, 25 bp, Homo sapien
gttctggcaggttatgagcagcact

SEQ ID NO: 470530 - DNA, 25 bp, Homo sapien
caggttatgagcagcactagggata

SEQ ID NO: 470531 - DNA, 25 bp, Homo sapien
gcagcactagggataaagtatggtt

SEQ ID NO: 470532 - DNA, 25 bp, Homo sapien
ttcaacaaagcccttgtctaaaata

SEQ ID NO: 470533 - DNA, 25 bp, Homo sapien
tctgactgtcagtagaagtgagata

SEQ ID NO: 470534 - DNA, 25 bp, Homo sapien
aagtgagataagatcctcagaggaa

SEQ ID NO: 470535 - DNA, 25 bp, Homo sapien
gatcctcagaggaaacagtaagaag

SEQ ID NO: 470536 - DNA, 25 bp, Homo sapien
aaacaggcaaagcagaatcacatgt

SEQ ID NO: 470537 - DNA, 25 bp, Homo sapien
caggcaaagcagaatcacatgtgca

SEQ ID NO: 470538 - DNA, 25 bp, Homo sapien
gtaacatccttaacgggacatcctg

SEQ ID NO: 470539 - DNA, 25 bp, Homo sapien
acatcctgttgtcctacgctagaaa

SEQ ID NO: 470540 - DNA, 25 bp, Homo sapien
aaggcaactgcaacattctctgaca

SEQ ID NO: 470541 - DNA, 25 bp, Homo sapien
attctctgacacactcccagaagaa

SEQ ID NO: 470542 - DNA, 25 bp, Homo sapien
gtgatgctacctgagcagagcctgt

SEQ ID NO: 470543 - DNA, 25 bp, Homo sapien
gtggctttggataactgctcttgca

SEQ ID NO: 470544 - DNA, 25 bp, Homo sapien
actgctcttgcagctgaggaatgtg

SEQ ID NO: 470545 - DNA, 25 bp, Homo sapien
ggaatgtgtttcttggcctcttgga

SEQ ID NO: 470546 - DNA, 25 bp, Homo sapien
gcctcttggatctcttttagcaatc

SEQ ID NO: 470547 - DNA, 25 bp, Homo sapien
atctttgggcaggtgttcggttgta

SEQ ID NO: 470548 - DNA, 25 bp, Homo sapien
gttcggttgtaatcttcctgcaata

SEQ ID NO: 470549 - DNA, 25 bp, Homo sapien
gctaaaagacactgttctcctacct

SEQ ID NO: 470550 - DNA, 25 bp, Homo sapien
taaaagacactgttctcctacctgg

SEQ ID NO: 470551 - DNA, 25 bp, Homo sapien
gacactgttctcctacctggcaagt

SEQ ID NO: 470552 - DNA, 25 bp, Homo sapien
tcctacctggcaagtctctctttat

SEQ ID NO: 470553 - DNA, 25 bp, Homo sapien
tggcaagtctctctttatccgcaga

SEQ ID NO: 470554 - DNA, 25 bp, Homo sapien
agtctctctttatccgcagagctct

SEQ ID NO: 470555 - DNA, 25 bp, Homo sapien
tctgctcatcatccgacctaaaaat

SEQ ID NO: 470556 - DNA, 25 bp, Homo sapien
gatatagaactaaacagatgcagag

SEQ ID NO: 470557 - DNA, 25 bp, Homo sapien
gaaatggaattataggcaggaacct

SEQ ID NO: 470558 - DNA, 25 bp, Homo sapien
ggcaggaaccttgcctgtaactcta

SEQ ID NO: 470559 - DNA, 25 bp, Homo sapien
gaaccttgcctgtaactctacaaag

SEQ ID NO: 470560 - DNA, 25 bp, Homo sapien
tgggttgtagaccttgtcccagtaa

SEQ ID NO: 470561 - DNA, 25 bp, Homo sapien
ggttgtagaccttgtcccagtaata

SEQ ID NO: 470562 - DNA, 25 bp, Homo sapien
tagaccttgtcccagtaatatctcc

SEQ ID NO: 470563 - DNA, 25 bp, Homo sapien
gaccttgtcccagtaatatctccag

SEQ ID NO: 470564 - DNA, 25 bp, Homo sapien
ttgtcccagtaatatctccagcagc

SEQ ID NO: 470565 - DNA, 25 bp, Homo sapien
gtcccagtaatatctccagcagctc

SEQ ID NO: 470566 - DNA, 25 bp, Homo sapien
gcagctccaacacattttgtcaact

SEQ ID NO: 470567 - DNA, 25 bp, Homo sapien
gctccaacacattttgtcaacttcg

SEQ ID NO: 470568 - DNA, 25 bp, Homo sapien
ccaacacattttgtcaacttcgtat

SEQ ID NO: 470569 - DNA, 25 bp, Homo sapien
agtacagtggggtcatatcggctaa

SEQ ID NO: 470570 - DNA, 25 bp, Homo sapien
gtggggtcatatcggctaactgcaa

SEQ ID NO: 470571 - DNA, 25 bp, Homo sapien
tctgtggtcctgctgtcaagatgct

SEQ ID NO: 470572 - DNA, 25 bp, Homo sapien
tggtcctgctgtcaagatgcttggc

SEQ ID NO: 470573 - DNA, 25 bp, Homo sapien
agatgcttggccctcccacaggcat

SEQ ID NO: 470574 - DNA, 25 bp, Homo sapien
cccacaggcatctgggagtttccct

SEQ ID NO: 470575 - DNA, 25 bp, Homo sapien
tgggagtttccctcagccactgcct

SEQ ID NO: 470576 - DNA, 25 bp, Homo sapien
agccactgcctggagcggttactgc

SEQ ID NO: 470577 - DNA, 25 bp, Homo sapien
cttccacaaatactcccgaaagcta

SEQ ID NO: 470578 - DNA, 25 bp, Homo sapien
aatactcccgaaagctaagccaagt

SEQ ID NO: 470579 - DNA, 25 bp, Homo sapien
caagtggacatgtggctagcagtag

SEQ ID NO: 470580 - DNA, 25 bp, Homo sapien
ttgtgttctccttcgtaatacacgt

SEQ ID NO: 470581 - DNA, 25 bp, Homo sapien
cgtaatacacgtatgcttgagttaa

SEQ ID NO: 470582 - DNA, 25 bp, Homo sapien
ttacctactgaacagaggatgttgt

SEQ ID NO: 470583 - DNA, 25 bp, Homo sapien
cagaggatgttgtacactgattaca

SEQ ID NO: 470584 - DNA, 25 bp, Homo sapien
acactgattacatttaccctttcct

SEQ ID NO: 470585 - DNA, 25 bp, Homo sapien
cctttccttccataggatcatagaa

SEQ ID NO: 470586 - DNA, 25 bp, Homo sapien
catagaagtgttcctattagggaga

SEQ ID NO: 470587 - DNA, 25 bp, Homo sapien
tagggagaattcaggccgtctcaat

SEQ ID NO: 470588 - DNA, 25 bp, Homo sapien
gaattcaggccgtctcaatttctga

SEQ ID NO: 470589 - DNA, 25 bp, Homo sapien
gtccaagaggatagcactggcatct

SEQ ID NO: 470590 - DNA, 25 bp, Homo sapien
gaggatagcactggcatctggcaag

SEQ ID NO: 470591 - DNA, 25 bp, Homo sapien
atcagaatgatggacacagcatctt

SEQ ID NO: 470592 - DNA, 25 bp, Homo sapien
acagcatctttatggcctatctagt

SEQ ID NO: 470593 - DNA, 25 bp, Homo sapien
aataagaagctgtaactttgggcca

SEQ ID NO: 470594 - DNA, 25 bp, Homo sapien
aagaagctgtaactttgggccaggt

SEQ ID NO: 470595 - DNA, 25 bp, Homo sapien
agaagctgtaactttgggccaggtg

SEQ ID NO: 470596 - DNA, 25 bp, Homo sapien
caggaaggtagcttgaagtcaggaa

SEQ ID NO: 470597 - DNA, 25 bp, Homo sapien
atctcagctacttggatgggtgagt

SEQ ID NO: 470598 - DNA, 25 bp, Homo sapien
ctcagctacttggatgggtgagttg

SEQ ID NO: 470599 - DNA, 25 bp, Homo sapien
tgggtgagttgggagcgtcgcttga

SEQ ID NO: 470600 - DNA, 25 bp, Homo sapien
agctgtggttgcactactgagctgt

SEQ ID NO: 470601 - DNA, 25 bp, Homo sapien
gtggttgcactactgagctgtgatt

SEQ ID NO: 470602 - DNA, 25 bp, Homo sapien
ctgtgattgcactcaaggctgggcc

SEQ ID NO: 470603 - DNA, 25 bp, Homo sapien
gattgcactcaaggctgggccacag

SEQ ID NO: 470604 - DNA, 25 bp, Homo sapien
ccccaacagctgtgctcgttttcat

SEQ ID NO: 470605 - DNA, 25 bp, Homo sapien
tttgcccatacattctcctggaatg

SEQ ID NO: 470606 - DNA, 25 bp, Homo sapien
caaatcccatcacctctggaagtct

SEQ ID NO: 470607 - DNA, 25 bp, Homo sapien
tggaagtctcctattcgctagctgt

SEQ ID NO: 470608 - DNA, 25 bp, Homo sapien
gtgtccctgggaaagtctgccaggc

SEQ ID NO: 470609 - DNA, 25 bp, Homo sapien
actgatctccccatcgggaagctgg

SEQ ID NO: 470610 - DNA, 25 bp, Homo sapien
tcgggaagctgggacattacttgtt

SEQ ID NO: 470611 - DNA, 25 bp, Homo sapien
attacttgtttaagccgcctgtgac

SEQ ID NO: 470612 - DNA, 25 bp, Homo sapien
aagccgcctgtgacagtgaatgctc

SEQ ID NO: 470613 - DNA, 25 bp, Homo sapien
agtgaatgctcagtccgagtctcta

SEQ ID NO: 470614 - DNA, 25 bp, Homo sapien
tcagtccgagtctctacttggttcc

SEQ ID NO: 470615 - DNA, 25 bp, Homo sapien
agaaggccaagaatccctcgctggt

SEQ ID NO: 470616 - DNA, 25 bp, Homo sapien
aaggccaagaatccctcgctggtgg

SEQ ID NO: 470617 - DNA, 25 bp, Homo sapien
aagaatccctcgctggtggccaagt

SEQ ID NO: 470618 - DNA, 25 bp, Homo sapien
gccttgggacaataagacggacatg

SEQ ID NO: 470619 - DNA, 25 bp, Homo sapien
gggacaataagacggacatgaccca

SEQ ID NO: 470620 - DNA, 25 bp, Homo sapien
ctctatccagctggatgggctagtg

SEQ ID NO: 470621 - DNA, 25 bp, Homo sapien
tatccagctggatgggctagtgagc

SEQ ID NO: 470622 - DNA, 25 bp, Homo sapien
gggcctccaagctggcgtccgtggg

SEQ ID NO: 470623 - DNA, 25 bp, Homo sapien
cgtccgtgggctatggtatccggaa

SEQ ID NO: 470624 - DNA, 25 bp, Homo sapien
tgggctatggtatccggaagatgca

SEQ ID NO: 470625 - DNA, 25 bp, Homo sapien
tatggtatccggaagatgcagattc

SEQ ID NO: 470626 - DNA, 25 bp, Homo sapien
gcaaggctggtctgagatggatctc

SEQ ID NO: 470627 - DNA, 25 bp, Homo sapien
ctctctggctgtatgcaaatattta

SEQ ID NO: 470628 - DNA, 25 bp, Homo sapien
agagcacctgttgggtgtctcgcaa

SEQ ID NO: 470629 - DNA, 25 bp, Homo sapien
agagcaattgctctgaagtccagaa

SEQ ID NO: 470630 - DNA, 25 bp, Homo sapien
gaaatggaattactgtcacgaaaag

SEQ ID NO: 470631 - DNA, 25 bp, Homo sapien
ataattaagcctcctaatgagagca

SEQ ID NO: 470632 - DNA, 25 bp, Homo sapien
gagagcattaatatttccccaatag

SEQ ID NO: 470633 - DNA, 25 bp, Homo sapien
gatttagagcttctttctctgggat

SEQ ID NO: 470634 - DNA, 25 bp, Homo sapien
gcttctttctctgggattgttgcac

SEQ ID NO: 470635 - DNA, 25 bp, Homo sapien
gttgcacaaacttacctgagctggc

SEQ ID NO: 470636 - DNA, 25 bp, Homo sapien
tgagctggccatctatcttgattgt

SEQ ID NO: 470637 - DNA, 25 bp, Homo sapien
atcatgtctctaggccttcttagga

SEQ ID NO: 470638 - DNA, 25 bp, Homo sapien
atgtctctaggccttcttaggagtg

SEQ ID NO: 470639 - DNA, 25 bp, Homo sapien
gtctctaggccttcttaggagtgat

SEQ ID NO: 470640 - DNA, 25 bp, Homo sapien
ctctaggccttcttaggagtgatag

SEQ ID NO: 470641 - DNA, 25 bp, Homo sapien
ggccttcttaggagtgatagaatct

SEQ ID NO: 470642 - DNA, 25 bp, Homo sapien
gaatctttattagaagcctcctagg

SEQ ID NO: 470643 - DNA, 25 bp, Homo sapien
atctttattagaagcctcctaggcc

SEQ ID NO: 470644 - DNA, 25 bp, Homo sapien
ttattagaagcctcctaggccgggc

SEQ ID NO: 470645 - DNA, 25 bp, Homo sapien
tagaagcctcctaggccgggcgcag

SEQ ID NO: 470646 - DNA, 25 bp, Homo sapien
gctactcgggtgactgaggtatgaa

SEQ ID NO: 470647 - DNA, 25 bp, Homo sapien
ggtgactgaggtatgaaaatcgctt

SEQ ID NO: 470648 - DNA, 25 bp, Homo sapien
tcacagcaagctgactggcgcaggc

SEQ ID NO: 470649 - DNA, 25 bp, Homo sapien
cggtggtggctgtggcatcacactc

SEQ ID NO: 470650 - DNA, 25 bp, Homo sapien
tggcatcacactcctcaagccaggg

SEQ ID NO: 470651 - DNA, 25 bp, Homo sapien
tgactgcttggaaaccagcatcggt

SEQ ID NO: 470652 - DNA, 25 bp, Homo sapien
gcagtacctcgtgctggaagagctc

SEQ ID NO: 470653 - DNA, 25 bp, Homo sapien
acctcgtgctggaagagctcattga

SEQ ID NO: 470654 - DNA, 25 bp, Homo sapien
agagctcattgacatgaaccagcac

SEQ ID NO: 470655 - DNA, 25 bp, Homo sapien
agcaccatctgaatgccctcggcgt

SEQ ID NO: 470656 - DNA, 25 bp, Homo sapien
atctgaatgccctcggcgtgggcca

SEQ ID NO: 470657 - DNA, 25 bp, Homo sapien
agctctgccaggtgaccagggcccg

SEQ ID NO: 470658 - DNA, 25 bp, Homo sapien
cagggcccgcggacttcacagcaag

SEQ ID NO: 470659 - DNA, 25 bp, Homo sapien
acatgaagcaaagtcaagactgcaa

SEQ ID NO: 470660 - DNA, 25 bp, Homo sapien
tgaagcaaagtcaagactgcaaccc

SEQ ID NO: 470661 - DNA, 25 bp, Homo sapien
gaagcaaagtcaagactgcaacccg

SEQ ID NO: 470662 - DNA, 25 bp, Homo sapien
aagcaaagtcaagactgcaacccgg

SEQ ID NO: 470663 - DNA, 25 bp, Homo sapien
agcaaagtcaagactgcaacccggc

SEQ ID NO: 470664 - DNA, 25 bp, Homo sapien
gcaaagtcaagactgcaacccggcc

SEQ ID NO: 470665 - DNA, 25 bp, Homo sapien
caaagtcaagactgcaacccggccg

SEQ ID NO: 470666 - DNA, 25 bp, Homo sapien
aagtcaagactgcaacccggccggg

SEQ ID NO: 470667 - DNA, 25 bp, Homo sapien
tcaagactgcaacccggccgggcgt

SEQ ID NO: 470668 - DNA, 25 bp, Homo sapien
caagcctggccaagacgatgaaatg

SEQ ID NO: 470669 - DNA, 25 bp, Homo sapien
tggccaagacgatgaaatgccatct

SEQ ID NO: 470670 - DNA, 25 bp, Homo sapien
gacaaggcgggaaatggccaattct

SEQ ID NO: 470671 - DNA, 25 bp, Homo sapien
gaaatggccaattcttcagtgaagt

SEQ ID NO: 470672 - DNA, 25 bp, Homo sapien
cttcagtgaagtggccaggagagta

SEQ ID NO: 470673 - DNA, 25 bp, Homo sapien
atctgcagaggcagctgagtgctga

SEQ ID NO: 470674 - DNA, 25 bp, Homo sapien
agcagctcccaactccggaggagga

SEQ ID NO: 470675 - DNA, 25 bp, Homo sapien
tcccaactccggaggaggacgctgg

SEQ ID NO: 470676 - DNA, 25 bp, Homo sapien
tgcccaaggccgagaatgcatgctc

SEQ ID NO: 470677 - DNA, 25 bp, Homo sapien
gagaatgcatgctccagacagcggc

SEQ ID NO: 470678 - DNA, 25 bp, Homo sapien
agacagcggcctttattccatggtg

SEQ ID NO: 470679 - DNA, 25 bp, Homo sapien
agcggcctttattccatggtggaga

SEQ ID NO: 470680 - DNA, 25 bp, Homo sapien
gagacagtgatggttttaagttgaa

SEQ ID NO: 470681 - DNA, 25 bp, Homo sapien
ctggttccacgactgggcttaaaga

SEQ ID NO: 470682 - DNA, 25 bp, Homo sapien
ccacgactgggcttaaagatcagct

SEQ ID NO: 470683 - DNA, 25 bp, Homo sapien
cacgactgggcttaaagatcagctt

SEQ ID NO: 470684 - DNA, 25 bp, Homo sapien
acgactgggcttaaagatcagctta

SEQ ID NO: 470685 - DNA, 25 bp, Homo sapien
cgactgggcttaaagatcagcttag

SEQ ID NO: 470686 - DNA, 25 bp, Homo sapien
gactgggcttaaagatcagcttaga

SEQ ID NO: 470687 - DNA, 25 bp, Homo sapien
actgggcttaaagatcagcttagaa

SEQ ID NO: 470688 - DNA, 25 bp, Homo sapien
tgggcttaaagatcagcttagaaac

SEQ ID NO: 470689 - DNA, 25 bp, Homo sapien
ggcttaaagatcagcttagaaacaa

SEQ ID NO: 470690 - DNA, 25 bp, Homo sapien
taaagatcagcttagaaacaaggag

SEQ ID NO: 470691 - DNA, 25 bp, Homo sapien
gatcagcttagaaacaaggaggaga

SEQ ID NO: 470692 - DNA, 25 bp, Homo sapien
cctgaagctatccaagattcccgaa

SEQ ID NO: 470693 - DNA, 25 bp, Homo sapien
ctgaagctatccaagattcccgaag

SEQ ID NO: 470694 - DNA, 25 bp, Homo sapien
gaagctatccaagattcccgaagcc

SEQ ID NO: 470695 - DNA, 25 bp, Homo sapien
agctatccaagattcccgaagcccg

SEQ ID NO: 470696 - DNA, 25 bp, Homo sapien
ctatccaagattcccgaagcccggt

SEQ ID NO: 470697 - DNA, 25 bp, Homo sapien
caagattcccgaagcccggtcatct

SEQ ID NO: 470698 - DNA, 25 bp, Homo sapien
gaagcccggtcatctcattagcatg

SEQ ID NO: 470699 - DNA, 25 bp, Homo sapien
gcaaaagacacgcatatcactctgg

SEQ ID NO: 470700 - DNA, 25 bp, Homo sapien
caaaagacacgcatatcactctgga

SEQ ID NO: 470701 - DNA, 25 bp, Homo sapien
atatcactctggagattccacgggt

SEQ ID NO: 470702 - DNA, 25 bp, Homo sapien
ctctggagattccacgggttttaga

SEQ ID NO: 470703 - DNA, 25 bp, Homo sapien
attaacttttctctcacctatatag

SEQ ID NO: 470704 - DNA, 25 bp, Homo sapien
gaagtatgctgttttctatcctaga

SEQ ID NO: 470705 - DNA, 25 bp, Homo sapien
tttcacaaaaatcagtttctccttt

SEQ ID NO: 470706 - DNA, 25 bp, Homo sapien
aactgctgtacgtaggactctggac

SEQ ID NO: 470707 - DNA, 25 bp, Homo sapien
gactctggactctcttagatgcttt

SEQ ID NO: 470708 - DNA, 25 bp, Homo sapien
agatgctttttggagatctcagagt

SEQ ID NO: 470709 - DNA, 25 bp, Homo sapien
gagatctcagagttcctaagaataa

SEQ ID NO: 470710 - DNA, 25 bp, Homo sapien
aaggtagcatcatagcagtatttat

SEQ ID NO: 470711 - DNA, 25 bp, Homo sapien
ttttccttgctaatggttattaagc

SEQ ID NO: 470712 - DNA, 25 bp, Homo sapien
agcaactgactgacggactgactgt

SEQ ID NO: 470713 - DNA, 25 bp, Homo sapien
actgactgtcagaggtatacattgg

SEQ ID NO: 470714 - DNA, 25 bp, Homo sapien
tagcagtctcttaaaaacttaaacg

SEQ ID NO: 470715 - DNA, 25 bp, Homo sapien
aaacgtacactaacatatgatctga

SEQ ID NO: 470716 - DNA, 25 bp, Homo sapien
gatcattccactcttaactatttaa

SEQ ID NO: 470717 - DNA, 25 bp, Homo sapien
taatctgcatatgggtattcaaggc

SEQ ID NO: 470718 - DNA, 25 bp, Homo sapien
tcaaggcagttttaattgcaatagc

SEQ ID NO: 470719 - DNA, 25 bp, Homo sapien
aaatagcttgtggtatgccttgcaa

SEQ ID NO: 470720 - DNA, 25 bp, Homo sapien
gtggtatgccttgcaatggaatact

SEQ ID NO: 470721 - DNA, 25 bp, Homo sapien
ttcagcagtgaaatggaccctacaa

SEQ ID NO: 470722 - DNA, 25 bp, Homo sapien
ggaccctacaacataaatggatctg

SEQ ID NO: 470723 - DNA, 25 bp, Homo sapien
aattatcctgaaagatgccagacta

SEQ ID NO: 470724 - DNA, 25 bp, Homo sapien
aagatgccagactatatgattccat

SEQ ID NO: 470725 - DNA, 25 bp, Homo sapien
tataagatatatatagggtagggca

SEQ ID NO: 470726 - DNA, 25 bp, Homo sapien
ataagatatatatagggtagggcat

SEQ ID NO: 470727 - DNA, 25 bp, Homo sapien
taagatatatatagggtagggcatg

SEQ ID NO: 470728 - DNA, 25 bp, Homo sapien
aagatatatatagggtagggcatgg

SEQ ID NO: 470729 - DNA, 25 bp, Homo sapien
agatatatatagggtagggcatggt

SEQ ID NO: 470730 - DNA, 25 bp, Homo sapien
gatatatatagggtagggcatggtg

SEQ ID NO: 470731 - DNA, 25 bp, Homo sapien
atatatatagggtagggcatggtga

SEQ ID NO: 470732 - DNA, 25 bp, Homo sapien
tatatatagggtagggcatggtgac

SEQ ID NO: 470733 - DNA, 25 bp, Homo sapien
atatatagggtagggcatggtgacc

SEQ ID NO: 470734 - DNA, 25 bp, Homo sapien
tatatagggtagggcatggtgaccc

SEQ ID NO: 470735 - DNA, 25 bp, Homo sapien
atatagggtagggcatggtgaccca

SEQ ID NO: 470736 - DNA, 25 bp, Homo sapien
atgaccgaaagtgaccaagaccaag

SEQ ID NO: 470737 - DNA, 25 bp, Homo sapien
gaaagtgaccaagaccaaggcccac

SEQ ID NO: 470738 - DNA, 25 bp, Homo sapien
gcccaccaaggcagcagactgttaa

SEQ ID NO: 470739 - DNA, 25 bp, Homo sapien
ccaaggcagcagactgttaatcaga

SEQ ID NO: 470740 - DNA, 25 bp, Homo sapien
cagacaaacagatctctgagaaggt

SEQ ID NO: 470741 - DNA, 25 bp, Homo sapien
ttgaaggctgaagattgttttgtat

SEQ ID NO: 470742 - DNA, 25 bp, Homo sapien
gttttgtatgatactgcacagcatc

SEQ ID NO: 470743 - DNA, 25 bp, Homo sapien
cagcatcaggcattttaaagcagat

SEQ ID NO: 470744 - DNA, 25 bp, Homo sapien
aaagcagatctttactaaacaggtt

SEQ ID NO: 470745 - DNA, 25 bp, Homo sapien
atgagctaacaagcaggttctctcg

SEQ ID NO: 470746 - DNA, 25 bp, Homo sapien
gtccccaagtagagactagtactac

SEQ ID NO: 470747 - DNA, 25 bp, Homo sapien
ctcagtgccctcctgtgcttctggg

SEQ ID NO: 470748 - DNA, 25 bp, Homo sapien
tcccaaaggagccgtcgcctgcaaa

SEQ ID NO: 470749 - DNA, 25 bp, Homo sapien
aggagccgtcgcctgcaaacccttt

SEQ ID NO: 470750 - DNA, 25 bp, Homo sapien
gtcgcctgcaaaccctttcagggtc

SEQ ID NO: 470751 - DNA, 25 bp, Homo sapien
ctgcaaaccctttcagggtccactt

SEQ ID NO: 470752 - DNA, 25 bp, Homo sapien
tgcaaaccctttcagggtccacttc

SEQ ID NO: 470753 - DNA, 25 bp, Homo sapien
agaacccaaaccagacatcctcagg

SEQ ID NO: 470754 - DNA, 25 bp, Homo sapien
atcctcaggcccctggttggtttgt

SEQ ID NO: 470755 - DNA, 25 bp, Homo sapien
tttcctctttaaaaagatcagcttt

SEQ ID NO: 470756 - DNA, 25 bp, Homo sapien
aaaagatcagctttaggctgggcat

SEQ ID NO: 470757 - DNA, 25 bp, Homo sapien
aaagatcagctttaggctgggcatg

SEQ ID NO: 470758 - DNA, 25 bp, Homo sapien
cttaaaggactaaaatgtcatcgtt

SEQ ID NO: 470759 - DNA, 25 bp, Homo sapien
aaatgtcatcgttatttatcctgat

SEQ ID NO: 470760 - DNA, 25 bp, Homo sapien
atgtcatcgttatttatcctgatta

SEQ ID NO: 470761 - DNA, 25 bp, Homo sapien
gtcatcgttatttatcctgattata

SEQ ID NO: 470762 - DNA, 25 bp, Homo sapien
atcgttatttatcctgattatagcc

SEQ ID NO: 470763 - DNA, 25 bp, Homo sapien
gttatttatcctgattatagcctaa

SEQ ID NO: 470764 - DNA, 25 bp, Homo sapien
atttatcctgattatagcctaatgg

SEQ ID NO: 470765 - DNA, 25 bp, Homo sapien
tatcctgattatagcctaatggtat

SEQ ID NO: 470766 - DNA, 25 bp, Homo sapien
cctgattatagcctaatggtatttt

SEQ ID NO: 470767 - DNA, 25 bp, Homo sapien
attttattttctctacagcaatatg

SEQ ID NO: 470768 - DNA, 25 bp, Homo sapien
tattttctctacagcaatatgactg

SEQ ID NO: 470769 - DNA, 25 bp, Homo sapien
aaggaacattttggctgggaattag

SEQ ID NO: 470770 - DNA, 25 bp, Homo sapien
ggaaaatttcgttctatgtataaca

SEQ ID NO: 470771 - DNA, 25 bp, Homo sapien
cgttctatgtataacatctacgaag

SEQ ID NO: 470772 - DNA, 25 bp, Homo sapien
atctacgaagatgtttaaactgtaa

SEQ ID NO: 470773 - DNA, 25 bp, Homo sapien
taaactgtaattgcatgccatttca

SEQ ID NO: 470774 - DNA, 25 bp, Homo sapien
acagtgaagactgacctactcggga

SEQ ID NO: 470775 - DNA, 25 bp, Homo sapien
gaagactgacctactcgggaatatt

SEQ ID NO: 470776 - DNA, 25 bp, Homo sapien
gacctactcgggaatattaaaatgt

SEQ ID NO: 470777 - DNA, 25 bp, Homo sapien
gggttcacattttggtgataatatt

SEQ ID NO: 470778 - DNA, 25 bp, Homo sapien
atacacccccacattacattttagt

SEQ ID NO: 470779 - DNA, 25 bp, Homo sapien
ttcactttctttaacacccattaat

SEQ ID NO: 470780 - DNA, 25 bp, Homo sapien
cctagattgtacagatctcctgaaa

SEQ ID NO: 470781 - DNA, 25 bp, Homo sapien
agatctcctgaaaattgactcattt

SEQ ID NO: 470782 - DNA, 25 bp, Homo sapien
gactcattttatcaaaccatatcaa

SEQ ID NO: 470783 - DNA, 25 bp, Homo sapien
attaccactagtctcatcagataag

SEQ ID NO: 470784 - DNA, 25 bp, Homo sapien
gtctcatcagataagtcttcagtat

SEQ ID NO: 470785 - DNA, 25 bp, Homo sapien
gtcttcagtattgagaagctgtcaa

SEQ ID NO: 470786 - DNA, 25 bp, Homo sapien
agctgtcaagcttaggatggcagat

SEQ ID NO: 470787 - DNA, 25 bp, Homo sapien
ggatggcagatgtatgttttccaaa

SEQ ID NO: 470788 - DNA, 25 bp, Homo sapien
gctaatttttgcttgaaaactcaaa

SEQ ID NO: 470789 - DNA, 25 bp, Homo sapien
ggcaacaagtgttgttttcctggaa

SEQ ID NO: 470790 - DNA, 25 bp, Homo sapien
tatctgccaaatgctcaagtctgaa

SEQ ID NO: 470791 - DNA, 25 bp, Homo sapien
agtaataaatctgatctccaggttc

SEQ ID NO: 470792 - DNA, 25 bp, Homo sapien
caggttcccagtccagaactttctg

SEQ ID NO: 470793 - DNA, 25 bp, Homo sapien
gaactttctgcagcactatcttttt

SEQ ID NO: 470794 - DNA, 25 bp, Homo sapien
gcagcactatctttttgttcccttt

SEQ ID NO: 470795 - DNA, 25 bp, Homo sapien
tgttccctttaactaccagaagctt

SEQ ID NO: 470796 - DNA, 25 bp, Homo sapien
gctttaacccaaaatgaggcttcaa

SEQ ID NO: 470797 - DNA, 25 bp, Homo sapien
aagaccttatggctgcgtatctctg

SEQ ID NO: 470798 - DNA, 25 bp, Homo sapien
atctctgccctaagttttctcttga

SEQ ID NO: 470799 - DNA, 25 bp, Homo sapien
tttatttcaataagccacgccaaaa

SEQ ID NO: 470800 - DNA, 25 bp, Homo sapien
aagccacgccaaaatctgtgtgtca

SEQ ID NO: 470801 - DNA, 25 bp, Homo sapien
tctgtgtgtcataagctatctatac

SEQ ID NO: 470802 - DNA, 25 bp, Homo sapien
ttactttctggtctttcatagaaaa

SEQ ID NO: 470803 - DNA, 25 bp, Homo sapien
tactttctggtctttcatagaaaat

SEQ ID NO: 470804 - DNA, 25 bp, Homo sapien
ctttctggtctttcatagaaaatgt

SEQ ID NO: 470805 - DNA, 25 bp, Homo sapien
tagaaaatgtttctgacctgccggg

SEQ ID NO: 470806 - DNA, 25 bp, Homo sapien
agaaaatgtttctgacctgccgggc

SEQ ID NO: 470807 - DNA, 25 bp, Homo sapien
gaaaatgtttctgacctgccgggca

SEQ ID NO: 470808 - DNA, 25 bp, Homo sapien
aaaatgtttctgacctgccgggcac

SEQ ID NO: 470809 - DNA, 25 bp, Homo sapien
aaatgtttctgacctgccgggcacg

SEQ ID NO: 470810 - DNA, 25 bp, Homo sapien
aatgtttctgacctgccgggcacga

SEQ ID NO: 470811 - DNA, 25 bp, Homo sapien
atgtttctgacctgccgggcacgat

SEQ ID NO: 470812 - DNA, 25 bp, Homo sapien
tgtttctgacctgccgggcacgatg

SEQ ID NO: 470813 - DNA, 25 bp, Homo sapien
gccccattaagaagtttccttgtgg

SEQ ID NO: 470814 - DNA, 25 bp, Homo sapien
cccattaagaagtttccttgtggct

SEQ ID NO: 470815 - DNA, 25 bp, Homo sapien
ccattaagaagtttccttgtggctg

SEQ ID NO: 470816 - DNA, 25 bp, Homo sapien
cattaagaagtttccttgtggctgg

SEQ ID NO: 470817 - DNA, 25 bp, Homo sapien
attaagaagtttccttgtggctggg

SEQ ID NO: 470818 - DNA, 25 bp, Homo sapien
ttaagaagtttccttgtggctgggc

SEQ ID NO: 470819 - DNA, 25 bp, Homo sapien
aagaagtttccttgtggctgggctg

SEQ ID NO: 470820 - DNA, 25 bp, Homo sapien
aagtttccttgtggctgggctggct

SEQ ID NO: 470821 - DNA, 25 bp, Homo sapien
agctgagatcgcattaccgcactcc

SEQ ID NO: 470822 - DNA, 25 bp, Homo sapien
atcgcattaccgcactccagcttgg

SEQ ID NO: 470823 - DNA, 25 bp, Homo sapien
tcgcattaccgcactccagcttggg

SEQ ID NO: 470824 - DNA, 25 bp, Homo sapien
agtagtcctctatttcagttacagt

SEQ ID NO: 470825 - DNA, 25 bp, Homo sapien
gtcctctatttcagttacagtccca

SEQ ID NO: 470826 - DNA, 25 bp, Homo sapien
atttcagttacagtcccactggaat

SEQ ID NO: 470827 - DNA, 25 bp, Homo sapien
acagtcccactggaatactctgcaa

SEQ ID NO: 470828 - DNA, 25 bp, Homo sapien
cactggaatactctgcaacctcaag

SEQ ID NO: 470829 - DNA, 25 bp, Homo sapien
ggaatactctgcaacctcaagacta

SEQ ID NO: 470830 - DNA, 25 bp, Homo sapien
tgcaacctcaagactaaatcctaat

SEQ ID NO: 470831 - DNA, 25 bp, Homo sapien
aaatcctaatgtaagccaccaccac

SEQ ID NO: 470832 - DNA, 25 bp, Homo sapien
accaccaagccttacataaaataat

SEQ ID NO: 470833 - DNA, 25 bp, Homo sapien
acacatatatactcacatacccaaa

SEQ ID NO: 470834 - DNA, 25 bp, Homo sapien
gctacagtagaatttttcacttctt

SEQ ID NO: 470835 - DNA, 25 bp, Homo sapien
agcaccacacttgtggctttccagg

SEQ ID NO: 470836 - DNA, 25 bp, Homo sapien
aagggctggccttgagtacttgtag

SEQ ID NO: 470837 - DNA, 25 bp, Homo sapien
gtacttgtagctttttcaggctgag

SEQ ID NO: 470838 - DNA, 25 bp, Homo sapien
gagagtgcaagctgccagtggatct

SEQ ID NO: 470839 - DNA, 25 bp, Homo sapien
gtggatctaccattatgatgtcagg

SEQ ID NO: 470840 - DNA, 25 bp, Homo sapien
cagtggttctcttctcatagctcca

SEQ ID NO: 470841 - DNA, 25 bp, Homo sapien
atagctccactaggaagtgctccag

SEQ ID NO: 470842 - DNA, 25 bp, Homo sapien
tccacactgccctggtagagattct

SEQ ID NO: 470843 - DNA, 25 bp, Homo sapien
gagattctccatgagggttccactc

SEQ ID NO: 470844 - DNA, 25 bp, Homo sapien
agggttccactcgtgcagcaggctt

SEQ ID NO: 470845 - DNA, 25 bp, Homo sapien
tggacatccagacttttccctgaat

SEQ ID NO: 470846 - DNA, 25 bp, Homo sapien
cttcgtatacattattcatttgagc

SEQ ID NO: 470847 - DNA, 25 bp, Homo sapien
tattcatttgagctttacataattc

SEQ ID NO: 470848 - DNA, 25 bp, Homo sapien
gggatagacattaaaaccaagactc

SEQ ID NO: 470849 - DNA, 25 bp, Homo sapien
taaaaccaagactcagtaagcttaa

SEQ ID NO: 470850 - DNA, 25 bp, Homo sapien
cagtaagcttaaacaacttccagtt

SEQ ID NO: 470851 - DNA, 25 bp, Homo sapien
tccagtttagtgcaagaattcttag

SEQ ID NO: 470852 - DNA, 25 bp, Homo sapien
agaattcttagtctgtgttacttgg

SEQ ID NO: 470853 - DNA, 25 bp, Homo sapien
gtccaagaggaccacaagtagattt

SEQ ID NO: 470854 - DNA, 25 bp, Homo sapien
gaggaccacaagtagatttttagga

SEQ ID NO: 470855 - DNA, 25 bp, Homo sapien
tgtgaggttcctgaaattgttttgc

SEQ ID NO: 470856 - DNA, 25 bp, Homo sapien
tttgcaattttgttctataagctat

SEQ ID NO: 470857 - DNA, 25 bp, Homo sapien
gaagaaaaaaggatcagccgggtgt

SEQ ID NO: 470858 - DNA, 25 bp, Homo sapien
aagaaaaaaggatcagccgggtgtg

SEQ ID NO: 470859 - DNA, 25 bp, Homo sapien
gaaaaaaggatcagccgggtgtggt

SEQ ID NO: 470860 - DNA, 25 bp, Homo sapien
aaaaaaggatcagccgggtgtggtg

SEQ ID NO: 470861 - DNA, 25 bp, Homo sapien
aaaaaggatcagccgggtgtggtgg

SEQ ID NO: 470862 - DNA, 25 bp, Homo sapien
catggtgaaactccacccctactaa

SEQ ID NO: 470863 - DNA, 25 bp, Homo sapien
gccaggcagcgtggcacatgcctgt

SEQ ID NO: 470864 - DNA, 25 bp, Homo sapien
aacccaggaggtgtgggccgcagtg

SEQ ID NO: 470865 - DNA, 25 bp, Homo sapien
caggaggtgtgggccgcagtgagcc

SEQ ID NO: 470866 - DNA, 25 bp, Homo sapien
aggtgtgggccgcagtgagccaaga

SEQ ID NO: 470867 - DNA, 25 bp, Homo sapien
ggtgtgggccgcagtgagccaagat

SEQ ID NO: 470868 - DNA, 25 bp, Homo sapien
ctttctgcaacggttgaactaattt

SEQ ID NO: 470869 - DNA, 25 bp, Homo sapien
gatgctgagtttttcatatgcctgt

SEQ ID NO: 470870 - DNA, 25 bp, Homo sapien
gttggctgcatgtatcagacttgat

SEQ ID NO: 470871 - DNA, 25 bp, Homo sapien
ggctgcatgtatcagacttgattct

SEQ ID NO: 470872 - DNA, 25 bp, Homo sapien
tatcagacttgattctgagggctac

SEQ ID NO: 470873 - DNA, 25 bp, Homo sapien
ttctgagggctacaaggaatatgat

SEQ ID NO: 470874 - DNA, 25 bp, Homo sapien
ggaatatgatgacctatttttgtat

SEQ ID NO: 470875 - DNA, 25 bp, Homo sapien
attttagaaatattgccctgtctgc

SEQ ID NO: 470876 - DNA, 25 bp, Homo sapien
aatattgccctgtctgcaatgtgga

SEQ ID NO: 470877 - DNA, 25 bp, Homo sapien
ccctgtctgcaatgtggagcaccaa

SEQ ID NO: 470878 - DNA, 25 bp, Homo sapien
tctgcaatgtggagcaccaaatggt

SEQ ID NO: 470879 - DNA, 25 bp, Homo sapien
gtatgaaatggtaccactctcaagg

SEQ ID NO: 470880 - DNA, 25 bp, Homo sapien
cactctcaaggtagctcagcgacta

SEQ ID NO: 470881 - DNA, 25 bp, Homo sapien
gtagctcagcgactagaggtatagt

SEQ ID NO: 470882 - DNA, 25 bp, Homo sapien
caaaagttcccactggaaagcaaat

SEQ ID NO: 470883 - DNA, 25 bp, Homo sapien
gggaattatgcctcatgcaccctga

SEQ ID NO: 470884 - DNA, 25 bp, Homo sapien
tgcaccctgacttgacagtaacttc

SEQ ID NO: 470885 - DNA, 25 bp, Homo sapien
gacagtaacttccaaatacacgcta

SEQ ID NO: 470886 - DNA, 25 bp, Homo sapien
aatacacgctatcaagaacacccac

SEQ ID NO: 470887 - DNA, 25 bp, Homo sapien
aaccatctgtccgtgtgtgattcct

SEQ ID NO: 470888 - DNA, 25 bp, Homo sapien
tgtgtgattcctttgcttattcgca

SEQ ID NO: 470889 - DNA, 25 bp, Homo sapien
gattcctttgcttattcgcacagag

SEQ ID NO: 470890 - DNA, 25 bp, Homo sapien
catggtgttaagtatgaaggtgcta

SEQ ID NO: 470891 - DNA, 25 bp, Homo sapien
atggtgttaagtatgaaggtgctat

SEQ ID NO: 470892 - DNA, 25 bp, Homo sapien
tggtgttaagtatgaaggtgctata

SEQ ID NO: 470893 - DNA, 25 bp, Homo sapien
ggtgttaagtatgaaggtgctataa

SEQ ID NO: 470894 - DNA, 25 bp, Homo sapien
gtgttaagtatgaaggtgctataaa

SEQ ID NO: 470895 - DNA, 25 bp, Homo sapien
tgttaagtatgaaggtgctataaag

SEQ ID NO: 470896 - DNA, 25 bp, Homo sapien
gttaagtatgaaggtgctataaaga

SEQ ID NO: 470897 - DNA, 25 bp, Homo sapien
ttaagtatgaaggtgctataaagaa

SEQ ID NO: 470898 - DNA, 25 bp, Homo sapien
taagtatgaaggtgctataaagaaa

SEQ ID NO: 470899 - DNA, 25 bp, Homo sapien
aagtatgaaggtgctataaagaaaa

SEQ ID NO: 470900 - DNA, 25 bp, Homo sapien
gtatgaaggtgctataaagaaaagg

SEQ ID NO: 470901 - DNA, 25 bp, Homo sapien
attactcaaagtagccaggctcact

SEQ ID NO: 470902 - DNA, 25 bp, Homo sapien
gccaggctcactgggtgagaagact

SEQ ID NO: 470903 - DNA, 25 bp, Homo sapien
gagaagactgcttagaatcacgtct

SEQ ID NO: 470904 - DNA, 25 bp, Homo sapien
agaatcacgtctagaaggctctccc

SEQ ID NO: 470905 - DNA, 25 bp, Homo sapien
tgcccatcagggtttccggtcttct

SEQ ID NO: 470906 - DNA, 25 bp, Homo sapien
tccggtcttctgttgttagtggtga

SEQ ID NO: 470907 - DNA, 25 bp, Homo sapien
ttagtggtgacatttctggtgccct

SEQ ID NO: 470908 - DNA, 25 bp, Homo sapien
atttctggtgcccttcaaatgctgt

SEQ ID NO: 470909 - DNA, 25 bp, Homo sapien
aatgctgtgcatgcaagaatcgcta

SEQ ID NO: 470910 - DNA, 25 bp, Homo sapien
tccagttagtaaaagagcccaccct

SEQ ID NO: 470911 - DNA, 25 bp, Homo sapien
aaagagcccaccctggaacctggat

SEQ ID NO: 470912 - DNA, 25 bp, Homo sapien
ctgatgataaagtctagtatgcata

SEQ ID NO: 470913 - DNA, 25 bp, Homo sapien
tctgtatgtgtaatatcatagtatc

SEQ ID NO: 470914 - DNA, 25 bp, Homo sapien
atcatagtatcatttattgctggga

SEQ ID NO: 470915 - DNA, 25 bp, Homo sapien
gtatcatttattgctgggatggatc

SEQ ID NO: 470916 - DNA, 25 bp, Homo sapien
gggatggatcgaaaagcactgcttt

SEQ ID NO: 470917 - DNA, 25 bp, Homo sapien
aaagcactgcttttacttttctgat

SEQ ID NO: 470918 - DNA, 25 bp, Homo sapien
tcaaaatgattttccagtaccaact

SEQ ID NO: 470919 - DNA, 25 bp, Homo sapien
atgattttccagtaccaacttgact

SEQ ID NO: 470920 - DNA, 25 bp, Homo sapien
tccagtaccaacttgactggctttt

SEQ ID NO: 470921 - DNA, 25 bp, Homo sapien
actggcttttaattattgtcacaca

SEQ ID NO: 470922 - DNA, 25 bp, Homo sapien
ggcttttaattattgtcacacacac

SEQ ID NO: 470923 - DNA, 25 bp, Homo sapien
acgacccagaggacgtggccagctg

SEQ ID NO: 470924 - DNA, 25 bp, Homo sapien
gtggccagctggaacctaccaggtg

SEQ ID NO: 470925 - DNA, 25 bp, Homo sapien
ggtgccctgcggctctcagtagctt

SEQ ID NO: 470926 - DNA, 25 bp, Homo sapien
aacgggaaggcctcgttgctcaggt

SEQ ID NO: 470927 - DNA, 25 bp, Homo sapien
aaggcctcgttgctcaggtctgcgt

SEQ ID NO: 470928 - DNA, 25 bp, Homo sapien
agcacctcctgcaaaatggctcggc

SEQ ID NO: 470929 - DNA, 25 bp, Homo sapien
aaagtcgctcagtcagcaagtgctc

SEQ ID NO: 470930 - DNA, 25 bp, Homo sapien
tcagtcagcaagtgctcacgggtgg

SEQ ID NO: 470931 - DNA, 25 bp, Homo sapien
ggacctgccatgagtgggataagtc

SEQ ID NO: 470932 - DNA, 25 bp, Homo sapien
tgagtgggataagtccctgtcctca

SEQ ID NO: 470933 - DNA, 25 bp, Homo sapien
gtccctgtcctcatgagacagatga

SEQ ID NO: 470934 - DNA, 25 bp, Homo sapien
atgaaaaaggctcaacaccaccaat

SEQ ID NO: 470935 - DNA, 25 bp, Homo sapien
gaaaaaggctcaacaccaccaatca

SEQ ID NO: 470936 - DNA, 25 bp, Homo sapien
aaaggctcaacaccaccaatcatta

SEQ ID NO: 470937 - DNA, 25 bp, Homo sapien
ctcacactagtcagaatggctgatg

SEQ ID NO: 470938 - DNA, 25 bp, Homo sapien
cacactagtcagaatggctgatggc

SEQ ID NO: 470939 - DNA, 25 bp, Homo sapien
ggagaaaaggcaatgcttatgcact

SEQ ID NO: 470940 - DNA, 25 bp, Homo sapien
aattagttcaatcattgtggttgac

SEQ ID NO: 470941 - DNA, 25 bp, Homo sapien
caatcattgtggttgacagtgtggt

SEQ ID NO: 470942 - DNA, 25 bp, Homo sapien
tataattctacctagcaatgctact

SEQ ID NO: 470943 - DNA, 25 bp, Homo sapien
cctagcaatgctactactgggtata

SEQ ID NO: 470944 - DNA, 25 bp, Homo sapien
tagcaatgctactactgggtatata

SEQ ID NO: 470945 - DNA, 25 bp, Homo sapien
ctgcctttgaattcttgaagtctaa

SEQ ID NO: 470946 - DNA, 25 bp, Homo sapien
catcctgggcctcaaacatctggtc

SEQ ID NO: 470947 - DNA, 25 bp, Homo sapien
gggcctcaaacatctggtccagcaa

SEQ ID NO: 470948 - DNA, 25 bp, Homo sapien
aacatctggtccagcaaagcaagac

SEQ ID NO: 470949 - DNA, 25 bp, Homo sapien
agacctgcctccataattcagtcat

SEQ ID NO: 470950 - DNA, 25 bp, Homo sapien
aattcagtcatctctcactgggttc

SEQ ID NO: 470951 - DNA, 25 bp, Homo sapien
ctgggttccccccataacacatggg

SEQ ID NO: 470952 - DNA, 25 bp, Homo sapien
aaaccatatcagctgagaactgctc

SEQ ID NO: 470953 - DNA, 25 bp, Homo sapien
atatcagctgagaactgctctgcct

SEQ ID NO: 470954 - DNA, 25 bp, Homo sapien
actgctctgcctttgaattcttgaa

SEQ ID NO: 470955 - DNA, 25 bp, Homo sapien
gctctgcctttgaattcttgaagtc

SEQ ID NO: 470956 - DNA, 25 bp, Homo sapien
tatgactgctaaaagaaccaaccca

SEQ ID NO: 470957 - DNA, 25 bp, Homo sapien
aaagaaccaacccaggacagagcca

SEQ ID NO: 470958 - DNA, 25 bp, Homo sapien
aacccaggacagagccacaatcttc

SEQ ID NO: 470959 - DNA, 25 bp, Homo sapien
aggacagagccacaatcttcctcta

SEQ ID NO: 470960 - DNA, 25 bp, Homo sapien
agccacaatcttcctctatttcatt

SEQ ID NO: 470961 - DNA, 25 bp, Homo sapien
caatcttcctctatttcattgtaat

SEQ ID NO: 470962 - DNA, 25 bp, Homo sapien
tttcacttgtattcatttgtaaaac

SEQ ID NO: 470963 - DNA, 25 bp, Homo sapien
tttgtattagtgtaacatactcccc

SEQ ID NO: 470964 - DNA, 25 bp, Homo sapien
aaacgcctgtaaagactggcatctt

SEQ ID NO: 470965 - DNA, 25 bp, Homo sapien
agactggcatcttcacaggatgtca

SEQ ID NO: 470966 - DNA, 25 bp, Homo sapien
atcttcacaggatgtcagtgtttaa

SEQ ID NO: 470967 - DNA, 25 bp, Homo sapien
tttgggggtagctattttcttattg

SEQ ID NO: 470968 - DNA, 25 bp, Homo sapien
ttgggggtagctattttcttattgt

SEQ ID NO: 470969 - DNA, 25 bp, Homo sapien
tattttcttattgttaccaaatagg

SEQ ID NO: 470970 - DNA, 25 bp, Homo sapien
tgttaccaaataggtaaatgaggtc

SEQ ID NO: 470971 - DNA, 25 bp, Homo sapien
gttaccaaataggtaaatgaggtca

SEQ ID NO: 470972 - DNA, 25 bp, Homo sapien
ttaccaaataggtaaatgaggtcag

SEQ ID NO: 470973 - DNA, 25 bp, Homo sapien
taccaaataggtaaatgaggtcagg

SEQ ID NO: 470974 - DNA, 25 bp, Homo sapien
accaaataggtaaatgaggtcaggt

SEQ ID NO: 470975 - DNA, 25 bp, Homo sapien
ccaaataggtaaatgaggtcaggtg

SEQ ID NO: 470976 - DNA, 25 bp, Homo sapien
caaataggtaaatgaggtcaggtgt

SEQ ID NO: 470977 - DNA, 25 bp, Homo sapien
aaataggtaaatgaggtcaggtgtg

SEQ ID NO: 470978 - DNA, 25 bp, Homo sapien
tacagaaccatagcctttcagagaa

SEQ ID NO: 470979 - DNA, 25 bp, Homo sapien
aggaagtgacagcaagcttacctgt

SEQ ID NO: 470980 - DNA, 25 bp, Homo sapien
atgacaaggcaggtcacagctcgcc

SEQ ID NO: 470981 - DNA, 25 bp, Homo sapien
caggtcacagctcgcccactgggat

SEQ ID NO: 470982 - DNA, 25 bp, Homo sapien
agaggctgctcagatcagtaaacgt

SEQ ID NO: 470983 - DNA, 25 bp, Homo sapien
gctcagatcagtaaacgtgcatagt

SEQ ID NO: 470984 - DNA, 25 bp, Homo sapien
acgtgcatagttcatgccaatgccc

SEQ ID NO: 470985 - DNA, 25 bp, Homo sapien
gctttattacaaaattgccctctac

SEQ ID NO: 470986 - DNA, 25 bp, Homo sapien
ccccaataccttgctgtccaaaaga

SEQ ID NO: 470987 - DNA, 25 bp, Homo sapien
ttgccctctacatcaattttgctct

SEQ ID NO: 470988 - DNA, 25 bp, Homo sapien
gagaaatgttcaaccaaattacaga

SEQ ID NO: 470989 - DNA, 25 bp, Homo sapien
ggtcctcagagccaaccccgggaga

SEQ ID NO: 470990 - DNA, 25 bp, Homo sapien
caaccccgggagagaccttctggag

SEQ ID NO: 470991 - DNA, 25 bp, Homo sapien
ggagagaccttctggagctgctgac

SEQ ID NO: 470992 - DNA, 25 bp, Homo sapien
agaccttctggagctgctgactgag

SEQ ID NO: 470993 - DNA, 25 bp, Homo sapien
ctgactgaggtcaacaggcgggtgt

SEQ ID NO: 470994 - DNA, 25 bp, Homo sapien
gactgcgatgaactccgcaaggcct

SEQ ID NO: 470995 - DNA, 25 bp, Homo sapien
atgaactccgcaaggcctgcctgga

SEQ ID NO: 470996 - DNA, 25 bp, Homo sapien
aaggcctgcctggagatccgcagct

SEQ ID NO: 470997 - DNA, 25 bp, Homo sapien
gtggccagatcccagcgccattctt

SEQ ID NO: 470998 - DNA, 25 bp, Homo sapien
tttcctcatctgagagcgaggcgtg

SEQ ID NO: 470999 - DNA, 25 bp, Homo sapien
cctcatctgagagcgaggcgtggca

SEQ ID NO: 471000 - DNA, 25 bp, Homo sapien
aattgctagctgttaaacaagccca

SEQ ID NO: 471001 - DNA, 25 bp, Homo sapien
gctgttaaacaagcccaaatttgat

SEQ ID NO: 471002 - DNA, 25 bp, Homo sapien
agcccaaatttgatatactttttat

SEQ ID NO: 471003 - DNA, 25 bp, Homo sapien
attcactgcccccataagagcaatc

SEQ ID NO: 471004 - DNA, 25 bp, Homo sapien
ccccataagagcaatcaaggcatgt

SEQ ID NO: 471005 - DNA, 25 bp, Homo sapien
gagcaatcaaggcatgtctttaaat

SEQ ID NO: 471006 - DNA, 25 bp, Homo sapien
tcaaggcatgtctttaaattctata

SEQ ID NO: 471007 - DNA, 25 bp, Homo sapien
aatagtgcatttagtaacattcttt

SEQ ID NO: 471008 - DNA, 25 bp, Homo sapien
cttgggaatgaatatctgtttcttc

SEQ ID NO: 471009 - DNA, 25 bp, Homo sapien
gtttcttctaacagtttgagtgata

SEQ ID NO: 471010 - DNA, 25 bp, Homo sapien
gagtgataatctatacctgtagata

SEQ ID NO: 471011 - DNA, 25 bp, Homo sapien
gagtattgttttgtacacctgtctt

SEQ ID NO: 471012 - DNA, 25 bp, Homo sapien
attgttttgtacacctgtctttgaa

SEQ ID NO: 471013 - DNA, 25 bp, Homo sapien
aacacaaattaagctgagtacaaat

SEQ ID NO: 471014 - DNA, 25 bp, Homo sapien
gatgggattttttatatgcagatca

SEQ ID NO: 471015 - DNA, 25 bp, Homo sapien
gaaacagaatgaattgctgaacctc

SEQ ID NO: 471016 - DNA, 25 bp, Homo sapien
gctgaacctcagattgtgtctttac

SEQ ID NO: 471017 - DNA, 25 bp, Homo sapien
gaacctcagattgtgtctttacaag

SEQ ID NO: 471018 - DNA, 25 bp, Homo sapien
gtctttacaagggaatgtcattctt

SEQ ID NO: 471019 - DNA, 25 bp, Homo sapien
atgtcattctttaaaggtacctcaa

SEQ ID NO: 471020 - DNA, 25 bp, Homo sapien
agtaaaaacctgcacgttgggcaca

SEQ ID NO: 471021 - DNA, 25 bp, Homo sapien
gtacgttgtgcacatatacctaaag

SEQ ID NO: 471022 - DNA, 25 bp, Homo sapien
tgttttctagtcacataaggctcga

SEQ ID NO: 471023 - DNA, 25 bp, Homo sapien
gtcacataaggctcgacaatttact

SEQ ID NO: 471024 - DNA, 25 bp, Homo sapien
ggctcgacaatttacttaaactatc

SEQ ID NO: 471025 - DNA, 25 bp, Homo sapien
ggaaatgtgttctttgggtgaccca

SEQ ID NO: 471026 - DNA, 25 bp, Homo sapien
gggtgacccaaatatttagcttcaa

SEQ ID NO: 471027 - DNA, 25 bp, Homo sapien
gcttcaaaattgagtctgccacaag

SEQ ID NO: 471028 - DNA, 25 bp, Homo sapien
attgagtctgccacaagagggagat

SEQ ID NO: 471029 - DNA, 25 bp, Homo sapien
gagggagatctaaacttgcttatgg

SEQ ID NO: 471030 - DNA, 25 bp, Homo sapien
aaaatgtggcctgagtaggaacaat

SEQ ID NO: 471031 - DNA, 25 bp, Homo sapien
agctttctaagctcatctaaacatg

SEQ ID NO: 471032 - DNA, 25 bp, Homo sapien
aagctcatctaaacatgggcatctt

SEQ ID NO: 471033 - DNA, 25 bp, Homo sapien
aggaattagttgagcgattcgcttt

SEQ ID NO: 471034 - DNA, 25 bp, Homo sapien
gagcgattcgctttatatggtgcaa

SEQ ID NO: 471035 - DNA, 25 bp, Homo sapien
gcgattcgctttatatggtgcaatt

SEQ ID NO: 471036 - DNA, 25 bp, Homo sapien
gattcgctttatatggtgcaattga

SEQ ID NO: 471037 - DNA, 25 bp, Homo sapien
tcgctttatatggtgcaattgaaca

SEQ ID NO: 471038 - DNA, 25 bp, Homo sapien
ggtgcaattgaacagtacaatgctc

SEQ ID NO: 471039 - DNA, 25 bp, Homo sapien
gaacagtacaatgctctagatgaat

SEQ ID NO: 471040 - DNA, 25 bp, Homo sapien
tacaatgctctagatgaatacccag

SEQ ID NO: 471041 - DNA, 25 bp, Homo sapien
aatgctctagatgaatacccagcag

SEQ ID NO: 471042 - DNA, 25 bp, Homo sapien
gaatacccagcagaagactttactg

SEQ ID NO: 471043 - DNA, 25 bp, Homo sapien
acccagcagaagactttactgaagt

SEQ ID NO: 471044 - DNA, 25 bp, Homo sapien
gatctcttgggccaaggagtatgaa

SEQ ID NO: 471045 - DNA, 25 bp, Homo sapien
tctcttgggccaaggagtatgaaac

SEQ ID NO: 471046 - DNA, 25 bp, Homo sapien
ctcttgggccaaggagtatgaaacc

SEQ ID NO: 471047 - DNA, 25 bp, Homo sapien
tcttgggccaaggagtatgaaacca

SEQ ID NO: 471048 - DNA, 25 bp, Homo sapien
aaaggtataaaggttggccaggcat

SEQ ID NO: 471049 - DNA, 25 bp, Homo sapien
aaggtataaaggttggccaggcatg

SEQ ID NO: 471050 - DNA, 25 bp, Homo sapien
ggaggaccattggagcccggagggt

SEQ ID NO: 471051 - DNA, 25 bp, Homo sapien
gaggaccattggagcccggagggtt

SEQ ID NO: 471052 - DNA, 25 bp, Homo sapien
aggaccattggagcccggagggttg

SEQ ID NO: 471053 - DNA, 25 bp, Homo sapien
cattggagcccggagggttgaagct

SEQ ID NO: 471054 - DNA, 25 bp, Homo sapien
attggagcccggagggttgaagctg

SEQ ID NO: 471055 - DNA, 25 bp, Homo sapien
cttgatatgttgagggaagtgactt

SEQ ID NO: 471056 - DNA, 25 bp, Homo sapien
ttgatatgttgagggaagtgacttg

SEQ ID NO: 471057 - DNA, 25 bp, Homo sapien
agtgacttgttataagatagaggcc

SEQ ID NO: 471058 - DNA, 25 bp, Homo sapien
gtgacttgttataagatagaggcca

SEQ ID NO: 471059 - DNA, 25 bp, Homo sapien
tgacttgttataagatagaggccag

SEQ ID NO: 471060 - DNA, 25 bp, Homo sapien
gacttgttataagatagaggccagg

SEQ ID NO: 471061 - DNA, 25 bp, Homo sapien
acttgttataagatagaggccaggt

SEQ ID NO: 471062 - DNA, 25 bp, Homo sapien
cttgttataagatagaggccaggta

SEQ ID NO: 471063 - DNA, 25 bp, Homo sapien
ttgttataagatagaggccaggtat

SEQ ID NO: 471064 - DNA, 25 bp, Homo sapien
tgttataagatagaggccaggtatg

SEQ ID NO: 471065 - DNA, 25 bp, Homo sapien
ttataagatagaggccaggtatggt

SEQ ID NO: 471066 - DNA, 25 bp, Homo sapien
ggttaattatagcagtaagtccctt

SEQ ID NO: 471067 - DNA, 25 bp, Homo sapien
agtaagtcccttacaatgcattgta

SEQ ID NO: 471068 - DNA, 25 bp, Homo sapien
caatgcattgtatatgttctcttac

SEQ ID NO: 471069 - DNA, 25 bp, Homo sapien
gttctcttacatgcatttgttcatc

SEQ ID NO: 471070 - DNA, 25 bp, Homo sapien
caaatcttgtgaattctacccttta

SEQ ID NO: 471071 - DNA, 25 bp, Homo sapien
gtttgtcaattccatccatacttct

SEQ ID NO: 471072 - DNA, 25 bp, Homo sapien
gtcaattccatccatacttcttcag

SEQ ID NO: 471073 - DNA, 25 bp, Homo sapien
acttcttcagccctattatgtccta

SEQ ID NO: 471074 - DNA, 25 bp, Homo sapien
tatccaatcaaactggttgtccatg

SEQ ID NO: 471075 - DNA, 25 bp, Homo sapien
ggttgtccatgattggatcctgtta

SEQ ID NO: 471076 - DNA, 25 bp, Homo sapien
ggatcctgttatcactgttgactat

SEQ ID NO: 471077 - DNA, 25 bp, Homo sapien
cagaggagatgtggccagaggcaac

SEQ ID NO: 471078 - DNA, 25 bp, Homo sapien
aatcttaattttgtcccataccact

SEQ ID NO: 471079 - DNA, 25 bp, Homo sapien
tcttaattttgtcccataccactgt

SEQ ID NO: 471080 - DNA, 25 bp, Homo sapien
ttttgtcccataccactgtaaccgc

SEQ ID NO: 471081 - DNA, 25 bp, Homo sapien
aaagagtaattcacatggagccagc

SEQ ID NO: 471082 - DNA, 25 bp, Homo sapien
agagtaattcacatggagccagctg

SEQ ID NO: 471083 - DNA, 25 bp, Homo sapien
gagtaattcacatggagccagctgt

SEQ ID NO: 471084 - DNA, 25 bp, Homo sapien
agtaattcacatggagccagctgtg

SEQ ID NO: 471085 - DNA, 25 bp, Homo sapien
ccagctgtgtgggagaccagagttt

SEQ ID NO: 471086 - DNA, 25 bp, Homo sapien
tctatgaataatttggtgggtggga

SEQ ID NO: 471087 - DNA, 25 bp, Homo sapien
ggagtgctgattggttagagattaa

SEQ ID NO: 471088 - DNA, 25 bp, Homo sapien
gccaacttgaagaaccagacccaga

SEQ ID NO: 471089 - DNA, 25 bp, Homo sapien
agacccagagctgcagggactcaag

SEQ ID NO: 471090 - DNA, 25 bp, Homo sapien
gggactcaagcaccgatgcgctcag

SEQ ID NO: 471091 - DNA, 25 bp, Homo sapien
gacagagggctgtctagaccatctg

SEQ ID NO: 471092 - DNA, 25 bp, Homo sapien
tagaccatctgtgggttatttcacc

SEQ ID NO: 471093 - DNA, 25 bp, Homo sapien
ttatttcaccacgttctaccttgct

SEQ ID NO: 471094 - DNA, 25 bp, Homo sapien
ttgctctccttcaagaaattggcat

SEQ ID NO: 471095 - DNA, 25 bp, Homo sapien
attggcatttgtacagtaacttctt

SEQ ID NO: 471096 - DNA, 25 bp, Homo sapien
aaataggacaaactctccatttcct

SEQ ID NO: 471097 - DNA, 25 bp, Homo sapien
gagctgctgagaggactggctcaat

SEQ ID NO: 471098 - DNA, 25 bp, Homo sapien
actggctcaatgcagaggctctgac

SEQ ID NO: 471099 - DNA, 25 bp, Homo sapien
gaaaaggcctatgaccaaacaagtg

SEQ ID NO: 471100 - DNA, 25 bp, Homo sapien
ttgcccagactggttgctaaatacc

SEQ ID NO: 471101 - DNA, 25 bp, Homo sapien
ggttgctaaataccatttccaacaa

SEQ ID NO: 471102 - DNA, 25 bp, Homo sapien
tttccaacaaaaccagggctccttg

SEQ ID NO: 471103 - DNA, 25 bp, Homo sapien
atgactgatttcagatctggactga

SEQ ID NO: 471104 - DNA, 25 bp, Homo sapien
atgtacaacatgatcctggaaatct

SEQ ID NO: 471105 - DNA, 25 bp, Homo sapien
ggaaatcttaccataccagaaagcg

SEQ ID NO: 471106 - DNA, 25 bp, Homo sapien
gaaagcgaggaaactgacaagatta

SEQ ID NO: 471107 - DNA, 25 bp, Homo sapien
caaattgagttgagttccactgacc

SEQ ID NO: 471108 - DNA, 25 bp, Homo sapien
ttccactgaccgaagacagaattag

SEQ ID NO: 471109 - DNA, 25 bp, Homo sapien
atcattgattagaaggccaggcaca

SEQ ID NO: 471110 - DNA, 25 bp, Homo sapien
tacttcaaaatttagcttgtgggcc

SEQ ID NO: 471111 - DNA, 25 bp, Homo sapien
acttcaaaatttagcttgtgggccg

SEQ ID NO: 471112 - DNA, 25 bp, Homo sapien
cttcaaaatttagcttgtgggccgg

SEQ ID NO: 471113 - DNA, 25 bp, Homo sapien
ttcaaaatttagcttgtgggccgga

SEQ ID NO: 471114 - DNA, 25 bp, Homo sapien
tcaaaatttagcttgtgggccggac

SEQ ID NO: 471115 - DNA, 25 bp, Homo sapien
caaaatttagcttgtgggccggacg

SEQ ID NO: 471116 - DNA, 25 bp, Homo sapien
aaatttagcttgtgggccggacgcg

SEQ ID NO: 471117 - DNA, 25 bp, Homo sapien
aatttagcttgtgggccggacgcgg

SEQ ID NO: 471118 - DNA, 25 bp, Homo sapien
atttagcttgtgggccggacgcggt

SEQ ID NO: 471119 - DNA, 25 bp, Homo sapien
tttagcttgtgggccggacgcggtg

SEQ ID NO: 471120 - DNA, 25 bp, Homo sapien
ttgtgggccggacgcggtggttcac

SEQ ID NO: 471121 - DNA, 25 bp, Homo sapien
aaagattttcatatggtaccatcca

SEQ ID NO: 471122 - DNA, 25 bp, Homo sapien
ggtaccatccatgaaaaccaacgtc

SEQ ID NO: 471123 - DNA, 25 bp, Homo sapien
aaccaacgtctcttcctatggatgt

SEQ ID NO: 471124 - DNA, 25 bp, Homo sapien
agacagggcctattagatgccctaa

SEQ ID NO: 471125 - DNA, 25 bp, Homo sapien
gatgccctaatgctgattttctacc

SEQ ID NO: 471126 - DNA, 25 bp, Homo sapien
ttttctaccattctgagcctgagga

SEQ ID NO: 471127 - DNA, 25 bp, Homo sapien
aaatctatggcttctagagcttaaa

SEQ ID NO: 471128 - DNA, 25 bp, Homo sapien
cagtcaccacctagtcaaacttatt

SEQ ID NO: 471129 - DNA, 25 bp, Homo sapien
gggacgtgattaggccaagatcctt

SEQ ID NO: 471130 - DNA, 25 bp, Homo sapien
taggccaagatcctttcaacacagg

SEQ ID NO: 471131 - DNA, 25 bp, Homo sapien
aacacaggacatctgccatactaaa

SEQ ID NO: 471132 - DNA, 25 bp, Homo sapien
ggtgaattcattaattgacttttaa

SEQ ID NO: 471133 - DNA, 25 bp, Homo sapien
ttcaatgaatattggagtgatttcc

SEQ ID NO: 471134 - DNA, 25 bp, Homo sapien
gtaaaaggttattcatatctaatgc

SEQ ID NO: 471135 - DNA, 25 bp, Homo sapien
gttattcatatctaatgcttgtagc

SEQ ID NO: 471136 - DNA, 25 bp, Homo sapien
tatctaatgcttgtagcaactttat

SEQ ID NO: 471137 - DNA, 25 bp, Homo sapien
atgtattatactttgttgccatgag

SEQ ID NO: 471138 - DNA, 25 bp, Homo sapien
gtattatactttgttgccatgagtg

SEQ ID NO: 471139 - DNA, 25 bp, Homo sapien
ttctgtagcctaaactagagggcac

SEQ ID NO: 471140 - DNA, 25 bp, Homo sapien
gtagcctaaactagagggcacaaca

SEQ ID NO: 471141 - DNA, 25 bp, Homo sapien
gagggcacaacaaatgtaggcacat

SEQ ID NO: 471142 - DNA, 25 bp, Homo sapien
aatgtaggcacattattacaccaca

SEQ ID NO: 471143 - DNA, 25 bp, Homo sapien
gtagatattgacaagctaattctaa

SEQ ID NO: 471144 - DNA, 25 bp, Homo sapien
gtgaactagaagagcccccaaaatt

SEQ ID NO: 471145 - DNA, 25 bp, Homo sapien
gaagagcccccaaaatttgaaatgg

SEQ ID NO: 471146 - DNA, 25 bp, Homo sapien
ggaacaaagttgagaattcacacta

SEQ ID NO: 471147 - DNA, 25 bp, Homo sapien
ttgagaattcacactacccaatttt

SEQ ID NO: 471148 - DNA, 25 bp, Homo sapien
cccaattttaatataaggctacata

SEQ ID NO: 471149 - DNA, 25 bp, Homo sapien
aggctacataagtcaaaccagtggg

SEQ ID NO: 471150 - DNA, 25 bp, Homo sapien
gggtcctggccaaaggataaacata

SEQ ID NO: 471151 - DNA, 25 bp, Homo sapien
attcagtgagacagaatagagagct

SEQ ID NO: 471152 - DNA, 25 bp, Homo sapien
aatattatcaactgactgttggcag

SEQ ID NO: 471153 - DNA, 25 bp, Homo sapien
caactgactgttggcagaagctaaa

SEQ ID NO: 471154 - DNA, 25 bp, Homo sapien
agcacccatgcactgaaggagcctt

SEQ ID NO: 471155 - DNA, 25 bp, Homo sapien
gagcctttggaccagacctagccaa

SEQ ID NO: 471156 - DNA, 25 bp, Homo sapien
gacctagccaaagaggactcatcca

SEQ ID NO: 471157 - DNA, 25 bp, Homo sapien
atccatcccggcaataagaatctga

SEQ ID NO: 471158 - DNA, 25 bp, Homo sapien
gaatctgaatttcttggcaagtctc

SEQ ID NO: 471159 - DNA, 25 bp, Homo sapien
gcaagtctcactaccatgggctaaa

SEQ ID NO: 471160 - DNA, 25 bp, Homo sapien
atgggctaaagtgctccagggtgct

SEQ ID NO: 471161 - DNA, 25 bp, Homo sapien
gtgctccagggtgctaggtaaacct

SEQ ID NO: 471162 - DNA, 25 bp, Homo sapien
ggacaacaactcctaggcaactctt

SEQ ID NO: 471163 - DNA, 25 bp, Homo sapien
actcctaggcaactcttagggctgg

SEQ ID NO: 471164 - DNA, 25 bp, Homo sapien
taacctagggaggtaccagctggga

SEQ ID NO: 471165 - DNA, 25 bp, Homo sapien
ccgaggtgtttggaccacttgaggt

SEQ ID NO: 471166 - DNA, 25 bp, Homo sapien
tttgggggtagctattttcttattg

SEQ ID NO: 471167 - DNA, 25 bp, Homo sapien
ttgggggtagctattttcttattgt

SEQ ID NO: 471168 - DNA, 25 bp, Homo sapien
ggtagctattttcttattgttacca

SEQ ID NO: 471169 - DNA, 25 bp, Homo sapien
gtagctattttcttattgttaccaa

SEQ ID NO: 471170 - DNA, 25 bp, Homo sapien
tagctattttcttattgttaccaaa

SEQ ID NO: 471171 - DNA, 25 bp, Homo sapien
agctattttcttattgttaccaaat

SEQ ID NO: 471172 - DNA, 25 bp, Homo sapien
tattttcttattgttaccaaatagg

SEQ ID NO: 471173 - DNA, 25 bp, Homo sapien
ccaaataggtaaatgaggtcaggtg

SEQ ID NO: 471174 - DNA, 25 bp, Homo sapien
caaataggtaaatgaggtcaggtgt

SEQ ID NO: 471175 - DNA, 25 bp, Homo sapien
aaataggtaaatgaggtcaggtgtg

SEQ ID NO: 471176 - DNA, 25 bp, Homo sapien
ttacctgcatgaaccgtaagtggtc

SEQ ID NO: 471177 - DNA, 25 bp, Homo sapien
ctgcatgaaccgtaagtggtccttt

SEQ ID NO: 471178 - DNA, 25 bp, Homo sapien
catgaaccgtaagtggtcctttaga

SEQ ID NO: 471179 - DNA, 25 bp, Homo sapien
gtaagtggtcctttagaaagaatgg

SEQ ID NO: 471180 - DNA, 25 bp, Homo sapien
gaaagaatggactaccgtgctataa

SEQ ID NO: 471181 - DNA, 25 bp, Homo sapien
gaatggactaccgtgctataacaac

SEQ ID NO: 471182 - DNA, 25 bp, Homo sapien
ggactaccgtgctataacaactact

SEQ ID NO: 471183 - DNA, 25 bp, Homo sapien
taccgtgctataacaactactagac

SEQ ID NO: 471184 - DNA, 25 bp, Homo sapien
taacaactactagacaccttcattt

SEQ ID NO: 471185 - DNA, 25 bp, Homo sapien
tatcggcagtttagggtatggagca

SEQ ID NO: 471186 - DNA, 25 bp, Homo sapien
gcagtttagggtatggagcaagtaa

SEQ ID NO: 471187 - DNA, 25 bp, Homo sapien
agcggctgcggctgtacgccaagaa

SEQ ID NO: 471188 - DNA, 25 bp, Homo sapien
agaaggccaagaatccctcgctggt

SEQ ID NO: 471189 - DNA, 25 bp, Homo sapien
aagaatccctcgctggtggccaagt

SEQ ID NO: 471190 - DNA, 25 bp, Homo sapien
gccttgggacaataagacggacatg

SEQ ID NO: 471191 - DNA, 25 bp, Homo sapien
aataagacggacatgacccagctgg

SEQ ID NO: 471192 - DNA, 25 bp, Homo sapien
ctctatccagctggatgggctagtg

SEQ ID NO: 471193 - DNA, 25 bp, Homo sapien
tatccagctggatgggctagtgagc

SEQ ID NO: 471194 - DNA, 25 bp, Homo sapien
gggcctccaagctggcgtccgtggg

SEQ ID NO: 471195 - DNA, 25 bp, Homo sapien
cgtccgtgggctatggtatccggaa

SEQ ID NO: 471196 - DNA, 25 bp, Homo sapien
tgggctatggtatccggaagatgca

SEQ ID NO: 471197 - DNA, 25 bp, Homo sapien
tatggtatccggaagatgcagattc

SEQ ID NO: 471198 - DNA, 25 bp, Homo sapien
acaactgcttacacacagcaaatgg

SEQ ID NO: 471199 - DNA, 25 bp, Homo sapien
agaacactacttccaatttgcctca

SEQ ID NO: 471200 - DNA, 25 bp, Homo sapien
aatttgcctcaactggcaggctttc

SEQ ID NO: 471201 - DNA, 25 bp, Homo sapien
gcaggctttccggtgacagttccag

SEQ ID NO: 471202 - DNA, 25 bp, Homo sapien
gtgacagttccagctcatccagttg

SEQ ID NO: 471203 - DNA, 25 bp, Homo sapien
agctcatccagttgcacagcagcac

SEQ ID NO: 471204 - DNA, 25 bp, Homo sapien
acagcagcacacaaattaccatcag

SEQ ID NO: 471205 - DNA, 25 bp, Homo sapien
agcagcctctcctttagaaacaaat

SEQ ID NO: 471206 - DNA, 25 bp, Homo sapien
aagcattttcttgaaagccttcata

SEQ ID NO: 471207 - DNA, 25 bp, Homo sapien
taagtgtattattcagtccttgtga

SEQ ID NO: 471208 - DNA, 25 bp, Homo sapien
agtccttgtgataccaacctgaaaa

SEQ ID NO: 471209 - DNA, 25 bp, Homo sapien
gtaagttaatgttcttgttctgagc

SEQ ID NO: 471210 - DNA, 25 bp, Homo sapien
agttaatgttcttgttctgagctga

SEQ ID NO: 471211 - DNA, 25 bp, Homo sapien
taatgttcttgttctgagctgaaat

SEQ ID NO: 471212 - DNA, 25 bp, Homo sapien
gttcttgttctgagctgaaattagt

SEQ ID NO: 471213 - DNA, 25 bp, Homo sapien
gagctgaaattagtttgagcctata

SEQ ID NO: 471214 - DNA, 25 bp, Homo sapien
ggcaaagctgtctaaaactcccaaa

SEQ ID NO: 471215 - DNA, 25 bp, Homo sapien
taaaactcccaaatagttctgcaaa

SEQ ID NO: 471216 - DNA, 25 bp, Homo sapien
actcccaaatagttctgcaaaaaga

SEQ ID NO: 471217 - DNA, 25 bp, Homo sapien
tagttctgcaaaaagattttcagtg

SEQ ID NO: 471218 - DNA, 25 bp, Homo sapien
gagatgaatctaagtgaaggctata

SEQ ID NO: 471219 - DNA, 25 bp, Homo sapien
gctatatggggtgttcattgcacaa

SEQ ID NO: 471220 - DNA, 25 bp, Homo sapien
tttagaaaggtatactattcagctg

SEQ ID NO: 471221 - DNA, 25 bp, Homo sapien
ttagaaaggtatactattcagctgg

SEQ ID NO: 471222 - DNA, 25 bp, Homo sapien
tagaaaggtatactattcagctggg

SEQ ID NO: 471223 - DNA, 25 bp, Homo sapien
agaaaggtatactattcagctgggc

SEQ ID NO: 471224 - DNA, 25 bp, Homo sapien
gaaaggtatactattcagctgggcg

SEQ ID NO: 471225 - DNA, 25 bp, Homo sapien
aaaggtatactattcagctgggcgt

SEQ ID NO: 471226 - DNA, 25 bp, Homo sapien
aaggtatactattcagctgggcgta

SEQ ID NO: 471227 - DNA, 25 bp, Homo sapien
aggtatactattcagctgggcgtag

SEQ ID NO: 471228 - DNA, 25 bp, Homo sapien
ggtatactattcagctgggcgtagt

SEQ ID NO: 471229 - DNA, 25 bp, Homo sapien
gtatactattcagctgggcgtagtg

SEQ ID NO: 471230 - DNA, 25 bp, Homo sapien
tatactattcagctgggcgtagtgg

SEQ ID NO: 471231 - DNA, 25 bp, Homo sapien
tgcaggaacataaaaccaaacgcca

SEQ ID NO: 471232 - DNA, 25 bp, Homo sapien
gcaggaacataaaaccaaacgccac

SEQ ID NO: 471233 - DNA, 25 bp, Homo sapien
acataaaaccaaacgccacatgttt

SEQ ID NO: 471234 - DNA, 25 bp, Homo sapien
cataaaaccaaacgccacatgtttt

SEQ ID NO: 471235 - DNA, 25 bp, Homo sapien
aaccaaacgccacatgttttcattc

SEQ ID NO: 471236 - DNA, 25 bp, Homo sapien
accaaacgccacatgttttcattca

SEQ ID NO: 471237 - DNA, 25 bp, Homo sapien
ccaaacgccacatgttttcattcat

SEQ ID NO: 471238 - DNA, 25 bp, Homo sapien
aacaacacacactggtgtctgtcct

SEQ ID NO: 471239 - DNA, 25 bp, Homo sapien
acaacacacactggtgtctgtcctg

SEQ ID NO: 471240 - DNA, 25 bp, Homo sapien
ggcttactacctaggtagtgggttg

SEQ ID NO: 471241 - DNA, 25 bp, Homo sapien
cttactacctaggtagtgggttgat

SEQ ID NO: 471242 - DNA, 25 bp, Homo sapien
tttgaccttgtgtccgtggaacacc

SEQ ID NO: 471243 - DNA, 25 bp, Homo sapien
cttcctatcatttcaacccattgag

SEQ ID NO: 471244 - DNA, 25 bp, Homo sapien
aacccattgaggcacttgaactctc

SEQ ID NO: 471245 - DNA, 25 bp, Homo sapien
gagtgcaaactcttgaccctggagg

SEQ ID NO: 471246 - DNA, 25 bp, Homo sapien
aaaatgttctcatgtttgccttccc

SEQ ID NO: 471247 - DNA, 25 bp, Homo sapien
cacttactttctgcgagaacgtggg

SEQ ID NO: 471248 - DNA, 25 bp, Homo sapien
gaacgtgggaagatcttaacctctc

SEQ ID NO: 471249 - DNA, 25 bp, Homo sapien
gatcttaacctctcagaagcacagt

SEQ ID NO: 471250 - DNA, 25 bp, Homo sapien
cagaagcacagtttcttccttctaa

SEQ ID NO: 471251 - DNA, 25 bp, Homo sapien
aacctctccctgtctacattcttaa

SEQ ID NO: 471252 - DNA, 25 bp, Homo sapien
gtcacgttctccgtcctaagaatta

SEQ ID NO: 471253 - DNA, 25 bp, Homo sapien
tgtccagcggactgccacgggtctc

SEQ ID NO: 471254 - DNA, 25 bp, Homo sapien
agcctctctctttcagatgtcatcc

SEQ ID NO: 471255 - DNA, 25 bp, Homo sapien
tccttacatcgctgtgtatcctttc

SEQ ID NO: 471256 - DNA, 25 bp, Homo sapien
tacatcgctgtgtatcctttctgaa

SEQ ID NO: 471257 - DNA, 25 bp, Homo sapien
catcgctgtgtatcctttctgaatc

SEQ ID NO: 471258 - DNA, 25 bp, Homo sapien
gggatgttatttgcgaatggtatgc

SEQ ID NO: 471259 - DNA, 25 bp, Homo sapien
gtatgcattgtgaagcaggctcctt

SEQ ID NO: 471260 - DNA, 25 bp, Homo sapien
ttgtgaagcaggctcctttaccaga

SEQ ID NO: 471261 - DNA, 25 bp, Homo sapien
tgaagcaggctcctttaccagatgt

SEQ ID NO: 471262 - DNA, 25 bp, Homo sapien
gcaggctcctttaccagatgtgtat

SEQ ID NO: 471263 - DNA, 25 bp, Homo sapien
ggctcctttaccagatgtgtatttt

SEQ ID NO: 471264 - DNA, 25 bp, Homo sapien
gatatgcttttcctgtgttacagga

SEQ ID NO: 471265 - DNA, 25 bp, Homo sapien
aaaagtgagctctattctgttgatg

SEQ ID NO: 471266 - DNA, 25 bp, Homo sapien
gtgagctctattctgttgatgttta

SEQ ID NO: 471267 - DNA, 25 bp, Homo sapien
gttgatgtttatgtgaagctagtta

SEQ ID NO: 471268 - DNA, 25 bp, Homo sapien
ttatttaaactaatgctcaaagctt

SEQ ID NO: 471269 - DNA, 25 bp, Homo sapien
atgctcaaagctttagccttaccta

SEQ ID NO: 471270 - DNA, 25 bp, Homo sapien
gtgattggacaaatttccaggcaca

SEQ ID NO: 471271 - DNA, 25 bp, Homo sapien
ggacaaatttccaggcacaagaaaa

SEQ ID NO: 471272 - DNA, 25 bp, Homo sapien
gaaaatacataagcctatctctagg

SEQ ID NO: 471273 - DNA, 25 bp, Homo sapien
gcctatctctaggtcaatactgact

SEQ ID NO: 471274 - DNA, 25 bp, Homo sapien
aatactgacttttccctatctgcaa

SEQ ID NO: 471275 - DNA, 25 bp, Homo sapien
tattaggagtactacagtggatacc

SEQ ID NO: 471276 - DNA, 25 bp, Homo sapien
ggagtactacagtggatacctacat

SEQ ID NO: 471277 - DNA, 25 bp, Homo sapien
gtactacagtggatacctacatact

SEQ ID NO: 471278 - DNA, 25 bp, Homo sapien
cagtggatacctacatacttgctat

SEQ ID NO: 471279 - DNA, 25 bp, Homo sapien
ggatacctacatacttgctattcag

SEQ ID NO: 471280 - DNA, 25 bp, Homo sapien
atacctacatacttgctattcagca

SEQ ID NO: 471281 - DNA, 25 bp, Homo sapien
atacttgctattcagcatacctggt

SEQ ID NO: 471282 - DNA, 25 bp, Homo sapien
ttgctattcagcatacctggttttt

SEQ ID NO: 471283 - DNA, 25 bp, Homo sapien
gctattcagcatacctggttttttg

SEQ ID NO: 471284 - DNA, 25 bp, Homo sapien
gacagtcttctctgtgatccaggtt

SEQ ID NO: 471285 - DNA, 25 bp, Homo sapien
tcttctctgtgatccaggttggagt

SEQ ID NO: 471286 - DNA, 25 bp, Homo sapien
ggctcatgccgcacacaatggctca

SEQ ID NO: 471287 - DNA, 25 bp, Homo sapien
gctcatgccgcacacaatggctcat

SEQ ID NO: 471288 - DNA, 25 bp, Homo sapien
gcacacaatggctcatcccagaact

SEQ ID NO: 471289 - DNA, 25 bp, Homo sapien
cacacaatggctcatcccagaactt

SEQ ID NO: 471290 - DNA, 25 bp, Homo sapien
tgcacctcagcttgggtgacaacgc

SEQ ID NO: 471291 - DNA, 25 bp, Homo sapien
acctcagcttgggtgacaacgcgaa

SEQ ID NO: 471292 - DNA, 25 bp, Homo sapien
cctcagcttgggtgacaacgcgaac

SEQ ID NO: 471293 - DNA, 25 bp, Homo sapien
ctcagcttgggtgacaacgcgaacc

SEQ ID NO: 471294 - DNA, 25 bp, Homo sapien
cagcttgggtgacaacgcgaaccct

SEQ ID NO: 471295 - DNA, 25 bp, Homo sapien
gcttgggtgacaacgcgaaccctgt

SEQ ID NO: 471296 - DNA, 25 bp, Homo sapien
gtgacaacgcgaaccctgtctcaaa

SEQ ID NO: 471297 - DNA, 25 bp, Homo sapien
ttgaccttggcctggccggtgaaga

SEQ ID NO: 471298 - DNA, 25 bp, Homo sapien
gcctggccggtgaagacacggacaa

SEQ ID NO: 471299 - DNA, 25 bp, Homo sapien
gacacggacaaaaacacgcacgtag

SEQ ID NO: 471300 - DNA, 25 bp, Homo sapien
cgcacgtagaagtcagcgctgatgc

SEQ ID NO: 471301 - DNA, 25 bp, Homo sapien
cagcggcaccacgaagcgctggtag

SEQ ID NO: 471302 - DNA, 25 bp, Homo sapien
ccacgaagcgctggtagcagttggc

SEQ ID NO: 471303 - DNA, 25 bp, Homo sapien
cagttggcgcggaggtccaggctgt

SEQ ID NO: 471304 - DNA, 25 bp, Homo sapien
caggctgtgcaggacgattctcagg

SEQ ID NO: 471305 - DNA, 25 bp, Homo sapien
tgtgcaggacgattctcagggcctg

SEQ ID NO: 471306 - DNA, 25 bp, Homo sapien
aggagccctatgtggtactcacaag

SEQ ID NO: 471307 - DNA, 25 bp, Homo sapien
ggtactcacaagtacaggctcaggg

SEQ ID NO: 471308 - DNA, 25 bp, Homo sapien
tcctgcccttcttgttatgaactgt

SEQ ID NO: 471309 - DNA, 25 bp, Homo sapien
gcccttcttgttatgaactgtattt

SEQ ID NO: 471310 - DNA, 25 bp, Homo sapien
tttaggcagccaagtaactgaggga

SEQ ID NO: 471311 - DNA, 25 bp, Homo sapien
ggaaaatttccagctaataggtgca

SEQ ID NO: 471312 - DNA, 25 bp, Homo sapien
tagtgaatctagacagcagtatttc

SEQ ID NO: 471313 - DNA, 25 bp, Homo sapien
ggatgtgaaaaccattagatgatag

SEQ ID NO: 471314 - DNA, 25 bp, Homo sapien
gatcaaacccactgattgaagatga

SEQ ID NO: 471315 - DNA, 25 bp, Homo sapien
gacagtcaattattgtgtacctcct

SEQ ID NO: 471316 - DNA, 25 bp, Homo sapien
ttgtgtacctcctggtttgatgcaa

SEQ ID NO: 471317 - DNA, 25 bp, Homo sapien
gtacctcctggtttgatgcaagaga

SEQ ID NO: 471318 - DNA, 25 bp, Homo sapien
gatgcaagagacagtacacaacagt

SEQ ID NO: 471319 - DNA, 25 bp, Homo sapien
agttgtttcatagtcttagcttcca

SEQ ID NO: 471320 - DNA, 25 bp, Homo sapien
ttcatagtcttagcttccagaagca

SEQ ID NO: 471321 - DNA, 25 bp, Homo sapien
gggcaagcagcaaattcttttaatt

SEQ ID NO: 471322 - DNA, 25 bp, Homo sapien
gtgtattcaataactatgagtctct

SEQ ID NO: 471323 - DNA, 25 bp, Homo sapien
atgagtctctttgaatttacacctt

SEQ ID NO: 471324 - DNA, 25 bp, Homo sapien
gtctctttgaatttacacctttaat

SEQ ID NO: 471325 - DNA, 25 bp, Homo sapien
aatatactgtaatgctttccttaag

SEQ ID NO: 471326 - DNA, 25 bp, Homo sapien
gctttccttaagaatccaaccacat

SEQ ID NO: 471327 - DNA, 25 bp, Homo sapien
gaatccaaccacattaattttcttg

SEQ ID NO: 471328 - DNA, 25 bp, Homo sapien
aatagttcagtaactgttgtatcta

SEQ ID NO: 471329 - DNA, 25 bp, Homo sapien
aactgttgtatctaattgaagggag

SEQ ID NO: 471330 - DNA, 25 bp, Homo sapien
attagcggggctgtgatggcgtgcc

SEQ ID NO: 471331 - DNA, 25 bp, Homo sapien
ttagcggggctgtgatggcgtgcct

SEQ ID NO: 471332 - DNA, 25 bp, Homo sapien
tagcggggctgtgatggcgtgcctg

SEQ ID NO: 471333 - DNA, 25 bp, Homo sapien
agcggggctgtgatggcgtgcctgt

SEQ ID NO: 471334 - DNA, 25 bp, Homo sapien
gcggggctgtgatggcgtgcctgta

SEQ ID NO: 471335 - DNA, 25 bp, Homo sapien
cggggctgtgatggcgtgcctgtaa

SEQ ID NO: 471336 - DNA, 25 bp, Homo sapien
aaagcccacaaaaatcagtaactca

SEQ ID NO: 471337 - DNA, 25 bp, Homo sapien
aagcccacaaaaatcagtaactcaa

SEQ ID NO: 471338 - DNA, 25 bp, Homo sapien
agcccacaaaaatcagtaactcaac

SEQ ID NO: 471339 - DNA, 25 bp, Homo sapien
gcccacaaaaatcagtaactcaacc

SEQ ID NO: 471340 - DNA, 25 bp, Homo sapien
cacaaaaatcagtaactcaacccct

SEQ ID NO: 471341 - DNA, 25 bp, Homo sapien
atttccttataacatagacccgttg

SEQ ID NO: 471342 - DNA, 25 bp, Homo sapien
taacatagacccgttgctactctca

SEQ ID NO: 471343 - DNA, 25 bp, Homo sapien
atagacccgttgctactctcagcac

SEQ ID NO: 471344 - DNA, 25 bp, Homo sapien
gcatgtgatgcctgattaaactcat

SEQ ID NO: 471345 - DNA, 25 bp, Homo sapien
gattaaactcattttcatttgcttt

SEQ ID NO: 471346 - DNA, 25 bp, Homo sapien
gagtgaactctaaatataggttgta

SEQ ID NO: 471347 - DNA, 25 bp, Homo sapien
gtaataaaacatcattagcctaatt

SEQ ID NO: 471348 - DNA, 25 bp, Homo sapien
attaagtaccagcacatagaaacat

SEQ ID NO: 471349 - DNA, 25 bp, Homo sapien
gaaattgcttagtcattgtaccttt

SEQ ID NO: 471350 - DNA, 25 bp, Homo sapien
ctttgtcagcaattttgacagtcat

SEQ ID NO: 471351 - DNA, 25 bp, Homo sapien
gacagtcattaatgtttgtcataat

SEQ ID NO: 471352 - DNA, 25 bp, Homo sapien
gccctcttgtgtagttttcattgtg

SEQ ID NO: 471353 - DNA, 25 bp, Homo sapien
attgtgtctagtgcaatgccgtaaa

SEQ ID NO: 471354 - DNA, 25 bp, Homo sapien
tagtgcaatgccgtaaaccttaaca

SEQ ID NO: 471355 - DNA, 25 bp, Homo sapien
tgccgtaaaccttaacaccatgaga

SEQ ID NO: 471356 - DNA, 25 bp, Homo sapien
aaaccttaacaccatgagacccata

SEQ ID NO: 471357 - DNA, 25 bp, Homo sapien
ttaacaccatgagacccatatgaag

SEQ ID NO: 471358 - DNA, 25 bp, Homo sapien
atatgaagtgccaacagtgatgatg

SEQ ID NO: 471359 - DNA, 25 bp, Homo sapien
acagtgatgatggaagcgctttcaa

SEQ ID NO: 471360 - DNA, 25 bp, Homo sapien
atgatggaagcgctttcaaagaaag

SEQ ID NO: 471361 - DNA, 25 bp, Homo sapien
attataagaataaagcgacttgctt

SEQ ID NO: 471362 - DNA, 25 bp, Homo sapien
gtgcccggccctcttgtgtagtttt

SEQ ID NO: 471363 - DNA, 25 bp, Homo sapien
gaaagcagcccttagcaggctgcgg

SEQ ID NO: 471364 - DNA, 25 bp, Homo sapien
cccttagcaggctgcgggcacagtc

SEQ ID NO: 471365 - DNA, 25 bp, Homo sapien
agtcccggctcaagcacagcctaga

SEQ ID NO: 471366 - DNA, 25 bp, Homo sapien
agcacagcctagagcgcactgcagg

SEQ ID NO: 471367 - DNA, 25 bp, Homo sapien
tcctgctttccagctttggagtcct

SEQ ID NO: 471368 - DNA, 25 bp, Homo sapien
ttccagctttggagtccttgttaag

SEQ ID NO: 471369 - DNA, 25 bp, Homo sapien
gctttggagtccttgttaagaggga

SEQ ID NO: 471370 - DNA, 25 bp, Homo sapien
taagagggactcgaaccacaaggtt

SEQ ID NO: 471371 - DNA, 25 bp, Homo sapien
gagggactcgaaccacaaggttata

SEQ ID NO: 471372 - DNA, 25 bp, Homo sapien
ggttataaacacgacacctgcattc

SEQ ID NO: 471373 - DNA, 25 bp, Homo sapien
tttacacacaaagcttacaaccttt

SEQ ID NO: 471374 - DNA, 25 bp, Homo sapien
atgagtctccactaagcatggccta

SEQ ID NO: 471375 - DNA, 25 bp, Homo sapien
gcatggcctatgtctctgaaataaa

SEQ ID NO: 471376 - DNA, 25 bp, Homo sapien
aaaagtccttcaaaccacaggatct

SEQ ID NO: 471377 - DNA, 25 bp, Homo sapien
aaccacaggatctcagcactagaaa

SEQ ID NO: 471378 - DNA, 25 bp, Homo sapien
aagaaatttcctaaacacagtgcta

SEQ ID NO: 471379 - DNA, 25 bp, Homo sapien
acacagtgctaggaacagtcaatca

SEQ ID NO: 471380 - DNA, 25 bp, Homo sapien
gaaatcttttcccactgagcagtat

SEQ ID NO: 471381 - DNA, 25 bp, Homo sapien
agtatattgctatcagaacctggga

SEQ ID NO: 471382 - DNA, 25 bp, Homo sapien
tcctttcaataactctagctttcga

SEQ ID NO: 471383 - DNA, 25 bp, Homo sapien
taactctagctttcgaagtatgtat

SEQ ID NO: 471384 - DNA, 25 bp, Homo sapien
gaaattcagagctaatggatcaact

SEQ ID NO: 471385 - DNA, 25 bp, Homo sapien
gaagctggccttgggaacttcaagt

SEQ ID NO: 471386 - DNA, 25 bp, Homo sapien
agctggccttgggaacttcaagtaa

SEQ ID NO: 471387 - DNA, 25 bp, Homo sapien
gctggccttgggaacttcaagtaac

SEQ ID NO: 471388 - DNA, 25 bp, Homo sapien
tggccttgggaacttcaagtaacca

SEQ ID NO: 471389 - DNA, 25 bp, Homo sapien
ggccttgggaacttcaagtaaccag

SEQ ID NO: 471390 - DNA, 25 bp, Homo sapien
gccttgggaacttcaagtaaccagg

SEQ ID NO: 471391 - DNA, 25 bp, Homo sapien
ttgggaacttcaagtaaccaggcat

SEQ ID NO: 471392 - DNA, 25 bp, Homo sapien
tgggaacttcaagtaaccaggcatt

SEQ ID NO: 471393 - DNA, 25 bp, Homo sapien
gggaacttcaagtaaccaggcattt

SEQ ID NO: 471394 - DNA, 25 bp, Homo sapien
ggaacttcaagtaaccaggcattta

SEQ ID NO: 471395 - DNA, 25 bp, Homo sapien
gaacttcaagtaaccaggcatttaa

SEQ ID NO: 471396 - DNA, 25 bp, Homo sapien
aatacaaaaatagggccaggtgctg

SEQ ID NO: 471397 - DNA, 25 bp, Homo sapien
atacaaaaatagggccaggtgctgt

SEQ ID NO: 471398 - DNA, 25 bp, Homo sapien
tacaaaaatagggccaggtgctgtg

SEQ ID NO: 471399 - DNA, 25 bp, Homo sapien
acaaaaatagggccaggtgctgtgg

SEQ ID NO: 471400 - DNA, 25 bp, Homo sapien
aaaaatagggccaggtgctgtggct

SEQ ID NO: 471401 - DNA, 25 bp, Homo sapien
ggagattgtggtgagtcgaaatcgt

SEQ ID NO: 471402 - DNA, 25 bp, Homo sapien
agattgtggtgagtcgaaatcgtgc

SEQ ID NO: 471403 - DNA, 25 bp, Homo sapien
attgtggtgagtcgaaatcgtgcca

SEQ ID NO: 471404 - DNA, 25 bp, Homo sapien
ttgtggtgagtcgaaatcgtgccat

SEQ ID NO: 471405 - DNA, 25 bp, Homo sapien
tgtggtgagtcgaaatcgtgccatt

SEQ ID NO: 471406 - DNA, 25 bp, Homo sapien
tggtgagtcgaaatcgtgccattgc

SEQ ID NO: 471407 - DNA, 25 bp, Homo sapien
gggagtgcttacacttatggagcta

SEQ ID NO: 471408 - DNA, 25 bp, Homo sapien
ggagtgcttacacttatggagctaa

SEQ ID NO: 471409 - DNA, 25 bp, Homo sapien
gagtgcttacacttatggagctaac

SEQ ID NO: 471410 - DNA, 25 bp, Homo sapien
agtgcttacacttatggagctaaca

SEQ ID NO: 471411 - DNA, 25 bp, Homo sapien
gtgcttacacttatggagctaacat

SEQ ID NO: 471412 - DNA, 25 bp, Homo sapien
tgcttacacttatggagctaacatt

SEQ ID NO: 471413 - DNA, 25 bp, Homo sapien
gcttacacttatggagctaacattt

SEQ ID NO: 471414 - DNA, 25 bp, Homo sapien
ttacacttatggagctaacattttc

SEQ ID NO: 471415 - DNA, 25 bp, Homo sapien
acacttatggagctaacattttcag

SEQ ID NO: 471416 - DNA, 25 bp, Homo sapien
cacttatggagctaacattttcaga

SEQ ID NO: 471417 - DNA, 25 bp, Homo sapien
acttatggagctaacattttcagag

SEQ ID NO: 471418 - DNA, 25 bp, Homo sapien
gaatgagcactatatgaagaattac

SEQ ID NO: 471419 - DNA, 25 bp, Homo sapien
ttttaaagcataggtctgtgatcat

SEQ ID NO: 471420 - DNA, 25 bp, Homo sapien
aggtctgtgatcattttgtaggttt

SEQ ID NO: 471421 - DNA, 25 bp, Homo sapien
gtgatcattttgtaggtttttgttg

SEQ ID NO: 471422 - DNA, 25 bp, Homo sapien
tgttactgtcagtctattggttttt

SEQ ID NO: 471423 - DNA, 25 bp, Homo sapien
gtataactgatacacaaacgacata

SEQ ID NO: 471424 - DNA, 25 bp, Homo sapien
agtttggacatatccgaggactcat

SEQ ID NO: 471425 - DNA, 25 bp, Homo sapien
atccgaggactcatgagactgtcac

SEQ ID NO: 471426 - DNA, 25 bp, Homo sapien
ggactcatgagactgtcactgcaat

SEQ ID NO: 471427 - DNA, 25 bp, Homo sapien
gagactgtcactgcaatcaaggtaa

SEQ ID NO: 471428 - DNA, 25 bp, Homo sapien
gtcactgcaatcaaggtaataaatg

SEQ ID NO: 471429 - DNA, 25 bp, Homo sapien
ggagtgtgaatagccgtaacttgcc

SEQ ID NO: 471430 - DNA, 25 bp, Homo sapien
gtgtgaatagccgtaacttgcctgc

SEQ ID NO: 471431 - DNA, 25 bp, Homo sapien
gtgaatagccgtaacttgcctgcac

SEQ ID NO: 471432 - DNA, 25 bp, Homo sapien
tgaatagccgtaacttgcctgcacc

SEQ ID NO: 471433 - DNA, 25 bp, Homo sapien
aatagccgtaacttgcctgcacctg

SEQ ID NO: 471434 - DNA, 25 bp, Homo sapien
atagccgtaacttgcctgcacctgc

SEQ ID NO: 471435 - DNA, 25 bp, Homo sapien
tgcacctgctgccttaacagtggag

SEQ ID NO: 471436 - DNA, 25 bp, Homo sapien
gctgccttaacagtggagttggcca

SEQ ID NO: 471437 - DNA, 25 bp, Homo sapien
ttaacagtggagttggccaggcgca

SEQ ID NO: 471438 - DNA, 25 bp, Homo sapien
gcttgaatatgagaggcggagccaa

SEQ ID NO: 471439 - DNA, 25 bp, Homo sapien
atatgagaggcggagccaagatgat

SEQ ID NO: 471440 - DNA, 25 bp, Homo sapien
ctctgggagtgacaggacattttct

SEQ ID NO: 471441 - DNA, 25 bp, Homo sapien
acattttctgcactgccccgaggaa

SEQ ID NO: 471442 - DNA, 25 bp, Homo sapien
actgccccgaggaacgctgagcctt

SEQ ID NO: 471443 - DNA, 25 bp, Homo sapien
tccctgggtttgtctggacaccgag

SEQ ID NO: 471444 - DNA, 25 bp, Homo sapien
tctggacaccgagagcgaccacatc

SEQ ID NO: 471445 - DNA, 25 bp, Homo sapien
accccatactcttggctctgtagca

SEQ ID NO: 471446 - DNA, 25 bp, Homo sapien
atactcttggctctgtagcatttcc

SEQ ID NO: 471447 - DNA, 25 bp, Homo sapien
actcttggctctgtagcatttccaa

SEQ ID NO: 471448 - DNA, 25 bp, Homo sapien
gcatttccaagttcagataaacccc

SEQ ID NO: 471449 - DNA, 25 bp, Homo sapien
agttcagataaacccctgagtgctc

SEQ ID NO: 471450 - DNA, 25 bp, Homo sapien
tcagataaacccctgagtgctcacc

SEQ ID NO: 471451 - DNA, 25 bp, Homo sapien
aagatatatatagggtagggcatgg

SEQ ID NO: 471452 - DNA, 25 bp, Homo sapien
atatatatagggtagggcatggtga

SEQ ID NO: 471453 - DNA, 25 bp, Homo sapien
tatatatagggtagggcatggtgac

SEQ ID NO: 471454 - DNA, 25 bp, Homo sapien
atatatagggtagggcatggtgacc

SEQ ID NO: 471455 - DNA, 25 bp, Homo sapien
atatagggtagggcatggtgaccca

SEQ ID NO: 471456 - DNA, 25 bp, Homo sapien
atagggtagggcatggtgacccaca

SEQ ID NO: 471457 - DNA, 25 bp, Homo sapien
agggtagggcatggtgacccacacc

SEQ ID NO: 471458 - DNA, 25 bp, Homo sapien
gggtagggcatggtgacccacacct

SEQ ID NO: 471459 - DNA, 25 bp, Homo sapien
agacctcatctttacaaaacgttag

SEQ ID NO: 471460 - DNA, 25 bp, Homo sapien
ggattgcccgagtccaggaattaga

SEQ ID NO: 471461 - DNA, 25 bp, Homo sapien
ccgagtccaggaattagaggttgca

SEQ ID NO: 471462 - DNA, 25 bp, Homo sapien
tctgaaaagttttctcacatatttt

SEQ ID NO: 471463 - DNA, 25 bp, Homo sapien
gaaaagttttctcacatattttata

SEQ ID NO: 471464 - DNA, 25 bp, Homo sapien
ttcatttctggtggagaaacctagc

SEQ ID NO: 471465 - DNA, 25 bp, Homo sapien
ttctggtggagaaacctagcaatct

SEQ ID NO: 471466 - DNA, 25 bp, Homo sapien
tggtggagaaacctagcaatctgtg

SEQ ID NO: 471467 - DNA, 25 bp, Homo sapien
gtggagaaacctagcaatctgtgga

SEQ ID NO: 471468 - DNA, 25 bp, Homo sapien
ggagaaacctagcaatctgtggata

SEQ ID NO: 471469 - DNA, 25 bp, Homo sapien
tctgtggataatacatgggtgagcc

SEQ ID NO: 471470 - DNA, 25 bp, Homo sapien
gataatacatgggtgagccagtatc

SEQ ID NO: 471471 - DNA, 25 bp, Homo sapien
atacatgggtgagccagtatctgga

SEQ ID NO: 471472 - DNA, 25 bp, Homo sapien
tgggtgagccagtatctggaaaccc

SEQ ID NO: 471473 - DNA, 25 bp, Homo sapien
ggtgtgggtcccacctctgtcctca

SEQ ID NO: 471474 - DNA, 25 bp, Homo sapien
gggaccagggctctaggctgaggtc

SEQ ID NO: 471475 - DNA, 25 bp, Homo sapien
tctaggctgaggtccggctgagctc

SEQ ID NO: 471476 - DNA, 25 bp, Homo sapien
gaagaggctaccttggtcttatcca

SEQ ID NO: 471477 - DNA, 25 bp, Homo sapien
agaggctaccttggtcttatccacc

SEQ ID NO: 471478 - DNA, 25 bp, Homo sapien
agaacaggacctgctccagtcagtg

SEQ ID NO: 471479 - DNA, 25 bp, Homo sapien
gaacaggacctgctccagtcagtgc

SEQ ID NO: 471480 - DNA, 25 bp, Homo sapien
catggacatgctgaatgaacgaatg

SEQ ID NO: 471481 - DNA, 25 bp, Homo sapien
aatgactattccaatgagccggcct

SEQ ID NO: 471482 - DNA, 25 bp, Homo sapien
tgactattccaatgagccggcctag

SEQ ID NO: 471483 - DNA, 25 bp, Homo sapien
actattccaatgagccggcctaggg

SEQ ID NO: 471484 - DNA, 25 bp, Homo sapien
tgcaggtggaagggcctgaccccaa

SEQ ID NO: 471485 - DNA, 25 bp, Homo sapien
acaggagctgctggtgattaggagc

SEQ ID NO: 471486 - DNA, 25 bp, Homo sapien
caggagctgctggtgattaggagcc

SEQ ID NO: 471487 - DNA, 25 bp, Homo sapien
ggagctgctggtgattaggagccgc

SEQ ID NO: 471488 - DNA, 25 bp, Homo sapien
gagctgctggtgattaggagccgcc

SEQ ID NO: 471489 - DNA, 25 bp, Homo sapien
agctgctggtgattaggagccgccg

SEQ ID NO: 471490 - DNA, 25 bp, Homo sapien
gctgctggtgattaggagccgccgg

SEQ ID NO: 471491 - DNA, 25 bp, Homo sapien
ctgctggtgattaggagccgccggg

SEQ ID NO: 471492 - DNA, 25 bp, Homo sapien
tggtgattaggagccgccggggacg

SEQ ID NO: 471493 - DNA, 25 bp, Homo sapien
tcagcgctgacggccagtcccggcc

SEQ ID NO: 471494 - DNA, 25 bp, Homo sapien
tccccgccctgcaggcctgcggaac

SEQ ID NO: 471495 - DNA, 25 bp, Homo sapien
ttgccctataggttgcatactaact

SEQ ID NO: 471496 - DNA, 25 bp, Homo sapien
tcatgtcaccataaaatgcctttag

SEQ ID NO: 471497 - DNA, 25 bp, Homo sapien
gcctttagcatttctcaatgactgg

SEQ ID NO: 471498 - DNA, 25 bp, Homo sapien
aattttcctttattgcctagctgct

SEQ ID NO: 471499 - DNA, 25 bp, Homo sapien
ctgcttgtgtttgagtggttgtcct

SEQ ID NO: 471500 - DNA, 25 bp, Homo sapien
gtggttgtcctatgagcaatgcatt

SEQ ID NO: 471501 - DNA, 25 bp, Homo sapien
agcaatgcatttggagttcttcagc

SEQ ID NO: 471502 - DNA, 25 bp, Homo sapien
ggagttcttcagctttcactacttc

SEQ ID NO: 471503 - DNA, 25 bp, Homo sapien
tcactacttctctgttgcttgctaa

SEQ ID NO: 471504 - DNA, 25 bp, Homo sapien
tgcttgctaatcatgtaactactaa

SEQ ID NO: 471505 - DNA, 25 bp, Homo sapien
gagggctcatgtgatgatcatttgt

SEQ ID NO: 471506 - DNA, 25 bp, Homo sapien
tgcctatcctcactaatgcgtgcaa

SEQ ID NO: 471507 - DNA, 25 bp, Homo sapien
taatgcgtgcaacattcctcggtat

SEQ ID NO: 471508 - DNA, 25 bp, Homo sapien
gtgcaacattcctcggtatctaatt

SEQ ID NO: 471509 - DNA, 25 bp, Homo sapien
cattcctcggtatctaatttcctta

SEQ ID NO: 471510 - DNA, 25 bp, Homo sapien
aaattttgcatcattcgtctggcct

SEQ ID NO: 471511 - DNA, 25 bp, Homo sapien
attcgtctggccttgaatctggagc

SEQ ID NO: 471512 - DNA, 25 bp, Homo sapien
gaatctggagccgtgtcttggttaa

SEQ ID NO: 471513 - DNA, 25 bp, Homo sapien
gagccgtgtcttggttaaatcaatt

SEQ ID NO: 471514 - DNA, 25 bp, Homo sapien
ggatacgtagtgatatattactgag

SEQ ID NO: 471515 - DNA, 25 bp, Homo sapien
gaggaaacattcagactacaatata

SEQ ID NO: 471516 - DNA, 25 bp, Homo sapien
atggcactttgcaatcttgtttata

SEQ ID NO: 471517 - DNA, 25 bp, Homo sapien
attaaacctattagtgtatttgata

SEQ ID NO: 471518 - DNA, 25 bp, Homo sapien
tgcttactggccttctttaagcctt

SEQ ID NO: 471519 - DNA, 25 bp, Homo sapien
gcttactggccttctttaagccttt

SEQ ID NO: 471520 - DNA, 25 bp, Homo sapien
aagcctttggggaagagtctgttca

SEQ ID NO: 471521 - DNA, 25 bp, Homo sapien
gctgaagtgcgtggccagatcatgt

SEQ ID NO: 471522 - DNA, 25 bp, Homo sapien
tggccagatcatgtggttttgcaat

SEQ ID NO: 471523 - DNA, 25 bp, Homo sapien
ggccagatcatgtggttttgcaata

SEQ ID NO: 471524 - DNA, 25 bp, Homo sapien
gccagatcatgtggttttgcaatat

SEQ ID NO: 471525 - DNA, 25 bp, Homo sapien
ccagatcatgtggttttgcaatatt

SEQ ID NO: 471526 - DNA, 25 bp, Homo sapien
cagatcatgtggttttgcaatattt

SEQ ID NO: 471527 - DNA, 25 bp, Homo sapien
gatcatgtggttttgcaatatttat

SEQ ID NO: 471528 - DNA, 25 bp, Homo sapien
cctcgaatgaatggcttagtgaact

SEQ ID NO: 471529 - DNA, 25 bp, Homo sapien
cgaatgaatggcttagtgaactgac

SEQ ID NO: 471530 - DNA, 25 bp, Homo sapien
cttagtgaactgacccaggaagttg

SEQ ID NO: 471531 - DNA, 25 bp, Homo sapien
ttagtgaactgacccaggaagttga

SEQ ID NO: 471532 - DNA, 25 bp, Homo sapien
gtgaactgacccaggaagttgatgt

SEQ ID NO: 471533 - DNA, 25 bp, Homo sapien
gaactgacccaggaagttgatgtag

SEQ ID NO: 471534 - DNA, 25 bp, Homo sapien
actgacccaggaagttgatgtagac

SEQ ID NO: 471535 - DNA, 25 bp, Homo sapien
tgacccaggaagttgatgtagactt

SEQ ID NO: 471536 - DNA, 25 bp, Homo sapien
acccaggaagttgatgtagacttac

SEQ ID NO: 471537 - DNA, 25 bp, Homo sapien
tgtagacttacattttgttcattaa

SEQ ID NO: 471538 - DNA, 25 bp, Homo sapien
aatcaagcagttgccagcactttgg

SEQ ID NO: 471539 - DNA, 25 bp, Homo sapien
attgcagctcacagctgagctatgg

SEQ ID NO: 471540 - DNA, 25 bp, Homo sapien
agacttgagcatcaaccggcaggat

SEQ ID NO: 471541 - DNA, 25 bp, Homo sapien
aaccggcaggatggagactcaccag

SEQ ID NO: 471542 - DNA, 25 bp, Homo sapien
ctcaccaggagggattacatcacaa

SEQ ID NO: 471543 - DNA, 25 bp, Homo sapien
tacatcacaatcacacagggaacca

SEQ ID NO: 471544 - DNA, 25 bp, Homo sapien
gggaaccactgtcactttaatcatt

SEQ ID NO: 471545 - DNA, 25 bp, Homo sapien
ttatcacctgactagttcctctctg

SEQ ID NO: 471546 - DNA, 25 bp, Homo sapien
gactagttcctctctgtgatgtgga

SEQ ID NO: 471547 - DNA, 25 bp, Homo sapien
gatgtggaaattgtatcctcaactg

SEQ ID NO: 471548 - DNA, 25 bp, Homo sapien
gtatcctcaactgccagtttaccta

SEQ ID NO: 471549 - DNA, 25 bp, Homo sapien
actgccagtttacctaatgattaga

SEQ ID NO: 471550 - DNA, 25 bp, Homo sapien
ttctgtggtcatactgccttctctc

SEQ ID NO: 471551 - DNA, 25 bp, Homo sapien
tcatactgccttctctcgtctgtaa

SEQ ID NO: 471552 - DNA, 25 bp, Homo sapien
tctcgtctgtaacctgaccctcatg

SEQ ID NO: 471553 - DNA, 25 bp, Homo sapien
gtctgtaacctgaccctcatgcatc

SEQ ID NO: 471554 - DNA, 25 bp, Homo sapien
atgcatccctcttttcatttactga

SEQ ID NO: 471555 - DNA, 25 bp, Homo sapien
ttactgaaaaagcaatgactgtgac

SEQ ID NO: 471556 - DNA, 25 bp, Homo sapien
gcaatgactgtgacatgactaaata

SEQ ID NO: 471557 - DNA, 25 bp, Homo sapien
gataacaaatcaatacgcagggtat

SEQ ID NO: 471558 - DNA, 25 bp, Homo sapien
acgcagggtatgaaattactccaga

SEQ ID NO: 471559 - DNA, 25 bp, Homo sapien
ataattatattcatggttgctcaag

SEQ ID NO: 471560 - DNA, 25 bp, Homo sapien
attcatggttgctcaagatataaag

SEQ ID NO: 471561 - DNA, 25 bp, Homo sapien
ctctggctgtacaaggcggcaggat

SEQ ID NO: 471562 - DNA, 25 bp, Homo sapien
ggcggcaggatggatttggcctttg

SEQ ID NO: 471563 - DNA, 25 bp, Homo sapien
gtagtttgccaaccactcaactaga

SEQ ID NO: 471564 - DNA, 25 bp, Homo sapien
ttgccaaccactcaactagacttta

SEQ ID NO: 471565 - DNA, 25 bp, Homo sapien
caactagactttaagtaagcgtgtt

SEQ ID NO: 471566 - DNA, 25 bp, Homo sapien
gagtgaacattcaccctgtttgtct

SEQ ID NO: 471567 - DNA, 25 bp, Homo sapien
cctgtttgtctcaacctaaaggaag

SEQ ID NO: 471568 - DNA, 25 bp, Homo sapien
agaggactaaacttactggctaaag

SEQ ID NO: 471569 - DNA, 25 bp, Homo sapien
acttactggctaaaggacagcttgc

SEQ ID NO: 471570 - DNA, 25 bp, Homo sapien
taaaggacagcttgccagaatggat

SEQ ID NO: 471571 - DNA, 25 bp, Homo sapien
ggacagcttgccagaatggattttt

SEQ ID NO: 471572 - DNA, 25 bp, Homo sapien
tagtcatgtcggtgtatctttaaca

SEQ ID NO: 471573 - DNA, 25 bp, Homo sapien
gtatctttaacactgcttcaagcaa

SEQ ID NO: 471574 - DNA, 25 bp, Homo sapien
aagaacccaacctctggtcttgctg

SEQ ID NO: 471575 - DNA, 25 bp, Homo sapien
gtcttgctgctttattaatactggt

SEQ ID NO: 471576 - DNA, 25 bp, Homo sapien
tattaatactggttagcactctaaa

SEQ ID NO: 471577 - DNA, 25 bp, Homo sapien
gcactctaaaaattctgggttaaga

SEQ ID NO: 471578 - DNA, 25 bp, Homo sapien
tctgggttaagaccttatggagttt

SEQ ID NO: 471579 - DNA, 25 bp, Homo sapien
gagttcattctgacatgtgatattt

SEQ ID NO: 471580 - DNA, 25 bp, Homo sapien
gagccaatcctctaagatggatcct

SEQ ID NO: 471581 - DNA, 25 bp, Homo sapien
taagatggatcctgagtggctaacc

SEQ ID NO: 471582 - DNA, 25 bp, Homo sapien
ctgagtggctaaccgggtctaaatt

SEQ ID NO: 471583 - DNA, 25 bp, Homo sapien
cagtcgttcctaggccctgataatg

SEQ ID NO: 471584 - DNA, 25 bp, Homo sapien
tgataatgttacactgcagggacag

SEQ ID NO: 471585 - DNA, 25 bp, Homo sapien
gacagtgtggacaatattcgtgact

SEQ ID NO: 471586 - DNA, 25 bp, Homo sapien
atattcgtgacttggcggcacatct

SEQ ID NO: 471587 - DNA, 25 bp, Homo sapien
cggcacatctcgacactgcagtgaa

SEQ ID NO: 471588 - DNA, 25 bp, Homo sapien
aaggcaccacaaaagcctcgctggt

SEQ ID NO: 471589 - DNA, 25 bp, Homo sapien
aaagcctcgctggtgtgactcaaga

SEQ ID NO: 471590 - DNA, 25 bp, Homo sapien
atagcttgggctgctttatctgggt

SEQ ID NO: 471591 - DNA, 25 bp, Homo sapien
tctggctttaatgggcaccgaggta

SEQ ID NO: 471592 - DNA, 25 bp, Homo sapien
tgggcaccgaggtacctaggaactt

SEQ ID NO: 471593 - DNA, 25 bp, Homo sapien
ggccaagtttctgtagttcccacat

SEQ ID NO: 471594 - DNA, 25 bp, Homo sapien
taatttcttggcatgtggttttggc

SEQ ID NO: 471595 - DNA, 25 bp, Homo sapien
tcttggcatgtggttttggcaatca

SEQ ID NO: 471596 - DNA, 25 bp, Homo sapien
ggttttggcaatcagagttttattt

SEQ ID NO: 471597 - DNA, 25 bp, Homo sapien
tttttccctgtacctgcttggttag

SEQ ID NO: 471598 - DNA, 25 bp, Homo sapien
gactttaaaatcttgtcctggccca

SEQ ID NO: 471599 - DNA, 25 bp, Homo sapien
aaatcttgtcctggcccaattgaga

SEQ ID NO: 471600 - DNA, 25 bp, Homo sapien
ggcccaattgagaggagttatctag

SEQ ID NO: 471601 - DNA, 25 bp, Homo sapien
gaaaaataggtaggccctggctgct

SEQ ID NO: 471602 - DNA, 25 bp, Homo sapien
tttctgggctaagacccgtaacctg

SEQ ID NO: 471603 - DNA, 25 bp, Homo sapien
gtaacctgggtttcttcatttgaag

SEQ ID NO: 471604 - DNA, 25 bp, Homo sapien
agtgtgagaatgcacgtgtaatccc

SEQ ID NO: 471605 - DNA, 25 bp, Homo sapien
actgattttgtcctcctataacttc

SEQ ID NO: 471606 - DNA, 25 bp, Homo sapien
ctataacttcactccattctttaca

SEQ ID NO: 471607 - DNA, 25 bp, Homo sapien
aattttactacttagccaatgccaa

SEQ ID NO: 471608 - DNA, 25 bp, Homo sapien
atagaaccgctataatcaagatgag

SEQ ID NO: 471609 - DNA, 25 bp, Homo sapien
ctgagggtaggaaaacattcccagt

SEQ ID NO: 471610 - DNA, 25 bp, Homo sapien
attcccagtggaaataatgttcttt

SEQ ID NO: 471611 - DNA, 25 bp, Homo sapien
tgttctttatacaggacatcttacc

SEQ ID NO: 471612 - DNA, 25 bp, Homo sapien
ggacatcttacctcctcaaggaaat

SEQ ID NO: 471613 - DNA, 25 bp, Homo sapien
cctcctcaaggaaatctacagttta

SEQ ID NO: 471614 - DNA, 25 bp, Homo sapien
ctacagtttatttttgatgacggtg

SEQ ID NO: 471615 - DNA, 25 bp, Homo sapien
tagggactcagtatctgtttggtgc

SEQ ID NO: 471616 - DNA, 25 bp, Homo sapien
ccctagcccccaactccctgacagg

SEQ ID NO: 471617 - DNA, 25 bp, Homo sapien
cctagcccccaactccctgacaggc

SEQ ID NO: 471618 - DNA, 25 bp, Homo sapien
ctagcccccaactccctgacaggcc

SEQ ID NO: 471619 - DNA, 25 bp, Homo sapien
tagcccccaactccctgacaggccc

SEQ ID NO: 471620 - DNA, 25 bp, Homo sapien
agcccccaactccctgacaggccct

SEQ ID NO: 471621 - DNA, 25 bp, Homo sapien
gcccccaactccctgacaggccctg

SEQ ID NO: 471622 - DNA, 25 bp, Homo sapien
catgcagtattttgttttctgttct

SEQ ID NO: 471623 - DNA, 25 bp, Homo sapien
atgcagtattttgttttctgttctt

SEQ ID NO: 471624 - DNA, 25 bp, Homo sapien
gcagtattttgttttctgttcttgt

SEQ ID NO: 471625 - DNA, 25 bp, Homo sapien
agtattttgttttctgttcttgtgt

SEQ ID NO: 471626 - DNA, 25 bp, Homo sapien
attttgttttctgttcttgtgttag

SEQ ID NO: 471627 - DNA, 25 bp, Homo sapien
gaaatcctgtaagaggttgtctgca

SEQ ID NO: 471628 - DNA, 25 bp, Homo sapien
ggttgtctgcaaactagagaccctg

SEQ ID NO: 471629 - DNA, 25 bp, Homo sapien
gatgctggtagtatgattcagtcca

SEQ ID NO: 471630 - DNA, 25 bp, Homo sapien
aacgcctcagaaccagagaacccaa

SEQ ID NO: 471631 - DNA, 25 bp, Homo sapien
caatggtccaattctcagtctgagg

SEQ ID NO: 471632 - DNA, 25 bp, Homo sapien
cagtctgaggttaaaggcctggcta

SEQ ID NO: 471633 - DNA, 25 bp, Homo sapien
aaggcctggctaaagcagggctgct

SEQ ID NO: 471634 - DNA, 25 bp, Homo sapien
gctgggctaagtcctggagtcctaa

SEQ ID NO: 471635 - DNA, 25 bp, Homo sapien
aagtcctggagtcctaaggctagag

SEQ ID NO: 471636 - DNA, 25 bp, Homo sapien
ggaagagagtatccttgctccaaga

SEQ ID NO: 471637 - DNA, 25 bp, Homo sapien
tccttgctccaagagagaggcaggg

SEQ ID NO: 471638 - DNA, 25 bp, Homo sapien
actttccttgtacatttggagagtg

SEQ ID NO: 471639 - DNA, 25 bp, Homo sapien
ttccttgtacatttggagagtggca

SEQ ID NO: 471640 - DNA, 25 bp, Homo sapien
tgccttttagataggatctaggagt

SEQ ID NO: 471641 - DNA, 25 bp, Homo sapien
atagcaacagcagctctgtacctca

SEQ ID NO: 471642 - DNA, 25 bp, Homo sapien
gcaacagcagctctgtacctcatct

SEQ ID NO: 471643 - DNA, 25 bp, Homo sapien
gtacctcatctgttgatcccacctt

SEQ ID NO: 471644 - DNA, 25 bp, Homo sapien
atctgttgatcccacctttgaagag

SEQ ID NO: 471645 - DNA, 25 bp, Homo sapien
gttgatcccacctttgaagaggaga

SEQ ID NO: 471646 - DNA, 25 bp, Homo sapien
gaggagacacagtgctcaccttaat

SEQ ID NO: 471647 - DNA, 25 bp, Homo sapien
gacacagtgctcaccttaattgcgc

SEQ ID NO: 471648 - DNA, 25 bp, Homo sapien
gtgctcaccttaattgcgctggtag

SEQ ID NO: 471649 - DNA, 25 bp, Homo sapien
gagctgccaggaagggtctccagtc

SEQ ID NO: 471650 - DNA, 25 bp, Homo sapien
gccaggaagggtctccagtctcagc

SEQ ID NO: 471651 - DNA, 25 bp, Homo sapien
gccatcccttcatcacttatagaaa

SEQ ID NO: 471652 - DNA, 25 bp, Homo sapien
ttcatcacttatagaaacccctctc

SEQ ID NO: 471653 - DNA, 25 bp, Homo sapien
atcagttcccctttctattccatgg

SEQ ID NO: 471654 - DNA, 25 bp, Homo sapien
agttcccctttctattccatgggag

SEQ ID NO: 471655 - DNA, 25 bp, Homo sapien
cccctttctattccatgggaggagt

SEQ ID NO: 471656 - DNA, 25 bp, Homo sapien
attccatgggaggagtattccaaac

SEQ ID NO: 471657 - DNA, 25 bp, Homo sapien
ggaggagtattccaaactggactac

SEQ ID NO: 471658 - DNA, 25 bp, Homo sapien
gccctttgctcatgtagagggtggt

SEQ ID NO: 471659 - DNA, 25 bp, Homo sapien
catgttttcccgaggcggagcttgc

SEQ ID NO: 471660 - DNA, 25 bp, Homo sapien
agcactggcccagggtgcgctggag

SEQ ID NO: 471661 - DNA, 25 bp, Homo sapien
tctgcccttgctgactacttttctg

SEQ ID NO: 471662 - DNA, 25 bp, Homo sapien
tgcccttgctgactacttttctgga

SEQ ID NO: 471663 - DNA, 25 bp, Homo sapien
gcccttgctgactacttttctggaa

SEQ ID NO: 471664 - DNA, 25 bp, Homo sapien
cccttgctgactacttttctggaat

SEQ ID NO: 471665 - DNA, 25 bp, Homo sapien
ccttgctgactacttttctggaatg

SEQ ID NO: 471666 - DNA, 25 bp, Homo sapien
cttgctgactacttttctggaatgt

SEQ ID NO: 471667 - DNA, 25 bp, Homo sapien
ttgctgactacttttctggaatgtg

SEQ ID NO: 471668 - DNA, 25 bp, Homo sapien
gggaaataaacaagtgcctgtttca

SEQ ID NO: 471669 - DNA, 25 bp, Homo sapien
taaacaagtgcctgtttcagctgct

SEQ ID NO: 471670 - DNA, 25 bp, Homo sapien
aaacaagtgcctgtttcagctgctt

SEQ ID NO: 471671 - DNA, 25 bp, Homo sapien
gcaagttgtacatatgtaccctaaa

SEQ ID NO: 471672 - DNA, 25 bp, Homo sapien
gatcagtagctcatccaagggcaca

SEQ ID NO: 471673 - DNA, 25 bp, Homo sapien
tcagtagctcatccaagggcacagt

SEQ ID NO: 471674 - DNA, 25 bp, Homo sapien
agtagctcatccaagggcacagtaa

SEQ ID NO: 471675 - DNA, 25 bp, Homo sapien
gtagctcatccaagggcacagtaaa

SEQ ID NO: 471676 - DNA, 25 bp, Homo sapien
tagctcatccaagggcacagtaaaa

SEQ ID NO: 471677 - DNA, 25 bp, Homo sapien
tcatccaagggcacagtaaaagttg

SEQ ID NO: 471678 - DNA, 25 bp, Homo sapien
caagggcacagtaaaagttgacgct

SEQ ID NO: 471679 - DNA, 25 bp, Homo sapien
gggcacagtaaaagttgacgctgaa

SEQ ID NO: 471680 - DNA, 25 bp, Homo sapien
agtaaaagttgacgctgaaattcca

SEQ ID NO: 471681 - DNA, 25 bp, Homo sapien
aaaagttgacgctgaaattccaggt

SEQ ID NO: 471682 - DNA, 25 bp, Homo sapien
acagtggctcgtgtcacctgcagag

SEQ ID NO: 471683 - DNA, 25 bp, Homo sapien
gcaggtcttagagctggcatactgt

SEQ ID NO: 471684 - DNA, 25 bp, Homo sapien
agagctggcatactgtcaacactaa

SEQ ID NO: 471685 - DNA, 25 bp, Homo sapien
taaaatgccacatgcccttcatact

SEQ ID NO: 471686 - DNA, 25 bp, Homo sapien
atgcccttcatactgtacctttagc

SEQ ID NO: 471687 - DNA, 25 bp, Homo sapien
tgtacctttagcaactctaccttat

SEQ ID NO: 471688 - DNA, 25 bp, Homo sapien
tctaccttatctcacctttggagtg

SEQ ID NO: 471689 - DNA, 25 bp, Homo sapien
gaggtgaactctgaagtctatctta

SEQ ID NO: 471690 - DNA, 25 bp, Homo sapien
tcttatttcagattacaggtcaaag

SEQ ID NO: 471691 - DNA, 25 bp, Homo sapien
ggtcaaagtcattcacgtgtagctc

SEQ ID NO: 471692 - DNA, 25 bp, Homo sapien
attcacgtgtagctcagggccatga

SEQ ID NO: 471693 - DNA, 25 bp, Homo sapien
acgccattctcctcaactggaggat

SEQ ID NO: 471694 - DNA, 25 bp, Homo sapien
gccattctcctcaactggaggattc

SEQ ID NO: 471695 - DNA, 25 bp, Homo sapien
cattctcctcaactggaggattcta

SEQ ID NO: 471696 - DNA, 25 bp, Homo sapien
attctcctcaactggaggattctac

SEQ ID NO: 471697 - DNA, 25 bp, Homo sapien
tctcctcaactggaggattctacgc

SEQ ID NO: 471698 - DNA, 25 bp, Homo sapien
tcctcaactggaggattctacgcct

SEQ ID NO: 471699 - DNA, 25 bp, Homo sapien
tcaactggaggattctacgcctccc

SEQ ID NO: 471700 - DNA, 25 bp, Homo sapien
aactggaggattctacgcctcccaa

SEQ ID NO: 471701 - DNA, 25 bp, Homo sapien
actggaggattctacgcctcccaag

SEQ ID NO: 471702 - DNA, 25 bp, Homo sapien
tggaggattctacgcctcccaagta

SEQ ID NO: 471703 - DNA, 25 bp, Homo sapien
gaggattctacgcctcccaagtagc

SEQ ID NO: 471704 - DNA, 25 bp, Homo sapien
ttttccctccttacacacaatgtag

SEQ ID NO: 471705 - DNA, 25 bp, Homo sapien
tttccctccttacacacaatgtaga

SEQ ID NO: 471706 - DNA, 25 bp, Homo sapien
tccctccttacacacaatgtagact

SEQ ID NO: 471707 - DNA, 25 bp, Homo sapien
ctccttacacacaatgtagactgat

SEQ ID NO: 471708 - DNA, 25 bp, Homo sapien
acacacaatgtagactgatagaaaa

SEQ ID NO: 471709 - DNA, 25 bp, Homo sapien
atataaattttgtaagctccaccca

SEQ ID NO: 471710 - DNA, 25 bp, Homo sapien
ataaattttgtaagctccacccatg

SEQ ID NO: 471711 - DNA, 25 bp, Homo sapien
aaattttgtaagctccacccatgac

SEQ ID NO: 471712 - DNA, 25 bp, Homo sapien
aattttgtaagctccacccatgacc

SEQ ID NO: 471713 - DNA, 25 bp, Homo sapien
ttttgtaagctccacccatgacctg

SEQ ID NO: 471714 - DNA, 25 bp, Homo sapien
tttgtaagctccacccatgacctgc

SEQ ID NO: 471715 - DNA, 25 bp, Homo sapien
tgggcaaggaaacccttctatggcc

SEQ ID NO: 471716 - DNA, 25 bp, Homo sapien
gggcaaggaaacccttctatggcca

SEQ ID NO: 471717 - DNA, 25 bp, Homo sapien
ggcaaggaaacccttctatggccag

SEQ ID NO: 471718 - DNA, 25 bp, Homo sapien
gcaaggaaacccttctatggccagg

SEQ ID NO: 471719 - DNA, 25 bp, Homo sapien
caaggaaacccttctatggccagga

SEQ ID NO: 471720 - DNA, 25 bp, Homo sapien
aaggaaacccttctatggccaggag

SEQ ID NO: 471721 - DNA, 25 bp, Homo sapien
aggaaacccttctatggccaggagt

SEQ ID NO: 471722 - DNA, 25 bp, Homo sapien
ggaaacccttctatggccaggagtg

SEQ ID NO: 471723 - DNA, 25 bp, Homo sapien
gaaacccttctatggccaggagtgg

SEQ ID NO: 471724 - DNA, 25 bp, Homo sapien
aaacccttctatggccaggagtggt

SEQ ID NO: 471725 - DNA, 25 bp, Homo sapien
atgaaaaaggctcaacaccaccaat

SEQ ID NO: 471726 - DNA, 25 bp, Homo sapien
aaaggctcaacaccaccaatcatta

SEQ ID NO: 471727 - DNA, 25 bp, Homo sapien
ctcacactagtcagaatggctgatg

SEQ ID NO: 471728 - DNA, 25 bp, Homo sapien
cagaatggctgatggctgttattaa

SEQ ID NO: 471729 - DNA, 25 bp, Homo sapien
ggagaaaaggcaatgcttatgcact

SEQ ID NO: 471730 - DNA, 25 bp, Homo sapien
aggcaatgcttatgcactgttggtg

SEQ ID NO: 471731 - DNA, 25 bp, Homo sapien
aattagttcaatcattgtggttgac

SEQ ID NO: 471732 - DNA, 25 bp, Homo sapien
caatcattgtggttgacagtgtggt

SEQ ID NO: 471733 - DNA, 25 bp, Homo sapien
gttgacagtgtggtgattcctcaaa

SEQ ID NO: 471734 - DNA, 25 bp, Homo sapien
tataattctacctagcaatgctact

SEQ ID NO: 471735 - DNA, 25 bp, Homo sapien
ctagcaatgctactactgggtatat

SEQ ID NO: 471736 - DNA, 25 bp, Homo sapien
gggcttaagtccttgatagagcttc

SEQ ID NO: 471737 - DNA, 25 bp, Homo sapien
gcacagtagttatagggccaggtca

SEQ ID NO: 471738 - DNA, 25 bp, Homo sapien
ggccaggtcagaaaatgtcctcaca

SEQ ID NO: 471739 - DNA, 25 bp, Homo sapien
gtcctcacacactaagaaggcattt

SEQ ID NO: 471740 - DNA, 25 bp, Homo sapien
cttgtcccaaattgcagttccaatg

SEQ ID NO: 471741 - DNA, 25 bp, Homo sapien
aaaacctaaatccatctggctgtgg

SEQ ID NO: 471742 - DNA, 25 bp, Homo sapien
ccatctggctgtggaggtcaatctc

SEQ ID NO: 471743 - DNA, 25 bp, Homo sapien
aggtcaatctcgtattctctatgtg

SEQ ID NO: 471744 - DNA, 25 bp, Homo sapien
gtattctctatgtgatattgctgac

SEQ ID NO: 471745 - DNA, 25 bp, Homo sapien
ggaagcaccttttctttatagtaca

SEQ ID NO: 471746 - DNA, 25 bp, Homo sapien
agtacattcacctaccttaacagac

SEQ ID NO: 471747 - DNA, 25 bp, Homo sapien
aataagaagctgtaactttgggcca

SEQ ID NO: 471748 - DNA, 25 bp, Homo sapien
ataagaagctgtaactttgggccag

SEQ ID NO: 471749 - DNA, 25 bp, Homo sapien
taagaagctgtaactttgggccagg

SEQ ID NO: 471750 - DNA, 25 bp, Homo sapien
aagaagctgtaactttgggccaggt

SEQ ID NO: 471751 - DNA, 25 bp, Homo sapien
agaagctgtaactttgggccaggtg

SEQ ID NO: 471752 - DNA, 25 bp, Homo sapien
atctcagctacttggatgggtgagt

SEQ ID NO: 471753 - DNA, 25 bp, Homo sapien
tctcagctacttggatgggtgagtt

SEQ ID NO: 471754 - DNA, 25 bp, Homo sapien
ctcagctacttggatgggtgagttg

SEQ ID NO: 471755 - DNA, 25 bp, Homo sapien
gatgggtgagttgggagcgtcgctt

SEQ ID NO: 471756 - DNA, 25 bp, Homo sapien
ggtgagttgggagcgtcgcttgagc

SEQ ID NO: 471757 - DNA, 25 bp, Homo sapien
agctgtggttgcactactgagctgt

SEQ ID NO: 471758 - DNA, 25 bp, Homo sapien
cctgaagctatccaagattcccgaa

SEQ ID NO: 471759 - DNA, 25 bp, Homo sapien
gaagctatccaagattcccgaagcc

SEQ ID NO: 471760 - DNA, 25 bp, Homo sapien
ctatccaagattcccgaagcccggt

SEQ ID NO: 471761 - DNA, 25 bp, Homo sapien
caagattcccgaagcccggtcatct

SEQ ID NO: 471762 - DNA, 25 bp, Homo sapien
gaagcccggtcatctcattagcatg

SEQ ID NO: 471763 - DNA, 25 bp, Homo sapien
gcaaaagacacgcatatcactctgg

SEQ ID NO: 471764 - DNA, 25 bp, Homo sapien
atatcactctggagattccacgggt

SEQ ID NO: 471765 - DNA, 25 bp, Homo sapien
ctctggagattccacgggttttaga

SEQ ID NO: 471766 - DNA, 25 bp, Homo sapien
gattccacgggttttagaaactctg

SEQ ID NO: 471767 - DNA, 25 bp, Homo sapien
tttagaaactctggtccagcctggc

SEQ ID NO: 471768 - DNA, 25 bp, Homo sapien
agaaactctggtccagcctggccaa

SEQ ID NO: 471769 - DNA, 25 bp, Homo sapien
tttcttgccctatgctactcagaac

SEQ ID NO: 471770 - DNA, 25 bp, Homo sapien
gaacccgggttctgacagctgaaga

SEQ ID NO: 471771 - DNA, 25 bp, Homo sapien
agctgaagacccttggccctgtgga

SEQ ID NO: 471772 - DNA, 25 bp, Homo sapien
ttggccctgtggagccttaagcagg

SEQ ID NO: 471773 - DNA, 25 bp, Homo sapien
tctcagggcagaggtgtcaccagtc

SEQ ID NO: 471774 - DNA, 25 bp, Homo sapien
agaggtgtcaccagtcaccatcatt

SEQ ID NO: 471775 - DNA, 25 bp, Homo sapien
attccccaaatgctcatgctgaagg

SEQ ID NO: 471776 - DNA, 25 bp, Homo sapien
agccacagcatggataccagtcctg

SEQ ID NO: 471777 - DNA, 25 bp, Homo sapien
tgtaagcacaaacagtcccataggg

SEQ ID NO: 471778 - DNA, 25 bp, Homo sapien
aaacagtcccatagggcccaatcta

SEQ ID NO: 471779 - DNA, 25 bp, Homo sapien
agggcccaatctatacttctgtgct

SEQ ID NO: 471780 - DNA, 25 bp, Homo sapien
cgttcctaatgcagagccgccaacg

SEQ ID NO: 471781 - DNA, 25 bp, Homo sapien
cgctcagagtccctttcaggagata

SEQ ID NO: 471782 - DNA, 25 bp, Homo sapien
accgcaggtgtcaggcaatccgatt

SEQ ID NO: 471783 - DNA, 25 bp, Homo sapien
gtcaggcaatccgattataggacta

SEQ ID NO: 471784 - DNA, 25 bp, Homo sapien
aagctgactgaagttgtccccaagg

SEQ ID NO: 471785 - DNA, 25 bp, Homo sapien
tagccacttccccttggctttaagg

SEQ ID NO: 471786 - DNA, 25 bp, Homo sapien
tccccttggctttaaggcaggaaca

SEQ ID NO: 471787 - DNA, 25 bp, Homo sapien
aacactgaaggaagcctgagccata

SEQ ID NO: 471788 - DNA, 25 bp, Homo sapien
aagcctgagccatagcttctctgca

SEQ ID NO: 471789 - DNA, 25 bp, Homo sapien
tctctgcaccttcgctgcttctgag

SEQ ID NO: 471790 - DNA, 25 bp, Homo sapien
gagaacctagtctctgtgcttcatt

SEQ ID NO: 471791 - DNA, 25 bp, Homo sapien
acgtacattcttagtctgcaaggaa

SEQ ID NO: 471792 - DNA, 25 bp, Homo sapien
ggaaaagtgctcctgactgaccagc

SEQ ID NO: 471793 - DNA, 25 bp, Homo sapien
agtgctcctgactgaccagccagaa

SEQ ID NO: 471794 - DNA, 25 bp, Homo sapien
gaatcctctctcaggtcttttctat

SEQ ID NO: 471795 - DNA, 25 bp, Homo sapien
ctctctcaggtcttttctataataa

SEQ ID NO: 471796 - DNA, 25 bp, Homo sapien
aacatctccaaccaaaaacattcca

SEQ ID NO: 471797 - DNA, 25 bp, Homo sapien
gacacctcccacagagaaatgctag

SEQ ID NO: 471798 - DNA, 25 bp, Homo sapien
gaaatgctagcctcgggataacccc

SEQ ID NO: 471799 - DNA, 25 bp, Homo sapien
taacccctctcctgccggaaagatg

SEQ ID NO: 471800 - DNA, 25 bp, Homo sapien
ttgtaataagctccctcaccctaaa

SEQ ID NO: 471801 - DNA, 25 bp, Homo sapien
tcaccctaaaaccaacgtacattct

SEQ ID NO: 471802 - DNA, 25 bp, Homo sapien
catggtgttaagtatgaaggtgcta

SEQ ID NO: 471803 - DNA, 25 bp, Homo sapien
atggtgttaagtatgaaggtgctat

SEQ ID NO: 471804 - DNA, 25 bp, Homo sapien
tggtgttaagtatgaaggtgctata

SEQ ID NO: 471805 - DNA, 25 bp, Homo sapien
ggtgttaagtatgaaggtgctataa

SEQ ID NO: 471806 - DNA, 25 bp, Homo sapien
gtgttaagtatgaaggtgctataaa

SEQ ID NO: 471807 - DNA, 25 bp, Homo sapien
tgttaagtatgaaggtgctataaag

SEQ ID NO: 471808 - DNA, 25 bp, Homo sapien
gttaagtatgaaggtgctataaaga

SEQ ID NO: 471809 - DNA, 25 bp, Homo sapien
ttaagtatgaaggtgctataaagaa

SEQ ID NO: 471810 - DNA, 25 bp, Homo sapien
tgccagtaaggcacctgctacatca

SEQ ID NO: 471811 - DNA, 25 bp, Homo sapien
taaggcacctgctacatcatcatgt

SEQ ID NO: 471812 - DNA, 25 bp, Homo sapien
gctacatcatcatgtcacagaaggt

SEQ ID NO: 471813 - DNA, 25 bp, Homo sapien
aagaggcaaaaggagcccaaacttg

SEQ ID NO: 471814 - DNA, 25 bp, Homo sapien
caaaaggagcccaaacttgctcttt

SEQ ID NO: 471815 - DNA, 25 bp, Homo sapien
gtaaatcttatctttgatcaggttg

SEQ ID NO: 471816 - DNA, 25 bp, Homo sapien
gatcaggttgaagagttcccttcta

SEQ ID NO: 471817 - DNA, 25 bp, Homo sapien
gaagagttcccttctatttgtagtt

SEQ ID NO: 471818 - DNA, 25 bp, Homo sapien
cccttctatttgtagtttattgagc

SEQ ID NO: 471819 - DNA, 25 bp, Homo sapien
gagcatttaaaaagattatacccaa

SEQ ID NO: 471820 - DNA, 25 bp, Homo sapien
tacccaataattggattctgtcaaa

SEQ ID NO: 471821 - DNA, 25 bp, Homo sapien
aaaggtgtggacacctgcaggctct

SEQ ID NO: 471822 - DNA, 25 bp, Homo sapien
ggtgtgggtcccacctctgtcctca

SEQ ID NO: 471823 - DNA, 25 bp, Homo sapien
tctaggctgaggtccggctgagctc

SEQ ID NO: 471824 - DNA, 25 bp, Homo sapien
gctgagctccttagagaagaggcta

SEQ ID NO: 471825 - DNA, 25 bp, Homo sapien
gaagaggctaccttggtcttatcca

SEQ ID NO: 471826 - DNA, 25 bp, Homo sapien
agaggctaccttggtcttatccacc

SEQ ID NO: 471827 - DNA, 25 bp, Homo sapien
agaacaggacctgctccagtcagtg

SEQ ID NO: 471828 - DNA, 25 bp, Homo sapien
tccagtcagtgctcaacatggacat

SEQ ID NO: 471829 - DNA, 25 bp, Homo sapien
catggacatgctgaatgaacgaatg

SEQ ID NO: 471830 - DNA, 25 bp, Homo sapien
aatgactattccaatgagccggcct

SEQ ID NO: 471831 - DNA, 25 bp, Homo sapien
actattccaatgagccggcctaggg

SEQ ID NO: 471832 - DNA, 25 bp, Homo sapien
acatgaagcaaagtcaagactgcaa

SEQ ID NO: 471833 - DNA, 25 bp, Homo sapien
catgaagcaaagtcaagactgcaac

SEQ ID NO: 471834 - DNA, 25 bp, Homo sapien
atgaagcaaagtcaagactgcaacc

SEQ ID NO: 471835 - DNA, 25 bp, Homo sapien
tgaagcaaagtcaagactgcaaccc

SEQ ID NO: 471836 - DNA, 25 bp, Homo sapien
gaagcaaagtcaagactgcaacccg

SEQ ID NO: 471837 - DNA, 25 bp, Homo sapien
aagcaaagtcaagactgcaacccgg

SEQ ID NO: 471838 - DNA, 25 bp, Homo sapien
agcaaagtcaagactgcaacccggc

SEQ ID NO: 471839 - DNA, 25 bp, Homo sapien
gcaaagtcaagactgcaacccggcc

SEQ ID NO: 471840 - DNA, 25 bp, Homo sapien
caaagtcaagactgcaacccggccg

SEQ ID NO: 471841 - DNA, 25 bp, Homo sapien
gaaattttcaacaagtaggaccaag

SEQ ID NO: 471842 - DNA, 25 bp, Homo sapien
gtaggaccaagatactaaagcattc

SEQ ID NO: 471843 - DNA, 25 bp, Homo sapien
agatactaaagcattctttccagta

SEQ ID NO: 471844 - DNA, 25 bp, Homo sapien
tctttccagtataatcctgaagata

SEQ ID NO: 471845 - DNA, 25 bp, Homo sapien
aatcctgaagatagtaaagcacaat

SEQ ID NO: 471846 - DNA, 25 bp, Homo sapien
aaagcacaattaaggcaatggccac

SEQ ID NO: 471847 - DNA, 25 bp, Homo sapien
taaggcaatggccaccaagaggcag

SEQ ID NO: 471848 - DNA, 25 bp, Homo sapien
gaggcagaagtgattcagtcaaagc

SEQ ID NO: 471849 - DNA, 25 bp, Homo sapien
gcaaagatcatggaaacagttttct

SEQ ID NO: 471850 - DNA, 25 bp, Homo sapien
atgataacgtgcttattatgagtgt

SEQ ID NO: 471851 - DNA, 25 bp, Homo sapien
ccaaagcttcggcagaaaaatgcct

SEQ ID NO: 471852 - DNA, 25 bp, Homo sapien
ctatgggtcaacaagcctaagagag

SEQ ID NO: 471853 - DNA, 25 bp, Homo sapien
aacaagcctaagagaggagctaccc

SEQ ID NO: 471854 - DNA, 25 bp, Homo sapien
gatgatggaacagccagttgcagaa

SEQ ID NO: 471855 - DNA, 25 bp, Homo sapien
gttgcagaaaggacctaccctccct

SEQ ID NO: 471856 - DNA, 25 bp, Homo sapien
gcagagacaacctgtgggcagagaa

SEQ ID NO: 471857 - DNA, 25 bp, Homo sapien
gagagctgcagacattaggacgatc

SEQ ID NO: 471858 - DNA, 25 bp, Homo sapien
acattaggacgatcagttgcagaga

SEQ ID NO: 471859 - DNA, 25 bp, Homo sapien
gcctcctctctactgagaactgaat

SEQ ID NO: 471860 - DNA, 25 bp, Homo sapien
gaatacctgatggacaacctgccta

SEQ ID NO: 471861 - DNA, 25 bp, Homo sapien
ctgatggacaacctgcctacagaga

SEQ ID NO: 471862 - DNA, 25 bp, Homo sapien
ggaaatacccactggaggtctctga

SEQ ID NO: 471863 - DNA, 25 bp, Homo sapien
aatgacaatttcataagcaaccata

SEQ ID NO: 471864 - DNA, 25 bp, Homo sapien
ataagcaaccataaatttgaacatt

SEQ ID NO: 471865 - DNA, 25 bp, Homo sapien
gaacatttttgatatctgtaacaat

SEQ ID NO: 471866 - DNA, 25 bp, Homo sapien
aataatgccatagttctatgaggaa

SEQ ID NO: 471867 - DNA, 25 bp, Homo sapien
atgtacatatttatctatctatgca

SEQ ID NO: 471868 - DNA, 25 bp, Homo sapien
atctatgcatagatactatttcttg

SEQ ID NO: 471869 - DNA, 25 bp, Homo sapien
gttaaatctattatacttccatcat

SEQ ID NO: 471870 - DNA, 25 bp, Homo sapien
attatacttccatcatattaggcta

SEQ ID NO: 471871 - DNA, 25 bp, Homo sapien
atacttccatcatattaggctatat

SEQ ID NO: 471872 - DNA, 25 bp, Homo sapien
tattaggctatatatgcatgcttct

SEQ ID NO: 471873 - DNA, 25 bp, Homo sapien
aggctatatatgcatgcttctatat

SEQ ID NO: 471874 - DNA, 25 bp, Homo sapien
aacccagtccttgataataccagat

SEQ ID NO: 471875 - DNA, 25 bp, Homo sapien
cagattctcggtgcattgttcatgt

SEQ ID NO: 471876 - DNA, 25 bp, Homo sapien
gttcatgtctgtatctgcaagcctg

SEQ ID NO: 471877 - DNA, 25 bp, Homo sapien
atctgcaagcctgttctgccattgc

SEQ ID NO: 471878 - DNA, 25 bp, Homo sapien
ctgccattgcagtgtgatgaaccta

SEQ ID NO: 471879 - DNA, 25 bp, Homo sapien
gaggtaactaccatgtgaacttgaa

SEQ ID NO: 471880 - DNA, 25 bp, Homo sapien
tgtgtctcttagaccatgacccctt

SEQ ID NO: 471881 - DNA, 25 bp, Homo sapien
gaccatgaccccttttcacttttgt

SEQ ID NO: 471882 - DNA, 25 bp, Homo sapien
atataggtttaatccccaagccaag

SEQ ID NO: 471883 - DNA, 25 bp, Homo sapien
gtatttcactacacttctattctca

SEQ ID NO: 471884 - DNA, 25 bp, Homo sapien
tattctcagtaaccaagattgcttg

SEQ ID NO: 471885 - DNA, 25 bp, Homo sapien
gagaccagggatgtgagacccacct

SEQ ID NO: 471886 - DNA, 25 bp, Homo sapien
atgtgagacccacctggtaccacag

SEQ ID NO: 471887 - DNA, 25 bp, Homo sapien
agaggagcctcaatgccctccacat

SEQ ID NO: 471888 - DNA, 25 bp, Homo sapien
aatgccctccacatcagcttgggtt

SEQ ID NO: 471889 - DNA, 25 bp, Homo sapien
acatcagcttgggttgcagagaaaa

SEQ ID NO: 471890 - DNA, 25 bp, Homo sapien
aggtggcccggctggttctctggat

SEQ ID NO: 471891 - DNA, 25 bp, Homo sapien
ggtggtggtgcagcctcgatcccat

SEQ ID NO: 471892 - DNA, 25 bp, Homo sapien
accaaggccaggagtcaagtcctga

SEQ ID NO: 471893 - DNA, 25 bp, Homo sapien
gaaattcaatatgtccatctctaga

SEQ ID NO: 471894 - DNA, 25 bp, Homo sapien
ccatctctagaagtagtccagtgta

SEQ ID NO: 471895 - DNA, 25 bp, Homo sapien
agtgtaggcaaggagcacggacctc

SEQ ID NO: 471896 - DNA, 25 bp, Homo sapien
ggctcatgccgcacacaatggctca

SEQ ID NO: 471897 - DNA, 25 bp, Homo sapien
gcacacaatggctcatcccagaact

SEQ ID NO: 471898 - DNA, 25 bp, Homo sapien
cacacaatggctcatcccagaactt

SEQ ID NO: 471899 - DNA, 25 bp, Homo sapien
ctgggtgtgttggtgtaggcctgtg

SEQ ID NO: 471900 - DNA, 25 bp, Homo sapien
attgcttgagcttggaaagtcgaag

SEQ ID NO: 471901 - DNA, 25 bp, Homo sapien
gaaagtcgaagctgcagtcagctgt

SEQ ID NO: 471902 - DNA, 25 bp, Homo sapien
tgcacctcagcttgggtgacaacgc

SEQ ID NO: 471903 - DNA, 25 bp, Homo sapien
acctcagcttgggtgacaacgcgaa

SEQ ID NO: 471904 - DNA, 25 bp, Homo sapien
ctcagcttgggtgacaacgcgaacc

SEQ ID NO: 471905 - DNA, 25 bp, Homo sapien
gcttgggtgacaacgcgaaccctgt

SEQ ID NO: 471906 - DNA, 25 bp, Homo sapien
gtgacaacgcgaaccctgtctcaaa

SEQ ID NO: 471907 - DNA, 25 bp, Homo sapien
taattaccatacgatagccactaag

SEQ ID NO: 471908 - DNA, 25 bp, Homo sapien
taccatacgatagccactaagtgtt

SEQ ID NO: 471909 - DNA, 25 bp, Homo sapien
atacgatagccactaagtgttcaag

SEQ ID NO: 471910 - DNA, 25 bp, Homo sapien
aagtcacacatttctcaatttaaat

SEQ ID NO: 471911 - DNA, 25 bp, Homo sapien
gcatgttgcaagttgacataggctg

SEQ ID NO: 471912 - DNA, 25 bp, Homo sapien
tgcaagttgacataggctgaaagct

SEQ ID NO: 471913 - DNA, 25 bp, Homo sapien
agttgacataggctgaaagctaagc

SEQ ID NO: 471914 - DNA, 25 bp, Homo sapien
aaagctaagcctcttgtaccagtta

SEQ ID NO: 471915 - DNA, 25 bp, Homo sapien
taagcctcttgtaccagttagccaa

SEQ ID NO: 471916 - DNA, 25 bp, Homo sapien
taaagttctactccagtgaatccat

SEQ ID NO: 471917 - DNA, 25 bp, Homo sapien
gaatgataagaaagcaaaacaccag

SEQ ID NO: 471918 - DNA, 25 bp, Homo sapien
cttgatatgttgagggaagtgactt

SEQ ID NO: 471919 - DNA, 25 bp, Homo sapien
ttgatatgttgagggaagtgacttg

SEQ ID NO: 471920 - DNA, 25 bp, Homo sapien
gatatgttgagggaagtgacttgtt

SEQ ID NO: 471921 - DNA, 25 bp, Homo sapien
gtgacttgttataagatagaggcca

SEQ ID NO: 471922 - DNA, 25 bp, Homo sapien
tgacttgttataagatagaggccag

SEQ ID NO: 471923 - DNA, 25 bp, Homo sapien
gacttgttataagatagaggccagg

SEQ ID NO: 471924 - DNA, 25 bp, Homo sapien
acttgttataagatagaggccaggt

SEQ ID NO: 471925 - DNA, 25 bp, Homo sapien
cttgttataagatagaggccaggta

SEQ ID NO: 471926 - DNA, 25 bp, Homo sapien
ttgttataagatagaggccaggtat

SEQ ID NO: 471927 - DNA, 25 bp, Homo sapien
tgttataagatagaggccaggtatg

SEQ ID NO: 471928 - DNA, 25 bp, Homo sapien
ttataagatagaggccaggtatggt

SEQ ID NO: 471929 - DNA, 25 bp, Homo sapien
atgaggccgagcggcgcgcccgtgg

SEQ ID NO: 471930 - DNA, 25 bp, Homo sapien
aggccgagcggcgcgcccgtggctg

SEQ ID NO: 471931 - DNA, 25 bp, Homo sapien
acctgcagtaccagcgggccggtgt

SEQ ID NO: 471932 - DNA, 25 bp, Homo sapien
cctgcagtaccagcgggccggtgtg

SEQ ID NO: 471933 - DNA, 25 bp, Homo sapien
tgcagtaccagcgggccggtgtgcg

SEQ ID NO: 471934 - DNA, 25 bp, Homo sapien
gcagtaccagcgggccggtgtgcgc

SEQ ID NO: 471935 - DNA, 25 bp, Homo sapien
cagtaccagcgggccggtgtgcgct

SEQ ID NO: 471936 - DNA, 25 bp, Homo sapien
accagcgggccggtgtgcgcttcct

SEQ ID NO: 471937 - DNA, 25 bp, Homo sapien
ccagcgggccggtgtgcgcttcctc

SEQ ID NO: 471938 - DNA, 25 bp, Homo sapien
agcgggccggtgtgcgcttcctcgc

SEQ ID NO: 471939 - DNA, 25 bp, Homo sapien
gggccggtgtgcgcttcctcgcccc

SEQ ID NO: 471940 - DNA, 25 bp, Homo sapien
gtgtagacactagtccattttatca

SEQ ID NO: 471941 - DNA, 25 bp, Homo sapien
atatgcacacatctgttatacaaag

SEQ ID NO: 471942 - DNA, 25 bp, Homo sapien
catgcatagcataatttgtggttga

SEQ ID NO: 471943 - DNA, 25 bp, Homo sapien
gatgcagtattattacgcatataat

SEQ ID NO: 471944 - DNA, 25 bp, Homo sapien
catataataactgtagtccatgctg

SEQ ID NO: 471945 - DNA, 25 bp, Homo sapien
tagccacctcttgttgctgttgtga

SEQ ID NO: 471946 - DNA, 25 bp, Homo sapien
acctcttgttgctgttgtgactcac

SEQ ID NO: 471947 - DNA, 25 bp, Homo sapien
tgttgctgttgtgactcactcagtg

SEQ ID NO: 471948 - DNA, 25 bp, Homo sapien
actcactcagtgttgacactcatca

SEQ ID NO: 471949 - DNA, 25 bp, Homo sapien
ttgacactcatcaccttcttgtgaa

SEQ ID NO: 471950 - DNA, 25 bp, Homo sapien
tcaccttcttgtgaacagttcatct

SEQ ID NO: 471951 - DNA, 25 bp, Homo sapien
aaagagaagagaacaggccaggcgc

SEQ ID NO: 471952 - DNA, 25 bp, Homo sapien
aagagaagagaacaggccaggcgca

SEQ ID NO: 471953 - DNA, 25 bp, Homo sapien
agagaagagaacaggccaggcgcag

SEQ ID NO: 471954 - DNA, 25 bp, Homo sapien
atcgcttgaactcaagagatggaga

SEQ ID NO: 471955 - DNA, 25 bp, Homo sapien
tcgcttgaactcaagagatggagat

SEQ ID NO: 471956 - DNA, 25 bp, Homo sapien
ttgaactcaagagatggagattgcg

SEQ ID NO: 471957 - DNA, 25 bp, Homo sapien
tgaactcaagagatggagattgcgg

SEQ ID NO: 471958 - DNA, 25 bp, Homo sapien
gaactcaagagatggagattgcggt

SEQ ID NO: 471959 - DNA, 25 bp, Homo sapien
aactcaagagatggagattgcggtg

SEQ ID NO: 471960 - DNA, 25 bp, Homo sapien
actcaagagatggagattgcggtga

SEQ ID NO: 471961 - DNA, 25 bp, Homo sapien
ctcaagagatggagattgcggtgag

SEQ ID NO: 471962 - DNA, 25 bp, Homo sapien
gagtgacacagtgaagactccgtct

SEQ ID NO: 471963 - DNA, 25 bp, Homo sapien
agtgacacagtgaagactccgtctc

SEQ ID NO: 471964 - DNA, 25 bp, Homo sapien
gtgacacagtgaagactccgtctca

SEQ ID NO: 471965 - DNA, 25 bp, Homo sapien
tgacacagtgaagactccgtctcaa

SEQ ID NO: 471966 - DNA, 25 bp, Homo sapien
ttaaagacatgaaaaagagcgagac

SEQ ID NO: 471967 - DNA, 25 bp, Homo sapien
taaagacatgaaaaagagcgagact

SEQ ID NO: 471968 - DNA, 25 bp, Homo sapien
aaagacatgaaaaagagcgagactc

SEQ ID NO: 471969 - DNA, 25 bp, Homo sapien
aagacatgaaaaagagcgagactct

SEQ ID NO: 471970 - DNA, 25 bp, Homo sapien
agacatgaaaaagagcgagactctg

SEQ ID NO: 471971 - DNA, 25 bp, Homo sapien
gacatgaaaaagagcgagactctgt

SEQ ID NO: 471972 - DNA, 25 bp, Homo sapien
ctgtctccaaataaataaatgaaag

SEQ ID NO: 471973 - DNA, 25 bp, Homo sapien
gcaagctctccgatgatgtggctgt

SEQ ID NO: 471974 - DNA, 25 bp, Homo sapien
caagctctccgatgatgtggctgtg

SEQ ID NO: 471975 - DNA, 25 bp, Homo sapien
aagctctccgatgatgtggctgtgc

SEQ ID NO: 471976 - DNA, 25 bp, Homo sapien
agctctccgatgatgtggctgtgct

SEQ ID NO: 471977 - DNA, 25 bp, Homo sapien
ctctccgatgatgtggctgtgctgg

SEQ ID NO: 471978 - DNA, 25 bp, Homo sapien
ccgatgatgtggctgtgctgggttg

SEQ ID NO: 471979 - DNA, 25 bp, Homo sapien
ctgtgctgggttgtggagcacactt

SEQ ID NO: 471980 - DNA, 25 bp, Homo sapien
tgctgggttgtggagcacactttga

SEQ ID NO: 471981 - DNA, 25 bp, Homo sapien
ctgggttgtggagcacactttgagt

SEQ ID NO: 471982 - DNA, 25 bp, Homo sapien
gttgtggagcacactttgagtagca

SEQ ID NO: 471983 - DNA, 25 bp, Homo sapien
ataaaagacaattcaggccgggtgt

SEQ ID NO: 471984 - DNA, 25 bp, Homo sapien
gcctcagagctgaacttacatgggt

SEQ ID NO: 471985 - DNA, 25 bp, Homo sapien
ttacatgggtccagtttaaacctgt

SEQ ID NO: 471986 - DNA, 25 bp, Homo sapien
aacagagcagcacttcttacctcat

SEQ ID NO: 471987 - DNA, 25 bp, Homo sapien
acttcttacctcataccatggtggg

SEQ ID NO: 471988 - DNA, 25 bp, Homo sapien
caattcacgctatggacagtcctat

SEQ ID NO: 471989 - DNA, 25 bp, Homo sapien
taaggacttggacatgagctcaggt

SEQ ID NO: 471990 - DNA, 25 bp, Homo sapien
ggagaactcccaagatatacctaca

SEQ ID NO: 471991 - DNA, 25 bp, Homo sapien
gatatacctacagtggctcattaga

SEQ ID NO: 471992 - DNA, 25 bp, Homo sapien
tggctcattagaggcaggcttcagc

SEQ ID NO: 471993 - DNA, 25 bp, Homo sapien
aggcttcagcagtctaggttctcat

SEQ ID NO: 471994 - DNA, 25 bp, Homo sapien
aggttctcattttgccaacttcaag

SEQ ID NO: 471995 - DNA, 25 bp, Homo sapien
gtagttcaaaagataaggcttcctg

SEQ ID NO: 471996 - DNA, 25 bp, Homo sapien
taaggcttcctgacagaatagcaaa

SEQ ID NO: 471997 - DNA, 25 bp, Homo sapien
tagcaaaatttgacagtcaccccaa

SEQ ID NO: 471998 - DNA, 25 bp, Homo sapien
ccctgggctttgtgaaatcccaaat

SEQ ID NO: 471999 - DNA, 25 bp, Homo sapien
gtgaaatcccaaattgctgtggaac

SEQ ID NO: 472000 - DNA, 25 bp, Homo sapien
gagaaagaagtttaactggagctta

SEQ ID NO: 472001 - DNA, 25 bp, Homo sapien
aaaataaaatggctcaggagccctc

SEQ ID NO: 472002 - DNA, 25 bp, Homo sapien
tcaggacagggacaaaggtgttcct

SEQ ID NO: 472003 - DNA, 25 bp, Homo sapien
aaggtgttcctgtttttggctgtat

SEQ ID NO: 472004 - DNA, 25 bp, Homo sapien
tatgtctggcatatggactttcaat

SEQ ID NO: 472005 - DNA, 25 bp, Homo sapien
ctggcatatggactttcaataaata

SEQ ID NO: 472006 - DNA, 25 bp, Homo sapien
tgcacggccgcgtttggaggcagct

SEQ ID NO: 472007 - DNA, 25 bp, Homo sapien
gtctctccttcctgtatgttcgtct

SEQ ID NO: 472008 - DNA, 25 bp, Homo sapien
tctccttcctgtatgttcgtctggg

SEQ ID NO: 472009 - DNA, 25 bp, Homo sapien
aggagcgaggtcctggcctgcagag

SEQ ID NO: 472010 - DNA, 25 bp, Homo sapien
ggacaaatctgggttctgttagcag

SEQ ID NO: 472011 - DNA, 25 bp, Homo sapien
caaatctgggttctgttagcagata

SEQ ID NO: 472012 - DNA, 25 bp, Homo sapien
ggttctgttagcagataaacaatct

SEQ ID NO: 472013 - DNA, 25 bp, Homo sapien
gataaacaatctggcgatgactgtc

SEQ ID NO: 472014 - DNA, 25 bp, Homo sapien
aggcggccagaaactagggagatcc

SEQ ID NO: 472015 - DNA, 25 bp, Homo sapien
gaaactagggagatcccggcggctc

SEQ ID NO: 472016 - DNA, 25 bp, Homo sapien
gggcaggaagcagggccggctgtgt

SEQ ID NO: 472017 - DNA, 25 bp, Homo sapien
gaggaagggctgaaatgctttctat

SEQ ID NO: 472018 - DNA, 25 bp, Homo sapien
attggatactatctgggcatattac

SEQ ID NO: 472019 - DNA, 25 bp, Homo sapien
atctgggcatattacttcctgtggt

SEQ ID NO: 472020 - DNA, 25 bp, Homo sapien
gggcatattacttcctgtggttcac

SEQ ID NO: 472021 - DNA, 25 bp, Homo sapien
tattacttcctgtggttcactgtct

SEQ ID NO: 472022 - DNA, 25 bp, Homo sapien
tgtctgggtgacaggattcatagaa

SEQ ID NO: 472023 - DNA, 25 bp, Homo sapien
gacaggattcatagaagcccaaact

SEQ ID NO: 472024 - DNA, 25 bp, Homo sapien
gaagcccaaactttagcaccacgca

SEQ ID NO: 472025 - DNA, 25 bp, Homo sapien
aaactttagcaccacgcagcatacc

SEQ ID NO: 472026 - DNA, 25 bp, Homo sapien
accacgcagcatacccttgtaacaa

SEQ ID NO: 472027 - DNA, 25 bp, Homo sapien
tacccttgtaacaaagccgcacacg

SEQ ID NO: 472028 - DNA, 25 bp, Homo sapien
gggcattggcatgaactatgcacgt

SEQ ID NO: 472029 - DNA, 25 bp, Homo sapien
gaactatgcacgtttactgatctga

SEQ ID NO: 472030 - DNA, 25 bp, Homo sapien
gcacgtttactgatctgagcagcct

SEQ ID NO: 472031 - DNA, 25 bp, Homo sapien
cgtttactgatctgagcagcctctg

SEQ ID NO: 472032 - DNA, 25 bp, Homo sapien
tgctttaacacctgcacccctgtgg

SEQ ID NO: 472033 - DNA, 25 bp, Homo sapien
gcacccctgtggtcatcccagtggg

SEQ ID NO: 472034 - DNA, 25 bp, Homo sapien
atcccagtgggcgagctgtgacctg

SEQ ID NO: 472035 - DNA, 25 bp, Homo sapien
taaacaggtaagcttgctgtcactt

SEQ ID NO: 472036 - DNA, 25 bp, Homo sapien
ctttctctgaaaggctatggttctg

SEQ ID NO: 472037 - DNA, 25 bp, Homo sapien
aaggctatggttctgtaatttggtt

SEQ ID NO: 472038 - DNA, 25 bp, Homo sapien
ttggttgaacatttctcttaaaaat

SEQ ID NO: 472039 - DNA, 25 bp, Homo sapien
gtgggagttgataaaggcagttctt

SEQ ID NO: 472040 - DNA, 25 bp, Homo sapien
agttgataaaggcagttcttgagcc

SEQ ID NO: 472041 - DNA, 25 bp, Homo sapien
aatatgaggaacagcaactggaaga

SEQ ID NO: 472042 - DNA, 25 bp, Homo sapien
cctctccccctaatgggtgagaaga

SEQ ID NO: 472043 - DNA, 25 bp, Homo sapien
gggtgagaagatgaattagctgtaa

SEQ ID NO: 472044 - DNA, 25 bp, Homo sapien
tagctgtaaaacttaccgctccggt

SEQ ID NO: 472045 - DNA, 25 bp, Homo sapien
gctgtaaaacttaccgctccggtag

SEQ ID NO: 472046 - DNA, 25 bp, Homo sapien
taaaacttaccgctccggtagctgc

SEQ ID NO: 472047 - DNA, 25 bp, Homo sapien
aaacttaccgctccggtagctgcaa

SEQ ID NO: 472048 - DNA, 25 bp, Homo sapien
taccgctccggtagctgcaacatta

SEQ ID NO: 472049 - DNA, 25 bp, Homo sapien
cgctccggtagctgcaacattaaaa

SEQ ID NO: 472050 - DNA, 25 bp, Homo sapien
ggactgctacaatgacatactgaga

SEQ ID NO: 472051 - DNA, 25 bp, Homo sapien
tcatgctttacaaactgacttacag

SEQ ID NO: 472052 - DNA, 25 bp, Homo sapien
actgacttacagcttaggaaatgca

SEQ ID NO: 472053 - DNA, 25 bp, Homo sapien
gtcaagtttttcttttcaccctgag

SEQ ID NO: 472054 - DNA, 25 bp, Homo sapien
ttcttttcaccctgaggcactcagt

SEQ ID NO: 472055 - DNA, 25 bp, Homo sapien
ggcactcagtgcataaaggttcaag

SEQ ID NO: 472056 - DNA, 25 bp, Homo sapien
gaatgtttccaaaagaccagcaatg

SEQ ID NO: 472057 - DNA, 25 bp, Homo sapien
tttcgtgtatactagacgtgccttt

SEQ ID NO: 472058 - DNA, 25 bp, Homo sapien
ctagacgtgcctttaagcaataaaa

SEQ ID NO: 472059 - DNA, 25 bp, Homo sapien
aaaaattccaagagctgatcattat

SEQ ID NO: 472060 - DNA, 25 bp, Homo sapien
gctgatcattattgtgcttccattt

SEQ ID NO: 472061 - DNA, 25 bp, Homo sapien
atgtgcagtccatttattgccctgt

SEQ ID NO: 472062 - DNA, 25 bp, Homo sapien
attgccctgtcttgcttaaatattc

SEQ ID NO: 472063 - DNA, 25 bp, Homo sapien
acagctggaggctttgactgggttc

SEQ ID NO: 472064 - DNA, 25 bp, Homo sapien
ttgactgggttcctagttctgtttt

SEQ ID NO: 472065 - DNA, 25 bp, Homo sapien
gttctgttttctgggaaggcaacgt

SEQ ID NO: 472066 - DNA, 25 bp, Homo sapien
gatgtatgttcgttgggcatgctga

SEQ ID NO: 472067 - DNA, 25 bp, Homo sapien
tgagaagcggcctcctgtggttctg

SEQ ID NO: 472068 - DNA, 25 bp, Homo sapien
ggttctgggcccaaggtgtgacata

SEQ ID NO: 472069 - DNA, 25 bp, Homo sapien
ggtgtgacatacatttcccactaat

SEQ ID NO: 472070 - DNA, 25 bp, Homo sapien
tcccactaattgcttctctcaagaa

SEQ ID NO: 472071 - DNA, 25 bp, Homo sapien
gaagcaagagattggctgttcctct

SEQ ID NO: 472072 - DNA, 25 bp, Homo sapien
agggccacacaggtaagcagctact

SEQ ID NO: 472073 - DNA, 25 bp, Homo sapien
gataatgaactcaagcctgcctttt

SEQ ID NO: 472074 - DNA, 25 bp, Homo sapien
aagcctgccttttccatcagggaac

SEQ ID NO: 472075 - DNA, 25 bp, Homo sapien
cagggaacatactctttttgggcaa

SEQ ID NO: 472076 - DNA, 25 bp, Homo sapien
cacccatggtttttccatgtcgtaa

SEQ ID NO: 472077 - DNA, 25 bp, Homo sapien
aacatgtccctggagcctcttgatt

SEQ ID NO: 472078 - DNA, 25 bp, Homo sapien
agcctcttgattggccaggtgatct

SEQ ID NO: 472079 - DNA, 25 bp, Homo sapien
caggtgatctgcatctcgtaggtta

SEQ ID NO: 472080 - DNA, 25 bp, Homo sapien
gcatctcgtaggttactcaggattt

SEQ ID NO: 472081 - DNA, 25 bp, Homo sapien
gatttatgttaacagccattggact

SEQ ID NO: 472082 - DNA, 25 bp, Homo sapien
ggaagtctttaactttcatatggag

SEQ ID NO: 472083 - DNA, 25 bp, Homo sapien
aagcttcttgaactgcatttactat

SEQ ID NO: 472084 - DNA, 25 bp, Homo sapien
ctgcatttactattgtgaagtttca

SEQ ID NO: 472085 - DNA, 25 bp, Homo sapien
tgtgaagtttcaagtcccgctgtaa

SEQ ID NO: 472086 - DNA, 25 bp, Homo sapien
aagtcccgctgtaaagatcatgttg

SEQ ID NO: 472087 - DNA, 25 bp, Homo sapien
cccgctgtaaagatcatgttgtttt

SEQ ID NO: 472088 - DNA, 25 bp, Homo sapien
tccccagggctttcactgtgattta

SEQ ID NO: 472089 - DNA, 25 bp, Homo sapien
gctttcactgtgatttactgcattg

SEQ ID NO: 472090 - DNA, 25 bp, Homo sapien
gagaaggctcttgattccttatgca

SEQ ID NO: 472091 - DNA, 25 bp, Homo sapien
aaaacattcacaaccttaagccgag

SEQ ID NO: 472092 - DNA, 25 bp, Homo sapien
attcacaaccttaagccgaggtggg

SEQ ID NO: 472093 - DNA, 25 bp, Homo sapien
aactgcaaaggatttacggtttgtg

SEQ ID NO: 472094 - DNA, 25 bp, Homo sapien
tgcaggtggaagggcctgaccccaa

SEQ ID NO: 472095 - DNA, 25 bp, Homo sapien
gtggaagggcctgaccccaagaggg

SEQ ID NO: 472096 - DNA, 25 bp, Homo sapien
acaggagctgctggtgattaggagc

SEQ ID NO: 472097 - DNA, 25 bp, Homo sapien
gagctgctggtgattaggagccgcc

SEQ ID NO: 472098 - DNA, 25 bp, Homo sapien
agctgctggtgattaggagccgccg

SEQ ID NO: 472099 - DNA, 25 bp, Homo sapien
ctgctggtgattaggagccgccggg

SEQ ID NO: 472100 - DNA, 25 bp, Homo sapien
acgagctgcgggtctccagcagctg

SEQ ID NO: 472101 - DNA, 25 bp, Homo sapien
tcagcgctgacggccagtcccggcc

SEQ ID NO: 472102 - DNA, 25 bp, Homo sapien
tccccgccctgcaggcctgcggaac

SEQ ID NO: 472103 - DNA, 25 bp, Homo sapien
gcaggcctgcggaacccgctgcaga

SEQ ID NO: 472104 - DNA, 25 bp, Homo sapien
acctgcagtaccagcgggccggtgt

SEQ ID NO: 472105 - DNA, 25 bp, Homo sapien
tgtccagcggactgccacgggtctc

SEQ ID NO: 472106 - DNA, 25 bp, Homo sapien
agcctctctctttcagatgtcatcc

SEQ ID NO: 472107 - DNA, 25 bp, Homo sapien
ggaacgtgaagcaggccactcctta

SEQ ID NO: 472108 - DNA, 25 bp, Homo sapien
ttacatcgctgtgtatcctttctga

SEQ ID NO: 472109 - DNA, 25 bp, Homo sapien
catcgctgtgtatcctttctgaatc

SEQ ID NO: 472110 - DNA, 25 bp, Homo sapien
tcctttctgaatctgagccagaagt

SEQ ID NO: 472111 - DNA, 25 bp, Homo sapien
gggatgttatttgcgaatggtatgc

SEQ ID NO: 472112 - DNA, 25 bp, Homo sapien
gtatgcattgtgaagcaggctcctt

SEQ ID NO: 472113 - DNA, 25 bp, Homo sapien
tgtgaagcaggctcctttaccagat

SEQ ID NO: 472114 - DNA, 25 bp, Homo sapien
gcaggctcctttaccagatgtgtat

SEQ ID NO: 472115 - DNA, 25 bp, Homo sapien
ggctcctttaccagatgtgtatttt

SEQ ID NO: 472116 - DNA, 25 bp, Homo sapien
ttctttagaaactcagggcctggcg

SEQ ID NO: 472117 - DNA, 25 bp, Homo sapien
gatctcttgggccaaggagtatgaa

SEQ ID NO: 472118 - DNA, 25 bp, Homo sapien
ctcttgggccaaggagtatgaaacc

SEQ ID NO: 472119 - DNA, 25 bp, Homo sapien
tcttgggccaaggagtatgaaacca

SEQ ID NO: 472120 - DNA, 25 bp, Homo sapien
ggccaaggagtatgaaaccagcctg

SEQ ID NO: 472121 - DNA, 25 bp, Homo sapien
aaaggtataaaggttggccaggcat

SEQ ID NO: 472122 - DNA, 25 bp, Homo sapien
aaggtataaaggttggccaggcatg

SEQ ID NO: 472123 - DNA, 25 bp, Homo sapien
tgtgcacttttggtcccagctattc

SEQ ID NO: 472124 - DNA, 25 bp, Homo sapien
ggaggaccattggagcccggagggt

SEQ ID NO: 472125 - DNA, 25 bp, Homo sapien
aggaccattggagcccggagggttg

SEQ ID NO: 472126 - DNA, 25 bp, Homo sapien
attggagcccggagggttgaagctg

SEQ ID NO: 472127 - DNA, 25 bp, Homo sapien
gaaagcaaggcataaaagcattaat

SEQ ID NO: 472128 - DNA, 25 bp, Homo sapien
gcattaataccagacaaagcacatt

SEQ ID NO: 472129 - DNA, 25 bp, Homo sapien
taaactcactaaaggtacaattcac

SEQ ID NO: 472130 - DNA, 25 bp, Homo sapien
taaaggtacaattcaccaggaagat

SEQ ID NO: 472131 - DNA, 25 bp, Homo sapien
gaggcatcaagttgtatgtacataa

SEQ ID NO: 472132 - DNA, 25 bp, Homo sapien
gtaaaagacaaagactctcagcctg

SEQ ID NO: 472133 - DNA, 25 bp, Homo sapien
agacaaagactctcagcctggtttt

SEQ ID NO: 472134 - DNA, 25 bp, Homo sapien
aagactctcagcctggtttttaaga

SEQ ID NO: 472135 - DNA, 25 bp, Homo sapien
ctcagcctggtttttaagaatgtcc

SEQ ID NO: 472136 - DNA, 25 bp, Homo sapien
aagaatgtccaaagacactcctaaa

SEQ ID NO: 472137 - DNA, 25 bp, Homo sapien
tgtccaaagacactcctaaattaaa

SEQ ID NO: 472138 - DNA, 25 bp, Homo sapien
ggtgggcgggtgcacggccgcgttt

SEQ ID NO: 472139 - DNA, 25 bp, Homo sapien
tgcacggccgcgtttggaggcagct

SEQ ID NO: 472140 - DNA, 25 bp, Homo sapien
gtctctccttcctgtatgttcgtct

SEQ ID NO: 472141 - DNA, 25 bp, Homo sapien
tctccttcctgtatgttcgtctggg

SEQ ID NO: 472142 - DNA, 25 bp, Homo sapien
ggacaaatctgggttctgttagcag

SEQ ID NO: 472143 - DNA, 25 bp, Homo sapien
caaatctgggttctgttagcagata

SEQ ID NO: 472144 - DNA, 25 bp, Homo sapien
tctgggttctgttagcagataaaca

SEQ ID NO: 472145 - DNA, 25 bp, Homo sapien
ggttctgttagcagataaacaatct

SEQ ID NO: 472146 - DNA, 25 bp, Homo sapien
aggcggccagaaactagggagatcc

SEQ ID NO: 472147 - DNA, 25 bp, Homo sapien
ggccagaaactagggagatcccggc

SEQ ID NO: 472148 - DNA, 25 bp, Homo sapien
ccagaaactagggagatcccggcgg

SEQ ID NO: 472149 - DNA, 25 bp, Homo sapien
gtgacacactcctataatcctagca

SEQ ID NO: 472150 - DNA, 25 bp, Homo sapien
tgacacactcctataatcctagcac

SEQ ID NO: 472151 - DNA, 25 bp, Homo sapien
gacacactcctataatcctagcact

SEQ ID NO: 472152 - DNA, 25 bp, Homo sapien
acacactcctataatcctagcactt

SEQ ID NO: 472153 - DNA, 25 bp, Homo sapien
cacactcctataatcctagcacttt

SEQ ID NO: 472154 - DNA, 25 bp, Homo sapien
attagctaggcctggtggcagaggc

SEQ ID NO: 472155 - DNA, 25 bp, Homo sapien
ttagctaggcctggtggcagaggcc

SEQ ID NO: 472156 - DNA, 25 bp, Homo sapien
tagctaggcctggtggcagaggcct

SEQ ID NO: 472157 - DNA, 25 bp, Homo sapien
ctaggcctggtggcagaggcctgta

SEQ ID NO: 472158 - DNA, 25 bp, Homo sapien
taggcctggtggcagaggcctgtaa

SEQ ID NO: 472159 - DNA, 25 bp, Homo sapien
gcctggtggcagaggcctgtaatcc

SEQ ID NO: 472160 - DNA, 25 bp, Homo sapien
ggtgaattcattaattgacttttaa

SEQ ID NO: 472161 - DNA, 25 bp, Homo sapien
ttcaatgaatattggagtgatttcc

SEQ ID NO: 472162 - DNA, 25 bp, Homo sapien
aggttattcatatctaatgcttgta

SEQ ID NO: 472163 - DNA, 25 bp, Homo sapien
tatctaatgcttgtagcaactttat

SEQ ID NO: 472164 - DNA, 25 bp, Homo sapien
atgtattatactttgttgccatgag

SEQ ID NO: 472165 - DNA, 25 bp, Homo sapien
tactttgttgccatgagtggatgaa

SEQ ID NO: 472166 - DNA, 25 bp, Homo sapien
ggatgaagaacctttctgtagccta

SEQ ID NO: 472167 - DNA, 25 bp, Homo sapien
gaacctttctgtagcctaaactaga

SEQ ID NO: 472168 - DNA, 25 bp, Homo sapien
ctgtagcctaaactagagggcacaa

SEQ ID NO: 472169 - DNA, 25 bp, Homo sapien
gagggcacaacaaatgtaggcacat

SEQ ID NO: 472170 - DNA, 25 bp, Homo sapien
aatgtaggcacattattacaccaca

SEQ ID NO: 472171 - DNA, 25 bp, Homo sapien
ttcctatgggaaaagttatcagcta

SEQ ID NO: 472172 - DNA, 25 bp, Homo sapien
ttatcagctagattgaagagactct

SEQ ID NO: 472173 - DNA, 25 bp, Homo sapien
aagagactctgaggaacttgcacag

SEQ ID NO: 472174 - DNA, 25 bp, Homo sapien
aggaacttgcacagagggaacagaa

SEQ ID NO: 472175 - DNA, 25 bp, Homo sapien
ggagaatcaggaagacgagcattaa

SEQ ID NO: 472176 - DNA, 25 bp, Homo sapien
aaagaagcaaacgaggtccacaggg

SEQ ID NO: 472177 - DNA, 25 bp, Homo sapien
aatgagtagggagtcagcagtctga

SEQ ID NO: 472178 - DNA, 25 bp, Homo sapien
gggagtcagcagtctgacgaacaaa

SEQ ID NO: 472179 - DNA, 25 bp, Homo sapien
ctgacgaacaaaaggactggaagga

SEQ ID NO: 472180 - DNA, 25 bp, Homo sapien
gggtgagactctggcagccctcaaa

SEQ ID NO: 472181 - DNA, 25 bp, Homo sapien
gagactctggcagccctcaaaaaag

SEQ ID NO: 472182 - DNA, 25 bp, Homo sapien
tctagctctgccacccaggctgggg

SEQ ID NO: 472183 - DNA, 25 bp, Homo sapien
ctagctctgccacccaggctggggt

SEQ ID NO: 472184 - DNA, 25 bp, Homo sapien
gcgcccgccacgaggcccagctaat

SEQ ID NO: 472185 - DNA, 25 bp, Homo sapien
ccgccacgaggcccagctaattttt

SEQ ID NO: 472186 - DNA, 25 bp, Homo sapien
tacaagcgtgagccatgcgcccagc

SEQ ID NO: 472187 - DNA, 25 bp, Homo sapien
acaagcgtgagccatgcgcccagcc

SEQ ID NO: 472188 - DNA, 25 bp, Homo sapien
caagcgtgagccatgcgcccagcca

SEQ ID NO: 472189 - DNA, 25 bp, Homo sapien
aagcgtgagccatgcgcccagccaa

SEQ ID NO: 472190 - DNA, 25 bp, Homo sapien
agcgtgagccatgcgcccagccaaa

SEQ ID NO: 472191 - DNA, 25 bp, Homo sapien
gcgtgagccatgcgcccagccaaat

SEQ ID NO: 472192 - DNA, 25 bp, Homo sapien
ccagccaaatccctctaaatctttt

SEQ ID NO: 472193 - DNA, 25 bp, Homo sapien
caagactgccctgcaagcaggtctg

SEQ ID NO: 472194 - DNA, 25 bp, Homo sapien
ggtgctcaggtcgaatcagccctgt

SEQ ID NO: 472195 - DNA, 25 bp, Homo sapien
caggtcgaatcagccctgtctgatg

SEQ ID NO: 472196 - DNA, 25 bp, Homo sapien
tgatggacaagaccaccctgcagag

SEQ ID NO: 472197 - DNA, 25 bp, Homo sapien
gacaagaccaccctgcagagatcag

SEQ ID NO: 472198 - DNA, 25 bp, Homo sapien
accctgcagagatcaggatggacag

SEQ ID NO: 472199 - DNA, 25 bp, Homo sapien
agatggctctccctggctgtgctcc

SEQ ID NO: 472200 - DNA, 25 bp, Homo sapien
tggctgtgctccactgcaggtgctc

SEQ ID NO: 472201 - DNA, 25 bp, Homo sapien
tgcaggtgctcccacatcaaatcgt

SEQ ID NO: 472202 - DNA, 25 bp, Homo sapien
atcaaatcgtcctggctccacatca

SEQ ID NO: 472203 - DNA, 25 bp, Homo sapien
cacgacttctctaaggagctcttct

SEQ ID NO: 472204 - DNA, 25 bp, Homo sapien
tagcctaagtctttcccgctgtgtg

SEQ ID NO: 472205 - DNA, 25 bp, Homo sapien
tgtgtgttcccttctggtgaacttg

SEQ ID NO: 472206 - DNA, 25 bp, Homo sapien
gtgaacttgttcaaccctgctccat

SEQ ID NO: 472207 - DNA, 25 bp, Homo sapien
aagcctatcagctggccacttggag

SEQ ID NO: 472208 - DNA, 25 bp, Homo sapien
ggagtggcggtcagtatttttacaa

SEQ ID NO: 472209 - DNA, 25 bp, Homo sapien
tgatttgaagtctccttgcattccc

SEQ ID NO: 472210 - DNA, 25 bp, Homo sapien
ttgcattcccagaatgtcagacccg

SEQ ID NO: 472211 - DNA, 25 bp, Homo sapien
acccgccctgattcacaaggattga

SEQ ID NO: 472212 - DNA, 25 bp, Homo sapien
agggtctgagccaaccagaggaatt

SEQ ID NO: 472213 - DNA, 25 bp, Homo sapien
ggaatttgaagacttagtcatcccc

SEQ ID NO: 472214 - DNA, 25 bp, Homo sapien
ccttggatcatctgcacattcttct

SEQ ID NO: 472215 - DNA, 25 bp, Homo sapien
tattaggagtactacagtggatacc

SEQ ID NO: 472216 - DNA, 25 bp, Homo sapien
ggagtactacagtggatacctacat

SEQ ID NO: 472217 - DNA, 25 bp, Homo sapien
gtactacagtggatacctacatact

SEQ ID NO: 472218 - DNA, 25 bp, Homo sapien
tacagtggatacctacatacttgct

SEQ ID NO: 472219 - DNA, 25 bp, Homo sapien
cagtggatacctacatacttgctat

SEQ ID NO: 472220 - DNA, 25 bp, Homo sapien
gtggatacctacatacttgctattc

SEQ ID NO: 472221 - DNA, 25 bp, Homo sapien
ggatacctacatacttgctattcag

SEQ ID NO: 472222 - DNA, 25 bp, Homo sapien
atacctacatacttgctattcagca

SEQ ID NO: 472223 - DNA, 25 bp, Homo sapien
atacttgctattcagcatacctggt

SEQ ID NO: 472224 - DNA, 25 bp, Homo sapien
ttgctattcagcatacctggttttt

SEQ ID NO: 472225 - DNA, 25 bp, Homo sapien
gctattcagcatacctggttttttg

SEQ ID NO: 472226 - DNA, 25 bp, Homo sapien
tctaatttagaaggaggcagagcta

SEQ ID NO: 472227 - DNA, 25 bp, Homo sapien
ctaatttagaaggaggcagagctag

SEQ ID NO: 472228 - DNA, 25 bp, Homo sapien
taatttagaaggaggcagagctagc

SEQ ID NO: 472229 - DNA, 25 bp, Homo sapien
aatttagaaggaggcagagctagct

SEQ ID NO: 472230 - DNA, 25 bp, Homo sapien
atttagaaggaggcagagctagctg

SEQ ID NO: 472231 - DNA, 25 bp, Homo sapien
gaaggaggcagagctagctgggcat

SEQ ID NO: 472232 - DNA, 25 bp, Homo sapien
aaggaggcagagctagctgggcatg

SEQ ID NO: 472233 - DNA, 25 bp, Homo sapien
aggaggcagagctagctgggcatgg

SEQ ID NO: 472234 - DNA, 25 bp, Homo sapien
ggaggcagagctagctgggcatggt

SEQ ID NO: 472235 - DNA, 25 bp, Homo sapien
gaggcagagctagctgggcatggtg

SEQ ID NO: 472236 - DNA, 25 bp, Homo sapien
aggtggaaggttgcagttagccgag

SEQ ID NO: 472237 - DNA, 25 bp, Homo sapien
gaggtgtggaggaagaagcgccagc

SEQ ID NO: 472238 - DNA, 25 bp, Homo sapien
aggtgtggaggaagaagcgccagcg

SEQ ID NO: 472239 - DNA, 25 bp, Homo sapien
aggaagaagcgccagcgggaaccgg

SEQ ID NO: 472240 - DNA, 25 bp, Homo sapien
ggaagaagcgccagcgggaaccggg

SEQ ID NO: 472241 - DNA, 25 bp, Homo sapien
aagcgccagcgggaaccggggctgc

SEQ ID NO: 472242 - DNA, 25 bp, Homo sapien
aaccggggctgcgcgtggggcttgc

SEQ ID NO: 472243 - DNA, 25 bp, Homo sapien
ctcggagcagccggccggccctgtt

SEQ ID NO: 472244 - DNA, 25 bp, Homo sapien
cggagcagccggccggccctgttgg

SEQ ID NO: 472245 - DNA, 25 bp, Homo sapien
ggagcagccggccggccctgttggc

SEQ ID NO: 472246 - DNA, 25 bp, Homo sapien
agcagccggccggccctgttggccc

SEQ ID NO: 472247 - DNA, 25 bp, Homo sapien
gcagccggccggccctgttggccca

SEQ ID NO: 472248 - DNA, 25 bp, Homo sapien
tgagacagagccacatgctcaggaa

SEQ ID NO: 472249 - DNA, 25 bp, Homo sapien
catgctcaggaaaaaggtcctttat

SEQ ID NO: 472250 - DNA, 25 bp, Homo sapien
ggtcctttatccagggaaactgctg

SEQ ID NO: 472251 - DNA, 25 bp, Homo sapien
gaaaacttttagagctcagaccatc

SEQ ID NO: 472252 - DNA, 25 bp, Homo sapien
ctcagaccatctttagagagcatct

SEQ ID NO: 472253 - DNA, 25 bp, Homo sapien
ccccatttccattgtacacagaata

SEQ ID NO: 472254 - DNA, 25 bp, Homo sapien
acagaataccaaggaggcagcattt

SEQ ID NO: 472255 - DNA, 25 bp, Homo sapien
tgcaaagagcaggaagtgctgtttc

SEQ ID NO: 472256 - DNA, 25 bp, Homo sapien
gctgtttctgtcagccatgaactga

SEQ ID NO: 472257 - DNA, 25 bp, Homo sapien
atgaactgatgaccaccacactcta

SEQ ID NO: 472258 - DNA, 25 bp, Homo sapien
ccaccacactctaattcctaatatt

SEQ ID NO: 472259 - DNA, 25 bp, Homo sapien
ctgttttgcttttgtgatatatggt

SEQ ID NO: 472260 - DNA, 25 bp, Homo sapien
ataagtttgtgctgtgtgcttacac

SEQ ID NO: 472261 - DNA, 25 bp, Homo sapien
tgtgctgtgtgcttacacacacaca

SEQ ID NO: 472262 - DNA, 25 bp, Homo sapien
atgcatgcacaccagaaacctgagt

SEQ ID NO: 472263 - DNA, 25 bp, Homo sapien
gtctgaaagtagtgactgtgcttga

SEQ ID NO: 472264 - DNA, 25 bp, Homo sapien
ggaacatctttccaagagtaatcct

SEQ ID NO: 472265 - DNA, 25 bp, Homo sapien
caagagtaatcctttaatgccgaaa

SEQ ID NO: 472266 - DNA, 25 bp, Homo sapien
ctttaatgccgaaagtctctcatat

SEQ ID NO: 472267 - DNA, 25 bp, Homo sapien
ggaaaattagctaagtggcctgtct

SEQ ID NO: 472268 - DNA, 25 bp, Homo sapien
agtggcctgtctattattttcaaac

SEQ ID NO: 472269 - DNA, 25 bp, Homo sapien
aaatgtctttccactctttataata

SEQ ID NO: 472270 - DNA, 25 bp, Homo sapien
caagttttagcagaagtgtggtgat

SEQ ID NO: 472271 - DNA, 25 bp, Homo sapien
atcagttttaaatccatctctccta

SEQ ID NO: 472272 - DNA, 25 bp, Homo sapien
acacatacttgtgtgggcatgcaca

SEQ ID NO: 472273 - DNA, 25 bp, Homo sapien
tgtgggcatgcacacataaaacatg

SEQ ID NO: 472274 - DNA, 25 bp, Homo sapien
catgaagagtgcttacagttactac

SEQ ID NO: 472275 - DNA, 25 bp, Homo sapien
gagtgcttacagttactacactgat

SEQ ID NO: 472276 - DNA, 25 bp, Homo sapien
gttactacactgattgacttcatct

SEQ ID NO: 472277 - DNA, 25 bp, Homo sapien
actgattgacttcatcttctggtaa

SEQ ID NO: 472278 - DNA, 25 bp, Homo sapien
gacttcatcttctggtaagttatag

SEQ ID NO: 472279 - DNA, 25 bp, Homo sapien
gatgaactctttcatgatgccagtt

SEQ ID NO: 472280 - DNA, 25 bp, Homo sapien
tcatgatgccagttctatgtttttc

SEQ ID NO: 472281 - DNA, 25 bp, Homo sapien
tgggcaaggaaacccttctatggcc

SEQ ID NO: 472282 - DNA, 25 bp, Homo sapien
ggcaaggaaacccttctatggccag

SEQ ID NO: 472283 - DNA, 25 bp, Homo sapien
gcaaggaaacccttctatggccagg

SEQ ID NO: 472284 - DNA, 25 bp, Homo sapien
caaggaaacccttctatggccagga

SEQ ID NO: 472285 - DNA, 25 bp, Homo sapien
aaggaaacccttctatggccaggag

SEQ ID NO: 472286 - DNA, 25 bp, Homo sapien
aggaaacccttctatggccaggagt

SEQ ID NO: 472287 - DNA, 25 bp, Homo sapien
ggaaacccttctatggccaggagtg

SEQ ID NO: 472288 - DNA, 25 bp, Homo sapien
gaaacccttctatggccaggagtgg

SEQ ID NO: 472289 - DNA, 25 bp, Homo sapien
aaacccttctatggccaggagtggt

SEQ ID NO: 472290 - DNA, 25 bp, Homo sapien
aacactgtgagatgccaaggcagaa

SEQ ID NO: 472291 - DNA, 25 bp, Homo sapien
ttgagactggagtgagtggagatca

SEQ ID NO: 472292 - DNA, 25 bp, Homo sapien
gaaagagtgagcagtcgtggaccaa

SEQ ID NO: 472293 - DNA, 25 bp, Homo sapien
aagagtgagcagtcgtggaccaaac

SEQ ID NO: 472294 - DNA, 25 bp, Homo sapien
gagtgagcagtcgtggaccaaacat

SEQ ID NO: 472295 - DNA, 25 bp, Homo sapien
gtgagcagtcgtggaccaaacattt

SEQ ID NO: 472296 - DNA, 25 bp, Homo sapien
tgagcagtcgtggaccaaacatttc

SEQ ID NO: 472297 - DNA, 25 bp, Homo sapien
gagcagtcgtggaccaaacatttca

SEQ ID NO: 472298 - DNA, 25 bp, Homo sapien
agcagtcgtggaccaaacatttcat

SEQ ID NO: 472299 - DNA, 25 bp, Homo sapien
accaaacatttcatggtctgatgaa

SEQ ID NO: 472300 - DNA, 25 bp, Homo sapien
catggtctgatgaaaagctagtgga

SEQ ID NO: 472301 - DNA, 25 bp, Homo sapien
tggtctgatgaaaagctagtggatg

SEQ ID NO: 472302 - DNA, 25 bp, Homo sapien
atgaaaagctagtggatgctggcca

SEQ ID NO: 472303 - DNA, 25 bp, Homo sapien
tcccactttggtggcacttgatgag

SEQ ID NO: 472304 - DNA, 25 bp, Homo sapien
cactttggtggcacttgatgagccc

SEQ ID NO: 472305 - DNA, 25 bp, Homo sapien
tttggtggcacttgatgagcccttc

SEQ ID NO: 472306 - DNA, 25 bp, Homo sapien
tggtggcacttgatgagcccttcag

SEQ ID NO: 472307 - DNA, 25 bp, Homo sapien
gaggtgtggaggaagaagcgccagc

SEQ ID NO: 472308 - DNA, 25 bp, Homo sapien
aggtgtggaggaagaagcgccagcg

SEQ ID NO: 472309 - DNA, 25 bp, Homo sapien
aggaagaagcgccagcgggaaccgg

SEQ ID NO: 472310 - DNA, 25 bp, Homo sapien
ggaagaagcgccagcgggaaccggg

SEQ ID NO: 472311 - DNA, 25 bp, Homo sapien
gggcttgcgggccagctggagttcc

SEQ ID NO: 472312 - DNA, 25 bp, Homo sapien
ggagcagccggccggccctgttggc

SEQ ID NO: 472313 - DNA, 25 bp, Homo sapien
gccggccctgttggcccagggcaat

SEQ ID NO: 472314 - DNA, 25 bp, Homo sapien
tggagttagatattttacccttaca

SEQ ID NO: 472315 - DNA, 25 bp, Homo sapien
gatattttacccttacaagaagcaa

SEQ ID NO: 472316 - DNA, 25 bp, Homo sapien
aagcaaatgctgagctgagtgagaa

SEQ ID NO: 472317 - DNA, 25 bp, Homo sapien
aaaagcggtatgttgcaggcagaga

SEQ ID NO: 472318 - DNA, 25 bp, Homo sapien
aaagcacgtaaccagcatctagtaa

SEQ ID NO: 472319 - DNA, 25 bp, Homo sapien
taaccagcatctagtaagtcaacag

SEQ ID NO: 472320 - DNA, 25 bp, Homo sapien
atacagaagaatatcggaagctcct

SEQ ID NO: 472321 - DNA, 25 bp, Homo sapien
agaatatcggaagctcctttctgaa

SEQ ID NO: 472322 - DNA, 25 bp, Homo sapien
ggaagttcatactaagcgtattcaa

SEQ ID NO: 472323 - DNA, 25 bp, Homo sapien
aagcgtattcaacaattgacagaag

SEQ ID NO: 472324 - DNA, 25 bp, Homo sapien
aaagctgaaattgcaagatcaaatg

SEQ ID NO: 472325 - DNA, 25 bp, Homo sapien
ttcctccaatgctctctacttatta

SEQ ID NO: 472326 - DNA, 25 bp, Homo sapien
gctctctacttattactgtattgtt

SEQ ID NO: 472327 - DNA, 25 bp, Homo sapien
tatagcacttatcactagctgaagt

SEQ ID NO: 472328 - DNA, 25 bp, Homo sapien
tcactagctgaagttaccttttttg

SEQ ID NO: 472329 - DNA, 25 bp, Homo sapien
agaaatccttgctctcctagagctt

SEQ ID NO: 472330 - DNA, 25 bp, Homo sapien
gctctcctagagcttgttgagttct

SEQ ID NO: 472331 - DNA, 25 bp, Homo sapien
gttgagttcttatcatcatcttctc

SEQ ID NO: 472332 - DNA, 25 bp, Homo sapien
atcttctccccttcaggatgcaagt

SEQ ID NO: 472333 - DNA, 25 bp, Homo sapien
ttcaggatgcaagttccatgagagc

SEQ ID NO: 472334 - DNA, 25 bp, Homo sapien
gagagcaggaacctttgtccattgg

SEQ ID NO: 472335 - DNA, 25 bp, Homo sapien
gaccttgaacaccacctagctaaag

SEQ ID NO: 472336 - DNA, 25 bp, Homo sapien
ataactgttataatttactccctgg

SEQ ID NO: 472337 - DNA, 25 bp, Homo sapien
tttactccctggtaatttatgagag

SEQ ID NO: 472338 - DNA, 25 bp, Homo sapien
gagagtattaccaacaacatcttaa

SEQ ID NO: 472339 - DNA, 25 bp, Homo sapien
ttcttcagctttaaaaattcgttat

SEQ ID NO: 472340 - DNA, 25 bp, Homo sapien
cagaactttagttaacaccttgtgt

SEQ ID NO: 472341 - DNA, 25 bp, Homo sapien
gttaacaccttgtgtaccttcacag

SEQ ID NO: 472342 - DNA, 25 bp, Homo sapien
tgtaccttcacaggccatcttttga

SEQ ID NO: 472343 - DNA, 25 bp, Homo sapien
tcacaggccatcttttgacatttat

SEQ ID NO: 472344 - DNA, 25 bp, Homo sapien
atgatagtggttttttaggtgatac

SEQ ID NO: 472345 - DNA, 25 bp, Homo sapien
taggtgatacctacccaatggaatg

SEQ ID NO: 472346 - DNA, 25 bp, Homo sapien
gaatggttggtttataggatgcaca

SEQ ID NO: 472347 - DNA, 25 bp, Homo sapien
tgccgtttgaatccagacaggcttg

SEQ ID NO: 472348 - DNA, 25 bp, Homo sapien
gtttgaatccagacaggcttgcctc

SEQ ID NO: 472349 - DNA, 25 bp, Homo sapien
ttgaatccagacaggcttgcctcac

SEQ ID NO: 472350 - DNA, 25 bp, Homo sapien
accacccaggcttttaactgccagg

SEQ ID NO: 472351 - DNA, 25 bp, Homo sapien
cacccaggcttttaactgccaggaa

SEQ ID NO: 472352 - DNA, 25 bp, Homo sapien
ccaggcttttaactgccaggaaggg

SEQ ID NO: 472353 - DNA, 25 bp, Homo sapien
gagacgggttggtgtgggatatgat

SEQ ID NO: 472354 - DNA, 25 bp, Homo sapien
tgttaaatgcccagacacgccacaa

SEQ ID NO: 472355 - DNA, 25 bp, Homo sapien
taaatgcccagacacgccacaatac

SEQ ID NO: 472356 - DNA, 25 bp, Homo sapien
aaggactaactttctaactcatcac

SEQ ID NO: 472357 - DNA, 25 bp, Homo sapien
ggactaactttctaactcatcacag

SEQ ID NO: 472358 - DNA, 25 bp, Homo sapien
ggtggaacttgagctcatgtggaaa

SEQ ID NO: 472359 - DNA, 25 bp, Homo sapien
gaacttgagctcatgtggaaaggac

SEQ ID NO: 472360 - DNA, 25 bp, Homo sapien
tgagctcatgtggaaaggacaattt

SEQ ID NO: 472361 - DNA, 25 bp, Homo sapien
caggtactgtgtgtgctaactaacc

SEQ ID NO: 472362 - DNA, 25 bp, Homo sapien
gtactgtgtgtgctaactaacctct

SEQ ID NO: 472363 - DNA, 25 bp, Homo sapien
actgtgtgtgctaactaacctcttc

SEQ ID NO: 472364 - DNA, 25 bp, Homo sapien
gtgtgtgctaactaacctcttcctg

SEQ ID NO: 472365 - DNA, 25 bp, Homo sapien
tgtgctaactaacctcttcctggac

SEQ ID NO: 472366 - DNA, 25 bp, Homo sapien
aatgtgaaagtttattgaagccaat

SEQ ID NO: 472367 - DNA, 25 bp, Homo sapien
gtttttgacaagtaactgtactgta

SEQ ID NO: 472368 - DNA, 25 bp, Homo sapien
gacaagtaactgtactgtaattatg

SEQ ID NO: 472369 - DNA, 25 bp, Homo sapien
aggtttcccatccacataccaagct

SEQ ID NO: 472370 - DNA, 25 bp, Homo sapien
cataccaagctgatgaggatcccat

SEQ ID NO: 472371 - DNA, 25 bp, Homo sapien
gctgatgaggatcccatcgttcttc

SEQ ID NO: 472372 - DNA, 25 bp, Homo sapien
atcgttcttccccagtcctgaggag

SEQ ID NO: 472373 - DNA, 25 bp, Homo sapien
atctgcaccttccatagccaaatca

SEQ ID NO: 472374 - DNA, 25 bp, Homo sapien
cttccatagccaaatcagggtcatt

SEQ ID NO: 472375 - DNA, 25 bp, Homo sapien
gggtcattggactcagaactttcag

SEQ ID NO: 472376 - DNA, 25 bp, Homo sapien
tctctcggacacacaaagataaggg

SEQ ID NO: 472377 - DNA, 25 bp, Homo sapien
ccttttcacatactgagttcaacca

SEQ ID NO: 472378 - DNA, 25 bp, Homo sapien
tgagttcaaccagccagacaaacaa

SEQ ID NO: 472379 - DNA, 25 bp, Homo sapien
aagggcagagccaggcccctgcgtc

SEQ ID NO: 472380 - DNA, 25 bp, Homo sapien
gtcgaggtcatacacctatatagtg

SEQ ID NO: 472381 - DNA, 25 bp, Homo sapien
tcgaggtcatacacctatatagtga

SEQ ID NO: 472382 - DNA, 25 bp, Homo sapien
cgaggtcatacacctatatagtgac

SEQ ID NO: 472383 - DNA, 25 bp, Homo sapien
gaggtcatacacctatatagtgaca

SEQ ID NO: 472384 - DNA, 25 bp, Homo sapien
aggtcatacacctatatagtgacaa

SEQ ID NO: 472385 - DNA, 25 bp, Homo sapien
ggtcatacacctatatagtgacaag

SEQ ID NO: 472386 - DNA, 25 bp, Homo sapien
gtcatacacctatatagtgacaagt

SEQ ID NO: 472387 - DNA, 25 bp, Homo sapien
atacacctatatagtgacaagtaag

SEQ ID NO: 472388 - DNA, 25 bp, Homo sapien
cctatatagtgacaagtaagaagct

SEQ ID NO: 472389 - DNA, 25 bp, Homo sapien
agaagctagaggagtgccgagcgca

SEQ ID NO: 472390 - DNA, 25 bp, Homo sapien
agctagaggagtgccgagcgcagtg

SEQ ID NO: 472391 - DNA, 25 bp, Homo sapien
aatactgagtggttacctgtgccag

SEQ ID NO: 472392 - DNA, 25 bp, Homo sapien
gttacctgtgccagacaatgttcta

SEQ ID NO: 472393 - DNA, 25 bp, Homo sapien
aaaagaaagattcctgcacccctgg

SEQ ID NO: 472394 - DNA, 25 bp, Homo sapien
cctggagctttacatcctggcattg

SEQ ID NO: 472395 - DNA, 25 bp, Homo sapien
acatcctggcattgtaatggcagaa

SEQ ID NO: 472396 - DNA, 25 bp, Homo sapien
ggatgatccaaagcgataatgtctc

SEQ ID NO: 472397 - DNA, 25 bp, Homo sapien
aaagcgataatgtctcataggcaga

SEQ ID NO: 472398 - DNA, 25 bp, Homo sapien
ttagtagagttacagttttgtgcat

SEQ ID NO: 472399 - DNA, 25 bp, Homo sapien
gtgcatatactcaaaagcctactag

SEQ ID NO: 472400 - DNA, 25 bp, Homo sapien
aaaagcctactagttacattgaaag

SEQ ID NO: 472401 - DNA, 25 bp, Homo sapien
aatggtgtgggttatgtggtaccaa

SEQ ID NO: 472402 - DNA, 25 bp, Homo sapien
tttacagaaccaagtggtgggccag

SEQ ID NO: 472403 - DNA, 25 bp, Homo sapien
ggactgtgggtattagtttgctgac

SEQ ID NO: 472404 - DNA, 25 bp, Homo sapien
gtattagtttgctgacctttgatct

SEQ ID NO: 472405 - DNA, 25 bp, Homo sapien
agtttgctgacctttgatctatatt

SEQ ID NO: 472406 - DNA, 25 bp, Homo sapien
ttgctgacctttgatctatattttt

SEQ ID NO: 472407 - DNA, 25 bp, Homo sapien
gtaagtttaactagatgctggttga

SEQ ID NO: 472408 - DNA, 25 bp, Homo sapien
gatgctggttgaaagtaaaagcctt

SEQ ID NO: 472409 - DNA, 25 bp, Homo sapien
gatagcagatgattcttggtgacct

SEQ ID NO: 472410 - DNA, 25 bp, Homo sapien
gatgattcttggtgacctaagtcaa

SEQ ID NO: 472411 - DNA, 25 bp, Homo sapien
ggagttcaagtacagcttgaccagc

SEQ ID NO: 472412 - DNA, 25 bp, Homo sapien
aagtacagcttgaccagcatagcaa

SEQ ID NO: 472413 - DNA, 25 bp, Homo sapien
gcagtctgccttctagattccatcc

SEQ ID NO: 472414 - DNA, 25 bp, Homo sapien
agtctgccttctagattccatcctg

SEQ ID NO: 472415 - DNA, 25 bp, Homo sapien
tctgccttctagattccatcctgtt

SEQ ID NO: 472416 - DNA, 25 bp, Homo sapien
tgccttctagattccatcctgtttt

SEQ ID NO: 472417 - DNA, 25 bp, Homo sapien
gccttctagattccatcctgttttg

SEQ ID NO: 472418 - DNA, 25 bp, Homo sapien
ccttctagattccatcctgttttgt

SEQ ID NO: 472419 - DNA, 25 bp, Homo sapien
ttctagattccatcctgttttgttc

SEQ ID NO: 472420 - DNA, 25 bp, Homo sapien
atcctgttttgttctaactcttggg

SEQ ID NO: 472421 - DNA, 25 bp, Homo sapien
tcctgttttgttctaactcttgggt

SEQ ID NO: 472422 - DNA, 25 bp, Homo sapien
tgttttgttctaactcttgggttca

SEQ ID NO: 472423 - DNA, 25 bp, Homo sapien
tttagaaaaatcaggctgtaatccc

SEQ ID NO: 472424 - DNA, 25 bp, Homo sapien
acaagtctcttgttcggatgataat

SEQ ID NO: 472425 - DNA, 25 bp, Homo sapien
ggtagtgtccttttagtatgctggt

SEQ ID NO: 472426 - DNA, 25 bp, Homo sapien
gtccttttagtatgctggttgatct

SEQ ID NO: 472427 - DNA, 25 bp, Homo sapien
gctggttgatctttcatagtgttag

SEQ ID NO: 472428 - DNA, 25 bp, Homo sapien
ggtatatttctatcaatggccagtt

SEQ ID NO: 472429 - DNA, 25 bp, Homo sapien
caatggccagttgttgtagtccaaa

SEQ ID NO: 472430 - DNA, 25 bp, Homo sapien
gttgtagtccaaaacctaaatcagt

SEQ ID NO: 472431 - DNA, 25 bp, Homo sapien
actgtggacagtgcgagattttatt

SEQ ID NO: 472432 - DNA, 25 bp, Homo sapien
gagattttattgacaggttaacaca

SEQ ID NO: 472433 - DNA, 25 bp, Homo sapien
ttaacacaatgcctacgtctatcca

SEQ ID NO: 472434 - DNA, 25 bp, Homo sapien
tacgtctatccacataggcattcaa

SEQ ID NO: 472435 - DNA, 25 bp, Homo sapien
actgggcctctactctacttttcga

SEQ ID NO: 472436 - DNA, 25 bp, Homo sapien
gcctctactctacttttcgatgttt

SEQ ID NO: 472437 - DNA, 25 bp, Homo sapien
ctactctacttttcgatgtttaggt

SEQ ID NO: 472438 - DNA, 25 bp, Homo sapien
ctacttttcgatgtttaggtatgtt

SEQ ID NO: 472439 - DNA, 25 bp, Homo sapien
aaatacctaccattgtgttaacaat

SEQ ID NO: 472440 - DNA, 25 bp, Homo sapien
gtgttaacaattgcccgtatattca

SEQ ID NO: 472441 - DNA, 25 bp, Homo sapien
aacaattgcccgtatattcagtaga

SEQ ID NO: 472442 - DNA, 25 bp, Homo sapien
aattgcccgtatattcagtagaatc

SEQ ID NO: 472443 - DNA, 25 bp, Homo sapien
cagtagaatcacatgctgtacaggt

SEQ ID NO: 472444 - DNA, 25 bp, Homo sapien
aaagtatggcacactgttcagtaaa

SEQ ID NO: 472445 - DNA, 25 bp, Homo sapien
aatttgcagggtaaaataagcgaat

SEQ ID NO: 472446 - DNA, 25 bp, Homo sapien
ggattgctagcaccaactgttagga

SEQ ID NO: 472447 - DNA, 25 bp, Homo sapien
caccaactgttaggagagatgcaaa

SEQ ID NO: 472448 - DNA, 25 bp, Homo sapien
gagagatgcaaagaggacactattt

SEQ ID NO: 472449 - DNA, 25 bp, Homo sapien
aaagacgaatcttcctacacccatg

SEQ ID NO: 472450 - DNA, 25 bp, Homo sapien
catggctatcttcctctgtttaaga

SEQ ID NO: 472451 - DNA, 25 bp, Homo sapien
tgtttaagagccctgtcctttcgct

SEQ ID NO: 472452 - DNA, 25 bp, Homo sapien
ctgtcctttcgctacataactgaat

SEQ ID NO: 472453 - DNA, 25 bp, Homo sapien
aactgaattatctctacactgtaag

SEQ ID NO: 472454 - DNA, 25 bp, Homo sapien
atgaggttaactctcaacttcccct

SEQ ID NO: 472455 - DNA, 25 bp, Homo sapien
gaaaatcttggtgtattctttagga

SEQ ID NO: 472456 - DNA, 25 bp, Homo sapien
ttaggaattcatcccacccaacaat

SEQ ID NO: 472457 - DNA, 25 bp, Homo sapien
gtctttatttgttgccttctcttct

SEQ ID NO: 472458 - DNA, 25 bp, Homo sapien
tcttctgctccgagtttaggttcat

SEQ ID NO: 472459 - DNA, 25 bp, Homo sapien
ttaggttcatgtcgccacctggtga

SEQ ID NO: 472460 - DNA, 25 bp, Homo sapien
ccacctggtgattggcttctctgtg

SEQ ID NO: 472461 - DNA, 25 bp, Homo sapien
ttgcacagttgcaggcatgaccagg

SEQ ID NO: 472462 - DNA, 25 bp, Homo sapien
gggcctgacgtgatgtaccatgttt

SEQ ID NO: 472463 - DNA, 25 bp, Homo sapien
gtaccatgtttcaagcctgtttcac

SEQ ID NO: 472464 - DNA, 25 bp, Homo sapien
gtttcacagcacaagacagcctcag

SEQ ID NO: 472465 - DNA, 25 bp, Homo sapien
cagctctgtggtccacaaaccacat

SEQ ID NO: 472466 - DNA, 25 bp, Homo sapien
tagatagttttcttggcatatggcc

SEQ ID NO: 472467 - DNA, 25 bp, Homo sapien
catatggccacacccgttcaaaaaa

SEQ ID NO: 472468 - DNA, 25 bp, Homo sapien
aaaaacttccaatgcggaagcctat

SEQ ID NO: 472469 - DNA, 25 bp, Homo sapien
aaaacttccaatgcggaagcctatg

SEQ ID NO: 472470 - DNA, 25 bp, Homo sapien
acttccaatgcggaagcctatggtt

SEQ ID NO: 472471 - DNA, 25 bp, Homo sapien
cttccaatgcggaagcctatggttg

SEQ ID NO: 472472 - DNA, 25 bp, Homo sapien
ttccaatgcggaagcctatggttgt

SEQ ID NO: 472473 - DNA, 25 bp, Homo sapien
tccaatgcggaagcctatggttgtt

SEQ ID NO: 472474 - DNA, 25 bp, Homo sapien
ccaatgcggaagcctatggttgtta

SEQ ID NO: 472475 - DNA, 25 bp, Homo sapien
caatgcggaagcctatggttgttaa

SEQ ID NO: 472476 - DNA, 25 bp, Homo sapien
aatgcggaagcctatggttgttaaa

SEQ ID NO: 472477 - DNA, 25 bp, Homo sapien
atgcggaagcctatggttgttaaaa

SEQ ID NO: 472478 - DNA, 25 bp, Homo sapien
tgcggaagcctatggttgttaaaac

SEQ ID NO: 472479 - DNA, 25 bp, Homo sapien
tggtgtaaatgtaattgcagttttt

SEQ ID NO: 472480 - DNA, 25 bp, Homo sapien
ggtgtaaatgtaattgcagtttttg

SEQ ID NO: 472481 - DNA, 25 bp, Homo sapien
gtgtaaatgtaattgcagtttttgc

SEQ ID NO: 472482 - DNA, 25 bp, Homo sapien
gtaaatgtaattgcagtttttgcca

SEQ ID NO: 472483 - DNA, 25 bp, Homo sapien
taaatgtaattgcagtttttgccat

SEQ ID NO: 472484 - DNA, 25 bp, Homo sapien
ttttgccattactttgaaaatattt

SEQ ID NO: 472485 - DNA, 25 bp, Homo sapien
tttgccattactttgaaaatatttt

SEQ ID NO: 472486 - DNA, 25 bp, Homo sapien
gaaaatattttaggccgggcgctgt

SEQ ID NO: 472487 - DNA, 25 bp, Homo sapien
aaaatattttaggccgggcgctgtg

SEQ ID NO: 472488 - DNA, 25 bp, Homo sapien
aaatattttaggccgggcgctgtgg

SEQ ID NO: 472489 - DNA, 25 bp, Homo sapien
ggcgtgaacctgggactcggaggtt

SEQ ID NO: 472490 - DNA, 25 bp, Homo sapien
tgagttagactgtatttggcataga

SEQ ID NO: 472491 - DNA, 25 bp, Homo sapien
gaaagactttttctgtcgacgccaa

SEQ ID NO: 472492 - DNA, 25 bp, Homo sapien
gactttttctgtcgacgccaaatgc

SEQ ID NO: 472493 - DNA, 25 bp, Homo sapien
tcgacgccaaatgcccgttgtaaat

SEQ ID NO: 472494 - DNA, 25 bp, Homo sapien
tgcccgttgtaaatgaaccttaaat

SEQ ID NO: 472495 - DNA, 25 bp, Homo sapien
aatattacattcctcctttgcacaa

SEQ ID NO: 472496 - DNA, 25 bp, Homo sapien
attacattcctcctttgcacaataa

SEQ ID NO: 472497 - DNA, 25 bp, Homo sapien
aacaaactgcccttaagagtcattt

SEQ ID NO: 472498 - DNA, 25 bp, Homo sapien
ctgcccttaagagtcatttccttgt

SEQ ID NO: 472499 - DNA, 25 bp, Homo sapien
atttccttgttatcacaggtgtcaa

SEQ ID NO: 472500 - DNA, 25 bp, Homo sapien
cacaggtgtcaatatttttctgtat

SEQ ID NO: 472501 - DNA, 25 bp, Homo sapien
gtctatgtgtaagtgtgcaggcatc

SEQ ID NO: 472502 - DNA, 25 bp, Homo sapien
ctatgtgtaagtgtgcaggcatcta

SEQ ID NO: 472503 - DNA, 25 bp, Homo sapien
aagtgtgcaggcatctaaagatata

SEQ ID NO: 472504 - DNA, 25 bp, Homo sapien
cctgaagacattcctctggaaccta

SEQ ID NO: 472505 - DNA, 25 bp, Homo sapien
gaagacattcctctggaacctaagt

SEQ ID NO: 472506 - DNA, 25 bp, Homo sapien
gacattcctctggaacctaagtaaa

SEQ ID NO: 472507 - DNA, 25 bp, Homo sapien
tttacttaatctacatggatcccag

SEQ ID NO: 472508 - DNA, 25 bp, Homo sapien
ttaatctacatggatcccagtgctg

SEQ ID NO: 472509 - DNA, 25 bp, Homo sapien
aatctacatggatcccagtgctggg

SEQ ID NO: 472510 - DNA, 25 bp, Homo sapien
gggagttcagacctccaaaccttca

SEQ ID NO: 472511 - DNA, 25 bp, Homo sapien
agttcagacctccaaaccttcagac

SEQ ID NO: 472512 - DNA, 25 bp, Homo sapien
tgacttgcctaaggtcatgtagcca

SEQ ID NO: 472513 - DNA, 25 bp, Homo sapien
aagcagtgcagcttctatgctctta

SEQ ID NO: 472514 - DNA, 25 bp, Homo sapien
atgctcttaccagtaagctatacag

SEQ ID NO: 472515 - DNA, 25 bp, Homo sapien
cagcattgagaagtggattggtccc

SEQ ID NO: 472516 - DNA, 25 bp, Homo sapien
gattggtcccaaagaatagtaagta

SEQ ID NO: 472517 - DNA, 25 bp, Homo sapien
agtaagtacacctctgtccagatac

SEQ ID NO: 472518 - DNA, 25 bp, Homo sapien
cagatacacccattgtttctcacag

SEQ ID NO: 472519 - DNA, 25 bp, Homo sapien
gtttctcacagatatcagcaagcaa

SEQ ID NO: 472520 - DNA, 25 bp, Homo sapien
aagcaataatgctcccctgtctggg

SEQ ID NO: 472521 - DNA, 25 bp, Homo sapien
tgtctgggtcctctgtgtctccact

SEQ ID NO: 472522 - DNA, 25 bp, Homo sapien
tctcatcccgtcaggtgttgttgaa

SEQ ID NO: 472523 - DNA, 25 bp, Homo sapien
aaatcgggctgcagacatagatgac

SEQ ID NO: 472524 - DNA, 25 bp, Homo sapien
agacatagatgacggcagttgtgcc

SEQ ID NO: 472525 - DNA, 25 bp, Homo sapien
ggcagttgtgccaatcgtgttcaaa

SEQ ID NO: 472526 - DNA, 25 bp, Homo sapien
aatcgtgttcaaaatggcggcccca

SEQ ID NO: 472527 - DNA, 25 bp, Homo sapien
cacaggtgcagtaaggagccgacaa

SEQ ID NO: 472528 - DNA, 25 bp, Homo sapien
gacaaaatggcaccctccgagagag

SEQ ID NO: 472529 - DNA, 25 bp, Homo sapien
cctccgagagagttcatttgcataa

SEQ ID NO: 472530 - DNA, 25 bp, Homo sapien
gtaaacaaacacctgatcaaaccaa

SEQ ID NO: 472531 - DNA, 25 bp, Homo sapien
caaaccaatctgtgagtcctaagta

SEQ ID NO: 472532 - DNA, 25 bp, Homo sapien
tcctaagtaaatcagacgccgcctc

SEQ ID NO: 472533 - DNA, 25 bp, Homo sapien
tggactataaattcggctcatctgc

SEQ ID NO: 472534 - DNA, 25 bp, Homo sapien
tgttctggaagaaaaatctctcaac

SEQ ID NO: 472535 - DNA, 25 bp, Homo sapien
aaatctctcaactgttttcgataag

SEQ ID NO: 472536 - DNA, 25 bp, Homo sapien
actgttttcgataagggtgatccaa

SEQ ID NO: 472537 - DNA, 25 bp, Homo sapien
aaaaatgtatcctgctttacactaa

SEQ ID NO: 472538 - DNA, 25 bp, Homo sapien
tgctttacactaaaatgctcaaggt

SEQ ID NO: 472539 - DNA, 25 bp, Homo sapien
gatacttaaactaactaatgcctgg

SEQ ID NO: 472540 - DNA, 25 bp, Homo sapien
ctaatgcctggtagaaataagtgct

SEQ ID NO: 472541 - DNA, 25 bp, Homo sapien
tagaaataagtgctaccctttttat

SEQ ID NO: 472542 - DNA, 25 bp, Homo sapien
tttatattaaactctaccatctttg

SEQ ID NO: 472543 - DNA, 25 bp, Homo sapien
gtatgtattttgagttacccacaga

SEQ ID NO: 472544 - DNA, 25 bp, Homo sapien
ttgagttacccacagatattccttt

SEQ ID NO: 472545 - DNA, 25 bp, Homo sapien
gtgccctcctgtgcttctggggacc

SEQ ID NO: 472546 - DNA, 25 bp, Homo sapien
tcccaaaggagccgtcgcctgcaaa

SEQ ID NO: 472547 - DNA, 25 bp, Homo sapien
aggagccgtcgcctgcaaacccttt

SEQ ID NO: 472548 - DNA, 25 bp, Homo sapien
cgtcgcctgcaaaccctttcagggt

SEQ ID NO: 472549 - DNA, 25 bp, Homo sapien
gtcgcctgcaaaccctttcagggtc

SEQ ID NO: 472550 - DNA, 25 bp, Homo sapien
ctgcaaaccctttcagggtccactt

SEQ ID NO: 472551 - DNA, 25 bp, Homo sapien
tgcaaaccctttcagggtccacttc

SEQ ID NO: 472552 - DNA, 25 bp, Homo sapien
agaacccaaaccagacatcctcagg

SEQ ID NO: 472553 - DNA, 25 bp, Homo sapien
aaaaagatcagctttaggctgggca

SEQ ID NO: 472554 - DNA, 25 bp, Homo sapien
aaaagatcagctttaggctgggcat

SEQ ID NO: 472555 - DNA, 25 bp, Homo sapien
aaagatcagctttaggctgggcatg

SEQ ID NO: 472556 - DNA, 25 bp, Homo sapien
taaaacagcccatacaaacctatat

SEQ ID NO: 472557 - DNA, 25 bp, Homo sapien
gcatgcgtatatacagttgatcttg

SEQ ID NO: 472558 - DNA, 25 bp, Homo sapien
gatcttgatcatttacagattccat

SEQ ID NO: 472559 - DNA, 25 bp, Homo sapien
ttgtgaatttgcctgtttgctaaaa

SEQ ID NO: 472560 - DNA, 25 bp, Homo sapien
tttgctaaaattcatgtgtaacccc

SEQ ID NO: 472561 - DNA, 25 bp, Homo sapien
atacttgtggtatttctgtggtcat

SEQ ID NO: 472562 - DNA, 25 bp, Homo sapien
tctgtggtcattgcagacatgtgca

SEQ ID NO: 472563 - DNA, 25 bp, Homo sapien
ttgagttaccatatgcacacgtccc

SEQ ID NO: 472564 - DNA, 25 bp, Homo sapien
atatgcacacgtccccagctgaagc

SEQ ID NO: 472565 - DNA, 25 bp, Homo sapien
gctgaagctgaactctgtgatctct

SEQ ID NO: 472566 - DNA, 25 bp, Homo sapien
tttcagctcttactatccacaacag

SEQ ID NO: 472567 - DNA, 25 bp, Homo sapien
tttctcacccgtaaaatcaggagtc

SEQ ID NO: 472568 - DNA, 25 bp, Homo sapien
ggagtcagaattagtcttatttcaa

SEQ ID NO: 472569 - DNA, 25 bp, Homo sapien
tatttcaattaaagtgccctacaag

SEQ ID NO: 472570 - DNA, 25 bp, Homo sapien
gtgccctacaagtaagaacattctc

SEQ ID NO: 472571 - DNA, 25 bp, Homo sapien
ctcagataatctgtcctattgaagt

SEQ ID NO: 472572 - DNA, 25 bp, Homo sapien
ctgtcctattgaagtttgggctaat

SEQ ID NO: 472573 - DNA, 25 bp, Homo sapien
tagaacttgcttagtctgacctata

SEQ ID NO: 472574 - DNA, 25 bp, Homo sapien
ggttagattttttctgtcaagacag

SEQ ID NO: 472575 - DNA, 25 bp, Homo sapien
cagacatgcttagcctttaaggcca

SEQ ID NO: 472576 - DNA, 25 bp, Homo sapien
gcctttaaggccatgttttagaaat

SEQ ID NO: 472577 - DNA, 25 bp, Homo sapien
gagttacaagagttcccgtctgttt

SEQ ID NO: 472578 - DNA, 25 bp, Homo sapien
ggattactggaggttggaagttcat

SEQ ID NO: 472579 - DNA, 25 bp, Homo sapien
tactggaggttggaagttcatgacc

SEQ ID NO: 472580 - DNA, 25 bp, Homo sapien
tggcgtgcacctgtcattgcagctg

SEQ ID NO: 472581 - DNA, 25 bp, Homo sapien
ctgagacaggatgatcacccgaatc

SEQ ID NO: 472582 - DNA, 25 bp, Homo sapien
gagacaggatgatcacccgaatccg

SEQ ID NO: 472583 - DNA, 25 bp, Homo sapien
agacaggatgatcacccgaatccgg

SEQ ID NO: 472584 - DNA, 25 bp, Homo sapien
gacaggatgatcacccgaatccggg

SEQ ID NO: 472585 - DNA, 25 bp, Homo sapien
acaggatgatcacccgaatccggga

SEQ ID NO: 472586 - DNA, 25 bp, Homo sapien
ggatgatcacccgaatccgggaggt

SEQ ID NO: 472587 - DNA, 25 bp, Homo sapien
gatgatcacccgaatccgggaggtg

SEQ ID NO: 472588 - DNA, 25 bp, Homo sapien
atgatcacccgaatccgggaggtgg

SEQ ID NO: 472589 - DNA, 25 bp, Homo sapien
aacatggcatatttccacctatgat

SEQ ID NO: 472590 - DNA, 25 bp, Homo sapien
ggcatatttccacctatgattcgtg

SEQ ID NO: 472591 - DNA, 25 bp, Homo sapien
atttccacctatgattcgtgtttac

SEQ ID NO: 472592 - DNA, 25 bp, Homo sapien
cctatgattcgtgtttacctggtat

SEQ ID NO: 472593 - DNA, 25 bp, Homo sapien
atgattcgtgtttacctggtattag

SEQ ID NO: 472594 - DNA, 25 bp, Homo sapien
gtttacctggtattaggagctcaga

SEQ ID NO: 472595 - DNA, 25 bp, Homo sapien
cctggtattaggagctcagaatgga

SEQ ID NO: 472596 - DNA, 25 bp, Homo sapien
ctcagaatggaatgcataaagcttc

SEQ ID NO: 472597 - DNA, 25 bp, Homo sapien
aagcttcactggaagtgtatacaac

SEQ ID NO: 472598 - DNA, 25 bp, Homo sapien
acaactgtggtgtagaatctgttat

SEQ ID NO: 472599 - DNA, 25 bp, Homo sapien
ggtgtagaatctgttattattatca

SEQ ID NO: 472600 - DNA, 25 bp, Homo sapien
ttgcctacccctgaactttgtgtaa

SEQ ID NO: 472601 - DNA, 25 bp, Homo sapien
tacccctgaactttgtgtaagtgga

SEQ ID NO: 472602 - DNA, 25 bp, Homo sapien
gaaatacatggtttggcatcttgct

SEQ ID NO: 472603 - DNA, 25 bp, Homo sapien
acatggtttggcatcttgcttttat

SEQ ID NO: 472604 - DNA, 25 bp, Homo sapien
ttggcatcttgcttttatgcaacat

SEQ ID NO: 472605 - DNA, 25 bp, Homo sapien
tgcttttatgcaacattgtatctgt

SEQ ID NO: 472606 - DNA, 25 bp, Homo sapien
atctgtgagaatctattgtcatgtc

SEQ ID NO: 472607 - DNA, 25 bp, Homo sapien
gaatctattgtcatgtctgttttcc

SEQ ID NO: 472608 - DNA, 25 bp, Homo sapien
attccattgtggagatgtatcacaa

SEQ ID NO: 472609 - DNA, 25 bp, Homo sapien
cacaatgtatttatcttactgctga

SEQ ID NO: 472610 - DNA, 25 bp, Homo sapien
ggttattgtagataaagcagctatg

SEQ ID NO: 472611 - DNA, 25 bp, Homo sapien
tttagaaaggtatactattcagctg

SEQ ID NO: 472612 - DNA, 25 bp, Homo sapien
ttagaaaggtatactattcagctgg

SEQ ID NO: 472613 - DNA, 25 bp, Homo sapien
tagaaaggtatactattcagctggg

SEQ ID NO: 472614 - DNA, 25 bp, Homo sapien
agaaaggtatactattcagctgggc

SEQ ID NO: 472615 - DNA, 25 bp, Homo sapien
gaaaggtatactattcagctgggcg

SEQ ID NO: 472616 - DNA, 25 bp, Homo sapien
aaaggtatactattcagctgggcgt

SEQ ID NO: 472617 - DNA, 25 bp, Homo sapien
aaggtatactattcagctgggcgta

SEQ ID NO: 472618 - DNA, 25 bp, Homo sapien
aggtatactattcagctgggcgtag

SEQ ID NO: 472619 - DNA, 25 bp, Homo sapien
ggtatactattcagctgggcgtagt

SEQ ID NO: 472620 - DNA, 25 bp, Homo sapien
ctgcacccggcccatttatggtaaa

SEQ ID NO: 472621 - DNA, 25 bp, Homo sapien
tgcacccggcccatttatggtaaat

SEQ ID NO: 472622 - DNA, 25 bp, Homo sapien
gcacccggcccatttatggtaaata

SEQ ID NO: 472623 - DNA, 25 bp, Homo sapien
cacccggcccatttatggtaaatat

SEQ ID NO: 472624 - DNA, 25 bp, Homo sapien
ccggcccatttatggtaaatattat

SEQ ID NO: 472625 - DNA, 25 bp, Homo sapien
cggcccatttatggtaaatattatt

SEQ ID NO: 472626 - DNA, 25 bp, Homo sapien
ggcccatttatggtaaatattatta

SEQ ID NO: 472627 - DNA, 25 bp, Homo sapien
gcccatttatggtaaatattattag

SEQ ID NO: 472628 - DNA, 25 bp, Homo sapien
cccatttatggtaaatattattaga

SEQ ID NO: 472629 - DNA, 25 bp, Homo sapien
atattattagattatttttggaagg

SEQ ID NO: 472630 - DNA, 25 bp, Homo sapien
tattattagattatttttggaaggg

SEQ ID NO: 472631 - DNA, 25 bp, Homo sapien
aattccatcagaccaaggctgcaag

SEQ ID NO: 472632 - DNA, 25 bp, Homo sapien
aaggctgcaagtggccctccattcg

SEQ ID NO: 472633 - DNA, 25 bp, Homo sapien
aattgcttcccctctgtgatctcat

SEQ ID NO: 472634 - DNA, 25 bp, Homo sapien
atctgcactgccatacgtggagtga

SEQ ID NO: 472635 - DNA, 25 bp, Homo sapien
gtgagcaagacagggcttaccatcc

SEQ ID NO: 472636 - DNA, 25 bp, Homo sapien
ttaccatcctgtctaccagatgagg

SEQ ID NO: 472637 - DNA, 25 bp, Homo sapien
agaagtcactggtctagatcccgca

SEQ ID NO: 472638 - DNA, 25 bp, Homo sapien
gctagggttcaaaacgttctcacca

SEQ ID NO: 472639 - DNA, 25 bp, Homo sapien
aaacgttctcaccaaatccaatgct

SEQ ID NO: 472640 - DNA, 25 bp, Homo sapien
atccaatgctcctcacatattaatt

SEQ ID NO: 472641 - DNA, 25 bp, Homo sapien
atctggccaagcttgaggaagatgt

SEQ ID NO: 472642 - DNA, 25 bp, Homo sapien
gggactacagtcgtatgccatcact

SEQ ID NO: 472643 - DNA, 25 bp, Homo sapien
ggactacagtcgtatgccatcactc

SEQ ID NO: 472644 - DNA, 25 bp, Homo sapien
actacagtcgtatgccatcactcca

SEQ ID NO: 472645 - DNA, 25 bp, Homo sapien
agtcgtatgccatcactccaggcta

SEQ ID NO: 472646 - DNA, 25 bp, Homo sapien
cgtatgccatcactccaggctaatt

SEQ ID NO: 472647 - DNA, 25 bp, Homo sapien
cccagcccacttacaattcaataat

SEQ ID NO: 472648 - DNA, 25 bp, Homo sapien
gaagatatatgaatgaccaatgttt

SEQ ID NO: 472649 - DNA, 25 bp, Homo sapien
gaatgaccaatgtttaagtaactct

SEQ ID NO: 472650 - DNA, 25 bp, Homo sapien
gaccaatgtttaagtaactcttagg

SEQ ID NO: 472651 - DNA, 25 bp, Homo sapien
gtttaagtaactcttaggaagtcag

SEQ ID NO: 472652 - DNA, 25 bp, Homo sapien
taactcttaggaagtcaggaaaaag

SEQ ID NO: 472653 - DNA, 25 bp, Homo sapien
gcctggaagaggtcacagtccctcc

SEQ ID NO: 472654 - DNA, 25 bp, Homo sapien
ggaagaggtcacagtccctcccact

SEQ ID NO: 472655 - DNA, 25 bp, Homo sapien
ccactgcaagcctttcccaaaaatt

SEQ ID NO: 472656 - DNA, 25 bp, Homo sapien
tcaaagccccctattggatgactgt

SEQ ID NO: 472657 - DNA, 25 bp, Homo sapien
cccctattggatgactgtgcccagg

SEQ ID NO: 472658 - DNA, 25 bp, Homo sapien
cctattggatgactgtgcccagggc

SEQ ID NO: 472659 - DNA, 25 bp, Homo sapien
ccagggccgggctccatagggccgg

SEQ ID NO: 472660 - DNA, 25 bp, Homo sapien
cttgtgtggaggaccaggcttcaga

SEQ ID NO: 472661 - DNA, 25 bp, Homo sapien
tggaggaccaggcttcagaccccac

SEQ ID NO: 472662 - DNA, 25 bp, Homo sapien
ggaccaggcttcagaccccactggg

SEQ ID NO: 472663 - DNA, 25 bp, Homo sapien
ttcagaccccactgggtgatggcgg

SEQ ID NO: 472664 - DNA, 25 bp, Homo sapien
gggtcaggcctattttccaagtaat

SEQ ID NO: 472665 - DNA, 25 bp, Homo sapien
aatgttcacttcttgtttgtaaagc

SEQ ID NO: 472666 - DNA, 25 bp, Homo sapien
ataacttcatttctgggtactaatt

SEQ ID NO: 472667 - DNA, 25 bp, Homo sapien
ggtactaattccagtagcagctgtt

SEQ ID NO: 472668 - DNA, 25 bp, Homo sapien
gcagctgttttctgctaactgagaa

SEQ ID NO: 472669 - DNA, 25 bp, Homo sapien
gagaaatatgcctgtgctaacaact

SEQ ID NO: 472670 - DNA, 25 bp, Homo sapien
taacaactttacacttccagcaaaa

SEQ ID NO: 472671 - DNA, 25 bp, Homo sapien
actggaaccatggtgcacactaagc

SEQ ID NO: 472672 - DNA, 25 bp, Homo sapien
ggtgcacactaagctgtctaaagac

SEQ ID NO: 472673 - DNA, 25 bp, Homo sapien
acaaatgtgcggtgtttattttctt

SEQ ID NO: 472674 - DNA, 25 bp, Homo sapien
gaaacattaattgggattgactcat

SEQ ID NO: 472675 - DNA, 25 bp, Homo sapien
gaagaatggagccagtagtctctaa

SEQ ID NO: 472676 - DNA, 25 bp, Homo sapien
gagccagtagtctctaaaccacctt

SEQ ID NO: 472677 - DNA, 25 bp, Homo sapien
gtagtctctaaaccaccttcccgat

SEQ ID NO: 472678 - DNA, 25 bp, Homo sapien
gatccgcctcctcgtagttgtttta

SEQ ID NO: 472679 - DNA, 25 bp, Homo sapien
gagctcccagggaacttcagtgttt

SEQ ID NO: 472680 - DNA, 25 bp, Homo sapien
tcccagggaacttcagtgtttttct

SEQ ID NO: 472681 - DNA, 25 bp, Homo sapien
tattctatttaaatggttcctagac

SEQ ID NO: 472682 - DNA, 25 bp, Homo sapien
ggttcctagacataggtttttatga

SEQ ID NO: 472683 - DNA, 25 bp, Homo sapien
tgatccagtggtgcttgctgaggaa

SEQ ID NO: 472684 - DNA, 25 bp, Homo sapien
tatgtaaccgcccttttcctgagcc

SEQ ID NO: 472685 - DNA, 25 bp, Homo sapien
ttgccctcctggatacagatgtttt

SEQ ID NO: 472686 - DNA, 25 bp, Homo sapien
aattattagatattttaggctgggc

SEQ ID NO: 472687 - DNA, 25 bp, Homo sapien
attattagatattttaggctgggca

SEQ ID NO: 472688 - DNA, 25 bp, Homo sapien
tattagatattttaggctgggcacg

SEQ ID NO: 472689 - DNA, 25 bp, Homo sapien
attagatattttaggctgggcacgg

SEQ ID NO: 472690 - DNA, 25 bp, Homo sapien
ttagatattttaggctgggcacggt

SEQ ID NO: 472691 - DNA, 25 bp, Homo sapien
tagatattttaggctgggcacggtg

SEQ ID NO: 472692 - DNA, 25 bp, Homo sapien
agatattttaggctgggcacggtga

SEQ ID NO: 472693 - DNA, 25 bp, Homo sapien
acggtgactcacgccagcactttcg

SEQ ID NO: 472694 - DNA, 25 bp, Homo sapien
cagcactttcggagtaatcccagca

SEQ ID NO: 472695 - DNA, 25 bp, Homo sapien
agcactttcggagtaatcccagcac

SEQ ID NO: 472696 - DNA, 25 bp, Homo sapien
gcactttcggagtaatcccagcact

SEQ ID NO: 472697 - DNA, 25 bp, Homo sapien
atctgattaagaataaggaatggac

SEQ ID NO: 472698 - DNA, 25 bp, Homo sapien
tctgattaagaataaggaatggaca

SEQ ID NO: 472699 - DNA, 25 bp, Homo sapien
gattaagaataaggaatggacaggc

SEQ ID NO: 472700 - DNA, 25 bp, Homo sapien
attaagaataaggaatggacaggcg

SEQ ID NO: 472701 - DNA, 25 bp, Homo sapien
ttaagaataaggaatggacaggcgc

SEQ ID NO: 472702 - DNA, 25 bp, Homo sapien
taagaataaggaatggacaggcgca

SEQ ID NO: 472703 - DNA, 25 bp, Homo sapien
aagaataaggaatggacaggcgcag

SEQ ID NO: 472704 - DNA, 25 bp, Homo sapien
agaataaggaatggacaggcgcagt

SEQ ID NO: 472705 - DNA, 25 bp, Homo sapien
gaataaggaatggacaggcgcagtg

SEQ ID NO: 472706 - DNA, 25 bp, Homo sapien
gaatgagaccctgtcacacacacac

SEQ ID NO: 472707 - DNA, 25 bp, Homo sapien
acacacaaaaagttgaatgctgggc

SEQ ID NO: 472708 - DNA, 25 bp, Homo sapien
cacacaaaaagttgaatgctgggcc

SEQ ID NO: 472709 - DNA, 25 bp, Homo sapien
acacaaaaagttgaatgctgggcca

SEQ ID NO: 472710 - DNA, 25 bp, Homo sapien
cacaaaaagttgaatgctgggccag

SEQ ID NO: 472711 - DNA, 25 bp, Homo sapien
acaaaaagttgaatgctgggccagc

SEQ ID NO: 472712 - DNA, 25 bp, Homo sapien
caaaaagttgaatgctgggccagcg

SEQ ID NO: 472713 - DNA, 25 bp, Homo sapien
aaaaagttgaatgctgggccagcgc

SEQ ID NO: 472714 - DNA, 25 bp, Homo sapien
aaaagttgaatgctgggccagcgca

SEQ ID NO: 472715 - DNA, 25 bp, Homo sapien
aaagttgaatgctgggccagcgcag

SEQ ID NO: 472716 - DNA, 25 bp, Homo sapien
aagttgaatgctgggccagcgcagt

SEQ ID NO: 472717 - DNA, 25 bp, Homo sapien
ttgggcacttgagaagcttgagcta

SEQ ID NO: 472718 - DNA, 25 bp, Homo sapien
gaaaatcatctcctgcaagaccatt

SEQ ID NO: 472719 - DNA, 25 bp, Homo sapien
ctgcaagaccatttccacaggaaga

SEQ ID NO: 472720 - DNA, 25 bp, Homo sapien
atttccacaggaagagtgccacgca

SEQ ID NO: 472721 - DNA, 25 bp, Homo sapien
gagtgccacgcagcacatcagaagc

SEQ ID NO: 472722 - DNA, 25 bp, Homo sapien
caaagacactcagctaatggccagt

SEQ ID NO: 472723 - DNA, 25 bp, Homo sapien
gtgactgcagttctacaatctataa

SEQ ID NO: 472724 - DNA, 25 bp, Homo sapien
tctataatccacttgacacgagctt

SEQ ID NO: 472725 - DNA, 25 bp, Homo sapien
tgacacgagcttggcatcagtttca

SEQ ID NO: 472726 - DNA, 25 bp, Homo sapien
ggctttgataattgcatcagatctg

SEQ ID NO: 472727 - DNA, 25 bp, Homo sapien
gcaaggctgtgtaggcagaattctt

SEQ ID NO: 472728 - DNA, 25 bp, Homo sapien
gcgcccggccatgagtctatattat

SEQ ID NO: 472729 - DNA, 25 bp, Homo sapien
gcccggccatgagtctatattattt

SEQ ID NO: 472730 - DNA, 25 bp, Homo sapien
cggccatgagtctatattattttaa

SEQ ID NO: 472731 - DNA, 25 bp, Homo sapien
gaatagtaactcaagataccttaag

SEQ ID NO: 472732 - DNA, 25 bp, Homo sapien
tctgaaattggaaagcttttggtaa

SEQ ID NO: 472733 - DNA, 25 bp, Homo sapien
atgattattcattgatagtgtgaac

SEQ ID NO: 472734 - DNA, 25 bp, Homo sapien
gatagtgtgaacatttacctggaaa

SEQ ID NO: 472735 - DNA, 25 bp, Homo sapien
gtgtgaacatttacctggaaagcct

SEQ ID NO: 472736 - DNA, 25 bp, Homo sapien
gaacatttacctggaaagcctaaca

SEQ ID NO: 472737 - DNA, 25 bp, Homo sapien
acctggaaagcctaacaaaatcaag

SEQ ID NO: 472738 - DNA, 25 bp, Homo sapien
tgcaaaaatcaatcacttacatata

SEQ ID NO: 472739 - DNA, 25 bp, Homo sapien
ccaaagccaaggagtataaacatgt

SEQ ID NO: 472740 - DNA, 25 bp, Homo sapien
aacatgtatgcaaacgagcttgtca

SEQ ID NO: 472741 - DNA, 25 bp, Homo sapien
gcaaacgagcttgtcagaaggcaat

SEQ ID NO: 472742 - DNA, 25 bp, Homo sapien
cgagcttgtcagaaggcaattgaaa

SEQ ID NO: 472743 - DNA, 25 bp, Homo sapien
caattgaaaagctgcaggccggtgc

SEQ ID NO: 472744 - DNA, 25 bp, Homo sapien
tgaaaagctgcaggccggtgctctt

SEQ ID NO: 472745 - DNA, 25 bp, Homo sapien
agctgcaggccggtgctcttgcaac

SEQ ID NO: 472746 - DNA, 25 bp, Homo sapien
gtgctcttgcaactgacgcagtcac

SEQ ID NO: 472747 - DNA, 25 bp, Homo sapien
tcttgcaactgacgcagtcactgca

SEQ ID NO: 472748 - DNA, 25 bp, Homo sapien
gacgcagtcactgcagcactggtgg

SEQ ID NO: 472749 - DNA, 25 bp, Homo sapien
cgcagtcactgcagcactggtggaa

SEQ ID NO: 472750 - DNA, 25 bp, Homo sapien
ccacgactgggcttaaagatcagct

SEQ ID NO: 472751 - DNA, 25 bp, Homo sapien
cacgactgggcttaaagatcagctt

SEQ ID NO: 472752 - DNA, 25 bp, Homo sapien
acgactgggcttaaagatcagctta

SEQ ID NO: 472753 - DNA, 25 bp, Homo sapien
cgactgggcttaaagatcagcttag

SEQ ID NO: 472754 - DNA, 25 bp, Homo sapien
gactgggcttaaagatcagcttaga

SEQ ID NO: 472755 - DNA, 25 bp, Homo sapien
actgggcttaaagatcagcttagaa

SEQ ID NO: 472756 - DNA, 25 bp, Homo sapien
tgggcttaaagatcagcttagaaac

SEQ ID NO: 472757 - DNA, 25 bp, Homo sapien
gggcttaaagatcagcttagaaaca

SEQ ID NO: 472758 - DNA, 25 bp, Homo sapien
ggcttaaagatcagcttagaaacaa

SEQ ID NO: 472759 - DNA, 25 bp, Homo sapien
taaagatcagcttagaaacaaggag

SEQ ID NO: 472760 - DNA, 25 bp, Homo sapien
gatcagcttagaaacaaggaggaga

SEQ ID NO: 472761 - DNA, 25 bp, Homo sapien
agcttttaatcaccacacaccactg

SEQ ID NO: 472762 - DNA, 25 bp, Homo sapien
tgctttcccacttagcagatgaaac

SEQ ID NO: 472763 - DNA, 25 bp, Homo sapien
ggttaagaggttgtccaagatcaca

SEQ ID NO: 472764 - DNA, 25 bp, Homo sapien
agtgaccaagcctggatttgatcta

SEQ ID NO: 472765 - DNA, 25 bp, Homo sapien
gatttgatctatcctcacagagaca

SEQ ID NO: 472766 - DNA, 25 bp, Homo sapien
cacagagacagatatttgcaggtac

SEQ ID NO: 472767 - DNA, 25 bp, Homo sapien
atattagttacctgtttcccttgct

SEQ ID NO: 472768 - DNA, 25 bp, Homo sapien
cctagctctcagaccagggatagaa

SEQ ID NO: 472769 - DNA, 25 bp, Homo sapien
ttggaaaattaacgccttgaagact

SEQ ID NO: 472770 - DNA, 25 bp, Homo sapien
gaagactcaaagcagtccattcact

SEQ ID NO: 472771 - DNA, 25 bp, Homo sapien
gtccattcacttccacgagtaattt

SEQ ID NO: 472772 - DNA, 25 bp, Homo sapien
tagtggctcaaaagacagtgagact

SEQ ID NO: 472773 - DNA, 25 bp, Homo sapien
gaaattctatcattagggagatgaa

SEQ ID NO: 472774 - DNA, 25 bp, Homo sapien
ggagatgaatgtcaagttgtcctga

SEQ ID NO: 472775 - DNA, 25 bp, Homo sapien
caagttgtcctgacattgtttttca

SEQ ID NO: 472776 - DNA, 25 bp, Homo sapien
caaaggaatagcttgaacttcaaag

SEQ ID NO: 472777 - DNA, 25 bp, Homo sapien
gaagaaccactgtatctcttgtaga

SEQ ID NO: 472778 - DNA, 25 bp, Homo sapien
gtatctcttgtagattccaaacatt

SEQ ID NO: 472779 - DNA, 25 bp, Homo sapien
aagcacttgaggcaatagtttagca

SEQ ID NO: 472780 - DNA, 25 bp, Homo sapien
ggcaatagtttagcagctttctcaa

SEQ ID NO: 472781 - DNA, 25 bp, Homo sapien
agctttctcaaactggacagtatag

SEQ ID NO: 472782 - DNA, 25 bp, Homo sapien
agaaagataaagacgtcggcctggt

SEQ ID NO: 472783 - DNA, 25 bp, Homo sapien
tgctctctgggctaagaaggaccag

SEQ ID NO: 472784 - DNA, 25 bp, Homo sapien
agagagtggatcttctcctcaggga

SEQ ID NO: 472785 - DNA, 25 bp, Homo sapien
cagggatgagaatctctctgagcaa

SEQ ID NO: 472786 - DNA, 25 bp, Homo sapien
caaagaatgctttgctgcacccctg

SEQ ID NO: 472787 - DNA, 25 bp, Homo sapien
gatggctgggcaaacctcatggagt

SEQ ID NO: 472788 - DNA, 25 bp, Homo sapien
aacctcatggagtggctttggcaca

SEQ ID NO: 472789 - DNA, 25 bp, Homo sapien
gcacaggaagggtagccactgcaga

SEQ ID NO: 472790 - DNA, 25 bp, Homo sapien
ggaccccagcagatgtggagtttca

SEQ ID NO: 472791 - DNA, 25 bp, Homo sapien
atggaatagcctgatccctctgcag

SEQ ID NO: 472792 - DNA, 25 bp, Homo sapien
tccctctgcagggtctggagactga

SEQ ID NO: 472793 - DNA, 25 bp, Homo sapien
tggagactgacgtgatcagttctgt

SEQ ID NO: 472794 - DNA, 25 bp, Homo sapien
atggtgtagagtggcccctgtttga

SEQ ID NO: 472795 - DNA, 25 bp, Homo sapien
tggtgtagagtggcccctgtttgac

SEQ ID NO: 472796 - DNA, 25 bp, Homo sapien
gtgtagagtggcccctgtttgacct

SEQ ID NO: 472797 - DNA, 25 bp, Homo sapien
tgtagagtggcccctgtttgacctg

SEQ ID NO: 472798 - DNA, 25 bp, Homo sapien
gtagagtggcccctgtttgacctgc

SEQ ID NO: 472799 - DNA, 25 bp, Homo sapien
tagagtggcccctgtttgacctgcc

SEQ ID NO: 472800 - DNA, 25 bp, Homo sapien
gagtggcccctgtttgacctgccca

SEQ ID NO: 472801 - DNA, 25 bp, Homo sapien
agtggcccctgtttgacctgcccag

SEQ ID NO: 472802 - DNA, 25 bp, Homo sapien
gtggcccctgtttgacctgcccagg

SEQ ID NO: 472803 - DNA, 25 bp, Homo sapien
ggcccctgtttgacctgcccaggcc

SEQ ID NO: 472804 - DNA, 25 bp, Homo sapien
tgcccaggcccattctccaaagaag

SEQ ID NO: 472805 - DNA, 25 bp, Homo sapien
atataaggtgctgtgcaagtgccca

SEQ ID NO: 472806 - DNA, 25 bp, Homo sapien
taaataaaacgtggtgtggctgcct

SEQ ID NO: 472807 - DNA, 25 bp, Homo sapien
gtggctgcctagctcacagcaaata

SEQ ID NO: 472808 - DNA, 25 bp, Homo sapien
acagcaaataccctggcggtcacat

SEQ ID NO: 472809 - DNA, 25 bp, Homo sapien
ggcggtcacatctgtataacatctt

SEQ ID NO: 472810 - DNA, 25 bp, Homo sapien
gtataacatctttccttctatcatt

SEQ ID NO: 472811 - DNA, 25 bp, Homo sapien
atggagattgtcatcagccccaaga

SEQ ID NO: 472812 - DNA, 25 bp, Homo sapien
agccccaagaccttgcagtagtgat

SEQ ID NO: 472813 - DNA, 25 bp, Homo sapien
tgaggcatgagcacgtgagtctagt

SEQ ID NO: 472814 - DNA, 25 bp, Homo sapien
agcacgtgagtctagtccagccaat

SEQ ID NO: 472815 - DNA, 25 bp, Homo sapien
gtccagccaattagtcattacttca

SEQ ID NO: 472816 - DNA, 25 bp, Homo sapien
aagggagatagtgtgcccctctctt

SEQ ID NO: 472817 - DNA, 25 bp, Homo sapien
tctcttcacccctgctgctagtaag

SEQ ID NO: 472818 - DNA, 25 bp, Homo sapien
tgctagtaagcccatctccaagaga

SEQ ID NO: 472819 - DNA, 25 bp, Homo sapien
gtaagcccatctccaagagagcttt

SEQ ID NO: 472820 - DNA, 25 bp, Homo sapien
caagagagctttccccaagtgctaa

SEQ ID NO: 472821 - DNA, 25 bp, Homo sapien
agtggtcaacccacttgggaaatgt

SEQ ID NO: 472822 - DNA, 25 bp, Homo sapien
ttggcttaatcatcctcattctctt

SEQ ID NO: 472823 - DNA, 25 bp, Homo sapien
gaaaaaatggcttcctttgctcact

SEQ ID NO: 472824 - DNA, 25 bp, Homo sapien
tttgctcactccaagtaattctctg

SEQ ID NO: 472825 - DNA, 25 bp, Homo sapien
tgaaacctaactaataccacctcac

SEQ ID NO: 472826 - DNA, 25 bp, Homo sapien
taataccacctcacatttagatgct

SEQ ID NO: 472827 - DNA, 25 bp, Homo sapien
aagttctttctcattttcctctcta

SEQ ID NO: 472828 - DNA, 25 bp, Homo sapien
tctttctcattttcctctctaatca

SEQ ID NO: 472829 - DNA, 25 bp, Homo sapien
tcattttcctctctaatcaccatag

SEQ ID NO: 472830 - DNA, 25 bp, Homo sapien
tttcctctctaatcaccatagcttt

SEQ ID NO: 472831 - DNA, 25 bp, Homo sapien
tctaatcaccatagctttcctaatg

SEQ ID NO: 472832 - DNA, 25 bp, Homo sapien
tcaccatagctttcctaatgaaaca

SEQ ID NO: 472833 - DNA, 25 bp, Homo sapien
aactttgctagaattaaacctgaat

SEQ ID NO: 472834 - DNA, 25 bp, Homo sapien
aattaaacctgaattattaggcaag

SEQ ID NO: 472835 - DNA, 25 bp, Homo sapien
attaggcaagaatacagtgacataa

SEQ ID NO: 472836 - DNA, 25 bp, Homo sapien
tatattcttattacaggccaattag

SEQ ID NO: 472837 - DNA, 25 bp, Homo sapien
acaggccaattagaattttagatag

SEQ ID NO: 472838 - DNA, 25 bp, Homo sapien
cattgctcgtgtattctgccactaa

SEQ ID NO: 472839 - DNA, 25 bp, Homo sapien
attgctcgtgtattctgccactaac

SEQ ID NO: 472840 - DNA, 25 bp, Homo sapien
ttgctcgtgtattctgccactaaca

SEQ ID NO: 472841 - DNA, 25 bp, Homo sapien
tgctcgtgtattctgccactaacaa

SEQ ID NO: 472842 - DNA, 25 bp, Homo sapien
gctcgtgtattctgccactaacaag

SEQ ID NO: 472843 - DNA, 25 bp, Homo sapien
ctcgtgtattctgccactaacaaga

SEQ ID NO: 472844 - DNA, 25 bp, Homo sapien
gtattctgccactaacaagaatgaa

SEQ ID NO: 472845 - DNA, 25 bp, Homo sapien
ctgccactaacaagaatgaagacat

SEQ ID NO: 472846 - DNA, 25 bp, Homo sapien
aatgaagacatcacattggccgggc

SEQ ID NO: 472847 - DNA, 25 bp, Homo sapien
atgaagacatcacattggccgggcg

SEQ ID NO: 472848 - DNA, 25 bp, Homo sapien
tgaagacatcacattggccgggcgc

SEQ ID NO: 472849 - DNA, 25 bp, Homo sapien
atatttcttcccaatcttttttgtg

SEQ ID NO: 472850 - DNA, 25 bp, Homo sapien
tcttcccaatcttttttgtgttgtt

SEQ ID NO: 472851 - DNA, 25 bp, Homo sapien
gtttcattttcttaacaatgacagc

SEQ ID NO: 472852 - DNA, 25 bp, Homo sapien
ttcttaacaatgacagcacagcttt

SEQ ID NO: 472853 - DNA, 25 bp, Homo sapien
tgaaagtctttgaagggaatatcct

SEQ ID NO: 472854 - DNA, 25 bp, Homo sapien
gtctttgaagggaatatcctaaaag

SEQ ID NO: 472855 - DNA, 25 bp, Homo sapien
tatcctaaaaggtactaaagtagag

SEQ ID NO: 472856 - DNA, 25 bp, Homo sapien
taaagtagaggttttaccagcctgg

SEQ ID NO: 472857 - DNA, 25 bp, Homo sapien
gtagaggttttaccagcctgggcaa

SEQ ID NO: 472858 - DNA, 25 bp, Homo sapien
tagccaagtaaggtggtgcttgcct

SEQ ID NO: 472859 - DNA, 25 bp, Homo sapien
agccaagtaaggtggtgcttgcctg

SEQ ID NO: 472860 - DNA, 25 bp, Homo sapien
aggccaggtctccagagtccccagg

SEQ ID NO: 472861 - DNA, 25 bp, Homo sapien
agggcacttccaggaggacctctct

SEQ ID NO: 472862 - DNA, 25 bp, Homo sapien
aggccagaggtctgtgcctcagtaa

SEQ ID NO: 472863 - DNA, 25 bp, Homo sapien
gtctgtgcctcagtaaggattcatt

SEQ ID NO: 472864 - DNA, 25 bp, Homo sapien
ggattcattaacaccctatctcaga

SEQ ID NO: 472865 - DNA, 25 bp, Homo sapien
ggaattatctccttttggtaggcaa

SEQ ID NO: 472866 - DNA, 25 bp, Homo sapien
gtaggaagcagaaccggccagcata

SEQ ID NO: 472867 - DNA, 25 bp, Homo sapien
agcagaaccggccagcatacttggt

SEQ ID NO: 472868 - DNA, 25 bp, Homo sapien
catacttggtgaaagcttcaggtga

SEQ ID NO: 472869 - DNA, 25 bp, Homo sapien
gatcacttttgagacgcagagaggg

SEQ ID NO: 472870 - DNA, 25 bp, Homo sapien
ggctaaagcttcctcttaaaagcag

SEQ ID NO: 472871 - DNA, 25 bp, Homo sapien
atcacttgagggtgcttggctggca

SEQ ID NO: 472872 - DNA, 25 bp, Homo sapien
acttgagggtgcttggctggcatac

SEQ ID NO: 472873 - DNA, 25 bp, Homo sapien
gcttggctggcatacgggttagtct

SEQ ID NO: 472874 - DNA, 25 bp, Homo sapien
cttggctggcatacgggttagtctg

SEQ ID NO: 472875 - DNA, 25 bp, Homo sapien
tacgggttagtctggggaccactgc

SEQ ID NO: 472876 - DNA, 25 bp, Homo sapien
tttccggcatcctctgtgggttcca

SEQ ID NO: 472877 - DNA, 25 bp, Homo sapien
ggcatcctctgtgggttccagcatt

SEQ ID NO: 472878 - DNA, 25 bp, Homo sapien
atcctctgtgggttccagcattttt

SEQ ID NO: 472879 - DNA, 25 bp, Homo sapien
ctgtgggttccagcatttttctttt

SEQ ID NO: 472880 - DNA, 25 bp, Homo sapien
ccaggctaaagtgcatttgtgcgat

SEQ ID NO: 472881 - DNA, 25 bp, Homo sapien
taaagtgcatttgtgcgatctcagc

SEQ ID NO: 472882 - DNA, 25 bp, Homo sapien
ccctgcccttgtacagtttatagta

SEQ ID NO: 472883 - DNA, 25 bp, Homo sapien
aaaccttaacgcaatacacatccat

SEQ ID NO: 472884 - DNA, 25 bp, Homo sapien
catccatatgttaccagtgctacca

SEQ ID NO: 472885 - DNA, 25 bp, Homo sapien
atatgttaccagtgctaccagctat

SEQ ID NO: 472886 - DNA, 25 bp, Homo sapien
gtgctaccagctatggatgaccaat

SEQ ID NO: 472887 - DNA, 25 bp, Homo sapien
gatgaccaattatagtgatgtttac

SEQ ID NO: 472888 - DNA, 25 bp, Homo sapien
gtgatgtttactttgttatactttt

SEQ ID NO: 472889 - DNA, 25 bp, Homo sapien
gttatacttttctgaactctctaaa

SEQ ID NO: 472890 - DNA, 25 bp, Homo sapien
aactctctaaattctctaagcaggc

SEQ ID NO: 472891 - DNA, 25 bp, Homo sapien
tttacaagcagaaaacctcagcacc

SEQ ID NO: 472892 - DNA, 25 bp, Homo sapien
aacctcagcacccacaaagactaaa

SEQ ID NO: 472893 - DNA, 25 bp, Homo sapien
attaagaaaagggtgtgcttgctgg

SEQ ID NO: 472894 - DNA, 25 bp, Homo sapien
ttaagaaaagggtgtgcttgctggg

SEQ ID NO: 472895 - DNA, 25 bp, Homo sapien
taagaaaagggtgtgcttgctgggc

SEQ ID NO: 472896 - DNA, 25 bp, Homo sapien
aagaaaagggtgtgcttgctgggca

SEQ ID NO: 472897 - DNA, 25 bp, Homo sapien
agaaaagggtgtgcttgctgggcac

SEQ ID NO: 472898 - DNA, 25 bp, Homo sapien
gaaaagggtgtgcttgctgggcacg

SEQ ID NO: 472899 - DNA, 25 bp, Homo sapien
aaaagggtgtgcttgctgggcacgg

SEQ ID NO: 472900 - DNA, 25 bp, Homo sapien
aaagggtgtgcttgctgggcacggt

SEQ ID NO: 472901 - DNA, 25 bp, Homo sapien
aagggtgtgcttgctgggcacggtg

SEQ ID NO: 472902 - DNA, 25 bp, Homo sapien
agggtgtgcttgctgggcacggtgg

SEQ ID NO: 472903 - DNA, 25 bp, Homo sapien
gggtgtgcttgctgggcacggtggc

SEQ ID NO: 472904 - DNA, 25 bp, Homo sapien
gaggtagttatcatctttaaaaaag

SEQ ID NO: 472905 - DNA, 25 bp, Homo sapien
tcatctttaaaaaagtttgaggcca

SEQ ID NO: 472906 - DNA, 25 bp, Homo sapien
catctttaaaaaagtttgaggccag

SEQ ID NO: 472907 - DNA, 25 bp, Homo sapien
ttaaaaaagtttgaggccaggcgtg

SEQ ID NO: 472908 - DNA, 25 bp, Homo sapien
taaaaaagtttgaggccaggcgtgg

SEQ ID NO: 472909 - DNA, 25 bp, Homo sapien
aaaaagtttgaggccaggcgtggtg

SEQ ID NO: 472910 - DNA, 25 bp, Homo sapien
aaaagtttgaggccaggcgtggtgg

SEQ ID NO: 472911 - DNA, 25 bp, Homo sapien
aaagtttgaggccaggcgtggtggc

SEQ ID NO: 472912 - DNA, 25 bp, Homo sapien
aagtttgaggccaggcgtggtggct

SEQ ID NO: 472913 - DNA, 25 bp, Homo sapien
agtttgaggccaggcgtggtggctc

SEQ ID NO: 472914 - DNA, 25 bp, Homo sapien
gtttgaggccaggcgtggtggctca

SEQ ID NO: 472915 - DNA, 25 bp, Homo sapien
aggatcctcaaaattgttttgtcaa

SEQ ID NO: 472916 - DNA, 25 bp, Homo sapien
gttttgtcaatcatggagtaatctt

SEQ ID NO: 472917 - DNA, 25 bp, Homo sapien
ctcttcttcctggagaactgataac

SEQ ID NO: 472918 - DNA, 25 bp, Homo sapien
aaatgtgtaagatgtctgcccctcc

SEQ ID NO: 472919 - DNA, 25 bp, Homo sapien
ccctgagatagagggccttgcacac

SEQ ID NO: 472920 - DNA, 25 bp, Homo sapien
ttgcacacagtctcctgctcagctg

SEQ ID NO: 472921 - DNA, 25 bp, Homo sapien
tgagcacttactacatccccatttt

SEQ ID NO: 472922 - DNA, 25 bp, Homo sapien
cccattttttgcaacacgatctttc

SEQ ID NO: 472923 - DNA, 25 bp, Homo sapien
gcaacacgatctttctcaagtacaa

SEQ ID NO: 472924 - DNA, 25 bp, Homo sapien
gtacaatcatcctaagttgggcact

SEQ ID NO: 472925 - DNA, 25 bp, Homo sapien
tcatcctaagttgggcactattatt

SEQ ID NO: 472926 - DNA, 25 bp, Homo sapien
gcagcaggaagctgtaagactttaa

SEQ ID NO: 472927 - DNA, 25 bp, Homo sapien
cagcaggaagctgtaagactttaag

SEQ ID NO: 472928 - DNA, 25 bp, Homo sapien
agcaggaagctgtaagactttaagg

SEQ ID NO: 472929 - DNA, 25 bp, Homo sapien
caggaagctgtaagactttaagggc

SEQ ID NO: 472930 - DNA, 25 bp, Homo sapien
ggaagctgtaagactttaagggcca

SEQ ID NO: 472931 - DNA, 25 bp, Homo sapien
gaagctgtaagactttaagggccag

SEQ ID NO: 472932 - DNA, 25 bp, Homo sapien
aagctgtaagactttaagggccagg

SEQ ID NO: 472933 - DNA, 25 bp, Homo sapien
agctgtaagactttaagggccaggc

SEQ ID NO: 472934 - DNA, 25 bp, Homo sapien
gggtgcctgtactcggaggcggcgg

SEQ ID NO: 472935 - DNA, 25 bp, Homo sapien
tgcctgtactcggaggcggcgggag

SEQ ID NO: 472936 - DNA, 25 bp, Homo sapien
gcctgtactcggaggcggcgggagg

SEQ ID NO: 472937 - DNA, 25 bp, Homo sapien
ttctgtctctccacaaggatcagcg

SEQ ID NO: 472938 - DNA, 25 bp, Homo sapien
tgtctctccacaaggatcagcgtca

SEQ ID NO: 472939 - DNA, 25 bp, Homo sapien
gtgtcttagtctcactcagatttgg

SEQ ID NO: 472940 - DNA, 25 bp, Homo sapien
ttagtctcactcagatttggccctt

SEQ ID NO: 472941 - DNA, 25 bp, Homo sapien
agatttggcccttcttccgcgcctg

SEQ ID NO: 472942 - DNA, 25 bp, Homo sapien
gcgcctgccagttcagctagcactt

SEQ ID NO: 472943 - DNA, 25 bp, Homo sapien
agttcagctagcacttcggccagtg

SEQ ID NO: 472944 - DNA, 25 bp, Homo sapien
tcggccagtgtctcaggcagggtct

SEQ ID NO: 472945 - DNA, 25 bp, Homo sapien
tctagggttgcaggcaccagaagct

SEQ ID NO: 472946 - DNA, 25 bp, Homo sapien
ctctgcttacttcagccaaagggaa

SEQ ID NO: 472947 - DNA, 25 bp, Homo sapien
gagcacggagctaggatgcagaaat

SEQ ID NO: 472948 - DNA, 25 bp, Homo sapien
atgtgccagacaaacatgtcccaaa

SEQ ID NO: 472949 - DNA, 25 bp, Homo sapien
acatgtcccaaatgaggagtgctca

SEQ ID NO: 472950 - DNA, 25 bp, Homo sapien
ggagtgctcaggaccttactcccaa

SEQ ID NO: 472951 - DNA, 25 bp, Homo sapien
tctgaaatcaaagccctctgtacta

SEQ ID NO: 472952 - DNA, 25 bp, Homo sapien
ctctgtactatcacactggtcttta

SEQ ID NO: 472953 - DNA, 25 bp, Homo sapien
cacactggtctttaattgaaacaat

SEQ ID NO: 472954 - DNA, 25 bp, Homo sapien
aataaagagatcaaagccctctgta

SEQ ID NO: 472955 - DNA, 25 bp, Homo sapien
gccctctgtaaactctcccgttaat

SEQ ID NO: 472956 - DNA, 25 bp, Homo sapien
tcccgttaatttacataacctctct

SEQ ID NO: 472957 - DNA, 25 bp, Homo sapien
taacctctctagtatgtaaagccag

SEQ ID NO: 472958 - DNA, 25 bp, Homo sapien
gagcttaagtgcctcctatttcaga

SEQ ID NO: 472959 - DNA, 25 bp, Homo sapien
cttcctccaccacgtttaatagatt

SEQ ID NO: 472960 - DNA, 25 bp, Homo sapien
aatagattatgactcctctgggcct

SEQ ID NO: 472961 - DNA, 25 bp, Homo sapien
attatgactcctctgggccttcaca

SEQ ID NO: 472962 - DNA, 25 bp, Homo sapien
tatgcatagctgtggtgcactgctt

SEQ ID NO: 472963 - DNA, 25 bp, Homo sapien
agctgtggtgcactgcttctcattc

SEQ ID NO: 472964 - DNA, 25 bp, Homo sapien
ccatgggcctaaactccttgagtag

SEQ ID NO: 472965 - DNA, 25 bp, Homo sapien
aaatgtctacttcagtgttctatct

SEQ ID NO: 472966 - DNA, 25 bp, Homo sapien
gtgttctatctctagggcatacagt

SEQ ID NO: 472967 - DNA, 25 bp, Homo sapien
ggcatacagtaggtagtcaacacat

SEQ ID NO: 472968 - DNA, 25 bp, Homo sapien
gtgatacggtaacagataacaattt

SEQ ID NO: 472969 - DNA, 25 bp, Homo sapien
gtaaacaccaaatcacaagttcaag

SEQ ID NO: 472970 - DNA, 25 bp, Homo sapien
agccaccaagctcagccaggtagaa

SEQ ID NO: 472971 - DNA, 25 bp, Homo sapien
gctcagccaggtagaatttcatttt

SEQ ID NO: 472972 - DNA, 25 bp, Homo sapien
ggtttcatgttcactatttcctaag

SEQ ID NO: 472973 - DNA, 25 bp, Homo sapien
gttcactatttcctaagacaattta

SEQ ID NO: 472974 - DNA, 25 bp, Homo sapien
tgtcaactgaaagaactccgcatgt

SEQ ID NO: 472975 - DNA, 25 bp, Homo sapien
gaactccgcatgtagaatgctcagg

SEQ ID NO: 472976 - DNA, 25 bp, Homo sapien
tgtagaatgctcaggacatactaat

SEQ ID NO: 472977 - DNA, 25 bp, Homo sapien
ggacatactaataatgctttggaaa

SEQ ID NO: 472978 - DNA, 25 bp, Homo sapien
gcaatggtcttgtctatacttgatt

SEQ ID NO: 472979 - DNA, 25 bp, Homo sapien
gaaaagcgcattacatgtcacacac

SEQ ID NO: 472980 - DNA, 25 bp, Homo sapien
acatctgggctcatatgacaagtgt

SEQ ID NO: 472981 - DNA, 25 bp, Homo sapien
attgagaaggacttagtggcagtgt

SEQ ID NO: 472982 - DNA, 25 bp, Homo sapien
agctgacaatcaccaagtttcaggt

SEQ ID NO: 472983 - DNA, 25 bp, Homo sapien
ggaacaagcaagatccagtggttgt

SEQ ID NO: 472984 - DNA, 25 bp, Homo sapien
gggaggatatagagacagagaccat

SEQ ID NO: 472985 - DNA, 25 bp, Homo sapien
gagagactgagattcatgcctccaa

SEQ ID NO: 472986 - DNA, 25 bp, Homo sapien
gatggttgccgggacaggcaaacat

SEQ ID NO: 472987 - DNA, 25 bp, Homo sapien
aggcaaacatttccaccaacctcaa

SEQ ID NO: 472988 - DNA, 25 bp, Homo sapien
ccccatggccctagaaaaatcgtat

SEQ ID NO: 472989 - DNA, 25 bp, Homo sapien
aaatcgtattattggaggcacattc

SEQ ID NO: 472990 - DNA, 25 bp, Homo sapien
ttattggaggcacattcctctaccc

SEQ ID NO: 472991 - DNA, 25 bp, Homo sapien
attcctctaccctggaaacagagtg

SEQ ID NO: 472992 - DNA, 25 bp, Homo sapien
gataagaaagtaataggctgggtgt

SEQ ID NO: 472993 - DNA, 25 bp, Homo sapien
ttgaagctatgagttctagaccaac

SEQ ID NO: 472994 - DNA, 25 bp, Homo sapien
gaagctatgagttctagaccaacct

SEQ ID NO: 472995 - DNA, 25 bp, Homo sapien
aagctatgagttctagaccaacctg

SEQ ID NO: 472996 - DNA, 25 bp, Homo sapien
ggcatggtggtacactcctgcattc

SEQ ID NO: 472997 - DNA, 25 bp, Homo sapien
atggtggtacactcctgcattccta

SEQ ID NO: 472998 - DNA, 25 bp, Homo sapien
tggtggtacactcctgcattcctag

SEQ ID NO: 472999 - DNA, 25 bp, Homo sapien
gtggtacactcctgcattcctagct

SEQ ID NO: 473000 - DNA, 25 bp, Homo sapien
actcctgcattcctagctccttggg

SEQ ID NO: 473001 - DNA, 25 bp, Homo sapien
ggaaaatcgcttgagtccacaagtt

SEQ ID NO: 473002 - DNA, 25 bp, Homo sapien
aaatcgcttgagtccacaagttcaa

SEQ ID NO: 473003 - DNA, 25 bp, Homo sapien
gattaaatgtttttatttctacctg

SEQ ID NO: 473004 - DNA, 25 bp, Homo sapien
taaatgtttttatttctacctgcca

SEQ ID NO: 473005 - DNA, 25 bp, Homo sapien
aaatgtttttatttctacctgccat

SEQ ID NO: 473006 - DNA, 25 bp, Homo sapien
aatgtttttatttctacctgccatc

SEQ ID NO: 473007 - DNA, 25 bp, Homo sapien
atgtttttatttctacctgccatca

SEQ ID NO: 473008 - DNA, 25 bp, Homo sapien
tgtttttatttctacctgccatcat

SEQ ID NO: 473009 - DNA, 25 bp, Homo sapien
actaagtgaagtgacttctttcttt

SEQ ID NO: 473010 - DNA, 25 bp, Homo sapien
ctaagtgaagtgacttctttcttta

SEQ ID NO: 473011 - DNA, 25 bp, Homo sapien
agatgtggactgcacaacatcacat

SEQ ID NO: 473012 - DNA, 25 bp, Homo sapien
catcacatcatgctatctaacggaa

SEQ ID NO: 473013 - DNA, 25 bp, Homo sapien
gaatatttcctcttgtaatatgcaa

SEQ ID NO: 473014 - DNA, 25 bp, Homo sapien
agatggagacagtctttcatcccca

SEQ ID NO: 473015 - DNA, 25 bp, Homo sapien
caaattctcacccaaagtctaactt

SEQ ID NO: 473016 - DNA, 25 bp, Homo sapien
acttaagtacatgtccaattggcca

SEQ ID NO: 473017 - DNA, 25 bp, Homo sapien
ttctatggccagtaatatgctgtgc

SEQ ID NO: 473018 - DNA, 25 bp, Homo sapien
tgctgtgctgatgtgcataggcata

SEQ ID NO: 473019 - DNA, 25 bp, Homo sapien
taggcatagcttatgtcctctgtcc

SEQ ID NO: 473020 - DNA, 25 bp, Homo sapien
gtggctgggagtagaaccccaccta

SEQ ID NO: 473021 - DNA, 25 bp, Homo sapien
ccacctagatcccatggaacatgaa

SEQ ID NO: 473022 - DNA, 25 bp, Homo sapien
tacctccactacctgtgtttacatt

SEQ ID NO: 473023 - DNA, 25 bp, Homo sapien
gtgtttacattgctccttgtgcaat

SEQ ID NO: 473024 - DNA, 25 bp, Homo sapien
gtgcaattcccacaagaacagggat

SEQ ID NO: 473025 - DNA, 25 bp, Homo sapien
tatccaacaacactaggtactacgg

SEQ ID NO: 473026 - DNA, 25 bp, Homo sapien
ggtactacggaatctacacatcaaa

SEQ ID NO: 473027 - DNA, 25 bp, Homo sapien
ggaacatctctgattaccagtagta

SEQ ID NO: 473028 - DNA, 25 bp, Homo sapien
gtagtataaccattttcatcccttc

SEQ ID NO: 473029 - DNA, 25 bp, Homo sapien
attttcatcccttcactgtgtaaga

SEQ ID NO: 473030 - DNA, 25 bp, Homo sapien
agatcttttcccattgctgaattaa

SEQ ID NO: 473031 - DNA, 25 bp, Homo sapien
tatcataaaagtccactctagggtg

SEQ ID NO: 473032 - DNA, 25 bp, Homo sapien
gtataaaacttatccccatgctttc

SEQ ID NO: 473033 - DNA, 25 bp, Homo sapien
ttggtgtaatcttttaggaaaacag

SEQ ID NO: 473034 - DNA, 25 bp, Homo sapien
tggtgtaatcttttaggaaaacaga

SEQ ID NO: 473035 - DNA, 25 bp, Homo sapien
ggtgtaatcttttaggaaaacagat

SEQ ID NO: 473036 - DNA, 25 bp, Homo sapien
ttaggaaaacagattgtgtggctgg

SEQ ID NO: 473037 - DNA, 25 bp, Homo sapien
taggaaaacagattgtgtggctggg

SEQ ID NO: 473038 - DNA, 25 bp, Homo sapien
gaaaacagattgtgtggctgggcgt

SEQ ID NO: 473039 - DNA, 25 bp, Homo sapien
tcagaagtttgggaccagcttagcc

SEQ ID NO: 473040 - DNA, 25 bp, Homo sapien
cagaagtttgggaccagcttagcca

SEQ ID NO: 473041 - DNA, 25 bp, Homo sapien
gaagtttgggaccagcttagccaac

SEQ ID NO: 473042 - DNA, 25 bp, Homo sapien
aagtttgggaccagcttagccaaca

SEQ ID NO: 473043 - DNA, 25 bp, Homo sapien
agaaatgcaaaagttagtcaggcat

SEQ ID NO: 473044 - DNA, 25 bp, Homo sapien
gatacattgtttcagtgtggagaat

SEQ ID NO: 473045 - DNA, 25 bp, Homo sapien
cctctgtatcacttttgggtttcta

SEQ ID NO: 473046 - DNA, 25 bp, Homo sapien
gggtttctaacaattgtggattcca

SEQ ID NO: 473047 - DNA, 25 bp, Homo sapien
attgtggattccagcttactccttc

SEQ ID NO: 473048 - DNA, 25 bp, Homo sapien
gattccagcttactccttccttttt

SEQ ID NO: 473049 - DNA, 25 bp, Homo sapien
gacaattattttcattctccatcat

SEQ ID NO: 473050 - DNA, 25 bp, Homo sapien
cattctccatcatttactatttgct

SEQ ID NO: 473051 - DNA, 25 bp, Homo sapien
tactatttgcttaggctatgtagat

SEQ ID NO: 473052 - DNA, 25 bp, Homo sapien
agttatgtgaaagcatgatccccat

SEQ ID NO: 473053 - DNA, 25 bp, Homo sapien
aagcatgatccccatagtgtttttt

SEQ ID NO: 473054 - DNA, 25 bp, Homo sapien
gatccccatagtgttttttaataat

SEQ ID NO: 473055 - DNA, 25 bp, Homo sapien
gtctgtgctgcctccttggttgaaa

SEQ ID NO: 473056 - DNA, 25 bp, Homo sapien
gcctccttggttgaaagcagtacgg

SEQ ID NO: 473057 - DNA, 25 bp, Homo sapien
atgagatacctttggttccacgcgt

SEQ ID NO: 473058 - DNA, 25 bp, Homo sapien
ttggttccacgcgttcttacaagaa

SEQ ID NO: 473059 - DNA, 25 bp, Homo sapien
aagaagcagtcaaatgcacttgtaa

SEQ ID NO: 473060 - DNA, 25 bp, Homo sapien
acttgtaaattagtttgtgagccac

SEQ ID NO: 473061 - DNA, 25 bp, Homo sapien
ggcaagcttttaatttctgggagat

SEQ ID NO: 473062 - DNA, 25 bp, Homo sapien
gatggtgagtatgaattctccgaaa

SEQ ID NO: 473063 - DNA, 25 bp, Homo sapien
gaattctccgaaatcttttgattag

SEQ ID NO: 473064 - DNA, 25 bp, Homo sapien
gtaacttcaaataaacaggcaggct

SEQ ID NO: 473065 - DNA, 25 bp, Homo sapien
tctctgttccaaatgagctagggca

SEQ ID NO: 473066 - DNA, 25 bp, Homo sapien
aatgaaagcatggaaggacaccagt

SEQ ID NO: 473067 - DNA, 25 bp, Homo sapien
agattagatttcattctgaggcatg

SEQ ID NO: 473068 - DNA, 25 bp, Homo sapien
gcatgagaaactgttggagggtttt

SEQ ID NO: 473069 - DNA, 25 bp, Homo sapien
tttacctaagagtgggacacaacct

SEQ ID NO: 473070 - DNA, 25 bp, Homo sapien
gggacacaacctgagttgctttcct

SEQ ID NO: 473071 - DNA, 25 bp, Homo sapien
caacctgagttgctttcctagagat

SEQ ID NO: 473072 - DNA, 25 bp, Homo sapien
agttgctttcctagagatcactctg

SEQ ID NO: 473073 - DNA, 25 bp, Homo sapien
agagatcactctgctttgtggagaa

SEQ ID NO: 473074 - DNA, 25 bp, Homo sapien
cactctgctttgtggagaatggatt

SEQ ID NO: 473075 - DNA, 25 bp, Homo sapien
gcagaggcttactgtgatccaggtg

SEQ ID NO: 473076 - DNA, 25 bp, Homo sapien
ggcttactgtgatccaggtgagaga

SEQ ID NO: 473077 - DNA, 25 bp, Homo sapien
atgtgcaatcacaaattaatcatga

SEQ ID NO: 473078 - DNA, 25 bp, Homo sapien
aaagatgcatattatcattagaatg

SEQ ID NO: 473079 - DNA, 25 bp, Homo sapien
gaatgcaactatattgacatggcaa

SEQ ID NO: 473080 - DNA, 25 bp, Homo sapien
ttgacatggcaataatttactaaaa

SEQ ID NO: 473081 - DNA, 25 bp, Homo sapien
aaatctgaagtgcaattcttcacat

SEQ ID NO: 473082 - DNA, 25 bp, Homo sapien
gtgcaattcttcacatcaaaatagt

SEQ ID NO: 473083 - DNA, 25 bp, Homo sapien
aaaagacagcaaattccagtacatg

SEQ ID NO: 473084 - DNA, 25 bp, Homo sapien
gaactgcctcactgaagctgtatcc

SEQ ID NO: 473085 - DNA, 25 bp, Homo sapien
gcctcactgaagctgtatcctggat

SEQ ID NO: 473086 - DNA, 25 bp, Homo sapien
cactgaagctgtatcctggatgaaa

SEQ ID NO: 473087 - DNA, 25 bp, Homo sapien
tatcctggatgaaaggcgaaaccct

SEQ ID NO: 473088 - DNA, 25 bp, Homo sapien
tcccgaaccgtatgacctttacagg

SEQ ID NO: 473089 - DNA, 25 bp, Homo sapien
aatacgtactgcatagagttgctag

SEQ ID NO: 473090 - DNA, 25 bp, Homo sapien
gagttgctagtgcagattcaatatc

SEQ ID NO: 473091 - DNA, 25 bp, Homo sapien
ttcaatatcaagtacgcagggtgct

SEQ ID NO: 473092 - DNA, 25 bp, Homo sapien
tacgcagggtgctagacgtatgtct

SEQ ID NO: 473093 - DNA, 25 bp, Homo sapien
gctagacgtatgtctggcacataat

SEQ ID NO: 473094 - DNA, 25 bp, Homo sapien
agatggctatgtcctgtagtcccag

SEQ ID NO: 473095 - DNA, 25 bp, Homo sapien
agctctgttgctcatcagctgaggg

SEQ ID NO: 473096 - DNA, 25 bp, Homo sapien
gggtacgaggaagtcacattagctc

SEQ ID NO: 473097 - DNA, 25 bp, Homo sapien
aagtcacattagctcgtgggcgcca

SEQ ID NO: 473098 - DNA, 25 bp, Homo sapien
cactgccctcattggcaatactgag

SEQ ID NO: 473099 - DNA, 25 bp, Homo sapien
ctccagcctgggcgaaagagagact

SEQ ID NO: 473100 - DNA, 25 bp, Homo sapien
tccagcctgggcgaaagagagactc

SEQ ID NO: 473101 - DNA, 25 bp, Homo sapien
agcctgggcgaaagagagactccgt

SEQ ID NO: 473102 - DNA, 25 bp, Homo sapien
gcctgggcgaaagagagactccgtc

SEQ ID NO: 473103 - DNA, 25 bp, Homo sapien
tgggcgaaagagagactccgtctca

SEQ ID NO: 473104 - DNA, 25 bp, Homo sapien
gggcgaaagagagactccgtctcaa

SEQ ID NO: 473105 - DNA, 25 bp, Homo sapien
gaaagaaagagaaagaaacatccct

SEQ ID NO: 473106 - DNA, 25 bp, Homo sapien
gagaaagaaacatccctaaaataag

SEQ ID NO: 473107 - DNA, 25 bp, Homo sapien
agagtcttaaactctgttgcccagg

SEQ ID NO: 473108 - DNA, 25 bp, Homo sapien
ccgagaccgcgccatccattgccct

SEQ ID NO: 473109 - DNA, 25 bp, Homo sapien
cgagaccgcgccatccattgccctc

SEQ ID NO: 473110 - DNA, 25 bp, Homo sapien
gagaccgcgccatccattgccctcc

SEQ ID NO: 473111 - DNA, 25 bp, Homo sapien
agaccgcgccatccattgccctcca

SEQ ID NO: 473112 - DNA, 25 bp, Homo sapien
gaccgcgccatccattgccctccag

SEQ ID NO: 473113 - DNA, 25 bp, Homo sapien
accgcgccatccattgccctccagc

SEQ ID NO: 473114 - DNA, 25 bp, Homo sapien
ccgcgccatccattgccctccagcc

SEQ ID NO: 473115 - DNA, 25 bp, Homo sapien
cgcgccatccattgccctccagcct

SEQ ID NO: 473116 - DNA, 25 bp, Homo sapien
gcgccatccattgccctccagcctg

SEQ ID NO: 473117 - DNA, 25 bp, Homo sapien
cgccatccattgccctccagcctgg

SEQ ID NO: 473118 - DNA, 25 bp, Homo sapien
ttaagaataaggaatggacaggcgc

SEQ ID NO: 473119 - DNA, 25 bp, Homo sapien
taagaataaggaatggacaggcgca

SEQ ID NO: 473120 - DNA, 25 bp, Homo sapien
aagaataaggaatggacaggcgcag

SEQ ID NO: 473121 - DNA, 25 bp, Homo sapien
agaataaggaatggacaggcgcagt

SEQ ID NO: 473122 - DNA, 25 bp, Homo sapien
gaataaggaatggacaggcgcagtg

SEQ ID NO: 473123 - DNA, 25 bp, Homo sapien
tcacctgagatcttcctgacctgga

SEQ ID NO: 473124 - DNA, 25 bp, Homo sapien
cacctgagatcttcctgacctggag

SEQ ID NO: 473125 - DNA, 25 bp, Homo sapien
acctgagatcttcctgacctggagt

SEQ ID NO: 473126 - DNA, 25 bp, Homo sapien
gagatcttcctgacctggagttcga

SEQ ID NO: 473127 - DNA, 25 bp, Homo sapien
agatcttcctgacctggagttcgag

SEQ ID NO: 473128 - DNA, 25 bp, Homo sapien
gatcttcctgacctggagttcgaga

SEQ ID NO: 473129 - DNA, 25 bp, Homo sapien
aaaatataaatttcagccgggcacg

SEQ ID NO: 473130 - DNA, 25 bp, Homo sapien
aaatataaatttcagccgggcacgg

SEQ ID NO: 473131 - DNA, 25 bp, Homo sapien
aatataaatttcagccgggcacggt

SEQ ID NO: 473132 - DNA, 25 bp, Homo sapien
cagcaatttggaaggctgaggtggt

SEQ ID NO: 473133 - DNA, 25 bp, Homo sapien
agcaatttggaaggctgaggtggtg

SEQ ID NO: 473134 - DNA, 25 bp, Homo sapien
gcaatttggaaggctgaggtggtgg

SEQ ID NO: 473135 - DNA, 25 bp, Homo sapien
caatttggaaggctgaggtggtgga

SEQ ID NO: 473136 - DNA, 25 bp, Homo sapien
aatttggaaggctgaggtggtggat

SEQ ID NO: 473137 - DNA, 25 bp, Homo sapien
gaacgaatgaacttattctcaggtt

SEQ ID NO: 473138 - DNA, 25 bp, Homo sapien
gaatgaacttattctcaggtttatg

SEQ ID NO: 473139 - DNA, 25 bp, Homo sapien
ggtttatgttttatagtctgcctag

SEQ ID NO: 473140 - DNA, 25 bp, Homo sapien
tagtctgcctagaatacactccttg

SEQ ID NO: 473141 - DNA, 25 bp, Homo sapien
tctgcctagaatacactccttggtc

SEQ ID NO: 473142 - DNA, 25 bp, Homo sapien
tacactccttggtcaggccatttcc

SEQ ID NO: 473143 - DNA, 25 bp, Homo sapien
ggtcaggccatttcctgtgactaga

SEQ ID NO: 473144 - DNA, 25 bp, Homo sapien
ggccatttcctgtgactagatttcc

SEQ ID NO: 473145 - DNA, 25 bp, Homo sapien
tgtgactagatttcccttccctttt

SEQ ID NO: 473146 - DNA, 25 bp, Homo sapien
cttttttcctgttcatctgaatcct

SEQ ID NO: 473147 - DNA, 25 bp, Homo sapien
ttcctgttcatctgaatccttaaaa

SEQ ID NO: 473148 - DNA, 25 bp, Homo sapien
ggaatcaagccacaaaacagagtta

SEQ ID NO: 473149 - DNA, 25 bp, Homo sapien
aaacagagttaattcctaaaatgag

SEQ ID NO: 473150 - DNA, 25 bp, Homo sapien
atgagagtatcagaacttctttttg

SEQ ID NO: 473151 - DNA, 25 bp, Homo sapien
tgatgtcatactttggtgcacggcc

SEQ ID NO: 473152 - DNA, 25 bp, Homo sapien
ttggtgcacggccaaaggacaaaga

SEQ ID NO: 473153 - DNA, 25 bp, Homo sapien
tggatatgtcaggaagtccgaatat

SEQ ID NO: 473154 - DNA, 25 bp, Homo sapien
ggaagtccgaatatattctacagta

SEQ ID NO: 473155 - DNA, 25 bp, Homo sapien
ctacagtagactgccttcaaacaaa

SEQ ID NO: 473156 - DNA, 25 bp, Homo sapien
gtggaaaaaaccatttgagtctgta

SEQ ID NO: 473157 - DNA, 25 bp, Homo sapien
gagtctgtatttttcagtagttcta

SEQ ID NO: 473158 - DNA, 25 bp, Homo sapien
tcagtagttctaacaacaccaacca

SEQ ID NO: 473159 - DNA, 25 bp, Homo sapien
ggaaggctagaagtcctgtgggctg

SEQ ID NO: 473160 - DNA, 25 bp, Homo sapien
aaggctagaagtcctgtgggctggc

SEQ ID NO: 473161 - DNA, 25 bp, Homo sapien
gctagaagtcctgtgggctggccag

SEQ ID NO: 473162 - DNA, 25 bp, Homo sapien
ctagaagtcctgtgggctggccagg

SEQ ID NO: 473163 - DNA, 25 bp, Homo sapien
taatccctgcatttttgggtggcag

SEQ ID NO: 473164 - DNA, 25 bp, Homo sapien
aatccctgcatttttgggtggcaga

SEQ ID NO: 473165 - DNA, 25 bp, Homo sapien
atccctgcatttttgggtggcagag

SEQ ID NO: 473166 - DNA, 25 bp, Homo sapien
tccctgcatttttgggtggcagagg

SEQ ID NO: 473167 - DNA, 25 bp, Homo sapien
ccctgcatttttgggtggcagaggt

SEQ ID NO: 473168 - DNA, 25 bp, Homo sapien
gcatttttgggtggcagaggtgcgt

SEQ ID NO: 473169 - DNA, 25 bp, Homo sapien
ttttgggtggcagaggtgcgtggat

SEQ ID NO: 473170 - DNA, 25 bp, Homo sapien
caacgcacccagatcatctaggaaa

SEQ ID NO: 473171 - DNA, 25 bp, Homo sapien
tgcatttcacaagcaaagacggaat

SEQ ID NO: 473172 - DNA, 25 bp, Homo sapien
gaggtgtgcaatgcagccaacacga

SEQ ID NO: 473173 - DNA, 25 bp, Homo sapien
gccaacacgagcttttttcagggat

SEQ ID NO: 473174 - DNA, 25 bp, Homo sapien
tttcagggatgcactgtctgtgttt

SEQ ID NO: 473175 - DNA, 25 bp, Homo sapien
gcactgtctgtgtttaggtttatga

SEQ ID NO: 473176 - DNA, 25 bp, Homo sapien
tatgacttaaaggttagactgccaa

SEQ ID NO: 473177 - DNA, 25 bp, Homo sapien
ttttaaaggttgacacatctgtggc

SEQ ID NO: 473178 - DNA, 25 bp, Homo sapien
ccagagcaccataaaccacagtctt

SEQ ID NO: 473179 - DNA, 25 bp, Homo sapien
accataaaccacagtcttgccaaaa

SEQ ID NO: 473180 - DNA, 25 bp, Homo sapien
aaaggattgactgttcttcttcctc

SEQ ID NO: 473181 - DNA, 25 bp, Homo sapien
gtgtgtgtgacattcacatttagaa

SEQ ID NO: 473182 - DNA, 25 bp, Homo sapien
gtgacattcacatttagaattgtgt

SEQ ID NO: 473183 - DNA, 25 bp, Homo sapien
gacattcacatttagaattgtgtgc

SEQ ID NO: 473184 - DNA, 25 bp, Homo sapien
cattcacatttagaattgtgtgcag

SEQ ID NO: 473185 - DNA, 25 bp, Homo sapien
ttcacatttagaattgtgtgcagtg

SEQ ID NO: 473186 - DNA, 25 bp, Homo sapien
acatttagaattgtgtgcagtgtgc

SEQ ID NO: 473187 - DNA, 25 bp, Homo sapien
catttagaattgtgtgcagtgtgct

SEQ ID NO: 473188 - DNA, 25 bp, Homo sapien
atttagaattgtgtgcagtgtgctg

SEQ ID NO: 473189 - DNA, 25 bp, Homo sapien
tttagaattgtgtgcagtgtgctga

SEQ ID NO: 473190 - DNA, 25 bp, Homo sapien
ttagaattgtgtgcagtgtgctgag

SEQ ID NO: 473191 - DNA, 25 bp, Homo sapien
tgcagtgtgctgaggagttcaaaac

SEQ ID NO: 473192 - DNA, 25 bp, Homo sapien
gatgagtagagtaatagttggcttt

SEQ ID NO: 473193 - DNA, 25 bp, Homo sapien
tgagtagagtaatagttggcttttt

SEQ ID NO: 473194 - DNA, 25 bp, Homo sapien
gagtagagtaatagttggctttttt

SEQ ID NO: 473195 - DNA, 25 bp, Homo sapien
ggtgtgtaccaccactccgagctat

SEQ ID NO: 473196 - DNA, 25 bp, Homo sapien
gtgtgtaccaccactccgagctatt

SEQ ID NO: 473197 - DNA, 25 bp, Homo sapien
tgtgtaccaccactccgagctattt

SEQ ID NO: 473198 - DNA, 25 bp, Homo sapien
gtgtaccaccactccgagctatttt

SEQ ID NO: 473199 - DNA, 25 bp, Homo sapien
tgtaccaccactccgagctattttt

SEQ ID NO: 473200 - DNA, 25 bp, Homo sapien
gtaccaccactccgagctatttttt

SEQ ID NO: 473201 - DNA, 25 bp, Homo sapien
caccactccgagctatttttttgtt

SEQ ID NO: 473202 - DNA, 25 bp, Homo sapien
accactccgagctatttttttgttg

SEQ ID NO: 473203 - DNA, 25 bp, Homo sapien
ctgggctacagtgcactatgccaat

SEQ ID NO: 473204 - DNA, 25 bp, Homo sapien
gctacagtgcactatgccaattggt

SEQ ID NO: 473205 - DNA, 25 bp, Homo sapien
gcactatgccaattggtgtccacac

SEQ ID NO: 473206 - DNA, 25 bp, Homo sapien
aattggtgtccacactaagctcggc

SEQ ID NO: 473207 - DNA, 25 bp, Homo sapien
gtgtccacactaagctcggcattaa

SEQ ID NO: 473208 - DNA, 25 bp, Homo sapien
tccacactaagctcggcattaacat

SEQ ID NO: 473209 - DNA, 25 bp, Homo sapien
taagctcggcattaacattgtgatc

SEQ ID NO: 473210 - DNA, 25 bp, Homo sapien
attaacattgtgatctcctggtagc

SEQ ID NO: 473211 - DNA, 25 bp, Homo sapien
gggactaccaggttgccttaagagg

SEQ ID NO: 473212 - DNA, 25 bp, Homo sapien
ctgtgaatagccaccgcatttccac

SEQ ID NO: 473213 - DNA, 25 bp, Homo sapien
atagccaccgcatttccacctggga

SEQ ID NO: 473214 - DNA, 25 bp, Homo sapien
ctggtgtgctctgagacctgtggaa

SEQ ID NO: 473215 - DNA, 25 bp, Homo sapien
ggaaaaagcattttgggagcatctt

SEQ ID NO: 473216 - DNA, 25 bp, Homo sapien
atcttggaatagtgtttgctacatg

SEQ ID NO: 473217 - DNA, 25 bp, Homo sapien
tagatagatgttgttctctctgctt

SEQ ID NO: 473218 - DNA, 25 bp, Homo sapien
ttctctctgcttctagtgaacagag

SEQ ID NO: 473219 - DNA, 25 bp, Homo sapien
ttttggttgggctgattgggactcc

SEQ ID NO: 473220 - DNA, 25 bp, Homo sapien
gattgggactccactcacattttct

SEQ ID NO: 473221 - DNA, 25 bp, Homo sapien
tcctagcagcacatcccaatgggaa

SEQ ID NO: 473222 - DNA, 25 bp, Homo sapien
ttccaagcctttccatggtggagtt

SEQ ID NO: 473223 - DNA, 25 bp, Homo sapien
gagtttgtctccttaaagtggagct

SEQ ID NO: 473224 - DNA, 25 bp, Homo sapien
agtggagctgaatcactgcacttca

SEQ ID NO: 473225 - DNA, 25 bp, Homo sapien
ggatttggactgaggtctgactcca

SEQ ID NO: 473226 - DNA, 25 bp, Homo sapien
agaaccctacgatctttctactgta

SEQ ID NO: 473227 - DNA, 25 bp, Homo sapien
ttctactgtagcttaattctccctt

SEQ ID NO: 473228 - DNA, 25 bp, Homo sapien
gtagcttaattctcccttcttgtct

SEQ ID NO: 473229 - DNA, 25 bp, Homo sapien
atggctgggttctggttggtactca

SEQ ID NO: 473230 - DNA, 25 bp, Homo sapien
atcaacagcatcctaggtataagga

SEQ ID NO: 473231 - DNA, 25 bp, Homo sapien
ggattattagaatgctacaaccagt

SEQ ID NO: 473232 - DNA, 25 bp, Homo sapien
gctacaaccagtccacctaaggaag

SEQ ID NO: 473233 - DNA, 25 bp, Homo sapien
agagcaggtttcttagcttcgctta

SEQ ID NO: 473234 - DNA, 25 bp, Homo sapien
tagcttcgcttacaggattctcctt

SEQ ID NO: 473235 - DNA, 25 bp, Homo sapien
attctccttagagtacttctacttg

SEQ ID NO: 473236 - DNA, 25 bp, Homo sapien
tttaacctatttagacagtccctgt

SEQ ID NO: 473237 - DNA, 25 bp, Homo sapien
tatttagacagtccctgttgatgaa

SEQ ID NO: 473238 - DNA, 25 bp, Homo sapien
gaacatttgggttttcaatcagaag

SEQ ID NO: 473239 - DNA, 25 bp, Homo sapien
tcaatcagaaggtttgtgacagcaa

SEQ ID NO: 473240 - DNA, 25 bp, Homo sapien
aaatatgtggctagtcttcgtgagg

SEQ ID NO: 473241 - DNA, 25 bp, Homo sapien
tgtggctagtcttcgtgaggcagtc

SEQ ID NO: 473242 - DNA, 25 bp, Homo sapien
tagtcttcgtgaggcagtcaccaat

SEQ ID NO: 473243 - DNA, 25 bp, Homo sapien
ggcagtcaccaattaatcaacttca

SEQ ID NO: 473244 - DNA, 25 bp, Homo sapien
gaaccaagcagaatactgaggaggg

SEQ ID NO: 473245 - DNA, 25 bp, Homo sapien
aaatgctatcagagggcaacccgct

SEQ ID NO: 473246 - DNA, 25 bp, Homo sapien
tatcagagggcaacccgctctggtc

SEQ ID NO: 473247 - DNA, 25 bp, Homo sapien
tcagtgtttgttaagcttattcttt

SEQ ID NO: 473248 - DNA, 25 bp, Homo sapien
gtttggtttgtatgggatttgcttt

SEQ ID NO: 473249 - DNA, 25 bp, Homo sapien
ggatttgctttatccccaagccaaa

SEQ ID NO: 473250 - DNA, 25 bp, Homo sapien
gccaaacagcacatgacacacgaca

SEQ ID NO: 473251 - DNA, 25 bp, Homo sapien
atgacacacgacagccacttaagac

SEQ ID NO: 473252 - DNA, 25 bp, Homo sapien
gccacttaagacagtgtgtcactcg

SEQ ID NO: 473253 - DNA, 25 bp, Homo sapien
tgtcactcgtggttagagtcctttg

SEQ ID NO: 473254 - DNA, 25 bp, Homo sapien
agagtcctttgatgtttctgcccta

SEQ ID NO: 473255 - DNA, 25 bp, Homo sapien
ttctgccctatggaccctatttgaa

SEQ ID NO: 473256 - DNA, 25 bp, Homo sapien
aacaatacaaggaagcacgttatac

SEQ ID NO: 473257 - DNA, 25 bp, Homo sapien
gcacgttatacagaaaatgctcata

SEQ ID NO: 473258 - DNA, 25 bp, Homo sapien
gggtcaagggtaagagctcacatag

SEQ ID NO: 473259 - DNA, 25 bp, Homo sapien
ggtcaagggtaagagctcacataga

SEQ ID NO: 473260 - DNA, 25 bp, Homo sapien
gtcaagggtaagagctcacatagag

SEQ ID NO: 473261 - DNA, 25 bp, Homo sapien
tcaagggtaagagctcacatagagg

SEQ ID NO: 473262 - DNA, 25 bp, Homo sapien
aagggtaagagctcacatagaggca

SEQ ID NO: 473263 - DNA, 25 bp, Homo sapien
gggtaagagctcacatagaggcaca

SEQ ID NO: 473264 - DNA, 25 bp, Homo sapien
acatagaggcacaccatatatctac

SEQ ID NO: 473265 - DNA, 25 bp, Homo sapien
atagaggcacaccatatatctacat

SEQ ID NO: 473266 - DNA, 25 bp, Homo sapien
agaggcacaccatatatctacatat

SEQ ID NO: 473267 - DNA, 25 bp, Homo sapien
gaggcacaccatatatctacatatt

SEQ ID NO: 473268 - DNA, 25 bp, Homo sapien
ggcacaccatatatctacatatttg

SEQ ID NO: 473269 - DNA, 25 bp, Homo sapien
gtaatacgcatttaaggtccctcca

SEQ ID NO: 473270 - DNA, 25 bp, Homo sapien
atacgcatttaaggtccctccatat

SEQ ID NO: 473271 - DNA, 25 bp, Homo sapien
tttaaggtccctccatatctgttaa

SEQ ID NO: 473272 - DNA, 25 bp, Homo sapien
taaggtccctccatatctgttaatg

SEQ ID NO: 473273 - DNA, 25 bp, Homo sapien
gtccctccatatctgttaatgccgt

SEQ ID NO: 473274 - DNA, 25 bp, Homo sapien
cctccatatctgttaatgccgtcat

SEQ ID NO: 473275 - DNA, 25 bp, Homo sapien
atatctgttaatgccgtcatagctc

SEQ ID NO: 473276 - DNA, 25 bp, Homo sapien
gttaatgccgtcatagctcaattct

SEQ ID NO: 473277 - DNA, 25 bp, Homo sapien
agctcaattctttttaacaccggat

SEQ ID NO: 473278 - DNA, 25 bp, Homo sapien
tcaattctttttaacaccggataat

SEQ ID NO: 473279 - DNA, 25 bp, Homo sapien
ttaacaccggataatattccattgt

SEQ ID NO: 473280 - DNA, 25 bp, Homo sapien
aagaaggatttcgaaagtctaccag

SEQ ID NO: 473281 - DNA, 25 bp, Homo sapien
agaaggatttcgaaagtctaccaga

SEQ ID NO: 473282 - DNA, 25 bp, Homo sapien
gaaggatttcgaaagtctaccagat

SEQ ID NO: 473283 - DNA, 25 bp, Homo sapien
aaggatttcgaaagtctaccagatt

SEQ ID NO: 473284 - DNA, 25 bp, Homo sapien
aggatttcgaaagtctaccagattg

SEQ ID NO: 473285 - DNA, 25 bp, Homo sapien
ggatttcgaaagtctaccagattgg

SEQ ID NO: 473286 - DNA, 25 bp, Homo sapien
gatttcgaaagtctaccagattggg

SEQ ID NO: 473287 - DNA, 25 bp, Homo sapien
tttcgaaagtctaccagattggggc

SEQ ID NO: 473288 - DNA, 25 bp, Homo sapien
agtctaccagattggggccgggcga

SEQ ID NO: 473289 - DNA, 25 bp, Homo sapien
gccgggcgaggtgtctcaggcctat

SEQ ID NO: 473290 - DNA, 25 bp, Homo sapien
gggcgaggtgtctcaggcctataat

SEQ ID NO: 473291 - DNA, 25 bp, Homo sapien
agaaatgagacacatggaccaggca

SEQ ID NO: 473292 - DNA, 25 bp, Homo sapien
gaaatgagacacatggaccaggcac

SEQ ID NO: 473293 - DNA, 25 bp, Homo sapien
aaatgagacacatggaccaggcaca

SEQ ID NO: 473294 - DNA, 25 bp, Homo sapien
aatgagacacatggaccaggcacag

SEQ ID NO: 473295 - DNA, 25 bp, Homo sapien
atgagacacatggaccaggcacagt

SEQ ID NO: 473296 - DNA, 25 bp, Homo sapien
tgagacacatggaccaggcacagtg

SEQ ID NO: 473297 - DNA, 25 bp, Homo sapien
gagacacatggaccaggcacagtga

SEQ ID NO: 473298 - DNA, 25 bp, Homo sapien
agacacatggaccaggcacagtgac

SEQ ID NO: 473299 - DNA, 25 bp, Homo sapien
gacacatggaccaggcacagtgact

SEQ ID NO: 473300 - DNA, 25 bp, Homo sapien
gctggagcccaggaggcacaggctg

SEQ ID NO: 473301 - DNA, 25 bp, Homo sapien
ctggagcccaggaggcacaggctgc

SEQ ID NO: 473302 - DNA, 25 bp, Homo sapien
actggattgagttgtggtctgcttc

SEQ ID NO: 473303 - DNA, 25 bp, Homo sapien
gtggtctgcttcagcacttggaaaa

SEQ ID NO: 473304 - DNA, 25 bp, Homo sapien
gcacttggaaaaggagcggccaact

SEQ ID NO: 473305 - DNA, 25 bp, Homo sapien
agcggccaactggtgctccatgggc

SEQ ID NO: 473306 - DNA, 25 bp, Homo sapien
atgggctgcatttcgcccgcagata

SEQ ID NO: 473307 - DNA, 25 bp, Homo sapien
atttcgcccgcagatattttgtttg

SEQ ID NO: 473308 - DNA, 25 bp, Homo sapien
tgtttggcccacacggtatttgaaa

SEQ ID NO: 473309 - DNA, 25 bp, Homo sapien
attagatgccagtgttgaaaaaccg

SEQ ID NO: 473310 - DNA, 25 bp, Homo sapien
gaaaatccaaggatctagccacctt

SEQ ID NO: 473311 - DNA, 25 bp, Homo sapien
tcctgcatggcagctactgggagtc

SEQ ID NO: 473312 - DNA, 25 bp, Homo sapien
gctactgggagtcaaaaccaaggct

SEQ ID NO: 473313 - DNA, 25 bp, Homo sapien
taatctctcatactaatgagggctc

SEQ ID NO: 473314 - DNA, 25 bp, Homo sapien
atgagggctccatacactcacaaat

SEQ ID NO: 473315 - DNA, 25 bp, Homo sapien
tacactcacaaatctaaaatctctt

SEQ ID NO: 473316 - DNA, 25 bp, Homo sapien
aaatctcttaggtagatgcaaacca

SEQ ID NO: 473317 - DNA, 25 bp, Homo sapien
aggaatcatttgtgcttattcagca

SEQ ID NO: 473318 - DNA, 25 bp, Homo sapien
gcaagtactgaagatgtcaatcgta

SEQ ID NO: 473319 - DNA, 25 bp, Homo sapien
gatacgaacaagcaaacttcctttt

SEQ ID NO: 473320 - DNA, 25 bp, Homo sapien
gcaaacttccttttggtgatacaaa

SEQ ID NO: 473321 - DNA, 25 bp, Homo sapien
aatttcctgctatagttgctccatc

SEQ ID NO: 473322 - DNA, 25 bp, Homo sapien
agctggtgttgtattgtgtgtgttt

SEQ ID NO: 473323 - DNA, 25 bp, Homo sapien
aagctcagtaacagctcaaacactg

SEQ ID NO: 473324 - DNA, 25 bp, Homo sapien
taaacagatcattaaactcaccaat

SEQ ID NO: 473325 - DNA, 25 bp, Homo sapien
gatcattaaactcaccaatggattt

SEQ ID NO: 473326 - DNA, 25 bp, Homo sapien
ggattttttaacagtcaaatacctg

SEQ ID NO: 473327 - DNA, 25 bp, Homo sapien
tcaaatacctgccagtaaacaaagt

SEQ ID NO: 473328 - DNA, 25 bp, Homo sapien
gatcaagttcccgtgcatctgccaa

SEQ ID NO: 473329 - DNA, 25 bp, Homo sapien
tgcatctgccaattccaaaactcat

SEQ ID NO: 473330 - DNA, 25 bp, Homo sapien
attccaaaactcatgaacccagctg

SEQ ID NO: 473331 - DNA, 25 bp, Homo sapien
aactcatgaacccagctgatctgct

SEQ ID NO: 473332 - DNA, 25 bp, Homo sapien
ctgcattttattgaactattttccc

SEQ ID NO: 473333 - DNA, 25 bp, Homo sapien
attttcccctgtgagaactattcac

SEQ ID NO: 473334 - DNA, 25 bp, Homo sapien
gagaactattcacaaaaagtacatt

SEQ ID NO: 473335 - DNA, 25 bp, Homo sapien
gataagaaagtaataggctgggtgt

SEQ ID NO: 473336 - DNA, 25 bp, Homo sapien
tgaagctatgagttctagaccaacc

SEQ ID NO: 473337 - DNA, 25 bp, Homo sapien
aagctatgagttctagaccaacctg

SEQ ID NO: 473338 - DNA, 25 bp, Homo sapien
gctatgagttctagaccaacctggg

SEQ ID NO: 473339 - DNA, 25 bp, Homo sapien
caacctgggcaacttggcatttttt

SEQ ID NO: 473340 - DNA, 25 bp, Homo sapien
ggcatggtggtacactcctgcattc

SEQ ID NO: 473341 - DNA, 25 bp, Homo sapien
atggtggtacactcctgcattccta

SEQ ID NO: 473342 - DNA, 25 bp, Homo sapien
gtggtacactcctgcattcctagct

SEQ ID NO: 473343 - DNA, 25 bp, Homo sapien
actcctgcattcctagctccttggg

SEQ ID NO: 473344 - DNA, 25 bp, Homo sapien
ggaaaatcgcttgagtccacaagtt

SEQ ID NO: 473345 - DNA, 25 bp, Homo sapien
aaatcgcttgagtccacaagttcaa

SEQ ID NO: 473346 - DNA, 25 bp, Homo sapien
gcacagaattcttacattgacagga

SEQ ID NO: 473347 - DNA, 25 bp, Homo sapien
aggaggaatttgcacctgcgctctc

SEQ ID NO: 473348 - DNA, 25 bp, Homo sapien
cagggctgacaaaaccctaggcatt

SEQ ID NO: 473349 - DNA, 25 bp, Homo sapien
cctaggcattggcattgcgtccaaa

SEQ ID NO: 473350 - DNA, 25 bp, Homo sapien
gttctgcctcccaaaaggagaccca

SEQ ID NO: 473351 - DNA, 25 bp, Homo sapien
cagatggtgatcagcactgcttgtt

SEQ ID NO: 473352 - DNA, 25 bp, Homo sapien
tgatcagcactgcttgttttctttc

SEQ ID NO: 473353 - DNA, 25 bp, Homo sapien
ggagcttgctcttctgctatttaat

SEQ ID NO: 473354 - DNA, 25 bp, Homo sapien
aataattttgtatgagtgcccagca

SEQ ID NO: 473355 - DNA, 25 bp, Homo sapien
ccagcagagcagcttttgggcaact

SEQ ID NO: 473356 - DNA, 25 bp, Homo sapien
gcttttgggcaactagcttatgaaa

SEQ ID NO: 473357 - DNA, 25 bp, Homo sapien
ccccattttcttctatgtactctaa

SEQ ID NO: 473358 - DNA, 25 bp, Homo sapien
atgtactctaagtcactggacataa

SEQ ID NO: 473359 - DNA, 25 bp, Homo sapien
tcttcttgctcttctgatgactaac

SEQ ID NO: 473360 - DNA, 25 bp, Homo sapien
gctcttctgatgactaactcttggc

SEQ ID NO: 473361 - DNA, 25 bp, Homo sapien
taactcttggctttccctagagcct

SEQ ID NO: 473362 - DNA, 25 bp, Homo sapien
tagagcctccagcatgccaaatcac

SEQ ID NO: 473363 - DNA, 25 bp, Homo sapien
gcatgccaaatcacactggttctca

SEQ ID NO: 473364 - DNA, 25 bp, Homo sapien
gaacttgaagcagctattccttctc

SEQ ID NO: 473365 - DNA, 25 bp, Homo sapien
tctcttccaaccaggtgcactggaa

SEQ ID NO: 473366 - DNA, 25 bp, Homo sapien
caggtgcactggaaggcccctctgg

SEQ ID NO: 473367 - DNA, 25 bp, Homo sapien
gtctctgcactatcctcagtgtggt

SEQ ID NO: 473368 - DNA, 25 bp, Homo sapien
ttctcctttagaagtgtcaactggg

SEQ ID NO: 473369 - DNA, 25 bp, Homo sapien
tctcctttagaagtgtcaactgggg

SEQ ID NO: 473370 - DNA, 25 bp, Homo sapien
ctcctttagaagtgtcaactggggc

SEQ ID NO: 473371 - DNA, 25 bp, Homo sapien
tcctttagaagtgtcaactggggct

SEQ ID NO: 473372 - DNA, 25 bp, Homo sapien
cctttagaagtgtcaactggggctg

SEQ ID NO: 473373 - DNA, 25 bp, Homo sapien
ctttagaagtgtcaactggggctgg

SEQ ID NO: 473374 - DNA, 25 bp, Homo sapien
tttagaagtgtcaactggggctggg

SEQ ID NO: 473375 - DNA, 25 bp, Homo sapien
ttagaagtgtcaactggggctgggt

SEQ ID NO: 473376 - DNA, 25 bp, Homo sapien
agaagtgtcaactggggctgggtgt

SEQ ID NO: 473377 - DNA, 25 bp, Homo sapien
gaagtgtcaactggggctgggtgtg

SEQ ID NO: 473378 - DNA, 25 bp, Homo sapien
tccaggccagcctgaccggcatgga

SEQ ID NO: 473379 - DNA, 25 bp, Homo sapien
aaatgggttcaaggttagcaaggct

SEQ ID NO: 473380 - DNA, 25 bp, Homo sapien
gcaaggcttgactataaaatgtatc

SEQ ID NO: 473381 - DNA, 25 bp, Homo sapien
gtggtcagcctcagatgctctataa

SEQ ID NO: 473382 - DNA, 25 bp, Homo sapien
gatgctctataaacaaaagtccgaa

SEQ ID NO: 473383 - DNA, 25 bp, Homo sapien
aagcatattcttggtttgactccag

SEQ ID NO: 473384 - DNA, 25 bp, Homo sapien
ttggtttgactccaggctttctaaa

SEQ ID NO: 473385 - DNA, 25 bp, Homo sapien
ggctttctaaacattctctgcttat

SEQ ID NO: 473386 - DNA, 25 bp, Homo sapien
tctgcttatgatcacctatgtagga

SEQ ID NO: 473387 - DNA, 25 bp, Homo sapien
gactctacaacagagcatgcagatt

SEQ ID NO: 473388 - DNA, 25 bp, Homo sapien
tttgagtactgcttgtagccaccta

SEQ ID NO: 473389 - DNA, 25 bp, Homo sapien
gtagccacctacatgatgtttttct

SEQ ID NO: 473390 - DNA, 25 bp, Homo sapien
ctgtggtcctactggcagcatgttc

SEQ ID NO: 473391 - DNA, 25 bp, Homo sapien
tcctactggcagcatgttctagaca

SEQ ID NO: 473392 - DNA, 25 bp, Homo sapien
agcatgttctagacagacctgtgtg

SEQ ID NO: 473393 - DNA, 25 bp, Homo sapien
gaagtttgaggaagctgcatgttta

SEQ ID NO: 473394 - DNA, 25 bp, Homo sapien
gtcagcgggactttatttggatcca

SEQ ID NO: 473395 - DNA, 25 bp, Homo sapien
tatttggatccaccacaggtctttt

SEQ ID NO: 473396 - DNA, 25 bp, Homo sapien
cttgcagaaacaggctttaccccat

SEQ ID NO: 473397 - DNA, 25 bp, Homo sapien
tttaccccatacacacagaagagca

SEQ ID NO: 473398 - DNA, 25 bp, Homo sapien
aagagcaacgacttccttgttaaga

SEQ ID NO: 473399 - DNA, 25 bp, Homo sapien
acgacttccttgttaagagtctgaa

SEQ ID NO: 473400 - DNA, 25 bp, Homo sapien
tgtcagacccatggcctcagagagc

SEQ ID NO: 473401 - DNA, 25 bp, Homo sapien
caaatgttctgggtcatgcagctaa

SEQ ID NO: 473402 - DNA, 25 bp, Homo sapien
ctggttgaaccctgatctctagtaa

SEQ ID NO: 473403 - DNA, 25 bp, Homo sapien
gatctctagtaaacagcaccaactg

SEQ ID NO: 473404 - DNA, 25 bp, Homo sapien
agcaccaactgtctgattcagcaca

SEQ ID NO: 473405 - DNA, 25 bp, Homo sapien
gattcagcacatttaataagcccat

SEQ ID NO: 473406 - DNA, 25 bp, Homo sapien
taagcccatggaaagtggacttttt

SEQ ID NO: 473407 - DNA, 25 bp, Homo sapien
ggactttttccaaggttcagagtct

SEQ ID NO: 473408 - DNA, 25 bp, Homo sapien
agcaagtcattctctctcgctagaa

SEQ ID NO: 473409 - DNA, 25 bp, Homo sapien
tctctcgctagaatgctggctcctg

SEQ ID NO: 473410 - DNA, 25 bp, Homo sapien
cagtttgattcactgttctatctct

SEQ ID NO: 473411 - DNA, 25 bp, Homo sapien
tgaagcctggaatcgcacctggaac

SEQ ID NO: 473412 - DNA, 25 bp, Homo sapien
gaatcagaaaacaggctgtgttttc

SEQ ID NO: 473413 - DNA, 25 bp, Homo sapien
aaaacaggctgtgttttctgtgcgc

SEQ ID NO: 473414 - DNA, 25 bp, Homo sapien
aaacaggctgtgttttctgtgcgct

SEQ ID NO: 473415 - DNA, 25 bp, Homo sapien
aacaggctgtgttttctgtgcgctg

SEQ ID NO: 473416 - DNA, 25 bp, Homo sapien
acaggctgtgttttctgtgcgctgt

SEQ ID NO: 473417 - DNA, 25 bp, Homo sapien
caggctgtgttttctgtgcgctgtg

SEQ ID NO: 473418 - DNA, 25 bp, Homo sapien
ctgtgttttctgtgcgctgtggctc

SEQ ID NO: 473419 - DNA, 25 bp, Homo sapien
tgtgttttctgtgcgctgtggctca

SEQ ID NO: 473420 - DNA, 25 bp, Homo sapien
gtgttttctgtgcgctgtggctcat

SEQ ID NO: 473421 - DNA, 25 bp, Homo sapien
tgttttctgtgcgctgtggctcatg

SEQ ID NO: 473422 - DNA, 25 bp, Homo sapien
gttttctgtgcgctgtggctcatgc

SEQ ID NO: 473423 - DNA, 25 bp, Homo sapien
aagggacttagcctaaccgcaagag

SEQ ID NO: 473424 - DNA, 25 bp, Homo sapien
accgcaagagattcatgtttcctgt

SEQ ID NO: 473425 - DNA, 25 bp, Homo sapien
tgcctccaactcaaagtcagattgc

SEQ ID NO: 473426 - DNA, 25 bp, Homo sapien
gggcgtggatcttaacataactatc

SEQ ID NO: 473427 - DNA, 25 bp, Homo sapien
tatccaaacccaagaacagcccgag

SEQ ID NO: 473428 - DNA, 25 bp, Homo sapien
ttggaagaggcctctttgtcttcct

SEQ ID NO: 473429 - DNA, 25 bp, Homo sapien
tgccaggtcttatcttctcttttca

SEQ ID NO: 473430 - DNA, 25 bp, Homo sapien
ttctcttttcatatcctggtcttga

SEQ ID NO: 473431 - DNA, 25 bp, Homo sapien
atcaccgcttccacagtctttttat

SEQ ID NO: 473432 - DNA, 25 bp, Homo sapien
agtctttttatacttggcccacttg

SEQ ID NO: 473433 - DNA, 25 bp, Homo sapien
ggcccacttggcaatttatgcatgt

SEQ ID NO: 473434 - DNA, 25 bp, Homo sapien
aaccaacatgcagttataatctcta

SEQ ID NO: 473435 - DNA, 25 bp, Homo sapien
gttataatctctataagctttgaga

SEQ ID NO: 473436 - DNA, 25 bp, Homo sapien
gaaaatagcctgtttctagtggagt

SEQ ID NO: 473437 - DNA, 25 bp, Homo sapien
atagcctgtttctagtggagtggaa

SEQ ID NO: 473438 - DNA, 25 bp, Homo sapien
tggagtggaaatcaagtttcttcat

SEQ ID NO: 473439 - DNA, 25 bp, Homo sapien
ttatcttccactgaaacgccgaaca

SEQ ID NO: 473440 - DNA, 25 bp, Homo sapien
gaaacgccgaacatgtaagtgtcaa

SEQ ID NO: 473441 - DNA, 25 bp, Homo sapien
taaaacaaattgactcagagactat

SEQ ID NO: 473442 - DNA, 25 bp, Homo sapien
tcagagactatatcagaggaagcaa

SEQ ID NO: 473443 - DNA, 25 bp, Homo sapien
gcaatatggataacttcactggcta

SEQ ID NO: 473444 - DNA, 25 bp, Homo sapien
tatggataacttcactggctactgc

SEQ ID NO: 473445 - DNA, 25 bp, Homo sapien
taatattgcacagcacgaggcagac

SEQ ID NO: 473446 - DNA, 25 bp, Homo sapien
cacagcacgaggcagacacaaaagt

SEQ ID NO: 473447 - DNA, 25 bp, Homo sapien
gtgtgcatatgctatgattccattt

SEQ ID NO: 473448 - DNA, 25 bp, Homo sapien
atagtggttacctctggaaggtgga

SEQ ID NO: 473449 - DNA, 25 bp, Homo sapien
ggtgctgaaaacattctgtgcttgc

SEQ ID NO: 473450 - DNA, 25 bp, Homo sapien
aaacattctgtgcttgcaccgggtg

SEQ ID NO: 473451 - DNA, 25 bp, Homo sapien
atgtgggcattacataaaattcacc

SEQ ID NO: 473452 - DNA, 25 bp, Homo sapien
aaaattcaccaagctgcacccttaa

SEQ ID NO: 473453 - DNA, 25 bp, Homo sapien
caagctgcacccttaatgatttgta

SEQ ID NO: 473454 - DNA, 25 bp, Homo sapien
aatgatttgtacaatttgatgcaca

SEQ ID NO: 473455 - DNA, 25 bp, Homo sapien
tttgatgcacaaatctaacatctca

SEQ ID NO: 473456 - DNA, 25 bp, Homo sapien
gaggaggttttggtgagctgggatc

SEQ ID NO: 473457 - DNA, 25 bp, Homo sapien
aggaggttttggtgagctgggatcg

SEQ ID NO: 473458 - DNA, 25 bp, Homo sapien
aaacaaaactggtgtggtagtgtgc

SEQ ID NO: 473459 - DNA, 25 bp, Homo sapien
acaaaactggtgtggtagtgtgcac

SEQ ID NO: 473460 - DNA, 25 bp, Homo sapien
aaaactggtgtggtagtgtgcactt

SEQ ID NO: 473461 - DNA, 25 bp, Homo sapien
aactggtgtggtagtgtgcacttgt

SEQ ID NO: 473462 - DNA, 25 bp, Homo sapien
gagccaaagtcatgccactccactt

SEQ ID NO: 473463 - DNA, 25 bp, Homo sapien
atgccactccacttcaacctgagtg

SEQ ID NO: 473464 - DNA, 25 bp, Homo sapien
actccacttcaacctgagtgacaga

SEQ ID NO: 473465 - DNA, 25 bp, Homo sapien
ctccacttcaacctgagtgacagag

SEQ ID NO: 473466 - DNA, 25 bp, Homo sapien
tccacttcaacctgagtgacagaga

SEQ ID NO: 473467 - DNA, 25 bp, Homo sapien
ttgcaaaaccaattcatcacactat

SEQ ID NO: 473468 - DNA, 25 bp, Homo sapien
tcatcacactattatccccttgaga

SEQ ID NO: 473469 - DNA, 25 bp, Homo sapien
tatccccttgagatttatttcactg

SEQ ID NO: 473470 - DNA, 25 bp, Homo sapien
tatttcactgcatagtttccatggc

SEQ ID NO: 473471 - DNA, 25 bp, Homo sapien
gcatagtttccatggcacaagttga

SEQ ID NO: 473472 - DNA, 25 bp, Homo sapien
ggaatagaagtcaatgtagcccata

SEQ ID NO: 473473 - DNA, 25 bp, Homo sapien
gagaccaactaactcagtgcatctg

SEQ ID NO: 473474 - DNA, 25 bp, Homo sapien
atattggcaataaatcactcatgat

SEQ ID NO: 473475 - DNA, 25 bp, Homo sapien
aaacagcatttacttttcgacagat

SEQ ID NO: 473476 - DNA, 25 bp, Homo sapien
tttcgacagataactttgtgccaag

SEQ ID NO: 473477 - DNA, 25 bp, Homo sapien
ttgtgccaagaatttgtcctgcatt

SEQ ID NO: 473478 - DNA, 25 bp, Homo sapien
agctgtcacttccatcacagttgta

SEQ ID NO: 473479 - DNA, 25 bp, Homo sapien
gtcacttccatcacagttgtataaa

SEQ ID NO: 473480 - DNA, 25 bp, Homo sapien
cacagttgtataaagcctcattaaa

SEQ ID NO: 473481 - DNA, 25 bp, Homo sapien
aaagcctcattaaagatcgcagtgt

SEQ ID NO: 473482 - DNA, 25 bp, Homo sapien
gatcgcagtgttgctgtagcgacat

SEQ ID NO: 473483 - DNA, 25 bp, Homo sapien
gttgctgtagcgacatgcagtgctg

SEQ ID NO: 473484 - DNA, 25 bp, Homo sapien
agcgacatgcagtgctgtagtcagc

SEQ ID NO: 473485 - DNA, 25 bp, Homo sapien
agtgctgtagtcagcatctgccata

SEQ ID NO: 473486 - DNA, 25 bp, Homo sapien
gtcagcatctgccatagtatcagag

SEQ ID NO: 473487 - DNA, 25 bp, Homo sapien
tagtatcagagccaacagcccatat

SEQ ID NO: 473488 - DNA, 25 bp, Homo sapien
gagccaacagcccatatgacagctg

SEQ ID NO: 473489 - DNA, 25 bp, Homo sapien
ggatttagcttgcaacttgataaat

SEQ ID NO: 473490 - DNA, 25 bp, Homo sapien
gatttagcttgcaacttgataaata

SEQ ID NO: 473491 - DNA, 25 bp, Homo sapien
atttagcttgcaacttgataaataa

SEQ ID NO: 473492 - DNA, 25 bp, Homo sapien
tgataaataaaggtacttgaggctg

SEQ ID NO: 473493 - DNA, 25 bp, Homo sapien
gataaataaaggtacttgaggctgg

SEQ ID NO: 473494 - DNA, 25 bp, Homo sapien
ataaataaaggtacttgaggctggg

SEQ ID NO: 473495 - DNA, 25 bp, Homo sapien
cagaaggctgatatatgagaatagc

SEQ ID NO: 473496 - DNA, 25 bp, Homo sapien
agaaggctgatatatgagaatagct

SEQ ID NO: 473497 - DNA, 25 bp, Homo sapien
gaaggctgatatatgagaatagctt

SEQ ID NO: 473498 - DNA, 25 bp, Homo sapien
ggctgatatatgagaatagcttaaa

SEQ ID NO: 473499 - DNA, 25 bp, Homo sapien
gctgatatatgagaatagcttaaac

SEQ ID NO: 473500 - DNA, 25 bp, Homo sapien
tgaatatgaaaatctaaaaacttgg

SEQ ID NO: 473501 - DNA, 25 bp, Homo sapien
gaatatgaaaatctaaaaacttggc

SEQ ID NO: 473502 - DNA, 25 bp, Homo sapien
atatgaaaatctaaaaacttggccg

SEQ ID NO: 473503 - DNA, 25 bp, Homo sapien
tatgaaaatctaaaaacttggccgg

SEQ ID NO: 473504 - DNA, 25 bp, Homo sapien
aatctaaaaacttggccgggcgcag

SEQ ID NO: 473505 - DNA, 25 bp, Homo sapien
atctaaaaacttggccgggcgcagt

SEQ ID NO: 473506 - DNA, 25 bp, Homo sapien
tctaaaaacttggccgggcgcagtg

SEQ ID NO: 473507 - DNA, 25 bp, Homo sapien
ctaaaaacttggccgggcgcagtgg

SEQ ID NO: 473508 - DNA, 25 bp, Homo sapien
gtgcctgtaattgtagctactcggg

SEQ ID NO: 473509 - DNA, 25 bp, Homo sapien
caaagcccatgcttttaaccaccat

SEQ ID NO: 473510 - DNA, 25 bp, Homo sapien
aaccaccatggtatttcacacactc

SEQ ID NO: 473511 - DNA, 25 bp, Homo sapien
actcctacctcatcgtagtacagga

SEQ ID NO: 473512 - DNA, 25 bp, Homo sapien
tacctcatcgtagtacaggacttgt

SEQ ID NO: 473513 - DNA, 25 bp, Homo sapien
gtagtacaggacttgtgacctcatt

SEQ ID NO: 473514 - DNA, 25 bp, Homo sapien
agtacaggacttgtgacctcattat

SEQ ID NO: 473515 - DNA, 25 bp, Homo sapien
gtgacctcattattataacacaact

SEQ ID NO: 473516 - DNA, 25 bp, Homo sapien
acacaactagaacactgagctcttg

SEQ ID NO: 473517 - DNA, 25 bp, Homo sapien
agaacactgagctcttgtgctttca

SEQ ID NO: 473518 - DNA, 25 bp, Homo sapien
gagctcttgtgctttcagatgtgcc

SEQ ID NO: 473519 - DNA, 25 bp, Homo sapien
tcttgtgctttcagatgtgccttgt

SEQ ID NO: 473520 - DNA, 25 bp, Homo sapien
tcccctaagccttatctgcacataa

SEQ ID NO: 473521 - DNA, 25 bp, Homo sapien
cccctaagccttatctgcacataaa

SEQ ID NO: 473522 - DNA, 25 bp, Homo sapien
ccctaagccttatctgcacataaac

SEQ ID NO: 473523 - DNA, 25 bp, Homo sapien
cctaagccttatctgcacataaact

SEQ ID NO: 473524 - DNA, 25 bp, Homo sapien
ctaagccttatctgcacataaactg

SEQ ID NO: 473525 - DNA, 25 bp, Homo sapien
taagccttatctgcacataaactgg

SEQ ID NO: 473526 - DNA, 25 bp, Homo sapien
aagccttatctgcacataaactggg

SEQ ID NO: 473527 - DNA, 25 bp, Homo sapien
agccttatctgcacataaactgggg

SEQ ID NO: 473528 - DNA, 25 bp, Homo sapien
gccttatctgcacataaactggggg

SEQ ID NO: 473529 - DNA, 25 bp, Homo sapien
ttatctgcacataaactgggggccg

SEQ ID NO: 473530 - DNA, 25 bp, Homo sapien
atctgcacataaactgggggccggg

SEQ ID NO: 473531 - DNA, 25 bp, Homo sapien
ggccaagctctggttattttcttac

SEQ ID NO: 473532 - DNA, 25 bp, Homo sapien
ggaaaaaacctatcgctgacttagc

SEQ ID NO: 473533 - DNA, 25 bp, Homo sapien
aaacctatcgctgacttagcaacca

SEQ ID NO: 473534 - DNA, 25 bp, Homo sapien
atcgctgacttagcaaccaaagcct

SEQ ID NO: 473535 - DNA, 25 bp, Homo sapien
ttagcaaccaaagcctccatcgtta

SEQ ID NO: 473536 - DNA, 25 bp, Homo sapien
aagcctccatcgttaggcaaggaat

SEQ ID NO: 473537 - DNA, 25 bp, Homo sapien
ataaaaccagcacgctttttccact

SEQ ID NO: 473538 - DNA, 25 bp, Homo sapien
gcacgctttttccactgtgattttt

SEQ ID NO: 473539 - DNA, 25 bp, Homo sapien
aaaatatcttttcccttatgtacag

SEQ ID NO: 473540 - DNA, 25 bp, Homo sapien
gaaaaatatctaacttgctgagcat

SEQ ID NO: 473541 - DNA, 25 bp, Homo sapien
atatctaacttgctgagcatttgat

SEQ ID NO: 473542 - DNA, 25 bp, Homo sapien
ttcctagcatcctagggaatcaata

SEQ ID NO: 473543 - DNA, 25 bp, Homo sapien
tcctagcatcctagggaatcaatag

SEQ ID NO: 473544 - DNA, 25 bp, Homo sapien
cctagcatcctagggaatcaataga

SEQ ID NO: 473545 - DNA, 25 bp, Homo sapien
ctagcatcctagggaatcaatagaa

SEQ ID NO: 473546 - DNA, 25 bp, Homo sapien
tagcatcctagggaatcaatagaac

SEQ ID NO: 473547 - DNA, 25 bp, Homo sapien
agcatcctagggaatcaatagaaca

SEQ ID NO: 473548 - DNA, 25 bp, Homo sapien
gcatcctagggaatcaatagaacat

SEQ ID NO: 473549 - DNA, 25 bp, Homo sapien
catcctagggaatcaatagaacatt

SEQ ID NO: 473550 - DNA, 25 bp, Homo sapien
atcctagggaatcaatagaacattc

SEQ ID NO: 473551 - DNA, 25 bp, Homo sapien
tcctagggaatcaatagaacattct

SEQ ID NO: 473552 - DNA, 25 bp, Homo sapien
acattctcccaaccaggctgggtgc

SEQ ID NO: 473553 - DNA, 25 bp, Homo sapien
catgttaggctagtcttgcctgttc

SEQ ID NO: 473554 - DNA, 25 bp, Homo sapien
taggctagtcttgcctgttctagaa

SEQ ID NO: 473555 - DNA, 25 bp, Homo sapien
acagaatgtactcactagtagtgtc

SEQ ID NO: 473556 - DNA, 25 bp, Homo sapien
actagtagtgtctgactttttcaca

SEQ ID NO: 473557 - DNA, 25 bp, Homo sapien
ctttttcacaaaggataatgtctgt

SEQ ID NO: 473558 - DNA, 25 bp, Homo sapien
gtggtattcattcatgctgttgtat

SEQ ID NO: 473559 - DNA, 25 bp, Homo sapien
gtatgcatcagtagtttattttctt

SEQ ID NO: 473560 - DNA, 25 bp, Homo sapien
gtagtgttctaaggactattttaat

SEQ ID NO: 473561 - DNA, 25 bp, Homo sapien
tattttaatagcatcccacaaaggg

SEQ ID NO: 473562 - DNA, 25 bp, Homo sapien
gggtatgatatgttctatttacatt

SEQ ID NO: 473563 - DNA, 25 bp, Homo sapien
tgtgatttctcctttcactcatgaa

SEQ ID NO: 473564 - DNA, 25 bp, Homo sapien
gaacagatgtgcaatgaatgaccac

SEQ ID NO: 473565 - DNA, 25 bp, Homo sapien
agatgtgcaatgaatgaccactcat

SEQ ID NO: 473566 - DNA, 25 bp, Homo sapien
gatgtgcaatgaatgaccactcatt

SEQ ID NO: 473567 - DNA, 25 bp, Homo sapien
gtgcaatgaatgaccactcattggt

SEQ ID NO: 473568 - DNA, 25 bp, Homo sapien
caatgaatgaccactcattggttga

SEQ ID NO: 473569 - DNA, 25 bp, Homo sapien
attggttgattaactgaaggcagca

SEQ ID NO: 473570 - DNA, 25 bp, Homo sapien
ttgattaactgaaggcagcagggat

SEQ ID NO: 473571 - DNA, 25 bp, Homo sapien
attaactgaaggcagcagggattgt

SEQ ID NO: 473572 - DNA, 25 bp, Homo sapien
cagcagggattgtggttagacagcc

SEQ ID NO: 473573 - DNA, 25 bp, Homo sapien
agcagggattgtggttagacagcca

SEQ ID NO: 473574 - DNA, 25 bp, Homo sapien
gattgtggttagacagccaggatgc

SEQ ID NO: 473575 - DNA, 25 bp, Homo sapien
gacaggtaggccctgccgtctctct

SEQ ID NO: 473576 - DNA, 25 bp, Homo sapien
cagaatggtggaagcttcagtgcag

SEQ ID NO: 473577 - DNA, 25 bp, Homo sapien
gcaggaatccccttgtgttatttaa

SEQ ID NO: 473578 - DNA, 25 bp, Homo sapien
taagcctggcctcctgcgcagtggt

SEQ ID NO: 473579 - DNA, 25 bp, Homo sapien
cagtggtggagggaatgttccacat

SEQ ID NO: 473580 - DNA, 25 bp, Homo sapien
tgttccacatgtgggagaggccctc

SEQ ID NO: 473581 - DNA, 25 bp, Homo sapien
gagaggccctctgggcacctgtgta

SEQ ID NO: 473582 - DNA, 25 bp, Homo sapien
ggcacctgtgtaccacctatgtggt

SEQ ID NO: 473583 - DNA, 25 bp, Homo sapien
gtggtgaagacagccacctggcaaa

SEQ ID NO: 473584 - DNA, 25 bp, Homo sapien
ggaggatcctcctgatgtcccagag

SEQ ID NO: 473585 - DNA, 25 bp, Homo sapien
caggatggcaaaggaccttgcccac

SEQ ID NO: 473586 - DNA, 25 bp, Homo sapien
tagagcgccaaaggagcaaaccctc

SEQ ID NO: 473587 - DNA, 25 bp, Homo sapien
cactgcttcacgcagaggaagaaat

SEQ ID NO: 473588 - DNA, 25 bp, Homo sapien
atgtgtagggtaagcgagagcctca

SEQ ID NO: 473589 - DNA, 25 bp, Homo sapien
gcgagagcctcactgaaaatcagtc

SEQ ID NO: 473590 - DNA, 25 bp, Homo sapien
gaaaatcagtcacccaaggcaacag

SEQ ID NO: 473591 - DNA, 25 bp, Homo sapien
gtcacccaaggcaacaggcattttg

SEQ ID NO: 473592 - DNA, 25 bp, Homo sapien
gtctgtgctatttgaaggcttaagt

SEQ ID NO: 473593 - DNA, 25 bp, Homo sapien
attaattttatacatgcccatgttc

SEQ ID NO: 473594 - DNA, 25 bp, Homo sapien
taaaacatttatggcttggaactta

SEQ ID NO: 473595 - DNA, 25 bp, Homo sapien
gttctaatgtgctagtttgtccaca

SEQ ID NO: 473596 - DNA, 25 bp, Homo sapien
aaagcagagggtagtagagcgccaa

SEQ ID NO: 473597 - DNA, 25 bp, Homo sapien
aataaacttgggacatttcacataa

SEQ ID NO: 473598 - DNA, 25 bp, Homo sapien
atttcacataaaaccctactgtagc

SEQ ID NO: 473599 - DNA, 25 bp, Homo sapien
aaaaccctactgtagctgactgctc

SEQ ID NO: 473600 - DNA, 25 bp, Homo sapien
ccctactgtagctgactgctctgga

SEQ ID NO: 473601 - DNA, 25 bp, Homo sapien
aagtctgacgacagtgggccagcct

SEQ ID NO: 473602 - DNA, 25 bp, Homo sapien
ccatggcagcacttgttcagaactt

SEQ ID NO: 473603 - DNA, 25 bp, Homo sapien
atggcagcacttgttcagaacttgg

SEQ ID NO: 473604 - DNA, 25 bp, Homo sapien
cagcacttgttcagaacttgggaga

SEQ ID NO: 473605 - DNA, 25 bp, Homo sapien
tgggagagaccgtccccttttgtga

SEQ ID NO: 473606 - DNA, 25 bp, Homo sapien
tgtgaagcatgtgcttccctggtgt

SEQ ID NO: 473607 - DNA, 25 bp, Homo sapien
atagaaaacgctgggaacaccagca

SEQ ID NO: 473608 - DNA, 25 bp, Homo sapien
tcctgggatccttactgctgtcaac

SEQ ID NO: 473609 - DNA, 25 bp, Homo sapien
tactgctgtcaaccttggatgttca

SEQ ID NO: 473610 - DNA, 25 bp, Homo sapien
cagggaaggaaacttgtgtgcaaac

SEQ ID NO: 473611 - DNA, 25 bp, Homo sapien
tgtgcaaacagtatcctagctaggt

SEQ ID NO: 473612 - DNA, 25 bp, Homo sapien
cctagctaggtcagaggaggttata

SEQ ID NO: 473613 - DNA, 25 bp, Homo sapien
gtaatattgatataccctcactcag

SEQ ID NO: 473614 - DNA, 25 bp, Homo sapien
gatataccctcactcagcaggaaac

SEQ ID NO: 473615 - DNA, 25 bp, Homo sapien
acaattagttctgtactttttggag

SEQ ID NO: 473616 - DNA, 25 bp, Homo sapien
ggaggtttaatcatctgagacttac

SEQ ID NO: 473617 - DNA, 25 bp, Homo sapien
gagaacttgtatgtgatccagggat

SEQ ID NO: 473618 - DNA, 25 bp, Homo sapien
gatccagggatgcattgaatggtta

SEQ ID NO: 473619 - DNA, 25 bp, Homo sapien
tgtgttgcagaaaatgagggtgagg

SEQ ID NO: 473620 - DNA, 25 bp, Homo sapien
gtgttgcagaaaatgagggtgaggt

SEQ ID NO: 473621 - DNA, 25 bp, Homo sapien
tgcagaaaatgagggtgaggtggct

SEQ ID NO: 473622 - DNA, 25 bp, Homo sapien
aaatgagggtgaggtggctgggtgc

SEQ ID NO: 473623 - DNA, 25 bp, Homo sapien
aatgagggtgaggtggctgggtgcg

SEQ ID NO: 473624 - DNA, 25 bp, Homo sapien
tgagggtgaggtggctgggtgcggt

SEQ ID NO: 473625 - DNA, 25 bp, Homo sapien
gggaggctagagtgggtgagtcact

SEQ ID NO: 473626 - DNA, 25 bp, Homo sapien
ggaggctagagtgggtgagtcactt

SEQ ID NO: 473627 - DNA, 25 bp, Homo sapien
aggctagagtgggtgagtcacttga

SEQ ID NO: 473628 - DNA, 25 bp, Homo sapien
ctagagtgggtgagtcacttgaggc

SEQ ID NO: 473629 - DNA, 25 bp, Homo sapien
agccagggcttggtggcagcatgcc

SEQ ID NO: 473630 - DNA, 25 bp, Homo sapien
gacaattaggttgaggtcagatgca

SEQ ID NO: 473631 - DNA, 25 bp, Homo sapien
tgaggtcagatgcagtactactata

SEQ ID NO: 473632 - DNA, 25 bp, Homo sapien
tgcagtactactatatttaatggag

SEQ ID NO: 473633 - DNA, 25 bp, Homo sapien
aattagggccaaattaacatggaca

SEQ ID NO: 473634 - DNA, 25 bp, Homo sapien
aattaacatggacagttattcctga

SEQ ID NO: 473635 - DNA, 25 bp, Homo sapien
gttattcctgaatgcaaattaactc

SEQ ID NO: 473636 - DNA, 25 bp, Homo sapien
taaatttccatttttcagtctacca

SEQ ID NO: 473637 - DNA, 25 bp, Homo sapien
ttttcagtctaccacattttagcta

SEQ ID NO: 473638 - DNA, 25 bp, Homo sapien
gtctaccacattttagctaacaaga

SEQ ID NO: 473639 - DNA, 25 bp, Homo sapien
aatactaagcacaggaattccaaaa

SEQ ID NO: 473640 - DNA, 25 bp, Homo sapien
agcaaaggtctagctgagtaggcag

SEQ ID NO: 473641 - DNA, 25 bp, Homo sapien
tttggaggaacatgatacacacaca

SEQ ID NO: 473642 - DNA, 25 bp, Homo sapien
acacgcacgcacatgtatttgtaat

SEQ ID NO: 473643 - DNA, 25 bp, Homo sapien
tctgctttcctttgggggagacaaa

SEQ ID NO: 473644 - DNA, 25 bp, Homo sapien
gaaaataatgtgcactctgaagcca

SEQ ID NO: 473645 - DNA, 25 bp, Homo sapien
gacattatcaaatctcagttctgac

SEQ ID NO: 473646 - DNA, 25 bp, Homo sapien
ttctgacagttactgactgtttaaa

SEQ ID NO: 473647 - DNA, 25 bp, Homo sapien
gactgtttaaattttagtggagcac

SEQ ID NO: 473648 - DNA, 25 bp, Homo sapien
attttagtggagcacttaaactctt

SEQ ID NO: 473649 - DNA, 25 bp, Homo sapien
attggccaatgacatctatctttcg

SEQ ID NO: 473650 - DNA, 25 bp, Homo sapien
gccaatgacatctatctttcgtgtt

SEQ ID NO: 473651 - DNA, 25 bp, Homo sapien
catctatctttcgtgtttattggga

SEQ ID NO: 473652 - DNA, 25 bp, Homo sapien
attggctaaggcttactagaatttt

SEQ ID NO: 473653 - DNA, 25 bp, Homo sapien
ttggctaaggcttactagaatttta

SEQ ID NO: 473654 - DNA, 25 bp, Homo sapien
tggctaaggcttactagaattttaa

SEQ ID NO: 473655 - DNA, 25 bp, Homo sapien
ggctaaggcttactagaattttaag

SEQ ID NO: 473656 - DNA, 25 bp, Homo sapien
gctaaggcttactagaattttaagg

SEQ ID NO: 473657 - DNA, 25 bp, Homo sapien
agggaggtgtctaatattaagaaag

SEQ ID NO: 473658 - DNA, 25 bp, Homo sapien
aatattaagaaagcataagccaaaa

SEQ ID NO: 473659 - DNA, 25 bp, Homo sapien
atattaagaaagcataagccaaaat

SEQ ID NO: 473660 - DNA, 25 bp, Homo sapien
tattaagaaagcataagccaaaata

SEQ ID NO: 473661 - DNA, 25 bp, Homo sapien
attaagaaagcataagccaaaataa

SEQ ID NO: 473662 - DNA, 25 bp, Homo sapien
cttggttccccatctgagaagttga

SEQ ID NO: 473663 - DNA, 25 bp, Homo sapien
ttggttccccatctgagaagttgaa

SEQ ID NO: 473664 - DNA, 25 bp, Homo sapien
aaaaaatccctcttactgtgtcatc

SEQ ID NO: 473665 - DNA, 25 bp, Homo sapien
aaaatccctcttactgtgtcatcat

SEQ ID NO: 473666 - DNA, 25 bp, Homo sapien
aatccctcttactgtgtcatcataa

SEQ ID NO: 473667 - DNA, 25 bp, Homo sapien
tccctcttactgtgtcatcataagg

SEQ ID NO: 473668 - DNA, 25 bp, Homo sapien
tactgtgtcatcataaggactaact

SEQ ID NO: 473669 - DNA, 25 bp, Homo sapien
gactaactaattgaaggtgccctgg

SEQ ID NO: 473670 - DNA, 25 bp, Homo sapien
actaattgaaggtgccctggagtgc

SEQ ID NO: 473671 - DNA, 25 bp, Homo sapien
gtgccctggagtgcaatgcctgcat

SEQ ID NO: 473672 - DNA, 25 bp, Homo sapien
tgccctggagtgcaatgcctgcatg

SEQ ID NO: 473673 - DNA, 25 bp, Homo sapien
gggcaaccagaccaggctgccacaa

SEQ ID NO: 473674 - DNA, 25 bp, Homo sapien
aggctgccacaaagggctcctggaa

SEQ ID NO: 473675 - DNA, 25 bp, Homo sapien
gggctcctggaaaacaggcacattt

SEQ ID NO: 473676 - DNA, 25 bp, Homo sapien
aaaatccacttgtgggctagctcta

SEQ ID NO: 473677 - DNA, 25 bp, Homo sapien
ggctagctctacctggcatttaatt

SEQ ID NO: 473678 - DNA, 25 bp, Homo sapien
ttaaaatctcaactgttcctccaac

SEQ ID NO: 473679 - DNA, 25 bp, Homo sapien
acaacatgatccagcgtgaccacaa

SEQ ID NO: 473680 - DNA, 25 bp, Homo sapien
gtgaccacaacatccacagagtaaa

SEQ ID NO: 473681 - DNA, 25 bp, Homo sapien
aaaacccagggtcactcagatcctc

SEQ ID NO: 473682 - DNA, 25 bp, Homo sapien
tcagatcctcctagggtgactctgg

SEQ ID NO: 473683 - DNA, 25 bp, Homo sapien
ggccacacagtttactctctgggaa

SEQ ID NO: 473684 - DNA, 25 bp, Homo sapien
aggccgggtgttgtgactcaaaata

SEQ ID NO: 473685 - DNA, 25 bp, Homo sapien
ggccgggtgttgtgactcaaaatac

SEQ ID NO: 473686 - DNA, 25 bp, Homo sapien
gccgggtgttgtgactcaaaatact

SEQ ID NO: 473687 - DNA, 25 bp, Homo sapien
ccgggtgttgtgactcaaaatactg

SEQ ID NO: 473688 - DNA, 25 bp, Homo sapien
gggtgttgtgactcaaaatactgta

SEQ ID NO: 473689 - DNA, 25 bp, Homo sapien
ggtgttgtgactcaaaatactgtaa

SEQ ID NO: 473690 - DNA, 25 bp, Homo sapien
gttgtgactcaaaatactgtaatct

SEQ ID NO: 473691 - DNA, 25 bp, Homo sapien
ttgtgactcaaaatactgtaatctc

SEQ ID NO: 473692 - DNA, 25 bp, Homo sapien
gactcaaaatactgtaatctcagca

SEQ ID NO: 473693 - DNA, 25 bp, Homo sapien
gaggtttgcaaccagcctgagcaaa

SEQ ID NO: 473694 - DNA, 25 bp, Homo sapien
aaatggctagacataatggtgtgca

SEQ ID NO: 473695 - DNA, 25 bp, Homo sapien
ggcaaaggttgggtcatgaactatg

SEQ ID NO: 473696 - DNA, 25 bp, Homo sapien
gaattgcaagaggttgaacatgcct

SEQ ID NO: 473697 - DNA, 25 bp, Homo sapien
ttgcaagaggttgaacatgcctggg

SEQ ID NO: 473698 - DNA, 25 bp, Homo sapien
aattcagatggagcgttcatttcag

SEQ ID NO: 473699 - DNA, 25 bp, Homo sapien
tcagatggagcgttcatttcaggaa

SEQ ID NO: 473700 - DNA, 25 bp, Homo sapien
gagcgttcatttcaggaaggccacc

SEQ ID NO: 473701 - DNA, 25 bp, Homo sapien
gcgttcatttcaggaaggccaccct

SEQ ID NO: 473702 - DNA, 25 bp, Homo sapien
ttcaggaaggccaccctgggatctg

SEQ ID NO: 473703 - DNA, 25 bp, Homo sapien
gaaggccaccctgggatctgggcag

SEQ ID NO: 473704 - DNA, 25 bp, Homo sapien
caggagatgaatacctggcagggtc

SEQ ID NO: 473705 - DNA, 25 bp, Homo sapien
aaccccattcacattcttaaagtat

SEQ ID NO: 473706 - DNA, 25 bp, Homo sapien
atggtgtagagtggcccctgtttga

SEQ ID NO: 473707 - DNA, 25 bp, Homo sapien
gtagagtggcccctgtttgacctgc

SEQ ID NO: 473708 - DNA, 25 bp, Homo sapien
tagagtggcccctgtttgacctgcc

SEQ ID NO: 473709 - DNA, 25 bp, Homo sapien
gagtggcccctgtttgacctgccca

SEQ ID NO: 473710 - DNA, 25 bp, Homo sapien
agtggcccctgtttgacctgcccag

SEQ ID NO: 473711 - DNA, 25 bp, Homo sapien
gtggcccctgtttgacctgcccagg

SEQ ID NO: 473712 - DNA, 25 bp, Homo sapien
ggcccctgtttgacctgcccaggcc

SEQ ID NO: 473713 - DNA, 25 bp, Homo sapien
tgcccaggcccattctccaaagaag

SEQ ID NO: 473714 - DNA, 25 bp, Homo sapien
caggcccattctccaaagaagctgt

SEQ ID NO: 473715 - DNA, 25 bp, Homo sapien
tccaaagaagctgtacaggtgaggt

SEQ ID NO: 473716 - DNA, 25 bp, Homo sapien
aagaagctgtacaggtgaggtggct

SEQ ID NO: 473717 - DNA, 25 bp, Homo sapien
aattaccctaagagaaatgactatc

SEQ ID NO: 473718 - DNA, 25 bp, Homo sapien
gaaatgactatcatcctgtcagcag

SEQ ID NO: 473719 - DNA, 25 bp, Homo sapien
gactatcatcctgtcagcagattta

SEQ ID NO: 473720 - DNA, 25 bp, Homo sapien
atcatcctgtcagcagatttatcac

SEQ ID NO: 473721 - DNA, 25 bp, Homo sapien
gatttatcaccaacagttgtgacag

SEQ ID NO: 473722 - DNA, 25 bp, Homo sapien
gagaccaaaactgagaaactagaat

SEQ ID NO: 473723 - DNA, 25 bp, Homo sapien
gaaactagaattctatacctagcta

SEQ ID NO: 473724 - DNA, 25 bp, Homo sapien
atacctagctaaaccatctttcaag

SEQ ID NO: 473725 - DNA, 25 bp, Homo sapien
ctagctaaaccatctttcaagagaa

SEQ ID NO: 473726 - DNA, 25 bp, Homo sapien
atttaggatgcacacatactcattc

SEQ ID NO: 473727 - DNA, 25 bp, Homo sapien
atactcattcaaagaagtcctagga

SEQ ID NO: 473728 - DNA, 25 bp, Homo sapien
gtaaccatgctttccaaaccacagg

SEQ ID NO: 473729 - DNA, 25 bp, Homo sapien
ggaggtcagcctgccgcatgcagta

SEQ ID NO: 473730 - DNA, 25 bp, Homo sapien
gtacatgcctttcccagttacgaaa

SEQ ID NO: 473731 - DNA, 25 bp, Homo sapien
gttacgaaacagaaacccagcctga

SEQ ID NO: 473732 - DNA, 25 bp, Homo sapien
cttgcagagctatggcctgatctta

SEQ ID NO: 473733 - DNA, 25 bp, Homo sapien
agctatggcctgatcttaatgtaga

SEQ ID NO: 473734 - DNA, 25 bp, Homo sapien
tcaagtgctcgatggaaaaacaggt

SEQ ID NO: 473735 - DNA, 25 bp, Homo sapien
aggttaccgggttcaagcttgatct

SEQ ID NO: 473736 - DNA, 25 bp, Homo sapien
gcttgatcttcttgcaaaaagtccg

SEQ ID NO: 473737 - DNA, 25 bp, Homo sapien
atgcaaaacattccacttcatcggg

SEQ ID NO: 473738 - DNA, 25 bp, Homo sapien
cttcatcgggaagttctagagctga

SEQ ID NO: 473739 - DNA, 25 bp, Homo sapien
tgatcataccactgattacacagag

SEQ ID NO: 473740 - DNA, 25 bp, Homo sapien
taccactgattacacagagatgtca

SEQ ID NO: 473741 - DNA, 25 bp, Homo sapien
gagatgtcaggaactccacttactc

SEQ ID NO: 473742 - DNA, 25 bp, Homo sapien
tccacttactcctgtagctattgat

SEQ ID NO: 473743 - DNA, 25 bp, Homo sapien
cttactcctgtagctattgatgaaa

SEQ ID NO: 473744 - DNA, 25 bp, Homo sapien
gaaatagtagctacaagcagcagaa

SEQ ID NO: 473745 - DNA, 25 bp, Homo sapien
gaagaaattatgctgtccaacccct

SEQ ID NO: 473746 - DNA, 25 bp, Homo sapien
gaaattatgctgtccaacccctgca

SEQ ID NO: 473747 - DNA, 25 bp, Homo sapien
caacccctgcactgagatgcaaaag

SEQ ID NO: 473748 - DNA, 25 bp, Homo sapien
taaactatatattgggtagcataag

SEQ ID NO: 473749 - DNA, 25 bp, Homo sapien
gtggaaattcaatcatataaagtca

SEQ ID NO: 473750 - DNA, 25 bp, Homo sapien
gcttgggagatactcccgctgtctc

SEQ ID NO: 473751 - DNA, 25 bp, Homo sapien
cttgggagatactcccgctgtctca

SEQ ID NO: 473752 - DNA, 25 bp, Homo sapien
ttgggagatactcccgctgtctcaa

SEQ ID NO: 473753 - DNA, 25 bp, Homo sapien
tgggagatactcccgctgtctcaaa

SEQ ID NO: 473754 - DNA, 25 bp, Homo sapien
gggagatactcccgctgtctcaaaa

SEQ ID NO: 473755 - DNA, 25 bp, Homo sapien
gagatactcccgctgtctcaaaaat

SEQ ID NO: 473756 - DNA, 25 bp, Homo sapien
agatactcccgctgtctcaaaaata

SEQ ID NO: 473757 - DNA, 25 bp, Homo sapien
gatactcccgctgtctcaaaaataa

SEQ ID NO: 473758 - DNA, 25 bp, Homo sapien
aaataaataaataggccaggcacag

SEQ ID NO: 473759 - DNA, 25 bp, Homo sapien
aataaataaataggccaggcacagt

SEQ ID NO: 473760 - DNA, 25 bp, Homo sapien
ataaataaataggccaggcacagtg

SEQ ID NO: 473761 - DNA, 25 bp, Homo sapien
gacaggtaggccctgccgtctctct

SEQ ID NO: 473762 - DNA, 25 bp, Homo sapien
ggtccccccactcagaatggtggaa

SEQ ID NO: 473763 - DNA, 25 bp, Homo sapien
tttaagcctggcctcctgcgcagtg

SEQ ID NO: 473764 - DNA, 25 bp, Homo sapien
taagcctggcctcctgcgcagtggt

SEQ ID NO: 473765 - DNA, 25 bp, Homo sapien
cagtggtggagggaatgttccacat

SEQ ID NO: 473766 - DNA, 25 bp, Homo sapien
gagaggccctctgggcacctgtgta

SEQ ID NO: 473767 - DNA, 25 bp, Homo sapien
tgggcacctgtgtaccacctatgtg

SEQ ID NO: 473768 - DNA, 25 bp, Homo sapien
cacctgtgtaccacctatgtggtga

SEQ ID NO: 473769 - DNA, 25 bp, Homo sapien
gggaggatcctcctgatgtcccaga

SEQ ID NO: 473770 - DNA, 25 bp, Homo sapien
ggatcctcctgatgtcccagaggag

SEQ ID NO: 473771 - DNA, 25 bp, Homo sapien
caggatggcaaaggaccttgcccac

SEQ ID NO: 473772 - DNA, 25 bp, Homo sapien
aagaaccattggctaaggcttacta

SEQ ID NO: 473773 - DNA, 25 bp, Homo sapien
gaaccattggctaaggcttactaga

SEQ ID NO: 473774 - DNA, 25 bp, Homo sapien
attggctaaggcttactagaatttt

SEQ ID NO: 473775 - DNA, 25 bp, Homo sapien
ttggctaaggcttactagaatttta

SEQ ID NO: 473776 - DNA, 25 bp, Homo sapien
tggctaaggcttactagaattttaa

SEQ ID NO: 473777 - DNA, 25 bp, Homo sapien
ggctaaggcttactagaattttaag

SEQ ID NO: 473778 - DNA, 25 bp, Homo sapien
gctaaggcttactagaattttaagg

SEQ ID NO: 473779 - DNA, 25 bp, Homo sapien
tactagaattttaagggaggtgtct

SEQ ID NO: 473780 - DNA, 25 bp, Homo sapien
agggaggtgtctaatattaagaaag

SEQ ID NO: 473781 - DNA, 25 bp, Homo sapien
aatattaagaaagcataagccaaaa

SEQ ID NO: 473782 - DNA, 25 bp, Homo sapien
gaaagcataagccaaaataaacaat

SEQ ID NO: 473783 - DNA, 25 bp, Homo sapien
gtgtacaccctctgcgatactaaga

SEQ ID NO: 473784 - DNA, 25 bp, Homo sapien
accctctgcgatactaagagtcata

SEQ ID NO: 473785 - DNA, 25 bp, Homo sapien
agagtcatatcatcctctttggctc

SEQ ID NO: 473786 - DNA, 25 bp, Homo sapien
cctctttggctctggatattaggag

SEQ ID NO: 473787 - DNA, 25 bp, Homo sapien
taggagcaatatcacagggctgtgt

SEQ ID NO: 473788 - DNA, 25 bp, Homo sapien
tccacccaggaaattactaactagg

SEQ ID NO: 473789 - DNA, 25 bp, Homo sapien
ggagtaatgtcatcctccctaaacc

SEQ ID NO: 473790 - DNA, 25 bp, Homo sapien
tcctccctaaacctggatgttagca

SEQ ID NO: 473791 - DNA, 25 bp, Homo sapien
acctggatgttagcaacaagatcac

SEQ ID NO: 473792 - DNA, 25 bp, Homo sapien
accctgcgatattggaagtaatatg

SEQ ID NO: 473793 - DNA, 25 bp, Homo sapien
tggaagtaatatgatcctcttcccc

SEQ ID NO: 473794 - DNA, 25 bp, Homo sapien
ttaaagacatagcatttttgggctg

SEQ ID NO: 473795 - DNA, 25 bp, Homo sapien
taaagacatagcatttttgggctga

SEQ ID NO: 473796 - DNA, 25 bp, Homo sapien
aaagacatagcatttttgggctgag

SEQ ID NO: 473797 - DNA, 25 bp, Homo sapien
aagacatagcatttttgggctgagt

SEQ ID NO: 473798 - DNA, 25 bp, Homo sapien
agacatagcatttttgggctgagtg

SEQ ID NO: 473799 - DNA, 25 bp, Homo sapien
gacatagcatttttgggctgagtgc

SEQ ID NO: 473800 - DNA, 25 bp, Homo sapien
acatagcatttttgggctgagtgcg

SEQ ID NO: 473801 - DNA, 25 bp, Homo sapien
catagcatttttgggctgagtgcgg

SEQ ID NO: 473802 - DNA, 25 bp, Homo sapien
atagcatttttgggctgagtgcggt

SEQ ID NO: 473803 - DNA, 25 bp, Homo sapien
tttcaagtcagaattactggggtct

SEQ ID NO: 473804 - DNA, 25 bp, Homo sapien
ttcaagtcagaattactggggtctg

SEQ ID NO: 473805 - DNA, 25 bp, Homo sapien
tcaagtcagaattactggggtctgg

SEQ ID NO: 473806 - DNA, 25 bp, Homo sapien
caagtcagaattactggggtctggt

SEQ ID NO: 473807 - DNA, 25 bp, Homo sapien
aagtcagaattactggggtctggtt

SEQ ID NO: 473808 - DNA, 25 bp, Homo sapien
agtcagaattactggggtctggttg

SEQ ID NO: 473809 - DNA, 25 bp, Homo sapien
gtcagaattactggggtctggttgg

SEQ ID NO: 473810 - DNA, 25 bp, Homo sapien
ggggtctggttgggcgcggtggctc

SEQ ID NO: 473811 - DNA, 25 bp, Homo sapien
ggaaaaaacctatcgctgacttagc

SEQ ID NO: 473812 - DNA, 25 bp, Homo sapien
aaacctatcgctgacttagcaacca

SEQ ID NO: 473813 - DNA, 25 bp, Homo sapien
atcgctgacttagcaaccaaagcct

SEQ ID NO: 473814 - DNA, 25 bp, Homo sapien
ttagcaaccaaagcctccatcgtta

SEQ ID NO: 473815 - DNA, 25 bp, Homo sapien
aaccaaagcctccatcgttaggcaa

SEQ ID NO: 473816 - DNA, 25 bp, Homo sapien
aagcctccatcgttaggcaaggaat

SEQ ID NO: 473817 - DNA, 25 bp, Homo sapien
ataaaaccagcacgctttttccact

SEQ ID NO: 473818 - DNA, 25 bp, Homo sapien
aaaccagcacgctttttccactgtg

SEQ ID NO: 473819 - DNA, 25 bp, Homo sapien
gcacgctttttccactgtgattttt

SEQ ID NO: 473820 - DNA, 25 bp, Homo sapien
gaaaaatatctaacttgctgagcat

SEQ ID NO: 473821 - DNA, 25 bp, Homo sapien
atatctaacttgctgagcatttgat

SEQ ID NO: 473822 - DNA, 25 bp, Homo sapien
gaatttggattgacattggccagtc

SEQ ID NO: 473823 - DNA, 25 bp, Homo sapien
cattggccagtcaagtcaaggaaag

SEQ ID NO: 473824 - DNA, 25 bp, Homo sapien
ggaaagtagtcctcagttttgataa

SEQ ID NO: 473825 - DNA, 25 bp, Homo sapien
agatagagttatgccctaacctcaa

SEQ ID NO: 473826 - DNA, 25 bp, Homo sapien
gttatgccctaacctcaatgcagag

SEQ ID NO: 473827 - DNA, 25 bp, Homo sapien
aacctcaatgcagagccatggtgat

SEQ ID NO: 473828 - DNA, 25 bp, Homo sapien
gaatcaatgctcatcttgtcttcgt

SEQ ID NO: 473829 - DNA, 25 bp, Homo sapien
tcatcttgtcttcgttagcttagca

SEQ ID NO: 473830 - DNA, 25 bp, Homo sapien
gttagcttagcaaacacattttctt

SEQ ID NO: 473831 - DNA, 25 bp, Homo sapien
acattttcttcatgatggtgtgact

SEQ ID NO: 473832 - DNA, 25 bp, Homo sapien
tgaatcaatcatccttcttgcaaag

SEQ ID NO: 473833 - DNA, 25 bp, Homo sapien
actattttgtgcctcgggatgcatt

SEQ ID NO: 473834 - DNA, 25 bp, Homo sapien
tttgtgcctcgggatgcattcagat

SEQ ID NO: 473835 - DNA, 25 bp, Homo sapien
tgtgcctcgggatgcattcagatgc

SEQ ID NO: 473836 - DNA, 25 bp, Homo sapien
tgcctcgggatgcattcagatgctc

SEQ ID NO: 473837 - DNA, 25 bp, Homo sapien
ctcgggatgcattcagatgctcctt

SEQ ID NO: 473838 - DNA, 25 bp, Homo sapien
gggatgcattcagatgctcctttca

SEQ ID NO: 473839 - DNA, 25 bp, Homo sapien
gatgcattcagatgctcctttcaaa

SEQ ID NO: 473840 - DNA, 25 bp, Homo sapien
gcattcagatgctcctttcaaaagc

SEQ ID NO: 473841 - DNA, 25 bp, Homo sapien
ttcagatgctcctttcaaaagcaat

SEQ ID NO: 473842 - DNA, 25 bp, Homo sapien
gctcctttcaaaagcaatacatggg

SEQ ID NO: 473843 - DNA, 25 bp, Homo sapien
aaagcaatacatggggctcacgcct

SEQ ID NO: 473844 - DNA, 25 bp, Homo sapien
agcggtattttttgatgtcctccag

SEQ ID NO: 473845 - DNA, 25 bp, Homo sapien
tgtcctccagctctgaggtgccaat

SEQ ID NO: 473846 - DNA, 25 bp, Homo sapien
gaggtgccaatcagagcaatcctct

SEQ ID NO: 473847 - DNA, 25 bp, Homo sapien
ctcctctgacttcttcaaaagcatc

SEQ ID NO: 473848 - DNA, 25 bp, Homo sapien
aaagcatcactgtctccttgggtga

SEQ ID NO: 473849 - DNA, 25 bp, Homo sapien
gggcagcactgattttgcccaagct

SEQ ID NO: 473850 - DNA, 25 bp, Homo sapien
ttgcccaagctctaccatttatttt

SEQ ID NO: 473851 - DNA, 25 bp, Homo sapien
tattttctcagtgatctcttggcct

SEQ ID NO: 473852 - DNA, 25 bp, Homo sapien
tcttggcctccatcttctcatgtgt

SEQ ID NO: 473853 - DNA, 25 bp, Homo sapien
taaagacttttccaggtctctttct

SEQ ID NO: 473854 - DNA, 25 bp, Homo sapien
aggtctctttcttacagcggtattt

SEQ ID NO: 473855 - DNA, 25 bp, Homo sapien
agaaaatggtttttaggccatgcac

SEQ ID NO: 473856 - DNA, 25 bp, Homo sapien
gaaaatggtttttaggccatgcaca

SEQ ID NO: 473857 - DNA, 25 bp, Homo sapien
aaaatggtttttaggccatgcacag

SEQ ID NO: 473858 - DNA, 25 bp, Homo sapien
aaatggtttttaggccatgcacagg

SEQ ID NO: 473859 - DNA, 25 bp, Homo sapien
aatggtttttaggccatgcacaggg

SEQ ID NO: 473860 - DNA, 25 bp, Homo sapien
ggtttttaggccatgcacaggggct

SEQ ID NO: 473861 - DNA, 25 bp, Homo sapien
gtttttaggccatgcacaggggctc

SEQ ID NO: 473862 - DNA, 25 bp, Homo sapien
tttttaggccatgcacaggggctca

SEQ ID NO: 473863 - DNA, 25 bp, Homo sapien
ttttaggccatgcacaggggctcat

SEQ ID NO: 473864 - DNA, 25 bp, Homo sapien
tttaggccatgcacaggggctcatg

SEQ ID NO: 473865 - DNA, 25 bp, Homo sapien
taggccatgcacaggggctcatgct

SEQ ID NO: 473866 - DNA, 25 bp, Homo sapien
tgtgctccagctatttctttctttc

SEQ ID NO: 473867 - DNA, 25 bp, Homo sapien
ttttccttctccagaatgtcatagt

SEQ ID NO: 473868 - DNA, 25 bp, Homo sapien
gtaatacgcatttaaggtccctcca

SEQ ID NO: 473869 - DNA, 25 bp, Homo sapien
atacgcatttaaggtccctccatat

SEQ ID NO: 473870 - DNA, 25 bp, Homo sapien
taaggtccctccatatctgttaatg

SEQ ID NO: 473871 - DNA, 25 bp, Homo sapien
cctccatatctgttaatgccgtcat

SEQ ID NO: 473872 - DNA, 25 bp, Homo sapien
atatctgttaatgccgtcatagctc

SEQ ID NO: 473873 - DNA, 25 bp, Homo sapien
gttaatgccgtcatagctcaattct

SEQ ID NO: 473874 - DNA, 25 bp, Homo sapien
agctcaattctttttaacaccggat

SEQ ID NO: 473875 - DNA, 25 bp, Homo sapien
ttaacaccggataatattccattgt

SEQ ID NO: 473876 - DNA, 25 bp, Homo sapien
agacatcttcattgcttccaggctt

SEQ ID NO: 473877 - DNA, 25 bp, Homo sapien
ggcctattttgaaagcacagctgat

SEQ ID NO: 473878 - DNA, 25 bp, Homo sapien
gaagacctaggctcagcttcggcca

SEQ ID NO: 473879 - DNA, 25 bp, Homo sapien
gccgagggacacgtttctgagcagc

SEQ ID NO: 473880 - DNA, 25 bp, Homo sapien
ttctgagcagcgtttggcttctctg

SEQ ID NO: 473881 - DNA, 25 bp, Homo sapien
tggcttctctgtcaatacgtcatca

SEQ ID NO: 473882 - DNA, 25 bp, Homo sapien
acgctctcacctgactgttgggata

SEQ ID NO: 473883 - DNA, 25 bp, Homo sapien
gggatacttaaacgtacgagcacac

SEQ ID NO: 473884 - DNA, 25 bp, Homo sapien
gagcacacgggcagtcagcacaagc

SEQ ID NO: 473885 - DNA, 25 bp, Homo sapien
gtggttcttagcaaggcagtacctt

SEQ ID NO: 473886 - DNA, 25 bp, Homo sapien
aaggcagtaccttcagtgcctggtt

SEQ ID NO: 473887 - DNA, 25 bp, Homo sapien
tgcctggttcacttcttttatatct

SEQ ID NO: 473888 - DNA, 25 bp, Homo sapien
aggcagggccagtccctctactttc

SEQ ID NO: 473889 - DNA, 25 bp, Homo sapien
tccaattccttcttagtttccttct

SEQ ID NO: 473890 - DNA, 25 bp, Homo sapien
ttcttcctttagacccaatagcagc

SEQ ID NO: 473891 - DNA, 25 bp, Homo sapien
ctttagacccaatagcagccacatt

SEQ ID NO: 473892 - DNA, 25 bp, Homo sapien
gacaccatgctaaacacttctttta

SEQ ID NO: 473893 - DNA, 25 bp, Homo sapien
acttcttttatttaatccacaccag

SEQ ID NO: 473894 - DNA, 25 bp, Homo sapien
tccacaccaggtagttaataagcaa

SEQ ID NO: 473895 - DNA, 25 bp, Homo sapien
gtaggcataattactgccaacttca

SEQ ID NO: 473896 - DNA, 25 bp, Homo sapien
tgccaacttcatggataggaggaat

SEQ ID NO: 473897 - DNA, 25 bp, Homo sapien
ggctgcccaaaagtcagagagggaa

SEQ ID NO: 473898 - DNA, 25 bp, Homo sapien
aattcgaacttaggaggctctgact

SEQ ID NO: 473899 - DNA, 25 bp, Homo sapien
ccagcccatgctcaggtttaactaa

SEQ ID NO: 473900 - DNA, 25 bp, Homo sapien
cagcccatgctcaggtttaactaag

SEQ ID NO: 473901 - DNA, 25 bp, Homo sapien
agcccatgctcaggtttaactaagc

SEQ ID NO: 473902 - DNA, 25 bp, Homo sapien
gcccatgctcaggtttaactaagca

SEQ ID NO: 473903 - DNA, 25 bp, Homo sapien
ccatgctcaggtttaactaagcaca

SEQ ID NO: 473904 - DNA, 25 bp, Homo sapien
atgctcaggtttaactaagcacatt

SEQ ID NO: 473905 - DNA, 25 bp, Homo sapien
gctcaggtttaactaagcacattta

SEQ ID NO: 473906 - DNA, 25 bp, Homo sapien
ctcaggtttaactaagcacatttat

SEQ ID NO: 473907 - DNA, 25 bp, Homo sapien
caggtttaactaagcacatttatta

SEQ ID NO: 473908 - DNA, 25 bp, Homo sapien
ggtttaactaagcacatttattatt

SEQ ID NO: 473909 - DNA, 25 bp, Homo sapien
tttaactaagcacatttattatttc

SEQ ID NO: 473910 - DNA, 25 bp, Homo sapien
gcagcaggaagctgtaagactttaa

SEQ ID NO: 473911 - DNA, 25 bp, Homo sapien
cagcaggaagctgtaagactttaag

SEQ ID NO: 473912 - DNA, 25 bp, Homo sapien
agcaggaagctgtaagactttaagg

SEQ ID NO: 473913 - DNA, 25 bp, Homo sapien
caggaagctgtaagactttaagggc

SEQ ID NO: 473914 - DNA, 25 bp, Homo sapien
ggaagctgtaagactttaagggcca

SEQ ID NO: 473915 - DNA, 25 bp, Homo sapien
gaagctgtaagactttaagggccag

SEQ ID NO: 473916 - DNA, 25 bp, Homo sapien
aagctgtaagactttaagggccagg

SEQ ID NO: 473917 - DNA, 25 bp, Homo sapien
agctgtaagactttaagggccaggc

SEQ ID NO: 473918 - DNA, 25 bp, Homo sapien
gtaagactttaagggccaggcgccg

SEQ ID NO: 473919 - DNA, 25 bp, Homo sapien
gggtgcctgtactcggaggcggcgg

SEQ ID NO: 473920 - DNA, 25 bp, Homo sapien
tgcctgtactcggaggcggcgggag

SEQ ID NO: 473921 - DNA, 25 bp, Homo sapien
gaaaaccaggcagttagactagtta

SEQ ID NO: 473922 - DNA, 25 bp, Homo sapien
gttagactagttaggctagggcaaa

SEQ ID NO: 473923 - DNA, 25 bp, Homo sapien
ggataggtgtcttaacgttctgtgt

SEQ ID NO: 473924 - DNA, 25 bp, Homo sapien
gtcttaacgttctgtgtgcactttg

SEQ ID NO: 473925 - DNA, 25 bp, Homo sapien
tgtgtgcactttgaaccagcgatcc

SEQ ID NO: 473926 - DNA, 25 bp, Homo sapien
gatccccccctacaaatgtataaag

SEQ ID NO: 473927 - DNA, 25 bp, Homo sapien
aaatagtcatggctatgtgcataac

SEQ ID NO: 473928 - DNA, 25 bp, Homo sapien
ggctatgtgcataactacaagagtt

SEQ ID NO: 473929 - DNA, 25 bp, Homo sapien
agctgaaatgcccaacgataattaa

SEQ ID NO: 473930 - DNA, 25 bp, Homo sapien
aatgcccaacgataattaaagtatg

SEQ ID NO: 473931 - DNA, 25 bp, Homo sapien
gtatgaaacacctctgtaatgaaat

SEQ ID NO: 473932 - DNA, 25 bp, Homo sapien
ataaaggaagttaagcatggcttgc

SEQ ID NO: 473933 - DNA, 25 bp, Homo sapien
aggaagttaagcatggcttgctaga

SEQ ID NO: 473934 - DNA, 25 bp, Homo sapien
tagaagagtcccagcggtgctggtg

SEQ ID NO: 473935 - DNA, 25 bp, Homo sapien
tagaattaattggagagtctttttt

SEQ ID NO: 473936 - DNA, 25 bp, Homo sapien
gggaaaaggcacacctgtgccaaga

SEQ ID NO: 473937 - DNA, 25 bp, Homo sapien
gcacacctgtgccaagataagattt

SEQ ID NO: 473938 - DNA, 25 bp, Homo sapien
acctgtgccaagataagattttcct

SEQ ID NO: 473939 - DNA, 25 bp, Homo sapien
ctgtgccaagataagattttcctat

SEQ ID NO: 473940 - DNA, 25 bp, Homo sapien
attttcctatcttggatgagtggga

SEQ ID NO: 473941 - DNA, 25 bp, Homo sapien
cctatcttggatgagtgggaagttt

SEQ ID NO: 473942 - DNA, 25 bp, Homo sapien
ggaagcctaaatattagaacttatg

SEQ ID NO: 473943 - DNA, 25 bp, Homo sapien
atactcttaggtgaaatttgtgcaa

SEQ ID NO: 473944 - DNA, 25 bp, Homo sapien
gagggtgagctacagaactctccat

SEQ ID NO: 473945 - DNA, 25 bp, Homo sapien
gtgagctacagaactctccatgacc

SEQ ID NO: 473946 - DNA, 25 bp, Homo sapien
gaactctccatgaccactcaagaat

SEQ ID NO: 473947 - DNA, 25 bp, Homo sapien
atgaccactcaagaatgggacccaa

SEQ ID NO: 473948 - DNA, 25 bp, Homo sapien
gggacccaaaggcaaatgataactt

SEQ ID NO: 473949 - DNA, 25 bp, Homo sapien
tattcattcatcaagggataaactt

SEQ ID NO: 473950 - DNA, 25 bp, Homo sapien
taatagataaagatcccactctgcc

SEQ ID NO: 473951 - DNA, 25 bp, Homo sapien
cactctgccttggatttagccatcg

SEQ ID NO: 473952 - DNA, 25 bp, Homo sapien
tgccttggatttagccatcgcagtc

SEQ ID NO: 473953 - DNA, 25 bp, Homo sapien
atcgcagtccctgtgtaaaacccca

SEQ ID NO: 473954 - DNA, 25 bp, Homo sapien
gtttgttcatagaattctctgtgct

SEQ ID NO: 473955 - DNA, 25 bp, Homo sapien
ctctgtgctgtgtttcttttggata

SEQ ID NO: 473956 - DNA, 25 bp, Homo sapien
cacagcgttttctaagcatggttac

SEQ ID NO: 473957 - DNA, 25 bp, Homo sapien
catggttactttaggtgtgcacgag

SEQ ID NO: 473958 - DNA, 25 bp, Homo sapien
gtgtgcacgaggcaatgccagccac

SEQ ID NO: 473959 - DNA, 25 bp, Homo sapien
ccaaattacctgtggagcttgttaa

SEQ ID NO: 473960 - DNA, 25 bp, Homo sapien
ttcaatgtgtccttcatagggcctg

SEQ ID NO: 473961 - DNA, 25 bp, Homo sapien
gggcatcaatcttgcttaagacctg

SEQ ID NO: 473962 - DNA, 25 bp, Homo sapien
gacctgaaggattttgtgttctttt

SEQ ID NO: 473963 - DNA, 25 bp, Homo sapien
tgaccctaccctaatttcctcagtg

SEQ ID NO: 473964 - DNA, 25 bp, Homo sapien
ttcctcagtgaaatcgactttaagt

SEQ ID NO: 473965 - DNA, 25 bp, Homo sapien
gattttccaaatgtatactgtatgg

SEQ ID NO: 473966 - DNA, 25 bp, Homo sapien
gatatggggctttctataattctaa

SEQ ID NO: 473967 - DNA, 25 bp, Homo sapien
taagttttgggtccttccattgcct

SEQ ID NO: 473968 - DNA, 25 bp, Homo sapien
ttgggtccttccattgccttttcat

SEQ ID NO: 473969 - DNA, 25 bp, Homo sapien
tgccttttcatggtttagtagctca

SEQ ID NO: 473970 - DNA, 25 bp, Homo sapien
catggtttagtagctcattttgttt

SEQ ID NO: 473971 - DNA, 25 bp, Homo sapien
ttgcattgtctggaatggtacccac

SEQ ID NO: 473972 - DNA, 25 bp, Homo sapien
gtctggaatggtacccacactttat

SEQ ID NO: 473973 - DNA, 25 bp, Homo sapien
atggtacccacactttatccattca

SEQ ID NO: 473974 - DNA, 25 bp, Homo sapien
cctactggaaaggacatcttggctg

SEQ ID NO: 473975 - DNA, 25 bp, Homo sapien
ctgcttccaagttttagccaattat

SEQ ID NO: 473976 - DNA, 25 bp, Homo sapien
gttcatgtgtcatatcataaataac

SEQ ID NO: 473977 - DNA, 25 bp, Homo sapien
ttcatgtgtcatatcataaataacc

SEQ ID NO: 473978 - DNA, 25 bp, Homo sapien
tcatgtgtcatatcataaataacca

SEQ ID NO: 473979 - DNA, 25 bp, Homo sapien
tcataaataaccagtaaggccagat

SEQ ID NO: 473980 - DNA, 25 bp, Homo sapien
cataaataaccagtaaggccagatg

SEQ ID NO: 473981 - DNA, 25 bp, Homo sapien
ataaataaccagtaaggccagatgt

SEQ ID NO: 473982 - DNA, 25 bp, Homo sapien
taaataaccagtaaggccagatgtg

SEQ ID NO: 473983 - DNA, 25 bp, Homo sapien
aaataaccagtaaggccagatgtgg

SEQ ID NO: 473984 - DNA, 25 bp, Homo sapien
aataaccagtaaggccagatgtggt

SEQ ID NO: 473985 - DNA, 25 bp, Homo sapien
ataaccagtaaggccagatgtggtg

SEQ ID NO: 473986 - DNA, 25 bp, Homo sapien
taaccagtaaggccagatgtggtgg

SEQ ID NO: 473987 - DNA, 25 bp, Homo sapien
gcttgcggtgggctgagatcgcacc

SEQ ID NO: 473988 - DNA, 25 bp, Homo sapien
cttgcggtgggctgagatcgcacca

SEQ ID NO: 473989 - DNA, 25 bp, Homo sapien
ttgcggtgggctgagatcgcaccac

SEQ ID NO: 473990 - DNA, 25 bp, Homo sapien
tgcggtgggctgagatcgcaccact

SEQ ID NO: 473991 - DNA, 25 bp, Homo sapien
ctggggccaggcacctggctcacgc

SEQ ID NO: 473992 - DNA, 25 bp, Homo sapien
tggggccaggcacctggctcacgcc

SEQ ID NO: 473993 - DNA, 25 bp, Homo sapien
caggaggcggagcttgcggtgggct

SEQ ID NO: 473994 - DNA, 25 bp, Homo sapien
aggaggcggagcttgcggtgggctg

SEQ ID NO: 473995 - DNA, 25 bp, Homo sapien
ggaggcggagcttgcggtgggctga

SEQ ID NO: 473996 - DNA, 25 bp, Homo sapien
gaggcggagcttgcggtgggctgag

SEQ ID NO: 473997 - DNA, 25 bp, Homo sapien
agcttgcggtgggctgagatcgcac

SEQ ID NO: 473998 - DNA, 25 bp, Homo sapien
ataaaggaagttaagcatggcttgc

SEQ ID NO: 473999 - DNA, 25 bp, Homo sapien
aggaagttaagcatggcttgctaga

SEQ ID NO: 474000 - DNA, 25 bp, Homo sapien
agcatggcttgctagaagagtccca

SEQ ID NO: 474001 - DNA, 25 bp, Homo sapien
tagaagagtcccagcggtgctggtg

SEQ ID NO: 474002 - DNA, 25 bp, Homo sapien
gggaaaaggcacacctgtgccaaga

SEQ ID NO: 474003 - DNA, 25 bp, Homo sapien
gcacacctgtgccaagataagattt

SEQ ID NO: 474004 - DNA, 25 bp, Homo sapien
ctgtgccaagataagattttcctat

SEQ ID NO: 474005 - DNA, 25 bp, Homo sapien
attttcctatcttggatgagtggga

SEQ ID NO: 474006 - DNA, 25 bp, Homo sapien
cctatcttggatgagtgggaagttt

SEQ ID NO: 474007 - DNA, 25 bp, Homo sapien
ggaagcctaaatattagaacttatg

SEQ ID NO: 474008 - DNA, 25 bp, Homo sapien
agagttatgccttctaatgtattta

SEQ ID NO: 474009 - DNA, 25 bp, Homo sapien
gggtgcattcaggtcctttcagcca

SEQ ID NO: 474010 - DNA, 25 bp, Homo sapien
tgcattcaggtcctttcagccacat

SEQ ID NO: 474011 - DNA, 25 bp, Homo sapien
tttcagccacatcctgtgaggtctc

SEQ ID NO: 474012 - DNA, 25 bp, Homo sapien
atcctgtgaggtctcctgagggcca

SEQ ID NO: 474013 - DNA, 25 bp, Homo sapien
ggacacagatgagtcagccccgagc

SEQ ID NO: 474014 - DNA, 25 bp, Homo sapien
tgggagccccagtattcggagctgc

SEQ ID NO: 474015 - DNA, 25 bp, Homo sapien
agtattcggagctgcatgttctctg

SEQ ID NO: 474016 - DNA, 25 bp, Homo sapien
gcatgttctctggtgaggtgaccca

SEQ ID NO: 474017 - DNA, 25 bp, Homo sapien
ttctctggtgaggtgacccagggca

SEQ ID NO: 474018 - DNA, 25 bp, Homo sapien
gacccagggcattgtgaaagccttc

SEQ ID NO: 474019 - DNA, 25 bp, Homo sapien
ttcacagaggccagaggcggtggct

SEQ ID NO: 474020 - DNA, 25 bp, Homo sapien
ctagcaaacacacatggttacactg

SEQ ID NO: 474021 - DNA, 25 bp, Homo sapien
acacacatggttacactgctgtctg

SEQ ID NO: 474022 - DNA, 25 bp, Homo sapien
acatggttacactgctgtctgtcac

SEQ ID NO: 474023 - DNA, 25 bp, Homo sapien
gttacactgctgtctgtcactgtta

SEQ ID NO: 474024 - DNA, 25 bp, Homo sapien
cactgctgtctgtcactgttaatgg

SEQ ID NO: 474025 - DNA, 25 bp, Homo sapien
ctgtctgtcactgttaatggaaaac

SEQ ID NO: 474026 - DNA, 25 bp, Homo sapien
gtaaacttgtaatttgtcttgtatt

SEQ ID NO: 474027 - DNA, 25 bp, Homo sapien
tttgtcttgtatttggtggtaaaat

SEQ ID NO: 474028 - DNA, 25 bp, Homo sapien
gtatgaagtattttcctaggaaggg

SEQ ID NO: 474029 - DNA, 25 bp, Homo sapien
caaatctaaacttctgtttcagact

SEQ ID NO: 474030 - DNA, 25 bp, Homo sapien
ttctgtttcagactgttaagacact

SEQ ID NO: 474031 - DNA, 25 bp, Homo sapien
aaagatgcatctgtcttatccacta

SEQ ID NO: 474032 - DNA, 25 bp, Homo sapien
atgcatctgtcttatccactaccat

SEQ ID NO: 474033 - DNA, 25 bp, Homo sapien
actaccatgtcctaccacataatgt

SEQ ID NO: 474034 - DNA, 25 bp, Homo sapien
accacataatgtagtgtctggcact

SEQ ID NO: 474035 - DNA, 25 bp, Homo sapien
gtctggcactagttgaggcgtaata

SEQ ID NO: 474036 - DNA, 25 bp, Homo sapien
taataatgtagaaaggatcctcttc

SEQ ID NO: 474037 - DNA, 25 bp, Homo sapien
agtgttgttgaaagagcctcatcca

SEQ ID NO: 474038 - DNA, 25 bp, Homo sapien
tgaaagagcctcatccaggcaaata

SEQ ID NO: 474039 - DNA, 25 bp, Homo sapien
tacagacacaaagtaggcactgttt

SEQ ID NO: 474040 - DNA, 25 bp, Homo sapien
ggcactgtttgtttctgttaatttc

SEQ ID NO: 474041 - DNA, 25 bp, Homo sapien
gtgaaagaaagggagctagcagaca

SEQ ID NO: 474042 - DNA, 25 bp, Homo sapien
agtttctgcctcattgggaaatgga

SEQ ID NO: 474043 - DNA, 25 bp, Homo sapien
ggagaatcttcaccaatgccatgct

SEQ ID NO: 474044 - DNA, 25 bp, Homo sapien
cttcaccaatgccatgcttttctgt

SEQ ID NO: 474045 - DNA, 25 bp, Homo sapien
ttgaggtttaagacatttcactgca

SEQ ID NO: 474046 - DNA, 25 bp, Homo sapien
agctgttagccatcctgttttgtgt

SEQ ID NO: 474047 - DNA, 25 bp, Homo sapien
gttagccatcctgttttgtgtttaa

SEQ ID NO: 474048 - DNA, 25 bp, Homo sapien
taacaagaagtaatcccagtgggta

SEQ ID NO: 474049 - DNA, 25 bp, Homo sapien
gggtaattcccactaaacaagacag

SEQ ID NO: 474050 - DNA, 25 bp, Homo sapien
agacagaggtggtgcctgtcatcag

SEQ ID NO: 474051 - DNA, 25 bp, Homo sapien
gcctgtcatcaggaacttacattct

SEQ ID NO: 474052 - DNA, 25 bp, Homo sapien
tatcagatagtgtaactgtcctgaa

SEQ ID NO: 474053 - DNA, 25 bp, Homo sapien
tgaaatagaggcctctttctgtttg

SEQ ID NO: 474054 - DNA, 25 bp, Homo sapien
ttctggcttccaaataaatacattg

SEQ ID NO: 474055 - DNA, 25 bp, Homo sapien
ttggaaatcccaggagccgaagccc

SEQ ID NO: 474056 - DNA, 25 bp, Homo sapien
cgggccaccattttgctttgggatg

SEQ ID NO: 474057 - DNA, 25 bp, Homo sapien
gagacaccctaaacttgaactcctg

SEQ ID NO: 474058 - DNA, 25 bp, Homo sapien
taaacttgaactcctgtctgtgcag

SEQ ID NO: 474059 - DNA, 25 bp, Homo sapien
tccagccggccaggcgctaaataag

SEQ ID NO: 474060 - DNA, 25 bp, Homo sapien
ggcgctaaataaggccacggcccgt

SEQ ID NO: 474061 - DNA, 25 bp, Homo sapien
aagggcgatagcagaccccatcagg

SEQ ID NO: 474062 - DNA, 25 bp, Homo sapien
gaccccatcaggcaaaaagctgaga

SEQ ID NO: 474063 - DNA, 25 bp, Homo sapien
aaaagctgagaagccagggttgaaa

SEQ ID NO: 474064 - DNA, 25 bp, Homo sapien
cagccttgccactggagtggctatt

SEQ ID NO: 474065 - DNA, 25 bp, Homo sapien
gagtggctatttcatctcactgagc

SEQ ID NO: 474066 - DNA, 25 bp, Homo sapien
gcctatttctccttctgcaaattaa

SEQ ID NO: 474067 - DNA, 25 bp, Homo sapien
aaacgtatcccatgttggtgtcctg

SEQ ID NO: 474068 - DNA, 25 bp, Homo sapien
ttcttcctatcggtgtgtctagcac

SEQ ID NO: 474069 - DNA, 25 bp, Homo sapien
gtgtgtctagcaccaagactggcac

SEQ ID NO: 474070 - DNA, 25 bp, Homo sapien
gactggcacaaagaaccaacttctg

SEQ ID NO: 474071 - DNA, 25 bp, Homo sapien
acttctgaaaagacgctagccttat

SEQ ID NO: 474072 - DNA, 25 bp, Homo sapien
aagacgctagccttattaacgctat

SEQ ID NO: 474073 - DNA, 25 bp, Homo sapien
ttaacgctattatgattccttcctt

SEQ ID NO: 474074 - DNA, 25 bp, Homo sapien
cttccttcctttgaccaatgagcat

SEQ ID NO: 474075 - DNA, 25 bp, Homo sapien
gtgcgttgacaaagttctaggacct

SEQ ID NO: 474076 - DNA, 25 bp, Homo sapien
aggacctttggtaagctgcaccata

SEQ ID NO: 474077 - DNA, 25 bp, Homo sapien
gggtcaagtactggactctttcttc

SEQ ID NO: 474078 - DNA, 25 bp, Homo sapien
caggctgcttccctttgtaggagaa

SEQ ID NO: 474079 - DNA, 25 bp, Homo sapien
acgagggaagctctggtttcctgaa

SEQ ID NO: 474080 - DNA, 25 bp, Homo sapien
gtttcctgaagggattctttcacag

SEQ ID NO: 474081 - DNA, 25 bp, Homo sapien
aggacgtagcagagcctgcattcac

SEQ ID NO: 474082 - DNA, 25 bp, Homo sapien
ctgcattcaccttcctcatagaaga

SEQ ID NO: 474083 - DNA, 25 bp, Homo sapien
gagatttttggagcccaccagttgg

SEQ ID NO: 474084 - DNA, 25 bp, Homo sapien
agcccaccagttggtcctgaattat

SEQ ID NO: 474085 - DNA, 25 bp, Homo sapien
atttcctttgcatgtctttctttca

SEQ ID NO: 474086 - DNA, 25 bp, Homo sapien
tcccctaagccttatctgcacataa

SEQ ID NO: 474087 - DNA, 25 bp, Homo sapien
cccctaagccttatctgcacataaa

SEQ ID NO: 474088 - DNA, 25 bp, Homo sapien
ccctaagccttatctgcacataaac

SEQ ID NO: 474089 - DNA, 25 bp, Homo sapien
cctaagccttatctgcacataaact

SEQ ID NO: 474090 - DNA, 25 bp, Homo sapien
ctaagccttatctgcacataaactg

SEQ ID NO: 474091 - DNA, 25 bp, Homo sapien
taagccttatctgcacataaactgg

SEQ ID NO: 474092 - DNA, 25 bp, Homo sapien
aagccttatctgcacataaactggg

SEQ ID NO: 474093 - DNA, 25 bp, Homo sapien
gccttatctgcacataaactggggg

SEQ ID NO: 474094 - DNA, 25 bp, Homo sapien
ttatctgcacataaactgggggccg

SEQ ID NO: 474095 - DNA, 25 bp, Homo sapien
atctgcacataaactgggggccggg

SEQ ID NO: 474096 - DNA, 25 bp, Homo sapien
gtggtggagcacacctgttatccta

SEQ ID NO: 474097 - DNA, 25 bp, Homo sapien
aggccgggtgttgtgactcaaaata

SEQ ID NO: 474098 - DNA, 25 bp, Homo sapien
ggccgggtgttgtgactcaaaatac

SEQ ID NO: 474099 - DNA, 25 bp, Homo sapien
gccgggtgttgtgactcaaaatact

SEQ ID NO: 474100 - DNA, 25 bp, Homo sapien
gggtgttgtgactcaaaatactgta

SEQ ID NO: 474101 - DNA, 25 bp, Homo sapien
gttgtgactcaaaatactgtaatct

SEQ ID NO: 474102 - DNA, 25 bp, Homo sapien
gactcaaaatactgtaatctcagca

SEQ ID NO: 474103 - DNA, 25 bp, Homo sapien
gaggtttgcaaccagcctgagcaaa

SEQ ID NO: 474104 - DNA, 25 bp, Homo sapien
aaatggctagacataatggtgtgca

SEQ ID NO: 474105 - DNA, 25 bp, Homo sapien
cccagagtctgaggctgcggtaagc

SEQ ID NO: 474106 - DNA, 25 bp, Homo sapien
aggctgcggtaagctgtgttcgcac

SEQ ID NO: 474107 - DNA, 25 bp, Homo sapien
gcggtaagctgtgttcgcaccactg

SEQ ID NO: 474108 - DNA, 25 bp, Homo sapien
ttatgtaatctaaccagagcgctat

SEQ ID NO: 474109 - DNA, 25 bp, Homo sapien
aatctaaccagagcgctatggtggg

SEQ ID NO: 474110 - DNA, 25 bp, Homo sapien
gatatgaaactgtctaggcttgaat

SEQ ID NO: 474111 - DNA, 25 bp, Homo sapien
ggaatgatcatgttactacgaggaa

SEQ ID NO: 474112 - DNA, 25 bp, Homo sapien
aaatctaactacttttcatcttcag

SEQ ID NO: 474113 - DNA, 25 bp, Homo sapien
tacttttcatcttcagtctctgggt

SEQ ID NO: 474114 - DNA, 25 bp, Homo sapien
tctgggtctccctcagaagtagaca

SEQ ID NO: 474115 - DNA, 25 bp, Homo sapien
acaatattctggatgttgacggaga

SEQ ID NO: 474116 - DNA, 25 bp, Homo sapien
gatgttgacggagaacggctaccaa

SEQ ID NO: 474117 - DNA, 25 bp, Homo sapien
gacggagaacggctaccaacaccct

SEQ ID NO: 474118 - DNA, 25 bp, Homo sapien
ttctgggcaaattctccaacccttt

SEQ ID NO: 474119 - DNA, 25 bp, Homo sapien
ctcaactaacatttctagcactttc

SEQ ID NO: 474120 - DNA, 25 bp, Homo sapien
agcactttcagagaatattattcat

SEQ ID NO: 474121 - DNA, 25 bp, Homo sapien
gtgttttgtgtgaaacttcacatca

SEQ ID NO: 474122 - DNA, 25 bp, Homo sapien
cttcacatcaagtattttatgcctt

SEQ ID NO: 474123 - DNA, 25 bp, Homo sapien
tatgccttaactttttgtgattctt

SEQ ID NO: 474124 - DNA, 25 bp, Homo sapien
cctgtgttttctctgttcaagtgaa

SEQ ID NO: 474125 - DNA, 25 bp, Homo sapien
gaacacatcagtaggatcagtgatt

SEQ ID NO: 474126 - DNA, 25 bp, Homo sapien
cagtgatttgtcatgcacagacaca

SEQ ID NO: 474127 - DNA, 25 bp, Homo sapien
agacacagcacataactccacattt

SEQ ID NO: 474128 - DNA, 25 bp, Homo sapien
taactccacatttcaggtaacagct

SEQ ID NO: 474129 - DNA, 25 bp, Homo sapien
tcaggtaacagctctttttgtgtgt

SEQ ID NO: 474130 - DNA, 25 bp, Homo sapien
tggcttgcagttttcagggaccagc

SEQ ID NO: 474131 - DNA, 25 bp, Homo sapien
agttttcagggaccagctgagccgc

SEQ ID NO: 474132 - DNA, 25 bp, Homo sapien
gctgagccgcgctaggattaggata

SEQ ID NO: 474133 - DNA, 25 bp, Homo sapien
gccgcgctaggattaggataagtta

SEQ ID NO: 474134 - DNA, 25 bp, Homo sapien
gctgacaaaaatgtggcaatggaaa

SEQ ID NO: 474135 - DNA, 25 bp, Homo sapien
taagaagacttctgaaatacccaga

SEQ ID NO: 474136 - DNA, 25 bp, Homo sapien
tgtagagtattattgggccatgttc

SEQ ID NO: 474137 - DNA, 25 bp, Homo sapien
tgggccatgttcaatacttatttct

SEQ ID NO: 474138 - DNA, 25 bp, Homo sapien
tttctttcatcaccaggtaaaaatc

SEQ ID NO: 474139 - DNA, 25 bp, Homo sapien
attttattccttaaggcatcataaa

SEQ ID NO: 474140 - DNA, 25 bp, Homo sapien
atcataaaatttgatagacccaggg

SEQ ID NO: 474141 - DNA, 25 bp, Homo sapien
gtgaaggtatcctgagcagctgatg

SEQ ID NO: 474142 - DNA, 25 bp, Homo sapien
tcctgagcagctgatgtaacatgtg

SEQ ID NO: 474143 - DNA, 25 bp, Homo sapien
tgtaacatgtgtagcttgtttttac

SEQ ID NO: 474144 - DNA, 25 bp, Homo sapien
tccagtcagagaaagctaaccgaaa

SEQ ID NO: 474145 - DNA, 25 bp, Homo sapien
gaaagctaaccgaaacacactatgt

SEQ ID NO: 474146 - DNA, 25 bp, Homo sapien
accgaaacacactatgtcattattt

SEQ ID NO: 474147 - DNA, 25 bp, Homo sapien
tttccttgtcctcatttgaagcctt

SEQ ID NO: 474148 - DNA, 25 bp, Homo sapien
ccttgtcctcatttgaagccttcta

SEQ ID NO: 474149 - DNA, 25 bp, Homo sapien
gaagccttctataatttatctttac

SEQ ID NO: 474150 - DNA, 25 bp, Homo sapien
tctatttcccaattcttattttctt

SEQ ID NO: 474151 - DNA, 25 bp, Homo sapien
gatctaaaatgttctctactgtgta

SEQ ID NO: 474152 - DNA, 25 bp, Homo sapien
ggaattctcagatggttgcaagtca

SEQ ID NO: 474153 - DNA, 25 bp, Homo sapien
attctcagatggttgcaagtcattt

SEQ ID NO: 474154 - DNA, 25 bp, Homo sapien
atggttgcaagtcatttgaggtccc

SEQ ID NO: 474155 - DNA, 25 bp, Homo sapien
gttgcaagtcatttgaggtcccaga

SEQ ID NO: 474156 - DNA, 25 bp, Homo sapien
tgcaagtcatttgaggtcccagaag

SEQ ID NO: 474157 - DNA, 25 bp, Homo sapien
agtcatttgaggtcccagaagtcca

SEQ ID NO: 474158 - DNA, 25 bp, Homo sapien
atttgaggtcccagaagtccagcat

SEQ ID NO: 474159 - DNA, 25 bp, Homo sapien
tgaggtcccagaagtccagcataga

SEQ ID NO: 474160 - DNA, 25 bp, Homo sapien
aggtcccagaagtccagcatagaga

SEQ ID NO: 474161 - DNA, 25 bp, Homo sapien
gtcccagaagtccagcatagagata

SEQ ID NO: 474162 - DNA, 25 bp, Homo sapien
ccagcatagagatagggagattgtg

SEQ ID NO: 474163 - DNA, 25 bp, Homo sapien
gagtctcagtggtgcattaaggaac

SEQ ID NO: 474164 - DNA, 25 bp, Homo sapien
aaataaactggcacttctctgcctc

SEQ ID NO: 474165 - DNA, 25 bp, Homo sapien
tctctgcctcaagaagcatagcttg

SEQ ID NO: 474166 - DNA, 25 bp, Homo sapien
ccagcaggacaggtgattatgtgtg

SEQ ID NO: 474167 - DNA, 25 bp, Homo sapien
gattatgtgtggatggcgccacctt

SEQ ID NO: 474168 - DNA, 25 bp, Homo sapien
ggcgccaccttggacactgaaatgg

SEQ ID NO: 474169 - DNA, 25 bp, Homo sapien
atgggaacacaggaactgctgctcc

SEQ ID NO: 474170 - DNA, 25 bp, Homo sapien
aacacaggaactgctgctcctggtg

SEQ ID NO: 474171 - DNA, 25 bp, Homo sapien
tgctcctggtgtcccaagagtgcag

SEQ ID NO: 474172 - DNA, 25 bp, Homo sapien
aagagtgcaggacacccggctccca

SEQ ID NO: 474173 - DNA, 25 bp, Homo sapien
ggctcccagcgaactgagccaaaat

SEQ ID NO: 474174 - DNA, 25 bp, Homo sapien
taaaataagcgctacttcaggagga

SEQ ID NO: 474175 - DNA, 25 bp, Homo sapien
ataagcgctacttcaggaggagaaa

SEQ ID NO: 474176 - DNA, 25 bp, Homo sapien
gaacacatggatgcattgcagggaa

SEQ ID NO: 474177 - DNA, 25 bp, Homo sapien
ggatgcattgcagggaacaacacac

SEQ ID NO: 474178 - DNA, 25 bp, Homo sapien
acacactgggacttgtcggtagcgg

SEQ ID NO: 474179 - DNA, 25 bp, Homo sapien
tgcagtaaaccaccttggcacacag

SEQ ID NO: 474180 - DNA, 25 bp, Homo sapien
cagtaaaccaccttggcacacagtt

SEQ ID NO: 474181 - DNA, 25 bp, Homo sapien
gtaaaccaccttggcacacagttac

SEQ ID NO: 474182 - DNA, 25 bp, Homo sapien
aaccaccttggcacacagttacctg

SEQ ID NO: 474183 - DNA, 25 bp, Homo sapien
accttggcacacagttacctgtgta

SEQ ID NO: 474184 - DNA, 25 bp, Homo sapien
aaacctatacatcctgcacaggtac

SEQ ID NO: 474185 - DNA, 25 bp, Homo sapien
gaaccacaagtgcagaggccctaag

SEQ ID NO: 474186 - DNA, 25 bp, Homo sapien
gaggccctaaggtaagaagcagctt

SEQ ID NO: 474187 - DNA, 25 bp, Homo sapien
ttgatatttgaggaatggcagtgcc

SEQ ID NO: 474188 - DNA, 25 bp, Homo sapien
gggccatgcctgtgtgtgatgtaac

SEQ ID NO: 474189 - DNA, 25 bp, Homo sapien
gtaacggtcacaaacacttcttcac

SEQ ID NO: 474190 - DNA, 25 bp, Homo sapien
acttcttcacccaggttttacagca

SEQ ID NO: 474191 - DNA, 25 bp, Homo sapien
gcagaagggaactggtactccgaca

SEQ ID NO: 474192 - DNA, 25 bp, Homo sapien
ggtactccgacaagttccaaatgag

SEQ ID NO: 474193 - DNA, 25 bp, Homo sapien
gcagaagaatgtccgtatctctcct

SEQ ID NO: 474194 - DNA, 25 bp, Homo sapien
tatctctcctcttgtttgttccctt

SEQ ID NO: 474195 - DNA, 25 bp, Homo sapien
tgtttgttcccttcgtcagtttgtt

SEQ ID NO: 474196 - DNA, 25 bp, Homo sapien
aagtgggtctggagctaggattcga

SEQ ID NO: 474197 - DNA, 25 bp, Homo sapien
aatgtttggcggatgaaggcacaga

SEQ ID NO: 474198 - DNA, 25 bp, Homo sapien
acttgctgatcttgggctgtgccag

SEQ ID NO: 474199 - DNA, 25 bp, Homo sapien
ctgatcttgggctgtgccaggtgtt

SEQ ID NO: 474200 - DNA, 25 bp, Homo sapien
tctgggatacagagcctgcgagagc

SEQ ID NO: 474201 - DNA, 25 bp, Homo sapien
acagagcctgcgagagctaggttga

SEQ ID NO: 474202 - DNA, 25 bp, Homo sapien
taggttgagagctccagggagtcac

SEQ ID NO: 474203 - DNA, 25 bp, Homo sapien
gggagtcactgcgactacttccttg

SEQ ID NO: 474204 - DNA, 25 bp, Homo sapien
ttccttgctccatttgtgaactgag

SEQ ID NO: 474205 - DNA, 25 bp, Homo sapien
gtgaactgagaagtaagactcgttt

SEQ ID NO: 474206 - DNA, 25 bp, Homo sapien
gtaagactcgtttgatggacgaaat

SEQ ID NO: 474207 - DNA, 25 bp, Homo sapien
ccttcacattcctccattttattat

SEQ ID NO: 474208 - DNA, 25 bp, Homo sapien
cattcctccattttattatttgcag

SEQ ID NO: 474209 - DNA, 25 bp, Homo sapien
tgcaggatagcaatgataggattca

SEQ ID NO: 474210 - DNA, 25 bp, Homo sapien
ggattcatatttacctcactggatt

SEQ ID NO: 474211 - DNA, 25 bp, Homo sapien
acctcactggatttttatgagactt

SEQ ID NO: 474212 - DNA, 25 bp, Homo sapien
atgagacttaaaagaccaaatgctt

SEQ ID NO: 474213 - DNA, 25 bp, Homo sapien
aagggctaggatctttatttttatg

SEQ ID NO: 474214 - DNA, 25 bp, Homo sapien
gagcacaggagagtttttggaaagt

SEQ ID NO: 474215 - DNA, 25 bp, Homo sapien
tatttgtcaaaacctacagtgcttg

SEQ ID NO: 474216 - DNA, 25 bp, Homo sapien
acagtgcttgactatagtcccagat

SEQ ID NO: 474217 - DNA, 25 bp, Homo sapien
atacttgggagatcgtttgagtcca

SEQ ID NO: 474218 - DNA, 25 bp, Homo sapien
gatttgtatcaagctcattttctca

SEQ ID NO: 474219 - DNA, 25 bp, Homo sapien
atagtagcagccattctcctaaatt

SEQ ID NO: 474220 - DNA, 25 bp, Homo sapien
ttttgtgtccttagcatcttgtacc

SEQ ID NO: 474221 - DNA, 25 bp, Homo sapien
ttagcatcttgtaccatctctggca

SEQ ID NO: 474222 - DNA, 25 bp, Homo sapien
atctctggcacatggtaaattctcg

SEQ ID NO: 474223 - DNA, 25 bp, Homo sapien
aattctcgtgactgaaccctagtac

SEQ ID NO: 474224 - DNA, 25 bp, Homo sapien
tgaaccctagtacagcattgtgaag

SEQ ID NO: 474225 - DNA, 25 bp, Homo sapien
aatttttccttgtgtgtctttcatc

SEQ ID NO: 474226 - DNA, 25 bp, Homo sapien
gtctttcatcagaatggttcacgct

SEQ ID NO: 474227 - DNA, 25 bp, Homo sapien
tggttcacgctgtactatagttatt

SEQ ID NO: 474228 - DNA, 25 bp, Homo sapien
agttattactactctgtttcttcta

SEQ ID NO: 474229 - DNA, 25 bp, Homo sapien
tgtatctggctttgtctcccctaga

SEQ ID NO: 474230 - DNA, 25 bp, Homo sapien
gtctcccctagactagggaatcctg

SEQ ID NO: 474231 - DNA, 25 bp, Homo sapien
agggaatcctggaatattgggcctg

SEQ ID NO: 474232 - DNA, 25 bp, Homo sapien
ggctcatcattacagtgcccaggga

SEQ ID NO: 474233 - DNA, 25 bp, Homo sapien
cagggaggacaccaaaggcattgat

SEQ ID NO: 474234 - DNA, 25 bp, Homo sapien
attgatgagtagacagaaattccct

SEQ ID NO: 474235 - DNA, 25 bp, Homo sapien
agcaaacaccaaggcccagtctgga

SEQ ID NO: 474236 - DNA, 25 bp, Homo sapien
accaaggcccagtctggaagccagg

SEQ ID NO: 474237 - DNA, 25 bp, Homo sapien
tctggaagccaggagcaaccaggga

SEQ ID NO: 474238 - DNA, 25 bp, Homo sapien
agagcataggcagccaggccgcaga

SEQ ID NO: 474239 - DNA, 25 bp, Homo sapien
gccaggccgcagaaaggcaggacat

SEQ ID NO: 474240 - DNA, 25 bp, Homo sapien
agatgatctgcccactttagcctcc

SEQ ID NO: 474241 - DNA, 25 bp, Homo sapien
ccagcccatgctcaggtttaactaa

SEQ ID NO: 474242 - DNA, 25 bp, Homo sapien
cagcccatgctcaggtttaactaag

SEQ ID NO: 474243 - DNA, 25 bp, Homo sapien
agcccatgctcaggtttaactaagc

SEQ ID NO: 474244 - DNA, 25 bp, Homo sapien
gcccatgctcaggtttaactaagca

SEQ ID NO: 474245 - DNA, 25 bp, Homo sapien
ccatgctcaggtttaactaagcaca

SEQ ID NO: 474246 - DNA, 25 bp, Homo sapien
atgctcaggtttaactaagcacatt

SEQ ID NO: 474247 - DNA, 25 bp, Homo sapien
gctcaggtttaactaagcacattta

SEQ ID NO: 474248 - DNA, 25 bp, Homo sapien
ctcaggtttaactaagcacatttat

SEQ ID NO: 474249 - DNA, 25 bp, Homo sapien
caggtttaactaagcacatttatta

SEQ ID NO: 474250 - DNA, 25 bp, Homo sapien
ggtttaactaagcacatttattatt

SEQ ID NO: 474251 - DNA, 25 bp, Homo sapien
tttttcttcctacaaatcaaatttg

SEQ ID NO: 474252 - DNA, 25 bp, Homo sapien
gtttatgtacgtgtttcttacctgt

SEQ ID NO: 474253 - DNA, 25 bp, Homo sapien
gtacgtgtttcttacctgttacaat

SEQ ID NO: 474254 - DNA, 25 bp, Homo sapien
tgtataaataactagcaggcaggca

SEQ ID NO: 474255 - DNA, 25 bp, Homo sapien
caggcaggcagctgtctactcaaat

SEQ ID NO: 474256 - DNA, 25 bp, Homo sapien
gtctactcaaataggctgaacattt

SEQ ID NO: 474257 - DNA, 25 bp, Homo sapien
tgaacatttttctagcacaaggcca

SEQ ID NO: 474258 - DNA, 25 bp, Homo sapien
tttctagcacaaggccatgagatct

SEQ ID NO: 474259 - DNA, 25 bp, Homo sapien
ggccatgagatctgggtgaatttca

SEQ ID NO: 474260 - DNA, 25 bp, Homo sapien
agatgtgattctaactctgggccat

SEQ ID NO: 474261 - DNA, 25 bp, Homo sapien
tgattctaactctgggccatgagac

SEQ ID NO: 474262 - DNA, 25 bp, Homo sapien
aagagctggtagtttctaaaggata

SEQ ID NO: 474263 - DNA, 25 bp, Homo sapien
ctaaaggatattcttacttggcaaa

SEQ ID NO: 474264 - DNA, 25 bp, Homo sapien
aggatattcttacttggcaaaataa

SEQ ID NO: 474265 - DNA, 25 bp, Homo sapien
cagtcttatgttattctgccttcaa

SEQ ID NO: 474266 - DNA, 25 bp, Homo sapien
attctgccttcaaatttgaaacagt

SEQ ID NO: 474267 - DNA, 25 bp, Homo sapien
acactgttaagccatcattgcaaag

SEQ ID NO: 474268 - DNA, 25 bp, Homo sapien
gaagatagtgagaagtccaccctct

SEQ ID NO: 474269 - DNA, 25 bp, Homo sapien
gatagtgagaagtccaccctctgag

SEQ ID NO: 474270 - DNA, 25 bp, Homo sapien
agtgagaagtccaccctctgagggt

SEQ ID NO: 474271 - DNA, 25 bp, Homo sapien
agaagtccaccctctgagggttcct

SEQ ID NO: 474272 - DNA, 25 bp, Homo sapien
ctctgagggttcctcttgccacttg

SEQ ID NO: 474273 - DNA, 25 bp, Homo sapien
agtgttccattattgctatgggctg

SEQ ID NO: 474274 - DNA, 25 bp, Homo sapien
gtgttccattattgctatgggctgg

SEQ ID NO: 474275 - DNA, 25 bp, Homo sapien
gttccattattgctatgggctgggc

SEQ ID NO: 474276 - DNA, 25 bp, Homo sapien
ttccattattgctatgggctgggcg

SEQ ID NO: 474277 - DNA, 25 bp, Homo sapien
tccattattgctatgggctgggcgt

SEQ ID NO: 474278 - DNA, 25 bp, Homo sapien
ggtcccagcaactagggaggatgaa

SEQ ID NO: 474279 - DNA, 25 bp, Homo sapien
atagcaccattgcacaatctaaact

SEQ ID NO: 474280 - DNA, 25 bp, Homo sapien
agcaccattgcacaatctaaactgg

SEQ ID NO: 474281 - DNA, 25 bp, Homo sapien
gcaccattgcacaatctaaactggg

SEQ ID NO: 474282 - DNA, 25 bp, Homo sapien
cattgcacaatctaaactgggccac

SEQ ID NO: 474283 - DNA, 25 bp, Homo sapien
attgcacaatctaaactgggccaca

SEQ ID NO: 474284 - DNA, 25 bp, Homo sapien
tctactttgtctcttaatgttatgc

SEQ ID NO: 474285 - DNA, 25 bp, Homo sapien
ctactttgtctcttaatgttatgcc

SEQ ID NO: 474286 - DNA, 25 bp, Homo sapien
gggttaaataaaactcatcgatgag

SEQ ID NO: 474287 - DNA, 25 bp, Homo sapien
ctcatcgatgagaatttataatttg

SEQ ID NO: 474288 - DNA, 25 bp, Homo sapien
aattagaatttagtcctcaacacac

SEQ ID NO: 474289 - DNA, 25 bp, Homo sapien
attagaatttagtcctcaacacacc

SEQ ID NO: 474290 - DNA, 25 bp, Homo sapien
ttagaatttagtcctcaacacacca

SEQ ID NO: 474291 - DNA, 25 bp, Homo sapien
tagaatttagtcctcaacacaccac

SEQ ID NO: 474292 - DNA, 25 bp, Homo sapien
agaatttagtcctcaacacaccaca

SEQ ID NO: 474293 - DNA, 25 bp, Homo sapien
gaatttagtcctcaacacaccacac

SEQ ID NO: 474294 - DNA, 25 bp, Homo sapien
aatttagtcctcaacacaccacaca

SEQ ID NO: 474295 - DNA, 25 bp, Homo sapien
ggatttagcttgcaacttgataaat

SEQ ID NO: 474296 - DNA, 25 bp, Homo sapien
gatttagcttgcaacttgataaata

SEQ ID NO: 474297 - DNA, 25 bp, Homo sapien
atttagcttgcaacttgataaataa

SEQ ID NO: 474298 - DNA, 25 bp, Homo sapien
gataaataaaggtacttgaggctgg

SEQ ID NO: 474299 - DNA, 25 bp, Homo sapien
ataaataaaggtacttgaggctggg

SEQ ID NO: 474300 - DNA, 25 bp, Homo sapien
aataaaggtacttgaggctgggtgt

SEQ ID NO: 474301 - DNA, 25 bp, Homo sapien
cagaaggctgatatatgagaatagc

SEQ ID NO: 474302 - DNA, 25 bp, Homo sapien
gaaggctgatatatgagaatagctt

SEQ ID NO: 474303 - DNA, 25 bp, Homo sapien
ggctgatatatgagaatagcttaaa

SEQ ID NO: 474304 - DNA, 25 bp, Homo sapien
ctgatatatgagaatagcttaaacc

SEQ ID NO: 474305 - DNA, 25 bp, Homo sapien
gatatatgagaatagcttaaaccca

SEQ ID NO: 474306 - DNA, 25 bp, Homo sapien
tttctgaggatctggcttaagtaat

SEQ ID NO: 474307 - DNA, 25 bp, Homo sapien
gggaccttatcagtgtatcctgcgc

SEQ ID NO: 474308 - DNA, 25 bp, Homo sapien
gtgtatcctgcgctttgcactccag

SEQ ID NO: 474309 - DNA, 25 bp, Homo sapien
tgcactccagcctcttgatgctttt

SEQ ID NO: 474310 - DNA, 25 bp, Homo sapien
tgatgcttttctgtgggactgggaa

SEQ ID NO: 474311 - DNA, 25 bp, Homo sapien
tgggactgggaaatgggccttccat

SEQ ID NO: 474312 - DNA, 25 bp, Homo sapien
tgggccttccattgtatgtctctga

SEQ ID NO: 474313 - DNA, 25 bp, Homo sapien
gtatgtctctgacggaagaaccatg

SEQ ID NO: 474314 - DNA, 25 bp, Homo sapien
aagaaccatgtcatccttgcaggga

SEQ ID NO: 474315 - DNA, 25 bp, Homo sapien
tgcagggatccgagtcttagaccaa

SEQ ID NO: 474316 - DNA, 25 bp, Homo sapien
ttagaccaagtgtcgggctctgctg

SEQ ID NO: 474317 - DNA, 25 bp, Homo sapien
gaccccatactgtgttcatgctgaa

SEQ ID NO: 474318 - DNA, 25 bp, Homo sapien
ttcatgctgaaaatccggaacacca

SEQ ID NO: 474319 - DNA, 25 bp, Homo sapien
ggaacaccagtaatcctcctgtgga

SEQ ID NO: 474320 - DNA, 25 bp, Homo sapien
agtaatcctcctgtggaccagcaga

SEQ ID NO: 474321 - DNA, 25 bp, Homo sapien
tgtggaccagcagacagcccaacag

SEQ ID NO: 474322 - DNA, 25 bp, Homo sapien
gcagacagcccaacagaagcacatg

SEQ ID NO: 474323 - DNA, 25 bp, Homo sapien
aagcacatgggcatgagcaggcaca

SEQ ID NO: 474324 - DNA, 25 bp, Homo sapien
gaaatgctgccgtgcttttaacact

SEQ ID NO: 474325 - DNA, 25 bp, Homo sapien
tgcttttaacactcctgacagactg

SEQ ID NO: 474326 - DNA, 25 bp, Homo sapien
ttaacactcctgacagactgcacat

SEQ ID NO: 474327 - DNA, 25 bp, Homo sapien
tgaatcccgcaaatgctgggaccca

SEQ ID NO: 474328 - DNA, 25 bp, Homo sapien
atatgaatcggactattttgactag

SEQ ID NO: 474329 - DNA, 25 bp, Homo sapien
gaatcggactattttgactagtgaa

SEQ ID NO: 474330 - DNA, 25 bp, Homo sapien
actagtgaatattttatcaagtcaa

SEQ ID NO: 474331 - DNA, 25 bp, Homo sapien
ttccaagtcctaccttaacgttcat

SEQ ID NO: 474332 - DNA, 25 bp, Homo sapien
gtcctaccttaacgttcattgttct

SEQ ID NO: 474333 - DNA, 25 bp, Homo sapien
gagttactaaaatccgtcaaacaca

SEQ ID NO: 474334 - DNA, 25 bp, Homo sapien
atgacggataatttttgatgctggt

SEQ ID NO: 474335 - DNA, 25 bp, Homo sapien
tttttgatgctggtggaagggatat

SEQ ID NO: 474336 - DNA, 25 bp, Homo sapien
cttggagtcctcagcagagaaataa

SEQ ID NO: 474337 - DNA, 25 bp, Homo sapien
tcagcagagaaataactggtctcag

SEQ ID NO: 474338 - DNA, 25 bp, Homo sapien
tggtctcagaaatagctttaattaa

SEQ ID NO: 474339 - DNA, 25 bp, Homo sapien
ttaaagacatagcatttttgggctg

SEQ ID NO: 474340 - DNA, 25 bp, Homo sapien
taaagacatagcatttttgggctga

SEQ ID NO: 474341 - DNA, 25 bp, Homo sapien
aaagacatagcatttttgggctgag

SEQ ID NO: 474342 - DNA, 25 bp, Homo sapien
aagacatagcatttttgggctgagt

SEQ ID NO: 474343 - DNA, 25 bp, Homo sapien
agacatagcatttttgggctgagtg

SEQ ID NO: 474344 - DNA, 25 bp, Homo sapien
gacatagcatttttgggctgagtgc

SEQ ID NO: 474345 - DNA, 25 bp, Homo sapien
acatagcatttttgggctgagtgcg

SEQ ID NO: 474346 - DNA, 25 bp, Homo sapien
catagcatttttgggctgagtgcgg

SEQ ID NO: 474347 - DNA, 25 bp, Homo sapien
atagcatttttgggctgagtgcggt

SEQ ID NO: 474348 - DNA, 25 bp, Homo sapien
tagcatttttgggctgagtgcggtg

SEQ ID NO: 474349 - DNA, 25 bp, Homo sapien
agcatttttgggctgagtgcggtgg

SEQ ID NO: 474350 - DNA, 25 bp, Homo sapien
aaacatcgttggctttctgacgtcc

SEQ ID NO: 474351 - DNA, 25 bp, Homo sapien
ggctttctgacgtccaaagaataca

SEQ ID NO: 474352 - DNA, 25 bp, Homo sapien
atacacacagccgtgttattccatt

SEQ ID NO: 474353 - DNA, 25 bp, Homo sapien
gccgtgttattccattttccatcaa

SEQ ID NO: 474354 - DNA, 25 bp, Homo sapien
tttccatcaaggtttgttttacaat

SEQ ID NO: 474355 - DNA, 25 bp, Homo sapien
gttttacaatattttcagggtcact

SEQ ID NO: 474356 - DNA, 25 bp, Homo sapien
gtaacaactttctgctggaccattt

SEQ ID NO: 474357 - DNA, 25 bp, Homo sapien
actttctgctggaccatttcatgta

SEQ ID NO: 474358 - DNA, 25 bp, Homo sapien
catttcatgtaaggcttggagctct

SEQ ID NO: 474359 - DNA, 25 bp, Homo sapien
ttttccccatacagatagtcccagt

SEQ ID NO: 474360 - DNA, 25 bp, Homo sapien
agatagtcccagtcttctttcttac

SEQ ID NO: 474361 - DNA, 25 bp, Homo sapien
aataatgctggatctcgtatgccta

SEQ ID NO: 474362 - DNA, 25 bp, Homo sapien
gatctcgtatgcctagctagcattc

SEQ ID NO: 474363 - DNA, 25 bp, Homo sapien
agctagcattcaggagacttgacaa

SEQ ID NO: 474364 - DNA, 25 bp, Homo sapien
atcagatttaatattcaggaccagt

SEQ ID NO: 474365 - DNA, 25 bp, Homo sapien
aggaccagtttgactgtgagtctgt

SEQ ID NO: 474366 - DNA, 25 bp, Homo sapien
gactgtgagtctgtgggaataaaca

SEQ ID NO: 474367 - DNA, 25 bp, Homo sapien
acaggtccaagcaatttggtgttct

SEQ ID NO: 474368 - DNA, 25 bp, Homo sapien
gtgttctgcacaccacagaagaatg

SEQ ID NO: 474369 - DNA, 25 bp, Homo sapien
tgaccattttatctgtgggcacctc

SEQ ID NO: 474370 - DNA, 25 bp, Homo sapien
tatctgtgggcacctcttctttttc

SEQ ID NO: 474371 - DNA, 25 bp, Homo sapien
gggccattcccttaattccagagaa

SEQ ID NO: 474372 - DNA, 25 bp, Homo sapien
gcccagccactttggcatcttttaa

SEQ ID NO: 474373 - DNA, 25 bp, Homo sapien
cagccactttggcatcttttaatgc

SEQ ID NO: 474374 - DNA, 25 bp, Homo sapien
ttaatgcccaatccttatttgcctt

SEQ ID NO: 474375 - DNA, 25 bp, Homo sapien
tgccttttcctgattttctcaagaa

SEQ ID NO: 474376 - DNA, 25 bp, Homo sapien
tttatatagctgtacccccttatct

SEQ ID NO: 474377 - DNA, 25 bp, Homo sapien
gtgtatgttccgagatcctgtggat

SEQ ID NO: 474378 - DNA, 25 bp, Homo sapien
agatcctgtggatgccgtgaaacca

SEQ ID NO: 474379 - DNA, 25 bp, Homo sapien
gaaaccacagataatgccgagccct

SEQ ID NO: 474380 - DNA, 25 bp, Homo sapien
acagataatgccgagcccttgtata

SEQ ID NO: 474381 - DNA, 25 bp, Homo sapien
atgccgagcccttgtatactatatt

SEQ ID NO: 474382 - DNA, 25 bp, Homo sapien
gagcccttgtatactatattttttc

SEQ ID NO: 474383 - DNA, 25 bp, Homo sapien
cacaaatagagaaagcaaatgcagg

SEQ ID NO: 474384 - DNA, 25 bp, Homo sapien
acaaatagagaaagcaaatgcaggc

SEQ ID NO: 474385 - DNA, 25 bp, Homo sapien
caaatagagaaagcaaatgcaggct

SEQ ID NO: 474386 - DNA, 25 bp, Homo sapien
aaatagagaaagcaaatgcaggctg

SEQ ID NO: 474387 - DNA, 25 bp, Homo sapien
aatagagaaagcaaatgcaggctgg

SEQ ID NO: 474388 - DNA, 25 bp, Homo sapien
agagaaagcaaatgcaggctgggca

SEQ ID NO: 474389 - DNA, 25 bp, Homo sapien
gagaaagcaaatgcaggctgggcac

SEQ ID NO: 474390 - DNA, 25 bp, Homo sapien
aagcaaatgcaggctgggcacggtt

SEQ ID NO: 474391 - DNA, 25 bp, Homo sapien
agcaaatgcaggctgggcacggttg

SEQ ID NO: 474392 - DNA, 25 bp, Homo sapien
caaatgcaggctgggcacggttgct

SEQ ID NO: 474393 - DNA, 25 bp, Homo sapien
gttagctggatgtagtggcgggcgc

SEQ ID NO: 474394 - DNA, 25 bp, Homo sapien
atcacatttaatgccttcacacgcg

SEQ ID NO: 474395 - DNA, 25 bp, Homo sapien
gtcactgtcaatcccagcaaaccta

SEQ ID NO: 474396 - DNA, 25 bp, Homo sapien
gcaaacctaacagctgccaaattgg

SEQ ID NO: 474397 - DNA, 25 bp, Homo sapien
tttatgagtctccaagaacagtcga

SEQ ID NO: 474398 - DNA, 25 bp, Homo sapien
gaacagtcgaatcagcactaacaga

SEQ ID NO: 474399 - DNA, 25 bp, Homo sapien
gcactaacagaacagctatcgaagg

SEQ ID NO: 474400 - DNA, 25 bp, Homo sapien
tatcgaagggctgcttggctacctg

SEQ ID NO: 474401 - DNA, 25 bp, Homo sapien
tggctggctgggatttctcaaaagt

SEQ ID NO: 474402 - DNA, 25 bp, Homo sapien
agtgacaacccggacattcgtcttg

SEQ ID NO: 474403 - DNA, 25 bp, Homo sapien
tcgtcttgccggctggctcgaatgc

SEQ ID NO: 474404 - DNA, 25 bp, Homo sapien
tggctcgaatgccaccaacgtgaca

SEQ ID NO: 474405 - DNA, 25 bp, Homo sapien
tgctcaacgaaaaaatgaaaaccca

SEQ ID NO: 474406 - DNA, 25 bp, Homo sapien
gctcaacgaaaaaatgaaaacccag

SEQ ID NO: 474407 - DNA, 25 bp, Homo sapien
tcaacgaaaaaatgaaaacccagtg

SEQ ID NO: 474408 - DNA, 25 bp, Homo sapien
gaaaaaatgaaaacccagtggctca

SEQ ID NO: 474409 - DNA, 25 bp, Homo sapien
aaaatgaaaacccagtggctcacgc

SEQ ID NO: 474410 - DNA, 25 bp, Homo sapien
aaatgaaaacccagtggctcacgcc

SEQ ID NO: 474411 - DNA, 25 bp, Homo sapien
aatgaaaacccagtggctcacgcct

SEQ ID NO: 474412 - DNA, 25 bp, Homo sapien
tagctgggtatggtggcttacgcct

SEQ ID NO: 474413 - DNA, 25 bp, Homo sapien
agctgggtatggtggcttacgccta

SEQ ID NO: 474414 - DNA, 25 bp, Homo sapien
gctgggtatggtggcttacgcctat

SEQ ID NO: 474415 - DNA, 25 bp, Homo sapien
gggtatggtggcttacgcctataat

SEQ ID NO: 474416 - DNA, 25 bp, Homo sapien
gtccctgacccactgagattagcag

SEQ ID NO: 474417 - DNA, 25 bp, Homo sapien
ttagcaggtcacctaatccatcttc

SEQ ID NO: 474418 - DNA, 25 bp, Homo sapien
ttgaactccactgggcccttactgg

SEQ ID NO: 474419 - DNA, 25 bp, Homo sapien
cttactggcctgcttgacagctcca

SEQ ID NO: 474420 - DNA, 25 bp, Homo sapien
gacagctccacttggatttctggta

SEQ ID NO: 474421 - DNA, 25 bp, Homo sapien
tctggtattcttctggcattctttc

SEQ ID NO: 474422 - DNA, 25 bp, Homo sapien
ttctggcattctttctgacctttac

SEQ ID NO: 474423 - DNA, 25 bp, Homo sapien
tttctgacctttacccaccaaactg

SEQ ID NO: 474424 - DNA, 25 bp, Homo sapien
aaactgctcctctcacaatttctgc

SEQ ID NO: 474425 - DNA, 25 bp, Homo sapien
aattattagcatatcctgttggttc

SEQ ID NO: 474426 - DNA, 25 bp, Homo sapien
atatcctgttggttctatgtttaaa

SEQ ID NO: 474427 - DNA, 25 bp, Homo sapien
tgaataattgtctgcatttatcttt

SEQ ID NO: 474428 - DNA, 25 bp, Homo sapien
atttatcttttatctgtccttccag

SEQ ID NO: 474429 - DNA, 25 bp, Homo sapien
atcttttatctgtccttccaggagc

SEQ ID NO: 474430 - DNA, 25 bp, Homo sapien
ccaggagctctgacaagtactaaat

SEQ ID NO: 474431 - DNA, 25 bp, Homo sapien
gtagtcagttctggtatgccatgtt

SEQ ID NO: 474432 - DNA, 25 bp, Homo sapien
ggtatgccatgttgaagtaaatttc

SEQ ID NO: 474433 - DNA, 25 bp, Homo sapien
tatcactgccagaatattgccttgc

SEQ ID NO: 474434 - DNA, 25 bp, Homo sapien
tgccagaatattgccttgctttttt

SEQ ID NO: 474435 - DNA, 25 bp, Homo sapien
taaggacgtccagggtaaggtcaag

SEQ ID NO: 474436 - DNA, 25 bp, Homo sapien
gagaatgaccggctgaaatgaacct

SEQ ID NO: 474437 - DNA, 25 bp, Homo sapien
tgaaatgaacctaagctgagcaatg

SEQ ID NO: 474438 - DNA, 25 bp, Homo sapien
tataataaaagctttatggctgggc

SEQ ID NO: 474439 - DNA, 25 bp, Homo sapien
ataataaaagctttatggctgggca

SEQ ID NO: 474440 - DNA, 25 bp, Homo sapien
taataaaagctttatggctgggcac

SEQ ID NO: 474441 - DNA, 25 bp, Homo sapien
aataaaagctttatggctgggcaca

SEQ ID NO: 474442 - DNA, 25 bp, Homo sapien
ataaaagctttatggctgggcacag

SEQ ID NO: 474443 - DNA, 25 bp, Homo sapien
taaaagctttatggctgggcacagt

SEQ ID NO: 474444 - DNA, 25 bp, Homo sapien
tagcgagtcgtctctacaaataatt

SEQ ID NO: 474445 - DNA, 25 bp, Homo sapien
ttgtatcactgtactccaccatgag

SEQ ID NO: 474446 - DNA, 25 bp, Homo sapien
tgtatcactgtactccaccatgagt

SEQ ID NO: 474447 - DNA, 25 bp, Homo sapien
gtatcactgtactccaccatgagtg

SEQ ID NO: 474448 - DNA, 25 bp, Homo sapien
tatcactgtactccaccatgagtga

SEQ ID NO: 474449 - DNA, 25 bp, Homo sapien
aggctgttcagtttctctcattcat

SEQ ID NO: 474450 - DNA, 25 bp, Homo sapien
gtttctctcattcatgatttcctgt

SEQ ID NO: 474451 - DNA, 25 bp, Homo sapien
ttcctgtaaactggaagttaggcca

SEQ ID NO: 474452 - DNA, 25 bp, Homo sapien
gttaggccagaagtttgaagtctat

SEQ ID NO: 474453 - DNA, 25 bp, Homo sapien
gaagtctattagttcagttaatctt

SEQ ID NO: 474454 - DNA, 25 bp, Homo sapien
gagaaagtcagtgtcatcttcgcag

SEQ ID NO: 474455 - DNA, 25 bp, Homo sapien
gtcagtgtcatcttcgcagagtgat

SEQ ID NO: 474456 - DNA, 25 bp, Homo sapien
catcttcgcagagtgatttttctta

SEQ ID NO: 474457 - DNA, 25 bp, Homo sapien
ggaaggtgacacttgtcaacttctg

SEQ ID NO: 474458 - DNA, 25 bp, Homo sapien
gacacttgtcaacttctgattagag

SEQ ID NO: 474459 - DNA, 25 bp, Homo sapien
ctgattagagtctcttccttatttt

SEQ ID NO: 474460 - DNA, 25 bp, Homo sapien
agttgtgagctaaatgctttaaaat

SEQ ID NO: 474461 - DNA, 25 bp, Homo sapien
gtgttaacaagatgtagaactccat

SEQ ID NO: 474462 - DNA, 25 bp, Homo sapien
gatgtagaactccatcttatgaatg

SEQ ID NO: 474463 - DNA, 25 bp, Homo sapien
atgtagaactccatcttatgaatgg

SEQ ID NO: 474464 - DNA, 25 bp, Homo sapien
actccatcttatgaatggaaactat

SEQ ID NO: 474465 - DNA, 25 bp, Homo sapien
gaaccaaatgcaaattctagaatca

SEQ ID NO: 474466 - DNA, 25 bp, Homo sapien
aatgctgaagtatgcattcattctg

SEQ ID NO: 474467 - DNA, 25 bp, Homo sapien
acatgaatgccccaagagaagtaaa

SEQ ID NO: 474468 - DNA, 25 bp, Homo sapien
atgaatgccccaagagaagtaaaga

SEQ ID NO: 474469 - DNA, 25 bp, Homo sapien
gaatgccccaagagaagtaaagaag

SEQ ID NO: 474470 - DNA, 25 bp, Homo sapien
aaagaagaatgcttctagcaccatt

SEQ ID NO: 474471 - DNA, 25 bp, Homo sapien
tcctccatgctcttgagcaggtgga

SEQ ID NO: 474472 - DNA, 25 bp, Homo sapien
gtgctctgtggtggcgcatgattca

SEQ ID NO: 474473 - DNA, 25 bp, Homo sapien
ggtggcgcatgattcactgagcaaa

SEQ ID NO: 474474 - DNA, 25 bp, Homo sapien
tgattcactgagcaaacagcacttt

SEQ ID NO: 474475 - DNA, 25 bp, Homo sapien
attttgtaatatgtgtgtccagcgg

SEQ ID NO: 474476 - DNA, 25 bp, Homo sapien
aatatgtgtgtccagcgggattgac

SEQ ID NO: 474477 - DNA, 25 bp, Homo sapien
gtccagcgggattgacactcaaaaa

SEQ ID NO: 474478 - DNA, 25 bp, Homo sapien
tccttacctttgtatctcctttaca

SEQ ID NO: 474479 - DNA, 25 bp, Homo sapien
ttgtatctcctttacatcatgagag

SEQ ID NO: 474480 - DNA, 25 bp, Homo sapien
tcatgagagatcaaaaatccatttt

SEQ ID NO: 474481 - DNA, 25 bp, Homo sapien
aatccattttgccttacatatgcta

SEQ ID NO: 474482 - DNA, 25 bp, Homo sapien
acaaaatcctccaagctaaacaagc

SEQ ID NO: 474483 - DNA, 25 bp, Homo sapien
agctaaacaagcatgctctaaccca

SEQ ID NO: 474484 - DNA, 25 bp, Homo sapien
gctaaacaagcatgctctaacccaa

SEQ ID NO: 474485 - DNA, 25 bp, Homo sapien
taaacaagcatgctctaacccaatg

SEQ ID NO: 474486 - DNA, 25 bp, Homo sapien
aaacaagcatgctctaacccaatgc

SEQ ID NO: 474487 - DNA, 25 bp, Homo sapien
aacaagcatgctctaacccaatgca

SEQ ID NO: 474488 - DNA, 25 bp, Homo sapien
acaagcatgctctaacccaatgcaa

SEQ ID NO: 474489 - DNA, 25 bp, Homo sapien
gatgaagctgaaaacacagcccaag

SEQ ID NO: 474490 - DNA, 25 bp, Homo sapien
gaagctgaaaacacagcccaagaat

SEQ ID NO: 474491 - DNA, 25 bp, Homo sapien
gctgaaaacacagcccaagaatttc

SEQ ID NO: 474492 - DNA, 25 bp, Homo sapien
gctgaattgatcaagtgaaagaaag

SEQ ID NO: 474493 - DNA, 25 bp, Homo sapien
attcttcaatcccttttggaatcca

SEQ ID NO: 474494 - DNA, 25 bp, Homo sapien
tggaatccacaaacttgttatgaac

SEQ ID NO: 474495 - DNA, 25 bp, Homo sapien
acattacattctgataaaaaggcca

SEQ ID NO: 474496 - DNA, 25 bp, Homo sapien
ttctaccaaggtatgcaactttatc

SEQ ID NO: 474497 - DNA, 25 bp, Homo sapien
aggtatgcaactttatctgaaatca

SEQ ID NO: 474498 - DNA, 25 bp, Homo sapien
atctgaaatcagagccaccttatgc

SEQ ID NO: 474499 - DNA, 25 bp, Homo sapien
gccaccttatgcagaattctgtact

SEQ ID NO: 474500 - DNA, 25 bp, Homo sapien
ataacagctcacacaaattattgac

SEQ ID NO: 474501 - DNA, 25 bp, Homo sapien
aattattgactacttcttgcccagt

SEQ ID NO: 474502 - DNA, 25 bp, Homo sapien
ttcttgcccagtcagtacattcatc

SEQ ID NO: 474503 - DNA, 25 bp, Homo sapien
gtacattcatctaacaaagcaattt

SEQ ID NO: 474504 - DNA, 25 bp, Homo sapien
taaaaagggctaatagctgagcatg

SEQ ID NO: 474505 - DNA, 25 bp, Homo sapien
gctgggtggtgtggtatggcctgtg

SEQ ID NO: 474506 - DNA, 25 bp, Homo sapien
cagaagtctgaggtggaaggtttgc

SEQ ID NO: 474507 - DNA, 25 bp, Homo sapien
gtggaaggtttgcttgggcctaggg

SEQ ID NO: 474508 - DNA, 25 bp, Homo sapien
ggtcaaggctgcacaagccttggtg

SEQ ID NO: 474509 - DNA, 25 bp, Homo sapien
aaggctgcacaagccttggtgttgt

SEQ ID NO: 474510 - DNA, 25 bp, Homo sapien
gctgcacaagccttggtgttgtgcc

SEQ ID NO: 474511 - DNA, 25 bp, Homo sapien
acaagccttggtgttgtgccactgt

SEQ ID NO: 474512 - DNA, 25 bp, Homo sapien
caagccttggtgttgtgccactgta

SEQ ID NO: 474513 - DNA, 25 bp, Homo sapien
aagccttggtgttgtgccactgtac

SEQ ID NO: 474514 - DNA, 25 bp, Homo sapien
gtactccaatccgggcaacatagtg

SEQ ID NO: 474515 - DNA, 25 bp, Homo sapien
ggagagaaaacccagacttctactt

SEQ ID NO: 474516 - DNA, 25 bp, Homo sapien
cagacttctacttttactgttgggt

SEQ ID NO: 474517 - DNA, 25 bp, Homo sapien
gttgggtacacagccggtagcaaat

SEQ ID NO: 474518 - DNA, 25 bp, Homo sapien
atggtaagtttttccccaatgactg

SEQ ID NO: 474519 - DNA, 25 bp, Homo sapien
gtttttccccaatgactgtatcaac

SEQ ID NO: 474520 - DNA, 25 bp, Homo sapien
atacctccccttacctatgtaatca

SEQ ID NO: 474521 - DNA, 25 bp, Homo sapien
ttgattatccttcagtatatctggg

SEQ ID NO: 474522 - DNA, 25 bp, Homo sapien
gggtgaatccttacagtagatgtta

SEQ ID NO: 474523 - DNA, 25 bp, Homo sapien
gatgttatccaatatcttgttttat

SEQ ID NO: 474524 - DNA, 25 bp, Homo sapien
cacagacgtgtgctagtttggatgc

SEQ ID NO: 474525 - DNA, 25 bp, Homo sapien
gtttggatgcatttatcagattctg

SEQ ID NO: 474526 - DNA, 25 bp, Homo sapien
gtagatcctggaaggctctatctcc

SEQ ID NO: 474527 - DNA, 25 bp, Homo sapien
tggaaggctctatctcctccaacca

SEQ ID NO: 474528 - DNA, 25 bp, Homo sapien
aaccaatcagaaagctgccctgacc

SEQ ID NO: 474529 - DNA, 25 bp, Homo sapien
gggattatgaactcagcacaaattg

SEQ ID NO: 474530 - DNA, 25 bp, Homo sapien
acaaattgctctttccccgtgaatt

SEQ ID NO: 474531 - DNA, 25 bp, Homo sapien
ccgtgaattcccatgcacctagtaa

SEQ ID NO: 474532 - DNA, 25 bp, Homo sapien
atgcacctagtaaccctgcactaag

SEQ ID NO: 474533 - DNA, 25 bp, Homo sapien
gtaaccctgcactaagagagcagtg

SEQ ID NO: 474534 - DNA, 25 bp, Homo sapien
gggcaagtttggacatgaactcaaa

SEQ ID NO: 474535 - DNA, 25 bp, Homo sapien
gggttgtgttttcattagcttgcct

SEQ ID NO: 474536 - DNA, 25 bp, Homo sapien
tatattctgtgagatttccttcccc

SEQ ID NO: 474537 - DNA, 25 bp, Homo sapien
gatacaaatgctggatgatatagaa

SEQ ID NO: 474538 - DNA, 25 bp, Homo sapien
atagaagtggtttcttagtaatcac

SEQ ID NO: 474539 - DNA, 25 bp, Homo sapien
aagtggtttcttagtaatcactagt

SEQ ID NO: 474540 - DNA, 25 bp, Homo sapien
taaactgttaaattcacggaagcat

SEQ ID NO: 474541 - DNA, 25 bp, Homo sapien
taaattcacggaagcatacccagcc

SEQ ID NO: 474542 - DNA, 25 bp, Homo sapien
aggaattaccaagaaagcaaagcac

SEQ ID NO: 474543 - DNA, 25 bp, Homo sapien
gcacagaactccctcagaaactgga

SEQ ID NO: 474544 - DNA, 25 bp, Homo sapien
gaaaactctttatcaccatgtaatc

SEQ ID NO: 474545 - DNA, 25 bp, Homo sapien
actctttatcaccatgtaatcctgt

SEQ ID NO: 474546 - DNA, 25 bp, Homo sapien
gtaatcctgtacaatcacaagcact

SEQ ID NO: 474547 - DNA, 25 bp, Homo sapien
aatcctgtacaatcacaagcacttc

SEQ ID NO: 474548 - DNA, 25 bp, Homo sapien
taggtagagttttggtgaacagaat

SEQ ID NO: 474549 - DNA, 25 bp, Homo sapien
gaacagaattagttatgtagcctct

SEQ ID NO: 474550 - DNA, 25 bp, Homo sapien
acagaattagttatgtagcctctct

SEQ ID NO: 474551 - DNA, 25 bp, Homo sapien
agaattagttatgtagcctctctag

SEQ ID NO: 474552 - DNA, 25 bp, Homo sapien
gaattagttatgtagcctctctagc

SEQ ID NO: 474553 - DNA, 25 bp, Homo sapien
aattagttatgtagcctctctagcc

SEQ ID NO: 474554 - DNA, 25 bp, Homo sapien
attagttatgtagcctctctagcct

SEQ ID NO: 474555 - DNA, 25 bp, Homo sapien
tagttatgtagcctctctagcctca

SEQ ID NO: 474556 - DNA, 25 bp, Homo sapien
agtttccccactcaacggcagttgg

SEQ ID NO: 474557 - DNA, 25 bp, Homo sapien
gtttccccactcaacggcagttggg

SEQ ID NO: 474558 - DNA, 25 bp, Homo sapien
aatgcataaaaagtgcttggcctgg

SEQ ID NO: 474559 - DNA, 25 bp, Homo sapien
gtcacacagcggctgacacatattc

SEQ ID NO: 474560 - DNA, 25 bp, Homo sapien
gacacatattcaggcacatggctat

SEQ ID NO: 474561 - DNA, 25 bp, Homo sapien
acatggctattctttgcggctctcg

SEQ ID NO: 474562 - DNA, 25 bp, Homo sapien
tttgcggctctcgtacaaggtgggt

SEQ ID NO: 474563 - DNA, 25 bp, Homo sapien
aaggtgggtggctacgttcagcttt

SEQ ID NO: 474564 - DNA, 25 bp, Homo sapien
tacgttcagctttttctagaggaca

SEQ ID NO: 474565 - DNA, 25 bp, Homo sapien
ctagaggacattgttccaaagctgt

SEQ ID NO: 474566 - DNA, 25 bp, Homo sapien
gttccaaagctgtcaaccaacaaat

SEQ ID NO: 474567 - DNA, 25 bp, Homo sapien
atttctgtgttcagctatgtaaaac

SEQ ID NO: 474568 - DNA, 25 bp, Homo sapien
aactgttggtgatcctattggcttt

SEQ ID NO: 474569 - DNA, 25 bp, Homo sapien
atcctattggctttgttttgtgaca

SEQ ID NO: 474570 - DNA, 25 bp, Homo sapien
gatctgacaatatacttgccttcca

SEQ ID NO: 474571 - DNA, 25 bp, Homo sapien
tatacttgccttccaaatgtcacta

SEQ ID NO: 474572 - DNA, 25 bp, Homo sapien
aatgtcactattaatctttccccca

SEQ ID NO: 474573 - DNA, 25 bp, Homo sapien
tcagaacagcaaaatcactccatgg

SEQ ID NO: 474574 - DNA, 25 bp, Homo sapien
aaatcactccatggctgtttctaga

SEQ ID NO: 474575 - DNA, 25 bp, Homo sapien
ctccatggctgtttctagacatata

SEQ ID NO: 474576 - DNA, 25 bp, Homo sapien
aaacacaagacactgttgttagcat

SEQ ID NO: 474577 - DNA, 25 bp, Homo sapien
gttagcattgatattcacaagatgg

SEQ ID NO: 474578 - DNA, 25 bp, Homo sapien
taacagcaacttgttggctcactcc

SEQ ID NO: 474579 - DNA, 25 bp, Homo sapien
ggctcactccctctatgtctagatt

SEQ ID NO: 474580 - DNA, 25 bp, Homo sapien
ctatgtctagattatcacctgaaga

SEQ ID NO: 474581 - DNA, 25 bp, Homo sapien
aaatacagggttagcttccacgcct

SEQ ID NO: 474582 - DNA, 25 bp, Homo sapien
gtcatccaaccaatacatatttttg

SEQ ID NO: 474583 - DNA, 25 bp, Homo sapien
gtttttatctacagacaccttgttt

SEQ ID NO: 474584 - DNA, 25 bp, Homo sapien
gacaccttgtttaatatacgtttct

SEQ ID NO: 474585 - DNA, 25 bp, Homo sapien
tacgtttcttaccaatagttaactg

SEQ ID NO: 474586 - DNA, 25 bp, Homo sapien
tttacctggaagagtcatggccttg

SEQ ID NO: 474587 - DNA, 25 bp, Homo sapien
gtgcaggaagcatagctgtgatgca

SEQ ID NO: 474588 - DNA, 25 bp, Homo sapien
gatgcaagaagcatggccttggtga

SEQ ID NO: 474589 - DNA, 25 bp, Homo sapien
gtgagtgctggagtatgttctctaa

SEQ ID NO: 474590 - DNA, 25 bp, Homo sapien
gatactgtgaacactattagcccat

SEQ ID NO: 474591 - DNA, 25 bp, Homo sapien
actattagcccatactgaaccactg

SEQ ID NO: 474592 - DNA, 25 bp, Homo sapien
caagaactgccagggggagcacttc

SEQ ID NO: 474593 - DNA, 25 bp, Homo sapien
ctgacccacaaaatcctgagtgatg

SEQ ID NO: 474594 - DNA, 25 bp, Homo sapien
tcctgagtgatgtacaatggttgct

SEQ ID NO: 474595 - DNA, 25 bp, Homo sapien
gagtgatgtacaatggttgcttgaa

SEQ ID NO: 474596 - DNA, 25 bp, Homo sapien
tacaatggttgcttgaagctgccaa

SEQ ID NO: 474597 - DNA, 25 bp, Homo sapien
caatggttgcttgaagctgccaagt

SEQ ID NO: 474598 - DNA, 25 bp, Homo sapien
atggttgcttgaagctgccaagttt

SEQ ID NO: 474599 - DNA, 25 bp, Homo sapien
tagggtaacttattatacaacatag

SEQ ID NO: 474600 - DNA, 25 bp, Homo sapien
tacaacatagtaaccagagtgctta

SEQ ID NO: 474601 - DNA, 25 bp, Homo sapien
aacatagtaaccagagtgcttacct

SEQ ID NO: 474602 - DNA, 25 bp, Homo sapien
tcccttgccactggccggaacacag

SEQ ID NO: 474603 - DNA, 25 bp, Homo sapien
gtgagtcctactagactaataggct

SEQ ID NO: 474604 - DNA, 25 bp, Homo sapien
aggctaatacggcaactctgttcca

SEQ ID NO: 474605 - DNA, 25 bp, Homo sapien
aactctgttccacataatcctatca

SEQ ID NO: 474606 - DNA, 25 bp, Homo sapien
tgttccacataatcctatcacccta

SEQ ID NO: 474607 - DNA, 25 bp, Homo sapien
tatcaccctactatccaggcaagta

SEQ ID NO: 474608 - DNA, 25 bp, Homo sapien
aggcaagtagtccttgtcctcagga

SEQ ID NO: 474609 - DNA, 25 bp, Homo sapien
tgtcctcaggattcaaaatgcaagc

SEQ ID NO: 474610 - DNA, 25 bp, Homo sapien
gaggtacaccagctgtctcttaaag

SEQ ID NO: 474611 - DNA, 25 bp, Homo sapien
tgtctcttaaagaaggctcctgcaa

SEQ ID NO: 474612 - DNA, 25 bp, Homo sapien
aagaaggctcctgcaatctacacat

SEQ ID NO: 474613 - DNA, 25 bp, Homo sapien
atctacacatcatcatttacttata

SEQ ID NO: 474614 - DNA, 25 bp, Homo sapien
agatgagtagagtaatagttggctt

SEQ ID NO: 474615 - DNA, 25 bp, Homo sapien
gatgagtagagtaatagttggcttt

SEQ ID NO: 474616 - DNA, 25 bp, Homo sapien
atgagtagagtaatagttggctttt

SEQ ID NO: 474617 - DNA, 25 bp, Homo sapien
tgagtagagtaatagttggcttttt

SEQ ID NO: 474618 - DNA, 25 bp, Homo sapien
ggtgtgtaccaccactccgagctat

SEQ ID NO: 474619 - DNA, 25 bp, Homo sapien
gtgtgtaccaccactccgagctatt

SEQ ID NO: 474620 - DNA, 25 bp, Homo sapien
tgtgtaccaccactccgagctattt

SEQ ID NO: 474621 - DNA, 25 bp, Homo sapien
gtgtaccaccactccgagctatttt

SEQ ID NO: 474622 - DNA, 25 bp, Homo sapien
tgtaccaccactccgagctattttt

SEQ ID NO: 474623 - DNA, 25 bp, Homo sapien
gtaccaccactccgagctatttttt

SEQ ID NO: 474624 - DNA, 25 bp, Homo sapien
caccactccgagctatttttttgtt

SEQ ID NO: 474625 - DNA, 25 bp, Homo sapien
tttaacattatgatattctggctgg

SEQ ID NO: 474626 - DNA, 25 bp, Homo sapien
ttaacattatgatattctggctggg

SEQ ID NO: 474627 - DNA, 25 bp, Homo sapien
taacattatgatattctggctgggc

SEQ ID NO: 474628 - DNA, 25 bp, Homo sapien
aacattatgatattctggctgggca

SEQ ID NO: 474629 - DNA, 25 bp, Homo sapien
acattatgatattctggctgggcac

SEQ ID NO: 474630 - DNA, 25 bp, Homo sapien
cattatgatattctggctgggcaca

SEQ ID NO: 474631 - DNA, 25 bp, Homo sapien
attatgatattctggctgggcacag

SEQ ID NO: 474632 - DNA, 25 bp, Homo sapien
caagaccctgtgtctctataaaaaa

SEQ ID NO: 474633 - DNA, 25 bp, Homo sapien
aaaataaaaagttgagccaggcatg

SEQ ID NO: 474634 - DNA, 25 bp, Homo sapien
gctactgagaagactgaggcaggca

SEQ ID NO: 474635 - DNA, 25 bp, Homo sapien
actgagaagactgaggcaggcagat

SEQ ID NO: 474636 - DNA, 25 bp, Homo sapien
aaaaagcaaagcaagccctgcttat

SEQ ID NO: 474637 - DNA, 25 bp, Homo sapien
caagccctgcttataagtactccta

SEQ ID NO: 474638 - DNA, 25 bp, Homo sapien
tataagtactcctaaccccacatga

SEQ ID NO: 474639 - DNA, 25 bp, Homo sapien
gggctccgtatctgtgagatggaca

SEQ ID NO: 474640 - DNA, 25 bp, Homo sapien
gtgagatggacacctcctcagcaga

SEQ ID NO: 474641 - DNA, 25 bp, Homo sapien
tcttcagagcaagctcaggagtgct

SEQ ID NO: 474642 - DNA, 25 bp, Homo sapien
gagcaagctcaggagtgctgctcag

SEQ ID NO: 474643 - DNA, 25 bp, Homo sapien
gtgctgctcagcatgtgatctgtgt

SEQ ID NO: 474644 - DNA, 25 bp, Homo sapien
atgtgatctgtgtaccattggcatc

SEQ ID NO: 474645 - DNA, 25 bp, Homo sapien
gtaccattggcatcagtcactgcag

SEQ ID NO: 474646 - DNA, 25 bp, Homo sapien
tcactgcagaactagggaaggcctc

SEQ ID NO: 474647 - DNA, 25 bp, Homo sapien
acaagtcactcttccggtgaggtac

SEQ ID NO: 474648 - DNA, 25 bp, Homo sapien
tgaggtactattgatgctgcagaca

SEQ ID NO: 474649 - DNA, 25 bp, Homo sapien
ttttccccaccaaggcaatcaggta

SEQ ID NO: 474650 - DNA, 25 bp, Homo sapien
gcaatcaggtatatcccatgggccc

SEQ ID NO: 474651 - DNA, 25 bp, Homo sapien
gaagagcatccttattaccatccac

SEQ ID NO: 474652 - DNA, 25 bp, Homo sapien
cttattaccatccacctgagactgg

SEQ ID NO: 474653 - DNA, 25 bp, Homo sapien
agactggccagtgttgccctaagaa

SEQ ID NO: 474654 - DNA, 25 bp, Homo sapien
gtgtgtatacattagtcctgaggga

SEQ ID NO: 474655 - DNA, 25 bp, Homo sapien
tcctgagggatcactaacttagact

SEQ ID NO: 474656 - DNA, 25 bp, Homo sapien
taacttagactttcctcagatcaag

SEQ ID NO: 474657 - DNA, 25 bp, Homo sapien
tgaagagggccctgaccacaacctt

SEQ ID NO: 474658 - DNA, 25 bp, Homo sapien
ccttattagaactttgcagtgtatg

SEQ ID NO: 474659 - DNA, 25 bp, Homo sapien
gaactttgcagtgtatgtgtaccct

SEQ ID NO: 474660 - DNA, 25 bp, Homo sapien
gcagtgtatgtgtacccttaatata

SEQ ID NO: 474661 - DNA, 25 bp, Homo sapien
taatgaatgtttagttccccaaaag

SEQ ID NO: 474662 - DNA, 25 bp, Homo sapien
atttttggtaaattcctgtgatacg

SEQ ID NO: 474663 - DNA, 25 bp, Homo sapien
tggtaaattcctgtgatacgtaatt

SEQ ID NO: 474664 - DNA, 25 bp, Homo sapien
atagtaatgatagcctctgatattt

SEQ ID NO: 474665 - DNA, 25 bp, Homo sapien
taatgatagcctctgatattttttg

SEQ ID NO: 474666 - DNA, 25 bp, Homo sapien
ttgcagtttcacaatagactttttc

SEQ ID NO: 474667 - DNA, 25 bp, Homo sapien
gtttcacaatagactttttcttcct

SEQ ID NO: 474668 - DNA, 25 bp, Homo sapien
caatagactttttcttccttattag

SEQ ID NO: 474669 - DNA, 25 bp, Homo sapien
gcggtgaaactactctgtgtgatat

SEQ ID NO: 474670 - DNA, 25 bp, Homo sapien
tacactggcggatgcatgtcactgt

SEQ ID NO: 474671 - DNA, 25 bp, Homo sapien
atgtcactgtgcacttgtccagacc

SEQ ID NO: 474672 - DNA, 25 bp, Homo sapien
agacccacagaatgtgcactccgaa

SEQ ID NO: 474673 - DNA, 25 bp, Homo sapien
gcactccgaagtgtgaaccctcgta

SEQ ID NO: 474674 - DNA, 25 bp, Homo sapien
gaaccctcgtatggactatgaactc

SEQ ID NO: 474675 - DNA, 25 bp, Homo sapien
gacatgtccgtgtagggtcatcagt

SEQ ID NO: 474676 - DNA, 25 bp, Homo sapien
agggtcatcagttacacatgtacca

SEQ ID NO: 474677 - DNA, 25 bp, Homo sapien
acatgtaccagtctgatgtgggatg

SEQ ID NO: 474678 - DNA, 25 bp, Homo sapien
tggtagtaagggaccctgtgcctgt

SEQ ID NO: 474679 - DNA, 25 bp, Homo sapien
gtgggaactctgtacttctactcac

SEQ ID NO: 474680 - DNA, 25 bp, Homo sapien
taacatctccattttgctactaaag

SEQ ID NO: 474681 - DNA, 25 bp, Homo sapien
ttgctactaaagaaactgggaggtc

SEQ ID NO: 474682 - DNA, 25 bp, Homo sapien
taacatggaggaggtcacacagcta

SEQ ID NO: 474683 - DNA, 25 bp, Homo sapien
acagctagttagcatagggaccagg

SEQ ID NO: 474684 - DNA, 25 bp, Homo sapien
atagggaccaggtgtcaactttggg

SEQ ID NO: 474685 - DNA, 25 bp, Homo sapien
aaagccaggcttttgactactctca

SEQ ID NO: 474686 - DNA, 25 bp, Homo sapien
ggcttttgactactctcatatacta

SEQ ID NO: 474687 - DNA, 25 bp, Homo sapien
atatactaagtctggcgtatcccct

SEQ ID NO: 474688 - DNA, 25 bp, Homo sapien
tttcccgagggatttattctgttct

SEQ ID NO: 474689 - DNA, 25 bp, Homo sapien
ggatttattctgttctgcatttcat

SEQ ID NO: 474690 - DNA, 25 bp, Homo sapien
taaatctgaaacataccaactctac

SEQ ID NO: 474691 - DNA, 25 bp, Homo sapien
agcactgatccctatgaccttaatg

SEQ ID NO: 474692 - DNA, 25 bp, Homo sapien
gaccttaatgataacccagtgcgat

SEQ ID NO: 474693 - DNA, 25 bp, Homo sapien
gatgtcgactcaggaaacctttcta

SEQ ID NO: 474694 - DNA, 25 bp, Homo sapien
aaacctttctagtccagggcacatg

SEQ ID NO: 474695 - DNA, 25 bp, Homo sapien
aaaacacattcatctggtcggacat

SEQ ID NO: 474696 - DNA, 25 bp, Homo sapien
ggtcggacattttccatactctgat

SEQ ID NO: 474697 - DNA, 25 bp, Homo sapien
ttttatctttcttggcatgctcaac

SEQ ID NO: 474698 - DNA, 25 bp, Homo sapien
gcatgctcaactctcctttaataaa

SEQ ID NO: 474699 - DNA, 25 bp, Homo sapien
aaagtcacaaccctttgtagccatg

SEQ ID NO: 474700 - DNA, 25 bp, Homo sapien
aatcagacacggagcctgttactat

SEQ ID NO: 474701 - DNA, 25 bp, Homo sapien
tgttactatgacttccctgcagata

SEQ ID NO: 474702 - DNA, 25 bp, Homo sapien
gatacaaatgctggatgatatagaa

SEQ ID NO: 474703 - DNA, 25 bp, Homo sapien
gaagtggtttcttagtaatcactag

SEQ ID NO: 474704 - DNA, 25 bp, Homo sapien
gcagattctcttctattcaacagtg

SEQ ID NO: 474705 - DNA, 25 bp, Homo sapien
taaactgttaaattcacggaagcat

SEQ ID NO: 474706 - DNA, 25 bp, Homo sapien
taaattcacggaagcatacccagcc

SEQ ID NO: 474707 - DNA, 25 bp, Homo sapien
aggaattaccaagaaagcaaagcac

SEQ ID NO: 474708 - DNA, 25 bp, Homo sapien
gcacagaactccctcagaaactgga

SEQ ID NO: 474709 - DNA, 25 bp, Homo sapien
aactccctcagaaactggaggagcc

SEQ ID NO: 474710 - DNA, 25 bp, Homo sapien
gaaaactctttatcaccatgtaatc

SEQ ID NO: 474711 - DNA, 25 bp, Homo sapien
actctttatcaccatgtaatcctgt

SEQ ID NO: 474712 - DNA, 25 bp, Homo sapien
gtaatcctgtacaatcacaagcact

SEQ ID NO: 474713 - DNA, 25 bp, Homo sapien
gtttcattttcttaacaatgacagc

SEQ ID NO: 474714 - DNA, 25 bp, Homo sapien
tcattttcttaacaatgacagcaca

SEQ ID NO: 474715 - DNA, 25 bp, Homo sapien
tgaaagtctttgaagggaatatcct

SEQ ID NO: 474716 - DNA, 25 bp, Homo sapien
gaaagtctttgaagggaatatccta

SEQ ID NO: 474717 - DNA, 25 bp, Homo sapien
gtctttgaagggaatatcctaaaag

SEQ ID NO: 474718 - DNA, 25 bp, Homo sapien
tatcctaaaaggtactaaagtagag

SEQ ID NO: 474719 - DNA, 25 bp, Homo sapien
ctaaagtagaggttttaccagcctg

SEQ ID NO: 474720 - DNA, 25 bp, Homo sapien
taaagtagaggttttaccagcctgg

SEQ ID NO: 474721 - DNA, 25 bp, Homo sapien
ttagccaagtaaggtggtgcttgcc

SEQ ID NO: 474722 - DNA, 25 bp, Homo sapien
tagccaagtaaggtggtgcttgcct

SEQ ID NO: 474723 - DNA, 25 bp, Homo sapien
agccaagtaaggtggtgcttgcctg

SEQ ID NO: 474724 - DNA, 25 bp, Homo sapien
tgagcagtagcaacccatgaaatgg

SEQ ID NO: 474725 - DNA, 25 bp, Homo sapien
gtcagggttttgatgcacaggacaa

SEQ ID NO: 474726 - DNA, 25 bp, Homo sapien
attgggagggtcctcctggccacat

SEQ ID NO: 474727 - DNA, 25 bp, Homo sapien
ctggccacatctgcggtttagactt

SEQ ID NO: 474728 - DNA, 25 bp, Homo sapien
ggtttagacttccacacttcttaga

SEQ ID NO: 474729 - DNA, 25 bp, Homo sapien
ttcttagagaactgctctcaccctc

SEQ ID NO: 474730 - DNA, 25 bp, Homo sapien
ctcattctactctccactagtgaat

SEQ ID NO: 474731 - DNA, 25 bp, Homo sapien
gatatgtctggtgcaatctactatg

SEQ ID NO: 474732 - DNA, 25 bp, Homo sapien
atctactatgctaagtgcactacac

SEQ ID NO: 474733 - DNA, 25 bp, Homo sapien
tgcactacacatactccccatttaa

SEQ ID NO: 474734 - DNA, 25 bp, Homo sapien
tttaactctcacagcaccatgtggg

SEQ ID NO: 474735 - DNA, 25 bp, Homo sapien
aaataaaatttatggcctggcacag

SEQ ID NO: 474736 - DNA, 25 bp, Homo sapien
aataaaatttatggcctggcacagc

SEQ ID NO: 474737 - DNA, 25 bp, Homo sapien
aaaatttatggcctggcacagcggc

SEQ ID NO: 474738 - DNA, 25 bp, Homo sapien
aaatttatggcctggcacagcggct

SEQ ID NO: 474739 - DNA, 25 bp, Homo sapien
aatttatggcctggcacagcggctc

SEQ ID NO: 474740 - DNA, 25 bp, Homo sapien
atttatggcctggcacagcggctca

SEQ ID NO: 474741 - DNA, 25 bp, Homo sapien
gtggcaagggcctatgatcccggct

SEQ ID NO: 474742 - DNA, 25 bp, Homo sapien
tggcaagggcctatgatcccggcta

SEQ ID NO: 474743 - DNA, 25 bp, Homo sapien
ggcaagggcctatgatcccggctac

SEQ ID NO: 474744 - DNA, 25 bp, Homo sapien
gcaagggcctatgatcccggctact

SEQ ID NO: 474745 - DNA, 25 bp, Homo sapien
caagggcctatgatcccggctactt

SEQ ID NO: 474746 - DNA, 25 bp, Homo sapien
tatcggatgccaattcatttgctga

SEQ ID NO: 474747 - DNA, 25 bp, Homo sapien
tgaccatgagaaacgcagctctcgt

SEQ ID NO: 474748 - DNA, 25 bp, Homo sapien
agctctcgtcaggactagaatacca

SEQ ID NO: 474749 - DNA, 25 bp, Homo sapien
actagaataccatcaacacagcctg

SEQ ID NO: 474750 - DNA, 25 bp, Homo sapien
agcctgtgtattctttccccacggg

SEQ ID NO: 474751 - DNA, 25 bp, Homo sapien
gagccattggaaagccaagctatga

SEQ ID NO: 474752 - DNA, 25 bp, Homo sapien
agctatgacaccaagacattccctg

SEQ ID NO: 474753 - DNA, 25 bp, Homo sapien
gaggtgactgaatgatccaagaata

SEQ ID NO: 474754 - DNA, 25 bp, Homo sapien
tatgcattagcctaagccttaccct

SEQ ID NO: 474755 - DNA, 25 bp, Homo sapien
atggtcttatccatgggatcaaaac

SEQ ID NO: 474756 - DNA, 25 bp, Homo sapien
gttctctctccactgataatgcatg

SEQ ID NO: 474757 - DNA, 25 bp, Homo sapien
aagacatttcaagtcagaattactg

SEQ ID NO: 474758 - DNA, 25 bp, Homo sapien
agacatttcaagtcagaattactgg

SEQ ID NO: 474759 - DNA, 25 bp, Homo sapien
gacatttcaagtcagaattactggg

SEQ ID NO: 474760 - DNA, 25 bp, Homo sapien
tttcaagtcagaattactggggtct

SEQ ID NO: 474761 - DNA, 25 bp, Homo sapien
caagtcagaattactggggtctggt

SEQ ID NO: 474762 - DNA, 25 bp, Homo sapien
ggggtctggttgggcgcggtggctc

SEQ ID NO: 474763 - DNA, 25 bp, Homo sapien
aacattatctggttatggtggtgcg

SEQ ID NO: 474764 - DNA, 25 bp, Homo sapien
acattatctggttatggtggtgcgt

SEQ ID NO: 474765 - DNA, 25 bp, Homo sapien
cattatctggttatggtggtgcgtg

SEQ ID NO: 474766 - DNA, 25 bp, Homo sapien
attatctggttatggtggtgcgtgc

SEQ ID NO: 474767 - DNA, 25 bp, Homo sapien
ttatctggttatggtggtgcgtgcc

SEQ ID NO: 474768 - DNA, 25 bp, Homo sapien
gtgacattcacatttagaattgtgt

SEQ ID NO: 474769 - DNA, 25 bp, Homo sapien
gacattcacatttagaattgtgtgc

SEQ ID NO: 474770 - DNA, 25 bp, Homo sapien
cattcacatttagaattgtgtgcag

SEQ ID NO: 474771 - DNA, 25 bp, Homo sapien
ttcacatttagaattgtgtgcagtg

SEQ ID NO: 474772 - DNA, 25 bp, Homo sapien
tcacatttagaattgtgtgcagtgt

SEQ ID NO: 474773 - DNA, 25 bp, Homo sapien
acatttagaattgtgtgcagtgtgc

SEQ ID NO: 474774 - DNA, 25 bp, Homo sapien
catttagaattgtgtgcagtgtgct

SEQ ID NO: 474775 - DNA, 25 bp, Homo sapien
atttagaattgtgtgcagtgtgctg

SEQ ID NO: 474776 - DNA, 25 bp, Homo sapien
tttagaattgtgtgcagtgtgctga

SEQ ID NO: 474777 - DNA, 25 bp, Homo sapien
ttagaattgtgtgcagtgtgctgag

SEQ ID NO: 474778 - DNA, 25 bp, Homo sapien
tagaattgtgtgcagtgtgctgagg

SEQ ID NO: 474779 - DNA, 25 bp, Homo sapien
ttcctagcatcctagggaatcaata

SEQ ID NO: 474780 - DNA, 25 bp, Homo sapien
cctagcatcctagggaatcaataga

SEQ ID NO: 474781 - DNA, 25 bp, Homo sapien
tagcatcctagggaatcaatagaac

SEQ ID NO: 474782 - DNA, 25 bp, Homo sapien
agcatcctagggaatcaatagaaca

SEQ ID NO: 474783 - DNA, 25 bp, Homo sapien
gcatcctagggaatcaatagaacat

SEQ ID NO: 474784 - DNA, 25 bp, Homo sapien
catcctagggaatcaatagaacatt

SEQ ID NO: 474785 - DNA, 25 bp, Homo sapien
tcctagggaatcaatagaacattct

SEQ ID NO: 474786 - DNA, 25 bp, Homo sapien
acattctcccaaccaggctgggtgc

SEQ ID NO: 474787 - DNA, 25 bp, Homo sapien
ttctcccaaccaggctgggtgcggt

SEQ ID NO: 474788 - DNA, 25 bp, Homo sapien
agtgcaagactagcctggctgacat

SEQ ID NO: 474789 - DNA, 25 bp, Homo sapien
gcaagactagcctggctgacatggt

SEQ ID NO: 474790 - DNA, 25 bp, Homo sapien
aaggagcctgagacaaagattaagt

SEQ ID NO: 474791 - DNA, 25 bp, Homo sapien
aagcaaagctgataatcccagggaa

SEQ ID NO: 474792 - DNA, 25 bp, Homo sapien
ggaaaattgctgatcaagtcttgaa

SEQ ID NO: 474793 - DNA, 25 bp, Homo sapien
tcttgaaatccaacacatccttcgg

SEQ ID NO: 474794 - DNA, 25 bp, Homo sapien
atccttcggagtaatttttaatgct

SEQ ID NO: 474795 - DNA, 25 bp, Homo sapien
taatgctttcgcttcttttacctaa

SEQ ID NO: 474796 - DNA, 25 bp, Homo sapien
tcttttacctaagccatgtgtgttc

SEQ ID NO: 474797 - DNA, 25 bp, Homo sapien
gttccatatgaccttaaacctaagc

SEQ ID NO: 474798 - DNA, 25 bp, Homo sapien
ctaagccctaatattgtaaatggag

SEQ ID NO: 474799 - DNA, 25 bp, Homo sapien
gacaacttagtctcccattttcttt

SEQ ID NO: 474800 - DNA, 25 bp, Homo sapien
tctttcctggcattcattcaaataa

SEQ ID NO: 474801 - DNA, 25 bp, Homo sapien
agaatgtacggattgatcatgacat

SEQ ID NO: 474802 - DNA, 25 bp, Homo sapien
gtacggattgatcatgacattcctt

SEQ ID NO: 474803 - DNA, 25 bp, Homo sapien
gattgatcatgacattccttacctt

SEQ ID NO: 474804 - DNA, 25 bp, Homo sapien
tgatcatgacattccttaccttctt

SEQ ID NO: 474805 - DNA, 25 bp, Homo sapien
atcatgacattccttaccttcttag

SEQ ID NO: 474806 - DNA, 25 bp, Homo sapien
atgacattccttaccttcttaggct

SEQ ID NO: 474807 - DNA, 25 bp, Homo sapien
gacattccttaccttcttaggcttg

SEQ ID NO: 474808 - DNA, 25 bp, Homo sapien
cattccttaccttcttaggcttgtt

SEQ ID NO: 474809 - DNA, 25 bp, Homo sapien
gcaaagacttaaattttgtagatac

SEQ ID NO: 474810 - DNA, 25 bp, Homo sapien
tcatgttttattggaaatgctgttc

SEQ ID NO: 474811 - DNA, 25 bp, Homo sapien
gctgttcatactttaacataaagct

SEQ ID NO: 474812 - DNA, 25 bp, Homo sapien
attcttccctgactcactgcaggtg

SEQ ID NO: 474813 - DNA, 25 bp, Homo sapien
cctgactcactgcaggtggcaggaa

SEQ ID NO: 474814 - DNA, 25 bp, Homo sapien
cagtggccgcattctgttggaggaa

SEQ ID NO: 474815 - DNA, 25 bp, Homo sapien
tgttggaggaattgcttctttctgc

SEQ ID NO: 474816 - DNA, 25 bp, Homo sapien
gcttctttctgcacatgagaactct

SEQ ID NO: 474817 - DNA, 25 bp, Homo sapien
ctgaaaaattgcatgctgggccggg

SEQ ID NO: 474818 - DNA, 25 bp, Homo sapien
ccaattcttactaagggacctgcat

SEQ ID NO: 474819 - DNA, 25 bp, Homo sapien
ggacctgcatttgcattcgaagcaa

SEQ ID NO: 474820 - DNA, 25 bp, Homo sapien
ttcgaagcaacattcaggatactgt

SEQ ID NO: 474821 - DNA, 25 bp, Homo sapien
tcaggatactgtgagactatgagct

SEQ ID NO: 474822 - DNA, 25 bp, Homo sapien
gaatcagaagcattacagcataact

SEQ ID NO: 474823 - DNA, 25 bp, Homo sapien
tttccccaatctatgtacgttgttc

SEQ ID NO: 474824 - DNA, 25 bp, Homo sapien
ttccccaatctatgtacgttgttct

SEQ ID NO: 474825 - DNA, 25 bp, Homo sapien
tccccaatctatgtacgttgttctt

SEQ ID NO: 474826 - DNA, 25 bp, Homo sapien
ccccaatctatgtacgttgttctta

SEQ ID NO: 474827 - DNA, 25 bp, Homo sapien
ccaatctatgtacgttgttcttaag

SEQ ID NO: 474828 - DNA, 25 bp, Homo sapien
aatctatgtacgttgttcttaagaa

SEQ ID NO: 474829 - DNA, 25 bp, Homo sapien
ctatgtacgttgttcttaagaatgt

SEQ ID NO: 474830 - DNA, 25 bp, Homo sapien
gttcttaagaatgtacacttggcca

SEQ ID NO: 474831 - DNA, 25 bp, Homo sapien
cttaagaatgtacacttggccaggt

SEQ ID NO: 474832 - DNA, 25 bp, Homo sapien
taagaatgtacacttggccaggtgc

SEQ ID NO: 474833 - DNA, 25 bp, Homo sapien
aagaatgtacacttggccaggtgca

SEQ ID NO: 474834 - DNA, 25 bp, Homo sapien
gtatgtatctcttcattatacttgc

SEQ ID NO: 474835 - DNA, 25 bp, Homo sapien
tgctttaagtttcacaaattcccaa

SEQ ID NO: 474836 - DNA, 25 bp, Homo sapien
aattcccaaagttgtgtgcctcttc

SEQ ID NO: 474837 - DNA, 25 bp, Homo sapien
tgcctcttcccatgacttctaaaat

SEQ ID NO: 474838 - DNA, 25 bp, Homo sapien
ctcttcccatgacttctaaaattga

SEQ ID NO: 474839 - DNA, 25 bp, Homo sapien
tatgaaatcagagtccatcgaggct

SEQ ID NO: 474840 - DNA, 25 bp, Homo sapien
cagagtccatcgaggctgagctaaa

SEQ ID NO: 474841 - DNA, 25 bp, Homo sapien
gtccatcgaggctgagctaaagctc

SEQ ID NO: 474842 - DNA, 25 bp, Homo sapien
aattacatgataaacttctggacag

SEQ ID NO: 474843 - DNA, 25 bp, Homo sapien
aatagagtcgtttgccttctaacct

SEQ ID NO: 474844 - DNA, 25 bp, Homo sapien
gagtcgtttgccttctaacctctta

SEQ ID NO: 474845 - DNA, 25 bp, Homo sapien
aggtaaaaacagtccaaatcacatg

SEQ ID NO: 474846 - DNA, 25 bp, Homo sapien
aaaacagtccaaatcacatgaaatt

SEQ ID NO: 474847 - DNA, 25 bp, Homo sapien
tttggaaaccaggataaaatgtgaa

SEQ ID NO: 474848 - DNA, 25 bp, Homo sapien
gtttttctcatgttatgggaagatg

SEQ ID NO: 474849 - DNA, 25 bp, Homo sapien
ttaaaagagggtttgacatgaatca

SEQ ID NO: 474850 - DNA, 25 bp, Homo sapien
acaaatctaattatggtacaaccat

SEQ ID NO: 474851 - DNA, 25 bp, Homo sapien
tatggtacaaccatgctgttgcaaa

SEQ ID NO: 474852 - DNA, 25 bp, Homo sapien
gtacaaccatgctgttgcaaatgat

SEQ ID NO: 474853 - DNA, 25 bp, Homo sapien
gctgttgcaaatgataggatttcct

SEQ ID NO: 474854 - DNA, 25 bp, Homo sapien
cattgtgccacatggataaactgga

SEQ ID NO: 474855 - DNA, 25 bp, Homo sapien
ttaggtttagtgaaattagccaggc

SEQ ID NO: 474856 - DNA, 25 bp, Homo sapien
ttgctaaataaaactggctcaactg

SEQ ID NO: 474857 - DNA, 25 bp, Homo sapien
aactggctcaactgaagttttgaga

SEQ ID NO: 474858 - DNA, 25 bp, Homo sapien
ttgagattcttgagaaacactgaga

SEQ ID NO: 474859 - DNA, 25 bp, Homo sapien
ggaaatcatgggtcattgcacagtt

SEQ ID NO: 474860 - DNA, 25 bp, Homo sapien
catgggtcattgcacagttataagt

SEQ ID NO: 474861 - DNA, 25 bp, Homo sapien
aagagagaatgtggcttgaggctaa

SEQ ID NO: 474862 - DNA, 25 bp, Homo sapien
aatgagattatttgtgggctgctat

SEQ ID NO: 474863 - DNA, 25 bp, Homo sapien
gtgggctgctatttatgcataattt

SEQ ID NO: 474864 - DNA, 25 bp, Homo sapien
atatgttttctatctgtctttagta

SEQ ID NO: 474865 - DNA, 25 bp, Homo sapien
gtatgtcatcttaagtttccactgc

SEQ ID NO: 474866 - DNA, 25 bp, Homo sapien
gtttccactgctttacgtaattttg

SEQ ID NO: 474867 - DNA, 25 bp, Homo sapien
tgattacaataaacacaccataaga

SEQ ID NO: 474868 - DNA, 25 bp, Homo sapien
ttttgagactaacaggaaaatctga

SEQ ID NO: 474869 - DNA, 25 bp, Homo sapien
ggaaaatctgaacactgactagcta

SEQ ID NO: 474870 - DNA, 25 bp, Homo sapien
aaatctgaacactgactagctatat

SEQ ID NO: 474871 - DNA, 25 bp, Homo sapien
tctgaacactgactagctatatttg

SEQ ID NO: 474872 - DNA, 25 bp, Homo sapien
cactgactagctatatttgaaaata

SEQ ID NO: 474873 - DNA, 25 bp, Homo sapien
aaaacaaactttgctttgcattgac

SEQ ID NO: 474874 - DNA, 25 bp, Homo sapien
caaactttgctttgcattgacaact

SEQ ID NO: 474875 - DNA, 25 bp, Homo sapien
tttgctttgcattgacaacttagat

SEQ ID NO: 474876 - DNA, 25 bp, Homo sapien
taaacaattcatctagcttcctata

SEQ ID NO: 474877 - DNA, 25 bp, Homo sapien
aattcatctagcttcctataattct

SEQ ID NO: 474878 - DNA, 25 bp, Homo sapien
agacaatcaaactactctgagctaa

SEQ ID NO: 474879 - DNA, 25 bp, Homo sapien
gacaatcaaactactctgagctaaa

SEQ ID NO: 474880 - DNA, 25 bp, Homo sapien
acaatcaaactactctgagctaaag

SEQ ID NO: 474881 - DNA, 25 bp, Homo sapien
caatcaaactactctgagctaaagg

SEQ ID NO: 474882 - DNA, 25 bp, Homo sapien
aatcaaactactctgagctaaagga

SEQ ID NO: 474883 - DNA, 25 bp, Homo sapien
ggaggaagtttgaacccatggcaaa

SEQ ID NO: 474884 - DNA, 25 bp, Homo sapien
gaggaagtttgaacccatggcaaag

SEQ ID NO: 474885 - DNA, 25 bp, Homo sapien
aggaagtttgaacccatggcaaaga

SEQ ID NO: 474886 - DNA, 25 bp, Homo sapien
ttgaacccatggcaaagaagttaaa

SEQ ID NO: 474887 - DNA, 25 bp, Homo sapien
acaagcctcagtagctgattcgatc

SEQ ID NO: 474888 - DNA, 25 bp, Homo sapien
caagcctcagtagctgattcgatca

SEQ ID NO: 474889 - DNA, 25 bp, Homo sapien
gccacaggtactattaacattatgt

SEQ ID NO: 474890 - DNA, 25 bp, Homo sapien
ccacaggtactattaacattatgta

SEQ ID NO: 474891 - DNA, 25 bp, Homo sapien
cacaggtactattaacattatgtac

SEQ ID NO: 474892 - DNA, 25 bp, Homo sapien
aacattatgtactgtgggccaggcg

SEQ ID NO: 474893 - DNA, 25 bp, Homo sapien
acattatgtactgtgggccaggcgt

SEQ ID NO: 474894 - DNA, 25 bp, Homo sapien
cattatgtactgtgggccaggcgtg

SEQ ID NO: 474895 - DNA, 25 bp, Homo sapien
attatgtactgtgggccaggcgtgg

SEQ ID NO: 474896 - DNA, 25 bp, Homo sapien
ttatgtactgtgggccaggcgtggt

SEQ ID NO: 474897 - DNA, 25 bp, Homo sapien
tatgtactgtgggccaggcgtggtg

SEQ ID NO: 474898 - DNA, 25 bp, Homo sapien
atgtactgtgggccaggcgtggtgg

SEQ ID NO: 474899 - DNA, 25 bp, Homo sapien
tgtactgtgggccaggcgtggtggc

SEQ ID NO: 474900 - DNA, 25 bp, Homo sapien
acttaagagttcactgggctgggtg

SEQ ID NO: 474901 - DNA, 25 bp, Homo sapien
cttaagagttcactgggctgggtgt

SEQ ID NO: 474902 - DNA, 25 bp, Homo sapien
ttaagagttcactgggctgggtgtg

SEQ ID NO: 474903 - DNA, 25 bp, Homo sapien
tgtaatcctagcaccacaggaggag

SEQ ID NO: 474904 - DNA, 25 bp, Homo sapien
gtaatcctagcaccacaggaggagg

SEQ ID NO: 474905 - DNA, 25 bp, Homo sapien
aatcctagcaccacaggaggaggcc

SEQ ID NO: 474906 - DNA, 25 bp, Homo sapien
atcctagcaccacaggaggaggccg

SEQ ID NO: 474907 - DNA, 25 bp, Homo sapien
tagcaccacaggaggaggccgatgt

SEQ ID NO: 474908 - DNA, 25 bp, Homo sapien
aggaggaggccgatgtgggcggatc

SEQ ID NO: 474909 - DNA, 25 bp, Homo sapien
aggttacggtgagctgaggtggtac

SEQ ID NO: 474910 - DNA, 25 bp, Homo sapien
ttacggtgagctgaggtggtaccac

SEQ ID NO: 474911 - DNA, 25 bp, Homo sapien
tttacatcccttcttccaatttatt

SEQ ID NO: 474912 - DNA, 25 bp, Homo sapien
tcttccaatttattatctgcaccaa

SEQ ID NO: 474913 - DNA, 25 bp, Homo sapien
tatctgcaccaattattttgggcac

SEQ ID NO: 474914 - DNA, 25 bp, Homo sapien
attattttgggcacttctcctgtgt

SEQ ID NO: 474915 - DNA, 25 bp, Homo sapien
gggcacttctcctgtgtatgtaaac

SEQ ID NO: 474916 - DNA, 25 bp, Homo sapien
ctttggagtttaggtctacgtcatt

SEQ ID NO: 474917 - DNA, 25 bp, Homo sapien
ctacgtcatttatataagagcctgt

SEQ ID NO: 474918 - DNA, 25 bp, Homo sapien
taagagcctgtagacctgagtggat

SEQ ID NO: 474919 - DNA, 25 bp, Homo sapien
agacctgagtggatggacactgcct

SEQ ID NO: 474920 - DNA, 25 bp, Homo sapien
agagtatgtgtcaggtaggaaccaa

SEQ ID NO: 474921 - DNA, 25 bp, Homo sapien
tatattcaaactggttttctgttcc

SEQ ID NO: 474922 - DNA, 25 bp, Homo sapien
ttctcctttagaagtgtcaactggg

SEQ ID NO: 474923 - DNA, 25 bp, Homo sapien
tctcctttagaagtgtcaactgggg

SEQ ID NO: 474924 - DNA, 25 bp, Homo sapien
ctcctttagaagtgtcaactggggc

SEQ ID NO: 474925 - DNA, 25 bp, Homo sapien
tcctttagaagtgtcaactggggct

SEQ ID NO: 474926 - DNA, 25 bp, Homo sapien
cctttagaagtgtcaactggggctg

SEQ ID NO: 474927 - DNA, 25 bp, Homo sapien
ctttagaagtgtcaactggggctgg

SEQ ID NO: 474928 - DNA, 25 bp, Homo sapien
tttagaagtgtcaactggggctggg

SEQ ID NO: 474929 - DNA, 25 bp, Homo sapien
ttagaagtgtcaactggggctgggt

SEQ ID NO: 474930 - DNA, 25 bp, Homo sapien
agaagtgtcaactggggctgggtgt

SEQ ID NO: 474931 - DNA, 25 bp, Homo sapien
gaagtgtcaactggggctgggtgtg

SEQ ID NO: 474932 - DNA, 25 bp, Homo sapien
aacgcccagatagtaaagaccctga

SEQ ID NO: 474933 - DNA, 25 bp, Homo sapien
gaaaatctacgcaaagaactgtctg

SEQ ID NO: 474934 - DNA, 25 bp, Homo sapien
gaactgtctgcaaagcatcaatcag

SEQ ID NO: 474935 - DNA, 25 bp, Homo sapien
ggaggatttacaaaaccagtttcag

SEQ ID NO: 474936 - DNA, 25 bp, Homo sapien
agagctgagttggagaagatttttc

SEQ ID NO: 474937 - DNA, 25 bp, Homo sapien
tcaagacaaaaaccaggctgaacgg

SEQ ID NO: 474938 - DNA, 25 bp, Homo sapien
tgaacgggcccttaggaacctggag

SEQ ID NO: 474939 - DNA, 25 bp, Homo sapien
taggaacctggagagtcatcatcaa

SEQ ID NO: 474940 - DNA, 25 bp, Homo sapien
ggagagtcatcatcaagcagccatt

SEQ ID NO: 474941 - DNA, 25 bp, Homo sapien
gaagacctgcagtccgagcacggcc

SEQ ID NO: 474942 - DNA, 25 bp, Homo sapien
tgcagtccgagcacggccggtgttt

SEQ ID NO: 474943 - DNA, 25 bp, Homo sapien
gttcaagctgttctttcttggtctg

SEQ ID NO: 474944 - DNA, 25 bp, Homo sapien
aagctgttctttcttggtctgtctg

SEQ ID NO: 474945 - DNA, 25 bp, Homo sapien
ttctttcttggtctgtctgtgaagt

SEQ ID NO: 474946 - DNA, 25 bp, Homo sapien
ttcttggtctgtctgtgaagtccta

SEQ ID NO: 474947 - DNA, 25 bp, Homo sapien
tggtctgtctgtgaagtcctatgat

SEQ ID NO: 474948 - DNA, 25 bp, Homo sapien
gtctgtgaagtcctatgatgctccc

SEQ ID NO: 474949 - DNA, 25 bp, Homo sapien
tgtgaagtcctatgatgctccctta

SEQ ID NO: 474950 - DNA, 25 bp, Homo sapien
aagtcctatgatgctcccttacgat

SEQ ID NO: 474951 - DNA, 25 bp, Homo sapien
atgatgctcccttacgataggtctt

SEQ ID NO: 474952 - DNA, 25 bp, Homo sapien
tgctcccttacgataggtcttgttt

SEQ ID NO: 474953 - DNA, 25 bp, Homo sapien
tcccttacgataggtcttgtttttg

SEQ ID NO: 474954 - DNA, 25 bp, Homo sapien
ttagcatgggtcatctgaatgtgca

SEQ ID NO: 474955 - DNA, 25 bp, Homo sapien
aatgtgcacgtgtcgtctgggcaac

SEQ ID NO: 474956 - DNA, 25 bp, Homo sapien
aacaggtccagaattctgcccaagc

SEQ ID NO: 474957 - DNA, 25 bp, Homo sapien
agggaagcccggagattccagccca

SEQ ID NO: 474958 - DNA, 25 bp, Homo sapien
agcccagagctttttccacgcgggt

SEQ ID NO: 474959 - DNA, 25 bp, Homo sapien
ggcagacgtgcagctcagacgcagc

SEQ ID NO: 474960 - DNA, 25 bp, Homo sapien
agcgcgtgaacctttcgtcttgtgg

SEQ ID NO: 474961 - DNA, 25 bp, Homo sapien
gggcgcatcgcagtaattgaaacct

SEQ ID NO: 474962 - DNA, 25 bp, Homo sapien
gtaattgaaaccttgcgcaccgcag

SEQ ID NO: 474963 - DNA, 25 bp, Homo sapien
actgccgtggcgtctataaatactc

SEQ ID NO: 474964 - DNA, 25 bp, Homo sapien
tataaatactcaccgcctaactgct

SEQ ID NO: 474965 - DNA, 25 bp, Homo sapien
aataggtacatgtctaggctatcct

SEQ ID NO: 474966 - DNA, 25 bp, Homo sapien
taggctatcctacggacgcttctga

SEQ ID NO: 474967 - DNA, 25 bp, Homo sapien
ggacgcttctgaggttcctgataga

SEQ ID NO: 474968 - DNA, 25 bp, Homo sapien
gttcctgatagagtgtgactcccat

SEQ ID NO: 474969 - DNA, 25 bp, Homo sapien
atagagtgtgactcccatttctttt

SEQ ID NO: 474970 - DNA, 25 bp, Homo sapien
tgaactaaagattagcagccttttt

SEQ ID NO: 474971 - DNA, 25 bp, Homo sapien
gaacaaaatggatttgggcccagcc

SEQ ID NO: 474972 - DNA, 25 bp, Homo sapien
atccatccctgtcaaaacctttgtg

SEQ ID NO: 474973 - DNA, 25 bp, Homo sapien
atccctgtcaaaacctttgtgccag

SEQ ID NO: 474974 - DNA, 25 bp, Homo sapien
agggcccactcagtgtccacgttat

SEQ ID NO: 474975 - DNA, 25 bp, Homo sapien
ctcagtgtccacgttattgggatca

SEQ ID NO: 474976 - DNA, 25 bp, Homo sapien
gagagaccatgaagctcaccacagt

SEQ ID NO: 474977 - DNA, 25 bp, Homo sapien
tcaccacagtccatacatttgcaag

SEQ ID NO: 474978 - DNA, 25 bp, Homo sapien
agcaggtactaaccacgtgatcagt

SEQ ID NO: 474979 - DNA, 25 bp, Homo sapien
gagtggcatgaattaccctgggttt

SEQ ID NO: 474980 - DNA, 25 bp, Homo sapien
atgaattaccctgggtttcttgctg

SEQ ID NO: 474981 - DNA, 25 bp, Homo sapien
gtttcttgctgctaagcttgttcca

SEQ ID NO: 474982 - DNA, 25 bp, Homo sapien
aagcttgttccagctcgcagaagtc

SEQ ID NO: 474983 - DNA, 25 bp, Homo sapien
tccagctcgcagaagtcagtgataa

SEQ ID NO: 474984 - DNA, 25 bp, Homo sapien
tgataacagaacactttggcagaat

SEQ ID NO: 474985 - DNA, 25 bp, Homo sapien
gatcactagattcgtatccgggcca

SEQ ID NO: 474986 - DNA, 25 bp, Homo sapien
atccgggccagtctcaccagaacat

SEQ ID NO: 474987 - DNA, 25 bp, Homo sapien
atctatccaaatttccttcatgatt

SEQ ID NO: 474988 - DNA, 25 bp, Homo sapien
atttttagtaaatcctgctgtgagt

SEQ ID NO: 474989 - DNA, 25 bp, Homo sapien
tagtaaatcctgctgtgagttattt

SEQ ID NO: 474990 - DNA, 25 bp, Homo sapien
gaaattactgtagagtcagcaaaga

SEQ ID NO: 474991 - DNA, 25 bp, Homo sapien
aacaccaagaatgaggagaacctag

SEQ ID NO: 474992 - DNA, 25 bp, Homo sapien
gagaacctagcaagggcaggctttt

SEQ ID NO: 474993 - DNA, 25 bp, Homo sapien
caagggcaggcttttggaagcaaga

SEQ ID NO: 474994 - DNA, 25 bp, Homo sapien
ggatagttaatagtttcaaatgtgt

SEQ ID NO: 474995 - DNA, 25 bp, Homo sapien
caaatgtgttatgactttttgctct

SEQ ID NO: 474996 - DNA, 25 bp, Homo sapien
tgactttttgctctgagtctctact

SEQ ID NO: 474997 - DNA, 25 bp, Homo sapien
gagtctctactttttgtagtttgtg

SEQ ID NO: 474998 - DNA, 25 bp, Homo sapien
tttcatagtgccgtagtctaacctt

SEQ ID NO: 474999 - DNA, 25 bp, Homo sapien
atagtgccgtagtctaaccttgtct

SEQ ID NO: 475000 - DNA, 25 bp, Homo sapien
agtgccgtagtctaaccttgtcttt

SEQ ID NO: 475001 - DNA, 25 bp, Homo sapien
gccgtagtctaaccttgtctttggt

SEQ ID NO: 475002 - DNA, 25 bp, Homo sapien
tgtctttggtttctgctaggttatc

SEQ ID NO: 475003 - DNA, 25 bp, Homo sapien
ggtttctgctaggttatccagtttg

SEQ ID NO: 475004 - DNA, 25 bp, Homo sapien
gctaggttatccagtttgttggcct

SEQ ID NO: 475005 - DNA, 25 bp, Homo sapien
ggttatccagtttgttggcctgtga

SEQ ID NO: 475006 - DNA, 25 bp, Homo sapien
cctgtgatttttcatagtgccgtag

SEQ ID NO: 475007 - DNA, 25 bp, Homo sapien
gtgatttttcatagtgccgtagtct

SEQ ID NO: 475008 - DNA, 25 bp, Homo sapien
atttttcatagtgccgtagtctaac

SEQ ID NO: 475009 - DNA, 25 bp, Homo sapien
gaaactctgcacaaaagtaactcca

SEQ ID NO: 475010 - DNA, 25 bp, Homo sapien
aaactctgcacaaaagtaactccac

SEQ ID NO: 475011 - DNA, 25 bp, Homo sapien
aactctgcacaaaagtaactccact

SEQ ID NO: 475012 - DNA, 25 bp, Homo sapien
actctgcacaaaagtaactccactt

SEQ ID NO: 475013 - DNA, 25 bp, Homo sapien
ctctgcacaaaagtaactccacttt

SEQ ID NO: 475014 - DNA, 25 bp, Homo sapien
tctgcacaaaagtaactccactttt

SEQ ID NO: 475015 - DNA, 25 bp, Homo sapien
ctgcacaaaagtaactccactttta

SEQ ID NO: 475016 - DNA, 25 bp, Homo sapien
tgcacaaaagtaactccacttttat

SEQ ID NO: 475017 - DNA, 25 bp, Homo sapien
agtaactccacttttatttgagaca

SEQ ID NO: 475018 - DNA, 25 bp, Homo sapien
gtaactccacttttatttgagacag

SEQ ID NO: 475019 - DNA, 25 bp, Homo sapien
caagcaattctcccgtctctactaa

SEQ ID NO: 475020 - DNA, 25 bp, Homo sapien
aaataacctatgtatgaagactaat

SEQ ID NO: 475021 - DNA, 25 bp, Homo sapien
tatttttacttctgcattcaatcaa

SEQ ID NO: 475022 - DNA, 25 bp, Homo sapien
ttcaatcaactgcaacatgtcattt

SEQ ID NO: 475023 - DNA, 25 bp, Homo sapien
catgtcattttggttgatgtgtaca

SEQ ID NO: 475024 - DNA, 25 bp, Homo sapien
gaaaatactcaacatctcgcagata

SEQ ID NO: 475025 - DNA, 25 bp, Homo sapien
ctcaacatctcgcagatattgggtt

SEQ ID NO: 475026 - DNA, 25 bp, Homo sapien
tattgggttggaaaacagaggacat

SEQ ID NO: 475027 - DNA, 25 bp, Homo sapien
tatatttttctttgatagtacacca

SEQ ID NO: 475028 - DNA, 25 bp, Homo sapien
gatagtacaccaaaatttgacaagt

SEQ ID NO: 475029 - DNA, 25 bp, Homo sapien
gacaagtgactatttcttaaagggt

SEQ ID NO: 475030 - DNA, 25 bp, Homo sapien
gggtagttgcagcatgaaatccaaa

SEQ ID NO: 475031 - DNA, 25 bp, Homo sapien
agtgcggctcgttttcagtggtctt

SEQ ID NO: 475032 - DNA, 25 bp, Homo sapien
cagtggtctttgtctggagccattc

SEQ ID NO: 475033 - DNA, 25 bp, Homo sapien
tctggagccattccgttggagtagc

SEQ ID NO: 475034 - DNA, 25 bp, Homo sapien
cattccgttggagtagcagcagtgg

SEQ ID NO: 475035 - DNA, 25 bp, Homo sapien
gggcggtacagaatccagcttcatt

SEQ ID NO: 475036 - DNA, 25 bp, Homo sapien
gaatccagcttcattaacttgggaa

SEQ ID NO: 475037 - DNA, 25 bp, Homo sapien
acttgggaatcgactaaacacagga

SEQ ID NO: 475038 - DNA, 25 bp, Homo sapien
gagtgggaagcgcagccacaacaaa

SEQ ID NO: 475039 - DNA, 25 bp, Homo sapien
aactaattagcagggctgtgtgatc

SEQ ID NO: 475040 - DNA, 25 bp, Homo sapien
gttggcctgtctgtaggcagccagt

SEQ ID NO: 475041 - DNA, 25 bp, Homo sapien
agcccgcctggagcaaggctgaatt

SEQ ID NO: 475042 - DNA, 25 bp, Homo sapien
gtcacacctttgatgggtaaagaag

SEQ ID NO: 475043 - DNA, 25 bp, Homo sapien
gaagtaaggagccagttctatagga

SEQ ID NO: 475044 - DNA, 25 bp, Homo sapien
aaatttgcctgtcttagccttgggt

SEQ ID NO: 475045 - DNA, 25 bp, Homo sapien
tagccttgggtctgggtaaaagaca

SEQ ID NO: 475046 - DNA, 25 bp, Homo sapien
agtgatctccactgagaattcttaa

SEQ ID NO: 475047 - DNA, 25 bp, Homo sapien
aattctaggcccattctcagggagt

SEQ ID NO: 475048 - DNA, 25 bp, Homo sapien
gggccagaatcatacctatcttgtt

SEQ ID NO: 475049 - DNA, 25 bp, Homo sapien
acctatcttgttggtctgaaagcca

SEQ ID NO: 475050 - DNA, 25 bp, Homo sapien
tgaaagccaaccatcttgtagcctg

SEQ ID NO: 475051 - DNA, 25 bp, Homo sapien
caaccatcttgtagcctggcagaag

SEQ ID NO: 475052 - DNA, 25 bp, Homo sapien
agcaaatacaaatcctatctagagg

SEQ ID NO: 475053 - DNA, 25 bp, Homo sapien
ttaattattatgttctattttctgg

SEQ ID NO: 475054 - DNA, 25 bp, Homo sapien
cacagaatcaactggttttgaacct

SEQ ID NO: 475055 - DNA, 25 bp, Homo sapien
cagaatcaactggttttgaacctca

SEQ ID NO: 475056 - DNA, 25 bp, Homo sapien
gaatcaactggttttgaacctcaat

SEQ ID NO: 475057 - DNA, 25 bp, Homo sapien
aatcaactggttttgaacctcaatt

SEQ ID NO: 475058 - DNA, 25 bp, Homo sapien
tcaactggttttgaacctcaattta

SEQ ID NO: 475059 - DNA, 25 bp, Homo sapien
tggttttgaacctcaatttacttat

SEQ ID NO: 475060 - DNA, 25 bp, Homo sapien
gttttgaacctcaatttacttatag

SEQ ID NO: 475061 - DNA, 25 bp, Homo sapien
tgaacctcaatttacttataggtta

SEQ ID NO: 475062 - DNA, 25 bp, Homo sapien
ggttaatttagagagaattgacttt

SEQ ID NO: 475063 - DNA, 25 bp, Homo sapien
ggatcacatgatcccaggatttgag

SEQ ID NO: 475064 - DNA, 25 bp, Homo sapien
ggtcttgtccacttttgagttggag

SEQ ID NO: 475065 - DNA, 25 bp, Homo sapien
aggtcagctaggtgtgcacttccaa

SEQ ID NO: 475066 - DNA, 25 bp, Homo sapien
ggtgtgcacttccaaaagagccctc

SEQ ID NO: 475067 - DNA, 25 bp, Homo sapien
aaaagagccctcactgtccaaggtg

SEQ ID NO: 475068 - DNA, 25 bp, Homo sapien
gtccaaggtgcagttgtaatccagg

SEQ ID NO: 475069 - DNA, 25 bp, Homo sapien
tgaggtccatgatgtgccactatgt

SEQ ID NO: 475070 - DNA, 25 bp, Homo sapien
gagaactcacaggttatcacaacac

SEQ ID NO: 475071 - DNA, 25 bp, Homo sapien
ggagtttacatcgtgtcaggcccta

SEQ ID NO: 475072 - DNA, 25 bp, Homo sapien
tgtcaggccctacactatggagtgt

SEQ ID NO: 475073 - DNA, 25 bp, Homo sapien
gtagggatgccacccttggttccca

SEQ ID NO: 475074 - DNA, 25 bp, Homo sapien
atcttactgtccttcacattggtgt

SEQ ID NO: 475075 - DNA, 25 bp, Homo sapien
taagtcttcaaaacccagtgcgtaa

SEQ ID NO: 475076 - DNA, 25 bp, Homo sapien
tgcgtaacacacttcacttgggatg

SEQ ID NO: 475077 - DNA, 25 bp, Homo sapien
acacacttcacttgggatgtcccta

SEQ ID NO: 475078 - DNA, 25 bp, Homo sapien
atgtccctatttcagttgctcagta

SEQ ID NO: 475079 - DNA, 25 bp, Homo sapien
gttgctcagtagtggctagtggcta

SEQ ID NO: 475080 - DNA, 25 bp, Homo sapien
tggctagtggctacccagtcggaca

SEQ ID NO: 475081 - DNA, 25 bp, Homo sapien
acagctcagcgtcagtcacatggaa

SEQ ID NO: 475082 - DNA, 25 bp, Homo sapien
acatggaagctgttcctccgcaggg

SEQ ID NO: 475083 - DNA, 25 bp, Homo sapien
aagtctcactgggtttcttctcgtt

SEQ ID NO: 475084 - DNA, 25 bp, Homo sapien
catcggtatcttgagagcactgctt

SEQ ID NO: 475085 - DNA, 25 bp, Homo sapien
gagagcactgcttaataaatctttt

SEQ ID NO: 475086 - DNA, 25 bp, Homo sapien
gtttcaaattcctgagctcaagcag

SEQ ID NO: 475087 - DNA, 25 bp, Homo sapien
gctcaagcagtccatttgcctataa

SEQ ID NO: 475088 - DNA, 25 bp, Homo sapien
ctcaagcagtccatttgcctataat

SEQ ID NO: 475089 - DNA, 25 bp, Homo sapien
tcaagcagtccatttgcctataatc

SEQ ID NO: 475090 - DNA, 25 bp, Homo sapien
caagcagtccatttgcctataatcc

SEQ ID NO: 475091 - DNA, 25 bp, Homo sapien
aagcagtccatttgcctataatccc

SEQ ID NO: 475092 - DNA, 25 bp, Homo sapien
agcagtccatttgcctataatccca

SEQ ID NO: 475093 - DNA, 25 bp, Homo sapien
gcagtccatttgcctataatcccag

SEQ ID NO: 475094 - DNA, 25 bp, Homo sapien
aaggccaaggctggcagatcatctg

SEQ ID NO: 475095 - DNA, 25 bp, Homo sapien
aggccaaggctggcagatcatctga

SEQ ID NO: 475096 - DNA, 25 bp, Homo sapien
gccaacacaatgaaaccctatctct

SEQ ID NO: 475097 - DNA, 25 bp, Homo sapien
tgggaaggcagcacctactaacact

SEQ ID NO: 475098 - DNA, 25 bp, Homo sapien
tactaacactggctgtctcacaaca

SEQ ID NO: 475099 - DNA, 25 bp, Homo sapien
tgtctcacaacagctggattttccc

SEQ ID NO: 475100 - DNA, 25 bp, Homo sapien
caagtcttttccagtcaccgtaggt

SEQ ID NO: 475101 - DNA, 25 bp, Homo sapien
gtaggtcccagcatgtgagccagtg

SEQ ID NO: 475102 - DNA, 25 bp, Homo sapien
agtgctccttgtcatggtgacctac

SEQ ID NO: 475103 - DNA, 25 bp, Homo sapien
caggaatgcacaaggctgtcggccc

SEQ ID NO: 475104 - DNA, 25 bp, Homo sapien
tttgagtcagtacccagaagctctg

SEQ ID NO: 475105 - DNA, 25 bp, Homo sapien
agaagctctgagtgttctcctggcc

SEQ ID NO: 475106 - DNA, 25 bp, Homo sapien
gaagggataagcctgctgcctgctc

SEQ ID NO: 475107 - DNA, 25 bp, Homo sapien
tattggtagggccaccaggacacat

SEQ ID NO: 475108 - DNA, 25 bp, Homo sapien
tggtcagaggggctcccagtccatc

SEQ ID NO: 475109 - DNA, 25 bp, Homo sapien
tctgcctcagggatcacgagagagt

SEQ ID NO: 475110 - DNA, 25 bp, Homo sapien
ctgcctcagggatcacgagagagtc

SEQ ID NO: 475111 - DNA, 25 bp, Homo sapien
gcctcagggatcacgagagagtcct

SEQ ID NO: 475112 - DNA, 25 bp, Homo sapien
ctcagggatcacgagagagtcctgg

SEQ ID NO: 475113 - DNA, 25 bp, Homo sapien
cagcacagaagagagatagccaagt

SEQ ID NO: 475114 - DNA, 25 bp, Homo sapien
acagaagagagatagccaagtgcca

SEQ ID NO: 475115 - DNA, 25 bp, Homo sapien
agaagagagatagccaagtgccatc

SEQ ID NO: 475116 - DNA, 25 bp, Homo sapien
aagagagatagccaagtgccatcag

SEQ ID NO: 475117 - DNA, 25 bp, Homo sapien
gagagatagccaagtgccatcagac

SEQ ID NO: 475118 - DNA, 25 bp, Homo sapien
agagatagccaagtgccatcagaca

SEQ ID NO: 475119 - DNA, 25 bp, Homo sapien
gcacatacacagacaggaacaccca

SEQ ID NO: 475120 - DNA, 25 bp, Homo sapien
aacacccaggtgtatatgagagacc

SEQ ID NO: 475121 - DNA, 25 bp, Homo sapien
tatgagagacatgtgaagccccaag

SEQ ID NO: 475122 - DNA, 25 bp, Homo sapien
atgtgaagccccaagggacacagtg

SEQ ID NO: 475123 - DNA, 25 bp, Homo sapien
gtatgtacatgcagaaacacagaga

SEQ ID NO: 475124 - DNA, 25 bp, Homo sapien
agcagcagacatcacaaacacacat

SEQ ID NO: 475125 - DNA, 25 bp, Homo sapien
tcacaaacacacatgatgagttcag

SEQ ID NO: 475126 - DNA, 25 bp, Homo sapien
gttcagaacaagagctcacaggcct

SEQ ID NO: 475127 - DNA, 25 bp, Homo sapien
gagctgcctgcatacatcatatttg

SEQ ID NO: 475128 - DNA, 25 bp, Homo sapien
ttgtggattcagactctgtttcccc

SEQ ID NO: 475129 - DNA, 25 bp, Homo sapien
gggcatagtacctaccactgacacc

SEQ ID NO: 475130 - DNA, 25 bp, Homo sapien
tgtgcctggctctattaaaatttaa

SEQ ID NO: 475131 - DNA, 25 bp, Homo sapien
gtgcctggctctattaaaatttaat

SEQ ID NO: 475132 - DNA, 25 bp, Homo sapien
tgcctggctctattaaaatttaatt

SEQ ID NO: 475133 - DNA, 25 bp, Homo sapien
gcctggctctattaaaatttaatta

SEQ ID NO: 475134 - DNA, 25 bp, Homo sapien
taaaaagtgaaaattcaggctgggt

SEQ ID NO: 475135 - DNA, 25 bp, Homo sapien
aaaagtgaaaattcaggctgggtgt

SEQ ID NO: 475136 - DNA, 25 bp, Homo sapien
acacccagcttgctggctaacacgg

SEQ ID NO: 475137 - DNA, 25 bp, Homo sapien
aaatacaacaaattacccggacatg

SEQ ID NO: 475138 - DNA, 25 bp, Homo sapien
aatacaacaaattacccggacatgg

SEQ ID NO: 475139 - DNA, 25 bp, Homo sapien
atacaacaaattacccggacatggt

SEQ ID NO: 475140 - DNA, 25 bp, Homo sapien
tacaacaaattacccggacatggtg

SEQ ID NO: 475141 - DNA, 25 bp, Homo sapien
tagagcttggttcagtgttcccaca

SEQ ID NO: 475142 - DNA, 25 bp, Homo sapien
agagcttggttcagtgttcccacag

SEQ ID NO: 475143 - DNA, 25 bp, Homo sapien
agcttggttcagtgttcccacaggg

SEQ ID NO: 475144 - DNA, 25 bp, Homo sapien
gcttggttcagtgttcccacagggc

SEQ ID NO: 475145 - DNA, 25 bp, Homo sapien
ttctgatgtgtctccattaaaacgc

SEQ ID NO: 475146 - DNA, 25 bp, Homo sapien
tgatgtgtctccattaaaacgccct

SEQ ID NO: 475147 - DNA, 25 bp, Homo sapien
gatgtgtctccattaaaacgccctt

SEQ ID NO: 475148 - DNA, 25 bp, Homo sapien
atgtgtctccattaaaacgcccttc

SEQ ID NO: 475149 - DNA, 25 bp, Homo sapien
tgtgtctccattaaaacgcccttca

SEQ ID NO: 475150 - DNA, 25 bp, Homo sapien
tgtctccattaaaacgcccttcatt

SEQ ID NO: 475151 - DNA, 25 bp, Homo sapien
gtctccattaaaacgcccttcattg

SEQ ID NO: 475152 - DNA, 25 bp, Homo sapien
cataaagtgctagggatcgctgcta

SEQ ID NO: 475153 - DNA, 25 bp, Homo sapien
gatcgctgctagtgcttatttcttc

SEQ ID NO: 475154 - DNA, 25 bp, Homo sapien
atttatttacacagaacaagggagc

SEQ ID NO: 475155 - DNA, 25 bp, Homo sapien
aaatgtactcagatcaccgtcagca

SEQ ID NO: 475156 - DNA, 25 bp, Homo sapien
agatcaccgtcagcatcctcgaggg

SEQ ID NO: 475157 - DNA, 25 bp, Homo sapien
tcctcgagggcatgggttgctttca

SEQ ID NO: 475158 - DNA, 25 bp, Homo sapien
aggaagggctgagcttcagctcctg

SEQ ID NO: 475159 - DNA, 25 bp, Homo sapien
gctgtggctggttggaatccgcttt

SEQ ID NO: 475160 - DNA, 25 bp, Homo sapien
aatccgctttctgccatgctaagat

SEQ ID NO: 475161 - DNA, 25 bp, Homo sapien
tgtcttacacactgctgacactcgt

SEQ ID NO: 475162 - DNA, 25 bp, Homo sapien
tgacactcgtggtttgaactcctct

SEQ ID NO: 475163 - DNA, 25 bp, Homo sapien
gaagatattccaggaccgggcacga

SEQ ID NO: 475164 - DNA, 25 bp, Homo sapien
aagatattccaggaccgggcacgat

SEQ ID NO: 475165 - DNA, 25 bp, Homo sapien
agatattccaggaccgggcacgatg

SEQ ID NO: 475166 - DNA, 25 bp, Homo sapien
gatattccaggaccgggcacgatgg

SEQ ID NO: 475167 - DNA, 25 bp, Homo sapien
tattccaggaccgggcacgatggct

SEQ ID NO: 475168 - DNA, 25 bp, Homo sapien
aagttaacagggtgtggtagcctgc

SEQ ID NO: 475169 - DNA, 25 bp, Homo sapien
agttaacagggtgtggtagcctgca

SEQ ID NO: 475170 - DNA, 25 bp, Homo sapien
gttaacagggtgtggtagcctgcac

SEQ ID NO: 475171 - DNA, 25 bp, Homo sapien
ttaacagggtgtggtagcctgcacc

SEQ ID NO: 475172 - DNA, 25 bp, Homo sapien
taacagggtgtggtagcctgcacct

SEQ ID NO: 475173 - DNA, 25 bp, Homo sapien
aacagggtgtggtagcctgcacctg

SEQ ID NO: 475174 - DNA, 25 bp, Homo sapien
cgcgcccagccacaaaattgttttt

SEQ ID NO: 475175 - DNA, 25 bp, Homo sapien
gcgcccagccacaaaattgttttta

SEQ ID NO: 475176 - DNA, 25 bp, Homo sapien
tacaaaatctttgaccgtaattatt

SEQ ID NO: 475177 - DNA, 25 bp, Homo sapien
acaaatataagtattgattgcccaa

SEQ ID NO: 475178 - DNA, 25 bp, Homo sapien
atataagtattgattgcccaatgtt

SEQ ID NO: 475179 - DNA, 25 bp, Homo sapien
ataagtattgattgcccaatgttga

SEQ ID NO: 475180 - DNA, 25 bp, Homo sapien
taagtattgattgcccaatgttgag

SEQ ID NO: 475181 - DNA, 25 bp, Homo sapien
tgcccaatgttgagagagatcaaca

SEQ ID NO: 475182 - DNA, 25 bp, Homo sapien
tataaaaccattcactccaaaatta

SEQ ID NO: 475183 - DNA, 25 bp, Homo sapien
taaaaccattcactccaaaattata

SEQ ID NO: 475184 - DNA, 25 bp, Homo sapien
aaaccattcactccaaaattataat

SEQ ID NO: 475185 - DNA, 25 bp, Homo sapien
gacaatcctgtaaccttcaccaacg

SEQ ID NO: 475186 - DNA, 25 bp, Homo sapien
tgaaattctagcacagcccttcggg

SEQ ID NO: 475187 - DNA, 25 bp, Homo sapien
tgaaggccagaacccaaatgatttg

SEQ ID NO: 475188 - DNA, 25 bp, Homo sapien
atgattcctaagagtcatccccaca

SEQ ID NO: 475189 - DNA, 25 bp, Homo sapien
gagtcatccccacaaggaagctgca

SEQ ID NO: 475190 - DNA, 25 bp, Homo sapien
gcaccaccgagttccagtatgttga

SEQ ID NO: 475191 - DNA, 25 bp, Homo sapien
gcttattcatctgaagttgcttgct

SEQ ID NO: 475192 - DNA, 25 bp, Homo sapien
agttgcttgctattcacagacacga

SEQ ID NO: 475193 - DNA, 25 bp, Homo sapien
cagacacgaagctacatcgcaggat

SEQ ID NO: 475194 - DNA, 25 bp, Homo sapien
tggaagcaaggcttaccttcacctt

SEQ ID NO: 475195 - DNA, 25 bp, Homo sapien
taccttcaccttctagctcttggaa

SEQ ID NO: 475196 - DNA, 25 bp, Homo sapien
tatacatcaagaaacaggtaccgtt

SEQ ID NO: 475197 - DNA, 25 bp, Homo sapien
aagggaatggccaagtaagtatcaa

SEQ ID NO: 475198 - DNA, 25 bp, Homo sapien
agtaagtatcaatcagttcccaaat

SEQ ID NO: 475199 - DNA, 25 bp, Homo sapien
ttcccaaattaatcttggaggttat

SEQ ID NO: 475200 - DNA, 25 bp, Homo sapien
gagaggtttagtcctaccctcagaa

SEQ ID NO: 475201 - DNA, 25 bp, Homo sapien
gtcctaccctcagaatttcacaaat

SEQ ID NO: 475202 - DNA, 25 bp, Homo sapien
aaataattcctttgtgcaatccatg

SEQ ID NO: 475203 - DNA, 25 bp, Homo sapien
tcctttgtgcaatccatgtaagaaa

SEQ ID NO: 475204 - DNA, 25 bp, Homo sapien
aagaaatgttctctgaaatcacact

SEQ ID NO: 475205 - DNA, 25 bp, Homo sapien
aaactggtagtttctttgtgctgta

SEQ ID NO: 475206 - DNA, 25 bp, Homo sapien
gtttctttgtgctgtaagctttaaa

SEQ ID NO: 475207 - DNA, 25 bp, Homo sapien
tttctttgtgtctacgacatactag

SEQ ID NO: 475208 - DNA, 25 bp, Homo sapien
tatgtattctgttgccatccctctg

SEQ ID NO: 475209 - DNA, 25 bp, Homo sapien
cccctactcgatggcctgaaagtgt

SEQ ID NO: 475210 - DNA, 25 bp, Homo sapien
tgaaagtgtttcatcttccctgcct

SEQ ID NO: 475211 - DNA, 25 bp, Homo sapien
ttccctgcctgttatcagcatagaa

SEQ ID NO: 475212 - DNA, 25 bp, Homo sapien
gtattgtgacataatctgattgcct

SEQ ID NO: 475213 - DNA, 25 bp, Homo sapien
attgccttgaggcagagcttacctc

SEQ ID NO: 475214 - DNA, 25 bp, Homo sapien
agagcttacctccaagctgctagct

SEQ ID NO: 475215 - DNA, 25 bp, Homo sapien
tcccatttgacctttcccaaagaag

SEQ ID NO: 475216 - DNA, 25 bp, Homo sapien
gaagctaagaatccatgccttgttg

SEQ ID NO: 475217 - DNA, 25 bp, Homo sapien
catgccttgttgaaggtgggaacta

SEQ ID NO: 475218 - DNA, 25 bp, Homo sapien
cattctctaacaggttatatttagg

SEQ ID NO: 475219 - DNA, 25 bp, Homo sapien
acaggttatatttaggacagttagg

SEQ ID NO: 475220 - DNA, 25 bp, Homo sapien
caggttatatttaggacagttaggt

SEQ ID NO: 475221 - DNA, 25 bp, Homo sapien
tttaggacagttaggttacatttca

SEQ ID NO: 475222 - DNA, 25 bp, Homo sapien
ttaggacagttaggttacatttcat

SEQ ID NO: 475223 - DNA, 25 bp, Homo sapien
taggacagttaggttacatttcatt

SEQ ID NO: 475224 - DNA, 25 bp, Homo sapien
aggacagttaggttacatttcatta

SEQ ID NO: 475225 - DNA, 25 bp, Homo sapien
ggacagttaggttacatttcattat

SEQ ID NO: 475226 - DNA, 25 bp, Homo sapien
gacagttaggttacatttcattatt

SEQ ID NO: 475227 - DNA, 25 bp, Homo sapien
cagttaggttacatttcattattca

SEQ ID NO: 475228 - DNA, 25 bp, Homo sapien
agcctggggcaccatactgagatcc

SEQ ID NO: 475229 - DNA, 25 bp, Homo sapien
gaaaacaactgaggctaggcacagt

SEQ ID NO: 475230 - DNA, 25 bp, Homo sapien
aaaacaactgaggctaggcacagtg

SEQ ID NO: 475231 - DNA, 25 bp, Homo sapien
aaacaactgaggctaggcacagtgg

SEQ ID NO: 475232 - DNA, 25 bp, Homo sapien
aacaactgaggctaggcacagtggc

SEQ ID NO: 475233 - DNA, 25 bp, Homo sapien
aatatagctggggatggtggcgtgt

SEQ ID NO: 475234 - DNA, 25 bp, Homo sapien
gtaatcccagctaccagctactcag

SEQ ID NO: 475235 - DNA, 25 bp, Homo sapien
taatcccagctaccagctactcagg

SEQ ID NO: 475236 - DNA, 25 bp, Homo sapien
ctcaggaggttgagttgcttgaacc

SEQ ID NO: 475237 - DNA, 25 bp, Homo sapien
tcaggaggttgagttgcttgaaccc

SEQ ID NO: 475238 - DNA, 25 bp, Homo sapien
caggaggttgagttgcttgaaccca

SEQ ID NO: 475239 - DNA, 25 bp, Homo sapien
aggaggttgagttgcttgaacccag

SEQ ID NO: 475240 - DNA, 25 bp, Homo sapien
atggaaagatatgactgtatcctca

SEQ ID NO: 475241 - DNA, 25 bp, Homo sapien
gtatcctcaaatgtgctggcgtcaa

SEQ ID NO: 475242 - DNA, 25 bp, Homo sapien
aatgtgctggcgtcaatgcaaagat

SEQ ID NO: 475243 - DNA, 25 bp, Homo sapien
gcgtcaatgcaaagatgcacggatt

SEQ ID NO: 475244 - DNA, 25 bp, Homo sapien
gcacggattgtgaaaactcagggaa

SEQ ID NO: 475245 - DNA, 25 bp, Homo sapien
aactcagggaaataggacaccgata

SEQ ID NO: 475246 - DNA, 25 bp, Homo sapien
taggacaccgataaaagtaaccaag

SEQ ID NO: 475247 - DNA, 25 bp, Homo sapien
gtaaccaagaaaactccagcaatga

SEQ ID NO: 475248 - DNA, 25 bp, Homo sapien
gaaaactccagcaatgaaccgagaa

SEQ ID NO: 475249 - DNA, 25 bp, Homo sapien
atgaaccgagaagcattgaagacct

SEQ ID NO: 475250 - DNA, 25 bp, Homo sapien
gataggtcagaataatgctcttaaa

SEQ ID NO: 475251 - DNA, 25 bp, Homo sapien
cctagtttcccatgactgaaagtat

SEQ ID NO: 475252 - DNA, 25 bp, Homo sapien
gaaagtataattctacctctacctc

SEQ ID NO: 475253 - DNA, 25 bp, Homo sapien
cctctacctcactgattacactgta

SEQ ID NO: 475254 - DNA, 25 bp, Homo sapien
aggaagcttattattgcacacacaa

SEQ ID NO: 475255 - DNA, 25 bp, Homo sapien
ttgcacacacaagcatggtgcttag

SEQ ID NO: 475256 - DNA, 25 bp, Homo sapien
tggtgcttagggaaggcaaacttaa

SEQ ID NO: 475257 - DNA, 25 bp, Homo sapien
aaacttaaagccagatccagagtaa

SEQ ID NO: 475258 - DNA, 25 bp, Homo sapien
agtaaggctctattccatgaggaca

SEQ ID NO: 475259 - DNA, 25 bp, Homo sapien
caaatagttgtctctccatgaaaga

SEQ ID NO: 475260 - DNA, 25 bp, Homo sapien
tgatataatcaatctgccactaact

SEQ ID NO: 475261 - DNA, 25 bp, Homo sapien
aatctgccactaactatctggtcac

SEQ ID NO: 475262 - DNA, 25 bp, Homo sapien
gcctgctgtgaccacaagaggttca

SEQ ID NO: 475263 - DNA, 25 bp, Homo sapien
gctgtgaccacaagaggttcagaca

SEQ ID NO: 475264 - DNA, 25 bp, Homo sapien
gaccacaagaggttcagacaagaaa

SEQ ID NO: 475265 - DNA, 25 bp, Homo sapien
gacaagaaagcaatcaatgggaatt

SEQ ID NO: 475266 - DNA, 25 bp, Homo sapien
agcattcattcatgagagctagcag

SEQ ID NO: 475267 - DNA, 25 bp, Homo sapien
attcatgagagctagcaggtggcca

SEQ ID NO: 475268 - DNA, 25 bp, Homo sapien
atgagagctagcaggtggccaagcc

SEQ ID NO: 475269 - DNA, 25 bp, Homo sapien
ccagacaagggcagtctccattcct

SEQ ID NO: 475270 - DNA, 25 bp, Homo sapien
agacaagggcagtctccattcctcc

SEQ ID NO: 475271 - DNA, 25 bp, Homo sapien
tccattcctccttgactactgtctt

SEQ ID NO: 475272 - DNA, 25 bp, Homo sapien
accctcaccatcaaggaagttcttc

SEQ ID NO: 475273 - DNA, 25 bp, Homo sapien
cagcctggacgagagtgctagatgc

SEQ ID NO: 475274 - DNA, 25 bp, Homo sapien
agcctggacgagagtgctagatgcc

SEQ ID NO: 475275 - DNA, 25 bp, Homo sapien
gcctggacgagagtgctagatgcca

SEQ ID NO: 475276 - DNA, 25 bp, Homo sapien
cctggacgagagtgctagatgccat

SEQ ID NO: 475277 - DNA, 25 bp, Homo sapien
attaaaactactgataggtcggccg

SEQ ID NO: 475278 - DNA, 25 bp, Homo sapien
ttaaaactactgataggtcggccgg

SEQ ID NO: 475279 - DNA, 25 bp, Homo sapien
taaaactactgataggtcggccggg

SEQ ID NO: 475280 - DNA, 25 bp, Homo sapien
aaactactgataggtcggccgggtg

SEQ ID NO: 475281 - DNA, 25 bp, Homo sapien
aactactgataggtcggccgggtgc

SEQ ID NO: 475282 - DNA, 25 bp, Homo sapien
tttaatttaaagaatagaggccagg

SEQ ID NO: 475283 - DNA, 25 bp, Homo sapien
ttaatttaaagaatagaggccaggc

SEQ ID NO: 475284 - DNA, 25 bp, Homo sapien
taatttaaagaatagaggccaggcg

SEQ ID NO: 475285 - DNA, 25 bp, Homo sapien
aatttaaagaatagaggccaggcgc

SEQ ID NO: 475286 - DNA, 25 bp, Homo sapien
atttaaagaatagaggccaggcgca

SEQ ID NO: 475287 - DNA, 25 bp, Homo sapien
cagatcgtgaggtcgggagtttcag

SEQ ID NO: 475288 - DNA, 25 bp, Homo sapien
atcgtgaggtcgggagtttcagacc

SEQ ID NO: 475289 - DNA, 25 bp, Homo sapien
tcgtgaggtcgggagtttcagacca

SEQ ID NO: 475290 - DNA, 25 bp, Homo sapien
cagcctgaccaacaaccccatctct

SEQ ID NO: 475291 - DNA, 25 bp, Homo sapien
agcctgaccaacaaccccatctcta

SEQ ID NO: 475292 - DNA, 25 bp, Homo sapien
gcctgaccaacaaccccatctctac

SEQ ID NO: 475293 - DNA, 25 bp, Homo sapien
aaggatgtacggacagatgaacaga

SEQ ID NO: 475294 - DNA, 25 bp, Homo sapien
gaaacagatcagtctggaggagacg

SEQ ID NO: 475295 - DNA, 25 bp, Homo sapien
aggagacggagtgtgctatcccaga

SEQ ID NO: 475296 - DNA, 25 bp, Homo sapien
ggagtgtgctatcccagaagcctag

SEQ ID NO: 475297 - DNA, 25 bp, Homo sapien
gctatcccagaagcctagcagcaga

SEQ ID NO: 475298 - DNA, 25 bp, Homo sapien
agcagagcatcccactggcagcaga

SEQ ID NO: 475299 - DNA, 25 bp, Homo sapien
tctgggaccagatgccaaatctctt

SEQ ID NO: 475300 - DNA, 25 bp, Homo sapien
agatgccaaatctcttcccctgctg

SEQ ID NO: 475301 - DNA, 25 bp, Homo sapien
aatctcttcccctgctgttgcatct

SEQ ID NO: 475302 - DNA, 25 bp, Homo sapien
gtgctcctggccagcatcagtctgc

SEQ ID NO: 475303 - DNA, 25 bp, Homo sapien
gcatcagtctgctctcaaggtggaa

SEQ ID NO: 475304 - DNA, 25 bp, Homo sapien
aaagcccatgcttgttttctgtgcc

SEQ ID NO: 475305 - DNA, 25 bp, Homo sapien
gccatatccctactaagtgccaagt

SEQ ID NO: 475306 - DNA, 25 bp, Homo sapien
gcctgctgtgaccacaagaggttca

SEQ ID NO: 475307 - DNA, 25 bp, Homo sapien
tgaccacaagaggttcagacaagaa

SEQ ID NO: 475308 - DNA, 25 bp, Homo sapien
gacaagaaagcaatcaatgggaatt

SEQ ID NO: 475309 - DNA, 25 bp, Homo sapien
agcattcattcatgagagctagcag

SEQ ID NO: 475310 - DNA, 25 bp, Homo sapien
attcatgagagctagcaggtggcca

SEQ ID NO: 475311 - DNA, 25 bp, Homo sapien
atgagagctagcaggtggccaagcc

SEQ ID NO: 475312 - DNA, 25 bp, Homo sapien
agacaagggcagtctccattcctcc

SEQ ID NO: 475313 - DNA, 25 bp, Homo sapien
tccattcctccttgactactgtctt

SEQ ID NO: 475314 - DNA, 25 bp, Homo sapien
accctcaccatcaaggaagttcttc

SEQ ID NO: 475315 - DNA, 25 bp, Homo sapien
aaagtgccacagacaggccgggcac

SEQ ID NO: 475316 - DNA, 25 bp, Homo sapien
aagtgccacagacaggccgggcacg

SEQ ID NO: 475317 - DNA, 25 bp, Homo sapien
agtgccacagacaggccgggcacgg

SEQ ID NO: 475318 - DNA, 25 bp, Homo sapien
ggtacctgtgatcccggctagtcgg

SEQ ID NO: 475319 - DNA, 25 bp, Homo sapien
gtacctgtgatcccggctagtcggg

SEQ ID NO: 475320 - DNA, 25 bp, Homo sapien
tacctgtgatcccggctagtcggga

SEQ ID NO: 475321 - DNA, 25 bp, Homo sapien
cctgtgatcccggctagtcgggagc

SEQ ID NO: 475322 - DNA, 25 bp, Homo sapien
ctgtgatcccggctagtcgggagcc

SEQ ID NO: 475323 - DNA, 25 bp, Homo sapien
tgtgatcccggctagtcgggagcct

SEQ ID NO: 475324 - DNA, 25 bp, Homo sapien
tgatcccggctagtcgggagcctga

SEQ ID NO: 475325 - DNA, 25 bp, Homo sapien
gatcccggctagtcgggagcctgag

SEQ ID NO: 475326 - DNA, 25 bp, Homo sapien
ttgaaactatcctgcagggtaaaac

SEQ ID NO: 475327 - DNA, 25 bp, Homo sapien
atcctgcagggtaaaacaactgtcc

SEQ ID NO: 475328 - DNA, 25 bp, Homo sapien
aaggtaacagtgcatgttctcccct

SEQ ID NO: 475329 - DNA, 25 bp, Homo sapien
atgttctcccctcagcctgggacag

SEQ ID NO: 475330 - DNA, 25 bp, Homo sapien
gacagcttcaccaggcaaattcctg

SEQ ID NO: 475331 - DNA, 25 bp, Homo sapien
tcaccaggcaaattcctgctcattc

SEQ ID NO: 475332 - DNA, 25 bp, Homo sapien
ttcctcaacctcaagaacacatcga

SEQ ID NO: 475333 - DNA, 25 bp, Homo sapien
aacacatcgagttctctgtcttctg

SEQ ID NO: 475334 - DNA, 25 bp, Homo sapien
tagctcttgctgtaacagtagacac

SEQ ID NO: 475335 - DNA, 25 bp, Homo sapien
gtaacagtagacacatgatttcggt

SEQ ID NO: 475336 - DNA, 25 bp, Homo sapien
tggacactgctacatgccccagaac

SEQ ID NO: 475337 - DNA, 25 bp, Homo sapien
gtgagaccattttcagactgtccta

SEQ ID NO: 475338 - DNA, 25 bp, Homo sapien
agactgtcctagtctgccctcacat

SEQ ID NO: 475339 - DNA, 25 bp, Homo sapien
tgccctcacatatccctggaatgga

SEQ ID NO: 475340 - DNA, 25 bp, Homo sapien
atatccctggaatggacacatacag

SEQ ID NO: 475341 - DNA, 25 bp, Homo sapien
tacacttggatctcttgcgtatcac

SEQ ID NO: 475342 - DNA, 25 bp, Homo sapien
tcttgcgtatcacacgagactcatt

SEQ ID NO: 475343 - DNA, 25 bp, Homo sapien
gagactcatttattgatgactgcct

SEQ ID NO: 475344 - DNA, 25 bp, Homo sapien
atgactgcctagctggctcataata

SEQ ID NO: 475345 - DNA, 25 bp, Homo sapien
gctggctcataatactgatggctga

SEQ ID NO: 475346 - DNA, 25 bp, Homo sapien
gggtatgaaaactggtcctcaagag

SEQ ID NO: 475347 - DNA, 25 bp, Homo sapien
ggtcctcaagagtatccagtcttat

SEQ ID NO: 475348 - DNA, 25 bp, Homo sapien
ttttgtttcttctatactgccttat

SEQ ID NO: 475349 - DNA, 25 bp, Homo sapien
cttctatactgccttattttgtaga

SEQ ID NO: 475350 - DNA, 25 bp, Homo sapien
aaagtagctattttctcgtataaca

SEQ ID NO: 475351 - DNA, 25 bp, Homo sapien
gttattattacccttattatctatg

SEQ ID NO: 475352 - DNA, 25 bp, Homo sapien
tacccttattatctatgttacaaac

SEQ ID NO: 475353 - DNA, 25 bp, Homo sapien
gttacaaacccaaccatacagtgct

SEQ ID NO: 475354 - DNA, 25 bp, Homo sapien
caaccatacagtgctaatcttgttt

SEQ ID NO: 475355 - DNA, 25 bp, Homo sapien
tttaaccttctaatttgccacttat

SEQ ID NO: 475356 - DNA, 25 bp, Homo sapien
atttgccacttatacttctgattga

SEQ ID NO: 475357 - DNA, 25 bp, Homo sapien
acttctgattgattcctttgtgtag

SEQ ID NO: 475358 - DNA, 25 bp, Homo sapien
gattagagttacacaatttattgct

SEQ ID NO: 475359 - DNA, 25 bp, Homo sapien
gtcttcaaaagccagaacaatggcc

SEQ ID NO: 475360 - DNA, 25 bp, Homo sapien
tcttcaaaagccagaacaatggcca

SEQ ID NO: 475361 - DNA, 25 bp, Homo sapien
cttcaaaagccagaacaatggccag

SEQ ID NO: 475362 - DNA, 25 bp, Homo sapien
ttcaaaagccagaacaatggccaga

SEQ ID NO: 475363 - DNA, 25 bp, Homo sapien
tcaaaagccagaacaatggccagat

SEQ ID NO: 475364 - DNA, 25 bp, Homo sapien
caaaagccagaacaatggccagatg

SEQ ID NO: 475365 - DNA, 25 bp, Homo sapien
aaaagccagaacaatggccagatgt

SEQ ID NO: 475366 - DNA, 25 bp, Homo sapien
aaagccagaacaatggccagatgtg

SEQ ID NO: 475367 - DNA, 25 bp, Homo sapien
aagccagaacaatggccagatgtgg

SEQ ID NO: 475368 - DNA, 25 bp, Homo sapien
aaatggcagttatttgtgggacagg

SEQ ID NO: 475369 - DNA, 25 bp, Homo sapien
acagggctgtgttgagacttggcat

SEQ ID NO: 475370 - DNA, 25 bp, Homo sapien
gctgtgttgagacttggcatgcttc

SEQ ID NO: 475371 - DNA, 25 bp, Homo sapien
gtgttgagacttggcatgcttcttt

SEQ ID NO: 475372 - DNA, 25 bp, Homo sapien
ttgagacttggcatgcttcttttta

SEQ ID NO: 475373 - DNA, 25 bp, Homo sapien
gagtcagtgttgtaatttaggtata

SEQ ID NO: 475374 - DNA, 25 bp, Homo sapien
gaagcagtactttgtattagtttcc

SEQ ID NO: 475375 - DNA, 25 bp, Homo sapien
gtattagtttcctgtaggcgctgta

SEQ ID NO: 475376 - DNA, 25 bp, Homo sapien
attagtttcctgtaggcgctgtaac

SEQ ID NO: 475377 - DNA, 25 bp, Homo sapien
tagtttcctgtaggcgctgtaacaa

SEQ ID NO: 475378 - DNA, 25 bp, Homo sapien
aaaacaacagacatggccgggcacg

SEQ ID NO: 475379 - DNA, 25 bp, Homo sapien
tccagtgtctgctttttgaatcctt

SEQ ID NO: 475380 - DNA, 25 bp, Homo sapien
tgaatccttctgttcgtgtgtgtgt

SEQ ID NO: 475381 - DNA, 25 bp, Homo sapien
tccctatgatactggcagtggcaat

SEQ ID NO: 475382 - DNA, 25 bp, Homo sapien
ggcaataattttccacccagagaga

SEQ ID NO: 475383 - DNA, 25 bp, Homo sapien
cccagagagaagcttgtggtccaca

SEQ ID NO: 475384 - DNA, 25 bp, Homo sapien
tgtggtccacaatgctcgaagaatg

SEQ ID NO: 475385 - DNA, 25 bp, Homo sapien
gaatgaatttccaagtatttgccag

SEQ ID NO: 475386 - DNA, 25 bp, Homo sapien
ccagtggaaacggagcagaggctat

SEQ ID NO: 475387 - DNA, 25 bp, Homo sapien
gcagaggctatgacaagagtgattt

SEQ ID NO: 475388 - DNA, 25 bp, Homo sapien
ttagtgttgcactttcagagcaatt

SEQ ID NO: 475389 - DNA, 25 bp, Homo sapien
cagagcaattatctactgcagtaat

SEQ ID NO: 475390 - DNA, 25 bp, Homo sapien
aataatcattagatgggctcaacag

SEQ ID NO: 475391 - DNA, 25 bp, Homo sapien
ctcaacagtagagtgaagatgacaa

SEQ ID NO: 475392 - DNA, 25 bp, Homo sapien
agactgaaaaatgaaccatgcctca

SEQ ID NO: 475393 - DNA, 25 bp, Homo sapien
aaaatgaaccatgcctcaggtccat

SEQ ID NO: 475394 - DNA, 25 bp, Homo sapien
atgaaccatgcctcaggtccatgtg

SEQ ID NO: 475395 - DNA, 25 bp, Homo sapien
aaccatgcctcaggtccatgtggaa

SEQ ID NO: 475396 - DNA, 25 bp, Homo sapien
atgcctcaggtccatgtggaacagt

SEQ ID NO: 475397 - DNA, 25 bp, Homo sapien
acatttgtatcattagaggcctaga

SEQ ID NO: 475398 - DNA, 25 bp, Homo sapien
atcattagaggcctagaatggagaa

SEQ ID NO: 475399 - DNA, 25 bp, Homo sapien
aatggagaaaagagtgacgctgaaa

SEQ ID NO: 475400 - DNA, 25 bp, Homo sapien
tgacgctgaaagaacacctgaagaa

SEQ ID NO: 475401 - DNA, 25 bp, Homo sapien
gaccaggtgcaaagttctagtcaca

SEQ ID NO: 475402 - DNA, 25 bp, Homo sapien
gtcacaaggtcagcaaattcgtatt

SEQ ID NO: 475403 - DNA, 25 bp, Homo sapien
aaattcgtattagtctgagttctca

SEQ ID NO: 475404 - DNA, 25 bp, Homo sapien
tgagttctcatcttcagtgaatggg

SEQ ID NO: 475405 - DNA, 25 bp, Homo sapien
gtgtcttaactggtattcatgtcat

SEQ ID NO: 475406 - DNA, 25 bp, Homo sapien
gtcatcaaacttgggcttgacttga

SEQ ID NO: 475407 - DNA, 25 bp, Homo sapien
ggcttgacttgagactgcatgcaga

SEQ ID NO: 475408 - DNA, 25 bp, Homo sapien
ggatagaccacctgaatgtgcacat

SEQ ID NO: 475409 - DNA, 25 bp, Homo sapien
tgagtgtctgacacatttacctatg

SEQ ID NO: 475410 - DNA, 25 bp, Homo sapien
ttacctatgttaggccatccatctt

SEQ ID NO: 475411 - DNA, 25 bp, Homo sapien
aggccatccatcttcccatgaggat

SEQ ID NO: 475412 - DNA, 25 bp, Homo sapien
gaattatgctggatgcaatttatca

SEQ ID NO: 475413 - DNA, 25 bp, Homo sapien
gaaattcattaatctttcctcaaaa

SEQ ID NO: 475414 - DNA, 25 bp, Homo sapien
tttcctcaaaattgtagccatggtc

SEQ ID NO: 475415 - DNA, 25 bp, Homo sapien
agccatggtcaaaggagacattcca

SEQ ID NO: 475416 - DNA, 25 bp, Homo sapien
tccatccccgtaattggttggccct

SEQ ID NO: 475417 - DNA, 25 bp, Homo sapien
cagtaaaaatctctgtgttgggaac

SEQ ID NO: 475418 - DNA, 25 bp, Homo sapien
ctgtgttgggaacttatagcaaaat

SEQ ID NO: 475419 - DNA, 25 bp, Homo sapien
aaatgaactgccattctctgctctt

SEQ ID NO: 475420 - DNA, 25 bp, Homo sapien
tgccattctctgctcttataagtag

SEQ ID NO: 475421 - DNA, 25 bp, Homo sapien
gtagcaataaatttcaacaggacaa

SEQ ID NO: 475422 - DNA, 25 bp, Homo sapien
aaccagcaaacatttccaattaggg

SEQ ID NO: 475423 - DNA, 25 bp, Homo sapien
gagtagacactttctaagttgagat

SEQ ID NO: 475424 - DNA, 25 bp, Homo sapien
gacactttctaagttgagatttaaa

SEQ ID NO: 475425 - DNA, 25 bp, Homo sapien
gtaaataaccacttaccatttgctt

SEQ ID NO: 475426 - DNA, 25 bp, Homo sapien
ataaccacttaccatttgcttaata

SEQ ID NO: 475427 - DNA, 25 bp, Homo sapien
ccatttgcttaatatgtgctaacta

SEQ ID NO: 475428 - DNA, 25 bp, Homo sapien
tgcttaatatgtgctaactatagtg

SEQ ID NO: 475429 - DNA, 25 bp, Homo sapien
gtgctaactatagtgtgcattgtag

SEQ ID NO: 475430 - DNA, 25 bp, Homo sapien
aactatagtgtgcattgtaggaaaa

SEQ ID NO: 475431 - DNA, 25 bp, Homo sapien
gaaatacaaggaacagactctttta

SEQ ID NO: 475432 - DNA, 25 bp, Homo sapien
taggaagacctcatttctattagaa

SEQ ID NO: 475433 - DNA, 25 bp, Homo sapien
ggaagacctcatttctattagaaag

SEQ ID NO: 475434 - DNA, 25 bp, Homo sapien
tgacgtcatcctttgcatgggcgat

SEQ ID NO: 475435 - DNA, 25 bp, Homo sapien
ctttgcatgggcgatggcacttggt

SEQ ID NO: 475436 - DNA, 25 bp, Homo sapien
tggcacttggtgctggccactgcac

SEQ ID NO: 475437 - DNA, 25 bp, Homo sapien
gctggccactgcacggtgctaaagt

SEQ ID NO: 475438 - DNA, 25 bp, Homo sapien
actgcacggtgctaaagtgagcttt

SEQ ID NO: 475439 - DNA, 25 bp, Homo sapien
agtgagctttgcgattggcttctcc

SEQ ID NO: 475440 - DNA, 25 bp, Homo sapien
aggaccagggacagccaaactatat

SEQ ID NO: 475441 - DNA, 25 bp, Homo sapien
gacagccaaactatatacgcccaga

SEQ ID NO: 475442 - DNA, 25 bp, Homo sapien
tatatacgcccagaaaactttggtt

SEQ ID NO: 475443 - DNA, 25 bp, Homo sapien
cctgagtaagggtgcatgagctgcc

SEQ ID NO: 475444 - DNA, 25 bp, Homo sapien
gggttcctggcaatcaggtttcttg

SEQ ID NO: 475445 - DNA, 25 bp, Homo sapien
tcatctctgctctcttcggaagatt

SEQ ID NO: 475446 - DNA, 25 bp, Homo sapien
ttcggaagattcctcaatctctccc

SEQ ID NO: 475447 - DNA, 25 bp, Homo sapien
ttttttgagctccagacaagcccat

SEQ ID NO: 475448 - DNA, 25 bp, Homo sapien
gacaagcccatagggtgtctcagaa

SEQ ID NO: 475449 - DNA, 25 bp, Homo sapien
gggtgtctcagaagcatctcaaata

SEQ ID NO: 475450 - DNA, 25 bp, Homo sapien
gcatctcaaatataccaaggccaaa

SEQ ID NO: 475451 - DNA, 25 bp, Homo sapien
ggccaaaacactaaattcatctctt

SEQ ID NO: 475452 - DNA, 25 bp, Homo sapien
aattcatctcttttactctccaacc

SEQ ID NO: 475453 - DNA, 25 bp, Homo sapien
aagaggcacgtcaagatcccttgca

SEQ ID NO: 475454 - DNA, 25 bp, Homo sapien
atcccttgcatttccacaaactaga

SEQ ID NO: 475455 - DNA, 25 bp, Homo sapien
agaattctaacatccctaccttatg

SEQ ID NO: 475456 - DNA, 25 bp, Homo sapien
gtttctttagccacacggtgagcag

SEQ ID NO: 475457 - DNA, 25 bp, Homo sapien
acacggtgagcagcttggactctgg

SEQ ID NO: 475458 - DNA, 25 bp, Homo sapien
actaaacttgccagctctcttcaat

SEQ ID NO: 475459 - DNA, 25 bp, Homo sapien
ctgtgtttcattgctagtgtccctc

SEQ ID NO: 475460 - DNA, 25 bp, Homo sapien
gctagtgtccctccaggatggatat

SEQ ID NO: 475461 - DNA, 25 bp, Homo sapien
ggatggatattccagtcctcgcagc

SEQ ID NO: 475462 - DNA, 25 bp, Homo sapien
agtcctcgcagctcagggctctgca

SEQ ID NO: 475463 - DNA, 25 bp, Homo sapien
gggctctgcactccccatgaaagaa

SEQ ID NO: 475464 - DNA, 25 bp, Homo sapien
gaagcataacaattagcaccaaaag

SEQ ID NO: 475465 - DNA, 25 bp, Homo sapien
ttagcaccaaaagcaagctactggg

SEQ ID NO: 475466 - DNA, 25 bp, Homo sapien
acaccattgctctctaacctgggag

SEQ ID NO: 475467 - DNA, 25 bp, Homo sapien
agaaaatcataaggtccgtgtgtgg

SEQ ID NO: 475468 - DNA, 25 bp, Homo sapien
gaaaatcataaggtccgtgtgtggc

SEQ ID NO: 475469 - DNA, 25 bp, Homo sapien
aaaatcataaggtccgtgtgtggcg

SEQ ID NO: 475470 - DNA, 25 bp, Homo sapien
aaatcataaggtccgtgtgtggcgt

SEQ ID NO: 475471 - DNA, 25 bp, Homo sapien
atcataaggtccgtgtgtggcgtcc

SEQ ID NO: 475472 - DNA, 25 bp, Homo sapien
tcataaggtccgtgtgtggcgtccc

SEQ ID NO: 475473 - DNA, 25 bp, Homo sapien
cataaggtccgtgtgtggcgtccca

SEQ ID NO: 475474 - DNA, 25 bp, Homo sapien
ataaggtccgtgtgtggcgtcccac

SEQ ID NO: 475475 - DNA, 25 bp, Homo sapien
taaggtccgtgtgtggcgtcccacg

SEQ ID NO: 475476 - DNA, 25 bp, Homo sapien
aaggtccgtgtgtggcgtcccacgc

SEQ ID NO: 475477 - DNA, 25 bp, Homo sapien
ccgtgtgtggcgtcccacgcctgta

SEQ ID NO: 475478 - DNA, 25 bp, Homo sapien
ctcttgaatttatggttagggtctc

SEQ ID NO: 475479 - DNA, 25 bp, Homo sapien
atggttagggtctcaagaaggaagc

SEQ ID NO: 475480 - DNA, 25 bp, Homo sapien
gaaggaagcttgagactagactgta

SEQ ID NO: 475481 - DNA, 25 bp, Homo sapien
gactagactgtaatgtgtgtttgaa

SEQ ID NO: 475482 - DNA, 25 bp, Homo sapien
aatgtgtgtttgaaaaagcctgctc

SEQ ID NO: 475483 - DNA, 25 bp, Homo sapien
aagcctgctcaaggatgaacttaat

SEQ ID NO: 475484 - DNA, 25 bp, Homo sapien
ttaaattctctaaagctcaagtgga

SEQ ID NO: 475485 - DNA, 25 bp, Homo sapien
gctcaagtggagaaatgacatctgc

SEQ ID NO: 475486 - DNA, 25 bp, Homo sapien
ttatcttttagttgcattatgggta

SEQ ID NO: 475487 - DNA, 25 bp, Homo sapien
aaaggagagataacccaagtgatta

SEQ ID NO: 475488 - DNA, 25 bp, Homo sapien
cccaagtgattagaggttttagtag

SEQ ID NO: 475489 - DNA, 25 bp, Homo sapien
tgtcactctggcactgaggtcagcc

SEQ ID NO: 475490 - DNA, 25 bp, Homo sapien
tggcactgaggtcagccttgtccag

SEQ ID NO: 475491 - DNA, 25 bp, Homo sapien
actgaggtcagccttgtccaggtcg

SEQ ID NO: 475492 - DNA, 25 bp, Homo sapien
aggtcagccttgtccaggtcgcttt

SEQ ID NO: 475493 - DNA, 25 bp, Homo sapien
tgtccaggtcgctttgcatctgctg

SEQ ID NO: 475494 - DNA, 25 bp, Homo sapien
tgcatctgctgctgcgccaggtcct

SEQ ID NO: 475495 - DNA, 25 bp, Homo sapien
tgcgccaggtccttctcgcggagca

SEQ ID NO: 475496 - DNA, 25 bp, Homo sapien
tgcagcagggcctgtttctccaggg

SEQ ID NO: 475497 - DNA, 25 bp, Homo sapien
agcagggcctgtttctccagggctg

SEQ ID NO: 475498 - DNA, 25 bp, Homo sapien
ccgcctcctggacagctcgtgatgt

SEQ ID NO: 475499 - DNA, 25 bp, Homo sapien
tggacagctcgtgatgtccgggcca

SEQ ID NO: 475500 - DNA, 25 bp, Homo sapien
tacccacgtatgtcatctacgctca

SEQ ID NO: 475501 - DNA, 25 bp, Homo sapien
gtcatctacgctcattagaacggaa

SEQ ID NO: 475502 - DNA, 25 bp, Homo sapien
aacacctttcccgttgcacaaatag

SEQ ID NO: 475503 - DNA, 25 bp, Homo sapien
acaaatagggcctctcacccatgtg

SEQ ID NO: 475504 - DNA, 25 bp, Homo sapien
catgtgcttgcactggtggctaaca

SEQ ID NO: 475505 - DNA, 25 bp, Homo sapien
tggtataagcttttccgcagttctc

SEQ ID NO: 475506 - DNA, 25 bp, Homo sapien
cgcagttctcgtagttgcagcagta

SEQ ID NO: 475507 - DNA, 25 bp, Homo sapien
agcagtaaggccttgcctctgagga

SEQ ID NO: 475508 - DNA, 25 bp, Homo sapien
ggagttctgctctgctgtctgtgga

SEQ ID NO: 475509 - DNA, 25 bp, Homo sapien
atgctccggtaggaatgggcctgct

SEQ ID NO: 475510 - DNA, 25 bp, Homo sapien
gtctggctgacttacgagagtcctg

SEQ ID NO: 475511 - DNA, 25 bp, Homo sapien
aatataagggtattacgctgggcgt

SEQ ID NO: 475512 - DNA, 25 bp, Homo sapien
atataagggtattacgctgggcgtg

SEQ ID NO: 475513 - DNA, 25 bp, Homo sapien
gttgcagtgacctgtaatcagtcgc

SEQ ID NO: 475514 - DNA, 25 bp, Homo sapien
tgcagtgacctgtaatcagtcgcac

SEQ ID NO: 475515 - DNA, 25 bp, Homo sapien
gcagtgacctgtaatcagtcgcacc

SEQ ID NO: 475516 - DNA, 25 bp, Homo sapien
agtgacctgtaatcagtcgcaccac

SEQ ID NO: 475517 - DNA, 25 bp, Homo sapien
tgacctgtaatcagtcgcaccactg

SEQ ID NO: 475518 - DNA, 25 bp, Homo sapien
acctgtaatcagtcgcaccactgtt

SEQ ID NO: 475519 - DNA, 25 bp, Homo sapien
tgtaatcagtcgcaccactgttcac

SEQ ID NO: 475520 - DNA, 25 bp, Homo sapien
taatcagtcgcaccactgttcacca

SEQ ID NO: 475521 - DNA, 25 bp, Homo sapien
atcagtcgcaccactgttcaccagt

SEQ ID NO: 475522 - DNA, 25 bp, Homo sapien
catccctcaggacccaatgtggctg

SEQ ID NO: 475523 - DNA, 25 bp, Homo sapien
ccaatgtggctgtcttctctaggaa

SEQ ID NO: 475524 - DNA, 25 bp, Homo sapien
gctgtcttctctaggaagccatctg

SEQ ID NO: 475525 - DNA, 25 bp, Homo sapien
ggaagccatctgaacttataagttg

SEQ ID NO: 475526 - DNA, 25 bp, Homo sapien
gagttaggagtctgttctggacctc

SEQ ID NO: 475527 - DNA, 25 bp, Homo sapien
ttggcccctgtcataccttgtgaag

SEQ ID NO: 475528 - DNA, 25 bp, Homo sapien
ctgtcataccttgtgaagtcttgtt

SEQ ID NO: 475529 - DNA, 25 bp, Homo sapien
gaagtcttgtttaatcatctatctc

SEQ ID NO: 475530 - DNA, 25 bp, Homo sapien
atcatctatctcatacatgtcagta

SEQ ID NO: 475531 - DNA, 25 bp, Homo sapien
ggaaatgtgtccatcttgtttaaaa

SEQ ID NO: 475532 - DNA, 25 bp, Homo sapien
acagtatctttagggcttgatgtct

SEQ ID NO: 475533 - DNA, 25 bp, Homo sapien
cagcctggacgagagtgctagatgc

SEQ ID NO: 475534 - DNA, 25 bp, Homo sapien
agcctggacgagagtgctagatgcc

SEQ ID NO: 475535 - DNA, 25 bp, Homo sapien
gcctggacgagagtgctagatgcca

SEQ ID NO: 475536 - DNA, 25 bp, Homo sapien
cctggacgagagtgctagatgccat

SEQ ID NO: 475537 - DNA, 25 bp, Homo sapien
attaaaactactgataggtcggccg

SEQ ID NO: 475538 - DNA, 25 bp, Homo sapien
ttaaaactactgataggtcggccgg

SEQ ID NO: 475539 - DNA, 25 bp, Homo sapien
taaaactactgataggtcggccggg

SEQ ID NO: 475540 - DNA, 25 bp, Homo sapien
aaactactgataggtcggccgggtg

SEQ ID NO: 475541 - DNA, 25 bp, Homo sapien
aactactgataggtcggccgggtgc

SEQ ID NO: 475542 - DNA, 25 bp, Homo sapien
ggtcggccgggtgcgctggctcatg

SEQ ID NO: 475543 - DNA, 25 bp, Homo sapien
gtcggccgggtgcgctggctcatgc

SEQ ID NO: 475544 - DNA, 25 bp, Homo sapien
ggagaaatgacacaaatgccagtat

SEQ ID NO: 475545 - DNA, 25 bp, Homo sapien
atgccagtataccagttcaagatag

SEQ ID NO: 475546 - DNA, 25 bp, Homo sapien
tagctaaaatttaccctacttattg

SEQ ID NO: 475547 - DNA, 25 bp, Homo sapien
taccctacttattggtgcaattttt

SEQ ID NO: 475548 - DNA, 25 bp, Homo sapien
taatagaaaaccattcctcattgct

SEQ ID NO: 475549 - DNA, 25 bp, Homo sapien
cattgcttggaatttttatctgcac

SEQ ID NO: 475550 - DNA, 25 bp, Homo sapien
ttttatctgcactttccattttgaa

SEQ ID NO: 475551 - DNA, 25 bp, Homo sapien
gttgaacaccaggtttactctgcag

SEQ ID NO: 475552 - DNA, 25 bp, Homo sapien
ggtttactctgcaggacaccaagca

SEQ ID NO: 475553 - DNA, 25 bp, Homo sapien
aagcaaagctttagaaatttctgcc

SEQ ID NO: 475554 - DNA, 25 bp, Homo sapien
tgccatcattaaaccctgaacagac

SEQ ID NO: 475555 - DNA, 25 bp, Homo sapien
gtgtgtgtccacataaaagtgattt

SEQ ID NO: 475556 - DNA, 25 bp, Homo sapien
gtgtgtccacataaaagtgatttat

SEQ ID NO: 475557 - DNA, 25 bp, Homo sapien
gtgatttataagctagtggtagtat

SEQ ID NO: 475558 - DNA, 25 bp, Homo sapien
tgagaattatagcaaaccattaagc

SEQ ID NO: 475559 - DNA, 25 bp, Homo sapien
atagcaaaccattaagctttagaat

SEQ ID NO: 475560 - DNA, 25 bp, Homo sapien
gcaaaccattaagctttagaataat

SEQ ID NO: 475561 - DNA, 25 bp, Homo sapien
gaaaacatctatttctccagtaggc

SEQ ID NO: 475562 - DNA, 25 bp, Homo sapien
aaacatctatttctccagtaggcca

SEQ ID NO: 475563 - DNA, 25 bp, Homo sapien
aacatctatttctccagtaggccaa

SEQ ID NO: 475564 - DNA, 25 bp, Homo sapien
acatctatttctccagtaggccaac

SEQ ID NO: 475565 - DNA, 25 bp, Homo sapien
atctatttctccagtaggccaacag

SEQ ID NO: 475566 - DNA, 25 bp, Homo sapien
aagtgccatcagacaagatcagttg

SEQ ID NO: 475567 - DNA, 25 bp, Homo sapien
gccatcagacaagatcagttgatca

SEQ ID NO: 475568 - DNA, 25 bp, Homo sapien
gacaagatcagttgatcagaacaga

SEQ ID NO: 475569 - DNA, 25 bp, Homo sapien
gatcagaacagaaagctagctcgga

SEQ ID NO: 475570 - DNA, 25 bp, Homo sapien
agaaagctagctcggaaaatcctac

SEQ ID NO: 475571 - DNA, 25 bp, Homo sapien
aagctagctcggaaaatcctacaag

SEQ ID NO: 475572 - DNA, 25 bp, Homo sapien
gctagctcggaaaatcctacaagag

SEQ ID NO: 475573 - DNA, 25 bp, Homo sapien
gctcggaaaatcctacaagagaaag

SEQ ID NO: 475574 - DNA, 25 bp, Homo sapien
agaaagtagatgttttctacaatgg

SEQ ID NO: 475575 - DNA, 25 bp, Homo sapien
acagtcctgttcacaaagaaaaacg

SEQ ID NO: 475576 - DNA, 25 bp, Homo sapien
gtcctgttcacaaagaaaaacgaga

SEQ ID NO: 475577 - DNA, 25 bp, Homo sapien
gacagatcttactcagtgtagaact

SEQ ID NO: 475578 - DNA, 25 bp, Homo sapien
acagatcttactcagtgtagaactt

SEQ ID NO: 475579 - DNA, 25 bp, Homo sapien
cagatcttactcagtgtagaacttt

SEQ ID NO: 475580 - DNA, 25 bp, Homo sapien
agatcttactcagtgtagaactttt

SEQ ID NO: 475581 - DNA, 25 bp, Homo sapien
gatcttactcagtgtagaactttta

SEQ ID NO: 475582 - DNA, 25 bp, Homo sapien
atcttactcagtgtagaacttttat

SEQ ID NO: 475583 - DNA, 25 bp, Homo sapien
tcttactcagtgtagaacttttatt

SEQ ID NO: 475584 - DNA, 25 bp, Homo sapien
cttactcagtgtagaacttttattt

SEQ ID NO: 475585 - DNA, 25 bp, Homo sapien
ttactcagtgtagaacttttatttt

SEQ ID NO: 475586 - DNA, 25 bp, Homo sapien
aattcatcattctaccaggtggctg

SEQ ID NO: 475587 - DNA, 25 bp, Homo sapien
attctaccaggtggctggtaccctt

SEQ ID NO: 475588 - DNA, 25 bp, Homo sapien
gatgtgttataagccactctttaca

SEQ ID NO: 475589 - DNA, 25 bp, Homo sapien
ccaaggttacacagcaagggtgaga

SEQ ID NO: 475590 - DNA, 25 bp, Homo sapien
gaactaaggtctttctgatgcaaaa

SEQ ID NO: 475591 - DNA, 25 bp, Homo sapien
tgatgcaaaatctaccctctttcta

SEQ ID NO: 475592 - DNA, 25 bp, Homo sapien
caaaatctaccctctttctacaaca

SEQ ID NO: 475593 - DNA, 25 bp, Homo sapien
atcgcccttcaattttatctcacaa

SEQ ID NO: 475594 - DNA, 25 bp, Homo sapien
tcacaattgctaccagaggctcatt

SEQ ID NO: 475595 - DNA, 25 bp, Homo sapien
tgtttaactggcttgtccataccct

SEQ ID NO: 475596 - DNA, 25 bp, Homo sapien
ataccctctgcaatacactgctttc

SEQ ID NO: 475597 - DNA, 25 bp, Homo sapien
aagaaactctgaatccgaccagtgt

SEQ ID NO: 475598 - DNA, 25 bp, Homo sapien
atccgaccagtgtaggtgattacat

SEQ ID NO: 475599 - DNA, 25 bp, Homo sapien
ggtgattacattagcctttgaagtc

SEQ ID NO: 475600 - DNA, 25 bp, Homo sapien
tccaggattttgcaaagttgtatat

SEQ ID NO: 475601 - DNA, 25 bp, Homo sapien
tttaatgctgtgcaactgctaaact

SEQ ID NO: 475602 - DNA, 25 bp, Homo sapien
ggaactaaaagcaactagctcccta

SEQ ID NO: 475603 - DNA, 25 bp, Homo sapien
gcaactagctccctaatggtctata

SEQ ID NO: 475604 - DNA, 25 bp, Homo sapien
attcagtggttgtctactatccata

SEQ ID NO: 475605 - DNA, 25 bp, Homo sapien
ggttgtctactatccatacttctta

SEQ ID NO: 475606 - DNA, 25 bp, Homo sapien
gtctactatccatacttcttatcac

SEQ ID NO: 475607 - DNA, 25 bp, Homo sapien
acttcttatcactttagtttttcat

SEQ ID NO: 475608 - DNA, 25 bp, Homo sapien
gtattttttggcttcactcatggtg

SEQ ID NO: 475609 - DNA, 25 bp, Homo sapien
tttggcttcactcatggtggtgtga

SEQ ID NO: 475610 - DNA, 25 bp, Homo sapien
ttggcttcactcatggtggtgtgag

SEQ ID NO: 475611 - DNA, 25 bp, Homo sapien
gcttcactcatggtggtgtgagtct

SEQ ID NO: 475612 - DNA, 25 bp, Homo sapien
tcactcatggtggtgtgagtctgtg

SEQ ID NO: 475613 - DNA, 25 bp, Homo sapien
tgtggtcccagctatccgatggcag

SEQ ID NO: 475614 - DNA, 25 bp, Homo sapien
gtggtcccagctatccgatggcagg

SEQ ID NO: 475615 - DNA, 25 bp, Homo sapien
tggtcccagctatccgatggcaggg

SEQ ID NO: 475616 - DNA, 25 bp, Homo sapien
tcccagctatccgatggcagggcgg

SEQ ID NO: 475617 - DNA, 25 bp, Homo sapien
aggtgggacgattgcttaagagatc

SEQ ID NO: 475618 - DNA, 25 bp, Homo sapien
gcttaagagatcaagaggttgaggc

SEQ ID NO: 475619 - DNA, 25 bp, Homo sapien
cttgcactatcacacatacatatgg

SEQ ID NO: 475620 - DNA, 25 bp, Homo sapien
ttgcactatcacacatacatatgga

SEQ ID NO: 475621 - DNA, 25 bp, Homo sapien
tgcactatcacacatacatatggaa

SEQ ID NO: 475622 - DNA, 25 bp, Homo sapien
gcactatcacacatacatatggaaa

SEQ ID NO: 475623 - DNA, 25 bp, Homo sapien
actatcacacatacatatggaaaat

SEQ ID NO: 475624 - DNA, 25 bp, Homo sapien
cacatacatatggaaaatagacaag

SEQ ID NO: 475625 - DNA, 25 bp, Homo sapien
taagtagtgagttacaatacagcac

SEQ ID NO: 475626 - DNA, 25 bp, Homo sapien
agtagtgagttacaatacagcactt

SEQ ID NO: 475627 - DNA, 25 bp, Homo sapien
gtagtgagttacaatacagcacttt

SEQ ID NO: 475628 - DNA, 25 bp, Homo sapien
gtgagttacaatacagcactttgcg

SEQ ID NO: 475629 - DNA, 25 bp, Homo sapien
agttacaatacagcactttgcgagg

SEQ ID NO: 475630 - DNA, 25 bp, Homo sapien
aagagttgtggctgagatttgaacc

SEQ ID NO: 475631 - DNA, 25 bp, Homo sapien
agatttgaaccctgctctgtcttac

SEQ ID NO: 475632 - DNA, 25 bp, Homo sapien
tctgtcttactccagagcgcagcaa

SEQ ID NO: 475633 - DNA, 25 bp, Homo sapien
agagcgcagcaagtccctagggctt

SEQ ID NO: 475634 - DNA, 25 bp, Homo sapien
aagggcatgcctttaaccagatggc

SEQ ID NO: 475635 - DNA, 25 bp, Homo sapien
cggccggtggtctgttgtgccctct

SEQ ID NO: 475636 - DNA, 25 bp, Homo sapien
gtgagtgcacacaagccagactcca

SEQ ID NO: 475637 - DNA, 25 bp, Homo sapien
cctgcgttagccacgtgacctggag

SEQ ID NO: 475638 - DNA, 25 bp, Homo sapien
tagccacgtgacctggagctagctg

SEQ ID NO: 475639 - DNA, 25 bp, Homo sapien
tgcctcccattttcggactgtggat

SEQ ID NO: 475640 - DNA, 25 bp, Homo sapien
tttcggactgtggatccagagctag

SEQ ID NO: 475641 - DNA, 25 bp, Homo sapien
gacactataccacattaaaacactt

SEQ ID NO: 475642 - DNA, 25 bp, Homo sapien
gttaaggttgagtgtcctctcacta

SEQ ID NO: 475643 - DNA, 25 bp, Homo sapien
ttgagtgtcctctcactattatccc

SEQ ID NO: 475644 - DNA, 25 bp, Homo sapien
gactggtccaagttagtaaggtatt

SEQ ID NO: 475645 - DNA, 25 bp, Homo sapien
gtattattctacttctatgggtggt

SEQ ID NO: 475646 - DNA, 25 bp, Homo sapien
cttctatgggtggtacagtatggtg

SEQ ID NO: 475647 - DNA, 25 bp, Homo sapien
ctcctaccctgacaaagtgtccaga

SEQ ID NO: 475648 - DNA, 25 bp, Homo sapien
aaagtgtccagaactctacacaccc

SEQ ID NO: 475649 - DNA, 25 bp, Homo sapien
aggagccagtctggtgcagaagcca

SEQ ID NO: 475650 - DNA, 25 bp, Homo sapien
gtgcagaagccagcctgaggatgaa

SEQ ID NO: 475651 - DNA, 25 bp, Homo sapien
gcctgaggatgaactgacccaggga

SEQ ID NO: 475652 - DNA, 25 bp, Homo sapien
ttctcagaaaaagagtaacccaaat

SEQ ID NO: 475653 - DNA, 25 bp, Homo sapien
aatacttttcaagtccatgtggctt

SEQ ID NO: 475654 - DNA, 25 bp, Homo sapien
agtccatgtggcttgattaatcttt

SEQ ID NO: 475655 - DNA, 25 bp, Homo sapien
gtccatgtggcttgattaatcttta

SEQ ID NO: 475656 - DNA, 25 bp, Homo sapien
catgtggcttgattaatctttaata

SEQ ID NO: 475657 - DNA, 25 bp, Homo sapien
aaatggatattctacctagctttgt

SEQ ID NO: 475658 - DNA, 25 bp, Homo sapien
ggatattctacctagctttgttaat

SEQ ID NO: 475659 - DNA, 25 bp, Homo sapien
attctacctagctttgttaatcaaa

SEQ ID NO: 475660 - DNA, 25 bp, Homo sapien
ataaactcatattatctctgttaca

SEQ ID NO: 475661 - DNA, 25 bp, Homo sapien
actcatattatctctgttacaaaat

SEQ ID NO: 475662 - DNA, 25 bp, Homo sapien
gttacaaaatttgccagcaagaaaa

SEQ ID NO: 475663 - DNA, 25 bp, Homo sapien
gggcctttcagtgggtgggaggctg

SEQ ID NO: 475664 - DNA, 25 bp, Homo sapien
ggcctttcagtgggtgggaggctgg

SEQ ID NO: 475665 - DNA, 25 bp, Homo sapien
gcctttcagtgggtgggaggctggg

SEQ ID NO: 475666 - DNA, 25 bp, Homo sapien
gagaaattcctaatgtagatgatga

SEQ ID NO: 475667 - DNA, 25 bp, Homo sapien
agaaattcctaatgtagatgatgag

SEQ ID NO: 475668 - DNA, 25 bp, Homo sapien
gaaattcctaatgtagatgatgagt

SEQ ID NO: 475669 - DNA, 25 bp, Homo sapien
aaattcctaatgtagatgatgagtt

SEQ ID NO: 475670 - DNA, 25 bp, Homo sapien
ttcctaatgtagatgatgagttgat

SEQ ID NO: 475671 - DNA, 25 bp, Homo sapien
tcctaatgtagatgatgagttgatg

SEQ ID NO: 475672 - DNA, 25 bp, Homo sapien
atgtagatgatgagttgatgggtgt

SEQ ID NO: 475673 - DNA, 25 bp, Homo sapien
tgatgagttgatgggtgtggcaaac

SEQ ID NO: 475674 - DNA, 25 bp, Homo sapien
ggccttccaaagtgcaaagagactt

SEQ ID NO: 475675 - DNA, 25 bp, Homo sapien
gactttatgatattcgagttcacct

SEQ ID NO: 475676 - DNA, 25 bp, Homo sapien
tgatattcgagttcacctacctcag

SEQ ID NO: 475677 - DNA, 25 bp, Homo sapien
atattcgagttcacctacctcagtc

SEQ ID NO: 475678 - DNA, 25 bp, Homo sapien
gagttcacctacctcagtcttataa

SEQ ID NO: 475679 - DNA, 25 bp, Homo sapien
gttcacctacctcagtcttataata

SEQ ID NO: 475680 - DNA, 25 bp, Homo sapien
acctcagtcttataatactatttag

SEQ ID NO: 475681 - DNA, 25 bp, Homo sapien
gaatttctctctctgctatagctgg

SEQ ID NO: 475682 - DNA, 25 bp, Homo sapien
atttctctctctgctatagctgggc

SEQ ID NO: 475683 - DNA, 25 bp, Homo sapien
ctctctctgctatagctgggcgtgg

SEQ ID NO: 475684 - DNA, 25 bp, Homo sapien
tgagccgagattgctgggcgacaga

SEQ ID NO: 475685 - DNA, 25 bp, Homo sapien
gtaggccaacagtgctcgaggaatt

SEQ ID NO: 475686 - DNA, 25 bp, Homo sapien
acagtgctcgaggaattccgcagct

SEQ ID NO: 475687 - DNA, 25 bp, Homo sapien
gaggaattccgcagcttttagagca

SEQ ID NO: 475688 - DNA, 25 bp, Homo sapien
aattccgcagcttttagagcagaag

SEQ ID NO: 475689 - DNA, 25 bp, Homo sapien
gaagtaacacttccgtacaggccta

SEQ ID NO: 475690 - DNA, 25 bp, Homo sapien
gtaacacttccgtacaggcctagaa

SEQ ID NO: 475691 - DNA, 25 bp, Homo sapien
gaagtaaaggcaacatccactgagg

SEQ ID NO: 475692 - DNA, 25 bp, Homo sapien
gcaacatccactgaggagcagttct

SEQ ID NO: 475693 - DNA, 25 bp, Homo sapien
gagcagttctttgatttgcaccacc

SEQ ID NO: 475694 - DNA, 25 bp, Homo sapien
atttgcaccaccaccggatccggga

SEQ ID NO: 475695 - DNA, 25 bp, Homo sapien
gatccgggacctgaaataaaagaca

SEQ ID NO: 475696 - DNA, 25 bp, Homo sapien
acatccttgaatgtggaagacattt

SEQ ID NO: 475697 - DNA, 25 bp, Homo sapien
catccttgaatgtggaagacatttt

SEQ ID NO: 475698 - DNA, 25 bp, Homo sapien
atccttgaatgtggaagacatttta

SEQ ID NO: 475699 - DNA, 25 bp, Homo sapien
tccttgaatgtggaagacattttaa

SEQ ID NO: 475700 - DNA, 25 bp, Homo sapien
ccttgaatgtggaagacattttaaa

SEQ ID NO: 475701 - DNA, 25 bp, Homo sapien
cttgaatgtggaagacattttaaaa

SEQ ID NO: 475702 - DNA, 25 bp, Homo sapien
gatcgagaccactgtggctaacatg

SEQ ID NO: 475703 - DNA, 25 bp, Homo sapien
gagaccactgtggctaacatggtga

SEQ ID NO: 475704 - DNA, 25 bp, Homo sapien
ttagccaggtggcaggcgtctgtag

SEQ ID NO: 475705 - DNA, 25 bp, Homo sapien
tagccaggtggcaggcgtctgtagc

SEQ ID NO: 475706 - DNA, 25 bp, Homo sapien
caggtggcaggcgtctgtagcccca

SEQ ID NO: 475707 - DNA, 25 bp, Homo sapien
tggtttccagtcattatagtctcgt

SEQ ID NO: 475708 - DNA, 25 bp, Homo sapien
tatagtctcgtacttcatcatagaa

SEQ ID NO: 475709 - DNA, 25 bp, Homo sapien
gatggttttattactccagtgttgt

SEQ ID NO: 475710 - DNA, 25 bp, Homo sapien
ttactccagtgttgtttacatcccc

SEQ ID NO: 475711 - DNA, 25 bp, Homo sapien
atcccagatttttccattcgtctaa

SEQ ID NO: 475712 - DNA, 25 bp, Homo sapien
tttccattcgtctaaccttgcttga

SEQ ID NO: 475713 - DNA, 25 bp, Homo sapien
aaccttgcttgatttcctatagcac

SEQ ID NO: 475714 - DNA, 25 bp, Homo sapien
ttctgaccaggattttggtttctct

SEQ ID NO: 475715 - DNA, 25 bp, Homo sapien
tgtgtatctcttgtttacagcccca

SEQ ID NO: 475716 - DNA, 25 bp, Homo sapien
agtgtcctcttgtaaaacccatgca

SEQ ID NO: 475717 - DNA, 25 bp, Homo sapien
gattctaataaatcttgtgctcagc

SEQ ID NO: 475718 - DNA, 25 bp, Homo sapien
acctggatgggctgtgagtctctgt

SEQ ID NO: 475719 - DNA, 25 bp, Homo sapien
gagtctctgttactcagggtctcct

SEQ ID NO: 475720 - DNA, 25 bp, Homo sapien
agggtctccttgtgggcactgttct

SEQ ID NO: 475721 - DNA, 25 bp, Homo sapien
acccaggccttggtgggcgatgtga

SEQ ID NO: 475722 - DNA, 25 bp, Homo sapien
tgagtgccggaaaaagaccacagga

SEQ ID NO: 475723 - DNA, 25 bp, Homo sapien
ggcaaagaactgactcaggagtcca

SEQ ID NO: 475724 - DNA, 25 bp, Homo sapien
aggagtccacatccagggcttgcag

SEQ ID NO: 475725 - DNA, 25 bp, Homo sapien
agggcttgcagcagggtccccagta

SEQ ID NO: 475726 - DNA, 25 bp, Homo sapien
gcagggtccccagtacgcagctgga

SEQ ID NO: 475727 - DNA, 25 bp, Homo sapien
ctcccaatgaggtcaacccaggcag

SEQ ID NO: 475728 - DNA, 25 bp, Homo sapien
atgaggtcaacccaggcagcccaat

SEQ ID NO: 475729 - DNA, 25 bp, Homo sapien
gtcagccaagggactcagaagactc

SEQ ID NO: 475730 - DNA, 25 bp, Homo sapien
ggctgaacaatctgtgttccacaaa

SEQ ID NO: 475731 - DNA, 25 bp, Homo sapien
atctgtgttccacaaacactgctct

SEQ ID NO: 475732 - DNA, 25 bp, Homo sapien
aaacactgctctaccaagtctgcta

SEQ ID NO: 475733 - DNA, 25 bp, Homo sapien
tgctctaccaagtctgctatgatgt

SEQ ID NO: 475734 - DNA, 25 bp, Homo sapien
tctgctatgatgtaattctgactcg

SEQ ID NO: 475735 - DNA, 25 bp, Homo sapien
gatgtaattctgactcgtggatgtg

SEQ ID NO: 475736 - DNA, 25 bp, Homo sapien
tgactcgtggatgtgatggacctaa

SEQ ID NO: 475737 - DNA, 25 bp, Homo sapien
tggacctaagatgtgcacagctttt

SEQ ID NO: 475738 - DNA, 25 bp, Homo sapien
tactcataatgatctcccttacacc

SEQ ID NO: 475739 - DNA, 25 bp, Homo sapien
atgtgaaacgcatttgggatctaaa

SEQ ID NO: 475740 - DNA, 25 bp, Homo sapien
tttctaccccagaaatctgtgctct

SEQ ID NO: 475741 - DNA, 25 bp, Homo sapien
gtgctctgcctattattattcatcc

SEQ ID NO: 475742 - DNA, 25 bp, Homo sapien
ccaactcctgtcaatcactgatttt

SEQ ID NO: 475743 - DNA, 25 bp, Homo sapien
tgacttttccagaatggcatatagg

SEQ ID NO: 475744 - DNA, 25 bp, Homo sapien
ggtgcagtcatgcaatatatagcct

SEQ ID NO: 475745 - DNA, 25 bp, Homo sapien
gccttttcagaatggctcttagcaa

SEQ ID NO: 475746 - DNA, 25 bp, Homo sapien
agtttcctcaccaaatcattatctg

SEQ ID NO: 475747 - DNA, 25 bp, Homo sapien
atcattatctgaatgtaccacagtt

SEQ ID NO: 475748 - DNA, 25 bp, Homo sapien
gaataacatcttggttgctcccact

SEQ ID NO: 475749 - DNA, 25 bp, Homo sapien
gttgctcccactttggttacagttg

SEQ ID NO: 475750 - DNA, 25 bp, Homo sapien
ttggttacagttgccctaaactcca

SEQ ID NO: 475751 - DNA, 25 bp, Homo sapien
aacaaaactggtcttcaacagactg

SEQ ID NO: 475752 - DNA, 25 bp, Homo sapien
tcttaaatgtaagaagcactgctgt

SEQ ID NO: 475753 - DNA, 25 bp, Homo sapien
agaagcactgctgtgaaggtagaca

SEQ ID NO: 475754 - DNA, 25 bp, Homo sapien
gacagattggacagttctgctatct

SEQ ID NO: 475755 - DNA, 25 bp, Homo sapien
attggacagttctgctatctttgca

SEQ ID NO: 475756 - DNA, 25 bp, Homo sapien
gcaacttagctcttctgcatttgaa

SEQ ID NO: 475757 - DNA, 25 bp, Homo sapien
gctcttctgcatttgaaagttaaaa

SEQ ID NO: 475758 - DNA, 25 bp, Homo sapien
aactggccccatttccactataata

SEQ ID NO: 475759 - DNA, 25 bp, Homo sapien
ggccccatttccactataataaaga

SEQ ID NO: 475760 - DNA, 25 bp, Homo sapien
taataaagatcctggttacatttga

SEQ ID NO: 475761 - DNA, 25 bp, Homo sapien
tcctggttacatttgataagggaaa

SEQ ID NO: 475762 - DNA, 25 bp, Homo sapien
gattgcagtgagtctagactgtgcc

SEQ ID NO: 475763 - DNA, 25 bp, Homo sapien
attgcagtgagtctagactgtgcca

SEQ ID NO: 475764 - DNA, 25 bp, Homo sapien
gtgagtctagactgtgccattgggc

SEQ ID NO: 475765 - DNA, 25 bp, Homo sapien
tgagtctagactgtgccattgggct

SEQ ID NO: 475766 - DNA, 25 bp, Homo sapien
gagtctagactgtgccattgggctc

SEQ ID NO: 475767 - DNA, 25 bp, Homo sapien
agtctagactgtgccattgggctcc

SEQ ID NO: 475768 - DNA, 25 bp, Homo sapien
tctagactgtgccattgggctccag

SEQ ID NO: 475769 - DNA, 25 bp, Homo sapien
ctagactgtgccattgggctccagc

SEQ ID NO: 475770 - DNA, 25 bp, Homo sapien
ttgagactgcactgagcagtggatg

SEQ ID NO: 475771 - DNA, 25 bp, Homo sapien
tgcactgagcagtggatgtgccact

SEQ ID NO: 475772 - DNA, 25 bp, Homo sapien
gagcagtggatgtgccactgtactc

SEQ ID NO: 475773 - DNA, 25 bp, Homo sapien
tgtccccacattctcagtcgtccaa

SEQ ID NO: 475774 - DNA, 25 bp, Homo sapien
agtcgtccaacccatcatcccggga

SEQ ID NO: 475775 - DNA, 25 bp, Homo sapien
atcccgggactcttctccaagcagg

SEQ ID NO: 475776 - DNA, 25 bp, Homo sapien
ttggcagcatgaggcctcccatcat

SEQ ID NO: 475777 - DNA, 25 bp, Homo sapien
gcagcatgaggcctcccatcatcat

SEQ ID NO: 475778 - DNA, 25 bp, Homo sapien
accctgcgggccattcgcgtctaca

SEQ ID NO: 475779 - DNA, 25 bp, Homo sapien
cgtctacatgggtgactccgatgtc

SEQ ID NO: 475780 - DNA, 25 bp, Homo sapien
acatgggtgactccgatgtctacac

SEQ ID NO: 475781 - DNA, 25 bp, Homo sapien
gggtgactccgatgtctacaccgtg

SEQ ID NO: 475782 - DNA, 25 bp, Homo sapien
atgtctacaccgtgcaccatatggt

SEQ ID NO: 475783 - DNA, 25 bp, Homo sapien
tgtctacaccgtgcaccatatggtg

SEQ ID NO: 475784 - DNA, 25 bp, Homo sapien
aaagtgaactcacaagccctatgca

SEQ ID NO: 475785 - DNA, 25 bp, Homo sapien
aactcacaagccctatgcagtatat

SEQ ID NO: 475786 - DNA, 25 bp, Homo sapien
tcacaagccctatgcagtatatttc

SEQ ID NO: 475787 - DNA, 25 bp, Homo sapien
gtagaaaacttataagccatccagt

SEQ ID NO: 475788 - DNA, 25 bp, Homo sapien
aagccatccagtaaaaattccaaag

SEQ ID NO: 475789 - DNA, 25 bp, Homo sapien
aatgtagcaatattcttgagattcc

SEQ ID NO: 475790 - DNA, 25 bp, Homo sapien
attcttgagattcctaatgtctaga

SEQ ID NO: 475791 - DNA, 25 bp, Homo sapien
ttgagattcctaatgtctagagtag

SEQ ID NO: 475792 - DNA, 25 bp, Homo sapien
gtctagagtagttaatcagtgagat

SEQ ID NO: 475793 - DNA, 25 bp, Homo sapien
gatttgatgggtgatgagtctaaga

SEQ ID NO: 475794 - DNA, 25 bp, Homo sapien
aagaaatggattttgccatggccag

SEQ ID NO: 475795 - DNA, 25 bp, Homo sapien
aatttagttcttgctggatgacatg

SEQ ID NO: 475796 - DNA, 25 bp, Homo sapien
ctgtacttcagatgtaaagccggga

SEQ ID NO: 475797 - DNA, 25 bp, Homo sapien
aaagccgggatagtagcagtaccta

SEQ ID NO: 475798 - DNA, 25 bp, Homo sapien
agcagtacctacttcatgggattgt

SEQ ID NO: 475799 - DNA, 25 bp, Homo sapien
aacgtgtttagcacaatacctggca

SEQ ID NO: 475800 - DNA, 25 bp, Homo sapien
ggcacatggtaatcacccagtaaat

SEQ ID NO: 475801 - DNA, 25 bp, Homo sapien
agttgttactaccagctctaggagc

SEQ ID NO: 475802 - DNA, 25 bp, Homo sapien
ggagctgctcagagatgcaatttta

SEQ ID NO: 475803 - DNA, 25 bp, Homo sapien
gatgcaattttatagtccatggaat

SEQ ID NO: 475804 - DNA, 25 bp, Homo sapien
gtgtttgaagcagggtctggcacac

SEQ ID NO: 475805 - DNA, 25 bp, Homo sapien
agtaataatactgcactctatgcgg

SEQ ID NO: 475806 - DNA, 25 bp, Homo sapien
aagacaggtgcatcagttgaggtct

SEQ ID NO: 475807 - DNA, 25 bp, Homo sapien
agacaggtgcatcagttgaggtcta

SEQ ID NO: 475808 - DNA, 25 bp, Homo sapien
gacaggtgcatcagttgaggtctag

SEQ ID NO: 475809 - DNA, 25 bp, Homo sapien
acaggtgcatcagttgaggtctagg

SEQ ID NO: 475810 - DNA, 25 bp, Homo sapien
caggtgcatcagttgaggtctaggg

SEQ ID NO: 475811 - DNA, 25 bp, Homo sapien
gcatcagttgaggtctagggattga

SEQ ID NO: 475812 - DNA, 25 bp, Homo sapien
gaggtctagggattgagaccagcct

SEQ ID NO: 475813 - DNA, 25 bp, Homo sapien
gggcaacagaacaggactcggtcta

SEQ ID NO: 475814 - DNA, 25 bp, Homo sapien
gcaacagaacaggactcggtctaaa

SEQ ID NO: 475815 - DNA, 25 bp, Homo sapien
gaacaggactcggtctaaaataata

SEQ ID NO: 475816 - DNA, 25 bp, Homo sapien
caggactcggtctaaaataataata

SEQ ID NO: 475817 - DNA, 25 bp, Homo sapien
tagagcttggttcagtgttcccaca

SEQ ID NO: 475818 - DNA, 25 bp, Homo sapien
agagcttggttcagtgttcccacag

SEQ ID NO: 475819 - DNA, 25 bp, Homo sapien
agcttggttcagtgttcccacaggg

SEQ ID NO: 475820 - DNA, 25 bp, Homo sapien
gcttggttcagtgttcccacagggc

SEQ ID NO: 475821 - DNA, 25 bp, Homo sapien
ggtggacaggcctgcagcccagcac

SEQ ID NO: 475822 - DNA, 25 bp, Homo sapien
gcctgcagcccagcacaggaaggag

SEQ ID NO: 475823 - DNA, 25 bp, Homo sapien
ttctgatgtgtctccattaaaacgc

SEQ ID NO: 475824 - DNA, 25 bp, Homo sapien
gatgtgtctccattaaaacgccctt

SEQ ID NO: 475825 - DNA, 25 bp, Homo sapien
atgtgtctccattaaaacgcccttc

SEQ ID NO: 475826 - DNA, 25 bp, Homo sapien
gtgtctccattaaaacgcccttcat

SEQ ID NO: 475827 - DNA, 25 bp, Homo sapien
gtctccattaaaacgcccttcattg

SEQ ID NO: 475828 - DNA, 25 bp, Homo sapien
ggttagaaatcacctcatccacaca

SEQ ID NO: 475829 - DNA, 25 bp, Homo sapien
agtctcctctcaaatctctctagag

SEQ ID NO: 475830 - DNA, 25 bp, Homo sapien
agtttgtgagactacagctccgaga

SEQ ID NO: 475831 - DNA, 25 bp, Homo sapien
agctccgagaaagacatccaggttt

SEQ ID NO: 475832 - DNA, 25 bp, Homo sapien
atgaaaatgcatcgtgacctccgca

SEQ ID NO: 475833 - DNA, 25 bp, Homo sapien
tgcctaggcagcataccccagcatt

SEQ ID NO: 475834 - DNA, 25 bp, Homo sapien
taccccagcattcttgcagctgtga

SEQ ID NO: 475835 - DNA, 25 bp, Homo sapien
ctgtgacccatgtgcttaacagcac

SEQ ID NO: 475836 - DNA, 25 bp, Homo sapien
taacagcactgtggagtgccagcct

SEQ ID NO: 475837 - DNA, 25 bp, Homo sapien
gagagagaccgcagaaccatggccc

SEQ ID NO: 475838 - DNA, 25 bp, Homo sapien
tattcacctgccagcggaccatgct

SEQ ID NO: 475839 - DNA, 25 bp, Homo sapien
aagccatacacacagggatggagct

SEQ ID NO: 475840 - DNA, 25 bp, Homo sapien
gctgagaatggattacagatttgtt

SEQ ID NO: 475841 - DNA, 25 bp, Homo sapien
tacagatttgttactccagactcat

SEQ ID NO: 475842 - DNA, 25 bp, Homo sapien
gatttgttactccagactcatagtc

SEQ ID NO: 475843 - DNA, 25 bp, Homo sapien
gactcatagtctggacatgtctttc

SEQ ID NO: 475844 - DNA, 25 bp, Homo sapien
agtctggacatgtctttcccttcaa

SEQ ID NO: 475845 - DNA, 25 bp, Homo sapien
tttcccttcaattctccattgttga

SEQ ID NO: 475846 - DNA, 25 bp, Homo sapien
aattctccattgttgattagctcac

SEQ ID NO: 475847 - DNA, 25 bp, Homo sapien
gattagctcacgttatagttgatta

SEQ ID NO: 475848 - DNA, 25 bp, Homo sapien
gattagatggatggctttttattta

SEQ ID NO: 475849 - DNA, 25 bp, Homo sapien
gaatgttacaaattggctcagttat

SEQ ID NO: 475850 - DNA, 25 bp, Homo sapien
tgtttgtttaaaacctccttgccag

SEQ ID NO: 475851 - DNA, 25 bp, Homo sapien
ttgtttaaaacctccttgccaggcg

SEQ ID NO: 475852 - DNA, 25 bp, Homo sapien
tgtttaaaacctccttgccaggcgc

SEQ ID NO: 475853 - DNA, 25 bp, Homo sapien
gtttaaaacctccttgccaggcgcg

SEQ ID NO: 475854 - DNA, 25 bp, Homo sapien
tttaaaacctccttgccaggcgcgg

SEQ ID NO: 475855 - DNA, 25 bp, Homo sapien
ttaaaacctccttgccaggcgcggt

SEQ ID NO: 475856 - DNA, 25 bp, Homo sapien
taaaacctccttgccaggcgcggtg

SEQ ID NO: 475857 - DNA, 25 bp, Homo sapien
aaaacctccttgccaggcgcggtgg

SEQ ID NO: 475858 - DNA, 25 bp, Homo sapien
aaacctccttgccaggcgcggtggc

SEQ ID NO: 475859 - DNA, 25 bp, Homo sapien
ggaggccgagggaagaggatcacct

SEQ ID NO: 475860 - DNA, 25 bp, Homo sapien
gccgagggaagaggatcacctgagg

SEQ ID NO: 475861 - DNA, 25 bp, Homo sapien
acaagccactcatctctacagagat

SEQ ID NO: 475862 - DNA, 25 bp, Homo sapien
agcaagagacagaagaccgtggaga

SEQ ID NO: 475863 - DNA, 25 bp, Homo sapien
gaaaggccaccattcctgcttgatg

SEQ ID NO: 475864 - DNA, 25 bp, Homo sapien
gctcttgctcaagtggaataaaacc

SEQ ID NO: 475865 - DNA, 25 bp, Homo sapien
gaataaaaccccatggtcttcttga

SEQ ID NO: 475866 - DNA, 25 bp, Homo sapien
aaccccatggtcttcttgacatgat

SEQ ID NO: 475867 - DNA, 25 bp, Homo sapien
cttgatcttttctccactgagacac

SEQ ID NO: 475868 - DNA, 25 bp, Homo sapien
gacacacttaagtgatgatccttac

SEQ ID NO: 475869 - DNA, 25 bp, Homo sapien
tgatccttacaggactgacacccta

SEQ ID NO: 475870 - DNA, 25 bp, Homo sapien
ggactgacaccctaatgccaataaa

SEQ ID NO: 475871 - DNA, 25 bp, Homo sapien
aaaagttgctcattatggactgcta

SEQ ID NO: 475872 - DNA, 25 bp, Homo sapien
atatgcgccccacgagagcaggaag

SEQ ID NO: 475873 - DNA, 25 bp, Homo sapien
ttgctcactgctgaatctccaaggc

SEQ ID NO: 475874 - DNA, 25 bp, Homo sapien
cactgctgaatctccaaggcctggt

SEQ ID NO: 475875 - DNA, 25 bp, Homo sapien
actcgcgcatacagtaagtgcacaa

SEQ ID NO: 475876 - DNA, 25 bp, Homo sapien
gtgcacaataaatgcccgttcgctc

SEQ ID NO: 475877 - DNA, 25 bp, Homo sapien
taggcttccgctaacctcaatccat

SEQ ID NO: 475878 - DNA, 25 bp, Homo sapien
gctaacctcaatccattccaaaggg

SEQ ID NO: 475879 - DNA, 25 bp, Homo sapien
ccattccaaagggtgtcaggttcca

SEQ ID NO: 475880 - DNA, 25 bp, Homo sapien
aaagggtgtcaggttccaccctgag

SEQ ID NO: 475881 - DNA, 25 bp, Homo sapien
tggccagccctaaagaggaagaaca

SEQ ID NO: 475882 - DNA, 25 bp, Homo sapien
gaagaacaagtacccatactccctg

SEQ ID NO: 475883 - DNA, 25 bp, Homo sapien
aatcaagtgagggatgggtgcggtg

SEQ ID NO: 475884 - DNA, 25 bp, Homo sapien
atcaagtgagggatgggtgcggtgg

SEQ ID NO: 475885 - DNA, 25 bp, Homo sapien
tcaagtgagggatgggtgcggtggc

SEQ ID NO: 475886 - DNA, 25 bp, Homo sapien
caagtgagggatgggtgcggtggct

SEQ ID NO: 475887 - DNA, 25 bp, Homo sapien
aagtgagggatgggtgcggtggctc

SEQ ID NO: 475888 - DNA, 25 bp, Homo sapien
cgggaggtgcaggttgccgtgagct

SEQ ID NO: 475889 - DNA, 25 bp, Homo sapien
gggaggtgcaggttgccgtgagctg

SEQ ID NO: 475890 - DNA, 25 bp, Homo sapien
ggaggtgcaggttgccgtgagctga

SEQ ID NO: 475891 - DNA, 25 bp, Homo sapien
gcctgggagacaaagcaagcctctg

SEQ ID NO: 475892 - DNA, 25 bp, Homo sapien
cctgggagacaaagcaagcctctgt

SEQ ID NO: 475893 - DNA, 25 bp, Homo sapien
ctgggagacaaagcaagcctctgtc

SEQ ID NO: 475894 - DNA, 25 bp, Homo sapien
cagaagaagttagattttacagaat

SEQ ID NO: 475895 - DNA, 25 bp, Homo sapien
gctgtgagaaagaagcgtttagaca

SEQ ID NO: 475896 - DNA, 25 bp, Homo sapien
gaagcgtttagacatcttgaagtga

SEQ ID NO: 475897 - DNA, 25 bp, Homo sapien
aacagttagactgcacatactttct

SEQ ID NO: 475898 - DNA, 25 bp, Homo sapien
gactgcacatactttctatagctta

SEQ ID NO: 475899 - DNA, 25 bp, Homo sapien
gcacatactttctatagcttaagag

SEQ ID NO: 475900 - DNA, 25 bp, Homo sapien
actgagaaaatctttcagaatgcag

SEQ ID NO: 475901 - DNA, 25 bp, Homo sapien
gaatgcagtttagagagagttagaa

SEQ ID NO: 475902 - DNA, 25 bp, Homo sapien
atgacctgaggagctctaacataca

SEQ ID NO: 475903 - DNA, 25 bp, Homo sapien
cctgaggagctctaacatacatctg

SEQ ID NO: 475904 - DNA, 25 bp, Homo sapien
ggagctctaacatacatctgctagg

SEQ ID NO: 475905 - DNA, 25 bp, Homo sapien
gttgcaggttatggagaatttctaa

SEQ ID NO: 475906 - DNA, 25 bp, Homo sapien
tatagaatccaattcgagagtgttg

SEQ ID NO: 475907 - DNA, 25 bp, Homo sapien
gagagtgttggatactatatttcta

SEQ ID NO: 475908 - DNA, 25 bp, Homo sapien
atttctaagagtttgcatcagtgct

SEQ ID NO: 475909 - DNA, 25 bp, Homo sapien
taagagtttgcatcagtgctacttt

SEQ ID NO: 475910 - DNA, 25 bp, Homo sapien
agtgctactttgacccactggaaat

SEQ ID NO: 475911 - DNA, 25 bp, Homo sapien
ctttgacccactggaaatactgctt

SEQ ID NO: 475912 - DNA, 25 bp, Homo sapien
ggaaatactgctttaagacccagat

SEQ ID NO: 475913 - DNA, 25 bp, Homo sapien
gctttaagacccagatcaatttgag

SEQ ID NO: 475914 - DNA, 25 bp, Homo sapien
aatataatacaaggcattcatgcaa

SEQ ID NO: 475915 - DNA, 25 bp, Homo sapien
aaggcattcatgcaaacttgaaaac

SEQ ID NO: 475916 - DNA, 25 bp, Homo sapien
gggatagggtagtcgaattcacaga

SEQ ID NO: 475917 - DNA, 25 bp, Homo sapien
gggtagtcgaattcacagagttgga

SEQ ID NO: 475918 - DNA, 25 bp, Homo sapien
gtcgaattcacagagttggaaagta

SEQ ID NO: 475919 - DNA, 25 bp, Homo sapien
ttggaaagtagaatgtgggctgcca

SEQ ID NO: 475920 - DNA, 25 bp, Homo sapien
ttaatggctgcagagttttggccgg

SEQ ID NO: 475921 - DNA, 25 bp, Homo sapien
ggtgatggttgtacacagtgtcagt

SEQ ID NO: 475922 - DNA, 25 bp, Homo sapien
cacagtgtcagtgtacttaatgcta

SEQ ID NO: 475923 - DNA, 25 bp, Homo sapien
gtgtcagtgtacttaatgctactca

SEQ ID NO: 475924 - DNA, 25 bp, Homo sapien
agtgtacttaatgctactcaactgt

SEQ ID NO: 475925 - DNA, 25 bp, Homo sapien
taatatgtatattttgccacagttt

SEQ ID NO: 475926 - DNA, 25 bp, Homo sapien
tgtatattttgccacagtttaaaaa

SEQ ID NO: 475927 - DNA, 25 bp, Homo sapien
gtaaatgagtacagctggtcacttc

SEQ ID NO: 475928 - DNA, 25 bp, Homo sapien
acagctggtcacttctggctgagga

SEQ ID NO: 475929 - DNA, 25 bp, Homo sapien
gagttcagaggccttcactaaagaa

SEQ ID NO: 475930 - DNA, 25 bp, Homo sapien
atcaaaaagtggtggtcagcttccc

SEQ ID NO: 475931 - DNA, 25 bp, Homo sapien
gtggtggtcagcttcccacttcatg

SEQ ID NO: 475932 - DNA, 25 bp, Homo sapien
acttcatgggaaccctgtgttcaca

SEQ ID NO: 475933 - DNA, 25 bp, Homo sapien
agatgtccctggataaaaggcctga

SEQ ID NO: 475934 - DNA, 25 bp, Homo sapien
ctgagaggagctgttcaagcctgaa

SEQ ID NO: 475935 - DNA, 25 bp, Homo sapien
tcaagcctgaaccatttgtatgaga

SEQ ID NO: 475936 - DNA, 25 bp, Homo sapien
agagccctggcccacatacagaggg

SEQ ID NO: 475937 - DNA, 25 bp, Homo sapien
acatacagagggaccttgccaagtc

SEQ ID NO: 475938 - DNA, 25 bp, Homo sapien
ccctggttggcatctgaggccttga

SEQ ID NO: 475939 - DNA, 25 bp, Homo sapien
tggttggcatctgaggccttgacct

SEQ ID NO: 475940 - DNA, 25 bp, Homo sapien
gttggcatctgaggccttgacctcc

SEQ ID NO: 475941 - DNA, 25 bp, Homo sapien
ggcacctctggagagttaggaccca

SEQ ID NO: 475942 - DNA, 25 bp, Homo sapien
agagttaggacccaggcctgctctc

SEQ ID NO: 475943 - DNA, 25 bp, Homo sapien
agttaggacccaggcctgctctcag

SEQ ID NO: 475944 - DNA, 25 bp, Homo sapien
tgagaggaaaactaaccctgaactc

SEQ ID NO: 475945 - DNA, 25 bp, Homo sapien
acccctggcccctggaatgtgttag

SEQ ID NO: 475946 - DNA, 25 bp, Homo sapien
cctggcccctggaatgtgttagagt

SEQ ID NO: 475947 - DNA, 25 bp, Homo sapien
ggcccctggaatgtgttagagtgta

SEQ ID NO: 475948 - DNA, 25 bp, Homo sapien
ccctggaatgtgttagagtgtagat

SEQ ID NO: 475949 - DNA, 25 bp, Homo sapien
ctgaagtgatcaagatgagaagcat

SEQ ID NO: 475950 - DNA, 25 bp, Homo sapien
tgagaagcatggttccttggacgaa

SEQ ID NO: 475951 - DNA, 25 bp, Homo sapien
agcatggttccttggacgaaagtga

SEQ ID NO: 475952 - DNA, 25 bp, Homo sapien
ggttccttggacgaaagtgagaagt

SEQ ID NO: 475953 - DNA, 25 bp, Homo sapien
gaaagtagagccaagaggaccaatt

SEQ ID NO: 475954 - DNA, 25 bp, Homo sapien
gagccaagaggaccaattagatatg

SEQ ID NO: 475955 - DNA, 25 bp, Homo sapien
gagtgaaagttgaaaccagtatttt

SEQ ID NO: 475956 - DNA, 25 bp, Homo sapien
cagtatttttggcttgtgcacttaa

SEQ ID NO: 475957 - DNA, 25 bp, Homo sapien
tttggcttgtgcacttaaaaggaag

SEQ ID NO: 475958 - DNA, 25 bp, Homo sapien
ggaaggaattaccattagttgagat

SEQ ID NO: 475959 - DNA, 25 bp, Homo sapien
gtatatagatgaagcaagtcagatc

SEQ ID NO: 475960 - DNA, 25 bp, Homo sapien
gacttgcggaagaaacatacttttt

SEQ ID NO: 475961 - DNA, 25 bp, Homo sapien
tggcacaaaagctctgtataagcta

SEQ ID NO: 475962 - DNA, 25 bp, Homo sapien
tgtataagctagtcgtggccctatc

SEQ ID NO: 475963 - DNA, 25 bp, Homo sapien
gtggccctatccatacatagttttt

SEQ ID NO: 475964 - DNA, 25 bp, Homo sapien
catacatagtttttagctggtcaat

SEQ ID NO: 475965 - DNA, 25 bp, Homo sapien
tgactttaggcagggcacatgctct

SEQ ID NO: 475966 - DNA, 25 bp, Homo sapien
actccctatgatcttacactcttaa

SEQ ID NO: 475967 - DNA, 25 bp, Homo sapien
gatcttacactcttaacctctgtta

SEQ ID NO: 475968 - DNA, 25 bp, Homo sapien
tatatttatttaccacctagccccg

SEQ ID NO: 475969 - DNA, 25 bp, Homo sapien
aaccctgcaacatgatacgaaacct

SEQ ID NO: 475970 - DNA, 25 bp, Homo sapien
acgaaacctcataaagcaatccctt

SEQ ID NO: 475971 - DNA, 25 bp, Homo sapien
ttatggcagcgaacctgacccccaa

SEQ ID NO: 475972 - DNA, 25 bp, Homo sapien
gttctcctgacgcttggttgttccc

SEQ ID NO: 475973 - DNA, 25 bp, Homo sapien
tctcctgacgcttggttgttccctt

SEQ ID NO: 475974 - DNA, 25 bp, Homo sapien
tcctgacgcttggttgttcccttgc

SEQ ID NO: 475975 - DNA, 25 bp, Homo sapien
ctgacgcttggttgttcccttgccc

SEQ ID NO: 475976 - DNA, 25 bp, Homo sapien
gttcccttgccctttggtgcatgtg

SEQ ID NO: 475977 - DNA, 25 bp, Homo sapien
tcccttgccctttggtgcatgtggg

SEQ ID NO: 475978 - DNA, 25 bp, Homo sapien
ggtgcatgtgggtttaacaacctgt

SEQ ID NO: 475979 - DNA, 25 bp, Homo sapien
gcatgtgggtttaacaacctgtctt

SEQ ID NO: 475980 - DNA, 25 bp, Homo sapien
tgtgggtttaacaacctgtctttct

SEQ ID NO: 475981 - DNA, 25 bp, Homo sapien
tgggtttaacaacctgtctttctct

SEQ ID NO: 475982 - DNA, 25 bp, Homo sapien
tactggctagattcaataagagact

SEQ ID NO: 475983 - DNA, 25 bp, Homo sapien
ataagagactgttatgtcctaggtt

SEQ ID NO: 475984 - DNA, 25 bp, Homo sapien
atgtcctaggttatggtccattaga

SEQ ID NO: 475985 - DNA, 25 bp, Homo sapien
aaaggcacttgcatcatttattaat

SEQ ID NO: 475986 - DNA, 25 bp, Homo sapien
catttgttgtctttccaagtgtcaa

SEQ ID NO: 475987 - DNA, 25 bp, Homo sapien
gtgtcaaacgttcacttacggaact

SEQ ID NO: 475988 - DNA, 25 bp, Homo sapien
tcacttacggaactatttgcaaaag

SEQ ID NO: 475989 - DNA, 25 bp, Homo sapien
gctggtgagactaacgtaccgtgta

SEQ ID NO: 475990 - DNA, 25 bp, Homo sapien
acgtaccgtgtaaatgtattgtatc

SEQ ID NO: 475991 - DNA, 25 bp, Homo sapien
tgtatcactgtgatttcgaccagag

SEQ ID NO: 475992 - DNA, 25 bp, Homo sapien
aacactgccagtaaagctctgccag

SEQ ID NO: 475993 - DNA, 25 bp, Homo sapien
tgaacaaaacagtcttcaaaagcca

SEQ ID NO: 475994 - DNA, 25 bp, Homo sapien
aaacagtcttcaaaagccagaacaa

SEQ ID NO: 475995 - DNA, 25 bp, Homo sapien
aacagtcttcaaaagccagaacaat

SEQ ID NO: 475996 - DNA, 25 bp, Homo sapien
gtcttcaaaagccagaacaatggcc

SEQ ID NO: 475997 - DNA, 25 bp, Homo sapien
tcttcaaaagccagaacaatggcca

SEQ ID NO: 475998 - DNA, 25 bp, Homo sapien
ttcaaaagccagaacaatggccaga

SEQ ID NO: 475999 - DNA, 25 bp, Homo sapien
tcaaaagccagaacaatggccagat

SEQ ID NO: 476000 - DNA, 25 bp, Homo sapien
caaaagccagaacaatggccagatg

SEQ ID NO: 476001 - DNA, 25 bp, Homo sapien
aaaagccagaacaatggccagatgt

SEQ ID NO: 476002 - DNA, 25 bp, Homo sapien
aaagccagaacaatggccagatgtg

SEQ ID NO: 476003 - DNA, 25 bp, Homo sapien
aagccagaacaatggccagatgtgg

SEQ ID NO: 476004 - DNA, 25 bp, Homo sapien
gtacctgcagcgcagactccaggtg

SEQ ID NO: 476005 - DNA, 25 bp, Homo sapien
agcgcagactccaggtgggtccttc

SEQ ID NO: 476006 - DNA, 25 bp, Homo sapien
aggtgggtccttctccttgcgagtc

SEQ ID NO: 476007 - DNA, 25 bp, Homo sapien
actctgctcatccagaatctgttct

SEQ ID NO: 476008 - DNA, 25 bp, Homo sapien
cagaaacgtgttttgcctggcattt

SEQ ID NO: 476009 - DNA, 25 bp, Homo sapien
ttgcctggcatttatttagggtagc

SEQ ID NO: 476010 - DNA, 25 bp, Homo sapien
ttagggtagctgcttgattccttat

SEQ ID NO: 476011 - DNA, 25 bp, Homo sapien
ggtagctgcttgattccttataggc

SEQ ID NO: 476012 - DNA, 25 bp, Homo sapien
tgattccttataggcaagtagcttt

SEQ ID NO: 476013 - DNA, 25 bp, Homo sapien
taggcaagtagctttgactctgtac

SEQ ID NO: 476014 - DNA, 25 bp, Homo sapien
gtagctttgactctgtacttggagt

SEQ ID NO: 476015 - DNA, 25 bp, Homo sapien
ggaggcttgatttaaatgtgtgtgt

SEQ ID NO: 476016 - DNA, 25 bp, Homo sapien
gcgcgtgtgtattctccctttgtat

SEQ ID NO: 476017 - DNA, 25 bp, Homo sapien
gtgtattctccctttgtatgtgtat

SEQ ID NO: 476018 - DNA, 25 bp, Homo sapien
ggagattttcaggaagcccaagcat

SEQ ID NO: 476019 - DNA, 25 bp, Homo sapien
gaagcccaagcataggactcagttt

SEQ ID NO: 476020 - DNA, 25 bp, Homo sapien
ggactcagtttgacatacttcctaa

SEQ ID NO: 476021 - DNA, 25 bp, Homo sapien
gtcaactctcaagttttacttgcat

SEQ ID NO: 476022 - DNA, 25 bp, Homo sapien
tacttgcatcagtattaagttggct

SEQ ID NO: 476023 - DNA, 25 bp, Homo sapien
tttttgcccagacagtgagtgaact

SEQ ID NO: 476024 - DNA, 25 bp, Homo sapien
ggcttagaaataaagggcctcccat

SEQ ID NO: 476025 - DNA, 25 bp, Homo sapien
taaagggcctcccatagagggccct

SEQ ID NO: 476026 - DNA, 25 bp, Homo sapien
acttctaagttgattgaggcctgtg

SEQ ID NO: 476027 - DNA, 25 bp, Homo sapien
tgtgtcagacactttttggtttatt

SEQ ID NO: 476028 - DNA, 25 bp, Homo sapien
tggtttattactgtctctagagcac

SEQ ID NO: 476029 - DNA, 25 bp, Homo sapien
tagagcaccaacagtgcgtgccgat

SEQ ID NO: 476030 - DNA, 25 bp, Homo sapien
gaggacttgcatgtgccaggtgtca

SEQ ID NO: 476031 - DNA, 25 bp, Homo sapien
gtgccaggtgtcattaactcatcta

SEQ ID NO: 476032 - DNA, 25 bp, Homo sapien
actcatctaatccacataacttcag

SEQ ID NO: 476033 - DNA, 25 bp, Homo sapien
atggcacatagatttcctggaactc

SEQ ID NO: 476034 - DNA, 25 bp, Homo sapien
atttcctggaactcacctgtggtca

SEQ ID NO: 476035 - DNA, 25 bp, Homo sapien
acagatacgaaacaccatacccagg

SEQ ID NO: 476036 - DNA, 25 bp, Homo sapien
attcctgggatcagagagcatgtgc

SEQ ID NO: 476037 - DNA, 25 bp, Homo sapien
tacatgtttggctgggcgcagcagc

SEQ ID NO: 476038 - DNA, 25 bp, Homo sapien
acatgtttggctgggcgcagcagct

SEQ ID NO: 476039 - DNA, 25 bp, Homo sapien
tttggctgggcgcagcagcttgcgc

SEQ ID NO: 476040 - DNA, 25 bp, Homo sapien
aatcacttggacctgtgaggcccag

SEQ ID NO: 476041 - DNA, 25 bp, Homo sapien
atcacttggacctgtgaggcccaga

SEQ ID NO: 476042 - DNA, 25 bp, Homo sapien
cacttggacctgtgaggcccagatt

SEQ ID NO: 476043 - DNA, 25 bp, Homo sapien
acttggacctgtgaggcccagattg

SEQ ID NO: 476044 - DNA, 25 bp, Homo sapien
cttggacctgtgaggcccagattgt

SEQ ID NO: 476045 - DNA, 25 bp, Homo sapien
ttggacctgtgaggcccagattgtg

SEQ ID NO: 476046 - DNA, 25 bp, Homo sapien
acctgtgaggcccagattgtggtga

SEQ ID NO: 476047 - DNA, 25 bp, Homo sapien
gaggcccagattgtggtgagccgag

SEQ ID NO: 476048 - DNA, 25 bp, Homo sapien
gaaaatgtttcacccatgcatcgaa

SEQ ID NO: 476049 - DNA, 25 bp, Homo sapien
atgcatcgaacatgcctctatacag

SEQ ID NO: 476050 - DNA, 25 bp, Homo sapien
tgcctctatacaggacagtcataat

SEQ ID NO: 476051 - DNA, 25 bp, Homo sapien
gactgtgatgcatttcctaactttt

SEQ ID NO: 476052 - DNA, 25 bp, Homo sapien
atttcctaacttttattctctgctg

SEQ ID NO: 476053 - DNA, 25 bp, Homo sapien
agctatatgccctaaaacacagaaa

SEQ ID NO: 476054 - DNA, 25 bp, Homo sapien
aacacagaaataacctgaccccagg

SEQ ID NO: 476055 - DNA, 25 bp, Homo sapien
gaccccaggcctgttactgtggcag

SEQ ID NO: 476056 - DNA, 25 bp, Homo sapien
tactgtggcagcttggttggccttt

SEQ ID NO: 476057 - DNA, 25 bp, Homo sapien
gttggcctttagaggttaacattca

SEQ ID NO: 476058 - DNA, 25 bp, Homo sapien
gagaataacatcttcagatactgag

SEQ ID NO: 476059 - DNA, 25 bp, Homo sapien
gggaagtgaagctgtgaaagcacat

SEQ ID NO: 476060 - DNA, 25 bp, Homo sapien
tgtgaaagcacattggaggaaccga

SEQ ID NO: 476061 - DNA, 25 bp, Homo sapien
cacattggaggaaccgagggcctgc

SEQ ID NO: 476062 - DNA, 25 bp, Homo sapien
aaccgagggcctgcgcgaaacgtgt

SEQ ID NO: 476063 - DNA, 25 bp, Homo sapien
cctgcgcgaaacgtgtggttttgat

SEQ ID NO: 476064 - DNA, 25 bp, Homo sapien
tggaaatgagtctagtcacacaggg

SEQ ID NO: 476065 - DNA, 25 bp, Homo sapien
tcttgagccatagttggatccaact

SEQ ID NO: 476066 - DNA, 25 bp, Homo sapien
tggatccaactggagtttggagttt

SEQ ID NO: 476067 - DNA, 25 bp, Homo sapien
agtttctctgggtgagcacagtgaa

SEQ ID NO: 476068 - DNA, 25 bp, Homo sapien
ttctctgggtgagcacagtgaatgg

SEQ ID NO: 476069 - DNA, 25 bp, Homo sapien
aaggatggtttaaggacatggtgat

SEQ ID NO: 476070 - DNA, 25 bp, Homo sapien
aattatgagcaaattcacgaattcg

SEQ ID NO: 476071 - DNA, 25 bp, Homo sapien
tcacgaattcggttatgtactattg

SEQ ID NO: 476072 - DNA, 25 bp, Homo sapien
gttatgtactattgtggctggcaaa

SEQ ID NO: 476073 - DNA, 25 bp, Homo sapien
gctggcaaaagccacttaaactagg

SEQ ID NO: 476074 - DNA, 25 bp, Homo sapien
taaactaggctctctagcctgattt

SEQ ID NO: 476075 - DNA, 25 bp, Homo sapien
agcctgattttcagccatcattacc

SEQ ID NO: 476076 - DNA, 25 bp, Homo sapien
ttacccctcactaagaatccttgta

SEQ ID NO: 476077 - DNA, 25 bp, Homo sapien
gttaattacactcatcaccactgtt

SEQ ID NO: 476078 - DNA, 25 bp, Homo sapien
atcaccactgtttgctaatgggagc

SEQ ID NO: 476079 - DNA, 25 bp, Homo sapien
taatgggagcaaacccctagccaat

SEQ ID NO: 476080 - DNA, 25 bp, Homo sapien
ggagcaaacccctagccaatatttt

SEQ ID NO: 476081 - DNA, 25 bp, Homo sapien
agagtcaaagctgtggcaaccaaaa

SEQ ID NO: 476082 - DNA, 25 bp, Homo sapien
aaccaagagccttgctgaagatggc

SEQ ID NO: 476083 - DNA, 25 bp, Homo sapien
agatggcctgcctgagctgcagaga

SEQ ID NO: 476084 - DNA, 25 bp, Homo sapien
agggagctgcctgatgacgttctac

SEQ ID NO: 476085 - DNA, 25 bp, Homo sapien
tgatgacgttctactcctgtgacag

SEQ ID NO: 476086 - DNA, 25 bp, Homo sapien
agccagatctgcttccttcaattct

SEQ ID NO: 476087 - DNA, 25 bp, Homo sapien
cttcaattcttccttctgtgacatc

SEQ ID NO: 476088 - DNA, 25 bp, Homo sapien
tgtgacatccctcatctctgaacaa

SEQ ID NO: 476089 - DNA, 25 bp, Homo sapien
atctctgaacaataacaacctcttt

SEQ ID NO: 476090 - DNA, 25 bp, Homo sapien
ttgaataagtttccgttccttgcat

SEQ ID NO: 476091 - DNA, 25 bp, Homo sapien
cttgcatcccagaaatttccgacta

SEQ ID NO: 476092 - DNA, 25 bp, Homo sapien
tgtgaattgggctgtctgggctggc

SEQ ID NO: 476093 - DNA, 25 bp, Homo sapien
taggcccagagccactatggaccag

SEQ ID NO: 476094 - DNA, 25 bp, Homo sapien
ccagagccactatggaccagcttac

SEQ ID NO: 476095 - DNA, 25 bp, Homo sapien
aaatgtagcagggaggattctatag

SEQ ID NO: 476096 - DNA, 25 bp, Homo sapien
gggaggattctatagaggcgataac

SEQ ID NO: 476097 - DNA, 25 bp, Homo sapien
aggcgataactctcagaaggttgga

SEQ ID NO: 476098 - DNA, 25 bp, Homo sapien
gataactctcagaaggttggatacc

SEQ ID NO: 476099 - DNA, 25 bp, Homo sapien
gaaggttggataccattatttcaca

SEQ ID NO: 476100 - DNA, 25 bp, Homo sapien
ggataccattatttcacaacccaga

SEQ ID NO: 476101 - DNA, 25 bp, Homo sapien
gataccattatttcacaacccagag

SEQ ID NO: 476102 - DNA, 25 bp, Homo sapien
ttcacaacccagagctgtgccaaac

SEQ ID NO: 476103 - DNA, 25 bp, Homo sapien
gtgagcagacattctgcagctactt

SEQ ID NO: 476104 - DNA, 25 bp, Homo sapien
tgcagctacttcttccattatggaa

SEQ ID NO: 476105 - DNA, 25 bp, Homo sapien
tccattatggaatttgccaaatctg

SEQ ID NO: 476106 - DNA, 25 bp, Homo sapien
ggaatttgccaaatctgggtaaaag

SEQ ID NO: 476107 - DNA, 25 bp, Homo sapien
aggcccaagaagagagttactgtta

SEQ ID NO: 476108 - DNA, 25 bp, Homo sapien
gaacagggcctttaaaccaatcgca

SEQ ID NO: 476109 - DNA, 25 bp, Homo sapien
agggcctttaaaccaatcgcacttg

SEQ ID NO: 476110 - DNA, 25 bp, Homo sapien
taaaccaatcgcacttgggagagca

SEQ ID NO: 476111 - DNA, 25 bp, Homo sapien
gagagcagagatcctagtaagacag

SEQ ID NO: 476112 - DNA, 25 bp, Homo sapien
gttttcctcttgagtatttgctgaa

SEQ ID NO: 476113 - DNA, 25 bp, Homo sapien
atttgctgaattcttggattgctca

SEQ ID NO: 476114 - DNA, 25 bp, Homo sapien
agttagagacctggactgggcaaaa

SEQ ID NO: 476115 - DNA, 25 bp, Homo sapien
gttagagacctggactgggcaaaat

SEQ ID NO: 476116 - DNA, 25 bp, Homo sapien
ttagagacctggactgggcaaaatg

SEQ ID NO: 476117 - DNA, 25 bp, Homo sapien
tagagacctggactgggcaaaatgg

SEQ ID NO: 476118 - DNA, 25 bp, Homo sapien
attagcaaggtgtggtaatgtgcac

SEQ ID NO: 476119 - DNA, 25 bp, Homo sapien
ttagcaaggtgtggtaatgtgcacc

SEQ ID NO: 476120 - DNA, 25 bp, Homo sapien
tagcaaggtgtggtaatgtgcacca

SEQ ID NO: 476121 - DNA, 25 bp, Homo sapien
agcaaggtgtggtaatgtgcaccag

SEQ ID NO: 476122 - DNA, 25 bp, Homo sapien
gcaaggtgtggtaatgtgcaccagt

SEQ ID NO: 476123 - DNA, 25 bp, Homo sapien
caaggtgtggtaatgtgcaccagtg

SEQ ID NO: 476124 - DNA, 25 bp, Homo sapien
gtgtggtaatgtgcaccagtggtcc

SEQ ID NO: 476125 - DNA, 25 bp, Homo sapien
tagcggatgggcaggagcagctcca

SEQ ID NO: 476126 - DNA, 25 bp, Homo sapien
tccaggacgcggtcagggttcccgt

SEQ ID NO: 476127 - DNA, 25 bp, Homo sapien
acgcggtcagggttcccgtcctcag

SEQ ID NO: 476128 - DNA, 25 bp, Homo sapien
gatctgcgaacccaagacggtgccc

SEQ ID NO: 476129 - DNA, 25 bp, Homo sapien
tgcgaacccaagacggtgccctcag

SEQ ID NO: 476130 - DNA, 25 bp, Homo sapien
tgcccatcacagaacatccgggaag

SEQ ID NO: 476131 - DNA, 25 bp, Homo sapien
aacatccgggaagggcagagccatt

SEQ ID NO: 476132 - DNA, 25 bp, Homo sapien
gaagggcagagccatttcttcctca

SEQ ID NO: 476133 - DNA, 25 bp, Homo sapien
agagccatttcttcctcagcgaggt

SEQ ID NO: 476134 - DNA, 25 bp, Homo sapien
agtgcctgacacatgccacactgat

SEQ ID NO: 476135 - DNA, 25 bp, Homo sapien
tgccacactgatgaggtgaggtgac

SEQ ID NO: 476136 - DNA, 25 bp, Homo sapien
gaaactctgcacaaaagtaactcca

SEQ ID NO: 476137 - DNA, 25 bp, Homo sapien
aaactctgcacaaaagtaactccac

SEQ ID NO: 476138 - DNA, 25 bp, Homo sapien
aactctgcacaaaagtaactccact

SEQ ID NO: 476139 - DNA, 25 bp, Homo sapien
actctgcacaaaagtaactccactt

SEQ ID NO: 476140 - DNA, 25 bp, Homo sapien
ctctgcacaaaagtaactccacttt

SEQ ID NO: 476141 - DNA, 25 bp, Homo sapien
tctgcacaaaagtaactccactttt

SEQ ID NO: 476142 - DNA, 25 bp, Homo sapien
ctgcacaaaagtaactccactttta

SEQ ID NO: 476143 - DNA, 25 bp, Homo sapien
tgcacaaaagtaactccacttttat

SEQ ID NO: 476144 - DNA, 25 bp, Homo sapien
taaatgatctccttctagctgctct

SEQ ID NO: 476145 - DNA, 25 bp, Homo sapien
atctgtcttgctagatgagcctggc

SEQ ID NO: 476146 - DNA, 25 bp, Homo sapien
tcttgctagatgagcctggcttctt

SEQ ID NO: 476147 - DNA, 25 bp, Homo sapien
gcttcttttttcctgcagaaagatc

SEQ ID NO: 476148 - DNA, 25 bp, Homo sapien
ttttcagtttaacccgcatcacctt

SEQ ID NO: 476149 - DNA, 25 bp, Homo sapien
acccgcatcaccttttaaaattcat

SEQ ID NO: 476150 - DNA, 25 bp, Homo sapien
aaattcattgccagtgtagttccca

SEQ ID NO: 476151 - DNA, 25 bp, Homo sapien
gtagttcccaatatggcctcatact

SEQ ID NO: 476152 - DNA, 25 bp, Homo sapien
atatggcctcatactgacttcagat

SEQ ID NO: 476153 - DNA, 25 bp, Homo sapien
actgacttcagataccccagtgtat

SEQ ID NO: 476154 - DNA, 25 bp, Homo sapien
ataccccagtgtatctgaagaaagt

SEQ ID NO: 476155 - DNA, 25 bp, Homo sapien
acgcctgtaaattcaatgcaactga

SEQ ID NO: 476156 - DNA, 25 bp, Homo sapien
ctgaaaatctaacaggactctttgg

SEQ ID NO: 476157 - DNA, 25 bp, Homo sapien
taaggcgatcctaaaatccttaggg

SEQ ID NO: 476158 - DNA, 25 bp, Homo sapien
aaagccatgggctaaaaacagctga

SEQ ID NO: 476159 - DNA, 25 bp, Homo sapien
aacagctgagcggtagctgagagaa

SEQ ID NO: 476160 - DNA, 25 bp, Homo sapien
tcagcgcaggtcatgcctgacaggg

SEQ ID NO: 476161 - DNA, 25 bp, Homo sapien
gagggcaccccacacattgccagga

SEQ ID NO: 476162 - DNA, 25 bp, Homo sapien
acattgccaggacaactggttgggt

SEQ ID NO: 476163 - DNA, 25 bp, Homo sapien
ggtacagttaagatttctgccttac

SEQ ID NO: 476164 - DNA, 25 bp, Homo sapien
gttaagatttctgccttactctgta

SEQ ID NO: 476165 - DNA, 25 bp, Homo sapien
tctgccttactctgtacacacacat

SEQ ID NO: 476166 - DNA, 25 bp, Homo sapien
ttctcaactgttgccactagaatgt

SEQ ID NO: 476167 - DNA, 25 bp, Homo sapien
aactgttgccactagaatgtagtag

SEQ ID NO: 476168 - DNA, 25 bp, Homo sapien
gtataagtcttatacttcttttatt

SEQ ID NO: 476169 - DNA, 25 bp, Homo sapien
ctataaatgtagttgctttcttgat

SEQ ID NO: 476170 - DNA, 25 bp, Homo sapien
gatcttatgttttgtcaccttgctg

SEQ ID NO: 476171 - DNA, 25 bp, Homo sapien
ttatgttttgtcaccttgctgagct

SEQ ID NO: 476172 - DNA, 25 bp, Homo sapien
gtcaccttgctgagcttgcttatca

SEQ ID NO: 476173 - DNA, 25 bp, Homo sapien
gagcttgcttatcagtcctaacagt

SEQ ID NO: 476174 - DNA, 25 bp, Homo sapien
cttgcttatcagtcctaacagtttt

SEQ ID NO: 476175 - DNA, 25 bp, Homo sapien
ggattttctatatactgcaagatta

SEQ ID NO: 476176 - DNA, 25 bp, Homo sapien
tactgcaagattatggcatctacaa

SEQ ID NO: 476177 - DNA, 25 bp, Homo sapien
aggctttcttttcattacttcatta

SEQ ID NO: 476178 - DNA, 25 bp, Homo sapien
gctttcttttcattacttcattatc

SEQ ID NO: 476179 - DNA, 25 bp, Homo sapien
ttacttcattatctgaatcccccca

SEQ ID NO: 476180 - DNA, 25 bp, Homo sapien
cctatccccacttctcagggataat

SEQ ID NO: 476181 - DNA, 25 bp, Homo sapien
atccccacttctcagggataatgag

SEQ ID NO: 476182 - DNA, 25 bp, Homo sapien
tctgcctctgttttacatagaatgt

SEQ ID NO: 476183 - DNA, 25 bp, Homo sapien
tgcctctgttttacatagaatgtgc

SEQ ID NO: 476184 - DNA, 25 bp, Homo sapien
tagaatgtgcgcatgtccttaacct

SEQ ID NO: 476185 - DNA, 25 bp, Homo sapien
atgtccttaaccttgttatgtatga

SEQ ID NO: 476186 - DNA, 25 bp, Homo sapien
gtccttaaccttgttatgtatgaaa

SEQ ID NO: 476187 - DNA, 25 bp, Homo sapien
tgtatgaaatatacgtatcacgggt

SEQ ID NO: 476188 - DNA, 25 bp, Homo sapien
agggccggggcatccatgtcattgt

SEQ ID NO: 476189 - DNA, 25 bp, Homo sapien
cgtgatggcaaaacgtgtgtttgac

SEQ ID NO: 476190 - DNA, 25 bp, Homo sapien
gtgtgtttgacacgtactcacctca

SEQ ID NO: 476191 - DNA, 25 bp, Homo sapien
gtttgacacgtactcacctcatgag

SEQ ID NO: 476192 - DNA, 25 bp, Homo sapien
gacacgtactcacctcatgaggatg

SEQ ID NO: 476193 - DNA, 25 bp, Homo sapien
actcacctcatgaggatgaggccat

SEQ ID NO: 476194 - DNA, 25 bp, Homo sapien
aggccatggtgctattcctcaacat

SEQ ID NO: 476195 - DNA, 25 bp, Homo sapien
atggtgctattcctcaacatggtag

SEQ ID NO: 476196 - DNA, 25 bp, Homo sapien
tattcctcaacatggtagcgcccgg

SEQ ID NO: 476197 - DNA, 25 bp, Homo sapien
tcaacatggtagcgcccggccgagt

SEQ ID NO: 476198 - DNA, 25 bp, Homo sapien
gccgagtgctcatctgcactgtcaa

SEQ ID NO: 476199 - DNA, 25 bp, Homo sapien
tggatacattcctagaaacatacaa

SEQ ID NO: 476200 - DNA, 25 bp, Homo sapien
ggatacattcctagaaacatacaac

SEQ ID NO: 476201 - DNA, 25 bp, Homo sapien
tacattcctagaaacatacaaccta

SEQ ID NO: 476202 - DNA, 25 bp, Homo sapien
acattcctagaaacatacaacctat

SEQ ID NO: 476203 - DNA, 25 bp, Homo sapien
cattcctagaaacatacaacctata

SEQ ID NO: 476204 - DNA, 25 bp, Homo sapien
attcctagaaacatacaacctataa

SEQ ID NO: 476205 - DNA, 25 bp, Homo sapien
ttcctagaaacatacaacctataaa

SEQ ID NO: 476206 - DNA, 25 bp, Homo sapien
tcctagaaacatacaacctataaaa

SEQ ID NO: 476207 - DNA, 25 bp, Homo sapien
aattactccttagttgtgtcatgtc

SEQ ID NO: 476208 - DNA, 25 bp, Homo sapien
actccttagttgtgtcatgtcttcc

SEQ ID NO: 476209 - DNA, 25 bp, Homo sapien
cttagttgtgtcatgtcttcctttt

SEQ ID NO: 476210 - DNA, 25 bp, Homo sapien
tagttgtgtcatgtcttcctttttt

SEQ ID NO: 476211 - DNA, 25 bp, Homo sapien
gttaccctcattcagaaatttccca

SEQ ID NO: 476212 - DNA, 25 bp, Homo sapien
gaaatttcccatttctaatgatttg

SEQ ID NO: 476213 - DNA, 25 bp, Homo sapien
ttagctcagtttgaaatttgtttac

SEQ ID NO: 476214 - DNA, 25 bp, Homo sapien
atttgcatattgtttcatgtacttt

SEQ ID NO: 476215 - DNA, 25 bp, Homo sapien
gcatattgtttcatgtactttgatt

SEQ ID NO: 476216 - DNA, 25 bp, Homo sapien
tttgattttctgtagggacaccatt

SEQ ID NO: 476217 - DNA, 25 bp, Homo sapien
ttttctgtagggacaccattctcat

SEQ ID NO: 476218 - DNA, 25 bp, Homo sapien
gaaaatcataaggtccgtgtgtggc

SEQ ID NO: 476219 - DNA, 25 bp, Homo sapien
aaaatcataaggtccgtgtgtggcg

SEQ ID NO: 476220 - DNA, 25 bp, Homo sapien
aaatcataaggtccgtgtgtggcgt

SEQ ID NO: 476221 - DNA, 25 bp, Homo sapien
atcataaggtccgtgtgtggcgtcc

SEQ ID NO: 476222 - DNA, 25 bp, Homo sapien
tcataaggtccgtgtgtggcgtccc

SEQ ID NO: 476223 - DNA, 25 bp, Homo sapien
cataaggtccgtgtgtggcgtccca

SEQ ID NO: 476224 - DNA, 25 bp, Homo sapien
ataaggtccgtgtgtggcgtcccac

SEQ ID NO: 476225 - DNA, 25 bp, Homo sapien
taaggtccgtgtgtggcgtcccacg

SEQ ID NO: 476226 - DNA, 25 bp, Homo sapien
aaggtccgtgtgtggcgtcccacgc

SEQ ID NO: 476227 - DNA, 25 bp, Homo sapien
ccgtgtgtggcgtcccacgcctgta

SEQ ID NO: 476228 - DNA, 25 bp, Homo sapien
cgtgtgtggcgtcccacgcctgtaa

SEQ ID NO: 476229 - DNA, 25 bp, Homo sapien
cacttcctccacctaaagttctgtt

SEQ ID NO: 476230 - DNA, 25 bp, Homo sapien
gttctgttttcccagctattccagc

SEQ ID NO: 476231 - DNA, 25 bp, Homo sapien
agcctcaggttgagtcctcgcataa

SEQ ID NO: 476232 - DNA, 25 bp, Homo sapien
gagtcctcgcataaggttcctaagg

SEQ ID NO: 476233 - DNA, 25 bp, Homo sapien
aggttacattatcccctactgtagg

SEQ ID NO: 476234 - DNA, 25 bp, Homo sapien
acagtgtaaggtgacctagctggtc

SEQ ID NO: 476235 - DNA, 25 bp, Homo sapien
tagctggtcagaggtggcctccaga

SEQ ID NO: 476236 - DNA, 25 bp, Homo sapien
ctccagactctgtactaagagggct

SEQ ID NO: 476237 - DNA, 25 bp, Homo sapien
taagagggctgtttgaaaccagaac

SEQ ID NO: 476238 - DNA, 25 bp, Homo sapien
gcctctgcttcagaagccttgtcat

SEQ ID NO: 476239 - DNA, 25 bp, Homo sapien
gccttgtcatcctgatgtccacatg

SEQ ID NO: 476240 - DNA, 25 bp, Homo sapien
atctggccagcgcagccaaggcaca

SEQ ID NO: 476241 - DNA, 25 bp, Homo sapien
ggcagaacggcagaactcacctgaa

SEQ ID NO: 476242 - DNA, 25 bp, Homo sapien
gaacggcagaactcacctgaacaca

SEQ ID NO: 476243 - DNA, 25 bp, Homo sapien
gaactcacctgaacacagggctgta

SEQ ID NO: 476244 - DNA, 25 bp, Homo sapien
aaacgcctatccttcctgggaggct

SEQ ID NO: 476245 - DNA, 25 bp, Homo sapien
cgcctatccttcctgggaggctcag

SEQ ID NO: 476246 - DNA, 25 bp, Homo sapien
aggctcaggcggtgttgtctcgtct

SEQ ID NO: 476247 - DNA, 25 bp, Homo sapien
tcaggcggtgttgtctcgtctcggt

SEQ ID NO: 476248 - DNA, 25 bp, Homo sapien
tgttgtctcgtctcggtggtggacc

SEQ ID NO: 476249 - DNA, 25 bp, Homo sapien
tggacctgagtcgttctgaggaccc

SEQ ID NO: 476250 - DNA, 25 bp, Homo sapien
ctgagtcgttctgaggacccgggca

SEQ ID NO: 476251 - DNA, 25 bp, Homo sapien
gggccaggtgtagtgtttacacacc

SEQ ID NO: 476252 - DNA, 25 bp, Homo sapien
aggtgtagtgtttacacacctgtaa

SEQ ID NO: 476253 - DNA, 25 bp, Homo sapien
gtagtgtttacacacctgtaatcac

SEQ ID NO: 476254 - DNA, 25 bp, Homo sapien
gagcaacatggaaagatctcatcat

SEQ ID NO: 476255 - DNA, 25 bp, Homo sapien
acatggaaagatctcatcatctcta

SEQ ID NO: 476256 - DNA, 25 bp, Homo sapien
atggaaagatctcatcatctctagg

SEQ ID NO: 476257 - DNA, 25 bp, Homo sapien
ggaaagatctcatcatctctaggaa

SEQ ID NO: 476258 - DNA, 25 bp, Homo sapien
gaaagatctcatcatctctaggaaa

SEQ ID NO: 476259 - DNA, 25 bp, Homo sapien
aaagatctcatcatctctaggaaac

SEQ ID NO: 476260 - DNA, 25 bp, Homo sapien
gatctcatcatctctaggaaacagt

SEQ ID NO: 476261 - DNA, 25 bp, Homo sapien
atctcatcatctctaggaaacagtt

SEQ ID NO: 476262 - DNA, 25 bp, Homo sapien
cattctctaacaggttatatttagg

SEQ ID NO: 476263 - DNA, 25 bp, Homo sapien
acaggttatatttaggacagttagg

SEQ ID NO: 476264 - DNA, 25 bp, Homo sapien
caggttatatttaggacagttaggt

SEQ ID NO: 476265 - DNA, 25 bp, Homo sapien
tttaggacagttaggttacatttca

SEQ ID NO: 476266 - DNA, 25 bp, Homo sapien
taggacagttaggttacatttcatt

SEQ ID NO: 476267 - DNA, 25 bp, Homo sapien
aggacagttaggttacatttcatta

SEQ ID NO: 476268 - DNA, 25 bp, Homo sapien
ggacagttaggttacatttcattat

SEQ ID NO: 476269 - DNA, 25 bp, Homo sapien
gacagttaggttacatttcattatt

SEQ ID NO: 476270 - DNA, 25 bp, Homo sapien
cagttaggttacatttcattattca

SEQ ID NO: 476271 - DNA, 25 bp, Homo sapien
agttaggttacatttcattattcat

SEQ ID NO: 476272 - DNA, 25 bp, Homo sapien
agcctggggcaccatactgagatcc

SEQ ID NO: 476273 - DNA, 25 bp, Homo sapien
gtgacctaaggctgaccacacacaa

SEQ ID NO: 476274 - DNA, 25 bp, Homo sapien
ggctgaccacacacaaacaaggctt

SEQ ID NO: 476275 - DNA, 25 bp, Homo sapien
acaaggctttgggagacaggcaacc

SEQ ID NO: 476276 - DNA, 25 bp, Homo sapien
aggcaaccttagagtcctggtcctt

SEQ ID NO: 476277 - DNA, 25 bp, Homo sapien
tggtccttgctctagtgccaactag

SEQ ID NO: 476278 - DNA, 25 bp, Homo sapien
tagtgccaactagcagggagccctg

SEQ ID NO: 476279 - DNA, 25 bp, Homo sapien
tgcccctcaagtctctaaacctgaa

SEQ ID NO: 476280 - DNA, 25 bp, Homo sapien
taaacctgaagcttcatctgcaaaa

SEQ ID NO: 476281 - DNA, 25 bp, Homo sapien
gattatctgtgtaacaatctcagta

SEQ ID NO: 476282 - DNA, 25 bp, Homo sapien
gagtgaaccccagggagtagagaca

SEQ ID NO: 476283 - DNA, 25 bp, Homo sapien
ggagtagagacatggccaaggccac

SEQ ID NO: 476284 - DNA, 25 bp, Homo sapien
tggtgtctctgtgctcctgcgcttc

SEQ ID NO: 476285 - DNA, 25 bp, Homo sapien
tcctctcctcctgggtgttaataat

SEQ ID NO: 476286 - DNA, 25 bp, Homo sapien
ctcctcctgggtgttaataatgaca

SEQ ID NO: 476287 - DNA, 25 bp, Homo sapien
atgacagtgctttacagtttacaaa

SEQ ID NO: 476288 - DNA, 25 bp, Homo sapien
gtttacaaagcacaatcacctacag

SEQ ID NO: 476289 - DNA, 25 bp, Homo sapien
gcacaatcacctacagtaactcgtt

SEQ ID NO: 476290 - DNA, 25 bp, Homo sapien
acctacagtaactcgtttgattctt

SEQ ID NO: 476291 - DNA, 25 bp, Homo sapien
gtttgattcttataggagccctgtg

SEQ ID NO: 476292 - DNA, 25 bp, Homo sapien
attcttataggagccctgtgcagca

SEQ ID NO: 476293 - DNA, 25 bp, Homo sapien
gcagcagggactctgatcctcattg

SEQ ID NO: 476294 - DNA, 25 bp, Homo sapien
gatcctcattgcatgcaggaagaga

SEQ ID NO: 476295 - DNA, 25 bp, Homo sapien
aaaccagggttggagctacatgcta

SEQ ID NO: 476296 - DNA, 25 bp, Homo sapien
tggagctacatgctagagttctatc

SEQ ID NO: 476297 - DNA, 25 bp, Homo sapien
agagttctatccaatcactccatgc

SEQ ID NO: 476298 - DNA, 25 bp, Homo sapien
tccatgcctgcctcaagcataaagg

SEQ ID NO: 476299 - DNA, 25 bp, Homo sapien
tctggctttttgctagatggctaca

SEQ ID NO: 476300 - DNA, 25 bp, Homo sapien
catccttagttttaaccaccatgaa

SEQ ID NO: 476301 - DNA, 25 bp, Homo sapien
agatgagttttgtgcagactgccca

SEQ ID NO: 476302 - DNA, 25 bp, Homo sapien
tgcagactgcccactgtatggaata

SEQ ID NO: 476303 - DNA, 25 bp, Homo sapien
gaatagaagccacccagtatcactg

SEQ ID NO: 476304 - DNA, 25 bp, Homo sapien
gtatcactgcagttcagatccttgt

SEQ ID NO: 476305 - DNA, 25 bp, Homo sapien
agatccttgtccattaattacgaga

SEQ ID NO: 476306 - DNA, 25 bp, Homo sapien
tcagctcttccatcgagcatggaca

SEQ ID NO: 476307 - DNA, 25 bp, Homo sapien
atggacaacccaagcagcaccctga

SEQ ID NO: 476308 - DNA, 25 bp, Homo sapien
gagaaccatcccagaatatgcagag

SEQ ID NO: 476309 - DNA, 25 bp, Homo sapien
gggacagctagttgcctgaggacac

SEQ ID NO: 476310 - DNA, 25 bp, Homo sapien
agctagttgcctgaggacacacaga

SEQ ID NO: 476311 - DNA, 25 bp, Homo sapien
gacacacagagatagtggcacggct

SEQ ID NO: 476312 - DNA, 25 bp, Homo sapien
agagatagtggcacggctggaactt

SEQ ID NO: 476313 - DNA, 25 bp, Homo sapien
taaaactccttccaagggagataag

SEQ ID NO: 476314 - DNA, 25 bp, Homo sapien
agataagttggtgtctcccttttct

SEQ ID NO: 476315 - DNA, 25 bp, Homo sapien
tcccttttctagctgtggaggcttg

SEQ ID NO: 476316 - DNA, 25 bp, Homo sapien
tgtggaggcttgaacatattttctt

SEQ ID NO: 476317 - DNA, 25 bp, Homo sapien
ctctggtatttgaatctcactaatt

SEQ ID NO: 476318 - DNA, 25 bp, Homo sapien
gaatctcactaattcaatctggtat

SEQ ID NO: 476319 - DNA, 25 bp, Homo sapien
attcaatctggtatttgatggatgc

SEQ ID NO: 476320 - DNA, 25 bp, Homo sapien
tttccttgaggaatcagatgatatt

SEQ ID NO: 476321 - DNA, 25 bp, Homo sapien
tttgcatagttcagagtgccctcca

SEQ ID NO: 476322 - DNA, 25 bp, Homo sapien
atagttcagagtgccctccaaaaga

SEQ ID NO: 476323 - DNA, 25 bp, Homo sapien
gagtgccctccaaaagaaaatcaac

SEQ ID NO: 476324 - DNA, 25 bp, Homo sapien
taaggagttttctgcattactgaga

SEQ ID NO: 476325 - DNA, 25 bp, Homo sapien
gttttctgcattactgagatgaagt

SEQ ID NO: 476326 - DNA, 25 bp, Homo sapien
gcttacaagctttaacttgctgcat

SEQ ID NO: 476327 - DNA, 25 bp, Homo sapien
ctttaacttgctgcatatgtctctc

SEQ ID NO: 476328 - DNA, 25 bp, Homo sapien
agtgtttccctgagtctcatggttt

SEQ ID NO: 476329 - DNA, 25 bp, Homo sapien
tccctgagtctcatggtttcaacag

SEQ ID NO: 476330 - DNA, 25 bp, Homo sapien
tggtttcaacagacattctggagga

SEQ ID NO: 476331 - DNA, 25 bp, Homo sapien
tattgatagagtgaaaaggacccat

SEQ ID NO: 476332 - DNA, 25 bp, Homo sapien
aaggacccataggagttatctatgt

SEQ ID NO: 476333 - DNA, 25 bp, Homo sapien
ttttttagctagagacacctgtgtg

SEQ ID NO: 476334 - DNA, 25 bp, Homo sapien
gctagagacacctgtgtgagccaca

SEQ ID NO: 476335 - DNA, 25 bp, Homo sapien
gggccactgtaagatatctggaatg

SEQ ID NO: 476336 - DNA, 25 bp, Homo sapien
agtgacagttatgatggtcgtgact

SEQ ID NO: 476337 - DNA, 25 bp, Homo sapien
gatggtcgtgactgtcatgctaaaa

SEQ ID NO: 476338 - DNA, 25 bp, Homo sapien
gtcatgctaaaaagttcagccttta

SEQ ID NO: 476339 - DNA, 25 bp, Homo sapien
tgtgaggatcaaatgtttatttatg

SEQ ID NO: 476340 - DNA, 25 bp, Homo sapien
gtgaggatcaaatgtttatttatga

SEQ ID NO: 476341 - DNA, 25 bp, Homo sapien
tgaggatcaaatgtttatttatgaa

SEQ ID NO: 476342 - DNA, 25 bp, Homo sapien
ggatcaaatgtttatttatgaaaag

SEQ ID NO: 476343 - DNA, 25 bp, Homo sapien
aaaagcatttagagactgggcacgg

SEQ ID NO: 476344 - DNA, 25 bp, Homo sapien
aaagcatttagagactgggcacggt

SEQ ID NO: 476345 - DNA, 25 bp, Homo sapien
aagcatttagagactgggcacggtg

SEQ ID NO: 476346 - DNA, 25 bp, Homo sapien
agcatttagagactgggcacggtgg

SEQ ID NO: 476347 - DNA, 25 bp, Homo sapien
gaaaccctgtctctggccaggtgtg

SEQ ID NO: 476348 - DNA, 25 bp, Homo sapien
aaaccctgtctctggccaggtgtgg

SEQ ID NO: 476349 - DNA, 25 bp, Homo sapien
aaccctgtctctggccaggtgtggt

SEQ ID NO: 476350 - DNA, 25 bp, Homo sapien
gtgtcgagagtttcccgaaacaggt

SEQ ID NO: 476351 - DNA, 25 bp, Homo sapien
acaggttggcctttgttagtgcggt

SEQ ID NO: 476352 - DNA, 25 bp, Homo sapien
ggcctttgttagtgcggtccagaaa

SEQ ID NO: 476353 - DNA, 25 bp, Homo sapien
gtgcggtccagaaagaactctccaa

SEQ ID NO: 476354 - DNA, 25 bp, Homo sapien
cagaggactgtctgggctctgaaga

SEQ ID NO: 476355 - DNA, 25 bp, Homo sapien
ggcttaaagttttatgcttcagcaa

SEQ ID NO: 476356 - DNA, 25 bp, Homo sapien
aatacagctgttagtggactgggtt

SEQ ID NO: 476357 - DNA, 25 bp, Homo sapien
ccagggaagggtgaggcctctatca

SEQ ID NO: 476358 - DNA, 25 bp, Homo sapien
aagggtgaggcctctatcagaatgg

SEQ ID NO: 476359 - DNA, 25 bp, Homo sapien
cttccagtgaccttttaaggaggca

SEQ ID NO: 476360 - DNA, 25 bp, Homo sapien
atgctatctgtcctcacactcaaac

SEQ ID NO: 476361 - DNA, 25 bp, Homo sapien
ctctcctctcctatgaagtacagta

SEQ ID NO: 476362 - DNA, 25 bp, Homo sapien
gtacagtaagctgacccactattta

SEQ ID NO: 476363 - DNA, 25 bp, Homo sapien
aagctgacccactatttatacctct

SEQ ID NO: 476364 - DNA, 25 bp, Homo sapien
tatacctctcctagggatgggttaa

SEQ ID NO: 476365 - DNA, 25 bp, Homo sapien
aaattctttccccttcagtctagat

SEQ ID NO: 476366 - DNA, 25 bp, Homo sapien
ttccccttcagtctagattaaatag

SEQ ID NO: 476367 - DNA, 25 bp, Homo sapien
atagatctttagctccatagggtat

SEQ ID NO: 476368 - DNA, 25 bp, Homo sapien
agggtattggaaatctgtcctatat

SEQ ID NO: 476369 - DNA, 25 bp, Homo sapien
aatctgtcctatatttgcattcccc

SEQ ID NO: 476370 - DNA, 25 bp, Homo sapien
ttgcattccccctaagatctagtat

SEQ ID NO: 476371 - DNA, 25 bp, Homo sapien
gaatgtgagctttaagtcagtgatg

SEQ ID NO: 476372 - DNA, 25 bp, Homo sapien
tatctgggtgttaagtttgaaggct

SEQ ID NO: 476373 - DNA, 25 bp, Homo sapien
aaagcatttctatgtgtggtaggta

SEQ ID NO: 476374 - DNA, 25 bp, Homo sapien
tgcctcctgatgaacacatcttact

SEQ ID NO: 476375 - DNA, 25 bp, Homo sapien
acatcttacttaattccctattctg

SEQ ID NO: 476376 - DNA, 25 bp, Homo sapien
ctggatatcacttccacggttatat

SEQ ID NO: 476377 - DNA, 25 bp, Homo sapien
cacggttatattttgttacatggca

SEQ ID NO: 476378 - DNA, 25 bp, Homo sapien
ggattctgcatatgtaattaaggac

SEQ ID NO: 476379 - DNA, 25 bp, Homo sapien
taaggactccaatcagtttattttg

SEQ ID NO: 476380 - DNA, 25 bp, Homo sapien
aagattttcctagatgggccaggca

SEQ ID NO: 476381 - DNA, 25 bp, Homo sapien
ggccaggcatattcagggaaccctt

SEQ ID NO: 476382 - DNA, 25 bp, Homo sapien
tcagggaaccctttaaatgtagagt

SEQ ID NO: 476383 - DNA, 25 bp, Homo sapien
taatcatgtctgtaaaaggactttg

SEQ ID NO: 476384 - DNA, 25 bp, Homo sapien
aatcatgtctgtaaaaggactttgg

SEQ ID NO: 476385 - DNA, 25 bp, Homo sapien
tgtaatcacagaacatggggaagct

SEQ ID NO: 476386 - DNA, 25 bp, Homo sapien
gtaatcacagaacatggggaagctg

SEQ ID NO: 476387 - DNA, 25 bp, Homo sapien
tagccaggtgtaggggctcatgcct

SEQ ID NO: 476388 - DNA, 25 bp, Homo sapien
ctgtaatcctcccaagaagctgggc

SEQ ID NO: 476389 - DNA, 25 bp, Homo sapien
tgtaatcctcccaagaagctgggct

SEQ ID NO: 476390 - DNA, 25 bp, Homo sapien
ccaagaagctgggctgaggcacgag

SEQ ID NO: 476391 - DNA, 25 bp, Homo sapien
caagaagctgggctgaggcacgaga

SEQ ID NO: 476392 - DNA, 25 bp, Homo sapien
atcatgctgctgccctccagcttgg

SEQ ID NO: 476393 - DNA, 25 bp, Homo sapien
ccctccagcttgggcaataaagcaa

SEQ ID NO: 476394 - DNA, 25 bp, Homo sapien
ggatgccaataagggcttaaagact

SEQ ID NO: 476395 - DNA, 25 bp, Homo sapien
gatttttaaactgtacatgatgtga

SEQ ID NO: 476396 - DNA, 25 bp, Homo sapien
aaactgtacatgatgtgatctactg

SEQ ID NO: 476397 - DNA, 25 bp, Homo sapien
tgtgatctactgtcccctgaaggtc

SEQ ID NO: 476398 - DNA, 25 bp, Homo sapien
actgtcccctgaaggtcagccgtga

SEQ ID NO: 476399 - DNA, 25 bp, Homo sapien
tgaaggtcagccgtgatcagttaaa

SEQ ID NO: 476400 - DNA, 25 bp, Homo sapien
aggtcagccgtgatcagttaaaggt

SEQ ID NO: 476401 - DNA, 25 bp, Homo sapien
ccgtgatcagttaaaggtgtaccct

SEQ ID NO: 476402 - DNA, 25 bp, Homo sapien
gatcagttaaaggtgtaccctgtaa

SEQ ID NO: 476403 - DNA, 25 bp, Homo sapien
ccagctattaaactaacaaaggaga

SEQ ID NO: 476404 - DNA, 25 bp, Homo sapien
caaaggagatcaaatgggttcttaa

SEQ ID NO: 476405 - DNA, 25 bp, Homo sapien
tcttctccagaagctgtgttttgag

SEQ ID NO: 476406 - DNA, 25 bp, Homo sapien
atgggtacaggttggtaaatcagga

SEQ ID NO: 476407 - DNA, 25 bp, Homo sapien
ctcacccaccttgctagtatggaaa

SEQ ID NO: 476408 - DNA, 25 bp, Homo sapien
caccttgctagtatggaaacctcag

SEQ ID NO: 476409 - DNA, 25 bp, Homo sapien
gaaacctcaggctagggcgtactta

SEQ ID NO: 476410 - DNA, 25 bp, Homo sapien
ggctagggcgtacttactctaatta

SEQ ID NO: 476411 - DNA, 25 bp, Homo sapien
gtacttactctaattacattctcct

SEQ ID NO: 476412 - DNA, 25 bp, Homo sapien
attctcctgccatcctggaagaaag

SEQ ID NO: 476413 - DNA, 25 bp, Homo sapien
gccatcctggaagaaaggcagctct

SEQ ID NO: 476414 - DNA, 25 bp, Homo sapien
ttaagatcgagggacagtaggccag

SEQ ID NO: 476415 - DNA, 25 bp, Homo sapien
aacagatggctcaaaccctctcaga

SEQ ID NO: 476416 - DNA, 25 bp, Homo sapien
ctcacgcctgtaacctgtaatccca

SEQ ID NO: 476417 - DNA, 25 bp, Homo sapien
tcacgcctgtaacctgtaatcccag

SEQ ID NO: 476418 - DNA, 25 bp, Homo sapien
cacgcctgtaacctgtaatcccagc

SEQ ID NO: 476419 - DNA, 25 bp, Homo sapien
ctgggcgtggtggctaatgcttgta

SEQ ID NO: 476420 - DNA, 25 bp, Homo sapien
ggcgtggtggctaatgcttgtaatc

SEQ ID NO: 476421 - DNA, 25 bp, Homo sapien
gcgtggtggctaatgcttgtaatcc

SEQ ID NO: 476422 - DNA, 25 bp, Homo sapien
acaagagcaaaactcagtcttgaaa

SEQ ID NO: 476423 - DNA, 25 bp, Homo sapien
caagagcaaaactcagtcttgaaaa

SEQ ID NO: 476424 - DNA, 25 bp, Homo sapien
aagagcaaaactcagtcttgaaaaa

SEQ ID NO: 476425 - DNA, 25 bp, Homo sapien
agagcaaaactcagtcttgaaaaaa

SEQ ID NO: 476426 - DNA, 25 bp, Homo sapien
gagcaaaactcagtcttgaaaaaaa

SEQ ID NO: 476427 - DNA, 25 bp, Homo sapien
gaaagaaagattatgtaatacccta

SEQ ID NO: 476428 - DNA, 25 bp, Homo sapien
gaaagattatgtaataccctaaaat

SEQ ID NO: 476429 - DNA, 25 bp, Homo sapien
tatgtaataccctaaaatttgagag

SEQ ID NO: 476430 - DNA, 25 bp, Homo sapien
atgtaataccctaaaatttgagagt

SEQ ID NO: 476431 - DNA, 25 bp, Homo sapien
tgtaataccctaaaatttgagagta

SEQ ID NO: 476432 - DNA, 25 bp, Homo sapien
aaaattcattttgcatcaaaaggaa

SEQ ID NO: 476433 - DNA, 25 bp, Homo sapien
aattaagattgcagattacctaaaa

SEQ ID NO: 476434 - DNA, 25 bp, Homo sapien
aagattgcagattacctaaaaatgg

SEQ ID NO: 476435 - DNA, 25 bp, Homo sapien
gattgcagattacctaaaaatggtg

SEQ ID NO: 476436 - DNA, 25 bp, Homo sapien
gcagattacctaaaaatggtgaaaa

SEQ ID NO: 476437 - DNA, 25 bp, Homo sapien
atataaatccttcttataatgaaac

SEQ ID NO: 476438 - DNA, 25 bp, Homo sapien
ggagtgtctgcaatgatgcaaccca

SEQ ID NO: 476439 - DNA, 25 bp, Homo sapien
gtctgcaatgatgcaacccaccagt

SEQ ID NO: 476440 - DNA, 25 bp, Homo sapien
aatgatgcaacccaccagtcctagt

SEQ ID NO: 476441 - DNA, 25 bp, Homo sapien
tcatttccgtgtgcattttttgcta

SEQ ID NO: 476442 - DNA, 25 bp, Homo sapien
ttccgtgtgcattttttgctacaat

SEQ ID NO: 476443 - DNA, 25 bp, Homo sapien
tttttgctacaatttttatcacgtg

SEQ ID NO: 476444 - DNA, 25 bp, Homo sapien
atttttatcacgtgtaggttcaggc

SEQ ID NO: 476445 - DNA, 25 bp, Homo sapien
atcacgtgtaggttcaggcactcaa

SEQ ID NO: 476446 - DNA, 25 bp, Homo sapien
cgtgtaggttcaggcactcaacagc

SEQ ID NO: 476447 - DNA, 25 bp, Homo sapien
atgcaaaacagctctgtcccctcaa

SEQ ID NO: 476448 - DNA, 25 bp, Homo sapien
gcaaaacagctctgtcccctcaagg

SEQ ID NO: 476449 - DNA, 25 bp, Homo sapien
ctgcactgtcaaggtcagttattct

SEQ ID NO: 476450 - DNA, 25 bp, Homo sapien
gcactgtcaaggtcagttattctgt

SEQ ID NO: 476451 - DNA, 25 bp, Homo sapien
ctgtcaaggtcagttattctgtcct

SEQ ID NO: 476452 - DNA, 25 bp, Homo sapien
tgtcaaggtcagttattctgtcctg

SEQ ID NO: 476453 - DNA, 25 bp, Homo sapien
gtcaaggtcagttattctgtcctga

SEQ ID NO: 476454 - DNA, 25 bp, Homo sapien
tcaaggtcagttattctgtcctgac

SEQ ID NO: 476455 - DNA, 25 bp, Homo sapien
aaggtcagttattctgtcctgaccc

SEQ ID NO: 476456 - DNA, 25 bp, Homo sapien
aggtcagttattctgtcctgaccct

SEQ ID NO: 476457 - DNA, 25 bp, Homo sapien
gtcagttattctgtcctgaccctga

SEQ ID NO: 476458 - DNA, 25 bp, Homo sapien
tcagttattctgtcctgaccctgac

SEQ ID NO: 476459 - DNA, 25 bp, Homo sapien
agttattctgtcctgaccctgaccc

SEQ ID NO: 476460 - DNA, 25 bp, Homo sapien
gacagatcttactcagtgtagaact

SEQ ID NO: 476461 - DNA, 25 bp, Homo sapien
acagatcttactcagtgtagaactt

SEQ ID NO: 476462 - DNA, 25 bp, Homo sapien
cagatcttactcagtgtagaacttt

SEQ ID NO: 476463 - DNA, 25 bp, Homo sapien
agatcttactcagtgtagaactttt

SEQ ID NO: 476464 - DNA, 25 bp, Homo sapien
gatcttactcagtgtagaactttta

SEQ ID NO: 476465 - DNA, 25 bp, Homo sapien
atcttactcagtgtagaacttttat

SEQ ID NO: 476466 - DNA, 25 bp, Homo sapien
tcttactcagtgtagaacttttatt

SEQ ID NO: 476467 - DNA, 25 bp, Homo sapien
cttactcagtgtagaacttttattt

SEQ ID NO: 476468 - DNA, 25 bp, Homo sapien
ttactcagtgtagaacttttatttt

SEQ ID NO: 476469 - DNA, 25 bp, Homo sapien
cagtgtagaacttttattttggccg

SEQ ID NO: 476470 - DNA, 25 bp, Homo sapien
aggtgcctatgatcccaactactgg

SEQ ID NO: 476471 - DNA, 25 bp, Homo sapien
atataagggtattacgctgggcgtg

SEQ ID NO: 476472 - DNA, 25 bp, Homo sapien
tcacacctataaccctagacctttg

SEQ ID NO: 476473 - DNA, 25 bp, Homo sapien
ggagacaccagttgcagtgacctgt

SEQ ID NO: 476474 - DNA, 25 bp, Homo sapien
gttgcagtgacctgtaatcagtcgc

SEQ ID NO: 476475 - DNA, 25 bp, Homo sapien
tgcagtgacctgtaatcagtcgcac

SEQ ID NO: 476476 - DNA, 25 bp, Homo sapien
agtgacctgtaatcagtcgcaccac

SEQ ID NO: 476477 - DNA, 25 bp, Homo sapien
tgacctgtaatcagtcgcaccactg

SEQ ID NO: 476478 - DNA, 25 bp, Homo sapien
acctgtaatcagtcgcaccactgtt

SEQ ID NO: 476479 - DNA, 25 bp, Homo sapien
tgtaatcagtcgcaccactgttcac

SEQ ID NO: 476480 - DNA, 25 bp, Homo sapien
atcagtcgcaccactgttcaccagt

SEQ ID NO: 476481 - DNA, 25 bp, Homo sapien
accactgttcaccagtctgggtaac

SEQ ID NO: 476482 - DNA, 25 bp, Homo sapien
ctccttctccagaacaccacacctg

SEQ ID NO: 476483 - DNA, 25 bp, Homo sapien
caccatatggtgtgggtatgtctga

SEQ ID NO: 476484 - DNA, 25 bp, Homo sapien
accatatggtgtgggtatgtctgac

SEQ ID NO: 476485 - DNA, 25 bp, Homo sapien
catatggtgtgggtatgtctgacca

SEQ ID NO: 476486 - DNA, 25 bp, Homo sapien
atatggtgtgggtatgtctgaccat

SEQ ID NO: 476487 - DNA, 25 bp, Homo sapien
tatggtgtgggtatgtctgaccatc

SEQ ID NO: 476488 - DNA, 25 bp, Homo sapien
atggtgtgggtatgtctgaccatcc

SEQ ID NO: 476489 - DNA, 25 bp, Homo sapien
tggtgtgggtatgtctgaccatcca

SEQ ID NO: 476490 - DNA, 25 bp, Homo sapien
gtgtgggtatgtctgaccatccaga

SEQ ID NO: 476491 - DNA, 25 bp, Homo sapien
tgtgggtatgtctgaccatccagac

SEQ ID NO: 476492 - DNA, 25 bp, Homo sapien
gtgggtatgtctgaccatccagacc

SEQ ID NO: 476493 - DNA, 25 bp, Homo sapien
tttagcttacttgctttgatgcaaa

SEQ ID NO: 476494 - DNA, 25 bp, Homo sapien
gtagcacataacacaaagctcctgt

SEQ ID NO: 476495 - DNA, 25 bp, Homo sapien
aaagctcctgtaagcaacctgctag

SEQ ID NO: 476496 - DNA, 25 bp, Homo sapien
gtaagcaacctgctagcccctttct

SEQ ID NO: 476497 - DNA, 25 bp, Homo sapien
ccctttctccaagagtccagttata

SEQ ID NO: 476498 - DNA, 25 bp, Homo sapien
gaattggtaaaccaggctgttggaa

SEQ ID NO: 476499 - DNA, 25 bp, Homo sapien
gctgttggaaacgttgacttctttt

SEQ ID NO: 476500 - DNA, 25 bp, Homo sapien
atttttctttccacacataaccaca

SEQ ID NO: 476501 - DNA, 25 bp, Homo sapien
tttcccctcaattacctgtggtaag

SEQ ID NO: 476502 - DNA, 25 bp, Homo sapien
ttacctgtggtaagaaatgctgttc

SEQ ID NO: 476503 - DNA, 25 bp, Homo sapien
tgctgttcttatattacattccttc

SEQ ID NO: 476504 - DNA, 25 bp, Homo sapien
ttaaaatgtacacgtggccgggcac

SEQ ID NO: 476505 - DNA, 25 bp, Homo sapien
taaaatgtacacgtggccgggcaca

SEQ ID NO: 476506 - DNA, 25 bp, Homo sapien
aaaatgtacacgtggccgggcacag

SEQ ID NO: 476507 - DNA, 25 bp, Homo sapien
aaatgtacacgtggccgggcacagt

SEQ ID NO: 476508 - DNA, 25 bp, Homo sapien
gtggtgcgcggctgtaaccaaagct

SEQ ID NO: 476509 - DNA, 25 bp, Homo sapien
tggtgcgcggctgtaaccaaagcta

SEQ ID NO: 476510 - DNA, 25 bp, Homo sapien
ggtgcgcggctgtaaccaaagctac

SEQ ID NO: 476511 - DNA, 25 bp, Homo sapien
gtgcgcggctgtaaccaaagctact

SEQ ID NO: 476512 - DNA, 25 bp, Homo sapien
tgcgcggctgtaaccaaagctactt

SEQ ID NO: 476513 - DNA, 25 bp, Homo sapien
gcgcggctgtaaccaaagctacttg

SEQ ID NO: 476514 - DNA, 25 bp, Homo sapien
cgcggctgtaaccaaagctacttgg

SEQ ID NO: 476515 - DNA, 25 bp, Homo sapien
ggtttatcagctctttgttccatga

SEQ ID NO: 476516 - DNA, 25 bp, Homo sapien
ttgttccatgagaatcgggattcat

SEQ ID NO: 476517 - DNA, 25 bp, Homo sapien
gagctcagatagtaagccaggacag

SEQ ID NO: 476518 - DNA, 25 bp, Homo sapien
ggacagagaaagtcccacttttcat

SEQ ID NO: 476519 - DNA, 25 bp, Homo sapien
gtcccacttttcattctggaccaag

SEQ ID NO: 476520 - DNA, 25 bp, Homo sapien
ctggaccaagtaactttgaagtctt

SEQ ID NO: 476521 - DNA, 25 bp, Homo sapien
gttgacatgagagtgaaacgtgttc

SEQ ID NO: 476522 - DNA, 25 bp, Homo sapien
aaacgtgttcactttgcattttatg

SEQ ID NO: 476523 - DNA, 25 bp, Homo sapien
cactttgcattttatgaaggccatc

SEQ ID NO: 476524 - DNA, 25 bp, Homo sapien
atgaaggccatctttcatcgtccag

SEQ ID NO: 476525 - DNA, 25 bp, Homo sapien
tgcttcagcagtgaattttcaattg

SEQ ID NO: 476526 - DNA, 25 bp, Homo sapien
ataaaaaattagagcttaggccagg

SEQ ID NO: 476527 - DNA, 25 bp, Homo sapien
taaaaaattagagcttaggccaggc

SEQ ID NO: 476528 - DNA, 25 bp, Homo sapien
aaaaattagagcttaggccaggcac

SEQ ID NO: 476529 - DNA, 25 bp, Homo sapien
aaaattagagcttaggccaggcaca

SEQ ID NO: 476530 - DNA, 25 bp, Homo sapien
aaattagagcttaggccaggcacag

SEQ ID NO: 476531 - DNA, 25 bp, Homo sapien
caggcatggaagtgcctgcctgtag

SEQ ID NO: 476532 - DNA, 25 bp, Homo sapien
aggcatggaagtgcctgcctgtagt

SEQ ID NO: 476533 - DNA, 25 bp, Homo sapien
ggcatggaagtgcctgcctgtagtc

SEQ ID NO: 476534 - DNA, 25 bp, Homo sapien
gcatggaagtgcctgcctgtagtcc

SEQ ID NO: 476535 - DNA, 25 bp, Homo sapien
catggaagtgcctgcctgtagtccc

SEQ ID NO: 476536 - DNA, 25 bp, Homo sapien
atggaagtgcctgcctgtagtccca

SEQ ID NO: 476537 - DNA, 25 bp, Homo sapien
tttctaaatgtgtttttcgcaagca

SEQ ID NO: 476538 - DNA, 25 bp, Homo sapien
tgtgtttttcgcaagcatttttaaa

SEQ ID NO: 476539 - DNA, 25 bp, Homo sapien
atcacatgttagacgtaagcttttt

SEQ ID NO: 476540 - DNA, 25 bp, Homo sapien
gaaatcacagcaacatggctttctt

SEQ ID NO: 476541 - DNA, 25 bp, Homo sapien
acgatggatggtttgatattctctt

SEQ ID NO: 476542 - DNA, 25 bp, Homo sapien
tattctcttagaaaggctgacagct

SEQ ID NO: 476543 - DNA, 25 bp, Homo sapien
aaggctgacagctactatatagaac

SEQ ID NO: 476544 - DNA, 25 bp, Homo sapien
gctactatatagaaccactcaggaa

SEQ ID NO: 476545 - DNA, 25 bp, Homo sapien
gaaccactcaggaacaataatgata

SEQ ID NO: 476546 - DNA, 25 bp, Homo sapien
ggtatcaacgatactgattagatga

SEQ ID NO: 476547 - DNA, 25 bp, Homo sapien
gtttttctgctgaaatatcaatctt

SEQ ID NO: 476548 - DNA, 25 bp, Homo sapien
aagaattactgatgagcaaccataa

SEQ ID NO: 476549 - DNA, 25 bp, Homo sapien
gaattactgatgagcaaccataaat

SEQ ID NO: 476550 - DNA, 25 bp, Homo sapien
tactgatgagcaaccataaatagtt

SEQ ID NO: 476551 - DNA, 25 bp, Homo sapien
gatgagcaaccataaatagttttta

SEQ ID NO: 476552 - DNA, 25 bp, Homo sapien
gttactaagtatatgatgagaaatt

SEQ ID NO: 476553 - DNA, 25 bp, Homo sapien
atatctttatctgtttccaatttag

SEQ ID NO: 476554 - DNA, 25 bp, Homo sapien
atctttatctgtttccaatttagag

SEQ ID NO: 476555 - DNA, 25 bp, Homo sapien
ttatctgtttccaatttagagacgc

SEQ ID NO: 476556 - DNA, 25 bp, Homo sapien
atctgtttccaatttagagacgcca

SEQ ID NO: 476557 - DNA, 25 bp, Homo sapien
ctgtttccaatttagagacgccagg

SEQ ID NO: 476558 - DNA, 25 bp, Homo sapien
gtttccaatttagagacgccaggaa

SEQ ID NO: 476559 - DNA, 25 bp, Homo sapien
gtaatgtctaaatacttcatgagtc

SEQ ID NO: 476560 - DNA, 25 bp, Homo sapien
tcatgagtcttgctatatttaataa

SEQ ID NO: 476561 - DNA, 25 bp, Homo sapien
gacacagatgtacagaatctcagaa

SEQ ID NO: 476562 - DNA, 25 bp, Homo sapien
tctcagaaaaggctagacttgggca

SEQ ID NO: 476563 - DNA, 25 bp, Homo sapien
gtatgggcctagaaattggacaggt

SEQ ID NO: 476564 - DNA, 25 bp, Homo sapien
gacaggtgtggtgtgaaattgcaac

SEQ ID NO: 476565 - DNA, 25 bp, Homo sapien
gaaattgcaacccttgtacacactg

SEQ ID NO: 476566 - DNA, 25 bp, Homo sapien
acccttgtacacactggccacagga

SEQ ID NO: 476567 - DNA, 25 bp, Homo sapien
actggccacaggacctcagggaaga

SEQ ID NO: 476568 - DNA, 25 bp, Homo sapien
ggacctcagggaagatgtcttatct

SEQ ID NO: 476569 - DNA, 25 bp, Homo sapien
aagaatattacttaccttatggata

SEQ ID NO: 476570 - DNA, 25 bp, Homo sapien
cagtcatctgatttcatggcctaca

SEQ ID NO: 476571 - DNA, 25 bp, Homo sapien
gcctacaggctcaaccactatttta

SEQ ID NO: 476572 - DNA, 25 bp, Homo sapien
gagcacaaggtcaggtctcatgtac

SEQ ID NO: 476573 - DNA, 25 bp, Homo sapien
atgtactgttttctcagtcctggat

SEQ ID NO: 476574 - DNA, 25 bp, Homo sapien
ctcagtcctggataacacattttaa

SEQ ID NO: 476575 - DNA, 25 bp, Homo sapien
gaacatcattgacaatccagaggcc

SEQ ID NO: 476576 - DNA, 25 bp, Homo sapien
gaggccactgagaacacaactgaaa

SEQ ID NO: 476577 - DNA, 25 bp, Homo sapien
gcaaaggacttggaactctgtccat

SEQ ID NO: 476578 - DNA, 25 bp, Homo sapien
ggaactctgtccatatgcagcatag

SEQ ID NO: 476579 - DNA, 25 bp, Homo sapien
aagcactgaagattgtctctcttag

SEQ ID NO: 476580 - DNA, 25 bp, Homo sapien
gtctctcttagacctttttatcttc

SEQ ID NO: 476581 - DNA, 25 bp, Homo sapien
taactgagaaacatgatcctttggg

SEQ ID NO: 476582 - DNA, 25 bp, Homo sapien
ggctttcttttcattacttcattat

SEQ ID NO: 476583 - DNA, 25 bp, Homo sapien
ttacttcattatctgaatcccccca

SEQ ID NO: 476584 - DNA, 25 bp, Homo sapien
ttggtgaacagcctgtgactcttcc

SEQ ID NO: 476585 - DNA, 25 bp, Homo sapien
cctatccccacttctcagggataat

SEQ ID NO: 476586 - DNA, 25 bp, Homo sapien
atccccacttctcagggataatgag

SEQ ID NO: 476587 - DNA, 25 bp, Homo sapien
tctgcctctgttttacatagaatgt

SEQ ID NO: 476588 - DNA, 25 bp, Homo sapien
tgcctctgttttacatagaatgtgc

SEQ ID NO: 476589 - DNA, 25 bp, Homo sapien
tagaatgtgcgcatgtccttaacct

SEQ ID NO: 476590 - DNA, 25 bp, Homo sapien
atgtccttaaccttgttatgtatga

SEQ ID NO: 476591 - DNA, 25 bp, Homo sapien
tgtatgaaatatacgtatcacgggt

SEQ ID NO: 476592 - DNA, 25 bp, Homo sapien
agctccccatccgttagtgataact

SEQ ID NO: 476593 - DNA, 25 bp, Homo sapien
gtgataacttggactcgcagccact

SEQ ID NO: 476594 - DNA, 25 bp, Homo sapien
actcgccggttatcctgcgtgtggg

SEQ ID NO: 476595 - DNA, 25 bp, Homo sapien
tgcgtgtgggtgttttctccaaatt

SEQ ID NO: 476596 - DNA, 25 bp, Homo sapien
ccaaattggacacttagggaacagt

SEQ ID NO: 476597 - DNA, 25 bp, Homo sapien
gtttaagcagtatggagcacaattc

SEQ ID NO: 476598 - DNA, 25 bp, Homo sapien
attctgtgcctattagatgctctta

SEQ ID NO: 476599 - DNA, 25 bp, Homo sapien
gatgctcttaaatacccgacttctc

SEQ ID NO: 476600 - DNA, 25 bp, Homo sapien
agggccctacactgactgatagttt

SEQ ID NO: 476601 - DNA, 25 bp, Homo sapien
gactgatagtttgacctattggctg

SEQ ID NO: 476602 - DNA, 25 bp, Homo sapien
gacctattggctgtaaacacaccag

SEQ ID NO: 476603 - DNA, 25 bp, Homo sapien
aatatcactggagtctttggatggt

SEQ ID NO: 476604 - DNA, 25 bp, Homo sapien
ctggagtctttggatggttgacaga

SEQ ID NO: 476605 - DNA, 25 bp, Homo sapien
gagggaagtaaaaggctctcacttt

SEQ ID NO: 476606 - DNA, 25 bp, Homo sapien
aaaggctctcactttgaatttggaa

SEQ ID NO: 476607 - DNA, 25 bp, Homo sapien
ttgaatttggaaggatcactctggc

SEQ ID NO: 476608 - DNA, 25 bp, Homo sapien
ctctggctactatgtgtgggacaag

SEQ ID NO: 476609 - DNA, 25 bp, Homo sapien
accagttaggaagctattgcagcag

SEQ ID NO: 476610 - DNA, 25 bp, Homo sapien
ggaagctattgcagcagtccagtgg

SEQ ID NO: 476611 - DNA, 25 bp, Homo sapien
cagtccagtggaatggtagtgtgaa

SEQ ID NO: 476612 - DNA, 25 bp, Homo sapien
tatactgggtaggtaaagccctcca

SEQ ID NO: 476613 - DNA, 25 bp, Homo sapien
gtgggctggatgtctaaaatgtgaa

SEQ ID NO: 476614 - DNA, 25 bp, Homo sapien
agcgagatctctgtctctacgaaaa

SEQ ID NO: 476615 - DNA, 25 bp, Homo sapien
atttaggtcaagattattgcaaaag

SEQ ID NO: 476616 - DNA, 25 bp, Homo sapien
aggtcaagattattgcaaaagacag

SEQ ID NO: 476617 - DNA, 25 bp, Homo sapien
caaaagacagaaagacccaccaact

SEQ ID NO: 476618 - DNA, 25 bp, Homo sapien
gacagaaagacccaccaacttccga

SEQ ID NO: 476619 - DNA, 25 bp, Homo sapien
agaaagacccaccaacttccgatag

SEQ ID NO: 476620 - DNA, 25 bp, Homo sapien
gaaagacccaccaacttccgatagc

SEQ ID NO: 476621 - DNA, 25 bp, Homo sapien
aaagacccaccaacttccgatagct

SEQ ID NO: 476622 - DNA, 25 bp, Homo sapien
aagacccaccaacttccgatagctt

SEQ ID NO: 476623 - DNA, 25 bp, Homo sapien
gacccaccaacttccgatagctttt

SEQ ID NO: 476624 - DNA, 25 bp, Homo sapien
ccaccaacttccgatagcttttatg

SEQ ID NO: 476625 - DNA, 25 bp, Homo sapien
taggtaggaactgggtaggaacaca

SEQ ID NO: 476626 - DNA, 25 bp, Homo sapien
acaaagtagtggagagtggcttagc

SEQ ID NO: 476627 - DNA, 25 bp, Homo sapien
tagctttaccatcttacatttcccg

SEQ ID NO: 476628 - DNA, 25 bp, Homo sapien
ggccacgcctaagttcagatccgtg

SEQ ID NO: 476629 - DNA, 25 bp, Homo sapien
aagttcagatccgtgtggtgggaca

SEQ ID NO: 476630 - DNA, 25 bp, Homo sapien
tgggacaggcagaagtaatactcac

SEQ ID NO: 476631 - DNA, 25 bp, Homo sapien
gcaaagacaaaaccaggtcgagggt

SEQ ID NO: 476632 - DNA, 25 bp, Homo sapien
gtcgagggtccaaaggtgacttctc

SEQ ID NO: 476633 - DNA, 25 bp, Homo sapien
caaaggtgacttctcttttccctga

SEQ ID NO: 476634 - DNA, 25 bp, Homo sapien
aagctgggccaagggtctattttca

SEQ ID NO: 476635 - DNA, 25 bp, Homo sapien
tgggccaagggtctattttcataat

SEQ ID NO: 476636 - DNA, 25 bp, Homo sapien
tgaacatgctttaaaaagtgagcac

SEQ ID NO: 476637 - DNA, 25 bp, Homo sapien
gaacatgctttaaaaagtgagcacc

SEQ ID NO: 476638 - DNA, 25 bp, Homo sapien
aacatgctttaaaaagtgagcacca

SEQ ID NO: 476639 - DNA, 25 bp, Homo sapien
acatgctttaaaaagtgagcaccaa

SEQ ID NO: 476640 - DNA, 25 bp, Homo sapien
catgctttaaaaagtgagcaccaag

SEQ ID NO: 476641 - DNA, 25 bp, Homo sapien
atgctttaaaaagtgagcaccaagg

SEQ ID NO: 476642 - DNA, 25 bp, Homo sapien
tgctttaaaaagtgagcaccaaggc

SEQ ID NO: 476643 - DNA, 25 bp, Homo sapien
gctttaaaaagtgagcaccaaggcc

SEQ ID NO: 476644 - DNA, 25 bp, Homo sapien
ctttaaaaagtgagcaccaaggcca

SEQ ID NO: 476645 - DNA, 25 bp, Homo sapien
tttaaaaagtgagcaccaaggccag

SEQ ID NO: 476646 - DNA, 25 bp, Homo sapien
ttaaaaagtgagcaccaaggccagg

SEQ ID NO: 476647 - DNA, 25 bp, Homo sapien
ctagaattcgtgtagatgaacacaa

SEQ ID NO: 476648 - DNA, 25 bp, Homo sapien
aatagtagtgtatgcttgaagtgat

SEQ ID NO: 476649 - DNA, 25 bp, Homo sapien
atgcttgaagtgataacttagccta

SEQ ID NO: 476650 - DNA, 25 bp, Homo sapien
gaagtgataacttagcctatggtaa

SEQ ID NO: 476651 - DNA, 25 bp, Homo sapien
gcctatggtaaggatatgggaaact

SEQ ID NO: 476652 - DNA, 25 bp, Homo sapien
aaacaggaactaacaatctcagtga

SEQ ID NO: 476653 - DNA, 25 bp, Homo sapien
aggaactaacaatctcagtgacttc

SEQ ID NO: 476654 - DNA, 25 bp, Homo sapien
aataaagaattagccggtgctgtgg

SEQ ID NO: 476655 - DNA, 25 bp, Homo sapien
agaattagccggtgctgtggcttat

SEQ ID NO: 476656 - DNA, 25 bp, Homo sapien
ggcttatgccatatcctagtacttt

SEQ ID NO: 476657 - DNA, 25 bp, Homo sapien
gcttatgccatatcctagtactttg

SEQ ID NO: 476658 - DNA, 25 bp, Homo sapien
tttgttgccattgctaatattctta

SEQ ID NO: 476659 - DNA, 25 bp, Homo sapien
gttgccattgctaatattcttaaat

SEQ ID NO: 476660 - DNA, 25 bp, Homo sapien
acattctaagaaatcactctgtaat

SEQ ID NO: 476661 - DNA, 25 bp, Homo sapien
gtaatgaatgtaaaaccacctttgg

SEQ ID NO: 476662 - DNA, 25 bp, Homo sapien
tgtaaaaccacctttgggtagagag

SEQ ID NO: 476663 - DNA, 25 bp, Homo sapien
ccacctttgggtagagagtatgata

SEQ ID NO: 476664 - DNA, 25 bp, Homo sapien
gagagtatgataccagtagttctat

SEQ ID NO: 476665 - DNA, 25 bp, Homo sapien
taccagtagttctatttaatcttcc

SEQ ID NO: 476666 - DNA, 25 bp, Homo sapien
ttaaaacatgggtttttcatgattt

SEQ ID NO: 476667 - DNA, 25 bp, Homo sapien
ttcagcaatgtgtttaatactccag

SEQ ID NO: 476668 - DNA, 25 bp, Homo sapien
atgtgtttaatactccaggatacca

SEQ ID NO: 476669 - DNA, 25 bp, Homo sapien
tgtttaagtggtaagaaactgccca

SEQ ID NO: 476670 - DNA, 25 bp, Homo sapien
gtttaagtggtaagaaactgcccag

SEQ ID NO: 476671 - DNA, 25 bp, Homo sapien
tttaagtggtaagaaactgcccagc

SEQ ID NO: 476672 - DNA, 25 bp, Homo sapien
ttaagtggtaagaaactgcccagct

SEQ ID NO: 476673 - DNA, 25 bp, Homo sapien
taagtggtaagaaactgcccagctg

SEQ ID NO: 476674 - DNA, 25 bp, Homo sapien
aagtggtaagaaactgcccagctgg

SEQ ID NO: 476675 - DNA, 25 bp, Homo sapien
gtggtaagaaactgcccagctgggc

SEQ ID NO: 476676 - DNA, 25 bp, Homo sapien
tggtaagaaactgcccagctgggcc

SEQ ID NO: 476677 - DNA, 25 bp, Homo sapien
gtaagaaactgcccagctgggccag

SEQ ID NO: 476678 - DNA, 25 bp, Homo sapien
aaactgcccagctgggccaggcgca

SEQ ID NO: 476679 - DNA, 25 bp, Homo sapien
tgggtgacaaatggggactccgtct

SEQ ID NO: 476680 - DNA, 25 bp, Homo sapien
tgtctctctctgatacatggctcaa

SEQ ID NO: 476681 - DNA, 25 bp, Homo sapien
ctctctctgatacatggctcaagac

SEQ ID NO: 476682 - DNA, 25 bp, Homo sapien
tctgatacatggctcaagacattag

SEQ ID NO: 476683 - DNA, 25 bp, Homo sapien
aaaatactggcatggccaactaggg

SEQ ID NO: 476684 - DNA, 25 bp, Homo sapien
actggcatggccaactagggaacat

SEQ ID NO: 476685 - DNA, 25 bp, Homo sapien
ggcatggccaactagggaacataaa

SEQ ID NO: 476686 - DNA, 25 bp, Homo sapien
gtgatttaataagattgtcccgaaa

SEQ ID NO: 476687 - DNA, 25 bp, Homo sapien
aaaaagctatataatcagtgattct

SEQ ID NO: 476688 - DNA, 25 bp, Homo sapien
tctaacttataagccgattttctct

SEQ ID NO: 476689 - DNA, 25 bp, Homo sapien
tataagccgattttctctttctctc

SEQ ID NO: 476690 - DNA, 25 bp, Homo sapien
tctccctggccagatagttgttctt

SEQ ID NO: 476691 - DNA, 25 bp, Homo sapien
cttgcactatcacacatacatatgg

SEQ ID NO: 476692 - DNA, 25 bp, Homo sapien
ttgcactatcacacatacatatgga

SEQ ID NO: 476693 - DNA, 25 bp, Homo sapien
tgcactatcacacatacatatggaa

SEQ ID NO: 476694 - DNA, 25 bp, Homo sapien
gcactatcacacatacatatggaaa

SEQ ID NO: 476695 - DNA, 25 bp, Homo sapien
cactatcacacatacatatggaaaa

SEQ ID NO: 476696 - DNA, 25 bp, Homo sapien
actatcacacatacatatggaaaat

SEQ ID NO: 476697 - DNA, 25 bp, Homo sapien
cacatacatatggaaaatagacaag

SEQ ID NO: 476698 - DNA, 25 bp, Homo sapien
tagacaagtaagtagtgagttacaa

SEQ ID NO: 476699 - DNA, 25 bp, Homo sapien
taagtagtgagttacaatacagcac

SEQ ID NO: 476700 - DNA, 25 bp, Homo sapien
agtagtgagttacaatacagcactt

SEQ ID NO: 476701 - DNA, 25 bp, Homo sapien
gtagtgagttacaatacagcacttt

SEQ ID NO: 476702 - DNA, 25 bp, Homo sapien
ttgaactcaaatctcagcaccacag

SEQ ID NO: 476703 - DNA, 25 bp, Homo sapien
aaatctcagcaccacagttaaatga

SEQ ID NO: 476704 - DNA, 25 bp, Homo sapien
aggagcagatgtttctcttcacacc

SEQ ID NO: 476705 - DNA, 25 bp, Homo sapien
acaccacactgctttaacatccagt

SEQ ID NO: 476706 - DNA, 25 bp, Homo sapien
acatccagtattcgtgaccttttct

SEQ ID NO: 476707 - DNA, 25 bp, Homo sapien
cccaccatcctctgatttacatagg

SEQ ID NO: 476708 - DNA, 25 bp, Homo sapien
tctgatttacataggcttccaaagc

SEQ ID NO: 476709 - DNA, 25 bp, Homo sapien
tgccattgggcattgctatcctagt

SEQ ID NO: 476710 - DNA, 25 bp, Homo sapien
tgctatcctagttttaacccttggt

SEQ ID NO: 476711 - DNA, 25 bp, Homo sapien
aatactttgtgattcccacgactcc

SEQ ID NO: 476712 - DNA, 25 bp, Homo sapien
acgactccagaccaacaaaaatata

SEQ ID NO: 476713 - DNA, 25 bp, Homo sapien
tatttctgcctcctaaaactacatc

SEQ ID NO: 476714 - DNA, 25 bp, Homo sapien
taaaactacatcactgctgcgtcac

SEQ ID NO: 476715 - DNA, 25 bp, Homo sapien
tcactgctgcgtcactagatcaagg

SEQ ID NO: 476716 - DNA, 25 bp, Homo sapien
aaggcatcaagtgcattcaagtgac

SEQ ID NO: 476717 - DNA, 25 bp, Homo sapien
gacttacatccttgggtgaattcat

SEQ ID NO: 476718 - DNA, 25 bp, Homo sapien
gccacagtggttttattgaagagct

SEQ ID NO: 476719 - DNA, 25 bp, Homo sapien
gaagagcttcacaattacaaataca

SEQ ID NO: 476720 - DNA, 25 bp, Homo sapien
tacagatgccctaaagcccaggaca

SEQ ID NO: 476721 - DNA, 25 bp, Homo sapien
gacagccaatacatgttacaagcca

SEQ ID NO: 476722 - DNA, 25 bp, Homo sapien
gtcaatgatttcaaggacttcccta

SEQ ID NO: 476723 - DNA, 25 bp, Homo sapien
aaggacttccctactattaatgcag

SEQ ID NO: 476724 - DNA, 25 bp, Homo sapien
ggaaatggcatctttggcatggctt

SEQ ID NO: 476725 - DNA, 25 bp, Homo sapien
catctttggcatggcttggtggctc

SEQ ID NO: 476726 - DNA, 25 bp, Homo sapien
tggcttggtggctcccgcctggaat

SEQ ID NO: 476727 - DNA, 25 bp, Homo sapien
ccagcagttcaagacaggtccgggc

SEQ ID NO: 476728 - DNA, 25 bp, Homo sapien
cagcagttcaagacaggtccgggca

SEQ ID NO: 476729 - DNA, 25 bp, Homo sapien
gcagttcaagacaggtccgggcaac

SEQ ID NO: 476730 - DNA, 25 bp, Homo sapien
gttcaagacaggtccgggcaacata

SEQ ID NO: 476731 - DNA, 25 bp, Homo sapien
ttcaagacaggtccgggcaacatag

SEQ ID NO: 476732 - DNA, 25 bp, Homo sapien
agacaggtccgggcaacatagcgag

SEQ ID NO: 476733 - DNA, 25 bp, Homo sapien
atatacaaaaatctgctgggcaggg

SEQ ID NO: 476734 - DNA, 25 bp, Homo sapien
aatctgctgggcagggtggcgtgca

SEQ ID NO: 476735 - DNA, 25 bp, Homo sapien
aattttacagttcaggccgggcgcg

SEQ ID NO: 476736 - DNA, 25 bp, Homo sapien
attttacagttcaggccgggcgcgg

SEQ ID NO: 476737 - DNA, 25 bp, Homo sapien
ttttacagttcaggccgggcgcggt

SEQ ID NO: 476738 - DNA, 25 bp, Homo sapien
tttacagttcaggccgggcgcggtg

SEQ ID NO: 476739 - DNA, 25 bp, Homo sapien
ttacagttcaggccgggcgcggtgg

SEQ ID NO: 476740 - DNA, 25 bp, Homo sapien
gggaggctgaggctggcgggtcacc

SEQ ID NO: 476741 - DNA, 25 bp, Homo sapien
ggaggctgaggctggcgggtcacct

SEQ ID NO: 476742 - DNA, 25 bp, Homo sapien
gaggctgaggctggcgggtcacctg

SEQ ID NO: 476743 - DNA, 25 bp, Homo sapien
aggctgaggctggcgggtcacctga

SEQ ID NO: 476744 - DNA, 25 bp, Homo sapien
gcatggcaaaatcccgtctccacta

SEQ ID NO: 476745 - DNA, 25 bp, Homo sapien
caggcgtggtggcggatgcctataa

SEQ ID NO: 476746 - DNA, 25 bp, Homo sapien
tggttgttactgattattaatggtc

SEQ ID NO: 476747 - DNA, 25 bp, Homo sapien
taatggtctgtggtgtttaccttcc

SEQ ID NO: 476748 - DNA, 25 bp, Homo sapien
tggtctgtggtgtttaccttccaag

SEQ ID NO: 476749 - DNA, 25 bp, Homo sapien
tgtggtgtttaccttccaagggtct

SEQ ID NO: 476750 - DNA, 25 bp, Homo sapien
tgtttaccttccaagggtctaacat

SEQ ID NO: 476751 - DNA, 25 bp, Homo sapien
gaagaaggtttcgatggtaaaatca

SEQ ID NO: 476752 - DNA, 25 bp, Homo sapien
taaaatcaaccctaaggccacctag

SEQ ID NO: 476753 - DNA, 25 bp, Homo sapien
ctaaggccacctagtaaactcaatg

SEQ ID NO: 476754 - DNA, 25 bp, Homo sapien
gggctcttaacctgaagtccttaga

SEQ ID NO: 476755 - DNA, 25 bp, Homo sapien
taacctgaagtccttagaagggctt

SEQ ID NO: 476756 - DNA, 25 bp, Homo sapien
agaagggctttaatctgctgggtgc

SEQ ID NO: 476757 - DNA, 25 bp, Homo sapien
tctggcgtctaaatcctgagtaatt

SEQ ID NO: 476758 - DNA, 25 bp, Homo sapien
aaatcctgagtaattgtgccttaga

SEQ ID NO: 476759 - DNA, 25 bp, Homo sapien
cctgagtaattgtgccttagattgc

SEQ ID NO: 476760 - DNA, 25 bp, Homo sapien
tgtgccttagattgcagaagagttt

SEQ ID NO: 476761 - DNA, 25 bp, Homo sapien
agtgaaataagctgtctttactttt

SEQ ID NO: 476762 - DNA, 25 bp, Homo sapien
gtaaatccttttacaactgtgacgt

SEQ ID NO: 476763 - DNA, 25 bp, Homo sapien
tacaactgtgacgtaagtaactcat

SEQ ID NO: 476764 - DNA, 25 bp, Homo sapien
ctgtgacgtaagtaactcatttata

SEQ ID NO: 476765 - DNA, 25 bp, Homo sapien
atatagtttcagtacttgataagta

SEQ ID NO: 476766 - DNA, 25 bp, Homo sapien
gtaatcaaaacatcctttgctaaga

SEQ ID NO: 476767 - DNA, 25 bp, Homo sapien
caatatatgtatggtatgtgactat

SEQ ID NO: 476768 - DNA, 25 bp, Homo sapien
tctgatcagccccaatatttgttga

SEQ ID NO: 476769 - DNA, 25 bp, Homo sapien
tttgttgaatgcatccttctggctt

SEQ ID NO: 476770 - DNA, 25 bp, Homo sapien
ttaaggccattcttggcccctgaaa

SEQ ID NO: 476771 - DNA, 25 bp, Homo sapien
cttggcccctgaaacacatcaataa

SEQ ID NO: 476772 - DNA, 25 bp, Homo sapien
agcattgctggtgagagcctggttt

SEQ ID NO: 476773 - DNA, 25 bp, Homo sapien
gagagcctggtttgtgacagcccat

SEQ ID NO: 476774 - DNA, 25 bp, Homo sapien
tgacagcccatggtatcatcactga

SEQ ID NO: 476775 - DNA, 25 bp, Homo sapien
gtatcatcactgatctgtccacaga

SEQ ID NO: 476776 - DNA, 25 bp, Homo sapien
agagcacggcctggacagctgtgat

SEQ ID NO: 476777 - DNA, 25 bp, Homo sapien
acagctgtgataccaccatgtgggc

SEQ ID NO: 476778 - DNA, 25 bp, Homo sapien
agatgcccctctggctatcttaaga

SEQ ID NO: 476779 - DNA, 25 bp, Homo sapien
ctttgcagaaacatggacagagctg

SEQ ID NO: 476780 - DNA, 25 bp, Homo sapien
acacaggaagagaaaaccgaatatt

SEQ ID NO: 476781 - DNA, 25 bp, Homo sapien
tattgaatgttctcacgtacaagtg

SEQ ID NO: 476782 - DNA, 25 bp, Homo sapien
ttgaatgttctcacgtacaagtggg

SEQ ID NO: 476783 - DNA, 25 bp, Homo sapien
gtgggagctaaatgttgcaaacaca

SEQ ID NO: 476784 - DNA, 25 bp, Homo sapien
aaatgttgcaaacacatggacacat

SEQ ID NO: 476785 - DNA, 25 bp, Homo sapien
atggacacatactggggcctatcgg

SEQ ID NO: 476786 - DNA, 25 bp, Homo sapien
taatacctgggtgacaatataattt

SEQ ID NO: 476787 - DNA, 25 bp, Homo sapien
taatttgaataccaaacccccatga

SEQ ID NO: 476788 - DNA, 25 bp, Homo sapien
cacaagtttccctatatgacaaact

SEQ ID NO: 476789 - DNA, 25 bp, Homo sapien
gtttccctatatgacaaacttgcat

SEQ ID NO: 476790 - DNA, 25 bp, Homo sapien
gttagactacggcactatgaaaaat

SEQ ID NO: 476791 - DNA, 25 bp, Homo sapien
tacaggccaacaaattggataacct

SEQ ID NO: 476792 - DNA, 25 bp, Homo sapien
ggatacattcctagaaacatacaac

SEQ ID NO: 476793 - DNA, 25 bp, Homo sapien
tgaaaaatcataggccaacaaattg

SEQ ID NO: 476794 - DNA, 25 bp, Homo sapien
caaattggataacctagcagaaacc

SEQ ID NO: 476795 - DNA, 25 bp, Homo sapien
agactacggcactatgaaaaatcat

SEQ ID NO: 476796 - DNA, 25 bp, Homo sapien
agacaaggttagactatggcactat

SEQ ID NO: 476797 - DNA, 25 bp, Homo sapien
tgaaaaatcataggccaacaaactg

SEQ ID NO: 476798 - DNA, 25 bp, Homo sapien
aggccaacaaactggataacctagc

SEQ ID NO: 476799 - DNA, 25 bp, Homo sapien
ggataacctagcagaaaccaaagac

SEQ ID NO: 476800 - DNA, 25 bp, Homo sapien
agacaaggttagactacggcactat

SEQ ID NO: 476801 - DNA, 25 bp, Homo sapien
aaagtgcttggaaagtacttcatcc

SEQ ID NO: 476802 - DNA, 25 bp, Homo sapien
gtacttcatccaaagtgagcgctct

SEQ ID NO: 476803 - DNA, 25 bp, Homo sapien
cttcatccaaagtgagcgctcttca

SEQ ID NO: 476804 - DNA, 25 bp, Homo sapien
aaagtgagcgctcttcatgccattg

SEQ ID NO: 476805 - DNA, 25 bp, Homo sapien
tgagcgctcttcatgccattgcagt

SEQ ID NO: 476806 - DNA, 25 bp, Homo sapien
gctcttcatgccattgcagttgttg

SEQ ID NO: 476807 - DNA, 25 bp, Homo sapien
tcatgccattgcagttgttgggatt

SEQ ID NO: 476808 - DNA, 25 bp, Homo sapien
ggatttttgaggagtgtgcaaccaa

SEQ ID NO: 476809 - DNA, 25 bp, Homo sapien
gagtgtgcaaccaaggagttggaaa

SEQ ID NO: 476810 - DNA, 25 bp, Homo sapien
aaaagttcaagggaggccaggcgtg

SEQ ID NO: 476811 - DNA, 25 bp, Homo sapien
ctggacaaaaagagtcagactccat

SEQ ID NO: 476812 - DNA, 25 bp, Homo sapien
ttgcattacattcacccgtcactgc

SEQ ID NO: 476813 - DNA, 25 bp, Homo sapien
ttgtttgttttcataccacacctca

SEQ ID NO: 476814 - DNA, 25 bp, Homo sapien
gttttcataccacacctcactctgg

SEQ ID NO: 476815 - DNA, 25 bp, Homo sapien
taaatgagtcaggatctatggttac

SEQ ID NO: 476816 - DNA, 25 bp, Homo sapien
ggcttaggcattagagagagaattt

SEQ ID NO: 476817 - DNA, 25 bp, Homo sapien
ttatcctaataacaaccctttcaag

SEQ ID NO: 476818 - DNA, 25 bp, Homo sapien
tcctaataacaaccctttcaagtgg

SEQ ID NO: 476819 - DNA, 25 bp, Homo sapien
tttcaagtgggttttatcttcattt

SEQ ID NO: 476820 - DNA, 25 bp, Homo sapien
tatcttcattttcagctgaggaagc

SEQ ID NO: 476821 - DNA, 25 bp, Homo sapien
ggtggaccatactagaggactggaa

SEQ ID NO: 476822 - DNA, 25 bp, Homo sapien
actagaggactggaaggtctgagaa

SEQ ID NO: 476823 - DNA, 25 bp, Homo sapien
ttccacacattttccagctatgtat

SEQ ID NO: 476824 - DNA, 25 bp, Homo sapien
tttccagctatgtatgtgctcaagt

SEQ ID NO: 476825 - DNA, 25 bp, Homo sapien
aggcagtgatttaatcctcttccct

SEQ ID NO: 476826 - DNA, 25 bp, Homo sapien
gtgatttaatcctcttccctttcca

SEQ ID NO: 476827 - DNA, 25 bp, Homo sapien
gcttatgaaataacttctgcatcag

SEQ ID NO: 476828 - DNA, 25 bp, Homo sapien
cttctgcatcagtgtaatattcaaa

SEQ ID NO: 476829 - DNA, 25 bp, Homo sapien
aaagaagtctactgccatatggcca

SEQ ID NO: 476830 - DNA, 25 bp, Homo sapien
tatggccatacattaatctgagtag

SEQ ID NO: 476831 - DNA, 25 bp, Homo sapien
gcagagtggagagtatttagtctta

SEQ ID NO: 476832 - DNA, 25 bp, Homo sapien
gtaaagatagcccagagtccaaaga

SEQ ID NO: 476833 - DNA, 25 bp, Homo sapien
cccagagtccaaagaggcagatgat

SEQ ID NO: 476834 - DNA, 25 bp, Homo sapien
agcaaaactgtgaaaaagccaaatt

SEQ ID NO: 476835 - DNA, 25 bp, Homo sapien
gccaaattaggcatacaaggagtat

SEQ ID NO: 476836 - DNA, 25 bp, Homo sapien
aggagtatgatttaacagtatgaca

SEQ ID NO: 476837 - DNA, 25 bp, Homo sapien
acttttgtttgtaccttcaatgtgt

SEQ ID NO: 476838 - DNA, 25 bp, Homo sapien
accttcaatgtgtaagtacatgcat

SEQ ID NO: 476839 - DNA, 25 bp, Homo sapien
acatgcatgttttattgtcagagga

SEQ ID NO: 476840 - DNA, 25 bp, Homo sapien
gcatgttttattgtcagaggaagaa

SEQ ID NO: 476841 - DNA, 25 bp, Homo sapien
gagaggtgtgttaggataattgtcc

SEQ ID NO: 476842 - DNA, 25 bp, Homo sapien
gttaggataattgtccagttaattt

SEQ ID NO: 476843 - DNA, 25 bp, Homo sapien
cagttaatttgaaaaggccccagat

SEQ ID NO: 476844 - DNA, 25 bp, Homo sapien
ggccccagatgaatcaataaatata

SEQ ID NO: 476845 - DNA, 25 bp, Homo sapien
tttagaatatcttccactgttaccg

SEQ ID NO: 476846 - DNA, 25 bp, Homo sapien
ttagaatatcttccactgttaccgg

SEQ ID NO: 476847 - DNA, 25 bp, Homo sapien
tagaatatcttccactgttaccggg

SEQ ID NO: 476848 - DNA, 25 bp, Homo sapien
tcttccactgttaccgggcgcactg

SEQ ID NO: 476849 - DNA, 25 bp, Homo sapien
cttccactgttaccgggcgcactgg

SEQ ID NO: 476850 - DNA, 25 bp, Homo sapien
ttccactgttaccgggcgcactggc

SEQ ID NO: 476851 - DNA, 25 bp, Homo sapien
tccactgttaccgggcgcactggct

SEQ ID NO: 476852 - DNA, 25 bp, Homo sapien
tgttaccgggcgcactggctcacgc

SEQ ID NO: 476853 - DNA, 25 bp, Homo sapien
agaactgcttgaaccaggacctggg

SEQ ID NO: 476854 - DNA, 25 bp, Homo sapien
aactgcttgaaccaggacctgggag

SEQ ID NO: 476855 - DNA, 25 bp, Homo sapien
ctgcttgaaccaggacctgggagga

SEQ ID NO: 476856 - DNA, 25 bp, Homo sapien
ttcccacatccacaggcaatcatgg

SEQ ID NO: 476857 - DNA, 25 bp, Homo sapien
aggcaatcatggatctgttttctat

SEQ ID NO: 476858 - DNA, 25 bp, Homo sapien
catggatctgttttctattgttata

SEQ ID NO: 476859 - DNA, 25 bp, Homo sapien
atagattagtttgcgtttcctacaa

SEQ ID NO: 476860 - DNA, 25 bp, Homo sapien
gcgtttcctacaattttatacacat

SEQ ID NO: 476861 - DNA, 25 bp, Homo sapien
tactataggtactcttgtttggctc

SEQ ID NO: 476862 - DNA, 25 bp, Homo sapien
aggtactcttgtttggctccttcca

SEQ ID NO: 476863 - DNA, 25 bp, Homo sapien
gctccttccatccagcataataagt

SEQ ID NO: 476864 - DNA, 25 bp, Homo sapien
ttccatccagcataataagtttgag

SEQ ID NO: 476865 - DNA, 25 bp, Homo sapien
ttcattcatgttgttatatgcgtct

SEQ ID NO: 476866 - DNA, 25 bp, Homo sapien
atatgcgtctatgttcattcctttt

SEQ ID NO: 476867 - DNA, 25 bp, Homo sapien
agacgccaggaagaacggcatgata

SEQ ID NO: 476868 - DNA, 25 bp, Homo sapien
gaacggcatgataggtctttcagat

SEQ ID NO: 476869 - DNA, 25 bp, Homo sapien
cggcatgataggtctttcagatttc

SEQ ID NO: 476870 - DNA, 25 bp, Homo sapien
tcagatttcttctttccaaagagga

SEQ ID NO: 476871 - DNA, 25 bp, Homo sapien
aaaactctgaagatgtaggccatta

SEQ ID NO: 476872 - DNA, 25 bp, Homo sapien
ctctgaagatgtaggccattaatac

SEQ ID NO: 476873 - DNA, 25 bp, Homo sapien
gtaggccattaatacagagaagaat

SEQ ID NO: 476874 - DNA, 25 bp, Homo sapien
tttaatgtcaaaatagtgctcttta

SEQ ID NO: 476875 - DNA, 25 bp, Homo sapien
tgctctttaaaattctggcaccaaa

SEQ ID NO: 476876 - DNA, 25 bp, Homo sapien
gctctttaaaattctggcaccaaat

SEQ ID NO: 476877 - DNA, 25 bp, Homo sapien
aattctggcaccaaatacaacttac

SEQ ID NO: 476878 - DNA, 25 bp, Homo sapien
ataatgtgggattagcccgctagca

SEQ ID NO: 476879 - DNA, 25 bp, Homo sapien
tagcccgctagcattaggagcagtt

SEQ ID NO: 476880 - DNA, 25 bp, Homo sapien
cattaggagcagttgggaagttacc

SEQ ID NO: 476881 - DNA, 25 bp, Homo sapien
agttacctggtagatcaagcattac

SEQ ID NO: 476882 - DNA, 25 bp, Homo sapien
ggtagatcaagcattacacacaaaa

SEQ ID NO: 476883 - DNA, 25 bp, Homo sapien
agttgatcagagtatgggttctcca

SEQ ID NO: 476884 - DNA, 25 bp, Homo sapien
gggttctccatatagcaatacttca

SEQ ID NO: 476885 - DNA, 25 bp, Homo sapien
aacaacacagtctactctttctgct

SEQ ID NO: 476886 - DNA, 25 bp, Homo sapien
cagtctactctttctgcttacaaag

SEQ ID NO: 476887 - DNA, 25 bp, Homo sapien
gacaaagccttacaaactcactatg

SEQ ID NO: 476888 - DNA, 25 bp, Homo sapien
tgcttctttgcccagacatttacaa

SEQ ID NO: 476889 - DNA, 25 bp, Homo sapien
tttggcttcactcatggtggtgtga

SEQ ID NO: 476890 - DNA, 25 bp, Homo sapien
ttggcttcactcatggtggtgtgag

SEQ ID NO: 476891 - DNA, 25 bp, Homo sapien
tggcttcactcatggtggtgtgagt

SEQ ID NO: 476892 - DNA, 25 bp, Homo sapien
gcttcactcatggtggtgtgagtct

SEQ ID NO: 476893 - DNA, 25 bp, Homo sapien
ttcactcatggtggtgtgagtctgt

SEQ ID NO: 476894 - DNA, 25 bp, Homo sapien
tcactcatggtggtgtgagtctgtg

SEQ ID NO: 476895 - DNA, 25 bp, Homo sapien
tgtggtcccagctatccgatggcag

SEQ ID NO: 476896 - DNA, 25 bp, Homo sapien
gtggtcccagctatccgatggcagg

SEQ ID NO: 476897 - DNA, 25 bp, Homo sapien
tggtcccagctatccgatggcaggg

SEQ ID NO: 476898 - DNA, 25 bp, Homo sapien
tcccagctatccgatggcagggcgg

SEQ ID NO: 476899 - DNA, 25 bp, Homo sapien
gcttaagagatcaagaggttgaggc

SEQ ID NO: 476900 - DNA, 25 bp, Homo sapien
taatcagtttttgccttcacatttg

SEQ ID NO: 476901 - DNA, 25 bp, Homo sapien
ttcacatttggtcttcaattgctgt

SEQ ID NO: 476902 - DNA, 25 bp, Homo sapien
caattgctgtatagcattgtttcac

SEQ ID NO: 476903 - DNA, 25 bp, Homo sapien
cactctctaaattatgtgtcatagc

SEQ ID NO: 476904 - DNA, 25 bp, Homo sapien
gtgtcatagctatagaggtccatga

SEQ ID NO: 476905 - DNA, 25 bp, Homo sapien
gaggtccatgaattgctgcagctgt

SEQ ID NO: 476906 - DNA, 25 bp, Homo sapien
gggcatttttctatggtccatagaa

SEQ ID NO: 476907 - DNA, 25 bp, Homo sapien
tatggtccatagaataagcactgtt

SEQ ID NO: 476908 - DNA, 25 bp, Homo sapien
gaataagcactgtttgtatcctctt

SEQ ID NO: 476909 - DNA, 25 bp, Homo sapien
tttgtatcctcttttcacaaacatt

SEQ ID NO: 476910 - DNA, 25 bp, Homo sapien
aaagttcccatgatggtctaagaga

SEQ ID NO: 476911 - DNA, 25 bp, Homo sapien
ctctttccttgttcgtggagtggag

SEQ ID NO: 476912 - DNA, 25 bp, Homo sapien
caggcgattaggaagccggcagccc

SEQ ID NO: 476913 - DNA, 25 bp, Homo sapien
gtgatgcttccgaggcaccagtgac

SEQ ID NO: 476914 - DNA, 25 bp, Homo sapien
cagtgactcagtccacaaacgtggg

SEQ ID NO: 476915 - DNA, 25 bp, Homo sapien
caaacgtgggcgtaaaaggcctcat

SEQ ID NO: 476916 - DNA, 25 bp, Homo sapien
aggcctcatgattcaggtggagtga

SEQ ID NO: 476917 - DNA, 25 bp, Homo sapien
gcgtggtgcagtgataagtcctcct

SEQ ID NO: 476918 - DNA, 25 bp, Homo sapien
gacgccttatggatcatctgacatt

SEQ ID NO: 476919 - DNA, 25 bp, Homo sapien
tgacatttccagaacgcagcctctt

SEQ ID NO: 476920 - DNA, 25 bp, Homo sapien
agcctcttcattaccggtgcttgta

SEQ ID NO: 476921 - DNA, 25 bp, Homo sapien
accggtgcttgtaacgatgaattaa

SEQ ID NO: 476922 - DNA, 25 bp, Homo sapien
agttagagacctggactgggcaaaa

SEQ ID NO: 476923 - DNA, 25 bp, Homo sapien
gttagagacctggactgggcaaaat

SEQ ID NO: 476924 - DNA, 25 bp, Homo sapien
ttagagacctggactgggcaaaatg

SEQ ID NO: 476925 - DNA, 25 bp, Homo sapien
agagacctggactgggcaaaatggt

SEQ ID NO: 476926 - DNA, 25 bp, Homo sapien
gcaaaatggtgaggaccccatctct

SEQ ID NO: 476927 - DNA, 25 bp, Homo sapien
attagcaaggtgtggtaatgtgcac

SEQ ID NO: 476928 - DNA, 25 bp, Homo sapien
tagcaaggtgtggtaatgtgcacca

SEQ ID NO: 476929 - DNA, 25 bp, Homo sapien
gcaaggtgtggtaatgtgcaccagt

SEQ ID NO: 476930 - DNA, 25 bp, Homo sapien
caaggtgtggtaatgtgcaccagtg

SEQ ID NO: 476931 - DNA, 25 bp, Homo sapien
gtgtggtaatgtgcaccagtggtcc

SEQ ID NO: 476932 - DNA, 25 bp, Homo sapien
ccctgtctctaaatacatcaatcaa

SEQ ID NO: 476933 - DNA, 25 bp, Homo sapien
tatcagataaattgcctaggcccag

SEQ ID NO: 476934 - DNA, 25 bp, Homo sapien
taggcccagagccactatggaccag

SEQ ID NO: 476935 - DNA, 25 bp, Homo sapien
ccagagccactatggaccagcttac

SEQ ID NO: 476936 - DNA, 25 bp, Homo sapien
ggaccagcttacagagcaggaactt

SEQ ID NO: 476937 - DNA, 25 bp, Homo sapien
ttacctgcattgttcttgggtgcta

SEQ ID NO: 476938 - DNA, 25 bp, Homo sapien
gtctgggctggcagtgcaatgtaaa

SEQ ID NO: 476939 - DNA, 25 bp, Homo sapien
cagggaggattctatagaggcgata

SEQ ID NO: 476940 - DNA, 25 bp, Homo sapien
aggcgataactctcagaaggttgga

SEQ ID NO: 476941 - DNA, 25 bp, Homo sapien
gaaggttggataccattatttcaca

SEQ ID NO: 476942 - DNA, 25 bp, Homo sapien
gataccattatttcacaacccagag

SEQ ID NO: 476943 - DNA, 25 bp, Homo sapien
ttcacaacccagagctgtgccaaac

SEQ ID NO: 476944 - DNA, 25 bp, Homo sapien
gggtcattcttcagaaaggactgaa

SEQ ID NO: 476945 - DNA, 25 bp, Homo sapien
tgcatgcaggaatgattgtcacctt

SEQ ID NO: 476946 - DNA, 25 bp, Homo sapien
gtcaccttgaaacaattggccttct

SEQ ID NO: 476947 - DNA, 25 bp, Homo sapien
aaacaattggccttctgcacactct

SEQ ID NO: 476948 - DNA, 25 bp, Homo sapien
gcacactctttttgaagtcttgcaa

SEQ ID NO: 476949 - DNA, 25 bp, Homo sapien
agtcttgcaaaattagggtctcctt

SEQ ID NO: 476950 - DNA, 25 bp, Homo sapien
ttcccctttgcaagggaagagacac

SEQ ID NO: 476951 - DNA, 25 bp, Homo sapien
ggagtgcttagctctttacttgaag

SEQ ID NO: 476952 - DNA, 25 bp, Homo sapien
gaaggaatgctcattatgcttttat

SEQ ID NO: 476953 - DNA, 25 bp, Homo sapien
ttttctcgacatgctttatacctct

SEQ ID NO: 476954 - DNA, 25 bp, Homo sapien
tttatacctctaagagccagcccct

SEQ ID NO: 476955 - DNA, 25 bp, Homo sapien
gggcaaagcatctttcgagagcttg

SEQ ID NO: 476956 - DNA, 25 bp, Homo sapien
atctttcgagagcttgcctgccaac

SEQ ID NO: 476957 - DNA, 25 bp, Homo sapien
aaccctcagagtcacatacacgaag

SEQ ID NO: 476958 - DNA, 25 bp, Homo sapien
gtcacatacacgaaggtctcctgga

SEQ ID NO: 476959 - DNA, 25 bp, Homo sapien
ggtcagacacaaagtcactccttga

SEQ ID NO: 476960 - DNA, 25 bp, Homo sapien
cactccttgaccctatttattgaaa

SEQ ID NO: 476961 - DNA, 25 bp, Homo sapien
ttttttgagcacttttcccgtgtag

SEQ ID NO: 476962 - DNA, 25 bp, Homo sapien
acttttcccgtgtagactcaacagg

SEQ ID NO: 476963 - DNA, 25 bp, Homo sapien
gtgtagactcaacagggtctccctc

SEQ ID NO: 476964 - DNA, 25 bp, Homo sapien
gtagctgggaccacatgtgtaagtc

SEQ ID NO: 476965 - DNA, 25 bp, Homo sapien
ggaccacatgtgtaagtcactaagc

SEQ ID NO: 476966 - DNA, 25 bp, Homo sapien
cacagaatcaactggttttgaacct

SEQ ID NO: 476967 - DNA, 25 bp, Homo sapien
acagaatcaactggttttgaacctc

SEQ ID NO: 476968 - DNA, 25 bp, Homo sapien
agaatcaactggttttgaacctcaa

SEQ ID NO: 476969 - DNA, 25 bp, Homo sapien
gaatcaactggttttgaacctcaat

SEQ ID NO: 476970 - DNA, 25 bp, Homo sapien
aatcaactggttttgaacctcaatt

SEQ ID NO: 476971 - DNA, 25 bp, Homo sapien
tcaactggttttgaacctcaattta

SEQ ID NO: 476972 - DNA, 25 bp, Homo sapien
tggttttgaacctcaatttacttat

SEQ ID NO: 476973 - DNA, 25 bp, Homo sapien
gttttgaacctcaatttacttatag

SEQ ID NO: 476974 - DNA, 25 bp, Homo sapien
tttgaacctcaatttacttataggt

SEQ ID NO: 476975 - DNA, 25 bp, Homo sapien
tgaacctcaatttacttataggtta

SEQ ID NO: 476976 - DNA, 25 bp, Homo sapien
ggttaatttagagagaattgacttt

SEQ ID NO: 476977 - DNA, 25 bp, Homo sapien
gaatgtgactaccaggatcaaggaa

SEQ ID NO: 476978 - DNA, 25 bp, Homo sapien
gatcaaggaacttcataccagttga

SEQ ID NO: 476979 - DNA, 25 bp, Homo sapien
accagttgaaccatacagtatttgt

SEQ ID NO: 476980 - DNA, 25 bp, Homo sapien
tcactgaacataatagcctgaaggt

SEQ ID NO: 476981 - DNA, 25 bp, Homo sapien
taatagcctgaaggtttatccatgt

SEQ ID NO: 476982 - DNA, 25 bp, Homo sapien
ttgtgtgcagagatcaattgtcttt

SEQ ID NO: 476983 - DNA, 25 bp, Homo sapien
agatcaattgtctttatccattcat

SEQ ID NO: 476984 - DNA, 25 bp, Homo sapien
taatgaacacttgggttggttccac

SEQ ID NO: 476985 - DNA, 25 bp, Homo sapien
ttggttccaccttttggttattatg

SEQ ID NO: 476986 - DNA, 25 bp, Homo sapien
agtactgtgatgaacatgagtgcaa

SEQ ID NO: 476987 - DNA, 25 bp, Homo sapien
catgagtgcaaatatatctgtttga

SEQ ID NO: 476988 - DNA, 25 bp, Homo sapien
acaatctcccattgatcttgatgag

SEQ ID NO: 476989 - DNA, 25 bp, Homo sapien
ctcccattgatcttgatgagaaacc

SEQ ID NO: 476990 - DNA, 25 bp, Homo sapien
acctaatggtggcttctcctaggac

SEQ ID NO: 476991 - DNA, 25 bp, Homo sapien
tcctaggaccactgtctctgctggg

SEQ ID NO: 476992 - DNA, 25 bp, Homo sapien
aggaccactgtctctgctgggccca

SEQ ID NO: 476993 - DNA, 25 bp, Homo sapien
gcaccaggaggtgtgggtcccactc

SEQ ID NO: 476994 - DNA, 25 bp, Homo sapien
gtaggctagggagccgggcagtcat

SEQ ID NO: 476995 - DNA, 25 bp, Homo sapien
ggagtcagaacacctcccaacctga

SEQ ID NO: 476996 - DNA, 25 bp, Homo sapien
tcccaacctgagctctgactacagt

SEQ ID NO: 476997 - DNA, 25 bp, Homo sapien
tgagctctgactacagtccctgctg

SEQ ID NO: 476998 - DNA, 25 bp, Homo sapien
tatttttcacaatctcccattgatc

SEQ ID NO: 476999 - DNA, 25 bp, Homo sapien
gcttgcctttggtttcctgaaccag

SEQ ID NO: 477000 - DNA, 25 bp, Homo sapien
tgaaccagctacacagtcagactgt

SEQ ID NO: 477001 - DNA, 25 bp, Homo sapien
gatggattttcggatcactgggatt

SEQ ID NO: 477002 - DNA, 25 bp, Homo sapien
ggattgagtgagatactgcagtact

SEQ ID NO: 477003 - DNA, 25 bp, Homo sapien
gagaaactagtcttgggcatccact

SEQ ID NO: 477004 - DNA, 25 bp, Homo sapien
gggcatccacttcagtagaatttca

SEQ ID NO: 477005 - DNA, 25 bp, Homo sapien
tgatgaatcattccagaaagcctct

SEQ ID NO: 477006 - DNA, 25 bp, Homo sapien
ttccagaaagcctctggtgccacag

SEQ ID NO: 477007 - DNA, 25 bp, Homo sapien
ggctgacctctcagaatcccaggag

SEQ ID NO: 477008 - DNA, 25 bp, Homo sapien
atcccaggagggtcgagcatcttga

SEQ ID NO: 477009 - DNA, 25 bp, Homo sapien
ggttcccagattaacggtgcggaga

SEQ ID NO: 477010 - DNA, 25 bp, Homo sapien
acgcctcccaatacgatcacattgg

SEQ ID NO: 477011 - DNA, 25 bp, Homo sapien
cgatcacattggtaattaggtttca

SEQ ID NO: 477012 - DNA, 25 bp, Homo sapien
gaattttgtggagagacaagcattc

SEQ ID NO: 477013 - DNA, 25 bp, Homo sapien
ggagagacaagcattcggaccataa

SEQ ID NO: 477014 - DNA, 25 bp, Homo sapien
agagacaagcattcggaccataaca

SEQ ID NO: 477015 - DNA, 25 bp, Homo sapien
gacaagcattcggaccataacaaca

SEQ ID NO: 477016 - DNA, 25 bp, Homo sapien
gcattcggaccataacaacaacatt

SEQ ID NO: 477017 - DNA, 25 bp, Homo sapien
ttcggaccataacaacaacattctt

SEQ ID NO: 477018 - DNA, 25 bp, Homo sapien
ggaccataacaacaacattcttaaa

SEQ ID NO: 477019 - DNA, 25 bp, Homo sapien
acaacaacattcttaaaactaccat

SEQ ID NO: 477020 - DNA, 25 bp, Homo sapien
ttaaaactaccattgtaggccaggg

SEQ ID NO: 477021 - DNA, 25 bp, Homo sapien
aagatttctgcctgagagaatagga

SEQ ID NO: 477022 - DNA, 25 bp, Homo sapien
agatttctgcctgagagaataggaa

SEQ ID NO: 477023 - DNA, 25 bp, Homo sapien
gatttctgcctgagagaataggaaa

SEQ ID NO: 477024 - DNA, 25 bp, Homo sapien
atttctgcctgagagaataggaaaa

SEQ ID NO: 477025 - DNA, 25 bp, Homo sapien
gaataggaaaaatgtgtccaggcac

SEQ ID NO: 477026 - DNA, 25 bp, Homo sapien
aataggaaaaatgtgtccaggcacg

SEQ ID NO: 477027 - DNA, 25 bp, Homo sapien
ataggaaaaatgtgtccaggcacgg

SEQ ID NO: 477028 - DNA, 25 bp, Homo sapien
taggaaaaatgtgtccaggcacggt

SEQ ID NO: 477029 - DNA, 25 bp, Homo sapien
aggaaaaatgtgtccaggcacggtg

SEQ ID NO: 477030 - DNA, 25 bp, Homo sapien
ttagtcgggcgtggttgcgggcaca

SEQ ID NO: 477031 - DNA, 25 bp, Homo sapien
gttgcgggcacatgtagtcctagct

SEQ ID NO: 477032 - DNA, 25 bp, Homo sapien
aaagatggggtaggccagttgcggt

SEQ ID NO: 477033 - DNA, 25 bp, Homo sapien
aagatggggtaggccagttgcggtg

SEQ ID NO: 477034 - DNA, 25 bp, Homo sapien
agatggggtaggccagttgcggtgg

SEQ ID NO: 477035 - DNA, 25 bp, Homo sapien
gatggggtaggccagttgcggtggc

SEQ ID NO: 477036 - DNA, 25 bp, Homo sapien
atggggtaggccagttgcggtggct

SEQ ID NO: 477037 - DNA, 25 bp, Homo sapien
tggggtaggccagttgcggtggctc

SEQ ID NO: 477038 - DNA, 25 bp, Homo sapien
ggtggcgtatgcctgtagtcccaac

SEQ ID NO: 477039 - DNA, 25 bp, Homo sapien
tggcgtatgcctgtagtcccaactg

SEQ ID NO: 477040 - DNA, 25 bp, Homo sapien
ttatgcatgacaacacatagattag

SEQ ID NO: 477041 - DNA, 25 bp, Homo sapien
aagtgaaggcaagtcaactgcagga

SEQ ID NO: 477042 - DNA, 25 bp, Homo sapien
ctctgagacagaagcccatgatgac

SEQ ID NO: 477043 - DNA, 25 bp, Homo sapien
gaagcccatgatgacccaaactggc

SEQ ID NO: 477044 - DNA, 25 bp, Homo sapien
tgatgacccaaactggcactgctgc

SEQ ID NO: 477045 - DNA, 25 bp, Homo sapien
gcactgctgcccaggtttctctgag

SEQ ID NO: 477046 - DNA, 25 bp, Homo sapien
tgcccaggtttctctgagtcatcat

SEQ ID NO: 477047 - DNA, 25 bp, Homo sapien
ggtttctctgagtcatcattattac

SEQ ID NO: 477048 - DNA, 25 bp, Homo sapien
ttttagtggtttccagaagaacagg

SEQ ID NO: 477049 - DNA, 25 bp, Homo sapien
gtatattagtttgaggactaccagt

SEQ ID NO: 477050 - DNA, 25 bp, Homo sapien
gtttgaggactaccagttattattt

SEQ ID NO: 477051 - DNA, 25 bp, Homo sapien
aatcatggatagtacactgtgttat

SEQ ID NO: 477052 - DNA, 25 bp, Homo sapien
tatcatggatagtacactgtgttat

SEQ ID NO: 477053 - DNA, 25 bp, Homo sapien
gttatcatggatagttcaatcatag

SEQ ID NO: 477054 - DNA, 25 bp, Homo sapien
aaacagactttggataggctagcag

SEQ ID NO: 477055 - DNA, 25 bp, Homo sapien
ggataggctagcaggaggacttaat

SEQ ID NO: 477056 - DNA, 25 bp, Homo sapien
ggaggacttaatgcactttctttaa

SEQ ID NO: 477057 - DNA, 25 bp, Homo sapien
ctttctttaaattgttcctgcagga

SEQ ID NO: 477058 - DNA, 25 bp, Homo sapien
tcctgcaggaaaatctgtaccagaa

SEQ ID NO: 477059 - DNA, 25 bp, Homo sapien
gaaatgccaaacaactgaattcaaa

SEQ ID NO: 477060 - DNA, 25 bp, Homo sapien
gaatttctggaactcaacactcaaa

SEQ ID NO: 477061 - DNA, 25 bp, Homo sapien
gttcagagagaaggtatctactgct

SEQ ID NO: 477062 - DNA, 25 bp, Homo sapien
gaaactgcctctttggctgttcaca

SEQ ID NO: 477063 - DNA, 25 bp, Homo sapien
ccttgctccaatgctgttcagataa

SEQ ID NO: 477064 - DNA, 25 bp, Homo sapien
agagggttataagccaacctgccaa

SEQ ID NO: 477065 - DNA, 25 bp, Homo sapien
aagccaacctgccaatttgtcaatg

SEQ ID NO: 477066 - DNA, 25 bp, Homo sapien
tttatatgctgagctcccatccatc

SEQ ID NO: 477067 - DNA, 25 bp, Homo sapien
gagctcccatccatcatataggact

SEQ ID NO: 477068 - DNA, 25 bp, Homo sapien
aagaccgaagcacatggttggacaa

SEQ ID NO: 477069 - DNA, 25 bp, Homo sapien
taagtaccagaacaggcagtgccca

SEQ ID NO: 477070 - DNA, 25 bp, Homo sapien
gtgcccacaggtgtgcaatggaaaa

SEQ ID NO: 477071 - DNA, 25 bp, Homo sapien
aaaacacgtatctcaatagtcacta

SEQ ID NO: 477072 - DNA, 25 bp, Homo sapien
atagtcactacagagttagcatact

SEQ ID NO: 477073 - DNA, 25 bp, Homo sapien
gaacatgctttaaaaagtgagcacc

SEQ ID NO: 477074 - DNA, 25 bp, Homo sapien
aacatgctttaaaaagtgagcacca

SEQ ID NO: 477075 - DNA, 25 bp, Homo sapien
acatgctttaaaaagtgagcaccaa

SEQ ID NO: 477076 - DNA, 25 bp, Homo sapien
catgctttaaaaagtgagcaccaag

SEQ ID NO: 477077 - DNA, 25 bp, Homo sapien
atgctttaaaaagtgagcaccaagg

SEQ ID NO: 477078 - DNA, 25 bp, Homo sapien
gctttaaaaagtgagcaccaaggcc

SEQ ID NO: 477079 - DNA, 25 bp, Homo sapien
ctttaaaaagtgagcaccaaggcca

SEQ ID NO: 477080 - DNA, 25 bp, Homo sapien
tttaaaaagtgagcaccaaggccag

SEQ ID NO: 477081 - DNA, 25 bp, Homo sapien
ttaaaaagtgagcaccaaggccagg

SEQ ID NO: 477082 - DNA, 25 bp, Homo sapien
aaagtgagcaccaaggccaggcgca

SEQ ID NO: 477083 - DNA, 25 bp, Homo sapien
gccaggcgcagtgtcttgagcctgt

SEQ ID NO: 477084 - DNA, 25 bp, Homo sapien
atgttactagaaatgcacaaagtgg

SEQ ID NO: 477085 - DNA, 25 bp, Homo sapien
tgttactagaaatgcacaaagtggg

SEQ ID NO: 477086 - DNA, 25 bp, Homo sapien
gttactagaaatgcacaaagtgggc

SEQ ID NO: 477087 - DNA, 25 bp, Homo sapien
caaagtgggctgaacacagtggctc

SEQ ID NO: 477088 - DNA, 25 bp, Homo sapien
agtgggctgaacacagtggctcaca

SEQ ID NO: 477089 - DNA, 25 bp, Homo sapien
tcacttgaggttagaagttagagtc

SEQ ID NO: 477090 - DNA, 25 bp, Homo sapien
cacttgaggttagaagttagagtcc

SEQ ID NO: 477091 - DNA, 25 bp, Homo sapien
acttgaggttagaagttagagtcca

SEQ ID NO: 477092 - DNA, 25 bp, Homo sapien
cttgaggttagaagttagagtccag

SEQ ID NO: 477093 - DNA, 25 bp, Homo sapien
ttgaggttagaagttagagtccagc

SEQ ID NO: 477094 - DNA, 25 bp, Homo sapien
gtgtggtggggctcgcctgtaaccc

SEQ ID NO: 477095 - DNA, 25 bp, Homo sapien
gaagttctgcgcttatttcaaagac

SEQ ID NO: 477096 - DNA, 25 bp, Homo sapien
ttcaaagacactgacactgctcaaa

SEQ ID NO: 477097 - DNA, 25 bp, Homo sapien
gacactgctcaaacatttctgaatt

SEQ ID NO: 477098 - DNA, 25 bp, Homo sapien
catttctgaattctccttttgtaat

SEQ ID NO: 477099 - DNA, 25 bp, Homo sapien
gtatgcaccttatcttggatttaaa

SEQ ID NO: 477100 - DNA, 25 bp, Homo sapien
gatttaaaattatacccctcagctt

SEQ ID NO: 477101 - DNA, 25 bp, Homo sapien
aaattatacccctcagcttgttcat

SEQ ID NO: 477102 - DNA, 25 bp, Homo sapien
ccctcagcttgttcatcatgtaaat

SEQ ID NO: 477103 - DNA, 25 bp, Homo sapien
gaatagcctatggatattaccaaaa

SEQ ID NO: 477104 - DNA, 25 bp, Homo sapien
ttaccaaaacccaaagccacataca

SEQ ID NO: 477105 - DNA, 25 bp, Homo sapien
tgttgcttagacatgaatatgctga

SEQ ID NO: 477106 - DNA, 25 bp, Homo sapien
gtctggcagggctctagtcccaagg

SEQ ID NO: 477107 - DNA, 25 bp, Homo sapien
tggcagggctctagtcccaaggaca

SEQ ID NO: 477108 - DNA, 25 bp, Homo sapien
ttcccaccccgctgaggtctgaagg

SEQ ID NO: 477109 - DNA, 25 bp, Homo sapien
gctgaggtctgaaggatccgcccag

SEQ ID NO: 477110 - DNA, 25 bp, Homo sapien
aggtctgaaggatccgcccagcgag

SEQ ID NO: 477111 - DNA, 25 bp, Homo sapien
cgcccagcgagatcttctgtgaatg

SEQ ID NO: 477112 - DNA, 25 bp, Homo sapien
cttctgtgaatgatcaagggccgct

SEQ ID NO: 477113 - DNA, 25 bp, Homo sapien
gtgaatgatcaagggccgctgtcta

SEQ ID NO: 477114 - DNA, 25 bp, Homo sapien
caagggccgctgtctacagccatgg

SEQ ID NO: 477115 - DNA, 25 bp, Homo sapien
agccatggtctggagatggttctga

SEQ ID NO: 477116 - DNA, 25 bp, Homo sapien
gagatggttctgatctctccacact

SEQ ID NO: 477117 - DNA, 25 bp, Homo sapien
atgctgccgggcactcacgcctgta

SEQ ID NO: 477118 - DNA, 25 bp, Homo sapien
tgctgccgggcactcacgcctgtaa

SEQ ID NO: 477119 - DNA, 25 bp, Homo sapien
gctgccgggcactcacgcctgtaat

SEQ ID NO: 477120 - DNA, 25 bp, Homo sapien
ctgccgggcactcacgcctgtaatc

SEQ ID NO: 477121 - DNA, 25 bp, Homo sapien
aactaactgggcatgccagcatgtg

SEQ ID NO: 477122 - DNA, 25 bp, Homo sapien
actaactgggcatgccagcatgtgc

SEQ ID NO: 477123 - DNA, 25 bp, Homo sapien
ctaactgggcatgccagcatgtgcc

SEQ ID NO: 477124 - DNA, 25 bp, Homo sapien
taactgggcatgccagcatgtgcct

SEQ ID NO: 477125 - DNA, 25 bp, Homo sapien
aactgggcatgccagcatgtgcctg

SEQ ID NO: 477126 - DNA, 25 bp, Homo sapien
gggcatgccagcatgtgcctgtagt

SEQ ID NO: 477127 - DNA, 25 bp, Homo sapien
ggcatgccagcatgtgcctgtagtc

SEQ ID NO: 477128 - DNA, 25 bp, Homo sapien
acaactgtggtctcttttatcttaa

SEQ ID NO: 477129 - DNA, 25 bp, Homo sapien
aactgtggtctcttttatcttaagg

SEQ ID NO: 477130 - DNA, 25 bp, Homo sapien
ctgtggtctcttttatcttaagggt

SEQ ID NO: 477131 - DNA, 25 bp, Homo sapien
gtggtctcttttatcttaagggtct

SEQ ID NO: 477132 - DNA, 25 bp, Homo sapien
ggtctcttttatcttaagggtctct

SEQ ID NO: 477133 - DNA, 25 bp, Homo sapien
gtctcttttatcttaagggtctctt

SEQ ID NO: 477134 - DNA, 25 bp, Homo sapien
tctcttttatcttaagggtctcttt

SEQ ID NO: 477135 - DNA, 25 bp, Homo sapien
tatcttaagggtctcttttaactgc

SEQ ID NO: 477136 - DNA, 25 bp, Homo sapien
tcttaagggtctcttttaactgcta

SEQ ID NO: 477137 - DNA, 25 bp, Homo sapien
ccatttctcctcctaaaagagaagg

SEQ ID NO: 477138 - DNA, 25 bp, Homo sapien
tcctcctaaaagagaaggatttctt

SEQ ID NO: 477139 - DNA, 25 bp, Homo sapien
tcgggaattccttcacaggcctgcg

SEQ ID NO: 477140 - DNA, 25 bp, Homo sapien
cttcacaggcctgcgtctggatacg

SEQ ID NO: 477141 - DNA, 25 bp, Homo sapien
tcaatgaggtgaagcgccaggcgat

SEQ ID NO: 477142 - DNA, 25 bp, Homo sapien
agcgccaggcgatgacggagctgca

SEQ ID NO: 477143 - DNA, 25 bp, Homo sapien
ggaaagcccacgacatgatcacaac

SEQ ID NO: 477144 - DNA, 25 bp, Homo sapien
atgatcacaacagagagggccaaga

SEQ ID NO: 477145 - DNA, 25 bp, Homo sapien
cggaggacgcactggcagttatcaa

SEQ ID NO: 477146 - DNA, 25 bp, Homo sapien
ggcagttatcaatcagcaggaggat

SEQ ID NO: 477147 - DNA, 25 bp, Homo sapien
cagcaggaggattcaagcgagagtt

SEQ ID NO: 477148 - DNA, 25 bp, Homo sapien
gagttgctggaattgtggccgtaaa

SEQ ID NO: 477149 - DNA, 25 bp, Homo sapien
taaagcgagtgaaacctgcagtggc

SEQ ID NO: 477150 - DNA, 25 bp, Homo sapien
gttccaatcttcatcgtggcagcca

SEQ ID NO: 477151 - DNA, 25 bp, Homo sapien
acagggagatgcacaggagccgttt

SEQ ID NO: 477152 - DNA, 25 bp, Homo sapien
gagccgtttccttccttgttgcttc

SEQ ID NO: 477153 - DNA, 25 bp, Homo sapien
aagcaccttgagcagaagcattcat

SEQ ID NO: 477154 - DNA, 25 bp, Homo sapien
agcattcatatcttcctcaacattg

SEQ ID NO: 477155 - DNA, 25 bp, Homo sapien
tcttcctcaacattgtcacaactgg

SEQ ID NO: 477156 - DNA, 25 bp, Homo sapien
aaacttctgtgctgcgccaaaagca

SEQ ID NO: 477157 - DNA, 25 bp, Homo sapien
aagcagggctaagacgggcaattat

SEQ ID NO: 477158 - DNA, 25 bp, Homo sapien
atactatagaagtctgcattcacag

SEQ ID NO: 477159 - DNA, 25 bp, Homo sapien
aaatcaataactctacatctggaag

SEQ ID NO: 477160 - DNA, 25 bp, Homo sapien
aacaatcaggcgcagtgccgtctga

SEQ ID NO: 477161 - DNA, 25 bp, Homo sapien
taagaaaatccttggcactatgcct

SEQ ID NO: 477162 - DNA, 25 bp, Homo sapien
ttggcactatgcctggcaaatatta

SEQ ID NO: 477163 - DNA, 25 bp, Homo sapien
tggcaaatattaaaggttcgatcat

SEQ ID NO: 477164 - DNA, 25 bp, Homo sapien
gcagttatttcttgtctctctgtac

SEQ ID NO: 477165 - DNA, 25 bp, Homo sapien
ttgtctctctgtactgttctccgag

SEQ ID NO: 477166 - DNA, 25 bp, Homo sapien
ttctccgagcattgtctggtttcga

SEQ ID NO: 477167 - DNA, 25 bp, Homo sapien
cattgtctggtttcgaagattttcc

SEQ ID NO: 477168 - DNA, 25 bp, Homo sapien
ggatcagaaaacattgctttctcca

SEQ ID NO: 477169 - DNA, 25 bp, Homo sapien
ttctccagtgctcaggataactcat

SEQ ID NO: 477170 - DNA, 25 bp, Homo sapien
agtgctcaggataactcatagattc

SEQ ID NO: 477171 - DNA, 25 bp, Homo sapien
gggactataagtcttatttctatta

SEQ ID NO: 477172 - DNA, 25 bp, Homo sapien
gaccctgcactcctccaaagtgagt

SEQ ID NO: 477173 - DNA, 25 bp, Homo sapien
actcctccaaagtgagtgcctcctt

SEQ ID NO: 477174 - DNA, 25 bp, Homo sapien
aaagtgagtgcctcctttcggctca

SEQ ID NO: 477175 - DNA, 25 bp, Homo sapien
tgagtgcctcctttcggctcagaga

SEQ ID NO: 477176 - DNA, 25 bp, Homo sapien
tcctttcggctcagagaccttgctg

SEQ ID NO: 477177 - DNA, 25 bp, Homo sapien
tttcggctcagagaccttgctgctg

SEQ ID NO: 477178 - DNA, 25 bp, Homo sapien
tgctgaccaccacaggacacagaaa

SEQ ID NO: 477179 - DNA, 25 bp, Homo sapien
tgaccaccacaggacacagaaatgg

SEQ ID NO: 477180 - DNA, 25 bp, Homo sapien
ggacacagaaatggcaaagaccaga

SEQ ID NO: 477181 - DNA, 25 bp, Homo sapien
ggacggcaggatggctgcctctccc

SEQ ID NO: 477182 - DNA, 25 bp, Homo sapien
tgatgaggttccttcagttctagct

SEQ ID NO: 477183 - DNA, 25 bp, Homo sapien
tcacaactctcagacccatgcagtt

SEQ ID NO: 477184 - DNA, 25 bp, Homo sapien
cctggttccggaggcgaccagatga

SEQ ID NO: 477185 - DNA, 25 bp, Homo sapien
ccggaggcgaccagatgattggaat

SEQ ID NO: 477186 - DNA, 25 bp, Homo sapien
cggaggcgaccagatgattggaatc

SEQ ID NO: 477187 - DNA, 25 bp, Homo sapien
ggaggcgaccagatgattggaatct

SEQ ID NO: 477188 - DNA, 25 bp, Homo sapien
aggcgaccagatgattggaatctgt

SEQ ID NO: 477189 - DNA, 25 bp, Homo sapien
gcgaccagatgattggaatctgtct

SEQ ID NO: 477190 - DNA, 25 bp, Homo sapien
gaccagatgattggaatctgtctgc

SEQ ID NO: 477191 - DNA, 25 bp, Homo sapien
accagatgattggaatctgtctgct

SEQ ID NO: 477192 - DNA, 25 bp, Homo sapien
agatgattggaatctgtctgctggt

SEQ ID NO: 477193 - DNA, 25 bp, Homo sapien
atgattggaatctgtctgctggtgg

SEQ ID NO: 477194 - DNA, 25 bp, Homo sapien
tcagatccagccacccaattgtatt

SEQ ID NO: 477195 - DNA, 25 bp, Homo sapien
atccagccacccaattgtattctgt

SEQ ID NO: 477196 - DNA, 25 bp, Homo sapien
agccacccaattgtattctgtgttt

SEQ ID NO: 477197 - DNA, 25 bp, Homo sapien
cacccaattgtattctgtgtttctc

SEQ ID NO: 477198 - DNA, 25 bp, Homo sapien
ctttgtttgcatctctgctttctaa

SEQ ID NO: 477199 - DNA, 25 bp, Homo sapien
tgtttgcatctctgctttctaataa

SEQ ID NO: 477200 - DNA, 25 bp, Homo sapien
tctaataaacttttctgcacttaag

SEQ ID NO: 477201 - DNA, 25 bp, Homo sapien
attattccaatcttctgatttcctt

SEQ ID NO: 477202 - DNA, 25 bp, Homo sapien
attccaatcttctgatttccttatt

SEQ ID NO: 477203 - DNA, 25 bp, Homo sapien
ttatcactttaaggtacagattctc

SEQ ID NO: 477204 - DNA, 25 bp, Homo sapien
aggtacagattctccttctcagtga

SEQ ID NO: 477205 - DNA, 25 bp, Homo sapien
agcaattccacctggttcctgtaca

SEQ ID NO: 477206 - DNA, 25 bp, Homo sapien
gttcctgtacacttggacagagtcc

SEQ ID NO: 477207 - DNA, 25 bp, Homo sapien
gacagagtcctttaggtttccagac

SEQ ID NO: 477208 - DNA, 25 bp, Homo sapien
agtcctttaggtttccagactggct

SEQ ID NO: 477209 - DNA, 25 bp, Homo sapien
cagactggcttgctctttggctgac

SEQ ID NO: 477210 - DNA, 25 bp, Homo sapien
ttgctctttggctgaccttcaattc

SEQ ID NO: 477211 - DNA, 25 bp, Homo sapien
tttggctgaccttcaattccctctc

SEQ ID NO: 477212 - DNA, 25 bp, Homo sapien
gtcactgttacagaggcaagcggtg

SEQ ID NO: 477213 - DNA, 25 bp, Homo sapien
actaggtaagagttcactcatgaag

SEQ ID NO: 477214 - DNA, 25 bp, Homo sapien
gctctgaagagccagttaccctgtg

SEQ ID NO: 477215 - DNA, 25 bp, Homo sapien
aagagccagttaccctgtgttggct

SEQ ID NO: 477216 - DNA, 25 bp, Homo sapien
ggagcagatcccaatcaaccacaag

SEQ ID NO: 477217 - DNA, 25 bp, Homo sapien
aatcaaccacaagtccggcatgaac

SEQ ID NO: 477218 - DNA, 25 bp, Homo sapien
tgaaccagccatgcaactagatcag

SEQ ID NO: 477219 - DNA, 25 bp, Homo sapien
actagatcagccaaaccacaaccaa

SEQ ID NO: 477220 - DNA, 25 bp, Homo sapien
aaccaacccatagatccttgagcat

SEQ ID NO: 477221 - DNA, 25 bp, Homo sapien
atctgctgtcaaacaagcctctgaa

SEQ ID NO: 477222 - DNA, 25 bp, Homo sapien
aaaaactgcctaattcacatgggaa

SEQ ID NO: 477223 - DNA, 25 bp, Homo sapien
gaacaccgagtatcaataaagccat

SEQ ID NO: 477224 - DNA, 25 bp, Homo sapien
aagccatgcacatagacagcacaag

SEQ ID NO: 477225 - DNA, 25 bp, Homo sapien
gaccactgacagctgttcttgcaga

SEQ ID NO: 477226 - DNA, 25 bp, Homo sapien
ttgcagaattcccacctccttggtg

SEQ ID NO: 477227 - DNA, 25 bp, Homo sapien
gaaactttcaatgaccattcagcta

SEQ ID NO: 477228 - DNA, 25 bp, Homo sapien
attcagctataaccaactgcagttt

SEQ ID NO: 477229 - DNA, 25 bp, Homo sapien
gaatcagtggatgcctatagcttcc

SEQ ID NO: 477230 - DNA, 25 bp, Homo sapien
gcctatagcttcctgaagctgttcg

SEQ ID NO: 477231 - DNA, 25 bp, Homo sapien
aagctgttcgattccttcatattaa

SEQ ID NO: 477232 - DNA, 25 bp, Homo sapien
aaagtgtctctttctgtgggtggtt

SEQ ID NO: 477233 - DNA, 25 bp, Homo sapien
ggtggtttgggaattctgttttcag

SEQ ID NO: 477234 - DNA, 25 bp, Homo sapien
ttctgttttcagtcttgggtggtat

SEQ ID NO: 477235 - DNA, 25 bp, Homo sapien
agtcttgggtggtatctttctgaaa

SEQ ID NO: 477236 - DNA, 25 bp, Homo sapien
ggaagttcttcatgattatcctaat

SEQ ID NO: 477237 - DNA, 25 bp, Homo sapien
aattttacatctctggcatagccca

SEQ ID NO: 477238 - DNA, 25 bp, Homo sapien
gaccacaggctgagcacagggttgc

SEQ ID NO: 477239 - DNA, 25 bp, Homo sapien
tccaggtgggcccaaatgctgaaga

SEQ ID NO: 477240 - DNA, 25 bp, Homo sapien
gcccaaatgctgaagagcctcatgt

SEQ ID NO: 477241 - DNA, 25 bp, Homo sapien
gagcctcatgttagagtttttcacc

SEQ ID NO: 477242 - DNA, 25 bp, Homo sapien
gagtttttcacctctgcgatggaac

SEQ ID NO: 477243 - DNA, 25 bp, Homo sapien
ctctgcgatggaactgtggtggact

SEQ ID NO: 477244 - DNA, 25 bp, Homo sapien
tgtggtggactccagtatcatcatt

SEQ ID NO: 477245 - DNA, 25 bp, Homo sapien
gtgcagatagccttgaaaccactgg

SEQ ID NO: 477246 - DNA, 25 bp, Homo sapien
gaaaccactggtttcctaccactgt

SEQ ID NO: 477247 - DNA, 25 bp, Homo sapien
ggtttcctaccactgtttatttcag

SEQ ID NO: 477248 - DNA, 25 bp, Homo sapien
tgtgtggaatgctagctctggaaga

SEQ ID NO: 477249 - DNA, 25 bp, Homo sapien
ttcaaatctcaaccgtgtcatttag

SEQ ID NO: 477250 - DNA, 25 bp, Homo sapien
aaatctcaaccgtgtcatttaggag

SEQ ID NO: 477251 - DNA, 25 bp, Homo sapien
aatctcaaccgtgtcatttaggagt

SEQ ID NO: 477252 - DNA, 25 bp, Homo sapien
acttgagtcttacttctcacatctg

SEQ ID NO: 477253 - DNA, 25 bp, Homo sapien
ttgagtcttacttctcacatctgtg

SEQ ID NO: 477254 - DNA, 25 bp, Homo sapien
gagtcttacttctcacatctgtgtc

SEQ ID NO: 477255 - DNA, 25 bp, Homo sapien
atctgtgtctgtcataggataattg

SEQ ID NO: 477256 - DNA, 25 bp, Homo sapien
gtttattatctgaatagtgagagtt

SEQ ID NO: 477257 - DNA, 25 bp, Homo sapien
ggattcagtatgatgcctggaaggc

SEQ ID NO: 477258 - DNA, 25 bp, Homo sapien
tgcctggaaggcatgtatatattaa

SEQ ID NO: 477259 - DNA, 25 bp, Homo sapien
gtctcaataaatgctatttgttttg

SEQ ID NO: 477260 - DNA, 25 bp, Homo sapien
aaacccattcaatttctgattgtgt

SEQ ID NO: 477261 - DNA, 25 bp, Homo sapien
tgttccctggtgtaagatatctccc

SEQ ID NO: 477262 - DNA, 25 bp, Homo sapien
aggagagggccacacattccccaga

SEQ ID NO: 477263 - DNA, 25 bp, Homo sapien
gaggtggaccttcttggtacataca

SEQ ID NO: 477264 - DNA, 25 bp, Homo sapien
ggtacatacacctgtccaatgtgtc

SEQ ID NO: 477265 - DNA, 25 bp, Homo sapien
acctgtccaatgtgtcctgagtggg

SEQ ID NO: 477266 - DNA, 25 bp, Homo sapien
gactcctgttgtatagaaagggtct

SEQ ID NO: 477267 - DNA, 25 bp, Homo sapien
aaagggtctgcttagaaggtgtctc

SEQ ID NO: 477268 - DNA, 25 bp, Homo sapien
aaggtgtctcgtcttttgctccata

SEQ ID NO: 477269 - DNA, 25 bp, Homo sapien
tttgctccataccaacaacctagag

SEQ ID NO: 477270 - DNA, 25 bp, Homo sapien
aagatataagtgtcaggttctccag

SEQ ID NO: 477271 - DNA, 25 bp, Homo sapien
tgtccttgatgatttgacacccctc

SEQ ID NO: 477272 - DNA, 25 bp, Homo sapien
agggtttccacagactcgccgttga

SEQ ID NO: 477273 - DNA, 25 bp, Homo sapien
taaaacagattttctgctggagccc

SEQ ID NO: 477274 - DNA, 25 bp, Homo sapien
ccaaagccctgatgaaatagataaa

SEQ ID NO: 477275 - DNA, 25 bp, Homo sapien
acagactcgccgttgacagcaacta

SEQ ID NO: 477276 - DNA, 25 bp, Homo sapien
cccaggaagcttataagcacactat

SEQ ID NO: 477277 - DNA, 25 bp, Homo sapien
actcgccgttgacagcaactaccag

SEQ ID NO: 477278 - DNA, 25 bp, Homo sapien
gcaactaccagatcattgttcttca

SEQ ID NO: 477279 - DNA, 25 bp, Homo sapien
accagatcattgttcttcaagccag

SEQ ID NO: 477280 - DNA, 25 bp, Homo sapien
gctggacttccagaatctatgtcct

SEQ ID NO: 477281 - DNA, 25 bp, Homo sapien
acttccagaatctatgtccttgatg

SEQ ID NO: 477282 - DNA, 25 bp, Homo sapien
actcggctcagggtatgacctttga

SEQ ID NO: 477283 - DNA, 25 bp, Homo sapien
ggctcagggtatgacctttgaggat

SEQ ID NO: 477284 - DNA, 25 bp, Homo sapien
ggccatttatttctcccaagaagag

SEQ ID NO: 477285 - DNA, 25 bp, Homo sapien
gagtctcagaggttcctgtactgcg

SEQ ID NO: 477286 - DNA, 25 bp, Homo sapien
tctcagaggttcctgtactgcgatg

SEQ ID NO: 477287 - DNA, 25 bp, Homo sapien
atagggactgttgtgttcgaatgcc

SEQ ID NO: 477288 - DNA, 25 bp, Homo sapien
ggactgttgtgttcgaatgcccgcc

SEQ ID NO: 477289 - DNA, 25 bp, Homo sapien
gttgtgttcgaatgcccgccccggt

SEQ ID NO: 477290 - DNA, 25 bp, Homo sapien
tagtccacggagctcaatggcggca

SEQ ID NO: 477291 - DNA, 25 bp, Homo sapien
cacggagctcaatggcggcagtcgc

SEQ ID NO: 477292 - DNA, 25 bp, Homo sapien
cagtcgcgctgagggactcggctca

SEQ ID NO: 477293 - DNA, 25 bp, Homo sapien
tcaagatttttccttagacaagtga

SEQ ID NO: 477294 - DNA, 25 bp, Homo sapien
tagacaagtgaatgcccctctgttt

SEQ ID NO: 477295 - DNA, 25 bp, Homo sapien
ccctctgtttgccttgttctattta

SEQ ID NO: 477296 - DNA, 25 bp, Homo sapien
gtttgccttgttctatttactcctt

SEQ ID NO: 477297 - DNA, 25 bp, Homo sapien
gccttgttctatttactcctttctt

SEQ ID NO: 477298 - DNA, 25 bp, Homo sapien
gaaattagctttcttaaacgcctgc

SEQ ID NO: 477299 - DNA, 25 bp, Homo sapien
attagctttcttaaacgcctgctgc

SEQ ID NO: 477300 - DNA, 25 bp, Homo sapien
tttcttaaacgcctgctgctggcag

SEQ ID NO: 477301 - DNA, 25 bp, Homo sapien
tgctgctggcagctgaagtagtacc

SEQ ID NO: 477302 - DNA, 25 bp, Homo sapien
aaaagctttaactatgcccatccct

SEQ ID NO: 477303 - DNA, 25 bp, Homo sapien
caagacgtttagattttctcaagat

SEQ ID NO: 477304 - DNA, 25 bp, Homo sapien
ctgaggctatcaaggtcctcataaa

SEQ ID NO: 477305 - DNA, 25 bp, Homo sapien
ggttaagcccagatgccaaagggtg

SEQ ID NO: 477306 - DNA, 25 bp, Homo sapien
agcccagatgccaaagggtgtcagc

SEQ ID NO: 477307 - DNA, 25 bp, Homo sapien
gggtgtcagcctcaagctcaatcaa

SEQ ID NO: 477308 - DNA, 25 bp, Homo sapien
tcaagctcaatcaatttgcctacat

SEQ ID NO: 477309 - DNA, 25 bp, Homo sapien
aatcaatttgcctacattacccacc

SEQ ID NO: 477310 - DNA, 25 bp, Homo sapien
tgcttgtgcccgcattgccaagggt

SEQ ID NO: 477311 - DNA, 25 bp, Homo sapien
ccgcattgccaagggtctcaggttg

SEQ ID NO: 477312 - DNA, 25 bp, Homo sapien
cattgccaagggtctcaggttgtgt

SEQ ID NO: 477313 - DNA, 25 bp, Homo sapien
caagggtctcaggttgtgtgggcca

SEQ ID NO: 477314 - DNA, 25 bp, Homo sapien
tagagatctctgtctgccaacgtga

SEQ ID NO: 477315 - DNA, 25 bp, Homo sapien
ctttcagaccatgtttaagcctcca

SEQ ID NO: 477316 - DNA, 25 bp, Homo sapien
cagaccatgtttaagcctccatagt

SEQ ID NO: 477317 - DNA, 25 bp, Homo sapien
gtttaagcctccatagtttgttctg

SEQ ID NO: 477318 - DNA, 25 bp, Homo sapien
ttaagcctccatagtttgttctgtt

SEQ ID NO: 477319 - DNA, 25 bp, Homo sapien
aagcctccatagtttgttctgtttg

SEQ ID NO: 477320 - DNA, 25 bp, Homo sapien
agcctccatagtttgttctgtttgt

SEQ ID NO: 477321 - DNA, 25 bp, Homo sapien
gcctccatagtttgttctgtttgtt

SEQ ID NO: 477322 - DNA, 25 bp, Homo sapien
ctccatagtttgttctgtttgttct

SEQ ID NO: 477323 - DNA, 25 bp, Homo sapien
ctgtttgttcttgcttaagaagtca

SEQ ID NO: 477324 - DNA, 25 bp, Homo sapien
gttcttgcttaagaagtcattctag

SEQ ID NO: 477325 - DNA, 25 bp, Homo sapien
agaagtcattctagaggccgggcgc

SEQ ID NO: 477326 - DNA, 25 bp, Homo sapien
tgtggccagggttcgcatgagccaa

SEQ ID NO: 477327 - DNA, 25 bp, Homo sapien
agggttcgcatgagccaattcacat

SEQ ID NO: 477328 - DNA, 25 bp, Homo sapien
cgcatgagccaattcacatgtccat

SEQ ID NO: 477329 - DNA, 25 bp, Homo sapien
gtgactgaggccttatacagggcca

SEQ ID NO: 477330 - DNA, 25 bp, Homo sapien
agttcaagtcgcctcaccagcaaat

SEQ ID NO: 477331 - DNA, 25 bp, Homo sapien
gcctcaccagcaaatgattcacatc

SEQ ID NO: 477332 - DNA, 25 bp, Homo sapien
agtcagatgaatttgaaggcatggt

SEQ ID NO: 477333 - DNA, 25 bp, Homo sapien
cagatggctgtagggtcaaatgtca

SEQ ID NO: 477334 - DNA, 25 bp, Homo sapien
taatttcttttgcaccgccctaata

SEQ ID NO: 477335 - DNA, 25 bp, Homo sapien
cgccctaatacatcctcaactgtgg

SEQ ID NO: 477336 - DNA, 25 bp, Homo sapien
ctaatacatcctcaactgtggcctc

SEQ ID NO: 477337 - DNA, 25 bp, Homo sapien
cgcgcccggcctgggtcggtgccat

SEQ ID NO: 477338 - DNA, 25 bp, Homo sapien
tcggcttattgcaagctctgcctcg

SEQ ID NO: 477339 - DNA, 25 bp, Homo sapien
cggcttattgcaagctctgcctcgc

SEQ ID NO: 477340 - DNA, 25 bp, Homo sapien
ggcttattgcaagctctgcctcgcg

SEQ ID NO: 477341 - DNA, 25 bp, Homo sapien
ctgcctcgcgggttcatgccacttt

SEQ ID NO: 477342 - DNA, 25 bp, Homo sapien
tgcctcgcgggttcatgccactttc

SEQ ID NO: 477343 - DNA, 25 bp, Homo sapien
tcgcgggttcatgccactttcctgg

SEQ ID NO: 477344 - DNA, 25 bp, Homo sapien
cgcgggttcatgccactttcctggc

SEQ ID NO: 477345 - DNA, 25 bp, Homo sapien
gcgggttcatgccactttcctggct

SEQ ID NO: 477346 - DNA, 25 bp, Homo sapien
cgggttcatgccactttcctggctc

SEQ ID NO: 477347 - DNA, 25 bp, Homo sapien
gttcatgccactttcctggctcagc

SEQ ID NO: 477348 - DNA, 25 bp, Homo sapien
tgaccccttggtctccaggaaggag

SEQ ID NO: 477349 - DNA, 25 bp, Homo sapien
gaccccttggtctccaggaaggaga

SEQ ID NO: 477350 - DNA, 25 bp, Homo sapien
ccccttggtctccaggaaggagaag

SEQ ID NO: 477351 - DNA, 25 bp, Homo sapien
agtaggggcttctgagcaggctctc

SEQ ID NO: 477352 - DNA, 25 bp, Homo sapien
tctggcatccgatgccccaaagcgg

SEQ ID NO: 477353 - DNA, 25 bp, Homo sapien
atccgatgccccaaagcggtcaaaa

SEQ ID NO: 477354 - DNA, 25 bp, Homo sapien
tccgatgccccaaagcggtcaaaag

SEQ ID NO: 477355 - DNA, 25 bp, Homo sapien
cgatgccccaaagcggtcaaaagct

SEQ ID NO: 477356 - DNA, 25 bp, Homo sapien
gccccaaagcggtcaaaagcttctt

SEQ ID NO: 477357 - DNA, 25 bp, Homo sapien
caaagcggtcaaaagcttcttctcc

SEQ ID NO: 477358 - DNA, 25 bp, Homo sapien
ggtcaaaagcttcttctcccccagt

SEQ ID NO: 477359 - DNA, 25 bp, Homo sapien
ggagaccctgaacaacatcatggag

SEQ ID NO: 477360 - DNA, 25 bp, Homo sapien
gaccctgaacaacatcatggagtat

SEQ ID NO: 477361 - DNA, 25 bp, Homo sapien
gtattacaacgacggtaacgatcct

SEQ ID NO: 477362 - DNA, 25 bp, Homo sapien
tacaacgacggtaacgatcctccct

SEQ ID NO: 477363 - DNA, 25 bp, Homo sapien
cgacggtaacgatcctccctctgtg

SEQ ID NO: 477364 - DNA, 25 bp, Homo sapien
aattgatgtgcactggactcgggcc

SEQ ID NO: 477365 - DNA, 25 bp, Homo sapien
ggtggaaacggcacttacctgacct

SEQ ID NO: 477366 - DNA, 25 bp, Homo sapien
tggaaacggcacttacctgacctgg

SEQ ID NO: 477367 - DNA, 25 bp, Homo sapien
aaacggcacttacctgacctggttg

SEQ ID NO: 477368 - DNA, 25 bp, Homo sapien
gcacttacctgacctggttgttggt

SEQ ID NO: 477369 - DNA, 25 bp, Homo sapien
gacctggttgttggtgcatgtgccc

SEQ ID NO: 477370 - DNA, 25 bp, Homo sapien
gggtggcaaacagctgctccacagc

SEQ ID NO: 477371 - DNA, 25 bp, Homo sapien
ctgctccacagcccattctttaagg

SEQ ID NO: 477372 - DNA, 25 bp, Homo sapien
tgacctggagctggacactctgcct

SEQ ID NO: 477373 - DNA, 25 bp, Homo sapien
tggagctggacactctgccttgctg

SEQ ID NO: 477374 - DNA, 25 bp, Homo sapien
gagctggacactctgccttgctgtg

SEQ ID NO: 477375 - DNA, 25 bp, Homo sapien
ggacactctgccttgctgtgccgag

SEQ ID NO: 477376 - DNA, 25 bp, Homo sapien
ttgctgtgccgagacgcacaagtgg

SEQ ID NO: 477377 - DNA, 25 bp, Homo sapien
ccgagacgcacaagtgggcctggtt

SEQ ID NO: 477378 - DNA, 25 bp, Homo sapien
gagacgcacaagtgggcctggttcc

SEQ ID NO: 477379 - DNA, 25 bp, Homo sapien
tgctggtggcagtggaacaatttat

SEQ ID NO: 477380 - DNA, 25 bp, Homo sapien
ctggtggcagtggaacaatttatgg

SEQ ID NO: 477381 - DNA, 25 bp, Homo sapien
aaatacagctcctaaagtccgtctc

SEQ ID NO: 477382 - DNA, 25 bp, Homo sapien
aaagtccgtctccttggttaggctg

SEQ ID NO: 477383 - DNA, 25 bp, Homo sapien
ttaggctgctcttaggacaaggctt

SEQ ID NO: 477384 - DNA, 25 bp, Homo sapien
acaaggcttgtgtacctcatgggca

SEQ ID NO: 477385 - DNA, 25 bp, Homo sapien
atgggcactcctgctaactggcatg

SEQ ID NO: 477386 - DNA, 25 bp, Homo sapien
aactggcatgcagagactgtcgata

SEQ ID NO: 477387 - DNA, 25 bp, Homo sapien
gtcgataagtgagctatacctgcaa

SEQ ID NO: 477388 - DNA, 25 bp, Homo sapien
aaatcagtacattctacccaaaact

SEQ ID NO: 477389 - DNA, 25 bp, Homo sapien
tacccaaaacttatgacacgctgcc

SEQ ID NO: 477390 - DNA, 25 bp, Homo sapien
acacgctgcctttatcctggaaatg

SEQ ID NO: 477391 - DNA, 25 bp, Homo sapien
ctgcgttagtcatttcagatttgga

SEQ ID NO: 477392 - DNA, 25 bp, Homo sapien
tgttcctctcctgctggtaacaatt

SEQ ID NO: 477393 - DNA, 25 bp, Homo sapien
gttcctctcctgctggtaacaattt

SEQ ID NO: 477394 - DNA, 25 bp, Homo sapien
ttcctctcctgctggtaacaatttt

SEQ ID NO: 477395 - DNA, 25 bp, Homo sapien
tcctctcctgctggtaacaattttt

SEQ ID NO: 477396 - DNA, 25 bp, Homo sapien
cctctcctgctggtaacaattttta

SEQ ID NO: 477397 - DNA, 25 bp, Homo sapien
tctcctgctggtaacaatttttatt

SEQ ID NO: 477398 - DNA, 25 bp, Homo sapien
ctcctgctggtaacaatttttatta

SEQ ID NO: 477399 - DNA, 25 bp, Homo sapien
cctgctggtaacaatttttattagt

SEQ ID NO: 477400 - DNA, 25 bp, Homo sapien
ctagcttctttatgaataaaagcat

SEQ ID NO: 477401 - DNA, 25 bp, Homo sapien
agcttctttatgaataaaagcattg

SEQ ID NO: 477402 - DNA, 25 bp, Homo sapien
ctttatgaataaaagcattgtgctt

SEQ ID NO: 477403 - DNA, 25 bp, Homo sapien
ctttttgtgtgacctgcaatggtat

SEQ ID NO: 477404 - DNA, 25 bp, Homo sapien
gtgtgacctgcaatggtatattgat

SEQ ID NO: 477405 - DNA, 25 bp, Homo sapien
tactgacataggtgggtaggctcat

SEQ ID NO: 477406 - DNA, 25 bp, Homo sapien
gtgggtaggctcattcaattttgga

SEQ ID NO: 477407 - DNA, 25 bp, Homo sapien
atgctttacatagtccttgtacgat

SEQ ID NO: 477408 - DNA, 25 bp, Homo sapien
agtccttgtacgatgacagcagaga

SEQ ID NO: 477409 - DNA, 25 bp, Homo sapien
cttgactactgcaatcagcactgtt

SEQ ID NO: 477410 - DNA, 25 bp, Homo sapien
gcaatcagcactgttctgcattgag

SEQ ID NO: 477411 - DNA, 25 bp, Homo sapien
gcactgttctgcattgagatattca

SEQ ID NO: 477412 - DNA, 25 bp, Homo sapien
gagatattcatgtttctgtggagat

SEQ ID NO: 477413 - DNA, 25 bp, Homo sapien
ttcatgttaaaggatatttgctcac

SEQ ID NO: 477414 - DNA, 25 bp, Homo sapien
ttatatgatacactgttacgtgaag

SEQ ID NO: 477415 - DNA, 25 bp, Homo sapien
tatatgatacactgttacgtgaaga

SEQ ID NO: 477416 - DNA, 25 bp, Homo sapien
atatgatacactgttacgtgaagaa

SEQ ID NO: 477417 - DNA, 25 bp, Homo sapien
tatgatacactgttacgtgaagaaa

SEQ ID NO: 477418 - DNA, 25 bp, Homo sapien
gttacgtgaagaaatgcaatatgcg

SEQ ID NO: 477419 - DNA, 25 bp, Homo sapien
ttacgtgaagaaatgcaatatgcga

SEQ ID NO: 477420 - DNA, 25 bp, Homo sapien
acgtgaagaaatgcaatatgcgatt

SEQ ID NO: 477421 - DNA, 25 bp, Homo sapien
gaaatgcaatatgcgattaatcaca

SEQ ID NO: 477422 - DNA, 25 bp, Homo sapien
atgcaatatgcgattaatcacatta

SEQ ID NO: 477423 - DNA, 25 bp, Homo sapien
tgcaatatgcgattaatcacattaa

SEQ ID NO: 477424 - DNA, 25 bp, Homo sapien
gcaatatgcgattaatcacattaaa

SEQ ID NO: 477425 - DNA, 25 bp, Homo sapien
taagaaccagttatcctaagaattc

SEQ ID NO: 477426 - DNA, 25 bp, Homo sapien
tcctaagaattctgagcacgcctct

SEQ ID NO: 477427 - DNA, 25 bp, Homo sapien
tctgagcacgcctcttctgagaatt

SEQ ID NO: 477428 - DNA, 25 bp, Homo sapien
cttccaggccatcttgtgagacttg

SEQ ID NO: 477429 - DNA, 25 bp, Homo sapien
ggccatcttgtgagacttggtgtta

SEQ ID NO: 477430 - DNA, 25 bp, Homo sapien
cttggtgttaatagctgaagtccta

SEQ ID NO: 477431 - DNA, 25 bp, Homo sapien
aagtcctatctgtaccaacaagcaa

SEQ ID NO: 477432 - DNA, 25 bp, Homo sapien
gtaccaacaagcaaggccacttttc

SEQ ID NO: 477433 - DNA, 25 bp, Homo sapien
gagttcactgaatgcacctattata

SEQ ID NO: 477434 - DNA, 25 bp, Homo sapien
actgaatgcacctattataatctgt

SEQ ID NO: 477435 - DNA, 25 bp, Homo sapien
attataatctgtggccccagcagta

SEQ ID NO: 477436 - DNA, 25 bp, Homo sapien
aaagcatggctcctacacagatctt

SEQ ID NO: 477437 - DNA, 25 bp, Homo sapien
atgtagtattcagcagttctctggg

SEQ ID NO: 477438 - DNA, 25 bp, Homo sapien
gggacaaagagcacattttactatg

SEQ ID NO: 477439 - DNA, 25 bp, Homo sapien
gggtgaatactttgtcgtctgcaga

SEQ ID NO: 477440 - DNA, 25 bp, Homo sapien
aaaatattgtgcagagctccagttt

SEQ ID NO: 477441 - DNA, 25 bp, Homo sapien
gtgcagagctccagttttcctagat

SEQ ID NO: 477442 - DNA, 25 bp, Homo sapien
aaattacagatcagtccacctaaaa

SEQ ID NO: 477443 - DNA, 25 bp, Homo sapien
ttaaatgacaaattccaggagcctt

SEQ ID NO: 477444 - DNA, 25 bp, Homo sapien
attccaggagcctttgactgctaag

SEQ ID NO: 477445 - DNA, 25 bp, Homo sapien
gactgctaaggtcattattctaaca

SEQ ID NO: 477446 - DNA, 25 bp, Homo sapien
tcacctgtgccatggtccacgatgc

SEQ ID NO: 477447 - DNA, 25 bp, Homo sapien
gttctcccagagtgaagcttcttca

SEQ ID NO: 477448 - DNA, 25 bp, Homo sapien
tccgttgccagcgaaggcgctcgtt

SEQ ID NO: 477449 - DNA, 25 bp, Homo sapien
cttcttcatcgcactctagagttgc

SEQ ID NO: 477450 - DNA, 25 bp, Homo sapien
actctagagttgctgattcctgtga

SEQ ID NO: 477451 - DNA, 25 bp, Homo sapien
agttgctgattcctgtgatttcctc

SEQ ID NO: 477452 - DNA, 25 bp, Homo sapien
tgtgatttcctccatgtgggaaacg

SEQ ID NO: 477453 - DNA, 25 bp, Homo sapien
cctccatgtgggaaacggtgtttgt

SEQ ID NO: 477454 - DNA, 25 bp, Homo sapien
cagcgaaggcgctcgttaggccttg

SEQ ID NO: 477455 - DNA, 25 bp, Homo sapien
gggttcaagactgacatcgcctcac

SEQ ID NO: 477456 - DNA, 25 bp, Homo sapien
cacccgaaaacgtttacatggcttg

SEQ ID NO: 477457 - DNA, 25 bp, Homo sapien
cgtttacatggcttgtctctttttt

SEQ ID NO: 477458 - DNA, 25 bp, Homo sapien
gaagtgaccatcttgccgaacatac

SEQ ID NO: 477459 - DNA, 25 bp, Homo sapien
agtgaccatcttgccgaacatacta

SEQ ID NO: 477460 - DNA, 25 bp, Homo sapien
gaccatcttgccgaacatactaaaa

SEQ ID NO: 477461 - DNA, 25 bp, Homo sapien
tcttgccgaacatactaaaacacag

SEQ ID NO: 477462 - DNA, 25 bp, Homo sapien
gaacatactaaaacacagcagaata

SEQ ID NO: 477463 - DNA, 25 bp, Homo sapien
gtggaagctgtgcaagacgatactt

SEQ ID NO: 477464 - DNA, 25 bp, Homo sapien
aagctgtgcaagacgatactttgat

SEQ ID NO: 477465 - DNA, 25 bp, Homo sapien
tgtgcaagacgatactttgattact

SEQ ID NO: 477466 - DNA, 25 bp, Homo sapien
taggaacggttaatacctctgccac

SEQ ID NO: 477467 - DNA, 25 bp, Homo sapien
gaacggttaatacctctgccaccag

SEQ ID NO: 477468 - DNA, 25 bp, Homo sapien
tgccaccagcaatccagataccctt

SEQ ID NO: 477469 - DNA, 25 bp, Homo sapien
aaaggctcggctcatgttctgggac

SEQ ID NO: 477470 - DNA, 25 bp, Homo sapien
tcatgttctgggacttaggagggca

SEQ ID NO: 477471 - DNA, 25 bp, Homo sapien
gaccctgcactcctccaaagtgagt

SEQ ID NO: 477472 - DNA, 25 bp, Homo sapien
aaagtgagtgcctcctttcggctca

SEQ ID NO: 477473 - DNA, 25 bp, Homo sapien
tgagtgcctcctttcggctcagaga

SEQ ID NO: 477474 - DNA, 25 bp, Homo sapien
tttcggctcagagaccttgctgctg

SEQ ID NO: 477475 - DNA, 25 bp, Homo sapien
tgctgaccaccacaggacacagaaa

SEQ ID NO: 477476 - DNA, 25 bp, Homo sapien
cacaggacacagaaatggcaaagac

SEQ ID NO: 477477 - DNA, 25 bp, Homo sapien
tgatgaggttccttcagttctagct

SEQ ID NO: 477478 - DNA, 25 bp, Homo sapien
ggttccttcagttctagcttaacat

SEQ ID NO: 477479 - DNA, 25 bp, Homo sapien
gtgggcctaaacatcggcactgtgg

SEQ ID NO: 477480 - DNA, 25 bp, Homo sapien
tctcaatttggaatcatgatctcaa

SEQ ID NO: 477481 - DNA, 25 bp, Homo sapien
ggaatcatgatctcaactttgactc

SEQ ID NO: 477482 - DNA, 25 bp, Homo sapien
atcatgatctcaactttgactcaaa

SEQ ID NO: 477483 - DNA, 25 bp, Homo sapien
gaatataggtttctgcaaccgacca

SEQ ID NO: 477484 - DNA, 25 bp, Homo sapien
ataggtttctgcaaccgaccaataa

SEQ ID NO: 477485 - DNA, 25 bp, Homo sapien
gtttctgcaaccgaccaataatttt

SEQ ID NO: 477486 - DNA, 25 bp, Homo sapien
ttctgcaaccgaccaataatttttg

SEQ ID NO: 477487 - DNA, 25 bp, Homo sapien
taactttgagttatgtccttggtaa

SEQ ID NO: 477488 - DNA, 25 bp, Homo sapien
tgagttatgtccttggtaacagaga

SEQ ID NO: 477489 - DNA, 25 bp, Homo sapien
atgtccttggtaacagagattctta

SEQ ID NO: 477490 - DNA, 25 bp, Homo sapien
tccttggtaacagagattcttacct

SEQ ID NO: 477491 - DNA, 25 bp, Homo sapien
tgcatccaatttgcaatctggagtc

SEQ ID NO: 477492 - DNA, 25 bp, Homo sapien
tccaatttgcaatctggagtcccat

SEQ ID NO: 477493 - DNA, 25 bp, Homo sapien
caatttgcaatctggagtcccatct

SEQ ID NO: 477494 - DNA, 25 bp, Homo sapien
atttgcaatctggagtcccatctcg

SEQ ID NO: 477495 - DNA, 25 bp, Homo sapien
tttgcaatctggagtcccatctcgg

SEQ ID NO: 477496 - DNA, 25 bp, Homo sapien
tgcaatctggagtcccatctcggtt

SEQ ID NO: 477497 - DNA, 25 bp, Homo sapien
gcaatctggagtcccatctcggttc

SEQ ID NO: 477498 - DNA, 25 bp, Homo sapien
ttgcaacttattacggtcaacggac

SEQ ID NO: 477499 - DNA, 25 bp, Homo sapien
tgcaacttattacggtcaacggact

SEQ ID NO: 477500 - DNA, 25 bp, Homo sapien
ttattacggtcaacggacttacaat

SEQ ID NO: 477501 - DNA, 25 bp, Homo sapien
tacggtcaacggacttacaatgccc

SEQ ID NO: 477502 - DNA, 25 bp, Homo sapien
gtatgaagatggatacagcatcact

SEQ ID NO: 477503 - DNA, 25 bp, Homo sapien
ggatacagcatcactatggacactc

SEQ ID NO: 477504 - DNA, 25 bp, Homo sapien
acagcatcactatggacactcgtat

SEQ ID NO: 477505 - DNA, 25 bp, Homo sapien
gcatcactatggacactcgtattca

SEQ ID NO: 477506 - DNA, 25 bp, Homo sapien
cactatggacactcgtattcactta

SEQ ID NO: 477507 - DNA, 25 bp, Homo sapien
atggacactcgtattcacttatttg

SEQ ID NO: 477508 - DNA, 25 bp, Homo sapien
gacactcgtattcacttatttgcct

SEQ ID NO: 477509 - DNA, 25 bp, Homo sapien
actcgtattcacttatttgcctctt

SEQ ID NO: 477510 - DNA, 25 bp, Homo sapien
tcgtattcacttatttgcctcttca

SEQ ID NO: 477511 - DNA, 25 bp, Homo sapien
gtattcacttatttgcctcttcact

SEQ ID NO: 477512 - DNA, 25 bp, Homo sapien
attcacttatttgcctcttcactgc

SEQ ID NO: 477513 - DNA, 25 bp, Homo sapien
ctttgttgcatctctgctttttaat

SEQ ID NO: 477514 - DNA, 25 bp, Homo sapien
tatcactttgaggtacagatcttct

SEQ ID NO: 477515 - DNA, 25 bp, Homo sapien
cactttgaggtacagatcttcttct

SEQ ID NO: 477516 - DNA, 25 bp, Homo sapien
gaggtacagatcttcttctcagtga

SEQ ID NO: 477517 - DNA, 25 bp, Homo sapien
tacagatcttcttctcagtgaggca

SEQ ID NO: 477518 - DNA, 25 bp, Homo sapien
gatcttcttctcagtgaggcagaca

SEQ ID NO: 477519 - DNA, 25 bp, Homo sapien
tcttctcagtgaggcagacattatc

SEQ ID NO: 477520 - DNA, 25 bp, Homo sapien
agttttgtcactgaggttgcaccct

SEQ ID NO: 477521 - DNA, 25 bp, Homo sapien
gatccagccgcccagttatattctg

SEQ ID NO: 477522 - DNA, 25 bp, Homo sapien
agccgcccagttatattctgtgttt

SEQ ID NO: 477523 - DNA, 25 bp, Homo sapien
cgcccagttatattctgtgtttctc

SEQ ID NO: 477524 - DNA, 25 bp, Homo sapien
gaaggccagactccattcccataca

SEQ ID NO: 477525 - DNA, 25 bp, Homo sapien
tccattcccatacagctctctgtgg

SEQ ID NO: 477526 - DNA, 25 bp, Homo sapien
gtggtgccaaccctacttgcaaaat

SEQ ID NO: 477527 - DNA, 25 bp, Homo sapien
aaccctacttgcaaaatctgcagcg

SEQ ID NO: 477528 - DNA, 25 bp, Homo sapien
aatctgcagcgatgtacaatcccat

SEQ ID NO: 477529 - DNA, 25 bp, Homo sapien
aatcccatcatttaccaagttattg

SEQ ID NO: 477530 - DNA, 25 bp, Homo sapien
tgattacaaatttgcctgttgccaa

SEQ ID NO: 477531 - DNA, 25 bp, Homo sapien
ttgcctgttgccaaactggtggttt

SEQ ID NO: 477532 - DNA, 25 bp, Homo sapien
ttcaggctgcacaccgtaaccacag

SEQ ID NO: 477533 - DNA, 25 bp, Homo sapien
tgcacaccgtaaccacagtcaggaa

SEQ ID NO: 477534 - DNA, 25 bp, Homo sapien
cagtcaggaagtcttctgctgtgct

SEQ ID NO: 477535 - DNA, 25 bp, Homo sapien
gaggaaagactaacctctcccaatc

SEQ ID NO: 477536 - DNA, 25 bp, Homo sapien
aatcccttctgttcaagatgcctgt

SEQ ID NO: 477537 - DNA, 25 bp, Homo sapien
gaaggcaaatgcattacaccccact

SEQ ID NO: 477538 - DNA, 25 bp, Homo sapien
aggcctgtaacagagctgcagtagg

SEQ ID NO: 477539 - DNA, 25 bp, Homo sapien
gcagccacaggcatttggtaaaact

SEQ ID NO: 477540 - DNA, 25 bp, Homo sapien
tttggtaaaactgctgtctgtgtga

SEQ ID NO: 477541 - DNA, 25 bp, Homo sapien
gtctgtgtgaggtaccagcgtcagt

SEQ ID NO: 477542 - DNA, 25 bp, Homo sapien
cagcgtcagtgtggaagccgccatt

SEQ ID NO: 477543 - DNA, 25 bp, Homo sapien
agccgccattcttgtcaacatgaaa

SEQ ID NO: 477544 - DNA, 25 bp, Homo sapien
gggagcagccgcttttgctgtttga

SEQ ID NO: 477545 - DNA, 25 bp, Homo sapien
tgctgtttgacctcagggctgtgaa

SEQ ID NO: 477546 - DNA, 25 bp, Homo sapien
taaagaaacagaagccgagggatgg

SEQ ID NO: 477547 - DNA, 25 bp, Homo sapien
tgtactcccatcttttggaattggg

SEQ ID NO: 477548 - DNA, 25 bp, Homo sapien
ctcccatcttttggaattgggcttt

SEQ ID NO: 477549 - DNA, 25 bp, Homo sapien
attgggctttgttcttttggaacag

SEQ ID NO: 477550 - DNA, 25 bp, Homo sapien
cagggtttatttcatttgggtcact

SEQ ID NO: 477551 - DNA, 25 bp, Homo sapien
tgggtcactaggtcatggaggcatt

SEQ ID NO: 477552 - DNA, 25 bp, Homo sapien
gtcactaggtcatggaggcattatt

SEQ ID NO: 477553 - DNA, 25 bp, Homo sapien
gaggcattatttccaagtcatttga

SEQ ID NO: 477554 - DNA, 25 bp, Homo sapien
atagtaatgagatgggcaacttcaa

SEQ ID NO: 477555 - DNA, 25 bp, Homo sapien
aacttcaaatctatatcaactccta

SEQ ID NO: 477556 - DNA, 25 bp, Homo sapien
gctaatggcagaaaaattactagga

SEQ ID NO: 477557 - DNA, 25 bp, Homo sapien
aaaataagctacctaaagtgttatg

SEQ ID NO: 477558 - DNA, 25 bp, Homo sapien
aataagctacctaaagtgttatgag

SEQ ID NO: 477559 - DNA, 25 bp, Homo sapien
taagctacctaaagtgttatgagaa

SEQ ID NO: 477560 - DNA, 25 bp, Homo sapien
aagctacctaaagtgttatgagaat

SEQ ID NO: 477561 - DNA, 25 bp, Homo sapien
agctacctaaagtgttatgagaatt

SEQ ID NO: 477562 - DNA, 25 bp, Homo sapien
gctacctaaagtgttatgagaatta

SEQ ID NO: 477563 - DNA, 25 bp, Homo sapien
ctacctaaagtgttatgagaattaa

SEQ ID NO: 477564 - DNA, 25 bp, Homo sapien
tgagaattaaatgaggccggacatg

SEQ ID NO: 477565 - DNA, 25 bp, Homo sapien
gagaattaaatgaggccggacatgg

SEQ ID NO: 477566 - DNA, 25 bp, Homo sapien
agaattaaatgaggccggacatggt

SEQ ID NO: 477567 - DNA, 25 bp, Homo sapien
gaattaaatgaggccggacatggtg

SEQ ID NO: 477568 - DNA, 25 bp, Homo sapien
tcaactgtgagttcgcatttgtcag

SEQ ID NO: 477569 - DNA, 25 bp, Homo sapien
gtgagttcgcatttgtcagtttttt

SEQ ID NO: 477570 - DNA, 25 bp, Homo sapien
tagagttgcaatgtttactctccct

SEQ ID NO: 477571 - DNA, 25 bp, Homo sapien
ttcttctgtctgtaagcaatttcct

SEQ ID NO: 477572 - DNA, 25 bp, Homo sapien
gtaagcaatttccttgaagcttcaa

SEQ ID NO: 477573 - DNA, 25 bp, Homo sapien
cttccctgtccttgggaaagagtat

SEQ ID NO: 477574 - DNA, 25 bp, Homo sapien
ggaaagagtatattcaccctcagag

SEQ ID NO: 477575 - DNA, 25 bp, Homo sapien
gaaggcgtgaggaatcaccaaacca

SEQ ID NO: 477576 - DNA, 25 bp, Homo sapien
aatcaccaaaccagatcttttctcc

SEQ ID NO: 477577 - DNA, 25 bp, Homo sapien
tcttttctcccaaatcagtcaagaa

SEQ ID NO: 477578 - DNA, 25 bp, Homo sapien
aaatgttcactggaatgttgctatg

SEQ ID NO: 477579 - DNA, 25 bp, Homo sapien
actgctgctgacataaaaccaggac

SEQ ID NO: 477580 - DNA, 25 bp, Homo sapien
tccacaggcaggctcatttcactaa

SEQ ID NO: 477581 - DNA, 25 bp, Homo sapien
atttcactaagctcctcctttactt

SEQ ID NO: 477582 - DNA, 25 bp, Homo sapien
tctcctctttgatgtcaaacgcctt

SEQ ID NO: 477583 - DNA, 25 bp, Homo sapien
aacgccttgaaaacaagcctccact

SEQ ID NO: 477584 - DNA, 25 bp, Homo sapien
cttcccatttactcttgagactact

SEQ ID NO: 477585 - DNA, 25 bp, Homo sapien
gactacttcaattagttcccctact

SEQ ID NO: 477586 - DNA, 25 bp, Homo sapien
ttcccctactacactttgctagtga

SEQ ID NO: 477587 - DNA, 25 bp, Homo sapien
tgcccaggcaaagtgcacctcaaat

SEQ ID NO: 477588 - DNA, 25 bp, Homo sapien
cagttcctttgatctcgctgtaaga

SEQ ID NO: 477589 - DNA, 25 bp, Homo sapien
ttgtcaaggctgactactcacttct

SEQ ID NO: 477590 - DNA, 25 bp, Homo sapien
gtgacccctgactgctttcacagac

SEQ ID NO: 477591 - DNA, 25 bp, Homo sapien
tcccagtgaattccactgtctccag

SEQ ID NO: 477592 - DNA, 25 bp, Homo sapien
atgggcccttcgagaacctctcctg

SEQ ID NO: 477593 - DNA, 25 bp, Homo sapien
gttgctctcggcctcaaagaaaagt

SEQ ID NO: 477594 - DNA, 25 bp, Homo sapien
aagaaaagtctctaacccagcgcct

SEQ ID NO: 477595 - DNA, 25 bp, Homo sapien
agcgccttggaaagtgcctgttgca

SEQ ID NO: 477596 - DNA, 25 bp, Homo sapien
gcctgttgcactttccacagtgatg

SEQ ID NO: 477597 - DNA, 25 bp, Homo sapien
tgatggagacgtgctgagtctgcac

SEQ ID NO: 477598 - DNA, 25 bp, Homo sapien
agtctgcaccgcctatccagcatgg

SEQ ID NO: 477599 - DNA, 25 bp, Homo sapien
gcacgtggctgctaagcgcttgaaa

SEQ ID NO: 477600 - DNA, 25 bp, Homo sapien
gtggctggtgcaaccgtagaactaa

SEQ ID NO: 477601 - DNA, 25 bp, Homo sapien
tctgctgcaatacaggcttcaggcc

SEQ ID NO: 477602 - DNA, 25 bp, Homo sapien
aatacaggcttcaggccacggccat

SEQ ID NO: 477603 - DNA, 25 bp, Homo sapien
ccacggccatgggaggcatagtcca

SEQ ID NO: 477604 - DNA, 25 bp, Homo sapien
ctggagggtccatcaggaggagctt

SEQ ID NO: 477605 - DNA, 25 bp, Homo sapien
gggcccaacaggaggctaagatctg

SEQ ID NO: 477606 - DNA, 25 bp, Homo sapien
tggttggcctcatcccagtgggcct

SEQ ID NO: 477607 - DNA, 25 bp, Homo sapien
atcccagtgggcctgcagcatggcc

SEQ ID NO: 477608 - DNA, 25 bp, Homo sapien
ctaagatctgaggaggaactgcaaa

SEQ ID NO: 477609 - DNA, 25 bp, Homo sapien
aactgcaaagaacaggaggcgctcc

SEQ ID NO: 477610 - DNA, 25 bp, Homo sapien
aggaggcgctccaggtagctcgtcc

SEQ ID NO: 477611 - DNA, 25 bp, Homo sapien
ttgcttcccggctctgctgcaatac

SEQ ID NO: 477612 - DNA, 25 bp, Homo sapien
gtgacacgcttcaattcagagccta

SEQ ID NO: 477613 - DNA, 25 bp, Homo sapien
tagtgacacatgtcggacagctgcc

SEQ ID NO: 477614 - DNA, 25 bp, Homo sapien
ggacagctgccgtgttcagcacagt

SEQ ID NO: 477615 - DNA, 25 bp, Homo sapien
agcacagtccagagcgcgccatata

SEQ ID NO: 477616 - DNA, 25 bp, Homo sapien
tcaaccctgagaggtggatttcagt

SEQ ID NO: 477617 - DNA, 25 bp, Homo sapien
aagagaagagtcctaacacacagcc

SEQ ID NO: 477618 - DNA, 25 bp, Homo sapien
taacacacagcctcaggtgcttcct

SEQ ID NO: 477619 - DNA, 25 bp, Homo sapien
aggtgcttcctctctatggtgggtt

SEQ ID NO: 477620 - DNA, 25 bp, Homo sapien
tgcttccctggtgtgccataaaacc

SEQ ID NO: 477621 - DNA, 25 bp, Homo sapien
gtgccataaaaccaccaggttggtc

SEQ ID NO: 477622 - DNA, 25 bp, Homo sapien
accaggttggtcacagctcttttgg

SEQ ID NO: 477623 - DNA, 25 bp, Homo sapien
aagtaattgttcttgttccgcctca

SEQ ID NO: 477624 - DNA, 25 bp, Homo sapien
taattgttcttgttccgcctcacaa

SEQ ID NO: 477625 - DNA, 25 bp, Homo sapien
ttgttccgcctcacaagaatgtggg

SEQ ID NO: 477626 - DNA, 25 bp, Homo sapien
taacactataaaatgctgcgtccta

SEQ ID NO: 477627 - DNA, 25 bp, Homo sapien
gcgtcctaccttaaacttgtactgt

SEQ ID NO: 477628 - DNA, 25 bp, Homo sapien
ggtctgggttgcattgttagtttca

SEQ ID NO: 477629 - DNA, 25 bp, Homo sapien
ggttgcattgttagtttcatttgtg

SEQ ID NO: 477630 - DNA, 25 bp, Homo sapien
actgcttgtcaagagtgagcctcaa

SEQ ID NO: 477631 - DNA, 25 bp, Homo sapien
gagtgagcctcaagtcaaggcagtt

SEQ ID NO: 477632 - DNA, 25 bp, Homo sapien
gagcctcaagtcaaggcagttgtgc

SEQ ID NO: 477633 - DNA, 25 bp, Homo sapien
cagttgtgcctatgagaattagctc

SEQ ID NO: 477634 - DNA, 25 bp, Homo sapien
gagacagaaagttggcatactctag

SEQ ID NO: 477635 - DNA, 25 bp, Homo sapien
ggcatactctagttatgacatacat

SEQ ID NO: 477636 - DNA, 25 bp, Homo sapien
aatttggttgtctaagcaatgctat

SEQ ID NO: 477637 - DNA, 25 bp, Homo sapien
ttttttgatgtctactttgcttgat

SEQ ID NO: 477638 - DNA, 25 bp, Homo sapien
gatgtctactttgcttgatgaaaat

SEQ ID NO: 477639 - DNA, 25 bp, Homo sapien
aatgagcttctctttatatattgac

SEQ ID NO: 477640 - DNA, 25 bp, Homo sapien
ttcagcaaatactgtagcaattgca

SEQ ID NO: 477641 - DNA, 25 bp, Homo sapien
gtagcaattgcatagttataaccca

SEQ ID NO: 477642 - DNA, 25 bp, Homo sapien
ataacccatttatttcaactgaact

SEQ ID NO: 477643 - DNA, 25 bp, Homo sapien
taaacagaatttcagtacaccagaa

SEQ ID NO: 477644 - DNA, 25 bp, Homo sapien
gaatttcagtacaccagaaacattt

SEQ ID NO: 477645 - DNA, 25 bp, Homo sapien
gttcaggcacagagtatctattcag

SEQ ID NO: 477646 - DNA, 25 bp, Homo sapien
gaacatgtggacttcctgatgtcgt

SEQ ID NO: 477647 - DNA, 25 bp, Homo sapien
gtggacttcctgatgtcgtgaaaac

SEQ ID NO: 477648 - DNA, 25 bp, Homo sapien
agaagtttttattcctattgaatct

SEQ ID NO: 477649 - DNA, 25 bp, Homo sapien
ttacagtcaaattccacatcacatg

SEQ ID NO: 477650 - DNA, 25 bp, Homo sapien
aaatcttcaaatggtatccttctag

SEQ ID NO: 477651 - DNA, 25 bp, Homo sapien
gtatccttctagatgtttcttccta

SEQ ID NO: 477652 - DNA, 25 bp, Homo sapien
agatgtttcttcctaatgttttctg

SEQ ID NO: 477653 - DNA, 25 bp, Homo sapien
ttctgtggtatcaattttcatgtgg

SEQ ID NO: 477654 - DNA, 25 bp, Homo sapien
gtggaattgtttgatgttcctcaat

SEQ ID NO: 477655 - DNA, 25 bp, Homo sapien
tgttcctcaataaaacttcatagtg

SEQ ID NO: 477656 - DNA, 25 bp, Homo sapien
gatctgttccttgaggatttgtcac

SEQ ID NO: 477657 - DNA, 25 bp, Homo sapien
gttccttgaggatttgtcacagtct

SEQ ID NO: 477658 - DNA, 25 bp, Homo sapien
tttgtcacagtctgcccacagtgga

SEQ ID NO: 477659 - DNA, 25 bp, Homo sapien
actggatttggcatgtaggatgtta

SEQ ID NO: 477660 - DNA, 25 bp, Homo sapien
atactgaacatgaacctcaccgtcc

SEQ ID NO: 477661 - DNA, 25 bp, Homo sapien
tctcagctgtagctccttctgcgtc

SEQ ID NO: 477662 - DNA, 25 bp, Homo sapien
ttctgcgtctgcaacctggcttgtt

SEQ ID NO: 477663 - DNA, 25 bp, Homo sapien
ctggcttgttcccacgacaaaggaa

SEQ ID NO: 477664 - DNA, 25 bp, Homo sapien
tacacacatatctgaccatcttcac

SEQ ID NO: 477665 - DNA, 25 bp, Homo sapien
acatatctgaccatcttcactcagc

SEQ ID NO: 477666 - DNA, 25 bp, Homo sapien
tcagcgcctctgagaaaacaataca

SEQ ID NO: 477667 - DNA, 25 bp, Homo sapien
gaagtgaccatcttgccgaacatac

SEQ ID NO: 477668 - DNA, 25 bp, Homo sapien
gaccatcttgccgaacatactaaaa

SEQ ID NO: 477669 - DNA, 25 bp, Homo sapien
gccgaacatactaaaacacagcaga

SEQ ID NO: 477670 - DNA, 25 bp, Homo sapien
aaggtattcactctagcagtacggt

SEQ ID NO: 477671 - DNA, 25 bp, Homo sapien
cagtacggtgctggcatctgtggaa

SEQ ID NO: 477672 - DNA, 25 bp, Homo sapien
gtggaagctgtgcaagacgatactt

SEQ ID NO: 477673 - DNA, 25 bp, Homo sapien
tgtgcaagacgatactttgattact

SEQ ID NO: 477674 - DNA, 25 bp, Homo sapien
tattcaacaagcttctgtttcagga

SEQ ID NO: 477675 - DNA, 25 bp, Homo sapien
taggaacggttaatacctctgccac

SEQ ID NO: 477676 - DNA, 25 bp, Homo sapien
gaacggttaatacctctgccaccag

SEQ ID NO: 477677 - DNA, 25 bp, Homo sapien
agatacccttaccaacactgaaata

SEQ ID NO: 477678 - DNA, 25 bp, Homo sapien
tccatggtctcttcaggtggaagat

SEQ ID NO: 477679 - DNA, 25 bp, Homo sapien
cttcaggtggaagataggtcaggcc

SEQ ID NO: 477680 - DNA, 25 bp, Homo sapien
gaagataggtcaggccattggatta

SEQ ID NO: 477681 - DNA, 25 bp, Homo sapien
gataggtcaggccattggattatct

SEQ ID NO: 477682 - DNA, 25 bp, Homo sapien
gtcaggccattggattatcttacat

SEQ ID NO: 477683 - DNA, 25 bp, Homo sapien
ggccattggattatcttacatagac

SEQ ID NO: 477684 - DNA, 25 bp, Homo sapien
ggattatcttacatagacaccgata

SEQ ID NO: 477685 - DNA, 25 bp, Homo sapien
tacatagacaccgataagaacaaag

SEQ ID NO: 477686 - DNA, 25 bp, Homo sapien
atgaagtattttgagaatcccagga

SEQ ID NO: 477687 - DNA, 25 bp, Homo sapien
aagtattttgagaatcccaggaagt

SEQ ID NO: 477688 - DNA, 25 bp, Homo sapien
ttgagaatcccaggaagtacattcc

SEQ ID NO: 477689 - DNA, 25 bp, Homo sapien
ggagtggcttcccaaggtctcacag

SEQ ID NO: 477690 - DNA, 25 bp, Homo sapien
ggccaggcaggctgtctgtctgctt

SEQ ID NO: 477691 - DNA, 25 bp, Homo sapien
aggctgtctgtctgcttcacatgtc

SEQ ID NO: 477692 - DNA, 25 bp, Homo sapien
tgggacacacgggtcctcctgagtc

SEQ ID NO: 477693 - DNA, 25 bp, Homo sapien
cgtagcctcatttcttacagacggg

SEQ ID NO: 477694 - DNA, 25 bp, Homo sapien
gctcagagcagcaggtgttacccaa

SEQ ID NO: 477695 - DNA, 25 bp, Homo sapien
gcagcaggtgttacccaaggtcaca

SEQ ID NO: 477696 - DNA, 25 bp, Homo sapien
ccaaggtcacaaggccgaacatttt

SEQ ID NO: 477697 - DNA, 25 bp, Homo sapien
cagaaatctttcagaactcaaaggg

SEQ ID NO: 477698 - DNA, 25 bp, Homo sapien
aagaaggctgaaatcactaacacat

SEQ ID NO: 477699 - DNA, 25 bp, Homo sapien
ctaacacatatagggcttcctttgg

SEQ ID NO: 477700 - DNA, 25 bp, Homo sapien
tatcccattcgatccattcgttgtc

SEQ ID NO: 477701 - DNA, 25 bp, Homo sapien
cattcgatccattcgttgtccgtgt

SEQ ID NO: 477702 - DNA, 25 bp, Homo sapien
attcgatccattcgttgtccgtgtc

SEQ ID NO: 477703 - DNA, 25 bp, Homo sapien
tcgatccattcgttgtccgtgtcaa

SEQ ID NO: 477704 - DNA, 25 bp, Homo sapien
cgatccattcgttgtccgtgtcaaa

SEQ ID NO: 477705 - DNA, 25 bp, Homo sapien
gatccattcgttgtccgtgtcaaaa

SEQ ID NO: 477706 - DNA, 25 bp, Homo sapien
atccattcgttgtccgtgtcaaaaa

SEQ ID NO: 477707 - DNA, 25 bp, Homo sapien
tccattcgttgtccgtgtcaaaaat

SEQ ID NO: 477708 - DNA, 25 bp, Homo sapien
cattcgttgtccgtgtcaaaaatca

SEQ ID NO: 477709 - DNA, 25 bp, Homo sapien
attcgttgtccgtgtcaaaaatcaa

SEQ ID NO: 477710 - DNA, 25 bp, Homo sapien
tcgttgtccgtgtcaaaaatcaatt

SEQ ID NO: 477711 - DNA, 25 bp, Homo sapien
acggcagcgcaagatgagggtgaat

SEQ ID NO: 477712 - DNA, 25 bp, Homo sapien
ggtgaatgtagaccctgaggacctc

SEQ ID NO: 477713 - DNA, 25 bp, Homo sapien
acgtgccaggccctggtctacaggg

SEQ ID NO: 477714 - DNA, 25 bp, Homo sapien
ggccacagtgaccttgtccggtgcc

SEQ ID NO: 477715 - DNA, 25 bp, Homo sapien
acagtgaccttgtccggtgcctcag

SEQ ID NO: 477716 - DNA, 25 bp, Homo sapien
ttgtccggtgcctcagtgtctctcc

SEQ ID NO: 477717 - DNA, 25 bp, Homo sapien
tggtttcaggctctgacgacggctc

SEQ ID NO: 477718 - DNA, 25 bp, Homo sapien
tgcggctctgggaggtggccactgc

SEQ ID NO: 477719 - DNA, 25 bp, Homo sapien
gtggtcgtgctgaagtcaacagagc

SEQ ID NO: 477720 - DNA, 25 bp, Homo sapien
tcgtgctgaagtcaacagagccttt

SEQ ID NO: 477721 - DNA, 25 bp, Homo sapien
ctgaagtcaacagagcctttaccct

SEQ ID NO: 477722 - DNA, 25 bp, Homo sapien
tcagaatctgaggtggtaagtccag

SEQ ID NO: 477723 - DNA, 25 bp, Homo sapien
attcttcatgtttttacttacttag

SEQ ID NO: 477724 - DNA, 25 bp, Homo sapien
gttaaatttcaagtaccaagtatat

SEQ ID NO: 477725 - DNA, 25 bp, Homo sapien
gtaccaagtatatttgagacaggac

SEQ ID NO: 477726 - DNA, 25 bp, Homo sapien
aagtatatttgagacaggacacagg

SEQ ID NO: 477727 - DNA, 25 bp, Homo sapien
gacaggacacaggatgaactctttg

SEQ ID NO: 477728 - DNA, 25 bp, Homo sapien
acaggacacaggatgaactctttgt

SEQ ID NO: 477729 - DNA, 25 bp, Homo sapien
aggacacaggatgaactctttgtca

SEQ ID NO: 477730 - DNA, 25 bp, Homo sapien
ctctttgtcagttaaatactaagca

SEQ ID NO: 477731 - DNA, 25 bp, Homo sapien
attccatttaagtactggttcctct

SEQ ID NO: 477732 - DNA, 25 bp, Homo sapien
ccatttaagtactggttcctctagg

SEQ ID NO: 477733 - DNA, 25 bp, Homo sapien
ctaatctgggtggtctctttgggcg

SEQ ID NO: 477734 - DNA, 25 bp, Homo sapien
gtcaggccgttggattctcttacac

SEQ ID NO: 477735 - DNA, 25 bp, Homo sapien
ggccgttggattctcttacacagat

SEQ ID NO: 477736 - DNA, 25 bp, Homo sapien
ggattctcttacacagatgcccata

SEQ ID NO: 477737 - DNA, 25 bp, Homo sapien
attctcttacacagatgcccataag

SEQ ID NO: 477738 - DNA, 25 bp, Homo sapien
acacagatgcccataagaacaaagc

SEQ ID NO: 477739 - DNA, 25 bp, Homo sapien
ggagaatctccaaaagtacattcct

SEQ ID NO: 477740 - DNA, 25 bp, Homo sapien
gaatctccaaaagtacattcctgga

SEQ ID NO: 477741 - DNA, 25 bp, Homo sapien
agaagtccgcccagtgtcacaccat

SEQ ID NO: 477742 - DNA, 25 bp, Homo sapien
ggcaaaagcgcaagactgggctaat

SEQ ID NO: 477743 - DNA, 25 bp, Homo sapien
actgggctaatctgggtggtctctt

SEQ ID NO: 477744 - DNA, 25 bp, Homo sapien
gaaacaatgcccagtgagtgtgttt

SEQ ID NO: 477745 - DNA, 25 bp, Homo sapien
acaatgcccagtgagtgtgttttct

SEQ ID NO: 477746 - DNA, 25 bp, Homo sapien
aatgcccagtgagtgtgttttctga

SEQ ID NO: 477747 - DNA, 25 bp, Homo sapien
tgcccagtgagtgtgttttctgatg

SEQ ID NO: 477748 - DNA, 25 bp, Homo sapien
cccagtgagtgtgttttctgatgcc

SEQ ID NO: 477749 - DNA, 25 bp, Homo sapien
cagtgagtgtgttttctgatgccac

SEQ ID NO: 477750 - DNA, 25 bp, Homo sapien
gatgtatcattttggagtcttcttt

SEQ ID NO: 477751 - DNA, 25 bp, Homo sapien
tgtatcattttggagtcttcttttt

SEQ ID NO: 477752 - DNA, 25 bp, Homo sapien
aagtagaagctctgcactggctctc

SEQ ID NO: 477753 - DNA, 25 bp, Homo sapien
gtagaagctctgcactggctctcac

SEQ ID NO: 477754 - DNA, 25 bp, Homo sapien
gaagctctgcactggctctcacctt

SEQ ID NO: 477755 - DNA, 25 bp, Homo sapien
gaggacagacaatgtgatttgcttt

SEQ ID NO: 477756 - DNA, 25 bp, Homo sapien
acaactgtggtctcttttatcttaa

SEQ ID NO: 477757 - DNA, 25 bp, Homo sapien
aactgtggtctcttttatcttaagg

SEQ ID NO: 477758 - DNA, 25 bp, Homo sapien
ctgtggtctcttttatcttaagggt

SEQ ID NO: 477759 - DNA, 25 bp, Homo sapien
gtggtctcttttatcttaagggtct

SEQ ID NO: 477760 - DNA, 25 bp, Homo sapien
gtctcttttatcttaagggtctctt

SEQ ID NO: 477761 - DNA, 25 bp, Homo sapien
tatcttaagggtctcttttaactgc

SEQ ID NO: 477762 - DNA, 25 bp, Homo sapien
tcttaagggtctcttttaactgcta

SEQ ID NO: 477763 - DNA, 25 bp, Homo sapien
ttaactgctagagctctccatttct

SEQ ID NO: 477764 - DNA, 25 bp, Homo sapien
ccatttctcctcctaaaagagaagg

SEQ ID NO: 477765 - DNA, 25 bp, Homo sapien
tcctcctaaaagagaaggatttctt

SEQ ID NO: 477766 - DNA, 25 bp, Homo sapien
aggtctgagggtttcattatttgcc

SEQ ID NO: 477767 - DNA, 25 bp, Homo sapien
tgagggtttcattatttgcctgccc

SEQ ID NO: 477768 - DNA, 25 bp, Homo sapien
tgccccagatttggactccgttttt

SEQ ID NO: 477769 - DNA, 25 bp, Homo sapien
ttggactccgtttttcaggtgaaag

SEQ ID NO: 477770 - DNA, 25 bp, Homo sapien
agaatccttggataactgtttcatt

SEQ ID NO: 477771 - DNA, 25 bp, Homo sapien
ggataactgtttcattttcatagga

SEQ ID NO: 477772 - DNA, 25 bp, Homo sapien
tggtttcgggatccaaagtaatatg

SEQ ID NO: 477773 - DNA, 25 bp, Homo sapien
gatccaaagtaatatgtaggttcaa

SEQ ID NO: 477774 - DNA, 25 bp, Homo sapien
ggttttataatcaaatgtctcccta

SEQ ID NO: 477775 - DNA, 25 bp, Homo sapien
aatcaaatgtctccctaaagagatg

SEQ ID NO: 477776 - DNA, 25 bp, Homo sapien
tagcccatatttccgaacataaatc

SEQ ID NO: 477777 - DNA, 25 bp, Homo sapien
aacctcccgttggtgttgggatcat

SEQ ID NO: 477778 - DNA, 25 bp, Homo sapien
tgcttttagcatctcattccttgtg

SEQ ID NO: 477779 - DNA, 25 bp, Homo sapien
ttgtgacttccacagctttcttttc

SEQ ID NO: 477780 - DNA, 25 bp, Homo sapien
gctttcttttctacagctgctaaaa

SEQ ID NO: 477781 - DNA, 25 bp, Homo sapien
ctgctaaaatagtggcttatgggcc

SEQ ID NO: 477782 - DNA, 25 bp, Homo sapien
gcttatgggccattggactgttagc

SEQ ID NO: 477783 - DNA, 25 bp, Homo sapien
ggactgttagccctattgagagcaa

SEQ ID NO: 477784 - DNA, 25 bp, Homo sapien
agagcaaggctttccaatacataaa

SEQ ID NO: 477785 - DNA, 25 bp, Homo sapien
agtgtactgtgcttatttgttctaa

SEQ ID NO: 477786 - DNA, 25 bp, Homo sapien
tgcttctttatacagctccgacaga

SEQ ID NO: 477787 - DNA, 25 bp, Homo sapien
gagttaaaccttcagttgtatagac

SEQ ID NO: 477788 - DNA, 25 bp, Homo sapien
agaagccctcgacctttaccgtgtg

SEQ ID NO: 477789 - DNA, 25 bp, Homo sapien
gacctttaccgtgtgttggtctcca

SEQ ID NO: 477790 - DNA, 25 bp, Homo sapien
tctccagtggccaggtggacaccgg

SEQ ID NO: 477791 - DNA, 25 bp, Homo sapien
cagcaggcacggactgagctggtct

SEQ ID NO: 477792 - DNA, 25 bp, Homo sapien
aggcacggactgagctggtctccac

SEQ ID NO: 477793 - DNA, 25 bp, Homo sapien
cagctggaggctgaatgcctggtgg

SEQ ID NO: 477794 - DNA, 25 bp, Homo sapien
aggccctgctggaacactactcgga

SEQ ID NO: 477795 - DNA, 25 bp, Homo sapien
tgctggaacactactcggagctgct

SEQ ID NO: 477796 - DNA, 25 bp, Homo sapien
tggaacactactcggagctgctggt

SEQ ID NO: 477797 - DNA, 25 bp, Homo sapien
aacactactcggagctgctggtgca

SEQ ID NO: 477798 - DNA, 25 bp, Homo sapien
ggtgcaggccgtgcggaggaaggca

SEQ ID NO: 477799 - DNA, 25 bp, Homo sapien
gagctaaattttctgttgtactgat

SEQ ID NO: 477800 - DNA, 25 bp, Homo sapien
ttttctgttgtactgattgcacacg

SEQ ID NO: 477801 - DNA, 25 bp, Homo sapien
gttgtactgattgcacacgaccatc

SEQ ID NO: 477802 - DNA, 25 bp, Homo sapien
gtactgattgcacacgaccatcgtg

SEQ ID NO: 477803 - DNA, 25 bp, Homo sapien
cacgaccatcgtggcgggtacacat

SEQ ID NO: 477804 - DNA, 25 bp, Homo sapien
ccatcgtggcgggtacacattacac

SEQ ID NO: 477805 - DNA, 25 bp, Homo sapien
ggcgggtacacattacacgaagaaa

SEQ ID NO: 477806 - DNA, 25 bp, Homo sapien
atgaatattagcaacgattagtctt

SEQ ID NO: 477807 - DNA, 25 bp, Homo sapien
tagcaacgattagtcttatgagcag

SEQ ID NO: 477808 - DNA, 25 bp, Homo sapien
gtcttatgagcagactaaatgccaa

SEQ ID NO: 477809 - DNA, 25 bp, Homo sapien
atgccaaaattgacatggactcttt

SEQ ID NO: 477810 - DNA, 25 bp, Homo sapien
gaactaccagccctgtaatggcatg

SEQ ID NO: 477811 - DNA, 25 bp, Homo sapien
aggtccagttctggcacaaaactgt

SEQ ID NO: 477812 - DNA, 25 bp, Homo sapien
tggcacaaaactgtaggcatcctgc

SEQ ID NO: 477813 - DNA, 25 bp, Homo sapien
gaatgtgaaccagatagctttccct

SEQ ID NO: 477814 - DNA, 25 bp, Homo sapien
gatagctttccctggaccagccggc

SEQ ID NO: 477815 - DNA, 25 bp, Homo sapien
agcttcaacagcacagaggaccact

SEQ ID NO: 477816 - DNA, 25 bp, Homo sapien
gaggaccactccaaatggtgcgtgt

SEQ ID NO: 477817 - DNA, 25 bp, Homo sapien
tccaaatggtgcgtgtccccaaaag

SEQ ID NO: 477818 - DNA, 25 bp, Homo sapien
tgcgtgtccccaaaagggccctgga

SEQ ID NO: 477819 - DNA, 25 bp, Homo sapien
ccaaaagggccctggacctgcgtgg

SEQ ID NO: 477820 - DNA, 25 bp, Homo sapien
cctggacctgcgtgggtgacatgaa

SEQ ID NO: 477821 - DNA, 25 bp, Homo sapien
gtttcactgtaccaggcatgaggat

SEQ ID NO: 477822 - DNA, 25 bp, Homo sapien
ttcactgtaccaggcatgaggatgt

SEQ ID NO: 477823 - DNA, 25 bp, Homo sapien
gagcatatcagcatggagtacctct

SEQ ID NO: 477824 - DNA, 25 bp, Homo sapien
gcatatcagcatggagtacctctgg

SEQ ID NO: 477825 - DNA, 25 bp, Homo sapien
atatcagcatggagtacctctggtg

SEQ ID NO: 477826 - DNA, 25 bp, Homo sapien
tatcagcatggagtacctctggtgt

SEQ ID NO: 477827 - DNA, 25 bp, Homo sapien
atcagcatggagtacctctggtgtg

SEQ ID NO: 477828 - DNA, 25 bp, Homo sapien
tcagcatggagtacctctggtgtgg

SEQ ID NO: 477829 - DNA, 25 bp, Homo sapien
gcatggagtacctctggtgtggcaa

SEQ ID NO: 477830 - DNA, 25 bp, Homo sapien
catggagtacctctggtgtggcaat

SEQ ID NO: 477831 - DNA, 25 bp, Homo sapien
tggagtacctctggtgtggcaatgc

SEQ ID NO: 477832 - DNA, 25 bp, Homo sapien
aaccactgtgttagctaagagcctc

SEQ ID NO: 477833 - DNA, 25 bp, Homo sapien
accactgtgttagctaagagcctcc

SEQ ID NO: 477834 - DNA, 25 bp, Homo sapien
cactgtgttagctaagagcctccaa

SEQ ID NO: 477835 - DNA, 25 bp, Homo sapien
actgtgttagctaagagcctccaaa

SEQ ID NO: 477836 - DNA, 25 bp, Homo sapien
ctgtgttagctaagagcctccaaaa

SEQ ID NO: 477837 - DNA, 25 bp, Homo sapien
gtgttagctaagagcctccaaaaag

SEQ ID NO: 477838 - DNA, 25 bp, Homo sapien
tgttagctaagagcctccaaaaagg

SEQ ID NO: 477839 - DNA, 25 bp, Homo sapien
ctaagagcctccaaaaaggctgggt

SEQ ID NO: 477840 - DNA, 25 bp, Homo sapien
ggagtccgaggcgagtgaatcactt

SEQ ID NO: 477841 - DNA, 25 bp, Homo sapien
taagtggaaggatggcttaagctca

SEQ ID NO: 477842 - DNA, 25 bp, Homo sapien
aaggatggcttaagctcaggaggta

SEQ ID NO: 477843 - DNA, 25 bp, Homo sapien
gagaatggaagctcatcacccaaca

SEQ ID NO: 477844 - DNA, 25 bp, Homo sapien
atcacccaacattcagcttctaaga

SEQ ID NO: 477845 - DNA, 25 bp, Homo sapien
gaagtaggctggactttccacattt

SEQ ID NO: 477846 - DNA, 25 bp, Homo sapien
attttaacatctgatccatcccttg

SEQ ID NO: 477847 - DNA, 25 bp, Homo sapien
ctgatccatcccttggtttttggat

SEQ ID NO: 477848 - DNA, 25 bp, Homo sapien
gatcataatgatcttgcctgctgga

SEQ ID NO: 477849 - DNA, 25 bp, Homo sapien
tgcctgctggatatttcagttatat

SEQ ID NO: 477850 - DNA, 25 bp, Homo sapien
ggaatttatccatgagaactatcca

SEQ ID NO: 477851 - DNA, 25 bp, Homo sapien
tccacaagtctaatgtttccatgct

SEQ ID NO: 477852 - DNA, 25 bp, Homo sapien
gtttccatgctttataatctatttt

SEQ ID NO: 477853 - DNA, 25 bp, Homo sapien
tcaaagacaccaaattatagccaag

SEQ ID NO: 477854 - DNA, 25 bp, Homo sapien
gaagtaattatgtatactggtacca

SEQ ID NO: 477855 - DNA, 25 bp, Homo sapien
aagtaattatgtatactggtaccag

SEQ ID NO: 477856 - DNA, 25 bp, Homo sapien
catgggatgacagattgagtggttt

SEQ ID NO: 477857 - DNA, 25 bp, Homo sapien
atgggatgacagattgagtggtttt

SEQ ID NO: 477858 - DNA, 25 bp, Homo sapien
tgggatgacagattgagtggtttta

SEQ ID NO: 477859 - DNA, 25 bp, Homo sapien
gggatgacagattgagtggttttat

SEQ ID NO: 477860 - DNA, 25 bp, Homo sapien
ggatgacagattgagtggttttatg

SEQ ID NO: 477861 - DNA, 25 bp, Homo sapien
gatgacagattgagtggttttatgt

SEQ ID NO: 477862 - DNA, 25 bp, Homo sapien
gctccaacatcggaagtaattatgt

SEQ ID NO: 477863 - DNA, 25 bp, Homo sapien
ctccaacatcggaagtaattatgta

SEQ ID NO: 477864 - DNA, 25 bp, Homo sapien
tccaacatcggaagtaattatgtat

SEQ ID NO: 477865 - DNA, 25 bp, Homo sapien
ctttctctgcattgtggaagggtct

SEQ ID NO: 477866 - DNA, 25 bp, Homo sapien
ggaagggtctgaaattatcacatat

SEQ ID NO: 477867 - DNA, 25 bp, Homo sapien
atgtatcttttatcaatggccttgc

SEQ ID NO: 477868 - DNA, 25 bp, Homo sapien
atcaatggccttgcatacaaatttt

SEQ ID NO: 477869 - DNA, 25 bp, Homo sapien
gaatccagatttagaggtcttctcc

SEQ ID NO: 477870 - DNA, 25 bp, Homo sapien
agaggtcttctccaaacatttgcat

SEQ ID NO: 477871 - DNA, 25 bp, Homo sapien
tttcttaggatcagaacttctacct

SEQ ID NO: 477872 - DNA, 25 bp, Homo sapien
gaacttctacctattgtcattttaa

SEQ ID NO: 477873 - DNA, 25 bp, Homo sapien
atttattcattatttacacccttat

SEQ ID NO: 477874 - DNA, 25 bp, Homo sapien
tacacccttatattctttcccaaat

SEQ ID NO: 477875 - DNA, 25 bp, Homo sapien
attctttcccaaatgttttaatgtg

SEQ ID NO: 477876 - DNA, 25 bp, Homo sapien
acaacttgagtcatggaggaagcca

SEQ ID NO: 477877 - DNA, 25 bp, Homo sapien
aagccacagtggttgaggaggtttt

SEQ ID NO: 477878 - DNA, 25 bp, Homo sapien
aggaggttttggtagcaatcatggt

SEQ ID NO: 477879 - DNA, 25 bp, Homo sapien
tacagtgacagtgggcatggctata

SEQ ID NO: 477880 - DNA, 25 bp, Homo sapien
gagcagtttgagacgtggttgaaac

SEQ ID NO: 477881 - DNA, 25 bp, Homo sapien
gacgtggttgaaactacaaggattt

SEQ ID NO: 477882 - DNA, 25 bp, Homo sapien
tggcaattacaataagcaatcctta

SEQ ID NO: 477883 - DNA, 25 bp, Homo sapien
gaggcagaagctctagaccctttaa

SEQ ID NO: 477884 - DNA, 25 bp, Homo sapien
gaccctttaatggtggaagtcaaca

SEQ ID NO: 477885 - DNA, 25 bp, Homo sapien
ggtggaagtcaacactttgcccaac

SEQ ID NO: 477886 - DNA, 25 bp, Homo sapien
tttgcccaaccacaaaaccatagtg

SEQ ID NO: 477887 - DNA, 25 bp, Homo sapien
gccacatagtgtctgcctgttgaag

SEQ ID NO: 477888 - DNA, 25 bp, Homo sapien
gtgtctgcctgttgaagatctggaa

SEQ ID NO: 477889 - DNA, 25 bp, Homo sapien
tgaagatctggaaactgcctcccca

SEQ ID NO: 477890 - DNA, 25 bp, Homo sapien
ctccccagatctgtattgtatttgg

SEQ ID NO: 477891 - DNA, 25 bp, Homo sapien
gtgttgataatctacacaccatctg

SEQ ID NO: 477892 - DNA, 25 bp, Homo sapien
ggaactcctcctgtgtactaggagg

SEQ ID NO: 477893 - DNA, 25 bp, Homo sapien
tgaagtcacatcctgtctatgagcc

SEQ ID NO: 477894 - DNA, 25 bp, Homo sapien
gtctatgagcccactaatgctgtaa

SEQ ID NO: 477895 - DNA, 25 bp, Homo sapien
actaatgctgtaacattggcctgaa

SEQ ID NO: 477896 - DNA, 25 bp, Homo sapien
acattggcctgaaagagagtgttct

SEQ ID NO: 477897 - DNA, 25 bp, Homo sapien
tttaaaagcctttctcggctgttag

SEQ ID NO: 477898 - DNA, 25 bp, Homo sapien
tctaggatatatgtcctggctatac

SEQ ID NO: 477899 - DNA, 25 bp, Homo sapien
gtcctggctatacatctagaatata

SEQ ID NO: 477900 - DNA, 25 bp, Homo sapien
tatgttccccatgttgacccaagtg

SEQ ID NO: 477901 - DNA, 25 bp, Homo sapien
ttccccatgttgacccaagtgtgaa

SEQ ID NO: 477902 - DNA, 25 bp, Homo sapien
tggataccaagttcttctgtcccaa

SEQ ID NO: 477903 - DNA, 25 bp, Homo sapien
aagttcttctgtcccaaacatggaa

SEQ ID NO: 477904 - DNA, 25 bp, Homo sapien
ggaaattcttgcagggtaactcggg

SEQ ID NO: 477905 - DNA, 25 bp, Homo sapien
aaggatgtctcactctcagatttga

SEQ ID NO: 477906 - DNA, 25 bp, Homo sapien
agtctgattgtttcaccctgtattt

SEQ ID NO: 477907 - DNA, 25 bp, Homo sapien
ttcaccctgtatttccttttacagc

SEQ ID NO: 477908 - DNA, 25 bp, Homo sapien
ttctgtatcttatttttgctgcttc

SEQ ID NO: 477909 - DNA, 25 bp, Homo sapien
aaaaggcatggttgggacagccacg

SEQ ID NO: 477910 - DNA, 25 bp, Homo sapien
aggcaccacggtgtctgctgggtaa

SEQ ID NO: 477911 - DNA, 25 bp, Homo sapien
ggtgtctgctgggtaagcttctaca

SEQ ID NO: 477912 - DNA, 25 bp, Homo sapien
tgctgggtaagcttctacagatggg

SEQ ID NO: 477913 - DNA, 25 bp, Homo sapien
aatgcatcattaggcgttttcgacg

SEQ ID NO: 477914 - DNA, 25 bp, Homo sapien
attaggcgttttcgacgtcgtgcaa

SEQ ID NO: 477915 - DNA, 25 bp, Homo sapien
ggcgttttcgacgtcgtgcaaacat

SEQ ID NO: 477916 - DNA, 25 bp, Homo sapien
tcgacgtcgtgcaaacatcagaata

SEQ ID NO: 477917 - DNA, 25 bp, Homo sapien
atcagaatatactcacacaaaccta

SEQ ID NO: 477918 - DNA, 25 bp, Homo sapien
actgtaggcagttgttaaccatggt

SEQ ID NO: 477919 - DNA, 25 bp, Homo sapien
gcagttgttaaccatggtgagtatt

SEQ ID NO: 477920 - DNA, 25 bp, Homo sapien
gaacccagaccccagcactgtgatg

SEQ ID NO: 477921 - DNA, 25 bp, Homo sapien
ccagaccccagcactgtgatgggag

SEQ ID NO: 477922 - DNA, 25 bp, Homo sapien
gcactgtgatgggagtccacggcta

SEQ ID NO: 477923 - DNA, 25 bp, Homo sapien
agcgcctcttggaccctgcgggatg

SEQ ID NO: 477924 - DNA, 25 bp, Homo sapien
cctcttggaccctgcgggatgccgg

SEQ ID NO: 477925 - DNA, 25 bp, Homo sapien
ggaccaggatcacacctccaggcgc

SEQ ID NO: 477926 - DNA, 25 bp, Homo sapien
acctccaggcgcctctggttggaca

SEQ ID NO: 477927 - DNA, 25 bp, Homo sapien
tctggttggacattccaggtcgtgc

SEQ ID NO: 477928 - DNA, 25 bp, Homo sapien
ggttggacattccaggtcgtgccct

SEQ ID NO: 477929 - DNA, 25 bp, Homo sapien
tggacattccaggtcgtgccctggg

SEQ ID NO: 477930 - DNA, 25 bp, Homo sapien
cctggtgcagctggcagcatgtggg

SEQ ID NO: 477931 - DNA, 25 bp, Homo sapien
tggtgatgcccttgatcattatcct

SEQ ID NO: 477932 - DNA, 25 bp, Homo sapien
ttgatcattatcctttcctcttctg

SEQ ID NO: 477933 - DNA, 25 bp, Homo sapien
tcctcttctggtgctattgctaagg

SEQ ID NO: 477934 - DNA, 25 bp, Homo sapien
agaagaaagcatttggcacctgcat

SEQ ID NO: 477935 - DNA, 25 bp, Homo sapien
tgcatctctcaccttcttgtggttt

SEQ ID NO: 477936 - DNA, 25 bp, Homo sapien
gtttctctcttttatggcactgtca

SEQ ID NO: 477937 - DNA, 25 bp, Homo sapien
atggcactgtcacaggtgtctacct

SEQ ID NO: 477938 - DNA, 25 bp, Homo sapien
gtgtctaccttcaaccaaaaaatca

SEQ ID NO: 477939 - DNA, 25 bp, Homo sapien
aatttctcactcttttctacactgt

SEQ ID NO: 477940 - DNA, 25 bp, Homo sapien
tacactgtagtaaccccaactctta

SEQ ID NO: 477941 - DNA, 25 bp, Homo sapien
ctcatctacactctaaggaacaagg

SEQ ID NO: 477942 - DNA, 25 bp, Homo sapien
gtagttgagattacaagcccaacct

SEQ ID NO: 477943 - DNA, 25 bp, Homo sapien
gttgagattacaagcccaaccttcc

SEQ ID NO: 477944 - DNA, 25 bp, Homo sapien
ttgagattacaagcccaaccttcca

SEQ ID NO: 477945 - DNA, 25 bp, Homo sapien
agattacaagcccaaccttccataa

SEQ ID NO: 477946 - DNA, 25 bp, Homo sapien
gattacaagcccaaccttccataac

SEQ ID NO: 477947 - DNA, 25 bp, Homo sapien
ttacaagcccaaccttccataactg

SEQ ID NO: 477948 - DNA, 25 bp, Homo sapien
tacaagcccaaccttccataactga

SEQ ID NO: 477949 - DNA, 25 bp, Homo sapien
acaagcccaaccttccataactgaa

SEQ ID NO: 477950 - DNA, 25 bp, Homo sapien
caagcccaaccttccataactgaaa

SEQ ID NO: 477951 - DNA, 25 bp, Homo sapien
gcccaaccttccataactgaaaact

SEQ ID NO: 477952 - DNA, 25 bp, Homo sapien
ttccataactgaaaactaactttct

SEQ ID NO: 477953 - DNA, 25 bp, Homo sapien
aattagggcttagccatctccctgt

SEQ ID NO: 477954 - DNA, 25 bp, Homo sapien
ctctgcctctttcctggagagagaa

SEQ ID NO: 477955 - DNA, 25 bp, Homo sapien
gacagtgcacggagaggtttccaga

SEQ ID NO: 477956 - DNA, 25 bp, Homo sapien
gagaggtttccagagcacaaattgt

SEQ ID NO: 477957 - DNA, 25 bp, Homo sapien
gcacaaattgttggttcctagcaca

SEQ ID NO: 477958 - DNA, 25 bp, Homo sapien
ggttcctagcacaaattagatggtt

SEQ ID NO: 477959 - DNA, 25 bp, Homo sapien
agatggtttggagcacaatggtgaa

SEQ ID NO: 477960 - DNA, 25 bp, Homo sapien
gcacaatggtgaagcacactcccct

SEQ ID NO: 477961 - DNA, 25 bp, Homo sapien
atgttctgtctagtggcagcttttc

SEQ ID NO: 477962 - DNA, 25 bp, Homo sapien
gtggcagcttttcccctggaacagg

SEQ ID NO: 477963 - DNA, 25 bp, Homo sapien
gagttcacaggcttatccccaggaa

SEQ ID NO: 477964 - DNA, 25 bp, Homo sapien
tgctcccattatacccagatggtgt

SEQ ID NO: 477965 - DNA, 25 bp, Homo sapien
gatggtgtgggcatcctccaatcgg

SEQ ID NO: 477966 - DNA, 25 bp, Homo sapien
gcatcctccaatcggctgggctgtg

SEQ ID NO: 477967 - DNA, 25 bp, Homo sapien
tgtgccatccacacctgtagtagca

SEQ ID NO: 477968 - DNA, 25 bp, Homo sapien
acctgtagtagcatcagtgtctggg

SEQ ID NO: 477969 - DNA, 25 bp, Homo sapien
gcaacacctggcatcgggcggcata

SEQ ID NO: 477970 - DNA, 25 bp, Homo sapien
atcgggcggcatacctggtctgcaa

SEQ ID NO: 477971 - DNA, 25 bp, Homo sapien
acctggtctgcaactatgccattaa

SEQ ID NO: 477972 - DNA, 25 bp, Homo sapien
ttaagggcaactggattggcgagtc

SEQ ID NO: 477973 - DNA, 25 bp, Homo sapien
ggattggcgagtccccgtacaagat

SEQ ID NO: 477974 - DNA, 25 bp, Homo sapien
cccagttatcaaggcagctgcaata

SEQ ID NO: 477975 - DNA, 25 bp, Homo sapien
ttacttattgtagtggtttgaatta

SEQ ID NO: 477976 - DNA, 25 bp, Homo sapien
tccctttttagatttaggagattag

SEQ ID NO: 477977 - DNA, 25 bp, Homo sapien
ggagattagctattagctctttttg

SEQ ID NO: 477978 - DNA, 25 bp, Homo sapien
tagctattagctctttttgagttgt

SEQ ID NO: 477979 - DNA, 25 bp, Homo sapien
tgacaattaagcacatcagataata

SEQ ID NO: 477980 - DNA, 25 bp, Homo sapien
ttcatttataattctcctcccttac

SEQ ID NO: 477981 - DNA, 25 bp, Homo sapien
catttataattctcctcccttacag

SEQ ID NO: 477982 - DNA, 25 bp, Homo sapien
tttataattctcctcccttacagta

SEQ ID NO: 477983 - DNA, 25 bp, Homo sapien
ttatttccctggctaaatcaagtaa

SEQ ID NO: 477984 - DNA, 25 bp, Homo sapien
tttccctggctaaatcaagtaagta

SEQ ID NO: 477985 - DNA, 25 bp, Homo sapien
gctaaatcaagtaagtaaagttcgt

SEQ ID NO: 477986 - DNA, 25 bp, Homo sapien
gatcagtcatgcctgaagagagcct

SEQ ID NO: 477987 - DNA, 25 bp, Homo sapien
acaccgcctctatcattgacatctt

SEQ ID NO: 477988 - DNA, 25 bp, Homo sapien
gcctctatcattgacatcttcggtg

SEQ ID NO: 477989 - DNA, 25 bp, Homo sapien
gagtctatcatgaacttcaacgtga

SEQ ID NO: 477990 - DNA, 25 bp, Homo sapien
acgtgaaaggtacccaacagctgtt

SEQ ID NO: 477991 - DNA, 25 bp, Homo sapien
aaggtacccaacagctgttggaggc

SEQ ID NO: 477992 - DNA, 25 bp, Homo sapien
gctagtgtgctagtcttcatccata

SEQ ID NO: 477993 - DNA, 25 bp, Homo sapien
agtcttcatccataccagcagcata

SEQ ID NO: 477994 - DNA, 25 bp, Homo sapien
agcagcatacaggtagcctggccca

SEQ ID NO: 477995 - DNA, 25 bp, Homo sapien
aagagattttccagaatcgacacaa

SEQ ID NO: 477996 - DNA, 25 bp, Homo sapien
atcgacacaaacaagagcatctgga

SEQ ID NO: 477997 - DNA, 25 bp, Homo sapien
ctgagtggggagtcttccaggcctc

SEQ ID NO: 477998 - DNA, 25 bp, Homo sapien
aggcctcctcagaggtcttcccttt

SEQ ID NO: 477999 - DNA, 25 bp, Homo sapien
gacagggtgagtcagagctcagcat

SEQ ID NO: 478000 - DNA, 25 bp, Homo sapien
agagctcagcatttaatctcctctc

SEQ ID NO: 478001 - DNA, 25 bp, Homo sapien
aaagtagagagcaagtcgcccacag

SEQ ID NO: 478002 - DNA, 25 bp, Homo sapien
gtagagagcaagtcgcccacagtgg

SEQ ID NO: 478003 - DNA, 25 bp, Homo sapien
cccacagtgggcgtgtctgtaaata

SEQ ID NO: 478004 - DNA, 25 bp, Homo sapien
gtgggcgtgtctgtaaatattgtga

SEQ ID NO: 478005 - DNA, 25 bp, Homo sapien
gcgtgtctgtaaatattgtgacagt

SEQ ID NO: 478006 - DNA, 25 bp, Homo sapien
ttatcttatcttttctgtggatcag

SEQ ID NO: 478007 - DNA, 25 bp, Homo sapien
atcttatcttttctgtggatcagaa

SEQ ID NO: 478008 - DNA, 25 bp, Homo sapien
ttcaggaaccgcacggcaaccttgt

SEQ ID NO: 478009 - DNA, 25 bp, Homo sapien
cacggcaaccttgtggttcttccgg

SEQ ID NO: 478010 - DNA, 25 bp, Homo sapien
tccagcagcttctggtgcctgagcc

SEQ ID NO: 478011 - DNA, 25 bp, Homo sapien
tgagcccgagctccttctgggtgtt

SEQ ID NO: 478012 - DNA, 25 bp, Homo sapien
cttctgggtgttcagggacttcctg

SEQ ID NO: 478013 - DNA, 25 bp, Homo sapien
ctgatcctcagcagtcggttccgct

SEQ ID NO: 478014 - DNA, 25 bp, Homo sapien
tcctcacggtcagctgtccggaagg

SEQ ID NO: 478015 - DNA, 25 bp, Homo sapien
gtcagctgtccggaaggcctcgagt

SEQ ID NO: 478016 - DNA, 25 bp, Homo sapien
agctgtccggaaggcctcgagtcgc

SEQ ID NO: 478017 - DNA, 25 bp, Homo sapien
ctcctggatctcgatgtgccacatg

SEQ ID NO: 478018 - DNA, 25 bp, Homo sapien
atgtgccacatggtgttctcgctct

SEQ ID NO: 478019 - DNA, 25 bp, Homo sapien
atgccggatcatggaaacacaagct

SEQ ID NO: 478020 - DNA, 25 bp, Homo sapien
aaaagagctcaaggtgggactccag

SEQ ID NO: 478021 - DNA, 25 bp, Homo sapien
tctccagcctgtctgtaggtaggaa

SEQ ID NO: 478022 - DNA, 25 bp, Homo sapien
gaaaaactactcctggaagctcacc

SEQ ID NO: 478023 - DNA, 25 bp, Homo sapien
gaagctcacctcagtgaatgcacct

SEQ ID NO: 478024 - DNA, 25 bp, Homo sapien
gaatgcacctcagagtccaagagct

SEQ ID NO: 478025 - DNA, 25 bp, Homo sapien
agagtccaagagctgccgcgaatac

SEQ ID NO: 478026 - DNA, 25 bp, Homo sapien
agctgccgcgaatacagggcctggt

SEQ ID NO: 478027 - DNA, 25 bp, Homo sapien
ggtggctgctatactgtgcgtctca

SEQ ID NO: 478028 - DNA, 25 bp, Homo sapien
tactgtgcgtctcagagcagagcca

SEQ ID NO: 478029 - DNA, 25 bp, Homo sapien
cccatcgccagcttgtaaaatccaa

SEQ ID NO: 478030 - DNA, 25 bp, Homo sapien
tatgacacttaaccctgacagctag

SEQ ID NO: 478031 - DNA, 25 bp, Homo sapien
aaccctgacagctagagtcttactt

SEQ ID NO: 478032 - DNA, 25 bp, Homo sapien
gagtcttactttatgctaatgctag

SEQ ID NO: 478033 - DNA, 25 bp, Homo sapien
tctatttttaaattccacgtgtgta

SEQ ID NO: 478034 - DNA, 25 bp, Homo sapien
attccacgtgtgtaaacatgctata

SEQ ID NO: 478035 - DNA, 25 bp, Homo sapien
gtgtaaacatgctatactcttctga

SEQ ID NO: 478036 - DNA, 25 bp, Homo sapien
actcttctgatattaaacttactaa

SEQ ID NO: 478037 - DNA, 25 bp, Homo sapien
agttttggttttcctagtgcacatt

SEQ ID NO: 478038 - DNA, 25 bp, Homo sapien
ggttttcctagtgcacattagtttg

SEQ ID NO: 478039 - DNA, 25 bp, Homo sapien
acattagtttgtgcaagttcttgca

SEQ ID NO: 478040 - DNA, 25 bp, Homo sapien
tgctttgaataatgcagcccataaa

SEQ ID NO: 478041 - DNA, 25 bp, Homo sapien
atttcaaattctctttaagatgacc

SEQ ID NO: 478042 - DNA, 25 bp, Homo sapien
attctctttaagatgaccattcagg

SEQ ID NO: 478043 - DNA, 25 bp, Homo sapien
ttctctttaagatgaccattcaggt

SEQ ID NO: 478044 - DNA, 25 bp, Homo sapien
tctctttaagatgaccattcaggtc

SEQ ID NO: 478045 - DNA, 25 bp, Homo sapien
tttaagatgaccattcaggtcaggc

SEQ ID NO: 478046 - DNA, 25 bp, Homo sapien
taagatgaccattcaggtcaggcat

SEQ ID NO: 478047 - DNA, 25 bp, Homo sapien
aagatgaccattcaggtcaggcatg

SEQ ID NO: 478048 - DNA, 25 bp, Homo sapien
agatgaccattcaggtcaggcatgg

SEQ ID NO: 478049 - DNA, 25 bp, Homo sapien
aagtacaaaacgttagatgggcgtg

SEQ ID NO: 478050 - DNA, 25 bp, Homo sapien
gtacaaaacgttagatgggcgtggt

SEQ ID NO: 478051 - DNA, 25 bp, Homo sapien
tgggcgcctgtagaggcaggagaga

SEQ ID NO: 478052 - DNA, 25 bp, Homo sapien
atgttccaggatctaagaaaatgtc

SEQ ID NO: 478053 - DNA, 25 bp, Homo sapien
tgttccaggatctaagaaaatgtcc

SEQ ID NO: 478054 - DNA, 25 bp, Homo sapien
gttccaggatctaagaaaatgtcca

SEQ ID NO: 478055 - DNA, 25 bp, Homo sapien
ttccaggatctaagaaaatgtccaa

SEQ ID NO: 478056 - DNA, 25 bp, Homo sapien
tccaggatctaagaaaatgtccaat

SEQ ID NO: 478057 - DNA, 25 bp, Homo sapien
ccaggatctaagaaaatgtccaatg

SEQ ID NO: 478058 - DNA, 25 bp, Homo sapien
caggatctaagaaaatgtccaatgg

SEQ ID NO: 478059 - DNA, 25 bp, Homo sapien
aggatctaagaaaatgtccaatggg

SEQ ID NO: 478060 - DNA, 25 bp, Homo sapien
gataacagagtttgatcctgctatt

SEQ ID NO: 478061 - DNA, 25 bp, Homo sapien
tgctgtcaagcttggtaaatatgaa

SEQ ID NO: 478062 - DNA, 25 bp, Homo sapien
aattcagtgacatgttcagttcaac

SEQ ID NO: 478063 - DNA, 25 bp, Homo sapien
gacatgttcagttcaacacgacaat

SEQ ID NO: 478064 - DNA, 25 bp, Homo sapien
gacaataaaactgtgcactccactg

SEQ ID NO: 478065 - DNA, 25 bp, Homo sapien
aactgtgcactccactgactttgaa

SEQ ID NO: 478066 - DNA, 25 bp, Homo sapien
tgcactccactgactttgaagtgaa

SEQ ID NO: 478067 - DNA, 25 bp, Homo sapien
gaagacagattctacagatcacgta

SEQ ID NO: 478068 - DNA, 25 bp, Homo sapien
gattctacagatcacgtaaaaccaa

SEQ ID NO: 478069 - DNA, 25 bp, Homo sapien
gaaaacacaaagcaaccttcaaaga

SEQ ID NO: 478070 - DNA, 25 bp, Homo sapien
gcaaccttcaaagagctgccataaa

SEQ ID NO: 478071 - DNA, 25 bp, Homo sapien
ttgagctgagccagagtgctcccta

SEQ ID NO: 478072 - DNA, 25 bp, Homo sapien
agccagagtgctccctatgcagata

SEQ ID NO: 478073 - DNA, 25 bp, Homo sapien
cagagtgctccctatgcagatatta

SEQ ID NO: 478074 - DNA, 25 bp, Homo sapien
tcctttagtctgatgaagctctgta

SEQ ID NO: 478075 - DNA, 25 bp, Homo sapien
ctttagtctgatgaagctctgtaga

SEQ ID NO: 478076 - DNA, 25 bp, Homo sapien
atagtgaccgaaaacaagcagctgc

SEQ ID NO: 478077 - DNA, 25 bp, Homo sapien
gtgaccgaaaacaagcagctgccaa

SEQ ID NO: 478078 - DNA, 25 bp, Homo sapien
ccgaaaacaagcagctgccaaattt

SEQ ID NO: 478079 - DNA, 25 bp, Homo sapien
attttatagctttcttgtcctaaag

SEQ ID NO: 478080 - DNA, 25 bp, Homo sapien
gtcctaaagaaacagctggctattg

SEQ ID NO: 478081 - DNA, 25 bp, Homo sapien
aacagctggctattgagctgagcca

SEQ ID NO: 478082 - DNA, 25 bp, Homo sapien
gtcatttaaaatgcactgtagccag

SEQ ID NO: 478083 - DNA, 25 bp, Homo sapien
aaatgcactgtagccagccagtcac

SEQ ID NO: 478084 - DNA, 25 bp, Homo sapien
gccagtcactggaaaaatgaacact

SEQ ID NO: 478085 - DNA, 25 bp, Homo sapien
aaatgaacacttccctgccagtttg

SEQ ID NO: 478086 - DNA, 25 bp, Homo sapien
cagtttgtctcatgtggcattcaga

SEQ ID NO: 478087 - DNA, 25 bp, Homo sapien
ttcagagtggacattcagctcttct

SEQ ID NO: 478088 - DNA, 25 bp, Homo sapien
taaaatatgttatgccaggccccaa

SEQ ID NO: 478089 - DNA, 25 bp, Homo sapien
ccaggccccaatgcagttattttta

SEQ ID NO: 478090 - DNA, 25 bp, Homo sapien
tatttttagatgagcagtgtcttca

SEQ ID NO: 478091 - DNA, 25 bp, Homo sapien
gggacactaactgtgatgatctcat

SEQ ID NO: 478092 - DNA, 25 bp, Homo sapien
atgtattaataaacagccacttccc

SEQ ID NO: 478093 - DNA, 25 bp, Homo sapien
gaagaagcccaaggatgatgaaaac

SEQ ID NO: 478094 - DNA, 25 bp, Homo sapien
aataattcatcttcacaaagctgtg

SEQ ID NO: 478095 - DNA, 25 bp, Homo sapien
attcatcttcacaaagctgtgatgt

SEQ ID NO: 478096 - DNA, 25 bp, Homo sapien
cacaaagctgtgatgttacttgagt

SEQ ID NO: 478097 - DNA, 25 bp, Homo sapien
agctgtgatgttacttgagtatttc

SEQ ID NO: 478098 - DNA, 25 bp, Homo sapien
gatgttacttgagtatttcacaagt

SEQ ID NO: 478099 - DNA, 25 bp, Homo sapien
gtacggcagttacattaggcagaat

SEQ ID NO: 478100 - DNA, 25 bp, Homo sapien
actgcatgggaactgagaagtacat

SEQ ID NO: 478101 - DNA, 25 bp, Homo sapien
gcatgggaactgagaagtacatatt

SEQ ID NO: 478102 - DNA, 25 bp, Homo sapien
atattgaataaagaaacgtctggcc

SEQ ID NO: 478103 - DNA, 25 bp, Homo sapien
gaacaagttgcataatatatcttat

SEQ ID NO: 478104 - DNA, 25 bp, Homo sapien
gcaagtacaggtagagttcctccat

SEQ ID NO: 478105 - DNA, 25 bp, Homo sapien
ggtagagttcctccatcaagagaaa

SEQ ID NO: 478106 - DNA, 25 bp, Homo sapien
tcaagagaaaaaccaccactccctg

SEQ ID NO: 478107 - DNA, 25 bp, Homo sapien
aaaaccaccactccctgcttgtgag

SEQ ID NO: 478108 - DNA, 25 bp, Homo sapien
tgcttgtgagccttctctaccatca

SEQ ID NO: 478109 - DNA, 25 bp, Homo sapien
tctaccatcaccaaaggtcagacgt

SEQ ID NO: 478110 - DNA, 25 bp, Homo sapien
aggtcagacgtctttgttggtgcaa

SEQ ID NO: 478111 - DNA, 25 bp, Homo sapien
ctttgttggtgcaagatgcctcctc

SEQ ID NO: 478112 - DNA, 25 bp, Homo sapien
acctccaaaaccaagatatgctcct

SEQ ID NO: 478113 - DNA, 25 bp, Homo sapien
agatatgctcctttgcctgaagcac

SEQ ID NO: 478114 - DNA, 25 bp, Homo sapien
tgctcctttgcctgaagcaccgtgg

SEQ ID NO: 478115 - DNA, 25 bp, Homo sapien
aataattcatcttcacaaagctgtg

SEQ ID NO: 478116 - DNA, 25 bp, Homo sapien
attcatcttcacaaagctgtgatgt

SEQ ID NO: 478117 - DNA, 25 bp, Homo sapien
cacaaagctgtgatgttacttgagt

SEQ ID NO: 478118 - DNA, 25 bp, Homo sapien
caaagctgtgatgttacttgagtat

SEQ ID NO: 478119 - DNA, 25 bp, Homo sapien
agctgtgatgttacttgagtatttc

SEQ ID NO: 478120 - DNA, 25 bp, Homo sapien
gtgatgttacttgagtatttcacaa

SEQ ID NO: 478121 - DNA, 25 bp, Homo sapien
gatgttacttgagtatttcacaagt

SEQ ID NO: 478122 - DNA, 25 bp, Homo sapien
actgcatgggaactgagaagtacat

SEQ ID NO: 478123 - DNA, 25 bp, Homo sapien
gcatgggaactgagaagtacatatt

SEQ ID NO: 478124 - DNA, 25 bp, Homo sapien
atattgaataaagaaacgtctggcc

SEQ ID NO: 478125 - DNA, 25 bp, Homo sapien
gaacaagttgcataatatatcttat

SEQ ID NO: 478126 - DNA, 25 bp, Homo sapien
acccagatatgaagaacttaccttt

SEQ ID NO: 478127 - DNA, 25 bp, Homo sapien
gatatgaagaacttacctttggttt

SEQ ID NO: 478128 - DNA, 25 bp, Homo sapien
agctgaaaaaccatttggttcctgt

SEQ ID NO: 478129 - DNA, 25 bp, Homo sapien
ctgaaaaaccatttggttcctgtgg

SEQ ID NO: 478130 - DNA, 25 bp, Homo sapien
cctgtgggcaggtgaatgagtttta

SEQ ID NO: 478131 - DNA, 25 bp, Homo sapien
gcaggtgaatgagttttattagcaa

SEQ ID NO: 478132 - DNA, 25 bp, Homo sapien
ttagcaaaatactgtttcaatcttt

SEQ ID NO: 478133 - DNA, 25 bp, Homo sapien
aatactgtttcaatctttaagacct

SEQ ID NO: 478134 - DNA, 25 bp, Homo sapien
actgtttcaatctttaagacctcag

SEQ ID NO: 478135 - DNA, 25 bp, Homo sapien
gtttcaatctttaagacctcagatt

SEQ ID NO: 478136 - DNA, 25 bp, Homo sapien
atgttcttgatcatattgcttcctg

SEQ ID NO: 478137 - DNA, 25 bp, Homo sapien
gaagtaattatgtatactggtacca

SEQ ID NO: 478138 - DNA, 25 bp, Homo sapien
aagtaattatgtatactggtaccag

SEQ ID NO: 478139 - DNA, 25 bp, Homo sapien
tataggaataatcagcggccctcag

SEQ ID NO: 478140 - DNA, 25 bp, Homo sapien
ccatcagtgggctccggtccgagga

SEQ ID NO: 478141 - DNA, 25 bp, Homo sapien
ctgattattactgtgcagcatggga

SEQ ID NO: 478142 - DNA, 25 bp, Homo sapien
catgggatgacagattgagtggttt

SEQ ID NO: 478143 - DNA, 25 bp, Homo sapien
atgggatgacagattgagtggtttt

SEQ ID NO: 478144 - DNA, 25 bp, Homo sapien
gggatgacagattgagtggttttat

SEQ ID NO: 478145 - DNA, 25 bp, Homo sapien
gatgacagattgagtggttttatgt

SEQ ID NO: 478146 - DNA, 25 bp, Homo sapien
gctccaacatcggaagtaattatgt

SEQ ID NO: 478147 - DNA, 25 bp, Homo sapien
ctccaacatcggaagtaattatgta

SEQ ID NO: 478148 - DNA, 25 bp, Homo sapien
tggtatcaactacccactgctttct

SEQ ID NO: 478149 - DNA, 25 bp, Homo sapien
ccaggccccgaagaactatcaggtt

SEQ ID NO: 478150 - DNA, 25 bp, Homo sapien
atcaggttctgttgggaaacatcca

SEQ ID NO: 478151 - DNA, 25 bp, Homo sapien
acatccaactgtatcatcaaaccca

SEQ ID NO: 478152 - DNA, 25 bp, Homo sapien
agaagatgtctgtgcaccggatcat

SEQ ID NO: 478153 - DNA, 25 bp, Homo sapien
atcacccatccagactttgagaagc

SEQ ID NO: 478154 - DNA, 25 bp, Homo sapien
tttgagaagctccacccctttggga

SEQ ID NO: 478155 - DNA, 25 bp, Homo sapien
acccctttgggagtgacattgccat

SEQ ID NO: 478156 - DNA, 25 bp, Homo sapien
tgacattgccatgttgcagctgcac

SEQ ID NO: 478157 - DNA, 25 bp, Homo sapien
atgaacttcacttcctacattgtcc

SEQ ID NO: 478158 - DNA, 25 bp, Homo sapien
gcccagtaacgtgtcctgttggata

SEQ ID NO: 478159 - DNA, 25 bp, Homo sapien
agctaaattatctgcgaggttcaca

SEQ ID NO: 478160 - DNA, 25 bp, Homo sapien
gcgaggttcacagagtttgttacaa

SEQ ID NO: 478161 - DNA, 25 bp, Homo sapien
gtttgttacaaacctaggaattgca

SEQ ID NO: 478162 - DNA, 25 bp, Homo sapien
ctaggaattgcatccaggtttctgg

SEQ ID NO: 478163 - DNA, 25 bp, Homo sapien
tagactgtctttcaaactttgattt

SEQ ID NO: 478164 - DNA, 25 bp, Homo sapien
atgtatgtgggtatgggcatttttt

SEQ ID NO: 478165 - DNA, 25 bp, Homo sapien
taacagttattagcctttgtaagag

SEQ ID NO: 478166 - DNA, 25 bp, Homo sapien
agaggcttatgaagacctaattaaa

SEQ ID NO: 478167 - DNA, 25 bp, Homo sapien
gtgattgaatcagtcccatttttag

SEQ ID NO: 478168 - DNA, 25 bp, Homo sapien
gaatcagtcccatttttagatgagt

SEQ ID NO: 478169 - DNA, 25 bp, Homo sapien
gagtaaactaaggtctaaggaagct

SEQ ID NO: 478170 - DNA, 25 bp, Homo sapien
tgctgtgataaatgaatacggtact

SEQ ID NO: 478171 - DNA, 25 bp, Homo sapien
aatgaatacggtactctgaaggaga

SEQ ID NO: 478172 - DNA, 25 bp, Homo sapien
aaagtttctcaaatgagcttaaact

SEQ ID NO: 478173 - DNA, 25 bp, Homo sapien
attcttaaagctattgaaagtttca

SEQ ID NO: 478174 - DNA, 25 bp, Homo sapien
cctcaagtgaattttgtatgtaaat

SEQ ID NO: 478175 - DNA, 25 bp, Homo sapien
gtgattctttaagcaaacaattagc

SEQ ID NO: 478176 - DNA, 25 bp, Homo sapien
aacaattagctgaaaacttggtatt

SEQ ID NO: 478177 - DNA, 25 bp, Homo sapien
gctgaaaacttggtattgttgtagt

SEQ ID NO: 478178 - DNA, 25 bp, Homo sapien
gtagtaagtgacttggcacccatca

SEQ ID NO: 478179 - DNA, 25 bp, Homo sapien
taagtgacttggcacccatcagaaa

SEQ ID NO: 478180 - DNA, 25 bp, Homo sapien
gcacccatcagaaaataaagggcat

SEQ ID NO: 478181 - DNA, 25 bp, Homo sapien
gaggagaaactcaatacaaagacaa

SEQ ID NO: 478182 - DNA, 25 bp, Homo sapien
caaagacaagtacaactccattaga

SEQ ID NO: 478183 - DNA, 25 bp, Homo sapien
catcagtatagatctttccggtatc

SEQ ID NO: 478184 - DNA, 25 bp, Homo sapien
agtatagatctttccggtatccctg

SEQ ID NO: 478185 - DNA, 25 bp, Homo sapien
tagatctttccggtatccctgttct

SEQ ID NO: 478186 - DNA, 25 bp, Homo sapien
atatctgccaactgaacctgttgtc

SEQ ID NO: 478187 - DNA, 25 bp, Homo sapien
gccaactgaacctgttgtcttcaaa

SEQ ID NO: 478188 - DNA, 25 bp, Homo sapien
gaacctgttgtcttcaaatactaag

SEQ ID NO: 478189 - DNA, 25 bp, Homo sapien
cctgttgtcttcaaatactaaggaa

SEQ ID NO: 478190 - DNA, 25 bp, Homo sapien
gaggatattcttgcctcataaagaa

SEQ ID NO: 478191 - DNA, 25 bp, Homo sapien
gatattcttgcctcataaagaagaa

SEQ ID NO: 478192 - DNA, 25 bp, Homo sapien
tattttggcttccagtggtaccaat

SEQ ID NO: 478193 - DNA, 25 bp, Homo sapien
ttttggcttccagtggtaccaatca

SEQ ID NO: 478194 - DNA, 25 bp, Homo sapien
ttggcttccagtggtaccaatcaca

SEQ ID NO: 478195 - DNA, 25 bp, Homo sapien
ggcttccagtggtaccaatcacaga

SEQ ID NO: 478196 - DNA, 25 bp, Homo sapien
cttccagtggtaccaatcacagact

SEQ ID NO: 478197 - DNA, 25 bp, Homo sapien
tccagtggtaccaatcacagactga

SEQ ID NO: 478198 - DNA, 25 bp, Homo sapien
gtggtaccaatcacagactgaatgt

SEQ ID NO: 478199 - DNA, 25 bp, Homo sapien
ggtaccaatcacagactgaatgtct

SEQ ID NO: 478200 - DNA, 25 bp, Homo sapien
agataaaaaagacaggccaccagag

SEQ ID NO: 478201 - DNA, 25 bp, Homo sapien
aaagacaggccaccagagttattgt

SEQ ID NO: 478202 - DNA, 25 bp, Homo sapien
cctgatttctccgggaatcccaacg

SEQ ID NO: 478203 - DNA, 25 bp, Homo sapien
attggactatcaaccatgagccagt

SEQ ID NO: 478204 - DNA, 25 bp, Homo sapien
agtcaccatcccatgatatgaaagt

SEQ ID NO: 478205 - DNA, 25 bp, Homo sapien
gtgttaaatggccatcagctttatt

SEQ ID NO: 478206 - DNA, 25 bp, Homo sapien
attatcctgttattccactaagtaa

SEQ ID NO: 478207 - DNA, 25 bp, Homo sapien
ggtgaaagggcatccatctacattt

SEQ ID NO: 478208 - DNA, 25 bp, Homo sapien
taccactcatttttcccatggatct

SEQ ID NO: 478209 - DNA, 25 bp, Homo sapien
catggatctcttcccagcattcaga

SEQ ID NO: 478210 - DNA, 25 bp, Homo sapien
agcattcagacctcagatgcatgat

SEQ ID NO: 478211 - DNA, 25 bp, Homo sapien
atgatgcagttagactaagcctcta

SEQ ID NO: 478212 - DNA, 25 bp, Homo sapien
actaagcctctaagtctctgactgt

SEQ ID NO: 478213 - DNA, 25 bp, Homo sapien
gactgttatgcttgatttgaccttc

SEQ ID NO: 478214 - DNA, 25 bp, Homo sapien
tcagaatctgaggtggtaagtccag

SEQ ID NO: 478215 - DNA, 25 bp, Homo sapien
ctgaggtggtaagtccagagttttc

SEQ ID NO: 478216 - DNA, 25 bp, Homo sapien
gtccagagttttcattcttcatgtt

SEQ ID NO: 478217 - DNA, 25 bp, Homo sapien
attcttcatgtttttacttacttag

SEQ ID NO: 478218 - DNA, 25 bp, Homo sapien
gttaaatttcaagtaccaagtatat

SEQ ID NO: 478219 - DNA, 25 bp, Homo sapien
accaagtatatttgagacaggacac

SEQ ID NO: 478220 - DNA, 25 bp, Homo sapien
gacaggacacaggatgaactctttg

SEQ ID NO: 478221 - DNA, 25 bp, Homo sapien
aggacacaggatgaactctttgtca

SEQ ID NO: 478222 - DNA, 25 bp, Homo sapien
ctctttgtcagttaaatactaagca

SEQ ID NO: 478223 - DNA, 25 bp, Homo sapien
attccatttaagtactggttcctct

SEQ ID NO: 478224 - DNA, 25 bp, Homo sapien
ccatttaagtactggttcctctagg

SEQ ID NO: 478225 - DNA, 25 bp, Homo sapien
gaggagaaactcaatacaaagacaa

SEQ ID NO: 478226 - DNA, 25 bp, Homo sapien
caaagacaagtacaactccattaga

SEQ ID NO: 478227 - DNA, 25 bp, Homo sapien
ttcagacagcatcttctctattggc

SEQ ID NO: 478228 - DNA, 25 bp, Homo sapien
gacagcatcttctctattggcctct

SEQ ID NO: 478229 - DNA, 25 bp, Homo sapien
catcagtatagatctttccggtatc

SEQ ID NO: 478230 - DNA, 25 bp, Homo sapien
agtatagatctttccggtatccctg

SEQ ID NO: 478231 - DNA, 25 bp, Homo sapien
tagatctttccggtatccctgttct

SEQ ID NO: 478232 - DNA, 25 bp, Homo sapien
atatctgccaactgaacctgttgtc

SEQ ID NO: 478233 - DNA, 25 bp, Homo sapien
gccaactgaacctgttgtcttcaaa

SEQ ID NO: 478234 - DNA, 25 bp, Homo sapien
gaacctgttgtcttcaaatactaag

SEQ ID NO: 478235 - DNA, 25 bp, Homo sapien
gaggatattcttgcctcataaagaa

SEQ ID NO: 478236 - DNA, 25 bp, Homo sapien
caacaaatttgttctctcagagttc

SEQ ID NO: 478237 - DNA, 25 bp, Homo sapien
agaagtcccaaatcaggtgcgggca

SEQ ID NO: 478238 - DNA, 25 bp, Homo sapien
tccttaccttatccagcttctggga

SEQ ID NO: 478239 - DNA, 25 bp, Homo sapien
gggacgcattgtgccagtctcagag

SEQ ID NO: 478240 - DNA, 25 bp, Homo sapien
ttgtgccagtctcagaggcctgcat

SEQ ID NO: 478241 - DNA, 25 bp, Homo sapien
tcagaggcctgcatcttcacatggc

SEQ ID NO: 478242 - DNA, 25 bp, Homo sapien
gaaaggactctttcattgagcttct

SEQ ID NO: 478243 - DNA, 25 bp, Homo sapien
gactctttcattgagcttctttgac

SEQ ID NO: 478244 - DNA, 25 bp, Homo sapien
gagcttctttgactctaatccaaca

SEQ ID NO: 478245 - DNA, 25 bp, Homo sapien
gactctaatccaacatgatgtcacc

SEQ ID NO: 478246 - DNA, 25 bp, Homo sapien
gatgtcacctaaattcttaccttaa

SEQ ID NO: 478247 - DNA, 25 bp, Homo sapien
tcaggacattggcaactatttaaat

SEQ ID NO: 478248 - DNA, 25 bp, Homo sapien
gacattggcaactatttaaattggt

SEQ ID NO: 478249 - DNA, 25 bp, Homo sapien
tggacgtggatctgggacacatttt

SEQ ID NO: 478250 - DNA, 25 bp, Homo sapien
ggacgtggatctgggacacatttta

SEQ ID NO: 478251 - DNA, 25 bp, Homo sapien
actgtcaacagtatggtaatctccc

SEQ ID NO: 478252 - DNA, 25 bp, Homo sapien
gtcaacagtatggtaatctcccatt

SEQ ID NO: 478253 - DNA, 25 bp, Homo sapien
gtatggtaatctcccattcactttc

SEQ ID NO: 478254 - DNA, 25 bp, Homo sapien
atggtaatctcccattcactttcgg

SEQ ID NO: 478255 - DNA, 25 bp, Homo sapien
ggtaatctcccattcactttcggcc

SEQ ID NO: 478256 - DNA, 25 bp, Homo sapien
tgggaccaaagtgcatatcaaacga

SEQ ID NO: 478257 - DNA, 25 bp, Homo sapien
caaagtgcatatcaaacgaactgtg

SEQ ID NO: 478258 - DNA, 25 bp, Homo sapien
ggtgggcagatcaccaaatgtcagg

SEQ ID NO: 478259 - DNA, 25 bp, Homo sapien
tcgcgccattgcacttcaatctggg

SEQ ID NO: 478260 - DNA, 25 bp, Homo sapien
cgcgccattgcacttcaatctgggt

SEQ ID NO: 478261 - DNA, 25 bp, Homo sapien
gcgccattgcacttcaatctgggtg

SEQ ID NO: 478262 - DNA, 25 bp, Homo sapien
cgccattgcacttcaatctgggtga

SEQ ID NO: 478263 - DNA, 25 bp, Homo sapien
gccattgcacttcaatctgggtgac

SEQ ID NO: 478264 - DNA, 25 bp, Homo sapien
ccattgcacttcaatctgggtgaca

SEQ ID NO: 478265 - DNA, 25 bp, Homo sapien
cattgcacttcaatctgggtgacag

SEQ ID NO: 478266 - DNA, 25 bp, Homo sapien
gggtgacagatggaggctacatata

SEQ ID NO: 478267 - DNA, 25 bp, Homo sapien
ggtgacagatggaggctacatatat

SEQ ID NO: 478268 - DNA, 25 bp, Homo sapien
gtgacagatggaggctacatatata

SEQ ID NO: 478269 - DNA, 25 bp, Homo sapien
agcaggccctcaacattctcacagg

SEQ ID NO: 478270 - DNA, 25 bp, Homo sapien
ctcaacattctcacaggcaaggact

SEQ ID NO: 478271 - DNA, 25 bp, Homo sapien
ttctcacaggcaaggactggaagct

SEQ ID NO: 478272 - DNA, 25 bp, Homo sapien
ctggaagctgaaaggcaggcatgcc

SEQ ID NO: 478273 - DNA, 25 bp, Homo sapien
gaggcttaccacctgaatcaacaag

SEQ ID NO: 478274 - DNA, 25 bp, Homo sapien
acctgaatcaacaaggctcccaggg

SEQ ID NO: 478275 - DNA, 25 bp, Homo sapien
tgaacaggaggccttgcagactctg

SEQ ID NO: 478276 - DNA, 25 bp, Homo sapien
agactctgaaactggaccacccgaa

SEQ ID NO: 478277 - DNA, 25 bp, Homo sapien
tggaccacccgaagatagcagcctg

SEQ ID NO: 478278 - DNA, 25 bp, Homo sapien
ccgaagatagcagcctggcgctgga

SEQ ID NO: 478279 - DNA, 25 bp, Homo sapien
aaagctctacaacagcttgtgcccg

SEQ ID NO: 478280 - DNA, 25 bp, Homo sapien
tcttaaagatggcaccgacccaggc

SEQ ID NO: 478281 - DNA, 25 bp, Homo sapien
cttaaagatggcaccgacccaggcc

SEQ ID NO: 478282 - DNA, 25 bp, Homo sapien
ttaaagatggcaccgacccaggccg

SEQ ID NO: 478283 - DNA, 25 bp, Homo sapien
taaagatggcaccgacccaggccgg

SEQ ID NO: 478284 - DNA, 25 bp, Homo sapien
aaagatggcaccgacccaggccggg

SEQ ID NO: 478285 - DNA, 25 bp, Homo sapien
aagatggcaccgacccaggccgggc

SEQ ID NO: 478286 - DNA, 25 bp, Homo sapien
agatggcaccgacccaggccgggcg

SEQ ID NO: 478287 - DNA, 25 bp, Homo sapien
gccaggaaagtggcatgaacccgcg

SEQ ID NO: 478288 - DNA, 25 bp, Homo sapien
ccaggaaagtggcatgaacccgcga

SEQ ID NO: 478289 - DNA, 25 bp, Homo sapien
gaaagtggcatgaacccgcgaggca

SEQ ID NO: 478290 - DNA, 25 bp, Homo sapien
aaagtggcatgaacccgcgaggcag

SEQ ID NO: 478291 - DNA, 25 bp, Homo sapien
ccagtggcataagaacagtatagtt

SEQ ID NO: 478292 - DNA, 25 bp, Homo sapien
agaacagtatagttggcctgctttt

SEQ ID NO: 478293 - DNA, 25 bp, Homo sapien
tagttggcctgcttttagggaggtt

SEQ ID NO: 478294 - DNA, 25 bp, Homo sapien
tagggaggttggacttaccctgatc

SEQ ID NO: 478295 - DNA, 25 bp, Homo sapien
accctgatcccccaattttaagatg

SEQ ID NO: 478296 - DNA, 25 bp, Homo sapien
ccccaattttaagatgttgagattt

SEQ ID NO: 478297 - DNA, 25 bp, Homo sapien
gttgagatttgtaaatgcattcagt

SEQ ID NO: 478298 - DNA, 25 bp, Homo sapien
aaatgtgtatcttatagttcaggaa

SEQ ID NO: 478299 - DNA, 25 bp, Homo sapien
ggaaatatgcttagacatgtaagtc

SEQ ID NO: 478300 - DNA, 25 bp, Homo sapien
atgtaagtcatatttgcctaaagag

SEQ ID NO: 478301 - DNA, 25 bp, Homo sapien
gtcatatttgcctaaagagttactt

SEQ ID NO: 478302 - DNA, 25 bp, Homo sapien
tcctctgctctcttgactttgtctg

SEQ ID NO: 478303 - DNA, 25 bp, Homo sapien
gactttgtctgctggctttgacttc

SEQ ID NO: 478304 - DNA, 25 bp, Homo sapien
atttctgacagatgcctggctccac

SEQ ID NO: 478305 - DNA, 25 bp, Homo sapien
acagactccttatccaccatatgct

SEQ ID NO: 478306 - DNA, 25 bp, Homo sapien
gatgttttctcttcgtcttggttta

SEQ ID NO: 478307 - DNA, 25 bp, Homo sapien
tcgtcttggtttatcagtgctgcca

SEQ ID NO: 478308 - DNA, 25 bp, Homo sapien
agggcttcccagacactggatggtc

SEQ ID NO: 478309 - DNA, 25 bp, Homo sapien
agggcagtccagcactctgttgttt

SEQ ID NO: 478310 - DNA, 25 bp, Homo sapien
tgttgtttctgccagcactcatcat

SEQ ID NO: 478311 - DNA, 25 bp, Homo sapien
tcattcctttttacttgtctgtctc

SEQ ID NO: 478312 - DNA, 25 bp, Homo sapien
tcctgctctaatgccactggtataa

SEQ ID NO: 478313 - DNA, 25 bp, Homo sapien
gaactacattagagctggtcaggtc

SEQ ID NO: 478314 - DNA, 25 bp, Homo sapien
ttagagctggtcaggtcttcactat

SEQ ID NO: 478315 - DNA, 25 bp, Homo sapien
agactgagggcaagatcccagtgga

SEQ ID NO: 478316 - DNA, 25 bp, Homo sapien
aaaaggagccctttgatgtcatctt

SEQ ID NO: 478317 - DNA, 25 bp, Homo sapien
tttcaccagcctaagaccactctaa

SEQ ID NO: 478318 - DNA, 25 bp, Homo sapien
gcctaagaccactctaaggactggg

SEQ ID NO: 478319 - DNA, 25 bp, Homo sapien
taacttgcaggccacaggacatagc

SEQ ID NO: 478320 - DNA, 25 bp, Homo sapien
aggccacaggacatagccacctgaa

SEQ ID NO: 478321 - DNA, 25 bp, Homo sapien
ggacatagccacctgaagagccagt

SEQ ID NO: 478322 - DNA, 25 bp, Homo sapien
tagccacctgaagagccagttgttc

SEQ ID NO: 478323 - DNA, 25 bp, Homo sapien
acctgaagagccagttgttctgtgt

SEQ ID NO: 478324 - DNA, 25 bp, Homo sapien
gggcattcacttgtctaaggaaaaa

SEQ ID NO: 478325 - DNA, 25 bp, Homo sapien
atcttgagaaaatctaaacgtcttg

SEQ ID NO: 478326 - DNA, 25 bp, Homo sapien
ggtactacttcagctgccagcagca

SEQ ID NO: 478327 - DNA, 25 bp, Homo sapien
aatctaaacgtcttgaatttctatt

SEQ ID NO: 478328 - DNA, 25 bp, Homo sapien
ctaaacgtcttgaatttctattttg

SEQ ID NO: 478329 - DNA, 25 bp, Homo sapien
agttatacattttctagggatgggc

SEQ ID NO: 478330 - DNA, 25 bp, Homo sapien
agctgccagcagcaggcgtttaaga

SEQ ID NO: 478331 - DNA, 25 bp, Homo sapien
ctgccagcagcaggcgtttaagaaa

SEQ ID NO: 478332 - DNA, 25 bp, Homo sapien
cagcagcaggcgtttaagaaagcta

SEQ ID NO: 478333 - DNA, 25 bp, Homo sapien
gcaggcgtttaagaaagctaatttc

SEQ ID NO: 478334 - DNA, 25 bp, Homo sapien
taaatagaacaaggcaaacagaggg

SEQ ID NO: 478335 - DNA, 25 bp, Homo sapien
gctgattactctgagatttcagtta

SEQ ID NO: 478336 - DNA, 25 bp, Homo sapien
ttactctgagatttcagttaagact

SEQ ID NO: 478337 - DNA, 25 bp, Homo sapien
aaagacagatagctgactggttcat

SEQ ID NO: 478338 - DNA, 25 bp, Homo sapien
gacagatagctgactggttcataat

SEQ ID NO: 478339 - DNA, 25 bp, Homo sapien
cagatagctgactggttcataatac

SEQ ID NO: 478340 - DNA, 25 bp, Homo sapien
gttggatccaaactaataagaataa

SEQ ID NO: 478341 - DNA, 25 bp, Homo sapien
acttcaagtggcttttattaagatt

SEQ ID NO: 478342 - DNA, 25 bp, Homo sapien
ggcttttattaagattttctcagac

SEQ ID NO: 478343 - DNA, 25 bp, Homo sapien
ggttaaagcaaacccaaatgtgtat

SEQ ID NO: 478344 - DNA, 25 bp, Homo sapien
aaagcaaacccaaatgtgtattatt

SEQ ID NO: 478345 - DNA, 25 bp, Homo sapien
gttacagagctctgctttataattt

SEQ ID NO: 478346 - DNA, 25 bp, Homo sapien
cctcttatgctcagtaccagccaaa

SEQ ID NO: 478347 - DNA, 25 bp, Homo sapien
ctcttatgctcagtaccagccaaat

SEQ ID NO: 478348 - DNA, 25 bp, Homo sapien
tcttatgctcagtaccagccaaatc

SEQ ID NO: 478349 - DNA, 25 bp, Homo sapien
cttatgctcagtaccagccaaatcc

SEQ ID NO: 478350 - DNA, 25 bp, Homo sapien
ttatgctcagtaccagccaaatccg

SEQ ID NO: 478351 - DNA, 25 bp, Homo sapien
tatgctcagtaccagccaaatccgg

SEQ ID NO: 478352 - DNA, 25 bp, Homo sapien
atgctcagtaccagccaaatccgga

SEQ ID NO: 478353 - DNA, 25 bp, Homo sapien
tgctcagtaccagccaaatccggaa

SEQ ID NO: 478354 - DNA, 25 bp, Homo sapien
gctcagtaccagccaaatccggaag

SEQ ID NO: 478355 - DNA, 25 bp, Homo sapien
ctcagtaccagccaaatccggaaga

SEQ ID NO: 478356 - DNA, 25 bp, Homo sapien
ttatgtgatgtcatgctaggaagca

SEQ ID NO: 478357 - DNA, 25 bp, Homo sapien
gaagcagcgttgtcaatgtgccact

SEQ ID NO: 478358 - DNA, 25 bp, Homo sapien
atgtgccactttccatgagcactga

SEQ ID NO: 478359 - DNA, 25 bp, Homo sapien
aggcagggatctgagctgtacccac

SEQ ID NO: 478360 - DNA, 25 bp, Homo sapien
agctgtacccactgtgaatgcccat

SEQ ID NO: 478361 - DNA, 25 bp, Homo sapien
ctgacccctgtgctagtgtcttgtc

SEQ ID NO: 478362 - DNA, 25 bp, Homo sapien
tgtgctagtgtcttgtccctgcatg

SEQ ID NO: 478363 - DNA, 25 bp, Homo sapien
tcttctctctggactatgattcatg

SEQ ID NO: 478364 - DNA, 25 bp, Homo sapien
aacagcatccttcaattctttctac

SEQ ID NO: 478365 - DNA, 25 bp, Homo sapien
aattctttctaccatttctcttatc

SEQ ID NO: 478366 - DNA, 25 bp, Homo sapien
tctcttatctttaaagggttcttat

SEQ ID NO: 478367 - DNA, 25 bp, Homo sapien
taatttggagtcatgatctcagctt

SEQ ID NO: 478368 - DNA, 25 bp, Homo sapien
tttggagtcatgatctcagctttgt

SEQ ID NO: 478369 - DNA, 25 bp, Homo sapien
ggagtcatgatctcagctttgtctc

SEQ ID NO: 478370 - DNA, 25 bp, Homo sapien
catgatctcagctttgtctcaaaaa

SEQ ID NO: 478371 - DNA, 25 bp, Homo sapien
ttcattttaaatatccttctcatgg

SEQ ID NO: 478372 - DNA, 25 bp, Homo sapien
attttaaatatccttctcatggttc

SEQ ID NO: 478373 - DNA, 25 bp, Homo sapien
aactttgggttatgtctctggtagc

SEQ ID NO: 478374 - DNA, 25 bp, Homo sapien
actttgggttatgtctctggtagca

SEQ ID NO: 478375 - DNA, 25 bp, Homo sapien
ctttgggttatgtctctggtagcag

SEQ ID NO: 478376 - DNA, 25 bp, Homo sapien
tttgggttatgtctctggtagcaga

SEQ ID NO: 478377 - DNA, 25 bp, Homo sapien
gttatgtctctggtagcagagattc

SEQ ID NO: 478378 - DNA, 25 bp, Homo sapien
taacttctccgcaagttgtcctatt

SEQ ID NO: 478379 - DNA, 25 bp, Homo sapien
ttctccgcaagttgtcctatttttg

SEQ ID NO: 478380 - DNA, 25 bp, Homo sapien
ccgcaagttgtcctatttttgtcat

SEQ ID NO: 478381 - DNA, 25 bp, Homo sapien
gttgtcctatttttgtcattactat

SEQ ID NO: 478382 - DNA, 25 bp, Homo sapien
cacttttttatggtacagctatctc

SEQ ID NO: 478383 - DNA, 25 bp, Homo sapien
gtacagctatctccatgtacctgca

SEQ ID NO: 478384 - DNA, 25 bp, Homo sapien
gctttgctaaagacacagtgcttac

SEQ ID NO: 478385 - DNA, 25 bp, Homo sapien
gacacagtgcttacttaccttacta

SEQ ID NO: 478386 - DNA, 25 bp, Homo sapien
cacagtgcttacttaccttactaac

SEQ ID NO: 478387 - DNA, 25 bp, Homo sapien
gtgcttacttaccttactaacttct

SEQ ID NO: 478388 - DNA, 25 bp, Homo sapien
ttaccttactaacttctccgcaagt

SEQ ID NO: 478389 - DNA, 25 bp, Homo sapien
ttagcaactgagcacacccgaacac

SEQ ID NO: 478390 - DNA, 25 bp, Homo sapien
gagcacacccgaacacaatgtataa

SEQ ID NO: 478391 - DNA, 25 bp, Homo sapien
aaaaagctccttgcaagaccatggg

SEQ ID NO: 478392 - DNA, 25 bp, Homo sapien
gaccatgggacagccattttgcaaa

SEQ ID NO: 478393 - DNA, 25 bp, Homo sapien
ttctatttgtgccttcgaacctgac

SEQ ID NO: 478394 - DNA, 25 bp, Homo sapien
tttgtgccttcgaacctgaccttca

SEQ ID NO: 478395 - DNA, 25 bp, Homo sapien
ctgaccttcacactgttcaaatgct

SEQ ID NO: 478396 - DNA, 25 bp, Homo sapien
tcacactgttcaaatgcttgctgct

SEQ ID NO: 478397 - DNA, 25 bp, Homo sapien
ggttgcacacttctgcactgttttg

SEQ ID NO: 478398 - DNA, 25 bp, Homo sapien
tgttattttacctgtgttcctaacg

SEQ ID NO: 478399 - DNA, 25 bp, Homo sapien
aagaaacgtgccaagcgaaaggaga

SEQ ID NO: 478400 - DNA, 25 bp, Homo sapien
tccttgtatttgctcctatcacaaa

SEQ ID NO: 478401 - DNA, 25 bp, Homo sapien
attaatgaaatccactgtcctgagt

SEQ ID NO: 478402 - DNA, 25 bp, Homo sapien
tgtcctgagtattatctttcctcct

SEQ ID NO: 478403 - DNA, 25 bp, Homo sapien
tcctcctgttgtactttctcagaga

SEQ ID NO: 478404 - DNA, 25 bp, Homo sapien
tatggcagaatatctggatcttcct

SEQ ID NO: 478405 - DNA, 25 bp, Homo sapien
atgtgtcctacatctgaaattgcat

SEQ ID NO: 478406 - DNA, 25 bp, Homo sapien
aaattgcatgggactcatgcccagc

SEQ ID NO: 478407 - DNA, 25 bp, Homo sapien
agcaatctggttctaggcctttgac

SEQ ID NO: 478408 - DNA, 25 bp, Homo sapien
ggcctttgacacctgataatatgag

SEQ ID NO: 478409 - DNA, 25 bp, Homo sapien
aatatgagagcaattggccagccaa

SEQ ID NO: 478410 - DNA, 25 bp, Homo sapien
caatagccataagcccagaggattt

SEQ ID NO: 478411 - DNA, 25 bp, Homo sapien
tcgaggaggtgcttgtgactagact

SEQ ID NO: 478412 - DNA, 25 bp, Homo sapien
gtgcttgtgactagactgccaatgg

SEQ ID NO: 478413 - DNA, 25 bp, Homo sapien
tcacaaagtttaacccaaccttgat

SEQ ID NO: 478414 - DNA, 25 bp, Homo sapien
ttgatccccgagtcttcacaaatgc

SEQ ID NO: 478415 - DNA, 25 bp, Homo sapien
ccgagtcttcacaaatgctcactga

SEQ ID NO: 478416 - DNA, 25 bp, Homo sapien
aatgctcactgaagaaaattcctgg

SEQ ID NO: 478417 - DNA, 25 bp, Homo sapien
gaacaattcagggtcctttcataac

SEQ ID NO: 478418 - DNA, 25 bp, Homo sapien
gtcctttcataacctctactctgag

SEQ ID NO: 478419 - DNA, 25 bp, Homo sapien
taacctctactctgaggtgttaata

SEQ ID NO: 478420 - DNA, 25 bp, Homo sapien
aaaatgagctgtacacaaatactga

SEQ ID NO: 478421 - DNA, 25 bp, Homo sapien
aacggtgagttgataattggataga

SEQ ID NO: 478422 - DNA, 25 bp, Homo sapien
acccagatatgaagaacttaccttt

SEQ ID NO: 478423 - DNA, 25 bp, Homo sapien
gatatgaagaacttacctttggttt

SEQ ID NO: 478424 - DNA, 25 bp, Homo sapien
gctgaaaaaccatttggttcctgtg

SEQ ID NO: 478425 - DNA, 25 bp, Homo sapien
cctgtgggcaggtgaatgagtttta

SEQ ID NO: 478426 - DNA, 25 bp, Homo sapien
gcaggtgaatgagttttattagcaa

SEQ ID NO: 478427 - DNA, 25 bp, Homo sapien
ttagcaaaatactgtttcaatcttt

SEQ ID NO: 478428 - DNA, 25 bp, Homo sapien
aatactgtttcaatctttaagacct

SEQ ID NO: 478429 - DNA, 25 bp, Homo sapien
gtttcaatctttaagacctcagatt

SEQ ID NO: 478430 - DNA, 25 bp, Homo sapien
atgttcttgatcatattgcttcctg

SEQ ID NO: 478431 - DNA, 25 bp, Homo sapien
atattgcttcctggctcttgtttct

SEQ ID NO: 478432 - DNA, 25 bp, Homo sapien
tcctggctcttgtttcttgtactgg

SEQ ID NO: 478433 - DNA, 25 bp, Homo sapien
taataagaataagctgtacaggaac

SEQ ID NO: 478434 - DNA, 25 bp, Homo sapien
aagaataagctgtacaggaactagt

SEQ ID NO: 478435 - DNA, 25 bp, Homo sapien
gaataagctgtacaggaactagtgc

SEQ ID NO: 478436 - DNA, 25 bp, Homo sapien
aggaactagtgctcaatatacattg

SEQ ID NO: 478437 - DNA, 25 bp, Homo sapien
ggaactagtgctcaatatacattgt

SEQ ID NO: 478438 - DNA, 25 bp, Homo sapien
gaactagtgctcaatatacattgta

SEQ ID NO: 478439 - DNA, 25 bp, Homo sapien
aactagtgctcaatatacattgtat

SEQ ID NO: 478440 - DNA, 25 bp, Homo sapien
actagtgctcaatatacattgtata

SEQ ID NO: 478441 - DNA, 25 bp, Homo sapien
ctagtgctcaatatacattgtataa

SEQ ID NO: 478442 - DNA, 25 bp, Homo sapien
tagtgctcaatatacattgtataaa

SEQ ID NO: 478443 - DNA, 25 bp, Homo sapien
tacattgtataaatttgtggaaatc

SEQ ID NO: 478444 - DNA, 25 bp, Homo sapien
tgagcctacagaatatccttcccaa

SEQ ID NO: 478445 - DNA, 25 bp, Homo sapien
gaatatccttcccaattaggtacac

SEQ ID NO: 478446 - DNA, 25 bp, Homo sapien
taggtacacattatctccctttcaa

SEQ ID NO: 478447 - DNA, 25 bp, Homo sapien
tatctccctttcaaacatactattt

SEQ ID NO: 478448 - DNA, 25 bp, Homo sapien
acatactatttgtctgtcagccttt

SEQ ID NO: 478449 - DNA, 25 bp, Homo sapien
tctgtcagcctttcagtcattcttt

SEQ ID NO: 478450 - DNA, 25 bp, Homo sapien
tcttttggaaaggtaggaggctgcc

SEQ ID NO: 478451 - DNA, 25 bp, Homo sapien
ctctttctctcactgttcaagtttg

SEQ ID NO: 478452 - DNA, 25 bp, Homo sapien
tctttctctcactgttcaagtttgc

SEQ ID NO: 478453 - DNA, 25 bp, Homo sapien
ctttctctcactgttcaagtttgcc

SEQ ID NO: 478454 - DNA, 25 bp, Homo sapien
tttctctcactgttcaagtttgcca

SEQ ID NO: 478455 - DNA, 25 bp, Homo sapien
ttcctgtgttgttctcacgatagtg

SEQ ID NO: 478456 - DNA, 25 bp, Homo sapien
tcctgtgttgttctcacgatagtga

SEQ ID NO: 478457 - DNA, 25 bp, Homo sapien
cctgtgttgttctcacgatagtgaa

SEQ ID NO: 478458 - DNA, 25 bp, Homo sapien
ctgtgttgttctcacgatagtgaat

SEQ ID NO: 478459 - DNA, 25 bp, Homo sapien
tgtgttgttctcacgatagtgaata

SEQ ID NO: 478460 - DNA, 25 bp, Homo sapien
ttaaaaacaggagttgccctgtaag

SEQ ID NO: 478461 - DNA, 25 bp, Homo sapien
taaaaacaggagttgccctgtaaga

SEQ ID NO: 478462 - DNA, 25 bp, Homo sapien
ttgccctgtaagagctctttctccc

SEQ ID NO: 478463 - DNA, 25 bp, Homo sapien
gccctgtaagagctctttctccctt

SEQ ID NO: 478464 - DNA, 25 bp, Homo sapien
ccctgtaagagctctttctcccttt

SEQ ID NO: 478465 - DNA, 25 bp, Homo sapien
tctttctccctttgcctgctaccat

SEQ ID NO: 478466 - DNA, 25 bp, Homo sapien
gcttgttactttttactgaacctct

SEQ ID NO: 478467 - DNA, 25 bp, Homo sapien
tactgaacctctgattctcaattga

SEQ ID NO: 478468 - DNA, 25 bp, Homo sapien
gattctcaattgagttcctctggga

SEQ ID NO: 478469 - DNA, 25 bp, Homo sapien
caattgagttcctctgggaagagca

SEQ ID NO: 478470 - DNA, 25 bp, Homo sapien
ttgtttccacctcctcaaaaattga

SEQ ID NO: 478471 - DNA, 25 bp, Homo sapien
gaaaatcccaaaatagctcactgat

SEQ ID NO: 478472 - DNA, 25 bp, Homo sapien
aatgtgagattacagagcagagcaa

SEQ ID NO: 478473 - DNA, 25 bp, Homo sapien
agagcaagccctgctattcttcagc

SEQ ID NO: 478474 - DNA, 25 bp, Homo sapien
agggctacctgtgatccaagtttgt

SEQ ID NO: 478475 - DNA, 25 bp, Homo sapien
ctacctgtgatccaagtttgtcctg

SEQ ID NO: 478476 - DNA, 25 bp, Homo sapien
tcctggagaatggagtttatctttt

SEQ ID NO: 478477 - DNA, 25 bp, Homo sapien
tgaaagcttatctctagtaaaaatc

SEQ ID NO: 478478 - DNA, 25 bp, Homo sapien
ctgaggcatgggagtctaagacaga

SEQ ID NO: 478479 - DNA, 25 bp, Homo sapien
gcatgggagtctaagacagaagaat

SEQ ID NO: 478480 - DNA, 25 bp, Homo sapien
ctgggcaacaggctttttctgtgag

SEQ ID NO: 478481 - DNA, 25 bp, Homo sapien
gggcaacaggctttttctgtgagac

SEQ ID NO: 478482 - DNA, 25 bp, Homo sapien
ggcaacaggctttttctgtgagact

SEQ ID NO: 478483 - DNA, 25 bp, Homo sapien
gcaacaggctttttctgtgagactg

SEQ ID NO: 478484 - DNA, 25 bp, Homo sapien
caacaggctttttctgtgagactgc

SEQ ID NO: 478485 - DNA, 25 bp, Homo sapien
aacaggctttttctgtgagactgcg

SEQ ID NO: 478486 - DNA, 25 bp, Homo sapien
acaggctttttctgtgagactgcgt

SEQ ID NO: 478487 - DNA, 25 bp, Homo sapien
caggctttttctgtgagactgcgtt

SEQ ID NO: 478488 - DNA, 25 bp, Homo sapien
caccatttcctgtgaacacctgtgg

SEQ ID NO: 478489 - DNA, 25 bp, Homo sapien
catttcctgtgaacacctgtgggag

SEQ ID NO: 478490 - DNA, 25 bp, Homo sapien
agaagagtaagctgctgctgaaaag

SEQ ID NO: 478491 - DNA, 25 bp, Homo sapien
tgctgctgaaaaggctctgaccaag

SEQ ID NO: 478492 - DNA, 25 bp, Homo sapien
agggtgaatggacttctccatctcc

SEQ ID NO: 478493 - DNA, 25 bp, Homo sapien
gttgcagactggtatgaaggcatgc

SEQ ID NO: 478494 - DNA, 25 bp, Homo sapien
tattcagcagtttccttctgaagcc

SEQ ID NO: 478495 - DNA, 25 bp, Homo sapien
tccttctgaagcctggagtgctcag

SEQ ID NO: 478496 - DNA, 25 bp, Homo sapien
cagcctgccacagaagactgatgtg

SEQ ID NO: 478497 - DNA, 25 bp, Homo sapien
cacagaagactgatgtgtggctccc

SEQ ID NO: 478498 - DNA, 25 bp, Homo sapien
tgatgtgtggctcccaccgctcagg

SEQ ID NO: 478499 - DNA, 25 bp, Homo sapien
tcctcggaccggagcccactgatgg

SEQ ID NO: 478500 - DNA, 25 bp, Homo sapien
gggccgctgattattcctatagatg

SEQ ID NO: 478501 - DNA, 25 bp, Homo sapien
gctggtaccagtatacataattact

SEQ ID NO: 478502 - DNA, 25 bp, Homo sapien
acataattacttccgatgttggagc

SEQ ID NO: 478503 - DNA, 25 bp, Homo sapien
ataattacttccgatgttggagctg

SEQ ID NO: 478504 - DNA, 25 bp, Homo sapien
cgccgaataccacataaaaccactc

SEQ ID NO: 478505 - DNA, 25 bp, Homo sapien
cataaaaccactcaatctgtcatcc

SEQ ID NO: 478506 - DNA, 25 bp, Homo sapien
aaaaccactcaatctgtcatcccat

SEQ ID NO: 478507 - DNA, 25 bp, Homo sapien
tgtcatcccatgctgcacagtaata

SEQ ID NO: 478508 - DNA, 25 bp, Homo sapien
gtcatcccatgctgcacagtaataa

SEQ ID NO: 478509 - DNA, 25 bp, Homo sapien
catcccatgctgcacagtaataatc

SEQ ID NO: 478510 - DNA, 25 bp, Homo sapien
ggcttcttcaacctgaggcattact

SEQ ID NO: 478511 - DNA, 25 bp, Homo sapien
tgaggcattactgagagccccggcg

SEQ ID NO: 478512 - DNA, 25 bp, Homo sapien
cttccctgcctatggtgtcgcttgg

SEQ ID NO: 478513 - DNA, 25 bp, Homo sapien
cctatggtgtcgcttggctaagtga

SEQ ID NO: 478514 - DNA, 25 bp, Homo sapien
tgtcgcttggctaagtgactcccag

SEQ ID NO: 478515 - DNA, 25 bp, Homo sapien
tggctaagtgactcccagcccaatg

SEQ ID NO: 478516 - DNA, 25 bp, Homo sapien
aatgccccctcaagagtctgggtcg

SEQ ID NO: 478517 - DNA, 25 bp, Homo sapien
agtgggtggcctccttgatgggcag

SEQ ID NO: 478518 - DNA, 25 bp, Homo sapien
ggcaggcttggaagggacttctccc

SEQ ID NO: 478519 - DNA, 25 bp, Homo sapien
tctgtcccagtgacatacgggcagg

SEQ ID NO: 478520 - DNA, 25 bp, Homo sapien
ttgttgtgtctccaccttgttccta

SEQ ID NO: 478521 - DNA, 25 bp, Homo sapien
atactcacctgcctttattaaccag

SEQ ID NO: 478522 - DNA, 25 bp, Homo sapien
agcattcttgatatggtccacctgt

SEQ ID NO: 478523 - DNA, 25 bp, Homo sapien
gatatggtccacctgtgaactgaat

SEQ ID NO: 478524 - DNA, 25 bp, Homo sapien
aggccaattggacaacctcagttcc

SEQ ID NO: 478525 - DNA, 25 bp, Homo sapien
aattcttggattgagtttggcctcc

SEQ ID NO: 478526 - DNA, 25 bp, Homo sapien
gctcaccaaacactatgttgctacc

SEQ ID NO: 478527 - DNA, 25 bp, Homo sapien
gttgctaccctctaccaaatgaata

SEQ ID NO: 478528 - DNA, 25 bp, Homo sapien
ttctctgaaatatgtcaaccccatg

SEQ ID NO: 478529 - DNA, 25 bp, Homo sapien
caaccccatgttccctgaattgaaa

SEQ ID NO: 478530 - DNA, 25 bp, Homo sapien
tttgctctctaccataatttatcac

SEQ ID NO: 478531 - DNA, 25 bp, Homo sapien
tggagctattcctctatcttaaata

SEQ ID NO: 478532 - DNA, 25 bp, Homo sapien
atagaggcatgctcagtaagtacct

SEQ ID NO: 478533 - DNA, 25 bp, Homo sapien
gaggcatgctcagtaagtacctgtc

SEQ ID NO: 478534 - DNA, 25 bp, Homo sapien
ggcatgctcagtaagtacctgtcta

SEQ ID NO: 478535 - DNA, 25 bp, Homo sapien
gctcagtaagtacctgtctatccta

SEQ ID NO: 478536 - DNA, 25 bp, Homo sapien
gtaagtacctgtctatcctaaactc

SEQ ID NO: 478537 - DNA, 25 bp, Homo sapien
agtacctgtctatcctaaactcaac

SEQ ID NO: 478538 - DNA, 25 bp, Homo sapien
gtacctgtctatcctaaactcaacc

SEQ ID NO: 478539 - DNA, 25 bp, Homo sapien
tcctaaactcaaccaagaagcttgg

SEQ ID NO: 478540 - DNA, 25 bp, Homo sapien
aagaagcttggtatgcctctcatgc

SEQ ID NO: 478541 - DNA, 25 bp, Homo sapien
gaagcttggtatgcctctcatgcca

SEQ ID NO: 478542 - DNA, 25 bp, Homo sapien
agcttggtatgcctctcatgccatt

SEQ ID NO: 478543 - DNA, 25 bp, Homo sapien
ttaagtctcctactatatatggtaa

SEQ ID NO: 478544 - DNA, 25 bp, Homo sapien
aatgcaaagatgacctttactacag

SEQ ID NO: 478545 - DNA, 25 bp, Homo sapien
gcaaagatgacctttactacagtat

SEQ ID NO: 478546 - DNA, 25 bp, Homo sapien
aaagatgacctttactacagtatca

SEQ ID NO: 478547 - DNA, 25 bp, Homo sapien
gatgacctttactacagtatcaatg

SEQ ID NO: 478548 - DNA, 25 bp, Homo sapien
atgacctttactacagtatcaatga

SEQ ID NO: 478549 - DNA, 25 bp, Homo sapien
gttgtttggctgtttaaacagctga

SEQ ID NO: 478550 - DNA, 25 bp, Homo sapien
ttcaggcaatttgagtaggtcaaac

SEQ ID NO: 478551 - DNA, 25 bp, Homo sapien
taggtcaaactcaataacactggtg

SEQ ID NO: 478552 - DNA, 25 bp, Homo sapien
aggtcaaactcaataacactggtgt

SEQ ID NO: 478553 - DNA, 25 bp, Homo sapien
ggtcaaactcaataacactggtgtt

SEQ ID NO: 478554 - DNA, 25 bp, Homo sapien
caccatttcctgtgaacacctgtgg

SEQ ID NO: 478555 - DNA, 25 bp, Homo sapien
catttcctgtgaacacctgtgggag

SEQ ID NO: 478556 - DNA, 25 bp, Homo sapien
agaagagtaagctgctgctgaaaag

SEQ ID NO: 478557 - DNA, 25 bp, Homo sapien
agggtgaatggacttctccatctcc

SEQ ID NO: 478558 - DNA, 25 bp, Homo sapien
tctccatctcctgagttcaccgcta

SEQ ID NO: 478559 - DNA, 25 bp, Homo sapien
gttgcagactggtatgaaggcatgc

SEQ ID NO: 478560 - DNA, 25 bp, Homo sapien
tattcagcagtttccttctgaagcc

SEQ ID NO: 478561 - DNA, 25 bp, Homo sapien
cagcctgccacagaagactgatgtg

SEQ ID NO: 478562 - DNA, 25 bp, Homo sapien
cacagaagactgatgtgtggctccc

SEQ ID NO: 478563 - DNA, 25 bp, Homo sapien
agactgatgtgtggctcccaccgct

SEQ ID NO: 478564 - DNA, 25 bp, Homo sapien
tgatgtgtggctcccaccgctcagg

SEQ ID NO: 478565 - DNA, 25 bp, Homo sapien
tcccttttgctttcagtactaacca

SEQ ID NO: 478566 - DNA, 25 bp, Homo sapien
gtactaaccattgctggtagttctt

SEQ ID NO: 478567 - DNA, 25 bp, Homo sapien
ggtagttcttaacaggtctagcttt

SEQ ID NO: 478568 - DNA, 25 bp, Homo sapien
gtctagcttttaccaatattgtcaa

SEQ ID NO: 478569 - DNA, 25 bp, Homo sapien
gggccctagtactctgtacttccac

SEQ ID NO: 478570 - DNA, 25 bp, Homo sapien
gtaccatgctgcctgttcacatgat

SEQ ID NO: 478571 - DNA, 25 bp, Homo sapien
gctgcctgttcacatgatggacacc

SEQ ID NO: 478572 - DNA, 25 bp, Homo sapien
gatggacaccagctctgatattcac

SEQ ID NO: 478573 - DNA, 25 bp, Homo sapien
ccagctctgatattcaccctaagat

SEQ ID NO: 478574 - DNA, 25 bp, Homo sapien
aaacttgtattcaacaccgactcct

SEQ ID NO: 478575 - DNA, 25 bp, Homo sapien
caccgactcctactctggctaaaat

SEQ ID NO: 478576 - DNA, 25 bp, Homo sapien
agagactcatttgcagctcccgaaa

SEQ ID NO: 478577 - DNA, 25 bp, Homo sapien
ttgcagctcccgaaaaagatatttt

SEQ ID NO: 478578 - DNA, 25 bp, Homo sapien
tttcctagccttattaaactggtgt

SEQ ID NO: 478579 - DNA, 25 bp, Homo sapien
aatcatgcaggctgtgcgtttacct

SEQ ID NO: 478580 - DNA, 25 bp, Homo sapien
gtttacctctcatgagcctcacaga

SEQ ID NO: 478581 - DNA, 25 bp, Homo sapien
agcctcacagagcttctgaatgttg

SEQ ID NO: 478582 - DNA, 25 bp, Homo sapien
atgttgtgaggccttcaggactgct

SEQ ID NO: 478583 - DNA, 25 bp, Homo sapien
ctgtctcctgatgccatcctggatg

SEQ ID NO: 478584 - DNA, 25 bp, Homo sapien
tcctggatgccattaaagtgcgatc

SEQ ID NO: 478585 - DNA, 25 bp, Homo sapien
aagtgcgatctgagagccgggatat

SEQ ID NO: 478586 - DNA, 25 bp, Homo sapien
agccgggatatggacctcaattata

SEQ ID NO: 478587 - DNA, 25 bp, Homo sapien
aggtggctaactgatatggttggct

SEQ ID NO: 478588 - DNA, 25 bp, Homo sapien
catggaggcaagtctttcctgtgtt

SEQ ID NO: 478589 - DNA, 25 bp, Homo sapien
ttcctgtgttgttctcacgatagtg

SEQ ID NO: 478590 - DNA, 25 bp, Homo sapien
tcctgtgttgttctcacgatagtga

SEQ ID NO: 478591 - DNA, 25 bp, Homo sapien
cctgtgttgttctcacgatagtgaa

SEQ ID NO: 478592 - DNA, 25 bp, Homo sapien
tgtgttgttctcacgatagtgaata

SEQ ID NO: 478593 - DNA, 25 bp, Homo sapien
gttctcacgatagtgaatacatctc

SEQ ID NO: 478594 - DNA, 25 bp, Homo sapien
taaaaacaggagttgccctgtaaga

SEQ ID NO: 478595 - DNA, 25 bp, Homo sapien
ttgccctgtaagagctctttctccc

SEQ ID NO: 478596 - DNA, 25 bp, Homo sapien
ccctgtaagagctctttctcccttt

SEQ ID NO: 478597 - DNA, 25 bp, Homo sapien
tctttctccctttgcctgctaccat

SEQ ID NO: 478598 - DNA, 25 bp, Homo sapien
agcactagttcctgtacagcttatt

SEQ ID NO: 478599 - DNA, 25 bp, Homo sapien
ttcctgtacagcttattcttattag

SEQ ID NO: 478600 - DNA, 25 bp, Homo sapien
gcttattcttattagtttggatcca

SEQ ID NO: 478601 - DNA, 25 bp, Homo sapien
gatccaactattccaatgtattatg

SEQ ID NO: 478602 - DNA, 25 bp, Homo sapien
atgaaccagtcagctatctgtcttt

SEQ ID NO: 478603 - DNA, 25 bp, Homo sapien
gtcttttgaaacaagtcttaactga

SEQ ID NO: 478604 - DNA, 25 bp, Homo sapien
gaaatctcagagtaatcagcaaaag

SEQ ID NO: 478605 - DNA, 25 bp, Homo sapien
tcagcaaaagctacggaataattct

SEQ ID NO: 478606 - DNA, 25 bp, Homo sapien
gatgtttccatatcattaaaaccaa

SEQ ID NO: 478607 - DNA, 25 bp, Homo sapien
taactggaatgggatcttggaactc

SEQ ID NO: 478608 - DNA, 25 bp, Homo sapien
tggaactcccaactttaatttggtg

SEQ ID NO: 478609 - DNA, 25 bp, Homo sapien
ggcggtgcaccctgcaggtgacaac

SEQ ID NO: 478610 - DNA, 25 bp, Homo sapien
gtgacaacgtcatctgtgggagcta

SEQ ID NO: 478611 - DNA, 25 bp, Homo sapien
gtgtggtttgacctggatctttcca

SEQ ID NO: 478612 - DNA, 25 bp, Homo sapien
atctttccaccaagccatacaggat

SEQ ID NO: 478613 - DNA, 25 bp, Homo sapien
tacaggatgctgagacaccacaaga

SEQ ID NO: 478614 - DNA, 25 bp, Homo sapien
agacaccacaagaaggctctgcggg

SEQ ID NO: 478615 - DNA, 25 bp, Homo sapien
tcaggctcggacgacggcagtgtca

SEQ ID NO: 478616 - DNA, 25 bp, Homo sapien
agtgtcatcgtctgccatggcatgg

SEQ ID NO: 478617 - DNA, 25 bp, Homo sapien
atggtgtacaatgaccttctgcaga

SEQ ID NO: 478618 - DNA, 25 bp, Homo sapien
gaagggacacgtgctgacccgagat

SEQ ID NO: 478619 - DNA, 25 bp, Homo sapien
tgctgacccgagatctgggagtgct

SEQ ID NO: 478620 - DNA, 25 bp, Homo sapien
atcttggacaaattaattgcaggaa

SEQ ID NO: 478621 - DNA, 25 bp, Homo sapien
aattttggcttacatattttgcaac

SEQ ID NO: 478622 - DNA, 25 bp, Homo sapien
ggtggctttggcgtctacttttgac

SEQ ID NO: 478623 - DNA, 25 bp, Homo sapien
tggcgtctacttttgaccatagtgg

SEQ ID NO: 478624 - DNA, 25 bp, Homo sapien
cttttgaccatagtggtggccctgt

SEQ ID NO: 478625 - DNA, 25 bp, Homo sapien
agtggtggccctgttattcgtggct

SEQ ID NO: 478626 - DNA, 25 bp, Homo sapien
tggccctgttattcgtggctcccgg

SEQ ID NO: 478627 - DNA, 25 bp, Homo sapien
ttcctacacatccttcccgatggaa

SEQ ID NO: 478628 - DNA, 25 bp, Homo sapien
gtcagccagctgatgggttggacca

SEQ ID NO: 478629 - DNA, 25 bp, Homo sapien
ggttggaccaagaaagacagagtga

SEQ ID NO: 478630 - DNA, 25 bp, Homo sapien
taagaatgagtgacaccatgttcta

SEQ ID NO: 478631 - DNA, 25 bp, Homo sapien
aggcccactgggatgaggccaacca

SEQ ID NO: 478632 - DNA, 25 bp, Homo sapien
ggcccactgggatgaggccaaccag

SEQ ID NO: 478633 - DNA, 25 bp, Homo sapien
gcccactgggatgaggccaaccagc

SEQ ID NO: 478634 - DNA, 25 bp, Homo sapien
cccactgggatgaggccaaccagct

SEQ ID NO: 478635 - DNA, 25 bp, Homo sapien
ccactgggatgaggccaaccagctg

SEQ ID NO: 478636 - DNA, 25 bp, Homo sapien
agctgctcagcaccactctcccgcc

SEQ ID NO: 478637 - DNA, 25 bp, Homo sapien
gctgctcagcaccactctcccgccg

SEQ ID NO: 478638 - DNA, 25 bp, Homo sapien
ctgctcagcaccactctcccgccgc

SEQ ID NO: 478639 - DNA, 25 bp, Homo sapien
tgctcagcaccactctcccgccgcc

SEQ ID NO: 478640 - DNA, 25 bp, Homo sapien
gcgtcccgagtagttgagattacaa

SEQ ID NO: 478641 - DNA, 25 bp, Homo sapien
gtagttgagattacaagcccaacct

SEQ ID NO: 478642 - DNA, 25 bp, Homo sapien
gttgagattacaagcccaaccttcc

SEQ ID NO: 478643 - DNA, 25 bp, Homo sapien
ttgagattacaagcccaaccttcca

SEQ ID NO: 478644 - DNA, 25 bp, Homo sapien
agattacaagcccaaccttccataa

SEQ ID NO: 478645 - DNA, 25 bp, Homo sapien
gattacaagcccaaccttccataac

SEQ ID NO: 478646 - DNA, 25 bp, Homo sapien
ttacaagcccaaccttccataactg

SEQ ID NO: 478647 - DNA, 25 bp, Homo sapien
tacaagcccaaccttccataactga

SEQ ID NO: 478648 - DNA, 25 bp, Homo sapien
caagcccaaccttccataactgaaa

SEQ ID NO: 478649 - DNA, 25 bp, Homo sapien
gcccaaccttccataactgaaaact

SEQ ID NO: 478650 - DNA, 25 bp, Homo sapien
ttccataactgaaaactaactttct

SEQ ID NO: 478651 - DNA, 25 bp, Homo sapien
atgttccaggatctaagaaaatgtc

SEQ ID NO: 478652 - DNA, 25 bp, Homo sapien
tgttccaggatctaagaaaatgtcc

SEQ ID NO: 478653 - DNA, 25 bp, Homo sapien
gttccaggatctaagaaaatgtcca

SEQ ID NO: 478654 - DNA, 25 bp, Homo sapien
ttccaggatctaagaaaatgtccaa

SEQ ID NO: 478655 - DNA, 25 bp, Homo sapien
tccaggatctaagaaaatgtccaat

SEQ ID NO: 478656 - DNA, 25 bp, Homo sapien
ccaggatctaagaaaatgtccaatg

SEQ ID NO: 478657 - DNA, 25 bp, Homo sapien
caggatctaagaaaatgtccaatgg

SEQ ID NO: 478658 - DNA, 25 bp, Homo sapien
aggatctaagaaaatgtccaatggg

SEQ ID NO: 478659 - DNA, 25 bp, Homo sapien
atctaagaaaatgtccaatgggccg

SEQ ID NO: 478660 - DNA, 25 bp, Homo sapien
aagaaaatgtccaatgggccgggca

SEQ ID NO: 478661 - DNA, 25 bp, Homo sapien
gaaaatgtccaatgggccgggcaca

SEQ ID NO: 478662 - DNA, 25 bp, Homo sapien
gaacccagaccccagcactgtgatg

SEQ ID NO: 478663 - DNA, 25 bp, Homo sapien
ccagaccccagcactgtgatgggag

SEQ ID NO: 478664 - DNA, 25 bp, Homo sapien
gcactgtgatgggagtccacggcta

SEQ ID NO: 478665 - DNA, 25 bp, Homo sapien
agcgcctcttggaccctgcgggatg

SEQ ID NO: 478666 - DNA, 25 bp, Homo sapien
cctcttggaccctgcgggatgccgg

SEQ ID NO: 478667 - DNA, 25 bp, Homo sapien
acggacagacaggaccaggatcaca

SEQ ID NO: 478668 - DNA, 25 bp, Homo sapien
acctccaggcgcctctggttggaca

SEQ ID NO: 478669 - DNA, 25 bp, Homo sapien
tggttggacattccaggtcgtgccc

SEQ ID NO: 478670 - DNA, 25 bp, Homo sapien
tggacattccaggtcgtgccctggg

SEQ ID NO: 478671 - DNA, 25 bp, Homo sapien
cctggtgcagctggcagcatgtggg

SEQ ID NO: 478672 - DNA, 25 bp, Homo sapien
cagctgcctggagccagaacggttt

SEQ ID NO: 478673 - DNA, 25 bp, Homo sapien
aagaggccttgaagtttctcctcac

SEQ ID NO: 478674 - DNA, 25 bp, Homo sapien
caccatgctgtgagaagcctgggca

SEQ ID NO: 478675 - DNA, 25 bp, Homo sapien
agaagcctgggcatatctactggag

SEQ ID NO: 478676 - DNA, 25 bp, Homo sapien
ctgggcatatctactggaggccgag

SEQ ID NO: 478677 - DNA, 25 bp, Homo sapien
acatgacacgtctaaaactcatacg

SEQ ID NO: 478678 - DNA, 25 bp, Homo sapien
aaactcatacgtcaagatatgcttg

SEQ ID NO: 478679 - DNA, 25 bp, Homo sapien
tatgcttgaaagctgcacccatcaa

SEQ ID NO: 478680 - DNA, 25 bp, Homo sapien
tgcacccatcaagtgcgtcctgaat

SEQ ID NO: 478681 - DNA, 25 bp, Homo sapien
aagtgcgtcctgaatctgacgattc

SEQ ID NO: 478682 - DNA, 25 bp, Homo sapien
tctgacgattcactatcttcacttc

SEQ ID NO: 478683 - DNA, 25 bp, Homo sapien
attcactatcttcacttccgccagt

SEQ ID NO: 478684 - DNA, 25 bp, Homo sapien
gaaaatcaggtaaatccagcagaaa

SEQ ID NO: 478685 - DNA, 25 bp, Homo sapien
caggtaaatccagcagaaatgtttc

SEQ ID NO: 478686 - DNA, 25 bp, Homo sapien
tctctctccatgtttcatgtctgta

SEQ ID NO: 478687 - DNA, 25 bp, Homo sapien
tccatgtttcatgtctgtagaagaa

SEQ ID NO: 478688 - DNA, 25 bp, Homo sapien
ttcatgtctgtagaagaaacgtgag

SEQ ID NO: 478689 - DNA, 25 bp, Homo sapien
aaacgtgaggttatttccatgaagg

SEQ ID NO: 478690 - DNA, 25 bp, Homo sapien
ccatgaaggattgaaaaactttctt

SEQ ID NO: 478691 - DNA, 25 bp, Homo sapien
aaactttcttatatacacagtaact

SEQ ID NO: 478692 - DNA, 25 bp, Homo sapien
tacacagtaacttttttactgtcct

SEQ ID NO: 478693 - DNA, 25 bp, Homo sapien
tactgtcctcctttctgcaaaggga

SEQ ID NO: 478694 - DNA, 25 bp, Homo sapien
gtcctcctttctgcaaagggacaag

SEQ ID NO: 478695 - DNA, 25 bp, Homo sapien
tgcatctggaaatcttgacaaaaat

SEQ ID NO: 478696 - DNA, 25 bp, Homo sapien
gccagattttctgccatctacaggc

SEQ ID NO: 478697 - DNA, 25 bp, Homo sapien
tttctgccatctacaggcaagacag

SEQ ID NO: 478698 - DNA, 25 bp, Homo sapien
acagcaataagctatccaatgatga

SEQ ID NO: 478699 - DNA, 25 bp, Homo sapien
atgatgacatgctcaagttacttgc

SEQ ID NO: 478700 - DNA, 25 bp, Homo sapien
gttacttgcagactttcggaaacct

SEQ ID NO: 478701 - DNA, 25 bp, Homo sapien
tttcggaaacctgagaagatggcta

SEQ ID NO: 478702 - DNA, 25 bp, Homo sapien
gatggctaagctcccagtgatttta

SEQ ID NO: 478703 - DNA, 25 bp, Homo sapien
gctcccagtgattttaggcaatcta

SEQ ID NO: 478704 - DNA, 25 bp, Homo sapien
tgataatgtttcctcagacttccct

SEQ ID NO: 478705 - DNA, 25 bp, Homo sapien
gtttcctcagacttccctaattatg

SEQ ID NO: 478706 - DNA, 25 bp, Homo sapien
ggcctgtatagccaagaagaagaca

SEQ ID NO: 478707 - DNA, 25 bp, Homo sapien
gcacgaaaaacccttgatcctttgt

SEQ ID NO: 478708 - DNA, 25 bp, Homo sapien
tgatcctttgtatcagcagtctctg

SEQ ID NO: 478709 - DNA, 25 bp, Homo sapien
gaatggaccacaaatgctttatggg

SEQ ID NO: 478710 - DNA, 25 bp, Homo sapien
gctttatgggtgtggctcagatctt

SEQ ID NO: 478711 - DNA, 25 bp, Homo sapien
ttggaagaactcgacctgtccagca

SEQ ID NO: 478712 - DNA, 25 bp, Homo sapien
aagaactcgacctgtccagcatggt

SEQ ID NO: 478713 - DNA, 25 bp, Homo sapien
gtccagcatggtgatcggatggtac

SEQ ID NO: 478714 - DNA, 25 bp, Homo sapien
atcggatggtacaaattgttcccac

SEQ ID NO: 478715 - DNA, 25 bp, Homo sapien
aaattgttcccaccgtcctcactgg

SEQ ID NO: 478716 - DNA, 25 bp, Homo sapien
ggcgggcttcccagtcatctctgga

SEQ ID NO: 478717 - DNA, 25 bp, Homo sapien
aaggtggaaattattgacatgttat

SEQ ID NO: 478718 - DNA, 25 bp, Homo sapien
atatgatcttactacattgaccatg

SEQ ID NO: 478719 - DNA, 25 bp, Homo sapien
gatcttactacattgaccatgcaaa

SEQ ID NO: 478720 - DNA, 25 bp, Homo sapien
tacattgaccatgcaaattctgagg

SEQ ID NO: 478721 - DNA, 25 bp, Homo sapien
gaccatgcaaattctgaggttcata

SEQ ID NO: 478722 - DNA, 25 bp, Homo sapien
gaggttcatattgaatctaaagtca

SEQ ID NO: 478723 - DNA, 25 bp, Homo sapien
aaatctcaataaaatccctaatact

SEQ ID NO: 478724 - DNA, 25 bp, Homo sapien
tatgtatatattgcccatagacatg

SEQ ID NO: 478725 - DNA, 25 bp, Homo sapien
tatattgcccatagacatgtagtat

SEQ ID NO: 478726 - DNA, 25 bp, Homo sapien
gcccatagacatgtagtatgtattc

SEQ ID NO: 478727 - DNA, 25 bp, Homo sapien
gtatgtattcatgtatcatatatgt

SEQ ID NO: 478728 - DNA, 25 bp, Homo sapien
tcttgggcctcttataaacttggga

SEQ ID NO: 478729 - DNA, 25 bp, Homo sapien
ggcctcttataaacttgggaattct

SEQ ID NO: 478730 - DNA, 25 bp, Homo sapien
gaaagctgcttctattaccaggctg

SEQ ID NO: 478731 - DNA, 25 bp, Homo sapien
gctgcttctattaccaggctgtaat

SEQ ID NO: 478732 - DNA, 25 bp, Homo sapien
gatgttctgttattagtctgagaca

SEQ ID NO: 478733 - DNA, 25 bp, Homo sapien
aaatatcagtcagtgctccgggagg

SEQ ID NO: 478734 - DNA, 25 bp, Homo sapien
tgctccgggaggtaatttcctgtgg

SEQ ID NO: 478735 - DNA, 25 bp, Homo sapien
tgcaccctcctgtctgggtggtgga

SEQ ID NO: 478736 - DNA, 25 bp, Homo sapien
gtggtaccgtgtgggctcttaccct

SEQ ID NO: 478737 - DNA, 25 bp, Homo sapien
gggctcttaccctttatgtgatttt

SEQ ID NO: 478738 - DNA, 25 bp, Homo sapien
taccctttatgtgattttggacaac

SEQ ID NO: 478739 - DNA, 25 bp, Homo sapien
ttcatcccactcttcaattcataaa

SEQ ID NO: 478740 - DNA, 25 bp, Homo sapien
ggagattcttcaattcactgggcaa

SEQ ID NO: 478741 - DNA, 25 bp, Homo sapien
atatgcctaagtctatcctctgatg

SEQ ID NO: 478742 - DNA, 25 bp, Homo sapien
gaggctcgtacatgcaaaatccaat

SEQ ID NO: 478743 - DNA, 25 bp, Homo sapien
atccaatagcaacctgggaagattt

SEQ ID NO: 478744 - DNA, 25 bp, Homo sapien
gaggctggcatcaggctctcggtca

SEQ ID NO: 478745 - DNA, 25 bp, Homo sapien
ggtcaccgatcttcacattcaggtt

SEQ ID NO: 478746 - DNA, 25 bp, Homo sapien
aggtttcctgatgcactttgcgact

SEQ ID NO: 478747 - DNA, 25 bp, Homo sapien
atgcactttgcgactctttgggcaa

SEQ ID NO: 478748 - DNA, 25 bp, Homo sapien
ttgggcaacctctggactccttgtt

SEQ ID NO: 478749 - DNA, 25 bp, Homo sapien
tgttcccagggtccacatttagttt

SEQ ID NO: 478750 - DNA, 25 bp, Homo sapien
aactattgacagatataacccatat

SEQ ID NO: 478751 - DNA, 25 bp, Homo sapien
aagttctttgggatcctcaataatc

SEQ ID NO: 478752 - DNA, 25 bp, Homo sapien
tgatcctgagactgaacgctggaga

SEQ ID NO: 478753 - DNA, 25 bp, Homo sapien
ctgaacgctggagaacgagactgct

SEQ ID NO: 478754 - DNA, 25 bp, Homo sapien
gaacgagactgctctacagcatcat

SEQ ID NO: 478755 - DNA, 25 bp, Homo sapien
atgactgcatagtgtccctttgtgt

SEQ ID NO: 478756 - DNA, 25 bp, Homo sapien
tgtgtggctcttccctaatttgttt

SEQ ID NO: 478757 - DNA, 25 bp, Homo sapien
tgtttaccccatttccttaatgatg

SEQ ID NO: 478758 - DNA, 25 bp, Homo sapien
gatggacctgcaggttgtttccaac

SEQ ID NO: 478759 - DNA, 25 bp, Homo sapien
ttccaacctttcactatcataaaat

SEQ ID NO: 478760 - DNA, 25 bp, Homo sapien
gctacacaatcactcagtactcatg

SEQ ID NO: 478761 - DNA, 25 bp, Homo sapien
aagtaattgttcttgttccgcctca

SEQ ID NO: 478762 - DNA, 25 bp, Homo sapien
taattgttcttgttccgcctcacaa

SEQ ID NO: 478763 - DNA, 25 bp, Homo sapien
attgttcttgttccgcctcacaaga

SEQ ID NO: 478764 - DNA, 25 bp, Homo sapien
ttgttccgcctcacaagaatgtggg

SEQ ID NO: 478765 - DNA, 25 bp, Homo sapien
ggtctgggttgcattgttagtttca

SEQ ID NO: 478766 - DNA, 25 bp, Homo sapien
ctgggttgcattgttagtttcattt

SEQ ID NO: 478767 - DNA, 25 bp, Homo sapien
ggttgcattgttagtttcatttgtg

SEQ ID NO: 478768 - DNA, 25 bp, Homo sapien
actgcttgtcaagagtgagcctcaa

SEQ ID NO: 478769 - DNA, 25 bp, Homo sapien
ttgtcaagagtgagcctcaagtcaa

SEQ ID NO: 478770 - DNA, 25 bp, Homo sapien
gagtgagcctcaagtcaaggcagtt

SEQ ID NO: 478771 - DNA, 25 bp, Homo sapien
gagcctcaagtcaaggcagttgtgc

SEQ ID NO: 478772 - DNA, 25 bp, Homo sapien
cccatctccatatatgtcttacctg

SEQ ID NO: 478773 - DNA, 25 bp, Homo sapien
tctccatatatgtcttacctgtctc

SEQ ID NO: 478774 - DNA, 25 bp, Homo sapien
ccatatatgtcttacctgtctctca

SEQ ID NO: 478775 - DNA, 25 bp, Homo sapien
tgtctctcactcagactgcaagcat

SEQ ID NO: 478776 - DNA, 25 bp, Homo sapien
gactgcaagcatccaagttgccata

SEQ ID NO: 478777 - DNA, 25 bp, Homo sapien
gcaagcatccaagttgccataaaaa

SEQ ID NO: 478778 - DNA, 25 bp, Homo sapien
agaagctggagctgtgaaatttgtc

SEQ ID NO: 478779 - DNA, 25 bp, Homo sapien
ggtctatctggtgttgtggaacctt

SEQ ID NO: 478780 - DNA, 25 bp, Homo sapien
tggtgttgtggaaccttttactgtt

SEQ ID NO: 478781 - DNA, 25 bp, Homo sapien
actgttttcagtacacaattaggaa

SEQ ID NO: 478782 - DNA, 25 bp, Homo sapien
gtacacaattaggaatcaactgttt

SEQ ID NO: 478783 - DNA, 25 bp, Homo sapien
gcacatacctctagtacaaaagatg

SEQ ID NO: 478784 - DNA, 25 bp, Homo sapien
catacctctagtacaaaagatgttt

SEQ ID NO: 478785 - DNA, 25 bp, Homo sapien
tatacaagcaagagcaacagctcta

SEQ ID NO: 478786 - DNA, 25 bp, Homo sapien
gagaggcaatattcaactcccagtt

SEQ ID NO: 478787 - DNA, 25 bp, Homo sapien
agaggcaatattcaactcccagttc

SEQ ID NO: 478788 - DNA, 25 bp, Homo sapien
aagcctggtgttgaaagaaatccaa

SEQ ID NO: 478789 - DNA, 25 bp, Homo sapien
agagcaacagctctatatctggatc

SEQ ID NO: 478790 - DNA, 25 bp, Homo sapien
tctatatctggatcactgcagtgcc

SEQ ID NO: 478791 - DNA, 25 bp, Homo sapien
gcagtgcctagaagatacaacagca

SEQ ID NO: 478792 - DNA, 25 bp, Homo sapien
gaagatacaacagcacaatttacaa

SEQ ID NO: 478793 - DNA, 25 bp, Homo sapien
tacaacagcacaatttacaaatcca

SEQ ID NO: 478794 - DNA, 25 bp, Homo sapien
ttggatatcacttgcaaagagattt

SEQ ID NO: 478795 - DNA, 25 bp, Homo sapien
aagaactgtatgtagatgcctggct

SEQ ID NO: 478796 - DNA, 25 bp, Homo sapien
aactgtatgtagatgcctggctgaa

SEQ ID NO: 478797 - DNA, 25 bp, Homo sapien
ctgtatgtagatgcctggctgaaat

SEQ ID NO: 478798 - DNA, 25 bp, Homo sapien
gtaaggaattgagtggcagtagatt

SEQ ID NO: 478799 - DNA, 25 bp, Homo sapien
agtcgttacacaccatatgcagcca

SEQ ID NO: 478800 - DNA, 25 bp, Homo sapien
cgttacacaccatatgcagccatat

SEQ ID NO: 478801 - DNA, 25 bp, Homo sapien
gtatgccacactaaaaatcattatg

SEQ ID NO: 478802 - DNA, 25 bp, Homo sapien
cagacggcctctctataagaatatg

SEQ ID NO: 478803 - DNA, 25 bp, Homo sapien
taagaatatggtcctctctgtaggt

SEQ ID NO: 478804 - DNA, 25 bp, Homo sapien
accatgttcagtgactttggatatc

SEQ ID NO: 478805 - DNA, 25 bp, Homo sapien
tcccggactgagtgggatcaacctg

SEQ ID NO: 478806 - DNA, 25 bp, Homo sapien
tgggatcaacctgaccacctatgtt

SEQ ID NO: 478807 - DNA, 25 bp, Homo sapien
tgaccacctatgttcagcctggctg

SEQ ID NO: 478808 - DNA, 25 bp, Homo sapien
tcagcctggctgtgagagtccctgt

SEQ ID NO: 478809 - DNA, 25 bp, Homo sapien
acaggttccgtgaggtggctgccca

SEQ ID NO: 478810 - DNA, 25 bp, Homo sapien
aggtggctgcccaatgtcctctgca

SEQ ID NO: 478811 - DNA, 25 bp, Homo sapien
agcactcactactgcctacatcaag

SEQ ID NO: 478812 - DNA, 25 bp, Homo sapien
aattatttgcacatttgggtaccat

SEQ ID NO: 478813 - DNA, 25 bp, Homo sapien
ttgggtaccattggagacctccctt

SEQ ID NO: 478814 - DNA, 25 bp, Homo sapien
acctcccttctgtcttttaggctat

SEQ ID NO: 478815 - DNA, 25 bp, Homo sapien
taggctatttcatcactctttgaga

SEQ ID NO: 478816 - DNA, 25 bp, Homo sapien
tggtggaaagactgcaggccatgct

SEQ ID NO: 478817 - DNA, 25 bp, Homo sapien
tggaaagactgcaggccatgctgca

SEQ ID NO: 478818 - DNA, 25 bp, Homo sapien
aggcccactgggatgaggccaacca

SEQ ID NO: 478819 - DNA, 25 bp, Homo sapien
tggactatgcctcccatggccgtgg

SEQ ID NO: 478820 - DNA, 25 bp, Homo sapien
atggccgtggcctgaagcctgtatt

SEQ ID NO: 478821 - DNA, 25 bp, Homo sapien
gccgtggcctgaagcctgtattgca

SEQ ID NO: 478822 - DNA, 25 bp, Homo sapien
gtggcctgaagcctgtattgcagca

SEQ ID NO: 478823 - DNA, 25 bp, Homo sapien
tggcctgaagcctgtattgcagcag

SEQ ID NO: 478824 - DNA, 25 bp, Homo sapien
gcctgtattgcagcagagccgggaa

SEQ ID NO: 478825 - DNA, 25 bp, Homo sapien
aagggacgagctacctggagcgcct

SEQ ID NO: 478826 - DNA, 25 bp, Homo sapien
tggagcgcctcctgttctttgcagt

SEQ ID NO: 478827 - DNA, 25 bp, Homo sapien
atttgtctgtcagcctttcagtcat

SEQ ID NO: 478828 - DNA, 25 bp, Homo sapien
tttgtctgtcagcctttcagtcatt

SEQ ID NO: 478829 - DNA, 25 bp, Homo sapien
ttgtctgtcagcctttcagtcattc

SEQ ID NO: 478830 - DNA, 25 bp, Homo sapien
tgtctgtcagcctttcagtcattct

SEQ ID NO: 478831 - DNA, 25 bp, Homo sapien
gtctgtcagcctttcagtcattctt

SEQ ID NO: 478832 - DNA, 25 bp, Homo sapien
tctgtcagcctttcagtcattcttt

SEQ ID NO: 478833 - DNA, 25 bp, Homo sapien
gttcaagtttgccagaatttttcta

SEQ ID NO: 478834 - DNA, 25 bp, Homo sapien
ttttgagcctacagaatatccttcc

SEQ ID NO: 478835 - DNA, 25 bp, Homo sapien
tttgagcctacagaatatccttccc

SEQ ID NO: 478836 - DNA, 25 bp, Homo sapien
ttgagcctacagaatatccttccca

SEQ ID NO: 478837 - DNA, 25 bp, Homo sapien
tatttgtctgtcagcctttcagtca

SEQ ID NO: 478838 - DNA, 25 bp, Homo sapien
atacatgcaatgtggctggtgaaca

SEQ ID NO: 478839 - DNA, 25 bp, Homo sapien
ggctggtgaacacttctgaattcag

SEQ ID NO: 478840 - DNA, 25 bp, Homo sapien
gaaactatcccagatctcagctaga

SEQ ID NO: 478841 - DNA, 25 bp, Homo sapien
agaaccatccactgttctgtttgtc

SEQ ID NO: 478842 - DNA, 25 bp, Homo sapien
gttctgtttgtccagtttcaactta

SEQ ID NO: 478843 - DNA, 25 bp, Homo sapien
aacttaagggatctccatgcggtcc

SEQ ID NO: 478844 - DNA, 25 bp, Homo sapien
gcggtccctggaagtacccattgaa

SEQ ID NO: 478845 - DNA, 25 bp, Homo sapien
gcgtatttgtgtatagcagaactct

SEQ ID NO: 478846 - DNA, 25 bp, Homo sapien
ttataggtgattttccctttccgca

SEQ ID NO: 478847 - DNA, 25 bp, Homo sapien
tgattttccctttccgcatgataaa

SEQ ID NO: 478848 - DNA, 25 bp, Homo sapien
atatttgactgacttgaccgtaagt

SEQ ID NO: 478849 - DNA, 25 bp, Homo sapien
tggttccaatgcctctgacaaactg

SEQ ID NO: 478850 - DNA, 25 bp, Homo sapien
gacaaactggctgcttgatctctag

SEQ ID NO: 478851 - DNA, 25 bp, Homo sapien
ggctgcttgatctctaggttgtgac

SEQ ID NO: 478852 - DNA, 25 bp, Homo sapien
gatctctaggttgtgaccatgtcag

SEQ ID NO: 478853 - DNA, 25 bp, Homo sapien
accatgtcagggatagaggcagctt

SEQ ID NO: 478854 - DNA, 25 bp, Homo sapien
gcagcttaggtagaggtagactttc

SEQ ID NO: 478855 - DNA, 25 bp, Homo sapien
ggtagactttcttgtactcaacatt

SEQ ID NO: 478856 - DNA, 25 bp, Homo sapien
actcaacattgaattgtggcttagt

SEQ ID NO: 478857 - DNA, 25 bp, Homo sapien
gaactttcattcttggaataataca

SEQ ID NO: 478858 - DNA, 25 bp, Homo sapien
aagggtaagccaaatgattaacaca

SEQ ID NO: 478859 - DNA, 25 bp, Homo sapien
aacacatttacttaattacacattg

SEQ ID NO: 478860 - DNA, 25 bp, Homo sapien
ttcaggaaccgcacggcaaccttgt

SEQ ID NO: 478861 - DNA, 25 bp, Homo sapien
ggaaccgcacggcaaccttgtggtt

SEQ ID NO: 478862 - DNA, 25 bp, Homo sapien
cacggcaaccttgtggttcttccgg

SEQ ID NO: 478863 - DNA, 25 bp, Homo sapien
tccagcagcttctggtgcctgagcc

SEQ ID NO: 478864 - DNA, 25 bp, Homo sapien
tgagcccgagctccttctgggtgtt

SEQ ID NO: 478865 - DNA, 25 bp, Homo sapien
ctgatcctcagcagtcggttccgct

SEQ ID NO: 478866 - DNA, 25 bp, Homo sapien
agctgctcggctgcgcgcacctgga

SEQ ID NO: 478867 - DNA, 25 bp, Homo sapien
tcctcacggtcagctgtccggaagg

SEQ ID NO: 478868 - DNA, 25 bp, Homo sapien
gtcagctgtccggaaggcctcgagt

SEQ ID NO: 478869 - DNA, 25 bp, Homo sapien
agctgtccggaaggcctcgagtcgc

SEQ ID NO: 478870 - DNA, 25 bp, Homo sapien
ctcctggatctcgatgtgccacatg

SEQ ID NO: 478871 - DNA, 25 bp, Homo sapien
gcacccggcctgcttattcattttc

SEQ ID NO: 478872 - DNA, 25 bp, Homo sapien
aggaaaacaactcattttttgtgca

SEQ ID NO: 478873 - DNA, 25 bp, Homo sapien
ttttttgtgcattgatcttgtatcc

SEQ ID NO: 478874 - DNA, 25 bp, Homo sapien
tttgtgcattgatcttgtatcctgg

SEQ ID NO: 478875 - DNA, 25 bp, Homo sapien
tgtgcattgatcttgtatcctggac

SEQ ID NO: 478876 - DNA, 25 bp, Homo sapien
gtgcattgatcttgtatcctggact

SEQ ID NO: 478877 - DNA, 25 bp, Homo sapien
tgcattgatcttgtatcctggactg

SEQ ID NO: 478878 - DNA, 25 bp, Homo sapien
gcattgatcttgtatcctggactgt

SEQ ID NO: 478879 - DNA, 25 bp, Homo sapien
cattgatcttgtatcctggactgtt

SEQ ID NO: 478880 - DNA, 25 bp, Homo sapien
attgatcttgtatcctggactgtta

SEQ ID NO: 478881 - DNA, 25 bp, Homo sapien
ttgatcttgtatcctggactgttaa

SEQ ID NO: 478882 - DNA, 25 bp, Homo sapien
cacccaccacctcaagggtagggag

SEQ ID NO: 478883 - DNA, 25 bp, Homo sapien
ccaccacctcaagggtagggagttg

SEQ ID NO: 478884 - DNA, 25 bp, Homo sapien
accacctcaagggtagggagttgct

SEQ ID NO: 478885 - DNA, 25 bp, Homo sapien
cacctcaagggtagggagttgctct

SEQ ID NO: 478886 - DNA, 25 bp, Homo sapien
acctcaagggtagggagttgctctt

SEQ ID NO: 478887 - DNA, 25 bp, Homo sapien
ctcaagggtagggagttgctcttcc

SEQ ID NO: 478888 - DNA, 25 bp, Homo sapien
ggagttgctcttcctacctgtttta

SEQ ID NO: 478889 - DNA, 25 bp, Homo sapien
gagttgctcttcctacctgttttat

SEQ ID NO: 478890 - DNA, 25 bp, Homo sapien
agttgctcttcctacctgttttatt

SEQ ID NO: 478891 - DNA, 25 bp, Homo sapien
tttttctggagtgtgtggtgaaaca

SEQ ID NO: 478892 - DNA, 25 bp, Homo sapien
ctggagtgtgtggtgaaacagaaaa

SEQ ID NO: 478893 - DNA, 25 bp, Homo sapien
gctgagcagcccgttatcacgaagg

SEQ ID NO: 478894 - DNA, 25 bp, Homo sapien
gaagggcccctcagaagatggccag

SEQ ID NO: 478895 - DNA, 25 bp, Homo sapien
ctcagggcttcaccgcagagcaata

SEQ ID NO: 478896 - DNA, 25 bp, Homo sapien
accgcagagcaatacacgtttcctt

SEQ ID NO: 478897 - DNA, 25 bp, Homo sapien
acgtttccttgagaagcccatttct

SEQ ID NO: 478898 - DNA, 25 bp, Homo sapien
atttctcatctcttcatactagctc

SEQ ID NO: 478899 - DNA, 25 bp, Homo sapien
atactagctcacactatgcattgaa

SEQ ID NO: 478900 - DNA, 25 bp, Homo sapien
tgaagacaccttttcagaccaacca

SEQ ID NO: 478901 - DNA, 25 bp, Homo sapien
aatacttttcctaggactccagtct

SEQ ID NO: 478902 - DNA, 25 bp, Homo sapien
actccagtctaactcctatatcatg

SEQ ID NO: 478903 - DNA, 25 bp, Homo sapien
tatatcatgttgtctgctttctaat

SEQ ID NO: 478904 - DNA, 25 bp, Homo sapien
ggtggccactcaaaatttcaaattc

SEQ ID NO: 478905 - DNA, 25 bp, Homo sapien
atttcaaattctctttaagatgacc

SEQ ID NO: 478906 - DNA, 25 bp, Homo sapien
attctctttaagatgaccattcagg

SEQ ID NO: 478907 - DNA, 25 bp, Homo sapien
ttctctttaagatgaccattcaggt

SEQ ID NO: 478908 - DNA, 25 bp, Homo sapien
tctctttaagatgaccattcaggtc

SEQ ID NO: 478909 - DNA, 25 bp, Homo sapien
taagatgaccattcaggtcaggcat

SEQ ID NO: 478910 - DNA, 25 bp, Homo sapien
aagatgaccattcaggtcaggcatg

SEQ ID NO: 478911 - DNA, 25 bp, Homo sapien
agatgaccattcaggtcaggcatgg

SEQ ID NO: 478912 - DNA, 25 bp, Homo sapien
aagtacaaaacgttagatgggcgtg

SEQ ID NO: 478913 - DNA, 25 bp, Homo sapien
gtacaaaacgttagatgggcgtggt

SEQ ID NO: 478914 - DNA, 25 bp, Homo sapien
tgggcgcctgtagaggcaggagaga

SEQ ID NO: 478915 - DNA, 25 bp, Homo sapien
gatagaacctgcacattgcccatta

SEQ ID NO: 478916 - DNA, 25 bp, Homo sapien
attgcccattaatgcacacttgtgt

SEQ ID NO: 478917 - DNA, 25 bp, Homo sapien
gcacacttgtgtatgcctattacag

SEQ ID NO: 478918 - DNA, 25 bp, Homo sapien
aagccattacatattccttcccttg

SEQ ID NO: 478919 - DNA, 25 bp, Homo sapien
ttgcacagtctgaatcatcccgaca

SEQ ID NO: 478920 - DNA, 25 bp, Homo sapien
gacacttctcagactttgacttgaa

SEQ ID NO: 478921 - DNA, 25 bp, Homo sapien
gactttgacttgaatgcacactgtg

SEQ ID NO: 478922 - DNA, 25 bp, Homo sapien
atgcacactgtgctgtacaacaagg

SEQ ID NO: 478923 - DNA, 25 bp, Homo sapien
aaggaccttgacttggactgcactg

SEQ ID NO: 478924 - DNA, 25 bp, Homo sapien
tgacttggactgcactgtttcccag

SEQ ID NO: 478925 - DNA, 25 bp, Homo sapien
tttcccaggtttcagtttgcatttt

SEQ ID NO: 478926 - DNA, 25 bp, Homo sapien
agctcctctcgattaaatgctgagc

SEQ ID NO: 478927 - DNA, 25 bp, Homo sapien
taaatgctgagcctgtcgttttccc

SEQ ID NO: 478928 - DNA, 25 bp, Homo sapien
tgtcgttttccccaggtcagtggcc

SEQ ID NO: 478929 - DNA, 25 bp, Homo sapien
cgcgtccccaacgtggtggtgtgca

SEQ ID NO: 478930 - DNA, 25 bp, Homo sapien
agagggcgggcttgcttttctcctt

SEQ ID NO: 478931 - DNA, 25 bp, Homo sapien
ttctcctttaagtccgaaactgact

SEQ ID NO: 478932 - DNA, 25 bp, Homo sapien
agtccgaaactgactcccggagaat

SEQ ID NO: 478933 - DNA, 25 bp, Homo sapien
gactcccggagaatttatagacatg

SEQ ID NO: 478934 - DNA, 25 bp, Homo sapien
ccgcgtttgtgggtgctggtcaaca

SEQ ID NO: 478935 - DNA, 25 bp, Homo sapien
tgctggtcaacaccttgctccacaa

SEQ ID NO: 478936 - DNA, 25 bp, Homo sapien
aatacttttgtgagttgtgacgaaa

SEQ ID NO: 478937 - DNA, 25 bp, Homo sapien
agtgcactgactgcccggaacgcgt

SEQ ID NO: 478938 - DNA, 25 bp, Homo sapien
gaacgcgtaactcaccttctgaaaa

SEQ ID NO: 478939 - DNA, 25 bp, Homo sapien
cttctgaaaaagtcacactcccatt

SEQ ID NO: 478940 - DNA, 25 bp, Homo sapien
cactcccatttctctactttaacaa

SEQ ID NO: 478941 - DNA, 25 bp, Homo sapien
ttctctactttaacaaacctcctgc

SEQ ID NO: 478942 - DNA, 25 bp, Homo sapien
aagcagggaaccgagcactgggctc

SEQ ID NO: 478943 - DNA, 25 bp, Homo sapien
gcactgggctcatctattaagacct

SEQ ID NO: 478944 - DNA, 25 bp, Homo sapien
tcatctattaagacctgggccttct

SEQ ID NO: 478945 - DNA, 25 bp, Homo sapien
gaagcaatttccttcttcttaagat

SEQ ID NO: 478946 - DNA, 25 bp, Homo sapien
tcttcttaagatttcatggcatgtt

SEQ ID NO: 478947 - DNA, 25 bp, Homo sapien
atatctgttctttggccttgcaaaa

SEQ ID NO: 478948 - DNA, 25 bp, Homo sapien
gaatatctcatcctctcaaggcatc

SEQ ID NO: 478949 - DNA, 25 bp, Homo sapien
tcatcctctcaaggcatcaggacaa

SEQ ID NO: 478950 - DNA, 25 bp, Homo sapien
aaaatctccagtgttaactataatt

SEQ ID NO: 478951 - DNA, 25 bp, Homo sapien
agtgttaactataattttctgtctt

SEQ ID NO: 478952 - DNA, 25 bp, Homo sapien
ttttgtatcctaagtcctcatgatt

SEQ ID NO: 478953 - DNA, 25 bp, Homo sapien
atcctaagtcctcatgattattcct

SEQ ID NO: 478954 - DNA, 25 bp, Homo sapien
gattattcctttgaagtaacttcca

SEQ ID NO: 478955 - DNA, 25 bp, Homo sapien
tgaagtaacttccatttttgtccct

SEQ ID NO: 478956 - DNA, 25 bp, Homo sapien
tttttgtcccttcttacttctccat

SEQ ID NO: 478957 - DNA, 25 bp, Homo sapien
tatcagattgatacagtgtgttaca

SEQ ID NO: 478958 - DNA, 25 bp, Homo sapien
taaaccaaccctgcatccttaggat

SEQ ID NO: 478959 - DNA, 25 bp, Homo sapien
ggtgcagccggttctaggcaagatc

SEQ ID NO: 478960 - DNA, 25 bp, Homo sapien
ggttctaggcaagatcaggcagcat

SEQ ID NO: 478961 - DNA, 25 bp, Homo sapien
catcctcatgcctggtacagtgaaa

SEQ ID NO: 478962 - DNA, 25 bp, Homo sapien
tggacaagttgtcccatttctccat

SEQ ID NO: 478963 - DNA, 25 bp, Homo sapien
tcccatttctccatttgtctgtgat

SEQ ID NO: 478964 - DNA, 25 bp, Homo sapien
ttgtctgtgatgagatgtaactctt

SEQ ID NO: 478965 - DNA, 25 bp, Homo sapien
tgtaactctttgtgaccgaagagga

SEQ ID NO: 478966 - DNA, 25 bp, Homo sapien
ggaggttgaagtgtgcattgccaca

SEQ ID NO: 478967 - DNA, 25 bp, Homo sapien
attgccacaccagaggtactccatg

SEQ ID NO: 478968 - DNA, 25 bp, Homo sapien
ggtactccatgctgatatgctcaca

SEQ ID NO: 478969 - DNA, 25 bp, Homo sapien
caggtgcagccagtttgcataaaca

SEQ ID NO: 478970 - DNA, 25 bp, Homo sapien
aaaatatattgccatggtctcccat

SEQ ID NO: 478971 - DNA, 25 bp, Homo sapien
atggtctcccatgagcaacatcaga

SEQ ID NO: 478972 - DNA, 25 bp, Homo sapien
acaaggatgacttcagtgctgagtt

SEQ ID NO: 478973 - DNA, 25 bp, Homo sapien
gataagtgtgagtccttgcatacca

SEQ ID NO: 478974 - DNA, 25 bp, Homo sapien
gtccttgcataccagggtggagact

SEQ ID NO: 478975 - DNA, 25 bp, Homo sapien
ggtggagactacagctggaagattt

SEQ ID NO: 478976 - DNA, 25 bp, Homo sapien
agatttattattcttgccacacaag

SEQ ID NO: 478977 - DNA, 25 bp, Homo sapien
gcaccttcctccagttcaaaagagt

SEQ ID NO: 478978 - DNA, 25 bp, Homo sapien
aagagtgtcagactgttcatgaagt

SEQ ID NO: 478979 - DNA, 25 bp, Homo sapien
aagcagcctagtcacaattatgatg

SEQ ID NO: 478980 - DNA, 25 bp, Homo sapien
aagtggctcagactacaagacaaat

SEQ ID NO: 478981 - DNA, 25 bp, Homo sapien
ggagaccctgaacaacatcatggag

SEQ ID NO: 478982 - DNA, 25 bp, Homo sapien
gaccctgaacaacatcatggagtat

SEQ ID NO: 478983 - DNA, 25 bp, Homo sapien
ccctgaacaacatcatggagtatta

SEQ ID NO: 478984 - DNA, 25 bp, Homo sapien
gtattacaacgacggtaacgatcct

SEQ ID NO: 478985 - DNA, 25 bp, Homo sapien
tacaacgacggtaacgatcctccct

SEQ ID NO: 478986 - DNA, 25 bp, Homo sapien
cgacggtaacgatcctccctctgtg

SEQ ID NO: 478987 - DNA, 25 bp, Homo sapien
ggtggaaacggcacttacctgacct

SEQ ID NO: 478988 - DNA, 25 bp, Homo sapien
tggaaacggcacttacctgacctgg

SEQ ID NO: 478989 - DNA, 25 bp, Homo sapien
aaacggcacttacctgacctggttg

SEQ ID NO: 478990 - DNA, 25 bp, Homo sapien
acggcacttacctgacctggttgtt

SEQ ID NO: 478991 - DNA, 25 bp, Homo sapien
gcacttacctgacctggttgttggt

SEQ ID NO: 478992 - DNA, 25 bp, Homo sapien
tgcagatggggcagctcaatgccat

SEQ ID NO: 478993 - DNA, 25 bp, Homo sapien
ctactgcagcccactggaagacggg

SEQ ID NO: 478994 - DNA, 25 bp, Homo sapien
actgcagcccactggaagacgggaa

SEQ ID NO: 478995 - DNA, 25 bp, Homo sapien
tgcagcccactggaagacgggaaga

SEQ ID NO: 478996 - DNA, 25 bp, Homo sapien
gcccactggaagacgggaagaactt

SEQ ID NO: 478997 - DNA, 25 bp, Homo sapien
cgggaagaacttcaatcatggtgat

SEQ ID NO: 478998 - DNA, 25 bp, Homo sapien
gcagcagctccatggaaacaaccaa

SEQ ID NO: 478999 - DNA, 25 bp, Homo sapien
gcagctccatggaaacaaccaaaag

SEQ ID NO: 479000 - DNA, 25 bp, Homo sapien
gaaacaaccaaaagtccaccacctg

SEQ ID NO: 479001 - DNA, 25 bp, Homo sapien
accacctgcaggatagtggatgaca

SEQ ID NO: 479002 - DNA, 25 bp, Homo sapien
cctgcaggatagtggatgacaaagt

SEQ ID NO: 479003 - DNA, 25 bp, Homo sapien
tactgcagcccactggaagacggga

SEQ ID NO: 479004 - DNA, 25 bp, Homo sapien
tgcagcccactggaagacgggaaga

SEQ ID NO: 479005 - DNA, 25 bp, Homo sapien
gcccactggaagacgggaagaactt

SEQ ID NO: 479006 - DNA, 25 bp, Homo sapien
cgggaagaacttcaatcatggtgat

SEQ ID NO: 479007 - DNA, 25 bp, Homo sapien
ctggacagcagcagctccatggaaa

SEQ ID NO: 479008 - DNA, 25 bp, Homo sapien
gcagcagctccatggaaacaaccaa

SEQ ID NO: 479009 - DNA, 25 bp, Homo sapien
gcagctccatggaaacaaccaaaag

SEQ ID NO: 479010 - DNA, 25 bp, Homo sapien
gaaacaaccaaaagtccaccacctg

SEQ ID NO: 479011 - DNA, 25 bp, Homo sapien
accacctgcaggatagtggatgaca

SEQ ID NO: 479012 - DNA, 25 bp, Homo sapien
cctgcaggatagtggatgacaaagt

SEQ ID NO: 479013 - DNA, 25 bp, Homo sapien
aggtggaggtctgctatgccctgca

SEQ ID NO: 479014 - DNA, 25 bp, Homo sapien
ctcttggaaaggtaggaggctgccc

SEQ ID NO: 479015 - DNA, 25 bp, Homo sapien
tgctttctccctgttctctctttgt

SEQ ID NO: 479016 - DNA, 25 bp, Homo sapien
ttgtctctgtttgttcaagtttgcc

SEQ ID NO: 479017 - DNA, 25 bp, Homo sapien
tgtctctgtttgttcaagtttgcca

SEQ ID NO: 479018 - DNA, 25 bp, Homo sapien
gttctttatctttattgggttcaca

SEQ ID NO: 479019 - DNA, 25 bp, Homo sapien
atatattggattaaaccttttcatt

SEQ ID NO: 479020 - DNA, 25 bp, Homo sapien
tattggattaaaccttttcatttag

SEQ ID NO: 479021 - DNA, 25 bp, Homo sapien
gttttgagcctacagaatatccttc

SEQ ID NO: 479022 - DNA, 25 bp, Homo sapien
gaatatccttcccagtgaggtacac

SEQ ID NO: 479023 - DNA, 25 bp, Homo sapien
gtgaggtacacattatctccatttc

SEQ ID NO: 479024 - DNA, 25 bp, Homo sapien
ttatttgtctgtcagcctttcagtc

SEQ ID NO: 479025 - DNA, 25 bp, Homo sapien
gagctgatgaacgtcgggcttaccc

SEQ ID NO: 479026 - DNA, 25 bp, Homo sapien
agctgatgaacgtcgggcttaccct

SEQ ID NO: 479027 - DNA, 25 bp, Homo sapien
tgaacgtcgggcttaccctggacat

SEQ ID NO: 479028 - DNA, 25 bp, Homo sapien
gaacgtcgggcttaccctggacatc

SEQ ID NO: 479029 - DNA, 25 bp, Homo sapien
acgtcgggcttaccctggacatcga

SEQ ID NO: 479030 - DNA, 25 bp, Homo sapien
gtcgggcttaccctggacatcgaga

SEQ ID NO: 479031 - DNA, 25 bp, Homo sapien
ccggcatcatctaccgcctgggctc

SEQ ID NO: 479032 - DNA, 25 bp, Homo sapien
aagatcgagacccatgatggcaagc

SEQ ID NO: 479033 - DNA, 25 bp, Homo sapien
gatcgagacccatgatggcaagctg

SEQ ID NO: 479034 - DNA, 25 bp, Homo sapien
tcgagacccatgatggcaagctgga

SEQ ID NO: 479035 - DNA, 25 bp, Homo sapien
cgagacccatgatggcaagctggag

SEQ ID NO: 479036 - DNA, 25 bp, Homo sapien
cagaagtgcagactcattgctagat

SEQ ID NO: 479037 - DNA, 25 bp, Homo sapien
gactcattgctagattcagtgccct

SEQ ID NO: 479038 - DNA, 25 bp, Homo sapien
attgctagattcagtgcccttgagt

SEQ ID NO: 479039 - DNA, 25 bp, Homo sapien
agattcagtgcccttgagtgtgcca

SEQ ID NO: 479040 - DNA, 25 bp, Homo sapien
cagtgcccttgagtgtgccagaggt

SEQ ID NO: 479041 - DNA, 25 bp, Homo sapien
gagtgtgccagaggtcctctgtgtt

SEQ ID NO: 479042 - DNA, 25 bp, Homo sapien
tcctctgtgtttgagacaatcctgt

SEQ ID NO: 479043 - DNA, 25 bp, Homo sapien
gtttgagacaatcctgtgtgtgcca

SEQ ID NO: 479044 - DNA, 25 bp, Homo sapien
agaatcccgcttacccagctggaga

SEQ ID NO: 479045 - DNA, 25 bp, Homo sapien
aatctgtacctgaatgtgagctcct

SEQ ID NO: 479046 - DNA, 25 bp, Homo sapien
ataaaactctgaggctttggtgagc

SEQ ID NO: 479047 - DNA, 25 bp, Homo sapien
atctcactgtggtcaccctcttcta

SEQ ID NO: 479048 - DNA, 25 bp, Homo sapien
actgtggtcaccctcttctacagct

SEQ ID NO: 479049 - DNA, 25 bp, Homo sapien
accctcttctacagctcagtcattg

SEQ ID NO: 479050 - DNA, 25 bp, Homo sapien
ttctacagctcagtcattgctgtct

SEQ ID NO: 479051 - DNA, 25 bp, Homo sapien
acagctcagtcattgctgtctacct

SEQ ID NO: 479052 - DNA, 25 bp, Homo sapien
ctcagtcattgctgtctacctccag

SEQ ID NO: 479053 - DNA, 25 bp, Homo sapien
tgctgtctacctccagcccaaaaat

SEQ ID NO: 479054 - DNA, 25 bp, Homo sapien
tctttggtctcttctatgcagtggg

SEQ ID NO: 479055 - DNA, 25 bp, Homo sapien
ttggtctcttctatgcagtgggcac

SEQ ID NO: 479056 - DNA, 25 bp, Homo sapien
gtctcttctatgcagtgggcactcc

SEQ ID NO: 479057 - DNA, 25 bp, Homo sapien
tgggcactccttcacttaaccctct

SEQ ID NO: 479058 - DNA, 25 bp, Homo sapien
tcatctggactcaccagattctcat

SEQ ID NO: 479059 - DNA, 25 bp, Homo sapien
agattctcatcaaccagcattcttg

SEQ ID NO: 479060 - DNA, 25 bp, Homo sapien
accagcattcttgatgtagctcatc

SEQ ID NO: 479061 - DNA, 25 bp, Homo sapien
gctcatctatgagctgagttatggg

SEQ ID NO: 479062 - DNA, 25 bp, Homo sapien
ctgagttatgggaagctagttggaa

SEQ ID NO: 479063 - DNA, 25 bp, Homo sapien
cttagattgaatctggcctccaaat

SEQ ID NO: 479064 - DNA, 25 bp, Homo sapien
tgaatctggcctccaaatatatgct

SEQ ID NO: 479065 - DNA, 25 bp, Homo sapien
ttttacctctctaccaaatgaacat

SEQ ID NO: 479066 - DNA, 25 bp, Homo sapien
tgaaatctgtcaactatcttaattg

SEQ ID NO: 479067 - DNA, 25 bp, Homo sapien
ttgctctctgccataatttctcata

SEQ ID NO: 479068 - DNA, 25 bp, Homo sapien
taatttctcatatggagctattcca

SEQ ID NO: 479069 - DNA, 25 bp, Homo sapien
ctgaggctatcaaggtcctcataaa

SEQ ID NO: 479070 - DNA, 25 bp, Homo sapien
ggttaagcccagatgccaaagggtg

SEQ ID NO: 479071 - DNA, 25 bp, Homo sapien
agcccagatgccaaagggtgtcagc

SEQ ID NO: 479072 - DNA, 25 bp, Homo sapien
gggtgtcagcctcaagctcaatcaa

SEQ ID NO: 479073 - DNA, 25 bp, Homo sapien
tcaagctcaatcaatttgcctacat

SEQ ID NO: 479074 - DNA, 25 bp, Homo sapien
aatcaatttgcctacattacccacc

SEQ ID NO: 479075 - DNA, 25 bp, Homo sapien
tgcttgtgcccgcattgccaagggt

SEQ ID NO: 479076 - DNA, 25 bp, Homo sapien
tgtgcccgcattgccaagggtctca

SEQ ID NO: 479077 - DNA, 25 bp, Homo sapien
ccgcattgccaagggtctcaggttg

SEQ ID NO: 479078 - DNA, 25 bp, Homo sapien
cattgccaagggtctcaggttgtgt

SEQ ID NO: 479079 - DNA, 25 bp, Homo sapien
caagggtctcaggttgtgtgggcca

SEQ ID NO: 479080 - DNA, 25 bp, Homo sapien
tcctcggaccggagcccactgatgg

SEQ ID NO: 479081 - DNA, 25 bp, Homo sapien
gctggtaccagtatacataattact

SEQ ID NO: 479082 - DNA, 25 bp, Homo sapien
gtaccagtatacataattacttccg

SEQ ID NO: 479083 - DNA, 25 bp, Homo sapien
acataattacttccgatgttggagc

SEQ ID NO: 479084 - DNA, 25 bp, Homo sapien
ataattacttccgatgttggagctg

SEQ ID NO: 479085 - DNA, 25 bp, Homo sapien
cgccgaataccacataaaaccactc

SEQ ID NO: 479086 - DNA, 25 bp, Homo sapien
cataaaaccactcaatctgtcatcc

SEQ ID NO: 479087 - DNA, 25 bp, Homo sapien
aaaaccactcaatctgtcatcccat

SEQ ID NO: 479088 - DNA, 25 bp, Homo sapien
tgtcatcccatgctgcacagtaata

SEQ ID NO: 479089 - DNA, 25 bp, Homo sapien
gtcatcccatgctgcacagtaataa

SEQ ID NO: 479090 - DNA, 25 bp, Homo sapien
catcccatgctgcacagtaataatc

SEQ ID NO: 479091 - DNA, 25 bp, Homo sapien
ctgagtggggagtcttccaggcctc

SEQ ID NO: 479092 - DNA, 25 bp, Homo sapien
aggcctcctcagaggtcttcccttt

SEQ ID NO: 479093 - DNA, 25 bp, Homo sapien
cccaggacagggtgagtcagagctc

SEQ ID NO: 479094 - DNA, 25 bp, Homo sapien
agagctcagcatttaatctcctctc

SEQ ID NO: 479095 - DNA, 25 bp, Homo sapien
taatctcctctccaaagtagagagc

SEQ ID NO: 479096 - DNA, 25 bp, Homo sapien
aagtagagagcaagtcgcccacagt

SEQ ID NO: 479097 - DNA, 25 bp, Homo sapien
gtagagagcaagtcgcccacagtgg

SEQ ID NO: 479098 - DNA, 25 bp, Homo sapien
cccacagtgggcgtgtctgtaaata

SEQ ID NO: 479099 - DNA, 25 bp, Homo sapien
gtgggcgtgtctgtaaatattgtga

SEQ ID NO: 479100 - DNA, 25 bp, Homo sapien
tagggtgttcttgttttttgcttgg

SEQ ID NO: 479101 - DNA, 25 bp, Homo sapien
tatcttatcttttctgtggatcaga

SEQ ID NO: 479102 - DNA, 25 bp, Homo sapien
tagcagatgtgttgcctgtgaagga

SEQ ID NO: 479103 - DNA, 25 bp, Homo sapien
gaagcatcaaaggaaggcataagca

SEQ ID NO: 479104 - DNA, 25 bp, Homo sapien
gaatctaaaataccactttgaaaca

SEQ ID NO: 479105 - DNA, 25 bp, Homo sapien
gagaatccactgttttgataatgag

SEQ ID NO: 479106 - DNA, 25 bp, Homo sapien
gagaaatcaatgagagagccaggcc

SEQ ID NO: 479107 - DNA, 25 bp, Homo sapien
gagagccaggccatttccattaatc

SEQ ID NO: 479108 - DNA, 25 bp, Homo sapien
ggccatttccattaatcctataaaa

SEQ ID NO: 479109 - DNA, 25 bp, Homo sapien
agctaagggagatatctgttactaa

SEQ ID NO: 479110 - DNA, 25 bp, Homo sapien
atctgttactaaagaggacctacac

SEQ ID NO: 479111 - DNA, 25 bp, Homo sapien
aagaggacctacactgcctaaatga

SEQ ID NO: 479112 - DNA, 25 bp, Homo sapien
gacctacactgcctaaatgaaggaa

SEQ ID NO: 479113 - DNA, 25 bp, Homo sapien
tatcactttgaggtacagatcttct

SEQ ID NO: 479114 - DNA, 25 bp, Homo sapien
cactttgaggtacagatcttcttct

SEQ ID NO: 479115 - DNA, 25 bp, Homo sapien
gaggtacagatcttcttctcagtga

SEQ ID NO: 479116 - DNA, 25 bp, Homo sapien
tacagatcttcttctcagtgaggca

SEQ ID NO: 479117 - DNA, 25 bp, Homo sapien
acagatcttcttctcagtgaggcag

SEQ ID NO: 479118 - DNA, 25 bp, Homo sapien
gatcttcttctcagtgaggcagaca

SEQ ID NO: 479119 - DNA, 25 bp, Homo sapien
tcttctcagtgaggcagacattatc

SEQ ID NO: 479120 - DNA, 25 bp, Homo sapien
gatccagccgcccagttatattctg

SEQ ID NO: 479121 - DNA, 25 bp, Homo sapien
cagccgcccagttatattctgtgtt

SEQ ID NO: 479122 - DNA, 25 bp, Homo sapien
gccgcccagttatattctgtgtttc

SEQ ID NO: 479123 - DNA, 25 bp, Homo sapien
cgcccagttatattctgtgtttctc

SEQ ID NO: 479124 - DNA, 25 bp, Homo sapien
tcttaaagatggcaccgacccaggc

SEQ ID NO: 479125 - DNA, 25 bp, Homo sapien
cttaaagatggcaccgacccaggcc

SEQ ID NO: 479126 - DNA, 25 bp, Homo sapien
ttaaagatggcaccgacccaggccg

SEQ ID NO: 479127 - DNA, 25 bp, Homo sapien
taaagatggcaccgacccaggccgg

SEQ ID NO: 479128 - DNA, 25 bp, Homo sapien
aaagatggcaccgacccaggccggg

SEQ ID NO: 479129 - DNA, 25 bp, Homo sapien
aagatggcaccgacccaggccgggc

SEQ ID NO: 479130 - DNA, 25 bp, Homo sapien
agatggcaccgacccaggccgggcg

SEQ ID NO: 479131 - DNA, 25 bp, Homo sapien
ccaggaaagtggcatgaacccgcga

SEQ ID NO: 479132 - DNA, 25 bp, Homo sapien
gaaagtggcatgaacccgcgaggca

SEQ ID NO: 479133 - DNA, 25 bp, Homo sapien
aaagtggcatgaacccgcgaggcag

SEQ ID NO: 479134 - DNA, 25 bp, Homo sapien
acccgcgaggcagagcttgcaataa

SEQ ID NO: 479135 - DNA, 25 bp, Homo sapien
ggaggagttaataccttagcaacta

SEQ ID NO: 479136 - DNA, 25 bp, Homo sapien
ttagcaactacactggcggtcctta

SEQ ID NO: 479137 - DNA, 25 bp, Homo sapien
ggtccttatctcttatgctttcatt

SEQ ID NO: 479138 - DNA, 25 bp, Homo sapien
tttcattttctctagtatccttggt

SEQ ID NO: 479139 - DNA, 25 bp, Homo sapien
tctagtatccttggtattcattcca

SEQ ID NO: 479140 - DNA, 25 bp, Homo sapien
tgtagctcccatctcttggctgtgg

SEQ ID NO: 479141 - DNA, 25 bp, Homo sapien
ttttgggtctataacattcatgtat

SEQ ID NO: 479142 - DNA, 25 bp, Homo sapien
ggtgtcttctgtgttctacatcaca

SEQ ID NO: 479143 - DNA, 25 bp, Homo sapien
ttctacatcacaataatccccatgc

SEQ ID NO: 479144 - DNA, 25 bp, Homo sapien
taatccccatgctgaatcctctaat

SEQ ID NO: 479145 - DNA, 25 bp, Homo sapien
tgaatcctctaatctatagcctgag

SEQ ID NO: 479146 - DNA, 25 bp, Homo sapien
acgccgagaactacagccctgagga

SEQ ID NO: 479147 - DNA, 25 bp, Homo sapien
acagccctgaggacaacaggtttga

SEQ ID NO: 479148 - DNA, 25 bp, Homo sapien
gacaacaggtttgatctgcgaccat

SEQ ID NO: 479149 - DNA, 25 bp, Homo sapien
acaggtttgatctgcgaccatttct

SEQ ID NO: 479150 - DNA, 25 bp, Homo sapien
gtttgatctgcgaccatttctgtac

SEQ ID NO: 479151 - DNA, 25 bp, Homo sapien
tgatctgcgaccatttctgtacaac

SEQ ID NO: 479152 - DNA, 25 bp, Homo sapien
atctgcgaccatttctgtacaacac

SEQ ID NO: 479153 - DNA, 25 bp, Homo sapien
ggccttggcagtttcggtgcataga

SEQ ID NO: 479154 - DNA, 25 bp, Homo sapien
ccttggcagtttcggtgcatagaaa

SEQ ID NO: 479155 - DNA, 25 bp, Homo sapien
ggcagtttcggtgcatagaaaatca

SEQ ID NO: 479156 - DNA, 25 bp, Homo sapien
agtttcggtgcatagaaaatcaggt

SEQ ID NO: 479157 - DNA, 25 bp, Homo sapien
ttgtcgaagagacccgaatacccgc

SEQ ID NO: 479158 - DNA, 25 bp, Homo sapien
gaatacccgcccacctcgtggaagg

SEQ ID NO: 479159 - DNA, 25 bp, Homo sapien
tccttaggaccctcagaccggagac

SEQ ID NO: 479160 - DNA, 25 bp, Homo sapien
aggaccctcagaccggagacgcgca

SEQ ID NO: 479161 - DNA, 25 bp, Homo sapien
ctaccgtaacccatgaggatgcagg

SEQ ID NO: 479162 - DNA, 25 bp, Homo sapien
gtaacccatgaggatgcaggcgccc

SEQ ID NO: 479163 - DNA, 25 bp, Homo sapien
agatgtttcccacggctggatcctc

SEQ ID NO: 479164 - DNA, 25 bp, Homo sapien
tgtttcccacggctggatcctcgga

SEQ ID NO: 479165 - DNA, 25 bp, Homo sapien
tcggacaccgtcagcgaagtcgctg

SEQ ID NO: 479166 - DNA, 25 bp, Homo sapien
gaagtcgctgctcccaggtatttgt

SEQ ID NO: 479167 - DNA, 25 bp, Homo sapien
gctgctcccaggtatttgtcgaaga

SEQ ID NO: 479168 - DNA, 25 bp, Homo sapien
aaccactgtgttagctaagagcctc

SEQ ID NO: 479169 - DNA, 25 bp, Homo sapien
accactgtgttagctaagagcctcc

SEQ ID NO: 479170 - DNA, 25 bp, Homo sapien
ccactgtgttagctaagagcctcca

SEQ ID NO: 479171 - DNA, 25 bp, Homo sapien
cactgtgttagctaagagcctccaa

SEQ ID NO: 479172 - DNA, 25 bp, Homo sapien
actgtgttagctaagagcctccaaa

SEQ ID NO: 479173 - DNA, 25 bp, Homo sapien
ctgtgttagctaagagcctccaaaa

SEQ ID NO: 479174 - DNA, 25 bp, Homo sapien
tgtgttagctaagagcctccaaaaa

SEQ ID NO: 479175 - DNA, 25 bp, Homo sapien
gtgttagctaagagcctccaaaaag

SEQ ID NO: 479176 - DNA, 25 bp, Homo sapien
tgttagctaagagcctccaaaaagg

SEQ ID NO: 479177 - DNA, 25 bp, Homo sapien
ataagtggaaggatggcttaagctc

SEQ ID NO: 479178 - DNA, 25 bp, Homo sapien
taagtggaaggatggcttaagctca

SEQ ID NO: 479179 - DNA, 25 bp, Homo sapien
gtttaagcctccatagtttgttctg

SEQ ID NO: 479180 - DNA, 25 bp, Homo sapien
tttaagcctccatagtttgttctgt

SEQ ID NO: 479181 - DNA, 25 bp, Homo sapien
ttaagcctccatagtttgttctgtt

SEQ ID NO: 479182 - DNA, 25 bp, Homo sapien
taagcctccatagtttgttctgttt

SEQ ID NO: 479183 - DNA, 25 bp, Homo sapien
aagcctccatagtttgttctgtttg

SEQ ID NO: 479184 - DNA, 25 bp, Homo sapien
agcctccatagtttgttctgtttgt

SEQ ID NO: 479185 - DNA, 25 bp, Homo sapien
gcctccatagtttgttctgtttgtt

SEQ ID NO: 479186 - DNA, 25 bp, Homo sapien
cctccatagtttgttctgtttgttc

SEQ ID NO: 479187 - DNA, 25 bp, Homo sapien
ctccatagtttgttctgtttgttct

SEQ ID NO: 479188 - DNA, 25 bp, Homo sapien
ctgtttgttcttgcttaagaagtca

SEQ ID NO: 479189 - DNA, 25 bp, Homo sapien
gttcttgcttaagaagtcattctag

SEQ ID NO: 479190 - DNA, 25 bp, Homo sapien
ctgcactctgtcgttggagctgtgg

SEQ ID NO: 479191 - DNA, 25 bp, Homo sapien
tgtctctgaagtcctcctctctttt

SEQ ID NO: 479192 - DNA, 25 bp, Homo sapien
ctctcttttctctcatatggacatc

SEQ ID NO: 479193 - DNA, 25 bp, Homo sapien
tttctctcatatggacatcagtcag

SEQ ID NO: 479194 - DNA, 25 bp, Homo sapien
catcagtcagatgtaagggctgctg

SEQ ID NO: 479195 - DNA, 25 bp, Homo sapien
agggctgctgagttttgcttggtca

SEQ ID NO: 479196 - DNA, 25 bp, Homo sapien
ctgagttttgcttggtcagcagtga

SEQ ID NO: 479197 - DNA, 25 bp, Homo sapien
tcagcagtgaatttatcggtgggac

SEQ ID NO: 479198 - DNA, 25 bp, Homo sapien
agctcctcagaggtgaatcagataa

SEQ ID NO: 479199 - DNA, 25 bp, Homo sapien
cagaacaagatctgcccttgtgaat

SEQ ID NO: 479200 - DNA, 25 bp, Homo sapien
ttgattgccatcatcttaattttaa

SEQ ID NO: 479201 - DNA, 25 bp, Homo sapien
ttcttcttttcatgataaatttgtg

SEQ ID NO: 479202 - DNA, 25 bp, Homo sapien
tcttcttttcatgataaatttgtgt

SEQ ID NO: 479203 - DNA, 25 bp, Homo sapien
ataaatttgtgttgtgtccctggta

SEQ ID NO: 479204 - DNA, 25 bp, Homo sapien
taaatttgtgttgtgtccctggtag

SEQ ID NO: 479205 - DNA, 25 bp, Homo sapien
aaatttgtgttgtgtccctggtagc

SEQ ID NO: 479206 - DNA, 25 bp, Homo sapien
aatttgtgttgtgtccctggtagca

SEQ ID NO: 479207 - DNA, 25 bp, Homo sapien
atttgtgttgtgtccctggtagcag

SEQ ID NO: 479208 - DNA, 25 bp, Homo sapien
tttgtgttgtgtccctggtagcaga

SEQ ID NO: 479209 - DNA, 25 bp, Homo sapien
tgtgttgtgtccctggtagcagaaa

SEQ ID NO: 479210 - DNA, 25 bp, Homo sapien
gtgttgtgtccctggtagcagaaat

SEQ ID NO: 479211 - DNA, 25 bp, Homo sapien
tgttgtgtccctggtagcagaaatc

SEQ ID NO: 479212 - DNA, 25 bp, Homo sapien
gatcgatgatctttgcaatcttttt

SEQ ID NO: 479213 - DNA, 25 bp, Homo sapien
ttcttcttttcatgataaatttgtg

SEQ ID NO: 479214 - DNA, 25 bp, Homo sapien
ataaatttgtgttgtgtccctggta

SEQ ID NO: 479215 - DNA, 25 bp, Homo sapien
taaatttgtgttgtgtccctggtag

SEQ ID NO: 479216 - DNA, 25 bp, Homo sapien
aaatttgtgttgtgtccctggtagc

SEQ ID NO: 479217 - DNA, 25 bp, Homo sapien
aatttgtgttgtgtccctggtagca

SEQ ID NO: 479218 - DNA, 25 bp, Homo sapien
atttgtgttgtgtccctggtagcag

SEQ ID NO: 479219 - DNA, 25 bp, Homo sapien
tttgtgttgtgtccctggtagcaga

SEQ ID NO: 479220 - DNA, 25 bp, Homo sapien
tgtgttgtgtccctggtagcagaaa

SEQ ID NO: 479221 - DNA, 25 bp, Homo sapien
tgttgtgtccctggtagcagaaatc

SEQ ID NO: 479222 - DNA, 25 bp, Homo sapien
aaatccttacctatatgtttctgaa

SEQ ID NO: 479223 - DNA, 25 bp, Homo sapien
aaaagatctactgagtctgtcttca

SEQ ID NO: 479224 - DNA, 25 bp, Homo sapien
gagtctgtcttcagggacaagagca

SEQ ID NO: 479225 - DNA, 25 bp, Homo sapien
gtcttcagggacaagagcacagttt

SEQ ID NO: 479226 - DNA, 25 bp, Homo sapien
gggacaagagcacagtttctcctag

SEQ ID NO: 479227 - DNA, 25 bp, Homo sapien
aagagcacagtttctcctaggatct

SEQ ID NO: 479228 - DNA, 25 bp, Homo sapien
agcacagtttctcctaggatcttca

SEQ ID NO: 479229 - DNA, 25 bp, Homo sapien
acagtttctcctaggatcttcacac

SEQ ID NO: 479230 - DNA, 25 bp, Homo sapien
agtttctcctaggatcttcacacct

SEQ ID NO: 479231 - DNA, 25 bp, Homo sapien
taggatcttcacacctccctcaaaa

SEQ ID NO: 479232 - DNA, 25 bp, Homo sapien
ttcacacctccctcaaaatgtgtac

SEQ ID NO: 479233 - DNA, 25 bp, Homo sapien
cacctccctcaaaatgtgtacattt

SEQ ID NO: 479234 - DNA, 25 bp, Homo sapien
taaagaaacagaagccgagggatgg

SEQ ID NO: 479235 - DNA, 25 bp, Homo sapien
tgtactcccatcttttggaattggg

SEQ ID NO: 479236 - DNA, 25 bp, Homo sapien
ctcccatcttttggaattgggcttt

SEQ ID NO: 479237 - DNA, 25 bp, Homo sapien
tgggtcactaggtcatggaggcatt

SEQ ID NO: 479238 - DNA, 25 bp, Homo sapien
gtcactaggtcatggaggcattatt

SEQ ID NO: 479239 - DNA, 25 bp, Homo sapien
gaggcattatttccaagtcatttga

SEQ ID NO: 479240 - DNA, 25 bp, Homo sapien
tatttccaagtcatttgatagtaat

SEQ ID NO: 479241 - DNA, 25 bp, Homo sapien
atagtaatgagatgggcaacttcaa

SEQ ID NO: 479242 - DNA, 25 bp, Homo sapien
aacttcaaatctatatcaactccta

SEQ ID NO: 479243 - DNA, 25 bp, Homo sapien
tcctattaaaatagctaatggcaga

SEQ ID NO: 479244 - DNA, 25 bp, Homo sapien
gctaatggcagaaaaattactagga

SEQ ID NO: 479245 - DNA, 25 bp, Homo sapien
tcatccttgcctcttatggagccac

SEQ ID NO: 479246 - DNA, 25 bp, Homo sapien
catccttgcctcttatggagccact

SEQ ID NO: 479247 - DNA, 25 bp, Homo sapien
atccttgcctcttatggagccactg

SEQ ID NO: 479248 - DNA, 25 bp, Homo sapien
tccttgcctcttatggagccactgc

SEQ ID NO: 479249 - DNA, 25 bp, Homo sapien
ccttgcctcttatggagccactgcc

SEQ ID NO: 479250 - DNA, 25 bp, Homo sapien
cttgcctcttatggagccactgccc

SEQ ID NO: 479251 - DNA, 25 bp, Homo sapien
ttgcctcttatggagccactgccca

SEQ ID NO: 479252 - DNA, 25 bp, Homo sapien
tgcctcttatggagccactgcccag

SEQ ID NO: 479253 - DNA, 25 bp, Homo sapien
gctgctggtaacagatgctgcggaa

SEQ ID NO: 479254 - DNA, 25 bp, Homo sapien
ctgctggtaacagatgctgcggaaa

SEQ ID NO: 479255 - DNA, 25 bp, Homo sapien
gctggtaacagatgctgcggaaaaa

SEQ ID NO: 479256 - DNA, 25 bp, Homo sapien
tggtaacagatgctgcggaaaaaga

SEQ ID NO: 479257 - DNA, 25 bp, Homo sapien
aaagaatgccttaaacaaagccagg

SEQ ID NO: 479258 - DNA, 25 bp, Homo sapien
tgccttaaacaaagccaggcacggt

SEQ ID NO: 479259 - DNA, 25 bp, Homo sapien
agcctaggagttagacacctaccca

SEQ ID NO: 479260 - DNA, 25 bp, Homo sapien
gcctaggagttagacacctacccag

SEQ ID NO: 479261 - DNA, 25 bp, Homo sapien
taggagttagacacctacccagcct

SEQ ID NO: 479262 - DNA, 25 bp, Homo sapien
agctagatgtcgtggcgcacagctg

SEQ ID NO: 479263 - DNA, 25 bp, Homo sapien
gctagatgtcgtggcgcacagctgt

SEQ ID NO: 479264 - DNA, 25 bp, Homo sapien
gcatctaaggactatgtagtttctt

SEQ ID NO: 479265 - DNA, 25 bp, Homo sapien
gtagtttcttcagttcaatgttcac

SEQ ID NO: 479266 - DNA, 25 bp, Homo sapien
gtttcttcagttcaatgttcaccat

SEQ ID NO: 479267 - DNA, 25 bp, Homo sapien
ttcagttcaatgttcaccatagatt

SEQ ID NO: 479268 - DNA, 25 bp, Homo sapien
gttcaccatagattgacatttcaga

SEQ ID NO: 479269 - DNA, 25 bp, Homo sapien
agatatcaagtcttttgcactttta

SEQ ID NO: 479270 - DNA, 25 bp, Homo sapien
gaaaatatttacttactctgtttat

SEQ ID NO: 479271 - DNA, 25 bp, Homo sapien
ctctgtttatgaatgatactttagc

SEQ ID NO: 479272 - DNA, 25 bp, Homo sapien
atattcaattctagcttttaagcca

SEQ ID NO: 479273 - DNA, 25 bp, Homo sapien
agcttttaagccatgcttgctcatt

SEQ ID NO: 479274 - DNA, 25 bp, Homo sapien
ttttaagccatgcttgctcattgta

SEQ ID NO: 479275 - DNA, 25 bp, Homo sapien
aaatttattatagagtgggaggcag

SEQ ID NO: 479276 - DNA, 25 bp, Homo sapien
aatttattatagagtgggaggcagg

SEQ ID NO: 479277 - DNA, 25 bp, Homo sapien
atttattatagagtgggaggcaggg

SEQ ID NO: 479278 - DNA, 25 bp, Homo sapien
tttattatagagtgggaggcagggt

SEQ ID NO: 479279 - DNA, 25 bp, Homo sapien
ttattatagagtgggaggcagggtg

SEQ ID NO: 479280 - DNA, 25 bp, Homo sapien
tattatagagtgggaggcagggtgc

SEQ ID NO: 479281 - DNA, 25 bp, Homo sapien
attatagagtgggaggcagggtgcg

SEQ ID NO: 479282 - DNA, 25 bp, Homo sapien
ttatagagtgggaggcagggtgcgg

SEQ ID NO: 479283 - DNA, 25 bp, Homo sapien
tatagagtgggaggcagggtgcggt

SEQ ID NO: 479284 - DNA, 25 bp, Homo sapien
atagagtgggaggcagggtgcggtg

SEQ ID NO: 479285 - DNA, 25 bp, Homo sapien
gagtgggaggcagggtgcggtggct

SEQ ID NO: 479286 - DNA, 25 bp, Homo sapien
aactattttctgagcaaatctctga

SEQ ID NO: 479287 - DNA, 25 bp, Homo sapien
gagcaaatctctgatatgggatcat

SEQ ID NO: 479288 - DNA, 25 bp, Homo sapien
tgatatgggatcattactagtcttt

SEQ ID NO: 479289 - DNA, 25 bp, Homo sapien
ttgacctcttcaaatctttctttgg

SEQ ID NO: 479290 - DNA, 25 bp, Homo sapien
atctttctttggattgttctttgta

SEQ ID NO: 479291 - DNA, 25 bp, Homo sapien
gattgttctttgtatgtaggaattc

SEQ ID NO: 479292 - DNA, 25 bp, Homo sapien
aggaattcagtgtttgtcttcttgg

SEQ ID NO: 479293 - DNA, 25 bp, Homo sapien
gggattctggattagtttctgaact

SEQ ID NO: 479294 - DNA, 25 bp, Homo sapien
tctgaactggattttgacttcttgg

SEQ ID NO: 479295 - DNA, 25 bp, Homo sapien
ggattttgacttcttggattgttca

SEQ ID NO: 479296 - DNA, 25 bp, Homo sapien
cttggattgttcattttcatgtgat

SEQ ID NO: 479297 - DNA, 25 bp, Homo sapien
ttgttctccaacaccttctctggta

SEQ ID NO: 479298 - DNA, 25 bp, Homo sapien
ttctctggtatttcaaggcaccgag

SEQ ID NO: 479299 - DNA, 25 bp, Homo sapien
gcaccgagaacaagagccatactct

SEQ ID NO: 479300 - DNA, 25 bp, Homo sapien
gagccatactctgatgaaacattaa

SEQ ID NO: 479301 - DNA, 25 bp, Homo sapien
gaaacattaaaactcggtcacaact

SEQ ID NO: 479302 - DNA, 25 bp, Homo sapien
acaactaagtgatcccaagctcaag

SEQ ID NO: 479303 - DNA, 25 bp, Homo sapien
ggtgaatccccaatactttacttat

SEQ ID NO: 479304 - DNA, 25 bp, Homo sapien
taagacatcctcttcttcaaggtgt

SEQ ID NO: 479305 - DNA, 25 bp, Homo sapien
aggtgtctttgggactgatcctccg

SEQ ID NO: 479306 - DNA, 25 bp, Homo sapien
cctggctttctgcagctttgagatg

SEQ ID NO: 479307 - DNA, 25 bp, Homo sapien
tccatcttctttgtgagcctcttaa

SEQ ID NO: 479308 - DNA, 25 bp, Homo sapien
gtgtctttattaagcttgtgattga

SEQ ID NO: 479309 - DNA, 25 bp, Homo sapien
gaaacacaattgagctgttgcagtt

SEQ ID NO: 479310 - DNA, 25 bp, Homo sapien
tgttgcagttaagaccatgggcgtt

SEQ ID NO: 479311 - DNA, 25 bp, Homo sapien
agaccatgggcgttggcttagacaa

SEQ ID NO: 479312 - DNA, 25 bp, Homo sapien
ggcttagacaagagtgggtaccagt

SEQ ID NO: 479313 - DNA, 25 bp, Homo sapien
tgggtaccagtctctacctatctta

SEQ ID NO: 479314 - DNA, 25 bp, Homo sapien
tacctatcttactcccttgggcaag

SEQ ID NO: 479315 - DNA, 25 bp, Homo sapien
ttgggcaagttctccgacctaccta

SEQ ID NO: 479316 - DNA, 25 bp, Homo sapien
tagattgcgtgaacactgccacaga

SEQ ID NO: 479317 - DNA, 25 bp, Homo sapien
gaacactgccacagagtttatactc

SEQ ID NO: 479318 - DNA, 25 bp, Homo sapien
cagagtttatactccagttgtggga

SEQ ID NO: 479319 - DNA, 25 bp, Homo sapien
acacggtgagtgattttagcttttt

SEQ ID NO: 479320 - DNA, 25 bp, Homo sapien
acacatacactttctcgacacataa

SEQ ID NO: 479321 - DNA, 25 bp, Homo sapien
tacactttctcgacacataaaggag

SEQ ID NO: 479322 - DNA, 25 bp, Homo sapien
gatatgtaaactgaggtcccgggta

SEQ ID NO: 479323 - DNA, 25 bp, Homo sapien
gtaaactgaggtcccgggtattgct

SEQ ID NO: 479324 - DNA, 25 bp, Homo sapien
aggtcccgggtattgctacagcaaa

SEQ ID NO: 479325 - DNA, 25 bp, Homo sapien
ttgctacagcaaagacggtggtcct

SEQ ID NO: 479326 - DNA, 25 bp, Homo sapien
cagcaaagacggtggtcctgattcc

SEQ ID NO: 479327 - DNA, 25 bp, Homo sapien
agacggtggtcctgattcccacgat

SEQ ID NO: 479328 - DNA, 25 bp, Homo sapien
tgattcccacgatactgccagatta

SEQ ID NO: 479329 - DNA, 25 bp, Homo sapien
tcccacgatactgccagattatact

SEQ ID NO: 479330 - DNA, 25 bp, Homo sapien
gggcattgaattttgttcctttcat

SEQ ID NO: 479331 - DNA, 25 bp, Homo sapien
actgctgtagtggtggtccctatgc

SEQ ID NO: 479332 - DNA, 25 bp, Homo sapien
tgtagtggtggtccctatgcacaga

SEQ ID NO: 479333 - DNA, 25 bp, Homo sapien
tggtggtccctatgcacagaccttc

SEQ ID NO: 479334 - DNA, 25 bp, Homo sapien
ccttgctcagccactggcctggaag

SEQ ID NO: 479335 - DNA, 25 bp, Homo sapien
gatgtatttcactcttctgattggt

SEQ ID NO: 479336 - DNA, 25 bp, Homo sapien
gtatttcactcttctgattggtaga

SEQ ID NO: 479337 - DNA, 25 bp, Homo sapien
tatgatttgggttatcctaagagac

SEQ ID NO: 479338 - DNA, 25 bp, Homo sapien
gttatcctaagagaccctagcccaa

SEQ ID NO: 479339 - DNA, 25 bp, Homo sapien
taagagaccctagcccaatacataa

SEQ ID NO: 479340 - DNA, 25 bp, Homo sapien
gagaccctagcccaatacataaagg

SEQ ID NO: 479341 - DNA, 25 bp, Homo sapien
aggatccttctgctcgacacacaat

SEQ ID NO: 479342 - DNA, 25 bp, Homo sapien
ctgctcgacacacaatccggatggt

SEQ ID NO: 479343 - DNA, 25 bp, Homo sapien
atccggatggtgaggttcagctgcc

SEQ ID NO: 479344 - DNA, 25 bp, Homo sapien
tgaggttcagctgccgacggttgac

SEQ ID NO: 479345 - DNA, 25 bp, Homo sapien
gacggttgacgtcatagagtcgcat

SEQ ID NO: 479346 - DNA, 25 bp, Homo sapien
agtcgcattctcaccatatagtttt

SEQ ID NO: 479347 - DNA, 25 bp, Homo sapien
gttccaggtggaatgagcaattctt

SEQ ID NO: 479348 - DNA, 25 bp, Homo sapien
aaattctccagcgatacccctaaag

SEQ ID NO: 479349 - DNA, 25 bp, Homo sapien
cagagttctcactatttgtcaaaat

SEQ ID NO: 479350 - DNA, 25 bp, Homo sapien
tatttgtcaaaatagctcacagcaa

SEQ ID NO: 479351 - DNA, 25 bp, Homo sapien
aaatcttcattagaatggctctttc

SEQ ID NO: 479352 - DNA, 25 bp, Homo sapien
tggatggagagctagcctgcccctg

SEQ ID NO: 479353 - DNA, 25 bp, Homo sapien
agcctgcccctgatgatactcctgt

SEQ ID NO: 479354 - DNA, 25 bp, Homo sapien
ctgtccttctggctttctcaggaag

SEQ ID NO: 479355 - DNA, 25 bp, Homo sapien
tggctttctcaggaagcagcggcac

SEQ ID NO: 479356 - DNA, 25 bp, Homo sapien
ggaagcagcggcacccacataggga

SEQ ID NO: 479357 - DNA, 25 bp, Homo sapien
acaatctgtgtgctttccactggtc

SEQ ID NO: 479358 - DNA, 25 bp, Homo sapien
tgctttccactggtcccgagagaga

SEQ ID NO: 479359 - DNA, 25 bp, Homo sapien
ttctcgttagttcctctacccgagt

SEQ ID NO: 479360 - DNA, 25 bp, Homo sapien
ttgctttattgcctggcctcgtgga

SEQ ID NO: 479361 - DNA, 25 bp, Homo sapien
tattgcctggcctcgtggacttcat

SEQ ID NO: 479362 - DNA, 25 bp, Homo sapien
gtggacttcatcacatgcttttagc

SEQ ID NO: 479363 - DNA, 25 bp, Homo sapien
tagtgctctgagtaggaccgtaacc

SEQ ID NO: 479364 - DNA, 25 bp, Homo sapien
tgagtaggaccgtaaccgcctccgt

SEQ ID NO: 479365 - DNA, 25 bp, Homo sapien
aaccgcctccgtgcgtggcatatgg

SEQ ID NO: 479366 - DNA, 25 bp, Homo sapien
gtggcatatggtccctgcatgctgt

SEQ ID NO: 479367 - DNA, 25 bp, Homo sapien
atagtacttagtattcgctgaggct

SEQ ID NO: 479368 - DNA, 25 bp, Homo sapien
tagtattcgctgaggctaagaggcc

SEQ ID NO: 479369 - DNA, 25 bp, Homo sapien
aggtgcctgggcttctgcccttgga

SEQ ID NO: 479370 - DNA, 25 bp, Homo sapien
ggatatccagcctagtgctaattga

SEQ ID NO: 479371 - DNA, 25 bp, Homo sapien
aatgctaagcagtggtaattcaaaa

SEQ ID NO: 479372 - DNA, 25 bp, Homo sapien
cctgcctctagagtcatcatctaat

SEQ ID NO: 479373 - DNA, 25 bp, Homo sapien
gggacaggcagacctagataagaaa

SEQ ID NO: 479374 - DNA, 25 bp, Homo sapien
tctacactagcaagttctaaccctc

SEQ ID NO: 479375 - DNA, 25 bp, Homo sapien
ttctaaccctcctggtctgacacta

SEQ ID NO: 479376 - DNA, 25 bp, Homo sapien
actacgtctctgcttgtcttctcat

SEQ ID NO: 479377 - DNA, 25 bp, Homo sapien
gtctcagtgaaacagcagcctttct

SEQ ID NO: 479378 - DNA, 25 bp, Homo sapien
aacagcagcctttcttgtttaccca

SEQ ID NO: 479379 - DNA, 25 bp, Homo sapien
ttcttgtttacccatacccttgata

SEQ ID NO: 479380 - DNA, 25 bp, Homo sapien
tgtttacccatacccttgatatgaa

SEQ ID NO: 479381 - DNA, 25 bp, Homo sapien
ttgatatgaagagaagccctctgct

SEQ ID NO: 479382 - DNA, 25 bp, Homo sapien
ctctgctgtgtgtccgtggtgagtt

SEQ ID NO: 479383 - DNA, 25 bp, Homo sapien
tgtgcccaagtggattattgccctc

SEQ ID NO: 479384 - DNA, 25 bp, Homo sapien
ggattattgccctctacactagcaa

SEQ ID NO: 479385 - DNA, 25 bp, Homo sapien
tgcaggtgcacttttgtctatatga

SEQ ID NO: 479386 - DNA, 25 bp, Homo sapien
gtctatatgaccaagatcagtcctt

SEQ ID NO: 479387 - DNA, 25 bp, Homo sapien
agatcagtccttccattcagagtag

SEQ ID NO: 479388 - DNA, 25 bp, Homo sapien
tcagagtagcccctctttgagtagt

SEQ ID NO: 479389 - DNA, 25 bp, Homo sapien
cctctttgagtagtgctgataccta

SEQ ID NO: 479390 - DNA, 25 bp, Homo sapien
gcatctagctcatagcaagtgctta

SEQ ID NO: 479391 - DNA, 25 bp, Homo sapien
gtagtgctgatacctaatttttgat

SEQ ID NO: 479392 - DNA, 25 bp, Homo sapien
ttgatgttgataatttttctgctct

SEQ ID NO: 479393 - DNA, 25 bp, Homo sapien
taccacccttcagacatattatgtt

SEQ ID NO: 479394 - DNA, 25 bp, Homo sapien
agattttatcaagttgtgattgccc

SEQ ID NO: 479395 - DNA, 25 bp, Homo sapien
gcccagtggcaatcacaaacagaga

SEQ ID NO: 479396 - DNA, 25 bp, Homo sapien
gagtatatcattttatgcctgtaac

SEQ ID NO: 479397 - DNA, 25 bp, Homo sapien
gcctgtaacttattatagcattgga

SEQ ID NO: 479398 - DNA, 25 bp, Homo sapien
cttaagttgaacatcctaggtctat

SEQ ID NO: 479399 - DNA, 25 bp, Homo sapien
aataagctgttctttggaggtttga

SEQ ID NO: 479400 - DNA, 25 bp, Homo sapien
gactttaccagtacaatcattcccc

SEQ ID NO: 479401 - DNA, 25 bp, Homo sapien
agccggtcagtgtctgttgcacaaa

SEQ ID NO: 479402 - DNA, 25 bp, Homo sapien
tgcacaaaattacaaccgctctctg

SEQ ID NO: 479403 - DNA, 25 bp, Homo sapien
tacaaccgctctctgcttgtatttg

SEQ ID NO: 479404 - DNA, 25 bp, Homo sapien
cttgtatttgcctagttctccagaa

SEQ ID NO: 479405 - DNA, 25 bp, Homo sapien
ctaggtctatgaatgacgttggtca

SEQ ID NO: 479406 - DNA, 25 bp, Homo sapien
gcaggagagatttgctgtttcataa

SEQ ID NO: 479407 - DNA, 25 bp, Homo sapien
gctcttaccagtgaagtttgtctaa

SEQ ID NO: 479408 - DNA, 25 bp, Homo sapien
gaaagactggcagccacacatctca

SEQ ID NO: 479409 - DNA, 25 bp, Homo sapien
gctgggacagaaccggcatacattg

SEQ ID NO: 479410 - DNA, 25 bp, Homo sapien
ccggcatacattgaggtaagtccta

SEQ ID NO: 479411 - DNA, 25 bp, Homo sapien
gatgtaaaatatgctttcaggcttt

SEQ ID NO: 479412 - DNA, 25 bp, Homo sapien
caggcttttccttgggctttgcttg

SEQ ID NO: 479413 - DNA, 25 bp, Homo sapien
gctttgcttgccacctttcaaaata

SEQ ID NO: 479414 - DNA, 25 bp, Homo sapien
aactgaatttttgcaacgttaatgt

SEQ ID NO: 479415 - DNA, 25 bp, Homo sapien
atgttagaagatcctcctgctttgt

SEQ ID NO: 479416 - DNA, 25 bp, Homo sapien
aaggactgccaaaaacccagaatgg

SEQ ID NO: 479417 - DNA, 25 bp, Homo sapien
tggccccggctcaaatgggttgtaa

SEQ ID NO: 479418 - DNA, 25 bp, Homo sapien
cttttgttctttcatgacattaatg

SEQ ID NO: 479419 - DNA, 25 bp, Homo sapien
gtttgtgaagagtacagtccagttt

SEQ ID NO: 479420 - DNA, 25 bp, Homo sapien
gagtacagtccagtttctgttgtag

SEQ ID NO: 479421 - DNA, 25 bp, Homo sapien
gtccagtttctgttgtagaacgtcc

SEQ ID NO: 479422 - DNA, 25 bp, Homo sapien
ctgttgtagaacgtccttgaagttg

SEQ ID NO: 479423 - DNA, 25 bp, Homo sapien
gtttcatcatgacctggcaggaaaa

SEQ ID NO: 479424 - DNA, 25 bp, Homo sapien
gaaaaccaccagacctggaattttg

SEQ ID NO: 479425 - DNA, 25 bp, Homo sapien
ctggaattttgcttttacaactgtt

SEQ ID NO: 479426 - DNA, 25 bp, Homo sapien
acaactgtttaacttctgtttcata

SEQ ID NO: 479427 - DNA, 25 bp, Homo sapien
tttcatacaggatggaaaccggtga

SEQ ID NO: 479428 - DNA, 25 bp, Homo sapien
gaaaccggtgaattgtaatctcaca

SEQ ID NO: 479429 - DNA, 25 bp, Homo sapien
taaccactgcgccacgacaggaact

SEQ ID NO: 479430 - DNA, 25 bp, Homo sapien
acgacaggaactcccctgtgtctga

SEQ ID NO: 479431 - DNA, 25 bp, Homo sapien
actcccctgtgtctgacagttttaa

SEQ ID NO: 479432 - DNA, 25 bp, Homo sapien
aagcttttaagtggtgactcgacat

SEQ ID NO: 479433 - DNA, 25 bp, Homo sapien
aagtggtgactcgacatcccgaggt

SEQ ID NO: 479434 - DNA, 25 bp, Homo sapien
atcccgaggtgttgcggtcctatta

SEQ ID NO: 479435 - DNA, 25 bp, Homo sapien
gttgcggtcctattatcgcaagtgg

SEQ ID NO: 479436 - DNA, 25 bp, Homo sapien
tatcttaggcgttcaaataaaggac

SEQ ID NO: 479437 - DNA, 25 bp, Homo sapien
ggactaggaagcaaacacccaagca

SEQ ID NO: 479438 - DNA, 25 bp, Homo sapien
gggctatttcttgggctaatgcaag

SEQ ID NO: 479439 - DNA, 25 bp, Homo sapien
tttcttgggctaatgcaagggcagg

SEQ ID NO: 479440 - DNA, 25 bp, Homo sapien
atagtatctttcatgttgatccaaa

SEQ ID NO: 479441 - DNA, 25 bp, Homo sapien
gttgatccaaaatagagttctgcca

SEQ ID NO: 479442 - DNA, 25 bp, Homo sapien
gagttctgccaactacatttaatca

SEQ ID NO: 479443 - DNA, 25 bp, Homo sapien
actacatttaatcatatttggtcaa

SEQ ID NO: 479444 - DNA, 25 bp, Homo sapien
atctgagtttcttcttaggactttt

SEQ ID NO: 479445 - DNA, 25 bp, Homo sapien
tgagtttcttcttaggacttttggg

SEQ ID NO: 479446 - DNA, 25 bp, Homo sapien
tgggtaaaaacagttgtcatatttt

SEQ ID NO: 479447 - DNA, 25 bp, Homo sapien
acaaatcctaggtttgactagtagg

SEQ ID NO: 479448 - DNA, 25 bp, Homo sapien
gactagtaggaatgtgtatttgttg

SEQ ID NO: 479449 - DNA, 25 bp, Homo sapien
gactatatcaatttgttttaacgta

SEQ ID NO: 479450 - DNA, 25 bp, Homo sapien
ttctaaatatgccagtgaactcttc

SEQ ID NO: 479451 - DNA, 25 bp, Homo sapien
ggcagctttggagtatatatcccat

SEQ ID NO: 479452 - DNA, 25 bp, Homo sapien
gttgcagtatttacacagcagcatt

SEQ ID NO: 479453 - DNA, 25 bp, Homo sapien
acagcagcatttcttctcaggcttt

SEQ ID NO: 479454 - DNA, 25 bp, Homo sapien
ttattgggtgctgttgcttgctatg

SEQ ID NO: 479455 - DNA, 25 bp, Homo sapien
gtgtcagacaagtttagtgtgttct

SEQ ID NO: 479456 - DNA, 25 bp, Homo sapien
aacaacagtgttcatgggcttttag

SEQ ID NO: 479457 - DNA, 25 bp, Homo sapien
gggcttttagaatgcttttcacttt

SEQ ID NO: 479458 - DNA, 25 bp, Homo sapien
ttcacttttagtccttgtaactcag

SEQ ID NO: 479459 - DNA, 25 bp, Homo sapien
tagtccttgtaactcagctgttcag

SEQ ID NO: 479460 - DNA, 25 bp, Homo sapien
gtaactcagctgttcagtacctaaa

SEQ ID NO: 479461 - DNA, 25 bp, Homo sapien
atgaacattatctcctactagaagt

SEQ ID NO: 479462 - DNA, 25 bp, Homo sapien
ttccaggtcccctttaaagctgagg

SEQ ID NO: 479463 - DNA, 25 bp, Homo sapien
tcccctttaaagctgaggtccttag

SEQ ID NO: 479464 - DNA, 25 bp, Homo sapien
ggtccttagagtaatatgtccttaa

SEQ ID NO: 479465 - DNA, 25 bp, Homo sapien
aatggatacagccttgaccctccca

SEQ ID NO: 479466 - DNA, 25 bp, Homo sapien
attcagcaataagtctcacccttct

SEQ ID NO: 479467 - DNA, 25 bp, Homo sapien
gggtgaaggcctcttgcactccaga

SEQ ID NO: 479468 - DNA, 25 bp, Homo sapien
acgccccaacagcttctaattggat

SEQ ID NO: 479469 - DNA, 25 bp, Homo sapien
ggatagaacttgctttaccttacag

SEQ ID NO: 479470 - DNA, 25 bp, Homo sapien
tttaccttacagctcacaacctcag

SEQ ID NO: 479471 - DNA, 25 bp, Homo sapien
cacaacctcagctgggttttaggta

SEQ ID NO: 479472 - DNA, 25 bp, Homo sapien
aagggcctgtctagattttttcaga

SEQ ID NO: 479473 - DNA, 25 bp, Homo sapien
cagaggacaactggccaggaaatct

SEQ ID NO: 479474 - DNA, 25 bp, Homo sapien
tgtttcttgtctcaccctctagtcc

SEQ ID NO: 479475 - DNA, 25 bp, Homo sapien
tagtccacactctgcctaacactac

SEQ ID NO: 479476 - DNA, 25 bp, Homo sapien
ccacctgatccaaattctcacaggt

SEQ ID NO: 479477 - DNA, 25 bp, Homo sapien
ccatccacgtcgttgtcacaggcat

SEQ ID NO: 479478 - DNA, 25 bp, Homo sapien
cagttgtccttggtgtcctgatgcc

SEQ ID NO: 479479 - DNA, 25 bp, Homo sapien
ccatccccatcgctaatcagaagaa

SEQ ID NO: 479480 - DNA, 25 bp, Homo sapien
tccccatcgctaatcagaagaacag

SEQ ID NO: 479481 - DNA, 25 bp, Homo sapien
tcgctaatcagaagaacaggttggt

SEQ ID NO: 479482 - DNA, 25 bp, Homo sapien
gaagaacaggttggtgaaagtcccg

SEQ ID NO: 479483 - DNA, 25 bp, Homo sapien
tggtgaaagtcccgaactttgtctc

SEQ ID NO: 479484 - DNA, 25 bp, Homo sapien
atcagtgacaatttacaggaatgta

SEQ ID NO: 479485 - DNA, 25 bp, Homo sapien
tttacaggaatgtagcagcgatgga

SEQ ID NO: 479486 - DNA, 25 bp, Homo sapien
acaggaatgtagcagcgatggaatt

SEQ ID NO: 479487 - DNA, 25 bp, Homo sapien
gaatgtagcagcgatggaattacct

SEQ ID NO: 479488 - DNA, 25 bp, Homo sapien
atgtagcagcgatggaattacctgg

SEQ ID NO: 479489 - DNA, 25 bp, Homo sapien
gtagcagcgatggaattacctggaa

SEQ ID NO: 479490 - DNA, 25 bp, Homo sapien
tagcagcgatggaattacctggaac

SEQ ID NO: 479491 - DNA, 25 bp, Homo sapien
agcagcgatggaattacctggaaca

SEQ ID NO: 479492 - DNA, 25 bp, Homo sapien
gcagcgatggaattacctggaacag

SEQ ID NO: 479493 - DNA, 25 bp, Homo sapien
agcgatggaattacctggaacagtt

SEQ ID NO: 479494 - DNA, 25 bp, Homo sapien
gcgatggaattacctggaacagttt

SEQ ID NO: 479495 - DNA, 25 bp, Homo sapien
tgggtgtacgacagattattttgtg

SEQ ID NO: 479496 - DNA, 25 bp, Homo sapien
tattttgtgactgcagtctgttcaa

SEQ ID NO: 479497 - DNA, 25 bp, Homo sapien
tcacatcactaagcagcgctgagat

SEQ ID NO: 479498 - DNA, 25 bp, Homo sapien
taagcagcgctgagatgatttgttg

SEQ ID NO: 479499 - DNA, 25 bp, Homo sapien
cgctgagatgatttgttggtgcatt

SEQ ID NO: 479500 - DNA, 25 bp, Homo sapien
attaaaaggttttgcatcatggaac

SEQ ID NO: 479501 - DNA, 25 bp, Homo sapien
ccatacccaggcactttattttcat

SEQ ID NO: 479502 - DNA, 25 bp, Homo sapien
aataatccagcatttttgttcagac

SEQ ID NO: 479503 - DNA, 25 bp, Homo sapien
agtggaatggaattgtgacctgaca

SEQ ID NO: 479504 - DNA, 25 bp, Homo sapien
atggaattgtgacctgacagagaag

SEQ ID NO: 479505 - DNA, 25 bp, Homo sapien
tgatcgaatgggagaacagtgctgt

SEQ ID NO: 479506 - DNA, 25 bp, Homo sapien
cctttcttgtcacattatagccaaa

SEQ ID NO: 479507 - DNA, 25 bp, Homo sapien
ttgtcacattatagccaaaagaagc

SEQ ID NO: 479508 - DNA, 25 bp, Homo sapien
ctggttggccaggtataaatgagct

SEQ ID NO: 479509 - DNA, 25 bp, Homo sapien
ttggccaggtataaatgagctttac

SEQ ID NO: 479510 - DNA, 25 bp, Homo sapien
tctgtttacctccaccaaaacttga

SEQ ID NO: 479511 - DNA, 25 bp, Homo sapien
caaaacttgattttcccctagctat

SEQ ID NO: 479512 - DNA, 25 bp, Homo sapien
tgattttcccctagctattaattta

SEQ ID NO: 479513 - DNA, 25 bp, Homo sapien
tcccctagctattaatttaaggttg

SEQ ID NO: 479514 - DNA, 25 bp, Homo sapien
atttaaggttgcctttcctgcagct

SEQ ID NO: 479515 - DNA, 25 bp, Homo sapien
tttcctgcagctgcaatattttgaa

SEQ ID NO: 479516 - DNA, 25 bp, Homo sapien
attttgaataacacacagagtttgt

SEQ ID NO: 479517 - DNA, 25 bp, Homo sapien
tggctgtgttccagggcatgccctt

SEQ ID NO: 479518 - DNA, 25 bp, Homo sapien
tgtgttccagggcatgccctttaga

SEQ ID NO: 479519 - DNA, 25 bp, Homo sapien
tgccctttagaattgcacagaactt

SEQ ID NO: 479520 - DNA, 25 bp, Homo sapien
gccctttagaattgcacagaactta

SEQ ID NO: 479521 - DNA, 25 bp, Homo sapien
ccctttagaattgcacagaacttag

SEQ ID NO: 479522 - DNA, 25 bp, Homo sapien
cctttagaattgcacagaacttagc

SEQ ID NO: 479523 - DNA, 25 bp, Homo sapien
tttagaattgcacagaacttagcag

SEQ ID NO: 479524 - DNA, 25 bp, Homo sapien
tagaattgcacagaacttagcagat

SEQ ID NO: 479525 - DNA, 25 bp, Homo sapien
gaattgcacagaacttagcagatta

SEQ ID NO: 479526 - DNA, 25 bp, Homo sapien
attgcacagaacttagcagattacg

SEQ ID NO: 479527 - DNA, 25 bp, Homo sapien
gcacagaacttagcagattacggta

SEQ ID NO: 479528 - DNA, 25 bp, Homo sapien
tccttattcagcctaattattgttt

SEQ ID NO: 479529 - DNA, 25 bp, Homo sapien
tattgttttctacactcccctttca

SEQ ID NO: 479530 - DNA, 25 bp, Homo sapien
ctcccctttcattgaggcacaagaa

SEQ ID NO: 479531 - DNA, 25 bp, Homo sapien
gtagctctgctgtacctagttaatg

SEQ ID NO: 479532 - DNA, 25 bp, Homo sapien
ataatcgtgacaatactgcttttga

SEQ ID NO: 479533 - DNA, 25 bp, Homo sapien
actgcttttgaataccacactgtac

SEQ ID NO: 479534 - DNA, 25 bp, Homo sapien
actgtacaaggaggaacactagctt

SEQ ID NO: 479535 - DNA, 25 bp, Homo sapien
cactagcttggagaaatctgtcttc

SEQ ID NO: 479536 - DNA, 25 bp, Homo sapien
tctgtcttctgattatttgttgtga

SEQ ID NO: 479537 - DNA, 25 bp, Homo sapien
gttgtgacacattcctatgtactgt

SEQ ID NO: 479538 - DNA, 25 bp, Homo sapien
attcctatgtactgtgagctgggca

SEQ ID NO: 479539 - DNA, 25 bp, Homo sapien
tttgtatgccagtgattctcaagat

SEQ ID NO: 479540 - DNA, 25 bp, Homo sapien
aaatcatgattgtagtagttgttac

SEQ ID NO: 479541 - DNA, 25 bp, Homo sapien
gtagttgttactgttggcagtttgt

SEQ ID NO: 479542 - DNA, 25 bp, Homo sapien
cagtttgtagtagtattcaggtatt

SEQ ID NO: 479543 - DNA, 25 bp, Homo sapien
gtgatcactgtggtatctacagtat

SEQ ID NO: 479544 - DNA, 25 bp, Homo sapien
ggtatctacagtattctagtctcct

SEQ ID NO: 479545 - DNA, 25 bp, Homo sapien
acagtattctagtctcctgcacaaa

SEQ ID NO: 479546 - DNA, 25 bp, Homo sapien
gtattctagtctcctgcacaaaaac

SEQ ID NO: 479547 - DNA, 25 bp, Homo sapien
gtctcctgcacaaaaactgaaccca

SEQ ID NO: 479548 - DNA, 25 bp, Homo sapien
gcacaaaaactgaacccactgggcc

SEQ ID NO: 479549 - DNA, 25 bp, Homo sapien
gcctatgcatccctcacactttttt

SEQ ID NO: 479550 - DNA, 25 bp, Homo sapien
tatttgggtgttgccctagaagagc

SEQ ID NO: 479551 - DNA, 25 bp, Homo sapien
tgggtgttgccctagaagagcttac

SEQ ID NO: 479552 - DNA, 25 bp, Homo sapien
ggtgttgccctagaagagcttacaa

SEQ ID NO: 479553 - DNA, 25 bp, Homo sapien
gttgccctagaagagcttacaattt

SEQ ID NO: 479554 - DNA, 25 bp, Homo sapien
tgccctagaagagcttacaatttag

SEQ ID NO: 479555 - DNA, 25 bp, Homo sapien
caatttagtttatgttctttgcaca

SEQ ID NO: 479556 - DNA, 25 bp, Homo sapien
ttagtttatgttctttgcacaatga

SEQ ID NO: 479557 - DNA, 25 bp, Homo sapien
tatttctgtgaagaagccaaactcc

SEQ ID NO: 479558 - DNA, 25 bp, Homo sapien
aaagttctaaacatctcacaaatct

SEQ ID NO: 479559 - DNA, 25 bp, Homo sapien
gttctaaacatctcacaaatcttcc

SEQ ID NO: 479560 - DNA, 25 bp, Homo sapien
aaacatctcacaaatcttccagtta

SEQ ID NO: 479561 - DNA, 25 bp, Homo sapien
ataaatggtacatctgtggttttta

SEQ ID NO: 479562 - DNA, 25 bp, Homo sapien
ctgtggtttttaatctgtgctagac

SEQ ID NO: 479563 - DNA, 25 bp, Homo sapien
atctgtgctagacttcaaaactgtg

SEQ ID NO: 479564 - DNA, 25 bp, Homo sapien
gacttcaaaactgtgatctcctgtt

SEQ ID NO: 479565 - DNA, 25 bp, Homo sapien
actgtgatctcctgttattgtatgc

SEQ ID NO: 479566 - DNA, 25 bp, Homo sapien
gatctcctgttattgtatgcaacct

SEQ ID NO: 479567 - DNA, 25 bp, Homo sapien
gggttcttctgtgattaaataggtt

SEQ ID NO: 479568 - DNA, 25 bp, Homo sapien
gcactgaaactttacgacaaaatgt

SEQ ID NO: 479569 - DNA, 25 bp, Homo sapien
actttacgacaaaatgtctctggac

SEQ ID NO: 479570 - DNA, 25 bp, Homo sapien
gcaaaaggacactaattcatctgta

SEQ ID NO: 479571 - DNA, 25 bp, Homo sapien
aatttactgttggtaagcctagcag

SEQ ID NO: 479572 - DNA, 25 bp, Homo sapien
aggcaggccattctgacggctgccc

SEQ ID NO: 479573 - DNA, 25 bp, Homo sapien
gtgctcgagcactgagtccgggcat

SEQ ID NO: 479574 - DNA, 25 bp, Homo sapien
ctgagtccgggcatggagcagcgaa

SEQ ID NO: 479575 - DNA, 25 bp, Homo sapien
gcatggagcagcgaaggcgccgcct

SEQ ID NO: 479576 - DNA, 25 bp, Homo sapien
gggtgacctctgaggccgccggcag

SEQ ID NO: 479577 - DNA, 25 bp, Homo sapien
cggcagctccgaggtcgcgtgggat

SEQ ID NO: 479578 - DNA, 25 bp, Homo sapien
aggtcgcgtgggatccgggctccag

SEQ ID NO: 479579 - DNA, 25 bp, Homo sapien
gaggccggttccaactcggctgaag

SEQ ID NO: 479580 - DNA, 25 bp, Homo sapien
ccggttccaactcggctgaaggcag

SEQ ID NO: 479581 - DNA, 25 bp, Homo sapien
aactcggctgaaggcaggccattct

SEQ ID NO: 479582 - DNA, 25 bp, Homo sapien
tgaaggcaggccattctgacggctg

SEQ ID NO: 479583 - DNA, 25 bp, Homo sapien
aagtctgcatttgtatgggcaaaat

SEQ ID NO: 479584 - DNA, 25 bp, Homo sapien
tacctataaaagtctgttgggcctg

SEQ ID NO: 479585 - DNA, 25 bp, Homo sapien
agtctgttgggcctgtgaatttccc

SEQ ID NO: 479586 - DNA, 25 bp, Homo sapien
ttagatgcattagcacccattttct

SEQ ID NO: 479587 - DNA, 25 bp, Homo sapien
attttcttcagtcactcaggcattc

SEQ ID NO: 479588 - DNA, 25 bp, Homo sapien
aggcattccgtctgcgggttcttca

SEQ ID NO: 479589 - DNA, 25 bp, Homo sapien
gggttcttcagagtataatcccaga

SEQ ID NO: 479590 - DNA, 25 bp, Homo sapien
ggacacaggaaatatgtacttcgct

SEQ ID NO: 479591 - DNA, 25 bp, Homo sapien
gtacttcgctgttttaacaccaatg

SEQ ID NO: 479592 - DNA, 25 bp, Homo sapien
aatggagactgctagtttgcctaag

SEQ ID NO: 479593 - DNA, 25 bp, Homo sapien
tttgcctaagagactaccgaaaaca

SEQ ID NO: 479594 - DNA, 25 bp, Homo sapien
aagtgaaaacactgggctccctgtt

SEQ ID NO: 479595 - DNA, 25 bp, Homo sapien
actgggctccctgttaaacgatgaa

SEQ ID NO: 479596 - DNA, 25 bp, Homo sapien
ggctccctgttaaacgatgaagaat

SEQ ID NO: 479597 - DNA, 25 bp, Homo sapien
atgaagaattcaagacagtgacagc

SEQ ID NO: 479598 - DNA, 25 bp, Homo sapien
agtgacagcattacgtcacccctgg

SEQ ID NO: 479599 - DNA, 25 bp, Homo sapien
agaggtcagcctaaggtgacacacg

SEQ ID NO: 479600 - DNA, 25 bp, Homo sapien
ggactactgtgcttccggaggctcc

SEQ ID NO: 479601 - DNA, 25 bp, Homo sapien
gggcagctggacaagctcccaactg

SEQ ID NO: 479602 - DNA, 25 bp, Homo sapien
gctggacaagctcccaactgcagag

SEQ ID NO: 479603 - DNA, 25 bp, Homo sapien
gggactcagcatttctgatatgcct

SEQ ID NO: 479604 - DNA, 25 bp, Homo sapien
ctgatatgccttaagaattcattct

SEQ ID NO: 479605 - DNA, 25 bp, Homo sapien
ataggagagaacactgcaccaggat

SEQ ID NO: 479606 - DNA, 25 bp, Homo sapien
agagaacactgcaccaggattcaga

SEQ ID NO: 479607 - DNA, 25 bp, Homo sapien
tgaaaaatagcaagtgacactggca

SEQ ID NO: 479608 - DNA, 25 bp, Homo sapien
acactggcatgccatttaacctctc

SEQ ID NO: 479609 - DNA, 25 bp, Homo sapien
tggcatgccatttaacctctccggg

SEQ ID NO: 479610 - DNA, 25 bp, Homo sapien
cgggcctcaatttccactatagata

SEQ ID NO: 479611 - DNA, 25 bp, Homo sapien
aaatgtacccttgatttgatgctaa

SEQ ID NO: 479612 - DNA, 25 bp, Homo sapien
tgatgctaatgctgtatttagggct

SEQ ID NO: 479613 - DNA, 25 bp, Homo sapien
tgagtgcttttcagattccatctat

SEQ ID NO: 479614 - DNA, 25 bp, Homo sapien
cagattccatctatgctgaaaaaga

SEQ ID NO: 479615 - DNA, 25 bp, Homo sapien
gcccagtagggcataggagagaaca

SEQ ID NO: 479616 - DNA, 25 bp, Homo sapien
aagttttaaattcatggtacaagca

SEQ ID NO: 479617 - DNA, 25 bp, Homo sapien
aattcatggtacaagcatgccatag

SEQ ID NO: 479618 - DNA, 25 bp, Homo sapien
tacaagcatgccatagatgtgcctg

SEQ ID NO: 479619 - DNA, 25 bp, Homo sapien
aagcatgccatagatgtgcctgcaa

SEQ ID NO: 479620 - DNA, 25 bp, Homo sapien
gcatgccatagatgtgcctgcaaga

SEQ ID NO: 479621 - DNA, 25 bp, Homo sapien
tgccatagatgtgcctgcaagaaac

SEQ ID NO: 479622 - DNA, 25 bp, Homo sapien
gatgtgcctgcaagaaacacacaga

SEQ ID NO: 479623 - DNA, 25 bp, Homo sapien
agtgtggtggcgcgaacatggctca

SEQ ID NO: 479624 - DNA, 25 bp, Homo sapien
gcttcagattttcatttagctggga

SEQ ID NO: 479625 - DNA, 25 bp, Homo sapien
agattttcatttagctgggaccaca

SEQ ID NO: 479626 - DNA, 25 bp, Homo sapien
aaaagtgccatcaagttagaagttt

SEQ ID NO: 479627 - DNA, 25 bp, Homo sapien
gaaaacctagtgattctgtctggtc

SEQ ID NO: 479628 - DNA, 25 bp, Homo sapien
tgattctgtctggtcatcccacaca

SEQ ID NO: 479629 - DNA, 25 bp, Homo sapien
tactgagtgctccagagtcttagct

SEQ ID NO: 479630 - DNA, 25 bp, Homo sapien
agtgctccagagtcttagctcacat

SEQ ID NO: 479631 - DNA, 25 bp, Homo sapien
cagagtcttagctcacatgcactga

SEQ ID NO: 479632 - DNA, 25 bp, Homo sapien
acatgcactgagaattctttacagc

SEQ ID NO: 479633 - DNA, 25 bp, Homo sapien
gaagaagaggcttatccttctgcat

SEQ ID NO: 479634 - DNA, 25 bp, Homo sapien
gaggcttatccttctgcattagtat

SEQ ID NO: 479635 - DNA, 25 bp, Homo sapien
tgtttgtacttatgcattccccatg

SEQ ID NO: 479636 - DNA, 25 bp, Homo sapien
gtacttatgcattccccatgggtaa

SEQ ID NO: 479637 - DNA, 25 bp, Homo sapien
atgcattccccatgggtaaaaataa

SEQ ID NO: 479638 - DNA, 25 bp, Homo sapien
tctgagaaaactggaagcatgcata

SEQ ID NO: 479639 - DNA, 25 bp, Homo sapien
aaaactggaagcatgcataaagccc

SEQ ID NO: 479640 - DNA, 25 bp, Homo sapien
tgctgtgcactgaagtatgggtgcc

SEQ ID NO: 479641 - DNA, 25 bp, Homo sapien
gtgcactgaagtatgggtgccttga

SEQ ID NO: 479642 - DNA, 25 bp, Homo sapien
actgaagtatgggtgccttgaggaa

SEQ ID NO: 479643 - DNA, 25 bp, Homo sapien
tgaagtatgggtgccttgaggaaaa

SEQ ID NO: 479644 - DNA, 25 bp, Homo sapien
cttgaggaaaagcagttacacagtt

SEQ ID NO: 479645 - DNA, 25 bp, Homo sapien
ggaaaagcagttacacagttgagtt

SEQ ID NO: 479646 - DNA, 25 bp, Homo sapien
aagcagttacacagttgagttgcaa

SEQ ID NO: 479647 - DNA, 25 bp, Homo sapien
cagttacacagttgagttgcaagct

SEQ ID NO: 479648 - DNA, 25 bp, Homo sapien
tacacagttgagttgcaagctgaat

SEQ ID NO: 479649 - DNA, 25 bp, Homo sapien
gatttgcgaaaatcctacttagtta

SEQ ID NO: 479650 - DNA, 25 bp, Homo sapien
gaaaatcctacttagttactgcgtt

SEQ ID NO: 479651 - DNA, 25 bp, Homo sapien
tcctacttagttactgcgtttacag

SEQ ID NO: 479652 - DNA, 25 bp, Homo sapien
tactgcgtttacagttctttggccc

SEQ ID NO: 479653 - DNA, 25 bp, Homo sapien
tgcgtttacagttctttggcccagt

SEQ ID NO: 479654 - DNA, 25 bp, Homo sapien
tttacagttctttggcccagtctct

SEQ ID NO: 479655 - DNA, 25 bp, Homo sapien
atgattgtgtttactgctggatttt

SEQ ID NO: 479656 - DNA, 25 bp, Homo sapien
ttactgctggatttttgaaggtttt

SEQ ID NO: 479657 - DNA, 25 bp, Homo sapien
gaaagtgccatttcattatttgatt

SEQ ID NO: 479658 - DNA, 25 bp, Homo sapien
tttgattatcaccaaattatctgga

SEQ ID NO: 479659 - DNA, 25 bp, Homo sapien
ggaaataattgggacattgtaactt

SEQ ID NO: 479660 - DNA, 25 bp, Homo sapien
gacctcagtgtgctcctgagcctgg

SEQ ID NO: 479661 - DNA, 25 bp, Homo sapien
ggcggtggctgtgctagacttcatt

SEQ ID NO: 479662 - DNA, 25 bp, Homo sapien
ggtggctgtgctagacttcattcac

SEQ ID NO: 479663 - DNA, 25 bp, Homo sapien
ggctgtgctagacttcattcactac

SEQ ID NO: 479664 - DNA, 25 bp, Homo sapien
gtgctagacttcattcactactgca

SEQ ID NO: 479665 - DNA, 25 bp, Homo sapien
gctagacttcattcactactgcaga

SEQ ID NO: 479666 - DNA, 25 bp, Homo sapien
gacttcattcactactgcagagcca

SEQ ID NO: 479667 - DNA, 25 bp, Homo sapien
attcactactgcagagccaccgtgt

SEQ ID NO: 479668 - DNA, 25 bp, Homo sapien
tactgcagagccaccgtgtgctggg

SEQ ID NO: 479669 - DNA, 25 bp, Homo sapien
agagccaccgtgtgctgggaactaa

SEQ ID NO: 479670 - DNA, 25 bp, Homo sapien
gccaccgtgtgctgggaactaaagg

SEQ ID NO: 479671 - DNA, 25 bp, Homo sapien
agggccatttcccatcgatgtgagc

SEQ ID NO: 479672 - DNA, 25 bp, Homo sapien
atcgatgtgagctcttctcatctca

SEQ ID NO: 479673 - DNA, 25 bp, Homo sapien
tgtgagctcttctcatctcacagca

SEQ ID NO: 479674 - DNA, 25 bp, Homo sapien
agatacccagcatcgcagcagggat

SEQ ID NO: 479675 - DNA, 25 bp, Homo sapien
agcatcgcagcagggatttcacaat

SEQ ID NO: 479676 - DNA, 25 bp, Homo sapien
tttcacaatcccatactgtgtcgcc

SEQ ID NO: 479677 - DNA, 25 bp, Homo sapien
gtaggagctaagacttcctctggac

SEQ ID NO: 479678 - DNA, 25 bp, Homo sapien
gctaagacttcctctggacagatgg

SEQ ID NO: 479679 - DNA, 25 bp, Homo sapien
gcagggcagagttcactgaggtgaa

SEQ ID NO: 479680 - DNA, 25 bp, Homo sapien
gaagaccacaggttaacaccaaagt

SEQ ID NO: 479681 - DNA, 25 bp, Homo sapien
agtattgtacagctgtcaatgcaaa

SEQ ID NO: 479682 - DNA, 25 bp, Homo sapien
gaaaactttggtatattctgtggtt

SEQ ID NO: 479683 - DNA, 25 bp, Homo sapien
ggtatattctgtggttacaactaag

SEQ ID NO: 479684 - DNA, 25 bp, Homo sapien
gttacaactaagattgtgtctggca

SEQ ID NO: 479685 - DNA, 25 bp, Homo sapien
ttaacagaggtattaaaggctagcc

SEQ ID NO: 479686 - DNA, 25 bp, Homo sapien
aaggctagcctaactgttgtctaaa

SEQ ID NO: 479687 - DNA, 25 bp, Homo sapien
tgtacagtatttaagggattttcct

SEQ ID NO: 479688 - DNA, 25 bp, Homo sapien
tttcatctccagtggcattaaacat

SEQ ID NO: 479689 - DNA, 25 bp, Homo sapien
aaaagaccctggcattttttcacat

SEQ ID NO: 479690 - DNA, 25 bp, Homo sapien
atacttgaatccctaaatgcacctg

SEQ ID NO: 479691 - DNA, 25 bp, Homo sapien
tgaatccctaaatgcacctgtcttt

SEQ ID NO: 479692 - DNA, 25 bp, Homo sapien
tgcacctgtctttcactttttgaga

SEQ ID NO: 479693 - DNA, 25 bp, Homo sapien
gtgtgtgcagcggaaacttgtacga

SEQ ID NO: 479694 - DNA, 25 bp, Homo sapien
cagcggaaacttgtacgaatgcccc

SEQ ID NO: 479695 - DNA, 25 bp, Homo sapien
cccacagcggaaatggtgcgcacga

SEQ ID NO: 479696 - DNA, 25 bp, Homo sapien
agcggaaatggtgcgcacgagtaat

SEQ ID NO: 479697 - DNA, 25 bp, Homo sapien
aacaaaaggcgtgcgacttcttgac

SEQ ID NO: 479698 - DNA, 25 bp, Homo sapien
aaaggcgtgcgacttcttgactggc

SEQ ID NO: 479699 - DNA, 25 bp, Homo sapien
gtgcgacttcttgactggcttgttc

SEQ ID NO: 479700 - DNA, 25 bp, Homo sapien
gacttcttgactggcttgttcccgc

SEQ ID NO: 479701 - DNA, 25 bp, Homo sapien
tgactggcttgttcccgcctttctt

SEQ ID NO: 479702 - DNA, 25 bp, Homo sapien
tgctcttattcagtgcgacaacttt

SEQ ID NO: 479703 - DNA, 25 bp, Homo sapien
attcagtgcgacaacttttaataaa

SEQ ID NO: 479704 - DNA, 25 bp, Homo sapien
acacgtgggtttcagtgtatttgcc

SEQ ID NO: 479705 - DNA, 25 bp, Homo sapien
gtgtatttgcctttgaacccttcaa

SEQ ID NO: 479706 - DNA, 25 bp, Homo sapien
ctaaactttagccttttggctggtg

SEQ ID NO: 479707 - DNA, 25 bp, Homo sapien
agccttttggctggtgttgaatgtc

SEQ ID NO: 479708 - DNA, 25 bp, Homo sapien
ctggtgttgaatgtctttagctggg

SEQ ID NO: 479709 - DNA, 25 bp, Homo sapien
ggtgttgtggtttaccgtctccagc

SEQ ID NO: 479710 - DNA, 25 bp, Homo sapien
agcctttccagaaacccttgtggag

SEQ ID NO: 479711 - DNA, 25 bp, Homo sapien
cagtgttggctgcaggtttcatcat

SEQ ID NO: 479712 - DNA, 25 bp, Homo sapien
tcatattgcagtttgaggtcaccac

SEQ ID NO: 479713 - DNA, 25 bp, Homo sapien
cagtttgaggtcaccactatttggg

SEQ ID NO: 479714 - DNA, 25 bp, Homo sapien
gaacaagcttgcgtcctgctgaggg

SEQ ID NO: 479715 - DNA, 25 bp, Homo sapien
aggttggtcacttgaggctttctct

SEQ ID NO: 479716 - DNA, 25 bp, Homo sapien
aaaggtctgtggcatctcctcgtgt

SEQ ID NO: 479717 - DNA, 25 bp, Homo sapien
ggcatctcctcgtgttggagtcaag

SEQ ID NO: 479718 - DNA, 25 bp, Homo sapien
tggagtcaagtcctgtaggcagcat

SEQ ID NO: 479719 - DNA, 25 bp, Homo sapien
gtaggcagcatagggccctggctca

SEQ ID NO: 479720 - DNA, 25 bp, Homo sapien
gccctggctcagcttttctctgcag

SEQ ID NO: 479721 - DNA, 25 bp, Homo sapien
agcggccctctgaagtcacttgctt

SEQ ID NO: 479722 - DNA, 25 bp, Homo sapien
aagtcacttgcttcacggaggtgtt

SEQ ID NO: 479723 - DNA, 25 bp, Homo sapien
tcacggaggtgttactgtctgctgc

SEQ ID NO: 479724 - DNA, 25 bp, Homo sapien
tgtctgctgctggacagagcatgat

SEQ ID NO: 479725 - DNA, 25 bp, Homo sapien
ttcccagggctgtcaggttggtcac

SEQ ID NO: 479726 - DNA, 25 bp, Homo sapien
gtcatccgtgtcatttatcattttg

SEQ ID NO: 479727 - DNA, 25 bp, Homo sapien
taaagtttgaacaccggaaagtcat

SEQ ID NO: 479728 - DNA, 25 bp, Homo sapien
aagtcattactcagtgatttgtaat

SEQ ID NO: 479729 - DNA, 25 bp, Homo sapien
aatttgggacttggattatttatct

SEQ ID NO: 479730 - DNA, 25 bp, Homo sapien
agtaactaatactgcgctgccatca

SEQ ID NO: 479731 - DNA, 25 bp, Homo sapien
taatactgcgctgccatcatggtga

SEQ ID NO: 479732 - DNA, 25 bp, Homo sapien
atcatggtgactgtcatggttctac

SEQ ID NO: 479733 - DNA, 25 bp, Homo sapien
gtcatggttctacagaaatgccctc

SEQ ID NO: 479734 - DNA, 25 bp, Homo sapien
agaaatgccctccatgtgtccctct

SEQ ID NO: 479735 - DNA, 25 bp, Homo sapien
atgtgtccctctaatgttgcatgtt

SEQ ID NO: 479736 - DNA, 25 bp, Homo sapien
atgttgcatgtttcagtgggttgga

SEQ ID NO: 479737 - DNA, 25 bp, Homo sapien
tgcagaagcacctgcgcaagctggt

SEQ ID NO: 479738 - DNA, 25 bp, Homo sapien
gcagaagcacctgcgcaagctggtg

SEQ ID NO: 479739 - DNA, 25 bp, Homo sapien
agcacctgcgcaagctggtgccgct

SEQ ID NO: 479740 - DNA, 25 bp, Homo sapien
ggagcagatgcgcaagttcctttcg

SEQ ID NO: 479741 - DNA, 25 bp, Homo sapien
gagcagatgcgcaagttcctttcgg

SEQ ID NO: 479742 - DNA, 25 bp, Homo sapien
agcagatgcgcaagttcctttcgga

SEQ ID NO: 479743 - DNA, 25 bp, Homo sapien
gcagatgcgcaagttcctttcggac

SEQ ID NO: 479744 - DNA, 25 bp, Homo sapien
cagatgcgcaagttcctttcggacc

SEQ ID NO: 479745 - DNA, 25 bp, Homo sapien
agatgcgcaagttcctttcggaccc

SEQ ID NO: 479746 - DNA, 25 bp, Homo sapien
gatgcgcaagttcctttcggacccg

SEQ ID NO: 479747 - DNA, 25 bp, Homo sapien
gcaagttcctttcggacccgcaggt

SEQ ID NO: 479748 - DNA, 25 bp, Homo sapien
actctagtcctccaggatagtgctc

SEQ ID NO: 479749 - DNA, 25 bp, Homo sapien
agggctcctggatgtccttcctcaa

SEQ ID NO: 479750 - DNA, 25 bp, Homo sapien
tagacaatcctacctggtcccatct

SEQ ID NO: 479751 - DNA, 25 bp, Homo sapien
tgtgacccttgcctcttcctgatac

SEQ ID NO: 479752 - DNA, 25 bp, Homo sapien
tcttcctgatactcccaagagcagg

SEQ ID NO: 479753 - DNA, 25 bp, Homo sapien
gatactcccaagagcaggccccagg

SEQ ID NO: 479754 - DNA, 25 bp, Homo sapien
gggtctgtgtcacatatctctgtgt

SEQ ID NO: 479755 - DNA, 25 bp, Homo sapien
atatctctgtgtgattccttctggt

SEQ ID NO: 479756 - DNA, 25 bp, Homo sapien
tgtgtgattccttctggttgcatcc

SEQ ID NO: 479757 - DNA, 25 bp, Homo sapien
ggttgcatccccaatttcatacaaa

SEQ ID NO: 479758 - DNA, 25 bp, Homo sapien
taaaagtgacctcgttctagcacca

SEQ ID NO: 479759 - DNA, 25 bp, Homo sapien
tggtggagcagcacactgtgtgaac

SEQ ID NO: 479760 - DNA, 25 bp, Homo sapien
tgtgaacctggcagcgctcatcttg

SEQ ID NO: 479761 - DNA, 25 bp, Homo sapien
agcgctcatcttggcttgtttagca

SEQ ID NO: 479762 - DNA, 25 bp, Homo sapien
cttgtttagcagtgcctctgtttac

SEQ ID NO: 479763 - DNA, 25 bp, Homo sapien
gtgcctctgtttacaccataagatg

SEQ ID NO: 479764 - DNA, 25 bp, Homo sapien
taagatgttccgcatgtgtccaaaa

SEQ ID NO: 479765 - DNA, 25 bp, Homo sapien
atgtgtccaaaatttcgcctgctct

SEQ ID NO: 479766 - DNA, 25 bp, Homo sapien
tttcgcctgctctgaaaaacatgcc

SEQ ID NO: 479767 - DNA, 25 bp, Homo sapien
tcccacctgcagatgcggtcagttg

SEQ ID NO: 479768 - DNA, 25 bp, Homo sapien
agtggcgatggtgtttttcttccat

SEQ ID NO: 479769 - DNA, 25 bp, Homo sapien
gtgtttttcttccatgggtaagcca

SEQ ID NO: 479770 - DNA, 25 bp, Homo sapien
gcgattttctttgcgatatttatcc

SEQ ID NO: 479771 - DNA, 25 bp, Homo sapien
gatatttatcctggtctgcatcgag

SEQ ID NO: 479772 - DNA, 25 bp, Homo sapien
tcctggtctgcatcgagtctgtgtt

SEQ ID NO: 479773 - DNA, 25 bp, Homo sapien
tctgtgtttaagaagctgctgcgcc

SEQ ID NO: 479774 - DNA, 25 bp, Homo sapien
ctcttctcgttggtgatatggatat

SEQ ID NO: 479775 - DNA, 25 bp, Homo sapien
ggatatgccttgttgccatgggata

SEQ ID NO: 479776 - DNA, 25 bp, Homo sapien
ttgttgccatgggatacctgttcat

SEQ ID NO: 479777 - DNA, 25 bp, Homo sapien
ggatacctgttcatgtgttttggag

SEQ ID NO: 479778 - DNA, 25 bp, Homo sapien
atgtgttttggaggcaccgtctctc

SEQ ID NO: 479779 - DNA, 25 bp, Homo sapien
tgggaccaggtatcgttcttcctct

SEQ ID NO: 479780 - DNA, 25 bp, Homo sapien
atgcgagacgccatcattgccagcg

SEQ ID NO: 479781 - DNA, 25 bp, Homo sapien
gttgaagctgtacttactgcacaag

SEQ ID NO: 479782 - DNA, 25 bp, Homo sapien
aaactcccacaaaatcagctgcaag

SEQ ID NO: 479783 - DNA, 25 bp, Homo sapien
agctgcaagtaaatccctctggatg

SEQ ID NO: 479784 - DNA, 25 bp, Homo sapien
cctctggatggtgccgccacatgtt

SEQ ID NO: 479785 - DNA, 25 bp, Homo sapien
gccacatgttcctacaagtccagaa

SEQ ID NO: 479786 - DNA, 25 bp, Homo sapien
tcccaatgtgggacgagtgaccgaa

SEQ ID NO: 479787 - DNA, 25 bp, Homo sapien
caagtccagaacaacccttgccaaa

SEQ ID NO: 479788 - DNA, 25 bp, Homo sapien
ggacgagtgaccgaagctgaaccca

SEQ ID NO: 479789 - DNA, 25 bp, Homo sapien
gtgaccgaagctgaacccacaacag

SEQ ID NO: 479790 - DNA, 25 bp, Homo sapien
agccttcctgtgatattccacgtgg

SEQ ID NO: 479791 - DNA, 25 bp, Homo sapien
tcctgtgatattccacgtggtggtt

SEQ ID NO: 479792 - DNA, 25 bp, Homo sapien
aaaaacactccaagggccatccgtg

SEQ ID NO: 479793 - DNA, 25 bp, Homo sapien
gggaaggagagcactcttgtcccca

SEQ ID NO: 479794 - DNA, 25 bp, Homo sapien
aaggagagcactcttgtccccagtc

SEQ ID NO: 479795 - DNA, 25 bp, Homo sapien
tgggctgcagagattggtgccagaa

SEQ ID NO: 479796 - DNA, 25 bp, Homo sapien
gtttgggaattggagctcctccaag

SEQ ID NO: 479797 - DNA, 25 bp, Homo sapien
ggagctcctcctaagattgagtgct

SEQ ID NO: 479798 - DNA, 25 bp, Homo sapien
cctcctaagattgagtgctgcagct

SEQ ID NO: 479799 - DNA, 25 bp, Homo sapien
cagctgtagtggctgctggttggga

SEQ ID NO: 479800 - DNA, 25 bp, Homo sapien
gttgggagagtaagtgccatcacta

SEQ ID NO: 479801 - DNA, 25 bp, Homo sapien
agtgccatcactaatttaaaagtcc

SEQ ID NO: 479802 - DNA, 25 bp, Homo sapien
ttgccatctggaatcaggctttgtc

SEQ ID NO: 479803 - DNA, 25 bp, Homo sapien
gcctgattctcttagccacaaagtc

SEQ ID NO: 479804 - DNA, 25 bp, Homo sapien
gattctcttagccacaaagtcttgg

SEQ ID NO: 479805 - DNA, 25 bp, Homo sapien
ctcttagccacaaagtcttgggtgt

SEQ ID NO: 479806 - DNA, 25 bp, Homo sapien
gaggctgaaccccaaatgaatctgt

SEQ ID NO: 479807 - DNA, 25 bp, Homo sapien
gaaccccaaatgaatctgtcctttt

SEQ ID NO: 479808 - DNA, 25 bp, Homo sapien
gcatttccttcgtaagtgtgggagg

SEQ ID NO: 479809 - DNA, 25 bp, Homo sapien
ccttcgtaagtgtgggagggtctct

SEQ ID NO: 479810 - DNA, 25 bp, Homo sapien
tgtgaggctgggatcgggcgaatgc

SEQ ID NO: 479811 - DNA, 25 bp, Homo sapien
agtcactggatcctcccgtccgagt

SEQ ID NO: 479812 - DNA, 25 bp, Homo sapien
ggaggttttaatgggatgaacttga

SEQ ID NO: 479813 - DNA, 25 bp, Homo sapien
gaacttgatgaacctcaaggtggcc

SEQ ID NO: 479814 - DNA, 25 bp, Homo sapien
aaattgctgcatatttgtgccgtaa

SEQ ID NO: 479815 - DNA, 25 bp, Homo sapien
tgctgcatatttgtgccgtaattat

SEQ ID NO: 479816 - DNA, 25 bp, Homo sapien
gtgccgtaattatgtaccatgaata

SEQ ID NO: 479817 - DNA, 25 bp, Homo sapien
ttcgttgtccaatttgtaagtaaca

SEQ ID NO: 479818 - DNA, 25 bp, Homo sapien
ttgtaagtaacacagtattatgcct

SEQ ID NO: 479819 - DNA, 25 bp, Homo sapien
acacagtattatgcctgagttataa

SEQ ID NO: 479820 - DNA, 25 bp, Homo sapien
tttattttaatagcctgtcataggt

SEQ ID NO: 479821 - DNA, 25 bp, Homo sapien
agcctgtcataggttttaaatctgc

SEQ ID NO: 479822 - DNA, 25 bp, Homo sapien
taaatctgctttagtttcacattgc

SEQ ID NO: 479823 - DNA, 25 bp, Homo sapien
gtttcacattgcagttagccccaga

SEQ ID NO: 479824 - DNA, 25 bp, Homo sapien
gaaatccgtgaagtcacattccaca

SEQ ID NO: 479825 - DNA, 25 bp, Homo sapien
gatgctttatatggttatttctgta

SEQ ID NO: 479826 - DNA, 25 bp, Homo sapien
atttctgtagctgtgttaccatctt

SEQ ID NO: 479827 - DNA, 25 bp, Homo sapien
agctgtgttaccatcttcatcttat

SEQ ID NO: 479828 - DNA, 25 bp, Homo sapien
gtgttaccatcttcatcttattttt

SEQ ID NO: 479829 - DNA, 25 bp, Homo sapien
aaaactggcccaggattttacagtg

SEQ ID NO: 479830 - DNA, 25 bp, Homo sapien
gtgtccttcagagaatggttagttg

SEQ ID NO: 479831 - DNA, 25 bp, Homo sapien
ttagttgagagtagaccatagtggt

SEQ ID NO: 479832 - DNA, 25 bp, Homo sapien
agaccatagtggtaagtgttctata

SEQ ID NO: 479833 - DNA, 25 bp, Homo sapien
gtaactgggtggctactttagatct

SEQ ID NO: 479834 - DNA, 25 bp, Homo sapien
actgggtggctactttagatctagc

SEQ ID NO: 479835 - DNA, 25 bp, Homo sapien
ggaattttcagataaaagtccgata

SEQ ID NO: 479836 - DNA, 25 bp, Homo sapien
gtacttgtggtctacggtgagagca

SEQ ID NO: 479837 - DNA, 25 bp, Homo sapien
gacgctcacgctgccgggtctggta

SEQ ID NO: 479838 - DNA, 25 bp, Homo sapien
tgccgggtctggtatccgcggataa

SEQ ID NO: 479839 - DNA, 25 bp, Homo sapien
tggtatccgcggataacggcaccta

SEQ ID NO: 479840 - DNA, 25 bp, Homo sapien
ggataacggcacctacacttgcgag

SEQ ID NO: 479841 - DNA, 25 bp, Homo sapien
aacggcacctacacttgcgaggcgt

SEQ ID NO: 479842 - DNA, 25 bp, Homo sapien
ctacacttgcgaggcgtccaataag

SEQ ID NO: 479843 - DNA, 25 bp, Homo sapien
gaggcgtccaataagcacggccatg

SEQ ID NO: 479844 - DNA, 25 bp, Homo sapien
ataagcacggccatgcgagggcgct

SEQ ID NO: 479845 - DNA, 25 bp, Homo sapien
atgcgagggcgctctacgtacttgt

SEQ ID NO: 479846 - DNA, 25 bp, Homo sapien
ggcgctctacgtacttgtggtctac

SEQ ID NO: 479847 - DNA, 25 bp, Homo sapien
ggttaggcacctattaaaacatcac

SEQ ID NO: 479848 - DNA, 25 bp, Homo sapien
tggtttgaagaactggatattcccc

SEQ ID NO: 479849 - DNA, 25 bp, Homo sapien
ggatattccccaatgttttaactga

SEQ ID NO: 479850 - DNA, 25 bp, Homo sapien
tccccaatgttttaactgagtttat

SEQ ID NO: 479851 - DNA, 25 bp, Homo sapien
gagtttatgtgcctaagtcttcaaa

SEQ ID NO: 479852 - DNA, 25 bp, Homo sapien
tatgtgcctaagtcttcaaaatggg

SEQ ID NO: 479853 - DNA, 25 bp, Homo sapien
caagtgaggctgtttggttcttctg

SEQ ID NO: 479854 - DNA, 25 bp, Homo sapien
aaacacactcattttctgacacatg

SEQ ID NO: 479855 - DNA, 25 bp, Homo sapien
tttctgacacatggctagactttat

SEQ ID NO: 479856 - DNA, 25 bp, Homo sapien
gctagactttatgccaggtacatgc

SEQ ID NO: 479857 - DNA, 25 bp, Homo sapien
atgccaggtacatgctatttttgaa

SEQ ID NO: 479858 - DNA, 25 bp, Homo sapien
gggatgatgtctctgtcagttctgc

SEQ ID NO: 479859 - DNA, 25 bp, Homo sapien
gttttagcctagcaggaaaagaagc

SEQ ID NO: 479860 - DNA, 25 bp, Homo sapien
ttttagcctagcaggaaaagaagca

SEQ ID NO: 479861 - DNA, 25 bp, Homo sapien
aaaagaagcagagcccagaagcagg

SEQ ID NO: 479862 - DNA, 25 bp, Homo sapien
gaagcagagcccagaagcagggcct

SEQ ID NO: 479863 - DNA, 25 bp, Homo sapien
agaagcagggcctggtacccagcct

SEQ ID NO: 479864 - DNA, 25 bp, Homo sapien
ctggtacccagcctgcctaacaagg

SEQ ID NO: 479865 - DNA, 25 bp, Homo sapien
tggtacccagcctgcctaacaaggg

SEQ ID NO: 479866 - DNA, 25 bp, Homo sapien
ggtacccagcctgcctaacaaggga

SEQ ID NO: 479867 - DNA, 25 bp, Homo sapien
tactggatcctggtacccctgagaa

SEQ ID NO: 479868 - DNA, 25 bp, Homo sapien
tggtacccctgagaagacacccaga

SEQ ID NO: 479869 - DNA, 25 bp, Homo sapien
tttgtatgccagtgattctcaagat

SEQ ID NO: 479870 - DNA, 25 bp, Homo sapien
gtagtagttgttactgttggcagtt

SEQ ID NO: 479871 - DNA, 25 bp, Homo sapien
cagtttgtagtagtattcaggtatt

SEQ ID NO: 479872 - DNA, 25 bp, Homo sapien
aatcagtgtcttttatctggtgatc

SEQ ID NO: 479873 - DNA, 25 bp, Homo sapien
tctggtgatcactgtggtatctaca

SEQ ID NO: 479874 - DNA, 25 bp, Homo sapien
ggtatctacagtattctagtctcct

SEQ ID NO: 479875 - DNA, 25 bp, Homo sapien
agtattctagtctcctgcacaaaaa

SEQ ID NO: 479876 - DNA, 25 bp, Homo sapien
gtctcctgcacaaaaactgaaccca

SEQ ID NO: 479877 - DNA, 25 bp, Homo sapien
gcacaaaaactgaacccactgggcc

SEQ ID NO: 479878 - DNA, 25 bp, Homo sapien
aactgaacccactgggcctatgcat

SEQ ID NO: 479879 - DNA, 25 bp, Homo sapien
gcctatgcatccctcacactttttt

SEQ ID NO: 479880 - DNA, 25 bp, Homo sapien
gttctaagtagattgcatggtggat

SEQ ID NO: 479881 - DNA, 25 bp, Homo sapien
agattgcatggtggatagagcacat

SEQ ID NO: 479882 - DNA, 25 bp, Homo sapien
tggtggatagagcacatgctgccca

SEQ ID NO: 479883 - DNA, 25 bp, Homo sapien
tggatagagcacatgctgcccacat

SEQ ID NO: 479884 - DNA, 25 bp, Homo sapien
gatagagcacatgctgcccacatca

SEQ ID NO: 479885 - DNA, 25 bp, Homo sapien
gctgcccacatcacgggtgtcctta

SEQ ID NO: 479886 - DNA, 25 bp, Homo sapien
acatcacgggtgtccttaccatttt

SEQ ID NO: 479887 - DNA, 25 bp, Homo sapien
catcacgggtgtccttaccattttt

SEQ ID NO: 479888 - DNA, 25 bp, Homo sapien
tcacgggtgtccttaccatttttcg

SEQ ID NO: 479889 - DNA, 25 bp, Homo sapien
gtgtccttaccatttttcgtacaat

SEQ ID NO: 479890 - DNA, 25 bp, Homo sapien
tccttaccatttttcgtacaatccg

SEQ ID NO: 479891 - DNA, 25 bp, Homo sapien
aagttttaaattcatggtacaagca

SEQ ID NO: 479892 - DNA, 25 bp, Homo sapien
aattcatggtacaagcatgccatag

SEQ ID NO: 479893 - DNA, 25 bp, Homo sapien
tacaagcatgccatagatgtgcctg

SEQ ID NO: 479894 - DNA, 25 bp, Homo sapien
aagcatgccatagatgtgcctgcaa

SEQ ID NO: 479895 - DNA, 25 bp, Homo sapien
gcatgccatagatgtgcctgcaaga

SEQ ID NO: 479896 - DNA, 25 bp, Homo sapien
tgccatagatgtgcctgcaagaaac

SEQ ID NO: 479897 - DNA, 25 bp, Homo sapien
gatgtgcctgcaagaaacacacaga

SEQ ID NO: 479898 - DNA, 25 bp, Homo sapien
tgtggtggcgcgaacatggctcact

SEQ ID NO: 479899 - DNA, 25 bp, Homo sapien
tccacctgcttcagattttcattta

SEQ ID NO: 479900 - DNA, 25 bp, Homo sapien
agattttcatttagctgggaccaca

SEQ ID NO: 479901 - DNA, 25 bp, Homo sapien
aaaagtgccatcaagttagaagttt

SEQ ID NO: 479902 - DNA, 25 bp, Homo sapien
tactacgtacgtaaacttgacatac

SEQ ID NO: 479903 - DNA, 25 bp, Homo sapien
gggataaagctctccatatagctac

SEQ ID NO: 479904 - DNA, 25 bp, Homo sapien
gctctccatatagctacatggacta

SEQ ID NO: 479905 - DNA, 25 bp, Homo sapien
tacatggactactcaaatatgaagg

SEQ ID NO: 479906 - DNA, 25 bp, Homo sapien
atatgaaggaccatcccatcctatc

SEQ ID NO: 479907 - DNA, 25 bp, Homo sapien
ttacccttagaggtacgtgctctct

SEQ ID NO: 479908 - DNA, 25 bp, Homo sapien
ttagaggtacgtgctctctatcctc

SEQ ID NO: 479909 - DNA, 25 bp, Homo sapien
tgccccatggagcaacgccttatgt

SEQ ID NO: 479910 - DNA, 25 bp, Homo sapien
ggagcaacgccttatgtgaatattc

SEQ ID NO: 479911 - DNA, 25 bp, Homo sapien
aagggtggctgctgggcctaaaact

SEQ ID NO: 479912 - DNA, 25 bp, Homo sapien
gctgctgggcctaaaactcaaacct

SEQ ID NO: 479913 - DNA, 25 bp, Homo sapien
acactgccggtaaactggaatgtct

SEQ ID NO: 479914 - DNA, 25 bp, Homo sapien
ccggtaaactggaatgtctcatgaa

SEQ ID NO: 479915 - DNA, 25 bp, Homo sapien
tgaagatttcacgacaatggcacat

SEQ ID NO: 479916 - DNA, 25 bp, Homo sapien
aatggcacatcagaacatcctaaag

SEQ ID NO: 479917 - DNA, 25 bp, Homo sapien
agactggtttattcctgcgtgactt

SEQ ID NO: 479918 - DNA, 25 bp, Homo sapien
tattcctgcgtgacttcagttccca

SEQ ID NO: 479919 - DNA, 25 bp, Homo sapien
gtggcacatggagctaattctggtt

SEQ ID NO: 479920 - DNA, 25 bp, Homo sapien
aattctggttgatctctgcagacca

SEQ ID NO: 479921 - DNA, 25 bp, Homo sapien
atctctgcagaccatattccaatca

SEQ ID NO: 479922 - DNA, 25 bp, Homo sapien
tctacagtaggacgttgctaaccaa

SEQ ID NO: 479923 - DNA, 25 bp, Homo sapien
gttgctaaccaaatatcacctaaaa

SEQ ID NO: 479924 - DNA, 25 bp, Homo sapien
agggtctgcacttcggctgctctcg

SEQ ID NO: 479925 - DNA, 25 bp, Homo sapien
gctgctctcgggttagcaccctatg

SEQ ID NO: 479926 - DNA, 25 bp, Homo sapien
tagcaccctatggtgccttctcttg

SEQ ID NO: 479927 - DNA, 25 bp, Homo sapien
ccttctcttgtgatccctgacctaa

SEQ ID NO: 479928 - DNA, 25 bp, Homo sapien
ttgtgatccctgacctaacctgtct

SEQ ID NO: 479929 - DNA, 25 bp, Homo sapien
ttccttttcctcaacctcaggtgga

SEQ ID NO: 479930 - DNA, 25 bp, Homo sapien
ttttcctcaacctcaggtggagccg

SEQ ID NO: 479931 - DNA, 25 bp, Homo sapien
tacgggccgggtggtcatgaggaag

SEQ ID NO: 479932 - DNA, 25 bp, Homo sapien
gaggaagccaaggtccgaataaggt

SEQ ID NO: 479933 - DNA, 25 bp, Homo sapien
gccaaggtccgaataaggtcctgag

SEQ ID NO: 479934 - DNA, 25 bp, Homo sapien
gcacgagggtctgcacttcggctgc

SEQ ID NO: 479935 - DNA, 25 bp, Homo sapien
aggaggccgatgtcagtcctcccag

SEQ ID NO: 479936 - DNA, 25 bp, Homo sapien
agtcctcccagcaaagctgtgtcat

SEQ ID NO: 479937 - DNA, 25 bp, Homo sapien
cagcaaagctgtgtcatttatctga

SEQ ID NO: 479938 - DNA, 25 bp, Homo sapien
agctgtgtcatttatctgaatggaa

SEQ ID NO: 479939 - DNA, 25 bp, Homo sapien
agactcagattcttggctgtctgtt

SEQ ID NO: 479940 - DNA, 25 bp, Homo sapien
agattcttggctgtctgtttaacca

SEQ ID NO: 479941 - DNA, 25 bp, Homo sapien
ggctgtctgtttaaccaatcacgat

SEQ ID NO: 479942 - DNA, 25 bp, Homo sapien
aaccaatcacgatatgggatttgag

SEQ ID NO: 479943 - DNA, 25 bp, Homo sapien
gagacatgaaagctactaggtcagg

SEQ ID NO: 479944 - DNA, 25 bp, Homo sapien
gaaagctactaggtcagggaaaata

SEQ ID NO: 479945 - DNA, 25 bp, Homo sapien
atttttattgtccagatcctctact

SEQ ID NO: 479946 - DNA, 25 bp, Homo sapien
gtgtggctcggtgccagtctccaga

SEQ ID NO: 479947 - DNA, 25 bp, Homo sapien
gtggtggcagacatggctacctgca

SEQ ID NO: 479948 - DNA, 25 bp, Homo sapien
agacatggctacctgcagctgagct

SEQ ID NO: 479949 - DNA, 25 bp, Homo sapien
atggctacctgcagctgagctgcca

SEQ ID NO: 479950 - DNA, 25 bp, Homo sapien
tctgagtcctcaaagaccaggccat

SEQ ID NO: 479951 - DNA, 25 bp, Homo sapien
aaagaccaggccattttcttcatgt

SEQ ID NO: 479952 - DNA, 25 bp, Homo sapien
tcttcatgtttcaccagctcatgta

SEQ ID NO: 479953 - DNA, 25 bp, Homo sapien
gtttcaccagctcatgtaaactgca

SEQ ID NO: 479954 - DNA, 25 bp, Homo sapien
accagctcatgtaaactgcagagag

SEQ ID NO: 479955 - DNA, 25 bp, Homo sapien
tgcagagagaaccaagggaacccga

SEQ ID NO: 479956 - DNA, 25 bp, Homo sapien
ccaagggaacccgagagcttcctgg

SEQ ID NO: 479957 - DNA, 25 bp, Homo sapien
ctatgcagtgatggaacattatgta

SEQ ID NO: 479958 - DNA, 25 bp, Homo sapien
ggaacattatgtaatgcagctcatt

SEQ ID NO: 479959 - DNA, 25 bp, Homo sapien
cattatgtaatgcagctcatttctt

SEQ ID NO: 479960 - DNA, 25 bp, Homo sapien
atttcttgaccaactagttatagaa

SEQ ID NO: 479961 - DNA, 25 bp, Homo sapien
gaccaactagttatagaagtaccat

SEQ ID NO: 479962 - DNA, 25 bp, Homo sapien
aactagttatagaagtaccattagg

SEQ ID NO: 479963 - DNA, 25 bp, Homo sapien
agattctcagaggttttgatgttca

SEQ ID NO: 479964 - DNA, 25 bp, Homo sapien
ctcagaggttttgatgttcagtact

SEQ ID NO: 479965 - DNA, 25 bp, Homo sapien
gaggttttgatgttcagtactgacg

SEQ ID NO: 479966 - DNA, 25 bp, Homo sapien
ttgatgttcagtactgacggaccat

SEQ ID NO: 479967 - DNA, 25 bp, Homo sapien
tgttcagtactgacggaccatgttc

SEQ ID NO: 479968 - DNA, 25 bp, Homo sapien
ttcagtgaggttgctccccagctga

SEQ ID NO: 479969 - DNA, 25 bp, Homo sapien
cagtgaggttgctccccagctgagc

SEQ ID NO: 479970 - DNA, 25 bp, Homo sapien
gaggttgctccccagctgagcgcac

SEQ ID NO: 479971 - DNA, 25 bp, Homo sapien
cagctgagcgcaccgggcatgggat

SEQ ID NO: 479972 - DNA, 25 bp, Homo sapien
caccgggcatgggatgtggaggctg

SEQ ID NO: 479973 - DNA, 25 bp, Homo sapien
tggaggctggcgacacaccctgtgc

SEQ ID NO: 479974 - DNA, 25 bp, Homo sapien
gaggctggcgacacaccctgtgcct

SEQ ID NO: 479975 - DNA, 25 bp, Homo sapien
acaccctgtgcctctccaaggctgg

SEQ ID NO: 479976 - DNA, 25 bp, Homo sapien
ctctctgggtctcagatgtccatct

SEQ ID NO: 479977 - DNA, 25 bp, Homo sapien
tgagggtagaagaaagttattcccg

SEQ ID NO: 479978 - DNA, 25 bp, Homo sapien
aatgaaaagtcattgtactgaactg

SEQ ID NO: 479979 - DNA, 25 bp, Homo sapien
ggatggcacttagcgggtcctgcaa

SEQ ID NO: 479980 - DNA, 25 bp, Homo sapien
gtcctgccgagaactgtgagctttg

SEQ ID NO: 479981 - DNA, 25 bp, Homo sapien
actgtgagctttgagttaataaact

SEQ ID NO: 479982 - DNA, 25 bp, Homo sapien
tagagctgggccagtcgaagcgttt

SEQ ID NO: 479983 - DNA, 25 bp, Homo sapien
gggccagtcgaagcgtttgctatta

SEQ ID NO: 479984 - DNA, 25 bp, Homo sapien
gcgtttgctattatcattagcgcag

SEQ ID NO: 479985 - DNA, 25 bp, Homo sapien
tatcattagcgcagtgattatcatt

SEQ ID NO: 479986 - DNA, 25 bp, Homo sapien
agtgattatcatttcctgtgttgtc

SEQ ID NO: 479987 - DNA, 25 bp, Homo sapien
tttcctgtgttgtcagataccttgc

SEQ ID NO: 479988 - DNA, 25 bp, Homo sapien
agataccttgcaaggcgctaaacaa

SEQ ID NO: 479989 - DNA, 25 bp, Homo sapien
gcaaggcgctaaacaaaactttctg

SEQ ID NO: 479990 - DNA, 25 bp, Homo sapien
taactcatcctgtagctgcagcaac

SEQ ID NO: 479991 - DNA, 25 bp, Homo sapien
gtcctggtgatgtcattgaactctt

SEQ ID NO: 479992 - DNA, 25 bp, Homo sapien
ttctaagtagattgcatggtggata

SEQ ID NO: 479993 - DNA, 25 bp, Homo sapien
atggtggatagagcacatgctgccc

SEQ ID NO: 479994 - DNA, 25 bp, Homo sapien
tggatagagcacatgctgcccacat

SEQ ID NO: 479995 - DNA, 25 bp, Homo sapien
gatagagcacatgctgcccacatca

SEQ ID NO: 479996 - DNA, 25 bp, Homo sapien
gctgcccacatcacgggtgtcctta

SEQ ID NO: 479997 - DNA, 25 bp, Homo sapien
acatcacgggtgtccttaccatttt

SEQ ID NO: 479998 - DNA, 25 bp, Homo sapien
tcacgggtgtccttaccatttttcg

SEQ ID NO: 479999 - DNA, 25 bp, Homo sapien
gtgtccttaccatttttcgtacaat

SEQ ID NO: 480000 - DNA, 25 bp, Homo sapien
tccttaccatttttcgtacaatccg

SEQ ID NO: 480001 - DNA, 25 bp, Homo sapien
tataaacccgctggtgcgccgaact

SEQ ID NO: 480002 - DNA, 25 bp, Homo sapien
tgcgccgaactgtccgatttcttgg

SEQ ID NO: 480003 - DNA, 25 bp, Homo sapien
aatgctggacaagtagtcacaggaa

SEQ ID NO: 480004 - DNA, 25 bp, Homo sapien
tcacaggaaatctggccccacattt

SEQ ID NO: 480005 - DNA, 25 bp, Homo sapien
cttgccctgtgtaagcccaattata

SEQ ID NO: 480006 - DNA, 25 bp, Homo sapien
gcccaattatacagcacttggatgt

SEQ ID NO: 480007 - DNA, 25 bp, Homo sapien
gtcagcagtatacacaattcatcag

SEQ ID NO: 480008 - DNA, 25 bp, Homo sapien
gaagaggcctgtactggcaacccag

SEQ ID NO: 480009 - DNA, 25 bp, Homo sapien
tgagagcccgaaaaacctttccatc

SEQ ID NO: 480010 - DNA, 25 bp, Homo sapien
ctttccatccaaagaagcagctctc

SEQ ID NO: 480011 - DNA, 25 bp, Homo sapien
tatgcagctatgtatctgaccatgt

SEQ ID NO: 480012 - DNA, 25 bp, Homo sapien
tacaaccgcattaccatagagtcag

SEQ ID NO: 480013 - DNA, 25 bp, Homo sapien
gcattaccatagagtcagcgtttga

SEQ ID NO: 480014 - DNA, 25 bp, Homo sapien
gtcagcgtttgacaatccaacttac

SEQ ID NO: 480015 - DNA, 25 bp, Homo sapien
gtttgacaatccaacttacgagact

SEQ ID NO: 480016 - DNA, 25 bp, Homo sapien
aacttacgagactggagagacgaga

SEQ ID NO: 480017 - DNA, 25 bp, Homo sapien
gaatatgaagtctccatctaggtgg

SEQ ID NO: 480018 - DNA, 25 bp, Homo sapien
gggcagtctagggaagtcaactcag

SEQ ID NO: 480019 - DNA, 25 bp, Homo sapien
agtcaactcagacttgcaccacagt

SEQ ID NO: 480020 - DNA, 25 bp, Homo sapien
agacttgcaccacagtccagcagca

SEQ ID NO: 480021 - DNA, 25 bp, Homo sapien
acagtccagcagcaaggctccttgc

SEQ ID NO: 480022 - DNA, 25 bp, Homo sapien
ctggcagaggatgatgacaggctca

SEQ ID NO: 480023 - DNA, 25 bp, Homo sapien
aacatttttagcatgtcttgatata

SEQ ID NO: 480024 - DNA, 25 bp, Homo sapien
taatgtttgtttgtttcacctctct

SEQ ID NO: 480025 - DNA, 25 bp, Homo sapien
gtttcacctctctggttcattggat

SEQ ID NO: 480026 - DNA, 25 bp, Homo sapien
ctggttcattggattgctactattt

SEQ ID NO: 480027 - DNA, 25 bp, Homo sapien
ggattgctactatttatgctttcat

SEQ ID NO: 480028 - DNA, 25 bp, Homo sapien
atttatgctttcatggactttatct

SEQ ID NO: 480029 - DNA, 25 bp, Homo sapien
ggactttatcttcacagtttactgt

SEQ ID NO: 480030 - DNA, 25 bp, Homo sapien
tactgtatcttgtaaaggctttacc

SEQ ID NO: 480031 - DNA, 25 bp, Homo sapien
aggctttaccacatcagctgtactg

SEQ ID NO: 480032 - DNA, 25 bp, Homo sapien
accacatcagctgtactggctgttt

SEQ ID NO: 480033 - DNA, 25 bp, Homo sapien
acatctctttaattgcagaagcaag

SEQ ID NO: 480034 - DNA, 25 bp, Homo sapien
tgcccttgagaaccctctcgaggag

SEQ ID NO: 480035 - DNA, 25 bp, Homo sapien
tttgcctgaggttgactatacatac

SEQ ID NO: 480036 - DNA, 25 bp, Homo sapien
ctctcgaggagtctggcctcatgaa

SEQ ID NO: 480037 - DNA, 25 bp, Homo sapien
gcctgaggttgactatacatacaaa

SEQ ID NO: 480038 - DNA, 25 bp, Homo sapien
aaacggcagatatatcctgaatgaa

SEQ ID NO: 480039 - DNA, 25 bp, Homo sapien
gtgagatttttaccctgtgaatttc

SEQ ID NO: 480040 - DNA, 25 bp, Homo sapien
catacaaatattgagcatttcctcc

SEQ ID NO: 480041 - DNA, 25 bp, Homo sapien
atttcctcctggtctccgtgataaa

SEQ ID NO: 480042 - DNA, 25 bp, Homo sapien
ctcctggtctccgtgataaacaaag

SEQ ID NO: 480043 - DNA, 25 bp, Homo sapien
tggtctccgtgataaacaaaggttt

SEQ ID NO: 480044 - DNA, 25 bp, Homo sapien
aaggttttgatattgttcggcgaga

SEQ ID NO: 480045 - DNA, 25 bp, Homo sapien
tcacacatgcatcttaaaaggatgg

SEQ ID NO: 480046 - DNA, 25 bp, Homo sapien
ggcaatggttattgatagtctcaac

SEQ ID NO: 480047 - DNA, 25 bp, Homo sapien
aatggttattgatagtctcaacgta

SEQ ID NO: 480048 - DNA, 25 bp, Homo sapien
gatagtctcaacgtaatttcagtag

SEQ ID NO: 480049 - DNA, 25 bp, Homo sapien
tagtctcaacgtaatttcagtagaa

SEQ ID NO: 480050 - DNA, 25 bp, Homo sapien
agatttctttagggattattgtaca

SEQ ID NO: 480051 - DNA, 25 bp, Homo sapien
tagggattattgtacagagttctag

SEQ ID NO: 480052 - DNA, 25 bp, Homo sapien
taaaaatttatttggcagcctgatt

SEQ ID NO: 480053 - DNA, 25 bp, Homo sapien
ctaattaattgaaacgccatggaat

SEQ ID NO: 480054 - DNA, 25 bp, Homo sapien
gaaacgccatggaatgtattgtatt

SEQ ID NO: 480055 - DNA, 25 bp, Homo sapien
acgccatggaatgtattgtatttct

SEQ ID NO: 480056 - DNA, 25 bp, Homo sapien
aaaacatccttaggctgaatccagg

SEQ ID NO: 480057 - DNA, 25 bp, Homo sapien
acaaattaccctgcactcaggaatc

SEQ ID NO: 480058 - DNA, 25 bp, Homo sapien
gaatccaggttactttcaaattttg

SEQ ID NO: 480059 - DNA, 25 bp, Homo sapien
aacattaacacattagtcctcaaat

SEQ ID NO: 480060 - DNA, 25 bp, Homo sapien
ctgcactcaggaatctcctacatga

SEQ ID NO: 480061 - DNA, 25 bp, Homo sapien
gaaagtagtggaagcctcattttaa

SEQ ID NO: 480062 - DNA, 25 bp, Homo sapien
attgaagcagcgaaaactaaacctt

SEQ ID NO: 480063 - DNA, 25 bp, Homo sapien
caggaatctcctacatgatattgct

SEQ ID NO: 480064 - DNA, 25 bp, Homo sapien
gatattgctggaataagtgtccata

SEQ ID NO: 480065 - DNA, 25 bp, Homo sapien
agtgtccatatgaactacagttttg

SEQ ID NO: 480066 - DNA, 25 bp, Homo sapien
gaactacagttttgctgatatgaat

SEQ ID NO: 480067 - DNA, 25 bp, Homo sapien
ccatcttaaaccctggccactgtgg

SEQ ID NO: 480068 - DNA, 25 bp, Homo sapien
tgggagcctgtcaagaagcacagga

SEQ ID NO: 480069 - DNA, 25 bp, Homo sapien
aagaagcacaggatttctgaagtgg

SEQ ID NO: 480070 - DNA, 25 bp, Homo sapien
gtgatgcaaagttaccctatgtctg

SEQ ID NO: 480071 - DNA, 25 bp, Homo sapien
tgcaagttcaaggactagggcaggt

SEQ ID NO: 480072 - DNA, 25 bp, Homo sapien
gaagtcagcagcctcagcttggcgt

SEQ ID NO: 480073 - DNA, 25 bp, Homo sapien
agcagcctcagcttggcgtgcagct

SEQ ID NO: 480074 - DNA, 25 bp, Homo sapien
agcttggcgtgcagctcatcatgga

SEQ ID NO: 480075 - DNA, 25 bp, Homo sapien
tggcgtgcagctcatcatggacatg

SEQ ID NO: 480076 - DNA, 25 bp, Homo sapien
cacacagggctctgagcctgatgga

SEQ ID NO: 480077 - DNA, 25 bp, Homo sapien
acagggctctgagcctgatggagat

SEQ ID NO: 480078 - DNA, 25 bp, Homo sapien
accatgcctagtcgtcacgactcta

SEQ ID NO: 480079 - DNA, 25 bp, Homo sapien
gtcgtcacgactctaggcccagcaa

SEQ ID NO: 480080 - DNA, 25 bp, Homo sapien
gggacccaggcatttttgtgaggct

SEQ ID NO: 480081 - DNA, 25 bp, Homo sapien
tttttgtgaggctgtccacacccta

SEQ ID NO: 480082 - DNA, 25 bp, Homo sapien
tgtgaggctgtccacaccctatctg

SEQ ID NO: 480083 - DNA, 25 bp, Homo sapien
accctatctgcctgtgaggactggg

SEQ ID NO: 480084 - DNA, 25 bp, Homo sapien
ggaggctaggcctgactgtcattgc

SEQ ID NO: 480085 - DNA, 25 bp, Homo sapien
taggcctgactgtcattgctctacg

SEQ ID NO: 480086 - DNA, 25 bp, Homo sapien
gactgtcattgctctacggccacat

SEQ ID NO: 480087 - DNA, 25 bp, Homo sapien
agaggagtttttctaccttccatct

SEQ ID NO: 480088 - DNA, 25 bp, Homo sapien
ctaccttccatctgcttctgcatat

SEQ ID NO: 480089 - DNA, 25 bp, Homo sapien
gggccaacccagaggcacgtccaga

SEQ ID NO: 480090 - DNA, 25 bp, Homo sapien
aacccagaggcacgtccagattatc

SEQ ID NO: 480091 - DNA, 25 bp, Homo sapien
ccagaggcacgtccagattatcatg

SEQ ID NO: 480092 - DNA, 25 bp, Homo sapien
ggcacgtccagattatcatggagaa

SEQ ID NO: 480093 - DNA, 25 bp, Homo sapien
tggagaaacttctccggaccgtgaa

SEQ ID NO: 480094 - DNA, 25 bp, Homo sapien
tccggaccgtgaaccgaaccgtcat

SEQ ID NO: 480095 - DNA, 25 bp, Homo sapien
gaaccgaaccgtcatttccatggga

SEQ ID NO: 480096 - DNA, 25 bp, Homo sapien
gaaccgtcatttccatgggacgaga

SEQ ID NO: 480097 - DNA, 25 bp, Homo sapien
atttccatgggacgagattctgaac

SEQ ID NO: 480098 - DNA, 25 bp, Homo sapien
atgggacgagattctgaactcattg

SEQ ID NO: 480099 - DNA, 25 bp, Homo sapien
gccacatcctggaggtgctgtacag

SEQ ID NO: 480100 - DNA, 25 bp, Homo sapien
ggaactgagcccaaggaaatagcgg

SEQ ID NO: 480101 - DNA, 25 bp, Homo sapien
ttgcaggcagacattgagctgcgag

SEQ ID NO: 480102 - DNA, 25 bp, Homo sapien
agctgcgagacaatgggaataacct

SEQ ID NO: 480103 - DNA, 25 bp, Homo sapien
gaataaccttcgtgtccacctgtgg

SEQ ID NO: 480104 - DNA, 25 bp, Homo sapien
gggactgattcaatacatatgcacg

SEQ ID NO: 480105 - DNA, 25 bp, Homo sapien
atacatatgcacgtccacagcagag

SEQ ID NO: 480106 - DNA, 25 bp, Homo sapien
gcacgtccacagcagagaatgccat

SEQ ID NO: 480107 - DNA, 25 bp, Homo sapien
agagaatgccatgcggcctgtgtaa

SEQ ID NO: 480108 - DNA, 25 bp, Homo sapien
gccatgcggcctgtgtaagaattaa

SEQ ID NO: 480109 - DNA, 25 bp, Homo sapien
aaggcagatttatatgcactgatga

SEQ ID NO: 480110 - DNA, 25 bp, Homo sapien
gcactgatgaggaaagacatactgt

SEQ ID NO: 480111 - DNA, 25 bp, Homo sapien
cttaaaagtaatcgtcctagctatt

SEQ ID NO: 480112 - DNA, 25 bp, Homo sapien
aagtaatcgtcctagctattacatg

SEQ ID NO: 480113 - DNA, 25 bp, Homo sapien
aatcgtcctagctattacatgtttc

SEQ ID NO: 480114 - DNA, 25 bp, Homo sapien
atcgtcctagctattacatgtttcc

SEQ ID NO: 480115 - DNA, 25 bp, Homo sapien
tcgtcctagctattacatgtttcca

SEQ ID NO: 480116 - DNA, 25 bp, Homo sapien
gtcctagctattacatgtttccaag

SEQ ID NO: 480117 - DNA, 25 bp, Homo sapien
ctagctattacatgtttccaagatt

SEQ ID NO: 480118 - DNA, 25 bp, Homo sapien
atctcacttctctgtctcaaacttt

SEQ ID NO: 480119 - DNA, 25 bp, Homo sapien
agatccatttgcttttcgaaaccct

SEQ ID NO: 480120 - DNA, 25 bp, Homo sapien
ataattgagctaaacttggtgcctg

SEQ ID NO: 480121 - DNA, 25 bp, Homo sapien
atgaattattgcagcttagttcttc

SEQ ID NO: 480122 - DNA, 25 bp, Homo sapien
ggaattgttttgagtattaacacac

SEQ ID NO: 480123 - DNA, 25 bp, Homo sapien
attaacacacacactcattatacag

SEQ ID NO: 480124 - DNA, 25 bp, Homo sapien
cacacacactcattatacagatttt

SEQ ID NO: 480125 - DNA, 25 bp, Homo sapien
tgatcagtaaaaatgagctgctgtt

SEQ ID NO: 480126 - DNA, 25 bp, Homo sapien
aatgagctgctgttgtagtaattct

SEQ ID NO: 480127 - DNA, 25 bp, Homo sapien
gctgctgttgtagtaattcttttaa

SEQ ID NO: 480128 - DNA, 25 bp, Homo sapien
taattcttttaaactatggagtgaa

SEQ ID NO: 480129 - DNA, 25 bp, Homo sapien
ccaaatttttattatgtttaccatg

SEQ ID NO: 480130 - DNA, 25 bp, Homo sapien
ttaaatccgggctctggactttcct

SEQ ID NO: 480131 - DNA, 25 bp, Homo sapien
gctctggactttcctaactgtgtga

SEQ ID NO: 480132 - DNA, 25 bp, Homo sapien
ctttgagcacattacttatttcttt

SEQ ID NO: 480133 - DNA, 25 bp, Homo sapien
gcaggctgctgaggcgtttgtctcc

SEQ ID NO: 480134 - DNA, 25 bp, Homo sapien
gtttgtctccttgtacacgaatgct

SEQ ID NO: 480135 - DNA, 25 bp, Homo sapien
acgaatgctcacaaccagctgggtg

SEQ ID NO: 480136 - DNA, 25 bp, Homo sapien
aaccagctgggtggctaccctgtca

SEQ ID NO: 480137 - DNA, 25 bp, Homo sapien
ctaccctgtcattctgtgggtggaa

SEQ ID NO: 480138 - DNA, 25 bp, Homo sapien
gaggagcatctgaattctaggtact

SEQ ID NO: 480139 - DNA, 25 bp, Homo sapien
attctaggtactgaactgcaggaga

SEQ ID NO: 480140 - DNA, 25 bp, Homo sapien
tggattccagaagtattacagttct

SEQ ID NO: 480141 - DNA, 25 bp, Homo sapien
cagtaaatgcatcatggctcatctt

SEQ ID NO: 480142 - DNA, 25 bp, Homo sapien
tcatcttgtgagcatcatagcgggt

SEQ ID NO: 480143 - DNA, 25 bp, Homo sapien
tcatagcgggtaagggcacagcagc

SEQ ID NO: 480144 - DNA, 25 bp, Homo sapien
aatgtcactgcaaattagttttata

SEQ ID NO: 480145 - DNA, 25 bp, Homo sapien
gttgccatggaagttatggccctga

SEQ ID NO: 480146 - DNA, 25 bp, Homo sapien
agttatggccctgaaaatcgtctcc

SEQ ID NO: 480147 - DNA, 25 bp, Homo sapien
tatggccctgaaaatcgtctccctc

SEQ ID NO: 480148 - DNA, 25 bp, Homo sapien
ttctcttgctgtacagcatgcgttc

SEQ ID NO: 480149 - DNA, 25 bp, Homo sapien
tgctgtacagcatgcgttctctttt

SEQ ID NO: 480150 - DNA, 25 bp, Homo sapien
cagcatgcgttctctttttgtggtt

SEQ ID NO: 480151 - DNA, 25 bp, Homo sapien
cgttctctttttgtggttgctggct

SEQ ID NO: 480152 - DNA, 25 bp, Homo sapien
gctggctgggtactgtatttaatga

SEQ ID NO: 480153 - DNA, 25 bp, Homo sapien
gaagtagagaatagcacttgcaaaa

SEQ ID NO: 480154 - DNA, 25 bp, Homo sapien
cttggtacctagagactgtcatgca

SEQ ID NO: 480155 - DNA, 25 bp, Homo sapien
gcatatgctttctccggcatgcata

SEQ ID NO: 480156 - DNA, 25 bp, Homo sapien
gctttctccggcatgcatatgcttt

SEQ ID NO: 480157 - DNA, 25 bp, Homo sapien
atgcatatgctttctactacaatgt

SEQ ID NO: 480158 - DNA, 25 bp, Homo sapien
tactacaatgtgaacaagcctacga

SEQ ID NO: 480159 - DNA, 25 bp, Homo sapien
acaagcctacgaaagctagcctaat

SEQ ID NO: 480160 - DNA, 25 bp, Homo sapien
ctacgaaagctagcctaatggagga

SEQ ID NO: 480161 - DNA, 25 bp, Homo sapien
agctagcctacacccacagctattt

SEQ ID NO: 480162 - DNA, 25 bp, Homo sapien
tacacccacagctattttgcttgtg

SEQ ID NO: 480163 - DNA, 25 bp, Homo sapien
tttgcttgtgttccactcgtcctat

SEQ ID NO: 480164 - DNA, 25 bp, Homo sapien
ttccactcgtcctatttgcataata

SEQ ID NO: 480165 - DNA, 25 bp, Homo sapien
gtcctatttgcataatattgttctt

SEQ ID NO: 480166 - DNA, 25 bp, Homo sapien
aaagcagtgcagttacgattcagaa

SEQ ID NO: 480167 - DNA, 25 bp, Homo sapien
aaaggaaagtgtcggctcactcatc

SEQ ID NO: 480168 - DNA, 25 bp, Homo sapien
acgggtggttgaacagcttctccct

SEQ ID NO: 480169 - DNA, 25 bp, Homo sapien
ttctcccttggaaagacttgcaaaa

SEQ ID NO: 480170 - DNA, 25 bp, Homo sapien
aattgcgttgtggtctgttgtccca

SEQ ID NO: 480171 - DNA, 25 bp, Homo sapien
tcatttttgtaaagtctctcccctc

SEQ ID NO: 480172 - DNA, 25 bp, Homo sapien
cgccccgtatttacatacttatcct

SEQ ID NO: 480173 - DNA, 25 bp, Homo sapien
acttatccttggactaactcagttt

SEQ ID NO: 480174 - DNA, 25 bp, Homo sapien
gcaggagtttttcttctacttgccc

SEQ ID NO: 480175 - DNA, 25 bp, Homo sapien
gaatgtcttcttgtaaaggccgcct

SEQ ID NO: 480176 - DNA, 25 bp, Homo sapien
aggccgccttagaaatggtccagaa

SEQ ID NO: 480177 - DNA, 25 bp, Homo sapien
ggaggccgcccgtatttgtgccaac

SEQ ID NO: 480178 - DNA, 25 bp, Homo sapien
aggccgcccgtatttgtgccaacaa

SEQ ID NO: 480179 - DNA, 25 bp, Homo sapien
gccgcccgtatttgtgccaacaaat

SEQ ID NO: 480180 - DNA, 25 bp, Homo sapien
gtgccaacaaatacatggtgaaaag

SEQ ID NO: 480181 - DNA, 25 bp, Homo sapien
cagggtactgtagcccgggtccaca

SEQ ID NO: 480182 - DNA, 25 bp, Homo sapien
actgtagcccgggtccacattggtc

SEQ ID NO: 480183 - DNA, 25 bp, Homo sapien
tgtagcccgggtccacattggtcaa

SEQ ID NO: 480184 - DNA, 25 bp, Homo sapien
tagcccgggtccacattggtcaagt

SEQ ID NO: 480185 - DNA, 25 bp, Homo sapien
gcccgggtccacattggtcaagtca

SEQ ID NO: 480186 - DNA, 25 bp, Homo sapien
ccgggtccacattggtcaagtcatc

SEQ ID NO: 480187 - DNA, 25 bp, Homo sapien
cgggtccacattggtcaagtcatca

SEQ ID NO: 480188 - DNA, 25 bp, Homo sapien
ggttttccttgttcccgcatgttca

SEQ ID NO: 480189 - DNA, 25 bp, Homo sapien
gtgttctggaaaggcgcattgtacc

SEQ ID NO: 480190 - DNA, 25 bp, Homo sapien
tctggaaaggcgcattgtaccctgg

SEQ ID NO: 480191 - DNA, 25 bp, Homo sapien
tggaaaggcgcattgtaccctggat

SEQ ID NO: 480192 - DNA, 25 bp, Homo sapien
ccctggatgcagcaggaatcctatt

SEQ ID NO: 480193 - DNA, 25 bp, Homo sapien
ggatgcagcaggaatcctattcatc

SEQ ID NO: 480194 - DNA, 25 bp, Homo sapien
atgcagcaggaatcctattcatctt

SEQ ID NO: 480195 - DNA, 25 bp, Homo sapien
ctattcatcttcttcaccgatatgg

SEQ ID NO: 480196 - DNA, 25 bp, Homo sapien
tggactctgatgagccaaatctgac

SEQ ID NO: 480197 - DNA, 25 bp, Homo sapien
cgcatgttcagccaatcgtgtttaa

SEQ ID NO: 480198 - DNA, 25 bp, Homo sapien
aagttggaatgcagcctctggtgct

SEQ ID NO: 480199 - DNA, 25 bp, Homo sapien
tcccacgtatgagtgattggacaaa

SEQ ID NO: 480200 - DNA, 25 bp, Homo sapien
gaggcagcagagtatagatagcatt

SEQ ID NO: 480201 - DNA, 25 bp, Homo sapien
aatttttagggcagacaggctcagg

SEQ ID NO: 480202 - DNA, 25 bp, Homo sapien
tttagggcagacaggctcaggaaat

SEQ ID NO: 480203 - DNA, 25 bp, Homo sapien
ggcagacaggctcaggaaatacatt

SEQ ID NO: 480204 - DNA, 25 bp, Homo sapien
aggctcaggaaatacattccaggaa

SEQ ID NO: 480205 - DNA, 25 bp, Homo sapien
atacattccaggaagagcgaagagt

SEQ ID NO: 480206 - DNA, 25 bp, Homo sapien
agtgcgggtaatgacatggagtcaa

SEQ ID NO: 480207 - DNA, 25 bp, Homo sapien
gacatggagtcaaaaggctatattc

SEQ ID NO: 480208 - DNA, 25 bp, Homo sapien
aaaaggctatattccagccaggcac

SEQ ID NO: 480209 - DNA, 25 bp, Homo sapien
aggcacagtgactataatctcagct

SEQ ID NO: 480210 - DNA, 25 bp, Homo sapien
gtgttctggaaaggcgcattgtacc

SEQ ID NO: 480211 - DNA, 25 bp, Homo sapien
tctggaaaggcgcattgtaccctgg

SEQ ID NO: 480212 - DNA, 25 bp, Homo sapien
ctggaaaggcgcattgtaccctgga

SEQ ID NO: 480213 - DNA, 25 bp, Homo sapien
tggaaaggcgcattgtaccctggat

SEQ ID NO: 480214 - DNA, 25 bp, Homo sapien
ccctggatgcagcaggaatcctatt

SEQ ID NO: 480215 - DNA, 25 bp, Homo sapien
cctggatgcagcaggaatcctattc

SEQ ID NO: 480216 - DNA, 25 bp, Homo sapien
ctggatgcagcaggaatcctattca

SEQ ID NO: 480217 - DNA, 25 bp, Homo sapien
tggatgcagcaggaatcctattcat

SEQ ID NO: 480218 - DNA, 25 bp, Homo sapien
ggatgcagcaggaatcctattcatc

SEQ ID NO: 480219 - DNA, 25 bp, Homo sapien
gatgcagcaggaatcctattcatct

SEQ ID NO: 480220 - DNA, 25 bp, Homo sapien
atgcagcaggaatcctattcatctt

SEQ ID NO: 480221 - DNA, 25 bp, Homo sapien
tcagctttgaaatcatatgttacat

SEQ ID NO: 480222 - DNA, 25 bp, Homo sapien
tactttgtcagttgatcataatcat

SEQ ID NO: 480223 - DNA, 25 bp, Homo sapien
ttatgtttcatgtcaaaaagatctt

SEQ ID NO: 480224 - DNA, 25 bp, Homo sapien
aaaaatcccagccatctaaatatgt

SEQ ID NO: 480225 - DNA, 25 bp, Homo sapien
aatatgtttcccaactccattaagt

SEQ ID NO: 480226 - DNA, 25 bp, Homo sapien
gtatttatgttcagatgttgaagct

SEQ ID NO: 480227 - DNA, 25 bp, Homo sapien
atgttgaagctgtcattctcgaata

SEQ ID NO: 480228 - DNA, 25 bp, Homo sapien
gaagctgtcattctcgaataaaact

SEQ ID NO: 480229 - DNA, 25 bp, Homo sapien
tcattctcgaataaaactacacttt

SEQ ID NO: 480230 - DNA, 25 bp, Homo sapien
ggcctattgttacagtttgaatata

SEQ ID NO: 480231 - DNA, 25 bp, Homo sapien
tatactttgattctatttatgtgtc

SEQ ID NO: 480232 - DNA, 25 bp, Homo sapien
gcaaagatagcctcgactggacaaa

SEQ ID NO: 480233 - DNA, 25 bp, Homo sapien
ggacaaataacacttctgaccccgt

SEQ ID NO: 480234 - DNA, 25 bp, Homo sapien
tgactggtatgctgcccctggactt

SEQ ID NO: 480235 - DNA, 25 bp, Homo sapien
ccctggactttgtgtctctctaaaa

SEQ ID NO: 480236 - DNA, 25 bp, Homo sapien
gtgtctctctaaaatcactaccatt

SEQ ID NO: 480237 - DNA, 25 bp, Homo sapien
cactaccattcactgagatctgacc

SEQ ID NO: 480238 - DNA, 25 bp, Homo sapien
agatctgaccaggtgaggcactcac

SEQ ID NO: 480239 - DNA, 25 bp, Homo sapien
gaggcactcaccaacgctacagaag

SEQ ID NO: 480240 - DNA, 25 bp, Homo sapien
aagcaacacacaggtttccaatcct

SEQ ID NO: 480241 - DNA, 25 bp, Homo sapien
ggtttccaatcctctcaaacacaga

SEQ ID NO: 480242 - DNA, 25 bp, Homo sapien
gaatggagctgtcactaaagagagt

SEQ ID NO: 480243 - DNA, 25 bp, Homo sapien
gcaatgttgtgcatggccgcggata

SEQ ID NO: 480244 - DNA, 25 bp, Homo sapien
gggccttgtggttccaagagcctgt

SEQ ID NO: 480245 - DNA, 25 bp, Homo sapien
aagagcctgtctcaggtgtaccggc

SEQ ID NO: 480246 - DNA, 25 bp, Homo sapien
atcactgggcttcagaggttcaatc

SEQ ID NO: 480247 - DNA, 25 bp, Homo sapien
ggttcaatctgcaaggaggcatctc

SEQ ID NO: 480248 - DNA, 25 bp, Homo sapien
tctgttcctcagtcaagttattgta

SEQ ID NO: 480249 - DNA, 25 bp, Homo sapien
attgtagacatgacgactggagtaa

SEQ ID NO: 480250 - DNA, 25 bp, Homo sapien
taaacgacagaccataccgacgctt

SEQ ID NO: 480251 - DNA, 25 bp, Homo sapien
taccgacgctttgaaaacgtgactg

SEQ ID NO: 480252 - DNA, 25 bp, Homo sapien
aaacgtgactgagctggtgcacaaa

SEQ ID NO: 480253 - DNA, 25 bp, Homo sapien
aaacaatggtgcctagaattttgaa

SEQ ID NO: 480254 - DNA, 25 bp, Homo sapien
tgcctggacctaggcccagcaatga

SEQ ID NO: 480255 - DNA, 25 bp, Homo sapien
ccaatgccagtgcaactaagagaag

SEQ ID NO: 480256 - DNA, 25 bp, Homo sapien
ctaagagaagggttccactgggaag

SEQ ID NO: 480257 - DNA, 25 bp, Homo sapien
tgggaaggctgagaacccctctcct

SEQ ID NO: 480258 - DNA, 25 bp, Homo sapien
tcctcatgggttctctacaggcaaa

SEQ ID NO: 480259 - DNA, 25 bp, Homo sapien
atgggttctctacaggcaaaaaggc

SEQ ID NO: 480260 - DNA, 25 bp, Homo sapien
gtaacctagtacgatggttcccaga

SEQ ID NO: 480261 - DNA, 25 bp, Homo sapien
atggttcccagaattcctttcgaat

SEQ ID NO: 480262 - DNA, 25 bp, Homo sapien
gaattcctttcgaatttgccatttc

SEQ ID NO: 480263 - DNA, 25 bp, Homo sapien
aatttgccatttcgtttcccatgaa

SEQ ID NO: 480264 - DNA, 25 bp, Homo sapien
tttcgtttcccatgaatcacctatg

SEQ ID NO: 480265 - DNA, 25 bp, Homo sapien
gaagacctatgaaactaatttggaa

SEQ ID NO: 480266 - DNA, 25 bp, Homo sapien
gaaagaaaagaatcccaagctgact

SEQ ID NO: 480267 - DNA, 25 bp, Homo sapien
atcccaagctgactattgattgcaa

SEQ ID NO: 480268 - DNA, 25 bp, Homo sapien
gactattgattgcaatgcttccggg

SEQ ID NO: 480269 - DNA, 25 bp, Homo sapien
ggacctgggccagaatcattgtgga

SEQ ID NO: 480270 - DNA, 25 bp, Homo sapien
tgtgactttttttgctgagcagcct

SEQ ID NO: 480271 - DNA, 25 bp, Homo sapien
agcagcctgggatcgctctacgaat

SEQ ID NO: 480272 - DNA, 25 bp, Homo sapien
atcgctctacgaattacacaggaag

SEQ ID NO: 480273 - DNA, 25 bp, Homo sapien
acaggaagcgggattcgggtctcta

SEQ ID NO: 480274 - DNA, 25 bp, Homo sapien
gattcgggtctctaagatgtcttat

SEQ ID NO: 480275 - DNA, 25 bp, Homo sapien
agaactggatccttgaagatactca

SEQ ID NO: 480276 - DNA, 25 bp, Homo sapien
ggcgagaaatgacttccaatgacgt

SEQ ID NO: 480277 - DNA, 25 bp, Homo sapien
gaaatgacttccaatgacgtagctg

SEQ ID NO: 480278 - DNA, 25 bp, Homo sapien
atgacttccaatgacgtagctggat

SEQ ID NO: 480279 - DNA, 25 bp, Homo sapien
acttccaatgacgtagctggatccg

SEQ ID NO: 480280 - DNA, 25 bp, Homo sapien
ttccaatgacgtagctggatccgat

SEQ ID NO: 480281 - DNA, 25 bp, Homo sapien
catgtgcatgttcatatgtcctaag

SEQ ID NO: 480282 - DNA, 25 bp, Homo sapien
gtgcatgttcatatgtcctaagtct

SEQ ID NO: 480283 - DNA, 25 bp, Homo sapien
catgttcatatgtcctaagtcttcc

SEQ ID NO: 480284 - DNA, 25 bp, Homo sapien
gttcatatgtcctaagtcttccttg

SEQ ID NO: 480285 - DNA, 25 bp, Homo sapien
tcatatgtcctaagtcttccttgat

SEQ ID NO: 480286 - DNA, 25 bp, Homo sapien
tcttccttgatgatgtatctatatt

SEQ ID NO: 480287 - DNA, 25 bp, Homo sapien
gtcgaggctgcaatcgcaccactgc

SEQ ID NO: 480288 - DNA, 25 bp, Homo sapien
tgataaatatgtgccagactgttct

SEQ ID NO: 480289 - DNA, 25 bp, Homo sapien
cagactgttctaagccctttccctg

SEQ ID NO: 480290 - DNA, 25 bp, Homo sapien
tttccctgcgtgatctcagtgaagt

SEQ ID NO: 480291 - DNA, 25 bp, Homo sapien
agtgaagtcccataatagccccgtg

SEQ ID NO: 480292 - DNA, 25 bp, Homo sapien
aatagccccgtgaggcaggtactgt

SEQ ID NO: 480293 - DNA, 25 bp, Homo sapien
gtgaggcaggtactgtcctttatcc

SEQ ID NO: 480294 - DNA, 25 bp, Homo sapien
gtcctttatccccattgcagggatg

SEQ ID NO: 480295 - DNA, 25 bp, Homo sapien
aaattgaggccctgaggtcgaagag

SEQ ID NO: 480296 - DNA, 25 bp, Homo sapien
agctggtaagcgatgatgccgagat

SEQ ID NO: 480297 - DNA, 25 bp, Homo sapien
gatgatgccgagataggccccggat

SEQ ID NO: 480298 - DNA, 25 bp, Homo sapien
aaaggcccttctaaatgtgctattt

SEQ ID NO: 480299 - DNA, 25 bp, Homo sapien
tgacaataactatcagatttgcctt

SEQ ID NO: 480300 - DNA, 25 bp, Homo sapien
agcatttatcaaaacgtatcctcat

SEQ ID NO: 480301 - DNA, 25 bp, Homo sapien
caaaacgtatcctcatagactttat

SEQ ID NO: 480302 - DNA, 25 bp, Homo sapien
gtatcctcatagactttatgcagat

SEQ ID NO: 480303 - DNA, 25 bp, Homo sapien
tatgcagattaatatggtcaattga

SEQ ID NO: 480304 - DNA, 25 bp, Homo sapien
tttaagccaggacaagaagtgcaaa

SEQ ID NO: 480305 - DNA, 25 bp, Homo sapien
agtgcaaatgcctctttgaagcaat

SEQ ID NO: 480306 - DNA, 25 bp, Homo sapien
ctttgaagcaatttaggctaaactg

SEQ ID NO: 480307 - DNA, 25 bp, Homo sapien
attaagccaggacaagaagtgcaaa

SEQ ID NO: 480308 - DNA, 25 bp, Homo sapien
ggacaagaagtgcaaatgcctcttt

SEQ ID NO: 480309 - DNA, 25 bp, Homo sapien
gtgtgatttgaaacatatctgaatt

SEQ ID NO: 480310 - DNA, 25 bp, Homo sapien
cttttaaaaattgccactcataagg

SEQ ID NO: 480311 - DNA, 25 bp, Homo sapien
attgccactcataaggaaagaaaga

SEQ ID NO: 480312 - DNA, 25 bp, Homo sapien
ggaaagaaagaactttttcacatat

SEQ ID NO: 480313 - DNA, 25 bp, Homo sapien
ttttattgtacctccccttactgtg

SEQ ID NO: 480314 - DNA, 25 bp, Homo sapien
taatagagatatgctaacatttgct

SEQ ID NO: 480315 - DNA, 25 bp, Homo sapien
tttggtgtgtactttataggcttgc

SEQ ID NO: 480316 - DNA, 25 bp, Homo sapien
gtactttataggcttgcatattgct

SEQ ID NO: 480317 - DNA, 25 bp, Homo sapien
ataggcttgcatattgcttacttta

SEQ ID NO: 480318 - DNA, 25 bp, Homo sapien
cttactgtgcttcccagatgctaaa

SEQ ID NO: 480319 - DNA, 25 bp, Homo sapien
cccagatgctaaaagccaggagtgg

SEQ ID NO: 480320 - DNA, 25 bp, Homo sapien
agttgtctgagagggtaactgctta

SEQ ID NO: 480321 - DNA, 25 bp, Homo sapien
ttgtctgagagggtaactgcttaag

SEQ ID NO: 480322 - DNA, 25 bp, Homo sapien
tgagagggtaactgcttaaggctgc

SEQ ID NO: 480323 - DNA, 25 bp, Homo sapien
gggtaactgcttaaggctgcagact

SEQ ID NO: 480324 - DNA, 25 bp, Homo sapien
gtaactgcttaaggctgcagactag

SEQ ID NO: 480325 - DNA, 25 bp, Homo sapien
agaacgccaccgctgagaactgacc

SEQ ID NO: 480326 - DNA, 25 bp, Homo sapien
tttgggatggttctccttgctttaa

SEQ ID NO: 480327 - DNA, 25 bp, Homo sapien
tgggatggttctccttgctttaagc

SEQ ID NO: 480328 - DNA, 25 bp, Homo sapien
gagaactgaccctcacatctccctt

SEQ ID NO: 480329 - DNA, 25 bp, Homo sapien
tgtaagccatgggttttcatgcgga

SEQ ID NO: 480330 - DNA, 25 bp, Homo sapien
agccatgggttttcatgcggaggaa

SEQ ID NO: 480331 - DNA, 25 bp, Homo sapien
tattatgtatatagcctgatagtgc

SEQ ID NO: 480332 - DNA, 25 bp, Homo sapien
gcctgatagtgctgaatttctgaat

SEQ ID NO: 480333 - DNA, 25 bp, Homo sapien
gtgctgaatttctgaattgaccttc

SEQ ID NO: 480334 - DNA, 25 bp, Homo sapien
gaattgaccttcatcttatttactc

SEQ ID NO: 480335 - DNA, 25 bp, Homo sapien
taagtgcatatatgtgtcaggaact

SEQ ID NO: 480336 - DNA, 25 bp, Homo sapien
tgtgtcaggaactgtactagatgct

SEQ ID NO: 480337 - DNA, 25 bp, Homo sapien
gatatagcagtaagcgcaacagacc

SEQ ID NO: 480338 - DNA, 25 bp, Homo sapien
gcgcaacagaccaagctaacagctt

SEQ ID NO: 480339 - DNA, 25 bp, Homo sapien
ctaacagcttagtaaagggtgaggt

SEQ ID NO: 480340 - DNA, 25 bp, Homo sapien
aaaaatcacaaattggtatccatgt

SEQ ID NO: 480341 - DNA, 25 bp, Homo sapien
gtatccatgtataattcatttccgt

SEQ ID NO: 480342 - DNA, 25 bp, Homo sapien
cagagcatcctgttattttgttaca

SEQ ID NO: 480343 - DNA, 25 bp, Homo sapien
atgcatcctggaagtttctagtggc

SEQ ID NO: 480344 - DNA, 25 bp, Homo sapien
tttctagtggcaaaagcctctcccc

SEQ ID NO: 480345 - DNA, 25 bp, Homo sapien
cactctgcagctgtcacttatttat

SEQ ID NO: 480346 - DNA, 25 bp, Homo sapien
acttatttataagccagaggcactt

SEQ ID NO: 480347 - DNA, 25 bp, Homo sapien
cactttctgtatatgcaactttcat

SEQ ID NO: 480348 - DNA, 25 bp, Homo sapien
gcaactttcatcatagagctctgag

SEQ ID NO: 480349 - DNA, 25 bp, Homo sapien
tggccaacccagagctgcacagagc

SEQ ID NO: 480350 - DNA, 25 bp, Homo sapien
cactgtgggcatgacacgtggcaat

SEQ ID NO: 480351 - DNA, 25 bp, Homo sapien
tgggcatgacacgtggcaatgtgat

SEQ ID NO: 480352 - DNA, 25 bp, Homo sapien
aagcaattctttggacttcacagag

SEQ ID NO: 480353 - DNA, 25 bp, Homo sapien
accagtcaccccaaatggagacact

SEQ ID NO: 480354 - DNA, 25 bp, Homo sapien
aaatggagacactcgcagacctgca

SEQ ID NO: 480355 - DNA, 25 bp, Homo sapien
tggagacactcgcagacctgcagtt

SEQ ID NO: 480356 - DNA, 25 bp, Homo sapien
gcagacctgcagttctcagaccgaa

SEQ ID NO: 480357 - DNA, 25 bp, Homo sapien
aaccaaaggtacctagcctcagaga

SEQ ID NO: 480358 - DNA, 25 bp, Homo sapien
caaaggtacctagcctcagagacag

SEQ ID NO: 480359 - DNA, 25 bp, Homo sapien
gtctaagaggaaccctttagctgtt

SEQ ID NO: 480360 - DNA, 25 bp, Homo sapien
gaggaaccctttagctgtttctgca

SEQ ID NO: 480361 - DNA, 25 bp, Homo sapien
aagcctcccaagcaacgtcttaatc

SEQ ID NO: 480362 - DNA, 25 bp, Homo sapien
aagcaacgtcttaatctccaggaga

SEQ ID NO: 480363 - DNA, 25 bp, Homo sapien
gcaacgtcttaatctccaggagagc

SEQ ID NO: 480364 - DNA, 25 bp, Homo sapien
tctacctgtgaaccatctaaaatca

SEQ ID NO: 480365 - DNA, 25 bp, Homo sapien
gaaccatctaaaatcatctctgcat

SEQ ID NO: 480366 - DNA, 25 bp, Homo sapien
taaaatcatctctgcatgccacggt

SEQ ID NO: 480367 - DNA, 25 bp, Homo sapien
atctctgcatgccacggtttggaaa

SEQ ID NO: 480368 - DNA, 25 bp, Homo sapien
gcatgccacggtttggaaaacacca

SEQ ID NO: 480369 - DNA, 25 bp, Homo sapien
aacaatgatcatgatagctaattct

SEQ ID NO: 480370 - DNA, 25 bp, Homo sapien
gacatgctacttcatttgtatcaac

SEQ ID NO: 480371 - DNA, 25 bp, Homo sapien
gtatcaacccattgagtcctggcaa

SEQ ID NO: 480372 - DNA, 25 bp, Homo sapien
acccattgagtcctggcaattactg

SEQ ID NO: 480373 - DNA, 25 bp, Homo sapien
ctggcaattactgctggacaaggca

SEQ ID NO: 480374 - DNA, 25 bp, Homo sapien
gaattattatactgtctttctacaa

SEQ ID NO: 480375 - DNA, 25 bp, Homo sapien
gaaatgtcaatcctgaggacaacag

SEQ ID NO: 480376 - DNA, 25 bp, Homo sapien
gaggacaacagtgaacccctgtaat

SEQ ID NO: 480377 - DNA, 25 bp, Homo sapien
gaacccctgtaattctaagtagcag

SEQ ID NO: 480378 - DNA, 25 bp, Homo sapien
aagtagcagtttgtctctgagactt

SEQ ID NO: 480379 - DNA, 25 bp, Homo sapien
gagacttatcagacacagggttttc

SEQ ID NO: 480380 - DNA, 25 bp, Homo sapien
cagggttttcactgccaaaggatta

SEQ ID NO: 480381 - DNA, 25 bp, Homo sapien
aggattttagccatcttgagggtgc

SEQ ID NO: 480382 - DNA, 25 bp, Homo sapien
gccatcttgagggtgcttactttga

SEQ ID NO: 480383 - DNA, 25 bp, Homo sapien
gcttactttgactgctaaaaactga

SEQ ID NO: 480384 - DNA, 25 bp, Homo sapien
aatactgcttaagtgcatggcttat

SEQ ID NO: 480385 - DNA, 25 bp, Homo sapien
acagatgttctcagaattgtctaca

SEQ ID NO: 480386 - DNA, 25 bp, Homo sapien
gattatcgcatagagttcagagact

SEQ ID NO: 480387 - DNA, 25 bp, Homo sapien
gactggaaactgaattttccctcga

SEQ ID NO: 480388 - DNA, 25 bp, Homo sapien
attttccctcgactttcactttgtg

SEQ ID NO: 480389 - DNA, 25 bp, Homo sapien
ctcgactttcactttgtgggtaaat

SEQ ID NO: 480390 - DNA, 25 bp, Homo sapien
ggtaaatcacccaattttaggctct

SEQ ID NO: 480391 - DNA, 25 bp, Homo sapien
attttaggctcttttctgcaaggat

SEQ ID NO: 480392 - DNA, 25 bp, Homo sapien
gctcttttctgcaaggatggccaaa

SEQ ID NO: 480393 - DNA, 25 bp, Homo sapien
aaaagtagattcatgcccactgccc

SEQ ID NO: 480394 - DNA, 25 bp, Homo sapien
ttcatgcccactgcccttgggtgag

SEQ ID NO: 480395 - DNA, 25 bp, Homo sapien
ccatgtgatccaagggtttgtattt

SEQ ID NO: 480396 - DNA, 25 bp, Homo sapien
tgtacatgactatttaaagccaggg

SEQ ID NO: 480397 - DNA, 25 bp, Homo sapien
ttcacctctgaactgtgcaaccttc

SEQ ID NO: 480398 - DNA, 25 bp, Homo sapien
gtgcaaccttcctaaataacagact

SEQ ID NO: 480399 - DNA, 25 bp, Homo sapien
aatgaacttccatcactcagcttta

SEQ ID NO: 480400 - DNA, 25 bp, Homo sapien
ataggtttacctgctgaacttgaaa

SEQ ID NO: 480401 - DNA, 25 bp, Homo sapien
aaccactgttaagtgatctgtgatc

SEQ ID NO: 480402 - DNA, 25 bp, Homo sapien
atctgtgatcaaggcagatcttgaa

SEQ ID NO: 480403 - DNA, 25 bp, Homo sapien
atcactcagctttaacagttatcag

SEQ ID NO: 480404 - DNA, 25 bp, Homo sapien
cagttatcagcattcttccattctt

SEQ ID NO: 480405 - DNA, 25 bp, Homo sapien
tgttttatttatacctctgtggatt

SEQ ID NO: 480406 - DNA, 25 bp, Homo sapien
atacctctgtggatttgctacctct

SEQ ID NO: 480407 - DNA, 25 bp, Homo sapien
tgctacctctcctatttgattgtta

SEQ ID NO: 480408 - DNA, 25 bp, Homo sapien
aaaagaactttacggtgctgtgact

SEQ ID NO: 480409 - DNA, 25 bp, Homo sapien
gaactttacggtgctgtgactccga

SEQ ID NO: 480410 - DNA, 25 bp, Homo sapien
tacggtgctgtgactccgataggat

SEQ ID NO: 480411 - DNA, 25 bp, Homo sapien
gtgactccgataggatcagattcat

SEQ ID NO: 480412 - DNA, 25 bp, Homo sapien
aggatcagattcatcattggacccc

SEQ ID NO: 480413 - DNA, 25 bp, Homo sapien
ggaccccaagtgtgcacctttgaag

SEQ ID NO: 480414 - DNA, 25 bp, Homo sapien
aagccattgtcttcactcctgactg

SEQ ID NO: 480415 - DNA, 25 bp, Homo sapien
tgtcttcactcctgactgatagatc

SEQ ID NO: 480416 - DNA, 25 bp, Homo sapien
cttcactcctgactgatagatcggg

SEQ ID NO: 480417 - DNA, 25 bp, Homo sapien
atccaatggattctgaacacaagca

SEQ ID NO: 480418 - DNA, 25 bp, Homo sapien
aagtggctacttcaatggttggttg

SEQ ID NO: 480419 - DNA, 25 bp, Homo sapien
gctgggaactaaaggtactcatgga

SEQ ID NO: 480420 - DNA, 25 bp, Homo sapien
aactaaaggtactcatggaactgcc

SEQ ID NO: 480421 - DNA, 25 bp, Homo sapien
acctgtgacctccaagaactcagac

SEQ ID NO: 480422 - DNA, 25 bp, Homo sapien
aactcagacaggtccagacctcact

SEQ ID NO: 480423 - DNA, 25 bp, Homo sapien
agacctcacttgcttgctgtgatct

SEQ ID NO: 480424 - DNA, 25 bp, Homo sapien
gggttttggctttactctggcaggc

SEQ ID NO: 480425 - DNA, 25 bp, Homo sapien
tttggctttactctggcaggcccag

SEQ ID NO: 480426 - DNA, 25 bp, Homo sapien
tggcaggcccagaaagcttttgcag

SEQ ID NO: 480427 - DNA, 25 bp, Homo sapien
ccagaaagcttttgcagccaccctg

SEQ ID NO: 480428 - DNA, 25 bp, Homo sapien
tcccttacctgccattgctgaaaag

SEQ ID NO: 480429 - DNA, 25 bp, Homo sapien
tgccattgctgaaaagtaaagcccc

SEQ ID NO: 480430 - DNA, 25 bp, Homo sapien
agtcctgggtcaagctgagtatctc

SEQ ID NO: 480431 - DNA, 25 bp, Homo sapien
ggcctcccagccgtgaataatctga

SEQ ID NO: 480432 - DNA, 25 bp, Homo sapien
gccgtgaataatctgatggttcctg

SEQ ID NO: 480433 - DNA, 25 bp, Homo sapien
agcagacgcttcgtatggcagttga

SEQ ID NO: 480434 - DNA, 25 bp, Homo sapien
tgtgtctatgtgcatttaaaacctt

SEQ ID NO: 480435 - DNA, 25 bp, Homo sapien
ttctgtacttacacattcacacggg

SEQ ID NO: 480436 - DNA, 25 bp, Homo sapien
cacacgggaagacaggctcattctt

SEQ ID NO: 480437 - DNA, 25 bp, Homo sapien
aagacaggctcattcttgtgcacac

SEQ ID NO: 480438 - DNA, 25 bp, Homo sapien
tgagtatctccacgtttaggtgcac

SEQ ID NO: 480439 - DNA, 25 bp, Homo sapien
cattcttgtgcacacttgagagttt

SEQ ID NO: 480440 - DNA, 25 bp, Homo sapien
ccacgtttaggtgcacaaatactat

SEQ ID NO: 480441 - DNA, 25 bp, Homo sapien
gcaggcgtgggctccagcgggaagg

SEQ ID NO: 480442 - DNA, 25 bp, Homo sapien
tccagcgggaaggaagcccctcgtt

SEQ ID NO: 480443 - DNA, 25 bp, Homo sapien
aggaagcccctcgttgggttctcag

SEQ ID NO: 480444 - DNA, 25 bp, Homo sapien
aagcccctcgttgggttctcagcat

SEQ ID NO: 480445 - DNA, 25 bp, Homo sapien
cctcgttgggttctcagcatggaca

SEQ ID NO: 480446 - DNA, 25 bp, Homo sapien
ggacagctggatggcatcactggat

SEQ ID NO: 480447 - DNA, 25 bp, Homo sapien
gctggatggcatcactggattccct

SEQ ID NO: 480448 - DNA, 25 bp, Homo sapien
ggatggcatcactggattccctcac

SEQ ID NO: 480449 - DNA, 25 bp, Homo sapien
ggattccctcacctggatccggaga

SEQ ID NO: 480450 - DNA, 25 bp, Homo sapien
tccctcacctggatccggagacaaa

SEQ ID NO: 480451 - DNA, 25 bp, Homo sapien
ggagaaaatgatgaggcagcgccca

SEQ ID NO: 480452 - DNA, 25 bp, Homo sapien
ccgtagatttgggatccgattctga

SEQ ID NO: 480453 - DNA, 25 bp, Homo sapien
atttgggatccgattctgaacacac

SEQ ID NO: 480454 - DNA, 25 bp, Homo sapien
tgggatccgattctgaacacacaaa

SEQ ID NO: 480455 - DNA, 25 bp, Homo sapien
gaacacacaaaacagaaggcaagca

SEQ ID NO: 480456 - DNA, 25 bp, Homo sapien
gaaggcaagcactgacttatcacaa

SEQ ID NO: 480457 - DNA, 25 bp, Homo sapien
ggcaagcactgacttatcacaagat

SEQ ID NO: 480458 - DNA, 25 bp, Homo sapien
gcactgacttatcacaagatgaatt

SEQ ID NO: 480459 - DNA, 25 bp, Homo sapien
gaatcaaatcactttccaaaactat

SEQ ID NO: 480460 - DNA, 25 bp, Homo sapien
atcactttccaaaactattctgaat

SEQ ID NO: 480461 - DNA, 25 bp, Homo sapien
ttgcaaaattagaccaacaggaatt

SEQ ID NO: 480462 - DNA, 25 bp, Homo sapien
aggaatttggtctggatcttgagga

SEQ ID NO: 480463 - DNA, 25 bp, Homo sapien
tccaccacacactgaatctgtagct

SEQ ID NO: 480464 - DNA, 25 bp, Homo sapien
gaatctgtagcttccggataccgta

SEQ ID NO: 480465 - DNA, 25 bp, Homo sapien
ttccggataccgtagcccatgggca

SEQ ID NO: 480466 - DNA, 25 bp, Homo sapien
ttggaggccccctagaccagctctt

SEQ ID NO: 480467 - DNA, 25 bp, Homo sapien
ttccagctggatggagcacacacag

SEQ ID NO: 480468 - DNA, 25 bp, Homo sapien
ctgggccatgtcagtctcatcgtcc

SEQ ID NO: 480469 - DNA, 25 bp, Homo sapien
ggccatgtcagtctcatcgtcccaa

SEQ ID NO: 480470 - DNA, 25 bp, Homo sapien
gtctcatcgtcccaaggcttgaaat

SEQ ID NO: 480471 - DNA, 25 bp, Homo sapien
accagttcaggcttcttggccttct

SEQ ID NO: 480472 - DNA, 25 bp, Homo sapien
ttcttctcccgcgtactgctgcagc

SEQ ID NO: 480473 - DNA, 25 bp, Homo sapien
tgagctgtgccgcttcttgtcctcc

SEQ ID NO: 480474 - DNA, 25 bp, Homo sapien
gatttgcgaaaatcctacttagtta

SEQ ID NO: 480475 - DNA, 25 bp, Homo sapien
atcctacttagttactgcgtttaca

SEQ ID NO: 480476 - DNA, 25 bp, Homo sapien
tgcgtttacagttctttggcccagt

SEQ ID NO: 480477 - DNA, 25 bp, Homo sapien
tttacagttctttggcccagtctct

SEQ ID NO: 480478 - DNA, 25 bp, Homo sapien
atgattgtgtttactgctggatttt

SEQ ID NO: 480479 - DNA, 25 bp, Homo sapien
ttactgctggatttttgaaggtttt

SEQ ID NO: 480480 - DNA, 25 bp, Homo sapien
gaaagtgccatttcattatttgatt

SEQ ID NO: 480481 - DNA, 25 bp, Homo sapien
tttgattatcaccaaattatctgga

SEQ ID NO: 480482 - DNA, 25 bp, Homo sapien
ggaaataattgggacattgtaactt

SEQ ID NO: 480483 - DNA, 25 bp, Homo sapien
tcaccgcgggtgatgatttagcttt

SEQ ID NO: 480484 - DNA, 25 bp, Homo sapien
tgtgccttccaaatcatgccataat

SEQ ID NO: 480485 - DNA, 25 bp, Homo sapien
cctttgttcttgtatcctttatgaa

SEQ ID NO: 480486 - DNA, 25 bp, Homo sapien
tcatgcacttgaatgatgaccttga

SEQ ID NO: 480487 - DNA, 25 bp, Homo sapien
ataggaactgttcacttattctcat

SEQ ID NO: 480488 - DNA, 25 bp, Homo sapien
ggaactgttcacttattctcatatt

SEQ ID NO: 480489 - DNA, 25 bp, Homo sapien
attctcatattatttgggcaccaaa

SEQ ID NO: 480490 - DNA, 25 bp, Homo sapien
tttgggcaccaaaaccaggtggaag

SEQ ID NO: 480491 - DNA, 25 bp, Homo sapien
gaggaaaatctccactgctcagaaa

SEQ ID NO: 480492 - DNA, 25 bp, Homo sapien
ttttcccagtaaatgcctaatgtat

SEQ ID NO: 480493 - DNA, 25 bp, Homo sapien
aatatgttctagcaagacggcgctt

SEQ ID NO: 480494 - DNA, 25 bp, Homo sapien
acggcgcttggtgaaggtgatcaac

SEQ ID NO: 480495 - DNA, 25 bp, Homo sapien
aatcgagctaaactgctttcccttt

SEQ ID NO: 480496 - DNA, 25 bp, Homo sapien
gggccatattactaagagtacaact

SEQ ID NO: 480497 - DNA, 25 bp, Homo sapien
catcttgtgctactttgcactgatc

SEQ ID NO: 480498 - DNA, 25 bp, Homo sapien
actttgcactgatcagaccacatct

SEQ ID NO: 480499 - DNA, 25 bp, Homo sapien
ctgatcagaccacatctgatgccca

SEQ ID NO: 480500 - DNA, 25 bp, Homo sapien
tctgttttaatgtcactagatcaaa

SEQ ID NO: 480501 - DNA, 25 bp, Homo sapien
aatgtcactagatcaaatttgcgaa

SEQ ID NO: 480502 - DNA, 25 bp, Homo sapien
gagagatgtggcttagaggcatttt

SEQ ID NO: 480503 - DNA, 25 bp, Homo sapien
aaagctcatgagttgaaagtgtggt

SEQ ID NO: 480504 - DNA, 25 bp, Homo sapien
gaaagtgtggtttggttgctgtaaa

SEQ ID NO: 480505 - DNA, 25 bp, Homo sapien
gttgctgtaaaaagtattgtgacct

SEQ ID NO: 480506 - DNA, 25 bp, Homo sapien
agtattgtgaccttgggccatatta

SEQ ID NO: 480507 - DNA, 25 bp, Homo sapien
atctccctctgtcagcacaattccg

SEQ ID NO: 480508 - DNA, 25 bp, Homo sapien
cacctcctggtatttactacatctg

SEQ ID NO: 480509 - DNA, 25 bp, Homo sapien
tcctggtatttactacatctgtgcc

SEQ ID NO: 480510 - DNA, 25 bp, Homo sapien
ggtatttactacatctgtgccatcc

SEQ ID NO: 480511 - DNA, 25 bp, Homo sapien
tatttactacatctgtgccatccct

SEQ ID NO: 480512 - DNA, 25 bp, Homo sapien
ttactacatctgtgccatccctcat

SEQ ID NO: 480513 - DNA, 25 bp, Homo sapien
gtggcaggtgagaccagaacccgtt

SEQ ID NO: 480514 - DNA, 25 bp, Homo sapien
gcaggtgagaccagaacccgttctt

SEQ ID NO: 480515 - DNA, 25 bp, Homo sapien
gtgagaccagaacccgttcttttga

SEQ ID NO: 480516 - DNA, 25 bp, Homo sapien
gttcttttgagggtcccaccagaat

SEQ ID NO: 480517 - DNA, 25 bp, Homo sapien
tcttttgagggtcccaccagaatat

SEQ ID NO: 480518 - DNA, 25 bp, Homo sapien
aaaagaagcagagcccagaagcagg

SEQ ID NO: 480519 - DNA, 25 bp, Homo sapien
agaagcagagcccagaagcagggcc

SEQ ID NO: 480520 - DNA, 25 bp, Homo sapien
gaagcagagcccagaagcagggcct

SEQ ID NO: 480521 - DNA, 25 bp, Homo sapien
gggcctggtacccagcctgcctaac

SEQ ID NO: 480522 - DNA, 25 bp, Homo sapien
ggcctggtacccagcctgcctaaca

SEQ ID NO: 480523 - DNA, 25 bp, Homo sapien
gcctggtacccagcctgcctaacaa

SEQ ID NO: 480524 - DNA, 25 bp, Homo sapien
cctggtacccagcctgcctaacaag

SEQ ID NO: 480525 - DNA, 25 bp, Homo sapien
ctggtacccagcctgcctaacaagg

SEQ ID NO: 480526 - DNA, 25 bp, Homo sapien
tggtacccagcctgcctaacaaggg

SEQ ID NO: 480527 - DNA, 25 bp, Homo sapien
ggtacccagcctgcctaacaaggga

SEQ ID NO: 480528 - DNA, 25 bp, Homo sapien
ttggtagaaaccacattcacctctg

SEQ ID NO: 480529 - DNA, 25 bp, Homo sapien
agtcagatgtcaacatgtggcacac

SEQ ID NO: 480530 - DNA, 25 bp, Homo sapien
ggcacacattcaccaccataaatta

SEQ ID NO: 480531 - DNA, 25 bp, Homo sapien
aagttctatctctatacaaggcagg

SEQ ID NO: 480532 - DNA, 25 bp, Homo sapien
caaggcaggacatctacatttaaat

SEQ ID NO: 480533 - DNA, 25 bp, Homo sapien
atttaaatactgaacgaggcctgat

SEQ ID NO: 480534 - DNA, 25 bp, Homo sapien
gaacgaggcctgatgatcttgactt

SEQ ID NO: 480535 - DNA, 25 bp, Homo sapien
gatgatcttgacttatgagaccaac

SEQ ID NO: 480536 - DNA, 25 bp, Homo sapien
tcccagctctgcgatctatgcattt

SEQ ID NO: 480537 - DNA, 25 bp, Homo sapien
tgcgatctatgcatttctctgccac

SEQ ID NO: 480538 - DNA, 25 bp, Homo sapien
ccctctacttcatcaaaacttcttt

SEQ ID NO: 480539 - DNA, 25 bp, Homo sapien
ttcaccacgcggtcagacattgggc

SEQ ID NO: 480540 - DNA, 25 bp, Homo sapien
ttgggcccgcccgtgatgcaaatga

SEQ ID NO: 480541 - DNA, 25 bp, Homo sapien
gcccgtgatgcaaatgaccctgtgg

SEQ ID NO: 480542 - DNA, 25 bp, Homo sapien
tgaccctgtggatgatcgccatgca

SEQ ID NO: 480543 - DNA, 25 bp, Homo sapien
atcaggctgctgacgatgacgacga

SEQ ID NO: 480544 - DNA, 25 bp, Homo sapien
gacgacgaggatctaaatgacacca

SEQ ID NO: 480545 - DNA, 25 bp, Homo sapien
aatgacaccaattacgatgagttta

SEQ ID NO: 480546 - DNA, 25 bp, Homo sapien
ggagcctcttctcaagtggacccta

SEQ ID NO: 480547 - DNA, 25 bp, Homo sapien
aagtggaccctacgagaaagatgat

SEQ ID NO: 480548 - DNA, 25 bp, Homo sapien
agcagatgctatctatgcagccctg

SEQ ID NO: 480549 - DNA, 25 bp, Homo sapien
tgctatctatgcagccctggataaa

SEQ ID NO: 480550 - DNA, 25 bp, Homo sapien
actttgtcagcagggtggccttgat

SEQ ID NO: 480551 - DNA, 25 bp, Homo sapien
catgtttctaatggcatcagttctg

SEQ ID NO: 480552 - DNA, 25 bp, Homo sapien
gtggctgacacctgtgtaccaagcc

SEQ ID NO: 480553 - DNA, 25 bp, Homo sapien
tgtaccaagcccattcactgtctag

SEQ ID NO: 480554 - DNA, 25 bp, Homo sapien
actgtctagcttagccagccgtgga

SEQ ID NO: 480555 - DNA, 25 bp, Homo sapien
tttaccttcattcctactagcacag

SEQ ID NO: 480556 - DNA, 25 bp, Homo sapien
attcctactagcacagttgaccaaa

SEQ ID NO: 480557 - DNA, 25 bp, Homo sapien
gttgaccaaagacccagttgatccc

SEQ ID NO: 480558 - DNA, 25 bp, Homo sapien
gacccagttgatcccaaacactagt

SEQ ID NO: 480559 - DNA, 25 bp, Homo sapien
ttgatcccaaacactagtaatgcat

SEQ ID NO: 480560 - DNA, 25 bp, Homo sapien
tgcatcaatggagtctaacagagtt

SEQ ID NO: 480561 - DNA, 25 bp, Homo sapien
tgtgtgtttccttaatgctctccct

SEQ ID NO: 480562 - DNA, 25 bp, Homo sapien
ttaatgctctccctcctgagggagg

SEQ ID NO: 480563 - DNA, 25 bp, Homo sapien
agaagaccctgctcaactttgctgc

SEQ ID NO: 480564 - DNA, 25 bp, Homo sapien
gaatgccacaccatgggaggactca

SEQ ID NO: 480565 - DNA, 25 bp, Homo sapien
tgggaggactcattcattggctttg

SEQ ID NO: 480566 - DNA, 25 bp, Homo sapien
gaggactcattcattggctttgtag

SEQ ID NO: 480567 - DNA, 25 bp, Homo sapien
tcattcattggctttgtagtggcaa

SEQ ID NO: 480568 - DNA, 25 bp, Homo sapien
gctttgtagtggcaaatattcctct

SEQ ID NO: 480569 - DNA, 25 bp, Homo sapien
atattcctctagttctataactcaa

SEQ ID NO: 480570 - DNA, 25 bp, Homo sapien
tataactcaactagacattttgtag

SEQ ID NO: 480571 - DNA, 25 bp, Homo sapien
tagtttggggacacaatttcctaag

SEQ ID NO: 480572 - DNA, 25 bp, Homo sapien
cttttaaaaattgccactcataagg

SEQ ID NO: 480573 - DNA, 25 bp, Homo sapien
attgccactcataaggaaagaaaga

SEQ ID NO: 480574 - DNA, 25 bp, Homo sapien
ggaaagaaagaactttttcacatat

SEQ ID NO: 480575 - DNA, 25 bp, Homo sapien
atttttgaaagaaacgatggtgaga

SEQ ID NO: 480576 - DNA, 25 bp, Homo sapien
taatagagatatgctaacatttgct

SEQ ID NO: 480577 - DNA, 25 bp, Homo sapien
tttggtgtgtactttataggcttgc

SEQ ID NO: 480578 - DNA, 25 bp, Homo sapien
ggtgtgtactttataggcttgcata

SEQ ID NO: 480579 - DNA, 25 bp, Homo sapien
gtgtactttataggcttgcatattg

SEQ ID NO: 480580 - DNA, 25 bp, Homo sapien
actttataggcttgcatattgctta

SEQ ID NO: 480581 - DNA, 25 bp, Homo sapien
ataggcttgcatattgcttacttta

SEQ ID NO: 480582 - DNA, 25 bp, Homo sapien
cccagatgctaaaagccaggagtgg

SEQ ID NO: 480583 - DNA, 25 bp, Homo sapien
tttgcctgaggttgactatacatac

SEQ ID NO: 480584 - DNA, 25 bp, Homo sapien
gcctgaggttgactatacatacaaa

SEQ ID NO: 480585 - DNA, 25 bp, Homo sapien
aaacggcagatatatcctgaatgaa

SEQ ID NO: 480586 - DNA, 25 bp, Homo sapien
atgtgagatttttaccctgtgaatt

SEQ ID NO: 480587 - DNA, 25 bp, Homo sapien
gtgagatttttaccctgtgaatttc

SEQ ID NO: 480588 - DNA, 25 bp, Homo sapien
aatttcctgtgaggagtgtaagaag

SEQ ID NO: 480589 - DNA, 25 bp, Homo sapien
catacaaatattgagcatttcctcc

SEQ ID NO: 480590 - DNA, 25 bp, Homo sapien
atttcctcctggtctccgtgataaa

SEQ ID NO: 480591 - DNA, 25 bp, Homo sapien
ctcctggtctccgtgataaacaaag

SEQ ID NO: 480592 - DNA, 25 bp, Homo sapien
tggtctccgtgataaacaaaggttt

SEQ ID NO: 480593 - DNA, 25 bp, Homo sapien
aaggttttgatattgttcggcgaga

SEQ ID NO: 480594 - DNA, 25 bp, Homo sapien
acatttagaatgctctgtgttacac

SEQ ID NO: 480595 - DNA, 25 bp, Homo sapien
gaatgctctgtgttacacttgaacc

SEQ ID NO: 480596 - DNA, 25 bp, Homo sapien
ctctgtgttacacttgaaccatgta

SEQ ID NO: 480597 - DNA, 25 bp, Homo sapien
gaaccatgtataaatgtaacctgtg

SEQ ID NO: 480598 - DNA, 25 bp, Homo sapien
taaatgtaacctgtgtatctttttt

SEQ ID NO: 480599 - DNA, 25 bp, Homo sapien
tagcaaaatgcatcagaactggatt

SEQ ID NO: 480600 - DNA, 25 bp, Homo sapien
aagagtattgtgatattaagcactt

SEQ ID NO: 480601 - DNA, 25 bp, Homo sapien
aagcactttaacatacatatcagac

SEQ ID NO: 480602 - DNA, 25 bp, Homo sapien
catatcagacaaactgacgtgggtt

SEQ ID NO: 480603 - DNA, 25 bp, Homo sapien
gacaaactgacgtgggtttttcagg

SEQ ID NO: 480604 - DNA, 25 bp, Homo sapien
ttcaggtttgggagtacatttaaat

SEQ ID NO: 480605 - DNA, 25 bp, Homo sapien
acaaatgtaacagtgattcagatta

SEQ ID NO: 480606 - DNA, 25 bp, Homo sapien
gaaaggacaatttcaattctctcat

SEQ ID NO: 480607 - DNA, 25 bp, Homo sapien
caattctctcataatcagtaggtat

SEQ ID NO: 480608 - DNA, 25 bp, Homo sapien
atagtgatgtggcatctgtcctctt

SEQ ID NO: 480609 - DNA, 25 bp, Homo sapien
gtggcatctgtcctcttgtaagtag

SEQ ID NO: 480610 - DNA, 25 bp, Homo sapien
tcttgtaagtaggagcagcccacta

SEQ ID NO: 480611 - DNA, 25 bp, Homo sapien
taagtaggagcagcccactagctgt

SEQ ID NO: 480612 - DNA, 25 bp, Homo sapien
gcccactagctgttatggcttatct

SEQ ID NO: 480613 - DNA, 25 bp, Homo sapien
gctgttatggcttatctggttgcct

SEQ ID NO: 480614 - DNA, 25 bp, Homo sapien
tatctggttgcctgttatgacttac

SEQ ID NO: 480615 - DNA, 25 bp, Homo sapien
gttgcctgttatgacttacctggtt

SEQ ID NO: 480616 - DNA, 25 bp, Homo sapien
tctcctttttttttgcacatctttt

SEQ ID NO: 480617 - DNA, 25 bp, Homo sapien
gtgtcaaaaagtcacgactgactga

SEQ ID NO: 480618 - DNA, 25 bp, Homo sapien
aaaagtcacgactgactgacagccg

SEQ ID NO: 480619 - DNA, 25 bp, Homo sapien
aaagtcacgactgactgacagccgt

SEQ ID NO: 480620 - DNA, 25 bp, Homo sapien
aagtcacgactgactgacagccgtc

SEQ ID NO: 480621 - DNA, 25 bp, Homo sapien
agtcacgactgactgacagccgtca

SEQ ID NO: 480622 - DNA, 25 bp, Homo sapien
gtcacgactgactgacagccgtcag

SEQ ID NO: 480623 - DNA, 25 bp, Homo sapien
tcacgactgactgacagccgtcagt

SEQ ID NO: 480624 - DNA, 25 bp, Homo sapien
cacgactgactgacagccgtcagtc

SEQ ID NO: 480625 - DNA, 25 bp, Homo sapien
tgactgacagccgtcagtcccagag

SEQ ID NO: 480626 - DNA, 25 bp, Homo sapien
gccgtcagtcccagaggggctcatt

SEQ ID NO: 480627 - DNA, 25 bp, Homo sapien
gaattgtcttttcattcactttaag

SEQ ID NO: 480628 - DNA, 25 bp, Homo sapien
ataattcttaccatgtgccatcctg

SEQ ID NO: 480629 - DNA, 25 bp, Homo sapien
accatgtgccatcctgtcagtttta

SEQ ID NO: 480630 - DNA, 25 bp, Homo sapien
gtgccatcctgtcagttttaacaaa

SEQ ID NO: 480631 - DNA, 25 bp, Homo sapien
gtcagttttaacaaagcattttcac

SEQ ID NO: 480632 - DNA, 25 bp, Homo sapien
tttgtgtactaagacaaactgacac

SEQ ID NO: 480633 - DNA, 25 bp, Homo sapien
aactgacacattttgactcatacaa

SEQ ID NO: 480634 - DNA, 25 bp, Homo sapien
aataaaggaattctggatgtccagt

SEQ ID NO: 480635 - DNA, 25 bp, Homo sapien
gatgtccagtttagtcctcgttttc

SEQ ID NO: 480636 - DNA, 25 bp, Homo sapien
ttcttacgttaatctgggaccttat

SEQ ID NO: 480637 - DNA, 25 bp, Homo sapien
gggaccttatcacccataatatggt

SEQ ID NO: 480638 - DNA, 25 bp, Homo sapien
ttagctctccaacacaagactctgt

SEQ ID NO: 480639 - DNA, 25 bp, Homo sapien
caacacaagactctgtggtgtctgc

SEQ ID NO: 480640 - DNA, 25 bp, Homo sapien
ggatctgacttttgggaggctttaa

SEQ ID NO: 480641 - DNA, 25 bp, Homo sapien
tgcccactactctcactgttgagaa

SEQ ID NO: 480642 - DNA, 25 bp, Homo sapien
caaacactgaatactcctttttact

SEQ ID NO: 480643 - DNA, 25 bp, Homo sapien
gactgtcaagctttggattttctct

SEQ ID NO: 480644 - DNA, 25 bp, Homo sapien
agctttggattttctctgttaataa

SEQ ID NO: 480645 - DNA, 25 bp, Homo sapien
gaaattttaatacttacctagatat

SEQ ID NO: 480646 - DNA, 25 bp, Homo sapien
taagtgattatgattgcacttccct

SEQ ID NO: 480647 - DNA, 25 bp, Homo sapien
ttctctgatctcaccttggcttagc

SEQ ID NO: 480648 - DNA, 25 bp, Homo sapien
ttggcttagctctccaacacaagac

SEQ ID NO: 480649 - DNA, 25 bp, Homo sapien
tgggccagcctagtagcattacagt

SEQ ID NO: 480650 - DNA, 25 bp, Homo sapien
gtagcattacagtgttctagaatat

SEQ ID NO: 480651 - DNA, 25 bp, Homo sapien
tattatttatattggcggtggactc

SEQ ID NO: 480652 - DNA, 25 bp, Homo sapien
tattggcggtggactccaaggtgta

SEQ ID NO: 480653 - DNA, 25 bp, Homo sapien
gaaaacttgggtcttgggtaatatg

SEQ ID NO: 480654 - DNA, 25 bp, Homo sapien
tatggaccatttcatcctcagactt

SEQ ID NO: 480655 - DNA, 25 bp, Homo sapien
accatttcatcctcagacttgttag

SEQ ID NO: 480656 - DNA, 25 bp, Homo sapien
cctcagacttgttaggagtacattt

SEQ ID NO: 480657 - DNA, 25 bp, Homo sapien
ggagtacatttcttggtcttgagac

SEQ ID NO: 480658 - DNA, 25 bp, Homo sapien
tggtcttgagaccagtatttttcag

SEQ ID NO: 480659 - DNA, 25 bp, Homo sapien
gtatctaccatattctgggccagcc

SEQ ID NO: 480660 - DNA, 25 bp, Homo sapien
gcttgagcaaagaggccacataact

SEQ ID NO: 480661 - DNA, 25 bp, Homo sapien
agcaaagaggccacataactcaggg

SEQ ID NO: 480662 - DNA, 25 bp, Homo sapien
gctcaaattcgggttggctgcattc

SEQ ID NO: 480663 - DNA, 25 bp, Homo sapien
caaattcgggttggctgcattctat

SEQ ID NO: 480664 - DNA, 25 bp, Homo sapien
attcgggttggctgcattctattgc

SEQ ID NO: 480665 - DNA, 25 bp, Homo sapien
ggttggctgcattctattgcaggta

SEQ ID NO: 480666 - DNA, 25 bp, Homo sapien
gctgcattctattgcaggtaaccga

SEQ ID NO: 480667 - DNA, 25 bp, Homo sapien
ttgcaggtaaccgaacctgtctgcg

SEQ ID NO: 480668 - DNA, 25 bp, Homo sapien
aaccgaacctgtctgcgcctcagtt

SEQ ID NO: 480669 - DNA, 25 bp, Homo sapien
tcagtttacccatcagtaaagtgga

SEQ ID NO: 480670 - DNA, 25 bp, Homo sapien
tggaaataaacaatagcacctatat

SEQ ID NO: 480671 - DNA, 25 bp, Homo sapien
ggtcaggttcccttctaaacagaat

SEQ ID NO: 480672 - DNA, 25 bp, Homo sapien
gaatatgataatgctggcctgccaa

SEQ ID NO: 480673 - DNA, 25 bp, Homo sapien
tgccaaaactacagcttccccttta

SEQ ID NO: 480674 - DNA, 25 bp, Homo sapien
gcttcccctttaggaaagaactatg

SEQ ID NO: 480675 - DNA, 25 bp, Homo sapien
gcaattccagagttcacaactgcat

SEQ ID NO: 480676 - DNA, 25 bp, Homo sapien
aactgcattcagacctggcctacag

SEQ ID NO: 480677 - DNA, 25 bp, Homo sapien
tacagagcatctcacactcactgtg

SEQ ID NO: 480678 - DNA, 25 bp, Homo sapien
acactcactgtgcttgtgacattcc

SEQ ID NO: 480679 - DNA, 25 bp, Homo sapien
tgtgacattcccttgtaccaggccc

SEQ ID NO: 480680 - DNA, 25 bp, Homo sapien
aggccctccacaaagagctgggatt

SEQ ID NO: 480681 - DNA, 25 bp, Homo sapien
ggatttgaattctttgacgaagctc

SEQ ID NO: 480682 - DNA, 25 bp, Homo sapien
ataaaactccagaggttgttctact

SEQ ID NO: 480683 - DNA, 25 bp, Homo sapien
gttgttctactccatacagttcaca

SEQ ID NO: 480684 - DNA, 25 bp, Homo sapien
gattgtgacacattcttagtagcta

SEQ ID NO: 480685 - DNA, 25 bp, Homo sapien
attcttagtagctagtgtctgttct

SEQ ID NO: 480686 - DNA, 25 bp, Homo sapien
tgtctgttctagtcactgcactgga

SEQ ID NO: 480687 - DNA, 25 bp, Homo sapien
tgcactggagtctacgagccggaac

SEQ ID NO: 480688 - DNA, 25 bp, Homo sapien
agccggaactcgctatatgcacgtg

SEQ ID NO: 480689 - DNA, 25 bp, Homo sapien
gaactcgctatatgcacgtgtgtgt

SEQ ID NO: 480690 - DNA, 25 bp, Homo sapien
acgtgtgtgtgtccgtatgtaagaa

SEQ ID NO: 480691 - DNA, 25 bp, Homo sapien
gtgtgcaccgagtgactgaatggtt

SEQ ID NO: 480692 - DNA, 25 bp, Homo sapien
agactgatatcgagcattctgccca

SEQ ID NO: 480693 - DNA, 25 bp, Homo sapien
cttaaaagtaatcgtcctagctatt

SEQ ID NO: 480694 - DNA, 25 bp, Homo sapien
aaaagtaatcgtcctagctattaca

SEQ ID NO: 480695 - DNA, 25 bp, Homo sapien
aagtaatcgtcctagctattacatg

SEQ ID NO: 480696 - DNA, 25 bp, Homo sapien
gtaatcgtcctagctattacatgtt

SEQ ID NO: 480697 - DNA, 25 bp, Homo sapien
aatcgtcctagctattacatgtttc

SEQ ID NO: 480698 - DNA, 25 bp, Homo sapien
atcgtcctagctattacatgtttcc

SEQ ID NO: 480699 - DNA, 25 bp, Homo sapien
tcgtcctagctattacatgtttcca

SEQ ID NO: 480700 - DNA, 25 bp, Homo sapien
cgtcctagctattacatgtttccaa

SEQ ID NO: 480701 - DNA, 25 bp, Homo sapien
gtcctagctattacatgtttccaag

SEQ ID NO: 480702 - DNA, 25 bp, Homo sapien
cctagctattacatgtttccaagat

SEQ ID NO: 480703 - DNA, 25 bp, Homo sapien
ctagctattacatgtttccaagatt

SEQ ID NO: 480704 - DNA, 25 bp, Homo sapien
gcagaagttttcaggtggagaccaa

SEQ ID NO: 480705 - DNA, 25 bp, Homo sapien
aggtggagaccaagcggcctttgct

SEQ ID NO: 480706 - DNA, 25 bp, Homo sapien
gacctatggagggacagttttgacc

SEQ ID NO: 480707 - DNA, 25 bp, Homo sapien
gacagttttgacctgacccctagag

SEQ ID NO: 480708 - DNA, 25 bp, Homo sapien
gacccctagaggagacagttttgac

SEQ ID NO: 480709 - DNA, 25 bp, Homo sapien
ggagacagttttgacctcttcagca

SEQ ID NO: 480710 - DNA, 25 bp, Homo sapien
tgacctcttcagcaccaggaaggaa

SEQ ID NO: 480711 - DNA, 25 bp, Homo sapien
aggaagcatgggtctttaaggactt

SEQ ID NO: 480712 - DNA, 25 bp, Homo sapien
ctctctcttttttgctggacattat

SEQ ID NO: 480713 - DNA, 25 bp, Homo sapien
ctcttcctgctacctgtgggtctgc

SEQ ID NO: 480714 - DNA, 25 bp, Homo sapien
gtgggtctgcccagagtccctgcag

SEQ ID NO: 480715 - DNA, 25 bp, Homo sapien
tcatgcacttgaatgatgaccttga

SEQ ID NO: 480716 - DNA, 25 bp, Homo sapien
ataggaactgttcacttattctcat

SEQ ID NO: 480717 - DNA, 25 bp, Homo sapien
ggaactgttcacttattctcatatt

SEQ ID NO: 480718 - DNA, 25 bp, Homo sapien
aactgttcacttattctcatattat

SEQ ID NO: 480719 - DNA, 25 bp, Homo sapien
gttcacttattctcatattatttgg

SEQ ID NO: 480720 - DNA, 25 bp, Homo sapien
cttattctcatattatttgggcacc

SEQ ID NO: 480721 - DNA, 25 bp, Homo sapien
attctcatattatttgggcaccaaa

SEQ ID NO: 480722 - DNA, 25 bp, Homo sapien
ttatttgggcaccaaaaccaggtgg

SEQ ID NO: 480723 - DNA, 25 bp, Homo sapien
tttgggcaccaaaaccaggtggaag

SEQ ID NO: 480724 - DNA, 25 bp, Homo sapien
ttttcccagtaaatgcctaatgtat

SEQ ID NO: 480725 - DNA, 25 bp, Homo sapien
tttcccagtaaatgcctaatgtatt

SEQ ID NO: 480726 - DNA, 25 bp, Homo sapien
gcctgtgcgtgtttctgcctcatct

SEQ ID NO: 480727 - DNA, 25 bp, Homo sapien
tggacctgagcctcatgggaccgcg

SEQ ID NO: 480728 - DNA, 25 bp, Homo sapien
gtcactcttatgtgtcatcaccaaa

SEQ ID NO: 480729 - DNA, 25 bp, Homo sapien
tgggaccgcgtctcttcatccaggg

SEQ ID NO: 480730 - DNA, 25 bp, Homo sapien
cccttggtgggaggaacacagtgaa

SEQ ID NO: 480731 - DNA, 25 bp, Homo sapien
agacagagggtcatctcagtgccgt

SEQ ID NO: 480732 - DNA, 25 bp, Homo sapien
ggtcatctcagtgccgtgcaaaaga

SEQ ID NO: 480733 - DNA, 25 bp, Homo sapien
agaatgagagctcttccaggaccca

SEQ ID NO: 480734 - DNA, 25 bp, Homo sapien
gcatcaccaaaaagcattaccctct

SEQ ID NO: 480735 - DNA, 25 bp, Homo sapien
aaagcattaccctcttgaactgctc

SEQ ID NO: 480736 - DNA, 25 bp, Homo sapien
ttgaactgctcaagctgctctgtga

SEQ ID NO: 480737 - DNA, 25 bp, Homo sapien
ttgggttgtgttcctggaggtttga

SEQ ID NO: 480738 - DNA, 25 bp, Homo sapien
tgaagtgggccttcccgccttttga

SEQ ID NO: 480739 - DNA, 25 bp, Homo sapien
gttttgaacacatatcctggattag

SEQ ID NO: 480740 - DNA, 25 bp, Homo sapien
catatcctggattagttgggttgtt

SEQ ID NO: 480741 - DNA, 25 bp, Homo sapien
gttgttttgtattgaggatccctaa

SEQ ID NO: 480742 - DNA, 25 bp, Homo sapien
gtcttggaaaggactgctggcttcg

SEQ ID NO: 480743 - DNA, 25 bp, Homo sapien
aaggactgctggcttcgtcttgaac

SEQ ID NO: 480744 - DNA, 25 bp, Homo sapien
tgctggcttcgtcttgaacgttcgc

SEQ ID NO: 480745 - DNA, 25 bp, Homo sapien
aacgttcgccccatcaccagtgtga

SEQ ID NO: 480746 - DNA, 25 bp, Homo sapien
ccccatcaccagtgtgagtccgtgg

SEQ ID NO: 480747 - DNA, 25 bp, Homo sapien
gtctgttcttagtttgttctgagtt

SEQ ID NO: 480748 - DNA, 25 bp, Homo sapien
gcgcgctgtacagatcttcctgcag

SEQ ID NO: 480749 - DNA, 25 bp, Homo sapien
gaagggcatggaactgaccacagag

SEQ ID NO: 480750 - DNA, 25 bp, Homo sapien
ggctcgggcagggtacacaaactct

SEQ ID NO: 480751 - DNA, 25 bp, Homo sapien
gggtacacaaactctgtggctgcaa

SEQ ID NO: 480752 - DNA, 25 bp, Homo sapien
caaactctgtggctgcaaaatcccc

SEQ ID NO: 480753 - DNA, 25 bp, Homo sapien
ctgcaaaatccccagaggagctgct

SEQ ID NO: 480754 - DNA, 25 bp, Homo sapien
taaaacttccaggatctttgaaaga

SEQ ID NO: 480755 - DNA, 25 bp, Homo sapien
aaagctgaagatatcatgtgcatca

SEQ ID NO: 480756 - DNA, 25 bp, Homo sapien
catgtgcatcaaagtaaattccaga

SEQ ID NO: 480757 - DNA, 25 bp, Homo sapien
ggaagatgtgccttctactgctcag

SEQ ID NO: 480758 - DNA, 25 bp, Homo sapien
tgccttctactgctcagcatagctg

SEQ ID NO: 480759 - DNA, 25 bp, Homo sapien
aaggagtgggatcatgcccctaccc

SEQ ID NO: 480760 - DNA, 25 bp, Homo sapien
agcagaggtatctcatcactcgctc

SEQ ID NO: 480761 - DNA, 25 bp, Homo sapien
tatctcatcactcgctcatgtgcga

SEQ ID NO: 480762 - DNA, 25 bp, Homo sapien
cgctcatgtgcgagattctaaataa

SEQ ID NO: 480763 - DNA, 25 bp, Homo sapien
gcatcttctactaggcctcctataa

SEQ ID NO: 480764 - DNA, 25 bp, Homo sapien
actaggcctcctataaaatagatct

SEQ ID NO: 480765 - DNA, 25 bp, Homo sapien
tgttaatggaacctcactttctaga

SEQ ID NO: 480766 - DNA, 25 bp, Homo sapien
gcaggaatgtaaggaacccgcatca

SEQ ID NO: 480767 - DNA, 25 bp, Homo sapien
taaggaacccgcatcacctcaaatt

SEQ ID NO: 480768 - DNA, 25 bp, Homo sapien
cacctcaaattcagtgttacccaca

SEQ ID NO: 480769 - DNA, 25 bp, Homo sapien
tgttacccacacttgaccatgcttg

SEQ ID NO: 480770 - DNA, 25 bp, Homo sapien
gaaatacataaagtgcaggccgggc

SEQ ID NO: 480771 - DNA, 25 bp, Homo sapien
aaatacataaagtgcaggccgggcg

SEQ ID NO: 480772 - DNA, 25 bp, Homo sapien
aatacataaagtgcaggccgggcgc

SEQ ID NO: 480773 - DNA, 25 bp, Homo sapien
atacataaagtgcaggccgggcgcg

SEQ ID NO: 480774 - DNA, 25 bp, Homo sapien
tacataaagtgcaggccgggcgcgg

SEQ ID NO: 480775 - DNA, 25 bp, Homo sapien
acataaagtgcaggccgggcgcggt

SEQ ID NO: 480776 - DNA, 25 bp, Homo sapien
cataaagtgcaggccgggcgcggtg

SEQ ID NO: 480777 - DNA, 25 bp, Homo sapien
ataaagtgcaggccgggcgcggtgg

SEQ ID NO: 480778 - DNA, 25 bp, Homo sapien
aggacccagaggattcacacgccag

SEQ ID NO: 480779 - DNA, 25 bp, Homo sapien
agctcctcatcaaccggtgagccgc

SEQ ID NO: 480780 - DNA, 25 bp, Homo sapien
agaggcctgaagagaccaagacaga

SEQ ID NO: 480781 - DNA, 25 bp, Homo sapien
agcaccacagggaggccccagttac

SEQ ID NO: 480782 - DNA, 25 bp, Homo sapien
acagggaggccccagttaccccatg

SEQ ID NO: 480783 - DNA, 25 bp, Homo sapien
cagttaccccatgcggatgagtttc

SEQ ID NO: 480784 - DNA, 25 bp, Homo sapien
gcggatgagtttcatggccatctct

SEQ ID NO: 480785 - DNA, 25 bp, Homo sapien
gtttcatggccatctctaactaagg

SEQ ID NO: 480786 - DNA, 25 bp, Homo sapien
catggccatctctaactaaggacag

SEQ ID NO: 480787 - DNA, 25 bp, Homo sapien
gctcaggcgctcaggactgccagga

SEQ ID NO: 480788 - DNA, 25 bp, Homo sapien
aggactgccaggacccagaggattc

SEQ ID NO: 480789 - DNA, 25 bp, Homo sapien
aaggcttcctgcttcttggcccggt

SEQ ID NO: 480790 - DNA, 25 bp, Homo sapien
ttcttggcccggttcttggcagcgg

SEQ ID NO: 480791 - DNA, 25 bp, Homo sapien
tcttggcagcggcctcgttggccat

SEQ ID NO: 480792 - DNA, 25 bp, Homo sapien
tcgttggccatcttcagacccagcc

SEQ ID NO: 480793 - DNA, 25 bp, Homo sapien
gtgggccatgcctccacacggtcag

SEQ ID NO: 480794 - DNA, 25 bp, Homo sapien
tgcggcctggctccaggatctacaa

SEQ ID NO: 480795 - DNA, 25 bp, Homo sapien
gcctggctccaggatctacaaggta

SEQ ID NO: 480796 - DNA, 25 bp, Homo sapien
tggctccaggatctacaaggtagca

SEQ ID NO: 480797 - DNA, 25 bp, Homo sapien
aggatctacaaggtagcaggtgtgt

SEQ ID NO: 480798 - DNA, 25 bp, Homo sapien
catgcctccacacggtcagggcagg

SEQ ID NO: 480799 - DNA, 25 bp, Homo sapien
aggcagcccctcacacagaaagcca

SEQ ID NO: 480800 - DNA, 25 bp, Homo sapien
ctcctgactatcatttcttatctgg

SEQ ID NO: 480801 - DNA, 25 bp, Homo sapien
tcttgaagatattgccaggctttgt

SEQ ID NO: 480802 - DNA, 25 bp, Homo sapien
gccaggctttgtcaaacatcacaca

SEQ ID NO: 480803 - DNA, 25 bp, Homo sapien
aacatcacacagatttgcaaagctg

SEQ ID NO: 480804 - DNA, 25 bp, Homo sapien
gcaaagctgtgcatgtctgataaac

SEQ ID NO: 480805 - DNA, 25 bp, Homo sapien
tgcatgtctgataaactgtgggaac

SEQ ID NO: 480806 - DNA, 25 bp, Homo sapien
aacagatagtccagtcgacctgcga

SEQ ID NO: 480807 - DNA, 25 bp, Homo sapien
gagacagctgttcttcaccaacaag

SEQ ID NO: 480808 - DNA, 25 bp, Homo sapien
gcggcagctccgcaagaggaaacaa

SEQ ID NO: 480809 - DNA, 25 bp, Homo sapien
agcaaccttaggcacacattttcct

SEQ ID NO: 480810 - DNA, 25 bp, Homo sapien
acattttcctaccagcagggagctc

SEQ ID NO: 480811 - DNA, 25 bp, Homo sapien
aggagtgttccttattctctgcgga

SEQ ID NO: 480812 - DNA, 25 bp, Homo sapien
ttattctctgcggactcaccctaat

SEQ ID NO: 480813 - DNA, 25 bp, Homo sapien
gactcaccctaatccacaggaagct

SEQ ID NO: 480814 - DNA, 25 bp, Homo sapien
aagcagcagtagcaccacttggcta

SEQ ID NO: 480815 - DNA, 25 bp, Homo sapien
cacttggctagacggaccagctgga

SEQ ID NO: 480816 - DNA, 25 bp, Homo sapien
cggaccagctggaaagatcatgatg

SEQ ID NO: 480817 - DNA, 25 bp, Homo sapien
gtggcccagccttgggatgtcatgt

SEQ ID NO: 480818 - DNA, 25 bp, Homo sapien
tcctagggcgatccagttgtgcagc

SEQ ID NO: 480819 - DNA, 25 bp, Homo sapien
gcgatccagttgtgcagccttctga

SEQ ID NO: 480820 - DNA, 25 bp, Homo sapien
agccttctgaccatcagccaaggga

SEQ ID NO: 480821 - DNA, 25 bp, Homo sapien
ccaagggaagcaggcctctgatgga

SEQ ID NO: 480822 - DNA, 25 bp, Homo sapien
gggaaggagagcactcttgtcccca

SEQ ID NO: 480823 - DNA, 25 bp, Homo sapien
aaggagagcactcttgtccccagtc

SEQ ID NO: 480824 - DNA, 25 bp, Homo sapien
tgggctgcagagattggtgccagaa

SEQ ID NO: 480825 - DNA, 25 bp, Homo sapien
gtttgggaattggagctcctccaag

SEQ ID NO: 480826 - DNA, 25 bp, Homo sapien
aggagctcctcctaagattgagtgc

SEQ ID NO: 480827 - DNA, 25 bp, Homo sapien
gctcctcctaagattgagtgctgca

SEQ ID NO: 480828 - DNA, 25 bp, Homo sapien
cctcctaagattgagtgctgcagct

SEQ ID NO: 480829 - DNA, 25 bp, Homo sapien
cagctgtagtggctgctggttggga

SEQ ID NO: 480830 - DNA, 25 bp, Homo sapien
ggttgggagagtaagtgccatcact

SEQ ID NO: 480831 - DNA, 25 bp, Homo sapien
gggagagtaagtgccatcactaatt

SEQ ID NO: 480832 - DNA, 25 bp, Homo sapien
agtgccatcactaatttaaaagtcc

SEQ ID NO: 480833 - DNA, 25 bp, Homo sapien
ttacccctgcctttatcagcttcta

SEQ ID NO: 480834 - DNA, 25 bp, Homo sapien
tttatcagcttctaccttctggttt

SEQ ID NO: 480835 - DNA, 25 bp, Homo sapien
ctaccttctggtttcatgctgagtt

SEQ ID NO: 480836 - DNA, 25 bp, Homo sapien
tttcatgctgagttctagttgccta

SEQ ID NO: 480837 - DNA, 25 bp, Homo sapien
gttctagttgcctaaagtctccatt

SEQ ID NO: 480838 - DNA, 25 bp, Homo sapien
tagttgcctaaagtctccattgaaa

SEQ ID NO: 480839 - DNA, 25 bp, Homo sapien
agtctccattgaaacactcctgtta

SEQ ID NO: 480840 - DNA, 25 bp, Homo sapien
ttgaaacactcctgttataattgcc

SEQ ID NO: 480841 - DNA, 25 bp, Homo sapien
gccataaaatcataaatccactccc

SEQ ID NO: 480842 - DNA, 25 bp, Homo sapien
cctttctcctcctagtcaaaatttg

SEQ ID NO: 480843 - DNA, 25 bp, Homo sapien
ttctcctcctagtcaaaatttgtat

SEQ ID NO: 480844 - DNA, 25 bp, Homo sapien
tctggcatggtccttcctccagctg

SEQ ID NO: 480845 - DNA, 25 bp, Homo sapien
tcctttgcctggagtgagggtgttc

SEQ ID NO: 480846 - DNA, 25 bp, Homo sapien
cctggagtgagggtgttcataccaa

SEQ ID NO: 480847 - DNA, 25 bp, Homo sapien
gagggtgttcataccaaagacggaa

SEQ ID NO: 480848 - DNA, 25 bp, Homo sapien
taccaaagacggaaccatttcgcct

SEQ ID NO: 480849 - DNA, 25 bp, Homo sapien
gaaaatatatccagaagcagccgct

SEQ ID NO: 480850 - DNA, 25 bp, Homo sapien
ctctcgcctggctggttcggtctaa

SEQ ID NO: 480851 - DNA, 25 bp, Homo sapien
tcgcctggctggttcggtctaacgc

SEQ ID NO: 480852 - DNA, 25 bp, Homo sapien
tggttcggtctaacgccccggagag

SEQ ID NO: 480853 - DNA, 25 bp, Homo sapien
gattccgggcctggctgggcttcct

SEQ ID NO: 480854 - DNA, 25 bp, Homo sapien
cctcttcccacctgaggactgggtg

SEQ ID NO: 480855 - DNA, 25 bp, Homo sapien
tatgattgggagtccgagtgccaga

SEQ ID NO: 480856 - DNA, 25 bp, Homo sapien
agtccgagtgccagatgccggtcag

SEQ ID NO: 480857 - DNA, 25 bp, Homo sapien
atgccggtcaggacctgttatgctg

SEQ ID NO: 480858 - DNA, 25 bp, Homo sapien
ggacctgttatgctgggtctcagaa

SEQ ID NO: 480859 - DNA, 25 bp, Homo sapien
gggtctcagaatgcggaaactctcc

SEQ ID NO: 480860 - DNA, 25 bp, Homo sapien
atgcggaaactctccctgtccgagg

SEQ ID NO: 480861 - DNA, 25 bp, Homo sapien
gaacagtttgtccttgagtgaggac

SEQ ID NO: 480862 - DNA, 25 bp, Homo sapien
gagtgactcttttgatttgatcctg

SEQ ID NO: 480863 - DNA, 25 bp, Homo sapien
tgatttgatcctgtttccctcaaac

SEQ ID NO: 480864 - DNA, 25 bp, Homo sapien
tcaaacctgagatgggagcctcact

SEQ ID NO: 480865 - DNA, 25 bp, Homo sapien
gagatgggagcctcactgtattgcc

SEQ ID NO: 480866 - DNA, 25 bp, Homo sapien
aaatcacttgtagtcttggtgtggt

SEQ ID NO: 480867 - DNA, 25 bp, Homo sapien
tcacttgtagtcttggtgtggtatc

SEQ ID NO: 480868 - DNA, 25 bp, Homo sapien
cttgtagtcttggtgtggtatcaaa

SEQ ID NO: 480869 - DNA, 25 bp, Homo sapien
cttggtgtggtatcaaagaatagcc

SEQ ID NO: 480870 - DNA, 25 bp, Homo sapien
ggtatcaaagaatagccacaattag

SEQ ID NO: 480871 - DNA, 25 bp, Homo sapien
aaagaatagccacaattagctgaaa

SEQ ID NO: 480872 - DNA, 25 bp, Homo sapien
aacttttccaactgcgtatctgtgt

SEQ ID NO: 480873 - DNA, 25 bp, Homo sapien
gtgtgaagtcaacttacttcaacaa

SEQ ID NO: 480874 - DNA, 25 bp, Homo sapien
agtttggatgtagaagcagctgtaa

SEQ ID NO: 480875 - DNA, 25 bp, Homo sapien
gaagcagctgtaagaattcaactgt

SEQ ID NO: 480876 - DNA, 25 bp, Homo sapien
cagctgtaagaattcaactgtttat

SEQ ID NO: 480877 - DNA, 25 bp, Homo sapien
gccccaccggaaacagacccagcag

SEQ ID NO: 480878 - DNA, 25 bp, Homo sapien
gatgggggcgtctctcagctctgca

SEQ ID NO: 480879 - DNA, 25 bp, Homo sapien
tgcaagctggagaattaactccggg

SEQ ID NO: 480880 - DNA, 25 bp, Homo sapien
caagctggagaattaactccgggac

SEQ ID NO: 480881 - DNA, 25 bp, Homo sapien
agctggagaattaactccgggactt

SEQ ID NO: 480882 - DNA, 25 bp, Homo sapien
gctggagaattaactccgggacttg

SEQ ID NO: 480883 - DNA, 25 bp, Homo sapien
ctggagaattaactccgggacttga

SEQ ID NO: 480884 - DNA, 25 bp, Homo sapien
ggagaattaactccgggacttgagc

SEQ ID NO: 480885 - DNA, 25 bp, Homo sapien
aattaactccgggacttgagctcgg

SEQ ID NO: 480886 - DNA, 25 bp, Homo sapien
attaactccgggacttgagctcggg

SEQ ID NO: 480887 - DNA, 25 bp, Homo sapien
gggtccccgctgggcgcaggcgtgg

SEQ ID NO: 480888 - DNA, 25 bp, Homo sapien
aaagcacgatattatgatccaagaa

SEQ ID NO: 480889 - DNA, 25 bp, Homo sapien
agtggtcattgtacagcttgtctca

SEQ ID NO: 480890 - DNA, 25 bp, Homo sapien
cattgtacagcttgtctcactggaa

SEQ ID NO: 480891 - DNA, 25 bp, Homo sapien
ttgtctcactggaaaatatcctgta

SEQ ID NO: 480892 - DNA, 25 bp, Homo sapien
aattagaatggtagctggtagggtt

SEQ ID NO: 480893 - DNA, 25 bp, Homo sapien
gtcaagaagttatagtggtcacacc

SEQ ID NO: 480894 - DNA, 25 bp, Homo sapien
tggtcacacctcatctatttactgt

SEQ ID NO: 480895 - DNA, 25 bp, Homo sapien
acctcatctatttactgttactcag

SEQ ID NO: 480896 - DNA, 25 bp, Homo sapien
actgttactcagttggtacaatgta

SEQ ID NO: 480897 - DNA, 25 bp, Homo sapien
taaaatgccatgcttatgtttataa

SEQ ID NO: 480898 - DNA, 25 bp, Homo sapien
ggataccaaagtgcgataactgaac

SEQ ID NO: 480899 - DNA, 25 bp, Homo sapien
gggccgggagctcgacatctacaac

SEQ ID NO: 480900 - DNA, 25 bp, Homo sapien
ggagctcgacatctacaacaaccta

SEQ ID NO: 480901 - DNA, 25 bp, Homo sapien
atctacaacaacctacggcagacac

SEQ ID NO: 480902 - DNA, 25 bp, Homo sapien
tccacctggctgtgatcaccacatt

SEQ ID NO: 480903 - DNA, 25 bp, Homo sapien
tgtgatcaccacattaccgtctgtg

SEQ ID NO: 480904 - DNA, 25 bp, Homo sapien
attaccgtctgtggtccggctcctg

SEQ ID NO: 480905 - DNA, 25 bp, Homo sapien
agacggccgctcacctggcgtgcga

SEQ ID NO: 480906 - DNA, 25 bp, Homo sapien
gcacgttggacctggaggcccgcaa

SEQ ID NO: 480907 - DNA, 25 bp, Homo sapien
gttggacctggaggcccgcaattat

SEQ ID NO: 480908 - DNA, 25 bp, Homo sapien
gaggcccgcaattatgacgggctca

SEQ ID NO: 480909 - DNA, 25 bp, Homo sapien
attatgacgggctcaccgccctgca

SEQ ID NO: 480910 - DNA, 25 bp, Homo sapien
ttcttgacccattacaatctcttct

SEQ ID NO: 480911 - DNA, 25 bp, Homo sapien
tcttgacccattacaatctcttcta

SEQ ID NO: 480912 - DNA, 25 bp, Homo sapien
ttgacccattacaatctcttctacg

SEQ ID NO: 480913 - DNA, 25 bp, Homo sapien
tgacccattacaatctcttctacgg

SEQ ID NO: 480914 - DNA, 25 bp, Homo sapien
gacccattacaatctcttctacggg

SEQ ID NO: 480915 - DNA, 25 bp, Homo sapien
ccattacaatctcttctacgggcaa

SEQ ID NO: 480916 - DNA, 25 bp, Homo sapien
cattacaatctcttctacgggcaaa

SEQ ID NO: 480917 - DNA, 25 bp, Homo sapien
attacaatctcttctacgggcaaag

SEQ ID NO: 480918 - DNA, 25 bp, Homo sapien
tacaatctcttctacgggcaaagct

SEQ ID NO: 480919 - DNA, 25 bp, Homo sapien
acaatctcttctacgggcaaagctg

SEQ ID NO: 480920 - DNA, 25 bp, Homo sapien
aatctcttctacgggcaaagctgag

SEQ ID NO: 480921 - DNA, 25 bp, Homo sapien
ttatacgtttatatgctctgtctgc

SEQ ID NO: 480922 - DNA, 25 bp, Homo sapien
atatgctctgtctgcagttctggac

SEQ ID NO: 480923 - DNA, 25 bp, Homo sapien
gttctggaccagaatacctcaaacg

SEQ ID NO: 480924 - DNA, 25 bp, Homo sapien
acctcaaacgtctaccattacagtg

SEQ ID NO: 480925 - DNA, 25 bp, Homo sapien
tacagtgggtagatatagcacacct

SEQ ID NO: 480926 - DNA, 25 bp, Homo sapien
acacctatgcctttacaacctaagt

SEQ ID NO: 480927 - DNA, 25 bp, Homo sapien
tctgaacttgagcttatgacataca

SEQ ID NO: 480928 - DNA, 25 bp, Homo sapien
ggccctggagactggtatttgaaga

SEQ ID NO: 480929 - DNA, 25 bp, Homo sapien
gaagatgctacagtgctgcaaatgt

SEQ ID NO: 480930 - DNA, 25 bp, Homo sapien
cagtggtttcatgaggcttgtgtgc

SEQ ID NO: 480931 - DNA, 25 bp, Homo sapien
gtgtgcaatgccttcaaaagccaat

SEQ ID NO: 480932 - DNA, 25 bp, Homo sapien
aaggtgtgccacagctgagcttcac

SEQ ID NO: 480933 - DNA, 25 bp, Homo sapien
agctgagcttcacccggatatatag

SEQ ID NO: 480934 - DNA, 25 bp, Homo sapien
tcacccggatatatagaccagctct

SEQ ID NO: 480935 - DNA, 25 bp, Homo sapien
ggatatatagaccagctctccccac

SEQ ID NO: 480936 - DNA, 25 bp, Homo sapien
accctgcctggcagcgcaatggaac

SEQ ID NO: 480937 - DNA, 25 bp, Homo sapien
ctggcagcgcaatggaaccgaggat

SEQ ID NO: 480938 - DNA, 25 bp, Homo sapien
aactgtgacagaatcttgctccgct

SEQ ID NO: 480939 - DNA, 25 bp, Homo sapien
acagaatcttgctccgctgccaagg

SEQ ID NO: 480940 - DNA, 25 bp, Homo sapien
gtggatgcggcaggttataaatgat

SEQ ID NO: 480941 - DNA, 25 bp, Homo sapien
taaatgatgctgtctcctttgtttg

SEQ ID NO: 480942 - DNA, 25 bp, Homo sapien
atgctgtctcctttgtttggtgtac

SEQ ID NO: 480943 - DNA, 25 bp, Homo sapien
tcagataatgacctcagtgattggg

SEQ ID NO: 480944 - DNA, 25 bp, Homo sapien
taatgacctcagtgattgggttttc

SEQ ID NO: 480945 - DNA, 25 bp, Homo sapien
atgacctcagtgattgggttttcat

SEQ ID NO: 480946 - DNA, 25 bp, Homo sapien
gattgggttttcattaccaaacagc

SEQ ID NO: 480947 - DNA, 25 bp, Homo sapien
gggttttcattaccaaacagcatcc

SEQ ID NO: 480948 - DNA, 25 bp, Homo sapien
tttcattaccaaacagcatccagag

SEQ ID NO: 480949 - DNA, 25 bp, Homo sapien
tcattaccaaacagcatccagagat

SEQ ID NO: 480950 - DNA, 25 bp, Homo sapien
attaccaaacagcatccagagatta

SEQ ID NO: 480951 - DNA, 25 bp, Homo sapien
cagcatccagagattatcaacccat

SEQ ID NO: 480952 - DNA, 25 bp, Homo sapien
gcatccagagattatcaacccatag

SEQ ID NO: 480953 - DNA, 25 bp, Homo sapien
agagattatcaacccatagaagaag

SEQ ID NO: 480954 - DNA, 25 bp, Homo sapien
ggctccttatcagtgccatgagggc

SEQ ID NO: 480955 - DNA, 25 bp, Homo sapien
tgccatgagggcagaggtgctacct

SEQ ID NO: 480956 - DNA, 25 bp, Homo sapien
gcagaggtgctacctggccttcctg

SEQ ID NO: 480957 - DNA, 25 bp, Homo sapien
tgcagccagcgtggccctaggacag

SEQ ID NO: 480958 - DNA, 25 bp, Homo sapien
ccagcgtggccctaggacaggagga

SEQ ID NO: 480959 - DNA, 25 bp, Homo sapien
tgaggggtggccatctcctgccctg

SEQ ID NO: 480960 - DNA, 25 bp, Homo sapien
gggccactggcttcacattctgggc

SEQ ID NO: 480961 - DNA, 25 bp, Homo sapien
gccactggcttcacattctgggctg

SEQ ID NO: 480962 - DNA, 25 bp, Homo sapien
acattctgggctgactcatagggga

SEQ ID NO: 480963 - DNA, 25 bp, Homo sapien
ggagtcaccaaaaccagtgctggga

SEQ ID NO: 480964 - DNA, 25 bp, Homo sapien
ccaaaaccagtgctgggacaaagat

SEQ ID NO: 480965 - DNA, 25 bp, Homo sapien
tagaggatagagctgcatcacttaa

SEQ ID NO: 480966 - DNA, 25 bp, Homo sapien
gagctgcatcacttaaattcatgac

SEQ ID NO: 480967 - DNA, 25 bp, Homo sapien
gaagtgaagtttacgccacccaatg

SEQ ID NO: 480968 - DNA, 25 bp, Homo sapien
acgccacccaatgtatagccaaatt

SEQ ID NO: 480969 - DNA, 25 bp, Homo sapien
gtatagccaaattgtacgtgcttaa

SEQ ID NO: 480970 - DNA, 25 bp, Homo sapien
gtacgtgcttaaaaaacagtgccga

SEQ ID NO: 480971 - DNA, 25 bp, Homo sapien
acagtgccgagagtatgttcagttc

SEQ ID NO: 480972 - DNA, 25 bp, Homo sapien
gagtatgttcagttcgcagtaagta

SEQ ID NO: 480973 - DNA, 25 bp, Homo sapien
aaatattctatggtacattctcaga

SEQ ID NO: 480974 - DNA, 25 bp, Homo sapien
attctcagaaattggcttccaacta

SEQ ID NO: 480975 - DNA, 25 bp, Homo sapien
atacgtttgacccattttgaataag

SEQ ID NO: 480976 - DNA, 25 bp, Homo sapien
tgaattcatgtatcgctccacgtag

SEQ ID NO: 480977 - DNA, 25 bp, Homo sapien
gtatcgctccacgtagtctgaccag

SEQ ID NO: 480978 - DNA, 25 bp, Homo sapien
gtctgaccagcgctaagatggcaaa

SEQ ID NO: 480979 - DNA, 25 bp, Homo sapien
aaaacagctcctaatgcattgggca

SEQ ID NO: 480980 - DNA, 25 bp, Homo sapien
ctatgattacaatgccccgaattca

SEQ ID NO: 480981 - DNA, 25 bp, Homo sapien
caatgccccgaattcataaatttca

SEQ ID NO: 480982 - DNA, 25 bp, Homo sapien
tccggatccgccgtagattcctggg

SEQ ID NO: 480983 - DNA, 25 bp, Homo sapien
ttcaagatcaaaaaagtccctttct

SEQ ID NO: 480984 - DNA, 25 bp, Homo sapien
tactggtttctgtgctagatgttca

SEQ ID NO: 480985 - DNA, 25 bp, Homo sapien
gatgttcacgaagctcaggcgaggt

SEQ ID NO: 480986 - DNA, 25 bp, Homo sapien
aggcgaggtagtatctgaattcatg

SEQ ID NO: 480987 - DNA, 25 bp, Homo sapien
atatttctaaacagcccctgtaaag

SEQ ID NO: 480988 - DNA, 25 bp, Homo sapien
atgaggtttagttactgcaggcttt

SEQ ID NO: 480989 - DNA, 25 bp, Homo sapien
gttactgcaggctttgttgagaaga

SEQ ID NO: 480990 - DNA, 25 bp, Homo sapien
gatgatcagggatgactttccccta

SEQ ID NO: 480991 - DNA, 25 bp, Homo sapien
tcccctagcaaatatttggatgcct

SEQ ID NO: 480992 - DNA, 25 bp, Homo sapien
tatttggatgcctcctgtttgtcaa

SEQ ID NO: 480993 - DNA, 25 bp, Homo sapien
ggatgcctcctgtttgtcaaataga

SEQ ID NO: 480994 - DNA, 25 bp, Homo sapien
gctaggttaacttcttacaggtata

SEQ ID NO: 480995 - DNA, 25 bp, Homo sapien
aatgcctgaaattctgtagtttcat

SEQ ID NO: 480996 - DNA, 25 bp, Homo sapien
gtagtttcatttctttggattagtc

SEQ ID NO: 480997 - DNA, 25 bp, Homo sapien
tctttggattagtcgttgtcttttc

SEQ ID NO: 480998 - DNA, 25 bp, Homo sapien
tgacaataactatcagatttgcctt

SEQ ID NO: 480999 - DNA, 25 bp, Homo sapien
atagcatttatcaaaacgtatcctc

SEQ ID NO: 481000 - DNA, 25 bp, Homo sapien
gcatttatcaaaacgtatcctcata

SEQ ID NO: 481001 - DNA, 25 bp, Homo sapien
ttatcaaaacgtatcctcatagact

SEQ ID NO: 481002 - DNA, 25 bp, Homo sapien
atcaaaacgtatcctcatagacttt

SEQ ID NO: 481003 - DNA, 25 bp, Homo sapien
caaaacgtatcctcatagactttat

SEQ ID NO: 481004 - DNA, 25 bp, Homo sapien
tatgcagattaatatggtcaattga

SEQ ID NO: 481005 - DNA, 25 bp, Homo sapien
tttaagccaggacaagaagtgcaaa

SEQ ID NO: 481006 - DNA, 25 bp, Homo sapien
ctctttgaagcaatttaggctaaac

SEQ ID NO: 481007 - DNA, 25 bp, Homo sapien
gcaatttaggctaaactgattttga

SEQ ID NO: 481008 - DNA, 25 bp, Homo sapien
attaagccaggacaagaagtgcaaa

SEQ ID NO: 481009 - DNA, 25 bp, Homo sapien
ttgaacacagataaggttaaccttg

SEQ ID NO: 481010 - DNA, 25 bp, Homo sapien
gttaaccttgatatatttctaaatt

SEQ ID NO: 481011 - DNA, 25 bp, Homo sapien
cctggacttgtcttcacttatttac

SEQ ID NO: 481012 - DNA, 25 bp, Homo sapien
gtcttcacttatttacagctctatt

SEQ ID NO: 481013 - DNA, 25 bp, Homo sapien
tgatccaaccttaccaagcttgttt

SEQ ID NO: 481014 - DNA, 25 bp, Homo sapien
agcttgttttgggtgaattactcca

SEQ ID NO: 481015 - DNA, 25 bp, Homo sapien
gaattactccaaaacccgaaggcag

SEQ ID NO: 481016 - DNA, 25 bp, Homo sapien
caggatgagggagtcttacagattc

SEQ ID NO: 481017 - DNA, 25 bp, Homo sapien
tttggcgccctttccgcaatggcac

SEQ ID NO: 481018 - DNA, 25 bp, Homo sapien
tttccgcaatggcacatcagcagta

SEQ ID NO: 481019 - DNA, 25 bp, Homo sapien
gtaaaagtggtaccactgtacagac

SEQ ID NO: 481020 - DNA, 25 bp, Homo sapien
agtgctgacctaattggctgattga

SEQ ID NO: 481021 - DNA, 25 bp, Homo sapien
cctagaatgaggtaactgactgatt

SEQ ID NO: 481022 - DNA, 25 bp, Homo sapien
actgactgattggatttacctgatc

SEQ ID NO: 481023 - DNA, 25 bp, Homo sapien
tttacctgatctgagctaattggct

SEQ ID NO: 481024 - DNA, 25 bp, Homo sapien
ggctgatcagaattacctagaccaa

SEQ ID NO: 481025 - DNA, 25 bp, Homo sapien
ggctaattggaatacactgggctga

SEQ ID NO: 481026 - DNA, 25 bp, Homo sapien
cactgggctgagctaattggctgat

SEQ ID NO: 481027 - DNA, 25 bp, Homo sapien
tgcttgtattcacctcccctgagaa

SEQ ID NO: 481028 - DNA, 25 bp, Homo sapien
atgatctctgacttacctttttttt

SEQ ID NO: 481029 - DNA, 25 bp, Homo sapien
attgactgtaatgacctgatttgag

SEQ ID NO: 481030 - DNA, 25 bp, Homo sapien
gacctgatttgagttaattgactga

SEQ ID NO: 481031 - DNA, 25 bp, Homo sapien
acggtttcttcctcatacacctatt

SEQ ID NO: 481032 - DNA, 25 bp, Homo sapien
cacgggcagagcattcttggctgat

SEQ ID NO: 481033 - DNA, 25 bp, Homo sapien
gggaagttccagcaatcagcacaag

SEQ ID NO: 481034 - DNA, 25 bp, Homo sapien
gttccagcaatcagcacaagtgttc

SEQ ID NO: 481035 - DNA, 25 bp, Homo sapien
gtgttctttataccccaaatcacta

SEQ ID NO: 481036 - DNA, 25 bp, Homo sapien
tggtggaacaaatctcataatcaag

SEQ ID NO: 481037 - DNA, 25 bp, Homo sapien
atcaagaggatcatagtccctggta

SEQ ID NO: 481038 - DNA, 25 bp, Homo sapien
atcatagtccctggtaagtggatcc

SEQ ID NO: 481039 - DNA, 25 bp, Homo sapien
aagtggatccctggagcattggcac

SEQ ID NO: 481040 - DNA, 25 bp, Homo sapien
ggagcattggcaccatgttttccag

SEQ ID NO: 481041 - DNA, 25 bp, Homo sapien
tggcaccatgttttccagtaaagtc

SEQ ID NO: 481042 - DNA, 25 bp, Homo sapien
ttatgttactaactttcaccacccg

SEQ ID NO: 481043 - DNA, 25 bp, Homo sapien
agcatgtattgctagtaagccccag

SEQ ID NO: 481044 - DNA, 25 bp, Homo sapien
gtaagccccaggtacagctatgtga

SEQ ID NO: 481045 - DNA, 25 bp, Homo sapien
gccccaggtacagctatgtgagaga

SEQ ID NO: 481046 - DNA, 25 bp, Homo sapien
ggaagtcccccaaatggtggccaga

SEQ ID NO: 481047 - DNA, 25 bp, Homo sapien
aatggtggccagaagagcagaaaac

SEQ ID NO: 481048 - DNA, 25 bp, Homo sapien
gggtgggaaaaattctacctcacag

SEQ ID NO: 481049 - DNA, 25 bp, Homo sapien
aaattctacctcacagttttgcata

SEQ ID NO: 481050 - DNA, 25 bp, Homo sapien
ttctacctcacagttttgcataggg

SEQ ID NO: 481051 - DNA, 25 bp, Homo sapien
gatagctatgcttttacgggacatt

SEQ ID NO: 481052 - DNA, 25 bp, Homo sapien
tgcttttacgggacattttagcgtt

SEQ ID NO: 481053 - DNA, 25 bp, Homo sapien
tcccatgatgacgatcagtcagtac

SEQ ID NO: 481054 - DNA, 25 bp, Homo sapien
attctgaactcattgtaagtgcttg

SEQ ID NO: 481055 - DNA, 25 bp, Homo sapien
aactcattgtaagtgcttggtgaca

SEQ ID NO: 481056 - DNA, 25 bp, Homo sapien
attgtaagtgcttggtgacatatgt

SEQ ID NO: 481057 - DNA, 25 bp, Homo sapien
gacgatcagtcagtacatctggaga

SEQ ID NO: 481058 - DNA, 25 bp, Homo sapien
tttggatatttaactggggctgaca

SEQ ID NO: 481059 - DNA, 25 bp, Homo sapien
ctccaactgctgtttgaacatagct

SEQ ID NO: 481060 - DNA, 25 bp, Homo sapien
tcagtcagtacatctggagagacag

SEQ ID NO: 481061 - DNA, 25 bp, Homo sapien
caactgctgtttgaacatagcttat

SEQ ID NO: 481062 - DNA, 25 bp, Homo sapien
gaacatagcttattatactgcaatg

SEQ ID NO: 481063 - DNA, 25 bp, Homo sapien
tagcttattatactgcaatgtagtg

SEQ ID NO: 481064 - DNA, 25 bp, Homo sapien
caggctcccaggtgacttacgttaa

SEQ ID NO: 481065 - DNA, 25 bp, Homo sapien
ggctcccaggtgacttacgttaata

SEQ ID NO: 481066 - DNA, 25 bp, Homo sapien
tcccaggtgacttacgttaatagca

SEQ ID NO: 481067 - DNA, 25 bp, Homo sapien
gtgacttacgttaatagcagacttc

SEQ ID NO: 481068 - DNA, 25 bp, Homo sapien
gttaatagcagacttctagttagaa

SEQ ID NO: 481069 - DNA, 25 bp, Homo sapien
gtcaaacagttcaagaaagtatcca

SEQ ID NO: 481070 - DNA, 25 bp, Homo sapien
gaagtcaatgggtatgttactaaag

SEQ ID NO: 481071 - DNA, 25 bp, Homo sapien
gtaaatgtagaagtctgtatcgtaa

SEQ ID NO: 481072 - DNA, 25 bp, Homo sapien
gtatcgtaataaatctgttgctaag

SEQ ID NO: 481073 - DNA, 25 bp, Homo sapien
tctgttgctaagtaaaatgggaata

SEQ ID NO: 481074 - DNA, 25 bp, Homo sapien
atgggaatacatgacaacgaggaat

SEQ ID NO: 481075 - DNA, 25 bp, Homo sapien
atgccattccggcacaagcctggga

SEQ ID NO: 481076 - DNA, 25 bp, Homo sapien
ccattccggcacaagcctgggagtg

SEQ ID NO: 481077 - DNA, 25 bp, Homo sapien
agcctgggagtgtgttctccgtgga

SEQ ID NO: 481078 - DNA, 25 bp, Homo sapien
cctggaccttgcaatgtccaaggag

SEQ ID NO: 481079 - DNA, 25 bp, Homo sapien
gaccttgcaatgtccaaggaggagg

SEQ ID NO: 481080 - DNA, 25 bp, Homo sapien
gagaggcacctgactctttgcctga

SEQ ID NO: 481081 - DNA, 25 bp, Homo sapien
aggcacctgactctttgcctgagtt

SEQ ID NO: 481082 - DNA, 25 bp, Homo sapien
tgactctttgcctgagttcacggtg

SEQ ID NO: 481083 - DNA, 25 bp, Homo sapien
tctttgcctgagttcacggtgcaga

SEQ ID NO: 481084 - DNA, 25 bp, Homo sapien
ttgcctgagttcacggtgcagatgg

SEQ ID NO: 481085 - DNA, 25 bp, Homo sapien
agatggggaacttgcgcttctccct

SEQ ID NO: 481086 - DNA, 25 bp, Homo sapien
accttctaggtgttggactcagcaa

SEQ ID NO: 481087 - DNA, 25 bp, Homo sapien
ttctaggtgttggactcagcaatat

SEQ ID NO: 481088 - DNA, 25 bp, Homo sapien
gtgttggactcagcaatatatcaca

SEQ ID NO: 481089 - DNA, 25 bp, Homo sapien
tggactcagcaatatatcacaatgt

SEQ ID NO: 481090 - DNA, 25 bp, Homo sapien
atcacaatgtctgcagtattttgga

SEQ ID NO: 481091 - DNA, 25 bp, Homo sapien
ggagaggagagtcaccattacttag

SEQ ID NO: 481092 - DNA, 25 bp, Homo sapien
gtcattattctcctttgggcagtgc

SEQ ID NO: 481093 - DNA, 25 bp, Homo sapien
attattctcctttgggcagtgcttc

SEQ ID NO: 481094 - DNA, 25 bp, Homo sapien
tcctttgggcagtgcttctgcagaa

SEQ ID NO: 481095 - DNA, 25 bp, Homo sapien
ttgggcagtgcttctgcagaaaagt

SEQ ID NO: 481096 - DNA, 25 bp, Homo sapien
gcagaaaagttgcaccttctaggtg

SEQ ID NO: 481097 - DNA, 25 bp, Homo sapien
aactttaacattgaatggacagcaa

SEQ ID NO: 481098 - DNA, 25 bp, Homo sapien
gttctgtttaattatcactccttga

SEQ ID NO: 481099 - DNA, 25 bp, Homo sapien
atcactccttgaccattatgttaat

SEQ ID NO: 481100 - DNA, 25 bp, Homo sapien
tgaccattatgttaatttctttccc

SEQ ID NO: 481101 - DNA, 25 bp, Homo sapien
ttctttccctaacaaggtgacgcat

SEQ ID NO: 481102 - DNA, 25 bp, Homo sapien
caaggtgacgcattgttttaagtaa

SEQ ID NO: 481103 - DNA, 25 bp, Homo sapien
aatgaccaactcatctactcttctt

SEQ ID NO: 481104 - DNA, 25 bp, Homo sapien
catctactcttcttccaaattgtgt

SEQ ID NO: 481105 - DNA, 25 bp, Homo sapien
gggaaaacgctaaatttgaatgcta

SEQ ID NO: 481106 - DNA, 25 bp, Homo sapien
gcttctttgcaatattatggcgttt

SEQ ID NO: 481107 - DNA, 25 bp, Homo sapien
tattatggcgtttcggaacagataa

SEQ ID NO: 481108 - DNA, 25 bp, Homo sapien
aaaagtacacactttaggctgggcg

SEQ ID NO: 481109 - DNA, 25 bp, Homo sapien
aaagtacacactttaggctgggcgt

SEQ ID NO: 481110 - DNA, 25 bp, Homo sapien
aagtacacactttaggctgggcgtg

SEQ ID NO: 481111 - DNA, 25 bp, Homo sapien
agtacacactttaggctgggcgtgg

SEQ ID NO: 481112 - DNA, 25 bp, Homo sapien
gtacacactttaggctgggcgtggt

SEQ ID NO: 481113 - DNA, 25 bp, Homo sapien
tacacactttaggctgggcgtggtg

SEQ ID NO: 481114 - DNA, 25 bp, Homo sapien
tactaaacacacaacaaaattagct

SEQ ID NO: 481115 - DNA, 25 bp, Homo sapien
actaaacacacaacaaaattagctg

SEQ ID NO: 481116 - DNA, 25 bp, Homo sapien
gagaccgaggttgcaatgagtggag

SEQ ID NO: 481117 - DNA, 25 bp, Homo sapien
agaccgaggttgcaatgagtggaga

SEQ ID NO: 481118 - DNA, 25 bp, Homo sapien
gaccgaggttgcaatgagtggagat

SEQ ID NO: 481119 - DNA, 25 bp, Homo sapien
agcgaccttcttgacataggatata

SEQ ID NO: 481120 - DNA, 25 bp, Homo sapien
gacataggatatatgggctccaaca

SEQ ID NO: 481121 - DNA, 25 bp, Homo sapien
gggctccaacagtcaaggacagttt

SEQ ID NO: 481122 - DNA, 25 bp, Homo sapien
tacaaagctgctctgaaggaccatc

SEQ ID NO: 481123 - DNA, 25 bp, Homo sapien
ggaccatcaggtccggactcatgga

SEQ ID NO: 481124 - DNA, 25 bp, Homo sapien
gaagtgatgactctaaacagtgcaa

SEQ ID NO: 481125 - DNA, 25 bp, Homo sapien
gtaaagacacacagccacacatatc

SEQ ID NO: 481126 - DNA, 25 bp, Homo sapien
cagccacacatatcccacagatatt

SEQ ID NO: 481127 - DNA, 25 bp, Homo sapien
acagatattttcattgtgttcttct

SEQ ID NO: 481128 - DNA, 25 bp, Homo sapien
tgttcttctcttaagtacaccaccc

SEQ ID NO: 481129 - DNA, 25 bp, Homo sapien
ccaccttaactctttcttgtcagga

SEQ ID NO: 481130 - DNA, 25 bp, Homo sapien
ggaaaagcaactgtctttctctccc

SEQ ID NO: 481131 - DNA, 25 bp, Homo sapien
tctcctttttttttgcacatctttt

SEQ ID NO: 481132 - DNA, 25 bp, Homo sapien
tttgcacatcttttctttaaaactg

SEQ ID NO: 481133 - DNA, 25 bp, Homo sapien
aatccgaggaaaacagcctgcctgc

SEQ ID NO: 481134 - DNA, 25 bp, Homo sapien
tgcctgctgctgtatttgaagttgt

SEQ ID NO: 481135 - DNA, 25 bp, Homo sapien
gtgtcaaaaagtcacgactgactga

SEQ ID NO: 481136 - DNA, 25 bp, Homo sapien
aaagtcacgactgactgacagccgt

SEQ ID NO: 481137 - DNA, 25 bp, Homo sapien
agtcacgactgactgacagccgtca

SEQ ID NO: 481138 - DNA, 25 bp, Homo sapien
tcacgactgactgacagccgtcagt

SEQ ID NO: 481139 - DNA, 25 bp, Homo sapien
tgactgacagccgtcagtcccagag

SEQ ID NO: 481140 - DNA, 25 bp, Homo sapien
ttcattaccaaacagcatccagaga

SEQ ID NO: 481141 - DNA, 25 bp, Homo sapien
gggcacgctggaacagcctagtctc

SEQ ID NO: 481142 - DNA, 25 bp, Homo sapien
ataacattcttccataggggctgag

SEQ ID NO: 481143 - DNA, 25 bp, Homo sapien
gccccgtccctgacagggatgaaaa

SEQ ID NO: 481144 - DNA, 25 bp, Homo sapien
ggatgaaaagtgaacccctcaggtc

SEQ ID NO: 481145 - DNA, 25 bp, Homo sapien
gcagagttgaggttctgccacttcc

SEQ ID NO: 481146 - DNA, 25 bp, Homo sapien
gggagccactcaagttaccagggct

SEQ ID NO: 481147 - DNA, 25 bp, Homo sapien
gttaccagggctaccggctgaaata

SEQ ID NO: 481148 - DNA, 25 bp, Homo sapien
ggctaccggctgaaataaatctttt

SEQ ID NO: 481149 - DNA, 25 bp, Homo sapien
gctgaaataaatcttttccgggtag

SEQ ID NO: 481150 - DNA, 25 bp, Homo sapien
ccaaggcaactgatgtaggccagtt

SEQ ID NO: 481151 - DNA, 25 bp, Homo sapien
atgtaggccagttgcgtgactccag

SEQ ID NO: 481152 - DNA, 25 bp, Homo sapien
gctggcaatgatggcgtctcgcatg

SEQ ID NO: 481153 - DNA, 25 bp, Homo sapien
gaagggcagcatggtgtacaccacg

SEQ ID NO: 481154 - DNA, 25 bp, Homo sapien
aggaagaacgatacctggtcccagg

SEQ ID NO: 481155 - DNA, 25 bp, Homo sapien
gagacggtgcctccaaaacacatga

SEQ ID NO: 481156 - DNA, 25 bp, Homo sapien
atgaacaggtatcccatggcaacaa

SEQ ID NO: 481157 - DNA, 25 bp, Homo sapien
ggtatcccatggcaacaaggcatat

SEQ ID NO: 481158 - DNA, 25 bp, Homo sapien
ggcatatccatatcaccaacgagaa

SEQ ID NO: 481159 - DNA, 25 bp, Homo sapien
ccaacgagaagaggcgcagcagctt

SEQ ID NO: 481160 - DNA, 25 bp, Homo sapien
ggcgcagcagcttcttaaacacaga

SEQ ID NO: 481161 - DNA, 25 bp, Homo sapien
aacacagactcgatgcagaccagga

SEQ ID NO: 481162 - DNA, 25 bp, Homo sapien
aatcgccagggcagttggaactgtt

SEQ ID NO: 481163 - DNA, 25 bp, Homo sapien
gagaccctcccacacttacgaagga

SEQ ID NO: 481164 - DNA, 25 bp, Homo sapien
gggagctctacccaggaaaaagaag

SEQ ID NO: 481165 - DNA, 25 bp, Homo sapien
aaaggacagattcatttggggttca

SEQ ID NO: 481166 - DNA, 25 bp, Homo sapien
cacacccaagactttgtggctaaga

SEQ ID NO: 481167 - DNA, 25 bp, Homo sapien
gactttgtggctaagagaatcaggc

SEQ ID NO: 481168 - DNA, 25 bp, Homo sapien
aatcaggccaccttgaggttcatca

SEQ ID NO: 481169 - DNA, 25 bp, Homo sapien
gccaccttgaggttcatcaagttca

SEQ ID NO: 481170 - DNA, 25 bp, Homo sapien
tgtacaatgggatgctcgggactcg

SEQ ID NO: 481171 - DNA, 25 bp, Homo sapien
acaatgggatgctcgggactcggac

SEQ ID NO: 481172 - DNA, 25 bp, Homo sapien
actcggacgggaggatccagtgact

SEQ ID NO: 481173 - DNA, 25 bp, Homo sapien
gaggatccagtgactgcgagccccg

SEQ ID NO: 481174 - DNA, 25 bp, Homo sapien
cgacggcctgtgaagggcacactgt

SEQ ID NO: 481175 - DNA, 25 bp, Homo sapien
tacgaacataacgaagtgctgccca

SEQ ID NO: 481176 - DNA, 25 bp, Homo sapien
aacataacgaagtgctgcccaccca

SEQ ID NO: 481177 - DNA, 25 bp, Homo sapien
cagacctcacctttgagaaccacgt

SEQ ID NO: 481178 - DNA, 25 bp, Homo sapien
ctcacctttgagaaccacgtccaaa

SEQ ID NO: 481179 - DNA, 25 bp, Homo sapien
tcccagagcttggtgttacctcata

SEQ ID NO: 481180 - DNA, 25 bp, Homo sapien
agagcttggtgttacctcatagggt

SEQ ID NO: 481181 - DNA, 25 bp, Homo sapien
ggtgttacctcatagggtgtcagca

SEQ ID NO: 481182 - DNA, 25 bp, Homo sapien
cctcatagggtgtcagcagcggctt

SEQ ID NO: 481183 - DNA, 25 bp, Homo sapien
aaggctgtgccccagtcaatggaga

SEQ ID NO: 481184 - DNA, 25 bp, Homo sapien
caatggagagacgtggacatgccac

SEQ ID NO: 481185 - DNA, 25 bp, Homo sapien
gcccagcaagataaggctacattga

SEQ ID NO: 481186 - DNA, 25 bp, Homo sapien
aaggctacattgaaggaacacatta

SEQ ID NO: 481187 - DNA, 25 bp, Homo sapien
aggaacttgccaaactaaggactag

SEQ ID NO: 481188 - DNA, 25 bp, Homo sapien
gccaaactaaggactagggtgcaga

SEQ ID NO: 481189 - DNA, 25 bp, Homo sapien
gcagaaggaaaattagcaccaataa

SEQ ID NO: 481190 - DNA, 25 bp, Homo sapien
gcaactgcataatagctatgcccaa

SEQ ID NO: 481191 - DNA, 25 bp, Homo sapien
tagctatgcccaaggagtcaactat

SEQ ID NO: 481192 - DNA, 25 bp, Homo sapien
gtatatattgcagatttgccttttt

SEQ ID NO: 481193 - DNA, 25 bp, Homo sapien
tcactaattctacaatgtgccagat

SEQ ID NO: 481194 - DNA, 25 bp, Homo sapien
cagatacatgtttcctatgcccagg

SEQ ID NO: 481195 - DNA, 25 bp, Homo sapien
ctatgcccaggaagttatgaagact

SEQ ID NO: 481196 - DNA, 25 bp, Homo sapien
gtgtgtatactgtcacattttgact
